United States Patent 7,691,997 (FUNCTIONAL AND HYPERFUNCTIONAL SIRNA) - sequence listing, part 33

SEQ ID NO: 1337232 - RNA, 19 nt, Homo sapiens
gggauguaagugaguaaua

SEQ ID NO: 1337233 - RNA, 19 nt, Homo sapiens
agaaugcaguuugugauga

SEQ ID NO: 1337234 - RNA, 19 nt, Homo sapiens
ggaauggcagugcaggaaa

SEQ ID NO: 1337235 - RNA, 19 nt, Homo sapiens
gauacucaccucacucuca

SEQ ID NO: 1337236 - RNA, 19 nt, Homo sapiens
uccgauaccuaguuccuuu

SEQ ID NO: 1337237 - RNA, 19 nt, Homo sapiens
ucacaugaccaaagcauuc

SEQ ID NO: 1337238 - RNA, 19 nt, Homo sapiens
gcugauuugucuguucgua

SEQ ID NO: 1337239 - RNA, 19 nt, Homo sapiens
gggcuaauaucaggcuuca

SEQ ID NO: 1337240 - RNA, 19 nt, Homo sapiens
uauggugaauguuuacgaa

SEQ ID NO: 1337241 - RNA, 19 nt, Homo sapiens
cauuucggauccugcuaua

SEQ ID NO: 1337242 - RNA, 19 nt, Homo sapiens
gggcauuuccugucauuuc

SEQ ID NO: 1337243 - RNA, 19 nt, Homo sapiens
caauugugcugaagcugau

SEQ ID NO: 1337244 - RNA, 19 nt, Homo sapiens
aguagaaugucuuguaaag

SEQ ID NO: 1337245 - RNA, 19 nt, Homo sapiens
gaacuuggcaaugagagau

SEQ ID NO: 1337246 - RNA, 19 nt, Homo sapiens
gaaugcaguuugugaugac

SEQ ID NO: 1337247 - RNA, 19 nt, Homo sapiens
gccacuaacuacccaauac

SEQ ID NO: 1337248 - RNA, 19 nt, Homo sapiens
aagcauuccucuucuaugg

SEQ ID NO: 1337249 - RNA, 19 nt, Homo sapiens
ggaagcaccuacgcauuuu

SEQ ID NO: 1337250 - RNA, 19 nt, Homo sapiens
gucaugauuuccauucuuc

SEQ ID NO: 1337251 - RNA, 19 nt, Homo sapiens
gaggggagguuucuagaug

SEQ ID NO: 1337252 - RNA, 19 nt, Homo sapiens
cccaggaacuccaauugug

SEQ ID NO: 1337253 - RNA, 19 nt, Homo sapiens
uaggaucauugcacaguau

SEQ ID NO: 1337254 - RNA, 19 nt, Homo sapiens
gaggaagcaccuacgcauu

SEQ ID NO: 1337255 - RNA, 19 nt, Homo sapiens
ggagggagacgaucuagcu

SEQ ID NO: 1337256 - RNA, 19 nt, Homo sapiens
caccuagagugaguacuuu

SEQ ID NO: 1337257 - RNA, 19 nt, Homo sapiens
ugaagggugagaucucuaa

SEQ ID NO: 1337258 - RNA, 19 nt, Homo sapiens
aaagugcuauucuuguauc

SEQ ID NO: 1337259 - RNA, 19 nt, Homo sapiens
caucagacagggacagcua

SEQ ID NO: 1337260 - RNA, 19 nt, Homo sapiens
ucacuccgauaccuaguuc

SEQ ID NO: 1337261 - RNA, 19 nt, Homo sapiens
aggaagcaccuacgcauuu

SEQ ID NO: 1337262 - RNA, 19 nt, Homo sapiens
ucucucacuuucuuuaguu

SEQ ID NO: 1337263 - RNA, 19 nt, Homo sapiens
guuucaaguuuauccacua

SEQ ID NO: 1337264 - RNA, 19 nt, Homo sapiens
ucucaacagcuuauuggua

SEQ ID NO: 1337265 - RNA, 19 nt, Homo sapiens
gcuauucuguugacuaucc

SEQ ID NO: 1337266 - RNA, 19 nt, Homo sapiens
caauuacaucgacgcauuu

SEQ ID NO: 1337267 - RNA, 19 nt, Homo sapiens
cgaggucgauuccuauggu

SEQ ID NO: 1337268 - RNA, 19 nt, Homo sapiens
gugaucaccuuguucaacu

SEQ ID NO: 1337269 - RNA, 19 nt, Homo sapiens
gaucucaguccuucaugga

SEQ ID NO: 1337270 - RNA, 19 nt, Homo sapiens
cuagagccuucuugagguu

SEQ ID NO: 1337271 - RNA, 19 nt, Homo sapiens
ugccauagcucaucugaaa

SEQ ID NO: 1337272 - RNA, 19 nt, Homo sapiens
ugagaugccaccacuauua

SEQ ID NO: 1337273 - RNA, 19 nt, Homo sapiens
acacaaaccuggcuauaag

SEQ ID NO: 1337274 - RNA, 19 nt, Homo sapiens
gcacauucaucauuaaacu

SEQ ID NO: 1337275 - RNA, 19 nt, Homo sapiens
gagccgguuucccagauua

SEQ ID NO: 1337276 - RNA, 19 nt, Homo sapiens
aaaccaauacccacacuua

SEQ ID NO: 1337277 - RNA, 19 nt, Homo sapiens
gaccaucucuuguccaaca

SEQ ID NO: 1337278 - RNA, 19 nt, Homo sapiens
cuaccacucugcuggauuu

SEQ ID NO: 1337279 - RNA, 19 nt, Homo sapiens
gagaugccaccacuauuaa

SEQ ID NO: 1337280 - RNA, 19 nt, Homo sapiens
ucaaggagauccacuuucu

SEQ ID NO: 1337281 - RNA, 19 nt, Homo sapiens
acacauaagggacaaauga

SEQ ID NO: 1337282 - RNA, 19 nt, Homo sapiens
ggaugaggcuguacaugag

SEQ ID NO: 1337283 - RNA, 19 nt, Homo sapiens
gauauuaugcuucccacaa

SEQ ID NO: 1337284 - RNA, 19 nt, Homo sapiens
gguuuccacugcucauuaa

SEQ ID NO: 1337285 - RNA, 19 nt, Homo sapiens
ggaagacaccagucaguca

SEQ ID NO: 1337286 - RNA, 19 nt, Homo sapiens
gcucaaggagauccacuuu

SEQ ID NO: 1337287 - RNA, 19 nt, Homo sapiens
gggauggagccacacauaa

SEQ ID NO: 1337288 - RNA, 19 nt, Homo sapiens
ccacucugcuggauuugga

SEQ ID NO: 1337289 - RNA, 19 nt, Homo sapiens
gaugccaccacuauuaauu

SEQ ID NO: 1337290 - RNA, 19 nt, Homo sapiens
uaacucagacccagaaugg

SEQ ID NO: 1337291 - RNA, 19 nt, Homo sapiens
ggagccgguuucccagauu

SEQ ID NO: 1337292 - RNA, 19 nt, Homo sapiens
ugucaucuauguaucacaa

SEQ ID NO: 1337293 - RNA, 19 nt, Homo sapiens
gcacgguccuaccuagucu

SEQ ID NO: 1337294 - RNA, 19 nt, Homo sapiens
ggcgguggcuuugugcuuu

SEQ ID NO: 1337295 - RNA, 19 nt, Homo sapiens
ccacacaaaccuggcuaua

SEQ ID NO: 1337296 - RNA, 19 nt, Homo sapiens
gccacagccugaauucaug

SEQ ID NO: 1337297 - RNA, 19 nt, Homo sapiens
ccagauuauugccguguau

SEQ ID NO: 1337298 - RNA, 19 nt, Homo sapiens
ggauggagccacacauaag

SEQ ID NO: 1337299 - RNA, 19 nt, Homo sapiens
ggcuguacaugaguuaauu

SEQ ID NO: 1337300 - RNA, 19 nt, Homo sapiens
ccagagcaguggauauguc

SEQ ID NO: 1337301 - RNA, 19 nt, Homo sapiens
gcuguacaugaguuaauua

SEQ ID NO: 1337302 - RNA, 19 nt, Homo sapiens
gcccggaccugcuuauugc

SEQ ID NO: 1337303 - RNA, 19 nt, Homo sapiens
cccugcacauucaucauua

SEQ ID NO: 1337304 - RNA, 19 nt, Homo sapiens
cacacaaaccuggcuauaa

SEQ ID NO: 1337305 - RNA, 19 nt, Homo sapiens
acgcagauguguucgugaa

SEQ ID NO: 1337306 - RNA, 19 nt, Homo sapiens
gggcgacgcagauguguuc

SEQ ID NO: 1337307 - RNA, 19 nt, Homo sapiens
ccaguugaaacccguguaa

SEQ ID NO: 1337308 - RNA, 19 nt, Homo sapiens
gcuugcuggugacguaauu

SEQ ID NO: 1337309 - RNA, 19 nt, Homo sapiens
caaggagauccacuuucua

SEQ ID NO: 1337310 - RNA, 19 nt, Homo sapiens
ggccuucgacgacaccuuu

SEQ ID NO: 1337311 - RNA, 19 nt, Homo sapiens
aggaugaggcuguacauga

SEQ ID NO: 1337312 - RNA, 19 nt, Homo sapiens
acccacacuuaccuuaaua

SEQ ID NO: 1337313 - RNA, 19 nt, Homo sapiens
cagaggagccaaggaaugu

SEQ ID NO: 1337314 - RNA, 19 nt, Homo sapiens
ccugcuugcuggugacgua

SEQ ID NO: 1337315 - RNA, 19 nt, Homo sapiens
uacccacacuuaccuuaau

SEQ ID NO: 1337316 - RNA, 19 nt, Homo sapiens
ccugcacauucaucauuaa

SEQ ID NO: 1337317 - RNA, 19 nt, Homo sapiens
gcccaggaaccauauagga

SEQ ID NO: 1337318 - RNA, 19 nt, Homo sapiens
cuccugaacucacacaaca

SEQ ID NO: 1337319 - RNA, 19 nt, Homo sapiens
ccgagagccuugcguaugc

SEQ ID NO: 1337320 - RNA, 19 nt, Homo sapiens
ccugagaugccaccacuau

SEQ ID NO: 1337321 - RNA, 19 nt, Homo sapiens
aaggcugggugguagauga

SEQ ID NO: 1337322 - RNA, 19 nt, Homo sapiens
guguaauggugacccuuug

SEQ ID NO: 1337323 - RNA, 19 nt, Homo sapiens
gugcgcaggucgagcucuu

SEQ ID NO: 1337324 - RNA, 19 nt, Homo sapiens
ccaggaggaugggaacagu

SEQ ID NO: 1337325 - RNA, 19 nt, Homo sapiens
ucagaggagccaaggaaug

SEQ ID NO: 1337326 - RNA, 19 nt, Homo sapiens
ggcagggacuuagggaauc

SEQ ID NO: 1337327 - RNA, 19 nt, Homo sapiens
guugaaacccguguaaugg

SEQ ID NO: 1337328 - RNA, 19 nt, Homo sapiens
ccgcugacaucuggcuuau

SEQ ID NO: 1337329 - RNA, 19 nt, Homo sapiens
auaaggcccaggaaccaua

SEQ ID NO: 1337330 - RNA, 19 nt, Homo sapiens
gcacuuugccauagcucau

SEQ ID NO: 1337331 - RNA, 19 nt, Homo sapiens
ccacagccugaauucauga

SEQ ID NO: 1337332 - RNA, 19 nt, Homo sapiens
cccaagcuccuaacucaga

SEQ ID NO: 1337333 - RNA, 19 nt, Homo sapiens
gccccaagcuccuaacuca

SEQ ID NO: 1337334 - RNA, 19 nt, Homo sapiens
uuaaccagccgcacaagug

SEQ ID NO: 1337335 - RNA, 19 nt, Homo sapiens
uaagggcgacgcagaugug

SEQ ID NO: 1337336 - RNA, 19 nt, Homo sapiens
gucgggagcgccacacaaa

SEQ ID NO: 1337337 - RNA, 19 nt, Homo sapiens
ugccaccacuauuaauuuc

SEQ ID NO: 1337338 - RNA, 19 nt, Homo sapiens
gguccuaccuagucuuucc

SEQ ID NO: 1337339 - RNA, 19 nt, Homo sapiens
cgguuuccacugcucauua

SEQ ID NO: 1337340 - RNA, 19 nt, Homo sapiens
aaggagauccacuuucuag

SEQ ID NO: 1337341 - RNA, 19 nt, Homo sapiens
acaaguugcuagaccaaaa

SEQ ID NO: 1337342 - RNA, 19 nt, Homo sapiens
gccgagagccuugcguaug

SEQ ID NO: 1337343 - RNA, 19 nt, Homo sapiens
gauggagccacacauaagg

SEQ ID NO: 1337344 - RNA, 19 nt, Homo sapiens
gcgguggcuuugugcuuuc

SEQ ID NO: 1337345 - RNA, 19 nt, Homo sapiens
ucuguacacacauuugaaa

SEQ ID NO: 1337346 - RNA, 19 nt, Homo sapiens
gauuauugccguguaugug

SEQ ID NO: 1337347 - RNA, 19 nt, Homo sapiens
caucuauguaucacaaguu

SEQ ID NO: 1337348 - RNA, 19 nt, Homo sapiens
agacaccagucagucacaa

SEQ ID NO: 1337349 - RNA, 19 nt, Homo sapiens
ccaggccacaguccaaaug

SEQ ID NO: 1337350 - RNA, 19 nt, Homo sapiens
ccacacauaagggacaaau

SEQ ID NO: 1337351 - RNA, 19 nt, Homo sapiens
agggauggagccacacaua

SEQ ID NO: 1337352 - RNA, 19 nt, Homo sapiens
ucaucuauguaucacaagu

SEQ ID NO: 1337353 - RNA, 19 nt, Homo sapiens
aaucuguacacacauuuga

SEQ ID NO: 1337354 - RNA, 19 nt, Homo sapiens
cauauaggagccugagaca

SEQ ID NO: 1337355 - RNA, 19 nt, Homo sapiens
ccacacuuaccuuaauaca

SEQ ID NO: 1337356 - RNA, 19 nt, Homo sapiens
aauacccacacuuaccuua

SEQ ID NO: 1337357 - RNA, 19 nt, Homo sapiens
ccugaacucacacaacaau

SEQ ID NO: 1337358 - RNA, 19 nt, Homo sapiens
cguguaauggugacccuuu

SEQ ID NO: 1337359 - RNA, 19 nt, Homo sapiens
uagccugggccucagcuuu

SEQ ID NO: 1337360 - RNA, 19 nt, Homo sapiens
cccagauuauugccgugua

SEQ ID NO: 1337361 - RNA, 19 nt, Homo sapiens
gccgcugacaucuggcuua

SEQ ID NO: 1337362 - RNA, 19 nt, Homo sapiens
gagcugagaucacgccauu

SEQ ID NO: 1337363 - RNA, 19 nt, Homo sapiens
agaaggaacugaugaaugu

SEQ ID NO: 1337364 - RNA, 19 nt, Homo sapiens
gaaugugaauuucccucua

SEQ ID NO: 1337365 - RNA, 19 nt, Homo sapiens
gaauuucccucuaagaacu

SEQ ID NO: 1337366 - RNA, 19 nt, Homo sapiens
ucagagaguuggagggauu

SEQ ID NO: 1337367 - RNA, 19 nt, Homo sapiens
cuacgcgucucaacucuuu

SEQ ID NO: 1337368 - RNA, 19 nt, Homo sapiens
gauuaugcgucaucguaaa

SEQ ID NO: 1337369 - RNA, 19 nt, Homo sapiens
gagucucccuucucaguuu

SEQ ID NO: 1337370 - RNA, 19 nt, Homo sapiens
aaaccagacuugacaguuc

SEQ ID NO: 1337371 - RNA, 19 nt, Homo sapiens
gggauuaugcgucaucgua

SEQ ID NO: 1337372 - RNA, 19 nt, Homo sapiens
aaacccagaugcaaugaga

SEQ ID NO: 1337373 - RNA, 19 nt, Homo sapiens
gaacugaugaaugugaauu

SEQ ID NO: 1337374 - RNA, 19 nt, Homo sapiens
ggucaaacacccagaagga

SEQ ID NO: 1337375 - RNA, 19 nt, Homo sapiens
aaugugaauuucccucuaa

SEQ ID NO: 1337376 - RNA, 19 nt, Homo sapiens
ggauuaugcgucaucguaa

SEQ ID NO: 1337377 - RNA, 19 nt, Homo sapiens
gaaggucaaacacccagaa

SEQ ID NO: 1337378 - RNA, 19 nt, Homo sapiens
ggacuacgcgucucaacuc

SEQ ID NO: 1337379 - RNA, 19 nt, Homo sapiens
gugaauuucccucuaagaa

SEQ ID NO: 1337380 - RNA, 19 nt, Homo sapiens
gcgcauccauuaaguucca

SEQ ID NO: 1337381 - RNA, 19 nt, Homo sapiens
gagaccagccugaccaaca

SEQ ID NO: 1337382 - RNA, 19 nt, Homo sapiens
cagaaggaacugaugaaug

SEQ ID NO: 1337383 - RNA, 19 nt, Homo sapiens
ccacgaaacccagaugcaa

SEQ ID NO: 1337384 - RNA, 19 nt, Homo sapiens
acaggagaaucgcuugaau

SEQ ID NO: 1337385 - RNA, 19 nt, Homo sapiens
ucccuucucaguuucauua

SEQ ID NO: 1337386 - RNA, 19 nt, Homo sapiens
gcuuguaauuccagcacuu

SEQ ID NO: 1337387 - RNA, 19 nt, Homo sapiens
gaagaaacguggggcagau

SEQ ID NO: 1337388 - RNA, 19 nt, Homo sapiens
ggagcgaguuuuacuuuag

SEQ ID NO: 1337389 - RNA, 19 nt, Homo sapiens
ucuggccgcuggacuguug

SEQ ID NO: 1337390 - RNA, 19 nt, Homo sapiens
agaccagccugaccaacau

SEQ ID NO: 1337391 - RNA, 19 nt, Homo sapiens
gaucacgaggucaggaguu

SEQ ID NO: 1337392 - RNA, 19 nt, Homo sapiens
uggcuuguaccaucucuaa

SEQ ID NO: 1337393 - RNA, 19 nt, Homo sapiens
gacaggagaaucgcuugaa

SEQ ID NO: 1337394 - RNA, 19 nt, Homo sapiens
gaccagccugaccaacaua

SEQ ID NO: 1337395 - RNA, 19 nt, Homo sapiens
ggagcgggaaggucaaaca

SEQ ID NO: 1337396 - RNA, 19 nt, Homo sapiens
ggagggauuaugcgucauc

SEQ ID NO: 1337397 - RNA, 19 nt, Homo sapiens
gcuagaagagagacugagu

SEQ ID NO: 1337398 - RNA, 19 nt, Homo sapiens
gguaguuuagccugaagaa

SEQ ID NO: 1337399 - RNA, 19 nt, Homo sapiens
gcugagaucacgccauugc

SEQ ID NO: 1337400 - RNA, 19 nt, Homo sapiens
cuucucaguuucauuaggu

SEQ ID NO: 1337401 - RNA, 19 nt, Homo sapiens
ccagaaggaacugaugaau

SEQ ID NO: 1337402 - RNA, 19 nt, Homo sapiens
gaguuuuacuuuaggaaga

SEQ ID NO: 1337403 - RNA, 19 nt, Homo sapiens
caggagaaucgcuugaauc

SEQ ID NO: 1337404 - RNA, 19 nt, Homo sapiens
gggcuagaagagagacuga

SEQ ID NO: 1337405 - RNA, 19 nt, Homo sapiens
gcucacgcuuguaauucca

SEQ ID NO: 1337406 - RNA, 19 nt, Homo sapiens
guggcucacgcuuguaauu

SEQ ID NO: 1337407 - RNA, 19 nt, Homo sapiens
aggaacugaugaaugugaa

SEQ ID NO: 1337408 - RNA, 19 nt, Homo sapiens
uccauuaaguuccaguuac

SEQ ID NO: 1337409 - RNA, 19 nt, Homo sapiens
cagagaguuggagggauua

SEQ ID NO: 1337410 - RNA, 19 nt, Homo sapiens
gugcuguucccgaggacua

SEQ ID NO: 1337411 - RNA, 19 nt, Homo sapiens
guaguuuagccugaagaaa

SEQ ID NO: 1337412 - RNA, 19 nt, Homo sapiens
gagcugagaucgugccauu

SEQ ID NO: 1337413 - RNA, 19 nt, Homo sapiens
gaagggaggugcugaaugc

SEQ ID NO: 1337414 - RNA, 19 nt, Homo sapiens
gaaacccugugucugcuaa

SEQ ID NO: 1337415 - RNA, 19 nt, Homo sapiens
gaacagggacuuggugaga

SEQ ID NO: 1337416 - RNA, 19 nt, Homo sapiens
gggauggccuucgggcuua

SEQ ID NO: 1337417 - RNA, 19 nt, Homo sapiens
ggacagcacgugcaaagga

SEQ ID NO: 1337418 - RNA, 19 nt, Homo sapiens
cacaugagguugggaauuc

SEQ ID NO: 1337419 - RNA, 19 nt, Homo sapiens
gcagaugagcagagacuga

SEQ ID NO: 1337420 - RNA, 19 nt, Homo sapiens
gcaggagaauugcuugaac

SEQ ID NO: 1337421 - RNA, 19 nt, Homo sapiens
ggugacagaugagcagaug

SEQ ID NO: 1337422 - RNA, 19 nt, Homo sapiens
cugcagguguuagguguua

SEQ ID NO: 1337423 - RNA, 19 nt, Homo sapiens
gaacagccuggccaacaug

SEQ ID NO: 1337424 - RNA, 19 nt, Homo sapiens
gaaaccccgucucuacuaa

SEQ ID NO: 1337425 - RNA, 19 nt, Homo sapiens
ggagacagagcaaggaaca

SEQ ID NO: 1337426 - RNA, 19 nt, Homo sapiens
gagaacagccuggccaaca

SEQ ID NO: 1337427 - RNA, 19 nt, Homo sapiens
gagaucagcgggaccaaca

SEQ ID NO: 1337428 - RNA, 19 nt, Homo sapiens
gugaggcugugucuccaaa

SEQ ID NO: 1337429 - RNA, 19 nt, Homo sapiens
ggucaggaguuugagaaca

SEQ ID NO: 1337430 - RNA, 19 nt, Homo sapiens
ucgggcagcucaucuguca

SEQ ID NO: 1337431 - RNA, 19 nt, Homo sapiens
gaucagcgggaccaacaug

SEQ ID NO: 1337432 - RNA, 19 nt, Homo sapiens
gaggucaggaguuugagaa

SEQ ID NO: 1337433 - RNA, 19 nt, Homo sapiens
acagggacuuggugagaga

SEQ ID NO: 1337434 - RNA, 19 nt, Homo sapiens
gcugugagccgaggcauuc

SEQ ID NO: 1337435 - RNA, 19 nt, Homo sapiens
ggugaugagugccuguagu

SEQ ID NO: 1337436 - RNA, 19 nt, Homo sapiens
ccuguaaucccagcacuuu

SEQ ID NO: 1337437 - RNA, 19 nt, Homo sapiens
agaacagccuggccaacau

SEQ ID NO: 1337438 - RNA, 19 nt, Homo sapiens
gagcagaugagcagagacu

SEQ ID NO: 1337439 - RNA, 19 nt, Homo sapiens
cagaugagcagagacugaa

SEQ ID NO: 1337440 - RNA, 19 nt, Homo sapiens
aauuguggcugcagguguu

SEQ ID NO: 1337441 - RNA, 19 nt, Homo sapiens
gaaggcugaggcaggagaa

SEQ ID NO: 1337442 - RNA, 19 nt, Homo sapiens
uggagacucuguggaagga

SEQ ID NO: 1337443 - RNA, 19 nt, Homo sapiens
agauggagacucuguggaa

SEQ ID NO: 1337444 - RNA, 19 nt, Homo sapiens
gagcaaggaacagggacuu

SEQ ID NO: 1337445 - RNA, 19 nt, Homo sapiens
gucaggaguuugagaacag

SEQ ID NO: 1337446 - RNA, 19 nt, Homo sapiens
ucacaugagguugggaauu

SEQ ID NO: 1337447 - RNA, 19 nt, Homo sapiens
aguccaagcuacucaagag

SEQ ID NO: 1337448 - RNA, 19 nt, Homo sapiens
gcugagaucgugccauugc

SEQ ID NO: 1337449 - RNA, 19 nt, Homo sapiens
ggcugaggcaggagaauug

SEQ ID NO: 1337450 - RNA, 19 nt, Homo sapiens
gguggcacauaccuguaau

SEQ ID NO: 1337451 - RNA, 19 nt, Homo sapiens
aaaauuagcugggcauggu

SEQ ID NO: 1337452 - RNA, 19 nt, Homo sapiens
gaugagcagagacugaaag

SEQ ID NO: 1337453 - RNA, 19 nt, Homo sapiens
uagcugggcauggugauga

SEQ ID NO: 1337454 - RNA, 19 nt, Homo sapiens
caguggcucaugccuguaa

SEQ ID NO: 1337455 - RNA, 19 nt, Homo sapiens
ugacagaugagcagaugag

SEQ ID NO: 1337456 - RNA, 19 nt, Homo sapiens
ggcaggagaauugcuugaa

SEQ ID NO: 1337457 - RNA, 19 nt, Homo sapiens
gguugggaauucgagauca

SEQ ID NO: 1337458 - RNA, 19 nt, Homo sapiens
ggauggccuucgggcuuau

SEQ ID NO: 1337459 - RNA, 19 nt, Homo sapiens
gaaaugaacugcagcuuua

SEQ ID NO: 1337460 - RNA, 19 nt, Homo sapiens
gaacaaguauguccgaugu

SEQ ID NO: 1337461 - RNA, 19 nt, Homo sapiens
gcaagacagugaagagaaa

SEQ ID NO: 1337462 - RNA, 19 nt, Homo sapiens
cagagugucuucauacuuu

SEQ ID NO: 1337463 - RNA, 19 nt, Homo sapiens
ugaaguaccuccaaacuag

SEQ ID NO: 1337464 - RNA, 19 nt, Homo sapiens
ggaaccagcuccagucagu

SEQ ID NO: 1337465 - RNA, 19 nt, Homo sapiens
agaguuguauugugaagua

SEQ ID NO: 1337466 - RNA, 19 nt, Homo sapiens
gagugaagaucaaagacuu

SEQ ID NO: 1337467 - RNA, 19 nt, Homo sapiens
uauguccgauguucuguua

SEQ ID NO: 1337468 - RNA, 19 nt, Homo sapiens
ugucaccgcuugaugcuaa

SEQ ID NO: 1337469 - RNA, 19 nt, Homo sapiens
ugcaggacaucguguauaa

SEQ ID NO: 1337470 - RNA, 19 nt, Homo sapiens
ugcaagaguuguauuguga

SEQ ID NO: 1337471 - RNA, 19 nt, Homo sapiens
ugaaaugaacugcagcuuu

SEQ ID NO: 1337472 - RNA, 19 nt, Homo sapiens
ugaaagagaagaggaggua

SEQ ID NO: 1337473 - RNA, 19 nt, Homo sapiens
gcuaaacccucagcaugug

SEQ ID NO: 1337474 - RNA, 19 nt, Homo sapiens
ccacuacuaucgcuaugau

SEQ ID NO: 1337475 - RNA, 19 nt, Homo sapiens
ggaggagguucgagugaag

SEQ ID NO: 1337476 - RNA, 19 nt, Homo sapiens
gugaaguaccuccaaacua

SEQ ID NO: 1337477 - RNA, 19 nt, Homo sapiens
cuucauacuuucugcaaga

SEQ ID NO: 1337478 - RNA, 19 nt, Homo sapiens
caaugaaguucucccugau

SEQ ID NO: 1337479 - RNA, 19 nt, Homo sapiens
acaaguauguccgauguuc

SEQ ID NO: 1337480 - RNA, 19 nt, Homo sapiens
gaaguucucccugaucaca

SEQ ID NO: 1337481 - RNA, 19 nt, Homo sapiens
gcuggugccuggcuugcaa

SEQ ID NO: 1337482 - RNA, 19 nt, Homo sapiens
cauacuuucugcaagaguu

SEQ ID NO: 1337483 - RNA, 19 nt, Homo sapiens
ccugaucacaugacaauga

SEQ ID NO: 1337484 - RNA, 19 nt, Homo sapiens
gagcugagguacgccaucu

SEQ ID NO: 1337485 - RNA, 19 nt, Homo sapiens
gcuaugaugagcaguugaa

SEQ ID NO: 1337486 - RNA, 19 nt, Homo sapiens
gugccuggcuugcaagaca

SEQ ID NO: 1337487 - RNA, 19 nt, Homo sapiens
caagaguuguauugugaag

SEQ ID NO: 1337488 - RNA, 19 nt, Homo sapiens
uacaauacagugugaaaga

SEQ ID NO: 1337489 - RNA, 19 nt, Homo sapiens
gcaaagacaagaauaaaag

SEQ ID NO: 1337490 - RNA, 19 nt, Homo sapiens
gaggaggagguucgaguga

SEQ ID NO: 1337491 - RNA, 19 nt, Homo sapiens
gcaagaguuguauugugaa

SEQ ID NO: 1337492 - RNA, 19 nt, Homo sapiens
caauacagugugaaagaga

SEQ ID NO: 1337493 - RNA, 19 nt, Homo sapiens
uguccgauguucuguuaga

SEQ ID NO: 1337494 - RNA, 19 nt, Homo sapiens
gagguucgagugaagauca

SEQ ID NO: 1337495 - RNA, 19 nt, Homo sapiens
aauacagugugaaagagaa

SEQ ID NO: 1337496 - RNA, 19 nt, Homo sapiens
cugaucacaugacaaugaa

SEQ ID NO: 1337497 - RNA, 19 nt, Homo sapiens
ucacagagugucuucauac

SEQ ID NO: 1337498 - RNA, 19 nt, Homo sapiens
aaagcguccugcagaacaa

SEQ ID NO: 1337499 - RNA, 19 nt, Homo sapiens
gcugaguucuggcaaagac

SEQ ID NO: 1337500 - RNA, 19 nt, Homo sapiens
ugacaaugaagcagauaug

SEQ ID NO: 1337501 - RNA, 19 nt, Homo sapiens
cugcaagaguuguauugug

SEQ ID NO: 1337502 - RNA, 19 nt, Homo sapiens
uggcaaagacaagaauaaa

SEQ ID NO: 1337503 - RNA, 19 nt, Homo sapiens
gcggcugaguucuggcaaa

SEQ ID NO: 1337504 - RNA, 19 nt, Homo sapiens
cagcagcuuugaccacucu

SEQ ID NO: 1337505 - RNA, 19 nt, Homo sapiens
ccccuuugcuuuuacaaua

SEQ ID NO: 1337506 - RNA, 19 nt, Homo sapiens
cagcaugugcagcuccuuu

SEQ ID NO: 1337507 - RNA, 19 nt, Homo sapiens
acucuaaagcccacuacua

SEQ ID NO: 1337508 - RNA, 19 nt, Homo sapiens
ccuccaaacuagcaaguac

SEQ ID NO: 1337509 - RNA, 19 nt, Homo sapiens
cagcuuugaccacucuaaa

SEQ ID NO: 1337510 - RNA, 19 nt, Homo sapiens
gcagcuuugaccacucuaa

SEQ ID NO: 1337511 - RNA, 19 nt, Homo sapiens
cacauuguuugcugccuau

SEQ ID NO: 1337512 - RNA, 19 nt, Homo sapiens
agacacagccacugcucaa

SEQ ID NO: 1337513 - RNA, 19 nt, Homo sapiens
acaauacagugugaaagag

SEQ ID NO: 1337514 - RNA, 19 nt, Homo sapiens
cuaaagcccacuacuaucg

SEQ ID NO: 1337515 - RNA, 19 nt, Homo sapiens
cucuaaagcccacuacuau

SEQ ID NO: 1337516 - RNA, 19 nt, Homo sapiens
cccagauauuuaugugaaa

SEQ ID NO: 1337517 - RNA, 19 nt, Homo sapiens
gccauccccuuugcuuuua

SEQ ID NO: 1337518 - RNA, 19 nt, Homo sapiens
augaaguucucccugauca

SEQ ID NO: 1337519 - RNA, 19 nt, Homo sapiens
acuacuaucgcuaugauga

SEQ ID NO: 1337520 - RNA, 19 nt, Homo sapiens
cgaugaggcuucggaacca

SEQ ID NO: 1337521 - RNA, 19 nt, Homo sapiens
ccagucaguguacaagaug

SEQ ID NO: 1337522 - RNA, 19 nt, Homo sapiens
acaugacaaugaagcagau

SEQ ID NO: 1337523 - RNA, 19 nt, Homo sapiens
ucgcuaugaugagcaguug

SEQ ID NO: 1337524 - RNA, 19 nt, Homo sapiens
aggaggagguucgagugaa

SEQ ID NO: 1337525 - RNA, 19 nt, Homo sapiens
caucacagagugucuucau

SEQ ID NO: 1337526 - RNA, 19 nt, Homo sapiens
cuaccagucccgagguuug

SEQ ID NO: 1337527 - RNA, 19 nt, Homo sapiens
augaacugcagcuuuauuu

SEQ ID NO: 1337528 - RNA, 19 nt, Homo sapiens
uccagucaguguacaagau

SEQ ID NO: 1337529 - RNA, 19 nt, Homo sapiens
gcccacuacuaucgcuaug

SEQ ID NO: 1337530 - RNA, 19 nt, Homo sapiens
aaaggaaccugaaacauua

SEQ ID NO: 1337531 - RNA, 19 nt, Homo sapiens
gaagaggccugagcaguuu

SEQ ID NO: 1337532 - RNA, 19 nt, Homo sapiens
gaacagcaauaguaaagga

SEQ ID NO: 1337533 - RNA, 19 nt, Homo sapiens
gaaaagaacagcaauagua

SEQ ID NO: 1337534 - RNA, 19 nt, Homo sapiens
uaaaggaaccugaaacauu

SEQ ID NO: 1337535 - RNA, 19 nt, Homo sapiens
caagaucauucauguaaga

SEQ ID NO: 1337536 - RNA, 19 nt, Homo sapiens
ggagguaccuucagaacca

SEQ ID NO: 1337537 - RNA, 19 nt, Homo sapiens
gguccaagaucauucaugu

SEQ ID NO: 1337538 - RNA, 19 nt, Homo sapiens
gaaaggcaaaggaguguga

SEQ ID NO: 1337539 - RNA, 19 nt, Homo sapiens
gagagcagcuuauaguacu

SEQ ID NO: 1337540 - RNA, 19 nt, Homo sapiens
gguggucgguuccaugaaa

SEQ ID NO: 1337541 - RNA, 19 nt, Homo sapiens
gaucauucauguaagaagu

SEQ ID NO: 1337542 - RNA, 19 nt, Homo sapiens
gagagagcagcuuauagua

SEQ ID NO: 1337543 - RNA, 19 nt, Homo sapiens
gguggaggaucuucaaaca

SEQ ID NO: 1337544 - RNA, 19 nt, Homo sapiens
gaaauugaggguccaagau

SEQ ID NO: 1337545 - RNA, 19 nt, Homo sapiens
ccagagagagcagcuuaua

SEQ ID NO: 1337546 - RNA, 19 nt, Homo sapiens
ugaagaggccugagcaguu

SEQ ID NO: 1337547 - RNA, 19 nt, Homo sapiens
uggaggaucuucaaacaca

SEQ ID NO: 1337548 - RNA, 19 nt, Homo sapiens
uccaagaucauucauguaa

SEQ ID NO: 1337549 - RNA, 19 nt, Homo sapiens
gucacaagaugucugagaa

SEQ ID NO: 1337550 - RNA, 19 nt, Homo sapiens
gggcagguccaucugauug

SEQ ID NO: 1337551 - RNA, 19 nt, Homo sapiens
gcagucacaagaugucuga

SEQ ID NO: 1337552 - RNA, 19 nt, Homo sapiens
gagggaggcagggaaagua

SEQ ID NO: 1337553 - RNA, 19 nt, Homo sapiens
uucauguccucauuucuua

SEQ ID NO: 1337554 - RNA, 19 nt, Homo sapiens
uuagggagguaccuucaga

SEQ ID NO: 1337555 - RNA, 19 nt, Homo sapiens
gaucuucaaacacaggaaa

SEQ ID NO: 1337556 - RNA, 19 nt, Homo sapiens
guuguuauaucuucauguc

SEQ ID NO: 1337557 - RNA, 19 nt, Homo sapiens
agagagagcagcuuauagu

SEQ ID NO: 1337558 - RNA, 19 nt, Homo sapiens
gggaagaaaagaaugauaa

SEQ ID NO: 1337559 - RNA, 19 nt, Homo sapiens
caagguuguuauaucuuca

SEQ ID NO: 1337560 - RNA, 19 nt, Homo sapiens
ccacuaccaccauccagaa

SEQ ID NO: 1337561 - RNA, 19 nt, Homo sapiens
ucacaagaugucugagaaa

SEQ ID NO: 1337562 - RNA, 19 nt, Homo sapiens
ccaagaucauucauguaag

SEQ ID NO: 1337563 - RNA, 19 nt, Homo sapiens
caggaaaaccucuucaaaa

SEQ ID NO: 1337564 - RNA, 19 nt, Homo sapiens
ggcaaaggagugugagaga

SEQ ID NO: 1337565 - RNA, 19 nt, Homo sapiens
aauaaaggaaccugaaaca

SEQ ID NO: 1337566 - RNA, 19 nt, Homo sapiens
ggaauggaugucccacugu

SEQ ID NO: 1337567 - RNA, 19 nt, Homo sapiens
caaaauaaaggaaccugaa

SEQ ID NO: 1337568 - RNA, 19 nt, Homo sapiens
aagaacagcaauaguaaag

SEQ ID NO: 1337569 - RNA, 19 nt, Homo sapiens
cagcuuauaguacucaauc

SEQ ID NO: 1337570 - RNA, 19 nt, Homo sapiens
gagaggaguggauggucaa

SEQ ID NO: 1337571 - RNA, 19 nt, Homo sapiens
aggaaaaccucuucaaaag

SEQ ID NO: 1337572 - RNA, 19 nt, Homo sapiens
cagcaauaguaaaggaucu

SEQ ID NO: 1337573 - RNA, 19 nt, Homo sapiens
aauugaggguccaagauca

SEQ ID NO: 1337574 - RNA, 19 nt, Homo sapiens
uuucagaguccauuucaga

SEQ ID NO: 1337575 - RNA, 19 nt, Homo sapiens
gaugggagcagaaaauaau

SEQ ID NO: 1337576 - RNA, 19 nt, Homo sapiens
agaaauugaggguccaaga

SEQ ID NO: 1337577 - RNA, 19 nt, Homo sapiens
cuucauguccucauuucuu

SEQ ID NO: 1337578 - RNA, 19 nt, Homo sapiens
uaucuucauguccucauuu

SEQ ID NO: 1337579 - RNA, 19 nt, Homo sapiens
gguaccuucagaaccaaua

SEQ ID NO: 1337580 - RNA, 19 nt, Homo sapiens
gaguccauuucagagcaua

SEQ ID NO: 1337581 - RNA, 19 nt, Homo sapiens
gagguaccuucagaaccaa

SEQ ID NO: 1337582 - RNA, 19 nt, Homo sapiens
cagggcagguccaucugau

SEQ ID NO: 1337583 - RNA, 19 nt, Homo sapiens
guucagggcagguccaucu

SEQ ID NO: 1337584 - RNA, 19 nt, Homo sapiens
caagaugucugagaaaacu

SEQ ID NO: 1337585 - RNA, 19 nt, Homo sapiens
gaggguccaagaucauuca

SEQ ID NO: 1337586 - RNA, 19 nt, Homo sapiens
ccauuucagagcauaagaa

SEQ ID NO: 1337587 - RNA, 19 nt, Homo sapiens
cacaagaugucugagaaaa

SEQ ID NO: 1337588 - RNA, 19 nt, Homo sapiens
cuccagagagagcagcuua

SEQ ID NO: 1337589 - RNA, 19 nt, Homo sapiens
aaauugaggguccaagauc

SEQ ID NO: 1337590 - RNA, 19 nt, Homo sapiens
ccuccuaccaagaaucaaa

SEQ ID NO: 1337591 - RNA, 19 nt, Homo sapiens
gccugugccucagcuguga

SEQ ID NO: 1337592 - RNA, 19 nt, Homo sapiens
gcucugccuccuaccaaga

SEQ ID NO: 1337593 - RNA, 19 nt, Homo sapiens
gagcagcuuauaguacuca

SEQ ID NO: 1337594 - RNA, 19 nt, Homo sapiens
cagagagagcagcuuauag

SEQ ID NO: 1337595 - RNA, 19 nt, Homo sapiens
ugacguagcuuuagucgau

SEQ ID NO: 1337596 - RNA, 19 nt, Homo sapiens
aauccuaucuagagucaua

SEQ ID NO: 1337597 - RNA, 19 nt, Homo sapiens
cgccauaguuguugacgua

SEQ ID NO: 1337598 - RNA, 19 nt, Homo sapiens
ugagggcgguuaccuaguu

SEQ ID NO: 1337599 - RNA, 19 nt, Homo sapiens
cauaggacacauaaccuua

SEQ ID NO: 1337600 - RNA, 19 nt, Homo sapiens
agugagaaaugaacaaguu

SEQ ID NO: 1337601 - RNA, 19 nt, Homo sapiens
ucgcgaagauggcuuuaug

SEQ ID NO: 1337602 - RNA, 19 nt, Homo sapiens
ccuuauuccuggucuuuaa

SEQ ID NO: 1337603 - RNA, 19 nt, Homo sapiens
cgucgucgcugcuguguag

SEQ ID NO: 1337604 - RNA, 19 nt, Homo sapiens
ugccaucgcccuuaaguaa

SEQ ID NO: 1337605 - RNA, 19 nt, Homo sapiens
gagggcgguuaccuaguuu

SEQ ID NO: 1337606 - RNA, 19 nt, Homo sapiens
ggagugauggccagagaga

SEQ ID NO: 1337607 - RNA, 19 nt, Homo sapiens
gcaccaaagaggaggagaa

SEQ ID NO: 1337608 - RNA, 19 nt, Homo sapiens
gaagaccauguuagugcua

SEQ ID NO: 1337609 - RNA, 19 nt, Homo sapiens
guacccauaggacacauaa

SEQ ID NO: 1337610 - RNA, 19 nt, Homo sapiens
gcuacauugugcacaguga

SEQ ID NO: 1337611 - RNA, 19 nt, Homo sapiens
cgacgaggguggagaagac

SEQ ID NO: 1337612 - RNA, 19 nt, Homo sapiens
caggagugauggccagaga

SEQ ID NO: 1337613 - RNA, 19 nt, Homo sapiens
gcgaagauggcuuuaugga

SEQ ID NO: 1337614 - RNA, 19 nt, Homo sapiens
ccaucgcccuuaaguaaag

SEQ ID NO: 1337615 - RNA, 19 nt, Homo sapiens
ucucugccaucgcccuuaa

SEQ ID NO: 1337616 - RNA, 19 nt, Homo sapiens
gcacagugagaaaugaaca

SEQ ID NO: 1337617 - RNA, 19 nt, Homo sapiens
gcgguuaccuaguuuugaa

SEQ ID NO: 1337618 - RNA, 19 nt, Homo sapiens
ggguggagaagaccaaguu

SEQ ID NO: 1337619 - RNA, 19 nt, Homo sapiens
gugagaaaugaacaaguuu

SEQ ID NO: 1337620 - RNA, 19 nt, Homo sapiens
uuuagucgaucgcgaagau

SEQ ID NO: 1337621 - RNA, 19 nt, Homo sapiens
ccauaggacacauaaccuu

SEQ ID NO: 1337622 - RNA, 19 nt, Homo sapiens
gccaucgcccuuaaguaaa

SEQ ID NO: 1337623 - RNA, 19 nt, Homo sapiens
auaccaagcagcaguguuc

SEQ ID NO: 1337624 - RNA, 19 nt, Homo sapiens
guacaaaauccuaucuaga

SEQ ID NO: 1337625 - RNA, 19 nt, Homo sapiens
ugaauuuugucacuuguug

SEQ ID NO: 1337626 - RNA, 19 nt, Homo sapiens
agagagaacuuuugcacau

SEQ ID NO: 1337627 - RNA, 19 nt, Homo sapiens
gagagaacuuuugcacaug

SEQ ID NO: 1337628 - RNA, 19 nt, Homo sapiens
gguggagaagaccaaguuu

SEQ ID NO: 1337629 - RNA, 19 nt, Homo sapiens
aguuucaaguaccuuauga

SEQ ID NO: 1337630 - RNA, 19 nt, Homo sapiens
gaugauaucucaauuggua

SEQ ID NO: 1337631 - RNA, 19 nt, Homo sapiens
gaauaagccucacaaauga

SEQ ID NO: 1337632 - RNA, 19 nt, Homo sapiens
ggagggacguguuuaauga

SEQ ID NO: 1337633 - RNA, 19 nt, Homo sapiens
gggcagaaauguagugauu

SEQ ID NO: 1337634 - RNA, 19 nt, Homo sapiens
gauggcaacucaccaaauu

SEQ ID NO: 1337635 - RNA, 19 nt, Homo sapiens
gaaaucauguuggguagaa

SEQ ID NO: 1337636 - RNA, 19 nt, Homo sapiens
gaagagagagaacauacua

SEQ ID NO: 1337637 - RNA, 19 nt, Homo sapiens
ucuagaagcugcccaaauu

SEQ ID NO: 1337638 - RNA, 19 nt, Homo sapiens
agagaaaccuuaugaaugu

SEQ ID NO: 1337639 - RNA, 19 nt, Homo sapiens
gaucaugccuccauaucaa

SEQ ID NO: 1337640 - RNA, 19 nt, Homo sapiens
cagauucgcucuucaaguu

SEQ ID NO: 1337641 - RNA, 19 nt, Homo sapiens
gcaccaaacuaacacaaau

SEQ ID NO: 1337642 - RNA, 19 nt, Homo sapiens
gcaaggcccagcugaaaua

SEQ ID NO: 1337643 - RNA, 19 nt, Homo sapiens
gcagaaauguagugauugu

SEQ ID NO: 1337644 - RNA, 19 nt, Homo sapiens
gaacacaguaccuauagaa

SEQ ID NO: 1337645 - RNA, 19 nt, Homo sapiens
gcucacaccuguaaucuca

SEQ ID NO: 1337646 - RNA, 19 nt, Homo sapiens
aaucaagccuuuguaguua

SEQ ID NO: 1337647 - RNA, 19 nt, Homo sapiens
gagagaaaccuuaugaaug

SEQ ID NO: 1337648 - RNA, 19 nt, Homo sapiens
ggaguuaaauaccauagau

SEQ ID NO: 1337649 - RNA, 19 nt, Homo sapiens
gagagaacauacuagaguu

SEQ ID NO: 1337650 - RNA, 19 nt, Homo sapiens
cagagaaucuuaugcuaug

SEQ ID NO: 1337651 - RNA, 19 nt, Homo sapiens
gaauaaaucuucugauacc

SEQ ID NO: 1337652 - RNA, 19 nt, Homo sapiens
agaauaagccucacaaaug

SEQ ID NO: 1337653 - RNA, 19 nt, Homo sapiens
gaaauguugcuaaacguaa

SEQ ID NO: 1337654 - RNA, 19 nt, Homo sapiens
cauuauagaugcucuugaa

SEQ ID NO: 1337655 - RNA, 19 nt, Homo sapiens
ggagagaaaccuuaugaau

SEQ ID NO: 1337656 - RNA, 19 nt, Homo sapiens
gagagaaacccuacagaug

SEQ ID NO: 1337657 - RNA, 19 nt, Homo sapiens
uauagaugcucuugaaaug

SEQ ID NO: 1337658 - RNA, 19 nt, Homo sapiens
gagaauaagccucacaaau

SEQ ID NO: 1337659 - RNA, 19 nt, Homo sapiens
guacaaggaaguaauguug

SEQ ID NO: 1337660 - RNA, 19 nt, Homo sapiens
caucagcacuggaaaauaa

SEQ ID NO: 1337661 - RNA, 19 nt, Homo sapiens
gaacaaccuuuuccaagaa

SEQ ID NO: 1337662 - RNA, 19 nt, Homo sapiens
gaacaagacauuuucagua

SEQ ID NO: 1337663 - RNA, 19 nt, Homo sapiens
uuacaucacucaaacacuu

SEQ ID NO: 1337664 - RNA, 19 nt, Homo sapiens
gggaaaaucuuuaguagga

SEQ ID NO: 1337665 - RNA, 19 nt, Homo sapiens
cacaguaccuauagaaaug

SEQ ID NO: 1337666 - RNA, 19 nt, Homo sapiens
uaagagagacagccauaaa

SEQ ID NO: 1337667 - RNA, 19 nt, Homo sapiens
uagaugcucuugaaauguu

SEQ ID NO: 1337668 - RNA, 19 nt, Homo sapiens
ccuaagaguugaacgaaau

SEQ ID NO: 1337669 - RNA, 19 nt, Homo sapiens
ggacguguuuaaugaaauc

SEQ ID NO: 1337670 - RNA, 19 nt, Homo sapiens
agucaaaucuguccagguu

SEQ ID NO: 1337671 - RNA, 19 nt, Homo sapiens
ggagagagaccauauucau

SEQ ID NO: 1337672 - RNA, 19 nt, Homo sapiens
caucagcgaucacauacug

SEQ ID NO: 1337673 - RNA, 19 nt, Homo sapiens
cuaaaucacagcucaauga

SEQ ID NO: 1337674 - RNA, 19 nt, Homo sapiens
gaacauacuagaguugcua

SEQ ID NO: 1337675 - RNA, 19 nt, Homo sapiens
ggaggacauuucugugaga

SEQ ID NO: 1337676 - RNA, 19 nt, Homo sapiens
gagaaaccuuaugaaugua

SEQ ID NO: 1337677 - RNA, 19 nt, Homo sapiens
gaccagacaucagaggauu

SEQ ID NO: 1337678 - RNA, 19 nt, Homo sapiens
gagaaacccuacagaugca

SEQ ID NO: 1337679 - RNA, 19 nt, Homo sapiens
gaaguaauguuggagaacu

SEQ ID NO: 1337680 - RNA, 19 nt, Homo sapiens
gaaauaacaggaaacacau

SEQ ID NO: 1337681 - RNA, 19 nt, Homo sapiens
ccuguaaucucagcacuuu

SEQ ID NO: 1337682 - RNA, 19 nt, Homo sapiens
gccaaucagucuuacauca

SEQ ID NO: 1337683 - RNA, 19 nt, Homo sapiens
aaagaaacauagacaacug

SEQ ID NO: 1337684 - RNA, 19 nt, Homo sapiens
ccacaugucaguccucauu

SEQ ID NO: 1337685 - RNA, 19 nt, Homo sapiens
ccuuauaaaugcagugauu

SEQ ID NO: 1337686 - RNA, 19 nt, Homo sapiens
uaacaggaaacacaugaaa

SEQ ID NO: 1337687 - RNA, 19 nt, Homo sapiens
cagcugaaauaacaggaaa

SEQ ID NO: 1337688 - RNA, 19 nt, Homo sapiens
aaacauagacaacuguaga

SEQ ID NO: 1337689 - RNA, 19 nt, Homo sapiens
ugagaagucaaaccuguua

SEQ ID NO: 1337690 - RNA, 19 nt, Homo sapiens
ggaauuugaacagagaaua

SEQ ID NO: 1337691 - RNA, 19 nt, Homo sapiens
uccaagaaaucaagccuuu

SEQ ID NO: 1337692 - RNA, 19 nt, Homo sapiens
agacaucagcgaucacaua

SEQ ID NO: 1337693 - RNA, 19 nt, Homo sapiens
caauagacaucagcgauca

SEQ ID NO: 1337694 - RNA, 19 nt, Homo sapiens
ggaagugccggcucaauag

SEQ ID NO: 1337695 - RNA, 19 nt, Homo sapiens
ggagagaaacccuacagau

SEQ ID NO: 1337696 - RNA, 19 nt, Homo sapiens
agucauaccuccuuauaca

SEQ ID NO: 1337697 - RNA, 19 nt, Homo sapiens
gagagacagccauaaauuc

SEQ ID NO: 1337698 - RNA, 19 nt, Homo sapiens
ccauggauguggugaaugu

SEQ ID NO: 1337699 - RNA, 19 nt, Homo sapiens
ugaaauaacaggaaacaca

SEQ ID NO: 1337700 - RNA, 19 nt, Homo sapiens
uaugaaagauugugauggu

SEQ ID NO: 1337701 - RNA, 19 nt, Homo sapiens
cauaagagagacagccaua

SEQ ID NO: 1337702 - RNA, 19 nt, Homo sapiens
gcaagucgaagcucauuca

SEQ ID NO: 1337703 - RNA, 19 nt, Homo sapiens
ggagggaaaccacaugaau

SEQ ID NO: 1337704 - RNA, 19 nt, Homo sapiens
aaacaccauugaaaucaug

SEQ ID NO: 1337705 - RNA, 19 nt, Homo sapiens
ucaggaauuugaacagaga

SEQ ID NO: 1337706 - RNA, 19 nt, Homo sapiens
aaaucaagccuuuguaguu

SEQ ID NO: 1337707 - RNA, 19 nt, Homo sapiens
gaaaucaagccuuuguagu

SEQ ID NO: 1337708 - RNA, 19 nt, Homo sapiens
caagaaaucaagccuuugu

SEQ ID NO: 1337709 - RNA, 19 nt, Homo sapiens
ggagaacuacaucaaccua

SEQ ID NO: 1337710 - RNA, 19 nt, Homo sapiens
aggcaaguauguuaagauu

SEQ ID NO: 1337711 - RNA, 19 nt, Homo sapiens
gaaaagauucugaugcauu

SEQ ID NO: 1337712 - RNA, 19 nt, Homo sapiens
guuaguuucuuaugagugu

SEQ ID NO: 1337713 - RNA, 19 nt, Homo sapiens
gaauguagugagugugaaa

SEQ ID NO: 1337714 - RNA, 19 nt, Homo sapiens
ccaugaauguagugaaugu

SEQ ID NO: 1337715 - RNA, 19 nt, Homo sapiens
ggaaaacauucaugaggaa

SEQ ID NO: 1337716 - RNA, 19 nt, Homo sapiens
gaaaugcagcuguuaugag

SEQ ID NO: 1337717 - RNA, 19 nt, Homo sapiens
ggguagaaaugcagcuguu

SEQ ID NO: 1337718 - RNA, 19 nt, Homo sapiens
gagagagaccauauucaug

SEQ ID NO: 1337719 - RNA, 19 nt, Homo sapiens
agacaucagaggauucaua

SEQ ID NO: 1337720 - RNA, 19 nt, Homo sapiens
cggaagugccggcucaaua

SEQ ID NO: 1337721 - RNA, 19 nt, Homo sapiens
caauggccaaucagucuua

SEQ ID NO: 1337722 - RNA, 19 nt, Homo sapiens
ggaauccuccagccauuau

SEQ ID NO: 1337723 - RNA, 19 nt, Homo sapiens
gaaagucacagcucauggu

SEQ ID NO: 1337724 - RNA, 19 nt, Homo sapiens
gagggaaaccacaugaaug

SEQ ID NO: 1337725 - RNA, 19 nt, Homo sapiens
uguauggacuguggaguaa

SEQ ID NO: 1337726 - RNA, 19 nt, Homo sapiens
cuacaucaaccuaguauca

SEQ ID NO: 1337727 - RNA, 19 nt, Homo sapiens
ugagauuuauggugcuuga

SEQ ID NO: 1337728 - RNA, 19 nt, Homo sapiens
agagagacagccauaaauu

SEQ ID NO: 1337729 - RNA, 19 nt, Homo sapiens
acaugucaguccucauuaa

SEQ ID NO: 1337730 - RNA, 19 nt, Homo sapiens
gcacagcccugcaucauga

SEQ ID NO: 1337731 - RNA, 19 nt, Homo sapiens
gagcagagcuggguuuaau

SEQ ID NO: 1337732 - RNA, 19 nt, Homo sapiens
ggaguucacuacuggauuu

SEQ ID NO: 1337733 - RNA, 19 nt, Homo sapiens
gcacaggaguucuuucaga

SEQ ID NO: 1337734 - RNA, 19 nt, Homo sapiens
gagcagaaacuguuaugua

SEQ ID NO: 1337735 - RNA, 19 nt, Homo sapiens
gaacuggagugugcccuaa

SEQ ID NO: 1337736 - RNA, 19 nt, Homo sapiens
ggacugugcuugguacuug

SEQ ID NO: 1337737 - RNA, 19 nt, Homo sapiens
agaaggagauggaagugua

SEQ ID NO: 1337738 - RNA, 19 nt, Homo sapiens
gucaagagcuggagcagaa

SEQ ID NO: 1337739 - RNA, 19 nt, Homo sapiens
gaugggaaguugauauuag

SEQ ID NO: 1337740 - RNA, 19 nt, Homo sapiens
ucaagaaacugacuaaucg

SEQ ID NO: 1337741 - RNA, 19 nt, Homo sapiens
ucacaggaauuuacugaug

SEQ ID NO: 1337742 - RNA, 19 nt, Homo sapiens
gaaaauugcugcuuaugau

SEQ ID NO: 1337743 - RNA, 19 nt, Homo sapiens
gaagaaauccagcaucucu

SEQ ID NO: 1337744 - RNA, 19 nt, Homo sapiens
guaaaugaaucacaaacag

SEQ ID NO: 1337745 - RNA, 19 nt, Homo sapiens
aaacgugccugcugagaga

SEQ ID NO: 1337746 - RNA, 19 nt, Homo sapiens
agcagaaacuguuauguaa

SEQ ID NO: 1337747 - RNA, 19 nt, Homo sapiens
gaaggagacucaggagcaa

SEQ ID NO: 1337748 - RNA, 19 nt, Homo sapiens
gcacaggagucuugcugau

SEQ ID NO: 1337749 - RNA, 19 nt, Homo sapiens
gcagagcuggguuuaauga

SEQ ID NO: 1337750 - RNA, 19 nt, Homo sapiens
ggaacuggaggauguguuu

SEQ ID NO: 1337751 - RNA, 19 nt, Homo sapiens
ggagauggaacaacaaauc

SEQ ID NO: 1337752 - RNA, 19 nt, Homo sapiens
ucaggaagaugcaggugaa

SEQ ID NO: 1337753 - RNA, 19 nt, Homo sapiens
ccacaggaguucacuacug

SEQ ID NO: 1337754 - RNA, 19 nt, Homo sapiens
gguugcagcugaagaagga

SEQ ID NO: 1337755 - RNA, 19 nt, Homo sapiens
gauauuagaggaaagaagu

SEQ ID NO: 1337756 - RNA, 19 nt, Homo sapiens
uagccacucuauuauguuu

SEQ ID NO: 1337757 - RNA, 19 nt, Homo sapiens
gcaagaggccugcaaacuc

SEQ ID NO: 1337758 - RNA, 19 nt, Homo sapiens
gauggaacaacaaaucaaa

SEQ ID NO: 1337759 - RNA, 19 nt, Homo sapiens
uaacucggcuguguucugu

SEQ ID NO: 1337760 - RNA, 19 nt, Homo sapiens
cagaaacuguuauguaagg

SEQ ID NO: 1337761 - RNA, 19 nt, Homo sapiens
aaaggaaaauugcugcuua

SEQ ID NO: 1337762 - RNA, 19 nt, Homo sapiens
gcagcuggauuuccuaagg

SEQ ID NO: 1337763 - RNA, 19 nt, Homo sapiens
gcaaacgucgggccagcua

SEQ ID NO: 1337764 - RNA, 19 nt, Homo sapiens
gaaggacacagagagguuu

SEQ ID NO: 1337765 - RNA, 19 nt, Homo sapiens
cauguuuguugaaugagua

SEQ ID NO: 1337766 - RNA, 19 nt, Homo sapiens
gcuguguucuguucauguu

SEQ ID NO: 1337767 - RNA, 19 nt, Homo sapiens
gaauggaaauccguaacuc

SEQ ID NO: 1337768 - RNA, 19 nt, Homo sapiens
gaccacagcugcccuucag

SEQ ID NO: 1337769 - RNA, 19 nt, Homo sapiens
gaauaacccaagucaggaa

SEQ ID NO: 1337770 - RNA, 19 nt, Homo sapiens
uggaggaacuggaggaugu

SEQ ID NO: 1337771 - RNA, 19 nt, Homo sapiens
gagagagugcccucaauuc

SEQ ID NO: 1337772 - RNA, 19 nt, Homo sapiens
ccauugggcuguuugucaa

SEQ ID NO: 1337773 - RNA, 19 nt, Homo sapiens
aaacagagcaccaagaaaa

SEQ ID NO: 1337774 - RNA, 19 nt, Homo sapiens
gaaguugauauuagaggaa

SEQ ID NO: 1337775 - RNA, 19 nt, Homo sapiens
guagggcaguucauucaca

SEQ ID NO: 1337776 - RNA, 19 nt, Homo sapiens
gaggagauggaacaacaaa

SEQ ID NO: 1337777 - RNA, 19 nt, Homo sapiens
acaaacagagcaccaagaa

SEQ ID NO: 1337778 - RNA, 19 nt, Homo sapiens
gagauggaacaacaaauca

SEQ ID NO: 1337779 - RNA, 19 nt, Homo sapiens
gaaggcacaggaguucuuu

SEQ ID NO: 1337780 - RNA, 19 nt, Homo sapiens
ggaaggcacaggaguucuu

SEQ ID NO: 1337781 - RNA, 19 nt, Homo sapiens
gcgcccacauccaguuuau

SEQ ID NO: 1337782 - RNA, 19 nt, Homo sapiens
gaagaugaaagugauguca

SEQ ID NO: 1337783 - RNA, 19 nt, Homo sapiens
guuggaagaugaaagugau

SEQ ID NO: 1337784 - RNA, 19 nt, Homo sapiens
gaguagggcaguucauuca

SEQ ID NO: 1337785 - RNA, 19 nt, Homo sapiens
gcaaacuccaccaagagaa

SEQ ID NO: 1337786 - RNA, 19 nt, Homo sapiens
gagcugcaagguucugaaa

SEQ ID NO: 1337787 - RNA, 19 nt, Homo sapiens
gcccacauccaguuuauuc

SEQ ID NO: 1337788 - RNA, 19 nt, Homo sapiens
ccugcaaacuccaccaaga

SEQ ID NO: 1337789 - RNA, 19 nt, Homo sapiens
gagaauaccaagcugaaac

SEQ ID NO: 1337790 - RNA, 19 nt, Homo sapiens
gaacaacaaaucaaaagug

SEQ ID NO: 1337791 - RNA, 19 nt, Homo sapiens
ggaaaauugcugcuuauga

SEQ ID NO: 1337792 - RNA, 19 nt, Homo sapiens
aaagugagaaggagcaguu

SEQ ID NO: 1337793 - RNA, 19 nt, Homo sapiens
ucaagcagcucugguugca

SEQ ID NO: 1337794 - RNA, 19 nt, Homo sapiens
gaugguggaauucaaguca

SEQ ID NO: 1337795 - RNA, 19 nt, Homo sapiens
uauuauguuugguccguuu

SEQ ID NO: 1337796 - RNA, 19 nt, Homo sapiens
ucaagcagcuggauuuccu

SEQ ID NO: 1337797 - RNA, 19 nt, Homo sapiens
gaaauccagcaucucuaug

SEQ ID NO: 1337798 - RNA, 19 nt, Homo sapiens
caaacagagcaccaagaaa

SEQ ID NO: 1337799 - RNA, 19 nt, Homo sapiens
aguagccacucuauuaugu

SEQ ID NO: 1337800 - RNA, 19 nt, Homo sapiens
caacaaaucaaaagugaga

SEQ ID NO: 1337801 - RNA, 19 nt, Homo sapiens
aaauccagcaucucuauga

SEQ ID NO: 1337802 - RNA, 19 nt, Homo sapiens
gcagaaacuguuauguaag

SEQ ID NO: 1337803 - RNA, 19 nt, Homo sapiens
gaagaaugaacuggagugu

SEQ ID NO: 1337804 - RNA, 19 nt, Homo sapiens
cauuuacuguccaacuuug

SEQ ID NO: 1337805 - RNA, 19 nt, Homo sapiens
agaaauccagcaucucuau

SEQ ID NO: 1337806 - RNA, 19 nt, Homo sapiens
cccaugaggagaagaauga

SEQ ID NO: 1337807 - RNA, 19 nt, Homo sapiens
gaggaaggcacaggaguuc

SEQ ID NO: 1337808 - RNA, 19 nt, Homo sapiens
ggcaguucauucacaggaa

SEQ ID NO: 1337809 - RNA, 19 nt, Homo sapiens
gcgagcagagcuggguuua

SEQ ID NO: 1337810 - RNA, 19 nt, Homo sapiens
gcuggagcagaaacuguua

SEQ ID NO: 1337811 - RNA, 19 nt, Homo sapiens
uaacccaagucaggaagau

SEQ ID NO: 1337812 - RNA, 19 nt, Homo sapiens
uuuagucacuucuucuuca

SEQ ID NO: 1337813 - RNA, 19 nt, Homo sapiens
aaauugcugcuuaugauga

SEQ ID NO: 1337814 - RNA, 19 nt, Homo sapiens
agaugaaagugaugucaag

SEQ ID NO: 1337815 - RNA, 19 nt, Homo sapiens
caaaagguguuggaagaug

SEQ ID NO: 1337816 - RNA, 19 nt, Homo sapiens
ggaagaugcaggugaacag

SEQ ID NO: 1337817 - RNA, 19 nt, Homo sapiens
gagagucuacagcgugaga

SEQ ID NO: 1337818 - RNA, 19 nt, Homo sapiens
gcucagcagcaguuggaaa

SEQ ID NO: 1337819 - RNA, 19 nt, Homo sapiens
ggacacagagagguuucaa

SEQ ID NO: 1337820 - RNA, 19 nt, Homo sapiens
ugaaggacacagagagguu

SEQ ID NO: 1337821 - RNA, 19 nt, Homo sapiens
uguguucuguucauguuug

SEQ ID NO: 1337822 - RNA, 19 nt, Homo sapiens
ugaugggaaguugauauua

SEQ ID NO: 1337823 - RNA, 19 nt, Homo sapiens
gaccaaggcugagaauacc

SEQ ID NO: 1337824 - RNA, 19 nt, Homo sapiens
agaccaaggcugagaauac

SEQ ID NO: 1337825 - RNA, 19 nt, Homo sapiens
cuccaggugugaagaguug

SEQ ID NO: 1337826 - RNA, 19 nt, Homo sapiens
gccauugggcuguuuguca

SEQ ID NO: 1337827 - RNA, 19 nt, Homo sapiens
gaguggagccugccugcau

SEQ ID NO: 1337828 - RNA, 19 nt, Homo sapiens
gcaaaacuguuaggugagu

SEQ ID NO: 1337829 - RNA, 19 nt, Homo sapiens
augaggagauggaacaaca

SEQ ID NO: 1337830 - RNA, 19 nt, Homo sapiens
gaaagagccaauagucaua

SEQ ID NO: 1337831 - RNA, 19 nt, Homo sapiens
gagacagaaugacaagaua

SEQ ID NO: 1337832 - RNA, 19 nt, Homo sapiens
gaaggauuaugugaguuua

SEQ ID NO: 1337833 - RNA, 19 nt, Homo sapiens
ucacaucuggcaaauauua

SEQ ID NO: 1337834 - RNA, 19 nt, Homo sapiens
gagugugaaugauacuuua

SEQ ID NO: 1337835 - RNA, 19 nt, Homo sapiens
gcaacucaaugaaagcaaa

SEQ ID NO: 1337836 - RNA, 19 nt, Homo sapiens
ugacaaacaugaggagaaa

SEQ ID NO: 1337837 - RNA, 19 nt, Homo sapiens
gauuauuccuggauuguga

SEQ ID NO: 1337838 - RNA, 19 nt, Homo sapiens
gaugugacccucaagauga

SEQ ID NO: 1337839 - RNA, 19 nt, Homo sapiens
ggaaggauuaugugaguuu

SEQ ID NO: 1337840 - RNA, 19 nt, Homo sapiens
gaacauggaaaccacaaga

SEQ ID NO: 1337841 - RNA, 19 nt, Homo sapiens
gcaugaauguuggauguga

SEQ ID NO: 1337842 - RNA, 19 nt, Homo sapiens
uaaagcagauguggagcua

SEQ ID NO: 1337843 - RNA, 19 nt, Homo sapiens
uuucacaucuggcaaauau

SEQ ID NO: 1337844 - RNA, 19 nt, Homo sapiens
ucagaaaugugccuguaug

SEQ ID NO: 1337845 - RNA, 19 nt, Homo sapiens
gcaaaugugccauaaagca

SEQ ID NO: 1337846 - RNA, 19 nt, Homo sapiens
ugaagcaaaugugccauaa

SEQ ID NO: 1337847 - RNA, 19 nt, Homo sapiens
gaaccuguuuaucccagaa

SEQ ID NO: 1337848 - RNA, 19 nt, Homo sapiens
gagaagagacagaaugaca

SEQ ID NO: 1337849 - RNA, 19 nt, Homo sapiens
aagcaaaugugccauaaag

SEQ ID NO: 1337850 - RNA, 19 nt, Homo sapiens
gaacauuccagggagcuuu

SEQ ID NO: 1337851 - RNA, 19 nt, Homo sapiens
ggugcaauauguuccaaga

SEQ ID NO: 1337852 - RNA, 19 nt, Homo sapiens
gaaagcaaagccagaaugg

SEQ ID NO: 1337853 - RNA, 19 nt, Homo sapiens
gaaaggagggcgaggacau

SEQ ID NO: 1337854 - RNA, 19 nt, Homo sapiens
uaccagcacaguaggauua

SEQ ID NO: 1337855 - RNA, 19 nt, Homo sapiens
gaagcaaaugugccauaaa

SEQ ID NO: 1337856 - RNA, 19 nt, Homo sapiens
uaugugaguuuaaggauag

SEQ ID NO: 1337857 - RNA, 19 nt, Homo sapiens
aaacaaagcaaacucucuu

SEQ ID NO: 1337858 - RNA, 19 nt, Homo sapiens
aagcaaagccagaauggaa

SEQ ID NO: 1337859 - RNA, 19 nt, Homo sapiens
gaagagacagaaugacaag

SEQ ID NO: 1337860 - RNA, 19 nt, Homo sapiens
gagcuuuguugauguugau

SEQ ID NO: 1337861 - RNA, 19 nt, Homo sapiens
gguagaaccgugagcuuug

SEQ ID NO: 1337862 - RNA, 19 nt, Homo sapiens
gaaagagaagagacagaau

SEQ ID NO: 1337863 - RNA, 19 nt, Homo sapiens
aagcaugaauguuggaugu

SEQ ID NO: 1337864 - RNA, 19 nt, Homo sapiens
gaaacaaagcaaacucucu

SEQ ID NO: 1337865 - RNA, 19 nt, Homo sapiens
uauaucagagugugaauga

SEQ ID NO: 1337866 - RNA, 19 nt, Homo sapiens
gaauguaugaggaucugaa

SEQ ID NO: 1337867 - RNA, 19 nt, Homo sapiens
uggaaaggcugcgaaagga

SEQ ID NO: 1337868 - RNA, 19 nt, Homo sapiens
guagaaccgugagcuuugu

SEQ ID NO: 1337869 - RNA, 19 nt, Homo sapiens
ggaugugacccucaagaug

SEQ ID NO: 1337870 - RNA, 19 nt, Homo sapiens
ggagauuugagaagcauga

SEQ ID NO: 1337871 - RNA, 19 nt, Homo sapiens
caaaguucccugauauaca

SEQ ID NO: 1337872 - RNA, 19 nt, Homo sapiens
ucaagaugaucccgauauc

SEQ ID NO: 1337873 - RNA, 19 nt, Homo sapiens
gaaccgugagcuuuguuga

SEQ ID NO: 1337874 - RNA, 19 nt, Homo sapiens
gauuugagaagcaugaaug

SEQ ID NO: 1337875 - RNA, 19 nt, Homo sapiens
ugaaagagccaauagucau

SEQ ID NO: 1337876 - RNA, 19 nt, Homo sapiens
gacagaaugacaagauaga

SEQ ID NO: 1337877 - RNA, 19 nt, Homo sapiens
aaagagaagagacagaaug

SEQ ID NO: 1337878 - RNA, 19 nt, Homo sapiens
agagcaacaucacuuggaa

SEQ ID NO: 1337879 - RNA, 19 nt, Homo sapiens
uuuggugucuguaacaauu

SEQ ID NO: 1337880 - RNA, 19 nt, Homo sapiens
aaacaugaggagaaacaaa

SEQ ID NO: 1337881 - RNA, 19 nt, Homo sapiens
cugcauuucuccaugaaga

SEQ ID NO: 1337882 - RNA, 19 nt, Homo sapiens
gacacucacugcagucucu

SEQ ID NO: 1337883 - RNA, 19 nt, Homo sapiens
gagacauauuacacaggua

SEQ ID NO: 1337884 - RNA, 19 nt, Homo sapiens
augaggaucugaagcaaau

SEQ ID NO: 1337885 - RNA, 19 nt, Homo sapiens
gcucugggaaccuguuuau

SEQ ID NO: 1337886 - RNA, 19 nt, Homo sapiens
agucagaaaugugccugua

SEQ ID NO: 1337887 - RNA, 19 nt, Homo sapiens
aaaguucccugauauacac

SEQ ID NO: 1337888 - RNA, 19 nt, Homo sapiens
caauauguuccaagaccua

SEQ ID NO: 1337889 - RNA, 19 nt, Homo sapiens
gagaaacaaagcaaacucu

SEQ ID NO: 1337890 - RNA, 19 nt, Homo sapiens
cagcacaguaggauuauuc

SEQ ID NO: 1337891 - RNA, 19 nt, Homo sapiens
aagagaagagacagaauga

SEQ ID NO: 1337892 - RNA, 19 nt, Homo sapiens
gcucaggcuuucacaucug

SEQ ID NO: 1337893 - RNA, 19 nt, Homo sapiens
uugagaagcaugaauguug

SEQ ID NO: 1337894 - RNA, 19 nt, Homo sapiens
ggacagccucaguggauuc

SEQ ID NO: 1337895 - RNA, 19 nt, Homo sapiens
gagcaacaucacuuggaaa

SEQ ID NO: 1337896 - RNA, 19 nt, Homo sapiens
cagccucaguggauucaga

SEQ ID NO: 1337897 - RNA, 19 nt, Homo sapiens
guaugaggaucugaagcaa

SEQ ID NO: 1337898 - RNA, 19 nt, Homo sapiens
gcaaagccagaauggaaca

SEQ ID NO: 1337899 - RNA, 19 nt, Homo sapiens
gaagaagagcaacaucacu

SEQ ID NO: 1337900 - RNA, 19 nt, Homo sapiens
gaaaccacaagaaccagau

SEQ ID NO: 1337901 - RNA, 19 nt, Homo sapiens
cagaaugacaagauagaug

SEQ ID NO: 1337902 - RNA, 19 nt, Homo sapiens
ccucacuugugcuucaauu

SEQ ID NO: 1337903 - RNA, 19 nt, Homo sapiens
cucaguggauucagaguug

SEQ ID NO: 1337904 - RNA, 19 nt, Homo sapiens
gauuaugugaguuuaagga

SEQ ID NO: 1337905 - RNA, 19 nt, Homo sapiens
uuucgcaccucaucaaaca

SEQ ID NO: 1337906 - RNA, 19 nt, Homo sapiens
ggagaaacaaagcaaacuc

SEQ ID NO: 1337907 - RNA, 19 nt, Homo sapiens
gagccaauagucauaucuu

SEQ ID NO: 1337908 - RNA, 19 nt, Homo sapiens
ugaaagcaaagccagaaug

SEQ ID NO: 1337909 - RNA, 19 nt, Homo sapiens
aagaagagcaacaucacuu

SEQ ID NO: 1337910 - RNA, 19 nt, Homo sapiens
ugucuuuaguugcauucua

SEQ ID NO: 1337911 - RNA, 19 nt, Homo sapiens
cgugagcuuuguugauguu

SEQ ID NO: 1337912 - RNA, 19 nt, Homo sapiens
aaggauagaagcaaucaga

SEQ ID NO: 1337913 - RNA, 19 nt, Homo sapiens
gugaaaaucucagaaaucu

SEQ ID NO: 1337914 - RNA, 19 nt, Homo sapiens
gggcucaggcuuucacauc

SEQ ID NO: 1337915 - RNA, 19 nt, Homo sapiens
agacauauuacacagguau

SEQ ID NO: 1337916 - RNA, 19 nt, Homo sapiens
guuuaaggauagaagcaau

SEQ ID NO: 1337917 - RNA, 19 nt, Homo sapiens
gaugcuggaaggauuaugu

SEQ ID NO: 1337918 - RNA, 19 nt, Homo sapiens
uggguuaauuugucucuca

SEQ ID NO: 1337919 - RNA, 19 nt, Homo sapiens
gaggaucugaagcaaaugu

SEQ ID NO: 1337920 - RNA, 19 nt, Homo sapiens
cuggaaggauuaugugagu

SEQ ID NO: 1337921 - RNA, 19 nt, Homo sapiens
gaggagaaacaaagcaaac

SEQ ID NO: 1337922 - RNA, 19 nt, Homo sapiens
gaaaucugaacauggaaac

SEQ ID NO: 1337923 - RNA, 19 nt, Homo sapiens
acaaacaugaggagaaaca

SEQ ID NO: 1337924 - RNA, 19 nt, Homo sapiens
cgauaucacuggaaaaucu

SEQ ID NO: 1337925 - RNA, 19 nt, Homo sapiens
ugagcuuuguugauguuga

SEQ ID NO: 1337926 - RNA, 19 nt, Homo sapiens
agagugugaaugauacuuu

SEQ ID NO: 1337927 - RNA, 19 nt, Homo sapiens
agagacagaaugacaagau

SEQ ID NO: 1337928 - RNA, 19 nt, Homo sapiens
agaagagacagaaugacaa

SEQ ID NO: 1337929 - RNA, 19 nt, Homo sapiens
ucaaaguucccugauauac

SEQ ID NO: 1337930 - RNA, 19 nt, Homo sapiens
ccauuaaacucucucuaua

SEQ ID NO: 1337931 - RNA, 19 nt, Homo sapiens
gacccugucucuauuuaua

SEQ ID NO: 1337932 - RNA, 19 nt, Homo sapiens
acacguaccuguccuacuu

SEQ ID NO: 1337933 - RNA, 19 nt, Homo sapiens
gcugguagccucuccauug

SEQ ID NO: 1337934 - RNA, 19 nt, Homo sapiens
gcgcgcugcucgucacuaa

SEQ ID NO: 1337935 - RNA, 19 nt, Homo sapiens
caaauguccucaagaaggu

SEQ ID NO: 1337936 - RNA, 19 nt, Homo sapiens
gaacacacccaugaagaug

SEQ ID NO: 1337937 - RNA, 19 nt, Homo sapiens
gcucccaccuguaaucuca

SEQ ID NO: 1337938 - RNA, 19 nt, Homo sapiens
ggaacacacccaugaagau

SEQ ID NO: 1337939 - RNA, 19 nt, Homo sapiens
ucccaaauguccucaagaa

SEQ ID NO: 1337940 - RNA, 19 nt, Homo sapiens
guccugaacuguggaaaug

SEQ ID NO: 1337941 - RNA, 19 nt, Homo sapiens
gccauuaaacucucucuau

SEQ ID NO: 1337942 - RNA, 19 nt, Homo sapiens
aggcugagguggaaggauu

SEQ ID NO: 1337943 - RNA, 19 nt, Homo sapiens
ggacacccgagcagacuga

SEQ ID NO: 1337944 - RNA, 19 nt, Homo sapiens
ccucguggaucagcuggua

SEQ ID NO: 1337945 - RNA, 19 nt, Homo sapiens
agaagguccucguggauca

SEQ ID NO: 1337946 - RNA, 19 nt, Homo sapiens
gagcccaguuccucugaca

SEQ ID NO: 1337947 - RNA, 19 nt, Homo sapiens
cuccgaggcuucccaaaug

SEQ ID NO: 1337948 - RNA, 19 nt, Homo sapiens
guaccuguccuacuugaag

SEQ ID NO: 1337949 - RNA, 19 nt, Homo sapiens
caagaagguccucguggau

SEQ ID NO: 1337950 - RNA, 19 nt, Homo sapiens
cagccucuguguuucuuuc

SEQ ID NO: 1337951 - RNA, 19 nt, Homo sapiens
gcgcugcucgucacuaaca

SEQ ID NO: 1337952 - RNA, 19 nt, Homo sapiens
gaaguaccggagcccaguu

SEQ ID NO: 1337953 - RNA, 19 nt, Homo sapiens
cccugucucuauuuauauu

SEQ ID NO: 1337954 - RNA, 19 nt, Homo sapiens
cggaacacacccaugaaga

SEQ ID NO: 1337955 - RNA, 19 nt, Homo sapiens
ccacgucccagcaccacuu

SEQ ID NO: 1337956 - RNA, 19 nt, Homo sapiens
ucacuucugggacugaguu

SEQ ID NO: 1337957 - RNA, 19 nt, Homo sapiens
aaccggaacacacccauga

SEQ ID NO: 1337958 - RNA, 19 nt, Homo sapiens
gguccugaacuguggaaau

SEQ ID NO: 1337959 - RNA, 19 nt, Homo sapiens
gcacacuguugguuucaaa

SEQ ID NO: 1337960 - RNA, 19 nt, Homo sapiens
gcucucagcaugacuauuu

SEQ ID NO: 1337961 - RNA, 19 nt, Homo sapiens
agcuagagguccuuuauua

SEQ ID NO: 1337962 - RNA, 19 nt, Homo sapiens
gcuacugcccuuucuauaa

SEQ ID NO: 1337963 - RNA, 19 nt, Homo sapiens
cuacugcccuuucuauaau

SEQ ID NO: 1337964 - RNA, 19 nt, Homo sapiens
gcuagagguccuuuauuaa

SEQ ID NO: 1337965 - RNA, 19 nt, Homo sapiens
uagcugcccuggacuauuc

SEQ ID NO: 1337966 - RNA, 19 nt, Homo sapiens
gggccaggcuucucacuag

SEQ ID NO: 1337967 - RNA, 19 nt, Homo sapiens
gagcaaacuccaagacauc

SEQ ID NO: 1337968 - RNA, 19 nt, Homo sapiens
aaagcacacuguugguuuc

SEQ ID NO: 1337969 - RNA, 19 nt, Homo sapiens
ugagcaaacuccaagacau

SEQ ID NO: 1337970 - RNA, 19 nt, Homo sapiens
gucugucacugaaaccuuu

SEQ ID NO: 1337971 - RNA, 19 nt, Homo sapiens
gcacagcuagagguccuuu

SEQ ID NO: 1337972 - RNA, 19 nt, Homo sapiens
ggccauccgugagaucuuc

SEQ ID NO: 1337973 - RNA, 19 nt, Homo sapiens
cugcagccuugcucccuaa

SEQ ID NO: 1337974 - RNA, 19 nt, Homo sapiens
cagcuagagguccuuuauu

SEQ ID NO: 1337975 - RNA, 19 nt, Homo sapiens
agacggagcagacccaucu

SEQ ID NO: 1337976 - RNA, 19 nt, Homo sapiens
caacagcugccccugcuaa

SEQ ID NO: 1337977 - RNA, 19 nt, Homo sapiens
uacugcccuuucuauaaua

SEQ ID NO: 1337978 - RNA, 19 nt, Homo sapiens
uguccugcccaccuucuua

SEQ ID NO: 1337979 - RNA, 19 nt, Homo sapiens
gccauuaggcucucagcau

SEQ ID NO: 1337980 - RNA, 19 nt, Homo sapiens
acagcuagagguccuuuau

SEQ ID NO: 1337981 - RNA, 19 nt, Homo sapiens
gagacuauuccucccaucu

SEQ ID NO: 1337982 - RNA, 19 nt, Homo sapiens
ccacuugagcaaacuccaa

SEQ ID NO: 1337983 - RNA, 19 nt, Homo sapiens
ccaccuucuuccugaguca

SEQ ID NO: 1337984 - RNA, 19 nt, Homo sapiens
agccuugccuggaugucua

SEQ ID NO: 1337985 - RNA, 19 nt, Homo sapiens
aacccaaucugucuuccau

SEQ ID NO: 1337986 - RNA, 19 nt, Homo sapiens
gcaaacaccugguagagau

SEQ ID NO: 1337987 - RNA, 19 nt, Homo sapiens
gaaacagacucgugagaca

SEQ ID NO: 1337988 - RNA, 19 nt, Homo sapiens
ucagagaggucuaguaaca

SEQ ID NO: 1337989 - RNA, 19 nt, Homo sapiens
ugaauacugucuuuggaua

SEQ ID NO: 1337990 - RNA, 19 nt, Homo sapiens
gaaguaggguugaaauagg

SEQ ID NO: 1337991 - RNA, 19 nt, Homo sapiens
cuggaaagcuuguuggaaa

SEQ ID NO: 1337992 - RNA, 19 nt, Homo sapiens
gaacagugagugaagaaug

SEQ ID NO: 1337993 - RNA, 19 nt, Homo sapiens
gauuggaauugaacaguga

SEQ ID NO: 1337994 - RNA, 19 nt, Homo sapiens
guuaagauccguuauagug

SEQ ID NO: 1337995 - RNA, 19 nt, Homo sapiens
gagaacaccauaggaagua

SEQ ID NO: 1337996 - RNA, 19 nt, Homo sapiens
ggaaguaggguugaaauag

SEQ ID NO: 1337997 - RNA, 19 nt, Homo sapiens
ggaauugaacagugaguga

SEQ ID NO: 1337998 - RNA, 19 nt, Homo sapiens
uuaguggccucuuuaauuc

SEQ ID NO: 1337999 - RNA, 19 nt, Homo sapiens
gguagagauuggaauugaa

SEQ ID NO: 1338000 - RNA, 19 nt, Homo sapiens
gcauuucggcuuccuaugu

SEQ ID NO: 1338001 - RNA, 19 nt, Homo sapiens
cuuaguggccucuuuaauu

SEQ ID NO: 1338002 - RNA, 19 nt, Homo sapiens
agagugcccuuacuuagug

SEQ ID NO: 1338003 - RNA, 19 nt, Homo sapiens
gacaugaacagacacucua

SEQ ID NO: 1338004 - RNA, 19 nt, Homo sapiens
uuacuuaguggccucuuua

SEQ ID NO: 1338005 - RNA, 19 nt, Homo sapiens
aaagcuaagugcucuguag

SEQ ID NO: 1338006 - RNA, 19 nt, Homo sapiens
aacagugagugaagaauga

SEQ ID NO: 1338007 - RNA, 19 nt, Homo sapiens
gcaccucccucucuuucag

SEQ ID NO: 1338008 - RNA, 19 nt, Homo sapiens
cagggaauuugaauacugu

SEQ ID NO: 1338009 - RNA, 19 nt, Homo sapiens
ucagggaauuugaauacug

SEQ ID NO: 1338010 - RNA, 19 nt, Homo sapiens
gaauugaacagugagugaa

SEQ ID NO: 1338011 - RNA, 19 nt, Homo sapiens
uuggauauguugaugaaga

SEQ ID NO: 1338012 - RNA, 19 nt, Homo sapiens
gaauacugucuuuggauau

SEQ ID NO: 1338013 - RNA, 19 nt, Homo sapiens
ccacaucagggaauuugaa

SEQ ID NO: 1338014 - RNA, 19 nt, Homo sapiens
ugguagagauuggaauuga

SEQ ID NO: 1338015 - RNA, 19 nt, Homo sapiens
ggacaugaacagacacucu

SEQ ID NO: 1338016 - RNA, 19 nt, Homo sapiens
cguuauagugcuuuguuua

SEQ ID NO: 1338017 - RNA, 19 nt, Homo sapiens
caucagggaauuugaauac

SEQ ID NO: 1338018 - RNA, 19 nt, Homo sapiens
ggucugggacucagccauu

SEQ ID NO: 1338019 - RNA, 19 nt, Homo sapiens
aaugagacccuuccgcaaa

SEQ ID NO: 1338020 - RNA, 19 nt, Homo sapiens
cagacacucuaccacauca

SEQ ID NO: 1338021 - RNA, 19 nt, Homo sapiens
ggaauuugaauacugucuu

SEQ ID NO: 1338022 - RNA, 19 nt, Homo sapiens
cauaggaaguaggguugaa

SEQ ID NO: 1338023 - RNA, 19 nt, Homo sapiens
gcaaagcuaagugcucugu

SEQ ID NO: 1338024 - RNA, 19 nt, Homo sapiens
auucagagaggucuaguaa

SEQ ID NO: 1338025 - RNA, 19 nt, Homo sapiens
gacaagugcuuuugcuuuc

SEQ ID NO: 1338026 - RNA, 19 nt, Homo sapiens
gauccguuauagugcuuug

SEQ ID NO: 1338027 - RNA, 19 nt, Homo sapiens
cauuucggcuuccuaugug

SEQ ID NO: 1338028 - RNA, 19 nt, Homo sapiens
uuuagagugcccuuacuua

SEQ ID NO: 1338029 - RNA, 19 nt, Homo sapiens
ccacggugcuaugagaaca

SEQ ID NO: 1338030 - RNA, 19 nt, Homo sapiens
gugcuuuguuuauuuagag

SEQ ID NO: 1338031 - RNA, 19 nt, Homo sapiens
agagaggucuaguaacacu

SEQ ID NO: 1338032 - RNA, 19 nt, Homo sapiens
uguguaaugcgaauucuga

SEQ ID NO: 1338033 - RNA, 19 nt, Homo sapiens
cuuuggauauguugaugaa

SEQ ID NO: 1338034 - RNA, 19 nt, Homo sapiens
aauacugucuuuggauaug

SEQ ID NO: 1338035 - RNA, 19 nt, Homo sapiens
gggcaccucccucucuuuc

SEQ ID NO: 1338036 - RNA, 19 nt, Homo sapiens
ugguuaagauccguuauag

SEQ ID NO: 1338037 - RNA, 19 nt, Homo sapiens
caaacaccugguagagauu

SEQ ID NO: 1338038 - RNA, 19 nt, Homo sapiens
gggcauuucggcuuccuau

SEQ ID NO: 1338039 - RNA, 19 nt, Homo sapiens
ccguuauagugcuuuguuu

SEQ ID NO: 1338040 - RNA, 19 nt, Homo sapiens
cuauguggguucuggaaag

SEQ ID NO: 1338041 - RNA, 19 nt, Homo sapiens
ugagaacaccauaggaagu

SEQ ID NO: 1338042 - RNA, 19 nt, Homo sapiens
gaccucacgcugcccagaa

SEQ ID NO: 1338043 - RNA, 19 nt, Homo sapiens
gagauuggaauugaacagu

SEQ ID NO: 1338044 - RNA, 19 nt, Homo sapiens
uagagugcccuuacuuagu

SEQ ID NO: 1338045 - RNA, 19 nt, Homo sapiens
aggaaguaggguugaaaua

SEQ ID NO: 1338046 - RNA, 19 nt, Homo sapiens
guagagauuggaauugaac

SEQ ID NO: 1338047 - RNA, 19 nt, Homo sapiens
cugguuaagauccguuaua

SEQ ID NO: 1338048 - RNA, 19 nt, Homo sapiens
caaagcuaagugcucugua

SEQ ID NO: 1338049 - RNA, 19 nt, Homo sapiens
uuugaauacugucuuugga

SEQ ID NO: 1338050 - RNA, 19 nt, Homo sapiens
ugacaagugcuuuugcuuu

SEQ ID NO: 1338051 - RNA, 19 nt, Homo sapiens
ccugguagagauuggaauu

SEQ ID NO: 1338052 - RNA, 19 nt, Homo sapiens
cuuacuuaguggccucuuu

SEQ ID NO: 1338053 - RNA, 19 nt, Homo sapiens
aacagacacucuaccacau

SEQ ID NO: 1338054 - RNA, 19 nt, Homo sapiens
uuagagugcccuuacuuag

SEQ ID NO: 1338055 - RNA, 19 nt, Homo sapiens
ggacuugucuagaccagaa

SEQ ID NO: 1338056 - RNA, 19 nt, Homo sapiens
ggacugaacuucuccuaac

SEQ ID NO: 1338057 - RNA, 19 nt, Homo sapiens
gcagugaccauccucauug

SEQ ID NO: 1338058 - RNA, 19 nt, Homo sapiens
ggccuagucuccaauaaau

SEQ ID NO: 1338059 - RNA, 19 nt, Homo sapiens
gaacuucuccuaacaucca

SEQ ID NO: 1338060 - RNA, 19 nt, Homo sapiens
uugaguaucuccuaucugu

SEQ ID NO: 1338061 - RNA, 19 nt, Homo sapiens
caaaguugaguaucuccua

SEQ ID NO: 1338062 - RNA, 19 nt, Homo sapiens
gaguaucuccuaucugugu

SEQ ID NO: 1338063 - RNA, 19 nt, Homo sapiens
gaaccugggcguacuagag

SEQ ID NO: 1338064 - RNA, 19 nt, Homo sapiens
gaggccuagucuccaauaa

SEQ ID NO: 1338065 - RNA, 19 nt, Homo sapiens
agacucuucugccuacuga

SEQ ID NO: 1338066 - RNA, 19 nt, Homo sapiens
gggcugagcacacaugaag

SEQ ID NO: 1338067 - RNA, 19 nt, Homo sapiens
aaaguugaguaucuccuau

SEQ ID NO: 1338068 - RNA, 19 nt, Homo sapiens
uggguuugcugcacauuga

SEQ ID NO: 1338069 - RNA, 19 nt, Homo sapiens
gagcacagccgaggcaagu

SEQ ID NO: 1338070 - RNA, 19 nt, Homo sapiens
cuccuaacauccaguaaug

SEQ ID NO: 1338071 - RNA, 19 nt, Homo sapiens
gacugaacuucuccuaaca

SEQ ID NO: 1338072 - RNA, 19 nt, Homo sapiens
guaggcagcugggcuuacu

SEQ ID NO: 1338073 - RNA, 19 nt, Homo sapiens
ccagugggagugacaguug

SEQ ID NO: 1338074 - RNA, 19 nt, Homo sapiens
ccucagggauccggaaagu

SEQ ID NO: 1338075 - RNA, 19 nt, Homo sapiens
uccuaucuguguccucaua

SEQ ID NO: 1338076 - RNA, 19 nt, Homo sapiens
ucuccaaaguugaguaucu

SEQ ID NO: 1338077 - RNA, 19 nt, Homo sapiens
gauuuccacugggugaaug

SEQ ID NO: 1338078 - RNA, 19 nt, Homo sapiens
gagucugggugcuguccuu

SEQ ID NO: 1338079 - RNA, 19 nt, Homo sapiens
ucagggauccggaaagucu

SEQ ID NO: 1338080 - RNA, 19 nt, Homo sapiens
ggacacgguuguggaucca

SEQ ID NO: 1338081 - RNA, 19 nt, Homo sapiens
ugucuagaccagaaugaaa

SEQ ID NO: 1338082 - RNA, 19 nt, Homo sapiens
ggacaggcugcugcugcua

SEQ ID NO: 1338083 - RNA, 19 nt, Homo sapiens
cagugaccauccucauugu

SEQ ID NO: 1338084 - RNA, 19 nt, Homo sapiens
ggagugacaguuggauaca

SEQ ID NO: 1338085 - RNA, 19 nt, Homo sapiens
gggagugacaguuggauac

SEQ ID NO: 1338086 - RNA, 19 nt, Homo sapiens
gcgcuuucuuccucuccaa

SEQ ID NO: 1338087 - RNA, 19 nt, Homo sapiens
cagggucccagacacguuu

SEQ ID NO: 1338088 - RNA, 19 nt, Homo sapiens
gugaccauccucauuguag

SEQ ID NO: 1338089 - RNA, 19 nt, Homo sapiens
ccuagucuccaauaaaucu

SEQ ID NO: 1338090 - RNA, 19 nt, Homo sapiens
cugaacuucuccuaacauc

SEQ ID NO: 1338091 - RNA, 19 nt, Homo sapiens
gcacagagcugccaucuuu

SEQ ID NO: 1338092 - RNA, 19 nt, Homo sapiens
ggaaaccucuguugauaua

SEQ ID NO: 1338093 - RNA, 19 nt, Homo sapiens
gagaaacccuuuaaaugua

SEQ ID NO: 1338094 - RNA, 19 nt, Homo sapiens
ggaaaggucuuaauaguag

SEQ ID NO: 1338095 - RNA, 19 nt, Homo sapiens
gggaagggcuuuacaugua

SEQ ID NO: 1338096 - RNA, 19 nt, Homo sapiens
ccacaagccucauauauca

SEQ ID NO: 1338097 - RNA, 19 nt, Homo sapiens
gcaaagauuuacagaaugu

SEQ ID NO: 1338098 - RNA, 19 nt, Homo sapiens
ugagaaaccuuaugaaugu

SEQ ID NO: 1338099 - RNA, 19 nt, Homo sapiens
gagaagcccuuugaaugua

SEQ ID NO: 1338100 - RNA, 19 nt, Homo sapiens
ugagaaaccuuauaagugu

SEQ ID NO: 1338101 - RNA, 19 nt, Homo sapiens
gauaaacccuaugaaugua

SEQ ID NO: 1338102 - RNA, 19 nt, Homo sapiens
gggaaggccuuuaguguau

SEQ ID NO: 1338103 - RNA, 19 nt, Homo sapiens
gagaaacacuaugaaugua

SEQ ID NO: 1338104 - RNA, 19 nt, Homo sapiens
gcagagagcgccagauuug

SEQ ID NO: 1338105 - RNA, 19 nt, Homo sapiens
caaagcaggccuuaaagua

SEQ ID NO: 1338106 - RNA, 19 nt, Homo sapiens
guauagugcuguuagaauu

SEQ ID NO: 1338107 - RNA, 19 nt, Homo sapiens
caggaaaccucuguugaua

SEQ ID NO: 1338108 - RNA, 19 nt, Homo sapiens
uaagaaacccuaugaaugu

SEQ ID NO: 1338109 - RNA, 19 nt, Homo sapiens
ggagaaacacuaugaaugu

SEQ ID NO: 1338110 - RNA, 19 nt, Homo sapiens
uagccacucugcauauuua

SEQ ID NO: 1338111 - RNA, 19 nt, Homo sapiens
gagaaacccuacgaaugua

SEQ ID NO: 1338112 - RNA, 19 nt, Homo sapiens
gcucaaagcaggccuuaaa

SEQ ID NO: 1338113 - RNA, 19 nt, Homo sapiens
gagaaacccuacgaaugua

SEQ ID NO: 1338114 - RNA, 19 nt, Homo sapiens
gaaacccuaugaauguaaa

SEQ ID NO: 1338115 - RNA, 19 nt, Homo sapiens
ggagagaaacccuauguau

SEQ ID NO: 1338116 - RNA, 19 nt, Homo sapiens
guaagaaacccuaugaaug

SEQ ID NO: 1338117 - RNA, 19 nt, Homo sapiens
ggugaacucugccuuaugu

SEQ ID NO: 1338118 - RNA, 19 nt, Homo sapiens
ccucauaucuuguuauaca

SEQ ID NO: 1338119 - RNA, 19 nt, Homo sapiens
acauguagguaucaacuua

SEQ ID NO: 1338120 - RNA, 19 nt, Homo sapiens
ggagugagcagccaccuuu

SEQ ID NO: 1338121 - RNA, 19 nt, Homo sapiens
guacaucagagaauucaua

SEQ ID NO: 1338122 - RNA, 19 nt, Homo sapiens
guacaucagaguauucaua

SEQ ID NO: 1338123 - RNA, 19 nt, Homo sapiens
gggaaaggucuuaauagua

SEQ ID NO: 1338124 - RNA, 19 nt, Homo sapiens
ccucauaucuuguuagaca

SEQ ID NO: 1338125 - RNA, 19 nt, Homo sapiens
caacuuacuguacaucaua

SEQ ID NO: 1338126 - RNA, 19 nt, Homo sapiens
ugacacaucugaccuucuu

SEQ ID NO: 1338127 - RNA, 19 nt, Homo sapiens
uauaagcgaugaugggaaa

SEQ ID NO: 1338128 - RNA, 19 nt, Homo sapiens
ugagaaacccuuuaaaugu

SEQ ID NO: 1338129 - RNA, 19 nt, Homo sapiens
ccacggagauccucaaguc

SEQ ID NO: 1338130 - RNA, 19 nt, Homo sapiens
auagagaaauuguggcaua

SEQ ID NO: 1338131 - RNA, 19 nt, Homo sapiens
gagagaagccacaugaaug

SEQ ID NO: 1338132 - RNA, 19 nt, Homo sapiens
gccauaaacucacuauaca

SEQ ID NO: 1338133 - RNA, 19 nt, Homo sapiens
caacuuaccaugcaucaga

SEQ ID NO: 1338134 - RNA, 19 nt, Homo sapiens
ugaaguacaucagagaauu

SEQ ID NO: 1338135 - RNA, 19 nt, Homo sapiens
gguaagagacccuuugaau

SEQ ID NO: 1338136 - RNA, 19 nt, Homo sapiens
ugagaaacccuacaaaugu

SEQ ID NO: 1338137 - RNA, 19 nt, Homo sapiens
caacaucugcuuccuauag

SEQ ID NO: 1338138 - RNA, 19 nt, Homo sapiens
gagaaauuguggcauauac

SEQ ID NO: 1338139 - RNA, 19 nt, Homo sapiens
gagagaaacccuauguaug

SEQ ID NO: 1338140 - RNA, 19 nt, Homo sapiens
ggaagggcuuuacauguag

SEQ ID NO: 1338141 - RNA, 19 nt, Homo sapiens
ugaaggaaguaaagguaaa

SEQ ID NO: 1338142 - RNA, 19 nt, Homo sapiens
ggaagggacucacuuucuc

SEQ ID NO: 1338143 - RNA, 19 nt, Homo sapiens
gaaugaagacaauguggaa

SEQ ID NO: 1338144 - RNA, 19 nt, Homo sapiens
caacuuacugcaccucaua

SEQ ID NO: 1338145 - RNA, 19 nt, Homo sapiens
ggagagaagccacaugaau

SEQ ID NO: 1338146 - RNA, 19 nt, Homo sapiens
ugagaaacccuacgaaugu

SEQ ID NO: 1338147 - RNA, 19 nt, Homo sapiens
ugagaaacccuacgaaugu

SEQ ID NO: 1338148 - RNA, 19 nt, Homo sapiens
cgacaucaggguauucaua

SEQ ID NO: 1338149 - RNA, 19 nt, Homo sapiens
ggaauggcuuugagauaca

SEQ ID NO: 1338150 - RNA, 19 nt, Homo sapiens
gugagaaacccuuuaaaug

SEQ ID NO: 1338151 - RNA, 19 nt, Homo sapiens
ggcaaggccuuucgucaug

SEQ ID NO: 1338152 - RNA, 19 nt, Homo sapiens
guaggaaaccauucuuuau

SEQ ID NO: 1338153 - RNA, 19 nt, Homo sapiens
guaagagacccuuugaaug

SEQ ID NO: 1338154 - RNA, 19 nt, Homo sapiens
gagaaaccuuaugaaugua

SEQ ID NO: 1338155 - RNA, 19 nt, Homo sapiens
agucaugcuucacaucuua

SEQ ID NO: 1338156 - RNA, 19 nt, Homo sapiens
agagaaacccuauguaugu

SEQ ID NO: 1338157 - RNA, 19 nt, Homo sapiens
gguaagaaacccuaugaau

SEQ ID NO: 1338158 - RNA, 19 nt, Homo sapiens
gaacucugccuuauguaau

SEQ ID NO: 1338159 - RNA, 19 nt, Homo sapiens
aauaguagccaugaacuua

SEQ ID NO: 1338160 - RNA, 19 nt, Homo sapiens
ugauaaacccuaugaaugu

SEQ ID NO: 1338161 - RNA, 19 nt, Homo sapiens
gggaaggguuuuaguuaua

SEQ ID NO: 1338162 - RNA, 19 nt, Homo sapiens
gugagaaacccuacaaaug

SEQ ID NO: 1338163 - RNA, 19 nt, Homo sapiens
gugagaagcccuuugaaug

SEQ ID NO: 1338164 - RNA, 19 nt, Homo sapiens
cagaagacauugcauacca

SEQ ID NO: 1338165 - RNA, 19 nt, Homo sapiens
gcuggaagcugcagaagac

SEQ ID NO: 1338166 - RNA, 19 nt, Homo sapiens
cguaggaaaccauucuuua

SEQ ID NO: 1338167 - RNA, 19 nt, Homo sapiens
ggugagaaacccuuuaaau

SEQ ID NO: 1338168 - RNA, 19 nt, Homo sapiens
uaagagacccuuugaaugc

SEQ ID NO: 1338169 - RNA, 19 nt, Homo sapiens
gaaacccuauguaugucaa

SEQ ID NO: 1338170 - RNA, 19 nt, Homo sapiens
gaauucauaccagugauaa

SEQ ID NO: 1338171 - RNA, 19 nt, Homo sapiens
gaaaaguccuaugaaugua

SEQ ID NO: 1338172 - RNA, 19 nt, Homo sapiens
caacaaccuuauggaguga

SEQ ID NO: 1338173 - RNA, 19 nt, Homo sapiens
gguaugaccuguguuaacu

SEQ ID NO: 1338174 - RNA, 19 nt, Homo sapiens
gugauaaacccuaugaaug

SEQ ID NO: 1338175 - RNA, 19 nt, Homo sapiens
gugagaaaccuuaugaaug

SEQ ID NO: 1338176 - RNA, 19 nt, Homo sapiens
gggaaguccuuucguugug

SEQ ID NO: 1338177 - RNA, 19 nt, Homo sapiens
aggacuagccgucaacuua

SEQ ID NO: 1338178 - RNA, 19 nt, Homo sapiens
ggaaaccauucuuuauacu

SEQ ID NO: 1338179 - RNA, 19 nt, Homo sapiens
gggagaaacacuaugaaug

SEQ ID NO: 1338180 - RNA, 19 nt, Homo sapiens
agucaucacugguagcaaa

SEQ ID NO: 1338181 - RNA, 19 nt, Homo sapiens
gaucaacaucugcuuccua

SEQ ID NO: 1338182 - RNA, 19 nt, Homo sapiens
ccucauacauuugaaagug

SEQ ID NO: 1338183 - RNA, 19 nt, Homo sapiens
ggaagcugcagaagacauu

SEQ ID NO: 1338184 - RNA, 19 nt, Homo sapiens
uccuauagcugggaugaua

SEQ ID NO: 1338185 - RNA, 19 nt, Homo sapiens
gccaugaacuuaguauaca

SEQ ID NO: 1338186 - RNA, 19 nt, Homo sapiens
ugagaagcccuuugaaugu

SEQ ID NO: 1338187 - RNA, 19 nt, Homo sapiens
uaaagcccaucagaauauu

SEQ ID NO: 1338188 - RNA, 19 nt, Homo sapiens
uuaaagcccaucagaauau

SEQ ID NO: 1338189 - RNA, 19 nt, Homo sapiens
guacuuaaagcccaucaga

SEQ ID NO: 1338190 - RNA, 19 nt, Homo sapiens
uaguguaucuggacaacuu

SEQ ID NO: 1338191 - RNA, 19 nt, Homo sapiens
aagaagaucucucaaauga

SEQ ID NO: 1338192 - RNA, 19 nt, Homo sapiens
ggacaucccuggaaaccuu

SEQ ID NO: 1338193 - RNA, 19 nt, Homo sapiens
ugaagaagaucucucaaau

SEQ ID NO: 1338194 - RNA, 19 nt, Homo sapiens
ccagaaauguggccuuuga

SEQ ID NO: 1338195 - RNA, 19 nt, Homo sapiens
agaaaucaguguugcagua

SEQ ID NO: 1338196 - RNA, 19 nt, Homo sapiens
caaccuccgucucuacuaa

SEQ ID NO: 1338197 - RNA, 19 nt, Homo sapiens
gguguaaucucgaccuuga

SEQ ID NO: 1338198 - RNA, 19 nt, Homo sapiens
cggcagcccucucacauuu

SEQ ID NO: 1338199 - RNA, 19 nt, Homo sapiens
gaagaagaucucucaaaug

SEQ ID NO: 1338200 - RNA, 19 nt, Homo sapiens
gaaauguggccuuugaaga

SEQ ID NO: 1338201 - RNA, 19 nt, Homo sapiens
gagccgagaucgcgccauu

SEQ ID NO: 1338202 - RNA, 19 nt, Homo sapiens
gcucaaaccagcacuaaug

SEQ ID NO: 1338203 - RNA, 19 nt, Homo sapiens
agcaggagcuguacaauga

SEQ ID NO: 1338204 - RNA, 19 nt, Homo sapiens
gaaaucaguguugcaguaa

SEQ ID NO: 1338205 - RNA, 19 nt, Homo sapiens
aaugaugacuggaaacuga

SEQ ID NO: 1338206 - RNA, 19 nt, Homo sapiens
aaaccuugcuguugguauu

SEQ ID NO: 1338207 - RNA, 19 nt, Homo sapiens
guaacagcccuaaugauga

SEQ ID NO: 1338208 - RNA, 19 nt, Homo sapiens
gcuaguaacagcccuaaug

SEQ ID NO: 1338209 - RNA, 19 nt, Homo sapiens
gaccacgugucaaggugua

SEQ ID NO: 1338210 - RNA, 19 nt, Homo sapiens
caaaacaacucucuuaggu

SEQ ID NO: 1338211 - RNA, 19 nt, Homo sapiens
gcagucccaugaagaagau

SEQ ID NO: 1338212 - RNA, 19 nt, Homo sapiens
gaaacuacagcaucaugga

SEQ ID NO: 1338213 - RNA, 19 nt, Homo sapiens
cuugaaagcucauuaucug

SEQ ID NO: 1338214 - RNA, 19 nt, Homo sapiens
caguacagcugacucaauc

SEQ ID NO: 1338215 - RNA, 19 nt, Homo sapiens
ggcuaaagcaggagaauug

SEQ ID NO: 1338216 - RNA, 19 nt, Homo sapiens
uguagguccuugcuaguaa

SEQ ID NO: 1338217 - RNA, 19 nt, Homo sapiens
gcaggagaauugcuugaac

SEQ ID NO: 1338218 - RNA, 19 nt, Homo sapiens
acugagagguuccagagaa

SEQ ID NO: 1338219 - RNA, 19 nt, Homo sapiens
uaacagcccuaaugaugac

SEQ ID NO: 1338220 - RNA, 19 nt, Homo sapiens
uggagaaacuacagcauca

SEQ ID NO: 1338221 - RNA, 19 nt, Homo sapiens
gcagcuaaccacaggaaga

SEQ ID NO: 1338222 - RNA, 19 nt, Homo sapiens
gcauguggaagaagauuug

SEQ ID NO: 1338223 - RNA, 19 nt, Homo sapiens
gcacuaaugaacagcaugu

SEQ ID NO: 1338224 - RNA, 19 nt, Homo sapiens
gagaaacuacagcaucaug

SEQ ID NO: 1338225 - RNA, 19 nt, Homo sapiens
acaacucucuuaggucauu

SEQ ID NO: 1338226 - RNA, 19 nt, Homo sapiens
gagcucaaaccagcacuaa

SEQ ID NO: 1338227 - RNA, 19 nt, Homo sapiens
gcaccaugaugaccucaac

SEQ ID NO: 1338228 - RNA, 19 nt, Homo sapiens
gauggucccugggcacugu

SEQ ID NO: 1338229 - RNA, 19 nt, Homo sapiens
cagcuaugaucagggaauu

SEQ ID NO: 1338230 - RNA, 19 nt, Homo sapiens
caggagcuguacaaugaga

SEQ ID NO: 1338231 - RNA, 19 nt, Homo sapiens
aguaacagcccuaaugaug

SEQ ID NO: 1338232 - RNA, 19 nt, Homo sapiens
cuaguaacagcccuaauga

SEQ ID NO: 1338233 - RNA, 19 nt, Homo sapiens
gaagauuuggccugagugu

SEQ ID NO: 1338234 - RNA, 19 nt, Homo sapiens
gcuguugguauuuccauuu

SEQ ID NO: 1338235 - RNA, 19 nt, Homo sapiens
uaaagcggaagcaccauga

SEQ ID NO: 1338236 - RNA, 19 nt, Homo sapiens
aagaagauuuggccugagu

SEQ ID NO: 1338237 - RNA, 19 nt, Homo sapiens
ugaacagcauguggaagaa

SEQ ID NO: 1338238 - RNA, 19 nt, Homo sapiens
ggagcuguacaaugagaaa

SEQ ID NO: 1338239 - RNA, 19 nt, Homo sapiens
cugagagguuccagagaaa

SEQ ID NO: 1338240 - RNA, 19 nt, Homo sapiens
gauuuggccugaguguguu

SEQ ID NO: 1338241 - RNA, 19 nt, Homo sapiens
gaggacacagcuaugauca

SEQ ID NO: 1338242 - RNA, 19 nt, Homo sapiens
ggugaggacacagcuauga

SEQ ID NO: 1338243 - RNA, 19 nt, Homo sapiens
aaaucaguguugcaguaaa

SEQ ID NO: 1338244 - RNA, 19 nt, Homo sapiens
cagcuacucgggaggcuaa

SEQ ID NO: 1338245 - RNA, 19 nt, Homo sapiens
ccaggcagauaacauugca

SEQ ID NO: 1338246 - RNA, 19 nt, Homo sapiens
caaaccagcacuaaugaac

SEQ ID NO: 1338247 - RNA, 19 nt, Homo sapiens
cgaccuugaaagcucauua

SEQ ID NO: 1338248 - RNA, 19 nt, Homo sapiens
gcuagcaggagcuguacaa

SEQ ID NO: 1338249 - RNA, 19 nt, Homo sapiens
ccaugaagaagaucucuca

SEQ ID NO: 1338250 - RNA, 19 nt, Homo sapiens
gcugcagucccaugaagaa

SEQ ID NO: 1338251 - RNA, 19 nt, Homo sapiens
gaccuugaaagcucauuau

SEQ ID NO: 1338252 - RNA, 19 nt, Homo sapiens
ggaaaccuugcuguuggua

SEQ ID NO: 1338253 - RNA, 19 nt, Homo sapiens
gcucugugguguuggacau

SEQ ID NO: 1338254 - RNA, 19 nt, Homo sapiens
gcaaccuccgucucuacua

SEQ ID NO: 1338255 - RNA, 19 nt, Homo sapiens
gagagguuccagagaaauc

SEQ ID NO: 1338256 - RNA, 19 nt, Homo sapiens
uaacauugcacagcuucaa

SEQ ID NO: 1338257 - RNA, 19 nt, Homo sapiens
ggacaacaggagugaaacu

SEQ ID NO: 1338258 - RNA, 19 nt, Homo sapiens
uaaugaacagcauguggaa

SEQ ID NO: 1338259 - RNA, 19 nt, Homo sapiens
gaaaccuugcuguugguau

SEQ ID NO: 1338260 - RNA, 19 nt, Homo sapiens
uucaauguguguaaccaaa

SEQ ID NO: 1338261 - RNA, 19 nt, Homo sapiens
caacucucuuaggucauuu

SEQ ID NO: 1338262 - RNA, 19 nt, Homo sapiens
uagcaggagcuguacaaug

SEQ ID NO: 1338263 - RNA, 19 nt, Homo sapiens
gcagcccucucacauuuug

SEQ ID NO: 1338264 - RNA, 19 nt, Homo sapiens
aaauguggccuuugaagag

SEQ ID NO: 1338265 - RNA, 19 nt, Homo sapiens
aacagcauguggaagaaga

SEQ ID NO: 1338266 - RNA, 19 nt, Homo sapiens
gaacagcauguggaagaag

SEQ ID NO: 1338267 - RNA, 19 nt, Homo sapiens
ugacaguacagcugacuca

SEQ ID NO: 1338268 - RNA, 19 nt, Homo sapiens
uguaaucucgaccuugaaa

SEQ ID NO: 1338269 - RNA, 19 nt, Homo sapiens
gcccuaaugaugacuggaa

SEQ ID NO: 1338270 - RNA, 19 nt, Homo sapiens
ggagcucaaaccagcacua

SEQ ID NO: 1338271 - RNA, 19 nt, Homo sapiens
uguuggacaucccuggaaa

SEQ ID NO: 1338272 - RNA, 19 nt, Homo sapiens
aaucaguguugcaguaaac

SEQ ID NO: 1338273 - RNA, 19 nt, Homo sapiens
gacuggaaacugagagguu

SEQ ID NO: 1338274 - RNA, 19 nt, Homo sapiens
ucaaaccagcacuaaugaa

SEQ ID NO: 1338275 - RNA, 19 nt, Homo sapiens
agauaacauugcacagcuu

SEQ ID NO: 1338276 - RNA, 19 nt, Homo sapiens
agauuuggccugagugugu

SEQ ID NO: 1338277 - RNA, 19 nt, Homo sapiens
ccuggaaaccuugcuguug

SEQ ID NO: 1338278 - RNA, 19 nt, Homo sapiens
gugaaacuccgucucaaaa

SEQ ID NO: 1338279 - RNA, 19 nt, Homo sapiens
auaauaccuucaugacagu

SEQ ID NO: 1338280 - RNA, 19 nt, Homo sapiens
gggaggaggagagggaaga

SEQ ID NO: 1338281 - RNA, 19 nt, Homo sapiens
guugguauuuccauuuuga

SEQ ID NO: 1338282 - RNA, 19 nt, Homo sapiens
augaagaagaucucucaaa

SEQ ID NO: 1338283 - RNA, 19 nt, Homo sapiens
uugugacccuugccagaaa

SEQ ID NO: 1338284 - RNA, 19 nt, Homo sapiens
aaaccagcacuaaugaaca

SEQ ID NO: 1338285 - RNA, 19 nt, Homo sapiens
gcuaugaucagggaauuuu

SEQ ID NO: 1338286 - RNA, 19 nt, Homo sapiens
gacaagacccuuucaauaa

SEQ ID NO: 1338287 - RNA, 19 nt, Homo sapiens
caaauuugaugccaacuuu

SEQ ID NO: 1338288 - RNA, 19 nt, Homo sapiens
ggacuaugcuuaacccauu

SEQ ID NO: 1338289 - RNA, 19 nt, Homo sapiens
gaaauugccuguccuuuac

SEQ ID NO: 1338290 - RNA, 19 nt, Homo sapiens
gagcuaagguguaggaaug

SEQ ID NO: 1338291 - RNA, 19 nt, Homo sapiens
ggacagagcuaagguguag

SEQ ID NO: 1338292 - RNA, 19 nt, Homo sapiens
ccaagugacucauucauug

SEQ ID NO: 1338293 - RNA, 19 nt, Homo sapiens
gcaccuggcugcgaaguaa

SEQ ID NO: 1338294 - RNA, 19 nt, Homo sapiens
acaagacccuuucaauaaa

SEQ ID NO: 1338295 - RNA, 19 nt, Homo sapiens
uaagggaauuccugucuuu

SEQ ID NO: 1338296 - RNA, 19 nt, Homo sapiens
gaaggaaguuacaaucaca

SEQ ID NO: 1338297 - RNA, 19 nt, Homo sapiens
ugaaauugccuguccuuua

SEQ ID NO: 1338298 - RNA, 19 nt, Homo sapiens
gagcgugcaugaagaagaa

SEQ ID NO: 1338299 - RNA, 19 nt, Homo sapiens
agacaagacccuuucaaua

SEQ ID NO: 1338300 - RNA, 19 nt, Homo sapiens
gagcuagucuucggauuga

SEQ ID NO: 1338301 - RNA, 19 nt, Homo sapiens
gaugccaacuuuaugugua

SEQ ID NO: 1338302 - RNA, 19 nt, Homo sapiens
guugacaucucauuuacaa

SEQ ID NO: 1338303 - RNA, 19 nt, Homo sapiens
ggaaauuguguuugucuuu

SEQ ID NO: 1338304 - RNA, 19 nt, Homo sapiens
ggaagaacuugcagaaacu

SEQ ID NO: 1338305 - RNA, 19 nt, Homo sapiens
gcaguuggaugaaaaguuu

SEQ ID NO: 1338306 - RNA, 19 nt, Homo sapiens
gcaugaagaagaaaguuaa

SEQ ID NO: 1338307 - RNA, 19 nt, Homo sapiens
caacaucguggcugaauga

SEQ ID NO: 1338308 - RNA, 19 nt, Homo sapiens
ugaaugccauccacacaaa

SEQ ID NO: 1338309 - RNA, 19 nt, Homo sapiens
gagccuuccuuucuaaaug

SEQ ID NO: 1338310 - RNA, 19 nt, Homo sapiens
caucguggcugaaugaaca

SEQ ID NO: 1338311 - RNA, 19 nt, Homo sapiens
uaacaggauugccgacaga

SEQ ID NO: 1338312 - RNA, 19 nt, Homo sapiens
ggauugaaaugaauuacca

SEQ ID NO: 1338313 - RNA, 19 nt, Homo sapiens
caagacccuuucaauaaau

SEQ ID NO: 1338314 - RNA, 19 nt, Homo sapiens
gcuguuagcuccggcaguu

SEQ ID NO: 1338315 - RNA, 19 nt, Homo sapiens
caauaaauccagcucagaa

SEQ ID NO: 1338316 - RNA, 19 nt, Homo sapiens
gaaguuacaaucacaccaa

SEQ ID NO: 1338317 - RNA, 19 nt, Homo sapiens
ggaaggaaguuacaaucac

SEQ ID NO: 1338318 - RNA, 19 nt, Homo sapiens
gaacuagugauugugaauu

SEQ ID NO: 1338319 - RNA, 19 nt, Homo sapiens
cagcaacaaauguacuuua

SEQ ID NO: 1338320 - RNA, 19 nt, Homo sapiens
ggcaggaaauuguguuugu

SEQ ID NO: 1338321 - RNA, 19 nt, Homo sapiens
aagaagcgccuaagaaaug

SEQ ID NO: 1338322 - RNA, 19 nt, Homo sapiens
uauaagaagcgccuaagaa

SEQ ID NO: 1338323 - RNA, 19 nt, Homo sapiens
cggaagaacuugcagaaac

SEQ ID NO: 1338324 - RNA, 19 nt, Homo sapiens
guaagggaauuccugucuu

SEQ ID NO: 1338325 - RNA, 19 nt, Homo sapiens
auaagaagcgccuaagaaa

SEQ ID NO: 1338326 - RNA, 19 nt, Homo sapiens
caaaagagcuccuguugac

SEQ ID NO: 1338327 - RNA, 19 nt, Homo sapiens
cauuugcaguugcugauaa

SEQ ID NO: 1338328 - RNA, 19 nt, Homo sapiens
aauaaaggguugggaaaug

SEQ ID NO: 1338329 - RNA, 19 nt, Homo sapiens
ccaggguaauuauaguaaa

SEQ ID NO: 1338330 - RNA, 19 nt, Homo sapiens
cuugucaggucaccagaua

SEQ ID NO: 1338331 - RNA, 19 nt, Homo sapiens
gaagaacuugcagaaacua

SEQ ID NO: 1338332 - RNA, 19 nt, Homo sapiens
cagagagcgugcaugaaga

SEQ ID NO: 1338333 - RNA, 19 nt, Homo sapiens
cagcugggacuaugcuuaa

SEQ ID NO: 1338334 - RNA, 19 nt, Homo sapiens
gaagaagaaaguuaauggu

SEQ ID NO: 1338335 - RNA, 19 nt, Homo sapiens
ggagggagagagaaaggaa

SEQ ID NO: 1338336 - RNA, 19 nt, Homo sapiens
cagcugcagugaagcauca

SEQ ID NO: 1338337 - RNA, 19 nt, Homo sapiens
cauggcagcugcagugaag

SEQ ID NO: 1338338 - RNA, 19 nt, Homo sapiens
ugacaucucauuuacaauc

SEQ ID NO: 1338339 - RNA, 19 nt, Homo sapiens
ccuguugacaucucauuua

SEQ ID NO: 1338340 - RNA, 19 nt, Homo sapiens
gggaaggaaguuacaauca

SEQ ID NO: 1338341 - RNA, 19 nt, Homo sapiens
ccucagcccaggguaauua

SEQ ID NO: 1338342 - RNA, 19 nt, Homo sapiens
gcucagaaacaccuauugu

SEQ ID NO: 1338343 - RNA, 19 nt, Homo sapiens
gcuaacuccugccaacauc

SEQ ID NO: 1338344 - RNA, 19 nt, Homo sapiens
uaagaagcgccuaagaaau

SEQ ID NO: 1338345 - RNA, 19 nt, Homo sapiens
gccauuucccuucuucuuu

SEQ ID NO: 1338346 - RNA, 19 nt, Homo sapiens
ucagagagcgugcaugaag

SEQ ID NO: 1338347 - RNA, 19 nt, Homo sapiens
gcaggaaauuguguuuguc

SEQ ID NO: 1338348 - RNA, 19 nt, Homo sapiens
ggagucuugugccuaagug

SEQ ID NO: 1338349 - RNA, 19 nt, Homo sapiens
uaauaaaacgguugccuua

SEQ ID NO: 1338350 - RNA, 19 nt, Homo sapiens
aguggagucuugugccuaa

SEQ ID NO: 1338351 - RNA, 19 nt, Homo sapiens
ugaagaagaaaguuaaugg

SEQ ID NO: 1338352 - RNA, 19 nt, Homo sapiens
ugucagagagcgugcauga

SEQ ID NO: 1338353 - RNA, 19 nt, Homo sapiens
gggaauuccugucuuucag

SEQ ID NO: 1338354 - RNA, 19 nt, Homo sapiens
uaaaacgguugccuuauca

SEQ ID NO: 1338355 - RNA, 19 nt, Homo sapiens
gcuagucuucggauugaaa

SEQ ID NO: 1338356 - RNA, 19 nt, Homo sapiens
gaacuugcagaaacuagag

SEQ ID NO: 1338357 - RNA, 19 nt, Homo sapiens
cagacaagacccuuucaau

SEQ ID NO: 1338358 - RNA, 19 nt, Homo sapiens
aaagguggagugagucaaa

SEQ ID NO: 1338359 - RNA, 19 nt, Homo sapiens
gaaugaacagcugggacua

SEQ ID NO: 1338360 - RNA, 19 nt, Homo sapiens
caauaaaggguugggaaau

SEQ ID NO: 1338361 - RNA, 19 nt, Homo sapiens
gcuuaaggcaggaaauugu

SEQ ID NO: 1338362 - RNA, 19 nt, Homo sapiens
gggcuuaaggcaggaaauu

SEQ ID NO: 1338363 - RNA, 19 nt, Homo sapiens
acgguugccuuaucaucua

SEQ ID NO: 1338364 - RNA, 19 nt, Homo sapiens
gaaucuugccuguccuuuc

SEQ ID NO: 1338365 - RNA, 19 nt, Homo sapiens
aagaaaugccugugacguu

SEQ ID NO: 1338366 - RNA, 19 nt, Homo sapiens
caaggagagggaagcguuu

SEQ ID NO: 1338367 - RNA, 19 nt, Homo sapiens
gagggaaggaaguuacaau

SEQ ID NO: 1338368 - RNA, 19 nt, Homo sapiens
uaaggagggaaggaaguua

SEQ ID NO: 1338369 - RNA, 19 nt, Homo sapiens
gcccaggguaauuauagua

SEQ ID NO: 1338370 - RNA, 19 nt, Homo sapiens
uaaauccagcucagaaaca

SEQ ID NO: 1338371 - RNA, 19 nt, Homo sapiens
gacaucucauuuacaaucu

SEQ ID NO: 1338372 - RNA, 19 nt, Homo sapiens
ccauuucccuucuucuuuu

SEQ ID NO: 1338373 - RNA, 19 nt, Homo sapiens
ccacugauucccuucuuuc

SEQ ID NO: 1338374 - RNA, 19 nt, Homo sapiens
gaacagcugggacuaugcu

SEQ ID NO: 1338375 - RNA, 19 nt, Homo sapiens
ccaacaucguggcugaaug

SEQ ID NO: 1338376 - RNA, 19 nt, Homo sapiens
gguggaagcuaugaaaaga

SEQ ID NO: 1338377 - RNA, 19 nt, Homo sapiens
gcaaaagcagcaacaaaug

SEQ ID NO: 1338378 - RNA, 19 nt, Homo sapiens
caggauugccgacagauca

SEQ ID NO: 1338379 - RNA, 19 nt, Homo sapiens
ugucaggucaccagauaaa

SEQ ID NO: 1338380 - RNA, 19 nt, Homo sapiens
uuaacccauucccagcuua

SEQ ID NO: 1338381 - RNA, 19 nt, Homo sapiens
gcagcaacaaauguacuuu

SEQ ID NO: 1338382 - RNA, 19 nt, Homo sapiens
ugauaugggcugucuguuc

SEQ ID NO: 1338383 - RNA, 19 nt, Homo sapiens
ccaaauuugaugccaacuu

SEQ ID NO: 1338384 - RNA, 19 nt, Homo sapiens
cacaagaggacagagcuaa

SEQ ID NO: 1338385 - RNA, 19 nt, Homo sapiens
aaagagcuccuguugacau

SEQ ID NO: 1338386 - RNA, 19 nt, Homo sapiens
gaagaggccugucagcaaa

SEQ ID NO: 1338387 - RNA, 19 nt, Homo sapiens
gggaaaagguguuaaguua

SEQ ID NO: 1338388 - RNA, 19 nt, Homo sapiens
guuaggagcuucuacugua

SEQ ID NO: 1338389 - RNA, 19 nt, Homo sapiens
ggaagaugcuuaugcuaug

SEQ ID NO: 1338390 - RNA, 19 nt, Homo sapiens
ggacaaacgguaauuaaau

SEQ ID NO: 1338391 - RNA, 19 nt, Homo sapiens
gaacccggcuaccgaagaa

SEQ ID NO: 1338392 - RNA, 19 nt, Homo sapiens
cagacgaccugaugaauau

SEQ ID NO: 1338393 - RNA, 19 nt, Homo sapiens
gaagaugcuuaugcuauga

SEQ ID NO: 1338394 - RNA, 19 nt, Homo sapiens
gguggaaccuaaauacuau

SEQ ID NO: 1338395 - RNA, 19 nt, Homo sapiens
ucugguaacuccuccuuua

SEQ ID NO: 1338396 - RNA, 19 nt, Homo sapiens
gcagcacacuuucugauuc

SEQ ID NO: 1338397 - RNA, 19 nt, Homo sapiens
gaaguagucaggaccauga

SEQ ID NO: 1338398 - RNA, 19 nt, Homo sapiens
uggaagaaguauucaguuu

SEQ ID NO: 1338399 - RNA, 19 nt, Homo sapiens
gaauggcuucucacucuua

SEQ ID NO: 1338400 - RNA, 19 nt, Homo sapiens
gaagaaguauucaguuucc

SEQ ID NO: 1338401 - RNA, 19 nt, Homo sapiens
acacuacgcugccauuuua

SEQ ID NO: 1338402 - RNA, 19 nt, Homo sapiens
uaacuccuccuuuauacua

SEQ ID NO: 1338403 - RNA, 19 nt, Homo sapiens
gaaguauucaguuuccuuu

SEQ ID NO: 1338404 - RNA, 19 nt, Homo sapiens
agaacuaccagaugaaaua

SEQ ID NO: 1338405 - RNA, 19 nt, Homo sapiens
ccugagaacuaccagauga

SEQ ID NO: 1338406 - RNA, 19 nt, Homo sapiens
acccucaacuuucagauua

SEQ ID NO: 1338407 - RNA, 19 nt, Homo sapiens
gagcugagacgacaaaugg

SEQ ID NO: 1338408 - RNA, 19 nt, Homo sapiens
ccagacgaccugaugaaua

SEQ ID NO: 1338409 - RNA, 19 nt, Homo sapiens
gaagaaaguggcagugaca

SEQ ID NO: 1338410 - RNA, 19 nt, Homo sapiens
acaaccaccuuucacauau

SEQ ID NO: 1338411 - RNA, 19 nt, Homo sapiens
ggccagccuugcaccuuua

SEQ ID NO: 1338412 - RNA, 19 nt, Homo sapiens
ggaagaaguauucaguuuc

SEQ ID NO: 1338413 - RNA, 19 nt, Homo sapiens
gugguuauccugcaaguuu

SEQ ID NO: 1338414 - RNA, 19 nt, Homo sapiens
caaagaaccuaaggagucu

SEQ ID NO: 1338415 - RNA, 19 nt, Homo sapiens
gggaagaugcuuaugcuau

SEQ ID NO: 1338416 - RNA, 19 nt, Homo sapiens
ccuugcaccuuuauucuaa

SEQ ID NO: 1338417 - RNA, 19 nt, Homo sapiens
gaacuuuaacgccaaauac

SEQ ID NO: 1338418 - RNA, 19 nt, Homo sapiens
gguaacuccuccuuuauac

SEQ ID NO: 1338419 - RNA, 19 nt, Homo sapiens
gaugaggacgggaagauug

SEQ ID NO: 1338420 - RNA, 19 nt, Homo sapiens
ggaagauugugggcuaugu

SEQ ID NO: 1338421 - RNA, 19 nt, Homo sapiens
cuaacacccucaacuuuca

SEQ ID NO: 1338422 - RNA, 19 nt, Homo sapiens
gaaaagguguuaaguuagg

SEQ ID NO: 1338423 - RNA, 19 nt, Homo sapiens
gauggcagaugagcugaga

SEQ ID NO: 1338424 - RNA, 19 nt, Homo sapiens
ccagggccaugauagagaa

SEQ ID NO: 1338425 - RNA, 19 nt, Homo sapiens
gaagcagggcaaacucuug

SEQ ID NO: 1338426 - RNA, 19 nt, Homo sapiens
uuagaaugaugaacaggaa

SEQ ID NO: 1338427 - RNA, 19 nt, Homo sapiens
gacgacaaauggaccugaa

SEQ ID NO: 1338428 - RNA, 19 nt, Homo sapiens
ucucgcagauggcagauga

SEQ ID NO: 1338429 - RNA, 19 nt, Homo sapiens
gaacaggaagcagggcaaa

SEQ ID NO: 1338430 - RNA, 19 nt, Homo sapiens
caacagccaaggaacuuug

SEQ ID NO: 1338431 - RNA, 19 nt, Homo sapiens
aggaauaccuggacacaag

SEQ ID NO: 1338432 - RNA, 19 nt, Homo sapiens
ucagaaagcucggauucca

SEQ ID NO: 1338433 - RNA, 19 nt, Homo sapiens
acuaccagaugaaauacua

SEQ ID NO: 1338434 - RNA, 19 nt, Homo sapiens
ucaggaccaugaagucaga

SEQ ID NO: 1338435 - RNA, 19 nt, Homo sapiens
gaagauugugggcuauguu

SEQ ID NO: 1338436 - RNA, 19 nt, Homo sapiens
gcucagaaagcucggauuc

SEQ ID NO: 1338437 - RNA, 19 nt, Homo sapiens
ugaagaggccugucagcaa

SEQ ID NO: 1338438 - RNA, 19 nt, Homo sapiens
aaaggacaaacgguaauua

SEQ ID NO: 1338439 - RNA, 19 nt, Homo sapiens
gaaggaauaccuggacaca

SEQ ID NO: 1338440 - RNA, 19 nt, Homo sapiens
caaccaccuuucacauauc

SEQ ID NO: 1338441 - RNA, 19 nt, Homo sapiens
gcacacuuucugauucuga

SEQ ID NO: 1338442 - RNA, 19 nt, Homo sapiens
gaugagcugagacgacaaa

SEQ ID NO: 1338443 - RNA, 19 nt, Homo sapiens
caacacugcaaccuccuuu

SEQ ID NO: 1338444 - RNA, 19 nt, Homo sapiens
ucaaccacaucuacucugu

SEQ ID NO: 1338445 - RNA, 19 nt, Homo sapiens
ucccuacccucugccauua

SEQ ID NO: 1338446 - RNA, 19 nt, Homo sapiens
gccaugauagagaacuuua

SEQ ID NO: 1338447 - RNA, 19 nt, Homo sapiens
ggaggaaccagaugauguc

SEQ ID NO: 1338448 - RNA, 19 nt, Homo sapiens
gagcuucuacuguacaauc

SEQ ID NO: 1338449 - RNA, 19 nt, Homo sapiens
gcacaacagccaaggaacu

SEQ ID NO: 1338450 - RNA, 19 nt, Homo sapiens
uaaacaaccaccuuucaca

SEQ ID NO: 1338451 - RNA, 19 nt, Homo sapiens
gacaaauggaccugaagaa

SEQ ID NO: 1338452 - RNA, 19 nt, Homo sapiens
cgacaaauggaccugaaga

SEQ ID NO: 1338453 - RNA, 19 nt, Homo sapiens
gaacuuggagauuuuaaga

SEQ ID NO: 1338454 - RNA, 19 nt, Homo sapiens
gguguuaaguuaggagcuu

SEQ ID NO: 1338455 - RNA, 19 nt, Homo sapiens
cggccagccuugcaccuuu

SEQ ID NO: 1338456 - RNA, 19 nt, Homo sapiens
aaggacaaacgguaauuaa

SEQ ID NO: 1338457 - RNA, 19 nt, Homo sapiens
ggaagcagggcaaacucuu

SEQ ID NO: 1338458 - RNA, 19 nt, Homo sapiens
cacaagagccacugcacaa

SEQ ID NO: 1338459 - RNA, 19 nt, Homo sapiens
ggaauaccuggacacaaga

SEQ ID NO: 1338460 - RNA, 19 nt, Homo sapiens
aacaaccaccuuucacaua

SEQ ID NO: 1338461 - RNA, 19 nt, Homo sapiens
ugguaacuccuccuuuaua

SEQ ID NO: 1338462 - RNA, 19 nt, Homo sapiens
uuugagaccugccauuaca

SEQ ID NO: 1338463 - RNA, 19 nt, Homo sapiens
uauaaacaaccaccuuuca

SEQ ID NO: 1338464 - RNA, 19 nt, Homo sapiens
cagcacacuuucugauucu

SEQ ID NO: 1338465 - RNA, 19 nt, Homo sapiens
caagagccacugcacaaca

SEQ ID NO: 1338466 - RNA, 19 nt, Homo sapiens
cugcugggaucaugaagga

SEQ ID NO: 1338467 - RNA, 19 nt, Homo sapiens
gauuuccagcuuucaguuu

SEQ ID NO: 1338468 - RNA, 19 nt, Homo sapiens
gcucggauuccaccuccua

SEQ ID NO: 1338469 - RNA, 19 nt, Homo sapiens
ggaugaggacgggaagauu

SEQ ID NO: 1338470 - RNA, 19 nt, Homo sapiens
uugaggaggugaaguaguc

SEQ ID NO: 1338471 - RNA, 19 nt, Homo sapiens
ugugaacccuggcuuaguc

SEQ ID NO: 1338472 - RNA, 19 nt, Homo sapiens
cuugaagauuuccagcuuu

SEQ ID NO: 1338473 - RNA, 19 nt, Homo sapiens
gaacccuggcuuagucugu

SEQ ID NO: 1338474 - RNA, 19 nt, Homo sapiens
agagaacuuuaacgccaaa

SEQ ID NO: 1338475 - RNA, 19 nt, Homo sapiens
gagaacuaccagaugaaau

SEQ ID NO: 1338476 - RNA, 19 nt, Homo sapiens
gaacuaccagaugaaauac

SEQ ID NO: 1338477 - RNA, 19 nt, Homo sapiens
ucuauaaacaaccaccuuu

SEQ ID NO: 1338478 - RNA, 19 nt, Homo sapiens
ggcagcacacuuucugauu

SEQ ID NO: 1338479 - RNA, 19 nt, Homo sapiens
ccucugccauuaugaacau

SEQ ID NO: 1338480 - RNA, 19 nt, Homo sapiens
ggaggaggaaccagaugau

SEQ ID NO: 1338481 - RNA, 19 nt, Homo sapiens
aaacaaccaccuuucacau

SEQ ID NO: 1338482 - RNA, 19 nt, Homo sapiens
ugagaacuaccagaugaaa

SEQ ID NO: 1338483 - RNA, 19 nt, Homo sapiens
gggccaugauagagaacuu

SEQ ID NO: 1338484 - RNA, 19 nt, Homo sapiens
gaagauuuccagcuuucag

SEQ ID NO: 1338485 - RNA, 19 nt, Homo sapiens
uugaagauuuccagcuuuc

SEQ ID NO: 1338486 - RNA, 19 nt, Homo sapiens
gagcuaaacucuuauaauc

SEQ ID NO: 1338487 - RNA, 19 nt, Homo sapiens
gaaggaaagugauugauuc

SEQ ID NO: 1338488 - RNA, 19 nt, Homo sapiens
ggaaagugauugauucuag

SEQ ID NO: 1338489 - RNA, 19 nt, Homo sapiens
caacagcacggccugaaua

SEQ ID NO: 1338490 - RNA, 19 nt, Homo sapiens
gaagaaggaaagugauuga

SEQ ID NO: 1338491 - RNA, 19 nt, Homo sapiens
gaaagugauugauucuagu

SEQ ID NO: 1338492 - RNA, 19 nt, Homo sapiens
cagacgcagugaaguauuu

SEQ ID NO: 1338493 - RNA, 19 nt, Homo sapiens
cagcacggccugaauauug

SEQ ID NO: 1338494 - RNA, 19 nt, Homo sapiens
caaaguagacugugcuauc

SEQ ID NO: 1338495 - RNA, 19 nt, Homo sapiens
gaaaagcagguguuuaaaa

SEQ ID NO: 1338496 - RNA, 19 nt, Homo sapiens
gagcuuugcugcccugcau

SEQ ID NO: 1338497 - RNA, 19 nt, Homo sapiens
ccuagucagucacuuguau

SEQ ID NO: 1338498 - RNA, 19 nt, Homo sapiens
gcuaucuccugaacacaga

SEQ ID NO: 1338499 - RNA, 19 nt, Homo sapiens
uaacuuugcccaacagcuu

SEQ ID NO: 1338500 - RNA, 19 nt, Homo sapiens
agaaggaaagugauugauu

SEQ ID NO: 1338501 - RNA, 19 nt, Homo sapiens
aaaguagacugugcuaucu

SEQ ID NO: 1338502 - RNA, 19 nt, Homo sapiens
ggacccgcuuggcguaguu

SEQ ID NO: 1338503 - RNA, 19 nt, Homo sapiens
uagaagaaggaaagugauu

SEQ ID NO: 1338504 - RNA, 19 nt, Homo sapiens
gcacucggcccacagaaaa

SEQ ID NO: 1338505 - RNA, 19 nt, Homo sapiens
ccugcgcgauaguaacuuu

SEQ ID NO: 1338506 - RNA, 19 nt, Homo sapiens
gcaacagcacggccugaau

SEQ ID NO: 1338507 - RNA, 19 nt, Homo sapiens
ucgaaaagcagguguuuaa

SEQ ID NO: 1338508 - RNA, 19 nt, Homo sapiens
ucagucacuuguauagaca

SEQ ID NO: 1338509 - RNA, 19 nt, Homo sapiens
gucagucacuuguauagac

SEQ ID NO: 1338510 - RNA, 19 nt, Homo sapiens
uuuagaagaaggaaaguga

SEQ ID NO: 1338511 - RNA, 19 nt, Homo sapiens
ugacgcgggucuucuuguc

SEQ ID NO: 1338512 - RNA, 19 nt, Homo sapiens
guaaaacgcaagagcuaaa

SEQ ID NO: 1338513 - RNA, 19 nt, Homo sapiens
ggaucuuggcggucaggua

SEQ ID NO: 1338514 - RNA, 19 nt, Homo sapiens
gcaaaguagacugugcuau

SEQ ID NO: 1338515 - RNA, 19 nt, Homo sapiens
cuagucagucacuuguaua

SEQ ID NO: 1338516 - RNA, 19 nt, Homo sapiens
uaaucuauauucggcaaag

SEQ ID NO: 1338517 - RNA, 19 nt, Homo sapiens
agaagaaggaaagugauug

SEQ ID NO: 1338518 - RNA, 19 nt, Homo sapiens
auaguaacuuugcccaaca

SEQ ID NO: 1338519 - RNA, 19 nt, Homo sapiens
agacgcagugaaguauuua

SEQ ID NO: 1338520 - RNA, 19 nt, Homo sapiens
gcacauggaucuuucucaa

SEQ ID NO: 1338521 - RNA, 19 nt, Homo sapiens
gaugggaucuugugauguu

SEQ ID NO: 1338522 - RNA, 19 nt, Homo sapiens
gaaauagcaucaagcaucu

SEQ ID NO: 1338523 - RNA, 19 nt, Homo sapiens
caaagaaaugucagacuua

SEQ ID NO: 1338524 - RNA, 19 nt, Homo sapiens
gcacaaucaugucuucaau

SEQ ID NO: 1338525 - RNA, 19 nt, Homo sapiens
caaggacaaccauauguua

SEQ ID NO: 1338526 - RNA, 19 nt, Homo sapiens
gagggaaguuuauagcuau

SEQ ID NO: 1338527 - RNA, 19 nt, Homo sapiens
ccagaugacugaacuuugu

SEQ ID NO: 1338528 - RNA, 19 nt, Homo sapiens
caucaagcaucuucucuga

SEQ ID NO: 1338529 - RNA, 19 nt, Homo sapiens
guagugagagggaaguuua

SEQ ID NO: 1338530 - RNA, 19 nt, Homo sapiens
ucacaaagcaagucuuaaa

SEQ ID NO: 1338531 - RNA, 19 nt, Homo sapiens
gacuuaaucugcacuauag

SEQ ID NO: 1338532 - RNA, 19 nt, Homo sapiens
acaaagaaaugucagacuu

SEQ ID NO: 1338533 - RNA, 19 nt, Homo sapiens
ggucacaaagcaagucuua

SEQ ID NO: 1338534 - RNA, 19 nt, Homo sapiens
acaguaugcuccugaauga

SEQ ID NO: 1338535 - RNA, 19 nt, Homo sapiens
gaaacuauacaaacacaug

SEQ ID NO: 1338536 - RNA, 19 nt, Homo sapiens
ggaaacacaacauaccaaa

SEQ ID NO: 1338537 - RNA, 19 nt, Homo sapiens
gaacuaagagcaaacaaaa

SEQ ID NO: 1338538 - RNA, 19 nt, Homo sapiens
gcuauaagcaccuacauca

SEQ ID NO: 1338539 - RNA, 19 nt, Homo sapiens
gaaggucggugcggaguuc

SEQ ID NO: 1338540 - RNA, 19 nt, Homo sapiens
acaagugggucaaugaaga

SEQ ID NO: 1338541 - RNA, 19 nt, Homo sapiens
uauaagcaccuacaucaaa

SEQ ID NO: 1338542 - RNA, 19 nt, Homo sapiens
agagggaaguuuauagcua

SEQ ID NO: 1338543 - RNA, 19 nt, Homo sapiens
gugggucaaugaagaaauu

SEQ ID NO: 1338544 - RNA, 19 nt, Homo sapiens
cuagagaacuaagagcaaa

SEQ ID NO: 1338545 - RNA, 19 nt, Homo sapiens
ccaugaaucuuauagaacu

SEQ ID NO: 1338546 - RNA, 19 nt, Homo sapiens
uauguuaggucacaaagca

SEQ ID NO: 1338547 - RNA, 19 nt, Homo sapiens
ggacaaccauauguuaggu

SEQ ID NO: 1338548 - RNA, 19 nt, Homo sapiens
uaaacaguaugcuccugaa

SEQ ID NO: 1338549 - RNA, 19 nt, Homo sapiens
caucuucucugaccacagu

SEQ ID NO: 1338550 - RNA, 19 nt, Homo sapiens
agacuuaaucugcacuaua

SEQ ID NO: 1338551 - RNA, 19 nt, Homo sapiens
ugucuucaauaucccauuu

SEQ ID NO: 1338552 - RNA, 19 nt, Homo sapiens
agaaaugucagacuuaauc

SEQ ID NO: 1338553 - RNA, 19 nt, Homo sapiens
aaucaugucuucaauaucc

SEQ ID NO: 1338554 - RNA, 19 nt, Homo sapiens
caaagcaagucuuaaaaca

SEQ ID NO: 1338555 - RNA, 19 nt, Homo sapiens
ggaucuuucucaaggacaa

SEQ ID NO: 1338556 - RNA, 19 nt, Homo sapiens
uacagaacguuucauccaa

SEQ ID NO: 1338557 - RNA, 19 nt, Homo sapiens
gauaauggaaacacaacau

SEQ ID NO: 1338558 - RNA, 19 nt, Homo sapiens
caagugggucaaugaagaa

SEQ ID NO: 1338559 - RNA, 19 nt, Homo sapiens
gcaaacaaaauccaaaguu

SEQ ID NO: 1338560 - RNA, 19 nt, Homo sapiens
ucaauaacgagagggauuu

SEQ ID NO: 1338561 - RNA, 19 nt, Homo sapiens
ucaaggacaaccauauguu

SEQ ID NO: 1338562 - RNA, 19 nt, Homo sapiens
ccaaaguuacuagaagaaa

SEQ ID NO: 1338563 - RNA, 19 nt, Homo sapiens
cacaaucaugucuucaaua

SEQ ID NO: 1338564 - RNA, 19 nt, Homo sapiens
gauauuuacagaacguuuc

SEQ ID NO: 1338565 - RNA, 19 nt, Homo sapiens
gaaaugucagacuuaaucu

SEQ ID NO: 1338566 - RNA, 19 nt, Homo sapiens
aauccaaaguuacuagaag

SEQ ID NO: 1338567 - RNA, 19 nt, Homo sapiens
agaacuaagagcaaacaaa

SEQ ID NO: 1338568 - RNA, 19 nt, Homo sapiens
ccuagcacauggaucuuuc

SEQ ID NO: 1338569 - RNA, 19 nt, Homo sapiens
uuucagcauuggacagauu

SEQ ID NO: 1338570 - RNA, 19 nt, Homo sapiens
cagaacguuucauccaaca

SEQ ID NO: 1338571 - RNA, 19 nt, Homo sapiens
caccagaugacugaacuuu

SEQ ID NO: 1338572 - RNA, 19 nt, Homo sapiens
guaugcuccugaaugacaa

SEQ ID NO: 1338573 - RNA, 19 nt, Homo sapiens
ggauacagcaaaagcagua

SEQ ID NO: 1338574 - RNA, 19 nt, Homo sapiens
aauacacauucuucuccua

SEQ ID NO: 1338575 - RNA, 19 nt, Homo sapiens
uaccaaaaccuaugggaua

SEQ ID NO: 1338576 - RNA, 19 nt, Homo sapiens
gaaacacaacauaccaaaa

SEQ ID NO: 1338577 - RNA, 19 nt, Homo sapiens
aaccauauguuaggucaca

SEQ ID NO: 1338578 - RNA, 19 nt, Homo sapiens
acacauucuucuccuagca

SEQ ID NO: 1338579 - RNA, 19 nt, Homo sapiens
guggcacaaucaugucuuc

SEQ ID NO: 1338580 - RNA, 19 nt, Homo sapiens
uuacagaacguuucaucca

SEQ ID NO: 1338581 - RNA, 19 nt, Homo sapiens
auccaaaguuacuagaaga

SEQ ID NO: 1338582 - RNA, 19 nt, Homo sapiens
ggcacaaucaugucuucaa

SEQ ID NO: 1338583 - RNA, 19 nt, Homo sapiens
ccauauguuaggucacaaa

SEQ ID NO: 1338584 - RNA, 19 nt, Homo sapiens
cuuaaucugcacuauagaa

SEQ ID NO: 1338585 - RNA, 19 nt, Homo sapiens
cgagagggauuuuagaaac

SEQ ID NO: 1338586 - RNA, 19 nt, Homo sapiens
ucucaaggacaaccauaug

SEQ ID NO: 1338587 - RNA, 19 nt, Homo sapiens
cauggaucuuucucaagga

SEQ ID NO: 1338588 - RNA, 19 nt, Homo sapiens
ucaacaaagaaaugucaga

SEQ ID NO: 1338589 - RNA, 19 nt, Homo sapiens
gcucagcgcuggaaacuuu

SEQ ID NO: 1338590 - RNA, 19 nt, Homo sapiens
gagaaugacuucagcauca

SEQ ID NO: 1338591 - RNA, 19 nt, Homo sapiens
caucaaccaugacugcaaa

SEQ ID NO: 1338592 - RNA, 19 nt, Homo sapiens
ggugugaccucaucuuucu

SEQ ID NO: 1338593 - RNA, 19 nt, Homo sapiens
gcuaugggcugccuuacgu

SEQ ID NO: 1338594 - RNA, 19 nt, Homo sapiens
gggacgaggugacaugcuu

SEQ ID NO: 1338595 - RNA, 19 nt, Homo sapiens
gaagaaugagcacugugaa

SEQ ID NO: 1338596 - RNA, 19 nt, Homo sapiens
gaaggagcuuuccgaacca

SEQ ID NO: 1338597 - RNA, 19 nt, Homo sapiens
cccaggaccuccagaagga

SEQ ID NO: 1338598 - RNA, 19 nt, Homo sapiens
cacgagaacugugcgagaa

SEQ ID NO: 1338599 - RNA, 19 nt, Homo sapiens
gugcuauccuggugcuauu

SEQ ID NO: 1338600 - RNA, 19 nt, Homo sapiens
gagggucucucuccuagcu

SEQ ID NO: 1338601 - RNA, 19 nt, Homo sapiens
cgagaagaaugagcacugu

SEQ ID NO: 1338602 - RNA, 19 nt, Homo sapiens
gaggagaagcggaugagau

SEQ ID NO: 1338603 - RNA, 19 nt, Homo sapiens
ggaguggagucagcaccaa

SEQ ID NO: 1338604 - RNA, 19 nt, Homo sapiens
ccagggagcaaagccauaa

SEQ ID NO: 1338605 - RNA, 19 nt, Homo sapiens
ucugagcccugacccuuug

SEQ ID NO: 1338606 - RNA, 19 nt, Homo sapiens
agaagaaugagcacuguga

SEQ ID NO: 1338607 - RNA, 19 nt, Homo sapiens
gggauuggaagcacuugaa

SEQ ID NO: 1338608 - RNA, 19 nt, Homo sapiens
agaaugagcacugugaaug

SEQ ID NO: 1338609 - RNA, 19 nt, Homo sapiens
uggaagcacuugaacuuuu

SEQ ID NO: 1338610 - RNA, 19 nt, Homo sapiens
gaaugagcacugugaaugc

SEQ ID NO: 1338611 - RNA, 19 nt, Homo sapiens
ggaggagguggaacugaug

SEQ ID NO: 1338612 - RNA, 19 nt, Homo sapiens
gaaggugcuccgggacauu

SEQ ID NO: 1338613 - RNA, 19 nt, Homo sapiens
gggacuggguucgcucuca

SEQ ID NO: 1338614 - RNA, 19 nt, Homo sapiens
ggaaugggguugguuugga

SEQ ID NO: 1338615 - RNA, 19 nt, Homo sapiens
gacccuugacuccagcaua

SEQ ID NO: 1338616 - RNA, 19 nt, Homo sapiens
cagagugacagcacgagaa

SEQ ID NO: 1338617 - RNA, 19 nt, Homo sapiens
gaggaggagaagcggauga

SEQ ID NO: 1338618 - RNA, 19 nt, Homo sapiens
ggagguggaacugauguag

SEQ ID NO: 1338619 - RNA, 19 nt, Homo sapiens
aggaggagguggaacugau

SEQ ID NO: 1338620 - RNA, 19 nt, Homo sapiens
ggaugucggcggugaagag

SEQ ID NO: 1338621 - RNA, 19 nt, Homo sapiens
gagaagcggaugagaucgu

SEQ ID NO: 1338622 - RNA, 19 nt, Homo sapiens
ugagaggaaaggugaagga

SEQ ID NO: 1338623 - RNA, 19 nt, Homo sapiens
gagcccugacccuuuguga

SEQ ID NO: 1338624 - RNA, 19 nt, Homo sapiens
gguuuccgcacccauaaga

SEQ ID NO: 1338625 - RNA, 19 nt, Homo sapiens
gcccugacccuuugugacu

SEQ ID NO: 1338626 - RNA, 19 nt, Homo sapiens
acccuugacuccagcauag

SEQ ID NO: 1338627 - RNA, 19 nt, Homo sapiens
gcagcaaggccuggacagu

SEQ ID NO: 1338628 - RNA, 19 nt, Homo sapiens
ugaaggugcuccgggacau

SEQ ID NO: 1338629 - RNA, 19 nt, Homo sapiens
gaacgucucucaguugauu

SEQ ID NO: 1338630 - RNA, 19 nt, Homo sapiens
ggacauggcugcccuugag

SEQ ID NO: 1338631 - RNA, 19 nt, Homo sapiens
gaucaccaaugcuugcuuu

SEQ ID NO: 1338632 - RNA, 19 nt, Homo sapiens
ggaugagggugaagaguau

SEQ ID NO: 1338633 - RNA, 19 nt, Homo sapiens
caaggaagaugcugccaau

SEQ ID NO: 1338634 - RNA, 19 nt, Homo sapiens
ugagaaagccuaccaugaa

SEQ ID NO: 1338635 - RNA, 19 nt, Homo sapiens
ucuuggaacugucuuauuu

SEQ ID NO: 1338636 - RNA, 19 nt, Homo sapiens
cuucagggcuucuugguuu

SEQ ID NO: 1338637 - RNA, 19 nt, Homo sapiens
aaccuuaaccgccuuauua

SEQ ID NO: 1338638 - RNA, 19 nt, Homo sapiens
ggaagaugcugccaauaac

SEQ ID NO: 1338639 - RNA, 19 nt, Homo sapiens
acaaugaggccaucuauga

SEQ ID NO: 1338640 - RNA, 19 nt, Homo sapiens
caaccuacacuaaccuuaa

SEQ ID NO: 1338641 - RNA, 19 nt, Homo sapiens
gcagagaucaccaaugcuu

SEQ ID NO: 1338642 - RNA, 19 nt, Homo sapiens
ggagaugauuccuucaaca

SEQ ID NO: 1338643 - RNA, 19 nt, Homo sapiens
uagcagagaucaccaaugc

SEQ ID NO: 1338644 - RNA, 19 nt, Homo sapiens
ccacaaguuugaccugaug

SEQ ID NO: 1338645 - RNA, 19 nt, Homo sapiens
ugacagaauuccagaccaa

SEQ ID NO: 1338646 - RNA, 19 nt, Homo sapiens
gaucauugaccucguguug

SEQ ID NO: 1338647 - RNA, 19 nt, Homo sapiens
gagaaagccuaccaugaac

SEQ ID NO: 1338648 - RNA, 19 nt, Homo sapiens
gaagaguauuaaccugugu

SEQ ID NO: 1338649 - RNA, 19 nt, Homo sapiens
cuauugccguaaauuguua

SEQ ID NO: 1338650 - RNA, 19 nt, Homo sapiens
caucacugcuucccugaga

SEQ ID NO: 1338651 - RNA, 19 nt, Homo sapiens
cgagggcacuacaccauug

SEQ ID NO: 1338652 - RNA, 19 nt, Homo sapiens
uaaccugugugcuguacuu

SEQ ID NO: 1338653 - RNA, 19 nt, Homo sapiens
ucaagguuggcauuaauua

SEQ ID NO: 1338654 - RNA, 19 nt, Homo sapiens
gauggagcccugaauguug

SEQ ID NO: 1338655 - RNA, 19 nt, Homo sapiens
gaaggauuaugaggagguu

SEQ ID NO: 1338656 - RNA, 19 nt, Homo sapiens
ggccaucuaugacaucugu

SEQ ID NO: 1338657 - RNA, 19 nt, Homo sapiens
cauggaacgucucucaguu

SEQ ID NO: 1338658 - RNA, 19 nt, Homo sapiens
ucaccucgcugcucaugga

SEQ ID NO: 1338659 - RNA, 19 nt, Homo sapiens
aggaagaugcugccaauaa

SEQ ID NO: 1338660 - RNA, 19 nt, Homo sapiens
gcuucaagguuggcauuaa

SEQ ID NO: 1338661 - RNA, 19 nt, Homo sapiens
ucauugaccucguguugga

SEQ ID NO: 1338662 - RNA, 19 nt, Homo sapiens
ugacgugguucccaaagau

SEQ ID NO: 1338663 - RNA, 19 nt, Homo sapiens
cagauuguguccuccauca

SEQ ID NO: 1338664 - RNA, 19 nt, Homo sapiens
gcacuuaccgccagcucuu

SEQ ID NO: 1338665 - RNA, 19 nt, Homo sapiens
gauggaggaaggcgaguuu

SEQ ID NO: 1338666 - RNA, 19 nt, Homo sapiens
aaaugucuauugccguaaa

SEQ ID NO: 1338667 - RNA, 19 nt, Homo sapiens
gaacccacagucauugaug

SEQ ID NO: 1338668 - RNA, 19 nt, Homo sapiens
gggcaguguuuguagacuu

SEQ ID NO: 1338669 - RNA, 19 nt, Homo sapiens
uggaacgucucucaguuga

SEQ ID NO: 1338670 - RNA, 19 nt, Homo sapiens
ggcaguguuuguagacuug

SEQ ID NO: 1338671 - RNA, 19 nt, Homo sapiens
ucaacaccuucuucaguga

SEQ ID NO: 1338672 - RNA, 19 nt, Homo sapiens
gcucauggaacgucucuca

SEQ ID NO: 1338673 - RNA, 19 nt, Homo sapiens
cuucaagguuggcauuaau

SEQ ID NO: 1338674 - RNA, 19 nt, Homo sapiens
ccaagugacaagaccauug

SEQ ID NO: 1338675 - RNA, 19 nt, Homo sapiens
caccaaugcuugcuuugag

SEQ ID NO: 1338676 - RNA, 19 nt, Homo sapiens
ccugugugcuguacuuuua

SEQ ID NO: 1338677 - RNA, 19 nt, Homo sapiens
ugauugugccuucauggua

SEQ ID NO: 1338678 - RNA, 19 nt, Homo sapiens
gugacgugguucccaaaga

SEQ ID NO: 1338679 - RNA, 19 nt, Homo sapiens
gaaagccuaccaugaacag

SEQ ID NO: 1338680 - RNA, 19 nt, Homo sapiens
gaagaugcugccaauaacu

SEQ ID NO: 1338681 - RNA, 19 nt, Homo sapiens
gagcaauaccacagcuguu

SEQ ID NO: 1338682 - RNA, 19 nt, Homo sapiens
gugccuuuguucacuggua

SEQ ID NO: 1338683 - RNA, 19 nt, Homo sapiens
cugcuucccugagauuuga

SEQ ID NO: 1338684 - RNA, 19 nt, Homo sapiens
cuuauuagccagauugugu

SEQ ID NO: 1338685 - RNA, 19 nt, Homo sapiens
aagaugcugccaauaacua

SEQ ID NO: 1338686 - RNA, 19 nt, Homo sapiens
acuccuugguagucuguua

SEQ ID NO: 1338687 - RNA, 19 nt, Homo sapiens
caaguuugaccugauguau

SEQ ID NO: 1338688 - RNA, 19 nt, Homo sapiens
caagcguaccauccaguuu

SEQ ID NO: 1338689 - RNA, 19 nt, Homo sapiens
ggagcucuacugccuggaa

SEQ ID NO: 1338690 - RNA, 19 nt, Homo sapiens
auguugaccugacagaauu

SEQ ID NO: 1338691 - RNA, 19 nt, Homo sapiens
gaauguugaccugacagaa

SEQ ID NO: 1338692 - RNA, 19 nt, Homo sapiens
gugcaucuccauccacguu

SEQ ID NO: 1338693 - RNA, 19 nt, Homo sapiens
ggccagaugccaagugaca

SEQ ID NO: 1338694 - RNA, 19 nt, Homo sapiens
acacuccuuugucuuggaa

SEQ ID NO: 1338695 - RNA, 19 nt, Homo sapiens
aggaugagggugaagagua

SEQ ID NO: 1338696 - RNA, 19 nt, Homo sapiens
ugaggagguuggagcagau

SEQ ID NO: 1338697 - RNA, 19 nt, Homo sapiens
caagugacaagaccauugg

SEQ ID NO: 1338698 - RNA, 19 nt, Homo sapiens
ccaaccuacacuaaccuua

SEQ ID NO: 1338699 - RNA, 19 nt, Homo sapiens
gagaggaugagggugaaga

SEQ ID NO: 1338700 - RNA, 19 nt, Homo sapiens
ugauggagcccugaauguu

SEQ ID NO: 1338701 - RNA, 19 nt, Homo sapiens
ucacugcuucccugagauu

SEQ ID NO: 1338702 - RNA, 19 nt, Homo sapiens
uaaccuuaaccgccuuauu

SEQ ID NO: 1338703 - RNA, 19 nt, Homo sapiens
agacaaugaggccaucuau

SEQ ID NO: 1338704 - RNA, 19 nt, Homo sapiens
aagcguaccauccaguuug

SEQ ID NO: 1338705 - RNA, 19 nt, Homo sapiens
ucaccaaugcuugcuuuga

SEQ ID NO: 1338706 - RNA, 19 nt, Homo sapiens
cugagaaagccuaccauga

SEQ ID NO: 1338707 - RNA, 19 nt, Homo sapiens
auggagcccugaauguuga

SEQ ID NO: 1338708 - RNA, 19 nt, Homo sapiens
ugucguagaaaccucgaua

SEQ ID NO: 1338709 - RNA, 19 nt, Homo sapiens
gaggagguuggagcagaua

SEQ ID NO: 1338710 - RNA, 19 nt, Homo sapiens
ugccaagcgugccuuuguu

SEQ ID NO: 1338711 - RNA, 19 nt, Homo sapiens
ucccaaagaugucaaugcu

SEQ ID NO: 1338712 - RNA, 19 nt, Homo sapiens
gacaaugaggccaucuaug

SEQ ID NO: 1338713 - RNA, 19 nt, Homo sapiens
guucuguaaaugucuauug

SEQ ID NO: 1338714 - RNA, 19 nt, Homo sapiens
ccaagcguaccauccaguu

SEQ ID NO: 1338715 - RNA, 19 nt, Homo sapiens
ucuauugccguaaauuguu

SEQ ID NO: 1338716 - RNA, 19 nt, Homo sapiens
ggaacccacagucauugau

SEQ ID NO: 1338717 - RNA, 19 nt, Homo sapiens
ccuucaaguucuagucaug

SEQ ID NO: 1338718 - RNA, 19 nt, Homo sapiens
gagaugauuccuucaacac

SEQ ID NO: 1338719 - RNA, 19 nt, Homo sapiens
gccuggaccacaaguuuga

SEQ ID NO: 1338720 - RNA, 19 nt, Homo sapiens
aaaccaagcguaccaucca

SEQ ID NO: 1338721 - RNA, 19 nt, Homo sapiens
cggagaggaugagggugaa

SEQ ID NO: 1338722 - RNA, 19 nt, Homo sapiens
aguuugaccugauguaugc

SEQ ID NO: 1338723 - RNA, 19 nt, Homo sapiens
ucgccuggaccacaaguuu

SEQ ID NO: 1338724 - RNA, 19 nt, Homo sapiens
gagcgcccaaccuacacua

SEQ ID NO: 1338725 - RNA, 19 nt, Homo sapiens
uuccacagcuguaguugag

SEQ ID NO: 1338726 - RNA, 19 nt, Homo sapiens
cuucaacaccuucuucagu

SEQ ID NO: 1338727 - RNA, 19 nt, Homo sapiens
gcagaccccuucaaguucu

SEQ ID NO: 1338728 - RNA, 19 nt, Homo sapiens
gauaagaaguccacucaca

SEQ ID NO: 1338729 - RNA, 19 nt, Homo sapiens
gaaguccacucacagaaau

SEQ ID NO: 1338730 - RNA, 19 nt, Homo sapiens
ucacagaaauccugaagau

SEQ ID NO: 1338731 - RNA, 19 nt, Homo sapiens
gaacaucuuucacacuaag

SEQ ID NO: 1338732 - RNA, 19 nt, Homo sapiens
gaaacaaccacauauguca

SEQ ID NO: 1338733 - RNA, 19 nt, Homo sapiens
gcagggagguuuaauagac

SEQ ID NO: 1338734 - RNA, 19 nt, Homo sapiens
cagcaccgaucccgacaua

SEQ ID NO: 1338735 - RNA, 19 nt, Homo sapiens
gaaacugggcugacccuuu

SEQ ID NO: 1338736 - RNA, 19 nt, Homo sapiens
gauccuauguuuccuucuu

SEQ ID NO: 1338737 - RNA, 19 nt, Homo sapiens
gaagguaaacacaaacgaa

SEQ ID NO: 1338738 - RNA, 19 nt, Homo sapiens
uggcaaauaugaagguaaa

SEQ ID NO: 1338739 - RNA, 19 nt, Homo sapiens
gcaccgaucccgacauaga

SEQ ID NO: 1338740 - RNA, 19 nt, Homo sapiens
gaagaaagcaaaaccaaaa

SEQ ID NO: 1338741 - RNA, 19 nt, Homo sapiens
gaagaagagaagagagaaa

SEQ ID NO: 1338742 - RNA, 19 nt, Homo sapiens
caacauggcagggagguuu

SEQ ID NO: 1338743 - RNA, 19 nt, Homo sapiens
ggaggaaacaaccacauau

SEQ ID NO: 1338744 - RNA, 19 nt, Homo sapiens
auagaucagugacgucuuu

SEQ ID NO: 1338745 - RNA, 19 nt, Homo sapiens
ggaaacaaccacauauguc

SEQ ID NO: 1338746 - RNA, 19 nt, Homo sapiens
ccacauaugucaccuuucc

SEQ ID NO: 1338747 - RNA, 19 nt, Homo sapiens
gcacugugaagccuacaaa

SEQ ID NO: 1338748 - RNA, 19 nt, Homo sapiens
aaacugggcugacccuuuu

SEQ ID NO: 1338749 - RNA, 19 nt, Homo sapiens
gguaaacacaaacgaaaga

SEQ ID NO: 1338750 - RNA, 19 nt, Homo sapiens
gaggaaacaaccacauaug

SEQ ID NO: 1338751 - RNA, 19 nt, Homo sapiens
aaccacauaugucaccuuu

SEQ ID NO: 1338752 - RNA, 19 nt, Homo sapiens
gcaaauaugaagguaaaca

SEQ ID NO: 1338753 - RNA, 19 nt, Homo sapiens
uaagaaguccacucacaga

SEQ ID NO: 1338754 - RNA, 19 nt, Homo sapiens
ggauuugaauuugaacauc

SEQ ID NO: 1338755 - RNA, 19 nt, Homo sapiens
cacacuaaguucagacuca

SEQ ID NO: 1338756 - RNA, 19 nt, Homo sapiens
gggcugacccuuuugauuu

SEQ ID NO: 1338757 - RNA, 19 nt, Homo sapiens
gguuguuucucugcaguuu

SEQ ID NO: 1338758 - RNA, 19 nt, Homo sapiens
uaugucaccuuuccaagag

SEQ ID NO: 1338759 - RNA, 19 nt, Homo sapiens
gcuggcaaauaugaaggua

SEQ ID NO: 1338760 - RNA, 19 nt, Homo sapiens
agaaguccacucacagaaa

SEQ ID NO: 1338761 - RNA, 19 nt, Homo sapiens
cagggagguuuaauagaca

SEQ ID NO: 1338762 - RNA, 19 nt, Homo sapiens
guaaacacaaacgaaagaa

SEQ ID NO: 1338763 - RNA, 19 nt, Homo sapiens
gagguuuaauagacaugga

SEQ ID NO: 1338764 - RNA, 19 nt, Homo sapiens
aagaagaagagaagagaga

SEQ ID NO: 1338765 - RNA, 19 nt, Homo sapiens
uucagaugauccuauguuu

SEQ ID NO: 1338766 - RNA, 19 nt, Homo sapiens
aagguaaacacaaacgaaa

SEQ ID NO: 1338767 - RNA, 19 nt, Homo sapiens
gguuuaauagacauggaua

SEQ ID NO: 1338768 - RNA, 19 nt, Homo sapiens
aggaggaaacaaccacaua

SEQ ID NO: 1338769 - RNA, 19 nt, Homo sapiens
gagaagagagaaaacaaau

SEQ ID NO: 1338770 - RNA, 19 nt, Homo sapiens
uuaagaagaagagaagaga

SEQ ID NO: 1338771 - RNA, 19 nt, Homo sapiens
cagaugauccuauguuucc

SEQ ID NO: 1338772 - RNA, 19 nt, Homo sapiens
uggcagggagguuuaauag

SEQ ID NO: 1338773 - RNA, 19 nt, Homo sapiens
ucagacucaugaaaccaau

SEQ ID NO: 1338774 - RNA, 19 nt, Homo sapiens
aggaaacaaccacauaugu

SEQ ID NO: 1338775 - RNA, 19 nt, Homo sapiens
ucucugcaguuuccaacau

SEQ ID NO: 1338776 - RNA, 19 nt, Homo sapiens
gaugauccuauguuuccuu

SEQ ID NO: 1338777 - RNA, 19 nt, Homo sapiens
ccacauaauaaagaguuug

SEQ ID NO: 1338778 - RNA, 19 nt, Homo sapiens
cucuguaaaccacauaaua

SEQ ID NO: 1338779 - RNA, 19 nt, Homo sapiens
cuucagaugauccuauguu

SEQ ID NO: 1338780 - RNA, 19 nt, Homo sapiens
acacuaaguucagacucau

SEQ ID NO: 1338781 - RNA, 19 nt, Homo sapiens
ugucaagucggaccaaaca

SEQ ID NO: 1338782 - RNA, 19 nt, Homo sapiens
gaagagaagagagaaaaca

SEQ ID NO: 1338783 - RNA, 19 nt, Homo sapiens
guugucaagucggaccaaa

SEQ ID NO: 1338784 - RNA, 19 nt, Homo sapiens
gggauuugaauuugaacau

SEQ ID NO: 1338785 - RNA, 19 nt, Homo sapiens
ucagaugauccuauguuuc

SEQ ID NO: 1338786 - RNA, 19 nt, Homo sapiens
ggugaaaguugcaauauua

SEQ ID NO: 1338787 - RNA, 19 nt, Homo sapiens
gaucauagccuguauaaau

SEQ ID NO: 1338788 - RNA, 19 nt, Homo sapiens
gcaguauccuguacccuaa

SEQ ID NO: 1338789 - RNA, 19 nt, Homo sapiens
gcagaacaauaccaauaga

SEQ ID NO: 1338790 - RNA, 19 nt, Homo sapiens
gcugugugcugaauuacua

SEQ ID NO: 1338791 - RNA, 19 nt, Homo sapiens
gauuagaacauacggauuu

SEQ ID NO: 1338792 - RNA, 19 nt, Homo sapiens
gcacguguaucccgaagug

SEQ ID NO: 1338793 - RNA, 19 nt, Homo sapiens
cguuaaaucuugcugaauu

SEQ ID NO: 1338794 - RNA, 19 nt, Homo sapiens
ugaauaagccugugguuga

SEQ ID NO: 1338795 - RNA, 19 nt, Homo sapiens
gcacccuccuggaugaaua

SEQ ID NO: 1338796 - RNA, 19 nt, Homo sapiens
aaacuaucaugcagccuua

SEQ ID NO: 1338797 - RNA, 19 nt, Homo sapiens
gagaaucaguaagaagaaa

SEQ ID NO: 1338798 - RNA, 19 nt, Homo sapiens
gagagaaucaguaagaaga

SEQ ID NO: 1338799 - RNA, 19 nt, Homo sapiens
gauggaaauucacaaagug

SEQ ID NO: 1338800 - RNA, 19 nt, Homo sapiens
gcccagugcuuccauaugu

SEQ ID NO: 1338801 - RNA, 19 nt, Homo sapiens
gcacagccguggguuuguu

SEQ ID NO: 1338802 - RNA, 19 nt, Homo sapiens
gcacgcugcucaucuucuu

SEQ ID NO: 1338803 - RNA, 19 nt, Homo sapiens
gaauaagccugugguugau

SEQ ID NO: 1338804 - RNA, 19 nt, Homo sapiens
uaugcugugugcugaauua

SEQ ID NO: 1338805 - RNA, 19 nt, Homo sapiens
agaagcaaaucgaguuauu

SEQ ID NO: 1338806 - RNA, 19 nt, Homo sapiens
ccgaagugcuccugaguga

SEQ ID NO: 1338807 - RNA, 19 nt, Homo sapiens
gaugcacccuccuggauga

SEQ ID NO: 1338808 - RNA, 19 nt, Homo sapiens
ccaagaacacgaagcauga

SEQ ID NO: 1338809 - RNA, 19 nt, Homo sapiens
cauuaagucuggaugcaaa

SEQ ID NO: 1338810 - RNA, 19 nt, Homo sapiens
ccaagggucugggcucuga

SEQ ID NO: 1338811 - RNA, 19 nt, Homo sapiens
guacuuggcguuaaaucuu

SEQ ID NO: 1338812 - RNA, 19 nt, Homo sapiens
caaggugacuccuguuguc

SEQ ID NO: 1338813 - RNA, 19 nt, Homo sapiens
caaauccuguguguccuuu

SEQ ID NO: 1338814 - RNA, 19 nt, Homo sapiens
aagcagaacaauaccaaua

SEQ ID NO: 1338815 - RNA, 19 nt, Homo sapiens
uaaagacucccaaagugaa

SEQ ID NO: 1338816 - RNA, 19 nt, Homo sapiens
gaacauacggauuuaccau

SEQ ID NO: 1338817 - RNA, 19 nt, Homo sapiens
ccacuguacuuggcguuaa

SEQ ID NO: 1338818 - RNA, 19 nt, Homo sapiens
gagcacagccguggguuug

SEQ ID NO: 1338819 - RNA, 19 nt, Homo sapiens
gggauuaucgauugcauau

SEQ ID NO: 1338820 - RNA, 19 nt, Homo sapiens
guagcucaguuacagagaa

SEQ ID NO: 1338821 - RNA, 19 nt, Homo sapiens
acauacggauuuaccauga

SEQ ID NO: 1338822 - RNA, 19 nt, Homo sapiens
ugauggaaauucacaaagu

SEQ ID NO: 1338823 - RNA, 19 nt, Homo sapiens
uuuaaagacucccaaagug

SEQ ID NO: 1338824 - RNA, 19 nt, Homo sapiens
guacgaccuggcagacuua

SEQ ID NO: 1338825 - RNA, 19 nt, Homo sapiens
gaauugcaguauccuguac

SEQ ID NO: 1338826 - RNA, 19 nt, Homo sapiens
cagaggcccuguggugaaa

SEQ ID NO: 1338827 - RNA, 19 nt, Homo sapiens
guuaaaucuugcugaauuc

SEQ ID NO: 1338828 - RNA, 19 nt, Homo sapiens
gguacaagcagaacaauac

SEQ ID NO: 1338829 - RNA, 19 nt, Homo sapiens
ucagaacccuagcaguguu

SEQ ID NO: 1338830 - RNA, 19 nt, Homo sapiens
ucugcaaccuuuugaauua

SEQ ID NO: 1338831 - RNA, 19 nt, Homo sapiens
uuaaagacucccaaaguga

SEQ ID NO: 1338832 - RNA, 19 nt, Homo sapiens
ggcguuaaaucuugcugaa

SEQ ID NO: 1338833 - RNA, 19 nt, Homo sapiens
cagagaagcaaaucgaguu

SEQ ID NO: 1338834 - RNA, 19 nt, Homo sapiens
gccugcagguucauauuga

SEQ ID NO: 1338835 - RNA, 19 nt, Homo sapiens
gcaaacaauagaauucaag

SEQ ID NO: 1338836 - RNA, 19 nt, Homo sapiens
gugagagaaucaguaagaa

SEQ ID NO: 1338837 - RNA, 19 nt, Homo sapiens
cuagcaguguuaccuuaaa

SEQ ID NO: 1338838 - RNA, 19 nt, Homo sapiens
uggcauguguuaaauugug

SEQ ID NO: 1338839 - RNA, 19 nt, Homo sapiens
uuagguuccugcuguaguu

SEQ ID NO: 1338840 - RNA, 19 nt, Homo sapiens
cgacugccacgccaucaaa

SEQ ID NO: 1338841 - RNA, 19 nt, Homo sapiens
gcagguucauauugagauc

SEQ ID NO: 1338842 - RNA, 19 nt, Homo sapiens
uggugaaaguugcaauauu

SEQ ID NO: 1338843 - RNA, 19 nt, Homo sapiens
uaagguacaagcagaacaa

SEQ ID NO: 1338844 - RNA, 19 nt, Homo sapiens
ggaggugacucggacaaac

SEQ ID NO: 1338845 - RNA, 19 nt, Homo sapiens
acuaugccaugugcuauuu

SEQ ID NO: 1338846 - RNA, 19 nt, Homo sapiens
ugucgucuguugauaacuu

SEQ ID NO: 1338847 - RNA, 19 nt, Homo sapiens
aaaguuucccagauucuaa

SEQ ID NO: 1338848 - RNA, 19 nt, Homo sapiens
cccuagcaguguuaccuua

SEQ ID NO: 1338849 - RNA, 19 nt, Homo sapiens
ucuucaacauccauucuaa

SEQ ID NO: 1338850 - RNA, 19 nt, Homo sapiens
uaugugagagaaucaguaa

SEQ ID NO: 1338851 - RNA, 19 nt, Homo sapiens
agagaagcaaaucgaguua

SEQ ID NO: 1338852 - RNA, 19 nt, Homo sapiens
gauuuaccaugaaguucug

SEQ ID NO: 1338853 - RNA, 19 nt, Homo sapiens
ugugagagaaucaguaaga

SEQ ID NO: 1338854 - RNA, 19 nt, Homo sapiens
gaggcauuaucacuggaaa

SEQ ID NO: 1338855 - RNA, 19 nt, Homo sapiens
gagacgaucauagccugua

SEQ ID NO: 1338856 - RNA, 19 nt, Homo sapiens
uuuggcauguguuaaauug

SEQ ID NO: 1338857 - RNA, 19 nt, Homo sapiens
ucgaguuauuucccacaua

SEQ ID NO: 1338858 - RNA, 19 nt, Homo sapiens
ggauuuaccaugaaguucu

SEQ ID NO: 1338859 - RNA, 19 nt, Homo sapiens
cauacggauuuaccaugaa

SEQ ID NO: 1338860 - RNA, 19 nt, Homo sapiens
uaaagcccauguuuucaaa

SEQ ID NO: 1338861 - RNA, 19 nt, Homo sapiens
uaucaugcagccuuaagaa

SEQ ID NO: 1338862 - RNA, 19 nt, Homo sapiens
gaaggcccucccagacuga

SEQ ID NO: 1338863 - RNA, 19 nt, Homo sapiens
uguacgaccuggcagacuu

SEQ ID NO: 1338864 - RNA, 19 nt, Homo sapiens
gcauuuuccuugaccguuu

SEQ ID NO: 1338865 - RNA, 19 nt, Homo sapiens
caggaugacccaccaagug

SEQ ID NO: 1338866 - RNA, 19 nt, Homo sapiens
auauugagauccauugaag

SEQ ID NO: 1338867 - RNA, 19 nt, Homo sapiens
acaaagugaggcauuauca

SEQ ID NO: 1338868 - RNA, 19 nt, Homo sapiens
cagaacccuagcaguguua

SEQ ID NO: 1338869 - RNA, 19 nt, Homo sapiens
cgaccuggcagacuuaaag

SEQ ID NO: 1338870 - RNA, 19 nt, Homo sapiens
gcaaacugugcagcccuua

SEQ ID NO: 1338871 - RNA, 19 nt, Homo sapiens
gaaucaguaagaagaaauc

SEQ ID NO: 1338872 - RNA, 19 nt, Homo sapiens
ucgauugcauauaucaguu

SEQ ID NO: 1338873 - RNA, 19 nt, Homo sapiens
uuacagagaagcaaaucga

SEQ ID NO: 1338874 - RNA, 19 nt, Homo sapiens
agaguugucuuagaaugau

SEQ ID NO: 1338875 - RNA, 19 nt, Homo sapiens
ugccggaaaugggaaguuu

SEQ ID NO: 1338876 - RNA, 19 nt, Homo sapiens
gagaagcaaaucgaguuau

SEQ ID NO: 1338877 - RNA, 19 nt, Homo sapiens
uacuggcucugcaaccuuu

SEQ ID NO: 1338878 - RNA, 19 nt, Homo sapiens
guccugcagugguguugaa

SEQ ID NO: 1338879 - RNA, 19 nt, Homo sapiens
gcuggccucuggcuucaca

SEQ ID NO: 1338880 - RNA, 19 nt, Homo sapiens
guugauggaaauucacaaa

SEQ ID NO: 1338881 - RNA, 19 nt, Homo sapiens
cacuguacuuggcguuaaa

SEQ ID NO: 1338882 - RNA, 19 nt, Homo sapiens
gggcuacugucccaaaucc

SEQ ID NO: 1338883 - RNA, 19 nt, Homo sapiens
ccagugcuuccauauguga

SEQ ID NO: 1338884 - RNA, 19 nt, Homo sapiens
ucuaagaauugcaguaucc

SEQ ID NO: 1338885 - RNA, 19 nt, Homo sapiens
gacgaucauagccuguaua

SEQ ID NO: 1338886 - RNA, 19 nt, Homo sapiens
ccacaaugcucaagaaauu

SEQ ID NO: 1338887 - RNA, 19 nt, Homo sapiens
gagcaagcaucuucacuga

SEQ ID NO: 1338888 - RNA, 19 nt, Homo sapiens
gcacagaggugagaagcaa

SEQ ID NO: 1338889 - RNA, 19 nt, Homo sapiens
gcacagacauggcagaaaa

SEQ ID NO: 1338890 - RNA, 19 nt, Homo sapiens
gcagacagaguguuugauu

SEQ ID NO: 1338891 - RNA, 19 nt, Homo sapiens
cgaguuacauuuagugcaa

SEQ ID NO: 1338892 - RNA, 19 nt, Homo sapiens
acacugaucuggagcugaa

SEQ ID NO: 1338893 - RNA, 19 nt, Homo sapiens
ggccgcagauuuacacuga

SEQ ID NO: 1338894 - RNA, 19 nt, Homo sapiens
caaacucccugccuagcaa

SEQ ID NO: 1338895 - RNA, 19 nt, Homo sapiens
guucgagucugagccuuua

SEQ ID NO: 1338896 - RNA, 19 nt, Homo sapiens
gaaggaugcccaggucuuu

SEQ ID NO: 1338897 - RNA, 19 nt, Homo sapiens
gagaucaucccaggguuua

SEQ ID NO: 1338898 - RNA, 19 nt, Homo sapiens
aaacguacgaguuacauuu

SEQ ID NO: 1338899 - RNA, 19 nt, Homo sapiens
gcccaggucuuucccaaau

SEQ ID NO: 1338900 - RNA, 19 nt, Homo sapiens
ccaccacaaugcucaagaa

SEQ ID NO: 1338901 - RNA, 19 nt, Homo sapiens
ggagagagacgcuuaugca

SEQ ID NO: 1338902 - RNA, 19 nt, Homo sapiens
ccaggucuuucccaaauau

SEQ ID NO: 1338903 - RNA, 19 nt, Homo sapiens
agaagcagaucgcccaguu

SEQ ID NO: 1338904 - RNA, 19 nt, Homo sapiens
cagcacauguggccuuuag

SEQ ID NO: 1338905 - RNA, 19 nt, Homo sapiens
gggcugaggcuucaucuuc

SEQ ID NO: 1338906 - RNA, 19 nt, Homo sapiens
ggagaucaucccaggguuu

SEQ ID NO: 1338907 - RNA, 19 nt, Homo sapiens
cagacagaguguuugauug

SEQ ID NO: 1338908 - RNA, 19 nt, Homo sapiens
ucaaggaguugugcuggaa

SEQ ID NO: 1338909 - RNA, 19 nt, Homo sapiens
uuaccaaggugcuggauca

SEQ ID NO: 1338910 - RNA, 19 nt, Homo sapiens
guacauaaggccaccacaa

SEQ ID NO: 1338911 - RNA, 19 nt, Homo sapiens
caccagauuuggagagaau

SEQ ID NO: 1338912 - RNA, 19 nt, Homo sapiens
ccauccaccugaacuguga

SEQ ID NO: 1338913 - RNA, 19 nt, Homo sapiens
ucacagcucccauuaccaa

SEQ ID NO: 1338914 - RNA, 19 nt, Homo sapiens
gauaggagcaggacacaac

SEQ ID NO: 1338915 - RNA, 19 nt, Homo sapiens
gagcccagcuuccccgaua

SEQ ID NO: 1338916 - RNA, 19 nt, Homo sapiens
cagcguaccugcagagacu

SEQ ID NO: 1338917 - RNA, 19 nt, Homo sapiens
gacugguucuguuuuauua

SEQ ID NO: 1338918 - RNA, 19 nt, Homo sapiens
cauguagucucccucuuca

SEQ ID NO: 1338919 - RNA, 19 nt, Homo sapiens
gcaaaauggugcuguccaa

SEQ ID NO: 1338920 - RNA, 19 nt, Homo sapiens
gucugaagccugaguauga

SEQ ID NO: 1338921 - RNA, 19 nt, Homo sapiens
uggcgaaggugcaggugaa

SEQ ID NO: 1338922 - RNA, 19 nt, Homo sapiens
agccacagaugcagugauu

SEQ ID NO: 1338923 - RNA, 19 nt, Homo sapiens
gggacgagcaggagagaga

SEQ ID NO: 1338924 - RNA, 19 nt, Homo sapiens
gcaaguggccgaggucucu

SEQ ID NO: 1338925 - RNA, 19 nt, Homo sapiens
uacauggacugguucuguu

SEQ ID NO: 1338926 - RNA, 19 nt, Homo sapiens
gcaaacucccugccuagca

SEQ ID NO: 1338927 - RNA, 19 nt, Homo sapiens
caccugaacugugaagaca

SEQ ID NO: 1338928 - RNA, 19 nt, Homo sapiens
uuagggaccucaagagcau

SEQ ID NO: 1338929 - RNA, 19 nt, Homo sapiens
ggucgccugucaccaagau

SEQ ID NO: 1338930 - RNA, 19 nt, Homo sapiens
gcaugggugcccucucuga

SEQ ID NO: 1338931 - RNA, 19 nt, Homo sapiens
gcuucggguuaguacauaa

SEQ ID NO: 1338932 - RNA, 19 nt, Homo sapiens
ccucacaccaccagauuug

SEQ ID NO: 1338933 - RNA, 19 nt, Homo sapiens
ccacagaugcagugauugg

SEQ ID NO: 1338934 - RNA, 19 nt, Homo sapiens
cacaaugcucaagaaauua

SEQ ID NO: 1338935 - RNA, 19 nt, Homo sapiens
gcgaaaugcagcacaugug

SEQ ID NO: 1338936 - RNA, 19 nt, Homo sapiens
ugaagacacccuccuccuu

SEQ ID NO: 1338937 - RNA, 19 nt, Homo sapiens
caacacaucaccgcagauc

SEQ ID NO: 1338938 - RNA, 19 nt, Homo sapiens
cccaggucuuucccaaaua

SEQ ID NO: 1338939 - RNA, 19 nt, Homo sapiens
ccgcagauuuacacugauc

SEQ ID NO: 1338940 - RNA, 19 nt, Homo sapiens
guacgaguuacauuuagug

SEQ ID NO: 1338941 - RNA, 19 nt, Homo sapiens
aacguacgaguuacauuua

SEQ ID NO: 1338942 - RNA, 19 nt, Homo sapiens
ggaccucaagagcauguga

SEQ ID NO: 1338943 - RNA, 19 nt, Homo sapiens
uacauaaggccaccacaau

SEQ ID NO: 1338944 - RNA, 19 nt, Homo sapiens
gcaggagagagacgcuuau

SEQ ID NO: 1338945 - RNA, 19 nt, Homo sapiens
gcagugauuggagccauga

SEQ ID NO: 1338946 - RNA, 19 nt, Homo sapiens
ucccaaauaugaggaguuc

SEQ ID NO: 1338947 - RNA, 19 nt, Homo sapiens
gcugaggcuucaucuucga

SEQ ID NO: 1338948 - RNA, 19 nt, Homo sapiens
uacauuuagugcaaguuga

SEQ ID NO: 1338949 - RNA, 19 nt, Homo sapiens
gaucaucccaggguuuaag

SEQ ID NO: 1338950 - RNA, 19 nt, Homo sapiens
gaauuccaagugcuccauu

SEQ ID NO: 1338951 - RNA, 19 nt, Homo sapiens
aagagcaugugacccugaa

SEQ ID NO: 1338952 - RNA, 19 nt, Homo sapiens
ggaguugugcuggaagaug

SEQ ID NO: 1338953 - RNA, 19 nt, Homo sapiens
ccucacagcucccauuacc

SEQ ID NO: 1338954 - RNA, 19 nt, Homo sapiens
gaagcagaucgcccaguuc

SEQ ID NO: 1338955 - RNA, 19 nt, Homo sapiens
guaugaugcgguggugaua

SEQ ID NO: 1338956 - RNA, 19 nt, Homo sapiens
ccauguagucucccucuuc

SEQ ID NO: 1338957 - RNA, 19 nt, Homo sapiens
caucaccgcagaucaccuu

SEQ ID NO: 1338958 - RNA, 19 nt, Homo sapiens
guccucacagcucccauua

SEQ ID NO: 1338959 - RNA, 19 nt, Homo sapiens
guucagcuucggguuagua

SEQ ID NO: 1338960 - RNA, 19 nt, Homo sapiens
cuucaaggacucugugguu

SEQ ID NO: 1338961 - RNA, 19 nt, Homo sapiens
gacagaguguuugauugca

SEQ ID NO: 1338962 - RNA, 19 nt, Homo sapiens
gaucuggagcugaagaaac

SEQ ID NO: 1338963 - RNA, 19 nt, Homo sapiens
ggacugguucuguuuuauu

SEQ ID NO: 1338964 - RNA, 19 nt, Homo sapiens
cauaaggccaccacaaugc

SEQ ID NO: 1338965 - RNA, 19 nt, Homo sapiens
acauaaggccaccacaaug

SEQ ID NO: 1338966 - RNA, 19 nt, Homo sapiens
gggagcugcugggcgaaau

SEQ ID NO: 1338967 - RNA, 19 nt, Homo sapiens
ccaccagauuuggagagaa

SEQ ID NO: 1338968 - RNA, 19 nt, Homo sapiens
ugcugaggccgcagauuua

SEQ ID NO: 1338969 - RNA, 19 nt, Homo sapiens
uagugcaaguugaccuuau

SEQ ID NO: 1338970 - RNA, 19 nt, Homo sapiens
uuacauuuagugcaaguug

SEQ ID NO: 1338971 - RNA, 19 nt, Homo sapiens
cguacgaguuacauuuagu

SEQ ID NO: 1338972 - RNA, 19 nt, Homo sapiens
ucacaccaccagauuugga

SEQ ID NO: 1338973 - RNA, 19 nt, Homo sapiens
aagacacccuccuccuuca

SEQ ID NO: 1338974 - RNA, 19 nt, Homo sapiens
cagcucccauuaccaaggu

SEQ ID NO: 1338975 - RNA, 19 nt, Homo sapiens
agacgcuuaugcagacaga

SEQ ID NO: 1338976 - RNA, 19 nt, Homo sapiens
gggcacagacauggcagaa

SEQ ID NO: 1338977 - RNA, 19 nt, Homo sapiens
aaggaguugugcuggaaga

SEQ ID NO: 1338978 - RNA, 19 nt, Homo sapiens
aagccacucuagccacaga

SEQ ID NO: 1338979 - RNA, 19 nt, Homo sapiens
uagucucccucuucacuca

SEQ ID NO: 1338980 - RNA, 19 nt, Homo sapiens
cuuugaagaugccauggau

SEQ ID NO: 1338981 - RNA, 19 nt, Homo sapiens
ucaucaggccuuugaagau

SEQ ID NO: 1338982 - RNA, 19 nt, Homo sapiens
aggugcaggugaacaguga

SEQ ID NO: 1338983 - RNA, 19 nt, Homo sapiens
cgagaggcgccaugugauc

SEQ ID NO: 1338984 - RNA, 19 nt, Homo sapiens
acacauggagcaagcaucu

SEQ ID NO: 1338985 - RNA, 19 nt, Homo sapiens
gaggucugaagccugagua

SEQ ID NO: 1338986 - RNA, 19 nt, Homo sapiens
aaacugaggcuuagaauaa

SEQ ID NO: 1338987 - RNA, 19 nt, Homo sapiens
uagcugcucugaucaguua

SEQ ID NO: 1338988 - RNA, 19 nt, Homo sapiens
gcaaauauccguuaaccau

SEQ ID NO: 1338989 - RNA, 19 nt, Homo sapiens
ucacacagcuaguaaguag

SEQ ID NO: 1338990 - RNA, 19 nt, Homo sapiens
gagccuaagugcuuuaugu

SEQ ID NO: 1338991 - RNA, 19 nt, Homo sapiens
gaaacugaggcuuagaaua

SEQ ID NO: 1338992 - RNA, 19 nt, Homo sapiens
gcagaaagaaggaagaaug

SEQ ID NO: 1338993 - RNA, 19 nt, Homo sapiens
uaaccucacuucaagcauu

SEQ ID NO: 1338994 - RNA, 19 nt, Homo sapiens
caagucagaauuugguuua

SEQ ID NO: 1338995 - RNA, 19 nt, Homo sapiens
gcacaacgcaauacacaga

SEQ ID NO: 1338996 - RNA, 19 nt, Homo sapiens
gaaugacaggcuuuauaua

SEQ ID NO: 1338997 - RNA, 19 nt, Homo sapiens
cgaugugcuuuacuuauuu

SEQ ID NO: 1338998 - RNA, 19 nt, Homo sapiens
cuucaagcauucuucauuu

SEQ ID NO: 1338999 - RNA, 19 nt, Homo sapiens
ucucucgucucucuuauuu

SEQ ID NO: 1339000 - RNA, 19 nt, Homo sapiens
cacauuagguaccuuaaau

SEQ ID NO: 1339001 - RNA, 19 nt, Homo sapiens
gcaauacacagaacaagau

SEQ ID NO: 1339002 - RNA, 19 nt, Homo sapiens
gcacucaauucucuccaau

SEQ ID NO: 1339003 - RNA, 19 nt, Homo sapiens
gucagaauuugguuuauug

SEQ ID NO: 1339004 - RNA, 19 nt, Homo sapiens
gaaucgaucuucguuccaa

SEQ ID NO: 1339005 - RNA, 19 nt, Homo sapiens
gacagcaaauauccguuaa

SEQ ID NO: 1339006 - RNA, 19 nt, Homo sapiens
gaaagaaggaagaaugucu

SEQ ID NO: 1339007 - RNA, 19 nt, Homo sapiens
cgcacugcauguaauauua

SEQ ID NO: 1339008 - RNA, 19 nt, Homo sapiens
ucgaugugcuuuacuuauu

SEQ ID NO: 1339009 - RNA, 19 nt, Homo sapiens
ugacagcaaauauccguua

SEQ ID NO: 1339010 - RNA, 19 nt, Homo sapiens
ccucaagcauccugauuug

SEQ ID NO: 1339011 - RNA, 19 nt, Homo sapiens
ccagagcaagucagaauuu

SEQ ID NO: 1339012 - RNA, 19 nt, Homo sapiens
ugaaugacaggcuuuauau

SEQ ID NO: 1339013 - RNA, 19 nt, Homo sapiens
gcgcgugguuuacuagaug

SEQ ID NO: 1339014 - RNA, 19 nt, Homo sapiens
uaaagucacacagcuagua

SEQ ID NO: 1339015 - RNA, 19 nt, Homo sapiens
ccacguggauucccucaag

SEQ ID NO: 1339016 - RNA, 19 nt, Homo sapiens
ccuaauacauucauauggu

SEQ ID NO: 1339017 - RNA, 19 nt, Homo sapiens
caagcauccugauuuguuc

SEQ ID NO: 1339018 - RNA, 19 nt, Homo sapiens
caguguagcugcucugauc

SEQ ID NO: 1339019 - RNA, 19 nt, Homo sapiens
gaacagccuagccaacaug

SEQ ID NO: 1339020 - RNA, 19 nt, Homo sapiens
uuagguaccuuaaauucga

SEQ ID NO: 1339021 - RNA, 19 nt, Homo sapiens
aaagacauucugugccuua

SEQ ID NO: 1339022 - RNA, 19 nt, Homo sapiens
ccggguggguucugaguaa

SEQ ID NO: 1339023 - RNA, 19 nt, Homo sapiens
gcaagucagaauuugguuu

SEQ ID NO: 1339024 - RNA, 19 nt, Homo sapiens
cauauaguuugucucuuug

SEQ ID NO: 1339025 - RNA, 19 nt, Homo sapiens
ucaagcauccugauuuguu

SEQ ID NO: 1339026 - RNA, 19 nt, Homo sapiens
agaaugucuucgaauauug

SEQ ID NO: 1339027 - RNA, 19 nt, Homo sapiens
ugacaggcuuuauauaacu

SEQ ID NO: 1339028 - RNA, 19 nt, Homo sapiens
auaacggucugcagaggua

SEQ ID NO: 1339029 - RNA, 19 nt, Homo sapiens
gaaaccccgucucuacuaa

SEQ ID NO: 1339030 - RNA, 19 nt, Homo sapiens
ggacugaaugacaggcuuu

SEQ ID NO: 1339031 - RNA, 19 nt, Homo sapiens
gaggucaggaguucaagaa

SEQ ID NO: 1339032 - RNA, 19 nt, Homo sapiens
cagagcaagucagaauuug

SEQ ID NO: 1339033 - RNA, 19 nt, Homo sapiens
ggugggaggucugcagguu

SEQ ID NO: 1339034 - RNA, 19 nt, Homo sapiens
gcaggagaauggcgugaac

SEQ ID NO: 1339035 - RNA, 19 nt, Homo sapiens
gggaaacugaggcuuagaa

SEQ ID NO: 1339036 - RNA, 19 nt, Homo sapiens
cugaaugacaggcuuuaua

SEQ ID NO: 1339037 - RNA, 19 nt, Homo sapiens
ggacagagacaccccauug

SEQ ID NO: 1339038 - RNA, 19 nt, Homo sapiens
gggcccagaugguuugcaa

SEQ ID NO: 1339039 - RNA, 19 nt, Homo sapiens
ucgagaccauucuggcuaa

SEQ ID NO: 1339040 - RNA, 19 nt, Homo sapiens
guuucuccauugcaauaua

SEQ ID NO: 1339041 - RNA, 19 nt, Homo sapiens
gcgcacugcauguaauauu

SEQ ID NO: 1339042 - RNA, 19 nt, Homo sapiens
ggaaacugaggcuuagaau

SEQ ID NO: 1339043 - RNA, 19 nt, Homo sapiens
gagcaagucagaauuuggu

SEQ ID NO: 1339044 - RNA, 19 nt, Homo sapiens
gaaugucuucgaauauugu

SEQ ID NO: 1339045 - RNA, 19 nt, Homo sapiens
cgaggcaggcggaucauga

SEQ ID NO: 1339046 - RNA, 19 nt, Homo sapiens
acacagcuaguaaguagaa

SEQ ID NO: 1339047 - RNA, 19 nt, Homo sapiens
gugguuuacuagaugcuaa

SEQ ID NO: 1339048 - RNA, 19 nt, Homo sapiens
uuacacauuagguaccuua

SEQ ID NO: 1339049 - RNA, 19 nt, Homo sapiens
uaugugcacucaauucucu

SEQ ID NO: 1339050 - RNA, 19 nt, Homo sapiens
cagaaagaaggaagaaugu

SEQ ID NO: 1339051 - RNA, 19 nt, Homo sapiens
caagcauucuucauuuaac

SEQ ID NO: 1339052 - RNA, 19 nt, Homo sapiens
ggagggagagggucguugu

SEQ ID NO: 1339053 - RNA, 19 nt, Homo sapiens
gacgguuucuccauugcaa

SEQ ID NO: 1339054 - RNA, 19 nt, Homo sapiens
ccauccugcugaucauaaa

SEQ ID NO: 1339055 - RNA, 19 nt, Homo sapiens
ccuguaaucccaguacuuu

SEQ ID NO: 1339056 - RNA, 19 nt, Homo sapiens
aaagucacacagcuaguaa

SEQ ID NO: 1339057 - RNA, 19 nt, Homo sapiens
cagcgcacugcauguaaua

SEQ ID NO: 1339058 - RNA, 19 nt, Homo sapiens
caacucgucccgaaucgau

SEQ ID NO: 1339059 - RNA, 19 nt, Homo sapiens
cauuagguaccuuaaauuc

SEQ ID NO: 1339060 - RNA, 19 nt, Homo sapiens
gaucaugaggucaggagau

SEQ ID NO: 1339061 - RNA, 19 nt, Homo sapiens
caauacacagaacaagauu

SEQ ID NO: 1339062 - RNA, 19 nt, Homo sapiens
gucaggagaucgagaccau

SEQ ID NO: 1339063 - RNA, 19 nt, Homo sapiens
ccuguaaucccagcacuuu

SEQ ID NO: 1339064 - RNA, 19 nt, Homo sapiens
uaaccauccugcugaucau

SEQ ID NO: 1339065 - RNA, 19 nt, Homo sapiens
gguuuauuguuggagauuu

SEQ ID NO: 1339066 - RNA, 19 nt, Homo sapiens
gacaggcuuuauauaacug

SEQ ID NO: 1339067 - RNA, 19 nt, Homo sapiens
uguuacagcgcgugguuua

SEQ ID NO: 1339068 - RNA, 19 nt, Homo sapiens
gcgccuguauucccagcuu

SEQ ID NO: 1339069 - RNA, 19 nt, Homo sapiens
ggagccagagcaagucaga

SEQ ID NO: 1339070 - RNA, 19 nt, Homo sapiens
guagcaggagggucuuaaa

SEQ ID NO: 1339071 - RNA, 19 nt, Homo sapiens
ggagaggagcaaugaaagg

SEQ ID NO: 1339072 - RNA, 19 nt, Homo sapiens
guaaguagaagugcuaaaa

SEQ ID NO: 1339073 - RNA, 19 nt, Homo sapiens
cuaguaaguagaagugcua

SEQ ID NO: 1339074 - RNA, 19 nt, Homo sapiens
uacagcgcgugguuuacua

SEQ ID NO: 1339075 - RNA, 19 nt, Homo sapiens
gcaaggcagcagaaagaag

SEQ ID NO: 1339076 - RNA, 19 nt, Homo sapiens
acacauuagguaccuuaaa

SEQ ID NO: 1339077 - RNA, 19 nt, Homo sapiens
gacauucugugccuuacac

SEQ ID NO: 1339078 - RNA, 19 nt, Homo sapiens
caggagaucgagaccauuc

SEQ ID NO: 1339079 - RNA, 19 nt, Homo sapiens
cagcaaauauccguuaacc

SEQ ID NO: 1339080 - RNA, 19 nt, Homo sapiens
ucugugagccuaagugcuu

SEQ ID NO: 1339081 - RNA, 19 nt, Homo sapiens
ucucuuugccucuagacua

SEQ ID NO: 1339082 - RNA, 19 nt, Homo sapiens
uugcaaggcagcagaaaga

SEQ ID NO: 1339083 - RNA, 19 nt, Homo sapiens
ggagaucgagaccauucug

SEQ ID NO: 1339084 - RNA, 19 nt, Homo sapiens
ucucuccaauucuauaagu

SEQ ID NO: 1339085 - RNA, 19 nt, Homo sapiens
gcagcagaaagaaggaaga

SEQ ID NO: 1339086 - RNA, 19 nt, Homo sapiens
gaaaggaaccaacacauua

SEQ ID NO: 1339087 - RNA, 19 nt, Homo sapiens
ggauggagguuauuaaaga

SEQ ID NO: 1339088 - RNA, 19 nt, Homo sapiens
ccaaguaaaccaugauaua

SEQ ID NO: 1339089 - RNA, 19 nt, Homo sapiens
ucugggaucuugugaguua

SEQ ID NO: 1339090 - RNA, 19 nt, Homo sapiens
gcuagucccugaagccuuu

SEQ ID NO: 1339091 - RNA, 19 nt, Homo sapiens
uaacauggacgcucagauu

SEQ ID NO: 1339092 - RNA, 19 nt, Homo sapiens
ugucuucccuuccaccuua

SEQ ID NO: 1339093 - RNA, 19 nt, Homo sapiens
gagaguagaguacauaauc

SEQ ID NO: 1339094 - RNA, 19 nt, Homo sapiens
ggccaggucucucaaacuu

SEQ ID NO: 1339095 - RNA, 19 nt, Homo sapiens
gcgcaguauuuauugcuaa

SEQ ID NO: 1339096 - RNA, 19 nt, Homo sapiens
ccugaagccuuuaaccaaa

SEQ ID NO: 1339097 - RNA, 19 nt, Homo sapiens
cagaagccacugaauaauu

SEQ ID NO: 1339098 - RNA, 19 nt, Homo sapiens
ugaaaggaaccaacacauu

SEQ ID NO: 1339099 - RNA, 19 nt, Homo sapiens
cccagaagccacugaauaa

SEQ ID NO: 1339100 - RNA, 19 nt, Homo sapiens
gcucugggaucuugugagu

SEQ ID NO: 1339101 - RNA, 19 nt, Homo sapiens
ccaggucucucaaacuugu

SEQ ID NO: 1339102 - RNA, 19 nt, Homo sapiens
gauggagguuauuaaagau

SEQ ID NO: 1339103 - RNA, 19 nt, Homo sapiens
gggugucccuugagucuga

SEQ ID NO: 1339104 - RNA, 19 nt, Homo sapiens
aaaggaaccaacacauuaa

SEQ ID NO: 1339105 - RNA, 19 nt, Homo sapiens
gaaccaacacauuaacgau

SEQ ID NO: 1339106 - RNA, 19 nt, Homo sapiens
accaacacauuaacgauuu

SEQ ID NO: 1339107 - RNA, 19 nt, Homo sapiens
caacuccucuuuuauccua

SEQ ID NO: 1339108 - RNA, 19 nt, Homo sapiens
ggagguuauuaaagaucua

SEQ ID NO: 1339109 - RNA, 19 nt, Homo sapiens
uaccaugggugucccuuga

SEQ ID NO: 1339110 - RNA, 19 nt, Homo sapiens
agucugagcuagagugugu

SEQ ID NO: 1339111 - RNA, 19 nt, Homo sapiens
gggccagucccacacauuu

SEQ ID NO: 1339112 - RNA, 19 nt, Homo sapiens
ccaaagcgcccauccacau

SEQ ID NO: 1339113 - RNA, 19 nt, Homo sapiens
cauggacgcucagauuuca

SEQ ID NO: 1339114 - RNA, 19 nt, Homo sapiens
gagcaggucgggagaguag

SEQ ID NO: 1339115 - RNA, 19 nt, Homo sapiens
ggaaccaacacauuaacga

SEQ ID NO: 1339116 - RNA, 19 nt, Homo sapiens
gcucagauuucagaggaau

SEQ ID NO: 1339117 - RNA, 19 nt, Homo sapiens
gcccugcgcaguauuuauu

SEQ ID NO: 1339118 - RNA, 19 nt, Homo sapiens
uggagcagcagcuuugaua

SEQ ID NO: 1339119 - RNA, 19 nt, Homo sapiens
agaguagaguacauaauca

SEQ ID NO: 1339120 - RNA, 19 nt, Homo sapiens
gugcauguuucagauaugu

SEQ ID NO: 1339121 - RNA, 19 nt, Homo sapiens
ggugggauggagguuauua

SEQ ID NO: 1339122 - RNA, 19 nt, Homo sapiens
gggagaguagaguacauaa

SEQ ID NO: 1339123 - RNA, 19 nt, Homo sapiens
ggucaggucccauguuguc

SEQ ID NO: 1339124 - RNA, 19 nt, Homo sapiens
aaacgggagugggcacaga

SEQ ID NO: 1339125 - RNA, 19 nt, Homo sapiens
ggagaguagaguacauaau

SEQ ID NO: 1339126 - RNA, 19 nt, Homo sapiens
gguauuuauugcuguacau

SEQ ID NO: 1339127 - RNA, 19 nt, Homo sapiens
ugugagaccucccuguucu

SEQ ID NO: 1339128 - RNA, 19 nt, Homo sapiens
ucucuucucaccucaguuu

SEQ ID NO: 1339129 - RNA, 19 nt, Homo sapiens
ggucucuucucaccucagu

SEQ ID NO: 1339130 - RNA, 19 nt, Homo sapiens
ccggguauuuauugcugua

SEQ ID NO: 1339131 - RNA, 19 nt, Homo sapiens
gcagggcgugucugagaga

SEQ ID NO: 1339132 - RNA, 19 nt, Homo sapiens
gcagcagcuuugauaccau

SEQ ID NO: 1339133 - RNA, 19 nt, Homo sapiens
gcauguuucagauaugugu

SEQ ID NO: 1339134 - RNA, 19 nt, Homo sapiens
ggugaaaggaaccaacaca

SEQ ID NO: 1339135 - RNA, 19 nt, Homo sapiens
gggauggagguuauuaaag

SEQ ID NO: 1339136 - RNA, 19 nt, Homo sapiens
ugggauggagguuauuaaa

SEQ ID NO: 1339137 - RNA, 19 nt, Homo sapiens
gggugguggucucuucuca

SEQ ID NO: 1339138 - RNA, 19 nt, Homo sapiens
ggugcauguuucagauaug

SEQ ID NO: 1339139 - RNA, 19 nt, Homo sapiens
agaccucccuguucuuggu

SEQ ID NO: 1339140 - RNA, 19 nt, Homo sapiens
gccaaggccaggucucuca

SEQ ID NO: 1339141 - RNA, 19 nt, Homo sapiens
gcucuuggugcauguuuca

SEQ ID NO: 1339142 - RNA, 19 nt, Homo sapiens
ucccagcccugcccuucuu

SEQ ID NO: 1339143 - RNA, 19 nt, Homo sapiens
uagaguguguccccgauaa

SEQ ID NO: 1339144 - RNA, 19 nt, Homo sapiens
cgggagaguagaguacaua

SEQ ID NO: 1339145 - RNA, 19 nt, Homo sapiens
ccagaagccacugaauaau

SEQ ID NO: 1339146 - RNA, 19 nt, Homo sapiens
caaggccaggucucucaaa

SEQ ID NO: 1339147 - RNA, 19 nt, Homo sapiens
aaccaacacauuaacgauu

SEQ ID NO: 1339148 - RNA, 19 nt, Homo sapiens
aacauggacgcucagauuu

SEQ ID NO: 1339149 - RNA, 19 nt, Homo sapiens
gcugugguuuggugaaagg

SEQ ID NO: 1339150 - RNA, 19 nt, Homo sapiens
caaagcgcccauccacauc

SEQ ID NO: 1339151 - RNA, 19 nt, Homo sapiens
ggguauuuauugcuguaca

SEQ ID NO: 1339152 - RNA, 19 nt, Homo sapiens
ccaugggugucccuugagu

SEQ ID NO: 1339153 - RNA, 19 nt, Homo sapiens
ggagcaggucgggagagua

SEQ ID NO: 1339154 - RNA, 19 nt, Homo sapiens
uggugcauguuucagauau

SEQ ID NO: 1339155 - RNA, 19 nt, Homo sapiens
gguccaagcagaguugauc

SEQ ID NO: 1339156 - RNA, 19 nt, Homo sapiens
ugagaccucccuguucuug

SEQ ID NO: 1339157 - RNA, 19 nt, Homo sapiens
gccaaguaaaccaugauau

SEQ ID NO: 1339158 - RNA, 19 nt, Homo sapiens
gaccugauccaaccugaua

SEQ ID NO: 1339159 - RNA, 19 nt, Homo sapiens
ggaagugcgggacauggua

SEQ ID NO: 1339160 - RNA, 19 nt, Homo sapiens
acacugagcuggcuaucuc

SEQ ID NO: 1339161 - RNA, 19 nt, Homo sapiens
gggaggagcuguccauacg

SEQ ID NO: 1339162 - RNA, 19 nt, Homo sapiens
ccaaggacaugccuguuac

SEQ ID NO: 1339163 - RNA, 19 nt, Homo sapiens
cugauaaggugccaucuuc

SEQ ID NO: 1339164 - RNA, 19 nt, Homo sapiens
ggaagcaggccuugugagu

SEQ ID NO: 1339165 - RNA, 19 nt, Homo sapiens
aggagaagguggauaagug

SEQ ID NO: 1339166 - RNA, 19 nt, Homo sapiens
cccaaggacaugccuguua

SEQ ID NO: 1339167 - RNA, 19 nt, Homo sapiens
gagggaagcaggccuugug

SEQ ID NO: 1339168 - RNA, 19 nt, Homo sapiens
gggugucacuggccagaug

SEQ ID NO: 1339169 - RNA, 19 nt, Homo sapiens
cccacacccuugacauaaa

SEQ ID NO: 1339170 - RNA, 19 nt, Homo sapiens
gagcugcauucaggaagug

SEQ ID NO: 1339171 - RNA, 19 nt, Homo sapiens
ggacagggguauccagcuu

SEQ ID NO: 1339172 - RNA, 19 nt, Homo sapiens
ccacacccuugacauaaaa

SEQ ID NO: 1339173 - RNA, 19 nt, Homo sapiens
ccaacccagugcacaagga

SEQ ID NO: 1339174 - RNA, 19 nt, Homo sapiens
cccaggagaagguggauaa

SEQ ID NO: 1339175 - RNA, 19 nt, Homo sapiens
ucacuggccagaugucaug

SEQ ID NO: 1339176 - RNA, 19 nt, Homo sapiens
aaggugccaucuucagcua

SEQ ID NO: 1339177 - RNA, 19 nt, Homo sapiens
gggugaagcaggccagaau

SEQ ID NO: 1339178 - RNA, 19 nt, Homo sapiens
ccacugagccacccuucca

SEQ ID NO: 1339179 - RNA, 19 nt, Homo sapiens
gauaaggugccaucuucag

SEQ ID NO: 1339180 - RNA, 19 nt, Homo sapiens
ugagcugcauucaggaagu

SEQ ID NO: 1339181 - RNA, 19 nt, Homo sapiens
gacccaacccagugcacaa

SEQ ID NO: 1339182 - RNA, 19 nt, Homo sapiens
gaucagcacugcauuagau

SEQ ID NO: 1339183 - RNA, 19 nt, Homo sapiens
gaucaacgccgucaucuug

SEQ ID NO: 1339184 - RNA, 19 nt, Homo sapiens
gggcagcgcugaaggagaa

SEQ ID NO: 1339185 - RNA, 19 nt, Homo sapiens
gcaaaucgccuacguuaca

SEQ ID NO: 1339186 - RNA, 19 nt, Homo sapiens
gaaccaacccagaaacaga

SEQ ID NO: 1339187 - RNA, 19 nt, Homo sapiens
ugaagaagcagguguuuga

SEQ ID NO: 1339188 - RNA, 19 nt, Homo sapiens
caguaccgcuucagcauug

SEQ ID NO: 1339189 - RNA, 19 nt, Homo sapiens
ccaacgugauggugaagaa

SEQ ID NO: 1339190 - RNA, 19 nt, Homo sapiens
ucagaucagcacugcauua

SEQ ID NO: 1339191 - RNA, 19 nt, Homo sapiens
uaagugaaccaacccagaa

SEQ ID NO: 1339192 - RNA, 19 nt, Homo sapiens
gcaguaccgcuucagcauu

SEQ ID NO: 1339193 - RNA, 19 nt, Homo sapiens
uggcaaacacgcacaugua

SEQ ID NO: 1339194 - RNA, 19 nt, Homo sapiens
cauagaaaggacagaauga

SEQ ID NO: 1339195 - RNA, 19 nt, Homo sapiens
gcaagaugucggugaagga

SEQ ID NO: 1339196 - RNA, 19 nt, Homo sapiens
gaagcagguguuugagcua

SEQ ID NO: 1339197 - RNA, 19 nt, Homo sapiens
ggaacaguuuuaucccuaa

SEQ ID NO: 1339198 - RNA, 19 nt, Homo sapiens
ggugucaggcccacuagaa

SEQ ID NO: 1339199 - RNA, 19 nt, Homo sapiens
ccaauaagagggaacuaca

SEQ ID NO: 1339200 - RNA, 19 nt, Homo sapiens
gcaagugggcagcgcugaa

SEQ ID NO: 1339201 - RNA, 19 nt, Homo sapiens
acaaucuaaugccugauga

SEQ ID NO: 1339202 - RNA, 19 nt, Homo sapiens
accgguaccuggccuauug

SEQ ID NO: 1339203 - RNA, 19 nt, Homo sapiens
ucgaguacauccucagcaa

SEQ ID NO: 1339204 - RNA, 19 nt, Homo sapiens
gcggcuggauggugcaguu

SEQ ID NO: 1339205 - RNA, 19 nt, Homo sapiens
gacaaucuaaugccugaug

SEQ ID NO: 1339206 - RNA, 19 nt, Homo sapiens
gcauccggcugcuccagau

SEQ ID NO: 1339207 - RNA, 19 nt, Homo sapiens
gcgcgcuccucaugacaau

SEQ ID NO: 1339208 - RNA, 19 nt, Homo sapiens
ccauagaaaggacagaaug

SEQ ID NO: 1339209 - RNA, 19 nt, Homo sapiens
gguugcagcagccauagaa

SEQ ID NO: 1339210 - RNA, 19 nt, Homo sapiens
gcagguguuugagcuacug

SEQ ID NO: 1339211 - RNA, 19 nt, Homo sapiens
gcuggaggccgugauccua

SEQ ID NO: 1339212 - RNA, 19 nt, Homo sapiens
uggacgcccuggaccacua

SEQ ID NO: 1339213 - RNA, 19 nt, Homo sapiens
ggcagggcaucgaguacau

SEQ ID NO: 1339214 - RNA, 19 nt, Homo sapiens
uggcugcccugugcaucua

SEQ ID NO: 1339215 - RNA, 19 nt, Homo sapiens
ggugaagaagcagguguuu

SEQ ID NO: 1339216 - RNA, 19 nt, Homo sapiens
ccuacaggguacaguguuc

SEQ ID NO: 1339217 - RNA, 19 nt, Homo sapiens
ccaggucucaggcuagaau

SEQ ID NO: 1339218 - RNA, 19 nt, Homo sapiens
cuaagcagcaccuccagau

SEQ ID NO: 1339219 - RNA, 19 nt, Homo sapiens
aaugaaaugccaauaagag

SEQ ID NO: 1339220 - RNA, 19 nt, Homo sapiens
ucggcaagaugucggugaa

SEQ ID NO: 1339221 - RNA, 19 nt, Homo sapiens
ccagccaccucaccuaagc

SEQ ID NO: 1339222 - RNA, 19 nt, Homo sapiens
ggcaaacacgcacauguac

SEQ ID NO: 1339223 - RNA, 19 nt, Homo sapiens
caguguaccauguggcaaa

SEQ ID NO: 1339224 - RNA, 19 nt, Homo sapiens
ggggaccacugcccuagaa

SEQ ID NO: 1339225 - RNA, 19 nt, Homo sapiens
cagcugcccacagaaacua

SEQ ID NO: 1339226 - RNA, 19 nt, Homo sapiens
gaagaagcagguguuugag

SEQ ID NO: 1339227 - RNA, 19 nt, Homo sapiens
cagaucagcacugcauuag

SEQ ID NO: 1339228 - RNA, 19 nt, Homo sapiens
caguguucgucgcuacuug

SEQ ID NO: 1339229 - RNA, 19 nt, Homo sapiens
gcagcagccauagaaagga

SEQ ID NO: 1339230 - RNA, 19 nt, Homo sapiens
gcccuggaccacuacaaga

SEQ ID NO: 1339231 - RNA, 19 nt, Homo sapiens
gaaguuaaguggucugaaa

SEQ ID NO: 1339232 - RNA, 19 nt, Homo sapiens
caagguagcuuaagagaga

SEQ ID NO: 1339233 - RNA, 19 nt, Homo sapiens
caucguagccuaagaaaua

SEQ ID NO: 1339234 - RNA, 19 nt, Homo sapiens
gaugauggcugccugguuu

SEQ ID NO: 1339235 - RNA, 19 nt, Homo sapiens
caacugggcuagaauaaau

SEQ ID NO: 1339236 - RNA, 19 nt, Homo sapiens
caaggaaacuaacagcuuu

SEQ ID NO: 1339237 - RNA, 19 nt, Homo sapiens
gaaaugggaaugaaguuaa

SEQ ID NO: 1339238 - RNA, 19 nt, Homo sapiens
gcaguuaagucguauuuua

SEQ ID NO: 1339239 - RNA, 19 nt, Homo sapiens
guaauucccuucccagcua

SEQ ID NO: 1339240 - RNA, 19 nt, Homo sapiens
gagaacauccuuuaacuug

SEQ ID NO: 1339241 - RNA, 19 nt, Homo sapiens
gcauaugcauucuaccuuu

SEQ ID NO: 1339242 - RNA, 19 nt, Homo sapiens
caucuuaaaucacugguaa

SEQ ID NO: 1339243 - RNA, 19 nt, Homo sapiens
ggaagcuguugaauguuua

SEQ ID NO: 1339244 - RNA, 19 nt, Homo sapiens
gcucuuagcuccugauugg

SEQ ID NO: 1339245 - RNA, 19 nt, Homo sapiens
uaaccacagugucaacaua

SEQ ID NO: 1339246 - RNA, 19 nt, Homo sapiens
ggacaggccuaacaacaca

SEQ ID NO: 1339247 - RNA, 19 nt, Homo sapiens
gcauuguacuucaucuuaa

SEQ ID NO: 1339248 - RNA, 19 nt, Homo sapiens
gaacauccuuuaacuuggu

SEQ ID NO: 1339249 - RNA, 19 nt, Homo sapiens
uaccaucucugcaugauuu

SEQ ID NO: 1339250 - RNA, 19 nt, Homo sapiens
ggaucucuauugacaagua

SEQ ID NO: 1339251 - RNA, 19 nt, Homo sapiens
ggaaaugggaaugaaguua

SEQ ID NO: 1339252 - RNA, 19 nt, Homo sapiens
caaccuaggaucaugauaa

SEQ ID NO: 1339253 - RNA, 19 nt, Homo sapiens
gacaaagucucagcacauu

SEQ ID NO: 1339254 - RNA, 19 nt, Homo sapiens
gcaacacccuccagucugu

SEQ ID NO: 1339255 - RNA, 19 nt, Homo sapiens
ucaaagcggugaccacuca

SEQ ID NO: 1339256 - RNA, 19 nt, Homo sapiens
acacacaggucagacauuu

SEQ ID NO: 1339257 - RNA, 19 nt, Homo sapiens
gcacacaggguuuauuaau

SEQ ID NO: 1339258 - RNA, 19 nt, Homo sapiens
gcauugaucuuuagaagcu

SEQ ID NO: 1339259 - RNA, 19 nt, Homo sapiens
ccacacaguuguucaccaa

SEQ ID NO: 1339260 - RNA, 19 nt, Homo sapiens
uggaagcuguugaauguuu

SEQ ID NO: 1339261 - RNA, 19 nt, Homo sapiens
ggaaggccauuuguacaug

SEQ ID NO: 1339262 - RNA, 19 nt, Homo sapiens
ccagugcacuccaaugaug

SEQ ID NO: 1339263 - RNA, 19 nt, Homo sapiens
ucagugcaguuaagucgua

SEQ ID NO: 1339264 - RNA, 19 nt, Homo sapiens
caacagaccagaccuccuu

SEQ ID NO: 1339265 - RNA, 19 nt, Homo sapiens
gucuaaagcuacagagaaa

SEQ ID NO: 1339266 - RNA, 19 nt, Homo sapiens
ccaauauguucacaaccua

SEQ ID NO: 1339267 - RNA, 19 nt, Homo sapiens
uguagucaguguaccaaua

SEQ ID NO: 1339268 - RNA, 19 nt, Homo sapiens
gguuucagguggaacuuaa

SEQ ID NO: 1339269 - RNA, 19 nt, Homo sapiens
acacaggguuuauuaaugg

SEQ ID NO: 1339270 - RNA, 19 nt, Homo sapiens
caacauaguaucggaaaga

SEQ ID NO: 1339271 - RNA, 19 nt, Homo sapiens
gaucucuauugacaaguaa

SEQ ID NO: 1339272 - RNA, 19 nt, Homo sapiens
guagauuagucucuucuca

SEQ ID NO: 1339273 - RNA, 19 nt, Homo sapiens
gaagaaauaaucagguaag

SEQ ID NO: 1339274 - RNA, 19 nt, Homo sapiens
gaggauauucuccaaguug

SEQ ID NO: 1339275 - RNA, 19 nt, Homo sapiens
aguggaagcuguugaaugu

SEQ ID NO: 1339276 - RNA, 19 nt, Homo sapiens
acacaggucagacauuuaa

SEQ ID NO: 1339277 - RNA, 19 nt, Homo sapiens
uaucaggguucgucaucua

SEQ ID NO: 1339278 - RNA, 19 nt, Homo sapiens
ggucugaacagcuguaguu

SEQ ID NO: 1339279 - RNA, 19 nt, Homo sapiens
gaaggccauuuguacaugu

SEQ ID NO: 1339280 - RNA, 19 nt, Homo sapiens
guacagacacgugaccuuu

SEQ ID NO: 1339281 - RNA, 19 nt, Homo sapiens
gggcuagaauaaauguaaa

SEQ ID NO: 1339282 - RNA, 19 nt, Homo sapiens
ccugauugguuguguguuu

SEQ ID NO: 1339283 - RNA, 19 nt, Homo sapiens
gaccagaccuccuuuaacc

SEQ ID NO: 1339284 - RNA, 19 nt, Homo sapiens
gagagauggucaggagaaa

SEQ ID NO: 1339285 - RNA, 19 nt, Homo sapiens
ggaauauuguuucuaagac

SEQ ID NO: 1339286 - RNA, 19 nt, Homo sapiens
uaacaacacauguaagcuu

SEQ ID NO: 1339287 - RNA, 19 nt, Homo sapiens
gaacuuaaugcauugaucu

SEQ ID NO: 1339288 - RNA, 19 nt, Homo sapiens
guucaagguuauauucaga

SEQ ID NO: 1339289 - RNA, 19 nt, Homo sapiens
guaccaauauguucacaac

SEQ ID NO: 1339290 - RNA, 19 nt, Homo sapiens
ggaaguugaguaccuguga

SEQ ID NO: 1339291 - RNA, 19 nt, Homo sapiens
ggaaauaaucagggcaauu

SEQ ID NO: 1339292 - RNA, 19 nt, Homo sapiens
aaaggcagaugaggaggua

SEQ ID NO: 1339293 - RNA, 19 nt, Homo sapiens
ccaguuuguuguagaagaa

SEQ ID NO: 1339294 - RNA, 19 nt, Homo sapiens
ggaacuuaaugcauugauc

SEQ ID NO: 1339295 - RNA, 19 nt, Homo sapiens
ccuuggagcugaagagaga

SEQ ID NO: 1339296 - RNA, 19 nt, Homo sapiens
ggaauacuggaaauaauca

SEQ ID NO: 1339297 - RNA, 19 nt, Homo sapiens
ugaguaagaacaauccuuu

SEQ ID NO: 1339298 - RNA, 19 nt, Homo sapiens
caaaguggaagcuguugaa

SEQ ID NO: 1339299 - RNA, 19 nt, Homo sapiens
uaccagccuuucugucaua

SEQ ID NO: 1339300 - RNA, 19 nt, Homo sapiens
uaccuuuccugcuuuauga

SEQ ID NO: 1339301 - RNA, 19 nt, Homo sapiens
cuuaaguacugacugcuuu

SEQ ID NO: 1339302 - RNA, 19 nt, Homo sapiens
uuaaggaucagugcaguua

SEQ ID NO: 1339303 - RNA, 19 nt, Homo sapiens
uugaguaccugugaucuaa

SEQ ID NO: 1339304 - RNA, 19 nt, Homo sapiens
gaaguugaguaccugugau

SEQ ID NO: 1339305 - RNA, 19 nt, Homo sapiens
caaaugcuacagagaaaug

SEQ ID NO: 1339306 - RNA, 19 nt, Homo sapiens
cacacaggguuuauuaaug

SEQ ID NO: 1339307 - RNA, 19 nt, Homo sapiens
gagagaggaucagggugaa

SEQ ID NO: 1339308 - RNA, 19 nt, Homo sapiens
uuuguucucuagacucuua

SEQ ID NO: 1339309 - RNA, 19 nt, Homo sapiens
gguggaacuuaaugcauug

SEQ ID NO: 1339310 - RNA, 19 nt, Homo sapiens
gaagagagaaaucaaaaga

SEQ ID NO: 1339311 - RNA, 19 nt, Homo sapiens
caucuauuguguugacuau

SEQ ID NO: 1339312 - RNA, 19 nt, Homo sapiens
ccugggagcacacagaaua

SEQ ID NO: 1339313 - RNA, 19 nt, Homo sapiens
uuacuuagcacuugauugu

SEQ ID NO: 1339314 - RNA, 19 nt, Homo sapiens
ccaguuaaauaucaucucu

SEQ ID NO: 1339315 - RNA, 19 nt, Homo sapiens
uggcacacaggguuuauua

SEQ ID NO: 1339316 - RNA, 19 nt, Homo sapiens
gugauuauguuauggugau

SEQ ID NO: 1339317 - RNA, 19 nt, Homo sapiens
ucagcugguucaccucuuu

SEQ ID NO: 1339318 - RNA, 19 nt, Homo sapiens
aaaguucauuuccagagaa

SEQ ID NO: 1339319 - RNA, 19 nt, Homo sapiens
cccaaaugcuacagagaaa

SEQ ID NO: 1339320 - RNA, 19 nt, Homo sapiens
uaaagcgucuguggcgauu

SEQ ID NO: 1339321 - RNA, 19 nt, Homo sapiens
ccaaggaaacuaacagcuu

SEQ ID NO: 1339322 - RNA, 19 nt, Homo sapiens
ccacagugucaacauagua

SEQ ID NO: 1339323 - RNA, 19 nt, Homo sapiens
ccaagaccgugaucaaggu

SEQ ID NO: 1339324 - RNA, 19 nt, Homo sapiens
ugaucaagguagcuuaaga

SEQ ID NO: 1339325 - RNA, 19 nt, Homo sapiens
cauaugcugcuauuacaaa

SEQ ID NO: 1339326 - RNA, 19 nt, Homo sapiens
ggccuaacaacacauguaa

SEQ ID NO: 1339327 - RNA, 19 nt, Homo sapiens
gcaucucccuuuugccuua

SEQ ID NO: 1339328 - RNA, 19 nt, Homo sapiens
uaauuggacuagauaccuu

SEQ ID NO: 1339329 - RNA, 19 nt, Homo sapiens
uaacuuggugugcaauuug

SEQ ID NO: 1339330 - RNA, 19 nt, Homo sapiens
cugcagauguggagccauu

SEQ ID NO: 1339331 - RNA, 19 nt, Homo sapiens
ccaaaggagucgauucuua

SEQ ID NO: 1339332 - RNA, 19 nt, Homo sapiens
gaaacuacccauacuaauu

SEQ ID NO: 1339333 - RNA, 19 nt, Homo sapiens
gaacuugcaucaacaauac

SEQ ID NO: 1339334 - RNA, 19 nt, Homo sapiens
gaacuagcccuuagaaaug

SEQ ID NO: 1339335 - RNA, 19 nt, Homo sapiens
caauggaucucucagcuaa

SEQ ID NO: 1339336 - RNA, 19 nt, Homo sapiens
caacaauacuucagucaug

SEQ ID NO: 1339337 - RNA, 19 nt, Homo sapiens
gagcaaaggugaaggacau

SEQ ID NO: 1339338 - RNA, 19 nt, Homo sapiens
gggaucaguuugcugguua

SEQ ID NO: 1339339 - RNA, 19 nt, Homo sapiens
uaauuagccuugccacuuu

SEQ ID NO: 1339340 - RNA, 19 nt, Homo sapiens
gaagaaacuacccauacua

SEQ ID NO: 1339341 - RNA, 19 nt, Homo sapiens
caaaggagucgauucuuaa

SEQ ID NO: 1339342 - RNA, 19 nt, Homo sapiens
gauugucucuaccucuuua

SEQ ID NO: 1339343 - RNA, 19 nt, Homo sapiens
gaaggaacuugcaucaaca

SEQ ID NO: 1339344 - RNA, 19 nt, Homo sapiens
ugaaggacaucuuuaagga

SEQ ID NO: 1339345 - RNA, 19 nt, Homo sapiens
ucaguucggugaugcauuu

SEQ ID NO: 1339346 - RNA, 19 nt, Homo sapiens
gaacucaucgauaggguaa

SEQ ID NO: 1339347 - RNA, 19 nt, Homo sapiens
ggaacuugcaucaacaaua

SEQ ID NO: 1339348 - RNA, 19 nt, Homo sapiens
gaacauauugcugauaaga

SEQ ID NO: 1339349 - RNA, 19 nt, Homo sapiens
cagaggagcuagugucaug

SEQ ID NO: 1339350 - RNA, 19 nt, Homo sapiens
ccaaacacauuuucagaua

SEQ ID NO: 1339351 - RNA, 19 nt, Homo sapiens
gaaaagugagucaaaguua

SEQ ID NO: 1339352 - RNA, 19 nt, Homo sapiens
gccuuuagaucuagaacua

SEQ ID NO: 1339353 - RNA, 19 nt, Homo sapiens
guucucggcuucauccuuu

SEQ ID NO: 1339354 - RNA, 19 nt, Homo sapiens
ggauggauguuaugcuaug

SEQ ID NO: 1339355 - RNA, 19 nt, Homo sapiens
gaacaguaguaaauacaac

SEQ ID NO: 1339356 - RNA, 19 nt, Homo sapiens
gacaacggauggauguuau

SEQ ID NO: 1339357 - RNA, 19 nt, Homo sapiens
uaagucugcuauugcuaua

SEQ ID NO: 1339358 - RNA, 19 nt, Homo sapiens
ugaaggaacuugcaucaac

SEQ ID NO: 1339359 - RNA, 19 nt, Homo sapiens
uauaggaacuacacugguu

SEQ ID NO: 1339360 - RNA, 19 nt, Homo sapiens
gaaccaauguaaauuucca

SEQ ID NO: 1339361 - RNA, 19 nt, Homo sapiens
uaaggugguuuacugaguu

SEQ ID NO: 1339362 - RNA, 19 nt, Homo sapiens
caauguaaauuuccaguac

SEQ ID NO: 1339363 - RNA, 19 nt, Homo sapiens
ugagcugucugacguguuu

SEQ ID NO: 1339364 - RNA, 19 nt, Homo sapiens
guaacaaagagcuuaguuu

SEQ ID NO: 1339365 - RNA, 19 nt, Homo sapiens
gaaauuggaggaaccauac

SEQ ID NO: 1339366 - RNA, 19 nt, Homo sapiens
gaagggaggcauuuguguu

SEQ ID NO: 1339367 - RNA, 19 nt, Homo sapiens
gaacugguccaucugacuu

SEQ ID NO: 1339368 - RNA, 19 nt, Homo sapiens
gagcuagugucauggaauc

SEQ ID NO: 1339369 - RNA, 19 nt, Homo sapiens
guaauuagccuugccacuu

SEQ ID NO: 1339370 - RNA, 19 nt, Homo sapiens
gaugacagccuuuagaucu

SEQ ID NO: 1339371 - RNA, 19 nt, Homo sapiens
ggacggaugacagccuuua

SEQ ID NO: 1339372 - RNA, 19 nt, Homo sapiens
gaagaugcaguccaguuug

SEQ ID NO: 1339373 - RNA, 19 nt, Homo sapiens
ugacaacggauggauguua

SEQ ID NO: 1339374 - RNA, 19 nt, Homo sapiens
ggaagccauuguagaagau

SEQ ID NO: 1339375 - RNA, 19 nt, Homo sapiens
gguauuauccaaagagaug

SEQ ID NO: 1339376 - RNA, 19 nt, Homo sapiens
ggacugaaugaaauauuug

SEQ ID NO: 1339377 - RNA, 19 nt, Homo sapiens
gaaggacaucuuuaaggaa

SEQ ID NO: 1339378 - RNA, 19 nt, Homo sapiens
gagaagaugcaguccaguu

SEQ ID NO: 1339379 - RNA, 19 nt, Homo sapiens
ugagugaacugguccaucu

SEQ ID NO: 1339380 - RNA, 19 nt, Homo sapiens
ugaaugcuguagaucugua

SEQ ID NO: 1339381 - RNA, 19 nt, Homo sapiens
gcucguagaccacauuuua

SEQ ID NO: 1339382 - RNA, 19 nt, Homo sapiens
gaccagagaggaaggagaa

SEQ ID NO: 1339383 - RNA, 19 nt, Homo sapiens
uaagaagaaacuacccaua

SEQ ID NO: 1339384 - RNA, 19 nt, Homo sapiens
gaucgacaccugguuacua

SEQ ID NO: 1339385 - RNA, 19 nt, Homo sapiens
cauggaaucuccucacaag

SEQ ID NO: 1339386 - RNA, 19 nt, Homo sapiens
ggaggauuguauuuaggaa

SEQ ID NO: 1339387 - RNA, 19 nt, Homo sapiens
ucaguaagcuucgccaaag

SEQ ID NO: 1339388 - RNA, 19 nt, Homo sapiens
gcaauggaucucucagcua

SEQ ID NO: 1339389 - RNA, 19 nt, Homo sapiens
cacaagaaccaauguaaau

SEQ ID NO: 1339390 - RNA, 19 nt, Homo sapiens
ucacaagaaccaauguaaa

SEQ ID NO: 1339391 - RNA, 19 nt, Homo sapiens
gagcuuaguuuuccuuguu

SEQ ID NO: 1339392 - RNA, 19 nt, Homo sapiens
agaacuagcccuuagaaau

SEQ ID NO: 1339393 - RNA, 19 nt, Homo sapiens
uuugaacgcucagaaauga

SEQ ID NO: 1339394 - RNA, 19 nt, Homo sapiens
guaaauuuccaguacauca

SEQ ID NO: 1339395 - RNA, 19 nt, Homo sapiens
guuuggaacucaucgauag

SEQ ID NO: 1339396 - RNA, 19 nt, Homo sapiens
ggauggaggacuaaagaga

SEQ ID NO: 1339397 - RNA, 19 nt, Homo sapiens
cuucagucaugauguuuaa

SEQ ID NO: 1339398 - RNA, 19 nt, Homo sapiens
aagaaacuacccauacuaa

SEQ ID NO: 1339399 - RNA, 19 nt, Homo sapiens
ucagagagcuauggucaag

SEQ ID NO: 1339400 - RNA, 19 nt, Homo sapiens
gaagggauuggaagccauu

SEQ ID NO: 1339401 - RNA, 19 nt, Homo sapiens
gcugggccaucgucuguga

SEQ ID NO: 1339402 - RNA, 19 nt, Homo sapiens
acaugaagauccuagugaa

SEQ ID NO: 1339403 - RNA, 19 nt, Homo sapiens
gggauuggaagccauugua

SEQ ID NO: 1339404 - RNA, 19 nt, Homo sapiens
cagcuaagaggacggauga

SEQ ID NO: 1339405 - RNA, 19 nt, Homo sapiens
aauacaacauggugagcua

SEQ ID NO: 1339406 - RNA, 19 nt, Homo sapiens
ggaacaguaguaaauacaa

SEQ ID NO: 1339407 - RNA, 19 nt, Homo sapiens
ugaaauuggaggaaccaua

SEQ ID NO: 1339408 - RNA, 19 nt, Homo sapiens
ggaaucuccucacaagaac

SEQ ID NO: 1339409 - RNA, 19 nt, Homo sapiens
uggaagccauuguagaaga

SEQ ID NO: 1339410 - RNA, 19 nt, Homo sapiens
ugagcuaccugcuucgaau

SEQ ID NO: 1339411 - RNA, 19 nt, Homo sapiens
ucucugguaccauucauua

SEQ ID NO: 1339412 - RNA, 19 nt, Homo sapiens
uggcaucacuguggacuga

SEQ ID NO: 1339413 - RNA, 19 nt, Homo sapiens
uacauccaguugcaauuaa

SEQ ID NO: 1339414 - RNA, 19 nt, Homo sapiens
acggauggauguuaugcua

SEQ ID NO: 1339415 - RNA, 19 nt, Homo sapiens
uggaaucuccucacaagaa

SEQ ID NO: 1339416 - RNA, 19 nt, Homo sapiens
gauaggguaauucuccaaa

SEQ ID NO: 1339417 - RNA, 19 nt, Homo sapiens
auacuucagucaugauguu

SEQ ID NO: 1339418 - RNA, 19 nt, Homo sapiens
agaagaaacuacccauacu

SEQ ID NO: 1339419 - RNA, 19 nt, Homo sapiens
acauauugcugauaagaag

SEQ ID NO: 1339420 - RNA, 19 nt, Homo sapiens
ccucaugucugguuugaac

SEQ ID NO: 1339421 - RNA, 19 nt, Homo sapiens
agucaaaguuaaugugugu

SEQ ID NO: 1339422 - RNA, 19 nt, Homo sapiens
aauggaggauuguauuuag

SEQ ID NO: 1339423 - RNA, 19 nt, Homo sapiens
cugcaagguugaaaggaaa

SEQ ID NO: 1339424 - RNA, 19 nt, Homo sapiens
gcaucacuguggacugaau

SEQ ID NO: 1339425 - RNA, 19 nt, Homo sapiens
agaagaugcaguccaguuu

SEQ ID NO: 1339426 - RNA, 19 nt, Homo sapiens
ccaguugcaauuaaguaua

SEQ ID NO: 1339427 - RNA, 19 nt, Homo sapiens
ggaaccauacauccaguug

SEQ ID NO: 1339428 - RNA, 19 nt, Homo sapiens
ugucugacguguuuuauuu

SEQ ID NO: 1339429 - RNA, 19 nt, Homo sapiens
gaagugacccagagguuuu

SEQ ID NO: 1339430 - RNA, 19 nt, Homo sapiens
ucauuaguguguuggaaga

SEQ ID NO: 1339431 - RNA, 19 nt, Homo sapiens
ugaagaagcugguuuauua

SEQ ID NO: 1339432 - RNA, 19 nt, Homo sapiens
gaagaaaccacaagcauuu

SEQ ID NO: 1339433 - RNA, 19 nt, Homo sapiens
caggcuaccucaucaguua

SEQ ID NO: 1339434 - RNA, 19 nt, Homo sapiens
gggaaguggugguggaaua

SEQ ID NO: 1339435 - RNA, 19 nt, Homo sapiens
gcacaggaaugcuuuaaaa

SEQ ID NO: 1339436 - RNA, 19 nt, Homo sapiens
caagaaauccgugguguuu

SEQ ID NO: 1339437 - RNA, 19 nt, Homo sapiens
gcacacugcugcugcucua

SEQ ID NO: 1339438 - RNA, 19 nt, Homo sapiens
gcuacugcgucuuguguua

SEQ ID NO: 1339439 - RNA, 19 nt, Homo sapiens
ggaagaaaccacaagcauu

SEQ ID NO: 1339440 - RNA, 19 nt, Homo sapiens
caagggcucuacuuucuga

SEQ ID NO: 1339441 - RNA, 19 nt, Homo sapiens
gaacaguuuaugcagaaua

SEQ ID NO: 1339442 - RNA, 19 nt, Homo sapiens
cauaaugucucuaaacaag

SEQ ID NO: 1339443 - RNA, 19 nt, Homo sapiens
gaauaagggucaggaguca

SEQ ID NO: 1339444 - RNA, 19 nt, Homo sapiens
gcuaaucagguuacaauuu

SEQ ID NO: 1339445 - RNA, 19 nt, Homo sapiens
guaaacaaacuaccagcua

SEQ ID NO: 1339446 - RNA, 19 nt, Homo sapiens
gugaguagauggauuugga

SEQ ID NO: 1339447 - RNA, 19 nt, Homo sapiens
gauugaagaagcugguuua

SEQ ID NO: 1339448 - RNA, 19 nt, Homo sapiens
uaaauuccauacacuagga

SEQ ID NO: 1339449 - RNA, 19 nt, Homo sapiens
cagcaugguugugccuuua

SEQ ID NO: 1339450 - RNA, 19 nt, Homo sapiens
gaaagacccaugugcuguu

SEQ ID NO: 1339451 - RNA, 19 nt, Homo sapiens
ugaauuagaggauggguuu

SEQ ID NO: 1339452 - RNA, 19 nt, Homo sapiens
aacaguugcuggaauagua

SEQ ID NO: 1339453 - RNA, 19 nt, Homo sapiens
gaaccagccugucgcuuuu

SEQ ID NO: 1339454 - RNA, 19 nt, Homo sapiens
gcucugaaguuggacuaaa

SEQ ID NO: 1339455 - RNA, 19 nt, Homo sapiens
gugagcauauucagcguuu

SEQ ID NO: 1339456 - RNA, 19 nt, Homo sapiens
ccaccaauguguuucuguu

SEQ ID NO: 1339457 - RNA, 19 nt, Homo sapiens
uacauaggcuuggcuguuu

SEQ ID NO: 1339458 - RNA, 19 nt, Homo sapiens
gaagcugguuuauuagaac

SEQ ID NO: 1339459 - RNA, 19 nt, Homo sapiens
ggaaguggugguggaauaa

SEQ ID NO: 1339460 - RNA, 19 nt, Homo sapiens
gcaugguugugccuuuauu

SEQ ID NO: 1339461 - RNA, 19 nt, Homo sapiens
ccagucagguugcauccuu

SEQ ID NO: 1339462 - RNA, 19 nt, Homo sapiens
guacauaggcuuggcuguu

SEQ ID NO: 1339463 - RNA, 19 nt, Homo sapiens
gcacugauuuugauuaaag

SEQ ID NO: 1339464 - RNA, 19 nt, Homo sapiens
aaagugaguagauggauuu

SEQ ID NO: 1339465 - RNA, 19 nt, Homo sapiens
ucucaaugcuggucucguu

SEQ ID NO: 1339466 - RNA, 19 nt, Homo sapiens
agaagcugguuuauuagaa

SEQ ID NO: 1339467 - RNA, 19 nt, Homo sapiens
ccaauguguuucuguuugu

SEQ ID NO: 1339468 - RNA, 19 nt, Homo sapiens
gaagaagcugguuuauuag

SEQ ID NO: 1339469 - RNA, 19 nt, Homo sapiens
gggcuaaucagguuacaau

SEQ ID NO: 1339470 - RNA, 19 nt, Homo sapiens
gcaggaugaucagaaguca

SEQ ID NO: 1339471 - RNA, 19 nt, Homo sapiens
gguuaagacuggagcaaag

SEQ ID NO: 1339472 - RNA, 19 nt, Homo sapiens
ggccugccauugcgaaaga

SEQ ID NO: 1339473 - RNA, 19 nt, Homo sapiens
gagaagggccugccauugc

SEQ ID NO: 1339474 - RNA, 19 nt, Homo sapiens
gaaaccccgucucuacuaa

SEQ ID NO: 1339475 - RNA, 19 nt, Homo sapiens
aauuugagaugguugaaug

SEQ ID NO: 1339476 - RNA, 19 nt, Homo sapiens
gaggauggguuuuaucuca

SEQ ID NO: 1339477 - RNA, 19 nt, Homo sapiens
guagauggauuuggacaac

SEQ ID NO: 1339478 - RNA, 19 nt, Homo sapiens
gaaggagccaugacacagu

SEQ ID NO: 1339479 - RNA, 19 nt, Homo sapiens
ucacagccuucaucugcuu

SEQ ID NO: 1339480 - RNA, 19 nt, Homo sapiens
ggaaacaggagcagaagac

SEQ ID NO: 1339481 - RNA, 19 nt, Homo sapiens
ccaguuaaauuccauacac

SEQ ID NO: 1339482 - RNA, 19 nt, Homo sapiens
ggguggaagggaaauauuu

SEQ ID NO: 1339483 - RNA, 19 nt, Homo sapiens
uaaacaagcgacacucuag

SEQ ID NO: 1339484 - RNA, 19 nt, Homo sapiens
gagcagccaccaauguguu

SEQ ID NO: 1339485 - RNA, 19 nt, Homo sapiens
acagcuaacuaaauuugga

SEQ ID NO: 1339486 - RNA, 19 nt, Homo sapiens
ggagggaguuuucuaucaa

SEQ ID NO: 1339487 - RNA, 19 nt, Homo sapiens
gaaguggugguggaauaaa

SEQ ID NO: 1339488 - RNA, 19 nt, Homo sapiens
gggcucuacuuucugaugu

SEQ ID NO: 1339489 - RNA, 19 nt, Homo sapiens
acacagcuaacuaaauuug

SEQ ID NO: 1339490 - RNA, 19 nt, Homo sapiens
agaaccagccugucgcuuu

SEQ ID NO: 1339491 - RNA, 19 nt, Homo sapiens
gucaaauucugaucaacug

SEQ ID NO: 1339492 - RNA, 19 nt, Homo sapiens
gaagucacggcaccucaug

SEQ ID NO: 1339493 - RNA, 19 nt, Homo sapiens
gugacaggcuaccucauca

SEQ ID NO: 1339494 - RNA, 19 nt, Homo sapiens
gacaacauaaagcaacaaa

SEQ ID NO: 1339495 - RNA, 19 nt, Homo sapiens
uggcagucaugcuguacua

SEQ ID NO: 1339496 - RNA, 19 nt, Homo sapiens
uggagaccauccuggcuaa

SEQ ID NO: 1339497 - RNA, 19 nt, Homo sapiens
ccagcuugcucugaaguug

SEQ ID NO: 1339498 - RNA, 19 nt, Homo sapiens
uuauugagccuucauguca

SEQ ID NO: 1339499 - RNA, 19 nt, Homo sapiens
agccaugccugcaggauga

SEQ ID NO: 1339500 - RNA, 19 nt, Homo sapiens
cacugagacugcacugauu

SEQ ID NO: 1339501 - RNA, 19 nt, Homo sapiens
gggaagaaaccacaagcau

SEQ ID NO: 1339502 - RNA, 19 nt, Homo sapiens
ucagcaugguugugccuuu

SEQ ID NO: 1339503 - RNA, 19 nt, Homo sapiens
ggauuuggacaacauaaag

SEQ ID NO: 1339504 - RNA, 19 nt, Homo sapiens
gacagaacccaguggugaa

SEQ ID NO: 1339505 - RNA, 19 nt, Homo sapiens
guggugaugggaauaguaa

SEQ ID NO: 1339506 - RNA, 19 nt, Homo sapiens
cuaaacaagcgacacucua

SEQ ID NO: 1339507 - RNA, 19 nt, Homo sapiens
aaagacccaugugcuguug

SEQ ID NO: 1339508 - RNA, 19 nt, Homo sapiens
uggcuaucccacugaauua

SEQ ID NO: 1339509 - RNA, 19 nt, Homo sapiens
gaagggaagaaaccacaag

SEQ ID NO: 1339510 - RNA, 19 nt, Homo sapiens
gggcuucuuggauuuguuu

SEQ ID NO: 1339511 - RNA, 19 nt, Homo sapiens
gagcauauucagcguuuac

SEQ ID NO: 1339512 - RNA, 19 nt, Homo sapiens
gcuagagucccggcaggua

SEQ ID NO: 1339513 - RNA, 19 nt, Homo sapiens
augaacaguuuaugcagaa

SEQ ID NO: 1339514 - RNA, 19 nt, Homo sapiens
uuggugggcuucuuggauu

SEQ ID NO: 1339515 - RNA, 19 nt, Homo sapiens
ggugaugggaauaguaaau

SEQ ID NO: 1339516 - RNA, 19 nt, Homo sapiens
cagagaagggccugccauu

SEQ ID NO: 1339517 - RNA, 19 nt, Homo sapiens
cucaagggcucuacuuucu

SEQ ID NO: 1339518 - RNA, 19 nt, Homo sapiens
ccuguaaucccagcacuuu

SEQ ID NO: 1339519 - RNA, 19 nt, Homo sapiens
ccaagaaauccgugguguu

SEQ ID NO: 1339520 - RNA, 19 nt, Homo sapiens
ugaggaaccugcuguuuuc

SEQ ID NO: 1339521 - RNA, 19 nt, Homo sapiens
aaaccgggcaguacagaga

SEQ ID NO: 1339522 - RNA, 19 nt, Homo sapiens
agaaauccgugguguuuug

SEQ ID NO: 1339523 - RNA, 19 nt, Homo sapiens
aaauucugaucaacuggaa

SEQ ID NO: 1339524 - RNA, 19 nt, Homo sapiens
ggaaaggguugggguggaa

SEQ ID NO: 1339525 - RNA, 19 nt, Homo sapiens
gugaugggaauaguaaauu

SEQ ID NO: 1339526 - RNA, 19 nt, Homo sapiens
ggugacaggcuaccucauc

SEQ ID NO: 1339527 - RNA, 19 nt, Homo sapiens
gaaacaggagcagaagaca

SEQ ID NO: 1339528 - RNA, 19 nt, Homo sapiens
ucagugcucugggcuaucu

SEQ ID NO: 1339529 - RNA, 19 nt, Homo sapiens
gccagcggcacccuuauug

SEQ ID NO: 1339530 - RNA, 19 nt, Homo sapiens
accaauguguuucuguuug

SEQ ID NO: 1339531 - RNA, 19 nt, Homo sapiens
gcaaacccaugauaaugua

SEQ ID NO: 1339532 - RNA, 19 nt, Homo sapiens
gaacacagcccuccacaug

SEQ ID NO: 1339533 - RNA, 19 nt, Homo sapiens
ggagcccucuugaugauuu

SEQ ID NO: 1339534 - RNA, 19 nt, Homo sapiens
gagacaggcuggauugugu

SEQ ID NO: 1339535 - RNA, 19 nt, Homo sapiens
gagcucacaugcuggcuuu

SEQ ID NO: 1339536 - RNA, 19 nt, Homo sapiens
gcuggacccuggagaguuu

SEQ ID NO: 1339537 - RNA, 19 nt, Homo sapiens
cgccaggccuguccucuua

SEQ ID NO: 1339538 - RNA, 19 nt, Homo sapiens
gcaaaugggugcuaaucac

SEQ ID NO: 1339539 - RNA, 19 nt, Homo sapiens
gaacaggccccaauauuug

SEQ ID NO: 1339540 - RNA, 19 nt, Homo sapiens
gccaggagaucaagagcaa

SEQ ID NO: 1339541 - RNA, 19 nt, Homo sapiens
guaccggcgucuugacauu

SEQ ID NO: 1339542 - RNA, 19 nt, Homo sapiens
ggaccuuugucaacaugaa

SEQ ID NO: 1339543 - RNA, 19 nt, Homo sapiens
caacgcaaaccgugaagaa

SEQ ID NO: 1339544 - RNA, 19 nt, Homo sapiens
ggacagccagcguaugcua

SEQ ID NO: 1339545 - RNA, 19 nt, Homo sapiens
ccauugggguuuuacauua

SEQ ID NO: 1339546 - RNA, 19 nt, Homo sapiens
caagccuucuggcaugaaa

SEQ ID NO: 1339547 - RNA, 19 nt, Homo sapiens
uaauguauguggaauaucc

SEQ ID NO: 1339548 - RNA, 19 nt, Homo sapiens
gaauguggguguguuugag

SEQ ID NO: 1339549 - RNA, 19 nt, Homo sapiens
acaagacaguucugcacuu

SEQ ID NO: 1339550 - RNA, 19 nt, Homo sapiens
ucagggacguucggucuug

SEQ ID NO: 1339551 - RNA, 19 nt, Homo sapiens
gagaucaagagcaacaaga

SEQ ID NO: 1339552 - RNA, 19 nt, Homo sapiens
uguggaauauccugccauu

SEQ ID NO: 1339553 - RNA, 19 nt, Homo sapiens
caugaaacgcugagaagau

SEQ ID NO: 1339554 - RNA, 19 nt, Homo sapiens
ugcgcaaccuggagaauga

SEQ ID NO: 1339555 - RNA, 19 nt, Homo sapiens
gaucaagagcaacaagaca

SEQ ID NO: 1339556 - RNA, 19 nt, Homo sapiens
agaaugagcagcccguuca

SEQ ID NO: 1339557 - RNA, 19 nt, Homo sapiens
gcaugaaacgcugagaaga

SEQ ID NO: 1339558 - RNA, 19 nt, Homo sapiens
cauccuggcccuuaacguu

SEQ ID NO: 1339559 - RNA, 19 nt, Homo sapiens
aaggagcccucuugaugau

SEQ ID NO: 1339560 - RNA, 19 nt, Homo sapiens
ggagaccugcggaccuuug

SEQ ID NO: 1339561 - RNA, 19 nt, Homo sapiens
cugaggugcuccaggugua

SEQ ID NO: 1339562 - RNA, 19 nt, Homo sapiens
ugaacaggccccaauauuu

SEQ ID NO: 1339563 - RNA, 19 nt, Homo sapiens
gccagcguaugcuaauguu

SEQ ID NO: 1339564 - RNA, 19 nt, Homo sapiens
caaaugggugcuaaucaca

SEQ ID NO: 1339565 - RNA, 19 nt, Homo sapiens
gauuguggaggaucuguug

SEQ ID NO: 1339566 - RNA, 19 nt, Homo sapiens
uggaauauccugccauugg

SEQ ID NO: 1339567 - RNA, 19 nt, Homo sapiens
gcggaccuuugucaacaug

SEQ ID NO: 1339568 - RNA, 19 nt, Homo sapiens
augaaacgcugagaagaug

SEQ ID NO: 1339569 - RNA, 19 nt, Homo sapiens
caugauaauguauguggaa

SEQ ID NO: 1339570 - RNA, 19 nt, Homo sapiens
ccaaugccgcugaccauca

SEQ ID NO: 1339571 - RNA, 19 nt, Homo sapiens
cgaggccccuugauuguuu

SEQ ID NO: 1339572 - RNA, 19 nt, Homo sapiens
ugaauguggguguguuuga

SEQ ID NO: 1339573 - RNA, 19 nt, Homo sapiens
aaaugaauguggguguguu

SEQ ID NO: 1339574 - RNA, 19 nt, Homo sapiens
guugcaaacccaugauaau

SEQ ID NO: 1339575 - RNA, 19 nt, Homo sapiens
gacagccagcguaugcuaa

SEQ ID NO: 1339576 - RNA, 19 nt, Homo sapiens
uggaggaucuguugaaccu

SEQ ID NO: 1339577 - RNA, 19 nt, Homo sapiens
gaccugcggaccuuuguca

SEQ ID NO: 1339578 - RNA, 19 nt, Homo sapiens
caagagcaacaagacaguu

SEQ ID NO: 1339579 - RNA, 19 nt, Homo sapiens
ggagaucaagagcaacaag

SEQ ID NO: 1339580 - RNA, 19 nt, Homo sapiens
uaauguugcaaacccauga

SEQ ID NO: 1339581 - RNA, 19 nt, Homo sapiens
cugcggaccuuugucaaca

SEQ ID NO: 1339582 - RNA, 19 nt, Homo sapiens
ugacauucgugagcauaag

SEQ ID NO: 1339583 - RNA, 19 nt, Homo sapiens
acacgcuccuucaccuguu

SEQ ID NO: 1339584 - RNA, 19 nt, Homo sapiens
ggcaugaaacgcugagaag

SEQ ID NO: 1339585 - RNA, 19 nt, Homo sapiens
ugcaaacccaugauaaugu

SEQ ID NO: 1339586 - RNA, 19 nt, Homo sapiens
caggagaucaagagcaaca

SEQ ID NO: 1339587 - RNA, 19 nt, Homo sapiens
gcccaacgcaaaccgugaa

SEQ ID NO: 1339588 - RNA, 19 nt, Homo sapiens
uauuuggggugcugugaua

SEQ ID NO: 1339589 - RNA, 19 nt, Homo sapiens
cauugggguuuuacauuaa

SEQ ID NO: 1339590 - RNA, 19 nt, Homo sapiens
uaaaugaaugugggugugu

SEQ ID NO: 1339591 - RNA, 19 nt, Homo sapiens
ggagggaggugcuaaaguc

SEQ ID NO: 1339592 - RNA, 19 nt, Homo sapiens
ccagggagaugcaggauga

SEQ ID NO: 1339593 - RNA, 19 nt, Homo sapiens
guaggaggguggccagauu

SEQ ID NO: 1339594 - RNA, 19 nt, Homo sapiens
caagaggagucagagauga

SEQ ID NO: 1339595 - RNA, 19 nt, Homo sapiens
gaaguuguuguuuaucuga

SEQ ID NO: 1339596 - RNA, 19 nt, Homo sapiens
gacacaggguggccucaaa

SEQ ID NO: 1339597 - RNA, 19 nt, Homo sapiens
gagcagagaacacauggau

SEQ ID NO: 1339598 - RNA, 19 nt, Homo sapiens
agaauucgguggccucaga

SEQ ID NO: 1339599 - RNA, 19 nt, Homo sapiens
acacagggcauucgguuaa

SEQ ID NO: 1339600 - RNA, 19 nt, Homo sapiens
agggugagcuucuguccua

SEQ ID NO: 1339601 - RNA, 19 nt, Homo sapiens
gcauucgguuaauuucaga

SEQ ID NO: 1339602 - RNA, 19 nt, Homo sapiens
gaugagaacacagggcauu

SEQ ID NO: 1339603 - RNA, 19 nt, Homo sapiens
ggaggucauuuuacuaaga

SEQ ID NO: 1339604 - RNA, 19 nt, Homo sapiens
ugacaugugccugguguuu

SEQ ID NO: 1339605 - RNA, 19 nt, Homo sapiens
cauggaugcagcaccaaua

SEQ ID NO: 1339606 - RNA, 19 nt, Homo sapiens
gggccugucccaucauuug

SEQ ID NO: 1339607 - RNA, 19 nt, Homo sapiens
ccaagaggagucagagaug

SEQ ID NO: 1339608 - RNA, 19 nt, Homo sapiens
cagggcauucgguuaauuu

SEQ ID NO: 1339609 - RNA, 19 nt, Homo sapiens
acaugugccugguguuugu

SEQ ID NO: 1339610 - RNA, 19 nt, Homo sapiens
ggaugcagcaccaauaaaa

SEQ ID NO: 1339611 - RNA, 19 nt, Homo sapiens
ggcauucgguuaauuucag

SEQ ID NO: 1339612 - RNA, 19 nt, Homo sapiens
gaggucauuuuacuaagaa

SEQ ID NO: 1339613 - RNA, 19 nt, Homo sapiens
guggccagauucacagaug

SEQ ID NO: 1339614 - RNA, 19 nt, Homo sapiens
gaggguggccagauucaca

SEQ ID NO: 1339615 - RNA, 19 nt, Homo sapiens
gccaagaggagucagagau

SEQ ID NO: 1339616 - RNA, 19 nt, Homo sapiens
acagggcauucgguuaauu

SEQ ID NO: 1339617 - RNA, 19 nt, Homo sapiens
ggacgucagauccgcauac

SEQ ID NO: 1339618 - RNA, 19 nt, Homo sapiens
agaaguuguuguuuaucug

SEQ ID NO: 1339619 - RNA, 19 nt, Homo sapiens
caacgucggcaccaucucu

SEQ ID NO: 1339620 - RNA, 19 nt, Homo sapiens
ggacacaggguggccucaa

SEQ ID NO: 1339621 - RNA, 19 nt, Homo sapiens
gacaugugccugguguuug

SEQ ID NO: 1339622 - RNA, 19 nt, Homo sapiens
ggggaggucauuuuacuaa

SEQ ID NO: 1339623 - RNA, 19 nt, Homo sapiens
uaauuucagacaggcaaua

SEQ ID NO: 1339624 - RNA, 19 nt, Homo sapiens
gcugugaggacgucagauc

SEQ ID NO: 1339625 - RNA, 19 nt, Homo sapiens
gggcauucgguuaauuuca

SEQ ID NO: 1339626 - RNA, 19 nt, Homo sapiens
gcugagcagagaacacaug

SEQ ID NO: 1339627 - RNA, 19 nt, Homo sapiens
cugaggauccagccaguga

SEQ ID NO: 1339628 - RNA, 19 nt, Homo sapiens
gccugguguuuguagcuuu

SEQ ID NO: 1339629 - RNA, 19 nt, Homo sapiens
uggccagauucacagauga

SEQ ID NO: 1339630 - RNA, 19 nt, Homo sapiens
caaggacucuggauaauug

SEQ ID NO: 1339631 - RNA, 19 nt, Homo sapiens
gaucugaacugccuuguca

SEQ ID NO: 1339632 - RNA, 19 nt, Homo sapiens
gaucaaggacucuggauaa

SEQ ID NO: 1339633 - RNA, 19 nt, Homo sapiens
gguaaugccuguaagaaug

SEQ ID NO: 1339634 - RNA, 19 nt, Homo sapiens
ggcauaacauccuggaaua

SEQ ID NO: 1339635 - RNA, 19 nt, Homo sapiens
ugccauaaaugcucaauaa

SEQ ID NO: 1339636 - RNA, 19 nt, Homo sapiens
gaaggagucugagaagaug

SEQ ID NO: 1339637 - RNA, 19 nt, Homo sapiens
cagcaggccuugucucuga

SEQ ID NO: 1339638 - RNA, 19 nt, Homo sapiens
guccaaauauagucacaua

SEQ ID NO: 1339639 - RNA, 19 nt, Homo sapiens
ucacauacauuugaccauu

SEQ ID NO: 1339640 - RNA, 19 nt, Homo sapiens
guauacacguuuaaugaga

SEQ ID NO: 1339641 - RNA, 19 nt, Homo sapiens
gcuguccucuguugucuuu

SEQ ID NO: 1339642 - RNA, 19 nt, Homo sapiens
gcgcagccauagacaacua

SEQ ID NO: 1339643 - RNA, 19 nt, Homo sapiens
aaaugucccuagcucuuua

SEQ ID NO: 1339644 - RNA, 19 nt, Homo sapiens
gccaaccuaugaauguaua

SEQ ID NO: 1339645 - RNA, 19 nt, Homo sapiens
gagcaggagcgcccucuuu

SEQ ID NO: 1339646 - RNA, 19 nt, Homo sapiens
gcggaaggcugagaaggaa

SEQ ID NO: 1339647 - RNA, 19 nt, Homo sapiens
ucacccagcuggaggaaga

SEQ ID NO: 1339648 - RNA, 19 nt, Homo sapiens
cacauacauuugaccauuu

SEQ ID NO: 1339649 - RNA, 19 nt, Homo sapiens
ccaaauauagucacauaca

SEQ ID NO: 1339650 - RNA, 19 nt, Homo sapiens
guaagaaugccauaaaugc

SEQ ID NO: 1339651 - RNA, 19 nt, Homo sapiens
gagcuugagcgcagccaua

SEQ ID NO: 1339652 - RNA, 19 nt, Homo sapiens
caucaguauugucugcuuu

SEQ ID NO: 1339653 - RNA, 19 nt, Homo sapiens
ggucuucuauccugguguu

SEQ ID NO: 1339654 - RNA, 19 nt, Homo sapiens
gaagaggcggugcagaaug

SEQ ID NO: 1339655 - RNA, 19 nt, Homo sapiens
uaucagucccuuguauuua

SEQ ID NO: 1339656 - RNA, 19 nt, Homo sapiens
agaaggaacagcugaguga

SEQ ID NO: 1339657 - RNA, 19 nt, Homo sapiens
agauggcgcugucagagaa

SEQ ID NO: 1339658 - RNA, 19 nt, Homo sapiens
gucccuagcucuuuacuac

SEQ ID NO: 1339659 - RNA, 19 nt, Homo sapiens
aacaucaucugaaucauca

SEQ ID NO: 1339660 - RNA, 19 nt, Homo sapiens
ucacgccugccacaaguua

SEQ ID NO: 1339661 - RNA, 19 nt, Homo sapiens
ggagauggagcggcagaaa

SEQ ID NO: 1339662 - RNA, 19 nt, Homo sapiens
ggaagaggcggugcagaau

SEQ ID NO: 1339663 - RNA, 19 nt, Homo sapiens
caggacaaguuggaucuga

SEQ ID NO: 1339664 - RNA, 19 nt, Homo sapiens
uaacaucaucugaaucauc

SEQ ID NO: 1339665 - RNA, 19 nt, Homo sapiens
ugaaggagucugagaagau

SEQ ID NO: 1339666 - RNA, 19 nt, Homo sapiens
gcucuuuacuacaucagau

SEQ ID NO: 1339667 - RNA, 19 nt, Homo sapiens
gaaaaugucccuagcucuu

SEQ ID NO: 1339668 - RNA, 19 nt, Homo sapiens
gcugaaacagagauauuau

SEQ ID NO: 1339669 - RNA, 19 nt, Homo sapiens
uaaaagugcuggugacaag

SEQ ID NO: 1339670 - RNA, 19 nt, Homo sapiens
cuaugaauguauacacguu

SEQ ID NO: 1339671 - RNA, 19 nt, Homo sapiens
uaagguaaugccuguaaga

SEQ ID NO: 1339672 - RNA, 19 nt, Homo sapiens
aauaagguaaugccuguaa

SEQ ID NO: 1339673 - RNA, 19 nt, Homo sapiens
ucucugcuguccucuguug

SEQ ID NO: 1339674 - RNA, 19 nt, Homo sapiens
ucaaggacucuggauaauu

SEQ ID NO: 1339675 - RNA, 19 nt, Homo sapiens
uggaggagcugugguugga

SEQ ID NO: 1339676 - RNA, 19 nt, Homo sapiens
uagcugaaacagagauauu

SEQ ID NO: 1339677 - RNA, 19 nt, Homo sapiens
ccuuaucagucccuuguau

SEQ ID NO: 1339678 - RNA, 19 nt, Homo sapiens
ccuguaagaaugccauaaa

SEQ ID NO: 1339679 - RNA, 19 nt, Homo sapiens
gaaugccuaucuuccuuuu

SEQ ID NO: 1339680 - RNA, 19 nt, Homo sapiens
aagaggcggugcagaaugg

SEQ ID NO: 1339681 - RNA, 19 nt, Homo sapiens
gcuggugacaagaguguaa

SEQ ID NO: 1339682 - RNA, 19 nt, Homo sapiens
cuggauaauuggcauaaca

SEQ ID NO: 1339683 - RNA, 19 nt, Homo sapiens
ggaaggcugagaaggaaca

SEQ ID NO: 1339684 - RNA, 19 nt, Homo sapiens
uggccaaccuaugaaugua

SEQ ID NO: 1339685 - RNA, 19 nt, Homo sapiens
aguaacaucaucugaauca

SEQ ID NO: 1339686 - RNA, 19 nt, Homo sapiens
uuaucagucccuuguauuu

SEQ ID NO: 1339687 - RNA, 19 nt, Homo sapiens
cgucauaguccuuaucagu

SEQ ID NO: 1339688 - RNA, 19 nt, Homo sapiens
ggaauagcugaaacagaga

SEQ ID NO: 1339689 - RNA, 19 nt, Homo sapiens
ugaaucaucaguauugucu

SEQ ID NO: 1339690 - RNA, 19 nt, Homo sapiens
gagcgcagccauagacaac

SEQ ID NO: 1339691 - RNA, 19 nt, Homo sapiens
uguaagaaugccauaaaug

SEQ ID NO: 1339692 - RNA, 19 nt, Homo sapiens
cuguaagaaugccauaaau

SEQ ID NO: 1339693 - RNA, 19 nt, Homo sapiens
uugaaugccuaucuuccuu

SEQ ID NO: 1339694 - RNA, 19 nt, Homo sapiens
aggaagaggcggugcagaa

SEQ ID NO: 1339695 - RNA, 19 nt, Homo sapiens
aggaggcgcuggagcaaca

SEQ ID NO: 1339696 - RNA, 19 nt, Homo sapiens
gaagguccagggagaagag

SEQ ID NO: 1339697 - RNA, 19 nt, Homo sapiens
gaauagcugaaacagagau

SEQ ID NO: 1339698 - RNA, 19 nt, Homo sapiens
aucaaagccuucagggaaa

SEQ ID NO: 1339699 - RNA, 19 nt, Homo sapiens
ggcggaaggcugagaagga

SEQ ID NO: 1339700 - RNA, 19 nt, Homo sapiens
ggacaaguuggaucugaac

SEQ ID NO: 1339701 - RNA, 19 nt, Homo sapiens
gcauaacauccuggaauag

SEQ ID NO: 1339702 - RNA, 19 nt, Homo sapiens
uggcauaacauccuggaau

SEQ ID NO: 1339703 - RNA, 19 nt, Homo sapiens
ugaaugccuaucuuccuuu

SEQ ID NO: 1339704 - RNA, 19 nt, Homo sapiens
ggaggaagagcaggaagag

SEQ ID NO: 1339705 - RNA, 19 nt, Homo sapiens
ggucacccuccaucucuga

SEQ ID NO: 1339706 - RNA, 19 nt, Homo sapiens
ucucacgccugccacaagu

SEQ ID NO: 1339707 - RNA, 19 nt, Homo sapiens
cauguaucguggcagaugu

SEQ ID NO: 1339708 - RNA, 19 nt, Homo sapiens
aggacaaguuggaucugaa

SEQ ID NO: 1339709 - RNA, 19 nt, Homo sapiens
cugaaggagucugagaaga

SEQ ID NO: 1339710 - RNA, 19 nt, Homo sapiens
ggauaauuggcauaacauc

SEQ ID NO: 1339711 - RNA, 19 nt, Homo sapiens
cccuagcucuuuacuacau

SEQ ID NO: 1339712 - RNA, 19 nt, Homo sapiens
guucugcuauuuuacaaug

SEQ ID NO: 1339713 - RNA, 19 nt, Homo sapiens
gccauaaaugcucaauaau

SEQ ID NO: 1339714 - RNA, 19 nt, Homo sapiens
uguccucuguugucuuugu

SEQ ID NO: 1339715 - RNA, 19 nt, Homo sapiens
agaucaaggacucuggaua

SEQ ID NO: 1339716 - RNA, 19 nt, Homo sapiens
ggccaaccuaugaauguau

SEQ ID NO: 1339717 - RNA, 19 nt, Homo sapiens
ucaucaguauugucugcuu

SEQ ID NO: 1339718 - RNA, 19 nt, Homo sapiens
uuucaucaguaacaucauc

SEQ ID NO: 1339719 - RNA, 19 nt, Homo sapiens
gaacuugccuacaaaugga

SEQ ID NO: 1339720 - RNA, 19 nt, Homo sapiens
ggaagaugauggagauuug

SEQ ID NO: 1339721 - RNA, 19 nt, Homo sapiens
ccgaguaucugaagcguua

SEQ ID NO: 1339722 - RNA, 19 nt, Homo sapiens
ccaaggagaacaagaauaa

SEQ ID NO: 1339723 - RNA, 19 nt, Homo sapiens
ggaggaacuugccuacaaa

SEQ ID NO: 1339724 - RNA, 19 nt, Homo sapiens
aaagaaggcugcacacaug

SEQ ID NO: 1339725 - RNA, 19 nt, Homo sapiens
gaacagcaaauaugaguau

SEQ ID NO: 1339726 - RNA, 19 nt, Homo sapiens
caaagaacagcaaauauga

SEQ ID NO: 1339727 - RNA, 19 nt, Homo sapiens
gcaccaggauucugauuca

SEQ ID NO: 1339728 - RNA, 19 nt, Homo sapiens
caaggaggccucagcauaa

SEQ ID NO: 1339729 - RNA, 19 nt, Homo sapiens
gaaugcggauuguggauga

SEQ ID NO: 1339730 - RNA, 19 nt, Homo sapiens
ccagaaggguccauaacaa

SEQ ID NO: 1339731 - RNA, 19 nt, Homo sapiens
ccagaucccucuccuccua

SEQ ID NO: 1339732 - RNA, 19 nt, Homo sapiens
cgagauaagucuggucgua

SEQ ID NO: 1339733 - RNA, 19 nt, Homo sapiens
cgucaugguuccucagaua

SEQ ID NO: 1339734 - RNA, 19 nt, Homo sapiens
gggcauaggcagcgagaua

SEQ ID NO: 1339735 - RNA, 19 nt, Homo sapiens
gaaagaaggcugcacacau

SEQ ID NO: 1339736 - RNA, 19 nt, Homo sapiens
ccaaagaacagcaaauaug

SEQ ID NO: 1339737 - RNA, 19 nt, Homo sapiens
ccaaggaggccucagcaua

SEQ ID NO: 1339738 - RNA, 19 nt, Homo sapiens
gagaguccgucaugauuca

SEQ ID NO: 1339739 - RNA, 19 nt, Homo sapiens
ggacagcuaucuccacaac

SEQ ID NO: 1339740 - RNA, 19 nt, Homo sapiens
caaauggaguguugaggau

SEQ ID NO: 1339741 - RNA, 19 nt, Homo sapiens
uaagagaacaggaaagaga

SEQ ID NO: 1339742 - RNA, 19 nt, Homo sapiens
uggcagaguuuguggauga

SEQ ID NO: 1339743 - RNA, 19 nt, Homo sapiens
cagaagagguaaagcagau

SEQ ID NO: 1339744 - RNA, 19 nt, Homo sapiens
gaccugauguuuggacuga

SEQ ID NO: 1339745 - RNA, 19 nt, Homo sapiens
aagcauugauuucucauug

SEQ ID NO: 1339746 - RNA, 19 nt, Homo sapiens
ccaauggauuugaacagaa

SEQ ID NO: 1339747 - RNA, 19 nt, Homo sapiens
agagagagaugagcuguau

SEQ ID NO: 1339748 - RNA, 19 nt, Homo sapiens
aagaaaccauggcauuuga

SEQ ID NO: 1339749 - RNA, 19 nt, Homo sapiens
ggaggacucuuggcucuuc

SEQ ID NO: 1339750 - RNA, 19 nt, Homo sapiens
uggaggaacuugccuacaa

SEQ ID NO: 1339751 - RNA, 19 nt, Homo sapiens
caagaaaccauggcauuug

SEQ ID NO: 1339752 - RNA, 19 nt, Homo sapiens
gguguuaacugacauacag

SEQ ID NO: 1339753 - RNA, 19 nt, Homo sapiens
gcaaugaaagagaugcaaa

SEQ ID NO: 1339754 - RNA, 19 nt, Homo sapiens
acgaagaccuacccucaaa

SEQ ID NO: 1339755 - RNA, 19 nt, Homo sapiens
gcaagacuucuccacauug

SEQ ID NO: 1339756 - RNA, 19 nt, Homo sapiens
gcaagggaaugcggauugu

SEQ ID NO: 1339757 - RNA, 19 nt, Homo sapiens
gagauaagucuggucguaa

SEQ ID NO: 1339758 - RNA, 19 nt, Homo sapiens
caaggaacaggaucaagaa

SEQ ID NO: 1339759 - RNA, 19 nt, Homo sapiens
ggagacagaggaccaaauc

SEQ ID NO: 1339760 - RNA, 19 nt, Homo sapiens
ccagaaagcaacugauuca

SEQ ID NO: 1339761 - RNA, 19 nt, Homo sapiens
caaaggugacugccagaaa

SEQ ID NO: 1339762 - RNA, 19 nt, Homo sapiens
gcuaagagaacaggaaaga

SEQ ID NO: 1339763 - RNA, 19 nt, Homo sapiens
gauuguggaugaugaugug

SEQ ID NO: 1339764 - RNA, 19 nt, Homo sapiens
gaagaccuacccucaaaca

SEQ ID NO: 1339765 - RNA, 19 nt, Homo sapiens
ggaacuugccuacaaaugg

SEQ ID NO: 1339766 - RNA, 19 nt, Homo sapiens
agaauaaggccaaggagaa

SEQ ID NO: 1339767 - RNA, 19 nt, Homo sapiens
acgaagaucuggauaggau

SEQ ID NO: 1339768 - RNA, 19 nt, Homo sapiens
agaggaagaugauggagau

SEQ ID NO: 1339769 - RNA, 19 nt, Homo sapiens
ucaagaaaccauggcauuu

SEQ ID NO: 1339770 - RNA, 19 nt, Homo sapiens
ucaaggaacaggaucaaga

SEQ ID NO: 1339771 - RNA, 19 nt, Homo sapiens
cgucaugacuccucagaca

SEQ ID NO: 1339772 - RNA, 19 nt, Homo sapiens
ggaagaggaagaugaugga

SEQ ID NO: 1339773 - RNA, 19 nt, Homo sapiens
uuuaauaucuggccuggau

SEQ ID NO: 1339774 - RNA, 19 nt, Homo sapiens
ggucguaagaggaauuuga

SEQ ID NO: 1339775 - RNA, 19 nt, Homo sapiens
gagaacagcaggagcucaa

SEQ ID NO: 1339776 - RNA, 19 nt, Homo sapiens
ccaggaggauccgucauga

SEQ ID NO: 1339777 - RNA, 19 nt, Homo sapiens
gauauccagugguaacagu

SEQ ID NO: 1339778 - RNA, 19 nt, Homo sapiens
uggauaggaugcuaagaga

SEQ ID NO: 1339779 - RNA, 19 nt, Homo sapiens
ggaggaagaggaagaugau

SEQ ID NO: 1339780 - RNA, 19 nt, Homo sapiens
ggaacaggaucaagaaacc

SEQ ID NO: 1339781 - RNA, 19 nt, Homo sapiens
gaaggcugcacacauguau

SEQ ID NO: 1339782 - RNA, 19 nt, Homo sapiens
aaaggugacugccagaaag

SEQ ID NO: 1339783 - RNA, 19 nt, Homo sapiens
uagcaagacuucuccacau

SEQ ID NO: 1339784 - RNA, 19 nt, Homo sapiens
gaggaagcauugauuucuc

SEQ ID NO: 1339785 - RNA, 19 nt, Homo sapiens
caauggauuugaacagaag

SEQ ID NO: 1339786 - RNA, 19 nt, Homo sapiens
gcaaaggaggaaagcagaa

SEQ ID NO: 1339787 - RNA, 19 nt, Homo sapiens
caagacuucuccacauugg

SEQ ID NO: 1339788 - RNA, 19 nt, Homo sapiens
uguggaggaugcaaugaaa

SEQ ID NO: 1339789 - RNA, 19 nt, Homo sapiens
caaccaaacuagaaaagga

SEQ ID NO: 1339790 - RNA, 19 nt, Homo sapiens
ugaccaggguuuguucuug

SEQ ID NO: 1339791 - RNA, 19 nt, Homo sapiens
ucagaggaagcauugauuu

SEQ ID NO: 1339792 - RNA, 19 nt, Homo sapiens
caaaggaggaaagcagaaa

SEQ ID NO: 1339793 - RNA, 19 nt, Homo sapiens
gacagaggaccaaaucuuc

SEQ ID NO: 1339794 - RNA, 19 nt, Homo sapiens
guaugacccugacaucucu

SEQ ID NO: 1339795 - RNA, 19 nt, Homo sapiens
gccuacaaauggaguguug

SEQ ID NO: 1339796 - RNA, 19 nt, Homo sapiens
caagaaggcaguggaggaa

SEQ ID NO: 1339797 - RNA, 19 nt, Homo sapiens
ccucccaacagauuuaaua

SEQ ID NO: 1339798 - RNA, 19 nt, Homo sapiens
gcagcuugauuccaaaggu

SEQ ID NO: 1339799 - RNA, 19 nt, Homo sapiens
gagccucccauuugucauu

SEQ ID NO: 1339800 - RNA, 19 nt, Homo sapiens
ugauuuggcuccuaauguc

SEQ ID NO: 1339801 - RNA, 19 nt, Homo sapiens
ggagaguccgucaugauuc

SEQ ID NO: 1339802 - RNA, 19 nt, Homo sapiens
cuccuaaugucacuuauuc

SEQ ID NO: 1339803 - RNA, 19 nt, Homo sapiens
ucaggugcaucuccuagga

SEQ ID NO: 1339804 - RNA, 19 nt, Homo sapiens
ggaggccucagcauaauuc

SEQ ID NO: 1339805 - RNA, 19 nt, Homo sapiens
gauaggaugcuaagagaac

SEQ ID NO: 1339806 - RNA, 19 nt, Homo sapiens
uaagaggaauuugaaacuc

SEQ ID NO: 1339807 - RNA, 19 nt, Homo sapiens
ugacgaagaucuggauagg

SEQ ID NO: 1339808 - RNA, 19 nt, Homo sapiens
cuauauugaugacgaagau

SEQ ID NO: 1339809 - RNA, 19 nt, Homo sapiens
gaggaugcaaugaaagaga

SEQ ID NO: 1339810 - RNA, 19 nt, Homo sapiens
guaagaggaauuugaaacu

SEQ ID NO: 1339811 - RNA, 19 nt, Homo sapiens
ggcauuugaagcugaauuu

SEQ ID NO: 1339812 - RNA, 19 nt, Homo sapiens
ggaaagaaggcugcacaca

SEQ ID NO: 1339813 - RNA, 19 nt, Homo sapiens
agacagaggaccaaaucuu

SEQ ID NO: 1339814 - RNA, 19 nt, Homo sapiens
acucuuggcucuucagaca

SEQ ID NO: 1339815 - RNA, 19 nt, Homo sapiens
gcauugauuucucauugac

SEQ ID NO: 1339816 - RNA, 19 nt, Homo sapiens
gaagcauugauuucucauu

SEQ ID NO: 1339817 - RNA, 19 nt, Homo sapiens
ccacacagaccagcaacuu

SEQ ID NO: 1339818 - RNA, 19 nt, Homo sapiens
agcgagauauccaguggua

SEQ ID NO: 1339819 - RNA, 19 nt, Homo sapiens
gaauaugccuucagucuuu

SEQ ID NO: 1339820 - RNA, 19 nt, Homo sapiens
gcacaauacuuggcaguua

SEQ ID NO: 1339821 - RNA, 19 nt, Homo sapiens
gagcagaaccuucagaaua

SEQ ID NO: 1339822 - RNA, 19 nt, Homo sapiens
caacuaaucuuucccauca

SEQ ID NO: 1339823 - RNA, 19 nt, Homo sapiens
gagcagggcuucaccauug

SEQ ID NO: 1339824 - RNA, 19 nt, Homo sapiens
ggaaauggaccaagaauau

SEQ ID NO: 1339825 - RNA, 19 nt, Homo sapiens
ggaagaagcuaagauacuu

SEQ ID NO: 1339826 - RNA, 19 nt, Homo sapiens
auacaucucucuccaauuu

SEQ ID NO: 1339827 - RNA, 19 nt, Homo sapiens
gagaagaauucguacaguu

SEQ ID NO: 1339828 - RNA, 19 nt, Homo sapiens
ggaaggagaagaauucgua

SEQ ID NO: 1339829 - RNA, 19 nt, Homo sapiens
gauaucaucuuucucugaa

SEQ ID NO: 1339830 - RNA, 19 nt, Homo sapiens
gaaggcagguugcaacuag

SEQ ID NO: 1339831 - RNA, 19 nt, Homo sapiens
uaagaugaguuuccaagaa

SEQ ID NO: 1339832 - RNA, 19 nt, Homo sapiens
ggacagacucuuccaacua

SEQ ID NO: 1339833 - RNA, 19 nt, Homo sapiens
aggaagaccuggaauauga

SEQ ID NO: 1339834 - RNA, 19 nt, Homo sapiens
ccaagaaguucagcgguua

SEQ ID NO: 1339835 - RNA, 19 nt, Homo sapiens
ggagaaacaucuggaagga

SEQ ID NO: 1339836 - RNA, 19 nt, Homo sapiens
gaauagagaaaccuaaaga

SEQ ID NO: 1339837 - RNA, 19 nt, Homo sapiens
agcagaaccuucagaauaa

SEQ ID NO: 1339838 - RNA, 19 nt, Homo sapiens
gaaggaugcucgagagaac

SEQ ID NO: 1339839 - RNA, 19 nt, Homo sapiens
ccaacuauguggagaacaa

SEQ ID NO: 1339840 - RNA, 19 nt, Homo sapiens
caaaggagcacuaccacuu

SEQ ID NO: 1339841 - RNA, 19 nt, Homo sapiens
ccaagaauaugccuucagu

SEQ ID NO: 1339842 - RNA, 19 nt, Homo sapiens
cacaauacuuggcaguuaa

SEQ ID NO: 1339843 - RNA, 19 nt, Homo sapiens
gcaguuaagccguguguau

SEQ ID NO: 1339844 - RNA, 19 nt, Homo sapiens
ggaagcagaaccugaguug

SEQ ID NO: 1339845 - RNA, 19 nt, Homo sapiens
gaagcugacucugcuggaa

SEQ ID NO: 1339846 - RNA, 19 nt, Homo sapiens
gcuggaagaagcuaagaua

SEQ ID NO: 1339847 - RNA, 19 nt, Homo sapiens
ccgcccagcuuccaucuuu

SEQ ID NO: 1339848 - RNA, 19 nt, Homo sapiens
cagcuuccaucuuugugua

SEQ ID NO: 1339849 - RNA, 19 nt, Homo sapiens
caaggaggcuggcaaugag

SEQ ID NO: 1339850 - RNA, 19 nt, Homo sapiens
cagcaaagauuagggaaag

SEQ ID NO: 1339851 - RNA, 19 nt, Homo sapiens
agagaaaccuaaagaagca

SEQ ID NO: 1339852 - RNA, 19 nt, Homo sapiens
gacagacucuuccaacuac

SEQ ID NO: 1339853 - RNA, 19 nt, Homo sapiens
ccaagcgccucaucaagga

SEQ ID NO: 1339854 - RNA, 19 nt, Homo sapiens
ucagcuaccucugcucuaa

SEQ ID NO: 1339855 - RNA, 19 nt, Homo sapiens
gaaauggaccaagaauaug

SEQ ID NO: 1339856 - RNA, 19 nt, Homo sapiens
uaaugaauguggaaaugga

SEQ ID NO: 1339857 - RNA, 19 nt, Homo sapiens
aaauacaucucucuccaau

SEQ ID NO: 1339858 - RNA, 19 nt, Homo sapiens
gcuaagauacuucagacuu

SEQ ID NO: 1339859 - RNA, 19 nt, Homo sapiens
gaaaucccgaaaugacuuu

SEQ ID NO: 1339860 - RNA, 19 nt, Homo sapiens
ggagaagaauucguacagu

SEQ ID NO: 1339861 - RNA, 19 nt, Homo sapiens
cuaagauacuucagacuuc

SEQ ID NO: 1339862 - RNA, 19 nt, Homo sapiens
ggaaacacaggacugcuau

SEQ ID NO: 1339863 - RNA, 19 nt, Homo sapiens
ggaaaucccgaaaugacuu

SEQ ID NO: 1339864 - RNA, 19 nt, Homo sapiens
gacuggaaaucccgaaaug

SEQ ID NO: 1339865 - RNA, 19 nt, Homo sapiens
ggaacucauugaccgcuau

SEQ ID NO: 1339866 - RNA, 19 nt, Homo sapiens
auaccgacaucuacaacua

SEQ ID NO: 1339867 - RNA, 19 nt, Homo sapiens
ucucuucccugguuaucua

SEQ ID NO: 1339868 - RNA, 19 nt, Homo sapiens
aagaccagcugaccacuga

SEQ ID NO: 1339869 - RNA, 19 nt, Homo sapiens
acacaggacugcuauucug

SEQ ID NO: 1339870 - RNA, 19 nt, Homo sapiens
gcacaaaauuaccucauuc

SEQ ID NO: 1339871 - RNA, 19 nt, Homo sapiens
ggaaggaugcucgagagaa

SEQ ID NO: 1339872 - RNA, 19 nt, Homo sapiens
cugcagggcuugaaaugga

SEQ ID NO: 1339873 - RNA, 19 nt, Homo sapiens
ucaaggaggcuggcaauga

SEQ ID NO: 1339874 - RNA, 19 nt, Homo sapiens
ggagaacaaugguuuuaau

SEQ ID NO: 1339875 - RNA, 19 nt, Homo sapiens
gaaccugaguuggaagagu

SEQ ID NO: 1339876 - RNA, 19 nt, Homo sapiens
ggaauaugaggaagaggaa

SEQ ID NO: 1339877 - RNA, 19 nt, Homo sapiens
uauaaggcauugacuaaac

SEQ ID NO: 1339878 - RNA, 19 nt, Homo sapiens
uaagauacuucagacuuca

SEQ ID NO: 1339879 - RNA, 19 nt, Homo sapiens
gaucagcggucagcaacuc

SEQ ID NO: 1339880 - RNA, 19 nt, Homo sapiens
cagcgucgagggauauaua

SEQ ID NO: 1339881 - RNA, 19 nt, Homo sapiens
ucuauaaggcauugacuaa

SEQ ID NO: 1339882 - RNA, 19 nt, Homo sapiens
ccuaaugaauguggaaaug

SEQ ID NO: 1339883 - RNA, 19 nt, Homo sapiens
ggcaggagaccaacuaugu

SEQ ID NO: 1339884 - RNA, 19 nt, Homo sapiens
gcucuucucauaacaccua

SEQ ID NO: 1339885 - RNA, 19 nt, Homo sapiens
gaauggcggcuguggcuau

SEQ ID NO: 1339886 - RNA, 19 nt, Homo sapiens
guuggaagagucagaauug

SEQ ID NO: 1339887 - RNA, 19 nt, Homo sapiens
caucugcucuucucauaac

SEQ ID NO: 1339888 - RNA, 19 nt, Homo sapiens
cagcgguuauugcaccuaa

SEQ ID NO: 1339889 - RNA, 19 nt, Homo sapiens
gaacaaugguuuuaaucca

SEQ ID NO: 1339890 - RNA, 19 nt, Homo sapiens
caaagcccagacucucuua

SEQ ID NO: 1339891 - RNA, 19 nt, Homo sapiens
cuugaagucugucucauuc

SEQ ID NO: 1339892 - RNA, 19 nt, Homo sapiens
gcguggagguggauguaug

SEQ ID NO: 1339893 - RNA, 19 nt, Homo sapiens
gugcaggaacuguuugaaa

SEQ ID NO: 1339894 - RNA, 19 nt, Homo sapiens
gaauucguacaguucuaua

SEQ ID NO: 1339895 - RNA, 19 nt, Homo sapiens
gcugagcgauugguuucaa

SEQ ID NO: 1339896 - RNA, 19 nt, Homo sapiens
cuggacugcuuccuccuua

SEQ ID NO: 1339897 - RNA, 19 nt, Homo sapiens
gguugcaacuagaaauuca

SEQ ID NO: 1339898 - RNA, 19 nt, Homo sapiens
ccagacuuccugcgugaua

SEQ ID NO: 1339899 - RNA, 19 nt, Homo sapiens
gcagaaccuucagaauaag

SEQ ID NO: 1339900 - RNA, 19 nt, Homo sapiens
gaacacugcacagcacuca

SEQ ID NO: 1339901 - RNA, 19 nt, Homo sapiens
ugaggaagaccuggaauau

SEQ ID NO: 1339902 - RNA, 19 nt, Homo sapiens
aagaugaguuuccaagaag

SEQ ID NO: 1339903 - RNA, 19 nt, Homo sapiens
gauguggagacaauacgua

SEQ ID NO: 1339904 - RNA, 19 nt, Homo sapiens
caaagccaagggaaggaua

SEQ ID NO: 1339905 - RNA, 19 nt, Homo sapiens
gcuuccaucuuuguguaua

SEQ ID NO: 1339906 - RNA, 19 nt, Homo sapiens
gaggaagaccuggaauaug

SEQ ID NO: 1339907 - RNA, 19 nt, Homo sapiens
cugaggagcuucggaggaa

SEQ ID NO: 1339908 - RNA, 19 nt, Homo sapiens
ggugccagcugguggaaca

SEQ ID NO: 1339909 - RNA, 19 nt, Homo sapiens
aaaucaggaugguaagaug

SEQ ID NO: 1339910 - RNA, 19 nt, Homo sapiens
ccaagggaaggauaaauca

SEQ ID NO: 1339911 - RNA, 19 nt, Homo sapiens
aagcagaaccugaguugga

SEQ ID NO: 1339912 - RNA, 19 nt, Homo sapiens
gaccauggcccgucaucug

SEQ ID NO: 1339913 - RNA, 19 nt, Homo sapiens
guaagaugaguuuccaaga

SEQ ID NO: 1339914 - RNA, 19 nt, Homo sapiens
ggagcagggcuucaccauu

SEQ ID NO: 1339915 - RNA, 19 nt, Homo sapiens
ucauaagccuuugguaucu

SEQ ID NO: 1339916 - RNA, 19 nt, Homo sapiens
uuucuucccuuccuuuguu

SEQ ID NO: 1339917 - RNA, 19 nt, Homo sapiens
gaucuuuggcguucgucua

SEQ ID NO: 1339918 - RNA, 19 nt, Homo sapiens
gcccaucagcccuuucaaa

SEQ ID NO: 1339919 - RNA, 19 nt, Homo sapiens
ggacagcccuauuuagcuu

SEQ ID NO: 1339920 - RNA, 19 nt, Homo sapiens
caucaugacuguugaguuc

SEQ ID NO: 1339921 - RNA, 19 nt, Homo sapiens
ggaugugcauuucauguga

SEQ ID NO: 1339922 - RNA, 19 nt, Homo sapiens
gugcaacucuccacacuau

SEQ ID NO: 1339923 - RNA, 19 nt, Homo sapiens
caauacagaugacaugcaa

SEQ ID NO: 1339924 - RNA, 19 nt, Homo sapiens
aaacuuauuugaccacaga

SEQ ID NO: 1339925 - RNA, 19 nt, Homo sapiens
ggaaagggguuuugugguu

SEQ ID NO: 1339926 - RNA, 19 nt, Homo sapiens
gccaggaggugcucaugaa

SEQ ID NO: 1339927 - RNA, 19 nt, Homo sapiens
gcaacucuccacacuauau

SEQ ID NO: 1339928 - RNA, 19 nt, Homo sapiens
cagaugacaugcaaaugga

SEQ ID NO: 1339929 - RNA, 19 nt, Homo sapiens
gcaggugccauugccauua

SEQ ID NO: 1339930 - RNA, 19 nt, Homo sapiens
gggcaucgaugaggcuuug

SEQ ID NO: 1339931 - RNA, 19 nt, Homo sapiens
caaguuggacauucacaaa

SEQ ID NO: 1339932 - RNA, 19 nt, Homo sapiens
gauaaacagccaugugcaa

SEQ ID NO: 1339933 - RNA, 19 nt, Homo sapiens
ggagauaaacagccaugug

SEQ ID NO: 1339934 - RNA, 19 nt, Homo sapiens
ggccaucgauaucuguaug

SEQ ID NO: 1339935 - RNA, 19 nt, Homo sapiens
ggacguccucuccggcuuu

SEQ ID NO: 1339936 - RNA, 19 nt, Homo sapiens
ucacaaaggccguuauugc

SEQ ID NO: 1339937 - RNA, 19 nt, Homo sapiens
gaugacaugcaaauggaaa

SEQ ID NO: 1339938 - RNA, 19 nt, Homo sapiens
cugacaagcccuauagaaa

SEQ ID NO: 1339939 - RNA, 19 nt, Homo sapiens
gcacgacgccugccaaaau

SEQ ID NO: 1339940 - RNA, 19 nt, Homo sapiens
gcacugacguccccuugga

SEQ ID NO: 1339941 - RNA, 19 nt, Homo sapiens
caacucuccacacuauauu

SEQ ID NO: 1339942 - RNA, 19 nt, Homo sapiens
gacuccgugugaccuaaua

SEQ ID NO: 1339943 - RNA, 19 nt, Homo sapiens
gcucugacaagcccuauag

SEQ ID NO: 1339944 - RNA, 19 nt, Homo sapiens
ugacaauacagaugacaug

SEQ ID NO: 1339945 - RNA, 19 nt, Homo sapiens
caugugacaauacagauga

SEQ ID NO: 1339946 - RNA, 19 nt, Homo sapiens
cagcuuagggcagcacuuu

SEQ ID NO: 1339947 - RNA, 19 nt, Homo sapiens
ggccgagucuugucuuguc

SEQ ID NO: 1339948 - RNA, 19 nt, Homo sapiens
gacaccagccugcgagaug

SEQ ID NO: 1339949 - RNA, 19 nt, Homo sapiens
uggacuaccucaccaugga

SEQ ID NO: 1339950 - RNA, 19 nt, Homo sapiens
ugacaagcccuauagaaaa

SEQ ID NO: 1339951 - RNA, 19 nt, Homo sapiens
agucuugucuuguccuuuc

SEQ ID NO: 1339952 - RNA, 19 nt, Homo sapiens
caggugccauugccauuag

SEQ ID NO: 1339953 - RNA, 19 nt, Homo sapiens
aaacagccaugugcaacuc

SEQ ID NO: 1339954 - RNA, 19 nt, Homo sapiens
acucuccacacuauauuua

SEQ ID NO: 1339955 - RNA, 19 nt, Homo sapiens
gacaagcccuauagaaaag

SEQ ID NO: 1339956 - RNA, 19 nt, Homo sapiens
ucaugacuguugaguucuu

SEQ ID NO: 1339957 - RNA, 19 nt, Homo sapiens
cauuucaugugacaauaca

SEQ ID NO: 1339958 - RNA, 19 nt, Homo sapiens
auacagaugacaugcaaau

SEQ ID NO: 1339959 - RNA, 19 nt, Homo sapiens
gcauuggagggcucgauug

SEQ ID NO: 1339960 - RNA, 19 nt, Homo sapiens
uaauaggucguuuccaagu

SEQ ID NO: 1339961 - RNA, 19 nt, Homo sapiens
ugguggagcuggucuggau

SEQ ID NO: 1339962 - RNA, 19 nt, Homo sapiens
aggaggugcucaugaaucu

SEQ ID NO: 1339963 - RNA, 19 nt, Homo sapiens
acagaugacaugcaaaugg

SEQ ID NO: 1339964 - RNA, 19 nt, Homo sapiens
auaggucguuuccaaguca

SEQ ID NO: 1339965 - RNA, 19 nt, Homo sapiens
uaaagggccugggguguga

SEQ ID NO: 1339966 - RNA, 19 nt, Homo sapiens
ccgccaugguguccaaguu

SEQ ID NO: 1339967 - RNA, 19 nt, Homo sapiens
gugcauuucaugugacaau

SEQ ID NO: 1339968 - RNA, 19 nt, Homo sapiens
gggguuuugugguucaaua

SEQ ID NO: 1339969 - RNA, 19 nt, Homo sapiens
gaggucaccaugccagcuu

SEQ ID NO: 1339970 - RNA, 19 nt, Homo sapiens
ggccaggaggugcucauga

SEQ ID NO: 1339971 - RNA, 19 nt, Homo sapiens
ucugacaagcccuauagaa

SEQ ID NO: 1339972 - RNA, 19 nt, Homo sapiens
ugcauuucaugugacaaua

SEQ ID NO: 1339973 - RNA, 19 nt, Homo sapiens
guuuccaagucacccguuu

SEQ ID NO: 1339974 - RNA, 19 nt, Homo sapiens
caucggcuaccuccaguuc

SEQ ID NO: 1339975 - RNA, 19 nt, Homo sapiens
gacguccucuccggcuuug

SEQ ID NO: 1339976 - RNA, 19 nt, Homo sapiens
gccaugguguccaaguucu

SEQ ID NO: 1339977 - RNA, 19 nt, Homo sapiens
ggacuccgugugaccuaau

SEQ ID NO: 1339978 - RNA, 19 nt, Homo sapiens
auuauugguuccucaagug

SEQ ID NO: 1339979 - RNA, 19 nt, Homo sapiens
cagcacgacgccugccaaa

SEQ ID NO: 1339980 - RNA, 19 nt, Homo sapiens
caugacuguugaguucuug

SEQ ID NO: 1339981 - RNA, 19 nt, Homo sapiens
ggaaagauccggccaguua

SEQ ID NO: 1339982 - RNA, 19 nt, Homo sapiens
gaggaaagacuguaauuaa

SEQ ID NO: 1339983 - RNA, 19 nt, Homo sapiens
ggagaagaauuuccucuga

SEQ ID NO: 1339984 - RNA, 19 nt, Homo sapiens
ccagugaacuuguaaggaa

SEQ ID NO: 1339985 - RNA, 19 nt, Homo sapiens
ggaaagacuguaauuaaug

SEQ ID NO: 1339986 - RNA, 19 nt, Homo sapiens
gcaguuugcucccaagaug

SEQ ID NO: 1339987 - RNA, 19 nt, Homo sapiens
ccaaaucacucacucauac

SEQ ID NO: 1339988 - RNA, 19 nt, Homo sapiens
ggaaaggaguccauuaucg

SEQ ID NO: 1339989 - RNA, 19 nt, Homo sapiens
caaaggcauuaaagcauuu

SEQ ID NO: 1339990 - RNA, 19 nt, Homo sapiens
ucaaaggcauuaaagcauu

SEQ ID NO: 1339991 - RNA, 19 nt, Homo sapiens
aaacaugggcuccagauuu

SEQ ID NO: 1339992 - RNA, 19 nt, Homo sapiens
gacaagaauugcacaggaa

SEQ ID NO: 1339993 - RNA, 19 nt, Homo sapiens
gaagacuuguguacuuaga

SEQ ID NO: 1339994 - RNA, 19 nt, Homo sapiens
cauagcagauggcauguug

SEQ ID NO: 1339995 - RNA, 19 nt, Homo sapiens
uaugaagcgugauccuuua

SEQ ID NO: 1339996 - RNA, 19 nt, Homo sapiens
ggaggagaauggacagaau

SEQ ID NO: 1339997 - RNA, 19 nt, Homo sapiens
gaacguuaauucgagcauu

SEQ ID NO: 1339998 - RNA, 19 nt, Homo sapiens
ucaguuagaaggauuagua

SEQ ID NO: 1339999 - RNA, 19 nt, Homo sapiens
aauacugacuggaacguua

SEQ ID NO: 1340000 - RNA, 19 nt, Homo sapiens
caaaguugguggccugaau

SEQ ID NO: 1340001 - RNA, 19 nt, Homo sapiens
gcuacagcuuuaaauauga

SEQ ID NO: 1340002 - RNA, 19 nt, Homo sapiens
ccaaguguauuugaauuug

SEQ ID NO: 1340003 - RNA, 19 nt, Homo sapiens
gcacgaggaaagacuguaa

SEQ ID NO: 1340004 - RNA, 19 nt, Homo sapiens
ugacuuuggugacuccuuu

SEQ ID NO: 1340005 - RNA, 19 nt, Homo sapiens
gaggagaauggacagaaua

SEQ ID NO: 1340006 - RNA, 19 nt, Homo sapiens
ugaagucauugucaaaguu

SEQ ID NO: 1340007 - RNA, 19 nt, Homo sapiens
gaagcaaaguuguccaaaa

SEQ ID NO: 1340008 - RNA, 19 nt, Homo sapiens
caaccaguguuuacaaugg

SEQ ID NO: 1340009 - RNA, 19 nt, Homo sapiens
cugcuugggugauagauaa

SEQ ID NO: 1340010 - RNA, 19 nt, Homo sapiens
acaauggaauuucugaaga

SEQ ID NO: 1340011 - RNA, 19 nt, Homo sapiens
gaagagcggaauaacaguu

SEQ ID NO: 1340012 - RNA, 19 nt, Homo sapiens
cgaggaaagacuguaauua

SEQ ID NO: 1340013 - RNA, 19 nt, Homo sapiens
gugcuucgauucacucaga

SEQ ID NO: 1340014 - RNA, 19 nt, Homo sapiens
guuagaaggauuaguacua

SEQ ID NO: 1340015 - RNA, 19 nt, Homo sapiens
cugaagacuuguguacuua

SEQ ID NO: 1340016 - RNA, 19 nt, Homo sapiens
uggaauuucugaagacuug

SEQ ID NO: 1340017 - RNA, 19 nt, Homo sapiens
uaacaguuccguauucuuc

SEQ ID NO: 1340018 - RNA, 19 nt, Homo sapiens
gcaguucaaccaguguuua

SEQ ID NO: 1340019 - RNA, 19 nt, Homo sapiens
gaagagcaguugaaauccu

SEQ ID NO: 1340020 - RNA, 19 nt, Homo sapiens
uaugagaagugguuaugga

SEQ ID NO: 1340021 - RNA, 19 nt, Homo sapiens
cauuaaagcauuucuggaa

SEQ ID NO: 1340022 - RNA, 19 nt, Homo sapiens
gaaaacguguucuaaucuu

SEQ ID NO: 1340023 - RNA, 19 nt, Homo sapiens
ccaaaagccuucaguuaga

SEQ ID NO: 1340024 - RNA, 19 nt, Homo sapiens
gaaagauccggccaguuau

SEQ ID NO: 1340025 - RNA, 19 nt, Homo sapiens
ucugaagacuuguguacuu

SEQ ID NO: 1340026 - RNA, 19 nt, Homo sapiens
gacagaauacugacuggaa

SEQ ID NO: 1340027 - RNA, 19 nt, Homo sapiens
gcacugcgguuugcuucug

SEQ ID NO: 1340028 - RNA, 19 nt, Homo sapiens
ucuuucaguuucuccauua

SEQ ID NO: 1340029 - RNA, 19 nt, Homo sapiens
gaaacaugggcuccagauu

SEQ ID NO: 1340030 - RNA, 19 nt, Homo sapiens
gaagcuuggugcagacgau

SEQ ID NO: 1340031 - RNA, 19 nt, Homo sapiens
gagaauggacagaauacug

SEQ ID NO: 1340032 - RNA, 19 nt, Homo sapiens
ggucugcuauaaacaaagu

SEQ ID NO: 1340033 - RNA, 19 nt, Homo sapiens
gaaugugggcuugauguga

SEQ ID NO: 1340034 - RNA, 19 nt, Homo sapiens
gaaaaucaaaggagaagaa

SEQ ID NO: 1340035 - RNA, 19 nt, Homo sapiens
ccuauagacguuaauauga

SEQ ID NO: 1340036 - RNA, 19 nt, Homo sapiens
guccaaguguauuugaauu

SEQ ID NO: 1340037 - RNA, 19 nt, Homo sapiens
gcgaagagcggaauaacag

SEQ ID NO: 1340038 - RNA, 19 nt, Homo sapiens
guaaauccuauagacguua

SEQ ID NO: 1340039 - RNA, 19 nt, Homo sapiens
uggaagagcaguugaaauc

SEQ ID NO: 1340040 - RNA, 19 nt, Homo sapiens
guacuuagaagaaaugcau

SEQ ID NO: 1340041 - RNA, 19 nt, Homo sapiens
caguuucuccauuagauua

SEQ ID NO: 1340042 - RNA, 19 nt, Homo sapiens
gugcagacgauguaauuga

SEQ ID NO: 1340043 - RNA, 19 nt, Homo sapiens
aaugugggcuugaugugaa

SEQ ID NO: 1340044 - RNA, 19 nt, Homo sapiens
uggcagaauuugacugaau

SEQ ID NO: 1340045 - RNA, 19 nt, Homo sapiens
guuaauaugagaagugguu

SEQ ID NO: 1340046 - RNA, 19 nt, Homo sapiens
gaagucauugucaaaguuc

SEQ ID NO: 1340047 - RNA, 19 nt, Homo sapiens
ggcuugaugugaaauacuu

SEQ ID NO: 1340048 - RNA, 19 nt, Homo sapiens
agaauggacagaauacuga

SEQ ID NO: 1340049 - RNA, 19 nt, Homo sapiens
ccaccuaugugacuuuggu

SEQ ID NO: 1340050 - RNA, 19 nt, Homo sapiens
ggucaggagccaccuaugu

SEQ ID NO: 1340051 - RNA, 19 nt, Homo sapiens
guucaaaggcauuaaagca

SEQ ID NO: 1340052 - RNA, 19 nt, Homo sapiens
gauggaaugugggcuugau

SEQ ID NO: 1340053 - RNA, 19 nt, Homo sapiens
cuugggugauagauaaaua

SEQ ID NO: 1340054 - RNA, 19 nt, Homo sapiens
aacguuaauucgagcauuu

SEQ ID NO: 1340055 - RNA, 19 nt, Homo sapiens
gagaagcaaaguuguccaa

SEQ ID NO: 1340056 - RNA, 19 nt, Homo sapiens
ggacacgcacgaggaaaga

SEQ ID NO: 1340057 - RNA, 19 nt, Homo sapiens
guuggcggauccacugaaa

SEQ ID NO: 1340058 - RNA, 19 nt, Homo sapiens
gcagacgauguaauugauu

SEQ ID NO: 1340059 - RNA, 19 nt, Homo sapiens
cuauagacguuaauaugag

SEQ ID NO: 1340060 - RNA, 19 nt, Homo sapiens
uguaaauccuauagacguu

SEQ ID NO: 1340061 - RNA, 19 nt, Homo sapiens
aguacuaccucuccuagga

SEQ ID NO: 1340062 - RNA, 19 nt, Homo sapiens
uagaugacauugcagaacu

SEQ ID NO: 1340063 - RNA, 19 nt, Homo sapiens
caauggaauuucugaagac

SEQ ID NO: 1340064 - RNA, 19 nt, Homo sapiens
gaaagugagggaggagaau

SEQ ID NO: 1340065 - RNA, 19 nt, Homo sapiens
gauccggccaguuauugaa

SEQ ID NO: 1340066 - RNA, 19 nt, Homo sapiens
ccaagaugccagugaacuu

SEQ ID NO: 1340067 - RNA, 19 nt, Homo sapiens
gaagcgugauccuuuacac

SEQ ID NO: 1340068 - RNA, 19 nt, Homo sapiens
ccauuagauuagcuucauu

SEQ ID NO: 1340069 - RNA, 19 nt, Homo sapiens
guauucuucuuucaguuuc

SEQ ID NO: 1340070 - RNA, 19 nt, Homo sapiens
agaacaugaugaugccuau

SEQ ID NO: 1340071 - RNA, 19 nt, Homo sapiens
aaagauccggccaguuauu

SEQ ID NO: 1340072 - RNA, 19 nt, Homo sapiens
gagcaguugaaauccuuaa

SEQ ID NO: 1340073 - RNA, 19 nt, Homo sapiens
aagagcaguugaaauccuu

SEQ ID NO: 1340074 - RNA, 19 nt, Homo sapiens
gcucaugugacagcaguuu

SEQ ID NO: 1340075 - RNA, 19 nt, Homo sapiens
cguauucuucuuucaguuu

SEQ ID NO: 1340076 - RNA, 19 nt, Homo sapiens
uuagaaggauuaguacuac

SEQ ID NO: 1340077 - RNA, 19 nt, Homo sapiens
caaaagccuucaguuagaa

SEQ ID NO: 1340078 - RNA, 19 nt, Homo sapiens
gcggauccacugaaacaug

SEQ ID NO: 1340079 - RNA, 19 nt, Homo sapiens
uacucaagcugccucuuug

SEQ ID NO: 1340080 - RNA, 19 nt, Homo sapiens
ggucugggcugcaguuccu

SEQ ID NO: 1340081 - RNA, 19 nt, Homo sapiens
ggaaagauccaaauaauga

SEQ ID NO: 1340082 - RNA, 19 nt, Homo sapiens
caaaggaacgugauucuug

SEQ ID NO: 1340083 - RNA, 19 nt, Homo sapiens
guuguucucugaagauuaa

SEQ ID NO: 1340084 - RNA, 19 nt, Homo sapiens
gaacgugauucuugaaggu

SEQ ID NO: 1340085 - RNA, 19 nt, Homo sapiens
gcaugugucuaaacaauag

SEQ ID NO: 1340086 - RNA, 19 nt, Homo sapiens
gaaauguuguucucugaag

SEQ ID NO: 1340087 - RNA, 19 nt, Homo sapiens
aaaggaacgugauucuuga

SEQ ID NO: 1340088 - RNA, 19 nt, Homo sapiens
ggauggcaaucaugucuug

SEQ ID NO: 1340089 - RNA, 19 nt, Homo sapiens
gacgugcacuccuccagua

SEQ ID NO: 1340090 - RNA, 19 nt, Homo sapiens
gagaaaagccuuauuggaa

SEQ ID NO: 1340091 - RNA, 19 nt, Homo sapiens
guccugauuuguucuagua

SEQ ID NO: 1340092 - RNA, 19 nt, Homo sapiens
gguagaaucugagugucuu

SEQ ID NO: 1340093 - RNA, 19 nt, Homo sapiens
gcccaugaaccuuuaguuu

SEQ ID NO: 1340094 - RNA, 19 nt, Homo sapiens
gcaguaaaggcucaaagga

SEQ ID NO: 1340095 - RNA, 19 nt, Homo sapiens
gaacagcacaauggcaaga

SEQ ID NO: 1340096 - RNA, 19 nt, Homo sapiens
aaaugcccaugaaccuuua

SEQ ID NO: 1340097 - RNA, 19 nt, Homo sapiens
gaagcacauuagugaagga

SEQ ID NO: 1340098 - RNA, 19 nt, Homo sapiens
ccaugaaccuuuaguuugc

SEQ ID NO: 1340099 - RNA, 19 nt, Homo sapiens
cuucagaaauagcaguaaa

SEQ ID NO: 1340100 - RNA, 19 nt, Homo sapiens
aaacuggcaugugucuaaa

SEQ ID NO: 1340101 - RNA, 19 nt, Homo sapiens
ggaaauguuguucucugaa

SEQ ID NO: 1340102 - RNA, 19 nt, Homo sapiens
agaaaagccuuauuggaaa

SEQ ID NO: 1340103 - RNA, 19 nt, Homo sapiens
uggcaugugucuaaacaau

SEQ ID NO: 1340104 - RNA, 19 nt, Homo sapiens
uggaaauguuguucucuga

SEQ ID NO: 1340105 - RNA, 19 nt, Homo sapiens
caguaaaggcucaaaggaa

SEQ ID NO: 1340106 - RNA, 19 nt, Homo sapiens
ccaaauaaugacuucagaa

SEQ ID NO: 1340107 - RNA, 19 nt, Homo sapiens
ggcaugugucuaaacaaua

SEQ ID NO: 1340108 - RNA, 19 nt, Homo sapiens
ggcugaagcacauuaguga

SEQ ID NO: 1340109 - RNA, 19 nt, Homo sapiens
gaaaagccuuauuggaaag

SEQ ID NO: 1340110 - RNA, 19 nt, Homo sapiens
cccaugaaccuuuaguuug

SEQ ID NO: 1340111 - RNA, 19 nt, Homo sapiens
gucuugauguccugauuug

SEQ ID NO: 1340112 - RNA, 19 nt, Homo sapiens
ccaaccugguggaaauguu

SEQ ID NO: 1340113 - RNA, 19 nt, Homo sapiens
aaauguuguucucugaaga

SEQ ID NO: 1340114 - RNA, 19 nt, Homo sapiens
gggcugaagcacauuagug

SEQ ID NO: 1340115 - RNA, 19 nt, Homo sapiens
aggccaaccugguggaaau

SEQ ID NO: 1340116 - RNA, 19 nt, Homo sapiens
ggagaaaagccuuauugga

SEQ ID NO: 1340117 - RNA, 19 nt, Homo sapiens
gcucaaaggaacgugauuc

SEQ ID NO: 1340118 - RNA, 19 nt, Homo sapiens
gagaggggcugaagcacau

SEQ ID NO: 1340119 - RNA, 19 nt, Homo sapiens
gcaggcugaaccagucgua

SEQ ID NO: 1340120 - RNA, 19 nt, Homo sapiens
accuuuaguuugccuguaa

SEQ ID NO: 1340121 - RNA, 19 nt, Homo sapiens
uccaaauaaugacuucaga

SEQ ID NO: 1340122 - RNA, 19 nt, Homo sapiens
acuguauacuugcuuugaa

SEQ ID NO: 1340123 - RNA, 19 nt, Homo sapiens
uugauguccugauuuguuc

SEQ ID NO: 1340124 - RNA, 19 nt, Homo sapiens
gaaagauccaaauaaugac

SEQ ID NO: 1340125 - RNA, 19 nt, Homo sapiens
ucuugaaggugacgguaau

SEQ ID NO: 1340126 - RNA, 19 nt, Homo sapiens
guauacuugcuuugaauuc

SEQ ID NO: 1340127 - RNA, 19 nt, Homo sapiens
gauguccugauuuguucua

SEQ ID NO: 1340128 - RNA, 19 nt, Homo sapiens
cuugauguccugauuuguu

SEQ ID NO: 1340129 - RNA, 19 nt, Homo sapiens
aaaacuggcaugugucuaa

SEQ ID NO: 1340130 - RNA, 19 nt, Homo sapiens
cuguauacuugcuuugaau

SEQ ID NO: 1340131 - RNA, 19 nt, Homo sapiens
ucaaaggaacgugauucuu

SEQ ID NO: 1340132 - RNA, 19 nt, Homo sapiens
gugccuacacuacuuaagu

SEQ ID NO: 1340133 - RNA, 19 nt, Homo sapiens
gcugaagcacauuagugaa

SEQ ID NO: 1340134 - RNA, 19 nt, Homo sapiens
guacgaaucugguccuaua

SEQ ID NO: 1340135 - RNA, 19 nt, Homo sapiens
ggacgggacuuaaauaaag

SEQ ID NO: 1340136 - RNA, 19 nt, Homo sapiens
gggaagagccugaagauga

SEQ ID NO: 1340137 - RNA, 19 nt, Homo sapiens
ggacaagguucucgaguuc

SEQ ID NO: 1340138 - RNA, 19 nt, Homo sapiens
gaaccugacuccguuagga

SEQ ID NO: 1340139 - RNA, 19 nt, Homo sapiens
ggaagagccugaagaugag

SEQ ID NO: 1340140 - RNA, 19 nt, Homo sapiens
ggaaguaggaggagaguca

SEQ ID NO: 1340141 - RNA, 19 nt, Homo sapiens
guacuucacuacccagcaa

SEQ ID NO: 1340142 - RNA, 19 nt, Homo sapiens
ggacaaauacauccacaag

SEQ ID NO: 1340143 - RNA, 19 nt, Homo sapiens
gaccgcagaucauuaccuu

SEQ ID NO: 1340144 - RNA, 19 nt, Homo sapiens
caaagacgaugugcuacug

SEQ ID NO: 1340145 - RNA, 19 nt, Homo sapiens
ggacagagagugcacaaac

SEQ ID NO: 1340146 - RNA, 19 nt, Homo sapiens
cuacgcaccugcagacaga

SEQ ID NO: 1340147 - RNA, 19 nt, Homo sapiens
agaaggagaccgacuguga

SEQ ID NO: 1340148 - RNA, 19 nt, Homo sapiens
gcuaugggacgaugacuug

SEQ ID NO: 1340149 - RNA, 19 nt, Homo sapiens
ucucaaagacgaugugcua

SEQ ID NO: 1340150 - RNA, 19 nt, Homo sapiens
ccacuggucccaccgcuuu

SEQ ID NO: 1340151 - RNA, 19 nt, Homo sapiens
gggacgggacuuaaauaaa

SEQ ID NO: 1340152 - RNA, 19 nt, Homo sapiens
gaccgacugugaccucugu

SEQ ID NO: 1340153 - RNA, 19 nt, Homo sapiens
gccagugucugcagcuaug

SEQ ID NO: 1340154 - RNA, 19 nt, Homo sapiens
ggagugagguacgaaucug

SEQ ID NO: 1340155 - RNA, 19 nt, Homo sapiens
ggcugaggcucuugaaaca

SEQ ID NO: 1340156 - RNA, 19 nt, Homo sapiens
uggacaagguucucgaguu

SEQ ID NO: 1340157 - RNA, 19 nt, Homo sapiens
ccgcagaucauuaccuuga

SEQ ID NO: 1340158 - RNA, 19 nt, Homo sapiens
acagagagugcacaaacua

SEQ ID NO: 1340159 - RNA, 19 nt, Homo sapiens
cagcucgccuuggagagua

SEQ ID NO: 1340160 - RNA, 19 nt, Homo sapiens
gaacccaguggcuguacuu

SEQ ID NO: 1340161 - RNA, 19 nt, Homo sapiens
gcagaucauuaccuugaac

SEQ ID NO: 1340162 - RNA, 19 nt, Homo sapiens
gacagagagugcacaaacu

SEQ ID NO: 1340163 - RNA, 19 nt, Homo sapiens
gaagcccagugguccuuuc

SEQ ID NO: 1340164 - RNA, 19 nt, Homo sapiens
gaaggaacucaaccacaca

SEQ ID NO: 1340165 - RNA, 19 nt, Homo sapiens
gaaucugguccuauacuca

SEQ ID NO: 1340166 - RNA, 19 nt, Homo sapiens
ccaccuggcaccuagaaga

SEQ ID NO: 1340167 - RNA, 19 nt, Homo sapiens
caacgugcaucugguucug

SEQ ID NO: 1340168 - RNA, 19 nt, Homo sapiens
ccucugggacagugacaua

SEQ ID NO: 1340169 - RNA, 19 nt, Homo sapiens
ugacaacgugcaucugguu

SEQ ID NO: 1340170 - RNA, 19 nt, Homo sapiens
gcccagugguccuuucucu

SEQ ID NO: 1340171 - RNA, 19 nt, Homo sapiens
aauaaaggcagacgcuguu

SEQ ID NO: 1340172 - RNA, 19 nt, Homo sapiens
aagacgaugugcuacuguu

SEQ ID NO: 1340173 - RNA, 19 nt, Homo sapiens
ccuauacucagcccaggua

SEQ ID NO: 1340174 - RNA, 19 nt, Homo sapiens
cgaaucugguccuauacuc

SEQ ID NO: 1340175 - RNA, 19 nt, Homo sapiens
ugugggcucugugguauau

SEQ ID NO: 1340176 - RNA, 19 nt, Homo sapiens
cugguucccugccucugua

SEQ ID NO: 1340177 - RNA, 19 nt, Homo sapiens
gacgggacuuaaauaaagg

SEQ ID NO: 1340178 - RNA, 19 nt, Homo sapiens
ugugccagcucaccucuuc

SEQ ID NO: 1340179 - RNA, 19 nt, Homo sapiens
caacgugucagcagauggu

SEQ ID NO: 1340180 - RNA, 19 nt, Homo sapiens
ugggcucugugguauauga

SEQ ID NO: 1340181 - RNA, 19 nt, Homo sapiens
agagagagcggagcaagug

SEQ ID NO: 1340182 - RNA, 19 nt, Homo sapiens
ccucccaacugccagacuu

SEQ ID NO: 1340183 - RNA, 19 nt, Homo sapiens
guggagccgucgugaacug

SEQ ID NO: 1340184 - RNA, 19 nt, Homo sapiens
uggaggagcagcugacuca

SEQ ID NO: 1340185 - RNA, 19 nt, Homo sapiens
gcacugggaagagccugaa

SEQ ID NO: 1340186 - RNA, 19 nt, Homo sapiens
ccucauccuccuucucaaa

SEQ ID NO: 1340187 - RNA, 19 nt, Homo sapiens
ccgcugcgcuuucccucau

SEQ ID NO: 1340188 - RNA, 19 nt, Homo sapiens
cacccuaaccucuguguuc

SEQ ID NO: 1340189 - RNA, 19 nt, Homo sapiens
cgaguucccauugcugaaa

SEQ ID NO: 1340190 - RNA, 19 nt, Homo sapiens
gugguggucuugcucuucu

SEQ ID NO: 1340191 - RNA, 19 nt, Homo sapiens
gcuggccugccuacucuuu

SEQ ID NO: 1340192 - RNA, 19 nt, Homo sapiens
gcugaaaggccacccuaac

SEQ ID NO: 1340193 - RNA, 19 nt, Homo sapiens
gaguucccauugcugaaag

SEQ ID NO: 1340194 - RNA, 19 nt, Homo sapiens
gugcaucugguucugaaug

SEQ ID NO: 1340195 - RNA, 19 nt, Homo sapiens
ucugugggcucugugguau

SEQ ID NO: 1340196 - RNA, 19 nt, Homo sapiens
uggcuggccugccuacucu

SEQ ID NO: 1340197 - RNA, 19 nt, Homo sapiens
gcagcucgccuuggagagu

SEQ ID NO: 1340198 - RNA, 19 nt, Homo sapiens
gccucucccuguacuggaa

SEQ ID NO: 1340199 - RNA, 19 nt, Homo sapiens
gcucaacgugucagcagau

SEQ ID NO: 1340200 - RNA, 19 nt, Homo sapiens
gguacgagaaggaacucaa

SEQ ID NO: 1340201 - RNA, 19 nt, Homo sapiens
ugacuggaccgcagaucau

SEQ ID NO: 1340202 - RNA, 19 nt, Homo sapiens
guacgaaucugguccuaua

SEQ ID NO: 1340203 - RNA, 19 nt, Homo sapiens
ggacgggacuuaaauaaag

SEQ ID NO: 1340204 - RNA, 19 nt, Homo sapiens
gggaagagccugaagauga

SEQ ID NO: 1340205 - RNA, 19 nt, Homo sapiens
ggacaagguucucgaguuc

SEQ ID NO: 1340206 - RNA, 19 nt, Homo sapiens
gaaccugacuccguuagga

SEQ ID NO: 1340207 - RNA, 19 nt, Homo sapiens
ggaagagccugaagaugag

SEQ ID NO: 1340208 - RNA, 19 nt, Homo sapiens
ggaaguaggaggagaguca

SEQ ID NO: 1340209 - RNA, 19 nt, Homo sapiens
guacuucacuacccagcaa

SEQ ID NO: 1340210 - RNA, 19 nt, Homo sapiens
ggacaaauacauccacaag

SEQ ID NO: 1340211 - RNA, 19 nt, Homo sapiens
gaccgcagaucauuaccuu

SEQ ID NO: 1340212 - RNA, 19 nt, Homo sapiens
caaagacgaugugcuacug

SEQ ID NO: 1340213 - RNA, 19 nt, Homo sapiens
ggacagagagugcacaaac

SEQ ID NO: 1340214 - RNA, 19 nt, Homo sapiens
cuacgcaccugcagacaga

SEQ ID NO: 1340215 - RNA, 19 nt, Homo sapiens
agaaggagaccgacuguga

SEQ ID NO: 1340216 - RNA, 19 nt, Homo sapiens
gcuaugggacgaugacuug

SEQ ID NO: 1340217 - RNA, 19 nt, Homo sapiens
ucucaaagacgaugugcua

SEQ ID NO: 1340218 - RNA, 19 nt, Homo sapiens
ccacuggucccaccgcuuu

SEQ ID NO: 1340219 - RNA, 19 nt, Homo sapiens
gggacgggacuuaaauaaa

SEQ ID NO: 1340220 - RNA, 19 nt, Homo sapiens
gaccgacugugaccucugu

SEQ ID NO: 1340221 - RNA, 19 nt, Homo sapiens
gccagugucugcagcuaug

SEQ ID NO: 1340222 - RNA, 19 nt, Homo sapiens
ggagugagguacgaaucug

SEQ ID NO: 1340223 - RNA, 19 nt, Homo sapiens
ggcugaggcucuugaaaca

SEQ ID NO: 1340224 - RNA, 19 nt, Homo sapiens
uggacaagguucucgaguu

SEQ ID NO: 1340225 - RNA, 19 nt, Homo sapiens
ccgcagaucauuaccuuga

SEQ ID NO: 1340226 - RNA, 19 nt, Homo sapiens
acagagagugcacaaacua

SEQ ID NO: 1340227 - RNA, 19 nt, Homo sapiens
cagcucgccuuggagagua

SEQ ID NO: 1340228 - RNA, 19 nt, Homo sapiens
gaacccaguggcuguacuu

SEQ ID NO: 1340229 - RNA, 19 nt, Homo sapiens
gcagaucauuaccuugaac

SEQ ID NO: 1340230 - RNA, 19 nt, Homo sapiens
gacagagagugcacaaacu

SEQ ID NO: 1340231 - RNA, 19 nt, Homo sapiens
gaagcccagugguccuuuc

SEQ ID NO: 1340232 - RNA, 19 nt, Homo sapiens
gaaggaacucaaccacaca

SEQ ID NO: 1340233 - RNA, 19 nt, Homo sapiens
gaaucugguccuauacuca

SEQ ID NO: 1340234 - RNA, 19 nt, Homo sapiens
ccaccuggcaccuagaaga

SEQ ID NO: 1340235 - RNA, 19 nt, Homo sapiens
caacgugcaucugguucug

SEQ ID NO: 1340236 - RNA, 19 nt, Homo sapiens
ccucugggacagugacaua

SEQ ID NO: 1340237 - RNA, 19 nt, Homo sapiens
ugacaacgugcaucugguu

SEQ ID NO: 1340238 - RNA, 19 nt, Homo sapiens
gcccagugguccuuucucu

SEQ ID NO: 1340239 - RNA, 19 nt, Homo sapiens
aauaaaggcagacgcuguu

SEQ ID NO: 1340240 - RNA, 19 nt, Homo sapiens
aagacgaugugcuacuguu

SEQ ID NO: 1340241 - RNA, 19 nt, Homo sapiens
ccuauacucagcccaggua

SEQ ID NO: 1340242 - RNA, 19 nt, Homo sapiens
cgaaucugguccuauacuc

SEQ ID NO: 1340243 - RNA, 19 nt, Homo sapiens
ugugggcucugugguauau

SEQ ID NO: 1340244 - RNA, 19 nt, Homo sapiens
cugguucccugccucugua

SEQ ID NO: 1340245 - RNA, 19 nt, Homo sapiens
gacgggacuuaaauaaagg

SEQ ID NO: 1340246 - RNA, 19 nt, Homo sapiens
caacgugucagcagauggu

SEQ ID NO: 1340247 - RNA, 19 nt, Homo sapiens
ugggcucugugguauauga

SEQ ID NO: 1340248 - RNA, 19 nt, Homo sapiens
agagagagcggagcaagug

SEQ ID NO: 1340249 - RNA, 19 nt, Homo sapiens
ccucccaacugccagacuu

SEQ ID NO: 1340250 - RNA, 19 nt, Homo sapiens
guggagccgucgugaacug

SEQ ID NO: 1340251 - RNA, 19 nt, Homo sapiens
uggaggagcagcugacuca

SEQ ID NO: 1340252 - RNA, 19 nt, Homo sapiens
gcacugggaagagccugaa

SEQ ID NO: 1340253 - RNA, 19 nt, Homo sapiens
ccucauccuccuucucaaa

SEQ ID NO: 1340254 - RNA, 19 nt, Homo sapiens
ccgcugcgcuuucccucau

SEQ ID NO: 1340255 - RNA, 19 nt, Homo sapiens
cacccuaaccucuguguuc

SEQ ID NO: 1340256 - RNA, 19 nt, Homo sapiens
cgaguucccauugcugaaa

SEQ ID NO: 1340257 - RNA, 19 nt, Homo sapiens
gugguggucuugcucuucu

SEQ ID NO: 1340258 - RNA, 19 nt, Homo sapiens
gcuggccugccuacucuuu

SEQ ID NO: 1340259 - RNA, 19 nt, Homo sapiens
gcugaaaggccacccuaac

SEQ ID NO: 1340260 - RNA, 19 nt, Homo sapiens
gaguucccauugcugaaag

SEQ ID NO: 1340261 - RNA, 19 nt, Homo sapiens
gugcaucugguucugaaug

SEQ ID NO: 1340262 - RNA, 19 nt, Homo sapiens
ucugugggcucugugguau

SEQ ID NO: 1340263 - RNA, 19 nt, Homo sapiens
uggcuggccugccuacucu

SEQ ID NO: 1340264 - RNA, 19 nt, Homo sapiens
gcagcucgccuuggagagu

SEQ ID NO: 1340265 - RNA, 19 nt, Homo sapiens
gccucucccuguacuggaa

SEQ ID NO: 1340266 - RNA, 19 nt, Homo sapiens
gcucaacgugucagcagau

SEQ ID NO: 1340267 - RNA, 19 nt, Homo sapiens
gguacgagaaggaacucaa

SEQ ID NO: 1340268 - RNA, 19 nt, Homo sapiens
ugacuggaccgcagaucau

SEQ ID NO: 1340269 - RNA, 19 nt, Homo sapiens
guacgaaucugguccuaua

SEQ ID NO: 1340270 - RNA, 19 nt, Homo sapiens
ggacgggacuuaaauaaag

SEQ ID NO: 1340271 - RNA, 19 nt, Homo sapiens
gggaagagccugaagauga

SEQ ID NO: 1340272 - RNA, 19 nt, Homo sapiens
ggacaagguucucgaguuc

SEQ ID NO: 1340273 - RNA, 19 nt, Homo sapiens
gaaccugacuccguuagga

SEQ ID NO: 1340274 - RNA, 19 nt, Homo sapiens
ggaagagccugaagaugag

SEQ ID NO: 1340275 - RNA, 19 nt, Homo sapiens
ggaaguaggaggagaguca

SEQ ID NO: 1340276 - RNA, 19 nt, Homo sapiens
guacuucacuacccagcaa

SEQ ID NO: 1340277 - RNA, 19 nt, Homo sapiens
ggacaaauacauccacaag

SEQ ID NO: 1340278 - RNA, 19 nt, Homo sapiens
gaccgcagaucauuaccuu

SEQ ID NO: 1340279 - RNA, 19 nt, Homo sapiens
caaagacgaugugcuacug

SEQ ID NO: 1340280 - RNA, 19 nt, Homo sapiens
ggacagagagugcacaaac

SEQ ID NO: 1340281 - RNA, 19 nt, Homo sapiens
cuacgcaccugcagacaga

SEQ ID NO: 1340282 - RNA, 19 nt, Homo sapiens
agaaggagaccgacuguga

SEQ ID NO: 1340283 - RNA, 19 nt, Homo sapiens
gcuaugggacgaugacuug

SEQ ID NO: 1340284 - RNA, 19 nt, Homo sapiens
ucucaaagacgaugugcua

SEQ ID NO: 1340285 - RNA, 19 nt, Homo sapiens
ccacuggucccaccgcuuu

SEQ ID NO: 1340286 - RNA, 19 nt, Homo sapiens
gggacgggacuuaaauaaa

SEQ ID NO: 1340287 - RNA, 19 nt, Homo sapiens
gaccgacugugaccucugu

SEQ ID NO: 1340288 - RNA, 19 nt, Homo sapiens
gccagugucugcagcuaug

SEQ ID NO: 1340289 - RNA, 19 nt, Homo sapiens
ggagugagguacgaaucug

SEQ ID NO: 1340290 - RNA, 19 nt, Homo sapiens
ggcugaggcucuugaaaca

SEQ ID NO: 1340291 - RNA, 19 nt, Homo sapiens
uggacaagguucucgaguu

SEQ ID NO: 1340292 - RNA, 19 nt, Homo sapiens
ccgcagaucauuaccuuga

SEQ ID NO: 1340293 - RNA, 19 nt, Homo sapiens
acagagagugcacaaacua

SEQ ID NO: 1340294 - RNA, 19 nt, Homo sapiens
cagcucgccuuggagagua

SEQ ID NO: 1340295 - RNA, 19 nt, Homo sapiens
gaacccaguggcuguacuu

SEQ ID NO: 1340296 - RNA, 19 nt, Homo sapiens
gcagaucauuaccuugaac

SEQ ID NO: 1340297 - RNA, 19 nt, Homo sapiens
gacagagagugcacaaacu

SEQ ID NO: 1340298 - RNA, 19 nt, Homo sapiens
gaagcccagugguccuuuc

SEQ ID NO: 1340299 - RNA, 19 nt, Homo sapiens
gaaggaacucaaccacaca

SEQ ID NO: 1340300 - RNA, 19 nt, Homo sapiens
gaaaggcucaggguucagu

SEQ ID NO: 1340301 - RNA, 19 nt, Homo sapiens
gaaucugguccuauacuca

SEQ ID NO: 1340302 - RNA, 19 nt, Homo sapiens
ccacugcucuccggugagu

SEQ ID NO: 1340303 - RNA, 19 nt, Homo sapiens
ccaccuggcaccuagaaga

SEQ ID NO: 1340304 - RNA, 19 nt, Homo sapiens
caacgugcaucugguucug

SEQ ID NO: 1340305 - RNA, 19 nt, Homo sapiens
ccucugggacagugacaua

SEQ ID NO: 1340306 - RNA, 19 nt, Homo sapiens
ugccagaacugcccugucu

SEQ ID NO: 1340307 - RNA, 19 nt, Homo sapiens
ugacaacgugcaucugguu

SEQ ID NO: 1340308 - RNA, 19 nt, Homo sapiens
gcccagugguccuuucucu

SEQ ID NO: 1340309 - RNA, 19 nt, Homo sapiens
aauaaaggcagacgcuguu

SEQ ID NO: 1340310 - RNA, 19 nt, Homo sapiens
aagacgaugugcuacuguu

SEQ ID NO: 1340311 - RNA, 19 nt, Homo sapiens
ccuauacucagcccaggua

SEQ ID NO: 1340312 - RNA, 19 nt, Homo sapiens
cgaaucugguccuauacuc

SEQ ID NO: 1340313 - RNA, 19 nt, Homo sapiens
ugugggcucugugguauau

SEQ ID NO: 1340314 - RNA, 19 nt, Homo sapiens
aggaaaggcucaggguuca

SEQ ID NO: 1340315 - RNA, 19 nt, Homo sapiens
cugguucccugccucugua

SEQ ID NO: 1340316 - RNA, 19 nt, Homo sapiens
gacgggacuuaaauaaagg

SEQ ID NO: 1340317 - RNA, 19 nt, Homo sapiens
caacgugucagcagauggu

SEQ ID NO: 1340318 - RNA, 19 nt, Homo sapiens
ugggcucugugguauauga

SEQ ID NO: 1340319 - RNA, 19 nt, Homo sapiens
agagagagcggagcaagug

SEQ ID NO: 1340320 - RNA, 19 nt, Homo sapiens
ccucccaacugccagacuu

SEQ ID NO: 1340321 - RNA, 19 nt, Homo sapiens
guggagccgucgugaacug

SEQ ID NO: 1340322 - RNA, 19 nt, Homo sapiens
uggaggagcagcugacuca

SEQ ID NO: 1340323 - RNA, 19 nt, Homo sapiens
gcacugggaagagccugaa

SEQ ID NO: 1340324 - RNA, 19 nt, Homo sapiens
gagcugggucugucuuucu

SEQ ID NO: 1340325 - RNA, 19 nt, Homo sapiens
ccucauccuccuucucaaa

SEQ ID NO: 1340326 - RNA, 19 nt, Homo sapiens
ccgcugcgcuuucccucau

SEQ ID NO: 1340327 - RNA, 19 nt, Homo sapiens
cacccuaaccucuguguuc

SEQ ID NO: 1340328 - RNA, 19 nt, Homo sapiens
cugggagggucugggaaua

SEQ ID NO: 1340329 - RNA, 19 nt, Homo sapiens
cgaguucccauugcugaaa

SEQ ID NO: 1340330 - RNA, 19 nt, Homo sapiens
gugguggucuugcucuucu

SEQ ID NO: 1340331 - RNA, 19 nt, Homo sapiens
gcuggccugccuacucuuu

SEQ ID NO: 1340332 - RNA, 19 nt, Homo sapiens
gcugaaaggccacccuaac

SEQ ID NO: 1340333 - RNA, 19 nt, Homo sapiens
gaguucccauugcugaaag

SEQ ID NO: 1340334 - RNA, 19 nt, Homo sapiens
gugcaucugguucugaaug

SEQ ID NO: 1340335 - RNA, 19 nt, Homo sapiens
ucugugggcucugugguau

SEQ ID NO: 1340336 - RNA, 19 nt, Homo sapiens
uggcuggccugccuacucu

SEQ ID NO: 1340337 - RNA, 19 nt, Homo sapiens
gcagcucgccuuggagagu

SEQ ID NO: 1340338 - RNA, 19 nt, Homo sapiens
gccucucccuguacuggaa

SEQ ID NO: 1340339 - RNA, 19 nt, Homo sapiens
gcucaacgugucagcagau

SEQ ID NO: 1340340 - RNA, 19 nt, Homo sapiens
gguacgagaaggaacucaa

SEQ ID NO: 1340341 - RNA, 19 nt, Homo sapiens
ugacuggaccgcagaucau

SEQ ID NO: 1340342 - RNA, 19 nt, Homo sapiens
guacgaaucugguccuaua

SEQ ID NO: 1340343 - RNA, 19 nt, Homo sapiens
ggacgggacuuaaauaaag

SEQ ID NO: 1340344 - RNA, 19 nt, Homo sapiens
gggaagagccugaagauga

SEQ ID NO: 1340345 - RNA, 19 nt, Homo sapiens
ggacaagguucucgaguuc

SEQ ID NO: 1340346 - RNA, 19 nt, Homo sapiens
caaccuccuuccuuuauuu

SEQ ID NO: 1340347 - RNA, 19 nt, Homo sapiens
gaaccugacuccguuagga

SEQ ID NO: 1340348 - RNA, 19 nt, Homo sapiens
ggaagagccugaagaugag

SEQ ID NO: 1340349 - RNA, 19 nt, Homo sapiens
ggaaguaggaggagaguca

SEQ ID NO: 1340350 - RNA, 19 nt, Homo sapiens
cagagaggauccuugaaga

SEQ ID NO: 1340351 - RNA, 19 nt, Homo sapiens
guacuucacuacccagcaa

SEQ ID NO: 1340352 - RNA, 19 nt, Homo sapiens
ggacaaauacauccacaag

SEQ ID NO: 1340353 - RNA, 19 nt, Homo sapiens
gaccgcagaucauuaccuu

SEQ ID NO: 1340354 - RNA, 19 nt, Homo sapiens
caaaggacgcagugccaua

SEQ ID NO: 1340355 - RNA, 19 nt, Homo sapiens
caaagacgaugugcuacug

SEQ ID NO: 1340356 - RNA, 19 nt, Homo sapiens
ggacagagagugcacaaac

SEQ ID NO: 1340357 - RNA, 19 nt, Homo sapiens
cuacgcaccugcagacaga

SEQ ID NO: 1340358 - RNA, 19 nt, Homo sapiens
ccaaguccauucccacugu

SEQ ID NO: 1340359 - RNA, 19 nt, Homo sapiens
ucuccaaccuccuuccuuu

SEQ ID NO: 1340360 - RNA, 19 nt, Homo sapiens
agaaggagaccgacuguga

SEQ ID NO: 1340361 - RNA, 19 nt, Homo sapiens
gcuaugggacgaugacuug

SEQ ID NO: 1340362 - RNA, 19 nt, Homo sapiens
ucucaaagacgaugugcua

SEQ ID NO: 1340363 - RNA, 19 nt, Homo sapiens
ccacuggucccaccgcuuu

SEQ ID NO: 1340364 - RNA, 19 nt, Homo sapiens
ccaaccuccuuccuuuauu

SEQ ID NO: 1340365 - RNA, 19 nt, Homo sapiens
uaucagagaggauccuuga

SEQ ID NO: 1340366 - RNA, 19 nt, Homo sapiens
gggacgggacuuaaauaaa

SEQ ID NO: 1340367 - RNA, 19 nt, Homo sapiens
gaccgacugugaccucugu

SEQ ID NO: 1340368 - RNA, 19 nt, Homo sapiens
caaguccauucccacugua

SEQ ID NO: 1340369 - RNA, 19 nt, Homo sapiens
ggagugagguacgaaucug

SEQ ID NO: 1340370 - RNA, 19 nt, Homo sapiens
ggcugaggcucuugaaaca

SEQ ID NO: 1340371 - RNA, 19 nt, Homo sapiens
uggacaagguucucgaguu

SEQ ID NO: 1340372 - RNA, 19 nt, Homo sapiens
ccgcagaucauuaccuuga

SEQ ID NO: 1340373 - RNA, 19 nt, Homo sapiens
acagagagugcacaaacua

SEQ ID NO: 1340374 - RNA, 19 nt, Homo sapiens
gaagcccagugguccuuuc

SEQ ID NO: 1340375 - RNA, 19 nt, Homo sapiens
gcaaagccuccacgcuaug

SEQ ID NO: 1340376 - RNA, 19 nt, Homo sapiens
gacagagagugcacaaacu

SEQ ID NO: 1340377 - RNA, 19 nt, Homo sapiens
gaacccaguggcuguacuu

SEQ ID NO: 1340378 - RNA, 19 nt, Homo sapiens
gcagaucauuaccuugaac

SEQ ID NO: 1340379 - RNA, 19 nt, Homo sapiens
gaaggaacucaaccacaca

SEQ ID NO: 1340380 - RNA, 19 nt, Homo sapiens
gaaucugguccuauacuca

SEQ ID NO: 1340381 - RNA, 19 nt, Homo sapiens
ccaccuggcaccuagaaga

SEQ ID NO: 1340382 - RNA, 19 nt, Homo sapiens
cuccuccucuuccuccuua

SEQ ID NO: 1340383 - RNA, 19 nt, Homo sapiens
caacgugcaucugguucug

SEQ ID NO: 1340384 - RNA, 19 nt, Homo sapiens
ccucugggacagugacaua

SEQ ID NO: 1340385 - RNA, 19 nt, Homo sapiens
ccuccuuccuuuauuuguu

SEQ ID NO: 1340386 - RNA, 19 nt, Homo sapiens
gcccagugguccuuucucu

SEQ ID NO: 1340387 - RNA, 19 nt, Homo sapiens
ucagagaggauccuugaag

SEQ ID NO: 1340388 - RNA, 19 nt, Homo sapiens
ugacaacgugcaucugguu

SEQ ID NO: 1340389 - RNA, 19 nt, Homo sapiens
aauaaaggcagacgcuguu

SEQ ID NO: 1340390 - RNA, 19 nt, Homo sapiens
aagacgaugugcuacuguu

SEQ ID NO: 1340391 - RNA, 19 nt, Homo sapiens
ccuauacucagcccaggua

SEQ ID NO: 1340392 - RNA, 19 nt, Homo sapiens
cgaaucugguccuauacuc

SEQ ID NO: 1340393 - RNA, 19 nt, Homo sapiens
ugugggcucugugguauau

SEQ ID NO: 1340394 - RNA, 19 nt, Homo sapiens
agcaaagccuccacgcuau

SEQ ID NO: 1340395 - RNA, 19 nt, Homo sapiens
cugguucccugccucugua

SEQ ID NO: 1340396 - RNA, 19 nt, Homo sapiens
gacgggacuuaaauaaagg

SEQ ID NO: 1340397 - RNA, 19 nt, Homo sapiens
caacgugucagcagauggu

SEQ ID NO: 1340398 - RNA, 19 nt, Homo sapiens
ugggcucugugguauauga

SEQ ID NO: 1340399 - RNA, 19 nt, Homo sapiens
agagagagcggagcaagug

SEQ ID NO: 1340400 - RNA, 19 nt, Homo sapiens
ccucccaacugccagacuu

SEQ ID NO: 1340401 - RNA, 19 nt, Homo sapiens
guggagccgucgugaacug

SEQ ID NO: 1340402 - RNA, 19 nt, Homo sapiens
gcacugggaagagccugaa

SEQ ID NO: 1340403 - RNA, 19 nt, Homo sapiens
uggaggagcagcugacuca

SEQ ID NO: 1340404 - RNA, 19 nt, Homo sapiens
ccucauccuccuucucaaa

SEQ ID NO: 1340405 - RNA, 19 nt, Homo sapiens
ccgcugcgcuuucccucau

SEQ ID NO: 1340406 - RNA, 19 nt, Homo sapiens
cacccuaaccucuguguuc

SEQ ID NO: 1340407 - RNA, 19 nt, Homo sapiens
cgaguucccauugcugaaa

SEQ ID NO: 1340408 - RNA, 19 nt, Homo sapiens
aaaggacgcagugccauau

SEQ ID NO: 1340409 - RNA, 19 nt, Homo sapiens
gugguggucuugcucuucu

SEQ ID NO: 1340410 - RNA, 19 nt, Homo sapiens
gcuggccugccuacucuuu

SEQ ID NO: 1340411 - RNA, 19 nt, Homo sapiens
gcugaaaggccacccuaac

SEQ ID NO: 1340412 - RNA, 19 nt, Homo sapiens
gaguucccauugcugaaag

SEQ ID NO: 1340413 - RNA, 19 nt, Homo sapiens
gugcaucugguucugaaug

SEQ ID NO: 1340414 - RNA, 19 nt, Homo sapiens
ucugugggcucugugguau

SEQ ID NO: 1340415 - RNA, 19 nt, Homo sapiens
uggcuggccugccuacucu

SEQ ID NO: 1340416 - RNA, 19 nt, Homo sapiens
gccgaugccugugcaaagg

SEQ ID NO: 1340417 - RNA, 19 nt, Homo sapiens
gccucucccuguacuggaa

SEQ ID NO: 1340418 - RNA, 19 nt, Homo sapiens
gcucaacgugucagcagau

SEQ ID NO: 1340419 - RNA, 19 nt, Homo sapiens
gguacgagaaggaacucaa

SEQ ID NO: 1340420 - RNA, 19 nt, Homo sapiens
guacgaaucugguccuaua

SEQ ID NO: 1340421 - RNA, 19 nt, Homo sapiens
ggacgggacuuaaauaaag

SEQ ID NO: 1340422 - RNA, 19 nt, Homo sapiens
gggaagagccugaagauga

SEQ ID NO: 1340423 - RNA, 19 nt, Homo sapiens
ggacaagguucucgaguuc

SEQ ID NO: 1340424 - RNA, 19 nt, Homo sapiens
gaaccugacuccguuagga

SEQ ID NO: 1340425 - RNA, 19 nt, Homo sapiens
ggaagagccugaagaugag

SEQ ID NO: 1340426 - RNA, 19 nt, Homo sapiens
ggaaguaggaggagaguca

SEQ ID NO: 1340427 - RNA, 19 nt, Homo sapiens
cagagaggauccuugaaga

SEQ ID NO: 1340428 - RNA, 19 nt, Homo sapiens
ggacaaauacauccacaag

SEQ ID NO: 1340429 - RNA, 19 nt, Homo sapiens
gaccgcagaucauuaccuu

SEQ ID NO: 1340430 - RNA, 19 nt, Homo sapiens
caaaggacgcagugccaua

SEQ ID NO: 1340431 - RNA, 19 nt, Homo sapiens
ggacagagagugcacaaac

SEQ ID NO: 1340432 - RNA, 19 nt, Homo sapiens
cuacgcaccugcagacaga

SEQ ID NO: 1340433 - RNA, 19 nt, Homo sapiens
acacacagacagugacaua

SEQ ID NO: 1340434 - RNA, 19 nt, Homo sapiens
ccaaguccauucccacugu

SEQ ID NO: 1340435 - RNA, 19 nt, Homo sapiens
agaaggagaccgacuguga

SEQ ID NO: 1340436 - RNA, 19 nt, Homo sapiens
gcuaugggacgaugacuug

SEQ ID NO: 1340437 - RNA, 19 nt, Homo sapiens
ccacuggucccaccgcuuu

SEQ ID NO: 1340438 - RNA, 19 nt, Homo sapiens
uaucagagaggauccuuga

SEQ ID NO: 1340439 - RNA, 19 nt, Homo sapiens
gggacgggacuuaaauaaa

SEQ ID NO: 1340440 - RNA, 19 nt, Homo sapiens
gaccgacugugaccucugu

SEQ ID NO: 1340441 - RNA, 19 nt, Homo sapiens
caaguccauucccacugua

SEQ ID NO: 1340442 - RNA, 19 nt, Homo sapiens
ggagugagguacgaaucug

SEQ ID NO: 1340443 - RNA, 19 nt, Homo sapiens
ggcugaggcucuugaaaca

SEQ ID NO: 1340444 - RNA, 19 nt, Homo sapiens
uggacaagguucucgaguu

SEQ ID NO: 1340445 - RNA, 19 nt, Homo sapiens
ccgcagaucauuaccuuga

SEQ ID NO: 1340446 - RNA, 19 nt, Homo sapiens
acagagagugcacaaacua

SEQ ID NO: 1340447 - RNA, 19 nt, Homo sapiens
gcagaucauuaccuugaac

SEQ ID NO: 1340448 - RNA, 19 nt, Homo sapiens
gacagagagugcacaaacu

SEQ ID NO: 1340449 - RNA, 19 nt, Homo sapiens
gaagcccagugguccuuuc

SEQ ID NO: 1340450 - RNA, 19 nt, Homo sapiens
gaaggaacucaaccacaca

SEQ ID NO: 1340451 - RNA, 19 nt, Homo sapiens
gaaucugguccuauacuca

SEQ ID NO: 1340452 - RNA, 19 nt, Homo sapiens
ccaccuggcaccuagaaga

SEQ ID NO: 1340453 - RNA, 19 nt, Homo sapiens
caacgugcaucugguucug

SEQ ID NO: 1340454 - RNA, 19 nt, Homo sapiens
ucagagaggauccuugaag

SEQ ID NO: 1340455 - RNA, 19 nt, Homo sapiens
ugacaacgugcaucugguu

SEQ ID NO: 1340456 - RNA, 19 nt, Homo sapiens
gcccagugguccuuucucu

SEQ ID NO: 1340457 - RNA, 19 nt, Homo sapiens
aauaaaggcagacgcuguu

SEQ ID NO: 1340458 - RNA, 19 nt, Homo sapiens
ccuauacucagcccaggua

SEQ ID NO: 1340459 - RNA, 19 nt, Homo sapiens
cgaaucugguccuauacuc

SEQ ID NO: 1340460 - RNA, 19 nt, Homo sapiens
ugugggcucugugguauau

SEQ ID NO: 1340461 - RNA, 19 nt, Homo sapiens
cugguucccugccucugua

SEQ ID NO: 1340462 - RNA, 19 nt, Homo sapiens
gacgggacuuaaauaaagg

SEQ ID NO: 1340463 - RNA, 19 nt, Homo sapiens
caacgugucagcagauggu

SEQ ID NO: 1340464 - RNA, 19 nt, Homo sapiens
ugggcucugugguauauga

SEQ ID NO: 1340465 - RNA, 19 nt, Homo sapiens
agagagagcggagcaagug

SEQ ID NO: 1340466 - RNA, 19 nt, Homo sapiens
ccucccaacugccagacuu

SEQ ID NO: 1340467 - RNA, 19 nt, Homo sapiens
guggagccgucgugaacug

SEQ ID NO: 1340468 - RNA, 19 nt, Homo sapiens
uggaggagcagcugacuca

SEQ ID NO: 1340469 - RNA, 19 nt, Homo sapiens
gcacugggaagagccugaa

SEQ ID NO: 1340470 - RNA, 19 nt, Homo sapiens
ccucauccuccuucucaaa

SEQ ID NO: 1340471 - RNA, 19 nt, Homo sapiens
ccgcugcgcuuucccucau

SEQ ID NO: 1340472 - RNA, 19 nt, Homo sapiens
cacccuaaccucuguguuc

SEQ ID NO: 1340473 - RNA, 19 nt, Homo sapiens
cgaguucccauugcugaaa

SEQ ID NO: 1340474 - RNA, 19 nt, Homo sapiens
aaaggacgcagugccauau

SEQ ID NO: 1340475 - RNA, 19 nt, Homo sapiens
gugguggucuugcucuucu

SEQ ID NO: 1340476 - RNA, 19 nt, Homo sapiens
gcuggccugccuacucuuu

SEQ ID NO: 1340477 - RNA, 19 nt, Homo sapiens
gcugaaaggccacccuaac

SEQ ID NO: 1340478 - RNA, 19 nt, Homo sapiens
gaguucccauugcugaaag

SEQ ID NO: 1340479 - RNA, 19 nt, Homo sapiens
gugcaucugguucugaaug

SEQ ID NO: 1340480 - RNA, 19 nt, Homo sapiens
ucugugggcucugugguau

SEQ ID NO: 1340481 - RNA, 19 nt, Homo sapiens
cacagacagugacauacuc

SEQ ID NO: 1340482 - RNA, 19 nt, Homo sapiens
uggcuggccugccuacucu

SEQ ID NO: 1340483 - RNA, 19 nt, Homo sapiens
gccgaugccugugcaaagg

SEQ ID NO: 1340484 - RNA, 19 nt, Homo sapiens
gccucucccuguacuggaa

SEQ ID NO: 1340485 - RNA, 19 nt, Homo sapiens
gcucaacgugucagcagau

SEQ ID NO: 1340486 - RNA, 19 nt, Homo sapiens
gguacgagaaggaacucaa

SEQ ID NO: 1340487 - RNA, 19 nt, Homo sapiens
ugacuggaccgcagaucau

SEQ ID NO: 1340488 - RNA, 19 nt, Homo sapiens
ggagaaauggaaacaauua

SEQ ID NO: 1340489 - RNA, 19 nt, Homo sapiens
gauaguaggcacucaauaa

SEQ ID NO: 1340490 - RNA, 19 nt, Homo sapiens
gagaaccacugaacugaau

SEQ ID NO: 1340491 - RNA, 19 nt, Homo sapiens
aguaggcacucaauaaaua

SEQ ID NO: 1340492 - RNA, 19 nt, Homo sapiens
gaauuaaggcugguuauug

SEQ ID NO: 1340493 - RNA, 19 nt, Homo sapiens
gaagccagauguugcucuu

SEQ ID NO: 1340494 - RNA, 19 nt, Homo sapiens
agacugcgcuucuaacaag

SEQ ID NO: 1340495 - RNA, 19 nt, Homo sapiens
gaaccacugaacugaauga

SEQ ID NO: 1340496 - RNA, 19 nt, Homo sapiens
aauuaaggcugguuauugu

SEQ ID NO: 1340497 - RNA, 19 nt, Homo sapiens
gaucagauuggguuugaga

SEQ ID NO: 1340498 - RNA, 19 nt, Homo sapiens
uauaguaccacgauuauuc

SEQ ID NO: 1340499 - RNA, 19 nt, Homo sapiens
cgccuccgcuccuguuuaa

SEQ ID NO: 1340500 - RNA, 19 nt, Homo sapiens
gaaugaagcaugugaaaau

SEQ ID NO: 1340501 - RNA, 19 nt, Homo sapiens
auaccgagcuugacacaca

SEQ ID NO: 1340502 - RNA, 19 nt, Homo sapiens
aaaggugccuggugauagu

SEQ ID NO: 1340503 - RNA, 19 nt, Homo sapiens
gaaauggaaacaauuacag

SEQ ID NO: 1340504 - RNA, 19 nt, Homo sapiens
gcccaucccuagaguguag

SEQ ID NO: 1340505 - RNA, 19 nt, Homo sapiens
ugaacugaaugaagcaugu

SEQ ID NO: 1340506 - RNA, 19 nt, Homo sapiens
ucuaacaagucucccaguu

SEQ ID NO: 1340507 - RNA, 19 nt, Homo sapiens
ucaaaggugccuggugaua

SEQ ID NO: 1340508 - RNA, 19 nt, Homo sapiens
ccuuauuucuguaaaccua

SEQ ID NO: 1340509 - RNA, 19 nt, Homo sapiens
guugcucuuugaccuauuu

SEQ ID NO: 1340510 - RNA, 19 nt, Homo sapiens
ucagguagcacagauuauu

SEQ ID NO: 1340511 - RNA, 19 nt, Homo sapiens
gauauccgggaguucauuu

SEQ ID NO: 1340512 - RNA, 19 nt, Homo sapiens
ucucagguagcacagauua

SEQ ID NO: 1340513 - RNA, 19 nt, Homo sapiens
gccagauguugcucuuuga

SEQ ID NO: 1340514 - RNA, 19 nt, Homo sapiens
ggagccuuauuucuguaaa

SEQ ID NO: 1340515 - RNA, 19 nt, Homo sapiens
gaaaauuggagaaauggaa

SEQ ID NO: 1340516 - RNA, 19 nt, Homo sapiens
acacacacacucacuccua

SEQ ID NO: 1340517 - RNA, 19 nt, Homo sapiens
uggaucagauuggguuuga

SEQ ID NO: 1340518 - RNA, 19 nt, Homo sapiens
uuggagaaauggaaacaau

SEQ ID NO: 1340519 - RNA, 19 nt, Homo sapiens
gcucuuugaccuauuuaau

SEQ ID NO: 1340520 - RNA, 19 nt, Homo sapiens
ccuaagacugcgcuucuaa

SEQ ID NO: 1340521 - RNA, 19 nt, Homo sapiens
cacacacacucacuccuau

SEQ ID NO: 1340522 - RNA, 19 nt, Homo sapiens
caaaggugccuggugauag

SEQ ID NO: 1340523 - RNA, 19 nt, Homo sapiens
cuaacaagucucccaguug

SEQ ID NO: 1340524 - RNA, 19 nt, Homo sapiens
agccagauguugcucuuug

SEQ ID NO: 1340525 - RNA, 19 nt, Homo sapiens
guaggcacucaauaaauau

SEQ ID NO: 1340526 - RNA, 19 nt, Homo sapiens
gauguugcucuuugaccua

SEQ ID NO: 1340527 - RNA, 19 nt, Homo sapiens
ugaauuaaggcugguuauu

SEQ ID NO: 1340528 - RNA, 19 nt, Homo sapiens
gcgccuccgcuccuguuua

SEQ ID NO: 1340529 - RNA, 19 nt, Homo sapiens
auaguaggcacucaauaaa

SEQ ID NO: 1340530 - RNA, 19 nt, Homo sapiens
uccgggaguucauuucuga

SEQ ID NO: 1340531 - RNA, 19 nt, Homo sapiens
gccuaagacugcgcuucua

SEQ ID NO: 1340532 - RNA, 19 nt, Homo sapiens
uaagacugcgcuucuaaca

SEQ ID NO: 1340533 - RNA, 19 nt, Homo sapiens
ccacgauuauucccaucau

SEQ ID NO: 1340534 - RNA, 19 nt, Homo sapiens
ugagaaccacugaacugaa

SEQ ID NO: 1340535 - RNA, 19 nt, Homo sapiens
uaugagaaccacugaacug

SEQ ID NO: 1340536 - RNA, 19 nt, Homo sapiens
gguuauuguuggaucagau

SEQ ID NO: 1340537 - RNA, 19 nt, Homo sapiens
gagaaauggaaacaauuac

SEQ ID NO: 1340538 - RNA, 19 nt, Homo sapiens
ggauauccgggaguucauu

SEQ ID NO: 1340539 - RNA, 19 nt, Homo sapiens
gggaccacauuaugagaac

SEQ ID NO: 1340540 - RNA, 19 nt, Homo sapiens
gcugguuauuguuggauca

SEQ ID NO: 1340541 - RNA, 19 nt, Homo sapiens
gauuauucccaucaucuca

SEQ ID NO: 1340542 - RNA, 19 nt, Homo sapiens
gagccuuauuucuguaaac

SEQ ID NO: 1340543 - RNA, 19 nt, Homo sapiens
gaacugaaugaagcaugug

SEQ ID NO: 1340544 - RNA, 19 nt, Homo sapiens
cuugaacucccgcuugauu

SEQ ID NO: 1340545 - RNA, 19 nt, Homo sapiens
ugacacacacacacaaucu

SEQ ID NO: 1340546 - RNA, 19 nt, Homo sapiens
cagguagcacagauuauug

SEQ ID NO: 1340547 - RNA, 19 nt, Homo sapiens
acaauuacaguacccuuca

SEQ ID NO: 1340548 - RNA, 19 nt, Homo sapiens
uuaaggcugguuauuguug

SEQ ID NO: 1340549 - RNA, 19 nt, Homo sapiens
ugauaguaggcacucaaua

SEQ ID NO: 1340550 - RNA, 19 nt, Homo sapiens
gggagccuuauuucuguaa

SEQ ID NO: 1340551 - RNA, 19 nt, Homo sapiens
gaccugagcacacgaacac

SEQ ID NO: 1340552 - RNA, 19 nt, Homo sapiens
cccaguugcugcugcuguu

SEQ ID NO: 1340553 - RNA, 19 nt, Homo sapiens
ggguuuagaagccagaugu

SEQ ID NO: 1340554 - RNA, 19 nt, Homo sapiens
ggugauaguaggcacucaa

SEQ ID NO: 1340555 - RNA, 19 nt, Homo sapiens
uccuugaacucccgcuuga

SEQ ID NO: 1340556 - RNA, 19 nt, Homo sapiens
gguagcacagauuauugaa

SEQ ID NO: 1340557 - RNA, 19 nt, Homo sapiens
ucugcaacauuuauaguac

SEQ ID NO: 1340558 - RNA, 19 nt, Homo sapiens
uaguaggcacucaauaaau

SEQ ID NO: 1340559 - RNA, 19 nt, Homo sapiens
guaaaccuaggccucaaag

SEQ ID NO: 1340560 - RNA, 19 nt, Homo sapiens
acacgaacacugccacuac

SEQ ID NO: 1340561 - RNA, 19 nt, Homo sapiens
cugaaugaagcaugugaaa

SEQ ID NO: 1340562 - RNA, 19 nt, Homo sapiens
acacacacacacacacuca

SEQ ID NO: 1340563 - RNA, 19 nt, Homo sapiens
guuauuguuggaucagauu

SEQ ID NO: 1340564 - RNA, 19 nt, Homo sapiens
ugaaugaguaaaugaguac

SEQ ID NO: 1340565 - RNA, 19 nt, Homo sapiens
uggagaaauggaaacaauu

SEQ ID NO: 1340566 - RNA, 19 nt, Homo sapiens
ucacacacacacacacaca

SEQ ID NO: 1340567 - RNA, 19 nt, Homo sapiens
gcaaucagauaugcauuua

SEQ ID NO: 1340568 - RNA, 19 nt, Homo sapiens
ggaaccaguuugugaauuu

SEQ ID NO: 1340569 - RNA, 19 nt, Homo sapiens
agaaagaacuggcaugaaa

SEQ ID NO: 1340570 - RNA, 19 nt, Homo sapiens
ggcagaaucucuaugauga

SEQ ID NO: 1340571 - RNA, 19 nt, Homo sapiens
caaaggaggcaaucagaua

SEQ ID NO: 1340572 - RNA, 19 nt, Homo sapiens
ggaauggacuugaccaaca

SEQ ID NO: 1340573 - RNA, 19 nt, Homo sapiens
gggaguaaaugcaaacaug

SEQ ID NO: 1340574 - RNA, 19 nt, Homo sapiens
agacaucgaucaacauaug

SEQ ID NO: 1340575 - RNA, 19 nt, Homo sapiens
gaauggacuugaccaacaa

SEQ ID NO: 1340576 - RNA, 19 nt, Homo sapiens
aaauauuggucucugcuua

SEQ ID NO: 1340577 - RNA, 19 nt, Homo sapiens
ggucagaacaguuugguuu

SEQ ID NO: 1340578 - RNA, 19 nt, Homo sapiens
gcaaugacaauaaugauca

SEQ ID NO: 1340579 - RNA, 19 nt, Homo sapiens
ggucucaguuaauuuagaa

SEQ ID NO: 1340580 - RNA, 19 nt, Homo sapiens
caacuugacuuuucccuuu

SEQ ID NO: 1340581 - RNA, 19 nt, Homo sapiens
gacauuccauuucauaaca

SEQ ID NO: 1340582 - RNA, 19 nt, Homo sapiens
gcaggcagaaucucuauga

SEQ ID NO: 1340583 - RNA, 19 nt, Homo sapiens
gaaccaguuugugaauuug

SEQ ID NO: 1340584 - RNA, 19 nt, Homo sapiens
ggacuugaccaacaaccua

SEQ ID NO: 1340585 - RNA, 19 nt, Homo sapiens
gagcaaugacuuuaauaga

SEQ ID NO: 1340586 - RNA, 19 nt, Homo sapiens
ugaauacucugcuugaaag

SEQ ID NO: 1340587 - RNA, 19 nt, Homo sapiens
gcagaaagaacuggcauga

SEQ ID NO: 1340588 - RNA, 19 nt, Homo sapiens
ccacgugguugaagcagaa

SEQ ID NO: 1340589 - RNA, 19 nt, Homo sapiens
gcuaauagagccucguuug

SEQ ID NO: 1340590 - RNA, 19 nt, Homo sapiens
gagacuacaaaccaaauaa

SEQ ID NO: 1340591 - RNA, 19 nt, Homo sapiens
caugagacaucgaucaaca

SEQ ID NO: 1340592 - RNA, 19 nt, Homo sapiens
ggagacuacaaaccaaaua

SEQ ID NO: 1340593 - RNA, 19 nt, Homo sapiens
gaaagaugaaggagggauu

SEQ ID NO: 1340594 - RNA, 19 nt, Homo sapiens
gaguaaaugcaaacaugua

SEQ ID NO: 1340595 - RNA, 19 nt, Homo sapiens
acaggucucaguuaauuua

SEQ ID NO: 1340596 - RNA, 19 nt, Homo sapiens
caacuucaaucaaggaaaa

SEQ ID NO: 1340597 - RNA, 19 nt, Homo sapiens
uaauagagccucguuugaa

SEQ ID NO: 1340598 - RNA, 19 nt, Homo sapiens
gaccaacaaccuagagauu

SEQ ID NO: 1340599 - RNA, 19 nt, Homo sapiens
caaaagauuucccacaaug

SEQ ID NO: 1340600 - RNA, 19 nt, Homo sapiens
ggugacauuccauuucaua

SEQ ID NO: 1340601 - RNA, 19 nt, Homo sapiens
gugauugucauucaucuuu

SEQ ID NO: 1340602 - RNA, 19 nt, Homo sapiens
ggauaaguaagauguguga

SEQ ID NO: 1340603 - RNA, 19 nt, Homo sapiens
gcccgaaauuugaagauuc

SEQ ID NO: 1340604 - RNA, 19 nt, Homo sapiens
ccucagcaaugacaauaau

SEQ ID NO: 1340605 - RNA, 19 nt, Homo sapiens
ggucauagguagguaagag

SEQ ID NO: 1340606 - RNA, 19 nt, Homo sapiens
ugagacaucgaucaacaua

SEQ ID NO: 1340607 - RNA, 19 nt, Homo sapiens
ccaaagcggucagaacagu

SEQ ID NO: 1340608 - RNA, 19 nt, Homo sapiens
aaagacaucugccucaacu

SEQ ID NO: 1340609 - RNA, 19 nt, Homo sapiens
aauagagccucguuugaau

SEQ ID NO: 1340610 - RNA, 19 nt, Homo sapiens
cccuuuagcuuagugauuu

SEQ ID NO: 1340611 - RNA, 19 nt, Homo sapiens
ccaacaaccuagagauuuu

SEQ ID NO: 1340612 - RNA, 19 nt, Homo sapiens
gagaaacuguaggcagaug

SEQ ID NO: 1340613 - RNA, 19 nt, Homo sapiens
ggagcaaugacuuuaauag

SEQ ID NO: 1340614 - RNA, 19 nt, Homo sapiens
gaagacaugagacaucgau

SEQ ID NO: 1340615 - RNA, 19 nt, Homo sapiens
gauagcaagagaaacugua

SEQ ID NO: 1340616 - RNA, 19 nt, Homo sapiens
ggcaaucagauaugcauuu

SEQ ID NO: 1340617 - RNA, 19 nt, Homo sapiens
ucuucuggguuucugauua

SEQ ID NO: 1340618 - RNA, 19 nt, Homo sapiens
gauugucauucaucuuuca

SEQ ID NO: 1340619 - RNA, 19 nt, Homo sapiens
cuuagaggauacauuaaug

SEQ ID NO: 1340620 - RNA, 19 nt, Homo sapiens
uaauguuccucaucucuag

SEQ ID NO: 1340621 - RNA, 19 nt, Homo sapiens
ucucagugauugucauuca

SEQ ID NO: 1340622 - RNA, 19 nt, Homo sapiens
gcccaaagcggucagaaca

SEQ ID NO: 1340623 - RNA, 19 nt, Homo sapiens
gagauuuucuuucaguuga

SEQ ID NO: 1340624 - RNA, 19 nt, Homo sapiens
ccucaucucuagcaguguu

SEQ ID NO: 1340625 - RNA, 19 nt, Homo sapiens
ggaguaaaugcaaacaugu

SEQ ID NO: 1340626 - RNA, 19 nt, Homo sapiens
gagauagauuuuacucuga

SEQ ID NO: 1340627 - RNA, 19 nt, Homo sapiens
gaaagaacuggcaugaaac

SEQ ID NO: 1340628 - RNA, 19 nt, Homo sapiens
ucaccucccugcucaucuu

SEQ ID NO: 1340629 - RNA, 19 nt, Homo sapiens
ccagagaugacucaaagug

SEQ ID NO: 1340630 - RNA, 19 nt, Homo sapiens
gccgaacuguagcaaauca

SEQ ID NO: 1340631 - RNA, 19 nt, Homo sapiens
ggaauuuugucuaucaaug

SEQ ID NO: 1340632 - RNA, 19 nt, Homo sapiens
ccagcaaaauacucaauaa

SEQ ID NO: 1340633 - RNA, 19 nt, Homo sapiens
gacaugagacaucgaucaa

SEQ ID NO: 1340634 - RNA, 19 nt, Homo sapiens
ucagaacaguuugguuuua

SEQ ID NO: 1340635 - RNA, 19 nt, Homo sapiens
gaggacaagcccacucaga

SEQ ID NO: 1340636 - RNA, 19 nt, Homo sapiens
gagccucguuugaauacuc

SEQ ID NO: 1340637 - RNA, 19 nt, Homo sapiens
gcacugcuguguacaaaag

SEQ ID NO: 1340638 - RNA, 19 nt, Homo sapiens
ucagcaaugacaauaauga

SEQ ID NO: 1340639 - RNA, 19 nt, Homo sapiens
uguagcaaaucaguaacua

SEQ ID NO: 1340640 - RNA, 19 nt, Homo sapiens
cuaauagagccucguuuga

SEQ ID NO: 1340641 - RNA, 19 nt, Homo sapiens
auuaaugucucagugauug

SEQ ID NO: 1340642 - RNA, 19 nt, Homo sapiens
ugauuagucucuccaaagg

SEQ ID NO: 1340643 - RNA, 19 nt, Homo sapiens
gagggugacauuccauuuc

SEQ ID NO: 1340644 - RNA, 19 nt, Homo sapiens
cagaugcaacggcaggaua

SEQ ID NO: 1340645 - RNA, 19 nt, Homo sapiens
uaugaugacuggaauuuug

SEQ ID NO: 1340646 - RNA, 19 nt, Homo sapiens
uagaaugggaggcauguau

SEQ ID NO: 1340647 - RNA, 19 nt, Homo sapiens
aaaggaggcaaucagauau

SEQ ID NO: 1340648 - RNA, 19 nt, Homo sapiens
guagguaagagacaaaugg

SEQ ID NO: 1340649 - RNA, 19 nt, Homo sapiens
guugcauucuucuggguuu

SEQ ID NO: 1340650 - RNA, 19 nt, Homo sapiens
ccauucugccuucaaguuu

SEQ ID NO: 1340651 - RNA, 19 nt, Homo sapiens
gguggaaccaguuugugaa

SEQ ID NO: 1340652 - RNA, 19 nt, Homo sapiens
agccagagaugacucaaag

SEQ ID NO: 1340653 - RNA, 19 nt, Homo sapiens
aaagcggucagaacaguuu

SEQ ID NO: 1340654 - RNA, 19 nt, Homo sapiens
agacaucugccucaacuuc

SEQ ID NO: 1340655 - RNA, 19 nt, Homo sapiens
ugacuggaauuuugucuau

SEQ ID NO: 1340656 - RNA, 19 nt, Homo sapiens
aaagauuucccacaaugga

SEQ ID NO: 1340657 - RNA, 19 nt, Homo sapiens
ucgaucaacauauguaaga

SEQ ID NO: 1340658 - RNA, 19 nt, Homo sapiens
ggccagacaggcuaauguu

SEQ ID NO: 1340659 - RNA, 19 nt, Homo sapiens
aauauuggucucugcuuaa

SEQ ID NO: 1340660 - RNA, 19 nt, Homo sapiens
gcaacggcaggauaaaaua

SEQ ID NO: 1340661 - RNA, 19 nt, Homo sapiens
caucgaucaacauauguaa

SEQ ID NO: 1340662 - RNA, 19 nt, Homo sapiens
aaagcgauagcaagagaaa

SEQ ID NO: 1340663 - RNA, 19 nt, Homo sapiens
aaagaugaaggagggauuu

SEQ ID NO: 1340664 - RNA, 19 nt, Homo sapiens
uacaaaagauuucccacaa

SEQ ID NO: 1340665 - RNA, 19 nt, Homo sapiens
cuaauguuccucaucucua

SEQ ID NO: 1340666 - RNA, 19 nt, Homo sapiens
agauaaacauugguucagu

SEQ ID NO: 1340667 - RNA, 19 nt, Homo sapiens
ggcaauagcucaccguuua

SEQ ID NO: 1340668 - RNA, 19 nt, Homo sapiens
guacaacacuccaauaaac

SEQ ID NO: 1340669 - RNA, 19 nt, Homo sapiens
caaauacgcuuagcugugu

SEQ ID NO: 1340670 - RNA, 19 nt, Homo sapiens
ggagaucgccuacaaguuc

SEQ ID NO: 1340671 - RNA, 19 nt, Homo sapiens
ggagguucauugagaauug

SEQ ID NO: 1340672 - RNA, 19 nt, Homo sapiens
gggaggagaucgccuacaa

SEQ ID NO: 1340673 - RNA, 19 nt, Homo sapiens
gaaaccaucccucugugua

SEQ ID NO: 1340674 - RNA, 19 nt, Homo sapiens
acacaugcgucuauccaua

SEQ ID NO: 1340675 - RNA, 19 nt, Homo sapiens
aagugcagcucaagucuua

SEQ ID NO: 1340676 - RNA, 19 nt, Homo sapiens
gaacaacucggacaaggau

SEQ ID NO: 1340677 - RNA, 19 nt, Homo sapiens
gggaaacaauuugcauuug

SEQ ID NO: 1340678 - RNA, 19 nt, Homo sapiens
cguaagaccugucacaaca

SEQ ID NO: 1340679 - RNA, 19 nt, Homo sapiens
ggacuuucauuucagagau

SEQ ID NO: 1340680 - RNA, 19 nt, Homo sapiens
ggcauggacuuucauuuca

SEQ ID NO: 1340681 - RNA, 19 nt, Homo sapiens
gaagaaguccucggugaug

SEQ ID NO: 1340682 - RNA, 19 nt, Homo sapiens
agaauugagucuuuggaaa

SEQ ID NO: 1340683 - RNA, 19 nt, Homo sapiens
ggaguacgacuucaagaug

SEQ ID NO: 1340684 - RNA, 19 nt, Homo sapiens
gcccaguccuguccugaaa

SEQ ID NO: 1340685 - RNA, 19 nt, Homo sapiens
ggaggaggaagccgaguuu

SEQ ID NO: 1340686 - RNA, 19 nt, Homo sapiens
uaacgcggauggcgaggaa

SEQ ID NO: 1340687 - RNA, 19 nt, Homo sapiens
cauugagaauugagucuuu

SEQ ID NO: 1340688 - RNA, 19 nt, Homo sapiens
ggaguuggucugugauuug

SEQ ID NO: 1340689 - RNA, 19 nt, Homo sapiens
ccucgacgcugguguggaa

SEQ ID NO: 1340690 - RNA, 19 nt, Homo sapiens
acgcggcaguucuuuguua

SEQ ID NO: 1340691 - RNA, 19 nt, Homo sapiens
guaagcccgugccguguga

SEQ ID NO: 1340692 - RNA, 19 nt, Homo sapiens
ggcagagccuccuucagaa

SEQ ID NO: 1340693 - RNA, 19 nt, Homo sapiens
cggcagagccuccuucaga

SEQ ID NO: 1340694 - RNA, 19 nt, Homo sapiens
ggcagaagcugugaguuuc

SEQ ID NO: 1340695 - RNA, 19 nt, Homo sapiens
uaagaccugucacaacaau

SEQ ID NO: 1340696 - RNA, 19 nt, Homo sapiens
ccucauagauacacagaag

SEQ ID NO: 1340697 - RNA, 19 nt, Homo sapiens
gcagagccuccuucagaaa

SEQ ID NO: 1340698 - RNA, 19 nt, Homo sapiens
gaagaugcuugggcuugga

SEQ ID NO: 1340699 - RNA, 19 nt, Homo sapiens
cuugauacauuucuagaga

SEQ ID NO: 1340700 - RNA, 19 nt, Homo sapiens
gagaauugagucuuuggaa

SEQ ID NO: 1340701 - RNA, 19 nt, Homo sapiens
gaaacugcguaggaauuca

SEQ ID NO: 1340702 - RNA, 19 nt, Homo sapiens
gcaaguuugugcagcucaa

SEQ ID NO: 1340703 - RNA, 19 nt, Homo sapiens
gggcuggcauggacuuuca

SEQ ID NO: 1340704 - RNA, 19 nt, Homo sapiens
gcagggaacgccaccaugu

SEQ ID NO: 1340705 - RNA, 19 nt, Homo sapiens
gaagagggagggcgagcuu

SEQ ID NO: 1340706 - RNA, 19 nt, Homo sapiens
gugcacagcgccagguuaa

SEQ ID NO: 1340707 - RNA, 19 nt, Homo sapiens
gagaucgccuacaaguuca

SEQ ID NO: 1340708 - RNA, 19 nt, Homo sapiens
gcacgcggcaguucuuugu

SEQ ID NO: 1340709 - RNA, 19 nt, Homo sapiens
gagguucauugagaauuga

SEQ ID NO: 1340710 - RNA, 19 nt, Homo sapiens
agaccugucacaacaauaa

SEQ ID NO: 1340711 - RNA, 19 nt, Homo sapiens
ggaaacugcguaggaauuc

SEQ ID NO: 1340712 - RNA, 19 nt, Homo sapiens
ccacacaccuuucuuuacc

SEQ ID NO: 1340713 - RNA, 19 nt, Homo sapiens
aaaagcagcuggagaagga

SEQ ID NO: 1340714 - RNA, 19 nt, Homo sapiens
gaggagaucgccuacaagu

SEQ ID NO: 1340715 - RNA, 19 nt, Homo sapiens
gggcgcaucuuaccaaagc

SEQ ID NO: 1340716 - RNA, 19 nt, Homo sapiens
guuuacacccucccucaua

SEQ ID NO: 1340717 - RNA, 19 nt, Homo sapiens
gaaagugcagcucaagucu

SEQ ID NO: 1340718 - RNA, 19 nt, Homo sapiens
caacaagagcgccaagaag

SEQ ID NO: 1340719 - RNA, 19 nt, Homo sapiens
gacuuucauuucagagauu

SEQ ID NO: 1340720 - RNA, 19 nt, Homo sapiens
cgucugcccugugccuaua

SEQ ID NO: 1340721 - RNA, 19 nt, Homo sapiens
gaagcuggcccuggacaug

SEQ ID NO: 1340722 - RNA, 19 nt, Homo sapiens
caacacuccaauaaacauu

SEQ ID NO: 1340723 - RNA, 19 nt, Homo sapiens
aaaccaucccucuguguaa

SEQ ID NO: 1340724 - RNA, 19 nt, Homo sapiens
ggucucagccacauccuau

SEQ ID NO: 1340725 - RNA, 19 nt, Homo sapiens
gaagucccggucccaugua

SEQ ID NO: 1340726 - RNA, 19 nt, Homo sapiens
gugccuauauauacacaug

SEQ ID NO: 1340727 - RNA, 19 nt, Homo sapiens
ucaacaagagcgccaagaa

SEQ ID NO: 1340728 - RNA, 19 nt, Homo sapiens
gaagcugugaguuucagaa

SEQ ID NO: 1340729 - RNA, 19 nt, Homo sapiens
aggcagaagcugugaguuu

SEQ ID NO: 1340730 - RNA, 19 nt, Homo sapiens
ucauuggcuuucuuuaguu

SEQ ID NO: 1340731 - RNA, 19 nt, Homo sapiens
gcgaggaaguggccaugag

SEQ ID NO: 1340732 - RNA, 19 nt, Homo sapiens
cauggacuuucauuucaga

SEQ ID NO: 1340733 - RNA, 19 nt, Homo sapiens
aaagcuguauccuggaguu

SEQ ID NO: 1340734 - RNA, 19 nt, Homo sapiens
cauagauacacagaaguua

SEQ ID NO: 1340735 - RNA, 19 nt, Homo sapiens
caaggccaccugacuccua

SEQ ID NO: 1340736 - RNA, 19 nt, Homo sapiens
gcgcggaaacugcguagga

SEQ ID NO: 1340737 - RNA, 19 nt, Homo sapiens
ggaggaagaggaggaggaa

SEQ ID NO: 1340738 - RNA, 19 nt, Homo sapiens
uaagaagaugcaugccuaa

SEQ ID NO: 1340739 - RNA, 19 nt, Homo sapiens
aacaagagcgccaagaaga

SEQ ID NO: 1340740 - RNA, 19 nt, Homo sapiens
ugggaaacaauuugcauuu

SEQ ID NO: 1340741 - RNA, 19 nt, Homo sapiens
gaccggcuccugcucaaga

SEQ ID NO: 1340742 - RNA, 19 nt, Homo sapiens
ucauagauacacagaaguu

SEQ ID NO: 1340743 - RNA, 19 nt, Homo sapiens
gaagcugagggcagaguug

SEQ ID NO: 1340744 - RNA, 19 nt, Homo sapiens
cauccacacaccuuucuuu

SEQ ID NO: 1340745 - RNA, 19 nt, Homo sapiens
ccaugaggacugugaagaa

SEQ ID NO: 1340746 - RNA, 19 nt, Homo sapiens
cgaccuggagggcaaguuu

SEQ ID NO: 1340747 - RNA, 19 nt, Homo sapiens
ggagaugcgggacgugaug

SEQ ID NO: 1340748 - RNA, 19 nt, Homo sapiens
ugggaaugcuggcgacaga

SEQ ID NO: 1340749 - RNA, 19 nt, Homo sapiens
uauauacacaugcgucuau

SEQ ID NO: 1340750 - RNA, 19 nt, Homo sapiens
cuccucaucucaccauuug

SEQ ID NO: 1340751 - RNA, 19 nt, Homo sapiens
ggacaaguuccggaagaug

SEQ ID NO: 1340752 - RNA, 19 nt, Homo sapiens
gcauggacuuucauuucag

SEQ ID NO: 1340753 - RNA, 19 nt, Homo sapiens
cgggacaaguuccggaaga

SEQ ID NO: 1340754 - RNA, 19 nt, Homo sapiens
ugucgcggcugcaggagaa

SEQ ID NO: 1340755 - RNA, 19 nt, Homo sapiens
gcagaagcugugaguuuca

SEQ ID NO: 1340756 - RNA, 19 nt, Homo sapiens
cggaaacugcguaggaauu

SEQ ID NO: 1340757 - RNA, 19 nt, Homo sapiens
caugaggacugugaagaag

SEQ ID NO: 1340758 - RNA, 19 nt, Homo sapiens
cgaggugaguggcaucaag

SEQ ID NO: 1340759 - RNA, 19 nt, Homo sapiens
gcaucuuaccaaagcauuu

SEQ ID NO: 1340760 - RNA, 19 nt, Homo sapiens
gugcagcucaagucuuaaa

SEQ ID NO: 1340761 - RNA, 19 nt, Homo sapiens
gggacaaguuccggaagau

SEQ ID NO: 1340762 - RNA, 19 nt, Homo sapiens
uggcauggacuuucauuuc

SEQ ID NO: 1340763 - RNA, 19 nt, Homo sapiens
ucacagcacaaccugcaaa

SEQ ID NO: 1340764 - RNA, 19 nt, Homo sapiens
gcaggaguacgacuucaag

SEQ ID NO: 1340765 - RNA, 19 nt, Homo sapiens
gggccaagccugcauucug

SEQ ID NO: 1340766 - RNA, 19 nt, Homo sapiens
gcaucaaggcgcuguacga

SEQ ID NO: 1340767 - RNA, 19 nt, Homo sapiens
gcaagaagaugacauguau

SEQ ID NO: 1340768 - RNA, 19 nt, Homo sapiens
gaauagaaguaaacaguuc

SEQ ID NO: 1340769 - RNA, 19 nt, Homo sapiens
gaauccagcuccucagaaa

SEQ ID NO: 1340770 - RNA, 19 nt, Homo sapiens
cuacaaggauggaaggaua

SEQ ID NO: 1340771 - RNA, 19 nt, Homo sapiens
gaugagacaguuagauuua

SEQ ID NO: 1340772 - RNA, 19 nt, Homo sapiens
gcaaggagaugagacaguu

SEQ ID NO: 1340773 - RNA, 19 nt, Homo sapiens
gcagagcccucaugauuag

SEQ ID NO: 1340774 - RNA, 19 nt, Homo sapiens
gaggaugacuugacugaug

SEQ ID NO: 1340775 - RNA, 19 nt, Homo sapiens
ccagaacuaugagaaauaa

SEQ ID NO: 1340776 - RNA, 19 nt, Homo sapiens
gaagaugacauguaugaga

SEQ ID NO: 1340777 - RNA, 19 nt, Homo sapiens
ggaaguggauugaauacag

SEQ ID NO: 1340778 - RNA, 19 nt, Homo sapiens
gaguuuagcuauaauugug

SEQ ID NO: 1340779 - RNA, 19 nt, Homo sapiens
caaaggcuacugcugaaua

SEQ ID NO: 1340780 - RNA, 19 nt, Homo sapiens
gugcagagcccucaugauu

SEQ ID NO: 1340781 - RNA, 19 nt, Homo sapiens
ggauuagugcccuuauuua

SEQ ID NO: 1340782 - RNA, 19 nt, Homo sapiens
gcuauggucuguucuuuag

SEQ ID NO: 1340783 - RNA, 19 nt, Homo sapiens
guaguuaggugaguguaaa

SEQ ID NO: 1340784 - RNA, 19 nt, Homo sapiens
gagaugagacaguuagauu

SEQ ID NO: 1340785 - RNA, 19 nt, Homo sapiens
gauuagugcccuuauuuaa

SEQ ID NO: 1340786 - RNA, 19 nt, Homo sapiens
ggucuguucuuuaguucua

SEQ ID NO: 1340787 - RNA, 19 nt, Homo sapiens
aaagagaacuaauggaagu

SEQ ID NO: 1340788 - RNA, 19 nt, Homo sapiens
gaucaggaauuucuaucug

SEQ ID NO: 1340789 - RNA, 19 nt, Homo sapiens
ucugagagguuucauguug

SEQ ID NO: 1340790 - RNA, 19 nt, Homo sapiens
ggacguggcaagaagauga

SEQ ID NO: 1340791 - RNA, 19 nt, Homo sapiens
aaaauaaucuggcccaaaa

SEQ ID NO: 1340792 - RNA, 19 nt, Homo sapiens
aaacagcugucgccaaaca

SEQ ID NO: 1340793 - RNA, 19 nt, Homo sapiens
accagaauguugugauuua

SEQ ID NO: 1340794 - RNA, 19 nt, Homo sapiens
cgaccagaauguugugauu

SEQ ID NO: 1340795 - RNA, 19 nt, Homo sapiens
gaauucugcugucuagauc

SEQ ID NO: 1340796 - RNA, 19 nt, Homo sapiens
uaauggaaguggauugaau

SEQ ID NO: 1340797 - RNA, 19 nt, Homo sapiens
aagaugacauguaugagaa

SEQ ID NO: 1340798 - RNA, 19 nt, Homo sapiens
uaaacacagucaccaugaa

SEQ ID NO: 1340799 - RNA, 19 nt, Homo sapiens
ccagaauguugugauuuaa

SEQ ID NO: 1340800 - RNA, 19 nt, Homo sapiens
ggucaaggccuacacuuuc

SEQ ID NO: 1340801 - RNA, 19 nt, Homo sapiens
caaaagccauuauguugaa

SEQ ID NO: 1340802 - RNA, 19 nt, Homo sapiens
gaugggccuucuucucaaa

SEQ ID NO: 1340803 - RNA, 19 nt, Homo sapiens
cagcaucuguuguggcuau

SEQ ID NO: 1340804 - RNA, 19 nt, Homo sapiens
gaacuuccagccuccagaa

SEQ ID NO: 1340805 - RNA, 19 nt, Homo sapiens
gaagaucacuccgggucau

SEQ ID NO: 1340806 - RNA, 19 nt, Homo sapiens
ggagacauuuuggucauua

SEQ ID NO: 1340807 - RNA, 19 nt, Homo sapiens
gaaguaaacaguucaucca

SEQ ID NO: 1340808 - RNA, 19 nt, Homo sapiens
cacaaaggcuacugcugaa

SEQ ID NO: 1340809 - RNA, 19 nt, Homo sapiens
caggagaccuaaacacagu

SEQ ID NO: 1340810 - RNA, 19 nt, Homo sapiens
aagaagaugacauguauga

SEQ ID NO: 1340811 - RNA, 19 nt, Homo sapiens
ggcaagaagaugacaugua

SEQ ID NO: 1340812 - RNA, 19 nt, Homo sapiens
uauggucuguucuuuaguu

SEQ ID NO: 1340813 - RNA, 19 nt, Homo sapiens
cauccaugaucucacuuaa

SEQ ID NO: 1340814 - RNA, 19 nt, Homo sapiens
ggaaggauagugcaaagca

SEQ ID NO: 1340815 - RNA, 19 nt, Homo sapiens
gugauggcauuaagaagug

SEQ ID NO: 1340816 - RNA, 19 nt, Homo sapiens
gaauacagcagucucaacu

SEQ ID NO: 1340817 - RNA, 19 nt, Homo sapiens
uugagacgcugcaguguga

SEQ ID NO: 1340818 - RNA, 19 nt, Homo sapiens
ccaugaagcugggcugugu

SEQ ID NO: 1340819 - RNA, 19 nt, Homo sapiens
gaacuaauggaaguggauu

SEQ ID NO: 1340820 - RNA, 19 nt, Homo sapiens
ucaggaauuucuaucuguu

SEQ ID NO: 1340821 - RNA, 19 nt, Homo sapiens
ugacauguaugagaaccaa

SEQ ID NO: 1340822 - RNA, 19 nt, Homo sapiens
gacuuugucccuucuaauu

SEQ ID NO: 1340823 - RNA, 19 nt, Homo sapiens
uuucuaaucugagagguuu

SEQ ID NO: 1340824 - RNA, 19 nt, Homo sapiens
uguauucucucuuaacaca

SEQ ID NO: 1340825 - RNA, 19 nt, Homo sapiens
cagaugggccuucuucuca

SEQ ID NO: 1340826 - RNA, 19 nt, Homo sapiens
gcccucaugauuaggauua

SEQ ID NO: 1340827 - RNA, 19 nt, Homo sapiens
ccaaggugauggcauuaag

SEQ ID NO: 1340828 - RNA, 19 nt, Homo sapiens
gugcuauggucuguucuuu

SEQ ID NO: 1340829 - RNA, 19 nt, Homo sapiens
guuaggugaguguaaauaa

SEQ ID NO: 1340830 - RNA, 19 nt, Homo sapiens
uaaugaaacccuagguguu

SEQ ID NO: 1340831 - RNA, 19 nt, Homo sapiens
cgcuaaacauccuauaaug

SEQ ID NO: 1340832 - RNA, 19 nt, Homo sapiens
gcacauaugcauaaguacu

SEQ ID NO: 1340833 - RNA, 19 nt, Homo sapiens
ccauuauguugaaauccua

SEQ ID NO: 1340834 - RNA, 19 nt, Homo sapiens
guucuuuaguucuaguuug

SEQ ID NO: 1340835 - RNA, 19 nt, Homo sapiens
cuaaacauccuauaaugca

SEQ ID NO: 1340836 - RNA, 19 nt, Homo sapiens
caggaauuucuaucuguua

SEQ ID NO: 1340837 - RNA, 19 nt, Homo sapiens
gucaaggccuacacuuuca

SEQ ID NO: 1340838 - RNA, 19 nt, Homo sapiens
uaggauuagugcccuuauu

SEQ ID NO: 1340839 - RNA, 19 nt, Homo sapiens
ggugauggcauuaagaagu

SEQ ID NO: 1340840 - RNA, 19 nt, Homo sapiens
gaccagaauguugugauuu

SEQ ID NO: 1340841 - RNA, 19 nt, Homo sapiens
aaaggcuacugcugaauag

SEQ ID NO: 1340842 - RNA, 19 nt, Homo sapiens
caaggagaugagacaguua

SEQ ID NO: 1340843 - RNA, 19 nt, Homo sapiens
cuaaacacagucaccauga

SEQ ID NO: 1340844 - RNA, 19 nt, Homo sapiens
ccacacggaggaugacuug

SEQ ID NO: 1340845 - RNA, 19 nt, Homo sapiens
ugcagagcccucaugauua

SEQ ID NO: 1340846 - RNA, 19 nt, Homo sapiens
ccucauucagcuauucuua

SEQ ID NO: 1340847 - RNA, 19 nt, Homo sapiens
gucguugccuugaucuuga

SEQ ID NO: 1340848 - RNA, 19 nt, Homo sapiens
gcugggcuguguccucaug

SEQ ID NO: 1340849 - RNA, 19 nt, Homo sapiens
gcucuggaaugggacuuug

SEQ ID NO: 1340850 - RNA, 19 nt, Homo sapiens
ucauggaguugagggaauu

SEQ ID NO: 1340851 - RNA, 19 nt, Homo sapiens
cuuccagccuccagaacua

SEQ ID NO: 1340852 - RNA, 19 nt, Homo sapiens
cagcuauucuuacugacau

SEQ ID NO: 1340853 - RNA, 19 nt, Homo sapiens
aauggaaguggauugaaua

SEQ ID NO: 1340854 - RNA, 19 nt, Homo sapiens
gcaccucccacauugaauc

SEQ ID NO: 1340855 - RNA, 19 nt, Homo sapiens
ccacugaggacaaccaagu

SEQ ID NO: 1340856 - RNA, 19 nt, Homo sapiens
ggugugaggcagccacuga

SEQ ID NO: 1340857 - RNA, 19 nt, Homo sapiens
gauggaaggauagugcaaa

SEQ ID NO: 1340858 - RNA, 19 nt, Homo sapiens
aggauuagugcccuuauuu

SEQ ID NO: 1340859 - RNA, 19 nt, Homo sapiens
ggaguugagggaauuaucu

SEQ ID NO: 1340860 - RNA, 19 nt, Homo sapiens
gaacccuuccaccugauug

SEQ ID NO: 1340861 - RNA, 19 nt, Homo sapiens
uaacucacccuuccaccau

SEQ ID NO: 1340862 - RNA, 19 nt, Homo sapiens
ccgcuaaacauccuauaau

SEQ ID NO: 1340863 - RNA, 19 nt, Homo sapiens
cugagagguuucauguuga

SEQ ID NO: 1340864 - RNA, 19 nt, Homo sapiens
cuuugucccuucuaauuau

SEQ ID NO: 1340865 - RNA, 19 nt, Homo sapiens
aaugaaacccuagguguug

SEQ ID NO: 1340866 - RNA, 19 nt, Homo sapiens
ucacuuaaccaccccaaua

SEQ ID NO: 1340867 - RNA, 19 nt, Homo sapiens
gaugaaaggugauuacaaa

SEQ ID NO: 1340868 - RNA, 19 nt, Homo sapiens
uaacaagccugucaaauau

SEQ ID NO: 1340869 - RNA, 19 nt, Homo sapiens
guaacaagccugucaaaua

SEQ ID NO: 1340870 - RNA, 19 nt, Homo sapiens
gaucgcaucucauuguuaa

SEQ ID NO: 1340871 - RNA, 19 nt, Homo sapiens
gaacgcagcuggaagaaaa

SEQ ID NO: 1340872 - RNA, 19 nt, Homo sapiens
cuacauugcugucuacaaa

SEQ ID NO: 1340873 - RNA, 19 nt, Homo sapiens
ggacuaaagcauucuguaa

SEQ ID NO: 1340874 - RNA, 19 nt, Homo sapiens
aaacaaaugccaagcuaua

SEQ ID NO: 1340875 - RNA, 19 nt, Homo sapiens
ucaaauaucugcaagaacu

SEQ ID NO: 1340876 - RNA, 19 nt, Homo sapiens
ucaaacaaaugccaagcua

SEQ ID NO: 1340877 - RNA, 19 nt, Homo sapiens
cagauaauauggauguuug

SEQ ID NO: 1340878 - RNA, 19 nt, Homo sapiens
cuggaaagauuguuaaguu

SEQ ID NO: 1340879 - RNA, 19 nt, Homo sapiens
gcaagguguucagauugua

SEQ ID NO: 1340880 - RNA, 19 nt, Homo sapiens
uaaggucacuccgaugaaa

SEQ ID NO: 1340881 - RNA, 19 nt, Homo sapiens
ugcaagaacuauggaauaa

SEQ ID NO: 1340882 - RNA, 19 nt, Homo sapiens
gaaaguucaggacaucaaa

SEQ ID NO: 1340883 - RNA, 19 nt, Homo sapiens
gacuaaagcauucuguaaa

SEQ ID NO: 1340884 - RNA, 19 nt, Homo sapiens
guugcaagguguucagauu

SEQ ID NO: 1340885 - RNA, 19 nt, Homo sapiens
ugucaaauaucugcaagaa

SEQ ID NO: 1340886 - RNA, 19 nt, Homo sapiens
cagccuagguuucagacuu

SEQ ID NO: 1340887 - RNA, 19 nt, Homo sapiens
gaagacaguugaaaagauc

SEQ ID NO: 1340888 - RNA, 19 nt, Homo sapiens
caucuacccugaccacauc

SEQ ID NO: 1340889 - RNA, 19 nt, Homo sapiens
ggaaaguucaggacaucaa

SEQ ID NO: 1340890 - RNA, 19 nt, Homo sapiens
gcaagaacuauggaauaaa

SEQ ID NO: 1340891 - RNA, 19 nt, Homo sapiens
agaaacccgugaauucaga

SEQ ID NO: 1340892 - RNA, 19 nt, Homo sapiens
uggcagagguuuccuaaaa

SEQ ID NO: 1340893 - RNA, 19 nt, Homo sapiens
gaauaaaacuacugaugca

SEQ ID NO: 1340894 - RNA, 19 nt, Homo sapiens
gaagugcaauucucaaaag

SEQ ID NO: 1340895 - RNA, 19 nt, Homo sapiens
ggaaagauuguuaaguucu

SEQ ID NO: 1340896 - RNA, 19 nt, Homo sapiens
caaaggaacgcagcuggaa

SEQ ID NO: 1340897 - RNA, 19 nt, Homo sapiens
acaguggauuugaauuuga

SEQ ID NO: 1340898 - RNA, 19 nt, Homo sapiens
uauaaggucacuccgauga

SEQ ID NO: 1340899 - RNA, 19 nt, Homo sapiens
gcagugaagacaguugaaa

SEQ ID NO: 1340900 - RNA, 19 nt, Homo sapiens
aaacuaacuggaaagauug

SEQ ID NO: 1340901 - RNA, 19 nt, Homo sapiens
uuaacaggaugcagacaug

SEQ ID NO: 1340902 - RNA, 19 nt, Homo sapiens
gagcuuacaguggauuuga

SEQ ID NO: 1340903 - RNA, 19 nt, Homo sapiens
gaaaagaucaaacaaaugc

SEQ ID NO: 1340904 - RNA, 19 nt, Homo sapiens
cugcaagaacuauggaaua

SEQ ID NO: 1340905 - RNA, 19 nt, Homo sapiens
uacaguggauuugaauuug

SEQ ID NO: 1340906 - RNA, 19 nt, Homo sapiens
uggaaagauuguuaaguuc

SEQ ID NO: 1340907 - RNA, 19 nt, Homo sapiens
acaaaugccaagcuauauu

SEQ ID NO: 1340908 - RNA, 19 nt, Homo sapiens
caguggauuugaauuugaa

SEQ ID NO: 1340909 - RNA, 19 nt, Homo sapiens
acuaaagcauucuguaaag

SEQ ID NO: 1340910 - RNA, 19 nt, Homo sapiens
ucaaagaagucaggcaaaa

SEQ ID NO: 1340911 - RNA, 19 nt, Homo sapiens
caaauaucugcaagaacua

SEQ ID NO: 1340912 - RNA, 19 nt, Homo sapiens
aaagcauucuguaaagcaa

SEQ ID NO: 1340913 - RNA, 19 nt, Homo sapiens
uagguggacuaaagcauuc

SEQ ID NO: 1340914 - RNA, 19 nt, Homo sapiens
ucaucuacauugcugucua

SEQ ID NO: 1340915 - RNA, 19 nt, Homo sapiens
uuuagaaacccgugaauuc

SEQ ID NO: 1340916 - RNA, 19 nt, Homo sapiens
gcagacauggcagagguuu

SEQ ID NO: 1340917 - RNA, 19 nt, Homo sapiens
acugagaaguguuaguuuc

SEQ ID NO: 1340918 - RNA, 19 nt, Homo sapiens
acaagccugucaaauaucu

SEQ ID NO: 1340919 - RNA, 19 nt, Homo sapiens
ggaacgcagcuggaagaaa

SEQ ID NO: 1340920 - RNA, 19 nt, Homo sapiens
caaacaaaugccaagcuau

SEQ ID NO: 1340921 - RNA, 19 nt, Homo sapiens
agccuagguuucagacuuu

SEQ ID NO: 1340922 - RNA, 19 nt, Homo sapiens
guguucagauuguauaaac

SEQ ID NO: 1340923 - RNA, 19 nt, Homo sapiens
caucuacauugcugucuac

SEQ ID NO: 1340924 - RNA, 19 nt, Homo sapiens
uuagaaacccgugaauuca

SEQ ID NO: 1340925 - RNA, 19 nt, Homo sapiens
uaaagcauucuguaaagca

SEQ ID NO: 1340926 - RNA, 19 nt, Homo sapiens
ccucucaagcuccguguuu

SEQ ID NO: 1340927 - RNA, 19 nt, Homo sapiens
gcaucucauuguuaacucu

SEQ ID NO: 1340928 - RNA, 19 nt, Homo sapiens
cauggcagagguuuccuaa

SEQ ID NO: 1340929 - RNA, 19 nt, Homo sapiens
ugcaagguguucagauugu

SEQ ID NO: 1340930 - RNA, 19 nt, Homo sapiens
gaaguguuaguuucuuugg

SEQ ID NO: 1340931 - RNA, 19 nt, Homo sapiens
cgaugaaaggugauuacaa

SEQ ID NO: 1340932 - RNA, 19 nt, Homo sapiens
aaaggacuacggaaaguuc

SEQ ID NO: 1340933 - RNA, 19 nt, Homo sapiens
uauaguaacaagccuguca

SEQ ID NO: 1340934 - RNA, 19 nt, Homo sapiens
caagguguucagauuguau

SEQ ID NO: 1340935 - RNA, 19 nt, Homo sapiens
gaaacccgugaauucagaa

SEQ ID NO: 1340936 - RNA, 19 nt, Homo sapiens
guucaggacaucaaagaag

SEQ ID NO: 1340937 - RNA, 19 nt, Homo sapiens
cuaauaaugagcuuacagu

SEQ ID NO: 1340938 - RNA, 19 nt, Homo sapiens
gugcaauucucaaaagguu

SEQ ID NO: 1340939 - RNA, 19 nt, Homo sapiens
ugaagacaguugaaaagau

SEQ ID NO: 1340940 - RNA, 19 nt, Homo sapiens
ugaucgcaucucauuguua

SEQ ID NO: 1340941 - RNA, 19 nt, Homo sapiens
aaggaacgcagcuggaaga

SEQ ID NO: 1340942 - RNA, 19 nt, Homo sapiens
cgaaguaacuguggucuua

SEQ ID NO: 1340943 - RNA, 19 nt, Homo sapiens
ccagaaggguaucagauua

SEQ ID NO: 1340944 - RNA, 19 nt, Homo sapiens
gcaauacacuaggaaguaa

SEQ ID NO: 1340945 - RNA, 19 nt, Homo sapiens
agaaguugcuuucgaagua

SEQ ID NO: 1340946 - RNA, 19 nt, Homo sapiens
gcacaucaguuacuugaag

SEQ ID NO: 1340947 - RNA, 19 nt, Homo sapiens
ggaaguaggucccagacau

SEQ ID NO: 1340948 - RNA, 19 nt, Homo sapiens
cgaguuagcugcucuugug

SEQ ID NO: 1340949 - RNA, 19 nt, Homo sapiens
gaaguugcuuucgaaguaa

SEQ ID NO: 1340950 - RNA, 19 nt, Homo sapiens
guaaagacuugugccauug

SEQ ID NO: 1340951 - RNA, 19 nt, Homo sapiens
ucuacaagcucgaauuauu

SEQ ID NO: 1340952 - RNA, 19 nt, Homo sapiens
ugcaguaucuucagaauga

SEQ ID NO: 1340953 - RNA, 19 nt, Homo sapiens
uguauagccugcuuuguaa

SEQ ID NO: 1340954 - RNA, 19 nt, Homo sapiens
caaaugcaguaucuucaga

SEQ ID NO: 1340955 - RNA, 19 nt, Homo sapiens
gagagcaaaugcaguaucu

SEQ ID NO: 1340956 - RNA, 19 nt, Homo sapiens
uguaaagacuugugccauu

SEQ ID NO: 1340957 - RNA, 19 nt, Homo sapiens
ggaggcugcuugugagaga

SEQ ID NO: 1340958 - RNA, 19 nt, Homo sapiens
cgaaggcccugcccuaaca

SEQ ID NO: 1340959 - RNA, 19 nt, Homo sapiens
gaaauccugcaaauagaaa

SEQ ID NO: 1340960 - RNA, 19 nt, Homo sapiens
ggaaauccugcaaauagaa

SEQ ID NO: 1340961 - RNA, 19 nt, Homo sapiens
gcuccucgaugucagcuuu

SEQ ID NO: 1340962 - RNA, 19 nt, Homo sapiens
ugagagagcaaaugcagua

SEQ ID NO: 1340963 - RNA, 19 nt, Homo sapiens
gagccuaacauucugauga

SEQ ID NO: 1340964 - RNA, 19 nt, Homo sapiens
guugggagcuccucgaugu

SEQ ID NO: 1340965 - RNA, 19 nt, Homo sapiens
gguaugagccuaacauucu

SEQ ID NO: 1340966 - RNA, 19 nt, Homo sapiens
gagcaaaugcaguaucuuc

SEQ ID NO: 1340967 - RNA, 19 nt, Homo sapiens
ucagaucaaugcagucaga

SEQ ID NO: 1340968 - RNA, 19 nt, Homo sapiens
ccugagauuugguaaagaa

SEQ ID NO: 1340969 - RNA, 19 nt, Homo sapiens
cgacggaccgaaagaaauu

SEQ ID NO: 1340970 - RNA, 19 nt, Homo sapiens
gaugugagacgguuauuag

SEQ ID NO: 1340971 - RNA, 19 nt, Homo sapiens
gaugguuuaucucggguuu

SEQ ID NO: 1340972 - RNA, 19 nt, Homo sapiens
gaaauuuccugccccaaga

SEQ ID NO: 1340973 - RNA, 19 nt, Homo sapiens
cgaaagcgacggaccgaaa

SEQ ID NO: 1340974 - RNA, 19 nt, Homo sapiens
guuagcugcucuugugauu

SEQ ID NO: 1340975 - RNA, 19 nt, Homo sapiens
ggaucccaguguugccuua

SEQ ID NO: 1340976 - RNA, 19 nt, Homo sapiens
cggaaauccugcaaauaga

SEQ ID NO: 1340977 - RNA, 19 nt, Homo sapiens
uauggugccuuauaacaug

SEQ ID NO: 1340978 - RNA, 19 nt, Homo sapiens
ugacacaaguggccaacau

SEQ ID NO: 1340979 - RNA, 19 nt, Homo sapiens
gaagguaugagccuaacau

SEQ ID NO: 1340980 - RNA, 19 nt, Homo sapiens
gaauucagccacuggacuu

SEQ ID NO: 1340981 - RNA, 19 nt, Homo sapiens
cagaaggguaucagauuaa

SEQ ID NO: 1340982 - RNA, 19 nt, Homo sapiens
gcccugagauuugguaaag

SEQ ID NO: 1340983 - RNA, 19 nt, Homo sapiens
agaaggguaucagauuaaa

SEQ ID NO: 1340984 - RNA, 19 nt, Homo sapiens
gugagacgguuauuagaag

SEQ ID NO: 1340985 - RNA, 19 nt, Homo sapiens
ggaugugagacgguuauua

SEQ ID NO: 1340986 - RNA, 19 nt, Homo sapiens
uuaacggucucuucggaaa

SEQ ID NO: 1340987 - RNA, 19 nt, Homo sapiens
uaacagccugcgagucuaa

SEQ ID NO: 1340988 - RNA, 19 nt, Homo sapiens
gcugcuggcugcacugugu

SEQ ID NO: 1340989 - RNA, 19 nt, Homo sapiens
gaaguaggucccagacauc

SEQ ID NO: 1340990 - RNA, 19 nt, Homo sapiens
guucagcaguuacuuuuaa

SEQ ID NO: 1340991 - RNA, 19 nt, Homo sapiens
guaaagaacacugccuugu

SEQ ID NO: 1340992 - RNA, 19 nt, Homo sapiens
gcacugcugcuuccuccaa

SEQ ID NO: 1340993 - RNA, 19 nt, Homo sapiens
ucggaaauccugcaaauag

SEQ ID NO: 1340994 - RNA, 19 nt, Homo sapiens
cagauuaaacaccgaauuc

SEQ ID NO: 1340995 - RNA, 19 nt, Homo sapiens
agucagaaccugggaagua

SEQ ID NO: 1340996 - RNA, 19 nt, Homo sapiens
aaauuauucucuccagugu

SEQ ID NO: 1340997 - RNA, 19 nt, Homo sapiens
uagcugcucuugugauuuu

SEQ ID NO: 1340998 - RNA, 19 nt, Homo sapiens
gaagagccacaccucagau

SEQ ID NO: 1340999 - RNA, 19 nt, Homo sapiens
uuguauagccugcuuugua

SEQ ID NO: 1341000 - RNA, 19 nt, Homo sapiens
gaaagcgacggaccgaaag

SEQ ID NO: 1341001 - RNA, 19 nt, Homo sapiens
cccaagaagugacacaagu

SEQ ID NO: 1341002 - RNA, 19 nt, Homo sapiens
ccagaagguaugagccuaa

SEQ ID NO: 1341003 - RNA, 19 nt, Homo sapiens
uagccugcuuuguaaacua

SEQ ID NO: 1341004 - RNA, 19 nt, Homo sapiens
aaccauggauuucuacaag

SEQ ID NO: 1341005 - RNA, 19 nt, Homo sapiens
cuucggaaauccugcaaau

SEQ ID NO: 1341006 - RNA, 19 nt, Homo sapiens
uauuagaaguugcuuucga

SEQ ID NO: 1341007 - RNA, 19 nt, Homo sapiens
guuauuagaaguugcuuuc

SEQ ID NO: 1341008 - RNA, 19 nt, Homo sapiens
gcgcuugacugcacaucag

SEQ ID NO: 1341009 - RNA, 19 nt, Homo sapiens
auuagaaguugcuuucgaa

SEQ ID NO: 1341010 - RNA, 19 nt, Homo sapiens
gucagaaccugggaaguag

SEQ ID NO: 1341011 - RNA, 19 nt, Homo sapiens
gagccacaccucagaucaa

SEQ ID NO: 1341012 - RNA, 19 nt, Homo sapiens
cacaucaguuacuugaaga

SEQ ID NO: 1341013 - RNA, 19 nt, Homo sapiens
gaaaggaaaauuaguugug

SEQ ID NO: 1341014 - RNA, 19 nt, Homo sapiens
guaugagccuaacauucug

SEQ ID NO: 1341015 - RNA, 19 nt, Homo sapiens
uuucuacaagcucgaauua

SEQ ID NO: 1341016 - RNA, 19 nt, Homo sapiens
gcuauacuaagacuuggaa

SEQ ID NO: 1341017 - RNA, 19 nt, Homo sapiens
gcaaaugcaguaucuucag

SEQ ID NO: 1341018 - RNA, 19 nt, Homo sapiens
gagauuugguaaagaacac

SEQ ID NO: 1341019 - RNA, 19 nt, Homo sapiens
ugaagagccacaccucaga

SEQ ID NO: 1341020 - RNA, 19 nt, Homo sapiens
caguagcaauacacuagga

SEQ ID NO: 1341021 - RNA, 19 nt, Homo sapiens
agacgguuauuagaaguug

SEQ ID NO: 1341022 - RNA, 19 nt, Homo sapiens
auuauucucuccaguguca

SEQ ID NO: 1341023 - RNA, 19 nt, Homo sapiens
ccaagaagugacacaagug

SEQ ID NO: 1341024 - RNA, 19 nt, Homo sapiens
gcucuacgcaccgguguug

SEQ ID NO: 1341025 - RNA, 19 nt, Homo sapiens
ccuaacagccugcgagucu

SEQ ID NO: 1341026 - RNA, 19 nt, Homo sapiens
guacuuaagaugguuuauc

SEQ ID NO: 1341027 - RNA, 19 nt, Homo sapiens
agugguagauguagcuuag

SEQ ID NO: 1341028 - RNA, 19 nt, Homo sapiens
gcgacggaccgaaagaaau

SEQ ID NO: 1341029 - RNA, 19 nt, Homo sapiens
gaacuggugacaggaugug

SEQ ID NO: 1341030 - RNA, 19 nt, Homo sapiens
gccaacauccacacuguag

SEQ ID NO: 1341031 - RNA, 19 nt, Homo sapiens
ugugagacgguuauuagaa

SEQ ID NO: 1341032 - RNA, 19 nt, Homo sapiens
guaacuguggucuuagguu

SEQ ID NO: 1341033 - RNA, 19 nt, Homo sapiens
ccuccaaccccaaaauuua

SEQ ID NO: 1341034 - RNA, 19 nt, Homo sapiens
caauacacuaggaaguaaa

SEQ ID NO: 1341035 - RNA, 19 nt, Homo sapiens
gagacgguuauuagaaguu

SEQ ID NO: 1341036 - RNA, 19 nt, Homo sapiens
cuaacagccugcgagucua

SEQ ID NO: 1341037 - RNA, 19 nt, Homo sapiens
uggccaacauccacacugu

SEQ ID NO: 1341038 - RNA, 19 nt, Homo sapiens
ugagacgguuauuagaagu

SEQ ID NO: 1341039 - RNA, 19 nt, Homo sapiens
aaggguaucagauuaaaca

SEQ ID NO: 1341040 - RNA, 19 nt, Homo sapiens
ggccaacauccacacugua

SEQ ID NO: 1341041 - RNA, 19 nt, Homo sapiens
ugucugucgugccgcagua

SEQ ID NO: 1341042 - RNA, 19 nt, Homo sapiens
ggacagagagugauacuua

SEQ ID NO: 1341043 - RNA, 19 nt, Homo sapiens
ggaccuagaugagaaguua

SEQ ID NO: 1341044 - RNA, 19 nt, Homo sapiens
gaagguagcuuaacuugag

SEQ ID NO: 1341045 - RNA, 19 nt, Homo sapiens
caaagaaacucacauaaac

SEQ ID NO: 1341046 - RNA, 19 nt, Homo sapiens
ggaggaacauagcaaagua

SEQ ID NO: 1341047 - RNA, 19 nt, Homo sapiens
gguauacuuuccucaauua

SEQ ID NO: 1341048 - RNA, 19 nt, Homo sapiens
ggaagaagaggaaguaauu

SEQ ID NO: 1341049 - RNA, 19 nt, Homo sapiens
ggagauggcuacuacugaa

SEQ ID NO: 1341050 - RNA, 19 nt, Homo sapiens
ggaggauggucucugguua

SEQ ID NO: 1341051 - RNA, 19 nt, Homo sapiens
gagaacaucuagagagaga

SEQ ID NO: 1341052 - RNA, 19 nt, Homo sapiens
guucugagcugguauacuu

SEQ ID NO: 1341053 - RNA, 19 nt, Homo sapiens
ggugcaagguggaaauaua

SEQ ID NO: 1341054 - RNA, 19 nt, Homo sapiens
ccaaagaaacucacauaaa

SEQ ID NO: 1341055 - RNA, 19 nt, Homo sapiens
caucaaacauagugacauu

SEQ ID NO: 1341056 - RNA, 19 nt, Homo sapiens
gaugagaaguuaccugcaa

SEQ ID NO: 1341057 - RNA, 19 nt, Homo sapiens
ucacauaaacuugguguua

SEQ ID NO: 1341058 - RNA, 19 nt, Homo sapiens
gaaggaugcugaggaccua

SEQ ID NO: 1341059 - RNA, 19 nt, Homo sapiens
agaaaguacucaagacauu

SEQ ID NO: 1341060 - RNA, 19 nt, Homo sapiens
gacagagagugauacuuaa

SEQ ID NO: 1341061 - RNA, 19 nt, Homo sapiens
gaagacaaugggaaaguaa

SEQ ID NO: 1341062 - RNA, 19 nt, Homo sapiens
gaccaaagaaacucacaua

SEQ ID NO: 1341063 - RNA, 19 nt, Homo sapiens
gcaaugcacacuuucauau

SEQ ID NO: 1341064 - RNA, 19 nt, Homo sapiens
gcaaaaggguuacuuagug

SEQ ID NO: 1341065 - RNA, 19 nt, Homo sapiens
gaaccaaggcaaugacuuc

SEQ ID NO: 1341066 - RNA, 19 nt, Homo sapiens
ugaagacaaugggaaagua

SEQ ID NO: 1341067 - RNA, 19 nt, Homo sapiens
ggaaguaauugcacaccau

SEQ ID NO: 1341068 - RNA, 19 nt, Homo sapiens
guuaaaaucugaccaaaga

SEQ ID NO: 1341069 - RNA, 19 nt, Homo sapiens
gaagaaaacacaagagauu

SEQ ID NO: 1341070 - RNA, 19 nt, Homo sapiens
gaacaucuagagagagaga

SEQ ID NO: 1341071 - RNA, 19 nt, Homo sapiens
uaaacuugguguuagagaa

SEQ ID NO: 1341072 - RNA, 19 nt, Homo sapiens
guuccuaacugccuucaga

SEQ ID NO: 1341073 - RNA, 19 nt, Homo sapiens
gcaaaaggcaaaaggguua

SEQ ID NO: 1341074 - RNA, 19 nt, Homo sapiens
uagcuuaacuugagaacuc

SEQ ID NO: 1341075 - RNA, 19 nt, Homo sapiens
gaaguaauugcacaccauu

SEQ ID NO: 1341076 - RNA, 19 nt, Homo sapiens
gcagcuuucuucucucuca

SEQ ID NO: 1341077 - RNA, 19 nt, Homo sapiens
gucaaaaccucuuccauuu

SEQ ID NO: 1341078 - RNA, 19 nt, Homo sapiens
ugacuucucucucccagau

SEQ ID NO: 1341079 - RNA, 19 nt, Homo sapiens
ggagggacagagagugaua

SEQ ID NO: 1341080 - RNA, 19 nt, Homo sapiens
caaucgagaucucauuuac

SEQ ID NO: 1341081 - RNA, 19 nt, Homo sapiens
aaauauaugacgcugcuua

SEQ ID NO: 1341082 - RNA, 19 nt, Homo sapiens
gcaagguggaaauauauga

SEQ ID NO: 1341083 - RNA, 19 nt, Homo sapiens
gaggauggucucugguuaa

SEQ ID NO: 1341084 - RNA, 19 nt, Homo sapiens
gaaggacgccagaaaguac

SEQ ID NO: 1341085 - RNA, 19 nt, Homo sapiens
aagacaagcauuucaguaa

SEQ ID NO: 1341086 - RNA, 19 nt, Homo sapiens
gccagcaucuaccuacuug

SEQ ID NO: 1341087 - RNA, 19 nt, Homo sapiens
ccucaggccucacuccuau

SEQ ID NO: 1341088 - RNA, 19 nt, Homo sapiens
gggcagguauaaacaucaa

SEQ ID NO: 1341089 - RNA, 19 nt, Homo sapiens
acaaugggaaaguaaguua

SEQ ID NO: 1341090 - RNA, 19 nt, Homo sapiens
gagaggaacuuagagucau

SEQ ID NO: 1341091 - RNA, 19 nt, Homo sapiens
gaagaagaggaaguaauug

SEQ ID NO: 1341092 - RNA, 19 nt, Homo sapiens
gcauauaccacuuccuugu

SEQ ID NO: 1341093 - RNA, 19 nt, Homo sapiens
cuacugaaguugucugucu

SEQ ID NO: 1341094 - RNA, 19 nt, Homo sapiens
ccugcuaucucagaauuaa

SEQ ID NO: 1341095 - RNA, 19 nt, Homo sapiens
gguccuagauacugucauc

SEQ ID NO: 1341096 - RNA, 19 nt, Homo sapiens
ccaaggcaaugacuucucu

SEQ ID NO: 1341097 - RNA, 19 nt, Homo sapiens
gauccucuuucucuacaau

SEQ ID NO: 1341098 - RNA, 19 nt, Homo sapiens
ucaccugccuggaugaugu

SEQ ID NO: 1341099 - RNA, 19 nt, Homo sapiens
gaaaguacucaagacauuc

SEQ ID NO: 1341100 - RNA, 19 nt, Homo sapiens
ggaacuuagagucauuuaa

SEQ ID NO: 1341101 - RNA, 19 nt, Homo sapiens
acauaaacuugguguuaga

SEQ ID NO: 1341102 - RNA, 19 nt, Homo sapiens
caagaaccaagaaagaaga

SEQ ID NO: 1341103 - RNA, 19 nt, Homo sapiens
gaagcucaaccacuggaaa

SEQ ID NO: 1341104 - RNA, 19 nt, Homo sapiens
gaaaagacauuaaguuccu

SEQ ID NO: 1341105 - RNA, 19 nt, Homo sapiens
aaagacaagcauuucagua

SEQ ID NO: 1341106 - RNA, 19 nt, Homo sapiens
gauggucucugguuaaaau

SEQ ID NO: 1341107 - RNA, 19 nt, Homo sapiens
ucuagcagcuuucuucucu

SEQ ID NO: 1341108 - RNA, 19 nt, Homo sapiens
ccaagguccuagauacugu

SEQ ID NO: 1341109 - RNA, 19 nt, Homo sapiens
ccucaauuauuacaucuca

SEQ ID NO: 1341110 - RNA, 19 nt, Homo sapiens
cuacaugcauauaccacuu

SEQ ID NO: 1341111 - RNA, 19 nt, Homo sapiens
gcauucagggcagguauaa

SEQ ID NO: 1341112 - RNA, 19 nt, Homo sapiens
gauggcuacuacugaaguu

SEQ ID NO: 1341113 - RNA, 19 nt, Homo sapiens
gcauuucaguaagcuaguu

SEQ ID NO: 1341114 - RNA, 19 nt, Homo sapiens
uccuauggcucuacuuuga

SEQ ID NO: 1341115 - RNA, 19 nt, Homo sapiens
aaugcacacuuucauauuc

SEQ ID NO: 1341116 - RNA, 19 nt, Homo sapiens
caaugcacacuuucauauu

SEQ ID NO: 1341117 - RNA, 19 nt, Homo sapiens
agacaagcauuucaguaag

SEQ ID NO: 1341118 - RNA, 19 nt, Homo sapiens
gaaagaagaaaacacaaga

SEQ ID NO: 1341119 - RNA, 19 nt, Homo sapiens
gcacaccauuuuccaagaa

SEQ ID NO: 1341120 - RNA, 19 nt, Homo sapiens
cugaggaccuagaugagaa

SEQ ID NO: 1341121 - RNA, 19 nt, Homo sapiens
cacauaaacuugguguuag

SEQ ID NO: 1341122 - RNA, 19 nt, Homo sapiens
gcacucgccaugacgaaga

SEQ ID NO: 1341123 - RNA, 19 nt, Homo sapiens
agaggaacuuagagucauu

SEQ ID NO: 1341124 - RNA, 19 nt, Homo sapiens
agagagagaggaacuuaga

SEQ ID NO: 1341125 - RNA, 19 nt, Homo sapiens
agagagagagaggaacuua

SEQ ID NO: 1341126 - RNA, 19 nt, Homo sapiens
gugcaagguggaaauauau

SEQ ID NO: 1341127 - RNA, 19 nt, Homo sapiens
ugguauacuuuccucaauu

SEQ ID NO: 1341128 - RNA, 19 nt, Homo sapiens
agaaggacgccagaaagua

SEQ ID NO: 1341129 - RNA, 19 nt, Homo sapiens
acaaucgagaucucauuua

SEQ ID NO: 1341130 - RNA, 19 nt, Homo sapiens
ccucuuccauuugaacauu

SEQ ID NO: 1341131 - RNA, 19 nt, Homo sapiens
gggagauggcuacuacuga

SEQ ID NO: 1341132 - RNA, 19 nt, Homo sapiens
gacaagcauuucaguaagc

SEQ ID NO: 1341133 - RNA, 19 nt, Homo sapiens
caacuccugcuaucucaga

SEQ ID NO: 1341134 - RNA, 19 nt, Homo sapiens
gaaccaagaaagaagaaaa

SEQ ID NO: 1341135 - RNA, 19 nt, Homo sapiens
ucaaacauagugacauugu

SEQ ID NO: 1341136 - RNA, 19 nt, Homo sapiens
caaaaggguuacuuagugu

SEQ ID NO: 1341137 - RNA, 19 nt, Homo sapiens
uauaugacgcugcuuaauc

SEQ ID NO: 1341138 - RNA, 19 nt, Homo sapiens
cauccuauggcucuacuuu

SEQ ID NO: 1341139 - RNA, 19 nt, Homo sapiens
auaugacgcugcuuaaucu

SEQ ID NO: 1341140 - RNA, 19 nt, Homo sapiens
ccagaaaguacucaagaca

SEQ ID NO: 1341141 - RNA, 19 nt, Homo sapiens
aaacucacauaaacuuggu

SEQ ID NO: 1341142 - RNA, 19 nt, Homo sapiens
caacaaagcugacaaucaa

SEQ ID NO: 1341143 - RNA, 19 nt, Homo sapiens
gaaauuaggucagaugaga

SEQ ID NO: 1341144 - RNA, 19 nt, Homo sapiens
caaagucacucaacagaaa

SEQ ID NO: 1341145 - RNA, 19 nt, Homo sapiens
guagauaaauugcgucauu

SEQ ID NO: 1341146 - RNA, 19 nt, Homo sapiens
gaagaagaccuguugcaua

SEQ ID NO: 1341147 - RNA, 19 nt, Homo sapiens
aagaagaccuguugcauaa

SEQ ID NO: 1341148 - RNA, 19 nt, Homo sapiens
acaagaggaugaucaauaa

SEQ ID NO: 1341149 - RNA, 19 nt, Homo sapiens
caacuuacagcgacuauaa

SEQ ID NO: 1341150 - RNA, 19 nt, Homo sapiens
gaaagcagaaagagaagua

SEQ ID NO: 1341151 - RNA, 19 nt, Homo sapiens
caguggaacuuaaagauaa

SEQ ID NO: 1341152 - RNA, 19 nt, Homo sapiens
aaagcaagauggccaaauu

SEQ ID NO: 1341153 - RNA, 19 nt, Homo sapiens
aaagugagauguaggauuc

SEQ ID NO: 1341154 - RNA, 19 nt, Homo sapiens
ggcaaagacugacgaaaug

SEQ ID NO: 1341155 - RNA, 19 nt, Homo sapiens
caaguaagauuaugucaac

SEQ ID NO: 1341156 - RNA, 19 nt, Homo sapiens
aaagaucaguggaacuuaa

SEQ ID NO: 1341157 - RNA, 19 nt, Homo sapiens
guacacaaguggccaagau

SEQ ID NO: 1341158 - RNA, 19 nt, Homo sapiens
acacaaugcuccguucuaa

SEQ ID NO: 1341159 - RNA, 19 nt, Homo sapiens
aaagagagcuaaaccaaac

SEQ ID NO: 1341160 - RNA, 19 nt, Homo sapiens
aaacugagcuccauaacac

SEQ ID NO: 1341161 - RNA, 19 nt, Homo sapiens
gaagaaauuaggucagaug

SEQ ID NO: 1341162 - RNA, 19 nt, Homo sapiens
gaagaccuguugcauaaaa

SEQ ID NO: 1341163 - RNA, 19 nt, Homo sapiens
caaaagagacuaucugaaa

SEQ ID NO: 1341164 - RNA, 19 nt, Homo sapiens
gaaagugagauguaggauu

SEQ ID NO: 1341165 - RNA, 19 nt, Homo sapiens
caaguuugaugcagcaguu

SEQ ID NO: 1341166 - RNA, 19 nt, Homo sapiens
caucguagacugaauguug

SEQ ID NO: 1341167 - RNA, 19 nt, Homo sapiens
cagcaguuauugcaagaaa

SEQ ID NO: 1341168 - RNA, 19 nt, Homo sapiens
ccuaaacaaucaacaacaa

SEQ ID NO: 1341169 - RNA, 19 nt, Homo sapiens
gaauucucauguucugauu

SEQ ID NO: 1341170 - RNA, 19 nt, Homo sapiens
gagaaguaguugugagaca

SEQ ID NO: 1341171 - RNA, 19 nt, Homo sapiens
gaaagagaaguaguuguga

SEQ ID NO: 1341172 - RNA, 19 nt, Homo sapiens
agagaaagcagaaagagaa

SEQ ID NO: 1341173 - RNA, 19 nt, Homo sapiens
caaagagagcuaaaccaaa

SEQ ID NO: 1341174 - RNA, 19 nt, Homo sapiens
caaagcaggcaaagacuga

SEQ ID NO: 1341175 - RNA, 19 nt, Homo sapiens
gaaacuacagaaauagaug

SEQ ID NO: 1341176 - RNA, 19 nt, Homo sapiens
cugacgaaauggaaucaua

SEQ ID NO: 1341177 - RNA, 19 nt, Homo sapiens
gcagaaagagaaguaguug

SEQ ID NO: 1341178 - RNA, 19 nt, Homo sapiens
gcaaguaagauuaugucaa

SEQ ID NO: 1341179 - RNA, 19 nt, Homo sapiens
accaaacggugucaaauga

SEQ ID NO: 1341180 - RNA, 19 nt, Homo sapiens
gggcacaguagauaaauug

SEQ ID NO: 1341181 - RNA, 19 nt, Homo sapiens
caacagaaagagaccaaga

SEQ ID NO: 1341182 - RNA, 19 nt, Homo sapiens
ggaaucauaccaucguaga

SEQ ID NO: 1341183 - RNA, 19 nt, Homo sapiens
aacaagaggaugaucaaua

SEQ ID NO: 1341184 - RNA, 19 nt, Homo sapiens
ucaguggaacuuaaagaua

SEQ ID NO: 1341185 - RNA, 19 nt, Homo sapiens
ggagggauaacauuacaug

SEQ ID NO: 1341186 - RNA, 19 nt, Homo sapiens
guaagauuaugucaacuac

SEQ ID NO: 1341187 - RNA, 19 nt, Homo sapiens
caaacggugucaaaugaag

SEQ ID NO: 1341188 - RNA, 19 nt, Homo sapiens
agaaagagaccaagagcuu

SEQ ID NO: 1341189 - RNA, 19 nt, Homo sapiens
agaaguauuuccagaaucu

SEQ ID NO: 1341190 - RNA, 19 nt, Homo sapiens
aaacaaagcaggcaaagac

SEQ ID NO: 1341191 - RNA, 19 nt, Homo sapiens
ugagacaacuucaacaaaa

SEQ ID NO: 1341192 - RNA, 19 nt, Homo sapiens
gagagaaagcagaaagaga

SEQ ID NO: 1341193 - RNA, 19 nt, Homo sapiens
ugaaagagagaaagcagaa

SEQ ID NO: 1341194 - RNA, 19 nt, Homo sapiens
aagauuaugucaacuacga

SEQ ID NO: 1341195 - RNA, 19 nt, Homo sapiens
gcaagaaaaugaaacuaca

SEQ ID NO: 1341196 - RNA, 19 nt, Homo sapiens
ggucagaugagaauucaau

SEQ ID NO: 1341197 - RNA, 19 nt, Homo sapiens
gagaaagugagauguagga

SEQ ID NO: 1341198 - RNA, 19 nt, Homo sapiens
ggaagaaauuaggucagau

SEQ ID NO: 1341199 - RNA, 19 nt, Homo sapiens
uagaagaacaagaggauga

SEQ ID NO: 1341200 - RNA, 19 nt, Homo sapiens
uggccaagauaaaguagaa

SEQ ID NO: 1341201 - RNA, 19 nt, Homo sapiens
acaaagagagcuaaaccaa

SEQ ID NO: 1341202 - RNA, 19 nt, Homo sapiens
cauuauaguggacagcuua

SEQ ID NO: 1341203 - RNA, 19 nt, Homo sapiens
aaauugagcagcuucagaa

SEQ ID NO: 1341204 - RNA, 19 nt, Homo sapiens
gagaguuacuguggaucuu

SEQ ID NO: 1341205 - RNA, 19 nt, Homo sapiens
ggauucaaggaagaaauua

SEQ ID NO: 1341206 - RNA, 19 nt, Homo sapiens
agaaagagaaguaguugug

SEQ ID NO: 1341207 - RNA, 19 nt, Homo sapiens
gaucaguggaacuuaaaga

SEQ ID NO: 1341208 - RNA, 19 nt, Homo sapiens
acacaaguggccaagauaa

SEQ ID NO: 1341209 - RNA, 19 nt, Homo sapiens
uaaaccaaacggugucaaa

SEQ ID NO: 1341210 - RNA, 19 nt, Homo sapiens
ugacagaugagaacacaau

SEQ ID NO: 1341211 - RNA, 19 nt, Homo sapiens
gcuggaaauacacacaaua

SEQ ID NO: 1341212 - RNA, 19 nt, Homo sapiens
gaaagagagaaagcagaaa

SEQ ID NO: 1341213 - RNA, 19 nt, Homo sapiens
aagaaagcaugaagaccuu

SEQ ID NO: 1341214 - RNA, 19 nt, Homo sapiens
caaauugagcagcuucaga

SEQ ID NO: 1341215 - RNA, 19 nt, Homo sapiens
caagccaaaugugaugcua

SEQ ID NO: 1341216 - RNA, 19 nt, Homo sapiens
gcaacuggaugauguucac

SEQ ID NO: 1341217 - RNA, 19 nt, Homo sapiens
caacagcaacuggaugaug

SEQ ID NO: 1341218 - RNA, 19 nt, Homo sapiens
gaggaugaucaauaaaguu

SEQ ID NO: 1341219 - RNA, 19 nt, Homo sapiens
gaacaagaggaugaucaau

SEQ ID NO: 1341220 - RNA, 19 nt, Homo sapiens
agaggaugaucaauaaagu

SEQ ID NO: 1341221 - RNA, 19 nt, Homo sapiens
gcuagaagaacaagaggau

SEQ ID NO: 1341222 - RNA, 19 nt, Homo sapiens
ccagggcacaguagauaaa

SEQ ID NO: 1341223 - RNA, 19 nt, Homo sapiens
cuggaaauacacacaauaa

SEQ ID NO: 1341224 - RNA, 19 nt, Homo sapiens
caggagaguuacuguggau

SEQ ID NO: 1341225 - RNA, 19 nt, Homo sapiens
aggaagaaauuaggucaga

SEQ ID NO: 1341226 - RNA, 19 nt, Homo sapiens
gugagacaacuucaacaaa

SEQ ID NO: 1341227 - RNA, 19 nt, Homo sapiens
gaucaaagucacucaacag

SEQ ID NO: 1341228 - RNA, 19 nt, Homo sapiens
ucaaaaggcucuaaaacag

SEQ ID NO: 1341229 - RNA, 19 nt, Homo sapiens
cagaaaauccugcgaaguu

SEQ ID NO: 1341230 - RNA, 19 nt, Homo sapiens
ggagacgcaaggccacgua

SEQ ID NO: 1341231 - RNA, 19 nt, Homo sapiens
caaagcugacaaucaagaa

SEQ ID NO: 1341232 - RNA, 19 nt, Homo sapiens
acaacaaagcugacaauca

SEQ ID NO: 1341233 - RNA, 19 nt, Homo sapiens
aacagcaacuggaugaugu

SEQ ID NO: 1341234 - RNA, 19 nt, Homo sapiens
ccaggugccucaaaacuga

SEQ ID NO: 1341235 - RNA, 19 nt, Homo sapiens
uuucuaaagcugagaguaa

SEQ ID NO: 1341236 - RNA, 19 nt, Homo sapiens
guccaugaccuguuaggaa

SEQ ID NO: 1341237 - RNA, 19 nt, Homo sapiens
gaauuuaaaucuggauccu

SEQ ID NO: 1341238 - RNA, 19 nt, Homo sapiens
caagaggaugaucaauaaa

SEQ ID NO: 1341239 - RNA, 19 nt, Homo sapiens
ucuucaagcugagugcaua

SEQ ID NO: 1341240 - RNA, 19 nt, Homo sapiens
acacauacaaagagagcua

SEQ ID NO: 1341241 - RNA, 19 nt, Homo sapiens
ucucauguucugauucuuu

SEQ ID NO: 1341242 - RNA, 19 nt, Homo sapiens
gaauacgucuugucuauaa

SEQ ID NO: 1341243 - RNA, 19 nt, Homo sapiens
gaaauucaugccuuuguaa

SEQ ID NO: 1341244 - RNA, 19 nt, Homo sapiens
gacaccagcugcggaauuu

SEQ ID NO: 1341245 - RNA, 19 nt, Homo sapiens
gaaagcaacauaaauggau

SEQ ID NO: 1341246 - RNA, 19 nt, Homo sapiens
agaaauucaugccuuugua

SEQ ID NO: 1341247 - RNA, 19 nt, Homo sapiens
gauaggcggucaugcauac

SEQ ID NO: 1341248 - RNA, 19 nt, Homo sapiens
ggccacauauggaagcauu

SEQ ID NO: 1341249 - RNA, 19 nt, Homo sapiens
uugaauacgucuugucuau

SEQ ID NO: 1341250 - RNA, 19 nt, Homo sapiens
ggacaccagcugcggaauu

SEQ ID NO: 1341251 - RNA, 19 nt, Homo sapiens
ggaagcauugcauugauug

SEQ ID NO: 1341252 - RNA, 19 nt, Homo sapiens
guacuggccacauauggaa

SEQ ID NO: 1341253 - RNA, 19 nt, Homo sapiens
guucuuaaccucaucuguu

SEQ ID NO: 1341254 - RNA, 19 nt, Homo sapiens
uggaagcauugcauugauu

SEQ ID NO: 1341255 - RNA, 19 nt, Homo sapiens
guagauaggcggucaugca

SEQ ID NO: 1341256 - RNA, 19 nt, Homo sapiens
aaccucaucuguuaaguuc

SEQ ID NO: 1341257 - RNA, 19 nt, Homo sapiens
gcugugaaagcaacauaaa

SEQ ID NO: 1341258 - RNA, 19 nt, Homo sapiens
cauggcagguccagaaagu

SEQ ID NO: 1341259 - RNA, 19 nt, Homo sapiens
ugugaaagcaacauaaaug

SEQ ID NO: 1341260 - RNA, 19 nt, Homo sapiens
cagguagaaugaacugugu

SEQ ID NO: 1341261 - RNA, 19 nt, Homo sapiens
gcucgucugugcugccaau

SEQ ID NO: 1341262 - RNA, 19 nt, Homo sapiens
gcauugcauugauugucuu

SEQ ID NO: 1341263 - RNA, 19 nt, Homo sapiens
ugaauacgucuugucuaua

SEQ ID NO: 1341264 - RNA, 19 nt, Homo sapiens
aaucauggcagguccagaa

SEQ ID NO: 1341265 - RNA, 19 nt, Homo sapiens
gagaggugguuacauucgu

SEQ ID NO: 1341266 - RNA, 19 nt, Homo sapiens
cugcggaauuugcggcuuu

SEQ ID NO: 1341267 - RNA, 19 nt, Homo sapiens
uaaacugucuacgguucuu

SEQ ID NO: 1341268 - RNA, 19 nt, Homo sapiens
uauggaagcauugcauuga

SEQ ID NO: 1341269 - RNA, 19 nt, Homo sapiens
ugaaagcaacauaaaugga

SEQ ID NO: 1341270 - RNA, 19 nt, Homo sapiens
caacucuuauacucucaca

SEQ ID NO: 1341271 - RNA, 19 nt, Homo sapiens
agaggugguuacauucguu

SEQ ID NO: 1341272 - RNA, 19 nt, Homo sapiens
gagaagcuaaugccaacuc

SEQ ID NO: 1341273 - RNA, 19 nt, Homo sapiens
uagaaugaacuguguacug

SEQ ID NO: 1341274 - RNA, 19 nt, Homo sapiens
cgucugugcugccaaucga

SEQ ID NO: 1341275 - RNA, 19 nt, Homo sapiens
uggcagguccagaaaguga

SEQ ID NO: 1341276 - RNA, 19 nt, Homo sapiens
uggcgucggucgugguaga

SEQ ID NO: 1341277 - RNA, 19 nt, Homo sapiens
gugaaagcaacauaaaugg

SEQ ID NO: 1341278 - RNA, 19 nt, Homo sapiens
cagcugugaaagcaacaua

SEQ ID NO: 1341279 - RNA, 19 nt, Homo sapiens
cauauggaagcauugcauu

SEQ ID NO: 1341280 - RNA, 19 nt, Homo sapiens
ggucaugcauacgaauuuu

SEQ ID NO: 1341281 - RNA, 19 nt, Homo sapiens
ucucacagguagaaugaac

SEQ ID NO: 1341282 - RNA, 19 nt, Homo sapiens
agaagcuaaugccaacuca

SEQ ID NO: 1341283 - RNA, 19 nt, Homo sapiens
gcagguccagaaagugaug

SEQ ID NO: 1341284 - RNA, 19 nt, Homo sapiens
gugguuacauucguugaag

SEQ ID NO: 1341285 - RNA, 19 nt, Homo sapiens
aaugccaacucaucaugug

SEQ ID NO: 1341286 - RNA, 19 nt, Homo sapiens
gaagcauugcauugauugu

SEQ ID NO: 1341287 - RNA, 19 nt, Homo sapiens
gcggucaugcauacgaauu

SEQ ID NO: 1341288 - RNA, 19 nt, Homo sapiens
cuaaugccaacucaucaug

SEQ ID NO: 1341289 - RNA, 19 nt, Homo sapiens
aagcuaaugccaacucauc

SEQ ID NO: 1341290 - RNA, 19 nt, Homo sapiens
ucuuauacucucacaggua

SEQ ID NO: 1341291 - RNA, 19 nt, Homo sapiens
cacugucacugccuaccaa

SEQ ID NO: 1341292 - RNA, 19 nt, Homo sapiens
gagggcaacugcauaggua

SEQ ID NO: 1341293 - RNA, 19 nt, Homo sapiens
ggaggucggugaaauaaag

SEQ ID NO: 1341294 - RNA, 19 nt, Homo sapiens
ggacuggcaugcacauugu

SEQ ID NO: 1341295 - RNA, 19 nt, Homo sapiens
gcagaaauaacaccuaugu

SEQ ID NO: 1341296 - RNA, 19 nt, Homo sapiens
aaucaaugcugccaacuau

SEQ ID NO: 1341297 - RNA, 19 nt, Homo sapiens
caaggcauguucuuaaagu

SEQ ID NO: 1341298 - RNA, 19 nt, Homo sapiens
uacaugagcuucuccuguu

SEQ ID NO: 1341299 - RNA, 19 nt, Homo sapiens
auacagggcugcuggacuu

SEQ ID NO: 1341300 - RNA, 19 nt, Homo sapiens
cuccagcucugauuguaua

SEQ ID NO: 1341301 - RNA, 19 nt, Homo sapiens
guacugcugcugcauggua

SEQ ID NO: 1341302 - RNA, 19 nt, Homo sapiens
ugaagcagcugcccaacca

SEQ ID NO: 1341303 - RNA, 19 nt, Homo sapiens
ugucuggguucuugucuuu

SEQ ID NO: 1341304 - RNA, 19 nt, Homo sapiens
guaaauggcagaggcagaa

SEQ ID NO: 1341305 - RNA, 19 nt, Homo sapiens
gaagacuccagcucugauu

SEQ ID NO: 1341306 - RNA, 19 nt, Homo sapiens
cccaaggcauguucuuaaa

SEQ ID NO: 1341307 - RNA, 19 nt, Homo sapiens
gagccauccuuguuuccaa

SEQ ID NO: 1341308 - RNA, 19 nt, Homo sapiens
cauccuuguuuccaaauau

SEQ ID NO: 1341309 - RNA, 19 nt, Homo sapiens
cuauaugucuggguucuug

SEQ ID NO: 1341310 - RNA, 19 nt, Homo sapiens
cagguuacacacuaaagua

SEQ ID NO: 1341311 - RNA, 19 nt, Homo sapiens
gaguggaggucggugaaau

SEQ ID NO: 1341312 - RNA, 19 nt, Homo sapiens
ggacuccuaaccaugcuaa

SEQ ID NO: 1341313 - RNA, 19 nt, Homo sapiens
aauaugacccuucgcuuga

SEQ ID NO: 1341314 - RNA, 19 nt, Homo sapiens
ggaaucaaggaacauaauc

SEQ ID NO: 1341315 - RNA, 19 nt, Homo sapiens
gacuccagcucugauugua

SEQ ID NO: 1341316 - RNA, 19 nt, Homo sapiens
gggguaaaaucaagagaaa

SEQ ID NO: 1341317 - RNA, 19 nt, Homo sapiens
ccacuccuccuucugcaaa

SEQ ID NO: 1341318 - RNA, 19 nt, Homo sapiens
aggcagaaauaacaccuau

SEQ ID NO: 1341319 - RNA, 19 nt, Homo sapiens
ccauccuuguuuccaaaua

SEQ ID NO: 1341320 - RNA, 19 nt, Homo sapiens
guuuagagccauccuuguu

SEQ ID NO: 1341321 - RNA, 19 nt, Homo sapiens
guucuuaaaguucuggaaa

SEQ ID NO: 1341322 - RNA, 19 nt, Homo sapiens
uacaugagccuccacacaa

SEQ ID NO: 1341323 - RNA, 19 nt, Homo sapiens
uuagagccauccuuguuuc

SEQ ID NO: 1341324 - RNA, 19 nt, Homo sapiens
ucucaggaaucaaggaaca

SEQ ID NO: 1341325 - RNA, 19 nt, Homo sapiens
ggcagaggcagaaauaaca

SEQ ID NO: 1341326 - RNA, 19 nt, Homo sapiens
aauggcagaggcagaaaua

SEQ ID NO: 1341327 - RNA, 19 nt, Homo sapiens
auaauccuguggaggguaa

SEQ ID NO: 1341328 - RNA, 19 nt, Homo sapiens
ucaggaaucaaggaacaua

SEQ ID NO: 1341329 - RNA, 19 nt, Homo sapiens
ccagaggaguggcauacag

SEQ ID NO: 1341330 - RNA, 19 nt, Homo sapiens
cagcucugauuguauaugg

SEQ ID NO: 1341331 - RNA, 19 nt, Homo sapiens
caacuaugccagugugaag

SEQ ID NO: 1341332 - RNA, 19 nt, Homo sapiens
guggaggucggugaaauaa

SEQ ID NO: 1341333 - RNA, 19 nt, Homo sapiens
cauguggacuccuaaccau

SEQ ID NO: 1341334 - RNA, 19 nt, Homo sapiens
cuaccgggcuguggccauu

SEQ ID NO: 1341335 - RNA, 19 nt, Homo sapiens
caggcucgcuucucuguac

SEQ ID NO: 1341336 - RNA, 19 nt, Homo sapiens
gcaacugcauagguacauc

SEQ ID NO: 1341337 - RNA, 19 nt, Homo sapiens
aaaucaaugcugccaacua

SEQ ID NO: 1341338 - RNA, 19 nt, Homo sapiens
ucggugaaauaaagugaug

SEQ ID NO: 1341339 - RNA, 19 nt, Homo sapiens
uaaccaugcuaaccucacu

SEQ ID NO: 1341340 - RNA, 19 nt, Homo sapiens
ggcauguucuuaaaguucu

SEQ ID NO: 1341341 - RNA, 19 nt, Homo sapiens
caucugcacugacaaaauc

SEQ ID NO: 1341342 - RNA, 19 nt, Homo sapiens
gugcgucugucuauauguc

SEQ ID NO: 1341343 - RNA, 19 nt, Homo sapiens
caggugcgucugucuauau

SEQ ID NO: 1341344 - RNA, 19 nt, Homo sapiens
gguguggccagcccugaaa

SEQ ID NO: 1341345 - RNA, 19 nt, Homo sapiens
caggaaucaaggaacauaa

SEQ ID NO: 1341346 - RNA, 19 nt, Homo sapiens
cauauacacacaugcauac

SEQ ID NO: 1341347 - RNA, 19 nt, Homo sapiens
ggcagaaccuggguacacu

SEQ ID NO: 1341348 - RNA, 19 nt, Homo sapiens
ggucggugaaauaaaguga

SEQ ID NO: 1341349 - RNA, 19 nt, Homo sapiens
acaugagccuccacacaag

SEQ ID NO: 1341350 - RNA, 19 nt, Homo sapiens
cugcauagguacaucuaac

SEQ ID NO: 1341351 - RNA, 19 nt, Homo sapiens
gcuugagggcaacugcaua

SEQ ID NO: 1341352 - RNA, 19 nt, Homo sapiens
gugaagacuccagcucuga

SEQ ID NO: 1341353 - RNA, 19 nt, Homo sapiens
gcaggaggcccuuuugcaa

SEQ ID NO: 1341354 - RNA, 19 nt, Homo sapiens
gaggcagaaauaacaccua

SEQ ID NO: 1341355 - RNA, 19 nt, Homo sapiens
uuuagagccauccuuguuu

SEQ ID NO: 1341356 - RNA, 19 nt, Homo sapiens
ccuguuaccuggacaaacc

SEQ ID NO: 1341357 - RNA, 19 nt, Homo sapiens
aguggaggucggugaaaua

SEQ ID NO: 1341358 - RNA, 19 nt, Homo sapiens
gcauagguacaucuaacuc

SEQ ID NO: 1341359 - RNA, 19 nt, Homo sapiens
ccacuuccccaccuccuua

SEQ ID NO: 1341360 - RNA, 19 nt, Homo sapiens
ucaaugcugccaacuaugc

SEQ ID NO: 1341361 - RNA, 19 nt, Homo sapiens
gcaggcucgcuucucugua

SEQ ID NO: 1341362 - RNA, 19 nt, Homo sapiens
gaggaucgcucgccaacua

SEQ ID NO: 1341363 - RNA, 19 nt, Homo sapiens
ggucguaacucaagagcaa

SEQ ID NO: 1341364 - RNA, 19 nt, Homo sapiens
caagguugcuuuuguguua

SEQ ID NO: 1341365 - RNA, 19 nt, Homo sapiens
gcaaaggaaccagauauug

SEQ ID NO: 1341366 - RNA, 19 nt, Homo sapiens
caucuacuccaauuuguua

SEQ ID NO: 1341367 - RNA, 19 nt, Homo sapiens
gagaagaggaguccauuuc

SEQ ID NO: 1341368 - RNA, 19 nt, Homo sapiens
ccaccuggcuuuuauuaua

SEQ ID NO: 1341369 - RNA, 19 nt, Homo sapiens
gaagaggaguccauuucuc

SEQ ID NO: 1341370 - RNA, 19 nt, Homo sapiens
caaaggaaccagauauugu

SEQ ID NO: 1341371 - RNA, 19 nt, Homo sapiens
ccaaccagaaguacauuua

SEQ ID NO: 1341372 - RNA, 19 nt, Homo sapiens
gaaugcuucucgauaaauc

SEQ ID NO: 1341373 - RNA, 19 nt, Homo sapiens
ccacaucuacuccaauuug

SEQ ID NO: 1341374 - RNA, 19 nt, Homo sapiens
uacauaagguacugaaguu

SEQ ID NO: 1341375 - RNA, 19 nt, Homo sapiens
gguagaaaccacugccuuu

SEQ ID NO: 1341376 - RNA, 19 nt, Homo sapiens
gcaaaccaccguacugcaa

SEQ ID NO: 1341377 - RNA, 19 nt, Homo sapiens
aaacugagguccugugacu

SEQ ID NO: 1341378 - RNA, 19 nt, Homo sapiens
gcacaggagacuuaaaaua

SEQ ID NO: 1341379 - RNA, 19 nt, Homo sapiens
ucucugagcauuaaagaaa

SEQ ID NO: 1341380 - RNA, 19 nt, Homo sapiens
gcugaauggugcagugaga

SEQ ID NO: 1341381 - RNA, 19 nt, Homo sapiens
uauggucucugagcauuaa

SEQ ID NO: 1341382 - RNA, 19 nt, Homo sapiens
ccgaaugcuucucgauaaa

SEQ ID NO: 1341383 - RNA, 19 nt, Homo sapiens
aaccacaucuacuccaauu

SEQ ID NO: 1341384 - RNA, 19 nt, Homo sapiens
ccaccguacugcaaaggaa

SEQ ID NO: 1341385 - RNA, 19 nt, Homo sapiens
gagaaaggacgguagaaac

SEQ ID NO: 1341386 - RNA, 19 nt, Homo sapiens
ccacuaccagccuaacuuu

SEQ ID NO: 1341387 - RNA, 19 nt, Homo sapiens
guaaauuuguccccauaaa

SEQ ID NO: 1341388 - RNA, 19 nt, Homo sapiens
ugagggcacugacgcugaa

SEQ ID NO: 1341389 - RNA, 19 nt, Homo sapiens
accgaaugcuucucgauaa

SEQ ID NO: 1341390 - RNA, 19 nt, Homo sapiens
guagaaaccacugccuuug

SEQ ID NO: 1341391 - RNA, 19 nt, Homo sapiens
caaaccaccguacugcaaa

SEQ ID NO: 1341392 - RNA, 19 nt, Homo sapiens
gugccacacucacccagaa

SEQ ID NO: 1341393 - RNA, 19 nt, Homo sapiens
caccgaaugcuucucgaua

SEQ ID NO: 1341394 - RNA, 19 nt, Homo sapiens
ugagaaaggacgguagaaa

SEQ ID NO: 1341395 - RNA, 19 nt, Homo sapiens
aaaggaaccagauauugug

SEQ ID NO: 1341396 - RNA, 19 nt, Homo sapiens
uccaauuuguuaagucuga

SEQ ID NO: 1341397 - RNA, 19 nt, Homo sapiens
gaaaggacgguagaaacca

SEQ ID NO: 1341398 - RNA, 19 nt, Homo sapiens
guagagcacacugggcuuu

SEQ ID NO: 1341399 - RNA, 19 nt, Homo sapiens
aaagaaagcaagggaggaa

SEQ ID NO: 1341400 - RNA, 19 nt, Homo sapiens
gaaguuagccaagguugcu

SEQ ID NO: 1341401 - RNA, 19 nt, Homo sapiens
aauaguugccagcagauaa

SEQ ID NO: 1341402 - RNA, 19 nt, Homo sapiens
aaaccacugccuuugcuuu

SEQ ID NO: 1341403 - RNA, 19 nt, Homo sapiens
cgagaagaggaguccauuu

SEQ ID NO: 1341404 - RNA, 19 nt, Homo sapiens
cauaagguacugaaguuag

SEQ ID NO: 1341405 - RNA, 19 nt, Homo sapiens
uguuaagucugaaagaaag

SEQ ID NO: 1341406 - RNA, 19 nt, Homo sapiens
acugagguccugugacuuu

SEQ ID NO: 1341407 - RNA, 19 nt, Homo sapiens
ugaauggugcagugagaaa

SEQ ID NO: 1341408 - RNA, 19 nt, Homo sapiens
gccuugcacaggagacuua

SEQ ID NO: 1341409 - RNA, 19 nt, Homo sapiens
uugagacucuagaaauuuc

SEQ ID NO: 1341410 - RNA, 19 nt, Homo sapiens
aaaacugccuguugguaaa

SEQ ID NO: 1341411 - RNA, 19 nt, Homo sapiens
uuacauaagguacugaagu

SEQ ID NO: 1341412 - RNA, 19 nt, Homo sapiens
gagaagccaagacguggau

SEQ ID NO: 1341413 - RNA, 19 nt, Homo sapiens
gcgagaagaggaguccauu

SEQ ID NO: 1341414 - RNA, 19 nt, Homo sapiens
cacaucuacuccaauuugu

SEQ ID NO: 1341415 - RNA, 19 nt, Homo sapiens
ccaagacguggaucgagaa

SEQ ID NO: 1341416 - RNA, 19 nt, Homo sapiens
cuuauggucucugagcauu

SEQ ID NO: 1341417 - RNA, 19 nt, Homo sapiens
cuacuccaauuuguuaagu

SEQ ID NO: 1341418 - RNA, 19 nt, Homo sapiens
gaaaccacugccuuugcuu

SEQ ID NO: 1341419 - RNA, 19 nt, Homo sapiens
agaaaccacugccuuugcu

SEQ ID NO: 1341420 - RNA, 19 nt, Homo sapiens
gauucaguacguucuguga

SEQ ID NO: 1341421 - RNA, 19 nt, Homo sapiens
caguaaauuuguccccaua

SEQ ID NO: 1341422 - RNA, 19 nt, Homo sapiens
acauaagguacugaaguua

SEQ ID NO: 1341423 - RNA, 19 nt, Homo sapiens
ccaauuuguuaagucugaa

SEQ ID NO: 1341424 - RNA, 19 nt, Homo sapiens
uuggguguguuucucauga

SEQ ID NO: 1341425 - RNA, 19 nt, Homo sapiens
ggucucugagcauuaaaga

SEQ ID NO: 1341426 - RNA, 19 nt, Homo sapiens
caaccagaaguacauuuac

SEQ ID NO: 1341427 - RNA, 19 nt, Homo sapiens
cugcaaaggaaccagauau

SEQ ID NO: 1341428 - RNA, 19 nt, Homo sapiens
caggagacuuaaaauaguu

SEQ ID NO: 1341429 - RNA, 19 nt, Homo sapiens
cgaaugcuucucgauaaau

SEQ ID NO: 1341430 - RNA, 19 nt, Homo sapiens
gccacuaccagccuaacuu

SEQ ID NO: 1341431 - RNA, 19 nt, Homo sapiens
gcaccgaaugcuucucgau

SEQ ID NO: 1341432 - RNA, 19 nt, Homo sapiens
ugcaaaggaaccagauauu

SEQ ID NO: 1341433 - RNA, 19 nt, Homo sapiens
gguuucuggucguaacuca

SEQ ID NO: 1341434 - RNA, 19 nt, Homo sapiens
aaaccaccguacugcaaag

SEQ ID NO: 1341435 - RNA, 19 nt, Homo sapiens
gccuuaaacauauucacuu

SEQ ID NO: 1341436 - RNA, 19 nt, Homo sapiens
ucaguacguucugugaaag

SEQ ID NO: 1341437 - RNA, 19 nt, Homo sapiens
gcugugagcuccauuugua

SEQ ID NO: 1341438 - RNA, 19 nt, Homo sapiens
ggagaaagcaacaccauug

SEQ ID NO: 1341439 - RNA, 19 nt, Homo sapiens
gugcagaccuccaagaagu

SEQ ID NO: 1341440 - RNA, 19 nt, Homo sapiens
gaacagccuggaugaagaa

SEQ ID NO: 1341441 - RNA, 19 nt, Homo sapiens
caagaaguccuacgugugu

SEQ ID NO: 1341442 - RNA, 19 nt, Homo sapiens
acagcgaccuugcaaagaa

SEQ ID NO: 1341443 - RNA, 19 nt, Homo sapiens
gaggauuggucccuucuag

SEQ ID NO: 1341444 - RNA, 19 nt, Homo sapiens
ugaagacccuguggugauu

SEQ ID NO: 1341445 - RNA, 19 nt, Homo sapiens
ggaccuggaugggcaccua

SEQ ID NO: 1341446 - RNA, 19 nt, Homo sapiens
ccaaagagccgcuggaaaa

SEQ ID NO: 1341447 - RNA, 19 nt, Homo sapiens
ugaaagaguggccaaguga

SEQ ID NO: 1341448 - RNA, 19 nt, Homo sapiens
gaaagaguggccaagugaa

SEQ ID NO: 1341449 - RNA, 19 nt, Homo sapiens
agaacagccuggaugaaga

SEQ ID NO: 1341450 - RNA, 19 nt, Homo sapiens
uauggagaguucaucauug

SEQ ID NO: 1341451 - RNA, 19 nt, Homo sapiens
cgagucggguuucuccauu

SEQ ID NO: 1341452 - RNA, 19 nt, Homo sapiens
gagaacagccuggaugaag

SEQ ID NO: 1341453 - RNA, 19 nt, Homo sapiens
cagccuggaugaagaagug

SEQ ID NO: 1341454 - RNA, 19 nt, Homo sapiens
uaacaagaacagugacuuc

SEQ ID NO: 1341455 - RNA, 19 nt, Homo sapiens
ucaagagcuucacgcagaa

SEQ ID NO: 1341456 - RNA, 19 nt, Homo sapiens
gguagaagaaagaaggaaa

SEQ ID NO: 1341457 - RNA, 19 nt, Homo sapiens
ggauuggucccuucuagau

SEQ ID NO: 1341458 - RNA, 19 nt, Homo sapiens
cuccggagcuucaagauag

SEQ ID NO: 1341459 - RNA, 19 nt, Homo sapiens
gagaaagcaacaccauugu

SEQ ID NO: 1341460 - RNA, 19 nt, Homo sapiens
ggacccaguucugcaagau

SEQ ID NO: 1341461 - RNA, 19 nt, Homo sapiens
aaagaguggccaagugaaa

SEQ ID NO: 1341462 - RNA, 19 nt, Homo sapiens
ccacagcgaccuugcaaag

SEQ ID NO: 1341463 - RNA, 19 nt, Homo sapiens
ucaaggacaugauuuuaug

SEQ ID NO: 1341464 - RNA, 19 nt, Homo sapiens
cacgagcgccugcacauga

SEQ ID NO: 1341465 - RNA, 19 nt, Homo sapiens
caggaugcccagcccauaa

SEQ ID NO: 1341466 - RNA, 19 nt, Homo sapiens
gagcccaccuggagagaac

SEQ ID NO: 1341467 - RNA, 19 nt, Homo sapiens
gagcuccauuuguaaaggu

SEQ ID NO: 1341468 - RNA, 19 nt, Homo sapiens
ggacgaggacucccagcau

SEQ ID NO: 1341469 - RNA, 19 nt, Homo sapiens
gagcuucacgcagaacuau

SEQ ID NO: 1341470 - RNA, 19 nt, Homo sapiens
gggagaaagcaacaccauu

SEQ ID NO: 1341471 - RNA, 19 nt, Homo sapiens
gguacugcgucaagagcuu

SEQ ID NO: 1341472 - RNA, 19 nt, Homo sapiens
gcuggagggucaacuucau

SEQ ID NO: 1341473 - RNA, 19 nt, Homo sapiens
cuccaagucuccagccauu

SEQ ID NO: 1341474 - RNA, 19 nt, Homo sapiens
gugaagacccuguggugau

SEQ ID NO: 1341475 - RNA, 19 nt, Homo sapiens
aaagugaggagcccaggaa

SEQ ID NO: 1341476 - RNA, 19 nt, Homo sapiens
acaccucccuccuguccuu

SEQ ID NO: 1341477 - RNA, 19 nt, Homo sapiens
gcuucacgcagaacuauga

SEQ ID NO: 1341478 - RNA, 19 nt, Homo sapiens
gccacgcguuccagaguug

SEQ ID NO: 1341479 - RNA, 19 nt, Homo sapiens
cuauggagaguucaucauu

SEQ ID NO: 1341480 - RNA, 19 nt, Homo sapiens
uggcuucuauggagaguuc

SEQ ID NO: 1341481 - RNA, 19 nt, Homo sapiens
gcacaccaaggagcagauu

SEQ ID NO: 1341482 - RNA, 19 nt, Homo sapiens
ucaagauaguggccugcuu

SEQ ID NO: 1341483 - RNA, 19 nt, Homo sapiens
uagagaacagccuggauga

SEQ ID NO: 1341484 - RNA, 19 nt, Homo sapiens
gagucggguuucuccauuc

SEQ ID NO: 1341485 - RNA, 19 nt, Homo sapiens
aggagcagcugccgguaga

SEQ ID NO: 1341486 - RNA, 19 nt, Homo sapiens
agucuuggcuccgaaggaa

SEQ ID NO: 1341487 - RNA, 19 nt, Homo sapiens
cccaucaaaucccaucaug

SEQ ID NO: 1341488 - RNA, 19 nt, Homo sapiens
ucugcaagaugcuuuccuu

SEQ ID NO: 1341489 - RNA, 19 nt, Homo sapiens
gggacccaguucugcaaga

SEQ ID NO: 1341490 - RNA, 19 nt, Homo sapiens
agcaggcucugaacuccua

SEQ ID NO: 1341491 - RNA, 19 nt, Homo sapiens
cgacagcgaggaccuggau

SEQ ID NO: 1341492 - RNA, 19 nt, Homo sapiens
ccaagcaggcucugaacuc

SEQ ID NO: 1341493 - RNA, 19 nt, Homo sapiens
guuccaagcaggcucugaa

SEQ ID NO: 1341494 - RNA, 19 nt, Homo sapiens
gaggagcccaggaaaauga

SEQ ID NO: 1341495 - RNA, 19 nt, Homo sapiens
cuacguguguccgaacugu

SEQ ID NO: 1341496 - RNA, 19 nt, Homo sapiens
gagccacgcguuccagagu

SEQ ID NO: 1341497 - RNA, 19 nt, Homo sapiens
ccaggaugcccagcccaua

SEQ ID NO: 1341498 - RNA, 19 nt, Homo sapiens
gccguggcuuuccggauga

SEQ ID NO: 1341499 - RNA, 19 nt, Homo sapiens
gcaaggccaaacugagcuu

SEQ ID NO: 1341500 - RNA, 19 nt, Homo sapiens
gccauuccagguagaagaa

SEQ ID NO: 1341501 - RNA, 19 nt, Homo sapiens
gggucucaaugccuccaaa

SEQ ID NO: 1341502 - RNA, 19 nt, Homo sapiens
gaagacccuguggugauug

SEQ ID NO: 1341503 - RNA, 19 nt, Homo sapiens
augaaagaguggccaagug

SEQ ID NO: 1341504 - RNA, 19 nt, Homo sapiens
augaagaagugaccaucga

SEQ ID NO: 1341505 - RNA, 19 nt, Homo sapiens
gcaacccgcgaucucuaga

SEQ ID NO: 1341506 - RNA, 19 nt, Homo sapiens
ucucaaugccuccaaacga

SEQ ID NO: 1341507 - RNA, 19 nt, Homo sapiens
gcucaagcacugugaagac

SEQ ID NO: 1341508 - RNA, 19 nt, Homo sapiens
uuccaggccugcccacaga

SEQ ID NO: 1341509 - RNA, 19 nt, Homo sapiens
guagaagaaagaaggaaac

SEQ ID NO: 1341510 - RNA, 19 nt, Homo sapiens
acgagcgccugcacaugaa

SEQ ID NO: 1341511 - RNA, 19 nt, Homo sapiens
ggaucuccagggcaaagaa

SEQ ID NO: 1341512 - RNA, 19 nt, Homo sapiens
ccauucaaggacaugauuu

SEQ ID NO: 1341513 - RNA, 19 nt, Homo sapiens
acccuguggugauugauga

SEQ ID NO: 1341514 - RNA, 19 nt, Homo sapiens
aagacccuguggugauuga

SEQ ID NO: 1341515 - RNA, 19 nt, Homo sapiens
gcaguaagcacaagaaaga

SEQ ID NO: 1341516 - RNA, 19 nt, Homo sapiens
ccaagaagcugaggcaaga

SEQ ID NO: 1341517 - RNA, 19 nt, Homo sapiens
gccagacccugacucaaua

SEQ ID NO: 1341518 - RNA, 19 nt, Homo sapiens
gacccugacucaauacaaa

SEQ ID NO: 1341519 - RNA, 19 nt, Homo sapiens
ggaggugacccaaguauuc

SEQ ID NO: 1341520 - RNA, 19 nt, Homo sapiens
guaagcacaagaaagauuu

SEQ ID NO: 1341521 - RNA, 19 nt, Homo sapiens
ggauggagcugccuuucag

SEQ ID NO: 1341522 - RNA, 19 nt, Homo sapiens
caucccagcuacccaagaa

SEQ ID NO: 1341523 - RNA, 19 nt, Homo sapiens
gcaccaccuucaccaccua

SEQ ID NO: 1341524 - RNA, 19 nt, Homo sapiens
guaaaucucucugcuucuc

SEQ ID NO: 1341525 - RNA, 19 nt, Homo sapiens
gcaggugucccguggaaau

SEQ ID NO: 1341526 - RNA, 19 nt, Homo sapiens
cgggaccgcugacucugua

SEQ ID NO: 1341527 - RNA, 19 nt, Homo sapiens
ggcaggaggugacccaagu

SEQ ID NO: 1341528 - RNA, 19 nt, Homo sapiens
gugggaggauugcuugaga

SEQ ID NO: 1341529 - RNA, 19 nt, Homo sapiens
ggaggaaccgcaccaccuu

SEQ ID NO: 1341530 - RNA, 19 nt, Homo sapiens
ucagucuccugucuguuaa

SEQ ID NO: 1341531 - RNA, 19 nt, Homo sapiens
cuucgggccucaugccuuu

SEQ ID NO: 1341532 - RNA, 19 nt, Homo sapiens
aaacagggacggugacaca

SEQ ID NO: 1341533 - RNA, 19 nt, Homo sapiens
ucuguaagaugaguguaaa

SEQ ID NO: 1341534 - RNA, 19 nt, Homo sapiens
gcaggaggugacccaagua

SEQ ID NO: 1341535 - RNA, 19 nt, Homo sapiens
ggacggugacacacacaga

SEQ ID NO: 1341536 - RNA, 19 nt, Homo sapiens
cucagucuccugucuguua

SEQ ID NO: 1341537 - RNA, 19 nt, Homo sapiens
gcucccaccuucgcagaug

SEQ ID NO: 1341538 - RNA, 19 nt, Homo sapiens
ccagucgcaucgcccaaga

SEQ ID NO: 1341539 - RNA, 19 nt, Homo sapiens
gaagccagguccccaaagu

SEQ ID NO: 1341540 - RNA, 19 nt, Homo sapiens
cgcugacucuguaagauga

SEQ ID NO: 1341541 - RNA, 19 nt, Homo sapiens
agaagaagcaccggaggaa

SEQ ID NO: 1341542 - RNA, 19 nt, Homo sapiens
guucgaggccucucacuac

SEQ ID NO: 1341543 - RNA, 19 nt, Homo sapiens
gagcgggaccagagagaca

SEQ ID NO: 1341544 - RNA, 19 nt, Homo sapiens
agaaggaagagcagacaga

SEQ ID NO: 1341545 - RNA, 19 nt, Homo sapiens
ccuguaaucccagugcuuu

SEQ ID NO: 1341546 - RNA, 19 nt, Homo sapiens
ugucagcccauucuauaga

SEQ ID NO: 1341547 - RNA, 19 nt, Homo sapiens
ucuccugucuguuaauugg

SEQ ID NO: 1341548 - RNA, 19 nt, Homo sapiens
aggcugaggugggaggauu

SEQ ID NO: 1341549 - RNA, 19 nt, Homo sapiens
gcgacagguucuggagaga

SEQ ID NO: 1341550 - RNA, 19 nt, Homo sapiens
gcacuccccucuccguugu

SEQ ID NO: 1341551 - RNA, 19 nt, Homo sapiens
gaccgcugacucuguaaga

SEQ ID NO: 1341552 - RNA, 19 nt, Homo sapiens
ggugacacacacagagaga

SEQ ID NO: 1341553 - RNA, 19 nt, Homo sapiens
gggccucagucuccugucu

SEQ ID NO: 1341554 - RNA, 19 nt, Homo sapiens
gaagcugaggcaagaggau

SEQ ID NO: 1341555 - RNA, 19 nt, Homo sapiens
aguaagcacaagaaagauu

SEQ ID NO: 1341556 - RNA, 19 nt, Homo sapiens
ucucucugcuucuccuaau

SEQ ID NO: 1341557 - RNA, 19 nt, Homo sapiens
caguggagggaaccgauuu

SEQ ID NO: 1341558 - RNA, 19 nt, Homo sapiens
ccaggugggagccauguuc

SEQ ID NO: 1341559 - RNA, 19 nt, Homo sapiens
ucacuacccggauguguac

SEQ ID NO: 1341560 - RNA, 19 nt, Homo sapiens
gcacacaucuguauuaaua

SEQ ID NO: 1341561 - RNA, 19 nt, Homo sapiens
gcaagaugauuuccaauaa

SEQ ID NO: 1341562 - RNA, 19 nt, Homo sapiens
ggacaugaguauuuaagga

SEQ ID NO: 1341563 - RNA, 19 nt, Homo sapiens
ggacaaacauugagcuucu

SEQ ID NO: 1341564 - RNA, 19 nt, Homo sapiens
gaacgugggaccuuuguuu

SEQ ID NO: 1341565 - RNA, 19 nt, Homo sapiens
guuaagagauuacugugaa

SEQ ID NO: 1341566 - RNA, 19 nt, Homo sapiens
ucagagagcugcaggaaca

SEQ ID NO: 1341567 - RNA, 19 nt, Homo sapiens
gaaagaauacccagagcaa

SEQ ID NO: 1341568 - RNA, 19 nt, Homo sapiens
uaaagcaugugguucagaa

SEQ ID NO: 1341569 - RNA, 19 nt, Homo sapiens
ggagggaacuacagucagu

SEQ ID NO: 1341570 - RNA, 19 nt, Homo sapiens
gaaguucuguuugcuguca

SEQ ID NO: 1341571 - RNA, 19 nt, Homo sapiens
cagcacacaucuguauuaa

SEQ ID NO: 1341572 - RNA, 19 nt, Homo sapiens
ggaaaauggugaaggaaaa

SEQ ID NO: 1341573 - RNA, 19 nt, Homo sapiens
cauccaaugucuccuuaaa

SEQ ID NO: 1341574 - RNA, 19 nt, Homo sapiens
guauuaauagccuguguua

SEQ ID NO: 1341575 - RNA, 19 nt, Homo sapiens
uggaggacaugaguauuua

SEQ ID NO: 1341576 - RNA, 19 nt, Homo sapiens
gaaauucagaccaggaaau

SEQ ID NO: 1341577 - RNA, 19 nt, Homo sapiens
gaacaaagaccaggcaaaa

SEQ ID NO: 1341578 - RNA, 19 nt, Homo sapiens
cagauuuacucuagauuca

SEQ ID NO: 1341579 - RNA, 19 nt, Homo sapiens
aaagagccuuggagaaguu

SEQ ID NO: 1341580 - RNA, 19 nt, Homo sapiens
gaacuacagucaguaacag

SEQ ID NO: 1341581 - RNA, 19 nt, Homo sapiens
gaacagcuacuccagaaac

SEQ ID NO: 1341582 - RNA, 19 nt, Homo sapiens
gaaauuccaauacaucagu

SEQ ID NO: 1341583 - RNA, 19 nt, Homo sapiens
uaagcuaccugaaguucug

SEQ ID NO: 1341584 - RNA, 19 nt, Homo sapiens
gcaugugguucagaauuga

SEQ ID NO: 1341585 - RNA, 19 nt, Homo sapiens
gguaugaauuuuccuguaa

SEQ ID NO: 1341586 - RNA, 19 nt, Homo sapiens
guggaggacaugaguauuu

SEQ ID NO: 1341587 - RNA, 19 nt, Homo sapiens
caagaugauuuccaauaac

SEQ ID NO: 1341588 - RNA, 19 nt, Homo sapiens
gcagauuuacucuagauuc

SEQ ID NO: 1341589 - RNA, 19 nt, Homo sapiens
cugaacagcuacuccagaa

SEQ ID NO: 1341590 - RNA, 19 nt, Homo sapiens
ggaacuacagucaguaaca

SEQ ID NO: 1341591 - RNA, 19 nt, Homo sapiens
acagagaguuucaguaaaa

SEQ ID NO: 1341592 - RNA, 19 nt, Homo sapiens
agagcaagaugauuuccaa

SEQ ID NO: 1341593 - RNA, 19 nt, Homo sapiens
gaaaagagccuuggagaag

SEQ ID NO: 1341594 - RNA, 19 nt, Homo sapiens
ccuaugagguuuaucuucu

SEQ ID NO: 1341595 - RNA, 19 nt, Homo sapiens
ggacaaggagggaacuaca

SEQ ID NO: 1341596 - RNA, 19 nt, Homo sapiens
ucaugcagauuuacucuag

SEQ ID NO: 1341597 - RNA, 19 nt, Homo sapiens
aaacauuagucccuacaag

SEQ ID NO: 1341598 - RNA, 19 nt, Homo sapiens
gagugagagugguaugaau

SEQ ID NO: 1341599 - RNA, 19 nt, Homo sapiens
uagccuguguuaagagauu

SEQ ID NO: 1341600 - RNA, 19 nt, Homo sapiens
acauugagcuucugaacag

SEQ ID NO: 1341601 - RNA, 19 nt, Homo sapiens
ccuguaagcuaccugaagu

SEQ ID NO: 1341602 - RNA, 19 nt, Homo sapiens
gugagagugguaugaauuu

SEQ ID NO: 1341603 - RNA, 19 nt, Homo sapiens
guccacaucaugcagauuu

SEQ ID NO: 1341604 - RNA, 19 nt, Homo sapiens
uugagaacgugcagaguga

SEQ ID NO: 1341605 - RNA, 19 nt, Homo sapiens
uacagagaguuucaguaaa

SEQ ID NO: 1341606 - RNA, 19 nt, Homo sapiens
aagaauacccagagcaaga

SEQ ID NO: 1341607 - RNA, 19 nt, Homo sapiens
gcguuucuaugguauuugu

SEQ ID NO: 1341608 - RNA, 19 nt, Homo sapiens
caauaagggacaugaguca

SEQ ID NO: 1341609 - RNA, 19 nt, Homo sapiens
aagcguuucuaugguauuu

SEQ ID NO: 1341610 - RNA, 19 nt, Homo sapiens
ggaggacaugaguauuuaa

SEQ ID NO: 1341611 - RNA, 19 nt, Homo sapiens
uucaagcguuucuauggua

SEQ ID NO: 1341612 - RNA, 19 nt, Homo sapiens
caugaguauuuaaggagaa

SEQ ID NO: 1341613 - RNA, 19 nt, Homo sapiens
gagagcugcaggaacauug

SEQ ID NO: 1341614 - RNA, 19 nt, Homo sapiens
cagcuacuccagaaacuau

SEQ ID NO: 1341615 - RNA, 19 nt, Homo sapiens
ucaagcguuucuaugguau

SEQ ID NO: 1341616 - RNA, 19 nt, Homo sapiens
gucaguaacagcagcauga

SEQ ID NO: 1341617 - RNA, 19 nt, Homo sapiens
gaaaaguucagcucagaga

SEQ ID NO: 1341618 - RNA, 19 nt, Homo sapiens
agcaagaugauuuccaaua

SEQ ID NO: 1341619 - RNA, 19 nt, Homo sapiens
acccagagcaagaugauuu

SEQ ID NO: 1341620 - RNA, 19 nt, Homo sapiens
gugcagagugagaguggua

SEQ ID NO: 1341621 - RNA, 19 nt, Homo sapiens
gauggucccagccugcaaa

SEQ ID NO: 1341622 - RNA, 19 nt, Homo sapiens
guggugaaguccugguuag

SEQ ID NO: 1341623 - RNA, 19 nt, Homo sapiens
aauagccuguguuaagaga

SEQ ID NO: 1341624 - RNA, 19 nt, Homo sapiens
ccaccaggaucucccuucu

SEQ ID NO: 1341625 - RNA, 19 nt, Homo sapiens
acauuagucccuacaagaa

SEQ ID NO: 1341626 - RNA, 19 nt, Homo sapiens
gaacgugcagagugagagu

SEQ ID NO: 1341627 - RNA, 19 nt, Homo sapiens
uggaagggacaaacauuga

SEQ ID NO: 1341628 - RNA, 19 nt, Homo sapiens
gagaacgugcagagugaga

SEQ ID NO: 1341629 - RNA, 19 nt, Homo sapiens
agcaugugguucagaauug

SEQ ID NO: 1341630 - RNA, 19 nt, Homo sapiens
ugucagcuguggagcaaca

SEQ ID NO: 1341631 - RNA, 19 nt, Homo sapiens
gauaugcuuuucccaacaa

SEQ ID NO: 1341632 - RNA, 19 nt, Homo sapiens
gaggacaugaguauuuaag

SEQ ID NO: 1341633 - RNA, 19 nt, Homo sapiens
uccacaucaugcagauuua

SEQ ID NO: 1341634 - RNA, 19 nt, Homo sapiens
cuaugagguuuaucuucuu

SEQ ID NO: 1341635 - RNA, 19 nt, Homo sapiens
caaugucuccuuaaagcau

SEQ ID NO: 1341636 - RNA, 19 nt, Homo sapiens
ggaagggacaaacauugag

SEQ ID NO: 1341637 - RNA, 19 nt, Homo sapiens
aagcaugugguucagaauu

SEQ ID NO: 1341638 - RNA, 19 nt, Homo sapiens
uccaaugucuccuuaaagc

SEQ ID NO: 1341639 - RNA, 19 nt, Homo sapiens
acacaucuguauuaauagc

SEQ ID NO: 1341640 - RNA, 19 nt, Homo sapiens
gauucagcuuagacucauu

SEQ ID NO: 1341641 - RNA, 19 nt, Homo sapiens
ugucaagccgcauuuacaa

SEQ ID NO: 1341642 - RNA, 19 nt, Homo sapiens
ccaacaauaagggacauga

SEQ ID NO: 1341643 - RNA, 19 nt, Homo sapiens
gcugucauguggaagaaaa

SEQ ID NO: 1341644 - RNA, 19 nt, Homo sapiens
uaccugaaguucuguuugc

SEQ ID NO: 1341645 - RNA, 19 nt, Homo sapiens
ccuuaaagcaugugguuca

SEQ ID NO: 1341646 - RNA, 19 nt, Homo sapiens
uagauucagcuuagacuca

SEQ ID NO: 1341647 - RNA, 19 nt, Homo sapiens
gacaaacauugagcuucug

SEQ ID NO: 1341648 - RNA, 19 nt, Homo sapiens
ucaucagugugucuuggaa

SEQ ID NO: 1341649 - RNA, 19 nt, Homo sapiens
ggaccccuguuuugucuau

SEQ ID NO: 1341650 - RNA, 19 nt, Homo sapiens
acaaagaccaggcaaaaga

SEQ ID NO: 1341651 - RNA, 19 nt, Homo sapiens
gagcaacagcacacaucug

SEQ ID NO: 1341652 - RNA, 19 nt, Homo sapiens
aggcaugguugaccugcuu

SEQ ID NO: 1341653 - RNA, 19 nt, Homo sapiens
gagggaacuacagucagua

SEQ ID NO: 1341654 - RNA, 19 nt, Homo sapiens
gaauacccagagcaagaug

SEQ ID NO: 1341655 - RNA, 19 nt, Homo sapiens
aaaauuggauguggagguu

SEQ ID NO: 1341656 - RNA, 19 nt, Homo sapiens
gcagagugagagugguaug

SEQ ID NO: 1341657 - RNA, 19 nt, Homo sapiens
ggagcaacagcacacaucu

SEQ ID NO: 1341658 - RNA, 19 nt, Homo sapiens
gucaagccgcauuuacaaa

SEQ ID NO: 1341659 - RNA, 19 nt, Homo sapiens
cuaggaaaauggugaagga

SEQ ID NO: 1341660 - RNA, 19 nt, Homo sapiens
gcacagaacugaggaacau

SEQ ID NO: 1341661 - RNA, 19 nt, Homo sapiens
gcacgagccucaucugcuu

SEQ ID NO: 1341662 - RNA, 19 nt, Homo sapiens
gaagcugugucucucauug

SEQ ID NO: 1341663 - RNA, 19 nt, Homo sapiens
gagcugggccucgaaauga

SEQ ID NO: 1341664 - RNA, 19 nt, Homo sapiens
gcaggaggcccaacuagug

SEQ ID NO: 1341665 - RNA, 19 nt, Homo sapiens
cgaaaugacagcaggguuu

SEQ ID NO: 1341666 - RNA, 19 nt, Homo sapiens
gcaggugugacuuccauuu

SEQ ID NO: 1341667 - RNA, 19 nt, Homo sapiens
ccugcuagauggugauaaa

SEQ ID NO: 1341668 - RNA, 19 nt, Homo sapiens
gaaaugacagcaggguuug

SEQ ID NO: 1341669 - RNA, 19 nt, Homo sapiens
ugacuuccauuucaucagu

SEQ ID NO: 1341670 - RNA, 19 nt, Homo sapiens
gggcaggugugacuuccau

SEQ ID NO: 1341671 - RNA, 19 nt, Homo sapiens
guauacgccuaacauugug

SEQ ID NO: 1341672 - RNA, 19 nt, Homo sapiens
cuucaggucuucaccaagu

SEQ ID NO: 1341673 - RNA, 19 nt, Homo sapiens
agaauuacacacuaggaaa

SEQ ID NO: 1341674 - RNA, 19 nt, Homo sapiens
gagaccagcacagaacuga

SEQ ID NO: 1341675 - RNA, 19 nt, Homo sapiens
uguauacgccuaacauugu

SEQ ID NO: 1341676 - RNA, 19 nt, Homo sapiens
gaaccugcagcgccucuuc

SEQ ID NO: 1341677 - RNA, 19 nt, Homo sapiens
ggugauaaaggcaaguuuc

SEQ ID NO: 1341678 - RNA, 19 nt, Homo sapiens
ggugugacuuccauuucau

SEQ ID NO: 1341679 - RNA, 19 nt, Homo sapiens
gaauuacacacuaggaaaa

SEQ ID NO: 1341680 - RNA, 19 nt, Homo sapiens
cagaagcugugucucucau

SEQ ID NO: 1341681 - RNA, 19 nt, Homo sapiens
caggaggcccaacuaguga

SEQ ID NO: 1341682 - RNA, 19 nt, Homo sapiens
ggaggcccaacuagugaaa

SEQ ID NO: 1341683 - RNA, 19 nt, Homo sapiens
uaaaggcaaguuucugcuu

SEQ ID NO: 1341684 - RNA, 19 nt, Homo sapiens
caucagugccugccagaag

SEQ ID NO: 1341685 - RNA, 19 nt, Homo sapiens
gagccaggaagccuaagga

SEQ ID NO: 1341686 - RNA, 19 nt, Homo sapiens
uuacugaggacacuuucuu

SEQ ID NO: 1341687 - RNA, 19 nt, Homo sapiens
gcuguauacgccuaacauu

SEQ ID NO: 1341688 - RNA, 19 nt, Homo sapiens
aagaauuacacacuaggaa

SEQ ID NO: 1341689 - RNA, 19 nt, Homo sapiens
gcuccaaagaggugggauu

SEQ ID NO: 1341690 - RNA, 19 nt, Homo sapiens
caggagccaggaagccuaa

SEQ ID NO: 1341691 - RNA, 19 nt, Homo sapiens
ccacgacugccugggcuuu

SEQ ID NO: 1341692 - RNA, 19 nt, Homo sapiens
aaagaauuacacacuagga

SEQ ID NO: 1341693 - RNA, 19 nt, Homo sapiens
ggucuggagagccgcugua

SEQ ID NO: 1341694 - RNA, 19 nt, Homo sapiens
aaggcaaguuucugcuuca

SEQ ID NO: 1341695 - RNA, 19 nt, Homo sapiens
ggagugcagucaucucuua

SEQ ID NO: 1341696 - RNA, 19 nt, Homo sapiens
gaugaucucugucuuuauu

SEQ ID NO: 1341697 - RNA, 19 nt, Homo sapiens
gucaggagauguucuauuu

SEQ ID NO: 1341698 - RNA, 19 nt, Homo sapiens
caaacgagauggagguaaa

SEQ ID NO: 1341699 - RNA, 19 nt, Homo sapiens
gaagaguacuguguaaugu

SEQ ID NO: 1341700 - RNA, 19 nt, Homo sapiens
aaaggaaacuggacaacaa

SEQ ID NO: 1341701 - RNA, 19 nt, Homo sapiens
gaaaugugguuagacaaga

SEQ ID NO: 1341702 - RNA, 19 nt, Homo sapiens
gaaugcugcuggaacugua

SEQ ID NO: 1341703 - RNA, 19 nt, Homo sapiens
gcaggaaccaugacuagaa

SEQ ID NO: 1341704 - RNA, 19 nt, Homo sapiens
ggaaggagguaugccauca

SEQ ID NO: 1341705 - RNA, 19 nt, Homo sapiens
gcagucaucucuuauucau

SEQ ID NO: 1341706 - RNA, 19 nt, Homo sapiens
gcugaagaguacuguguaa

SEQ ID NO: 1341707 - RNA, 19 nt, Homo sapiens
ccaaggaucccgucuucua

SEQ ID NO: 1341708 - RNA, 19 nt, Homo sapiens
caggaaccaugacuagaaa

SEQ ID NO: 1341709 - RNA, 19 nt, Homo sapiens
caucagguguuuccauuca

SEQ ID NO: 1341710 - RNA, 19 nt, Homo sapiens
gaaucaggcaggccgauaa

SEQ ID NO: 1341711 - RNA, 19 nt, Homo sapiens
cuagaaaugugguuagaca

SEQ ID NO: 1341712 - RNA, 19 nt, Homo sapiens
ggacaauccggccuucuug

SEQ ID NO: 1341713 - RNA, 19 nt, Homo sapiens
aauaggaaguugugucaga

SEQ ID NO: 1341714 - RNA, 19 nt, Homo sapiens
guccaaggauacagaauca

SEQ ID NO: 1341715 - RNA, 19 nt, Homo sapiens
gugcagucaucucuuauuc

SEQ ID NO: 1341716 - RNA, 19 nt, Homo sapiens
gcauaacaggauuuaguaa

SEQ ID NO: 1341717 - RNA, 19 nt, Homo sapiens
uguaaugucugcaugagau

SEQ ID NO: 1341718 - RNA, 19 nt, Homo sapiens
gaaacuggacaacaaacga

SEQ ID NO: 1341719 - RNA, 19 nt, Homo sapiens
ggacaacaaacgagaugga

SEQ ID NO: 1341720 - RNA, 19 nt, Homo sapiens
uaacaggauuuaguaacug

SEQ ID NO: 1341721 - RNA, 19 nt, Homo sapiens
gaauuggcaugguauuuug

SEQ ID NO: 1341722 - RNA, 19 nt, Homo sapiens
ccacuguagucaaggauca

SEQ ID NO: 1341723 - RNA, 19 nt, Homo sapiens
aaggagguaugccaucaaa

SEQ ID NO: 1341724 - RNA, 19 nt, Homo sapiens
gacuagaaaugugguuaga

SEQ ID NO: 1341725 - RNA, 19 nt, Homo sapiens
ugaagaguacuguguaaug

SEQ ID NO: 1341726 - RNA, 19 nt, Homo sapiens
cagcauaacaggauuuagu

SEQ ID NO: 1341727 - RNA, 19 nt, Homo sapiens
gaaccaugacuagaaaugu

SEQ ID NO: 1341728 - RNA, 19 nt, Homo sapiens
ggaaccaugacuagaaaug

SEQ ID NO: 1341729 - RNA, 19 nt, Homo sapiens
aaaaugaaaucccaaagga

SEQ ID NO: 1341730 - RNA, 19 nt, Homo sapiens
agucugaauuggcauggua

SEQ ID NO: 1341731 - RNA, 19 nt, Homo sapiens
ucagaggagugcagucauc

SEQ ID NO: 1341732 - RNA, 19 nt, Homo sapiens
guuuagaccuuuugaagaa

SEQ ID NO: 1341733 - RNA, 19 nt, Homo sapiens
aaaugugguuagacaagaa

SEQ ID NO: 1341734 - RNA, 19 nt, Homo sapiens
uagcaggaacugaagcuuu

SEQ ID NO: 1341735 - RNA, 19 nt, Homo sapiens
ggaagccacaggauucuag

SEQ ID NO: 1341736 - RNA, 19 nt, Homo sapiens
uuacacagucacaggauaa

SEQ ID NO: 1341737 - RNA, 19 nt, Homo sapiens
gaaggagguaugccaucaa

SEQ ID NO: 1341738 - RNA, 19 nt, Homo sapiens
aguaacaggugguuugagu

SEQ ID NO: 1341739 - RNA, 19 nt, Homo sapiens
gacuuggguuucacaggaa

SEQ ID NO: 1341740 - RNA, 19 nt, Homo sapiens
cagggaagccacaggauuc

SEQ ID NO: 1341741 - RNA, 19 nt, Homo sapiens
ccagggaagccacaggauu

SEQ ID NO: 1341742 - RNA, 19 nt, Homo sapiens
aaaggaacgccuccaagga

SEQ ID NO: 1341743 - RNA, 19 nt, Homo sapiens
aaccaugacuagaaaugug

SEQ ID NO: 1341744 - RNA, 19 nt, Homo sapiens
uuaauccacuucagaucug

SEQ ID NO: 1341745 - RNA, 19 nt, Homo sapiens
agccaugcguccaaggaua

SEQ ID NO: 1341746 - RNA, 19 nt, Homo sapiens
uaguaacuguuuagaccuu

SEQ ID NO: 1341747 - RNA, 19 nt, Homo sapiens
ggauuuaguaacuguuuag

SEQ ID NO: 1341748 - RNA, 19 nt, Homo sapiens
agaguacuguguaaugucu

SEQ ID NO: 1341749 - RNA, 19 nt, Homo sapiens
ccacuucagaucugguuga

SEQ ID NO: 1341750 - RNA, 19 nt, Homo sapiens
guugcuuggugccucagua

SEQ ID NO: 1341751 - RNA, 19 nt, Homo sapiens
caggauuuaguaacuguuu

SEQ ID NO: 1341752 - RNA, 19 nt, Homo sapiens
guguuuccauucacuuuca

SEQ ID NO: 1341753 - RNA, 19 nt, Homo sapiens
ugacucaucaucagguguu

SEQ ID NO: 1341754 - RNA, 19 nt, Homo sapiens
cuccaaggaucccgucuuc

SEQ ID NO: 1341755 - RNA, 19 nt, Homo sapiens
ugcuggaacuguaauaaag

SEQ ID NO: 1341756 - RNA, 19 nt, Homo sapiens
cagaucugguugacucauc

SEQ ID NO: 1341757 - RNA, 19 nt, Homo sapiens
gcagccaugcguccaagga

SEQ ID NO: 1341758 - RNA, 19 nt, Homo sapiens
gaggagugcagucaucucu

SEQ ID NO: 1341759 - RNA, 19 nt, Homo sapiens
acaggugguuugaguggau

SEQ ID NO: 1341760 - RNA, 19 nt, Homo sapiens
gcugcuggaacuguaauaa

SEQ ID NO: 1341761 - RNA, 19 nt, Homo sapiens
ggagguaugccaucaaacc

SEQ ID NO: 1341762 - RNA, 19 nt, Homo sapiens
aaaugaaaucccaaaggaa

SEQ ID NO: 1341763 - RNA, 19 nt, Homo sapiens
cgagauggagguaaaauga

SEQ ID NO: 1341764 - RNA, 19 nt, Homo sapiens
guaaugucugcaugagauu

SEQ ID NO: 1341765 - RNA, 19 nt, Homo sapiens
agcauaacaggauuuagua

SEQ ID NO: 1341766 - RNA, 19 nt, Homo sapiens
gccagcacccugacagugu

SEQ ID NO: 1341767 - RNA, 19 nt, Homo sapiens
caaggaucccgucuucuac

SEQ ID NO: 1341768 - RNA, 19 nt, Homo sapiens
gcaggccgauaaaaggauu

SEQ ID NO: 1341769 - RNA, 19 nt, Homo sapiens
uaucucaggcugggaagaa

SEQ ID NO: 1341770 - RNA, 19 nt, Homo sapiens
gcguacaggagaagaaaca

SEQ ID NO: 1341771 - RNA, 19 nt, Homo sapiens
gugguuagacaagaauuug

SEQ ID NO: 1341772 - RNA, 19 nt, Homo sapiens
ggcugaagaguacugugua

SEQ ID NO: 1341773 - RNA, 19 nt, Homo sapiens
auuacacagucacaggaua

SEQ ID NO: 1341774 - RNA, 19 nt, Homo sapiens
gaucagaaggugcuuuuag

SEQ ID NO: 1341775 - RNA, 19 nt, Homo sapiens
ggaugaucucugucuuuau

SEQ ID NO: 1341776 - RNA, 19 nt, Homo sapiens
aaggaacgccuccaaggau

SEQ ID NO: 1341777 - RNA, 19 nt, Homo sapiens
cugcuggaacuguaauaaa

SEQ ID NO: 1341778 - RNA, 19 nt, Homo sapiens
ucaguaacaggugguuuga

SEQ ID NO: 1341779 - RNA, 19 nt, Homo sapiens
ugagauccacugcuaaagg

SEQ ID NO: 1341780 - RNA, 19 nt, Homo sapiens
agaaaugugguuagacaag

SEQ ID NO: 1341781 - RNA, 19 nt, Homo sapiens
aaucaggcaggccgauaaa

SEQ ID NO: 1341782 - RNA, 19 nt, Homo sapiens
aaggaaacuggacaacaaa

SEQ ID NO: 1341783 - RNA, 19 nt, Homo sapiens
ccaccagguucgcguacag

SEQ ID NO: 1341784 - RNA, 19 nt, Homo sapiens
cuggugggauggccugaga

SEQ ID NO: 1341785 - RNA, 19 nt, Homo sapiens
cauaacaggauuuaguaac

SEQ ID NO: 1341786 - RNA, 19 nt, Homo sapiens
agauggagguaaaaugaaa

SEQ ID NO: 1341787 - RNA, 19 nt, Homo sapiens
gaaaggcauuuacuuguuu

SEQ ID NO: 1341788 - RNA, 19 nt, Homo sapiens
agacagaccucuucuauga

SEQ ID NO: 1341789 - RNA, 19 nt, Homo sapiens
gcaaagaucuguucuccau

SEQ ID NO: 1341790 - RNA, 19 nt, Homo sapiens
gcaagugugugauuuguga

SEQ ID NO: 1341791 - RNA, 19 nt, Homo sapiens
gcgcauaugugaugagugu

SEQ ID NO: 1341792 - RNA, 19 nt, Homo sapiens
agagauggcugcccaaaga

SEQ ID NO: 1341793 - RNA, 19 nt, Homo sapiens
ugaaaggcauuuacuuguu

SEQ ID NO: 1341794 - RNA, 19 nt, Homo sapiens
caaccaagaucuucuaaaa

SEQ ID NO: 1341795 - RNA, 19 nt, Homo sapiens
aaagaucuguucuccauau

SEQ ID NO: 1341796 - RNA, 19 nt, Homo sapiens
gaaaaggauucuucacaga

SEQ ID NO: 1341797 - RNA, 19 nt, Homo sapiens
gauggcaagugugugauuu

SEQ ID NO: 1341798 - RNA, 19 nt, Homo sapiens
gaaaacaugccuacuacua

SEQ ID NO: 1341799 - RNA, 19 nt, Homo sapiens
gaagcgacgcccagugaaa

SEQ ID NO: 1341800 - RNA, 19 nt, Homo sapiens
gcauaugugaugaguguaa

SEQ ID NO: 1341801 - RNA, 19 nt, Homo sapiens
ucugaugccuauuauugua

SEQ ID NO: 1341802 - RNA, 19 nt, Homo sapiens
gcucugcccucuugaaagg

SEQ ID NO: 1341803 - RNA, 19 nt, Homo sapiens
gugggaagcuaucagaaca

SEQ ID NO: 1341804 - RNA, 19 nt, Homo sapiens
ugaggaaccuuuggugugu

SEQ ID NO: 1341805 - RNA, 19 nt, Homo sapiens
ggucucugaugccuauuau

SEQ ID NO: 1341806 - RNA, 19 nt, Homo sapiens
gagaagcaaagaucuguuc

SEQ ID NO: 1341807 - RNA, 19 nt, Homo sapiens
gagaaauuggaaacucuuu

SEQ ID NO: 1341808 - RNA, 19 nt, Homo sapiens
ccucuucuaugaacgcaaa

SEQ ID NO: 1341809 - RNA, 19 nt, Homo sapiens
gagcuauggcuaaacauca

SEQ ID NO: 1341810 - RNA, 19 nt, Homo sapiens
ucucugaugccuauuauug

SEQ ID NO: 1341811 - RNA, 19 nt, Homo sapiens
uaggagcuauggcuaaaca

SEQ ID NO: 1341812 - RNA, 19 nt, Homo sapiens
gguggcagcuguccuugag

SEQ ID NO: 1341813 - RNA, 19 nt, Homo sapiens
gugaagcgacgcccaguga

SEQ ID NO: 1341814 - RNA, 19 nt, Homo sapiens
uugaggaacugacugugaa

SEQ ID NO: 1341815 - RNA, 19 nt, Homo sapiens
gaguguaacuauggaucuu

SEQ ID NO: 1341816 - RNA, 19 nt, Homo sapiens
aggagugccugcuagugua

SEQ ID NO: 1341817 - RNA, 19 nt, Homo sapiens
gauggcugcccaaagauug

SEQ ID NO: 1341818 - RNA, 19 nt, Homo sapiens
ucacaggcaucaucauagc

SEQ ID NO: 1341819 - RNA, 19 nt, Homo sapiens
caaagaucuguucuccaua

SEQ ID NO: 1341820 - RNA, 19 nt, Homo sapiens
ccagaaaacaugccuacua

SEQ ID NO: 1341821 - RNA, 19 nt, Homo sapiens
uaacacuuguccagcuaca

SEQ ID NO: 1341822 - RNA, 19 nt, Homo sapiens
cuugaaaggcauuuacuug

SEQ ID NO: 1341823 - RNA, 19 nt, Homo sapiens
acagaccucuucuaugaac

SEQ ID NO: 1341824 - RNA, 19 nt, Homo sapiens
ugugaugaguguaacuaug

SEQ ID NO: 1341825 - RNA, 19 nt, Homo sapiens
gcuauucacaggcaucauc

SEQ ID NO: 1341826 - RNA, 19 nt, Homo sapiens
uuuaacacuuguccagcua

SEQ ID NO: 1341827 - RNA, 19 nt, Homo sapiens
ggagcuauggcuaaacauc

SEQ ID NO: 1341828 - RNA, 19 nt, Homo sapiens
cagaaaacaugccuacuac

SEQ ID NO: 1341829 - RNA, 19 nt, Homo sapiens
gcaccauccaggagaagga

SEQ ID NO: 1341830 - RNA, 19 nt, Homo sapiens
gggucucugaugccuauua

SEQ ID NO: 1341831 - RNA, 19 nt, Homo sapiens
gguguguggugggaagcua

SEQ ID NO: 1341832 - RNA, 19 nt, Homo sapiens
gacagaccucuucuaugaa

SEQ ID NO: 1341833 - RNA, 19 nt, Homo sapiens
auucacaggcaucaucaua

SEQ ID NO: 1341834 - RNA, 19 nt, Homo sapiens
aagaucuguucuccauauu

SEQ ID NO: 1341835 - RNA, 19 nt, Homo sapiens
gaagcaaagaucuguucuc

SEQ ID NO: 1341836 - RNA, 19 nt, Homo sapiens
gugaugaguguaacuaugg

SEQ ID NO: 1341837 - RNA, 19 nt, Homo sapiens
ccucaaccaagaucuucua

SEQ ID NO: 1341838 - RNA, 19 nt, Homo sapiens
uggcaagugugugauuugu

SEQ ID NO: 1341839 - RNA, 19 nt, Homo sapiens
ugugauuugugacuccuau

SEQ ID NO: 1341840 - RNA, 19 nt, Homo sapiens
cuacuacuaccagcagaaa

SEQ ID NO: 1341841 - RNA, 19 nt, Homo sapiens
aaaaugugauggcaagugu

SEQ ID NO: 1341842 - RNA, 19 nt, Homo sapiens
cggcuuaguuaggagcuau

SEQ ID NO: 1341843 - RNA, 19 nt, Homo sapiens
ugugauggcaaguguguga

SEQ ID NO: 1341844 - RNA, 19 nt, Homo sapiens
ugaugaguguaacuaugga

SEQ ID NO: 1341845 - RNA, 19 nt, Homo sapiens
ucaaccaagaucuucuaaa

SEQ ID NO: 1341846 - RNA, 19 nt, Homo sapiens
uauguucucccucaaccaa

SEQ ID NO: 1341847 - RNA, 19 nt, Homo sapiens
uaaaucggcucaagcaguu

SEQ ID NO: 1341848 - RNA, 19 nt, Homo sapiens
gcuacugccuugaagauga

SEQ ID NO: 1341849 - RNA, 19 nt, Homo sapiens
gcucuccgacgcugaauua

SEQ ID NO: 1341850 - RNA, 19 nt, Homo sapiens
caauacccaucccagcuuu

SEQ ID NO: 1341851 - RNA, 19 nt, Homo sapiens
caucccagcuuuugauuaa

SEQ ID NO: 1341852 - RNA, 19 nt, Homo sapiens
gcaauacccaucccagcuu

SEQ ID NO: 1341853 - RNA, 19 nt, Homo sapiens
uaucagggcauucuaaauc

SEQ ID NO: 1341854 - RNA, 19 nt, Homo sapiens
gcccgacucuggcuaaagu

SEQ ID NO: 1341855 - RNA, 19 nt, Homo sapiens
gaaaagcacuucgccuugu

SEQ ID NO: 1341856 - RNA, 19 nt, Homo sapiens
cuccgacgcugaauuauca

SEQ ID NO: 1341857 - RNA, 19 nt, Homo sapiens
acaggaagccaugcagaua

SEQ ID NO: 1341858 - RNA, 19 nt, Homo sapiens
ccuugaagaugaccucuag

SEQ ID NO: 1341859 - RNA, 19 nt, Homo sapiens
gcauggagaacccggcaau

SEQ ID NO: 1341860 - RNA, 19 nt, Homo sapiens
guccugggaucucgaacuc

SEQ ID NO: 1341861 - RNA, 19 nt, Homo sapiens
gaaacaagauucacaagug

SEQ ID NO: 1341862 - RNA, 19 nt, Homo sapiens
gcagaagacuuaagauuuc

SEQ ID NO: 1341863 - RNA, 19 nt, Homo sapiens
gugcuaagcugauaaguau

SEQ ID NO: 1341864 - RNA, 19 nt, Homo sapiens
gagcaauugucauuuguug

SEQ ID NO: 1341865 - RNA, 19 nt, Homo sapiens
gaaaggaauuccgauuuua

SEQ ID NO: 1341866 - RNA, 19 nt, Homo sapiens
uggcuugucuucucaauuu

SEQ ID NO: 1341867 - RNA, 19 nt, Homo sapiens
ggacugaucguucaauuuc

SEQ ID NO: 1341868 - RNA, 19 nt, Homo sapiens
ggcaagcccucuccuuuga

SEQ ID NO: 1341869 - RNA, 19 nt, Homo sapiens
ggcagaagacuuaagauuu

SEQ ID NO: 1341870 - RNA, 19 nt, Homo sapiens
gaugcaggcuauucauuau

SEQ ID NO: 1341871 - RNA, 19 nt, Homo sapiens
gaagagucaaggcuuuaua

SEQ ID NO: 1341872 - RNA, 19 nt, Homo sapiens
gaugcuggcagaagacuua

SEQ ID NO: 1341873 - RNA, 19 nt, Homo sapiens
gguauauccuguguacuaa

SEQ ID NO: 1341874 - RNA, 19 nt, Homo sapiens
aguaagaccuguaggagaa

SEQ ID NO: 1341875 - RNA, 19 nt, Homo sapiens
gcaagaggcaggacaaaca

SEQ ID NO: 1341876 - RNA, 19 nt, Homo sapiens
ggaggacuguuucuuccaa

SEQ ID NO: 1341877 - RNA, 19 nt, Homo sapiens
gcaauugucauuuguugga

SEQ ID NO: 1341878 - RNA, 19 nt, Homo sapiens
uuauguguguccuugauua

SEQ ID NO: 1341879 - RNA, 19 nt, Homo sapiens
uaaacaacacugcaauuug

SEQ ID NO: 1341880 - RNA, 19 nt, Homo sapiens
gcacaugcauugggucaag

SEQ ID NO: 1341881 - RNA, 19 nt, Homo sapiens
ugucacagcuaaagcaaug

SEQ ID NO: 1341882 - RNA, 19 nt, Homo sapiens
ugaugcaggcuauucauua

SEQ ID NO: 1341883 - RNA, 19 nt, Homo sapiens
gaaacuuacucagggugaa

SEQ ID NO: 1341884 - RNA, 19 nt, Homo sapiens
cuaaagcaauggccagugu

SEQ ID NO: 1341885 - RNA, 19 nt, Homo sapiens
gugaaaggaauuccgauuu

SEQ ID NO: 1341886 - RNA, 19 nt, Homo sapiens
cugaugaguuugagcaauu

SEQ ID NO: 1341887 - RNA, 19 nt, Homo sapiens
cuugauuacugaugaguuu

SEQ ID NO: 1341888 - RNA, 19 nt, Homo sapiens
ccauuuauguccucuguag

SEQ ID NO: 1341889 - RNA, 19 nt, Homo sapiens
aaacgaugaugcaggcuau

SEQ ID NO: 1341890 - RNA, 19 nt, Homo sapiens
ugaaaggaauuccgauuuu

SEQ ID NO: 1341891 - RNA, 19 nt, Homo sapiens
agucaaggcuuuauagucu

SEQ ID NO: 1341892 - RNA, 19 nt, Homo sapiens
ccacugagcugggcaccau

SEQ ID NO: 1341893 - RNA, 19 nt, Homo sapiens
gaagacuuaagauuucuga

SEQ ID NO: 1341894 - RNA, 19 nt, Homo sapiens
uaaacagcaucucuuugug

SEQ ID NO: 1341895 - RNA, 19 nt, Homo sapiens
uaauaucuccuuucacugu

SEQ ID NO: 1341896 - RNA, 19 nt, Homo sapiens
gucagacacuuucauuugu

SEQ ID NO: 1341897 - RNA, 19 nt, Homo sapiens
ccugcuaacugaaacaaga

SEQ ID NO: 1341898 - RNA, 19 nt, Homo sapiens
cauggaugcuggcagaaga

SEQ ID NO: 1341899 - RNA, 19 nt, Homo sapiens
ggaauuuucuugcgucuuc

SEQ ID NO: 1341900 - RNA, 19 nt, Homo sapiens
gaggacuguuucuuccaaa

SEQ ID NO: 1341901 - RNA, 19 nt, Homo sapiens
uuaaacagcaucucuuugu

SEQ ID NO: 1341902 - RNA, 19 nt, Homo sapiens
ccuuugcuuuggaaacuua

SEQ ID NO: 1341903 - RNA, 19 nt, Homo sapiens
aaauggauccaguaaagaa

SEQ ID NO: 1341904 - RNA, 19 nt, Homo sapiens
gacaauucccagucgcaua

SEQ ID NO: 1341905 - RNA, 19 nt, Homo sapiens
caggcaagcccucuccuuu

SEQ ID NO: 1341906 - RNA, 19 nt, Homo sapiens
ggcaccauguggaccuaua

SEQ ID NO: 1341907 - RNA, 19 nt, Homo sapiens
ugguauauccuguguacua

SEQ ID NO: 1341908 - RNA, 19 nt, Homo sapiens
ucagacacuuucauuugug

SEQ ID NO: 1341909 - RNA, 19 nt, Homo sapiens
uuauuucccucagugauuu

SEQ ID NO: 1341910 - RNA, 19 nt, Homo sapiens
guacauccacgaagcagau

SEQ ID NO: 1341911 - RNA, 19 nt, Homo sapiens
gacuaacucuugcguuguc

SEQ ID NO: 1341912 - RNA, 19 nt, Homo sapiens
ccagucgcauauaggaauu

SEQ ID NO: 1341913 - RNA, 19 nt, Homo sapiens
ggugaaaggaauuccgauu

SEQ ID NO: 1341914 - RNA, 19 nt, Homo sapiens
uauguccucuguagcaaga

SEQ ID NO: 1341915 - RNA, 19 nt, Homo sapiens
uuugagcaauugucauuug

SEQ ID NO: 1341916 - RNA, 19 nt, Homo sapiens
cauuugugcuaagcugaua

SEQ ID NO: 1341917 - RNA, 19 nt, Homo sapiens
uguuagcucuuacacaugu

SEQ ID NO: 1341918 - RNA, 19 nt, Homo sapiens
caaaaguuuccaaguguua

SEQ ID NO: 1341919 - RNA, 19 nt, Homo sapiens
acacuuucauuugugcuaa

SEQ ID NO: 1341920 - RNA, 19 nt, Homo sapiens
uuccaaguguuagcucuua

SEQ ID NO: 1341921 - RNA, 19 nt, Homo sapiens
aaacagcaucucuuugugu

SEQ ID NO: 1341922 - RNA, 19 nt, Homo sapiens
uggcagaagacuuaagauu

SEQ ID NO: 1341923 - RNA, 19 nt, Homo sapiens
gcuggcagaagacuuaaga

SEQ ID NO: 1341924 - RNA, 19 nt, Homo sapiens
gguguguccuuuucaaauu

SEQ ID NO: 1341925 - RNA, 19 nt, Homo sapiens
uguccuugauuacugauga

SEQ ID NO: 1341926 - RNA, 19 nt, Homo sapiens
acaauucccagucgcauau

SEQ ID NO: 1341927 - RNA, 19 nt, Homo sapiens
cauuauguguguccuugau

SEQ ID NO: 1341928 - RNA, 19 nt, Homo sapiens
guauaaacaacacugcaau

SEQ ID NO: 1341929 - RNA, 19 nt, Homo sapiens
aagaagagucaaggcuuua

SEQ ID NO: 1341930 - RNA, 19 nt, Homo sapiens
ugcaggcuauucauuaugu

SEQ ID NO: 1341931 - RNA, 19 nt, Homo sapiens
aaucagagacagaagacuu

SEQ ID NO: 1341932 - RNA, 19 nt, Homo sapiens
gagucaaggcuuuauaguc

SEQ ID NO: 1341933 - RNA, 19 nt, Homo sapiens
ggccagugucaguguauuu

SEQ ID NO: 1341934 - RNA, 19 nt, Homo sapiens
gcugacccuuggccugcua

SEQ ID NO: 1341935 - RNA, 19 nt, Homo sapiens
ucuuguagguguguccuuu

SEQ ID NO: 1341936 - RNA, 19 nt, Homo sapiens
gaggcaggacaaacaguga

SEQ ID NO: 1341937 - RNA, 19 nt, Homo sapiens
gcaggcuauucauuaugug

SEQ ID NO: 1341938 - RNA, 19 nt, Homo sapiens
gcauauaggaauuuucuug

SEQ ID NO: 1341939 - RNA, 19 nt, Homo sapiens
uaugccuguuugccauuua

SEQ ID NO: 1341940 - RNA, 19 nt, Homo sapiens
gcaggcaagcccucuccuu

SEQ ID NO: 1341941 - RNA, 19 nt, Homo sapiens
ugaugaguuugagcaauug

SEQ ID NO: 1341942 - RNA, 19 nt, Homo sapiens
ugugcuaagcugauaagua

SEQ ID NO: 1341943 - RNA, 19 nt, Homo sapiens
guguguccuugauuacuga

SEQ ID NO: 1341944 - RNA, 19 nt, Homo sapiens
acacauguauaaacaacac

SEQ ID NO: 1341945 - RNA, 19 nt, Homo sapiens
ccuguguacuaauucuuug

SEQ ID NO: 1341946 - RNA, 19 nt, Homo sapiens
guagcaagaggcaggacaa

SEQ ID NO: 1341947 - RNA, 19 nt, Homo sapiens
agugaggacugcaccaaca

SEQ ID NO: 1341948 - RNA, 19 nt, Homo sapiens
ggcuauucauuaugugugu

SEQ ID NO: 1341949 - RNA, 19 nt, Homo sapiens
uuacucagggugaaaggaa

SEQ ID NO: 1341950 - RNA, 19 nt, Homo sapiens
ccaaaaguuuccaaguguu

SEQ ID NO: 1341951 - RNA, 19 nt, Homo sapiens
gcacccaguaagaccugua

SEQ ID NO: 1341952 - RNA, 19 nt, Homo sapiens
cauccacgaagcagauuug

SEQ ID NO: 1341953 - RNA, 19 nt, Homo sapiens
cccuuggccugcuaacuga

SEQ ID NO: 1341954 - RNA, 19 nt, Homo sapiens
gucaaggcuuuauagucuu

SEQ ID NO: 1341955 - RNA, 19 nt, Homo sapiens
gacacuuucauuugugcua

SEQ ID NO: 1341956 - RNA, 19 nt, Homo sapiens
gaauuccgauuuuaaacag

SEQ ID NO: 1341957 - RNA, 19 nt, Homo sapiens
gcaccauguggaccuauag

SEQ ID NO: 1341958 - RNA, 19 nt, Homo sapiens
aaacuuacucagggugaaa

SEQ ID NO: 1341959 - RNA, 19 nt, Homo sapiens
ugcauugggucaagucaca

SEQ ID NO: 1341960 - RNA, 19 nt, Homo sapiens
uaacucuugcguugucaga

SEQ ID NO: 1341961 - RNA, 19 nt, Homo sapiens
gguagaauguaaacaauug

SEQ ID NO: 1341962 - RNA, 19 nt, Homo sapiens
aaacauuccuuguaccuuu

SEQ ID NO: 1341963 - RNA, 19 nt, Homo sapiens
cgagaugcaucgaaauuga

SEQ ID NO: 1341964 - RNA, 19 nt, Homo sapiens
gcagguagaauguaaacaa

SEQ ID NO: 1341965 - RNA, 19 nt, Homo sapiens
gugagcagcugcaagaagu

SEQ ID NO: 1341966 - RNA, 19 nt, Homo sapiens
ucucugcgguuccugguaa

SEQ ID NO: 1341967 - RNA, 19 nt, Homo sapiens
cagguagaauguaaacaau

SEQ ID NO: 1341968 - RNA, 19 nt, Homo sapiens
aggagcagguagaauguaa

SEQ ID NO: 1341969 - RNA, 19 nt, Homo sapiens
aacauuccuuguaccuuua

SEQ ID NO: 1341970 - RNA, 19 nt, Homo sapiens
gagcaagggauccugacuu

SEQ ID NO: 1341971 - RNA, 19 nt, Homo sapiens
ccagccagccuuccugaaa

SEQ ID NO: 1341972 - RNA, 19 nt, Homo sapiens
guaccuuuauuuacacgau

SEQ ID NO: 1341973 - RNA, 19 nt, Homo sapiens
ggacaacgaagaaaaccua

SEQ ID NO: 1341974 - RNA, 19 nt, Homo sapiens
cagccagccuuccugaaag

SEQ ID NO: 1341975 - RNA, 19 nt, Homo sapiens
guugcagugugccuagauu

SEQ ID NO: 1341976 - RNA, 19 nt, Homo sapiens
ccacaggacaacgaagaaa

SEQ ID NO: 1341977 - RNA, 19 nt, Homo sapiens
gcaggacccaggugagaca

SEQ ID NO: 1341978 - RNA, 19 nt, Homo sapiens
ggggaggacuggaaaagga

SEQ ID NO: 1341979 - RNA, 19 nt, Homo sapiens
ggagcagguagaauguaaa

SEQ ID NO: 1341980 - RNA, 19 nt, Homo sapiens
cucccgagaugcaucgaaa

SEQ ID NO: 1341981 - RNA, 19 nt, Homo sapiens
gagcagguagaauguaaac

SEQ ID NO: 1341982 - RNA, 19 nt, Homo sapiens
gaugcccuuuucugacuua

SEQ ID NO: 1341983 - RNA, 19 nt, Homo sapiens
cccgagaugcaucgaaauu

SEQ ID NO: 1341984 - RNA, 19 nt, Homo sapiens
gagaggagcugcuaaaugg

SEQ ID NO: 1341985 - RNA, 19 nt, Homo sapiens
gaaacuccaucucuacaaa

SEQ ID NO: 1341986 - RNA, 19 nt, Homo sapiens
cuaaaugggucguguguuu

SEQ ID NO: 1341987 - RNA, 19 nt, Homo sapiens
cuagagaucuguugcauga

SEQ ID NO: 1341988 - RNA, 19 nt, Homo sapiens
ggccugagauucugcauuu

SEQ ID NO: 1341989 - RNA, 19 nt, Homo sapiens
caugugagguaauuagaua

SEQ ID NO: 1341990 - RNA, 19 nt, Homo sapiens
gcagugaguugagauugua

SEQ ID NO: 1341991 - RNA, 19 nt, Homo sapiens
gcacagaccaucuuugaau

SEQ ID NO: 1341992 - RNA, 19 nt, Homo sapiens
gggcauagaauuucaguuu

SEQ ID NO: 1341993 - RNA, 19 nt, Homo sapiens
uaacugggcuacagaugaa

SEQ ID NO: 1341994 - RNA, 19 nt, Homo sapiens
gauaaaggaagaacaugua

SEQ ID NO: 1341995 - RNA, 19 nt, Homo sapiens
acucugaucuaguccauua

SEQ ID NO: 1341996 - RNA, 19 nt, Homo sapiens
gaaaagaguucuagagauc

SEQ ID NO: 1341997 - RNA, 19 nt, Homo sapiens
gcaaggcucuagauaacug

SEQ ID NO: 1341998 - RNA, 19 nt, Homo sapiens
gaguugagguggauaagga

SEQ ID NO: 1341999 - RNA, 19 nt, Homo sapiens
ugacaaacguuaccugaca

SEQ ID NO: 1342000 - RNA, 19 nt, Homo sapiens
aagcauaguugauaaagga

SEQ ID NO: 1342001 - RNA, 19 nt, Homo sapiens
gaggagagacagaaagaaa

SEQ ID NO: 1342002 - RNA, 19 nt, Homo sapiens
aaacguuaccugacaguua

SEQ ID NO: 1342003 - RNA, 19 nt, Homo sapiens
cacagaccaucuuugaaua

SEQ ID NO: 1342004 - RNA, 19 nt, Homo sapiens
gguaaaggauauauuagag

SEQ ID NO: 1342005 - RNA, 19 nt, Homo sapiens
caugcaagcuaauuuacaa

SEQ ID NO: 1342006 - RNA, 19 nt, Homo sapiens
gcacugauccaaauuaacu

SEQ ID NO: 1342007 - RNA, 19 nt, Homo sapiens
aaugaggaguuacgguuua

SEQ ID NO: 1342008 - RNA, 19 nt, Homo sapiens
ggagaggagcugcuaaaug

SEQ ID NO: 1342009 - RNA, 19 nt, Homo sapiens
guucuuguauaccauguuu

SEQ ID NO: 1342010 - RNA, 19 nt, Homo sapiens
gaucuaguccauuaugcua

SEQ ID NO: 1342011 - RNA, 19 nt, Homo sapiens
ggucguguguuucugaaug

SEQ ID NO: 1342012 - RNA, 19 nt, Homo sapiens
uagcaaggcucuagauaac

SEQ ID NO: 1342013 - RNA, 19 nt, Homo sapiens
ccaccaacauaauucauca

SEQ ID NO: 1342014 - RNA, 19 nt, Homo sapiens
gaagaacauguaaggcaaa

SEQ ID NO: 1342015 - RNA, 19 nt, Homo sapiens
cacaguggcucaugccuau

SEQ ID NO: 1342016 - RNA, 19 nt, Homo sapiens
cagggagacaaauaaauua

SEQ ID NO: 1342017 - RNA, 19 nt, Homo sapiens
ucuaguccauuaugcuaua

SEQ ID NO: 1342018 - RNA, 19 nt, Homo sapiens
gaccaucuuugaauagcaa

SEQ ID NO: 1342019 - RNA, 19 nt, Homo sapiens
aacguuaccugacaguuaa

SEQ ID NO: 1342020 - RNA, 19 nt, Homo sapiens
gacuauaaguugcuaugau

SEQ ID NO: 1342021 - RNA, 19 nt, Homo sapiens
gcagagaucgcagugaguu

SEQ ID NO: 1342022 - RNA, 19 nt, Homo sapiens
gaggcacugauccaaauua

SEQ ID NO: 1342023 - RNA, 19 nt, Homo sapiens
ggcugaggcaugagaauua

SEQ ID NO: 1342024 - RNA, 19 nt, Homo sapiens
gagaugaguugagguggau

SEQ ID NO: 1342025 - RNA, 19 nt, Homo sapiens
gugcacagaccaucuuuga

SEQ ID NO: 1342026 - RNA, 19 nt, Homo sapiens
gcauagaauuucaguuuug

SEQ ID NO: 1342027 - RNA, 19 nt, Homo sapiens
ugaaaucucagguaaagga

SEQ ID NO: 1342028 - RNA, 19 nt, Homo sapiens
acagggagacaaauaaauu

SEQ ID NO: 1342029 - RNA, 19 nt, Homo sapiens
gagggaaaaugaggaguua

SEQ ID NO: 1342030 - RNA, 19 nt, Homo sapiens
guucaggcuucucagacua

SEQ ID NO: 1342031 - RNA, 19 nt, Homo sapiens
aaucucagguaaaggauau

SEQ ID NO: 1342032 - RNA, 19 nt, Homo sapiens
cauaguugauaaaggaaga

SEQ ID NO: 1342033 - RNA, 19 nt, Homo sapiens
uaaacuacagggagacaaa

SEQ ID NO: 1342034 - RNA, 19 nt, Homo sapiens
gcaugagaauuacuugaac

SEQ ID NO: 1342035 - RNA, 19 nt, Homo sapiens
ccuauaaucccagcacuuu

SEQ ID NO: 1342036 - RNA, 19 nt, Homo sapiens
cuacuuccaugugagguaa

SEQ ID NO: 1342037 - RNA, 19 nt, Homo sapiens
ccauuaugcuauauacugu

SEQ ID NO: 1342038 - RNA, 19 nt, Homo sapiens
cuuaauaacaugcaagcua

SEQ ID NO: 1342039 - RNA, 19 nt, Homo sapiens
gaauagcaaggcucuagau

SEQ ID NO: 1342040 - RNA, 19 nt, Homo sapiens
ugaauggguuccugauagu

SEQ ID NO: 1342041 - RNA, 19 nt, Homo sapiens
cugaauggguuccugauag

SEQ ID NO: 1342042 - RNA, 19 nt, Homo sapiens
gaauuucaguuuuggaaga

SEQ ID NO: 1342043 - RNA, 19 nt, Homo sapiens
ggcaugagaauuacuugaa

SEQ ID NO: 1342044 - RNA, 19 nt, Homo sapiens
gaagccagcacuccucauc

SEQ ID NO: 1342045 - RNA, 19 nt, Homo sapiens
aggcacugauccaaauuaa

SEQ ID NO: 1342046 - RNA, 19 nt, Homo sapiens
gaggaguuacgguuuaaug

SEQ ID NO: 1342047 - RNA, 19 nt, Homo sapiens
gaugaguugagguggauaa

SEQ ID NO: 1342048 - RNA, 19 nt, Homo sapiens
ggguagagggaauaaacua

SEQ ID NO: 1342049 - RNA, 19 nt, Homo sapiens
agagaucuguugcaugaca

SEQ ID NO: 1342050 - RNA, 19 nt, Homo sapiens
cuacagggagacaaauaaa

SEQ ID NO: 1342051 - RNA, 19 nt, Homo sapiens
acuauaaguugcuaugauc

SEQ ID NO: 1342052 - RNA, 19 nt, Homo sapiens
aaaguguucuuguauacca

SEQ ID NO: 1342053 - RNA, 19 nt, Homo sapiens
gguuggcuguuccauccua

SEQ ID NO: 1342054 - RNA, 19 nt, Homo sapiens
gagaucuguugcaugacaa

SEQ ID NO: 1342055 - RNA, 19 nt, Homo sapiens
uaaugggcauagaauuuca

SEQ ID NO: 1342056 - RNA, 19 nt, Homo sapiens
caagugguagauaguacua

SEQ ID NO: 1342057 - RNA, 19 nt, Homo sapiens
gagguaauuagauacaguu

SEQ ID NO: 1342058 - RNA, 19 nt, Homo sapiens
caguuacucugaucuaguc

SEQ ID NO: 1342059 - RNA, 19 nt, Homo sapiens
cuagauaacugggcuacag

SEQ ID NO: 1342060 - RNA, 19 nt, Homo sapiens
gaacccaggaggcagagau

SEQ ID NO: 1342061 - RNA, 19 nt, Homo sapiens
guuccauccuaagcaguua

SEQ ID NO: 1342062 - RNA, 19 nt, Homo sapiens
auagcaaggcucuagauaa

SEQ ID NO: 1342063 - RNA, 19 nt, Homo sapiens
agaccuaagcauagaauug

SEQ ID NO: 1342064 - RNA, 19 nt, Homo sapiens
ccaccucaggaucuuguua

SEQ ID NO: 1342065 - RNA, 19 nt, Homo sapiens
gaccuaagcauagaauugg

SEQ ID NO: 1342066 - RNA, 19 nt, Homo sapiens
acgaggcacugauccaaau

SEQ ID NO: 1342067 - RNA, 19 nt, Homo sapiens
ccuaagcaguuacucugau

SEQ ID NO: 1342068 - RNA, 19 nt, Homo sapiens
ucuggaagcagcugaagaa

SEQ ID NO: 1342069 - RNA, 19 nt, Homo sapiens
aaagaguucuagagaucug

SEQ ID NO: 1342070 - RNA, 19 nt, Homo sapiens
caguggcucaugccuauaa

SEQ ID NO: 1342071 - RNA, 19 nt, Homo sapiens
gcaguuacucugaucuagu

SEQ ID NO: 1342072 - RNA, 19 nt, Homo sapiens
cuaagcaguuacucugauc

SEQ ID NO: 1342073 - RNA, 19 nt, Homo sapiens
ugauccaaauuaacuagga

SEQ ID NO: 1342074 - RNA, 19 nt, Homo sapiens
ugagguaauuagauacagu

SEQ ID NO: 1342075 - RNA, 19 nt, Homo sapiens
aaaggaagaacauguaagg

SEQ ID NO: 1342076 - RNA, 19 nt, Homo sapiens
cuucucagacuauaaguug

SEQ ID NO: 1342077 - RNA, 19 nt, Homo sapiens
gauaacugggcuacagaug

SEQ ID NO: 1342078 - RNA, 19 nt, Homo sapiens
ucaggcuucucagacuaua

SEQ ID NO: 1342079 - RNA, 19 nt, Homo sapiens
aauagcaaggcucuagaua

SEQ ID NO: 1342080 - RNA, 19 nt, Homo sapiens
gcugaggcaugagaauuac

SEQ ID NO: 1342081 - RNA, 19 nt, Homo sapiens
ucgggaggcugaggcauga

SEQ ID NO: 1342082 - RNA, 19 nt, Homo sapiens
ggcauagaauuucaguuuu

SEQ ID NO: 1342083 - RNA, 19 nt, Homo sapiens
aaaugaggaguuacgguuu

SEQ ID NO: 1342084 - RNA, 19 nt, Homo sapiens
gaagagacaucgauaagga

SEQ ID NO: 1342085 - RNA, 19 nt, Homo sapiens
uaaccgaacuugcaacauu

SEQ ID NO: 1342086 - RNA, 19 nt, Homo sapiens
gagaaccacuaaagaagaa

SEQ ID NO: 1342087 - RNA, 19 nt, Homo sapiens
acagcuagcuccugccuua

SEQ ID NO: 1342088 - RNA, 19 nt, Homo sapiens
gcuccugccuuaacugauu

SEQ ID NO: 1342089 - RNA, 19 nt, Homo sapiens
gcaccggagugaauaaaca

SEQ ID NO: 1342090 - RNA, 19 nt, Homo sapiens
ggagaaccacuaaagaaga

SEQ ID NO: 1342091 - RNA, 19 nt, Homo sapiens
caacauuccaccauuguga

SEQ ID NO: 1342092 - RNA, 19 nt, Homo sapiens
gcccuacccuaaauaauca

SEQ ID NO: 1342093 - RNA, 19 nt, Homo sapiens
gugauauccugccauguga

SEQ ID NO: 1342094 - RNA, 19 nt, Homo sapiens
caggagaaccacuaaagaa

SEQ ID NO: 1342095 - RNA, 19 nt, Homo sapiens
cuaugcaccuugugacauu

SEQ ID NO: 1342096 - RNA, 19 nt, Homo sapiens
gcaacaggagaaccacuaa

SEQ ID NO: 1342097 - RNA, 19 nt, Homo sapiens
gcaacuacggguccucuga

SEQ ID NO: 1342098 - RNA, 19 nt, Homo sapiens
gccgguccuuggaauauuu

SEQ ID NO: 1342099 - RNA, 19 nt, Homo sapiens
gagagccgguccuuggaau

SEQ ID NO: 1342100 - RNA, 19 nt, Homo sapiens
caacuguaaccuuccacua

SEQ ID NO: 1342101 - RNA, 19 nt, Homo sapiens
caaucggccuugugauauc

SEQ ID NO: 1342102 - RNA, 19 nt, Homo sapiens
acaccacgguugagccauu

SEQ ID NO: 1342103 - RNA, 19 nt, Homo sapiens
gaaccacuaaagaagaaga

SEQ ID NO: 1342104 - RNA, 19 nt, Homo sapiens
cuaccuaucccaaaccuau

SEQ ID NO: 1342105 - RNA, 19 nt, Homo sapiens
ccaccauugugauauguuc

SEQ ID NO: 1342106 - RNA, 19 nt, Homo sapiens
caacaggagaaccacuaaa

SEQ ID NO: 1342107 - RNA, 19 nt, Homo sapiens
caacuacggguccucugaa

SEQ ID NO: 1342108 - RNA, 19 nt, Homo sapiens
gugcaacucagcccacaaa

SEQ ID NO: 1342109 - RNA, 19 nt, Homo sapiens
ggagagccgguccuuggaa

SEQ ID NO: 1342110 - RNA, 19 nt, Homo sapiens
gagccgguccuuggaauau

SEQ ID NO: 1342111 - RNA, 19 nt, Homo sapiens
ggacaaaacggaagagaca

SEQ ID NO: 1342112 - RNA, 19 nt, Homo sapiens
gcucgcaccggagugaaua

SEQ ID NO: 1342113 - RNA, 19 nt, Homo sapiens
uaaucaaucggccuuguga

SEQ ID NO: 1342114 - RNA, 19 nt, Homo sapiens
gugguuggcucugccuuug

SEQ ID NO: 1342115 - RNA, 19 nt, Homo sapiens
ucaaucggccuugugauau

SEQ ID NO: 1342116 - RNA, 19 nt, Homo sapiens
gcacggugaggcaaucugu

SEQ ID NO: 1342117 - RNA, 19 nt, Homo sapiens
ggaagagacaucgauaagg

SEQ ID NO: 1342118 - RNA, 19 nt, Homo sapiens
uugcaacauuccaccauug

SEQ ID NO: 1342119 - RNA, 19 nt, Homo sapiens
uaacugauuaaccgaacuu

SEQ ID NO: 1342120 - RNA, 19 nt, Homo sapiens
gcuuugagcaacaggagaa

SEQ ID NO: 1342121 - RNA, 19 nt, Homo sapiens
gcucugccuuugcugucuu

SEQ ID NO: 1342122 - RNA, 19 nt, Homo sapiens
aaccgaacuugcaacauuc

SEQ ID NO: 1342123 - RNA, 19 nt, Homo sapiens
aaagaagaagaaacagcua

SEQ ID NO: 1342124 - RNA, 19 nt, Homo sapiens
ugugauauccugccaugug

SEQ ID NO: 1342125 - RNA, 19 nt, Homo sapiens
gcuagcuccugccuuaacu

SEQ ID NO: 1342126 - RNA, 19 nt, Homo sapiens
acaggagaaccacuaaaga

SEQ ID NO: 1342127 - RNA, 19 nt, Homo sapiens
aaacggaagagacaucgau

SEQ ID NO: 1342128 - RNA, 19 nt, Homo sapiens
gugagcaggucuggaugga

SEQ ID NO: 1342129 - RNA, 19 nt, Homo sapiens
cuccugccuuaacugauua

SEQ ID NO: 1342130 - RNA, 19 nt, Homo sapiens
cggaagagacaucgauaag

SEQ ID NO: 1342131 - RNA, 19 nt, Homo sapiens
gcaacauuccaccauugug

SEQ ID NO: 1342132 - RNA, 19 nt, Homo sapiens
cacuaaagaagaagaaaca

SEQ ID NO: 1342133 - RNA, 19 nt, Homo sapiens
cgaaaagacugccccaacu

SEQ ID NO: 1342134 - RNA, 19 nt, Homo sapiens
aauaaucaaucggccuugu

SEQ ID NO: 1342135 - RNA, 19 nt, Homo sapiens
cuugcaacauuccaccauu

SEQ ID NO: 1342136 - RNA, 19 nt, Homo sapiens
gaaaagacugccccaacug

SEQ ID NO: 1342137 - RNA, 19 nt, Homo sapiens
gugacuaugcaccuuguga

SEQ ID NO: 1342138 - RNA, 19 nt, Homo sapiens
guuccugcccuacccuaaa

SEQ ID NO: 1342139 - RNA, 19 nt, Homo sapiens
gaagaagaaacagcuagcu

SEQ ID NO: 1342140 - RNA, 19 nt, Homo sapiens
caccacgguugagccauug

SEQ ID NO: 1342141 - RNA, 19 nt, Homo sapiens
acauuccaccauugugaua

SEQ ID NO: 1342142 - RNA, 19 nt, Homo sapiens
ccuggagucacaaagcuuu

SEQ ID NO: 1342143 - RNA, 19 nt, Homo sapiens
gaaguaaacacaucucuuu

SEQ ID NO: 1342144 - RNA, 19 nt, Homo sapiens
guaaggaguuugcuuguug

SEQ ID NO: 1342145 - RNA, 19 nt, Homo sapiens
acacaucucuuucaccuuu

SEQ ID NO: 1342146 - RNA, 19 nt, Homo sapiens
ggaguuugcuuguuguguu

SEQ ID NO: 1342147 - RNA, 19 nt, Homo sapiens
gcagacaaauguagagauc

SEQ ID NO: 1342148 - RNA, 19 nt, Homo sapiens
gagaagcaccggcaguuaa

SEQ ID NO: 1342149 - RNA, 19 nt, Homo sapiens
gcacagcaaccaagcauga

SEQ ID NO: 1342150 - RNA, 19 nt, Homo sapiens
aaagaugacuugcagacaa

SEQ ID NO: 1342151 - RNA, 19 nt, Homo sapiens
ggagaagcaccggcaguua

SEQ ID NO: 1342152 - RNA, 19 nt, Homo sapiens
gaaaugcccaugaccuuca

SEQ ID NO: 1342153 - RNA, 19 nt, Homo sapiens
gaugagaaccacugcuuga

SEQ ID NO: 1342154 - RNA, 19 nt, Homo sapiens
gaguuugcuuguuguguuu

SEQ ID NO: 1342155 - RNA, 19 nt, Homo sapiens
gggagucgcaguacggaua

SEQ ID NO: 1342156 - RNA, 19 nt, Homo sapiens
gguaaggaguuugcuuguu

SEQ ID NO: 1342157 - RNA, 19 nt, Homo sapiens
aagaugacuugcagacaaa

SEQ ID NO: 1342158 - RNA, 19 nt, Homo sapiens
cuugagggccuuccuauuu

SEQ ID NO: 1342159 - RNA, 19 nt, Homo sapiens
guaaacacaucucuuucac

SEQ ID NO: 1342160 - RNA, 19 nt, Homo sapiens
agacaaauguagagaucau

SEQ ID NO: 1342161 - RNA, 19 nt, Homo sapiens
gcauuugcgcuaacgauga

SEQ ID NO: 1342162 - RNA, 19 nt, Homo sapiens
gagguguucucagacuuga

SEQ ID NO: 1342163 - RNA, 19 nt, Homo sapiens
ggagguguucucagacuug

SEQ ID NO: 1342164 - RNA, 19 nt, Homo sapiens
cuaccugacucacaaccuu

SEQ ID NO: 1342165 - RNA, 19 nt, Homo sapiens
guugcuaccugacucacaa

SEQ ID NO: 1342166 - RNA, 19 nt, Homo sapiens
ugccagagguaaggaguuu

SEQ ID NO: 1342167 - RNA, 19 nt, Homo sapiens
cuaaucccaugaucuuuua

SEQ ID NO: 1342168 - RNA, 19 nt, Homo sapiens
gaaagcaggagguguucuc

SEQ ID NO: 1342169 - RNA, 19 nt, Homo sapiens
uaaggaguuugcuuguugu

SEQ ID NO: 1342170 - RNA, 19 nt, Homo sapiens
gcuuggaagugcacagcaa

SEQ ID NO: 1342171 - RNA, 19 nt, Homo sapiens
caccaugcaucuggaaaug

SEQ ID NO: 1342172 - RNA, 19 nt, Homo sapiens
gcacucugcaccacucaug

SEQ ID NO: 1342173 - RNA, 19 nt, Homo sapiens
guucuaguuuccuuaucuu

SEQ ID NO: 1342174 - RNA, 19 nt, Homo sapiens
agccugaccucacaagaga

SEQ ID NO: 1342175 - RNA, 19 nt, Homo sapiens
ggaagugcacagcaaccaa

SEQ ID NO: 1342176 - RNA, 19 nt, Homo sapiens
agcaggagguguucucaga

SEQ ID NO: 1342177 - RNA, 19 nt, Homo sapiens
gggagaagcaccggcaguu

SEQ ID NO: 1342178 - RNA, 19 nt, Homo sapiens
gcaugaggacugaguuaag

SEQ ID NO: 1342179 - RNA, 19 nt, Homo sapiens
gaggacugaguuaagcuuu

SEQ ID NO: 1342180 - RNA, 19 nt, Homo sapiens
aagcaugaggacugaguua

SEQ ID NO: 1342181 - RNA, 19 nt, Homo sapiens
aaucgugcauuugcgcuaa

SEQ ID NO: 1342182 - RNA, 19 nt, Homo sapiens
uugagggccuuccuauuuc

SEQ ID NO: 1342183 - RNA, 19 nt, Homo sapiens
gcauuggcccagcuuggaa

SEQ ID NO: 1342184 - RNA, 19 nt, Homo sapiens
ccagggaugccgaaaguag

SEQ ID NO: 1342185 - RNA, 19 nt, Homo sapiens
ggacugaguuaagcuuuuc

SEQ ID NO: 1342186 - RNA, 19 nt, Homo sapiens
gaaagugccccaagaaagg

SEQ ID NO: 1342187 - RNA, 19 nt, Homo sapiens
ugacuugcagacaaaugua

SEQ ID NO: 1342188 - RNA, 19 nt, Homo sapiens
uacagcagcucugaaagca

SEQ ID NO: 1342189 - RNA, 19 nt, Homo sapiens
cuucuaaucccaugaucuu

SEQ ID NO: 1342190 - RNA, 19 nt, Homo sapiens
ucugaaagcaggagguguu

SEQ ID NO: 1342191 - RNA, 19 nt, Homo sapiens
caugaggacugaguuaagc

SEQ ID NO: 1342192 - RNA, 19 nt, Homo sapiens
caucuggaaaugcccauga

SEQ ID NO: 1342193 - RNA, 19 nt, Homo sapiens
gugccagccugaccucaca

SEQ ID NO: 1342194 - RNA, 19 nt, Homo sapiens
ugaaguaaacacaucucuu

SEQ ID NO: 1342195 - RNA, 19 nt, Homo sapiens
aaccaagcaugaggacuga

SEQ ID NO: 1342196 - RNA, 19 nt, Homo sapiens
ggaaagugccccaagaaag

SEQ ID NO: 1342197 - RNA, 19 nt, Homo sapiens
cuaguuuccuuaucuuggu

SEQ ID NO: 1342198 - RNA, 19 nt, Homo sapiens
agagacgucuugugugacu

SEQ ID NO: 1342199 - RNA, 19 nt, Homo sapiens
cauacagggagucgcagua

SEQ ID NO: 1342200 - RNA, 19 nt, Homo sapiens
gaugccgaaaguagacaua

SEQ ID NO: 1342201 - RNA, 19 nt, Homo sapiens
caggagguguucucagacu

SEQ ID NO: 1342202 - RNA, 19 nt, Homo sapiens
cuccagggaugccgaaagu

SEQ ID NO: 1342203 - RNA, 19 nt, Homo sapiens
aguaaacacaucucuuuca

SEQ ID NO: 1342204 - RNA, 19 nt, Homo sapiens
ccaagaaaggagaguccaa

SEQ ID NO: 1342205 - RNA, 19 nt, Homo sapiens
aggcgacaguuggcaauga

SEQ ID NO: 1342206 - RNA, 19 nt, Homo sapiens
ccaccaugcaucuggaaau

SEQ ID NO: 1342207 - RNA, 19 nt, Homo sapiens
uaucuuggucugagcaaau

SEQ ID NO: 1342208 - RNA, 19 nt, Homo sapiens
uggaaaugcccaugaccuu

SEQ ID NO: 1342209 - RNA, 19 nt, Homo sapiens
gcuugagggccuuccuauu

SEQ ID NO: 1342210 - RNA, 19 nt, Homo sapiens
cauuugcgcuaacgaugag

SEQ ID NO: 1342211 - RNA, 19 nt, Homo sapiens
cuucaucgcagcagcguau

SEQ ID NO: 1342212 - RNA, 19 nt, Homo sapiens
ggaggcgacaguuggcaau

SEQ ID NO: 1342213 - RNA, 19 nt, Homo sapiens
uaaaggugcacaacaaaua

SEQ ID NO: 1342214 - RNA, 19 nt, Homo sapiens
gauguuagccuaugacugu

SEQ ID NO: 1342215 - RNA, 19 nt, Homo sapiens
cuucagagcuccugggaaa

SEQ ID NO: 1342216 - RNA, 19 nt, Homo sapiens
auaaauguguccuucuuug

SEQ ID NO: 1342217 - RNA, 19 nt, Homo sapiens
aauguguccuucuuuguuu

SEQ ID NO: 1342218 - RNA, 19 nt, Homo sapiens
uaaguauccuuuccugagu

SEQ ID NO: 1342219 - RNA, 19 nt, Homo sapiens
aaaggugcacaacaaauaa

SEQ ID NO: 1342220 - RNA, 19 nt, Homo sapiens
ggucuucaauggccaaguc

SEQ ID NO: 1342221 - RNA, 19 nt, Homo sapiens
guggaccuguggaccauuu

SEQ ID NO: 1342222 - RNA, 19 nt, Homo sapiens
ggagaggguggacaagaug

SEQ ID NO: 1342223 - RNA, 19 nt, Homo sapiens
gaugcgcccucaugggaau

SEQ ID NO: 1342224 - RNA, 19 nt, Homo sapiens
agugugaacuggcucauuc

SEQ ID NO: 1342225 - RNA, 19 nt, Homo sapiens
caagcccacugcagaaucu

SEQ ID NO: 1342226 - RNA, 19 nt, Homo sapiens
ggugcacaacaaauaauaa

SEQ ID NO: 1342227 - RNA, 19 nt, Homo sapiens
caggcagacuggauuguca

SEQ ID NO: 1342228 - RNA, 19 nt, Homo sapiens
aaauguguccuucuuuguu

SEQ ID NO: 1342229 - RNA, 19 nt, Homo sapiens
uggagaggguggacaagau

SEQ ID NO: 1342230 - RNA, 19 nt, Homo sapiens
ucaucugacuuggaaggua

SEQ ID NO: 1342231 - RNA, 19 nt, Homo sapiens
uaaauguguccuucuuugu

SEQ ID NO: 1342232 - RNA, 19 nt, Homo sapiens
gagcuccugggaaacauga

SEQ ID NO: 1342233 - RNA, 19 nt, Homo sapiens
cuaaaggugcacaacaaau

SEQ ID NO: 1342234 - RNA, 19 nt, Homo sapiens
ucuaaaggugcacaacaaa

SEQ ID NO: 1342235 - RNA, 19 nt, Homo sapiens
uucuaaaggugcacaacaa

SEQ ID NO: 1342236 - RNA, 19 nt, Homo sapiens
gaccuguggaccauuucua

SEQ ID NO: 1342237 - RNA, 19 nt, Homo sapiens
gauguccucucagggucuu

SEQ ID NO: 1342238 - RNA, 19 nt, Homo sapiens
ucagagcuccugggaaaca

SEQ ID NO: 1342239 - RNA, 19 nt, Homo sapiens
aaguauccuuuccugaguu

SEQ ID NO: 1342240 - RNA, 19 nt, Homo sapiens
gcuagaaguuguuaguuua

SEQ ID NO: 1342241 - RNA, 19 nt, Homo sapiens
gaaagcggaugaccagcua

SEQ ID NO: 1342242 - RNA, 19 nt, Homo sapiens
ccacuuaaaggcauucuua

SEQ ID NO: 1342243 - RNA, 19 nt, Homo sapiens
guuggaagguuguggauuu

SEQ ID NO: 1342244 - RNA, 19 nt, Homo sapiens
gagcuggucucaucaagug

SEQ ID NO: 1342245 - RNA, 19 nt, Homo sapiens
gcaguuaacuagcccaaca

SEQ ID NO: 1342246 - RNA, 19 nt, Homo sapiens
uagcuaaucuguaaccuau

SEQ ID NO: 1342247 - RNA, 19 nt, Homo sapiens
ugacacagauggcggaaga

SEQ ID NO: 1342248 - RNA, 19 nt, Homo sapiens
uaaacaggccuuaaacuga

SEQ ID NO: 1342249 - RNA, 19 nt, Homo sapiens
caaaaucucugcagcacua

SEQ ID NO: 1342250 - RNA, 19 nt, Homo sapiens
gcuaaucuguaaccuauag

SEQ ID NO: 1342251 - RNA, 19 nt, Homo sapiens
gcccuaagccugucauaaa

SEQ ID NO: 1342252 - RNA, 19 nt, Homo sapiens
auacggaccuacugcauuu

SEQ ID NO: 1342253 - RNA, 19 nt, Homo sapiens
ugagugaucugugccuuaa

SEQ ID NO: 1342254 - RNA, 19 nt, Homo sapiens
gaaccugaccaauacugua

SEQ ID NO: 1342255 - RNA, 19 nt, Homo sapiens
gcagccaugucaagacuga

SEQ ID NO: 1342256 - RNA, 19 nt, Homo sapiens
caacugauuuggauaccau

SEQ ID NO: 1342257 - RNA, 19 nt, Homo sapiens
uuaacuagcccaacauauu

SEQ ID NO: 1342258 - RNA, 19 nt, Homo sapiens
ggaagguuguggauuuaca

SEQ ID NO: 1342259 - RNA, 19 nt, Homo sapiens
gcacuuuauuucugugugu

SEQ ID NO: 1342260 - RNA, 19 nt, Homo sapiens
ggaagaaaaucugaagaaa

SEQ ID NO: 1342261 - RNA, 19 nt, Homo sapiens
gaaugcuaaugacugguuu

SEQ ID NO: 1342262 - RNA, 19 nt, Homo sapiens
ggaaugagggcaaggaaca

SEQ ID NO: 1342263 - RNA, 19 nt, Homo sapiens
uaacuagcccaacauauuc

SEQ ID NO: 1342264 - RNA, 19 nt, Homo sapiens
caaacaauagcaugaguga

SEQ ID NO: 1342265 - RNA, 19 nt, Homo sapiens
ggaccuacugcauuuguuu

SEQ ID NO: 1342266 - RNA, 19 nt, Homo sapiens
gcagauaaucggccagaga

SEQ ID NO: 1342267 - RNA, 19 nt, Homo sapiens
ugacgaagcugccuuugcu

SEQ ID NO: 1342268 - RNA, 19 nt, Homo sapiens
caguagaaaucaaguaucu

SEQ ID NO: 1342269 - RNA, 19 nt, Homo sapiens
gcucaaaccacaaacaaca

SEQ ID NO: 1342270 - RNA, 19 nt, Homo sapiens
gccuuaaacugaccaugaa

SEQ ID NO: 1342271 - RNA, 19 nt, Homo sapiens
gaagagauuuugggaagaa

SEQ ID NO: 1342272 - RNA, 19 nt, Homo sapiens
caccugaaaucuugucaug

SEQ ID NO: 1342273 - RNA, 19 nt, Homo sapiens
gguuguggauuuacaggaa

SEQ ID NO: 1342274 - RNA, 19 nt, Homo sapiens
gcuuuuagcuaaucuguaa

SEQ ID NO: 1342275 - RNA, 19 nt, Homo sapiens
gcuacaaugaguaaucuaa

SEQ ID NO: 1342276 - RNA, 19 nt, Homo sapiens
guggguaaaucucuguuug

SEQ ID NO: 1342277 - RNA, 19 nt, Homo sapiens
gaccagcuacaaugaguaa

SEQ ID NO: 1342278 - RNA, 19 nt, Homo sapiens
ggccauaacgcccaaguug

SEQ ID NO: 1342279 - RNA, 19 nt, Homo sapiens
gcagcacuauaacauguuc

SEQ ID NO: 1342280 - RNA, 19 nt, Homo sapiens
ucuaaugucugcagaugug

SEQ ID NO: 1342281 - RNA, 19 nt, Homo sapiens
gaucugugccuuaagaaca

SEQ ID NO: 1342282 - RNA, 19 nt, Homo sapiens
caggauuucugcacgaaug

SEQ ID NO: 1342283 - RNA, 19 nt, Homo sapiens
ccugaaaucuugucaugag

SEQ ID NO: 1342284 - RNA, 19 nt, Homo sapiens
auaaauacguggguaaauc

SEQ ID NO: 1342285 - RNA, 19 nt, Homo sapiens
ccuggaaccugaccaauac

SEQ ID NO: 1342286 - RNA, 19 nt, Homo sapiens
aagcuggucucggcacaua

SEQ ID NO: 1342287 - RNA, 19 nt, Homo sapiens
ccagauuguuccaggauca

SEQ ID NO: 1342288 - RNA, 19 nt, Homo sapiens
caauaaacaugugggucaa

SEQ ID NO: 1342289 - RNA, 19 nt, Homo sapiens
ggccugagccuuaacaaca

SEQ ID NO: 1342290 - RNA, 19 nt, Homo sapiens
ugcuagaaguuguuaguuu

SEQ ID NO: 1342291 - RNA, 19 nt, Homo sapiens
gagaaguagcccaccauga

SEQ ID NO: 1342292 - RNA, 19 nt, Homo sapiens
cugguuugcuguuaauaaa

SEQ ID NO: 1342293 - RNA, 19 nt, Homo sapiens
gcacuauaacauguucaua

SEQ ID NO: 1342294 - RNA, 19 nt, Homo sapiens
ugaguggccugagccuuaa

SEQ ID NO: 1342295 - RNA, 19 nt, Homo sapiens
gcuaugacgcccacugcua

SEQ ID NO: 1342296 - RNA, 19 nt, Homo sapiens
ggccuuaaacugaccauga

SEQ ID NO: 1342297 - RNA, 19 nt, Homo sapiens
ugacugguuugcuguuaau

SEQ ID NO: 1342298 - RNA, 19 nt, Homo sapiens
uaaguggaccugcacaguu

SEQ ID NO: 1342299 - RNA, 19 nt, Homo sapiens
gccuggaaccugaccaaua

SEQ ID NO: 1342300 - RNA, 19 nt, Homo sapiens
ccacuuugcacuuuauuuc

SEQ ID NO: 1342301 - RNA, 19 nt, Homo sapiens
ucuguaaccuauagaaaca

SEQ ID NO: 1342302 - RNA, 19 nt, Homo sapiens
gucaugagccagauacuga

SEQ ID NO: 1342303 - RNA, 19 nt, Homo sapiens
gcauccaucucugaaagga

SEQ ID NO: 1342304 - RNA, 19 nt, Homo sapiens
cccaacauauuccuuuaau

SEQ ID NO: 1342305 - RNA, 19 nt, Homo sapiens
ggaugaccagcuacaauga

SEQ ID NO: 1342306 - RNA, 19 nt, Homo sapiens
caucaagacaccugaaauc

SEQ ID NO: 1342307 - RNA, 19 nt, Homo sapiens
caggaucaacccuacagua

SEQ ID NO: 1342308 - RNA, 19 nt, Homo sapiens
ccuauagaaacaaugcuua

SEQ ID NO: 1342309 - RNA, 19 nt, Homo sapiens
aaacugcucaaaccacaaa

SEQ ID NO: 1342310 - RNA, 19 nt, Homo sapiens
gucauaaacaggccuuaaa

SEQ ID NO: 1342311 - RNA, 19 nt, Homo sapiens
aaugacugguuugcuguua

SEQ ID NO: 1342312 - RNA, 19 nt, Homo sapiens
cugcagcacuauaacaugu

SEQ ID NO: 1342313 - RNA, 19 nt, Homo sapiens
ucaacccucugugcaugua

SEQ ID NO: 1342314 - RNA, 19 nt, Homo sapiens
gauucccacuuugcacuuu

SEQ ID NO: 1342315 - RNA, 19 nt, Homo sapiens
ucacuggcuugcugucaau

SEQ ID NO: 1342316 - RNA, 19 nt, Homo sapiens
caacccagccgaggcacua

SEQ ID NO: 1342317 - RNA, 19 nt, Homo sapiens
agugaucugugccuuaaga

SEQ ID NO: 1342318 - RNA, 19 nt, Homo sapiens
uuggaagguuguggauuua

SEQ ID NO: 1342319 - RNA, 19 nt, Homo sapiens
gccauaaacuguccccaaa

SEQ ID NO: 1342320 - RNA, 19 nt, Homo sapiens
gcacaguucaggcccagau

SEQ ID NO: 1342321 - RNA, 19 nt, Homo sapiens
uaaauacguggguaaaucu

SEQ ID NO: 1342322 - RNA, 19 nt, Homo sapiens
gcccaacauauuccuuuaa

SEQ ID NO: 1342323 - RNA, 19 nt, Homo sapiens
ccccaaaacuggccauaaa

SEQ ID NO: 1342324 - RNA, 19 nt, Homo sapiens
ccccaaaucuggccauaaa

SEQ ID NO: 1342325 - RNA, 19 nt, Homo sapiens
aaguggaccugcacaguuc

SEQ ID NO: 1342326 - RNA, 19 nt, Homo sapiens
uagaaagaaugcuaaugac

SEQ ID NO: 1342327 - RNA, 19 nt, Homo sapiens
aacaauagcaugagugauc

SEQ ID NO: 1342328 - RNA, 19 nt, Homo sapiens
ccacugcuagaaguuguua

SEQ ID NO: 1342329 - RNA, 19 nt, Homo sapiens
ggcaggaggagaaagaaga

SEQ ID NO: 1342330 - RNA, 19 nt, Homo sapiens
cagcuacaaugaguaaucu

SEQ ID NO: 1342331 - RNA, 19 nt, Homo sapiens
agacugacaauaaggaaga

SEQ ID NO: 1342332 - RNA, 19 nt, Homo sapiens
caauaaggaagacaucagu

SEQ ID NO: 1342333 - RNA, 19 nt, Homo sapiens
ugagccagauacugaggaa

SEQ ID NO: 1342334 - RNA, 19 nt, Homo sapiens
cacaaacaauagcaugagu

SEQ ID NO: 1342335 - RNA, 19 nt, Homo sapiens
ucuuaagccacaaacaaua

SEQ ID NO: 1342336 - RNA, 19 nt, Homo sapiens
augaguggccugagccuua

SEQ ID NO: 1342337 - RNA, 19 nt, Homo sapiens
gaagaaaaucugaagaaag

SEQ ID NO: 1342338 - RNA, 19 nt, Homo sapiens
cggagaacguggaacuaca

SEQ ID NO: 1342339 - RNA, 19 nt, Homo sapiens
aaucucugcagcacuauaa

SEQ ID NO: 1342340 - RNA, 19 nt, Homo sapiens
ggucuucucuuuaauguua

SEQ ID NO: 1342341 - RNA, 19 nt, Homo sapiens
ggacacugguauuuauuua

SEQ ID NO: 1342342 - RNA, 19 nt, Homo sapiens
ucccaucccuuguagauua

SEQ ID NO: 1342343 - RNA, 19 nt, Homo sapiens
ggauuaauguggaugugaa

SEQ ID NO: 1342344 - RNA, 19 nt, Homo sapiens
ccacagaacuagaggucuu

SEQ ID NO: 1342345 - RNA, 19 nt, Homo sapiens
gguggacacugguauuuau

SEQ ID NO: 1342346 - RNA, 19 nt, Homo sapiens
gcaaggacgacaagaaaga

SEQ ID NO: 1342347 - RNA, 19 nt, Homo sapiens
gaggacaagucgaguuuca

SEQ ID NO: 1342348 - RNA, 19 nt, Homo sapiens
ggugugcacuccucgcuaa

SEQ ID NO: 1342349 - RNA, 19 nt, Homo sapiens
gcaaacauguucgcagauc

SEQ ID NO: 1342350 - RNA, 19 nt, Homo sapiens
gggcaaggacgacaagaaa

SEQ ID NO: 1342351 - RNA, 19 nt, Homo sapiens
gcacgaacuggccacauuu

SEQ ID NO: 1342352 - RNA, 19 nt, Homo sapiens
ggcacgaacuggccacauu

SEQ ID NO: 1342353 - RNA, 19 nt, Homo sapiens
caaucaaggugcugaagau

SEQ ID NO: 1342354 - RNA, 19 nt, Homo sapiens
gaggucuucucuuuaaugu

SEQ ID NO: 1342355 - RNA, 19 nt, Homo sapiens
cgaaaggaaagaaauguau

SEQ ID NO: 1342356 - RNA, 19 nt, Homo sapiens
ugagaaaguguucaucuga

SEQ ID NO: 1342357 - RNA, 19 nt, Homo sapiens
ggacaagucgaguuucaag

SEQ ID NO: 1342358 - RNA, 19 nt, Homo sapiens
aaacccggcucggauaaga

SEQ ID NO: 1342359 - RNA, 19 nt, Homo sapiens
ccacgaaaggaaagaaaug

SEQ ID NO: 1342360 - RNA, 19 nt, Homo sapiens
gccaaccgccugccaauca

SEQ ID NO: 1342361 - RNA, 19 nt, Homo sapiens
uuugagcucuguagguaaa

SEQ ID NO: 1342362 - RNA, 19 nt, Homo sapiens
aguuugagcucuguaggua

SEQ ID NO: 1342363 - RNA, 19 nt, Homo sapiens
gcuuuaugcucccuaacga

SEQ ID NO: 1342364 - RNA, 19 nt, Homo sapiens
ccggauacccgcuggugua

SEQ ID NO: 1342365 - RNA, 19 nt, Homo sapiens
ccaaacccggcucggauaa

SEQ ID NO: 1342366 - RNA, 19 nt, Homo sapiens
ccaaccgccugccaaucaa

SEQ ID NO: 1342367 - RNA, 19 nt, Homo sapiens
caaaaccgccacagaacua

SEQ ID NO: 1342368 - RNA, 19 nt, Homo sapiens
caucccuuguagauuauaa

SEQ ID NO: 1342369 - RNA, 19 nt, Homo sapiens
ucaaggugcugaagaugcu

SEQ ID NO: 1342370 - RNA, 19 nt, Homo sapiens
cgagcucgaugccaagaag

SEQ ID NO: 1342371 - RNA, 19 nt, Homo sapiens
ccaaucaaggugcugaaga

SEQ ID NO: 1342372 - RNA, 19 nt, Homo sapiens
gcgacaaggacaccaaauc

SEQ ID NO: 1342373 - RNA, 19 nt, Homo sapiens
cgacaaggacaccaaaucg

SEQ ID NO: 1342374 - RNA, 19 nt, Homo sapiens
ucucugggcugcaguaagc

SEQ ID NO: 1342375 - RNA, 19 nt, Homo sapiens
gcggacccauacggcauuu

SEQ ID NO: 1342376 - RNA, 19 nt, Homo sapiens
uggaggacaagucgaguuu

SEQ ID NO: 1342377 - RNA, 19 nt, Homo sapiens
gggauuaauguggauguga

SEQ ID NO: 1342378 - RNA, 19 nt, Homo sapiens
gcggaccggugguucaaaa

SEQ ID NO: 1342379 - RNA, 19 nt, Homo sapiens
acgaaaggaaagaaaugua

SEQ ID NO: 1342380 - RNA, 19 nt, Homo sapiens
gcauuucccgggacagaca

SEQ ID NO: 1342381 - RNA, 19 nt, Homo sapiens
cgucggagaagucgggauu

SEQ ID NO: 1342382 - RNA, 19 nt, Homo sapiens
uggacacugguauuuauuu

SEQ ID NO: 1342383 - RNA, 19 nt, Homo sapiens
uugagaaaguguucaucug

SEQ ID NO: 1342384 - RNA, 19 nt, Homo sapiens
caagcggaccggugguuca

SEQ ID NO: 1342385 - RNA, 19 nt, Homo sapiens
gugaugacagccaguuugu

SEQ ID NO: 1342386 - RNA, 19 nt, Homo sapiens
gggcgacaaggacaccaaa

SEQ ID NO: 1342387 - RNA, 19 nt, Homo sapiens
cgguggacacugguauuua

SEQ ID NO: 1342388 - RNA, 19 nt, Homo sapiens
ggccacgaaaggaaagaaa

SEQ ID NO: 1342389 - RNA, 19 nt, Homo sapiens
guuugugccgggacccuua

SEQ ID NO: 1342390 - RNA, 19 nt, Homo sapiens
gaugugagcugcaaugaaa

SEQ ID NO: 1342391 - RNA, 19 nt, Homo sapiens
caacaaaggucaugcuuca

SEQ ID NO: 1342392 - RNA, 19 nt, Homo sapiens
ggacagaauucaagacaga

SEQ ID NO: 1342393 - RNA, 19 nt, Homo sapiens
ggaaugaaccuacagauga

SEQ ID NO: 1342394 - RNA, 19 nt, Homo sapiens
gaaagugucucuaccuugu

SEQ ID NO: 1342395 - RNA, 19 nt, Homo sapiens
uagcagagauuacuaaaga

SEQ ID NO: 1342396 - RNA, 19 nt, Homo sapiens
ggaaccaacugucaacauu

SEQ ID NO: 1342397 - RNA, 19 nt, Homo sapiens
gaacaaagacuacgaagag

SEQ ID NO: 1342398 - RNA, 19 nt, Homo sapiens
gaaugaaccuacagaugaa

SEQ ID NO: 1342399 - RNA, 19 nt, Homo sapiens
ggacaguggugauaagaga

SEQ ID NO: 1342400 - RNA, 19 nt, Homo sapiens
aagaagaaaucaccuagua

SEQ ID NO: 1342401 - RNA, 19 nt, Homo sapiens
gaagaaauuggacaccuua

SEQ ID NO: 1342402 - RNA, 19 nt, Homo sapiens
cagaagauaugagaagaua

SEQ ID NO: 1342403 - RNA, 19 nt, Homo sapiens
ggacagacauuucuuaagc

SEQ ID NO: 1342404 - RNA, 19 nt, Homo sapiens
aagaagagcuggaauuaau

SEQ ID NO: 1342405 - RNA, 19 nt, Homo sapiens
gcauugugcuagauauuaa

SEQ ID NO: 1342406 - RNA, 19 nt, Homo sapiens
gcaaaguccacauauuuaa

SEQ ID NO: 1342407 - RNA, 19 nt, Homo sapiens
gauagugccuugugcaugu

SEQ ID NO: 1342408 - RNA, 19 nt, Homo sapiens
ugacagaccuaaugcucua

SEQ ID NO: 1342409 - RNA, 19 nt, Homo sapiens
gaagggagcaguuaguaga

SEQ ID NO: 1342410 - RNA, 19 nt, Homo sapiens
cuccagaucugccggauua

SEQ ID NO: 1342411 - RNA, 19 nt, Homo sapiens
agacauuucuuaagcauug

SEQ ID NO: 1342412 - RNA, 19 nt, Homo sapiens
gaagaagagcuggaauuaa

SEQ ID NO: 1342413 - RNA, 19 nt, Homo sapiens
gaagaacuguacucaaguc

SEQ ID NO: 1342414 - RNA, 19 nt, Homo sapiens
acacagaccuggaacuuca

SEQ ID NO: 1342415 - RNA, 19 nt, Homo sapiens
gcacagauauguauaaaag

SEQ ID NO: 1342416 - RNA, 19 nt, Homo sapiens
ccaagcagauccagagaga

SEQ ID NO: 1342417 - RNA, 19 nt, Homo sapiens
uauagaagcaugucacuuu

SEQ ID NO: 1342418 - RNA, 19 nt, Homo sapiens
gaagaaaucaccuaguaca

SEQ ID NO: 1342419 - RNA, 19 nt, Homo sapiens
gagaagauacuuacaucaa

SEQ ID NO: 1342420 - RNA, 19 nt, Homo sapiens
ggcaaaguccacauauuua

SEQ ID NO: 1342421 - RNA, 19 nt, Homo sapiens
ccuacaagcucuaacauuc

SEQ ID NO: 1342422 - RNA, 19 nt, Homo sapiens
gaccaacugcguaaacaua

SEQ ID NO: 1342423 - RNA, 19 nt, Homo sapiens
gagaagaagagcuggaauu

SEQ ID NO: 1342424 - RNA, 19 nt, Homo sapiens
cagaaacaguucaucauuc

SEQ ID NO: 1342425 - RNA, 19 nt, Homo sapiens
caagugggcugugcugcua

SEQ ID NO: 1342426 - RNA, 19 nt, Homo sapiens
caugaggguucaccaguaa

SEQ ID NO: 1342427 - RNA, 19 nt, Homo sapiens
gaaagccaguaccaagaga

SEQ ID NO: 1342428 - RNA, 19 nt, Homo sapiens
ggauacagauauaaagagu

SEQ ID NO: 1342429 - RNA, 19 nt, Homo sapiens
cugaagagcuggcggaguu

SEQ ID NO: 1342430 - RNA, 19 nt, Homo sapiens
caacagaaacaguucauca

SEQ ID NO: 1342431 - RNA, 19 nt, Homo sapiens
caaagacuacgaagagaaa

SEQ ID NO: 1342432 - RNA, 19 nt, Homo sapiens
agaagaagagcuggaauua

SEQ ID NO: 1342433 - RNA, 19 nt, Homo sapiens
ggaucagauugacuacaua

SEQ ID NO: 1342434 - RNA, 19 nt, Homo sapiens
gauucaggcuucaauagug

SEQ ID NO: 1342435 - RNA, 19 nt, Homo sapiens
guacucaagucgcccuuau

SEQ ID NO: 1342436 - RNA, 19 nt, Homo sapiens
gcuccuagauggcguagau

SEQ ID NO: 1342437 - RNA, 19 nt, Homo sapiens
aacuauaccuucccaaauu

SEQ ID NO: 1342438 - RNA, 19 nt, Homo sapiens
gacauuugauggaacuuga

SEQ ID NO: 1342439 - RNA, 19 nt, Homo sapiens
aaucucaacuuguaccaaa

SEQ ID NO: 1342440 - RNA, 19 nt, Homo sapiens
gagaagggagcaguuagua

SEQ ID NO: 1342441 - RNA, 19 nt, Homo sapiens
guaaagccaguagccauua

SEQ ID NO: 1342442 - RNA, 19 nt, Homo sapiens
caacauugccgguacacuu

SEQ ID NO: 1342443 - RNA, 19 nt, Homo sapiens
gagaaagccaguaccaaga

SEQ ID NO: 1342444 - RNA, 19 nt, Homo sapiens
uuagacuucucaugcaaua

SEQ ID NO: 1342445 - RNA, 19 nt, Homo sapiens
gaaccaacugucaacauug

SEQ ID NO: 1342446 - RNA, 19 nt, Homo sapiens
caaacuauaccuucccaaa

SEQ ID NO: 1342447 - RNA, 19 nt, Homo sapiens
gaagagcuggaauuaauag

SEQ ID NO: 1342448 - RNA, 19 nt, Homo sapiens
ucaugaggguucaccagua

SEQ ID NO: 1342449 - RNA, 19 nt, Homo sapiens
gaagauaugagaagauacu

SEQ ID NO: 1342450 - RNA, 19 nt, Homo sapiens
uaacaauccacuacaauca

SEQ ID NO: 1342451 - RNA, 19 nt, Homo sapiens
uggaaaaucucaacuugua

SEQ ID NO: 1342452 - RNA, 19 nt, Homo sapiens
aggcaaaguccacauauuu

SEQ ID NO: 1342453 - RNA, 19 nt, Homo sapiens
agaagcaugucacuuuguu

SEQ ID NO: 1342454 - RNA, 19 nt, Homo sapiens
agccuuaguucacaguuua

SEQ ID NO: 1342455 - RNA, 19 nt, Homo sapiens
gcacaguggacagacauuu

SEQ ID NO: 1342456 - RNA, 19 nt, Homo sapiens
gaguaccgguugaaagugu

SEQ ID NO: 1342457 - RNA, 19 nt, Homo sapiens
ccaacugcguaaacauauu

SEQ ID NO: 1342458 - RNA, 19 nt, Homo sapiens
gaagagaaagccaguacca

SEQ ID NO: 1342459 - RNA, 19 nt, Homo sapiens
gauaacaauccacuacaau

SEQ ID NO: 1342460 - RNA, 19 nt, Homo sapiens
cagacgaucacccuagaua

SEQ ID NO: 1342461 - RNA, 19 nt, Homo sapiens
caacugcguaaacauauug

SEQ ID NO: 1342462 - RNA, 19 nt, Homo sapiens
uaaguucaccugcaacaga

SEQ ID NO: 1342463 - RNA, 19 nt, Homo sapiens
cagauugacuacauagaca

SEQ ID NO: 1342464 - RNA, 19 nt, Homo sapiens
gaaauuggacaccuuagac

SEQ ID NO: 1342465 - RNA, 19 nt, Homo sapiens
uaauagaccaacugcguaa

SEQ ID NO: 1342466 - RNA, 19 nt, Homo sapiens
uaacaggacagaauucaag

SEQ ID NO: 1342467 - RNA, 19 nt, Homo sapiens
gauaugagaagauacuuac

SEQ ID NO: 1342468 - RNA, 19 nt, Homo sapiens
gaucugccggauuaugaua

SEQ ID NO: 1342469 - RNA, 19 nt, Homo sapiens
agaaaucaccuaguacauu

SEQ ID NO: 1342470 - RNA, 19 nt, Homo sapiens
ucacuuuguuucucuggaa

SEQ ID NO: 1342471 - RNA, 19 nt, Homo sapiens
guaauuugccauugaaagu

SEQ ID NO: 1342472 - RNA, 19 nt, Homo sapiens
ggaauuaauagaccaacug

SEQ ID NO: 1342473 - RNA, 19 nt, Homo sapiens
gcaccuaccacugauucua

SEQ ID NO: 1342474 - RNA, 19 nt, Homo sapiens
cuugagagaccuuaaugua

SEQ ID NO: 1342475 - RNA, 19 nt, Homo sapiens
agaagaaauuggacaccuu

SEQ ID NO: 1342476 - RNA, 19 nt, Homo sapiens
ccauugaaagucuuaauug

SEQ ID NO: 1342477 - RNA, 19 nt, Homo sapiens
ucagagaagggagcaguua

SEQ ID NO: 1342478 - RNA, 19 nt, Homo sapiens
gggaaugaaccuacagaug

SEQ ID NO: 1342479 - RNA, 19 nt, Homo sapiens
agauaacaauccacuacaa

SEQ ID NO: 1342480 - RNA, 19 nt, Homo sapiens
ggacaccuuagacauuuga

SEQ ID NO: 1342481 - RNA, 19 nt, Homo sapiens
caccagcuguaguaaguug

SEQ ID NO: 1342482 - RNA, 19 nt, Homo sapiens
ccacugauucuacagauuc

SEQ ID NO: 1342483 - RNA, 19 nt, Homo sapiens
acagaaacaguucaucauu

SEQ ID NO: 1342484 - RNA, 19 nt, Homo sapiens
agaaauuccuauagaagca

SEQ ID NO: 1342485 - RNA, 19 nt, Homo sapiens
agacuucucaugcaauaaa

SEQ ID NO: 1342486 - RNA, 19 nt, Homo sapiens
gguuagacuucucaugcaa

SEQ ID NO: 1342487 - RNA, 19 nt, Homo sapiens
gacagacauuucuuaagca

SEQ ID NO: 1342488 - RNA, 19 nt, Homo sapiens
cauauugaguaccgguuga

SEQ ID NO: 1342489 - RNA, 19 nt, Homo sapiens
caagacagagagaagaaga

SEQ ID NO: 1342490 - RNA, 19 nt, Homo sapiens
ggacaccuauauccucaaa

SEQ ID NO: 1342491 - RNA, 19 nt, Homo sapiens
caacaacgaugccggauac

SEQ ID NO: 1342492 - RNA, 19 nt, Homo sapiens
ggaauccucuucgauguug

SEQ ID NO: 1342493 - RNA, 19 nt, Homo sapiens
gcccuucucuaccauuaua

SEQ ID NO: 1342494 - RNA, 19 nt, Homo sapiens
uggcagagcuguuugacuu

SEQ ID NO: 1342495 - RNA, 19 nt, Homo sapiens
caggcuacgugcacauuua

SEQ ID NO: 1342496 - RNA, 19 nt, Homo sapiens
gggacuggcucugugauaa

SEQ ID NO: 1342497 - RNA, 19 nt, Homo sapiens
caacaauguccaaggauuu

SEQ ID NO: 1342498 - RNA, 19 nt, Homo sapiens
cuucagaucccagaaauua

SEQ ID NO: 1342499 - RNA, 19 nt, Homo sapiens
ucaacaagcuguaugugau

SEQ ID NO: 1342500 - RNA, 19 nt, Homo sapiens
gcagagcuguuugacuuga

SEQ ID NO: 1342501 - RNA, 19 nt, Homo sapiens
caacaacuucguauacuug

SEQ ID NO: 1342502 - RNA, 19 nt, Homo sapiens
gcaccaggccacaguugua

SEQ ID NO: 1342503 - RNA, 19 nt, Homo sapiens
ugaaagagacacacugcua

SEQ ID NO: 1342504 - RNA, 19 nt, Homo sapiens
gggcccuucucuaccauua

SEQ ID NO: 1342505 - RNA, 19 nt, Homo sapiens
gaaauaaagcaucuuacag

SEQ ID NO: 1342506 - RNA, 19 nt, Homo sapiens
gcaacaacgaugccggaua

SEQ ID NO: 1342507 - RNA, 19 nt, Homo sapiens
caacuucguauacuugauu

SEQ ID NO: 1342508 - RNA, 19 nt, Homo sapiens
gcacgugguagcccucuuu

SEQ ID NO: 1342509 - RNA, 19 nt, Homo sapiens
ggacuggcucugugauaaa

SEQ ID NO: 1342510 - RNA, 19 nt, Homo sapiens
acaacaauguccaaggauu

SEQ ID NO: 1342511 - RNA, 19 nt, Homo sapiens
ucacccagcucugcaaguu

SEQ ID NO: 1342512 - RNA, 19 nt, Homo sapiens
gaucaguccuucuccaaaa

SEQ ID NO: 1342513 - RNA, 19 nt, Homo sapiens
ucaacaacuucguauacuu

SEQ ID NO: 1342514 - RNA, 19 nt, Homo sapiens
uggcaacccuccucaacaa

SEQ ID NO: 1342515 - RNA, 19 nt, Homo sapiens
gcaucgcggugcucaacaa

SEQ ID NO: 1342516 - RNA, 19 nt, Homo sapiens
gaccaggccaaguaucuaa

SEQ ID NO: 1342517 - RNA, 19 nt, Homo sapiens
gcggaauccucuucgaugu

SEQ ID NO: 1342518 - RNA, 19 nt, Homo sapiens
gaggauuaccugaaagaga

SEQ ID NO: 1342519 - RNA, 19 nt, Homo sapiens
gcauugcugugcuggacaa

SEQ ID NO: 1342520 - RNA, 19 nt, Homo sapiens
ggacagcggaauccucuuc

SEQ ID NO: 1342521 - RNA, 19 nt, Homo sapiens
ccauguuguuggucaauga

SEQ ID NO: 1342522 - RNA, 19 nt, Homo sapiens
gggcagaggagcagagaug

SEQ ID NO: 1342523 - RNA, 19 nt, Homo sapiens
caaagcuccuugagacagu

SEQ ID NO: 1342524 - RNA, 19 nt, Homo sapiens
gagcaacuggacaccuaua

SEQ ID NO: 1342525 - RNA, 19 nt, Homo sapiens
guccugcgauuacuucaga

SEQ ID NO: 1342526 - RNA, 19 nt, Homo sapiens
gcucaacaacuucguauac

SEQ ID NO: 1342527 - RNA, 19 nt, Homo sapiens
gcccugcccucuuucuuca

SEQ ID NO: 1342528 - RNA, 19 nt, Homo sapiens
gacaacaggaucuaugugu

SEQ ID NO: 1342529 - RNA, 19 nt, Homo sapiens
cagcaacacuuggcacaca

SEQ ID NO: 1342530 - RNA, 19 nt, Homo sapiens
guuggucaaugaaauaaag

SEQ ID NO: 1342531 - RNA, 19 nt, Homo sapiens
ggugcaggcugaccagauc

SEQ ID NO: 1342532 - RNA, 19 nt, Homo sapiens
cugagcaacuggacaccua

SEQ ID NO: 1342533 - RNA, 19 nt, Homo sapiens
ggccgugacuaccacaaug

SEQ ID NO: 1342534 - RNA, 19 nt, Homo sapiens
gguguguccuacaaugcua

SEQ ID NO: 1342535 - RNA, 19 nt, Homo sapiens
guuguuggucaaugaaaua

SEQ ID NO: 1342536 - RNA, 19 nt, Homo sapiens
guagcccucuuucugugaa

SEQ ID NO: 1342537 - RNA, 19 nt, Homo sapiens
gcgagaccgagguauauga

SEQ ID NO: 1342538 - RNA, 19 nt, Homo sapiens
gaaggagauggaacaggaa

SEQ ID NO: 1342539 - RNA, 19 nt, Homo sapiens
caucuuacagaagguguua

SEQ ID NO: 1342540 - RNA, 19 nt, Homo sapiens
ggacaacaggaucuaugug

SEQ ID NO: 1342541 - RNA, 19 nt, Homo sapiens
ucgcggugcucaacaacuu

SEQ ID NO: 1342542 - RNA, 19 nt, Homo sapiens
ucagcgaccaggccaagua

SEQ ID NO: 1342543 - RNA, 19 nt, Homo sapiens
caacuccagugaggacuag

SEQ ID NO: 1342544 - RNA, 19 nt, Homo sapiens
cuaccacaaugaccugaau

SEQ ID NO: 1342545 - RNA, 19 nt, Homo sapiens
gaaggacugcugggaggaa

SEQ ID NO: 1342546 - RNA, 19 nt, Homo sapiens
gcgauuacuucagaggaau

SEQ ID NO: 1342547 - RNA, 19 nt, Homo sapiens
gauccaggcagcaacacuu

SEQ ID NO: 1342548 - RNA, 19 nt, Homo sapiens
gggaggauuaccugaaaga

SEQ ID NO: 1342549 - RNA, 19 nt, Homo sapiens
gcaacuggacaccuauauc

SEQ ID NO: 1342550 - RNA, 19 nt, Homo sapiens
gcacggugagccuggcauu

SEQ ID NO: 1342551 - RNA, 19 nt, Homo sapiens
caacaagcuguaugugauc

SEQ ID NO: 1342552 - RNA, 19 nt, Homo sapiens
uuacuucagaggaauguuu

SEQ ID NO: 1342553 - RNA, 19 nt, Homo sapiens
gcugugauuuccucauguc

SEQ ID NO: 1342554 - RNA, 19 nt, Homo sapiens
ggacuuccagugcguugug

SEQ ID NO: 1342555 - RNA, 19 nt, Homo sapiens
acaaugcuaugugccaaau

SEQ ID NO: 1342556 - RNA, 19 nt, Homo sapiens
uuacgucacugcaggaacu

SEQ ID NO: 1342557 - RNA, 19 nt, Homo sapiens
gcuacgacccugccaccaa

SEQ ID NO: 1342558 - RNA, 19 nt, Homo sapiens
ucagaucccagaaauuauc

SEQ ID NO: 1342559 - RNA, 19 nt, Homo sapiens
gaggagcagagaugcauca

SEQ ID NO: 1342560 - RNA, 19 nt, Homo sapiens
gauugaaggagauggaaca

SEQ ID NO: 1342561 - RNA, 19 nt, Homo sapiens
uuacagaagguguuaacug

SEQ ID NO: 1342562 - RNA, 19 nt, Homo sapiens
ugacaaguaccgccagcuu

SEQ ID NO: 1342563 - RNA, 19 nt, Homo sapiens
ucucucggacugacaagua

SEQ ID NO: 1342564 - RNA, 19 nt, Homo sapiens
caacuggacaccuauaucc

SEQ ID NO: 1342565 - RNA, 19 nt, Homo sapiens
ccugagcaauguacaagag

SEQ ID NO: 1342566 - RNA, 19 nt, Homo sapiens
ggagauggaacaggaagag

SEQ ID NO: 1342567 - RNA, 19 nt, Homo sapiens
caggaucuauguguuaggu

SEQ ID NO: 1342568 - RNA, 19 nt, Homo sapiens
ccagcgcccucauguacca

SEQ ID NO: 1342569 - RNA, 19 nt, Homo sapiens
cagcuucagaucccagaaa

SEQ ID NO: 1342570 - RNA, 19 nt, Homo sapiens
cacgguguguccuacaaug

SEQ ID NO: 1342571 - RNA, 19 nt, Homo sapiens
uuuacgauguggagaagga

SEQ ID NO: 1342572 - RNA, 19 nt, Homo sapiens
uggcagaggagcaggaguu

SEQ ID NO: 1342573 - RNA, 19 nt, Homo sapiens
ugcgauuacuucagaggaa

SEQ ID NO: 1342574 - RNA, 19 nt, Homo sapiens
gaccuguccguguguguug

SEQ ID NO: 1342575 - RNA, 19 nt, Homo sapiens
caccaggccacaguuguaa

SEQ ID NO: 1342576 - RNA, 19 nt, Homo sapiens
ccugcgagaccgagguaua

SEQ ID NO: 1342577 - RNA, 19 nt, Homo sapiens
guaccgccagcuuccauug

SEQ ID NO: 1342578 - RNA, 19 nt, Homo sapiens
ccacacugcgugaacaaca

SEQ ID NO: 1342579 - RNA, 19 nt, Homo sapiens
cugcugugauuuccucaug

SEQ ID NO: 1342580 - RNA, 19 nt, Homo sapiens
gagcaauguacaagagaca

SEQ ID NO: 1342581 - RNA, 19 nt, Homo sapiens
cgaccaggccaaguaucua

SEQ ID NO: 1342582 - RNA, 19 nt, Homo sapiens
auccauuucugcugugauu

SEQ ID NO: 1342583 - RNA, 19 nt, Homo sapiens
gcagaggagcagagaugca

SEQ ID NO: 1342584 - RNA, 19 nt, Homo sapiens
cgugguagcccucuuucug

SEQ ID NO: 1342585 - RNA, 19 nt, Homo sapiens
aggaacugcuucugaaagg

SEQ ID NO: 1342586 - RNA, 19 nt, Homo sapiens
caacccuccucaacaagcu

SEQ ID NO: 1342587 - RNA, 19 nt, Homo sapiens
gcgaccaggccaaguaucu

SEQ ID NO: 1342588 - RNA, 19 nt, Homo sapiens
ccauuucugcugugauuuc

SEQ ID NO: 1342589 - RNA, 19 nt, Homo sapiens
gguagcccucuuucuguga

SEQ ID NO: 1342590 - RNA, 19 nt, Homo sapiens
guacaucuaucauuccuua

SEQ ID NO: 1342591 - RNA, 19 nt, Homo sapiens
ggacuucgcuucccuuugu

SEQ ID NO: 1342592 - RNA, 19 nt, Homo sapiens
aggagaagcuggaauguua

SEQ ID NO: 1342593 - RNA, 19 nt, Homo sapiens
uaacagaucugaagagucu

SEQ ID NO: 1342594 - RNA, 19 nt, Homo sapiens
guaagcagaugaaguuaga

SEQ ID NO: 1342595 - RNA, 19 nt, Homo sapiens
gaaaugaggaggaaacaga

SEQ ID NO: 1342596 - RNA, 19 nt, Homo sapiens
uaaccuggcuuuguucuuu

SEQ ID NO: 1342597 - RNA, 19 nt, Homo sapiens
guagugagacugcaguuua

SEQ ID NO: 1342598 - RNA, 19 nt, Homo sapiens
gggcaacgauucaguuuca

SEQ ID NO: 1342599 - RNA, 19 nt, Homo sapiens
caaguagucuagugccuuu

SEQ ID NO: 1342600 - RNA, 19 nt, Homo sapiens
aaaguuauccuguaccaua

SEQ ID NO: 1342601 - RNA, 19 nt, Homo sapiens
gaagccgggugauuuguug

SEQ ID NO: 1342602 - RNA, 19 nt, Homo sapiens
gccuucagcuuuaaacuuu

SEQ ID NO: 1342603 - RNA, 19 nt, Homo sapiens
cuacagcugugaaaucuga

SEQ ID NO: 1342604 - RNA, 19 nt, Homo sapiens
gacaagcccaugcccauua

SEQ ID NO: 1342605 - RNA, 19 nt, Homo sapiens
gaaguucagguuugcauuu

SEQ ID NO: 1342606 - RNA, 19 nt, Homo sapiens
gaacugcuuuccucagaca

SEQ ID NO: 1342607 - RNA, 19 nt, Homo sapiens
ucaccaaccucagagauuu

SEQ ID NO: 1342608 - RNA, 19 nt, Homo sapiens
acagaacgaugccaaagaa

SEQ ID NO: 1342609 - RNA, 19 nt, Homo sapiens
gaagcuggaauguuacuuu

SEQ ID NO: 1342610 - RNA, 19 nt, Homo sapiens
aaauaaagauggcaaagca

SEQ ID NO: 1342611 - RNA, 19 nt, Homo sapiens
uuacgaggcuguuaaagau

SEQ ID NO: 1342612 - RNA, 19 nt, Homo sapiens
gcacaauuccaauguauca

SEQ ID NO: 1342613 - RNA, 19 nt, Homo sapiens
gaggaugaauucaaguuuc

SEQ ID NO: 1342614 - RNA, 19 nt, Homo sapiens
gcaccuaccagaacaauuc

SEQ ID NO: 1342615 - RNA, 19 nt, Homo sapiens
gucaaggaccugaaacuua

SEQ ID NO: 1342616 - RNA, 19 nt, Homo sapiens
ucauuaaccuggcuuuguu

SEQ ID NO: 1342617 - RNA, 19 nt, Homo sapiens
ccucagacaugaagaagga

SEQ ID NO: 1342618 - RNA, 19 nt, Homo sapiens
gaaagaaagaacagcaaau

SEQ ID NO: 1342619 - RNA, 19 nt, Homo sapiens
aaaggaaagccugguauua

SEQ ID NO: 1342620 - RNA, 19 nt, Homo sapiens
ucaaggaccugaaacuuac

SEQ ID NO: 1342621 - RNA, 19 nt, Homo sapiens
aaaggaagacguggaguua

SEQ ID NO: 1342622 - RNA, 19 nt, Homo sapiens
gaacagcaaauuaccaagu

SEQ ID NO: 1342623 - RNA, 19 nt, Homo sapiens
agaaucaaaugccuacuau

SEQ ID NO: 1342624 - RNA, 19 nt, Homo sapiens
agacacacaugaugggaaa

SEQ ID NO: 1342625 - RNA, 19 nt, Homo sapiens
cggaaaguuuggaggcuua

SEQ ID NO: 1342626 - RNA, 19 nt, Homo sapiens
gcaggccggugcaugaguu

SEQ ID NO: 1342627 - RNA, 19 nt, Homo sapiens
ggaguuacgaggcuguuaa

SEQ ID NO: 1342628 - RNA, 19 nt, Homo sapiens
caaauuaccaagugucuca

SEQ ID NO: 1342629 - RNA, 19 nt, Homo sapiens
ucacaguacugccggauca

SEQ ID NO: 1342630 - RNA, 19 nt, Homo sapiens
cugcguaucuacuaacaaa

SEQ ID NO: 1342631 - RNA, 19 nt, Homo sapiens
uagugagacugcaguuuaa

SEQ ID NO: 1342632 - RNA, 19 nt, Homo sapiens
gaugggaaaugaggaggaa

SEQ ID NO: 1342633 - RNA, 19 nt, Homo sapiens
gcacaugaaagaaagaaca

SEQ ID NO: 1342634 - RNA, 19 nt, Homo sapiens
gcacugaagcaaauuugga

SEQ ID NO: 1342635 - RNA, 19 nt, Homo sapiens
gauguacuauggaagagau

SEQ ID NO: 1342636 - RNA, 19 nt, Homo sapiens
gcuaacagaucugaagagu

SEQ ID NO: 1342637 - RNA, 19 nt, Homo sapiens
gaggagaggaugaauucaa

SEQ ID NO: 1342638 - RNA, 19 nt, Homo sapiens
caugagaccucccuguuac

SEQ ID NO: 1342639 - RNA, 19 nt, Homo sapiens
gaaacuuacuacagaugag

SEQ ID NO: 1342640 - RNA, 19 nt, Homo sapiens
ugaagcaaauuuggaauag

SEQ ID NO: 1342641 - RNA, 19 nt, Homo sapiens
ggaagaagaagguuuuaaa

SEQ ID NO: 1342642 - RNA, 19 nt, Homo sapiens
acaagcccaugcccauuaa

SEQ ID NO: 1342643 - RNA, 19 nt, Homo sapiens
gaagcaaauuuggaauagu

SEQ ID NO: 1342644 - RNA, 19 nt, Homo sapiens
gcuacaagacgauuaagug

SEQ ID NO: 1342645 - RNA, 19 nt, Homo sapiens
caaaggaagacguggaguu

SEQ ID NO: 1342646 - RNA, 19 nt, Homo sapiens
gagaggcacgcaacacuau

SEQ ID NO: 1342647 - RNA, 19 nt, Homo sapiens
gagaggaugaauucaaguu

SEQ ID NO: 1342648 - RNA, 19 nt, Homo sapiens
aagcaaauuuggaauaguc

SEQ ID NO: 1342649 - RNA, 19 nt, Homo sapiens
ccacauuguccucacagua

SEQ ID NO: 1342650 - RNA, 19 nt, Homo sapiens
gcugugaaaucugaaguuc

SEQ ID NO: 1342651 - RNA, 19 nt, Homo sapiens
guacuaacgggcacaugaa

SEQ ID NO: 1342652 - RNA, 19 nt, Homo sapiens
gcuggacaguguagugaga

SEQ ID NO: 1342653 - RNA, 19 nt, Homo sapiens
aagaacugcuuuccucaga

SEQ ID NO: 1342654 - RNA, 19 nt, Homo sapiens
guuacgaggcuguuaaaga

SEQ ID NO: 1342655 - RNA, 19 nt, Homo sapiens
agaaagaacagcaaauuac

SEQ ID NO: 1342656 - RNA, 19 nt, Homo sapiens
cagaaucaaaugccuacua

SEQ ID NO: 1342657 - RNA, 19 nt, Homo sapiens
guagagagacacacaugau

SEQ ID NO: 1342658 - RNA, 19 nt, Homo sapiens
acaugagaccucccuguua

SEQ ID NO: 1342659 - RNA, 19 nt, Homo sapiens
gaacgaugccaaagaaagc

SEQ ID NO: 1342660 - RNA, 19 nt, Homo sapiens
uggaugcacugaagcaaau

SEQ ID NO: 1342661 - RNA, 19 nt, Homo sapiens
ggaguuacggaccggcaua

SEQ ID NO: 1342662 - RNA, 19 nt, Homo sapiens
ccuguaagcagaugaaguu

SEQ ID NO: 1342663 - RNA, 19 nt, Homo sapiens
ugaaagaaagaacagcaaa

SEQ ID NO: 1342664 - RNA, 19 nt, Homo sapiens
uaccgaggcuggacagugu

SEQ ID NO: 1342665 - RNA, 19 nt, Homo sapiens
gacagaacgaugccaaaga

SEQ ID NO: 1342666 - RNA, 19 nt, Homo sapiens
ggugauuuguuguacuuuc

SEQ ID NO: 1342667 - RNA, 19 nt, Homo sapiens
gauuuaaggaugagcuuug

SEQ ID NO: 1342668 - RNA, 19 nt, Homo sapiens
aggaaagccugguauuauc

SEQ ID NO: 1342669 - RNA, 19 nt, Homo sapiens
caucuaucauuccuuaaag

SEQ ID NO: 1342670 - RNA, 19 nt, Homo sapiens
aagcuggaauguuacuuug

SEQ ID NO: 1342671 - RNA, 19 nt, Homo sapiens
gcagaugaaguuagaagca

SEQ ID NO: 1342672 - RNA, 19 nt, Homo sapiens
uuaccugcguaucuacuaa

SEQ ID NO: 1342673 - RNA, 19 nt, Homo sapiens
uaauucaaguagucuagug

SEQ ID NO: 1342674 - RNA, 19 nt, Homo sapiens
aaggaaagccugguauuau

SEQ ID NO: 1342675 - RNA, 19 nt, Homo sapiens
ggagauuuccuuuuggaua

SEQ ID NO: 1342676 - RNA, 19 nt, Homo sapiens
gcauuuccuuacugcuuug

SEQ ID NO: 1342677 - RNA, 19 nt, Homo sapiens
guggucaguuggccaaaug

SEQ ID NO: 1342678 - RNA, 19 nt, Homo sapiens
uguuacagguggucaguug

SEQ ID NO: 1342679 - RNA, 19 nt, Homo sapiens
gcugaagccgggugauuug

SEQ ID NO: 1342680 - RNA, 19 nt, Homo sapiens
acccugcacuggccacaua

SEQ ID NO: 1342681 - RNA, 19 nt, Homo sapiens
ccagaggaaccauucauca

SEQ ID NO: 1342682 - RNA, 19 nt, Homo sapiens
gcagcuggagggagagaaa

SEQ ID NO: 1342683 - RNA, 19 nt, Homo sapiens
gaaagaacagcaaauuacc

SEQ ID NO: 1342684 - RNA, 19 nt, Homo sapiens
gcaguuuaaagaccacauu

SEQ ID NO: 1342685 - RNA, 19 nt, Homo sapiens
gaguuacgaggcuguuaaa

SEQ ID NO: 1342686 - RNA, 19 nt, Homo sapiens
cuaacgggcacaugaaaga

SEQ ID NO: 1342687 - RNA, 19 nt, Homo sapiens
gaauucaaguuuccuuacc

SEQ ID NO: 1342688 - RNA, 19 nt, Homo sapiens
cagaggaaccauucaucaa

SEQ ID NO: 1342689 - RNA, 19 nt, Homo sapiens
ccaucaagacagagacuuu

SEQ ID NO: 1342690 - RNA, 19 nt, Homo sapiens
ggacuuaccuccucuguug

SEQ ID NO: 1342691 - RNA, 19 nt, Homo sapiens
agaaggagcuggcaucuuu

SEQ ID NO: 1342692 - RNA, 19 nt, Homo sapiens
ggaauugcauauuaaggaa

SEQ ID NO: 1342693 - RNA, 19 nt, Homo sapiens
gaaagcauacuggagaaua

SEQ ID NO: 1342694 - RNA, 19 nt, Homo sapiens
gaaccaguccugaauccua

SEQ ID NO: 1342695 - RNA, 19 nt, Homo sapiens
gaagcugacugcacagauc

SEQ ID NO: 1342696 - RNA, 19 nt, Homo sapiens
aaagcauacuggagaauaa

SEQ ID NO: 1342697 - RNA, 19 nt, Homo sapiens
gggcagagcucagcaguac

SEQ ID NO: 1342698 - RNA, 19 nt, Homo sapiens
ucaagaccauccuggcuaa

SEQ ID NO: 1342699 - RNA, 19 nt, Homo sapiens
gagaauaagcuacaaagag

SEQ ID NO: 1342700 - RNA, 19 nt, Homo sapiens
gcucuuuccuccucucuug

SEQ ID NO: 1342701 - RNA, 19 nt, Homo sapiens
ucaauagccuggagagcuu

SEQ ID NO: 1342702 - RNA, 19 nt, Homo sapiens
ugaguaugcugguuuagug

SEQ ID NO: 1342703 - RNA, 19 nt, Homo sapiens
gcagagcucagcaguacuu

SEQ ID NO: 1342704 - RNA, 19 nt, Homo sapiens
ucagggaguugcuggaaga

SEQ ID NO: 1342705 - RNA, 19 nt, Homo sapiens
gcuccugccugaagaguca

SEQ ID NO: 1342706 - RNA, 19 nt, Homo sapiens
ggagaauaagcuacaaaga

SEQ ID NO: 1342707 - RNA, 19 nt, Homo sapiens
aaacaagccaugcaagguu

SEQ ID NO: 1342708 - RNA, 19 nt, Homo sapiens
uagugaguaugcugguuua

SEQ ID NO: 1342709 - RNA, 19 nt, Homo sapiens
gcaggagaauggugugaac

SEQ ID NO: 1342710 - RNA, 19 nt, Homo sapiens
gcaugaggcagaagcuuug

SEQ ID NO: 1342711 - RNA, 19 nt, Homo sapiens
agacugcgccuaccaccua

SEQ ID NO: 1342712 - RNA, 19 nt, Homo sapiens
gaggagcagugggagagaa

SEQ ID NO: 1342713 - RNA, 19 nt, Homo sapiens
aaccaguccugaauccuaa

SEQ ID NO: 1342714 - RNA, 19 nt, Homo sapiens
gcagcucaaacaagacuuu

SEQ ID NO: 1342715 - RNA, 19 nt, Homo sapiens
aacaagccaugcaagguuu

SEQ ID NO: 1342716 - RNA, 19 nt, Homo sapiens
accaggagccagaaaguua

SEQ ID NO: 1342717 - RNA, 19 nt, Homo sapiens
gcacgagagaguccaugaa

SEQ ID NO: 1342718 - RNA, 19 nt, Homo sapiens
uggcuugaccacauucuua

SEQ ID NO: 1342719 - RNA, 19 nt, Homo sapiens
uguauagccuggccucaga

SEQ ID NO: 1342720 - RNA, 19 nt, Homo sapiens
ccagacaggucagcugcaa

SEQ ID NO: 1342721 - RNA, 19 nt, Homo sapiens
ggagcuggcaucuuugugu

SEQ ID NO: 1342722 - RNA, 19 nt, Homo sapiens
ccaggagccagaaaguuaa

SEQ ID NO: 1342723 - RNA, 19 nt, Homo sapiens
gagccuguguugcaaggau

SEQ ID NO: 1342724 - RNA, 19 nt, Homo sapiens
uaccuccucuguugcauga

SEQ ID NO: 1342725 - RNA, 19 nt, Homo sapiens
gagcugggaccaagguuuc

SEQ ID NO: 1342726 - RNA, 19 nt, Homo sapiens
cgaggcaggcggaucauga

SEQ ID NO: 1342727 - RNA, 19 nt, Homo sapiens
gggaaucguuagguucguu

SEQ ID NO: 1342728 - RNA, 19 nt, Homo sapiens
ucucaagaaugucauaaac

SEQ ID NO: 1342729 - RNA, 19 nt, Homo sapiens
gaaccucccagugcuccua

SEQ ID NO: 1342730 - RNA, 19 nt, Homo sapiens
ccagacauuuggaauugca

SEQ ID NO: 1342731 - RNA, 19 nt, Homo sapiens
ggcagaagcuuuguauagc

SEQ ID NO: 1342732 - RNA, 19 nt, Homo sapiens
ggagcugggaccaagguuu

SEQ ID NO: 1342733 - RNA, 19 nt, Homo sapiens
gucaggagaucaagaccau

SEQ ID NO: 1342734 - RNA, 19 nt, Homo sapiens
cgagagaguccaugaaggu

SEQ ID NO: 1342735 - RNA, 19 nt, Homo sapiens
acuggaagcuuggaggaaa

SEQ ID NO: 1342736 - RNA, 19 nt, Homo sapiens
ccagugcuccuagugagua

SEQ ID NO: 1342737 - RNA, 19 nt, Homo sapiens
uagccugccuccacucguu

SEQ ID NO: 1342738 - RNA, 19 nt, Homo sapiens
ggaccaggagccagaaagu

SEQ ID NO: 1342739 - RNA, 19 nt, Homo sapiens
gcugugcgacucaugaaga

SEQ ID NO: 1342740 - RNA, 19 nt, Homo sapiens
gaucaugaggucaggagau

SEQ ID NO: 1342741 - RNA, 19 nt, Homo sapiens
caaagcacacuaggaggaa

SEQ ID NO: 1342742 - RNA, 19 nt, Homo sapiens
cuucaucagucgcuuaucu

SEQ ID NO: 1342743 - RNA, 19 nt, Homo sapiens
gaaggagcuggcaucuuug

SEQ ID NO: 1342744 - RNA, 19 nt, Homo sapiens
aggcagaagcuuuguauag

SEQ ID NO: 1342745 - RNA, 19 nt, Homo sapiens
uggaauugcauauuaagga

SEQ ID NO: 1342746 - RNA, 19 nt, Homo sapiens
gaccaggagccagaaaguu

SEQ ID NO: 1342747 - RNA, 19 nt, Homo sapiens
gugccuggcuugaccacau

SEQ ID NO: 1342748 - RNA, 19 nt, Homo sapiens
cuagugaguaugcugguuu

SEQ ID NO: 1342749 - RNA, 19 nt, Homo sapiens
gcagggaagugggaaucgu

SEQ ID NO: 1342750 - RNA, 19 nt, Homo sapiens
gaggcagaagcuuuguaua

SEQ ID NO: 1342751 - RNA, 19 nt, Homo sapiens
gaagugggaaucguuaggu

SEQ ID NO: 1342752 - RNA, 19 nt, Homo sapiens
cgcugcagcucaaacaaga

SEQ ID NO: 1342753 - RNA, 19 nt, Homo sapiens
ugaggcagaagcuuuguau

SEQ ID NO: 1342754 - RNA, 19 nt, Homo sapiens
cuacuucaucagucgcuua

SEQ ID NO: 1342755 - RNA, 19 nt, Homo sapiens
ggaaagcauacuggagaau

SEQ ID NO: 1342756 - RNA, 19 nt, Homo sapiens
aggaaagcauacuggagaa

SEQ ID NO: 1342757 - RNA, 19 nt, Homo sapiens
uaaacaagccaugcaaggu

SEQ ID NO: 1342758 - RNA, 19 nt, Homo sapiens
uuacggagcacgagagagu

SEQ ID NO: 1342759 - RNA, 19 nt, Homo sapiens
guuaagagcuccccaucuc

SEQ ID NO: 1342760 - RNA, 19 nt, Homo sapiens
gggaaccaguccugaaucc

SEQ ID NO: 1342761 - RNA, 19 nt, Homo sapiens
gucacagacuacuucauca

SEQ ID NO: 1342762 - RNA, 19 nt, Homo sapiens
ugucacagacuacuucauc

SEQ ID NO: 1342763 - RNA, 19 nt, Homo sapiens
gagaaggagcuggcaucuu

SEQ ID NO: 1342764 - RNA, 19 nt, Homo sapiens
gggcuuaagaauccaagau

SEQ ID NO: 1342765 - RNA, 19 nt, Homo sapiens
ggucagggaguugcuggaa

SEQ ID NO: 1342766 - RNA, 19 nt, Homo sapiens
ucucuuggaugcccuucga

SEQ ID NO: 1342767 - RNA, 19 nt, Homo sapiens
cagagcagccuucccacau

SEQ ID NO: 1342768 - RNA, 19 nt, Homo sapiens
agggcuaccuggugggaaa

SEQ ID NO: 1342769 - RNA, 19 nt, Homo sapiens
agagcagccuucccacauc

SEQ ID NO: 1342770 - RNA, 19 nt, Homo sapiens
caugaggucaggagaucaa

SEQ ID NO: 1342771 - RNA, 19 nt, Homo sapiens
ccuguaauccagcacuuug

SEQ ID NO: 1342772 - RNA, 19 nt, Homo sapiens
uuaaggaagcccagaacug

SEQ ID NO: 1342773 - RNA, 19 nt, Homo sapiens
ggaagugggaaucguuagg

SEQ ID NO: 1342774 - RNA, 19 nt, Homo sapiens
gacauuuggaauugcauau

SEQ ID NO: 1342775 - RNA, 19 nt, Homo sapiens
agacauuuggaauugcaua

SEQ ID NO: 1342776 - RNA, 19 nt, Homo sapiens
caagaaugucauaaacaag

SEQ ID NO: 1342777 - RNA, 19 nt, Homo sapiens
cuaagugucuuuucucaag

SEQ ID NO: 1342778 - RNA, 19 nt, Homo sapiens
uaccacacacuacagagaa

SEQ ID NO: 1342779 - RNA, 19 nt, Homo sapiens
agacaggucagcugcaaag

SEQ ID NO: 1342780 - RNA, 19 nt, Homo sapiens
ucauaaacaagccaugcaa

SEQ ID NO: 1342781 - RNA, 19 nt, Homo sapiens
gccuugggaucagcucuug

SEQ ID NO: 1342782 - RNA, 19 nt, Homo sapiens
ggacuacgaggcugaugcu

SEQ ID NO: 1342783 - RNA, 19 nt, Homo sapiens
ugcaagguuucaagcucua

SEQ ID NO: 1342784 - RNA, 19 nt, Homo sapiens
gcacacagcaaguuuaaua

SEQ ID NO: 1342785 - RNA, 19 nt, Homo sapiens
gaaagaaggagaccacaua

SEQ ID NO: 1342786 - RNA, 19 nt, Homo sapiens
gcacauaauucaacagcuu

SEQ ID NO: 1342787 - RNA, 19 nt, Homo sapiens
ggaguuggagccacaaaua

SEQ ID NO: 1342788 - RNA, 19 nt, Homo sapiens
ggagggcccugcauggauu

SEQ ID NO: 1342789 - RNA, 19 nt, Homo sapiens
gcauuucacugggcuguaa

SEQ ID NO: 1342790 - RNA, 19 nt, Homo sapiens
gaacauggagaaagaagga

SEQ ID NO: 1342791 - RNA, 19 nt, Homo sapiens
gcacccaucucugauauca

SEQ ID NO: 1342792 - RNA, 19 nt, Homo sapiens
gagcacacagcaaguuuaa

SEQ ID NO: 1342793 - RNA, 19 nt, Homo sapiens
cacagcaccuuguacagua

SEQ ID NO: 1342794 - RNA, 19 nt, Homo sapiens
gaccuaagaacacuuuaaa

SEQ ID NO: 1342795 - RNA, 19 nt, Homo sapiens
gcagauggcucagaacaac

SEQ ID NO: 1342796 - RNA, 19 nt, Homo sapiens
caacgccucugucauccuu

SEQ ID NO: 1342797 - RNA, 19 nt, Homo sapiens
ucacugggcacuagacuuu

SEQ ID NO: 1342798 - RNA, 19 nt, Homo sapiens
gcaauucaagccagagauu

SEQ ID NO: 1342799 - RNA, 19 nt, Homo sapiens
guugagaucuucuuuugua

SEQ ID NO: 1342800 - RNA, 19 nt, Homo sapiens
cuacggcguuagcacuuua

SEQ ID NO: 1342801 - RNA, 19 nt, Homo sapiens
cguuggaccuucucuacua

SEQ ID NO: 1342802 - RNA, 19 nt, Homo sapiens
agacaggaguauucucuug

SEQ ID NO: 1342803 - RNA, 19 nt, Homo sapiens
gaaaagagaagaaaaccaa

SEQ ID NO: 1342804 - RNA, 19 nt, Homo sapiens
caggacggcuuguagcuau

SEQ ID NO: 1342805 - RNA, 19 nt, Homo sapiens
gaccuucucuacuacuuca

SEQ ID NO: 1342806 - RNA, 19 nt, Homo sapiens
uggcauggccugcuguaua

SEQ ID NO: 1342807 - RNA, 19 nt, Homo sapiens
caauugcccuuugcacaga

SEQ ID NO: 1342808 - RNA, 19 nt, Homo sapiens
ggcauggccugcuguauac

SEQ ID NO: 1342809 - RNA, 19 nt, Homo sapiens
ggcuauaucuaucgagugu

SEQ ID NO: 1342810 - RNA, 19 nt, Homo sapiens
gcccuucacuucuucucuu

SEQ ID NO: 1342811 - RNA, 19 nt, Homo sapiens
gaacccaauugcccuuugc

SEQ ID NO: 1342812 - RNA, 19 nt, Homo sapiens
ccaguauuagcacaaguua

SEQ ID NO: 1342813 - RNA, 19 nt, Homo sapiens
gugcugggcuauaucuauc

SEQ ID NO: 1342814 - RNA, 19 nt, Homo sapiens
ccuccugguuguccuguuu

SEQ ID NO: 1342815 - RNA, 19 nt, Homo sapiens
ccaaagugaccuaagaaca

SEQ ID NO: 1342816 - RNA, 19 nt, Homo sapiens
ggaagaggcaggcgaugag

SEQ ID NO: 1342817 - RNA, 19 nt, Homo sapiens
ucuugggaauucuagguua

SEQ ID NO: 1342818 - RNA, 19 nt, Homo sapiens
caucucugauaucaaguga

SEQ ID NO: 1342819 - RNA, 19 nt, Homo sapiens
cuacuucacugggcacuag

SEQ ID NO: 1342820 - RNA, 19 nt, Homo sapiens
guuaugccacugccacuuu

SEQ ID NO: 1342821 - RNA, 19 nt, Homo sapiens
gggcgagacaggaguauuc

SEQ ID NO: 1342822 - RNA, 19 nt, Homo sapiens
cggcacccaucucugauau

SEQ ID NO: 1342823 - RNA, 19 nt, Homo sapiens
gagaucuucuuuuguaaug

SEQ ID NO: 1342824 - RNA, 19 nt, Homo sapiens
caaagugaccuaagaacac

SEQ ID NO: 1342825 - RNA, 19 nt, Homo sapiens
ggcauccucuaccuagcua

SEQ ID NO: 1342826 - RNA, 19 nt, Homo sapiens
ugagcacacagcaaguuua

SEQ ID NO: 1342827 - RNA, 19 nt, Homo sapiens
ggucgccacaggcacauaa

SEQ ID NO: 1342828 - RNA, 19 nt, Homo sapiens
ucucugcccuucacuucuu

SEQ ID NO: 1342829 - RNA, 19 nt, Homo sapiens
ugaccuaagaacacuuuaa

SEQ ID NO: 1342830 - RNA, 19 nt, Homo sapiens
gcaccagcaccuucacugu

SEQ ID NO: 1342831 - RNA, 19 nt, Homo sapiens
cguccaaccuucagcucaa

SEQ ID NO: 1342832 - RNA, 19 nt, Homo sapiens
ccucugucauccuuaaugu

SEQ ID NO: 1342833 - RNA, 19 nt, Homo sapiens
uuguagcuaugcaucauuu

SEQ ID NO: 1342834 - RNA, 19 nt, Homo sapiens
ggcgaugagucuaguagca

SEQ ID NO: 1342835 - RNA, 19 nt, Homo sapiens
ccugugccaucgcccagua

SEQ ID NO: 1342836 - RNA, 19 nt, Homo sapiens
gaucagccaacgccucugu

SEQ ID NO: 1342837 - RNA, 19 nt, Homo sapiens
ccacaggcacauaauucaa

SEQ ID NO: 1342838 - RNA, 19 nt, Homo sapiens
gggcacuucgggagaauga

SEQ ID NO: 1342839 - RNA, 19 nt, Homo sapiens
ggugggcccugcaugugau

SEQ ID NO: 1342840 - RNA, 19 nt, Homo sapiens
ccacugcugggcauuguug

SEQ ID NO: 1342841 - RNA, 19 nt, Homo sapiens
agcaacauguaaaugauug

SEQ ID NO: 1342842 - RNA, 19 nt, Homo sapiens
ggcguuagcacuuuaagca

SEQ ID NO: 1342843 - RNA, 19 nt, Homo sapiens
ggaggcaccagcaccuuca

SEQ ID NO: 1342844 - RNA, 19 nt, Homo sapiens
gcacccaggacggcuugua

SEQ ID NO: 1342845 - RNA, 19 nt, Homo sapiens
ccacagcaccuuguacagu

SEQ ID NO: 1342846 - RNA, 19 nt, Homo sapiens
ccaaggcauccucuaccua

SEQ ID NO: 1342847 - RNA, 19 nt, Homo sapiens
agccagagauugcccaagu

SEQ ID NO: 1342848 - RNA, 19 nt, Homo sapiens
cguuuggccuucugggauu

SEQ ID NO: 1342849 - RNA, 19 nt, Homo sapiens
gugccaucgcccaguauua

SEQ ID NO: 1342850 - RNA, 19 nt, Homo sapiens
cgugagcagugaugagauc

SEQ ID NO: 1342851 - RNA, 19 nt, Homo sapiens
ucucugauaucaagugacu

SEQ ID NO: 1342852 - RNA, 19 nt, Homo sapiens
cacacagcaaguuuaauaa

SEQ ID NO: 1342853 - RNA, 19 nt, Homo sapiens
ccacaaauagauggucaga

SEQ ID NO: 1342854 - RNA, 19 nt, Homo sapiens
gaguuggagccacaaauag

SEQ ID NO: 1342855 - RNA, 19 nt, Homo sapiens
acccaucucugauaucaag

SEQ ID NO: 1342856 - RNA, 19 nt, Homo sapiens
gcuuguagcuaugcaucau

SEQ ID NO: 1342857 - RNA, 19 nt, Homo sapiens
caccuccucuugggaauuc

SEQ ID NO: 1342858 - RNA, 19 nt, Homo sapiens
cuagcuaggucaccaacgu

SEQ ID NO: 1342859 - RNA, 19 nt, Homo sapiens
uaucaagugacuccaacaa

SEQ ID NO: 1342860 - RNA, 19 nt, Homo sapiens
cacauaauucaacagcuuu

SEQ ID NO: 1342861 - RNA, 19 nt, Homo sapiens
ccuacggcguuagcacuuu

SEQ ID NO: 1342862 - RNA, 19 nt, Homo sapiens
acaugucccucccguccaa

SEQ ID NO: 1342863 - RNA, 19 nt, Homo sapiens
caacauguaaaugauugga

SEQ ID NO: 1342864 - RNA, 19 nt, Homo sapiens
acaggcacauaauucaaca

SEQ ID NO: 1342865 - RNA, 19 nt, Homo sapiens
gccacaggcacauaauuca

SEQ ID NO: 1342866 - RNA, 19 nt, Homo sapiens
gcacuucgggagaaugaac

SEQ ID NO: 1342867 - RNA, 19 nt, Homo sapiens
agaacccaauugcccuuug

SEQ ID NO: 1342868 - RNA, 19 nt, Homo sapiens
gcuaccaguuggacguaag

SEQ ID NO: 1342869 - RNA, 19 nt, Homo sapiens
acgccucugucauccuuaa

SEQ ID NO: 1342870 - RNA, 19 nt, Homo sapiens
cauccuuaaugugcaauuc

SEQ ID NO: 1342871 - RNA, 19 nt, Homo sapiens
guuagcacuuuaagcacau

SEQ ID NO: 1342872 - RNA, 19 nt, Homo sapiens
cggccaaugucaccuggau

SEQ ID NO: 1342873 - RNA, 19 nt, Homo sapiens
ccaggacggcuuguagcua

SEQ ID NO: 1342874 - RNA, 19 nt, Homo sapiens
gaagaggcaggcgaugagu

SEQ ID NO: 1342875 - RNA, 19 nt, Homo sapiens
gaccaggaugggccaguga

SEQ ID NO: 1342876 - RNA, 19 nt, Homo sapiens
ggauuuuccuccuuccuau

SEQ ID NO: 1342877 - RNA, 19 nt, Homo sapiens
accagcaccuucacuguca

SEQ ID NO: 1342878 - RNA, 19 nt, Homo sapiens
cgagggcgagacaggagua

SEQ ID NO: 1342879 - RNA, 19 nt, Homo sapiens
gcugggcuauaucuaucga

SEQ ID NO: 1342880 - RNA, 19 nt, Homo sapiens
gccagagauugcccaaguc

SEQ ID NO: 1342881 - RNA, 19 nt, Homo sapiens
gcaggcgaugagucuagua

SEQ ID NO: 1342882 - RNA, 19 nt, Homo sapiens
ggaccuucucuacuacuuc

SEQ ID NO: 1342883 - RNA, 19 nt, Homo sapiens
ggccagggguguucagaug

SEQ ID NO: 1342884 - RNA, 19 nt, Homo sapiens
caacauguauuaucuugga

SEQ ID NO: 1342885 - RNA, 19 nt, Homo sapiens
cgacucaucucccucaaga

SEQ ID NO: 1342886 - RNA, 19 nt, Homo sapiens
ccagacaccuugggaauga

SEQ ID NO: 1342887 - RNA, 19 nt, Homo sapiens
gcauugcucuuccuacugu

SEQ ID NO: 1342888 - RNA, 19 nt, Homo sapiens
gcccgagacuccuguguuu

SEQ ID NO: 1342889 - RNA, 19 nt, Homo sapiens
guacgacgguguugagauc

SEQ ID NO: 1342890 - RNA, 19 nt, Homo sapiens
gaaccacgcugcugaugac

SEQ ID NO: 1342891 - RNA, 19 nt, Homo sapiens
gggcaugcaugacucuuug

SEQ ID NO: 1342892 - RNA, 19 nt, Homo sapiens
gugaggcacuggcaaggua

SEQ ID NO: 1342893 - RNA, 19 nt, Homo sapiens
gacaugugcugcagugaga

SEQ ID NO: 1342894 - RNA, 19 nt, Homo sapiens
gagcgaggccugaagcauu

SEQ ID NO: 1342895 - RNA, 19 nt, Homo sapiens
ugagaucacugugcagaaa

SEQ ID NO: 1342896 - RNA, 19 nt, Homo sapiens
ggcaacauguauuaucuug

SEQ ID NO: 1342897 - RNA, 19 nt, Homo sapiens
cagaguggauggaggagaa

SEQ ID NO: 1342898 - RNA, 19 nt, Homo sapiens
aggagaagaucgaggauga

SEQ ID NO: 1342899 - RNA, 19 nt, Homo sapiens
ugacugcgcuucuccuaca

SEQ ID NO: 1342900 - RNA, 19 nt, Homo sapiens
ucgaggagaugaacgagaa

SEQ ID NO: 1342901 - RNA, 19 nt, Homo sapiens
gagcacacgcccaucauug

SEQ ID NO: 1342902 - RNA, 19 nt, Homo sapiens
ccagaauguuuccgugcua

SEQ ID NO: 1342903 - RNA, 19 nt, Homo sapiens
agaaaugcaccgaguauug

SEQ ID NO: 1342904 - RNA, 19 nt, Homo sapiens
gaggggagcucaagguuug

SEQ ID NO: 1342905 - RNA, 19 nt, Homo sapiens
agcgaggccugaagcauua

SEQ ID NO: 1342906 - RNA, 19 nt, Homo sapiens
gaaaugcaccgaguauugg

SEQ ID NO: 1342907 - RNA, 19 nt, Homo sapiens
ccucugaguuccuacauca

SEQ ID NO: 1342908 - RNA, 19 nt, Homo sapiens
gaggagggcuuuggcuauc

SEQ ID NO: 1342909 - RNA, 19 nt, Homo sapiens
cuacaucaaugccaacuac

SEQ ID NO: 1342910 - RNA, 19 nt, Homo sapiens
ggucacagaacgccacaaa

SEQ ID NO: 1342911 - RNA, 19 nt, Homo sapiens
caaaccucgucuccucuuu

SEQ ID NO: 1342912 - RNA, 19 nt, Homo sapiens
gucaugagccucuacgaaa

SEQ ID NO: 1342913 - RNA, 19 nt, Homo sapiens
gaacuuuguggauccgaaa

SEQ ID NO: 1342914 - RNA, 19 nt, Homo sapiens
gaaggucaccagagagcuu

SEQ ID NO: 1342915 - RNA, 19 nt, Homo sapiens
agacuccuguguuugauug

SEQ ID NO: 1342916 - RNA, 19 nt, Homo sapiens
gcaugacucuuuggcaaca

SEQ ID NO: 1342917 - RNA, 19 nt, Homo sapiens
ggacucagcccagaucuac

SEQ ID NO: 1342918 - RNA, 19 nt, Homo sapiens
gcgcuucuccuacaagguu

SEQ ID NO: 1342919 - RNA, 19 nt, Homo sapiens
gaggaccggcugcuucauu

SEQ ID NO: 1342920 - RNA, 19 nt, Homo sapiens
gacaggcgccagucaguga

SEQ ID NO: 1342921 - RNA, 19 nt, Homo sapiens
ggagaacccagaggaucua

SEQ ID NO: 1342922 - RNA, 19 nt, Homo sapiens
uaccugauccagaauguuu

SEQ ID NO: 1342923 - RNA, 19 nt, Homo sapiens
cgagaaaugcaccgaguau

SEQ ID NO: 1342924 - RNA, 19 nt, Homo sapiens
ccuugggaaugaauuauga

SEQ ID NO: 1342925 - RNA, 19 nt, Homo sapiens
gcaauaaacggagcauuuu

SEQ ID NO: 1342926 - RNA, 19 nt, Homo sapiens
ucauucacacggaggauua

SEQ ID NO: 1342927 - RNA, 19 nt, Homo sapiens
ucaccaacaucgaggagau

SEQ ID NO: 1342928 - RNA, 19 nt, Homo sapiens
uccagaaggucaccagaga

SEQ ID NO: 1342929 - RNA, 19 nt, Homo sapiens
caggcggaauucuuugaaa

SEQ ID NO: 1342930 - RNA, 19 nt, Homo sapiens
gcugcaggcggaauucuuu

SEQ ID NO: 1342931 - RNA, 19 nt, Homo sapiens
ccaccucacucaccgucaa

SEQ ID NO: 1342932 - RNA, 19 nt, Homo sapiens
gagaaaugcaccgaguauu

SEQ ID NO: 1342933 - RNA, 19 nt, Homo sapiens
ggagcacacgcccaucauu

SEQ ID NO: 1342934 - RNA, 19 nt, Homo sapiens
ccucagauccagcucagaa

SEQ ID NO: 1342935 - RNA, 19 nt, Homo sapiens
gaggaucuaggcccuguug

SEQ ID NO: 1342936 - RNA, 19 nt, Homo sapiens
gcaggcggaauucuuugaa

SEQ ID NO: 1342937 - RNA, 19 nt, Homo sapiens
ccgagacuccuguguuuga

SEQ ID NO: 1342938 - RNA, 19 nt, Homo sapiens
ggagcagccugugccuguu

SEQ ID NO: 1342939 - RNA, 19 nt, Homo sapiens
agcaauaaacggagcauuu

SEQ ID NO: 1342940 - RNA, 19 nt, Homo sapiens
gcugcaauguguucugucu

SEQ ID NO: 1342941 - RNA, 19 nt, Homo sapiens
gagaugaacgagaaaugca

SEQ ID NO: 1342942 - RNA, 19 nt, Homo sapiens
cacccgcacuucucccaaa

SEQ ID NO: 1342943 - RNA, 19 nt, Homo sapiens
ggcuuuggcuaucucaugu

SEQ ID NO: 1342944 - RNA, 19 nt, Homo sapiens
auaauucgcucguggucau

SEQ ID NO: 1342945 - RNA, 19 nt, Homo sapiens
gcacacgcccaucauuguc

SEQ ID NO: 1342946 - RNA, 19 nt, Homo sapiens
ggacucacagagagagaug

SEQ ID NO: 1342947 - RNA, 19 nt, Homo sapiens
agaucuacgugagacauuu

SEQ ID NO: 1342948 - RNA, 19 nt, Homo sapiens
gggaggagaagguguacau

SEQ ID NO: 1342949 - RNA, 19 nt, Homo sapiens
ugcaauguguucugucugu

SEQ ID NO: 1342950 - RNA, 19 nt, Homo sapiens
aagcauuacugguucacau

SEQ ID NO: 1342951 - RNA, 19 nt, Homo sapiens
caucaaugccaacuacauc

SEQ ID NO: 1342952 - RNA, 19 nt, Homo sapiens
acaccuugggaaugaauua

SEQ ID NO: 1342953 - RNA, 19 nt, Homo sapiens
cgaggagggcuuuggcuau

SEQ ID NO: 1342954 - RNA, 19 nt, Homo sapiens
gugcagaaagucauucaca

SEQ ID NO: 1342955 - RNA, 19 nt, Homo sapiens
ggagaugaacgagaaaugc

SEQ ID NO: 1342956 - RNA, 19 nt, Homo sapiens
gcuccaggacucacagaga

SEQ ID NO: 1342957 - RNA, 19 nt, Homo sapiens
gagggagccaggagugaga

SEQ ID NO: 1342958 - RNA, 19 nt, Homo sapiens
aggcggaauucuuugaaau

SEQ ID NO: 1342959 - RNA, 19 nt, Homo sapiens
gggcuuuggcuaucucaug

SEQ ID NO: 1342960 - RNA, 19 nt, Homo sapiens
gagccaggagugagagaga

SEQ ID NO: 1342961 - RNA, 19 nt, Homo sapiens
ggauggaggagaagaucga

SEQ ID NO: 1342962 - RNA, 19 nt, Homo sapiens
gcucguggucauugaauag

SEQ ID NO: 1342963 - RNA, 19 nt, Homo sapiens
caugcgagcaguaccaguu

SEQ ID NO: 1342964 - RNA, 19 nt, Homo sapiens
ggagugagagagagaacca

SEQ ID NO: 1342965 - RNA, 19 nt, Homo sapiens
gccugaagcauuacugguu

SEQ ID NO: 1342966 - RNA, 19 nt, Homo sapiens
ggagggcuuuggcuaucuc

SEQ ID NO: 1342967 - RNA, 19 nt, Homo sapiens
gcagacagagacauuuggu

SEQ ID NO: 1342968 - RNA, 19 nt, Homo sapiens
aggaccggcugcuucauug

SEQ ID NO: 1342969 - RNA, 19 nt, Homo sapiens
gcauacacacuggcacaga

SEQ ID NO: 1342970 - RNA, 19 nt, Homo sapiens
uguguuugauugugugaug

SEQ ID NO: 1342971 - RNA, 19 nt, Homo sapiens
cgucaugagccucuacgaa

SEQ ID NO: 1342972 - RNA, 19 nt, Homo sapiens
cggaagaaccgguacaaaa

SEQ ID NO: 1342973 - RNA, 19 nt, Homo sapiens
gaaauccccaugaacuuug

SEQ ID NO: 1342974 - RNA, 19 nt, Homo sapiens
ucuuuggcaacauguauua

SEQ ID NO: 1342975 - RNA, 19 nt, Homo sapiens
gaagucucacugcgugugu

SEQ ID NO: 1342976 - RNA, 19 nt, Homo sapiens
gauuaccggcugcgacuca

SEQ ID NO: 1342977 - RNA, 19 nt, Homo sapiens
gaaccgguacaaaaccaua

SEQ ID NO: 1342978 - RNA, 19 nt, Homo sapiens
ggaagaaccgguacaaaac

SEQ ID NO: 1342979 - RNA, 19 nt, Homo sapiens
gcggaagaaccgguacaaa

SEQ ID NO: 1342980 - RNA, 19 nt, Homo sapiens
gagcagccugugccuguuc

SEQ ID NO: 1342981 - RNA, 19 nt, Homo sapiens
gagacuccuguguuugauu

SEQ ID NO: 1342982 - RNA, 19 nt, Homo sapiens
gagaaccacgcugcugaug

SEQ ID NO: 1342983 - RNA, 19 nt, Homo sapiens
ucacagaacgccacaaacc

SEQ ID NO: 1342984 - RNA, 19 nt, Homo sapiens
ggaccaaacugaagcuaua

SEQ ID NO: 1342985 - RNA, 19 nt, Homo sapiens
ggaauucgcucagaagaaa

SEQ ID NO: 1342986 - RNA, 19 nt, Homo sapiens
gaaauucgggcacaucaua

SEQ ID NO: 1342987 - RNA, 19 nt, Homo sapiens
gcaaaggccuucagcaauc

SEQ ID NO: 1342988 - RNA, 19 nt, Homo sapiens
gcaaagagaagauacagaa

SEQ ID NO: 1342989 - RNA, 19 nt, Homo sapiens
aaagggaugugaauuauug

SEQ ID NO: 1342990 - RNA, 19 nt, Homo sapiens
gaaaacaucuauaccauug

SEQ ID NO: 1342991 - RNA, 19 nt, Homo sapiens
gaccugcacugaacuuaaa

SEQ ID NO: 1342992 - RNA, 19 nt, Homo sapiens
gaagagaacguauaugaag

SEQ ID NO: 1342993 - RNA, 19 nt, Homo sapiens
gagccucccugauauaaau

SEQ ID NO: 1342994 - RNA, 19 nt, Homo sapiens
gagcagaguuuucccauuu

SEQ ID NO: 1342995 - RNA, 19 nt, Homo sapiens
ugaaagggaugugaauuau

SEQ ID NO: 1342996 - RNA, 19 nt, Homo sapiens
cuuggaauguugagauuua

SEQ ID NO: 1342997 - RNA, 19 nt, Homo sapiens
agacuucacugcagccuuu

SEQ ID NO: 1342998 - RNA, 19 nt, Homo sapiens
aaauaucucugaccaacuu

SEQ ID NO: 1342999 - RNA, 19 nt, Homo sapiens
gaaguacccaguccauuug

SEQ ID NO: 1343000 - RNA, 19 nt, Homo sapiens
gucauugccucuguauuua

SEQ ID NO: 1343001 - RNA, 19 nt, Homo sapiens
ggacauggcccagcagaga

SEQ ID NO: 1343002 - RNA, 19 nt, Homo sapiens
gagcggaggucggucagaa

SEQ ID NO: 1343003 - RNA, 19 nt, Homo sapiens
gacacacaauuggaacuua

SEQ ID NO: 1343004 - RNA, 19 nt, Homo sapiens
gauggagucuugcucuguu

SEQ ID NO: 1343005 - RNA, 19 nt, Homo sapiens
gaacugggaccugcacuga

SEQ ID NO: 1343006 - RNA, 19 nt, Homo sapiens
acacaaauauccacauugg

SEQ ID NO: 1343007 - RNA, 19 nt, Homo sapiens
gaaagggaugugaauuauu

SEQ ID NO: 1343008 - RNA, 19 nt, Homo sapiens
gacagagaguggucccuaa

SEQ ID NO: 1343009 - RNA, 19 nt, Homo sapiens
gcaccaccaugcccagcua

SEQ ID NO: 1343010 - RNA, 19 nt, Homo sapiens
guugugugcuugaaagaaa

SEQ ID NO: 1343011 - RNA, 19 nt, Homo sapiens
cagcaacccucacaaccuu

SEQ ID NO: 1343012 - RNA, 19 nt, Homo sapiens
agaguggucccuaaacuua

SEQ ID NO: 1343013 - RNA, 19 nt, Homo sapiens
gagguucuguccacugcua

SEQ ID NO: 1343014 - RNA, 19 nt, Homo sapiens
gcauuugauugguguguau

SEQ ID NO: 1343015 - RNA, 19 nt, Homo sapiens
guagacaguuggaagaagu

SEQ ID NO: 1343016 - RNA, 19 nt, Homo sapiens
ugucauugccucuguauuu

SEQ ID NO: 1343017 - RNA, 19 nt, Homo sapiens
gaaacuaugagcuguguca

SEQ ID NO: 1343018 - RNA, 19 nt, Homo sapiens
ccaaaucccaggcauaaug

SEQ ID NO: 1343019 - RNA, 19 nt, Homo sapiens
gaccauagagaaugugauu

SEQ ID NO: 1343020 - RNA, 19 nt, Homo sapiens
ccaaagcacugggauuaca

SEQ ID NO: 1343021 - RNA, 19 nt, Homo sapiens
uuucacaucuucccuuuga

SEQ ID NO: 1343022 - RNA, 19 nt, Homo sapiens
ugaucugucuugcuuauug

SEQ ID NO: 1343023 - RNA, 19 nt, Homo sapiens
ccaaacugaagcuauauuu

SEQ ID NO: 1343024 - RNA, 19 nt, Homo sapiens
agaaguacccaguccauuu

SEQ ID NO: 1343025 - RNA, 19 nt, Homo sapiens
uggaggagcccaaugagua

SEQ ID NO: 1343026 - RNA, 19 nt, Homo sapiens
ggaccugcacugaacuuaa

SEQ ID NO: 1343027 - RNA, 19 nt, Homo sapiens
gaagauaaugacucacaug

SEQ ID NO: 1343028 - RNA, 19 nt, Homo sapiens
ggagcaaccaucagaauag

SEQ ID NO: 1343029 - RNA, 19 nt, Homo sapiens
agacaggguuucaccaugu

SEQ ID NO: 1343030 - RNA, 19 nt, Homo sapiens
gcaugucauugccucugua

SEQ ID NO: 1343031 - RNA, 19 nt, Homo sapiens
ggucuaccuugaucuugaa

SEQ ID NO: 1343032 - RNA, 19 nt, Homo sapiens
ccagcuaauuuguuguauu

SEQ ID NO: 1343033 - RNA, 19 nt, Homo sapiens
uaucuucggcgcuuuaauu

SEQ ID NO: 1343034 - RNA, 19 nt, Homo sapiens
ggaguagacaguuggaaga

SEQ ID NO: 1343035 - RNA, 19 nt, Homo sapiens
gagccuguccuguguuuga

SEQ ID NO: 1343036 - RNA, 19 nt, Homo sapiens
ucaaacuccugaccucaug

SEQ ID NO: 1343037 - RNA, 19 nt, Homo sapiens
caaacgggcuuuuauauac

SEQ ID NO: 1343038 - RNA, 19 nt, Homo sapiens
gaauuuaagccucaucucu

SEQ ID NO: 1343039 - RNA, 19 nt, Homo sapiens
caaaugguauucucauagc

SEQ ID NO: 1343040 - RNA, 19 nt, Homo sapiens
caccaugcccagcuaauuu

SEQ ID NO: 1343041 - RNA, 19 nt, Homo sapiens
ugacucacaugggaauuga

SEQ ID NO: 1343042 - RNA, 19 nt, Homo sapiens
ggaggagcccaaugaguau

SEQ ID NO: 1343043 - RNA, 19 nt, Homo sapiens
agagaugacuggacuaggu

SEQ ID NO: 1343044 - RNA, 19 nt, Homo sapiens
cuccugaccucaugauuug

SEQ ID NO: 1343045 - RNA, 19 nt, Homo sapiens
gaagauacagaauuuaagc

SEQ ID NO: 1343046 - RNA, 19 nt, Homo sapiens
caaaucccaggcauaauga

SEQ ID NO: 1343047 - RNA, 19 nt, Homo sapiens
gauccaaaucccaggcaua

SEQ ID NO: 1343048 - RNA, 19 nt, Homo sapiens
ggaagugcauuugauuggu

SEQ ID NO: 1343049 - RNA, 19 nt, Homo sapiens
gaagaaguacccaguccau

SEQ ID NO: 1343050 - RNA, 19 nt, Homo sapiens
gaucugucuugcuuauugu

SEQ ID NO: 1343051 - RNA, 19 nt, Homo sapiens
auguugagauuuaggcuua

SEQ ID NO: 1343052 - RNA, 19 nt, Homo sapiens
uugaagagaacguauauga

SEQ ID NO: 1343053 - RNA, 19 nt, Homo sapiens
augaaagggaugugaauua

SEQ ID NO: 1343054 - RNA, 19 nt, Homo sapiens
gagaguggucccuaaacuu

SEQ ID NO: 1343055 - RNA, 19 nt, Homo sapiens
aaaggaagugcauuugauu

SEQ ID NO: 1343056 - RNA, 19 nt, Homo sapiens
gacaggguuucaccauguu

SEQ ID NO: 1343057 - RNA, 19 nt, Homo sapiens
ucuauaccauugaagagaa

SEQ ID NO: 1343058 - RNA, 19 nt, Homo sapiens
gaugaaagggaugugaauu

SEQ ID NO: 1343059 - RNA, 19 nt, Homo sapiens
cagaaacuaugagcugugu

SEQ ID NO: 1343060 - RNA, 19 nt, Homo sapiens
cagaauaggcaucuacauc

SEQ ID NO: 1343061 - RNA, 19 nt, Homo sapiens
ggcuugaucugucuugcuu

SEQ ID NO: 1343062 - RNA, 19 nt, Homo sapiens
ggcaaaggccuucagcaau

SEQ ID NO: 1343063 - RNA, 19 nt, Homo sapiens
ccucagaaguggaauacag

SEQ ID NO: 1343064 - RNA, 19 nt, Homo sapiens
ugaagagaacguauaugaa

SEQ ID NO: 1343065 - RNA, 19 nt, Homo sapiens
uuacgggacucuagauugg

SEQ ID NO: 1343066 - RNA, 19 nt, Homo sapiens
gagauuuaggcuuauuuga

SEQ ID NO: 1343067 - RNA, 19 nt, Homo sapiens
gaguauuauugcuauguca

SEQ ID NO: 1343068 - RNA, 19 nt, Homo sapiens
gagcaaccaucagaauagg

SEQ ID NO: 1343069 - RNA, 19 nt, Homo sapiens
ggcuacugcucaugugauu

SEQ ID NO: 1343070 - RNA, 19 nt, Homo sapiens
cugaccaacuucuguauuc

SEQ ID NO: 1343071 - RNA, 19 nt, Homo sapiens
gugcauagcccuucuuuug

SEQ ID NO: 1343072 - RNA, 19 nt, Homo sapiens
gggaauucgcucagaagaa

SEQ ID NO: 1343073 - RNA, 19 nt, Homo sapiens
agagggaauucgcucagaa

SEQ ID NO: 1343074 - RNA, 19 nt, Homo sapiens
auuuaagccucaucucuuu

SEQ ID NO: 1343075 - RNA, 19 nt, Homo sapiens
ucagcaaucuauauuacca

SEQ ID NO: 1343076 - RNA, 19 nt, Homo sapiens
gcccagcuaauuuguugua

SEQ ID NO: 1343077 - RNA, 19 nt, Homo sapiens
ccauugaagagaacguaua

SEQ ID NO: 1343078 - RNA, 19 nt, Homo sapiens
gaagaaaacaucuauacca

SEQ ID NO: 1343079 - RNA, 19 nt, Homo sapiens
ucccaggcauaaugaauga

SEQ ID NO: 1343080 - RNA, 19 nt, Homo sapiens
caaaggccuucagcaaucu

SEQ ID NO: 1343081 - RNA, 19 nt, Homo sapiens
gaacuuaaacaggcauguc

SEQ ID NO: 1343082 - RNA, 19 nt, Homo sapiens
uaucugcccugcuucuaca

SEQ ID NO: 1343083 - RNA, 19 nt, Homo sapiens
gguauucucauagcaaaga

SEQ ID NO: 1343084 - RNA, 19 nt, Homo sapiens
gagagggucuuagaaauaa

SEQ ID NO: 1343085 - RNA, 19 nt, Homo sapiens
uaucucagcuucauacuaa

SEQ ID NO: 1343086 - RNA, 19 nt, Homo sapiens
uaacagggauggucuucua

SEQ ID NO: 1343087 - RNA, 19 nt, Homo sapiens
gcauuuagcugugauguug

SEQ ID NO: 1343088 - RNA, 19 nt, Homo sapiens
ggagagggucuuagaaaua

SEQ ID NO: 1343089 - RNA, 19 nt, Homo sapiens
ggaaucacauuucaacaug

SEQ ID NO: 1343090 - RNA, 19 nt, Homo sapiens
gccauuauuuggaacauua

SEQ ID NO: 1343091 - RNA, 19 nt, Homo sapiens
ggagaucauuuggcauuua

SEQ ID NO: 1343092 - RNA, 19 nt, Homo sapiens
ggacaaacauccaaaccau

SEQ ID NO: 1343093 - RNA, 19 nt, Homo sapiens
cuaaagagguagcaagaaa

SEQ ID NO: 1343094 - RNA, 19 nt, Homo sapiens
cagggagggucuauuguua

SEQ ID NO: 1343095 - RNA, 19 nt, Homo sapiens
uggaagaacuguuacuaaa

SEQ ID NO: 1343096 - RNA, 19 nt, Homo sapiens
ggacuaugauucaacaaca

SEQ ID NO: 1343097 - RNA, 19 nt, Homo sapiens
cgaguaaauuucuugguaa

SEQ ID NO: 1343098 - RNA, 19 nt, Homo sapiens
gggaagccauuauuuggaa

SEQ ID NO: 1343099 - RNA, 19 nt, Homo sapiens
gcugugauguugcuaaaga

SEQ ID NO: 1343100 - RNA, 19 nt, Homo sapiens
cagagugacuugccuaaga

SEQ ID NO: 1343101 - RNA, 19 nt, Homo sapiens
gcacuaguggaauaacuua

SEQ ID NO: 1343102 - RNA, 19 nt, Homo sapiens
gcaccaagcuauucaugag

SEQ ID NO: 1343103 - RNA, 19 nt, Homo sapiens
caacagggagggucuauug

SEQ ID NO: 1343104 - RNA, 19 nt, Homo sapiens
gaagagauggagaaacauu

SEQ ID NO: 1343105 - RNA, 19 nt, Homo sapiens
ugucugagguaauucauaa

SEQ ID NO: 1343106 - RNA, 19 nt, Homo sapiens
guaaaugcagcugguauua

SEQ ID NO: 1343107 - RNA, 19 nt, Homo sapiens
gagggucuauuguuaaugu

SEQ ID NO: 1343108 - RNA, 19 nt, Homo sapiens
gcagagcuguggcccaguu

SEQ ID NO: 1343109 - RNA, 19 nt, Homo sapiens
ucgaguaaauuucuuggua

SEQ ID NO: 1343110 - RNA, 19 nt, Homo sapiens
gacaaagugugugcuguuu

SEQ ID NO: 1343111 - RNA, 19 nt, Homo sapiens
uuacacagcuaguuuaugg

SEQ ID NO: 1343112 - RNA, 19 nt, Homo sapiens
gaaucacauuucaacauga

SEQ ID NO: 1343113 - RNA, 19 nt, Homo sapiens
acaaacauccaaaccauaa

SEQ ID NO: 1343114 - RNA, 19 nt, Homo sapiens
ggacaaagugugugcuguu

SEQ ID NO: 1343115 - RNA, 19 nt, Homo sapiens
gaagaacuguuacuaaaag

SEQ ID NO: 1343116 - RNA, 19 nt, Homo sapiens
guuccaugcugaccuguaa

SEQ ID NO: 1343117 - RNA, 19 nt, Homo sapiens
gagaucauuuggcauuuag

SEQ ID NO: 1343118 - RNA, 19 nt, Homo sapiens
ggcggaagguaaagaggua

SEQ ID NO: 1343119 - RNA, 19 nt, Homo sapiens
gggagggucuauuguuaau

SEQ ID NO: 1343120 - RNA, 19 nt, Homo sapiens
cagggauggucuucuagua

SEQ ID NO: 1343121 - RNA, 19 nt, Homo sapiens
gaacuaacagugagaacuc

SEQ ID NO: 1343122 - RNA, 19 nt, Homo sapiens
gcucuggcaugaacuaaca

SEQ ID NO: 1343123 - RNA, 19 nt, Homo sapiens
uugaagagauggagaaaca

SEQ ID NO: 1343124 - RNA, 19 nt, Homo sapiens
ggagguggcaggcucuaaa

SEQ ID NO: 1343125 - RNA, 19 nt, Homo sapiens
gacaaacauccaaaccaua

SEQ ID NO: 1343126 - RNA, 19 nt, Homo sapiens
uaaaggaggauuaguugga

SEQ ID NO: 1343127 - RNA, 19 nt, Homo sapiens
gggauggucuucuaguaag

SEQ ID NO: 1343128 - RNA, 19 nt, Homo sapiens
agagauggagaaacauuua

SEQ ID NO: 1343129 - RNA, 19 nt, Homo sapiens
guuuauggaagaacuguua

SEQ ID NO: 1343130 - RNA, 19 nt, Homo sapiens
uaccugggauucagaguga

SEQ ID NO: 1343131 - RNA, 19 nt, Homo sapiens
uaaaugcagcugguauuaa

SEQ ID NO: 1343132 - RNA, 19 nt, Homo sapiens
gcggagaucauuuggcauu

SEQ ID NO: 1343133 - RNA, 19 nt, Homo sapiens
uaaaggacugucugaggua

SEQ ID NO: 1343134 - RNA, 19 nt, Homo sapiens
ggccaggaguuccagauca

SEQ ID NO: 1343135 - RNA, 19 nt, Homo sapiens
caacauugggaaucacauu

SEQ ID NO: 1343136 - RNA, 19 nt, Homo sapiens
gguaaaugcagcugguauu

SEQ ID NO: 1343137 - RNA, 19 nt, Homo sapiens
aaacauuuaggucgaguaa

SEQ ID NO: 1343138 - RNA, 19 nt, Homo sapiens
acagcuaguuuauggaaga

SEQ ID NO: 1343139 - RNA, 19 nt, Homo sapiens
guggagagggucuuagaaa

SEQ ID NO: 1343140 - RNA, 19 nt, Homo sapiens
gagaacucauuauuuacca

SEQ ID NO: 1343141 - RNA, 19 nt, Homo sapiens
aaaugcagcugguauuaac

SEQ ID NO: 1343142 - RNA, 19 nt, Homo sapiens
aaaggacugucugagguaa

SEQ ID NO: 1343143 - RNA, 19 nt, Homo sapiens
uauagggaagccauuauuu

SEQ ID NO: 1343144 - RNA, 19 nt, Homo sapiens
agagguagcaagaaagaaa

SEQ ID NO: 1343145 - RNA, 19 nt, Homo sapiens
uggagagggucuuagaaau

SEQ ID NO: 1343146 - RNA, 19 nt, Homo sapiens
gggaaucacauuucaacau

SEQ ID NO: 1343147 - RNA, 19 nt, Homo sapiens
caguaaaggaggauuaguu

SEQ ID NO: 1343148 - RNA, 19 nt, Homo sapiens
ugaggacuaugauucaaca

SEQ ID NO: 1343149 - RNA, 19 nt, Homo sapiens
guguuagccuguuugcauu

SEQ ID NO: 1343150 - RNA, 19 nt, Homo sapiens
guaccucauacucuauaua

SEQ ID NO: 1343151 - RNA, 19 nt, Homo sapiens
ggaagaacuguuacuaaaa

SEQ ID NO: 1343152 - RNA, 19 nt, Homo sapiens
gagggucuuagaaauaauu

SEQ ID NO: 1343153 - RNA, 19 nt, Homo sapiens
aaacauccaaaccauaaga

SEQ ID NO: 1343154 - RNA, 19 nt, Homo sapiens
caucuggguagaauaguuu

SEQ ID NO: 1343155 - RNA, 19 nt, Homo sapiens
aaagagguagcaagaaaga

SEQ ID NO: 1343156 - RNA, 19 nt, Homo sapiens
gaaacauuuaggucgagua

SEQ ID NO: 1343157 - RNA, 19 nt, Homo sapiens
aagauuacacagcuaguuu

SEQ ID NO: 1343158 - RNA, 19 nt, Homo sapiens
uggguagaauaguuuguaa

SEQ ID NO: 1343159 - RNA, 19 nt, Homo sapiens
ugacaucuggguagaauag

SEQ ID NO: 1343160 - RNA, 19 nt, Homo sapiens
gauuacacagcuaguuuau

SEQ ID NO: 1343161 - RNA, 19 nt, Homo sapiens
agagugacuugccuaagau

SEQ ID NO: 1343162 - RNA, 19 nt, Homo sapiens
gugaggcccaggaaacuuu

SEQ ID NO: 1343163 - RNA, 19 nt, Homo sapiens
uaauugacaucuggguaga

SEQ ID NO: 1343164 - RNA, 19 nt, Homo sapiens
ugagcaacauagcaagaug

SEQ ID NO: 1343165 - RNA, 19 nt, Homo sapiens
agauuacacagcuaguuua

SEQ ID NO: 1343166 - RNA, 19 nt, Homo sapiens
caacaucugcucagcuucu

SEQ ID NO: 1343167 - RNA, 19 nt, Homo sapiens
gcucuaaaggacugucuga

SEQ ID NO: 1343168 - RNA, 19 nt, Homo sapiens
aaaggaggauuaguuggau

SEQ ID NO: 1343169 - RNA, 19 nt, Homo sapiens
gccaugaggacuaugauuc

SEQ ID NO: 1343170 - RNA, 19 nt, Homo sapiens
cgagauggacaaagugugu

SEQ ID NO: 1343171 - RNA, 19 nt, Homo sapiens
ugacuugccuaagauuaca

SEQ ID NO: 1343172 - RNA, 19 nt, Homo sapiens
gguagcagccaagucauau

SEQ ID NO: 1343173 - RNA, 19 nt, Homo sapiens
agagguagcagccaaguca

SEQ ID NO: 1343174 - RNA, 19 nt, Homo sapiens
ccucauacucuauauaaag

SEQ ID NO: 1343175 - RNA, 19 nt, Homo sapiens
cccacucucuaccuucuuu

SEQ ID NO: 1343176 - RNA, 19 nt, Homo sapiens
cauugggaaucacauuuca

SEQ ID NO: 1343177 - RNA, 19 nt, Homo sapiens
gguggcaggcucuaaacaa

SEQ ID NO: 1343178 - RNA, 19 nt, Homo sapiens
caugaggacuaugauucaa

SEQ ID NO: 1343179 - RNA, 19 nt, Homo sapiens
acacagcuaguuuauggaa

SEQ ID NO: 1343180 - RNA, 19 nt, Homo sapiens
ggagggcaccaagcuauuc

SEQ ID NO: 1343181 - RNA, 19 nt, Homo sapiens
gagcuguggcccaguuaau

SEQ ID NO: 1343182 - RNA, 19 nt, Homo sapiens
uggcaugaacuaacaguga

SEQ ID NO: 1343183 - RNA, 19 nt, Homo sapiens
ugaggcaggaguauuguga

SEQ ID NO: 1343184 - RNA, 19 nt, Homo sapiens
gaaagugccuugacaauug

SEQ ID NO: 1343185 - RNA, 19 nt, Homo sapiens
gaacaggucuccaaucuau

SEQ ID NO: 1343186 - RNA, 19 nt, Homo sapiens
ggagaaagccaccacaaua

SEQ ID NO: 1343187 - RNA, 19 nt, Homo sapiens
gaaaggaagggaagcauua

SEQ ID NO: 1343188 - RNA, 19 nt, Homo sapiens
caaauggacaugucaguua

SEQ ID NO: 1343189 - RNA, 19 nt, Homo sapiens
gagaaagccaccacaauaa

SEQ ID NO: 1343190 - RNA, 19 nt, Homo sapiens
gcaguucagugcuuggaua

SEQ ID NO: 1343191 - RNA, 19 nt, Homo sapiens
ggaaagaauuggcaugaag

SEQ ID NO: 1343192 - RNA, 19 nt, Homo sapiens
caacaaaugagacaagaaa

SEQ ID NO: 1343193 - RNA, 19 nt, Homo sapiens
gcaaggagaauauaacaug

SEQ ID NO: 1343194 - RNA, 19 nt, Homo sapiens
cgacugauuucuuggcuuu

SEQ ID NO: 1343195 - RNA, 19 nt, Homo sapiens
agacaaauguggaagaaau

SEQ ID NO: 1343196 - RNA, 19 nt, Homo sapiens
gaagggauacuuucagaug

SEQ ID NO: 1343197 - RNA, 19 nt, Homo sapiens
gaguaugucucucuucaug

SEQ ID NO: 1343198 - RNA, 19 nt, Homo sapiens
uaacauguuugcaaaguca

SEQ ID NO: 1343199 - RNA, 19 nt, Homo sapiens
ggaaagugccuugacaauu

SEQ ID NO: 1343200 - RNA, 19 nt, Homo sapiens
guucagugcuuggauaauu

SEQ ID NO: 1343201 - RNA, 19 nt, Homo sapiens
ggauuuaucaucacagaaa

SEQ ID NO: 1343202 - RNA, 19 nt, Homo sapiens
gaaauaauacagcauccuu

SEQ ID NO: 1343203 - RNA, 19 nt, Homo sapiens
ccaaguggauauuauggaa

SEQ ID NO: 1343204 - RNA, 19 nt, Homo sapiens
ccuaacaccuacauauauu

SEQ ID NO: 1343205 - RNA, 19 nt, Homo sapiens
uaaacaacauucccaguag

SEQ ID NO: 1343206 - RNA, 19 nt, Homo sapiens
ggaaggcgccagcgaagaa

SEQ ID NO: 1343207 - RNA, 19 nt, Homo sapiens
gggaagcauuacuggguua

SEQ ID NO: 1343208 - RNA, 19 nt, Homo sapiens
gaaagccaccacaauaaau

SEQ ID NO: 1343209 - RNA, 19 nt, Homo sapiens
ucauagagcuggagacuac

SEQ ID NO: 1343210 - RNA, 19 nt, Homo sapiens
gaaagacaaauguggaaga

SEQ ID NO: 1343211 - RNA, 19 nt, Homo sapiens
gaagcagauuggaguaugu

SEQ ID NO: 1343212 - RNA, 19 nt, Homo sapiens
gugcuuggauaauuugaaa

SEQ ID NO: 1343213 - RNA, 19 nt, Homo sapiens
gaaaguacaauaguugguu

SEQ ID NO: 1343214 - RNA, 19 nt, Homo sapiens
uagagagugcucagaauua

SEQ ID NO: 1343215 - RNA, 19 nt, Homo sapiens
gacaggugcucuagccauu

SEQ ID NO: 1343216 - RNA, 19 nt, Homo sapiens
gaaacacggguccgagaaa

SEQ ID NO: 1343217 - RNA, 19 nt, Homo sapiens
gauauuauggaacucgaua

SEQ ID NO: 1343218 - RNA, 19 nt, Homo sapiens
gaauuggcaugaagcagau

SEQ ID NO: 1343219 - RNA, 19 nt, Homo sapiens
gaauacaucggcagccaaa

SEQ ID NO: 1343220 - RNA, 19 nt, Homo sapiens
aaagacaaauguggaagaa

SEQ ID NO: 1343221 - RNA, 19 nt, Homo sapiens
cuaaacaacauucccagua

SEQ ID NO: 1343222 - RNA, 19 nt, Homo sapiens
acaaacagcagcagaagaa

SEQ ID NO: 1343223 - RNA, 19 nt, Homo sapiens
caaggagaauauaacaugu

SEQ ID NO: 1343224 - RNA, 19 nt, Homo sapiens
ucacucucauccuguauuu

SEQ ID NO: 1343225 - RNA, 19 nt, Homo sapiens
gaucaaagaagggauacuu

SEQ ID NO: 1343226 - RNA, 19 nt, Homo sapiens
gcuauauucuucauacaag

SEQ ID NO: 1343227 - RNA, 19 nt, Homo sapiens
gaauuagggccuggcauuu

SEQ ID NO: 1343228 - RNA, 19 nt, Homo sapiens
cuucauacaagcauaguua

SEQ ID NO: 1343229 - RNA, 19 nt, Homo sapiens
uauauacgccuaacaccua

SEQ ID NO: 1343230 - RNA, 19 nt, Homo sapiens
gcacgccuaucggauguga

SEQ ID NO: 1343231 - RNA, 19 nt, Homo sapiens
gagaaagacaaauguggaa

SEQ ID NO: 1343232 - RNA, 19 nt, Homo sapiens
agagaaacauccuucaaag

SEQ ID NO: 1343233 - RNA, 19 nt, Homo sapiens
ucagaugguugucuugugu

SEQ ID NO: 1343234 - RNA, 19 nt, Homo sapiens
gcaacaugcucagauuaca

SEQ ID NO: 1343235 - RNA, 19 nt, Homo sapiens
aaagccaccacaauaaaua

SEQ ID NO: 1343236 - RNA, 19 nt, Homo sapiens
ggauuguggucaccuggaa

SEQ ID NO: 1343237 - RNA, 19 nt, Homo sapiens
aaauggacaugucaguuau

SEQ ID NO: 1343238 - RNA, 19 nt, Homo sapiens
agcaauaccugacagcaaa

SEQ ID NO: 1343239 - RNA, 19 nt, Homo sapiens
caaggaggcugugcaacau

SEQ ID NO: 1343240 - RNA, 19 nt, Homo sapiens
guaaacaugugccuguaac

SEQ ID NO: 1343241 - RNA, 19 nt, Homo sapiens
aagaagggauacuuucaga

SEQ ID NO: 1343242 - RNA, 19 nt, Homo sapiens
cccaguaguugcuauauuc

SEQ ID NO: 1343243 - RNA, 19 nt, Homo sapiens
gaagccaacaaccauacua

SEQ ID NO: 1343244 - RNA, 19 nt, Homo sapiens
aagaaugcauccuaacguu

SEQ ID NO: 1343245 - RNA, 19 nt, Homo sapiens
caaaugagacaagaaagug

SEQ ID NO: 1343246 - RNA, 19 nt, Homo sapiens
gagcaaggagaauauaaca

SEQ ID NO: 1343247 - RNA, 19 nt, Homo sapiens
aaauagagcaaggagaaua

SEQ ID NO: 1343248 - RNA, 19 nt, Homo sapiens
ggaacaggucuccaaucua

SEQ ID NO: 1343249 - RNA, 19 nt, Homo sapiens
gugcauaccagaauugaau

SEQ ID NO: 1343250 - RNA, 19 nt, Homo sapiens
ucaaaggacaguguuguuu

SEQ ID NO: 1343251 - RNA, 19 nt, Homo sapiens
gaccacaaauggacauguc

SEQ ID NO: 1343252 - RNA, 19 nt, Homo sapiens
caauggauguuugucaugu

SEQ ID NO: 1343253 - RNA, 19 nt, Homo sapiens
gaagaaugcauccuaacgu

SEQ ID NO: 1343254 - RNA, 19 nt, Homo sapiens
agaaagccaccacaauaaa

SEQ ID NO: 1343255 - RNA, 19 nt, Homo sapiens
gaacuaaaagggauacuau

SEQ ID NO: 1343256 - RNA, 19 nt, Homo sapiens
caaucuauguuagcacuau

SEQ ID NO: 1343257 - RNA, 19 nt, Homo sapiens
acuaugcacuugcgacuga

SEQ ID NO: 1343258 - RNA, 19 nt, Homo sapiens
gagaauauaacauguuugc

SEQ ID NO: 1343259 - RNA, 19 nt, Homo sapiens
caagagugcauaccagaau

SEQ ID NO: 1343260 - RNA, 19 nt, Homo sapiens
ccaucacucucauccugua

SEQ ID NO: 1343261 - RNA, 19 nt, Homo sapiens
ggaguucagggaagagaaa

SEQ ID NO: 1343262 - RNA, 19 nt, Homo sapiens
aaagaucaaagaagggaua

SEQ ID NO: 1343263 - RNA, 19 nt, Homo sapiens
caagcauaguuaacaacaa

SEQ ID NO: 1343264 - RNA, 19 nt, Homo sapiens
uccaugagauuauuguaga

SEQ ID NO: 1343265 - RNA, 19 nt, Homo sapiens
caaagaaaucccagagcaa

SEQ ID NO: 1343266 - RNA, 19 nt, Homo sapiens
gaaaguaaagaagcaauac

SEQ ID NO: 1343267 - RNA, 19 nt, Homo sapiens
gaagggagaggaaaagaaa

SEQ ID NO: 1343268 - RNA, 19 nt, Homo sapiens
gaaaguguacagugcaaag

SEQ ID NO: 1343269 - RNA, 19 nt, Homo sapiens
aacaugugccuguaacuua

SEQ ID NO: 1343270 - RNA, 19 nt, Homo sapiens
aagcauuacuggguuacua

SEQ ID NO: 1343271 - RNA, 19 nt, Homo sapiens
aagagaaacauccuucaaa

SEQ ID NO: 1343272 - RNA, 19 nt, Homo sapiens
guaugucucucuucauguc

SEQ ID NO: 1343273 - RNA, 19 nt, Homo sapiens
ccaaggaggcugugcaaca

SEQ ID NO: 1343274 - RNA, 19 nt, Homo sapiens
caggauuuaucaucacaga

SEQ ID NO: 1343275 - RNA, 19 nt, Homo sapiens
ucaugaugcugcuaucuca

SEQ ID NO: 1343276 - RNA, 19 nt, Homo sapiens
agucagcacuguacacuag

SEQ ID NO: 1343277 - RNA, 19 nt, Homo sapiens
ccuaauaaaggagaaagua

SEQ ID NO: 1343278 - RNA, 19 nt, Homo sapiens
acacggguccgagaaauaa

SEQ ID NO: 1343279 - RNA, 19 nt, Homo sapiens
gugcaacaugcucagauua

SEQ ID NO: 1343280 - RNA, 19 nt, Homo sapiens
cagcgaagaaugcauccua

SEQ ID NO: 1343281 - RNA, 19 nt, Homo sapiens
gccuaacaccuacauauau

SEQ ID NO: 1343282 - RNA, 19 nt, Homo sapiens
aguccaagauaaacagaaa

SEQ ID NO: 1343283 - RNA, 19 nt, Homo sapiens
caaaggaagaagugucaga

SEQ ID NO: 1343284 - RNA, 19 nt, Homo sapiens
gaagaagccuguauccuua

SEQ ID NO: 1343285 - RNA, 19 nt, Homo sapiens
ggaaggaacuuuagaugaa

SEQ ID NO: 1343286 - RNA, 19 nt, Homo sapiens
gaaacacccucaucauuug

SEQ ID NO: 1343287 - RNA, 19 nt, Homo sapiens
ggaaagauguaagaaguuu

SEQ ID NO: 1343288 - RNA, 19 nt, Homo sapiens
ggaaacacccucaucauuu

SEQ ID NO: 1343289 - RNA, 19 nt, Homo sapiens
gaacugagaagacuuggua

SEQ ID NO: 1343290 - RNA, 19 nt, Homo sapiens
guacauaccaggaaucaua

SEQ ID NO: 1343291 - RNA, 19 nt, Homo sapiens
gagaagacuugguaauuga

SEQ ID NO: 1343292 - RNA, 19 nt, Homo sapiens
ucacagaacuuucagucua

SEQ ID NO: 1343293 - RNA, 19 nt, Homo sapiens
gaaguuugaucuugaaugu

SEQ ID NO: 1343294 - RNA, 19 nt, Homo sapiens
gaagauauuuaccaguuug

SEQ ID NO: 1343295 - RNA, 19 nt, Homo sapiens
aaagagacaucuaaacuga

SEQ ID NO: 1343296 - RNA, 19 nt, Homo sapiens
gggaagagauaauuacaau

SEQ ID NO: 1343297 - RNA, 19 nt, Homo sapiens
gggaauaccuggucuucaa

SEQ ID NO: 1343298 - RNA, 19 nt, Homo sapiens
gaaggaacuuuagaugaaa

SEQ ID NO: 1343299 - RNA, 19 nt, Homo sapiens
gcuuugcucucccauaaua

SEQ ID NO: 1343300 - RNA, 19 nt, Homo sapiens
ggaguaggcucugcucuga

SEQ ID NO: 1343301 - RNA, 19 nt, Homo sapiens
ggacacagagauauuauga

SEQ ID NO: 1343302 - RNA, 19 nt, Homo sapiens
ccucuuaguuucuucauaa

SEQ ID NO: 1343303 - RNA, 19 nt, Homo sapiens
gagucuaccugggcaauua

SEQ ID NO: 1343304 - RNA, 19 nt, Homo sapiens
gaucuugaauguagacaau

SEQ ID NO: 1343305 - RNA, 19 nt, Homo sapiens
gacaggcucuccuaccuuu

SEQ ID NO: 1343306 - RNA, 19 nt, Homo sapiens
ugagaagacuugguaauug

SEQ ID NO: 1343307 - RNA, 19 nt, Homo sapiens
caccuuagaugaugcauau

SEQ ID NO: 1343308 - RNA, 19 nt, Homo sapiens
ccagguaccuugccaggaa

SEQ ID NO: 1343309 - RNA, 19 nt, Homo sapiens
caacuuaguggcucuguuu

SEQ ID NO: 1343310 - RNA, 19 nt, Homo sapiens
ccaaagccuuccaugauga

SEQ ID NO: 1343311 - RNA, 19 nt, Homo sapiens
gaucauugacuuccuugua

SEQ ID NO: 1343312 - RNA, 19 nt, Homo sapiens
ggaauaagaguuugagcuu

SEQ ID NO: 1343313 - RNA, 19 nt, Homo sapiens
gaaauaauccaggccaaga

SEQ ID NO: 1343314 - RNA, 19 nt, Homo sapiens
gaacucacacgcaguccua

SEQ ID NO: 1343315 - RNA, 19 nt, Homo sapiens
gcacagggaauguaacaga

SEQ ID NO: 1343316 - RNA, 19 nt, Homo sapiens
ggaggaggaaggaacuuua

SEQ ID NO: 1343317 - RNA, 19 nt, Homo sapiens
agagaaacauggauuacuu

SEQ ID NO: 1343318 - RNA, 19 nt, Homo sapiens
caacagccaacacucauuu

SEQ ID NO: 1343319 - RNA, 19 nt, Homo sapiens
acagagagcugccuggaau

SEQ ID NO: 1343320 - RNA, 19 nt, Homo sapiens
gggaaacacccucaucauu

SEQ ID NO: 1343321 - RNA, 19 nt, Homo sapiens
gagcaggucgugauacuga

SEQ ID NO: 1343322 - RNA, 19 nt, Homo sapiens
caaauuccuuuuccucuua

SEQ ID NO: 1343323 - RNA, 19 nt, Homo sapiens
guggaaagauguaagaagu

SEQ ID NO: 1343324 - RNA, 19 nt, Homo sapiens
ugauaagucugaaguggaa

SEQ ID NO: 1343325 - RNA, 19 nt, Homo sapiens
gaugagaagaggaaacaaa

SEQ ID NO: 1343326 - RNA, 19 nt, Homo sapiens
gaccuacccugccuuguuc

SEQ ID NO: 1343327 - RNA, 19 nt, Homo sapiens
ggaccuacccugccuuguu

SEQ ID NO: 1343328 - RNA, 19 nt, Homo sapiens
ggaaugggagcucgugauu

SEQ ID NO: 1343329 - RNA, 19 nt, Homo sapiens
gaaguggaaagauguaaga

SEQ ID NO: 1343330 - RNA, 19 nt, Homo sapiens
ugaagaagccuguauccuu

SEQ ID NO: 1343331 - RNA, 19 nt, Homo sapiens
gaugggauuugaucugaau

SEQ ID NO: 1343332 - RNA, 19 nt, Homo sapiens
gguguucucugaugggauu

SEQ ID NO: 1343333 - RNA, 19 nt, Homo sapiens
caccauguccggcuaauuu

SEQ ID NO: 1343334 - RNA, 19 nt, Homo sapiens
uagaugaaaugaacucugu

SEQ ID NO: 1343335 - RNA, 19 nt, Homo sapiens
guugaucuaugucuccuuu

SEQ ID NO: 1343336 - RNA, 19 nt, Homo sapiens
guagagaggcuaugcacaa

SEQ ID NO: 1343337 - RNA, 19 nt, Homo sapiens
gcauuaggaggcuguuaua

SEQ ID NO: 1343338 - RNA, 19 nt, Homo sapiens
uaacagaucguggcagauu

SEQ ID NO: 1343339 - RNA, 19 nt, Homo sapiens
aggaagagcuugaugaucu

SEQ ID NO: 1343340 - RNA, 19 nt, Homo sapiens
gaagggaggaugugguaga

SEQ ID NO: 1343341 - RNA, 19 nt, Homo sapiens
gagaacauacuaaagacaa

SEQ ID NO: 1343342 - RNA, 19 nt, Homo sapiens
agaaggcucugggacauuu

SEQ ID NO: 1343343 - RNA, 19 nt, Homo sapiens
ggugaguguuuauggaauu

SEQ ID NO: 1343344 - RNA, 19 nt, Homo sapiens
ggagguagaagugcucuuu

SEQ ID NO: 1343345 - RNA, 19 nt, Homo sapiens
gccaagggaucauugacuu

SEQ ID NO: 1343346 - RNA, 19 nt, Homo sapiens
ccaaagugcugagauuaca

SEQ ID NO: 1343347 - RNA, 19 nt, Homo sapiens
acagagaacauacuaaaga

SEQ ID NO: 1343348 - RNA, 19 nt, Homo sapiens
gaggaggccugcccuuagu

SEQ ID NO: 1343349 - RNA, 19 nt, Homo sapiens
acagagauauuaugauugg

SEQ ID NO: 1343350 - RNA, 19 nt, Homo sapiens
ucucuuuccuuacuucuuu

SEQ ID NO: 1343351 - RNA, 19 nt, Homo sapiens
ggaccacacuuccuauugc

SEQ ID NO: 1343352 - RNA, 19 nt, Homo sapiens
agagacaucuaaacugaga

SEQ ID NO: 1343353 - RNA, 19 nt, Homo sapiens
acacucgcuuccaacauua

SEQ ID NO: 1343354 - RNA, 19 nt, Homo sapiens
gaacguggcaugacuuagg

SEQ ID NO: 1343355 - RNA, 19 nt, Homo sapiens
gaucuugacuccuucuaac

SEQ ID NO: 1343356 - RNA, 19 nt, Homo sapiens
aauaagaguuugagcuugu

SEQ ID NO: 1343357 - RNA, 19 nt, Homo sapiens
ggauggaggugcuucuucu

SEQ ID NO: 1343358 - RNA, 19 nt, Homo sapiens
gcuuacugcuacccauaua

SEQ ID NO: 1343359 - RNA, 19 nt, Homo sapiens
gacaauggaaggacagauu

SEQ ID NO: 1343360 - RNA, 19 nt, Homo sapiens
aaacacagcauuaguacau

SEQ ID NO: 1343361 - RNA, 19 nt, Homo sapiens
uuacagguguucucugaug

SEQ ID NO: 1343362 - RNA, 19 nt, Homo sapiens
uagcagagaugggguuuua

SEQ ID NO: 1343363 - RNA, 19 nt, Homo sapiens
uacacucgcuuccaacauu

SEQ ID NO: 1343364 - RNA, 19 nt, Homo sapiens
acugagaguucccuaugua

SEQ ID NO: 1343365 - RNA, 19 nt, Homo sapiens
caucuaagcuaugcaaguc

SEQ ID NO: 1343366 - RNA, 19 nt, Homo sapiens
guagaauacuuagaaugug

SEQ ID NO: 1343367 - RNA, 19 nt, Homo sapiens
aaauccaggugagaaauaa

SEQ ID NO: 1343368 - RNA, 19 nt, Homo sapiens
ggcaauggcccuagaagga

SEQ ID NO: 1343369 - RNA, 19 nt, Homo sapiens
ccagaaugcugaggacuuc

SEQ ID NO: 1343370 - RNA, 19 nt, Homo sapiens
gagaagaggaaacaaacug

SEQ ID NO: 1343371 - RNA, 19 nt, Homo sapiens
acagggacaugcauuagga

SEQ ID NO: 1343372 - RNA, 19 nt, Homo sapiens
gacuucagacucaaugaua

SEQ ID NO: 1343373 - RNA, 19 nt, Homo sapiens
gguaugggcagaagcugua

SEQ ID NO: 1343374 - RNA, 19 nt, Homo sapiens
gaacauacuaaagacaaga

SEQ ID NO: 1343375 - RNA, 19 nt, Homo sapiens
caacccuuauucauaguga

SEQ ID NO: 1343376 - RNA, 19 nt, Homo sapiens
cugcaacccuuauucauag

SEQ ID NO: 1343377 - RNA, 19 nt, Homo sapiens
cuuaguggcucuguuugua

SEQ ID NO: 1343378 - RNA, 19 nt, Homo sapiens
aauuacagguguucucuga

SEQ ID NO: 1343379 - RNA, 19 nt, Homo sapiens
gaaaagggaagagauaauu

SEQ ID NO: 1343380 - RNA, 19 nt, Homo sapiens
ccaacacucauuuaucaaa

SEQ ID NO: 1343381 - RNA, 19 nt, Homo sapiens
agccaacacucauuuauca

SEQ ID NO: 1343382 - RNA, 19 nt, Homo sapiens
uugcuuugcucucccauaa

SEQ ID NO: 1343383 - RNA, 19 nt, Homo sapiens
gaugaaaugaacucuguau

SEQ ID NO: 1343384 - RNA, 19 nt, Homo sapiens
gaacaucccucgucuuguc

SEQ ID NO: 1343385 - RNA, 19 nt, Homo sapiens
gaggauggcuauaagaaga

SEQ ID NO: 1343386 - RNA, 19 nt, Homo sapiens
gcagaggagugcagacuga

SEQ ID NO: 1343387 - RNA, 19 nt, Homo sapiens
ccacucccauggugacuua

SEQ ID NO: 1343388 - RNA, 19 nt, Homo sapiens
gauaggagccuucagacaa

SEQ ID NO: 1343389 - RNA, 19 nt, Homo sapiens
guagagacuucuugaggaa

SEQ ID NO: 1343390 - RNA, 19 nt, Homo sapiens
caccaagaguggcaagaua

SEQ ID NO: 1343391 - RNA, 19 nt, Homo sapiens
ggaaagccaggaaagauug

SEQ ID NO: 1343392 - RNA, 19 nt, Homo sapiens
uaaagaagcaggucagcaa

SEQ ID NO: 1343393 - RNA, 19 nt, Homo sapiens
gcaacgggauuuugaguuu

SEQ ID NO: 1343394 - RNA, 19 nt, Homo sapiens
ugggaaagcugggaccaua

SEQ ID NO: 1343395 - RNA, 19 nt, Homo sapiens
ggguugggaugguguguuu

SEQ ID NO: 1343396 - RNA, 19 nt, Homo sapiens
ggaagcggguagaggaguu

SEQ ID NO: 1343397 - RNA, 19 nt, Homo sapiens
gcaaggaggaggucccuau

SEQ ID NO: 1343398 - RNA, 19 nt, Homo sapiens
ggacaagagacuacaagga

SEQ ID NO: 1343399 - RNA, 19 nt, Homo sapiens
caggaaagauugggaagug

SEQ ID NO: 1343400 - RNA, 19 nt, Homo sapiens
caagagacuacaaggagua

SEQ ID NO: 1343401 - RNA, 19 nt, Homo sapiens
ggaugaggauggcuauaag

SEQ ID NO: 1343402 - RNA, 19 nt, Homo sapiens
gggaaagccaggaaagauu

SEQ ID NO: 1343403 - RNA, 19 nt, Homo sapiens
caaguuccgucaccugcaa

SEQ ID NO: 1343404 - RNA, 19 nt, Homo sapiens
ugagcgagguguccaacuu

SEQ ID NO: 1343405 - RNA, 19 nt, Homo sapiens
gagagaaggccugauagga

SEQ ID NO: 1343406 - RNA, 19 nt, Homo sapiens
gcaaccugcuggccaccaa

SEQ ID NO: 1343407 - RNA, 19 nt, Homo sapiens
ggguagaggaguuaaagaa

SEQ ID NO: 1343408 - RNA, 19 nt, Homo sapiens
agaaugccaugcucaggaa

SEQ ID NO: 1343409 - RNA, 19 nt, Homo sapiens
gccaugacuuccagaacaa

SEQ ID NO: 1343410 - RNA, 19 nt, Homo sapiens
gagcauucauuacccuagu

SEQ ID NO: 1343411 - RNA, 19 nt, Homo sapiens
ccagagaucacgccacugu

SEQ ID NO: 1343412 - RNA, 19 nt, Homo sapiens
gaagcggguagaggaguua

SEQ ID NO: 1343413 - RNA, 19 nt, Homo sapiens
cggcugaccuaccaaaugg

SEQ ID NO: 1343414 - RNA, 19 nt, Homo sapiens
gagaggaaggacugacuga

SEQ ID NO: 1343415 - RNA, 19 nt, Homo sapiens
gagacuacaaggaguaugu

SEQ ID NO: 1343416 - RNA, 19 nt, Homo sapiens
ggaaagcugggaccauagu

SEQ ID NO: 1343417 - RNA, 19 nt, Homo sapiens
ccaagaguggcaagauaaa

SEQ ID NO: 1343418 - RNA, 19 nt, Homo sapiens
ugcccuggcucaaacaauu

SEQ ID NO: 1343419 - RNA, 19 nt, Homo sapiens
ccacugcaccagcgacuga

SEQ ID NO: 1343420 - RNA, 19 nt, Homo sapiens
uagaggaguuaaagaagca

SEQ ID NO: 1343421 - RNA, 19 nt, Homo sapiens
guuggacaauacaggaauu

SEQ ID NO: 1343422 - RNA, 19 nt, Homo sapiens
caugaucucuaugauaucu

SEQ ID NO: 1343423 - RNA, 19 nt, Homo sapiens
uaagaagacaggagagcuu

SEQ ID NO: 1343424 - RNA, 19 nt, Homo sapiens
gcauucauuacccuaguuu

SEQ ID NO: 1343425 - RNA, 19 nt, Homo sapiens
uugcuuggguuggacaaua

SEQ ID NO: 1343426 - RNA, 19 nt, Homo sapiens
agagacuucuugaggaaug

SEQ ID NO: 1343427 - RNA, 19 nt, Homo sapiens
cauggugacuuacccuauc

SEQ ID NO: 1343428 - RNA, 19 nt, Homo sapiens
gaugaggauggcuauaaga

SEQ ID NO: 1343429 - RNA, 19 nt, Homo sapiens
gagcgagguguccaacuug

SEQ ID NO: 1343430 - RNA, 19 nt, Homo sapiens
auaggagccuucagacaau

SEQ ID NO: 1343431 - RNA, 19 nt, Homo sapiens
gagggaaagccaggaaaga

SEQ ID NO: 1343432 - RNA, 19 nt, Homo sapiens
gcaaucaggccaaggucau

SEQ ID NO: 1343433 - RNA, 19 nt, Homo sapiens
ggccaccaaugagguacua

SEQ ID NO: 1343434 - RNA, 19 nt, Homo sapiens
ucagacaauuuggguccua

SEQ ID NO: 1343435 - RNA, 19 nt, Homo sapiens
ugccaugacuuccagaaca

SEQ ID NO: 1343436 - RNA, 19 nt, Homo sapiens
ggagagaaggccugauagg

SEQ ID NO: 1343437 - RNA, 19 nt, Homo sapiens
gcacugguuuuagaagaaa

SEQ ID NO: 1343438 - RNA, 19 nt, Homo sapiens
cagcugcccuggcucaaac

SEQ ID NO: 1343439 - RNA, 19 nt, Homo sapiens
uaaagaaaacccugaguug

SEQ ID NO: 1343440 - RNA, 19 nt, Homo sapiens
caaucaggccaaggucaua

SEQ ID NO: 1343441 - RNA, 19 nt, Homo sapiens
gagguacuacuggaacaaa

SEQ ID NO: 1343442 - RNA, 19 nt, Homo sapiens
gacaauuuggguccuaguu

SEQ ID NO: 1343443 - RNA, 19 nt, Homo sapiens
caaauugccguuucaucca

SEQ ID NO: 1343444 - RNA, 19 nt, Homo sapiens
gguagaggaguuaaagaag

SEQ ID NO: 1343445 - RNA, 19 nt, Homo sapiens
aagaguggcaagauaaaga

SEQ ID NO: 1343446 - RNA, 19 nt, Homo sapiens
caucuucugccaugacuuc

SEQ ID NO: 1343447 - RNA, 19 nt, Homo sapiens
ggaggaugaggauggcuau

SEQ ID NO: 1343448 - RNA, 19 nt, Homo sapiens
uacccuaguuugaccugaa

SEQ ID NO: 1343449 - RNA, 19 nt, Homo sapiens
gaaagcugggaccauagug

SEQ ID NO: 1343450 - RNA, 19 nt, Homo sapiens
gcacuguugccacuuuuaa

SEQ ID NO: 1343451 - RNA, 19 nt, Homo sapiens
uaggagccuucagacaauu

SEQ ID NO: 1343452 - RNA, 19 nt, Homo sapiens
gaugguguguuuucucuca

SEQ ID NO: 1343453 - RNA, 19 nt, Homo sapiens
aggaugaggauggcuauaa

SEQ ID NO: 1343454 - RNA, 19 nt, Homo sapiens
ucccagagcaugcgcauca

SEQ ID NO: 1343455 - RNA, 19 nt, Homo sapiens
aggaggaggucccuaucug

SEQ ID NO: 1343456 - RNA, 19 nt, Homo sapiens
ggauggcuauaagaagaca

SEQ ID NO: 1343457 - RNA, 19 nt, Homo sapiens
ccuaguugcuuggguugga

SEQ ID NO: 1343458 - RNA, 19 nt, Homo sapiens
acaauuuggguccuaguug

SEQ ID NO: 1343459 - RNA, 19 nt, Homo sapiens
cgauaucgccacccagaca

SEQ ID NO: 1343460 - RNA, 19 nt, Homo sapiens
accaagaguggcaagauaa

SEQ ID NO: 1343461 - RNA, 19 nt, Homo sapiens
agagaucacgccacuguca

SEQ ID NO: 1343462 - RNA, 19 nt, Homo sapiens
gagacuucuugaggaaugu

SEQ ID NO: 1343463 - RNA, 19 nt, Homo sapiens
gaaagccaggaaagauugg

SEQ ID NO: 1343464 - RNA, 19 nt, Homo sapiens
ccagagggaaagccaggaa

SEQ ID NO: 1343465 - RNA, 19 nt, Homo sapiens
uggcaggaaucacaaugag

SEQ ID NO: 1343466 - RNA, 19 nt, Homo sapiens
caaugagguacuacuggaa

SEQ ID NO: 1343467 - RNA, 19 nt, Homo sapiens
gcuggccaccaaugaggua

SEQ ID NO: 1343468 - RNA, 19 nt, Homo sapiens
gaggagccaagugcaaguu

SEQ ID NO: 1343469 - RNA, 19 nt, Homo sapiens
aaauugccguuucauccau

SEQ ID NO: 1343470 - RNA, 19 nt, Homo sapiens
aaacaauugcccagggaau

SEQ ID NO: 1343471 - RNA, 19 nt, Homo sapiens
ggagccuucagacaauuug

SEQ ID NO: 1343472 - RNA, 19 nt, Homo sapiens
gaggaugaggauggcuaua

SEQ ID NO: 1343473 - RNA, 19 nt, Homo sapiens
agaguggcaagauaaagaa

SEQ ID NO: 1343474 - RNA, 19 nt, Homo sapiens
gcccuugcccacucaccua

SEQ ID NO: 1343475 - RNA, 19 nt, Homo sapiens
ggacugagauguacaauug

SEQ ID NO: 1343476 - RNA, 19 nt, Homo sapiens
gaaagcaucuagacaguaa

SEQ ID NO: 1343477 - RNA, 19 nt, Homo sapiens
gaagauuguuagcacauua

SEQ ID NO: 1343478 - RNA, 19 nt, Homo sapiens
ccaaaucacuugacauauu

SEQ ID NO: 1343479 - RNA, 19 nt, Homo sapiens
ggacagauauucaacacuu

SEQ ID NO: 1343480 - RNA, 19 nt, Homo sapiens
aaagaaaguugccauagua

SEQ ID NO: 1343481 - RNA, 19 nt, Homo sapiens
acacagggauugcaaauuu

SEQ ID NO: 1343482 - RNA, 19 nt, Homo sapiens
gaaaggagcuagcaguucu

SEQ ID NO: 1343483 - RNA, 19 nt, Homo sapiens
cuucaggucuugcuuaaua

SEQ ID NO: 1343484 - RNA, 19 nt, Homo sapiens
gcaauacagucagcaaauu

SEQ ID NO: 1343485 - RNA, 19 nt, Homo sapiens
gaaaucacacucucugaaa

SEQ ID NO: 1343486 - RNA, 19 nt, Homo sapiens
gagugaagcuuccaaagug

SEQ ID NO: 1343487 - RNA, 19 nt, Homo sapiens
gggauuugcuuguauguau

SEQ ID NO: 1343488 - RNA, 19 nt, Homo sapiens
caucguaccuguaaccauu

SEQ ID NO: 1343489 - RNA, 19 nt, Homo sapiens
gcaaccauacuacuaauuu

SEQ ID NO: 1343490 - RNA, 19 nt, Homo sapiens
uaaauuaacugcugagaac

SEQ ID NO: 1343491 - RNA, 19 nt, Homo sapiens
caaagaaaguugccauagu

SEQ ID NO: 1343492 - RNA, 19 nt, Homo sapiens
gcaaacauguggcaaggau

SEQ ID NO: 1343493 - RNA, 19 nt, Homo sapiens
cagaaagucuuccucaaug

SEQ ID NO: 1343494 - RNA, 19 nt, Homo sapiens
gaaagucuuccucaaugua

SEQ ID NO: 1343495 - RNA, 19 nt, Homo sapiens
gcgagugguuggacagaua

SEQ ID NO: 1343496 - RNA, 19 nt, Homo sapiens
aaagugcuguggaagaaua

SEQ ID NO: 1343497 - RNA, 19 nt, Homo sapiens
ggaaaggacugagauguac

SEQ ID NO: 1343498 - RNA, 19 nt, Homo sapiens
aauaagaacuugcagacaa

SEQ ID NO: 1343499 - RNA, 19 nt, Homo sapiens
uaacauagcaauacaguca

SEQ ID NO: 1343500 - RNA, 19 nt, Homo sapiens
ucacagcaccacuuaauaa

SEQ ID NO: 1343501 - RNA, 19 nt, Homo sapiens
cagcaauguuguuauguuu

SEQ ID NO: 1343502 - RNA, 19 nt, Homo sapiens
ggaguuauuuauucucaga

SEQ ID NO: 1343503 - RNA, 19 nt, Homo sapiens
caagggcacugauggauuc

SEQ ID NO: 1343504 - RNA, 19 nt, Homo sapiens
gaaauugaaagcagaguau

SEQ ID NO: 1343505 - RNA, 19 nt, Homo sapiens
cacauuaucuguugcaguu

SEQ ID NO: 1343506 - RNA, 19 nt, Homo sapiens
ggacagacaccauuaacau

SEQ ID NO: 1343507 - RNA, 19 nt, Homo sapiens
cagcaaauuucucuucaga

SEQ ID NO: 1343508 - RNA, 19 nt, Homo sapiens
gaaaguugccauaguaaca

SEQ ID NO: 1343509 - RNA, 19 nt, Homo sapiens
ucaaagugcuguggaagaa

SEQ ID NO: 1343510 - RNA, 19 nt, Homo sapiens
ggagagauagaauuacaaa

SEQ ID NO: 1343511 - RNA, 19 nt, Homo sapiens
caaaaugacuccugaugaa

SEQ ID NO: 1343512 - RNA, 19 nt, Homo sapiens
agaguaccauuguuccuua

SEQ ID NO: 1343513 - RNA, 19 nt, Homo sapiens
ggaaaucacacucucugaa

SEQ ID NO: 1343514 - RNA, 19 nt, Homo sapiens
caucagcaauguuguuaug

SEQ ID NO: 1343515 - RNA, 19 nt, Homo sapiens
gacauggucuuuaguccaa

SEQ ID NO: 1343516 - RNA, 19 nt, Homo sapiens
gagaacaucacuagugcua

SEQ ID NO: 1343517 - RNA, 19 nt, Homo sapiens
ggaugugcacugucuguua

SEQ ID NO: 1343518 - RNA, 19 nt, Homo sapiens
ccucaaaaguccuaaaaua

SEQ ID NO: 1343519 - RNA, 19 nt, Homo sapiens
guaccauuguuccuuauau

SEQ ID NO: 1343520 - RNA, 19 nt, Homo sapiens
cuggaaaccucuccgagua

SEQ ID NO: 1343521 - RNA, 19 nt, Homo sapiens
guuagcacauuaucuguug

SEQ ID NO: 1343522 - RNA, 19 nt, Homo sapiens
caagacaugcggcuuugua

SEQ ID NO: 1343523 - RNA, 19 nt, Homo sapiens
ggaaauugaaagcagagua

SEQ ID NO: 1343524 - RNA, 19 nt, Homo sapiens
uaaaggacacaaagagaaa

SEQ ID NO: 1343525 - RNA, 19 nt, Homo sapiens
uuaccuggauucuagcaua

SEQ ID NO: 1343526 - RNA, 19 nt, Homo sapiens
ggaguggauuugugguuug

SEQ ID NO: 1343527 - RNA, 19 nt, Homo sapiens
gaagaaaagaagcuaguua

SEQ ID NO: 1343528 - RNA, 19 nt, Homo sapiens
caauacagucagcaaauuu

SEQ ID NO: 1343529 - RNA, 19 nt, Homo sapiens
gagcaaauggagacuuauu

SEQ ID NO: 1343530 - RNA, 19 nt, Homo sapiens
aauggcagauguauuugua

SEQ ID NO: 1343531 - RNA, 19 nt, Homo sapiens
gcugguggcugucgugugu

SEQ ID NO: 1343532 - RNA, 19 nt, Homo sapiens
ggauuugcuuguauguauu

SEQ ID NO: 1343533 - RNA, 19 nt, Homo sapiens
gagcuucaggucuugcuua

SEQ ID NO: 1343534 - RNA, 19 nt, Homo sapiens
gcaaggauacuccaaaugc

SEQ ID NO: 1343535 - RNA, 19 nt, Homo sapiens
auaauggacuugguaguuu

SEQ ID NO: 1343536 - RNA, 19 nt, Homo sapiens
ggaaagcaucuagacagua

SEQ ID NO: 1343537 - RNA, 19 nt, Homo sapiens
gaaccuaacauagcaauac

SEQ ID NO: 1343538 - RNA, 19 nt, Homo sapiens
uugagcaaauggagacuua

SEQ ID NO: 1343539 - RNA, 19 nt, Homo sapiens
cagcaccacuuaauaacau

SEQ ID NO: 1343540 - RNA, 19 nt, Homo sapiens
gaugucacagcaccacuua

SEQ ID NO: 1343541 - RNA, 19 nt, Homo sapiens
gaccauccuugcaaacaug

SEQ ID NO: 1343542 - RNA, 19 nt, Homo sapiens
ucagcaauguuguuauguu

SEQ ID NO: 1343543 - RNA, 19 nt, Homo sapiens
aaucagugguggaaccuaa

SEQ ID NO: 1343544 - RNA, 19 nt, Homo sapiens
ggaccauccuugcaaacau

SEQ ID NO: 1343545 - RNA, 19 nt, Homo sapiens
cuguuucucuccuuuauuu

SEQ ID NO: 1343546 - RNA, 19 nt, Homo sapiens
gcaaaggaaagcaucuaga

SEQ ID NO: 1343547 - RNA, 19 nt, Homo sapiens
gguggaaccuaacauagca

SEQ ID NO: 1343548 - RNA, 19 nt, Homo sapiens
gaaggaugaggaaauugaa

SEQ ID NO: 1343549 - RNA, 19 nt, Homo sapiens
gaugugcacugucuguuac

SEQ ID NO: 1343550 - RNA, 19 nt, Homo sapiens
gaaggacugggacacauau

SEQ ID NO: 1343551 - RNA, 19 nt, Homo sapiens
gacaugcggcuuuguaguu

SEQ ID NO: 1343552 - RNA, 19 nt, Homo sapiens
aaccuuacaugaacgcuuu

SEQ ID NO: 1343553 - RNA, 19 nt, Homo sapiens
ccgccuuacugcacuauuu

SEQ ID NO: 1343554 - RNA, 19 nt, Homo sapiens
ggucuggcucucacaguua

SEQ ID NO: 1343555 - RNA, 19 nt, Homo sapiens
gcugagaacaucacuagug

SEQ ID NO: 1343556 - RNA, 19 nt, Homo sapiens
uuaaucaccucguuugagu

SEQ ID NO: 1343557 - RNA, 19 nt, Homo sapiens
gaacccaaugguguuauaa

SEQ ID NO: 1343558 - RNA, 19 nt, Homo sapiens
agaacccaaugguguuaua

SEQ ID NO: 1343559 - RNA, 19 nt, Homo sapiens
ccucggcauuucauucuuu

SEQ ID NO: 1343560 - RNA, 19 nt, Homo sapiens
ucccaaaucacuugacaua

SEQ ID NO: 1343561 - RNA, 19 nt, Homo sapiens
gcugcaaccauacuacuaa

SEQ ID NO: 1343562 - RNA, 19 nt, Homo sapiens
gaauuucacacaacauaca

SEQ ID NO: 1343563 - RNA, 19 nt, Homo sapiens
ugaaggaugaggaaauuga

SEQ ID NO: 1343564 - RNA, 19 nt, Homo sapiens
cgaaggacugggacacaua

SEQ ID NO: 1343565 - RNA, 19 nt, Homo sapiens
gcaaaacugaugaaaauga

SEQ ID NO: 1343566 - RNA, 19 nt, Homo sapiens
caacgcuuauugagcaaau

SEQ ID NO: 1343567 - RNA, 19 nt, Homo sapiens
ugccgugccuggaaccuua

SEQ ID NO: 1343568 - RNA, 19 nt, Homo sapiens
ucaaagaguugcugcuacu

SEQ ID NO: 1343569 - RNA, 19 nt, Homo sapiens
gcagguagaggaugucaca

SEQ ID NO: 1343570 - RNA, 19 nt, Homo sapiens
cacacaacauacaagagua

SEQ ID NO: 1343571 - RNA, 19 nt, Homo sapiens
gaucgucuucagcuacaua

SEQ ID NO: 1343572 - RNA, 19 nt, Homo sapiens
cauaauggacuugguaguu

SEQ ID NO: 1343573 - RNA, 19 nt, Homo sapiens
ucagaaagucuuccucaau

SEQ ID NO: 1343574 - RNA, 19 nt, Homo sapiens
caaccuccucuuuguguuu

SEQ ID NO: 1343575 - RNA, 19 nt, Homo sapiens
gagcaacucuucaaauuua

SEQ ID NO: 1343576 - RNA, 19 nt, Homo sapiens
gaucagaggaugcauauua

SEQ ID NO: 1343577 - RNA, 19 nt, Homo sapiens
ggagaaggaucuuauaaau

SEQ ID NO: 1343578 - RNA, 19 nt, Homo sapiens
ggucauauuucaucccuua

SEQ ID NO: 1343579 - RNA, 19 nt, Homo sapiens
ggaagagccuuuggucaua

SEQ ID NO: 1343580 - RNA, 19 nt, Homo sapiens
gggagaagcuuagguuuaa

SEQ ID NO: 1343581 - RNA, 19 nt, Homo sapiens
uaacgacacuugugcauug

SEQ ID NO: 1343582 - RNA, 19 nt, Homo sapiens
agagaaaccuuacaaaugu

SEQ ID NO: 1343583 - RNA, 19 nt, Homo sapiens
agacaucacuggaacuuaa

SEQ ID NO: 1343584 - RNA, 19 nt, Homo sapiens
gagagaaaccuuacaaaug

SEQ ID NO: 1343585 - RNA, 19 nt, Homo sapiens
ggagagaaauccuacaagu

SEQ ID NO: 1343586 - RNA, 19 nt, Homo sapiens
ccacaucaggcaauaauua

SEQ ID NO: 1343587 - RNA, 19 nt, Homo sapiens
uaagaucaguccuuguuaa

SEQ ID NO: 1343588 - RNA, 19 nt, Homo sapiens
cauacugcaucccuuauua

SEQ ID NO: 1343589 - RNA, 19 nt, Homo sapiens
gagagaaacccuacaaaug

SEQ ID NO: 1343590 - RNA, 19 nt, Homo sapiens
gagagaaacccuacaaaug

SEQ ID NO: 1343591 - RNA, 19 nt, Homo sapiens
uagcagagauuauaaaugg

SEQ ID NO: 1343592 - RNA, 19 nt, Homo sapiens
ggucacacuucaucccuua

SEQ ID NO: 1343593 - RNA, 19 nt, Homo sapiens
gcaauggaguggucuagga

SEQ ID NO: 1343594 - RNA, 19 nt, Homo sapiens
gaagagggaacaaccaauu

SEQ ID NO: 1343595 - RNA, 19 nt, Homo sapiens
gaaacccugucucuccuaa

SEQ ID NO: 1343596 - RNA, 19 nt, Homo sapiens
guucacagcuguaguaugg

SEQ ID NO: 1343597 - RNA, 19 nt, Homo sapiens
gagaaucccugucaauguc

SEQ ID NO: 1343598 - RNA, 19 nt, Homo sapiens
ugagaaagguagacagcua

SEQ ID NO: 1343599 - RNA, 19 nt, Homo sapiens
gcuguaguauggagauuaa

SEQ ID NO: 1343600 - RNA, 19 nt, Homo sapiens
ugacaugccuuggccuaua

SEQ ID NO: 1343601 - RNA, 19 nt, Homo sapiens
gaaaccacgugaauguaau

SEQ ID NO: 1343602 - RNA, 19 nt, Homo sapiens
ggagagaaaccuuacaaau

SEQ ID NO: 1343603 - RNA, 19 nt, Homo sapiens
gagagacaccugaaacaaa

SEQ ID NO: 1343604 - RNA, 19 nt, Homo sapiens
guauggagauuaauagaca

SEQ ID NO: 1343605 - RNA, 19 nt, Homo sapiens
cuacaagugugguaaguau

SEQ ID NO: 1343606 - RNA, 19 nt, Homo sapiens
caucacucauugugcauua

SEQ ID NO: 1343607 - RNA, 19 nt, Homo sapiens
gaagagccuuuggucauau

SEQ ID NO: 1343608 - RNA, 19 nt, Homo sapiens
gcacauguuaccuuucuuu

SEQ ID NO: 1343609 - RNA, 19 nt, Homo sapiens
ggaggagccuuaucaaugc

SEQ ID NO: 1343610 - RNA, 19 nt, Homo sapiens
gggaggagccuuaucaaug

SEQ ID NO: 1343611 - RNA, 19 nt, Homo sapiens
ggagagaaacccuacaaau

SEQ ID NO: 1343612 - RNA, 19 nt, Homo sapiens
ggagagaaacccuacaaau

SEQ ID NO: 1343613 - RNA, 19 nt, Homo sapiens
gggagagccuucagccaaa

SEQ ID NO: 1343614 - RNA, 19 nt, Homo sapiens
cauguuaccuuucuuugug

SEQ ID NO: 1343615 - RNA, 19 nt, Homo sapiens
ccacgugaauguaaugaau

SEQ ID NO: 1343616 - RNA, 19 nt, Homo sapiens
caaaccucauugcuuuaua

SEQ ID NO: 1343617 - RNA, 19 nt, Homo sapiens
gagagauccuaaaggugua

SEQ ID NO: 1343618 - RNA, 19 nt, Homo sapiens
gaagggcuuugguggaugu

SEQ ID NO: 1343619 - RNA, 19 nt, Homo sapiens
guucaucucucacucaaca

SEQ ID NO: 1343620 - RNA, 19 nt, Homo sapiens
gagaaggaucuuauaaaug

SEQ ID NO: 1343621 - RNA, 19 nt, Homo sapiens
gggagaaggaucuuauaaa

SEQ ID NO: 1343622 - RNA, 19 nt, Homo sapiens
gaucaguccuuguuaacca

SEQ ID NO: 1343623 - RNA, 19 nt, Homo sapiens
agagacaccugaaacaaau

SEQ ID NO: 1343624 - RNA, 19 nt, Homo sapiens
cuaaagguguaauguaugu

SEQ ID NO: 1343625 - RNA, 19 nt, Homo sapiens
agagagagauccuaaaggu

SEQ ID NO: 1343626 - RNA, 19 nt, Homo sapiens
agccaaaccucauugcuuu

SEQ ID NO: 1343627 - RNA, 19 nt, Homo sapiens
caagaacacauacuagaga

SEQ ID NO: 1343628 - RNA, 19 nt, Homo sapiens
aguuguaucucuuccuuua

SEQ ID NO: 1343629 - RNA, 19 nt, Homo sapiens
cacuggaacuuaaagaauu

SEQ ID NO: 1343630 - RNA, 19 nt, Homo sapiens
agagaaacccuacaaaugu

SEQ ID NO: 1343631 - RNA, 19 nt, Homo sapiens
ggacgagccuuuggucaca

SEQ ID NO: 1343632 - RNA, 19 nt, Homo sapiens
agagaaacccuacaaaugu

SEQ ID NO: 1343633 - RNA, 19 nt, Homo sapiens
gcagagauuauaaauggaa

SEQ ID NO: 1343634 - RNA, 19 nt, Homo sapiens
gaaaagaagcugagaaauc

SEQ ID NO: 1343635 - RNA, 19 nt, Homo sapiens
ggagaauccauacuaguga

SEQ ID NO: 1343636 - RNA, 19 nt, Homo sapiens
gcucauacugcaucccuua

SEQ ID NO: 1343637 - RNA, 19 nt, Homo sapiens
gagaaaagcccuaugaaug

SEQ ID NO: 1343638 - RNA, 19 nt, Homo sapiens
gagaaaagcccuaugaaug

SEQ ID NO: 1343639 - RNA, 19 nt, Homo sapiens
gagaaaagccguaugaaug

SEQ ID NO: 1343640 - RNA, 19 nt, Homo sapiens
aaaagaagcugagaaauca

SEQ ID NO: 1343641 - RNA, 19 nt, Homo sapiens
gggaagggcuuugguggau

SEQ ID NO: 1343642 - RNA, 19 nt, Homo sapiens
ccuguaaccucagcacuuu

SEQ ID NO: 1343643 - RNA, 19 nt, Homo sapiens
uaugaaagcaggaaauaga

SEQ ID NO: 1343644 - RNA, 19 nt, Homo sapiens
agagagaggcccuaugaaa

SEQ ID NO: 1343645 - RNA, 19 nt, Homo sapiens
gcaucaagaacacauacua

SEQ ID NO: 1343646 - RNA, 19 nt, Homo sapiens
uaaagagaaucccugucaa

SEQ ID NO: 1343647 - RNA, 19 nt, Homo sapiens
gaauauagaagggcuuuca

SEQ ID NO: 1343648 - RNA, 19 nt, Homo sapiens
cugcaucccuuauuaaaca

SEQ ID NO: 1343649 - RNA, 19 nt, Homo sapiens
cauugugcauuacagauuu

SEQ ID NO: 1343650 - RNA, 19 nt, Homo sapiens
cacacuucaucccuuauua

SEQ ID NO: 1343651 - RNA, 19 nt, Homo sapiens
caacaccucuaugcacuuc

SEQ ID NO: 1343652 - RNA, 19 nt, Homo sapiens
gcugagaaaucaccuuguc

SEQ ID NO: 1343653 - RNA, 19 nt, Homo sapiens
uuagaacucucccuacuag

SEQ ID NO: 1343654 - RNA, 19 nt, Homo sapiens
gagagaggcccuaugaaag

SEQ ID NO: 1343655 - RNA, 19 nt, Homo sapiens
gagaaaccacgugaaugua

SEQ ID NO: 1343656 - RNA, 19 nt, Homo sapiens
agccagagcucaucacuca

SEQ ID NO: 1343657 - RNA, 19 nt, Homo sapiens
ucagagaacccacccagaa

SEQ ID NO: 1343658 - RNA, 19 nt, Homo sapiens
ugaaacaaaugucaaccau

SEQ ID NO: 1343659 - RNA, 19 nt, Homo sapiens
gacaggaucuuugcaguac

SEQ ID NO: 1343660 - RNA, 19 nt, Homo sapiens
cuagagagaggcccuauga

SEQ ID NO: 1343661 - RNA, 19 nt, Homo sapiens
agagaaauccuacaagugu

SEQ ID NO: 1343662 - RNA, 19 nt, Homo sapiens
ugagaaaccacgugaaugu

SEQ ID NO: 1343663 - RNA, 19 nt, Homo sapiens
guucugcacuauagauuuc

SEQ ID NO: 1343664 - RNA, 19 nt, Homo sapiens
ggagagacaccugaaacaa

SEQ ID NO: 1343665 - RNA, 19 nt, Homo sapiens
caacaggagcccacucaga

SEQ ID NO: 1343666 - RNA, 19 nt, Homo sapiens
gaggauggaggcugagaaa

SEQ ID NO: 1343667 - RNA, 19 nt, Homo sapiens
ucacucaacauuacagauu

SEQ ID NO: 1343668 - RNA, 19 nt, Homo sapiens
cauuacagauuucauacug

SEQ ID NO: 1343669 - RNA, 19 nt, Homo sapiens
gugcauuacagauuucaua

SEQ ID NO: 1343670 - RNA, 19 nt, Homo sapiens
gauggaggcugagaaaggu

SEQ ID NO: 1343671 - RNA, 19 nt, Homo sapiens
gagaaaccuugggaacaug

SEQ ID NO: 1343672 - RNA, 19 nt, Homo sapiens
gagaauuuguacauuagag

SEQ ID NO: 1343673 - RNA, 19 nt, Homo sapiens
ccuacuagcuggaaacucu

SEQ ID NO: 1343674 - RNA, 19 nt, Homo sapiens
gagagaaauccuacaagug

SEQ ID NO: 1343675 - RNA, 19 nt, Homo sapiens
ccaggcagaucaugaacua

SEQ ID NO: 1343676 - RNA, 19 nt, Homo sapiens
ccgaggagcuggcugagaa

SEQ ID NO: 1343677 - RNA, 19 nt, Homo sapiens
gcugcucacucucuacuuu

SEQ ID NO: 1343678 - RNA, 19 nt, Homo sapiens
gaucagaguuuggccuuuc

SEQ ID NO: 1343679 - RNA, 19 nt, Homo sapiens
guagagggauuaugacaac

SEQ ID NO: 1343680 - RNA, 19 nt, Homo sapiens
cgagucggcucuguuguuu

SEQ ID NO: 1343681 - RNA, 19 nt, Homo sapiens
ggacacaggccuugaagag

SEQ ID NO: 1343682 - RNA, 19 nt, Homo sapiens
ccaggcggcugaggaguuu

SEQ ID NO: 1343683 - RNA, 19 nt, Homo sapiens
caacgccgauggccauaag

SEQ ID NO: 1343684 - RNA, 19 nt, Homo sapiens
aguuguaccuggagaauga

SEQ ID NO: 1343685 - RNA, 19 nt, Homo sapiens
ggagauggugcuauugaug

SEQ ID NO: 1343686 - RNA, 19 nt, Homo sapiens
caggguagagggauuauga

SEQ ID NO: 1343687 - RNA, 19 nt, Homo sapiens
agucggcucuguuguuuga

SEQ ID NO: 1343688 - RNA, 19 nt, Homo sapiens
ggaaauugccauggacuca

SEQ ID NO: 1343689 - RNA, 19 nt, Homo sapiens
gcucuguuguuugaauaaa

SEQ ID NO: 1343690 - RNA, 19 nt, Homo sapiens
agcauuagcugccaugugu

SEQ ID NO: 1343691 - RNA, 19 nt, Homo sapiens
ccacuugaaggaccggaua

SEQ ID NO: 1343692 - RNA, 19 nt, Homo sapiens
cggcucuguuguuugaaua

SEQ ID NO: 1343693 - RNA, 19 nt, Homo sapiens
ggaucagaguuuggccuuu

SEQ ID NO: 1343694 - RNA, 19 nt, Homo sapiens
gaacaugaggggcugguaa

SEQ ID NO: 1343695 - RNA, 19 nt, Homo sapiens
ggacaggcagagcaaguca

SEQ ID NO: 1343696 - RNA, 19 nt, Homo sapiens
gugcagggacugugacaau

SEQ ID NO: 1343697 - RNA, 19 nt, Homo sapiens
guggagauggugcuauuga

SEQ ID NO: 1343698 - RNA, 19 nt, Homo sapiens
ugguggagauggugcuauu

SEQ ID NO: 1343699 - RNA, 19 nt, Homo sapiens
gguagagggauuaugacaa

SEQ ID NO: 1343700 - RNA, 19 nt, Homo sapiens
aaugggcucuggcgaggaa

SEQ ID NO: 1343701 - RNA, 19 nt, Homo sapiens
ucaguuccagugugucuuu

SEQ ID NO: 1343702 - RNA, 19 nt, Homo sapiens
gggaagggcguguauuucg

SEQ ID NO: 1343703 - RNA, 19 nt, Homo sapiens
gcucuaccaugaggaccuu

SEQ ID NO: 1343704 - RNA, 19 nt, Homo sapiens
aacaggcucuggccaggaa

SEQ ID NO: 1343705 - RNA, 19 nt, Homo sapiens
gugcaggguagagggauua

SEQ ID NO: 1343706 - RNA, 19 nt, Homo sapiens
ggaggagguccgagaacug

SEQ ID NO: 1343707 - RNA, 19 nt, Homo sapiens
uccugcagcucuaccauga

SEQ ID NO: 1343708 - RNA, 19 nt, Homo sapiens
gcccaguggagaccucuaa

SEQ ID NO: 1343709 - RNA, 19 nt, Homo sapiens
gcagggacugugacaaugg

SEQ ID NO: 1343710 - RNA, 19 nt, Homo sapiens
ggugcugacuggcgacuac

SEQ ID NO: 1343711 - RNA, 19 nt, Homo sapiens
cagcaucuucgucaucuuc

SEQ ID NO: 1343712 - RNA, 19 nt, Homo sapiens
gcggugccauggugugagu

SEQ ID NO: 1343713 - RNA, 19 nt, Homo sapiens
gucgcucucuugccacuug

SEQ ID NO: 1343714 - RNA, 19 nt, Homo sapiens
aggagggccugguggaaau

SEQ ID NO: 1343715 - RNA, 19 nt, Homo sapiens
ggaguuguaccuggagaau

SEQ ID NO: 1343716 - RNA, 19 nt, Homo sapiens
acgggaagggcguguauuu

SEQ ID NO: 1343717 - RNA, 19 nt, Homo sapiens
gagcggugccaugguguga

SEQ ID NO: 1343718 - RNA, 19 nt, Homo sapiens
uggaggagcaggcccagaa

SEQ ID NO: 1343719 - RNA, 19 nt, Homo sapiens
cauuagcugccauguguug

SEQ ID NO: 1343720 - RNA, 19 nt, Homo sapiens
ugaaggaccggauaugacu

SEQ ID NO: 1343721 - RNA, 19 nt, Homo sapiens
ggacucaccagagcaagag

SEQ ID NO: 1343722 - RNA, 19 nt, Homo sapiens
ggaggagcaggcccagaau

SEQ ID NO: 1343723 - RNA, 19 nt, Homo sapiens
ggcagaucaugaacuacau

SEQ ID NO: 1343724 - RNA, 19 nt, Homo sapiens
guggugcacucggccuuug

SEQ ID NO: 1343725 - RNA, 19 nt, Homo sapiens
cucacucucuacuuugaaa

SEQ ID NO: 1343726 - RNA, 19 nt, Homo sapiens
ggucuuggcccaggcagau

SEQ ID NO: 1343727 - RNA, 19 nt, Homo sapiens
ugcuguugcuggaguugua

SEQ ID NO: 1343728 - RNA, 19 nt, Homo sapiens
agauggugcuauugaugga

SEQ ID NO: 1343729 - RNA, 19 nt, Homo sapiens
uggagauggugcuauugau

SEQ ID NO: 1343730 - RNA, 19 nt, Homo sapiens
gccuagggcuaccaagcau

SEQ ID NO: 1343731 - RNA, 19 nt, Homo sapiens
gaauaagcauuuccuguuc

SEQ ID NO: 1343732 - RNA, 19 nt, Homo sapiens
gagcugagaucgcgccauu

SEQ ID NO: 1343733 - RNA, 19 nt, Homo sapiens
gcagugagcuaugguaaca

SEQ ID NO: 1343734 - RNA, 19 nt, Homo sapiens
gcucacgccuguaauccua

SEQ ID NO: 1343735 - RNA, 19 nt, Homo sapiens
ucaacgagcuggcggaguu

SEQ ID NO: 1343736 - RNA, 19 nt, Homo sapiens
gcaggaagauugccuaagc

SEQ ID NO: 1343737 - RNA, 19 nt, Homo sapiens
uaacaccacugcacuccaa

SEQ ID NO: 1343738 - RNA, 19 nt, Homo sapiens
cuuugaaacuguccucuaa

SEQ ID NO: 1343739 - RNA, 19 nt, Homo sapiens
gcacuuccagcuccuuuga

SEQ ID NO: 1343740 - RNA, 19 nt, Homo sapiens
agaauaagcauuuccuguu

SEQ ID NO: 1343741 - RNA, 19 nt, Homo sapiens
gcaggagaaucgcuugaac

SEQ ID NO: 1343742 - RNA, 19 nt, Homo sapiens
uaggugagccucuaggaaa

SEQ ID NO: 1343743 - RNA, 19 nt, Homo sapiens
cuacugcucacccugguua

SEQ ID NO: 1343744 - RNA, 19 nt, Homo sapiens
uugaaacuguccucuaaga

SEQ ID NO: 1343745 - RNA, 19 nt, Homo sapiens
gaaauuucugcacuuugaa

SEQ ID NO: 1343746 - RNA, 19 nt, Homo sapiens
gagaccagccugaccaaca

SEQ ID NO: 1343747 - RNA, 19 nt, Homo sapiens
gcauugaguguguacaugu

SEQ ID NO: 1343748 - RNA, 19 nt, Homo sapiens
ugagcaacgugcacaaucu

SEQ ID NO: 1343749 - RNA, 19 nt, Homo sapiens
uaagaccgaccgacaguuc

SEQ ID NO: 1343750 - RNA, 19 nt, Homo sapiens
cgucuucgccuuccacuuc

SEQ ID NO: 1343751 - RNA, 19 nt, Homo sapiens
gaaaccccaucuguacuaa

SEQ ID NO: 1343752 - RNA, 19 nt, Homo sapiens
gaccccaucucaaacaaaa

SEQ ID NO: 1343753 - RNA, 19 nt, Homo sapiens
gcaccuguuugcgcucaug

SEQ ID NO: 1343754 - RNA, 19 nt, Homo sapiens
gaggccaagucugcaguga

SEQ ID NO: 1343755 - RNA, 19 nt, Homo sapiens
ucccgugucuuguauuugu

SEQ ID NO: 1343756 - RNA, 19 nt, Homo sapiens
ggagaaaccccaucuguac

SEQ ID NO: 1343757 - RNA, 19 nt, Homo sapiens
agaccagccugaccaacau

SEQ ID NO: 1343758 - RNA, 19 nt, Homo sapiens
ccuguggucucagcuauuc

SEQ ID NO: 1343759 - RNA, 19 nt, Homo sapiens
uuccagugcuuuggccuua

SEQ ID NO: 1343760 - RNA, 19 nt, Homo sapiens
gacugaggcaggaagauug

SEQ ID NO: 1343761 - RNA, 19 nt, Homo sapiens
cuucccgugucuuguauuu

SEQ ID NO: 1343762 - RNA, 19 nt, Homo sapiens
cuaagagaauaagcauuuc

SEQ ID NO: 1343763 - RNA, 19 nt, Homo sapiens
ggaguuugcccgcuuacag

SEQ ID NO: 1343764 - RNA, 19 nt, Homo sapiens
ccaagucugcagugagcua

SEQ ID NO: 1343765 - RNA, 19 nt, Homo sapiens
gcaacgugcacaaucucaa

SEQ ID NO: 1343766 - RNA, 19 nt, Homo sapiens
aaaauuagcuggguuuggu

SEQ ID NO: 1343767 - RNA, 19 nt, Homo sapiens
gcccuucggccugaucuuu

SEQ ID NO: 1343768 - RNA, 19 nt, Homo sapiens
ccuguaauccuagcccuuu

SEQ ID NO: 1343769 - RNA, 19 nt, Homo sapiens
agacugaggcaggaagauu

SEQ ID NO: 1343770 - RNA, 19 nt, Homo sapiens
ucaccuacccggacuggau

SEQ ID NO: 1343771 - RNA, 19 nt, Homo sapiens
cauaagaccgaccgacagu

SEQ ID NO: 1343772 - RNA, 19 nt, Homo sapiens
cauugaguguguacaugug

SEQ ID NO: 1343773 - RNA, 19 nt, Homo sapiens
ugaccaacauggagaaacc

SEQ ID NO: 1343774 - RNA, 19 nt, Homo sapiens
ucaacgagcacuccaugca

SEQ ID NO: 1343775 - RNA, 19 nt, Homo sapiens
uaccuguggucucagcuau

SEQ ID NO: 1343776 - RNA, 19 nt, Homo sapiens
ccuucggccugaucuuuau

SEQ ID NO: 1343777 - RNA, 19 nt, Homo sapiens
ggccaaggcaggaggaucu

SEQ ID NO: 1343778 - RNA, 19 nt, Homo sapiens
cguccagcauugagugugu

SEQ ID NO: 1343779 - RNA, 19 nt, Homo sapiens
aauaagcauuuccuguucu

SEQ ID NO: 1343780 - RNA, 19 nt, Homo sapiens
gcagagcguggagggaaga

SEQ ID NO: 1343781 - RNA, 19 nt, Homo sapiens
ccugaucuuuaucgucuuc

SEQ ID NO: 1343782 - RNA, 19 nt, Homo sapiens
gcugagaucgcgccauugc

SEQ ID NO: 1343783 - RNA, 19 nt, Homo sapiens
gguggcgcaugcuuguaau

SEQ ID NO: 1343784 - RNA, 19 nt, Homo sapiens
gagccucuaggaaaacuua

SEQ ID NO: 1343785 - RNA, 19 nt, Homo sapiens
guccagcauugagugugua

SEQ ID NO: 1343786 - RNA, 19 nt, Homo sapiens
caacgagcuggcggaguuu

SEQ ID NO: 1343787 - RNA, 19 nt, Homo sapiens
caaggcaggaggaucucuu

SEQ ID NO: 1343788 - RNA, 19 nt, Homo sapiens
ggacgcugaccacgacuac

SEQ ID NO: 1343789 - RNA, 19 nt, Homo sapiens
gcucugcugggucaaguuc

SEQ ID NO: 1343790 - RNA, 19 nt, Homo sapiens
ucugagaacuggacuauuu

SEQ ID NO: 1343791 - RNA, 19 nt, Homo sapiens
caaguggacccaucauaua

SEQ ID NO: 1343792 - RNA, 19 nt, Homo sapiens
ggagaacgcgcucggagua

SEQ ID NO: 1343793 - RNA, 19 nt, Homo sapiens
ccacuggccucgcugacua

SEQ ID NO: 1343794 - RNA, 19 nt, Homo sapiens
gcgacuaccugcucaaaca

SEQ ID NO: 1343795 - RNA, 19 nt, Homo sapiens
ugacgaggaugacgaggaa

SEQ ID NO: 1343796 - RNA, 19 nt, Homo sapiens
gacgaaugcacgcagauua

SEQ ID NO: 1343797 - RNA, 19 nt, Homo sapiens
gaaaggaagguucaagucu

SEQ ID NO: 1343798 - RNA, 19 nt, Homo sapiens
gugcaggccuuuguucuga

SEQ ID NO: 1343799 - RNA, 19 nt, Homo sapiens
caaggucccuagcucucua

SEQ ID NO: 1343800 - RNA, 19 nt, Homo sapiens
gagcgcagguccucucucu

SEQ ID NO: 1343801 - RNA, 19 nt, Homo sapiens
gugcugagccaccuacgua

SEQ ID NO: 1343802 - RNA, 19 nt, Homo sapiens
gggacucucgcucuaauaa

SEQ ID NO: 1343803 - RNA, 19 nt, Homo sapiens
acauacaccugcagaacuu

SEQ ID NO: 1343804 - RNA, 19 nt, Homo sapiens
ucaaguggacccaucauau

SEQ ID NO: 1343805 - RNA, 19 nt, Homo sapiens
ggaaaggaagguucaaguc

SEQ ID NO: 1343806 - RNA, 19 nt, Homo sapiens
gaggacguauuuccagaca

SEQ ID NO: 1343807 - RNA, 19 nt, Homo sapiens
ugacgugacugugcgcauu

SEQ ID NO: 1343808 - RNA, 19 nt, Homo sapiens
gacucucgcucuaauaaag

SEQ ID NO: 1343809 - RNA, 19 nt, Homo sapiens
ugaccgaggugacgaggau

SEQ ID NO: 1343810 - RNA, 19 nt, Homo sapiens
agacaguuaucgacgaaug

SEQ ID NO: 1343811 - RNA, 19 nt, Homo sapiens
gguccucucucucccuuca

SEQ ID NO: 1343812 - RNA, 19 nt, Homo sapiens
ggacucucgcucuaauaaa

SEQ ID NO: 1343813 - RNA, 19 nt, Homo sapiens
cgaggaaagugacgaugag

SEQ ID NO: 1343814 - RNA, 19 nt, Homo sapiens
ugcgacagcugguagaguu

SEQ ID NO: 1343815 - RNA, 19 nt, Homo sapiens
ccucgggacucucgcucua

SEQ ID NO: 1343816 - RNA, 19 nt, Homo sapiens
gguuagaccacuucugaga

SEQ ID NO: 1343817 - RNA, 19 nt, Homo sapiens
acagacaguuaucgacgaa

SEQ ID NO: 1343818 - RNA, 19 nt, Homo sapiens
agaacgcgcucggaguaaa

SEQ ID NO: 1343819 - RNA, 19 nt, Homo sapiens
uuacuccucuccuccaugu

SEQ ID NO: 1343820 - RNA, 19 nt, Homo sapiens
gcaauggagcagaguaugg

SEQ ID NO: 1343821 - RNA, 19 nt, Homo sapiens
acagcuauguauccacuug

SEQ ID NO: 1343822 - RNA, 19 nt, Homo sapiens
ccaagcacauguucaucca

SEQ ID NO: 1343823 - RNA, 19 nt, Homo sapiens
ugggucagcugaggacgua

SEQ ID NO: 1343824 - RNA, 19 nt, Homo sapiens
gagaacgcgcucggaguaa

SEQ ID NO: 1343825 - RNA, 19 nt, Homo sapiens
uggacuauuuccugcguaa

SEQ ID NO: 1343826 - RNA, 19 nt, Homo sapiens
ccuucacccuuucuccaua

SEQ ID NO: 1343827 - RNA, 19 nt, Homo sapiens
ccaagcgcuucacgcagaa

SEQ ID NO: 1343828 - RNA, 19 nt, Homo sapiens
gggaaaggaagguucaagu

SEQ ID NO: 1343829 - RNA, 19 nt, Homo sapiens
ugagaccgauggcgaggau

SEQ ID NO: 1343830 - RNA, 19 nt, Homo sapiens
gcaggccuuuguucugaag

SEQ ID NO: 1343831 - RNA, 19 nt, Homo sapiens
gaacgcgcucggaguaaag

SEQ ID NO: 1343832 - RNA, 19 nt, Homo sapiens
gcauacagacaguuaucga

SEQ ID NO: 1343833 - RNA, 19 nt, Homo sapiens
gggcaauggagcagaguau

SEQ ID NO: 1343834 - RNA, 19 nt, Homo sapiens
ccagacagcuauguaucca

SEQ ID NO: 1343835 - RNA, 19 nt, Homo sapiens
ggucagcugaggacguauu

SEQ ID NO: 1343836 - RNA, 19 nt, Homo sapiens
cagcccgacugcauacugu

SEQ ID NO: 1343837 - RNA, 19 nt, Homo sapiens
cgucagugcuucgcauaca

SEQ ID NO: 1343838 - RNA, 19 nt, Homo sapiens
ggagcagaguaugggagaa

SEQ ID NO: 1343839 - RNA, 19 nt, Homo sapiens
cgacgaaugcacgcagauu

SEQ ID NO: 1343840 - RNA, 19 nt, Homo sapiens
gaaggcugucccacugaga

SEQ ID NO: 1343841 - RNA, 19 nt, Homo sapiens
uggccucgcugacuacagu

SEQ ID NO: 1343842 - RNA, 19 nt, Homo sapiens
cuucgcauacagacaguua

SEQ ID NO: 1343843 - RNA, 19 nt, Homo sapiens
ucuccuccauguacuugaa

SEQ ID NO: 1343844 - RNA, 19 nt, Homo sapiens
aaggaagguucaagucucu

SEQ ID NO: 1343845 - RNA, 19 nt, Homo sapiens
acacuucugugacgugacu

SEQ ID NO: 1343846 - RNA, 19 nt, Homo sapiens
gcugguagaguuccuguac

SEQ ID NO: 1343847 - RNA, 19 nt, Homo sapiens
cgucgggacugaggaaugg

SEQ ID NO: 1343848 - RNA, 19 nt, Homo sapiens
aaguggacccaucauauau

SEQ ID NO: 1343849 - RNA, 19 nt, Homo sapiens
aaacuacaccaagcacaug

SEQ ID NO: 1343850 - RNA, 19 nt, Homo sapiens
gcucuaauaaaggacugua

SEQ ID NO: 1343851 - RNA, 19 nt, Homo sapiens
gcugagccaccuacguaug

SEQ ID NO: 1343852 - RNA, 19 nt, Homo sapiens
uggcgaggauggcgaaggu

SEQ ID NO: 1343853 - RNA, 19 nt, Homo sapiens
gaggaaagugacgaugaga

SEQ ID NO: 1343854 - RNA, 19 nt, Homo sapiens
ucgggacucucgcucuaau

SEQ ID NO: 1343855 - RNA, 19 nt, Homo sapiens
ggacuauuuccugcguaaa

SEQ ID NO: 1343856 - RNA, 19 nt, Homo sapiens
acaccaagcacauguucau

SEQ ID NO: 1343857 - RNA, 19 nt, Homo sapiens
cugagccaccuacguauga

SEQ ID NO: 1343858 - RNA, 19 nt, Homo sapiens
gaaugcacgcagauuaucg

SEQ ID NO: 1343859 - RNA, 19 nt, Homo sapiens
gaaaggaucucaggcaaua

SEQ ID NO: 1343860 - RNA, 19 nt, Homo sapiens
ggagcugggugagcaauua

SEQ ID NO: 1343861 - RNA, 19 nt, Homo sapiens
gcaauuaugcuguuacuau

SEQ ID NO: 1343862 - RNA, 19 nt, Homo sapiens
uaacugaucuuuggaagga

SEQ ID NO: 1343863 - RNA, 19 nt, Homo sapiens
ccgcucaaguucauucaua

SEQ ID NO: 1343864 - RNA, 19 nt, Homo sapiens
caauuaugcuguuacuaug

SEQ ID NO: 1343865 - RNA, 19 nt, Homo sapiens
gaaaccccgucucuacuua

SEQ ID NO: 1343866 - RNA, 19 nt, Homo sapiens
gaacaccuuucuuuuguau

SEQ ID NO: 1343867 - RNA, 19 nt, Homo sapiens
ggucauggccaaaggagaa

SEQ ID NO: 1343868 - RNA, 19 nt, Homo sapiens
gauggugggcugauaaguu

SEQ ID NO: 1343869 - RNA, 19 nt, Homo sapiens
cgccucaacucugcuguua

SEQ ID NO: 1343870 - RNA, 19 nt, Homo sapiens
ucgggaagcuggagaguag

SEQ ID NO: 1343871 - RNA, 19 nt, Homo sapiens
auggugggcugauaaguuu

SEQ ID NO: 1343872 - RNA, 19 nt, Homo sapiens
ggaaaggaucucaggcaau

SEQ ID NO: 1343873 - RNA, 19 nt, Homo sapiens
ggagggaggaggcggaaau

SEQ ID NO: 1343874 - RNA, 19 nt, Homo sapiens
gcaggagaauggcgugaac

SEQ ID NO: 1343875 - RNA, 19 nt, Homo sapiens
gcaagcggauuuucagguu

SEQ ID NO: 1343876 - RNA, 19 nt, Homo sapiens
ucagggaugcucugggaua

SEQ ID NO: 1343877 - RNA, 19 nt, Homo sapiens
caacccaaccucccuagug

SEQ ID NO: 1343878 - RNA, 19 nt, Homo sapiens
gguagugggugccuguagu

SEQ ID NO: 1343879 - RNA, 19 nt, Homo sapiens
cagaggagcaucccgucua

SEQ ID NO: 1343880 - RNA, 19 nt, Homo sapiens
ugacugccuuuuccuuuua

SEQ ID NO: 1343881 - RNA, 19 nt, Homo sapiens
ccgcgucccucaggcauuu

SEQ ID NO: 1343882 - RNA, 19 nt, Homo sapiens
ccaggagggagguggcuua

SEQ ID NO: 1343883 - RNA, 19 nt, Homo sapiens
ccucaacucugcuguuagg

SEQ ID NO: 1343884 - RNA, 19 nt, Homo sapiens
ucgagaccaugcuggcuaa

SEQ ID NO: 1343885 - RNA, 19 nt, Homo sapiens
gggaugcucugggauaggu

SEQ ID NO: 1343886 - RNA, 19 nt, Homo sapiens
agaccaugcuggcuaacau

SEQ ID NO: 1343887 - RNA, 19 nt, Homo sapiens
ccaccagcauccuccaaag

SEQ ID NO: 1343888 - RNA, 19 nt, Homo sapiens
cgcucaaguucauucauaa

SEQ ID NO: 1343889 - RNA, 19 nt, Homo sapiens
ggauagccagggacaggaa

SEQ ID NO: 1343890 - RNA, 19 nt, Homo sapiens
uggcuaaggcugcuacgaa

SEQ ID NO: 1343891 - RNA, 19 nt, Homo sapiens
uagggauggugggcugaua

SEQ ID NO: 1343892 - RNA, 19 nt, Homo sapiens
gaagcucuggcugccuaua

SEQ ID NO: 1343893 - RNA, 19 nt, Homo sapiens
aagaauggagaacaccuuu

SEQ ID NO: 1343894 - RNA, 19 nt, Homo sapiens
gagcugggugagcaauuau

SEQ ID NO: 1343895 - RNA, 19 nt, Homo sapiens
gaaggaccaaauaaaauga

SEQ ID NO: 1343896 - RNA, 19 nt, Homo sapiens
uaagaauggagaacaccuu

SEQ ID NO: 1343897 - RNA, 19 nt, Homo sapiens
cagggaugcucugggauag

SEQ ID NO: 1343898 - RNA, 19 nt, Homo sapiens
gaaggagcugggugagcaa

SEQ ID NO: 1343899 - RNA, 19 nt, Homo sapiens
gugacugccuuuuccuuuu

SEQ ID NO: 1343900 - RNA, 19 nt, Homo sapiens
ccuagccgguuuccauucu

SEQ ID NO: 1343901 - RNA, 19 nt, Homo sapiens
ggauuccccuuuuccaugu

SEQ ID NO: 1343902 - RNA, 19 nt, Homo sapiens
uagccgguuuccauucuuc

SEQ ID NO: 1343903 - RNA, 19 nt, Homo sapiens
ggaaagaacauaaugguua

SEQ ID NO: 1343904 - RNA, 19 nt, Homo sapiens
cagagaagcuggaaaccua

SEQ ID NO: 1343905 - RNA, 19 nt, Homo sapiens
gaacaaagucuauuuacug

SEQ ID NO: 1343906 - RNA, 19 nt, Homo sapiens
ggagaacaaagucuauuua

SEQ ID NO: 1343907 - RNA, 19 nt, Homo sapiens
guuuagagaugccaaauga

SEQ ID NO: 1343908 - RNA, 19 nt, Homo sapiens
cuggaaaccuagauauuua

SEQ ID NO: 1343909 - RNA, 19 nt, Homo sapiens
caaacuuccucgcuucuuu

SEQ ID NO: 1343910 - RNA, 19 nt, Homo sapiens
gaaaggugccaucuugaaa

SEQ ID NO: 1343911 - RNA, 19 nt, Homo sapiens
ugagagugcugccauuaaa

SEQ ID NO: 1343912 - RNA, 19 nt, Homo sapiens
ggacauggcacaucaaguc

SEQ ID NO: 1343913 - RNA, 19 nt, Homo sapiens
ggaaaggugccaucuugaa

SEQ ID NO: 1343914 - RNA, 19 nt, Homo sapiens
gaaggaggaacucaacuug

SEQ ID NO: 1343915 - RNA, 19 nt, Homo sapiens
gcacugacccgaggaauuc

SEQ ID NO: 1343916 - RNA, 19 nt, Homo sapiens
gcggagagugcaagaaaua

SEQ ID NO: 1343917 - RNA, 19 nt, Homo sapiens
gcuggaaaccuagauauuu

SEQ ID NO: 1343918 - RNA, 19 nt, Homo sapiens
gauuagggaaccuguauaa

SEQ ID NO: 1343919 - RNA, 19 nt, Homo sapiens
ggacucugcuaacuucuca

SEQ ID NO: 1343920 - RNA, 19 nt, Homo sapiens
ggaaaccacagguguaaug

SEQ ID NO: 1343921 - RNA, 19 nt, Homo sapiens
ggagauggcuuugguuggu

SEQ ID NO: 1343922 - RNA, 19 nt, Homo sapiens
ugugaaaccucccagugua

SEQ ID NO: 1343923 - RNA, 19 nt, Homo sapiens
gugaauggcaggcagauaa

SEQ ID NO: 1343924 - RNA, 19 nt, Homo sapiens
gaacaaugaagccaagugu

SEQ ID NO: 1343925 - RNA, 19 nt, Homo sapiens
cauaaaugcccggagauua

SEQ ID NO: 1343926 - RNA, 19 nt, Homo sapiens
gcuaacuucucacuuggaa

SEQ ID NO: 1343927 - RNA, 19 nt, Homo sapiens
gcaaggagaaccgauguga

SEQ ID NO: 1343928 - RNA, 19 nt, Homo sapiens
guccaagaguuguuuagaa

SEQ ID NO: 1343929 - RNA, 19 nt, Homo sapiens
gaagcuggaaaccuagaua

SEQ ID NO: 1343930 - RNA, 19 nt, Homo sapiens
guauaaggguauugagugu

SEQ ID NO: 1343931 - RNA, 19 nt, Homo sapiens
acaaggacauggcacauca

SEQ ID NO: 1343932 - RNA, 19 nt, Homo sapiens
caaggaaaccacaggugua

SEQ ID NO: 1343933 - RNA, 19 nt, Homo sapiens
ucacugauguacuaccuau

SEQ ID NO: 1343934 - RNA, 19 nt, Homo sapiens
guaagagccaggugggaua

SEQ ID NO: 1343935 - RNA, 19 nt, Homo sapiens
ggaaggaggaacucaacuu

SEQ ID NO: 1343936 - RNA, 19 nt, Homo sapiens
gcuagcaguuugcagucua

SEQ ID NO: 1343937 - RNA, 19 nt, Homo sapiens
gcagauaacaugcacacau

SEQ ID NO: 1343938 - RNA, 19 nt, Homo sapiens
gaaccuguauaaggguauu

SEQ ID NO: 1343939 - RNA, 19 nt, Homo sapiens
ugaaugguauagaaguuug

SEQ ID NO: 1343940 - RNA, 19 nt, Homo sapiens
caaaugaggaucaaaauga

SEQ ID NO: 1343941 - RNA, 19 nt, Homo sapiens
gcccaucacuggaauaaaa

SEQ ID NO: 1343942 - RNA, 19 nt, Homo sapiens
ggaaaagccugcuggaagu

SEQ ID NO: 1343943 - RNA, 19 nt, Homo sapiens
caacuuggucugcaaacuu

SEQ ID NO: 1343944 - RNA, 19 nt, Homo sapiens
ccacagguguaaugguguu

SEQ ID NO: 1343945 - RNA, 19 nt, Homo sapiens
auaaggguauugaguguga

SEQ ID NO: 1343946 - RNA, 19 nt, Homo sapiens
gggauaagguaaagcaacu

SEQ ID NO: 1343947 - RNA, 19 nt, Homo sapiens
acaggacucugcuaacuuc

SEQ ID NO: 1343948 - RNA, 19 nt, Homo sapiens
gucagguggugaagaagua

SEQ ID NO: 1343949 - RNA, 19 nt, Homo sapiens
gcaguuugcagucuauguu

SEQ ID NO: 1343950 - RNA, 19 nt, Homo sapiens
ggaacagacugcguaagag

SEQ ID NO: 1343951 - RNA, 19 nt, Homo sapiens
ugcagucuauguuuaauga

SEQ ID NO: 1343952 - RNA, 19 nt, Homo sapiens
gcaccuaagcaaauaauac

SEQ ID NO: 1343953 - RNA, 19 nt, Homo sapiens
ccaguguauugccaacuaa

SEQ ID NO: 1343954 - RNA, 19 nt, Homo sapiens
ucugcuaacuucucacuug

SEQ ID NO: 1343955 - RNA, 19 nt, Homo sapiens
cagcaacaccacaagauga

SEQ ID NO: 1343956 - RNA, 19 nt, Homo sapiens
ggaacaagacacaaagaag

SEQ ID NO: 1343957 - RNA, 19 nt, Homo sapiens
cguguaguauguauccuuu

SEQ ID NO: 1343958 - RNA, 19 nt, Homo sapiens
ggggaaaggugccaucuug

SEQ ID NO: 1343959 - RNA, 19 nt, Homo sapiens
gggaacaagacacaaagaa

SEQ ID NO: 1343960 - RNA, 19 nt, Homo sapiens
gaucacaaguacucagacu

SEQ ID NO: 1343961 - RNA, 19 nt, Homo sapiens
aaacaucagcuucgaguuc

SEQ ID NO: 1343962 - RNA, 19 nt, Homo sapiens
cagcggagagugcaagaaa

SEQ ID NO: 1343963 - RNA, 19 nt, Homo sapiens
gaaaccucccaguguauug

SEQ ID NO: 1343964 - RNA, 19 nt, Homo sapiens
caagaaauagugcgguuca

SEQ ID NO: 1343965 - RNA, 19 nt, Homo sapiens
gaaacgggaacaagacaca

SEQ ID NO: 1343966 - RNA, 19 nt, Homo sapiens
gcacaucaaguccaagagu

SEQ ID NO: 1343967 - RNA, 19 nt, Homo sapiens
ucucuucacucucgucuca

SEQ ID NO: 1343968 - RNA, 19 nt, Homo sapiens
gcaccugggagcacaguga

SEQ ID NO: 1343969 - RNA, 19 nt, Homo sapiens
gcagcaacaccacaagaug

SEQ ID NO: 1343970 - RNA, 19 nt, Homo sapiens
ggaaaccuagauauuuaug

SEQ ID NO: 1343971 - RNA, 19 nt, Homo sapiens
gagaacaaagucuauuuac

SEQ ID NO: 1343972 - RNA, 19 nt, Homo sapiens
cuacagggcuuuuaaugga

SEQ ID NO: 1343973 - RNA, 19 nt, Homo sapiens
cacaucaaguccaagaguu

SEQ ID NO: 1343974 - RNA, 19 nt, Homo sapiens
cccaguguauugccaacua

SEQ ID NO: 1343975 - RNA, 19 nt, Homo sapiens
cuacugaacucugauuagg

SEQ ID NO: 1343976 - RNA, 19 nt, Homo sapiens
uaacuucucacuuggaaca

SEQ ID NO: 1343977 - RNA, 19 nt, Homo sapiens
gaucagugguuggcauuuu

SEQ ID NO: 1343978 - RNA, 19 nt, Homo sapiens
ggagaaccgaugugaaugg

SEQ ID NO: 1343979 - RNA, 19 nt, Homo sapiens
ugaauguaguuaugagagu

SEQ ID NO: 1343980 - RNA, 19 nt, Homo sapiens
gagagugcaagaaauagug

SEQ ID NO: 1343981 - RNA, 19 nt, Homo sapiens
ugaagcugguuggguguaa

SEQ ID NO: 1343982 - RNA, 19 nt, Homo sapiens
uaauggagaacaaagucua

SEQ ID NO: 1343983 - RNA, 19 nt, Homo sapiens
gauaagguaaagcaacuca

SEQ ID NO: 1343984 - RNA, 19 nt, Homo sapiens
uggaacagacugcguaaga

SEQ ID NO: 1343985 - RNA, 19 nt, Homo sapiens
uaugagagugcugccauua

SEQ ID NO: 1343986 - RNA, 19 nt, Homo sapiens
uaguauguauccuuucuag

SEQ ID NO: 1343987 - RNA, 19 nt, Homo sapiens
gagcaaggagaaccgaugu

SEQ ID NO: 1343988 - RNA, 19 nt, Homo sapiens
guccgugaauguaguuaug

SEQ ID NO: 1343989 - RNA, 19 nt, Homo sapiens
gcuuggagauggcuuuggu

SEQ ID NO: 1343990 - RNA, 19 nt, Homo sapiens
aaggagaaccgaugugaau

SEQ ID NO: 1343991 - RNA, 19 nt, Homo sapiens
aguuugcagucuauguuua

SEQ ID NO: 1343992 - RNA, 19 nt, Homo sapiens
ggauugcccagcuauagug

SEQ ID NO: 1343993 - RNA, 19 nt, Homo sapiens
uuacaggacucugcuaacu

SEQ ID NO: 1343994 - RNA, 19 nt, Homo sapiens
ggagcacagugaagaccau

SEQ ID NO: 1343995 - RNA, 19 nt, Homo sapiens
ggagagugcaagaaauagu

SEQ ID NO: 1343996 - RNA, 19 nt, Homo sapiens
gggaaaggugccaucuuga

SEQ ID NO: 1343997 - RNA, 19 nt, Homo sapiens
gagguugaauuuggucuac

SEQ ID NO: 1343998 - RNA, 19 nt, Homo sapiens
gugaagacccugagagcau

SEQ ID NO: 1343999 - RNA, 19 nt, Homo sapiens
caaguacucagacuggaau

SEQ ID NO: 1344000 - RNA, 19 nt, Homo sapiens
caaguccaagaguuguuua

SEQ ID NO: 1344001 - RNA, 19 nt, Homo sapiens
cauggcacaucaaguccaa

SEQ ID NO: 1344002 - RNA, 19 nt, Homo sapiens
ucuacaggcuagcaguuug

SEQ ID NO: 1344003 - RNA, 19 nt, Homo sapiens
agaaagagcuagauaaaug

SEQ ID NO: 1344004 - RNA, 19 nt, Homo sapiens
gaagaaagagcuagauaaa

SEQ ID NO: 1344005 - RNA, 19 nt, Homo sapiens
ggaauaagaugccaaugau

SEQ ID NO: 1344006 - RNA, 19 nt, Homo sapiens
ccaaguaucugucuuucuu

SEQ ID NO: 1344007 - RNA, 19 nt, Homo sapiens
cgacaggccuucuucuauu

SEQ ID NO: 1344008 - RNA, 19 nt, Homo sapiens
caccaugccuggcuaauuu

SEQ ID NO: 1344009 - RNA, 19 nt, Homo sapiens
gaggauacuuucuggguuu

SEQ ID NO: 1344010 - RNA, 19 nt, Homo sapiens
uaaaugugcucuucugguu

SEQ ID NO: 1344011 - RNA, 19 nt, Homo sapiens
ggagagaucuuccaaucca

SEQ ID NO: 1344012 - RNA, 19 nt, Homo sapiens
aaggagagcugcacauuga

SEQ ID NO: 1344013 - RNA, 19 nt, Homo sapiens
ccaaaucaguggcuucuau

SEQ ID NO: 1344014 - RNA, 19 nt, Homo sapiens
cagaauauccugagaaaga

SEQ ID NO: 1344015 - RNA, 19 nt, Homo sapiens
uagcagaagugguugauga

SEQ ID NO: 1344016 - RNA, 19 nt, Homo sapiens
ccacagguuucauuuaaga

SEQ ID NO: 1344017 - RNA, 19 nt, Homo sapiens
uaccacagguuucauuuaa

SEQ ID NO: 1344018 - RNA, 19 nt, Homo sapiens
ccaaaucucugccaucaca

SEQ ID NO: 1344019 - RNA, 19 nt, Homo sapiens
ggauagaccugaagaacca

SEQ ID NO: 1344020 - RNA, 19 nt, Homo sapiens
ggagauggcagcagagauu

SEQ ID NO: 1344021 - RNA, 19 nt, Homo sapiens
gccaucugcuuacccauua

SEQ ID NO: 1344022 - RNA, 19 nt, Homo sapiens
gcagauaaugugacucuuu

SEQ ID NO: 1344023 - RNA, 19 nt, Homo sapiens
gacagugccugauuugaga

SEQ ID NO: 1344024 - RNA, 19 nt, Homo sapiens
cagauaaugugacucuuug

SEQ ID NO: 1344025 - RNA, 19 nt, Homo sapiens
agagagagguauuaaacaa

SEQ ID NO: 1344026 - RNA, 19 nt, Homo sapiens
gaacuaaugcuauucuucu

SEQ ID NO: 1344027 - RNA, 19 nt, Homo sapiens
gccagcacauuuccacuuu

SEQ ID NO: 1344028 - RNA, 19 nt, Homo sapiens
gaaggagagcugcacauug

SEQ ID NO: 1344029 - RNA, 19 nt, Homo sapiens
gacaggccuucuucuauug

SEQ ID NO: 1344030 - RNA, 19 nt, Homo sapiens
ggagagagagagguauuaa

SEQ ID NO: 1344031 - RNA, 19 nt, Homo sapiens
cagaagugguugaugaguu

SEQ ID NO: 1344032 - RNA, 19 nt, Homo sapiens
gaaagagcuagauaaaugu

SEQ ID NO: 1344033 - RNA, 19 nt, Homo sapiens
gcccauacauucugcaaca

SEQ ID NO: 1344034 - RNA, 19 nt, Homo sapiens
ggaaggagagcugcacauu

SEQ ID NO: 1344035 - RNA, 19 nt, Homo sapiens
guaucugucuuucuuuaug

SEQ ID NO: 1344036 - RNA, 19 nt, Homo sapiens
cauuggagguguuuaagga

SEQ ID NO: 1344037 - RNA, 19 nt, Homo sapiens
gcuaacaggugcauaaucc

SEQ ID NO: 1344038 - RNA, 19 nt, Homo sapiens
gcaccggcaucaagaucaa

SEQ ID NO: 1344039 - RNA, 19 nt, Homo sapiens
ggccgacagugccugauuu

SEQ ID NO: 1344040 - RNA, 19 nt, Homo sapiens
cagcagagauuaaaacaga

SEQ ID NO: 1344041 - RNA, 19 nt, Homo sapiens
ggcaggaccuucggccuaa

SEQ ID NO: 1344042 - RNA, 19 nt, Homo sapiens
gagagagguauuaaacaaa

SEQ ID NO: 1344043 - RNA, 19 nt, Homo sapiens
gaggcagucuccaccuuga

SEQ ID NO: 1344044 - RNA, 19 nt, Homo sapiens
aacagaauauccugagaaa

SEQ ID NO: 1344045 - RNA, 19 nt, Homo sapiens
agaagaaagagcuagauaa

SEQ ID NO: 1344046 - RNA, 19 nt, Homo sapiens
ggagacaggguucgccaaa

SEQ ID NO: 1344047 - RNA, 19 nt, Homo sapiens
ugaggaaaauguugcaaua

SEQ ID NO: 1344048 - RNA, 19 nt, Homo sapiens
cuagauaaaugugcucuuc

SEQ ID NO: 1344049 - RNA, 19 nt, Homo sapiens
ucaugacgcgugccauuua

SEQ ID NO: 1344050 - RNA, 19 nt, Homo sapiens
agaagugguugaugaguuc

SEQ ID NO: 1344051 - RNA, 19 nt, Homo sapiens
ugccuuagccucccaagua

SEQ ID NO: 1344052 - RNA, 19 nt, Homo sapiens
cuuccuacauuuccacuuu

SEQ ID NO: 1344053 - RNA, 19 nt, Homo sapiens
gcccuucucucaucuuauc

SEQ ID NO: 1344054 - RNA, 19 nt, Homo sapiens
gagagagagagguauuaaa

SEQ ID NO: 1344055 - RNA, 19 nt, Homo sapiens
gggcaaguuuaaugagguu

SEQ ID NO: 1344056 - RNA, 19 nt, Homo sapiens
gcgacaggccuucuucuau

SEQ ID NO: 1344057 - RNA, 19 nt, Homo sapiens
gcauauuucuagguuacuu

SEQ ID NO: 1344058 - RNA, 19 nt, Homo sapiens
cagcauauuucuagguuac

SEQ ID NO: 1344059 - RNA, 19 nt, Homo sapiens
cagcacauuuccacuuuua

SEQ ID NO: 1344060 - RNA, 19 nt, Homo sapiens
cauaaucccugugcuccuu

SEQ ID NO: 1344061 - RNA, 19 nt, Homo sapiens
gagauggcagcagagauua

SEQ ID NO: 1344062 - RNA, 19 nt, Homo sapiens
ugggagagaucuuccaauc

SEQ ID NO: 1344063 - RNA, 19 nt, Homo sapiens
gcacauugagaacaaagga

SEQ ID NO: 1344064 - RNA, 19 nt, Homo sapiens
ggaugugcaugugugugua

SEQ ID NO: 1344065 - RNA, 19 nt, Homo sapiens
gcuagaaaugcaacuugua

SEQ ID NO: 1344066 - RNA, 19 nt, Homo sapiens
gcaagugcuagaacuaaug

SEQ ID NO: 1344067 - RNA, 19 nt, Homo sapiens
guccagcgcucacgguuca

SEQ ID NO: 1344068 - RNA, 19 nt, Homo sapiens
ggaagggcagauaauguga

SEQ ID NO: 1344069 - RNA, 19 nt, Homo sapiens
aaacagaauauccugagaa

SEQ ID NO: 1344070 - RNA, 19 nt, Homo sapiens
ccagcauauuucuagguua

SEQ ID NO: 1344071 - RNA, 19 nt, Homo sapiens
gggagagagagagguauua

SEQ ID NO: 1344072 - RNA, 19 nt, Homo sapiens
uggaauaagaugccaauga

SEQ ID NO: 1344073 - RNA, 19 nt, Homo sapiens
ggcaagugcuagaacuaau

SEQ ID NO: 1344074 - RNA, 19 nt, Homo sapiens
aagaagaaagagcuagaua

SEQ ID NO: 1344075 - RNA, 19 nt, Homo sapiens
ggagagcugcacauugaga

SEQ ID NO: 1344076 - RNA, 19 nt, Homo sapiens
gagcgccucgggucaguaa

SEQ ID NO: 1344077 - RNA, 19 nt, Homo sapiens
ggcaggaagugaaggagau

SEQ ID NO: 1344078 - RNA, 19 nt, Homo sapiens
gauggcagcagagauuaaa

SEQ ID NO: 1344079 - RNA, 19 nt, Homo sapiens
cuuaugggcagauuuguaa

SEQ ID NO: 1344080 - RNA, 19 nt, Homo sapiens
ggucaugacgcgugccauu

SEQ ID NO: 1344081 - RNA, 19 nt, Homo sapiens
gaauaagaugccaaugaug

SEQ ID NO: 1344082 - RNA, 19 nt, Homo sapiens
caaugaguaucgagaguac

SEQ ID NO: 1344083 - RNA, 19 nt, Homo sapiens
gcccugcccuucucucauc

SEQ ID NO: 1344084 - RNA, 19 nt, Homo sapiens
ucauggccuuccuacauuu

SEQ ID NO: 1344085 - RNA, 19 nt, Homo sapiens
gagagagagguauuaaaca

SEQ ID NO: 1344086 - RNA, 19 nt, Homo sapiens
cuagaaaugcaacuuguau

SEQ ID NO: 1344087 - RNA, 19 nt, Homo sapiens
aauaagaugccaaugaugu

SEQ ID NO: 1344088 - RNA, 19 nt, Homo sapiens
cauccaaguaucugucuuu

SEQ ID NO: 1344089 - RNA, 19 nt, Homo sapiens
guaucgagaguacaucaaa

SEQ ID NO: 1344090 - RNA, 19 nt, Homo sapiens
uaaggaagggcagauaaug

SEQ ID NO: 1344091 - RNA, 19 nt, Homo sapiens
cagguuucauuuaagaaga

SEQ ID NO: 1344092 - RNA, 19 nt, Homo sapiens
ggcuagaaaugcaacuugu

SEQ ID NO: 1344093 - RNA, 19 nt, Homo sapiens
agauaaaugugcucuucug

SEQ ID NO: 1344094 - RNA, 19 nt, Homo sapiens
gccuucuucuauugacuua

SEQ ID NO: 1344095 - RNA, 19 nt, Homo sapiens
ugacaaaacuccagcugau

SEQ ID NO: 1344096 - RNA, 19 nt, Homo sapiens
agacauucauuucuuacuc

SEQ ID NO: 1344097 - RNA, 19 nt, Homo sapiens
cucauggccuuccuacauu

SEQ ID NO: 1344098 - RNA, 19 nt, Homo sapiens
guacgugcuuguggucaug

SEQ ID NO: 1344099 - RNA, 19 nt, Homo sapiens
ucaaugaguaucgagagua

SEQ ID NO: 1344100 - RNA, 19 nt, Homo sapiens
uuacuuaugggcagauuug

SEQ ID NO: 1344101 - RNA, 19 nt, Homo sapiens
cgacagugccugauuugag

SEQ ID NO: 1344102 - RNA, 19 nt, Homo sapiens
cuucuggguucacgugauu

SEQ ID NO: 1344103 - RNA, 19 nt, Homo sapiens
uaaagcaaguccagucuua

SEQ ID NO: 1344104 - RNA, 19 nt, Homo sapiens
gaaucacgcuggugcucuu

SEQ ID NO: 1344105 - RNA, 19 nt, Homo sapiens
caaccuggcccacuucuuc

SEQ ID NO: 1344106 - RNA, 19 nt, Homo sapiens
gcgcaaccacccacucuuu

SEQ ID NO: 1344107 - RNA, 19 nt, Homo sapiens
gggaauucaucuccucaca

SEQ ID NO: 1344108 - RNA, 19 nt, Homo sapiens
ggucaggccuccgguucuu

SEQ ID NO: 1344109 - RNA, 19 nt, Homo sapiens
gggcugaggaggaggaaga

SEQ ID NO: 1344110 - RNA, 19 nt, Homo sapiens
gcaaccacccacucuuugu

SEQ ID NO: 1344111 - RNA, 19 nt, Homo sapiens
aagcaaguccagucuuaaa

SEQ ID NO: 1344112 - RNA, 19 nt, Homo sapiens
gagcuucaagucagacaga

SEQ ID NO: 1344113 - RNA, 19 nt, Homo sapiens
gugcacacuuuuacaaauu

SEQ ID NO: 1344114 - RNA, 19 nt, Homo sapiens
auaccgagcugcggcaaug

SEQ ID NO: 1344115 - RNA, 19 nt, Homo sapiens
ggagcagacagccaugguu

SEQ ID NO: 1344116 - RNA, 19 nt, Homo sapiens
ggaagaaggggaagaaaag

SEQ ID NO: 1344117 - RNA, 19 nt, Homo sapiens
caaccacccacucuuugug

SEQ ID NO: 1344118 - RNA, 19 nt, Homo sapiens
ccagaacggagcuucaagu

SEQ ID NO: 1344119 - RNA, 19 nt, Homo sapiens
aaagcaaguccagucuuaa

SEQ ID NO: 1344120 - RNA, 19 nt, Homo sapiens
gagcgcaaccacccacucu

SEQ ID NO: 1344121 - RNA, 19 nt, Homo sapiens
cuucggcgcugcagauacu

SEQ ID NO: 1344122 - RNA, 19 nt, Homo sapiens
caggagaucuuguaaauaa

SEQ ID NO: 1344123 - RNA, 19 nt, Homo sapiens
gaguauggauuguuguuua

SEQ ID NO: 1344124 - RNA, 19 nt, Homo sapiens
gcugagggcuguaggaauu

SEQ ID NO: 1344125 - RNA, 19 nt, Homo sapiens
cauaggaccuucugaaaug

SEQ ID NO: 1344126 - RNA, 19 nt, Homo sapiens
gcacaggucagcucaagua

SEQ ID NO: 1344127 - RNA, 19 nt, Homo sapiens
ggauucagcucaaggauuc

SEQ ID NO: 1344128 - RNA, 19 nt, Homo sapiens
gguagcaaauguauaugua

SEQ ID NO: 1344129 - RNA, 19 nt, Homo sapiens
gaagaacccuaaaauguuu

SEQ ID NO: 1344130 - RNA, 19 nt, Homo sapiens
guucucaccugaagccuua

SEQ ID NO: 1344131 - RNA, 19 nt, Homo sapiens
gguauagccuccugagauu

SEQ ID NO: 1344132 - RNA, 19 nt, Homo sapiens
ggucagggcucuucugcuu

SEQ ID NO: 1344133 - RNA, 19 nt, Homo sapiens
ggagaaaccugagcaugau

SEQ ID NO: 1344134 - RNA, 19 nt, Homo sapiens
cgaaagcgcuucacuuacu

SEQ ID NO: 1344135 - RNA, 19 nt, Homo sapiens
ggaagcugcugcacucaga

SEQ ID NO: 1344136 - RNA, 19 nt, Homo sapiens
gguagaaccagauauauau

SEQ ID NO: 1344137 - RNA, 19 nt, Homo sapiens
caggucagcucaaguaaug

SEQ ID NO: 1344138 - RNA, 19 nt, Homo sapiens
uuaaaugccuguuucauag

SEQ ID NO: 1344139 - RNA, 19 nt, Homo sapiens
uuucuuagcucuccauuug

SEQ ID NO: 1344140 - RNA, 19 nt, Homo sapiens
gaaagcgcuucacuuacuu

SEQ ID NO: 1344141 - RNA, 19 nt, Homo sapiens
caaagugugucuucuucuu

SEQ ID NO: 1344142 - RNA, 19 nt, Homo sapiens
uggaaguucuuguugcuua

SEQ ID NO: 1344143 - RNA, 19 nt, Homo sapiens
gaaagcuucugccucacuu

SEQ ID NO: 1344144 - RNA, 19 nt, Homo sapiens
uaacggcacuguucacaca

SEQ ID NO: 1344145 - RNA, 19 nt, Homo sapiens
cuccugagauuaaauguaa

SEQ ID NO: 1344146 - RNA, 19 nt, Homo sapiens
ggucaauauugccagauuu

SEQ ID NO: 1344147 - RNA, 19 nt, Homo sapiens
ucuggaaacuggucaauau

SEQ ID NO: 1344148 - RNA, 19 nt, Homo sapiens
gcucaaggauucagugucu

SEQ ID NO: 1344149 - RNA, 19 nt, Homo sapiens
gcaaccagccucuguuuca

SEQ ID NO: 1344150 - RNA, 19 nt, Homo sapiens
ucuuuaaccugcucugaua

SEQ ID NO: 1344151 - RNA, 19 nt, Homo sapiens
acugacgacuuguaacuua

SEQ ID NO: 1344152 - RNA, 19 nt, Homo sapiens
acacagggauccucagaau

SEQ ID NO: 1344153 - RNA, 19 nt, Homo sapiens
gagcagugggcauucuuua

SEQ ID NO: 1344154 - RNA, 19 nt, Homo sapiens
caaagucuaugcgaagaug

SEQ ID NO: 1344155 - RNA, 19 nt, Homo sapiens
gcuucugccucacuuagua

SEQ ID NO: 1344156 - RNA, 19 nt, Homo sapiens
ggaagaucaugcaggacaa

SEQ ID NO: 1344157 - RNA, 19 nt, Homo sapiens
uaaagcacauagcaacuca

SEQ ID NO: 1344158 - RNA, 19 nt, Homo sapiens
ccugaagccuuaaucuuug

SEQ ID NO: 1344159 - RNA, 19 nt, Homo sapiens
ggaaguucuuguugcuuau

SEQ ID NO: 1344160 - RNA, 19 nt, Homo sapiens
ucagugauuugauaacaga

SEQ ID NO: 1344161 - RNA, 19 nt, Homo sapiens
ggaaacuggucaauauugc

SEQ ID NO: 1344162 - RNA, 19 nt, Homo sapiens
agaguugcauguuuaaaga

SEQ ID NO: 1344163 - RNA, 19 nt, Homo sapiens
guagcaguguagucuuuaa

SEQ ID NO: 1344164 - RNA, 19 nt, Homo sapiens
aaacaaagagucagaugga

SEQ ID NO: 1344165 - RNA, 19 nt, Homo sapiens
gcagaagccaugucucuca

SEQ ID NO: 1344166 - RNA, 19 nt, Homo sapiens
gaagcgucauucuggaaga

SEQ ID NO: 1344167 - RNA, 19 nt, Homo sapiens
caaagagucagauggaguu

SEQ ID NO: 1344168 - RNA, 19 nt, Homo sapiens
cggcagaucuuccucuaca

SEQ ID NO: 1344169 - RNA, 19 nt, Homo sapiens
ccagcaauaacucuaauaa

SEQ ID NO: 1344170 - RNA, 19 nt, Homo sapiens
gaguuuguauucuguagug

SEQ ID NO: 1344171 - RNA, 19 nt, Homo sapiens
ugaucugccucuucuauug

SEQ ID NO: 1344172 - RNA, 19 nt, Homo sapiens
gcaaauguauauguaugag

SEQ ID NO: 1344173 - RNA, 19 nt, Homo sapiens
gaaccuaugguagcaaaug

SEQ ID NO: 1344174 - RNA, 19 nt, Homo sapiens
gcauggggcuguuguagaa

SEQ ID NO: 1344175 - RNA, 19 nt, Homo sapiens
gcagugggcauucuuuauc

SEQ ID NO: 1344176 - RNA, 19 nt, Homo sapiens
gaacagacugcggguaugu

SEQ ID NO: 1344177 - RNA, 19 nt, Homo sapiens
gauugagggugauguuauc

SEQ ID NO: 1344178 - RNA, 19 nt, Homo sapiens
cuaauuucuuucccacuuu

SEQ ID NO: 1344179 - RNA, 19 nt, Homo sapiens
gggcucuucugcuuaguug

SEQ ID NO: 1344180 - RNA, 19 nt, Homo sapiens
gcggguauguagcagugua

SEQ ID NO: 1344181 - RNA, 19 nt, Homo sapiens
ggauucagugucuucauuu

SEQ ID NO: 1344182 - RNA, 19 nt, Homo sapiens
ccaauauucccuccaaguu

SEQ ID NO: 1344183 - RNA, 19 nt, Homo sapiens
ggaaacaaagagucagaug

SEQ ID NO: 1344184 - RNA, 19 nt, Homo sapiens
gagcuuagaaaucccaguu

SEQ ID NO: 1344185 - RNA, 19 nt, Homo sapiens
uaugugaccuguugguugu

SEQ ID NO: 1344186 - RNA, 19 nt, Homo sapiens
ggaacagacugcggguaug

SEQ ID NO: 1344187 - RNA, 19 nt, Homo sapiens
gaaccagauauauaugcua

SEQ ID NO: 1344188 - RNA, 19 nt, Homo sapiens
uagaaccuaugguagcaaa

SEQ ID NO: 1344189 - RNA, 19 nt, Homo sapiens
uuauauccauuuccucuug

SEQ ID NO: 1344190 - RNA, 19 nt, Homo sapiens
ggauguguuucaaccaugu

SEQ ID NO: 1344191 - RNA, 19 nt, Homo sapiens
gagaagauccgcgagaagu

SEQ ID NO: 1344192 - RNA, 19 nt, Homo sapiens
gcccagcacccagcaauaa

SEQ ID NO: 1344193 - RNA, 19 nt, Homo sapiens
gguucuuucuguaccauuu

SEQ ID NO: 1344194 - RNA, 19 nt, Homo sapiens
aaccugcucugauacauau

SEQ ID NO: 1344195 - RNA, 19 nt, Homo sapiens
gcuguaggaauuauugaaa

SEQ ID NO: 1344196 - RNA, 19 nt, Homo sapiens
acagggauccucagaauca

SEQ ID NO: 1344197 - RNA, 19 nt, Homo sapiens
uaaccugcucugauacaua

SEQ ID NO: 1344198 - RNA, 19 nt, Homo sapiens
gggaacagacugcggguau

SEQ ID NO: 1344199 - RNA, 19 nt, Homo sapiens
gagaguaggccaaggugau

SEQ ID NO: 1344200 - RNA, 19 nt, Homo sapiens
gauguuaucagccaugaca

SEQ ID NO: 1344201 - RNA, 19 nt, Homo sapiens
uauagccuccugagauuaa

SEQ ID NO: 1344202 - RNA, 19 nt, Homo sapiens
gcacccagcaauaacucua

SEQ ID NO: 1344203 - RNA, 19 nt, Homo sapiens
ucuaauuucuuucccacuu

SEQ ID NO: 1344204 - RNA, 19 nt, Homo sapiens
aagaaagaccuguguccua

SEQ ID NO: 1344205 - RNA, 19 nt, Homo sapiens
cauagcaacucaccucaac

SEQ ID NO: 1344206 - RNA, 19 nt, Homo sapiens
uugcuuaugugaccuguug

SEQ ID NO: 1344207 - RNA, 19 nt, Homo sapiens
uucaggagaucuuguaaau

SEQ ID NO: 1344208 - RNA, 19 nt, Homo sapiens
ugaagacgggauuugauuu

SEQ ID NO: 1344209 - RNA, 19 nt, Homo sapiens
ggcaaagucuaugcgaaga

SEQ ID NO: 1344210 - RNA, 19 nt, Homo sapiens
guaugaguuuguauucugu

SEQ ID NO: 1344211 - RNA, 19 nt, Homo sapiens
ccaaggcugcccaguggua

SEQ ID NO: 1344212 - RNA, 19 nt, Homo sapiens
ucagggcucuucugcuuag

SEQ ID NO: 1344213 - RNA, 19 nt, Homo sapiens
uaauucaggagaucuugua

SEQ ID NO: 1344214 - RNA, 19 nt, Homo sapiens
guuaauaauucaggagauc

SEQ ID NO: 1344215 - RNA, 19 nt, Homo sapiens
gggacgaggaucuaacuug

SEQ ID NO: 1344216 - RNA, 19 nt, Homo sapiens
ccucaaaggauguguuuca

SEQ ID NO: 1344217 - RNA, 19 nt, Homo sapiens
gaagacgggauuugauuuu

SEQ ID NO: 1344218 - RNA, 19 nt, Homo sapiens
cgucucccuuucuuuaauu

SEQ ID NO: 1344219 - RNA, 19 nt, Homo sapiens
ucaggaagagccucccuuu

SEQ ID NO: 1344220 - RNA, 19 nt, Homo sapiens
cagcaaccagccucuguuu

SEQ ID NO: 1344221 - RNA, 19 nt, Homo sapiens
aggauucagugucuucauu

SEQ ID NO: 1344222 - RNA, 19 nt, Homo sapiens
gguaacagcuaucagauga

SEQ ID NO: 1344223 - RNA, 19 nt, Homo sapiens
ggagauaacauuacuguga

SEQ ID NO: 1344224 - RNA, 19 nt, Homo sapiens
ccucaugccuguuucaaua

SEQ ID NO: 1344225 - RNA, 19 nt, Homo sapiens
ggacagcucuuccaaguac

SEQ ID NO: 1344226 - RNA, 19 nt, Homo sapiens
gcuauuggcaugauacuua

SEQ ID NO: 1344227 - RNA, 19 nt, Homo sapiens
gaacugcuauaauguguca

SEQ ID NO: 1344228 - RNA, 19 nt, Homo sapiens
gagauaacauuacugugaa

SEQ ID NO: 1344229 - RNA, 19 nt, Homo sapiens
acaaauagacuucgacuuu

SEQ ID NO: 1344230 - RNA, 19 nt, Homo sapiens
ggaguggacuaguugaauu

SEQ ID NO: 1344231 - RNA, 19 nt, Homo sapiens
gagcaaagcaguugugguu

SEQ ID NO: 1344232 - RNA, 19 nt, Homo sapiens
gaaccagacucuaggagau

SEQ ID NO: 1344233 - RNA, 19 nt, Homo sapiens
ucaaugauaugcuugcaaa

SEQ ID NO: 1344234 - RNA, 19 nt, Homo sapiens
guggucaucugcuguguua

SEQ ID NO: 1344235 - RNA, 19 nt, Homo sapiens
guaccuugcacacuuauua

SEQ ID NO: 1344236 - RNA, 19 nt, Homo sapiens
gguguucacuguggcauua

SEQ ID NO: 1344237 - RNA, 19 nt, Homo sapiens
aaacauauggucuguguaa

SEQ ID NO: 1344238 - RNA, 19 nt, Homo sapiens
gaucugaauuuccugaugu

SEQ ID NO: 1344239 - RNA, 19 nt, Homo sapiens
acaaaugguugguuuaugu

SEQ ID NO: 1344240 - RNA, 19 nt, Homo sapiens
ggucuuacuuuauuucuuc

SEQ ID NO: 1344241 - RNA, 19 nt, Homo sapiens
uaacaccauucaucacaaa

SEQ ID NO: 1344242 - RNA, 19 nt, Homo sapiens
gaagacaggugggcuugga

SEQ ID NO: 1344243 - RNA, 19 nt, Homo sapiens
uaacagaucugaauuuccu

SEQ ID NO: 1344244 - RNA, 19 nt, Homo sapiens
gaagcaauguuaguuguca

SEQ ID NO: 1344245 - RNA, 19 nt, Homo sapiens
gguaacagaucugaauuuc

SEQ ID NO: 1344246 - RNA, 19 nt, Homo sapiens
gcaaccugcucuccucuau

SEQ ID NO: 1344247 - RNA, 19 nt, Homo sapiens
gcaugauacuuacauuugu

SEQ ID NO: 1344248 - RNA, 19 nt, Homo sapiens
aaccugcucuccucuauuu

SEQ ID NO: 1344249 - RNA, 19 nt, Homo sapiens
caaagaauggugagaguau

SEQ ID NO: 1344250 - RNA, 19 nt, Homo sapiens
gacugguucuucuuacaua

SEQ ID NO: 1344251 - RNA, 19 nt, Homo sapiens
guaccaggccuguugauug

SEQ ID NO: 1344252 - RNA, 19 nt, Homo sapiens
caucguggccuaacuuuga

SEQ ID NO: 1344253 - RNA, 19 nt, Homo sapiens
uaugcaaccuuucugauau

SEQ ID NO: 1344254 - RNA, 19 nt, Homo sapiens
guuguugccuggagacgua

SEQ ID NO: 1344255 - RNA, 19 nt, Homo sapiens
ccuccucuaugauguauuu

SEQ ID NO: 1344256 - RNA, 19 nt, Homo sapiens
uaagauaccauauggacaa

SEQ ID NO: 1344257 - RNA, 19 nt, Homo sapiens
caaugagucuguacaacug

SEQ ID NO: 1344258 - RNA, 19 nt, Homo sapiens
uggccuaacuuugauuaua

SEQ ID NO: 1344259 - RNA, 19 nt, Homo sapiens
gauaugaaccagacucuag

SEQ ID NO: 1344260 - RNA, 19 nt, Homo sapiens
guagaagauuugauguuca

SEQ ID NO: 1344261 - RNA, 19 nt, Homo sapiens
gggauugcuuucugucuga

SEQ ID NO: 1344262 - RNA, 19 nt, Homo sapiens
uuaguaccuugcacacuua

SEQ ID NO: 1344263 - RNA, 19 nt, Homo sapiens
gaaauggcacaaccaagga

SEQ ID NO: 1344264 - RNA, 19 nt, Homo sapiens
uaauugcgguguucacugu

SEQ ID NO: 1344265 - RNA, 19 nt, Homo sapiens
caacugucuugcugcacua

SEQ ID NO: 1344266 - RNA, 19 nt, Homo sapiens
caucagcaaugagucugua

SEQ ID NO: 1344267 - RNA, 19 nt, Homo sapiens
guuaugauggucuuacuuu

SEQ ID NO: 1344268 - RNA, 19 nt, Homo sapiens
caaauagacuucgacuuuu

SEQ ID NO: 1344269 - RNA, 19 nt, Homo sapiens
gaagaaaacccugugauau

SEQ ID NO: 1344270 - RNA, 19 nt, Homo sapiens
ggcaugauacuuacauuug

SEQ ID NO: 1344271 - RNA, 19 nt, Homo sapiens
gugagaguaucaugguuga

SEQ ID NO: 1344272 - RNA, 19 nt, Homo sapiens
gcaaugagucuguacaacu

SEQ ID NO: 1344273 - RNA, 19 nt, Homo sapiens
ggccuaacuuugauuauac

SEQ ID NO: 1344274 - RNA, 19 nt, Homo sapiens
ggaaagguaacagcuauca

SEQ ID NO: 1344275 - RNA, 19 nt, Homo sapiens
uguagaagauuugauguuc

SEQ ID NO: 1344276 - RNA, 19 nt, Homo sapiens
caccauucaucacaaagaa

SEQ ID NO: 1344277 - RNA, 19 nt, Homo sapiens
gugcauagcaguagcuguu

SEQ ID NO: 1344278 - RNA, 19 nt, Homo sapiens
gauaccauauggacaaugc

SEQ ID NO: 1344279 - RNA, 19 nt, Homo sapiens
uugcugcacuaauucauaa

SEQ ID NO: 1344280 - RNA, 19 nt, Homo sapiens
acuacugcaugcuuuauaa

SEQ ID NO: 1344281 - RNA, 19 nt, Homo sapiens
gcaauguuaguugucaaua

SEQ ID NO: 1344282 - RNA, 19 nt, Homo sapiens
aaagguaacagcuaucaga

SEQ ID NO: 1344283 - RNA, 19 nt, Homo sapiens
acaccacuaugcaaccuuu

SEQ ID NO: 1344284 - RNA, 19 nt, Homo sapiens
ccauuuggauugugcaaca

SEQ ID NO: 1344285 - RNA, 19 nt, Homo sapiens
gcacuaauucauaagauac

SEQ ID NO: 1344286 - RNA, 19 nt, Homo sapiens
gauagcaauuuucugcaua

SEQ ID NO: 1344287 - RNA, 19 nt, Homo sapiens
agugacaacugaagauaga

SEQ ID NO: 1344288 - RNA, 19 nt, Homo sapiens
cuaugcaaccuuucugaua

SEQ ID NO: 1344289 - RNA, 19 nt, Homo sapiens
uaaaacauauggucugugu

SEQ ID NO: 1344290 - RNA, 19 nt, Homo sapiens
cuucaagucaugugugaua

SEQ ID NO: 1344291 - RNA, 19 nt, Homo sapiens
gggcuguguuucgaaauga

SEQ ID NO: 1344292 - RNA, 19 nt, Homo sapiens
gcauagcaguagcuguugu

SEQ ID NO: 1344293 - RNA, 19 nt, Homo sapiens
ggucaucugcuguguuaug

SEQ ID NO: 1344294 - RNA, 19 nt, Homo sapiens
auacuggaguggacuaguu

SEQ ID NO: 1344295 - RNA, 19 nt, Homo sapiens
gcacaaccaaggacuacug

SEQ ID NO: 1344296 - RNA, 19 nt, Homo sapiens
uuuaguaccuugcacacuu

SEQ ID NO: 1344297 - RNA, 19 nt, Homo sapiens
ugugauaucuggugaacag

SEQ ID NO: 1344298 - RNA, 19 nt, Homo sapiens
acaguugccuaugcuauug

SEQ ID NO: 1344299 - RNA, 19 nt, Homo sapiens
uauacuauguuucgucuac

SEQ ID NO: 1344300 - RNA, 19 nt, Homo sapiens
uggacuaguugaauuggaa

SEQ ID NO: 1344301 - RNA, 19 nt, Homo sapiens
gcucuccucuauuuaguac

SEQ ID NO: 1344302 - RNA, 19 nt, Homo sapiens
cacaaagaauggugagagu

SEQ ID NO: 1344303 - RNA, 19 nt, Homo sapiens
caggugggcuuggauuuua

SEQ ID NO: 1344304 - RNA, 19 nt, Homo sapiens
cugcauagcaucagcaaug

SEQ ID NO: 1344305 - RNA, 19 nt, Homo sapiens
caacugaagauagagaaau

SEQ ID NO: 1344306 - RNA, 19 nt, Homo sapiens
gauuauacuauggugguua

SEQ ID NO: 1344307 - RNA, 19 nt, Homo sapiens
cuggaaagguaacagcuau

SEQ ID NO: 1344308 - RNA, 19 nt, Homo sapiens
ggagacguaaggaaaugaa

SEQ ID NO: 1344309 - RNA, 19 nt, Homo sapiens
gaucuauuucucaguaaug

SEQ ID NO: 1344310 - RNA, 19 nt, Homo sapiens
caaaugguugguuuauguu

SEQ ID NO: 1344311 - RNA, 19 nt, Homo sapiens
ucaugccuguuucaauauu

SEQ ID NO: 1344312 - RNA, 19 nt, Homo sapiens
gccaguagucaucagagua

SEQ ID NO: 1344313 - RNA, 19 nt, Homo sapiens
cauaacaccauucaucaca

SEQ ID NO: 1344314 - RNA, 19 nt, Homo sapiens
agcaguagcuguuguuugg

SEQ ID NO: 1344315 - RNA, 19 nt, Homo sapiens
gcugaagcaauguuaguug

SEQ ID NO: 1344316 - RNA, 19 nt, Homo sapiens
gcauuuauaagcuacaaag

SEQ ID NO: 1344317 - RNA, 19 nt, Homo sapiens
agccagaauugcacagaaa

SEQ ID NO: 1344318 - RNA, 19 nt, Homo sapiens
ugaagaaaacccugugaua

SEQ ID NO: 1344319 - RNA, 19 nt, Homo sapiens
ggacuacugcaugcuuuau

SEQ ID NO: 1344320 - RNA, 19 nt, Homo sapiens
uagaagauuugauguucag

SEQ ID NO: 1344321 - RNA, 19 nt, Homo sapiens
uccauuaguuugaugaauc

SEQ ID NO: 1344322 - RNA, 19 nt, Homo sapiens
uggaagagauuaagaguaa

SEQ ID NO: 1344323 - RNA, 19 nt, Homo sapiens
gcaagcauuucgcagauuu

SEQ ID NO: 1344324 - RNA, 19 nt, Homo sapiens
ggaugugucuuugcuauuu

SEQ ID NO: 1344325 - RNA, 19 nt, Homo sapiens
ggcaauaacuacugaauca

SEQ ID NO: 1344326 - RNA, 19 nt, Homo sapiens
cggcauaucucuacagcua

SEQ ID NO: 1344327 - RNA, 19 nt, Homo sapiens
gcagggccauccauuguga

SEQ ID NO: 1344328 - RNA, 19 nt, Homo sapiens
gcagcgaccuguuucuaug

SEQ ID NO: 1344329 - RNA, 19 nt, Homo sapiens
ggccauggcugaacucaau

SEQ ID NO: 1344330 - RNA, 19 nt, Homo sapiens
caacagcucucugaucauc

SEQ ID NO: 1344331 - RNA, 19 nt, Homo sapiens
cuaaugagcaucuuuguga

SEQ ID NO: 1344332 - RNA, 19 nt, Homo sapiens
caaacucacugaucuugug

SEQ ID NO: 1344333 - RNA, 19 nt, Homo sapiens
gcacaauaauggagaguac

SEQ ID NO: 1344334 - RNA, 19 nt, Homo sapiens
gagcaucuuugugaauauu

SEQ ID NO: 1344335 - RNA, 19 nt, Homo sapiens
ucagagaaguugacccuau

SEQ ID NO: 1344336 - RNA, 19 nt, Homo sapiens
aaugaugucuagcugcuua

SEQ ID NO: 1344337 - RNA, 19 nt, Homo sapiens
caugaucucuggcuucguu

SEQ ID NO: 1344338 - RNA, 19 nt, Homo sapiens
gcauuccucuucaaacuca

SEQ ID NO: 1344339 - RNA, 19 nt, Homo sapiens
gaagaggacuacgaauugg

SEQ ID NO: 1344340 - RNA, 19 nt, Homo sapiens
cagaagaggacuacgaauu

SEQ ID NO: 1344341 - RNA, 19 nt, Homo sapiens
gggaagaaguggaguugca

SEQ ID NO: 1344342 - RNA, 19 nt, Homo sapiens
cugaucaucuucuucaauu

SEQ ID NO: 1344343 - RNA, 19 nt, Homo sapiens
uaacccgucugcuucuaaa

SEQ ID NO: 1344344 - RNA, 19 nt, Homo sapiens
gguguggacugcagugguu

SEQ ID NO: 1344345 - RNA, 19 nt, Homo sapiens
gcauuucucuacauuggau

SEQ ID NO: 1344346 - RNA, 19 nt, Homo sapiens
gcugcucacuggauuguug

SEQ ID NO: 1344347 - RNA, 19 nt, Homo sapiens
cagagaaguugacccuaug

SEQ ID NO: 1344348 - RNA, 19 nt, Homo sapiens
gaacucaaugacaccuaua

SEQ ID NO: 1344349 - RNA, 19 nt, Homo sapiens
agaagaggacuacgaauug

SEQ ID NO: 1344350 - RNA, 19 nt, Homo sapiens
ugcaacagcucucugauca

SEQ ID NO: 1344351 - RNA, 19 nt, Homo sapiens
acuggaagcucacagaaga

SEQ ID NO: 1344352 - RNA, 19 nt, Homo sapiens
ccuaagcacccuggauuua

SEQ ID NO: 1344353 - RNA, 19 nt, Homo sapiens
gcacagccuggaagagauu

SEQ ID NO: 1344354 - RNA, 19 nt, Homo sapiens
cguggucucuggcauuauu

SEQ ID NO: 1344355 - RNA, 19 nt, Homo sapiens
gagcagcgaccuguuucua

SEQ ID NO: 1344356 - RNA, 19 nt, Homo sapiens
guucuuggguucgucauga

SEQ ID NO: 1344357 - RNA, 19 nt, Homo sapiens
cgagguggccaaagauaaa

SEQ ID NO: 1344358 - RNA, 19 nt, Homo sapiens
ggccaaauugucuauguuu

SEQ ID NO: 1344359 - RNA, 19 nt, Homo sapiens
ugaggcauuucucuacauu

SEQ ID NO: 1344360 - RNA, 19 nt, Homo sapiens
ucacccugaugaugccuua

SEQ ID NO: 1344361 - RNA, 19 nt, Homo sapiens
ucugggcucuggaggauuu

SEQ ID NO: 1344362 - RNA, 19 nt, Homo sapiens
cccauguccuugcagaaua

SEQ ID NO: 1344363 - RNA, 19 nt, Homo sapiens
ggaaccacaucucuaagac

SEQ ID NO: 1344364 - RNA, 19 nt, Homo sapiens
gguuucgacuguauugcua

SEQ ID NO: 1344365 - RNA, 19 nt, Homo sapiens
uaaugagcaucuuugugaa

SEQ ID NO: 1344366 - RNA, 19 nt, Homo sapiens
ugaacucaaugacaccuau

SEQ ID NO: 1344367 - RNA, 19 nt, Homo sapiens
gcgagguggccaaagauaa

SEQ ID NO: 1344368 - RNA, 19 nt, Homo sapiens
uaagcacccuggauuuagu

SEQ ID NO: 1344369 - RNA, 19 nt, Homo sapiens
ccacuaaugagcaucuuug

SEQ ID NO: 1344370 - RNA, 19 nt, Homo sapiens
gaauauccagauuucuuug

SEQ ID NO: 1344371 - RNA, 19 nt, Homo sapiens
ccauguccuugcagaauau

SEQ ID NO: 1344372 - RNA, 19 nt, Homo sapiens
gggaaccacaucucuaaga

SEQ ID NO: 1344373 - RNA, 19 nt, Homo sapiens
gcugugcuaugcggaguuu

SEQ ID NO: 1344374 - RNA, 19 nt, Homo sapiens
gguggauacuaauacaguu

SEQ ID NO: 1344375 - RNA, 19 nt, Homo sapiens
ccacuccccuucacuuuaa

SEQ ID NO: 1344376 - RNA, 19 nt, Homo sapiens
cgaccuguuucuaugcauu

SEQ ID NO: 1344377 - RNA, 19 nt, Homo sapiens
ggaaccucauccucuccua

SEQ ID NO: 1344378 - RNA, 19 nt, Homo sapiens
gaaggaugugucuuugcua

SEQ ID NO: 1344379 - RNA, 19 nt, Homo sapiens
ggacccugcuugcuuacuc

SEQ ID NO: 1344380 - RNA, 19 nt, Homo sapiens
ucaaugacaccuauagcuu

SEQ ID NO: 1344381 - RNA, 19 nt, Homo sapiens
uaaagcagggccauccauu

SEQ ID NO: 1344382 - RNA, 19 nt, Homo sapiens
gcuucuaaaugaugucuag

SEQ ID NO: 1344383 - RNA, 19 nt, Homo sapiens
ggugguggauacuaauaca

SEQ ID NO: 1344384 - RNA, 19 nt, Homo sapiens
gcucauuauugggaucauu

SEQ ID NO: 1344385 - RNA, 19 nt, Homo sapiens
uugggacccugcuugcuua

SEQ ID NO: 1344386 - RNA, 19 nt, Homo sapiens
gagaagaagcccagaaucc

SEQ ID NO: 1344387 - RNA, 19 nt, Homo sapiens
ucuaugcauuuguugguuu

SEQ ID NO: 1344388 - RNA, 19 nt, Homo sapiens
caacuggaagcucacagaa

SEQ ID NO: 1344389 - RNA, 19 nt, Homo sapiens
agacucgccuugccagaug

SEQ ID NO: 1344390 - RNA, 19 nt, Homo sapiens
gaaccucauccucuccuau

SEQ ID NO: 1344391 - RNA, 19 nt, Homo sapiens
gaugugucuuugcuauuuc

SEQ ID NO: 1344392 - RNA, 19 nt, Homo sapiens
augagcaucuuugugaaua

SEQ ID NO: 1344393 - RNA, 19 nt, Homo sapiens
cauccucuccuaugucauu

SEQ ID NO: 1344394 - RNA, 19 nt, Homo sapiens
aaggaugugucuuugcuau

SEQ ID NO: 1344395 - RNA, 19 nt, Homo sapiens
ugaaggaugugucuuugcu

SEQ ID NO: 1344396 - RNA, 19 nt, Homo sapiens
cagcacagccuggaagaga

SEQ ID NO: 1344397 - RNA, 19 nt, Homo sapiens
acuuuaaggugccugcuuu

SEQ ID NO: 1344398 - RNA, 19 nt, Homo sapiens
ugcagaauauccagauuuc

SEQ ID NO: 1344399 - RNA, 19 nt, Homo sapiens
acgcaagucuagagccaaa

SEQ ID NO: 1344400 - RNA, 19 nt, Homo sapiens
ccaguggucaguuccauug

SEQ ID NO: 1344401 - RNA, 19 nt, Homo sapiens
gcucucugaucaucuucuu

SEQ ID NO: 1344402 - RNA, 19 nt, Homo sapiens
uccacucucuggccaaauu

SEQ ID NO: 1344403 - RNA, 19 nt, Homo sapiens
ggagaagaagcccagaauc

SEQ ID NO: 1344404 - RNA, 19 nt, Homo sapiens
ccagauuucuuugcuuugg

SEQ ID NO: 1344405 - RNA, 19 nt, Homo sapiens
ggcaagcauuucgcagauu

SEQ ID NO: 1344406 - RNA, 19 nt, Homo sapiens
ggccauccauugugaucug

SEQ ID NO: 1344407 - RNA, 19 nt, Homo sapiens
gacaaagacuggggaagaa

SEQ ID NO: 1344408 - RNA, 19 nt, Homo sapiens
gcuccugcccgcuauguug

SEQ ID NO: 1344409 - RNA, 19 nt, Homo sapiens
ucacagaagaggacuacga

SEQ ID NO: 1344410 - RNA, 19 nt, Homo sapiens
uggcugcccugucuucugu

SEQ ID NO: 1344411 - RNA, 19 nt, Homo sapiens
cccgucugcuucuaaauga

SEQ ID NO: 1344412 - RNA, 19 nt, Homo sapiens
ccacucaguuugacaucgu

SEQ ID NO: 1344413 - RNA, 19 nt, Homo sapiens
uggcuuugcuaucuacuuc

SEQ ID NO: 1344414 - RNA, 19 nt, Homo sapiens
ucuagcugcuuaccaacuu

SEQ ID NO: 1344415 - RNA, 19 nt, Homo sapiens
uguacgaugugaaggaugu

SEQ ID NO: 1344416 - RNA, 19 nt, Homo sapiens
ugauuggcuuugcuaucua

SEQ ID NO: 1344417 - RNA, 19 nt, Homo sapiens
ccucuccucccacuaauga

SEQ ID NO: 1344418 - RNA, 19 nt, Homo sapiens
acagcucucugaucaucuu

SEQ ID NO: 1344419 - RNA, 19 nt, Homo sapiens
acucugugcucccuagguu

SEQ ID NO: 1344420 - RNA, 19 nt, Homo sapiens
cugauuggcuuugcuaucu

SEQ ID NO: 1344421 - RNA, 19 nt, Homo sapiens
ucaguuccauugcuuucug

SEQ ID NO: 1344422 - RNA, 19 nt, Homo sapiens
gagaugagcuacuguuuaa

SEQ ID NO: 1344423 - RNA, 19 nt, Homo sapiens
gagcuuaucuucccuauga

SEQ ID NO: 1344424 - RNA, 19 nt, Homo sapiens
gagcuggccugccuaauua

SEQ ID NO: 1344425 - RNA, 19 nt, Homo sapiens
gaucacagcuagagaauug

SEQ ID NO: 1344426 - RNA, 19 nt, Homo sapiens
gcaaauacuuggugaguga

SEQ ID NO: 1344427 - RNA, 19 nt, Homo sapiens
caaaggagcugaauguguu

SEQ ID NO: 1344428 - RNA, 19 nt, Homo sapiens
aaagggagauuugcuauua

SEQ ID NO: 1344429 - RNA, 19 nt, Homo sapiens
ccaaacaacugaauguaaa

SEQ ID NO: 1344430 - RNA, 19 nt, Homo sapiens
gaaaugaagucuugcuauc

SEQ ID NO: 1344431 - RNA, 19 nt, Homo sapiens
gagcuacuguuuaaaguga

SEQ ID NO: 1344432 - RNA, 19 nt, Homo sapiens
gaaaauaucuuccucucuu

SEQ ID NO: 1344433 - RNA, 19 nt, Homo sapiens
ggagaugagcuacuguuua

SEQ ID NO: 1344434 - RNA, 19 nt, Homo sapiens
ggacaugccacuuuauuau

SEQ ID NO: 1344435 - RNA, 19 nt, Homo sapiens
ccaaguauuuccugcauug

SEQ ID NO: 1344436 - RNA, 19 nt, Homo sapiens
gaagaucacagcuagagaa

SEQ ID NO: 1344437 - RNA, 19 nt, Homo sapiens
gcacagaagaucacagcua

SEQ ID NO: 1344438 - RNA, 19 nt, Homo sapiens
ggaucauucucacaacaua

SEQ ID NO: 1344439 - RNA, 19 nt, Homo sapiens
gaaauucagcaccugcaua

SEQ ID NO: 1344440 - RNA, 19 nt, Homo sapiens
cacaggacaugccacuuua

SEQ ID NO: 1344441 - RNA, 19 nt, Homo sapiens
caacauggccuccuugauc

SEQ ID NO: 1344442 - RNA, 19 nt, Homo sapiens
aauaacaacugugggauaa

SEQ ID NO: 1344443 - RNA, 19 nt, Homo sapiens
ugaaugugguuaucaauca

SEQ ID NO: 1344444 - RNA, 19 nt, Homo sapiens
ucuaagcccucuugauuga

SEQ ID NO: 1344445 - RNA, 19 nt, Homo sapiens
cuaaugagcacaaugauau

SEQ ID NO: 1344446 - RNA, 19 nt, Homo sapiens
gcuguaggauaguaauaaa

SEQ ID NO: 1344447 - RNA, 19 nt, Homo sapiens
gaguauuuguucccaguuu

SEQ ID NO: 1344448 - RNA, 19 nt, Homo sapiens
gagcagauuucauguugca

SEQ ID NO: 1344449 - RNA, 19 nt, Homo sapiens
ccagugguuugaauuguuu

SEQ ID NO: 1344450 - RNA, 19 nt, Homo sapiens
ugacugacuugguguguug

SEQ ID NO: 1344451 - RNA, 19 nt, Homo sapiens
gaggaaagaauaugcuuau

SEQ ID NO: 1344452 - RNA, 19 nt, Homo sapiens
gacaugccacuuuauuaua

SEQ ID NO: 1344453 - RNA, 19 nt, Homo sapiens
ccacaggacaugccacuuu

SEQ ID NO: 1344454 - RNA, 19 nt, Homo sapiens
cauggucacuuagagcuua

SEQ ID NO: 1344455 - RNA, 19 nt, Homo sapiens
cagcaucuacuaagaaauu

SEQ ID NO: 1344456 - RNA, 19 nt, Homo sapiens
uugauuagcuuaccaagau

SEQ ID NO: 1344457 - RNA, 19 nt, Homo sapiens
cgucuaagcccucuugauu

SEQ ID NO: 1344458 - RNA, 19 nt, Homo sapiens
ucaccuacaugcacaucua

SEQ ID NO: 1344459 - RNA, 19 nt, Homo sapiens
gcuagauuguuuccuggua

SEQ ID NO: 1344460 - RNA, 19 nt, Homo sapiens
gagcacuguuucucccuuu

SEQ ID NO: 1344461 - RNA, 19 nt, Homo sapiens
gagcagucuuaccuuguuu

SEQ ID NO: 1344462 - RNA, 19 nt, Homo sapiens
ggcagcaucuacuaagaaa

SEQ ID NO: 1344463 - RNA, 19 nt, Homo sapiens
gaaagacuaaugagcacaa

SEQ ID NO: 1344464 - RNA, 19 nt, Homo sapiens
gguuaucaaucacauacuu

SEQ ID NO: 1344465 - RNA, 19 nt, Homo sapiens
gagacaacauggccuccuu

SEQ ID NO: 1344466 - RNA, 19 nt, Homo sapiens
gcauguagaggacgagauu

SEQ ID NO: 1344467 - RNA, 19 nt, Homo sapiens
ccuaauuaauuccuuguga

SEQ ID NO: 1344468 - RNA, 19 nt, Homo sapiens
gauuaaacacuuccuacuu

SEQ ID NO: 1344469 - RNA, 19 nt, Homo sapiens
gauagaaggcacagaagau

SEQ ID NO: 1344470 - RNA, 19 nt, Homo sapiens
ucucaacccucucccuaaa

SEQ ID NO: 1344471 - RNA, 19 nt, Homo sapiens
ucgagcagauuucauguug

SEQ ID NO: 1344472 - RNA, 19 nt, Homo sapiens
ggauaguaauaaaggaaga

SEQ ID NO: 1344473 - RNA, 19 nt, Homo sapiens
ggcauaguaccaaguauuu

SEQ ID NO: 1344474 - RNA, 19 nt, Homo sapiens
guuguugcauucccuauau

SEQ ID NO: 1344475 - RNA, 19 nt, Homo sapiens
gauuucauguugcagauuc

SEQ ID NO: 1344476 - RNA, 19 nt, Homo sapiens
uagaggacgagauuuauuu

SEQ ID NO: 1344477 - RNA, 19 nt, Homo sapiens
uaauaacaacugugggaua

SEQ ID NO: 1344478 - RNA, 19 nt, Homo sapiens
gggacaaccugcaccagau

SEQ ID NO: 1344479 - RNA, 19 nt, Homo sapiens
cgagcagucuuaccuuguu

SEQ ID NO: 1344480 - RNA, 19 nt, Homo sapiens
cauauucucucaggaacuu

SEQ ID NO: 1344481 - RNA, 19 nt, Homo sapiens
ggugauagaguaauucugu

SEQ ID NO: 1344482 - RNA, 19 nt, Homo sapiens
gauuagcuuaccaagauua

SEQ ID NO: 1344483 - RNA, 19 nt, Homo sapiens
ucacuuagagcuuaucuuc

SEQ ID NO: 1344484 - RNA, 19 nt, Homo sapiens
gcccuggguucaucuaaug

SEQ ID NO: 1344485 - RNA, 19 nt, Homo sapiens
agacuaaugagcacaauga

SEQ ID NO: 1344486 - RNA, 19 nt, Homo sapiens
guaaauuaguggugaagac

SEQ ID NO: 1344487 - RNA, 19 nt, Homo sapiens
ggagauuugcuauuauuag

SEQ ID NO: 1344488 - RNA, 19 nt, Homo sapiens
guagggagaaauauuaugu

SEQ ID NO: 1344489 - RNA, 19 nt, Homo sapiens
aaacacuccuagccaguug

SEQ ID NO: 1344490 - RNA, 19 nt, Homo sapiens
gugauagaguaauucugua

SEQ ID NO: 1344491 - RNA, 19 nt, Homo sapiens
uguugcagauucaccuuua

SEQ ID NO: 1344492 - RNA, 19 nt, Homo sapiens
guagaggacgagauuuauu

SEQ ID NO: 1344493 - RNA, 19 nt, Homo sapiens
uauuguagcuccacauucu

SEQ ID NO: 1344494 - RNA, 19 nt, Homo sapiens
gggagauuugcuauuauua

SEQ ID NO: 1344495 - RNA, 19 nt, Homo sapiens
cuuaaaaggugauagagua

SEQ ID NO: 1344496 - RNA, 19 nt, Homo sapiens
gaugagcuacuguuuaaag

SEQ ID NO: 1344497 - RNA, 19 nt, Homo sapiens
uaacaacugugggauaaaa

SEQ ID NO: 1344498 - RNA, 19 nt, Homo sapiens
gacaaaauguggugcagaa

SEQ ID NO: 1344499 - RNA, 19 nt, Homo sapiens
guaaaaguagggagaaaua

SEQ ID NO: 1344500 - RNA, 19 nt, Homo sapiens
ggcguuggaucuacuggaa

SEQ ID NO: 1344501 - RNA, 19 nt, Homo sapiens
auuaaacacuuccuacuuc

SEQ ID NO: 1344502 - RNA, 19 nt, Homo sapiens
gaucauucucacaacauaa

SEQ ID NO: 1344503 - RNA, 19 nt, Homo sapiens
guguguugcuauuguguuu

SEQ ID NO: 1344504 - RNA, 19 nt, Homo sapiens
uugcccagcugucgucuaa

SEQ ID NO: 1344505 - RNA, 19 nt, Homo sapiens
gaagucuugcuaucuguga

SEQ ID NO: 1344506 - RNA, 19 nt, Homo sapiens
agggagaaauauuauguug

SEQ ID NO: 1344507 - RNA, 19 nt, Homo sapiens
ugagcuggccugccuaauu

SEQ ID NO: 1344508 - RNA, 19 nt, Homo sapiens
cguccaauauagauaaugu

SEQ ID NO: 1344509 - RNA, 19 nt, Homo sapiens
cuauauacuccguccaaua

SEQ ID NO: 1344510 - RNA, 19 nt, Homo sapiens
ugaggaaagaauaugcuua

SEQ ID NO: 1344511 - RNA, 19 nt, Homo sapiens
guaggauaguaauaaagga

SEQ ID NO: 1344512 - RNA, 19 nt, Homo sapiens
guacgugccuuugccucuu

SEQ ID NO: 1344513 - RNA, 19 nt, Homo sapiens
agggagauuugcuauuauu

SEQ ID NO: 1344514 - RNA, 19 nt, Homo sapiens
acacauguauugacaccau

SEQ ID NO: 1344515 - RNA, 19 nt, Homo sapiens
ggguucaucuaaugugguu

SEQ ID NO: 1344516 - RNA, 19 nt, Homo sapiens
agauucaccuuuaaugcaa

SEQ ID NO: 1344517 - RNA, 19 nt, Homo sapiens
uuaaggagaugagcuacug

SEQ ID NO: 1344518 - RNA, 19 nt, Homo sapiens
cauccuaaagccauaauga

SEQ ID NO: 1344519 - RNA, 19 nt, Homo sapiens
gcuuugauuuggaggaaug

SEQ ID NO: 1344520 - RNA, 19 nt, Homo sapiens
guacauuaaagcuacgaaa

SEQ ID NO: 1344521 - RNA, 19 nt, Homo sapiens
caacuuaguacauuaaagc

SEQ ID NO: 1344522 - RNA, 19 nt, Homo sapiens
ggccucagcuauguaauua

SEQ ID NO: 1344523 - RNA, 19 nt, Homo sapiens
ccucagcuauguaauuaaa

SEQ ID NO: 1344524 - RNA, 19 nt, Homo sapiens
gaggagaguucccgagauc

SEQ ID NO: 1344525 - RNA, 19 nt, Homo sapiens
ggccgcagcuccauucuca

SEQ ID NO: 1344526 - RNA, 19 nt, Homo sapiens
ggccaccguuuccgcaaua

SEQ ID NO: 1344527 - RNA, 19 nt, Homo sapiens
ggaauugccugcggaagag

SEQ ID NO: 1344528 - RNA, 19 nt, Homo sapiens
gcgagacgcuguacuagcu

SEQ ID NO: 1344529 - RNA, 19 nt, Homo sapiens
gugcagacgucaccuugga

SEQ ID NO: 1344530 - RNA, 19 nt, Homo sapiens
ucagaugcuuccaguauca

SEQ ID NO: 1344531 - RNA, 19 nt, Homo sapiens
guucagaugcuuccaguau

SEQ ID NO: 1344532 - RNA, 19 nt, Homo sapiens
uggagugccugaccuuuga

SEQ ID NO: 1344533 - RNA, 19 nt, Homo sapiens
gcagcugucucgccugaag

SEQ ID NO: 1344534 - RNA, 19 nt, Homo sapiens
gaggaugugccagagaaua

SEQ ID NO: 1344535 - RNA, 19 nt, Homo sapiens
guaaugcuggcaagaguug

SEQ ID NO: 1344536 - RNA, 19 nt, Homo sapiens
ccacuucccucuccuucca

SEQ ID NO: 1344537 - RNA, 19 nt, Homo sapiens
gcagagucccaggcagaua

SEQ ID NO: 1344538 - RNA, 19 nt, Homo sapiens
gacgucaccuuggaggaaa

SEQ ID NO: 1344539 - RNA, 19 nt, Homo sapiens
uaaaacgcccgaaguaaaa

SEQ ID NO: 1344540 - RNA, 19 nt, Homo sapiens
uaaacaagaagagcccaaa

SEQ ID NO: 1344541 - RNA, 19 nt, Homo sapiens
uugaggaugugccagagaa

SEQ ID NO: 1344542 - RNA, 19 nt, Homo sapiens
cuggcccacucccaucuua

SEQ ID NO: 1344543 - RNA, 19 nt, Homo sapiens
aggaugugccagagaauaa

SEQ ID NO: 1344544 - RNA, 19 nt, Homo sapiens
cuucuuggcagcagugaaa

SEQ ID NO: 1344545 - RNA, 19 nt, Homo sapiens
uggagcaguuccugagugu

SEQ ID NO: 1344546 - RNA, 19 nt, Homo sapiens
gcacaccaagaaacagauc

SEQ ID NO: 1344547 - RNA, 19 nt, Homo sapiens
cucaccagcuguucagaug

SEQ ID NO: 1344548 - RNA, 19 nt, Homo sapiens
ccaauccggaguugcaguu

SEQ ID NO: 1344549 - RNA, 19 nt, Homo sapiens
uuaaaacgcccgaaguaaa

SEQ ID NO: 1344550 - RNA, 19 nt, Homo sapiens
gccgaggcauugcuuucug

SEQ ID NO: 1344551 - RNA, 19 nt, Homo sapiens
gcuccuuccugugccuuug

SEQ ID NO: 1344552 - RNA, 19 nt, Homo sapiens
agaggagaguucccgagau

SEQ ID NO: 1344553 - RNA, 19 nt, Homo sapiens
ggagaguucccgagaucag

SEQ ID NO: 1344554 - RNA, 19 nt, Homo sapiens
uuucuggccucagcuaugu

SEQ ID NO: 1344555 - RNA, 19 nt, Homo sapiens
ccugcgcuccugagaguaa

SEQ ID NO: 1344556 - RNA, 19 nt, Homo sapiens
cagagucccaggcagauag

SEQ ID NO: 1344557 - RNA, 19 nt, Homo sapiens
aggaauugccugcggaaga

SEQ ID NO: 1344558 - RNA, 19 nt, Homo sapiens
gaagguggcuccugcaguu

SEQ ID NO: 1344559 - RNA, 19 nt, Homo sapiens
gcaaugagauccggcaguu

SEQ ID NO: 1344560 - RNA, 19 nt, Homo sapiens
guagagcucuucccauaug

SEQ ID NO: 1344561 - RNA, 19 nt, Homo sapiens
ccagugaaauuuaccugua

SEQ ID NO: 1344562 - RNA, 19 nt, Homo sapiens
guaaucauguacuguuuga

SEQ ID NO: 1344563 - RNA, 19 nt, Homo sapiens
gaagaacuguccauaccau

SEQ ID NO: 1344564 - RNA, 19 nt, Homo sapiens
gaaaccgaguaaucaugua

SEQ ID NO: 1344565 - RNA, 19 nt, Homo sapiens
ggacaucccaucccucauu

SEQ ID NO: 1344566 - RNA, 19 nt, Homo sapiens
caacgaggcugaggaguuc

SEQ ID NO: 1344567 - RNA, 19 nt, Homo sapiens
ugguagagcucuucccaua

SEQ ID NO: 1344568 - RNA, 19 nt, Homo sapiens
gauguuuccuacugaguuu

SEQ ID NO: 1344569 - RNA, 19 nt, Homo sapiens
ccacaacacucaguacuuc

SEQ ID NO: 1344570 - RNA, 19 nt, Homo sapiens
ggaacaugaugccagagaa

SEQ ID NO: 1344571 - RNA, 19 nt, Homo sapiens
gagaagaacuguccauacc

SEQ ID NO: 1344572 - RNA, 19 nt, Homo sapiens
ccacuacacucccuauaag

SEQ ID NO: 1344573 - RNA, 19 nt, Homo sapiens
ggaguacauucuggucuuu

SEQ ID NO: 1344574 - RNA, 19 nt, Homo sapiens
cagaucccauggaaccuua

SEQ ID NO: 1344575 - RNA, 19 nt, Homo sapiens
gaccacaccuuugcugaug

SEQ ID NO: 1344576 - RNA, 19 nt, Homo sapiens
gcccaggaguuccagauga

SEQ ID NO: 1344577 - RNA, 19 nt, Homo sapiens
gguaaggcuuucaccaguu

SEQ ID NO: 1344578 - RNA, 19 nt, Homo sapiens
ggaaaccgaguaaucaugu

SEQ ID NO: 1344579 - RNA, 19 nt, Homo sapiens
ugagggaggugaaguacga

SEQ ID NO: 1344580 - RNA, 19 nt, Homo sapiens
guaaggcuuucaccaguuc

SEQ ID NO: 1344581 - RNA, 19 nt, Homo sapiens
gaggagaggaggaagcaaa

SEQ ID NO: 1344582 - RNA, 19 nt, Homo sapiens
ucugggaacuauuuauuga

SEQ ID NO: 1344583 - RNA, 19 nt, Homo sapiens
gcuaggugauccugauguu

SEQ ID NO: 1344584 - RNA, 19 nt, Homo sapiens
gagaggaggaagcaaagaa

SEQ ID NO: 1344585 - RNA, 19 nt, Homo sapiens
ggagacuucugggaacuau

SEQ ID NO: 1344586 - RNA, 19 nt, Homo sapiens
gcacgguucaugacagaaa

SEQ ID NO: 1344587 - RNA, 19 nt, Homo sapiens
ucacagcacuccucuuugc

SEQ ID NO: 1344588 - RNA, 19 nt, Homo sapiens
cagaugugcuggugugcaa

SEQ ID NO: 1344589 - RNA, 19 nt, Homo sapiens
gaguggcucuuccgaaucu

SEQ ID NO: 1344590 - RNA, 19 nt, Homo sapiens
gaccgcaucugccgcuuca

SEQ ID NO: 1344591 - RNA, 19 nt, Homo sapiens
ugucacagcacuccucuuu

SEQ ID NO: 1344592 - RNA, 19 nt, Homo sapiens
aaccacaccuucacugaga

SEQ ID NO: 1344593 - RNA, 19 nt, Homo sapiens
guaccaguauggcuuugug

SEQ ID NO: 1344594 - RNA, 19 nt, Homo sapiens
ccgaguggcucuuccgaau

SEQ ID NO: 1344595 - RNA, 19 nt, Homo sapiens
agacuucugggaacuauuu

SEQ ID NO: 1344596 - RNA, 19 nt, Homo sapiens
uggcagcgguccuguggaa

SEQ ID NO: 1344597 - RNA, 19 nt, Homo sapiens
ccaacgaggcugaggaguu

SEQ ID NO: 1344598 - RNA, 19 nt, Homo sapiens
aagcaaagaaucacaagga

SEQ ID NO: 1344599 - RNA, 19 nt, Homo sapiens
cauggaaccuuaaauaccu

SEQ ID NO: 1344600 - RNA, 19 nt, Homo sapiens
ucccauggaaccuuaaaua

SEQ ID NO: 1344601 - RNA, 19 nt, Homo sapiens
gcaagcccguauccugcaa

SEQ ID NO: 1344602 - RNA, 19 nt, Homo sapiens
gacaucccaucccucauuc

SEQ ID NO: 1344603 - RNA, 19 nt, Homo sapiens
gaaucuaccaggacaccaa

SEQ ID NO: 1344604 - RNA, 19 nt, Homo sapiens
ucaaguggcucugcuacuc

SEQ ID NO: 1344605 - RNA, 19 nt, Homo sapiens
caacugugguagagcucuu

SEQ ID NO: 1344606 - RNA, 19 nt, Homo sapiens
gagauaagggaccugacuu

SEQ ID NO: 1344607 - RNA, 19 nt, Homo sapiens
cccaggaguuccagaugaa

SEQ ID NO: 1344608 - RNA, 19 nt, Homo sapiens
aaugagauccggcaguuug

SEQ ID NO: 1344609 - RNA, 19 nt, Homo sapiens
gugcacacuucgaccucua

SEQ ID NO: 1344610 - RNA, 19 nt, Homo sapiens
gagaacaucaagcccuuca

SEQ ID NO: 1344611 - RNA, 19 nt, Homo sapiens
ccuggcagaucccauggaa

SEQ ID NO: 1344612 - RNA, 19 nt, Homo sapiens
gaacaugaugccagagaac

SEQ ID NO: 1344613 - RNA, 19 nt, Homo sapiens
gcugaggaguucaucuucu

SEQ ID NO: 1344614 - RNA, 19 nt, Homo sapiens
ggaccacaccuuugcugau

SEQ ID NO: 1344615 - RNA, 19 nt, Homo sapiens
cagugaaauuuaccuguag

SEQ ID NO: 1344616 - RNA, 19 nt, Homo sapiens
acaccuacgugccuuacau

SEQ ID NO: 1344617 - RNA, 19 nt, Homo sapiens
gaguacauucuggucuuua

SEQ ID NO: 1344618 - RNA, 19 nt, Homo sapiens
cugaggaguucaucuucuu

SEQ ID NO: 1344619 - RNA, 19 nt, Homo sapiens
ucaagcccuucaccaccua

SEQ ID NO: 1344620 - RNA, 19 nt, Homo sapiens
uauguagccuggcggaaca

SEQ ID NO: 1344621 - RNA, 19 nt, Homo sapiens
caguggccgucaucucauu

SEQ ID NO: 1344622 - RNA, 19 nt, Homo sapiens
caaccucaugcacgucuuu

SEQ ID NO: 1344623 - RNA, 19 nt, Homo sapiens
agcaaagaaucacaaggaa

SEQ ID NO: 1344624 - RNA, 19 nt, Homo sapiens
gcagaucccauggaaccuu

SEQ ID NO: 1344625 - RNA, 19 nt, Homo sapiens
gaccacuacacucccuaua

SEQ ID NO: 1344626 - RNA, 19 nt, Homo sapiens
uaggugauccugauguuuc

SEQ ID NO: 1344627 - RNA, 19 nt, Homo sapiens
cuggagaaguuccuuagca

SEQ ID NO: 1344628 - RNA, 19 nt, Homo sapiens
ucucccauccugaacauuu

SEQ ID NO: 1344629 - RNA, 19 nt, Homo sapiens
guggacagucggccuauau

SEQ ID NO: 1344630 - RNA, 19 nt, Homo sapiens
cgaaggcacugcagauccu

SEQ ID NO: 1344631 - RNA, 19 nt, Homo sapiens
gguagagcucuucccauau

SEQ ID NO: 1344632 - RNA, 19 nt, Homo sapiens
ccacaccuuugcugauguc

SEQ ID NO: 1344633 - RNA, 19 nt, Homo sapiens
gugggccucuccaagauca

SEQ ID NO: 1344634 - RNA, 19 nt, Homo sapiens
uggcaacaccucugucaug

SEQ ID NO: 1344635 - RNA, 19 nt, Homo sapiens
ggaagcaaagaaucacaag

SEQ ID NO: 1344636 - RNA, 19 nt, Homo sapiens
gaggaggaagcaaagaauc

SEQ ID NO: 1344637 - RNA, 19 nt, Homo sapiens
caccuucacugagaacauc

SEQ ID NO: 1344638 - RNA, 19 nt, Homo sapiens
gcaguuugcacgguucaug

SEQ ID NO: 1344639 - RNA, 19 nt, Homo sapiens
gaaccuuaaauaccugaag

SEQ ID NO: 1344640 - RNA, 19 nt, Homo sapiens
ggaagcagaaguggacagu

SEQ ID NO: 1344641 - RNA, 19 nt, Homo sapiens
gugaaggguguguuuggaa

SEQ ID NO: 1344642 - RNA, 19 nt, Homo sapiens
ggagaggaggaagcaaaga

SEQ ID NO: 1344643 - RNA, 19 nt, Homo sapiens
gaacaccuacgugccuuac

SEQ ID NO: 1344644 - RNA, 19 nt, Homo sapiens
gaccacggaagcagaagug

SEQ ID NO: 1344645 - RNA, 19 nt, Homo sapiens
aggaguacauucuggucuu

SEQ ID NO: 1344646 - RNA, 19 nt, Homo sapiens
ugagaagaacuguccauac

SEQ ID NO: 1344647 - RNA, 19 nt, Homo sapiens
gaucccauggaaccuuaaa

SEQ ID NO: 1344648 - RNA, 19 nt, Homo sapiens
ucccaucccucauucaaac

SEQ ID NO: 1344649 - RNA, 19 nt, Homo sapiens
auaagacgcuggccaugcu

SEQ ID NO: 1344650 - RNA, 19 nt, Homo sapiens
acacuucgaccucuacaag

SEQ ID NO: 1344651 - RNA, 19 nt, Homo sapiens
cuucugggaacuauuuauu

SEQ ID NO: 1344652 - RNA, 19 nt, Homo sapiens
agaaccacaccuucacuga

SEQ ID NO: 1344653 - RNA, 19 nt, Homo sapiens
aggcacggcucuucuucau

SEQ ID NO: 1344654 - RNA, 19 nt, Homo sapiens
gcaucugccgcuucaagug

SEQ ID NO: 1344655 - RNA, 19 nt, Homo sapiens
caucccaucccucauucaa

SEQ ID NO: 1344656 - RNA, 19 nt, Homo sapiens
ccuggaggaccacaccuuu

SEQ ID NO: 1344657 - RNA, 19 nt, Homo sapiens
ggaguucaucuucuuccau

SEQ ID NO: 1344658 - RNA, 19 nt, Homo sapiens
gaagaugggugcacaaaga

SEQ ID NO: 1344659 - RNA, 19 nt, Homo sapiens
gagccaagcuuguguguaa

SEQ ID NO: 1344660 - RNA, 19 nt, Homo sapiens
ggagggagaucaucaguga

SEQ ID NO: 1344661 - RNA, 19 nt, Homo sapiens
gcaauaggauucacuacaa

SEQ ID NO: 1344662 - RNA, 19 nt, Homo sapiens
ggucaaagauggacaaaca

SEQ ID NO: 1344663 - RNA, 19 nt, Homo sapiens
ccucaacgcuggucaagua

SEQ ID NO: 1344664 - RNA, 19 nt, Homo sapiens
gaacaacagcugauucuga

SEQ ID NO: 1344665 - RNA, 19 nt, Homo sapiens
ggaaguaccagucaaagaa

SEQ ID NO: 1344666 - RNA, 19 nt, Homo sapiens
gaagaacggaggaaacaaa

SEQ ID NO: 1344667 - RNA, 19 nt, Homo sapiens
acgaagagcugaccauuga

SEQ ID NO: 1344668 - RNA, 19 nt, Homo sapiens
gcuacuaucuuggauguuu

SEQ ID NO: 1344669 - RNA, 19 nt, Homo sapiens
gggauuaacaucagcaaua

SEQ ID NO: 1344670 - RNA, 19 nt, Homo sapiens
aagcagagcugacaagcaa

SEQ ID NO: 1344671 - RNA, 19 nt, Homo sapiens
gaaaugagacgguuuaagc

SEQ ID NO: 1344672 - RNA, 19 nt, Homo sapiens
caagaagcgucucaucaug

SEQ ID NO: 1344673 - RNA, 19 nt, Homo sapiens
gaauggaauuuacuguaug

SEQ ID NO: 1344674 - RNA, 19 nt, Homo sapiens
uggaagaccucuauuggaa

SEQ ID NO: 1344675 - RNA, 19 nt, Homo sapiens
gagcuacuaucuuggaugu

SEQ ID NO: 1344676 - RNA, 19 nt, Homo sapiens
caaggugucuagauacaga

SEQ ID NO: 1344677 - RNA, 19 nt, Homo sapiens
gauacagagugaagaaugu

SEQ ID NO: 1344678 - RNA, 19 nt, Homo sapiens
gaccaacgccaacguguuu

SEQ ID NO: 1344679 - RNA, 19 nt, Homo sapiens
caagaucgcaguuguugaa

SEQ ID NO: 1344680 - RNA, 19 nt, Homo sapiens
caccaucacucaugagcua

SEQ ID NO: 1344681 - RNA, 19 nt, Homo sapiens
caaagaagaaguugaaucu

SEQ ID NO: 1344682 - RNA, 19 nt, Homo sapiens
gccuauaucuucaggagaa

SEQ ID NO: 1344683 - RNA, 19 nt, Homo sapiens
ggauuaacaucagcaauag

SEQ ID NO: 1344684 - RNA, 19 nt, Homo sapiens
gaacagccaaggacagaga

SEQ ID NO: 1344685 - RNA, 19 nt, Homo sapiens
caauuaaacaggcaccaua

SEQ ID NO: 1344686 - RNA, 19 nt, Homo sapiens
gaggaugaauggaauuuac

SEQ ID NO: 1344687 - RNA, 19 nt, Homo sapiens
gcauagccgugcuucucua

SEQ ID NO: 1344688 - RNA, 19 nt, Homo sapiens
gcugaaaugagacgguuua

SEQ ID NO: 1344689 - RNA, 19 nt, Homo sapiens
ucacagagcacgcugaaau

SEQ ID NO: 1344690 - RNA, 19 nt, Homo sapiens
gcacugagccacauuugca

SEQ ID NO: 1344691 - RNA, 19 nt, Homo sapiens
aaagaugcaucccugaguu

SEQ ID NO: 1344692 - RNA, 19 nt, Homo sapiens
gaagaggcgcaccagauga

SEQ ID NO: 1344693 - RNA, 19 nt, Homo sapiens
gacagagagucaugguuga

SEQ ID NO: 1344694 - RNA, 19 nt, Homo sapiens
caaguuaacacccuucaug

SEQ ID NO: 1344695 - RNA, 19 nt, Homo sapiens
agggaaggguggauucaua

SEQ ID NO: 1344696 - RNA, 19 nt, Homo sapiens
ggucaaguaugcagagaag

SEQ ID NO: 1344697 - RNA, 19 nt, Homo sapiens
aacaacagcugauucugaa

SEQ ID NO: 1344698 - RNA, 19 nt, Homo sapiens
gccauugacugccagcauu

SEQ ID NO: 1344699 - RNA, 19 nt, Homo sapiens
cuucagaguugagucauuu

SEQ ID NO: 1344700 - RNA, 19 nt, Homo sapiens
aaacaaaaccucgucauua

SEQ ID NO: 1344701 - RNA, 19 nt, Homo sapiens
ugugggagcuacuaucuug

SEQ ID NO: 1344702 - RNA, 19 nt, Homo sapiens
gcacaccagcuaucaugaa

SEQ ID NO: 1344703 - RNA, 19 nt, Homo sapiens
gaaggguggauucauaaga

SEQ ID NO: 1344704 - RNA, 19 nt, Homo sapiens
ccauccaacuuacacauga

SEQ ID NO: 1344705 - RNA, 19 nt, Homo sapiens
aaacagagauccgaaccau

SEQ ID NO: 1344706 - RNA, 19 nt, Homo sapiens
gugccugagucaugugaua

SEQ ID NO: 1344707 - RNA, 19 nt, Homo sapiens
gcugacaagcaacgucuua

SEQ ID NO: 1344708 - RNA, 19 nt, Homo sapiens
gggaaggguggauucauaa

SEQ ID NO: 1344709 - RNA, 19 nt, Homo sapiens
aagaagaaguugaaucucu

SEQ ID NO: 1344710 - RNA, 19 nt, Homo sapiens
aggauucacuacaacauuu

SEQ ID NO: 1344711 - RNA, 19 nt, Homo sapiens
ggacuuugcagaguacauu

SEQ ID NO: 1344712 - RNA, 19 nt, Homo sapiens
gauacacagccaccacuaa

SEQ ID NO: 1344713 - RNA, 19 nt, Homo sapiens
gaagcacugagccacauuu

SEQ ID NO: 1344714 - RNA, 19 nt, Homo sapiens
gcaagaagcagaggacagu

SEQ ID NO: 1344715 - RNA, 19 nt, Homo sapiens
agagcacgcugaaaugaga

SEQ ID NO: 1344716 - RNA, 19 nt, Homo sapiens
ugaagaagcugcccaucac

SEQ ID NO: 1344717 - RNA, 19 nt, Homo sapiens
cauuagaggugacgcaaag

SEQ ID NO: 1344718 - RNA, 19 nt, Homo sapiens
uaacaucagcaauaggauu

SEQ ID NO: 1344719 - RNA, 19 nt, Homo sapiens
gauaccugaugaaugaaga

SEQ ID NO: 1344720 - RNA, 19 nt, Homo sapiens
aucgauaccugaugaauga

SEQ ID NO: 1344721 - RNA, 19 nt, Homo sapiens
acaaugccaucccuguuga

SEQ ID NO: 1344722 - RNA, 19 nt, Homo sapiens
aacaaaaccucgucauuaa

SEQ ID NO: 1344723 - RNA, 19 nt, Homo sapiens
gaagagcugaccauugauc

SEQ ID NO: 1344724 - RNA, 19 nt, Homo sapiens
gugccuauuugguguaaga

SEQ ID NO: 1344725 - RNA, 19 nt, Homo sapiens
ucaagugccugagucaugu

SEQ ID NO: 1344726 - RNA, 19 nt, Homo sapiens
gcaagcagccgugcaccaa

SEQ ID NO: 1344727 - RNA, 19 nt, Homo sapiens
gacagccagucuccacuug

SEQ ID NO: 1344728 - RNA, 19 nt, Homo sapiens
ggacaaggcgcacguucuc

SEQ ID NO: 1344729 - RNA, 19 nt, Homo sapiens
gcacuucagaguugaguca

SEQ ID NO: 1344730 - RNA, 19 nt, Homo sapiens
gaaacaaaaccucgucauu

SEQ ID NO: 1344731 - RNA, 19 nt, Homo sapiens
gaagaaugucacaguagga

SEQ ID NO: 1344732 - RNA, 19 nt, Homo sapiens
agccuucgcuggccucuuu

SEQ ID NO: 1344733 - RNA, 19 nt, Homo sapiens
gacccggguucuuguguug

SEQ ID NO: 1344734 - RNA, 19 nt, Homo sapiens
ugacaagcaacgucuuaaa

SEQ ID NO: 1344735 - RNA, 19 nt, Homo sapiens
ccaagaagcgucucaucau

SEQ ID NO: 1344736 - RNA, 19 nt, Homo sapiens
cuuucaaggugucuagaua

SEQ ID NO: 1344737 - RNA, 19 nt, Homo sapiens
gcacauagggcggaaguac

SEQ ID NO: 1344738 - RNA, 19 nt, Homo sapiens
ggaccaacgccaacguguu

SEQ ID NO: 1344739 - RNA, 19 nt, Homo sapiens
guaagacucuagaaaacuu

SEQ ID NO: 1344740 - RNA, 19 nt, Homo sapiens
ccagcaacgucaucugcaa

SEQ ID NO: 1344741 - RNA, 19 nt, Homo sapiens
gagcagguuucuguaugug

SEQ ID NO: 1344742 - RNA, 19 nt, Homo sapiens
gccaagaagcgucucauca

SEQ ID NO: 1344743 - RNA, 19 nt, Homo sapiens
cagaagaggcgcaccagau

SEQ ID NO: 1344744 - RNA, 19 nt, Homo sapiens
caacgcuggucaaguaugc

SEQ ID NO: 1344745 - RNA, 19 nt, Homo sapiens
ugcugaaccucauacgaua

SEQ ID NO: 1344746 - RNA, 19 nt, Homo sapiens
ggucagggaagucaaagau

SEQ ID NO: 1344747 - RNA, 19 nt, Homo sapiens
aaagauggacaaacagaga

SEQ ID NO: 1344748 - RNA, 19 nt, Homo sapiens
gggauguucuuuugauaaa

SEQ ID NO: 1344749 - RNA, 19 nt, Homo sapiens
gaagcugcccaucaccuau

SEQ ID NO: 1344750 - RNA, 19 nt, Homo sapiens
gaaugucacaguaggaagu

SEQ ID NO: 1344751 - RNA, 19 nt, Homo sapiens
uagaagauuuggacuuugc

SEQ ID NO: 1344752 - RNA, 19 nt, Homo sapiens
gaaguaccagucaaagaag

SEQ ID NO: 1344753 - RNA, 19 nt, Homo sapiens
aagaaaaccauccaacuua

SEQ ID NO: 1344754 - RNA, 19 nt, Homo sapiens
uuaaagaggagccaucugu

SEQ ID NO: 1344755 - RNA, 19 nt, Homo sapiens
accauggucucuauccuaa

SEQ ID NO: 1344756 - RNA, 19 nt, Homo sapiens
ucaaagauggacaaacaga

SEQ ID NO: 1344757 - RNA, 19 nt, Homo sapiens
gauauuuggauccuucuuc

SEQ ID NO: 1344758 - RNA, 19 nt, Homo sapiens
ggacuucccugaugugcua

SEQ ID NO: 1344759 - RNA, 19 nt, Homo sapiens
gcaaggaguucaaggacuu

SEQ ID NO: 1344760 - RNA, 19 nt, Homo sapiens
gaacaagaucguuauccua

SEQ ID NO: 1344761 - RNA, 19 nt, Homo sapiens
guuacgaacuuucucugua

SEQ ID NO: 1344762 - RNA, 19 nt, Homo sapiens
caacaagaccuucgcuuuc

SEQ ID NO: 1344763 - RNA, 19 nt, Homo sapiens
gcaaccagcugaccacacu

SEQ ID NO: 1344764 - RNA, 19 nt, Homo sapiens
acaaugaccucgucuacau

SEQ ID NO: 1344765 - RNA, 19 nt, Homo sapiens
ccaacaagaccuucgcuuu

SEQ ID NO: 1344766 - RNA, 19 nt, Homo sapiens
gaacuuucucuguaacuug

SEQ ID NO: 1344767 - RNA, 19 nt, Homo sapiens
caagaucguuauccuacug

SEQ ID NO: 1344768 - RNA, 19 nt, Homo sapiens
guaacuuggguuucaauaa

SEQ ID NO: 1344769 - RNA, 19 nt, Homo sapiens
ucaaggacuucccugaugu

SEQ ID NO: 1344770 - RNA, 19 nt, Homo sapiens
caacaugaagaugauauga

SEQ ID NO: 1344771 - RNA, 19 nt, Homo sapiens
cuacacacguucucuuucu

SEQ ID NO: 1344772 - RNA, 19 nt, Homo sapiens
acacaaagcacaacaucga

SEQ ID NO: 1344773 - RNA, 19 nt, Homo sapiens
ccaugggcuucaucucuuu

SEQ ID NO: 1344774 - RNA, 19 nt, Homo sapiens
gcuggcggcucaacuucaa

SEQ ID NO: 1344775 - RNA, 19 nt, Homo sapiens
cuacuggacuacauguuuc

SEQ ID NO: 1344776 - RNA, 19 nt, Homo sapiens
ugaccaagcuggacaucag

SEQ ID NO: 1344777 - RNA, 19 nt, Homo sapiens
gcggcagagucaauaauuc

SEQ ID NO: 1344778 - RNA, 19 nt, Homo sapiens
caacacaaagcacaacauc

SEQ ID NO: 1344779 - RNA, 19 nt, Homo sapiens
ugaccacacuggaggaauc

SEQ ID NO: 1344780 - RNA, 19 nt, Homo sapiens
caucaagacccucaucauc

SEQ ID NO: 1344781 - RNA, 19 nt, Homo sapiens
aacaagaccuucgcuuuca

SEQ ID NO: 1344782 - RNA, 19 nt, Homo sapiens
gcaaggcccagcagguguu

SEQ ID NO: 1344783 - RNA, 19 nt, Homo sapiens
ucaacaaccucuucaaccu

SEQ ID NO: 1344784 - RNA, 19 nt, Homo sapiens
cgaacuuucucuguaacuu

SEQ ID NO: 1344785 - RNA, 19 nt, Homo sapiens
gcagagucaauaauucaau

SEQ ID NO: 1344786 - RNA, 19 nt, Homo sapiens
ucaaugccauccgggacua

SEQ ID NO: 1344787 - RNA, 19 nt, Homo sapiens
gacaucagcgagaacaaga

SEQ ID NO: 1344788 - RNA, 19 nt, Homo sapiens
ccuacuggacuacauguuu

SEQ ID NO: 1344789 - RNA, 19 nt, Homo sapiens
gcgagaacaagaucguuau

SEQ ID NO: 1344790 - RNA, 19 nt, Homo sapiens
ggaguugaaagccgacgaa

SEQ ID NO: 1344791 - RNA, 19 nt, Homo sapiens
ggacaucagcgagaacaag

SEQ ID NO: 1344792 - RNA, 19 nt, Homo sapiens
gcaagggcaacacaaagca

SEQ ID NO: 1344793 - RNA, 19 nt, Homo sapiens
gccacacggugcaguuugu

SEQ ID NO: 1344794 - RNA, 19 nt, Homo sapiens
gagaugcaggugagcaaga

SEQ ID NO: 1344795 - RNA, 19 nt, Homo sapiens
gcaaccgccugaagcucau

SEQ ID NO: 1344796 - RNA, 19 nt, Homo sapiens
ggcaagaaccgcaucaaaa

SEQ ID NO: 1344797 - RNA, 19 nt, Homo sapiens
caaagcacaacaucgagau

SEQ ID NO: 1344798 - RNA, 19 nt, Homo sapiens
uucaaggacuucccugaug

SEQ ID NO: 1344799 - RNA, 19 nt, Homo sapiens
cgacaaugaccucgucuac

SEQ ID NO: 1344800 - RNA, 19 nt, Homo sapiens
ggguuucaauaauuaugga

SEQ ID NO: 1344801 - RNA, 19 nt, Homo sapiens
cggcagagucaauaauuca

SEQ ID NO: 1344802 - RNA, 19 nt, Homo sapiens
gcucaaccaggacgaguuc

SEQ ID NO: 1344803 - RNA, 19 nt, Homo sapiens
caccuggucucagccaaga

SEQ ID NO: 1344804 - RNA, 19 nt, Homo sapiens
ugacagacuggaguugaaa

SEQ ID NO: 1344805 - RNA, 19 nt, Homo sapiens
gcauugacagacuggaguu

SEQ ID NO: 1344806 - RNA, 19 nt, Homo sapiens
ccuccucccuacccuucua

SEQ ID NO: 1344807 - RNA, 19 nt, Homo sapiens
ccauugagggcuccauguu

SEQ ID NO: 1344808 - RNA, 19 nt, Homo sapiens
uguacaaccucaagucacu

SEQ ID NO: 1344809 - RNA, 19 nt, Homo sapiens
acacgcggcagagucaaua

SEQ ID NO: 1344810 - RNA, 19 nt, Homo sapiens
gcaacacaaagcacaacau

SEQ ID NO: 1344811 - RNA, 19 nt, Homo sapiens
gggcaagggcaacacaaag

SEQ ID NO: 1344812 - RNA, 19 nt, Homo sapiens
cgggacuacuccuucaaga

SEQ ID NO: 1344813 - RNA, 19 nt, Homo sapiens
agaacaagaucguuauccu

SEQ ID NO: 1344814 - RNA, 19 nt, Homo sapiens
uugacagacuggaguugaa

SEQ ID NO: 1344815 - RNA, 19 nt, Homo sapiens
gcaagaaccgcaucaaaac

SEQ ID NO: 1344816 - RNA, 19 nt, Homo sapiens
guucaaggacuucccugau

SEQ ID NO: 1344817 - RNA, 19 nt, Homo sapiens
ugacgucccuguccaucac

SEQ ID NO: 1344818 - RNA, 19 nt, Homo sapiens
gacaucaagacccucauca

SEQ ID NO: 1344819 - RNA, 19 nt, Homo sapiens
gcucacagucuucccugau

SEQ ID NO: 1344820 - RNA, 19 nt, Homo sapiens
gcuacugcccaacuacuuc

SEQ ID NO: 1344821 - RNA, 19 nt, Homo sapiens
cauugagggcuccauguug

SEQ ID NO: 1344822 - RNA, 19 nt, Homo sapiens
gacaaugaccucgucuaca

SEQ ID NO: 1344823 - RNA, 19 nt, Homo sapiens
aggcaagaaccgcaucaaa

SEQ ID NO: 1344824 - RNA, 19 nt, Homo sapiens
accaugggcuucaucucuu

SEQ ID NO: 1344825 - RNA, 19 nt, Homo sapiens
caucacacacugcaaucug

SEQ ID NO: 1344826 - RNA, 19 nt, Homo sapiens
agcugacgcuggagaaaug

SEQ ID NO: 1344827 - RNA, 19 nt, Homo sapiens
ggaaggaguuugcagagaa

SEQ ID NO: 1344828 - RNA, 19 nt, Homo sapiens
gaaagugggccgacagaug

SEQ ID NO: 1344829 - RNA, 19 nt, Homo sapiens
ugacaggccugaugaccaa

SEQ ID NO: 1344830 - RNA, 19 nt, Homo sapiens
gcucugcccuuuccagguu

SEQ ID NO: 1344831 - RNA, 19 nt, Homo sapiens
ugagaggccugcaggagaa

SEQ ID NO: 1344832 - RNA, 19 nt, Homo sapiens
gcacuuugccuucaguuca

SEQ ID NO: 1344833 - RNA, 19 nt, Homo sapiens
ggagagaaaggcugugaga

SEQ ID NO: 1344834 - RNA, 19 nt, Homo sapiens
gaaggaguuugcagagaag

SEQ ID NO: 1344835 - RNA, 19 nt, Homo sapiens
gcagguuggucccgagaug

SEQ ID NO: 1344836 - RNA, 19 nt, Homo sapiens
ggcagugucuucucagugu

SEQ ID NO: 1344837 - RNA, 19 nt, Homo sapiens
gaaacugcccagcacuuug

SEQ ID NO: 1344838 - RNA, 19 nt, Homo sapiens
cagcuggccuguccugaug

SEQ ID NO: 1344839 - RNA, 19 nt, Homo sapiens
acgaggagaugcugagcua

SEQ ID NO: 1344840 - RNA, 19 nt, Homo sapiens
agagaaaggcugugagaga

SEQ ID NO: 1344841 - RNA, 19 nt, Homo sapiens
ugaggaagcucugcagaag

SEQ ID NO: 1344842 - RNA, 19 nt, Homo sapiens
ugagucgaauaaacaauug

SEQ ID NO: 1344843 - RNA, 19 nt, Homo sapiens
ugaagacguucuccuugga

SEQ ID NO: 1344844 - RNA, 19 nt, Homo sapiens
gaagacguucuccuuggaa

SEQ ID NO: 1344845 - RNA, 19 nt, Homo sapiens
gaggagaugcugagcuaug

SEQ ID NO: 1344846 - RNA, 19 nt, Homo sapiens
uggccaagcugcacugugu

SEQ ID NO: 1344847 - RNA, 19 nt, Homo sapiens
gacaagaguaaccagcuuu

SEQ ID NO: 1344848 - RNA, 19 nt, Homo sapiens
aggaagcucugcagaagug

SEQ ID NO: 1344849 - RNA, 19 nt, Homo sapiens
ccacuccugugcucucuuc

SEQ ID NO: 1344850 - RNA, 19 nt, Homo sapiens
gccgagggcacgucuauga

SEQ ID NO: 1344851 - RNA, 19 nt, Homo sapiens
ccacagagaggagaugaug

SEQ ID NO: 1344852 - RNA, 19 nt, Homo sapiens
cagagagccuguacaugca

SEQ ID NO: 1344853 - RNA, 19 nt, Homo sapiens
gugagucgaauaaacaauu

SEQ ID NO: 1344854 - RNA, 19 nt, Homo sapiens
gaggucagaggauguaugu

SEQ ID NO: 1344855 - RNA, 19 nt, Homo sapiens
acauuuccauggagaagaa

SEQ ID NO: 1344856 - RNA, 19 nt, Homo sapiens
gaugauggcagugaacuca

SEQ ID NO: 1344857 - RNA, 19 nt, Homo sapiens
gcagagaguccuguuagca

SEQ ID NO: 1344858 - RNA, 19 nt, Homo sapiens
gcugaagucugugcuuucu

SEQ ID NO: 1344859 - RNA, 19 nt, Homo sapiens
agacaagaguaaccagcuu

SEQ ID NO: 1344860 - RNA, 19 nt, Homo sapiens
gaacccagagacugcauca

SEQ ID NO: 1344861 - RNA, 19 nt, Homo sapiens
ggguuguuguggagaauug

SEQ ID NO: 1344862 - RNA, 19 nt, Homo sapiens
aguggcaucucuuccauug

SEQ ID NO: 1344863 - RNA, 19 nt, Homo sapiens
gcccagcacuuugccuuca

SEQ ID NO: 1344864 - RNA, 19 nt, Homo sapiens
ccaccucugucaccaccaa

SEQ ID NO: 1344865 - RNA, 19 nt, Homo sapiens
gaugaggacagccugacuu

SEQ ID NO: 1344866 - RNA, 19 nt, Homo sapiens
cagcagcgcaggcgugaau

SEQ ID NO: 1344867 - RNA, 19 nt, Homo sapiens
uggcaucucuuccauugag

SEQ ID NO: 1344868 - RNA, 19 nt, Homo sapiens
gagcaacgacacccugagu

SEQ ID NO: 1344869 - RNA, 19 nt, Homo sapiens
ccggauccaugggcacuaa

SEQ ID NO: 1344870 - RNA, 19 nt, Homo sapiens
gcaugugagcccuguccua

SEQ ID NO: 1344871 - RNA, 19 nt, Homo sapiens
agaggaggcugcugauggu

SEQ ID NO: 1344872 - RNA, 19 nt, Homo sapiens
ggagagcuacgaggagaug

SEQ ID NO: 1344873 - RNA, 19 nt, Homo sapiens
gcaaggcauggagcuguuu

SEQ ID NO: 1344874 - RNA, 19 nt, Homo sapiens
cuccugugcucucuucuga

SEQ ID NO: 1344875 - RNA, 19 nt, Homo sapiens
gauggugacaggccugaug

SEQ ID NO: 1344876 - RNA, 19 nt, Homo sapiens
cuacagugaccaggacuuu

SEQ ID NO: 1344877 - RNA, 19 nt, Homo sapiens
cggaaggaguuugcagaga

SEQ ID NO: 1344878 - RNA, 19 nt, Homo sapiens
gcaaugcagagagccugua

SEQ ID NO: 1344879 - RNA, 19 nt, Homo sapiens
agaaacugcccagcacuuu

SEQ ID NO: 1344880 - RNA, 19 nt, Homo sapiens
gcaggaacugggcccuuga

SEQ ID NO: 1344881 - RNA, 19 nt, Homo sapiens
ccaugacgguggccgagau

SEQ ID NO: 1344882 - RNA, 19 nt, Homo sapiens
gcuggucgguccugaaagc

SEQ ID NO: 1344883 - RNA, 19 nt, Homo sapiens
acaguguccugagcuagaa

SEQ ID NO: 1344884 - RNA, 19 nt, Homo sapiens
uguucgaccuggacaaugu

SEQ ID NO: 1344885 - RNA, 19 nt, Homo sapiens
gcaugagcuucuucgacau

SEQ ID NO: 1344886 - RNA, 19 nt, Homo sapiens
cuagagcccuguggugaag

SEQ ID NO: 1344887 - RNA, 19 nt, Homo sapiens
cuccagggcugcugacaag

SEQ ID NO: 1344888 - RNA, 19 nt, Homo sapiens
ucccuggguugguaucuga

SEQ ID NO: 1344889 - RNA, 19 nt, Homo sapiens
agucugugcuuucuucaag

SEQ ID NO: 1344890 - RNA, 19 nt, Homo sapiens
uugcugaagucugugcuuu

SEQ ID NO: 1344891 - RNA, 19 nt, Homo sapiens
ugaccaaggcugagaagag

SEQ ID NO: 1344892 - RNA, 19 nt, Homo sapiens
gggaaagugggccgacaga

SEQ ID NO: 1344893 - RNA, 19 nt, Homo sapiens
ccucgaugauggcagugaa

SEQ ID NO: 1344894 - RNA, 19 nt, Homo sapiens
cacuuugccuucaguucaa

SEQ ID NO: 1344895 - RNA, 19 nt, Homo sapiens
ggaggucagaggauguaug

SEQ ID NO: 1344896 - RNA, 19 nt, Homo sapiens
guuugcaacuccagagaag

SEQ ID NO: 1344897 - RNA, 19 nt, Homo sapiens
ggacauuuccauggagaag

SEQ ID NO: 1344898 - RNA, 19 nt, Homo sapiens
ugucacagcuucgacuuuu

SEQ ID NO: 1344899 - RNA, 19 nt, Homo sapiens
ggaggguggaggugaagga

SEQ ID NO: 1344900 - RNA, 19 nt, Homo sapiens
gaggggacauuuccaugga

SEQ ID NO: 1344901 - RNA, 19 nt, Homo sapiens
ugaguggcaucucuuccau

SEQ ID NO: 1344902 - RNA, 19 nt, Homo sapiens
gucacaguguccugagcua

SEQ ID NO: 1344903 - RNA, 19 nt, Homo sapiens
ggacaggcagagccaggau

SEQ ID NO: 1344904 - RNA, 19 nt, Homo sapiens
ucccuucccuggguuggua

SEQ ID NO: 1344905 - RNA, 19 nt, Homo sapiens
ggcuucaucucccauuucu

SEQ ID NO: 1344906 - RNA, 19 nt, Homo sapiens
agucacagcggaaggaguu

SEQ ID NO: 1344907 - RNA, 19 nt, Homo sapiens
ccucaaccgccuucucaga

SEQ ID NO: 1344908 - RNA, 19 nt, Homo sapiens
cccugcagcuggugaagga

SEQ ID NO: 1344909 - RNA, 19 nt, Homo sapiens
caccucaaccgccuucuca

SEQ ID NO: 1344910 - RNA, 19 nt, Homo sapiens
ccauugagcccagcaagca

SEQ ID NO: 1344911 - RNA, 19 nt, Homo sapiens
acccagagacugcaucaga

SEQ ID NO: 1344912 - RNA, 19 nt, Homo sapiens
ucuuggcccugaggacuuu

SEQ ID NO: 1344913 - RNA, 19 nt, Homo sapiens
gccuguagcagucgauugu

SEQ ID NO: 1344914 - RNA, 19 nt, Homo sapiens
cacuuacccugugcuguga

SEQ ID NO: 1344915 - RNA, 19 nt, Homo sapiens
caccugagcgagugucugu

SEQ ID NO: 1344916 - RNA, 19 nt, Homo sapiens
guaccugagggacauguuc

SEQ ID NO: 1344917 - RNA, 19 nt, Homo sapiens
cuucaucucccauuucuac

SEQ ID NO: 1344918 - RNA, 19 nt, Homo sapiens
gaggaagcucugcagaagu

SEQ ID NO: 1344919 - RNA, 19 nt, Homo sapiens
gaagcaggcugucgauuua

SEQ ID NO: 1344920 - RNA, 19 nt, Homo sapiens
gaaugaaguuguugguuua

SEQ ID NO: 1344921 - RNA, 19 nt, Homo sapiens
ggaaugaaguuguugguuu

SEQ ID NO: 1344922 - RNA, 19 nt, Homo sapiens
uacaugggcucaauuauua

SEQ ID NO: 1344923 - RNA, 19 nt, Homo sapiens
gaugaaagcucaguuuaug

SEQ ID NO: 1344924 - RNA, 19 nt, Homo sapiens
gaagaaugccuacaagauu

SEQ ID NO: 1344925 - RNA, 19 nt, Homo sapiens
gcagugacauacuuuacua

SEQ ID NO: 1344926 - RNA, 19 nt, Homo sapiens
gauuuaagguugugucaaa

SEQ ID NO: 1344927 - RNA, 19 nt, Homo sapiens
gaacgugggugcuuguguu

SEQ ID NO: 1344928 - RNA, 19 nt, Homo sapiens
gaagcaaauuggagugaaa

SEQ ID NO: 1344929 - RNA, 19 nt, Homo sapiens
ggagugauauagcagguuu

SEQ ID NO: 1344930 - RNA, 19 nt, Homo sapiens
cuuaguaucuagaggauua

SEQ ID NO: 1344931 - RNA, 19 nt, Homo sapiens
gaguaaagaucauuuguac

SEQ ID NO: 1344932 - RNA, 19 nt, Homo sapiens
guacagugauucagccauu

SEQ ID NO: 1344933 - RNA, 19 nt, Homo sapiens
gaccuugacucggcuauaa

SEQ ID NO: 1344934 - RNA, 19 nt, Homo sapiens
gaugguagaugcaauugau

SEQ ID NO: 1344935 - RNA, 19 nt, Homo sapiens
gaagcaauccugaaacuca

SEQ ID NO: 1344936 - RNA, 19 nt, Homo sapiens
aaagagaugugucgagaug

SEQ ID NO: 1344937 - RNA, 19 nt, Homo sapiens
aagaaugccuacaagauuu

SEQ ID NO: 1344938 - RNA, 19 nt, Homo sapiens
gauuucaccucuugaguau

SEQ ID NO: 1344939 - RNA, 19 nt, Homo sapiens
gagagaagcaauccugaaa

SEQ ID NO: 1344940 - RNA, 19 nt, Homo sapiens
cauguuacuuggagugaua

SEQ ID NO: 1344941 - RNA, 19 nt, Homo sapiens
gcuagaaguugcccaggaa

SEQ ID NO: 1344942 - RNA, 19 nt, Homo sapiens
ccuacaagauuucauauca

SEQ ID NO: 1344943 - RNA, 19 nt, Homo sapiens
ggugaacaauggauaacaa

SEQ ID NO: 1344944 - RNA, 19 nt, Homo sapiens
guaucuaucuguagucguu

SEQ ID NO: 1344945 - RNA, 19 nt, Homo sapiens
gagaagcaauccugaaacu

SEQ ID NO: 1344946 - RNA, 19 nt, Homo sapiens
gaucguuuauucuucaguu

SEQ ID NO: 1344947 - RNA, 19 nt, Homo sapiens
uuucaccucuugaguauaa

SEQ ID NO: 1344948 - RNA, 19 nt, Homo sapiens
ccaggaguaccaaauaaua

SEQ ID NO: 1344949 - RNA, 19 nt, Homo sapiens
gguacaugcugaagccuuu

SEQ ID NO: 1344950 - RNA, 19 nt, Homo sapiens
gaaggcggcuggaaugaac

SEQ ID NO: 1344951 - RNA, 19 nt, Homo sapiens
ucuguuagaucguuuauuc

SEQ ID NO: 1344952 - RNA, 19 nt, Homo sapiens
ugaggugccuucugaauca

SEQ ID NO: 1344953 - RNA, 19 nt, Homo sapiens
acagucaucuuaccuauca

SEQ ID NO: 1344954 - RNA, 19 nt, Homo sapiens
gccaugugcucaacacuga

SEQ ID NO: 1344955 - RNA, 19 nt, Homo sapiens
gggcucaauuauuauguuu

SEQ ID NO: 1344956 - RNA, 19 nt, Homo sapiens
gaaauagaacggaaagagu

SEQ ID NO: 1344957 - RNA, 19 nt, Homo sapiens
cuacgaaaccguucaaguu

SEQ ID NO: 1344958 - RNA, 19 nt, Homo sapiens
gcaggcugucgauuuauua

SEQ ID NO: 1344959 - RNA, 19 nt, Homo sapiens
acacugauuucaccucuug

SEQ ID NO: 1344960 - RNA, 19 nt, Homo sapiens
uuacauaggugguauuacu

SEQ ID NO: 1344961 - RNA, 19 nt, Homo sapiens
uguguccucuuaucaguua

SEQ ID NO: 1344962 - RNA, 19 nt, Homo sapiens
gaguauugcugcucaucuu

SEQ ID NO: 1344963 - RNA, 19 nt, Homo sapiens
guaaagaucauuuguacag

SEQ ID NO: 1344964 - RNA, 19 nt, Homo sapiens
ugacucggcuauaaugaga

SEQ ID NO: 1344965 - RNA, 19 nt, Homo sapiens
ggaagauugugaagaggau

SEQ ID NO: 1344966 - RNA, 19 nt, Homo sapiens
gggauggauuggauacuga

SEQ ID NO: 1344967 - RNA, 19 nt, Homo sapiens
gaagcuacagccaugauga

SEQ ID NO: 1344968 - RNA, 19 nt, Homo sapiens
cuucgacacugaccgauaa

SEQ ID NO: 1344969 - RNA, 19 nt, Homo sapiens
cuccacaucuugcauauau

SEQ ID NO: 1344970 - RNA, 19 nt, Homo sapiens
ggucuuaaagucauaaaug

SEQ ID NO: 1344971 - RNA, 19 nt, Homo sapiens
cauauauuguacagccuua

SEQ ID NO: 1344972 - RNA, 19 nt, Homo sapiens
caaccagccugcuuuaaaa

SEQ ID NO: 1344973 - RNA, 19 nt, Homo sapiens
caauugauccaaccagaaa

SEQ ID NO: 1344974 - RNA, 19 nt, Homo sapiens
ucaguacccuuuaauacau

SEQ ID NO: 1344975 - RNA, 19 nt, Homo sapiens
aaaccucaguacccuuuaa

SEQ ID NO: 1344976 - RNA, 19 nt, Homo sapiens
ccucuugaguauaaacuuu

SEQ ID NO: 1344977 - RNA, 19 nt, Homo sapiens
agaaagccaugacgaagau

SEQ ID NO: 1344978 - RNA, 19 nt, Homo sapiens
gaagcucucagaauaugaa

SEQ ID NO: 1344979 - RNA, 19 nt, Homo sapiens
gugcguguauguaugugua

SEQ ID NO: 1344980 - RNA, 19 nt, Homo sapiens
guacagccuuauagaaucu

SEQ ID NO: 1344981 - RNA, 19 nt, Homo sapiens
ggaaauagaacggaaagag

SEQ ID NO: 1344982 - RNA, 19 nt, Homo sapiens
ucaaccagccugcuuuaaa

SEQ ID NO: 1344983 - RNA, 19 nt, Homo sapiens
uaagugguauggagaaucu

SEQ ID NO: 1344984 - RNA, 19 nt, Homo sapiens
gugaagcucucagaauaug

SEQ ID NO: 1344985 - RNA, 19 nt, Homo sapiens
augugaagcucucagaaua

SEQ ID NO: 1344986 - RNA, 19 nt, Homo sapiens
gaagugaccuaaaagagau

SEQ ID NO: 1344987 - RNA, 19 nt, Homo sapiens
caaccauccaucaucuuua

SEQ ID NO: 1344988 - RNA, 19 nt, Homo sapiens
gauccaaccagaaagcaaa

SEQ ID NO: 1344989 - RNA, 19 nt, Homo sapiens
gaaaauacuaguucaguga

SEQ ID NO: 1344990 - RNA, 19 nt, Homo sapiens
acaguucagugaucuaguu

SEQ ID NO: 1344991 - RNA, 19 nt, Homo sapiens
ggaccugcaucgggcaauu

SEQ ID NO: 1344992 - RNA, 19 nt, Homo sapiens
gagaagaaugccuacaaga

SEQ ID NO: 1344993 - RNA, 19 nt, Homo sapiens
uguagacccucuuaauaug

SEQ ID NO: 1344994 - RNA, 19 nt, Homo sapiens
gcaauugauccaaccagaa

SEQ ID NO: 1344995 - RNA, 19 nt, Homo sapiens
uauggaagauugugaagag

SEQ ID NO: 1344996 - RNA, 19 nt, Homo sapiens
ccauuuccauuugucauuu

SEQ ID NO: 1344997 - RNA, 19 nt, Homo sapiens
gcauguagaccugcuagaa

SEQ ID NO: 1344998 - RNA, 19 nt, Homo sapiens
agaagcaggcugucgauuu

SEQ ID NO: 1344999 - RNA, 19 nt, Homo sapiens
uauagcagguuuagaugau

SEQ ID NO: 1345000 - RNA, 19 nt, Homo sapiens
ugauauagcagguuuagau

SEQ ID NO: 1345001 - RNA, 19 nt, Homo sapiens
gcucucagaauaugaaaug

SEQ ID NO: 1345002 - RNA, 19 nt, Homo sapiens
caucuugcauauauacaug

SEQ ID NO: 1345003 - RNA, 19 nt, Homo sapiens
caaaagguguucuucucua

SEQ ID NO: 1345004 - RNA, 19 nt, Homo sapiens
gugacauacuuuacuauca

SEQ ID NO: 1345005 - RNA, 19 nt, Homo sapiens
auacaugggcucaauuauu

SEQ ID NO: 1345006 - RNA, 19 nt, Homo sapiens
cuacaaccauccaucaucu

SEQ ID NO: 1345007 - RNA, 19 nt, Homo sapiens
gauaagugguauggagaau

SEQ ID NO: 1345008 - RNA, 19 nt, Homo sapiens
ccucuuaauaugcauguua

SEQ ID NO: 1345009 - RNA, 19 nt, Homo sapiens
uaaauugugcccuaaguca

SEQ ID NO: 1345010 - RNA, 19 nt, Homo sapiens
guucagugaucagcauuga

SEQ ID NO: 1345011 - RNA, 19 nt, Homo sapiens
gaugaaauucggccuguuc

SEQ ID NO: 1345012 - RNA, 19 nt, Homo sapiens
ccgcagcccuuaguaucua

SEQ ID NO: 1345013 - RNA, 19 nt, Homo sapiens
uaucuguagucguuuaaug

SEQ ID NO: 1345014 - RNA, 19 nt, Homo sapiens
cgugggugcuuguguuuga

SEQ ID NO: 1345015 - RNA, 19 nt, Homo sapiens
ugagaagaaugccuacaag

SEQ ID NO: 1345016 - RNA, 19 nt, Homo sapiens
aaccauccaucaucuuuau

SEQ ID NO: 1345017 - RNA, 19 nt, Homo sapiens
acacagucaucuuaccuau

SEQ ID NO: 1345018 - RNA, 19 nt, Homo sapiens
uagaugaaauagacuccuu

SEQ ID NO: 1345019 - RNA, 19 nt, Homo sapiens
gaaagaagguacuugcuaa

SEQ ID NO: 1345020 - RNA, 19 nt, Homo sapiens
gaccagaagugucuauaua

SEQ ID NO: 1345021 - RNA, 19 nt, Homo sapiens
gaagcuaaguuaacuggua

SEQ ID NO: 1345022 - RNA, 19 nt, Homo sapiens
gcacugccauucauaauug

SEQ ID NO: 1345023 - RNA, 19 nt, Homo sapiens
gcauuaagguagagguuua

SEQ ID NO: 1345024 - RNA, 19 nt, Homo sapiens
gaacugcucaggacuauaa

SEQ ID NO: 1345025 - RNA, 19 nt, Homo sapiens
gaagguacuugcuaaagaa

SEQ ID NO: 1345026 - RNA, 19 nt, Homo sapiens
cuaagucggucucuaauaa

SEQ ID NO: 1345027 - RNA, 19 nt, Homo sapiens
caaaugggauugguacuuu

SEQ ID NO: 1345028 - RNA, 19 nt, Homo sapiens
ggugagaauugaaugguua

SEQ ID NO: 1345029 - RNA, 19 nt, Homo sapiens
ugacaaacuucuacucuug

SEQ ID NO: 1345030 - RNA, 19 nt, Homo sapiens
gaucauggauuuaagaaac

SEQ ID NO: 1345031 - RNA, 19 nt, Homo sapiens
gaaaccauaugauaacaca

SEQ ID NO: 1345032 - RNA, 19 nt, Homo sapiens
gaaagaaggcagcaauuca

SEQ ID NO: 1345033 - RNA, 19 nt, Homo sapiens
ucacuaagccgguucauga

SEQ ID NO: 1345034 - RNA, 19 nt, Homo sapiens
ccaauucagucuucagauu

SEQ ID NO: 1345035 - RNA, 19 nt, Homo sapiens
gaaaugauauaugcugcuu

SEQ ID NO: 1345036 - RNA, 19 nt, Homo sapiens
gcaguguccucacguggua

SEQ ID NO: 1345037 - RNA, 19 nt, Homo sapiens
agagacagaucuuugauga

SEQ ID NO: 1345038 - RNA, 19 nt, Homo sapiens
ccaggcugcugcuuaauuu

SEQ ID NO: 1345039 - RNA, 19 nt, Homo sapiens
gaaaguccaguccaaggua

SEQ ID NO: 1345040 - RNA, 19 nt, Homo sapiens
caugaacccuugguagaua

SEQ ID NO: 1345041 - RNA, 19 nt, Homo sapiens
cgaccuggcuuucaugaug

SEQ ID NO: 1345042 - RNA, 19 nt, Homo sapiens
gcaaagagaacaacaaacu

SEQ ID NO: 1345043 - RNA, 19 nt, Homo sapiens
cgaagaagagccagaauga

SEQ ID NO: 1345044 - RNA, 19 nt, Homo sapiens
ggagauagggagauucuga

SEQ ID NO: 1345045 - RNA, 19 nt, Homo sapiens
aaacuucagccucuuauaa

SEQ ID NO: 1345046 - RNA, 19 nt, Homo sapiens
uaacguauuucaucaugga

SEQ ID NO: 1345047 - RNA, 19 nt, Homo sapiens
ggagaaugaugcagcuaug

SEQ ID NO: 1345048 - RNA, 19 nt, Homo sapiens
cuauauaccugucagauca

SEQ ID NO: 1345049 - RNA, 19 nt, Homo sapiens
acacagaaaugauauaugc

SEQ ID NO: 1345050 - RNA, 19 nt, Homo sapiens
acacugaaaccauaugaua

SEQ ID NO: 1345051 - RNA, 19 nt, Homo sapiens
caaauaccauagacagguu

SEQ ID NO: 1345052 - RNA, 19 nt, Homo sapiens
uaaucgggauguaaucuuu

SEQ ID NO: 1345053 - RNA, 19 nt, Homo sapiens
ccggagagcuagauuccua

SEQ ID NO: 1345054 - RNA, 19 nt, Homo sapiens
acaacaaacuggaagauca

SEQ ID NO: 1345055 - RNA, 19 nt, Homo sapiens
gagcgcagauucaaugucu

SEQ ID NO: 1345056 - RNA, 19 nt, Homo sapiens
uagacagguugguuuauaa

SEQ ID NO: 1345057 - RNA, 19 nt, Homo sapiens
gaaggggacugcuuaaaau

SEQ ID NO: 1345058 - RNA, 19 nt, Homo sapiens
auaaauggcuugagcauac

SEQ ID NO: 1345059 - RNA, 19 nt, Homo sapiens
caacccaggcugcugcuua

SEQ ID NO: 1345060 - RNA, 19 nt, Homo sapiens
auagggagauucugacaaa

SEQ ID NO: 1345061 - RNA, 19 nt, Homo sapiens
caacuauaguguguacgua

SEQ ID NO: 1345062 - RNA, 19 nt, Homo sapiens
ggacaacacaaaugggauu

SEQ ID NO: 1345063 - RNA, 19 nt, Homo sapiens
agaagguacuugcuaaaga

SEQ ID NO: 1345064 - RNA, 19 nt, Homo sapiens
agaaguaccggcugaagua

SEQ ID NO: 1345065 - RNA, 19 nt, Homo sapiens
gggagauucugacaaacuu

SEQ ID NO: 1345066 - RNA, 19 nt, Homo sapiens
agacagaucuuugaugaag

SEQ ID NO: 1345067 - RNA, 19 nt, Homo sapiens
uagaaagguugaacugguu

SEQ ID NO: 1345068 - RNA, 19 nt, Homo sapiens
aggcagcaauucagaagua

SEQ ID NO: 1345069 - RNA, 19 nt, Homo sapiens
gaacaagaagggaucagau

SEQ ID NO: 1345070 - RNA, 19 nt, Homo sapiens
cuucuacucuugauuguga

SEQ ID NO: 1345071 - RNA, 19 nt, Homo sapiens
auagacagguugguuuaua

SEQ ID NO: 1345072 - RNA, 19 nt, Homo sapiens
cagccuuugugucuucuua

SEQ ID NO: 1345073 - RNA, 19 nt, Homo sapiens
gaaaaugcaucaauuacca

SEQ ID NO: 1345074 - RNA, 19 nt, Homo sapiens
ugaaauugcucgucuugag

SEQ ID NO: 1345075 - RNA, 19 nt, Homo sapiens
uacuaaggaucauggauuu

SEQ ID NO: 1345076 - RNA, 19 nt, Homo sapiens
aaaugggauugguacuuua

SEQ ID NO: 1345077 - RNA, 19 nt, Homo sapiens
caauugaggacaacacaaa

SEQ ID NO: 1345078 - RNA, 19 nt, Homo sapiens
gguuuacucuaucaccuaa

SEQ ID NO: 1345079 - RNA, 19 nt, Homo sapiens
ugaaauuguuccugaagau

SEQ ID NO: 1345080 - RNA, 19 nt, Homo sapiens
ggacccagaaguagaagaa

SEQ ID NO: 1345081 - RNA, 19 nt, Homo sapiens
aauccaauguucugcuuaa

SEQ ID NO: 1345082 - RNA, 19 nt, Homo sapiens
ggugagggcccacuuccua

SEQ ID NO: 1345083 - RNA, 19 nt, Homo sapiens
ccauagacagguugguuua

SEQ ID NO: 1345084 - RNA, 19 nt, Homo sapiens
uaaacaagagugauagaga

SEQ ID NO: 1345085 - RNA, 19 nt, Homo sapiens
gcaauucagaaguaaagaa

SEQ ID NO: 1345086 - RNA, 19 nt, Homo sapiens
gcuaagucggucucuaaua

SEQ ID NO: 1345087 - RNA, 19 nt, Homo sapiens
ccaauguucugcuuaaacu

SEQ ID NO: 1345088 - RNA, 19 nt, Homo sapiens
aaacuucuacucuugauug

SEQ ID NO: 1345089 - RNA, 19 nt, Homo sapiens
ggaaccauuugggaagaaa

SEQ ID NO: 1345090 - RNA, 19 nt, Homo sapiens
gaggaaccauuugggaaga

SEQ ID NO: 1345091 - RNA, 19 nt, Homo sapiens
ccuaacaccucaacacuac

SEQ ID NO: 1345092 - RNA, 19 nt, Homo sapiens
gaacaacaaacuggaagau

SEQ ID NO: 1345093 - RNA, 19 nt, Homo sapiens
cuaaggaucauggauuuaa

SEQ ID NO: 1345094 - RNA, 19 nt, Homo sapiens
aagaagagccagaaugaga

SEQ ID NO: 1345095 - RNA, 19 nt, Homo sapiens
gggauggaguggugagaau

SEQ ID NO: 1345096 - RNA, 19 nt, Homo sapiens
cgagggagauagggagauu

SEQ ID NO: 1345097 - RNA, 19 nt, Homo sapiens
gaucaggcagcaguguuua

SEQ ID NO: 1345098 - RNA, 19 nt, Homo sapiens
ggaucaggcagcaguguuu

SEQ ID NO: 1345099 - RNA, 19 nt, Homo sapiens
gaugaaauugcucgucuug

SEQ ID NO: 1345100 - RNA, 19 nt, Homo sapiens
cauuaagucuguaguagca

SEQ ID NO: 1345101 - RNA, 19 nt, Homo sapiens
gaccuaaucaccucccaaa

SEQ ID NO: 1345102 - RNA, 19 nt, Homo sapiens
gcucgaaaaugcaucaauu

SEQ ID NO: 1345103 - RNA, 19 nt, Homo sapiens
uugcaguacucgaauauau

SEQ ID NO: 1345104 - RNA, 19 nt, Homo sapiens
ggaaggggacugcuuaaaa

SEQ ID NO: 1345105 - RNA, 19 nt, Homo sapiens
caacacaaaugggauuggu

SEQ ID NO: 1345106 - RNA, 19 nt, Homo sapiens
ggaaguccaaguucaagga

SEQ ID NO: 1345107 - RNA, 19 nt, Homo sapiens
gcugggaaguccaaguuca

SEQ ID NO: 1345108 - RNA, 19 nt, Homo sapiens
agaaagaagguacuugcua

SEQ ID NO: 1345109 - RNA, 19 nt, Homo sapiens
acagggagcugggccuauu

SEQ ID NO: 1345110 - RNA, 19 nt, Homo sapiens
gaaggcagcaauucagaag

SEQ ID NO: 1345111 - RNA, 19 nt, Homo sapiens
gaaauuguuccugaagaug

SEQ ID NO: 1345112 - RNA, 19 nt, Homo sapiens
cgaccgaccuggcuuucau

SEQ ID NO: 1345113 - RNA, 19 nt, Homo sapiens
agaauugaaugguuaaugc

SEQ ID NO: 1345114 - RNA, 19 nt, Homo sapiens
ccugugggaugccuuaguu

SEQ ID NO: 1345115 - RNA, 19 nt, Homo sapiens
ccaauaccaucacauuagg

SEQ ID NO: 1345116 - RNA, 19 nt, Homo sapiens
accuucagcugcuuuauuu

SEQ ID NO: 1345117 - RNA, 19 nt, Homo sapiens
guaaagaagauacuaacgu

SEQ ID NO: 1345118 - RNA, 19 nt, Homo sapiens
accaagggcugucuggaaa

SEQ ID NO: 1345119 - RNA, 19 nt, Homo sapiens
gaacauagaccaaauggaa

SEQ ID NO: 1345120 - RNA, 19 nt, Homo sapiens
gagaagaugugugagaaua

SEQ ID NO: 1345121 - RNA, 19 nt, Homo sapiens
ccacaugccuccaguuuaa

SEQ ID NO: 1345122 - RNA, 19 nt, Homo sapiens
gaaauucaacugucagaua

SEQ ID NO: 1345123 - RNA, 19 nt, Homo sapiens
guaguaaacuucaaagaug

SEQ ID NO: 1345124 - RNA, 19 nt, Homo sapiens
guacauagcaccuuuaaug

SEQ ID NO: 1345125 - RNA, 19 nt, Homo sapiens
ggacagaacaacaccagua

SEQ ID NO: 1345126 - RNA, 19 nt, Homo sapiens
gccagcaucuucuuuauug

SEQ ID NO: 1345127 - RNA, 19 nt, Homo sapiens
gaacaucucccguggacuu

SEQ ID NO: 1345128 - RNA, 19 nt, Homo sapiens
uuacagguguuaagacuaa

SEQ ID NO: 1345129 - RNA, 19 nt, Homo sapiens
gaaacaaaggguaaacaaa

SEQ ID NO: 1345130 - RNA, 19 nt, Homo sapiens
gaacauagaauucccuagu

SEQ ID NO: 1345131 - RNA, 19 nt, Homo sapiens
guucaaauguucucugaug

SEQ ID NO: 1345132 - RNA, 19 nt, Homo sapiens
ucugaugucucaaagauaa

SEQ ID NO: 1345133 - RNA, 19 nt, Homo sapiens
ggaaugucaucuauaguuc

SEQ ID NO: 1345134 - RNA, 19 nt, Homo sapiens
uaauggagcuucuacagau

SEQ ID NO: 1345135 - RNA, 19 nt, Homo sapiens
aaagagcaaugaugaaugu

SEQ ID NO: 1345136 - RNA, 19 nt, Homo sapiens
gcagccagcaucuucuuua

SEQ ID NO: 1345137 - RNA, 19 nt, Homo sapiens
gaagaugugugagaauaca

SEQ ID NO: 1345138 - RNA, 19 nt, Homo sapiens
gcucauggauggacgaauc

SEQ ID NO: 1345139 - RNA, 19 nt, Homo sapiens
ggaaacaaaggguaaacaa

SEQ ID NO: 1345140 - RNA, 19 nt, Homo sapiens
gcagugacuucucaguuuc

SEQ ID NO: 1345141 - RNA, 19 nt, Homo sapiens
ggacgaaucaucuuuggau

SEQ ID NO: 1345142 - RNA, 19 nt, Homo sapiens
ugaugaaugucucaagauu

SEQ ID NO: 1345143 - RNA, 19 nt, Homo sapiens
aaacaaacacacacacaaa

SEQ ID NO: 1345144 - RNA, 19 nt, Homo sapiens
gcgaugaaguuuagaagag

SEQ ID NO: 1345145 - RNA, 19 nt, Homo sapiens
agaagaugauaccaagaua

SEQ ID NO: 1345146 - RNA, 19 nt, Homo sapiens
gacgaaucaucuuuggaua

SEQ ID NO: 1345147 - RNA, 19 nt, Homo sapiens
ggagaagucguacaucgaa

SEQ ID NO: 1345148 - RNA, 19 nt, Homo sapiens
cgaagaagaacaauuuaug

SEQ ID NO: 1345149 - RNA, 19 nt, Homo sapiens
cagauaaguucaaccaauc

SEQ ID NO: 1345150 - RNA, 19 nt, Homo sapiens
gccuauaccuuuaagacaa

SEQ ID NO: 1345151 - RNA, 19 nt, Homo sapiens
gaauacagaaccaguggaa

SEQ ID NO: 1345152 - RNA, 19 nt, Homo sapiens
guacaucuccaggauaauu

SEQ ID NO: 1345153 - RNA, 19 nt, Homo sapiens
gauaauggcacagcacuug

SEQ ID NO: 1345154 - RNA, 19 nt, Homo sapiens
cauauacacuggagaaguc

SEQ ID NO: 1345155 - RNA, 19 nt, Homo sapiens
acagauaaguucaaccaau

SEQ ID NO: 1345156 - RNA, 19 nt, Homo sapiens
aaauuucgaucccagugua

SEQ ID NO: 1345157 - RNA, 19 nt, Homo sapiens
caccuuuaauggcaaauuu

SEQ ID NO: 1345158 - RNA, 19 nt, Homo sapiens
auacagaccacaauuacua

SEQ ID NO: 1345159 - RNA, 19 nt, Homo sapiens
ccacaggauccaacaaauu

SEQ ID NO: 1345160 - RNA, 19 nt, Homo sapiens
gagugaaucuguccuucga

SEQ ID NO: 1345161 - RNA, 19 nt, Homo sapiens
aagauaccauuuacacuga

SEQ ID NO: 1345162 - RNA, 19 nt, Homo sapiens
cgaaucaucuuuggauaca

SEQ ID NO: 1345163 - RNA, 19 nt, Homo sapiens
ugaaccaguuggagagaaa

SEQ ID NO: 1345164 - RNA, 19 nt, Homo sapiens
ccaccagccucccuacaga

SEQ ID NO: 1345165 - RNA, 19 nt, Homo sapiens
cauuuacacugaacauaga

SEQ ID NO: 1345166 - RNA, 19 nt, Homo sapiens
gcucagcccaggaaacaaa

SEQ ID NO: 1345167 - RNA, 19 nt, Homo sapiens
caagauuucuggacaagcu

SEQ ID NO: 1345168 - RNA, 19 nt, Homo sapiens
caaacaaacacacacacaa

SEQ ID NO: 1345169 - RNA, 19 nt, Homo sapiens
gagcagugacuucucaguu

SEQ ID NO: 1345170 - RNA, 19 nt, Homo sapiens
guggaaacuucuucucgaa

SEQ ID NO: 1345171 - RNA, 19 nt, Homo sapiens
caaaagagaagauguguga

SEQ ID NO: 1345172 - RNA, 19 nt, Homo sapiens
gagcaagcgucggccaaga

SEQ ID NO: 1345173 - RNA, 19 nt, Homo sapiens
ucucaagauugcuaagaaa

SEQ ID NO: 1345174 - RNA, 19 nt, Homo sapiens
ucugaaguaugacaagauu

SEQ ID NO: 1345175 - RNA, 19 nt, Homo sapiens
cuaguggaaugucaucuau

SEQ ID NO: 1345176 - RNA, 19 nt, Homo sapiens
gagagacgcccaagcagau

SEQ ID NO: 1345177 - RNA, 19 nt, Homo sapiens
gauuggcaguauggaguua

SEQ ID NO: 1345178 - RNA, 19 nt, Homo sapiens
cacaguacauagcaccuuu

SEQ ID NO: 1345179 - RNA, 19 nt, Homo sapiens
ucaaggcgguagacacgaa

SEQ ID NO: 1345180 - RNA, 19 nt, Homo sapiens
gaucgacaccuuugguuca

SEQ ID NO: 1345181 - RNA, 19 nt, Homo sapiens
caugagggaucgacaccuu

SEQ ID NO: 1345182 - RNA, 19 nt, Homo sapiens
ccuauaccuuuaagacaaa

SEQ ID NO: 1345183 - RNA, 19 nt, Homo sapiens
gcaggaguuauguuacuuu

SEQ ID NO: 1345184 - RNA, 19 nt, Homo sapiens
ggccugcgaugaaguuuag

SEQ ID NO: 1345185 - RNA, 19 nt, Homo sapiens
gaagaugauaccaagauag

SEQ ID NO: 1345186 - RNA, 19 nt, Homo sapiens
aagagaagaugugugagaa

SEQ ID NO: 1345187 - RNA, 19 nt, Homo sapiens
gcaagagugagaacaaaca

SEQ ID NO: 1345188 - RNA, 19 nt, Homo sapiens
gaaugucucaagauugcua

SEQ ID NO: 1345189 - RNA, 19 nt, Homo sapiens
cagaaccaguggaaacuuc

SEQ ID NO: 1345190 - RNA, 19 nt, Homo sapiens
gacaguggaugcccugaag

SEQ ID NO: 1345191 - RNA, 19 nt, Homo sapiens
caaccaaucauccagugaa

SEQ ID NO: 1345192 - RNA, 19 nt, Homo sapiens
gaugaugggcaggacaaua

SEQ ID NO: 1345193 - RNA, 19 nt, Homo sapiens
gaugaaugucucaagauug

SEQ ID NO: 1345194 - RNA, 19 nt, Homo sapiens
aaugaugaaugucucaaga

SEQ ID NO: 1345195 - RNA, 19 nt, Homo sapiens
ucucugaugucucaaagau

SEQ ID NO: 1345196 - RNA, 19 nt, Homo sapiens
caaauguucucugaugucu

SEQ ID NO: 1345197 - RNA, 19 nt, Homo sapiens
caaacacacacacaaacaa

SEQ ID NO: 1345198 - RNA, 19 nt, Homo sapiens
cccaguguauccagaaauu

SEQ ID NO: 1345199 - RNA, 19 nt, Homo sapiens
ggauacagaccacaauuac

SEQ ID NO: 1345200 - RNA, 19 nt, Homo sapiens
gaggauacagaccacaauu

SEQ ID NO: 1345201 - RNA, 19 nt, Homo sapiens
ggagguggaaguugauuca

SEQ ID NO: 1345202 - RNA, 19 nt, Homo sapiens
agacaagauuucuggacaa

SEQ ID NO: 1345203 - RNA, 19 nt, Homo sapiens
ucacggaccaguuucaguu

SEQ ID NO: 1345204 - RNA, 19 nt, Homo sapiens
agcagugacuucucaguuu

SEQ ID NO: 1345205 - RNA, 19 nt, Homo sapiens
aggaggagguggaaguuga

SEQ ID NO: 1345206 - RNA, 19 nt, Homo sapiens
agucguacaucgaaugcua

SEQ ID NO: 1345207 - RNA, 19 nt, Homo sapiens
aauguucucugaugucuca

SEQ ID NO: 1345208 - RNA, 19 nt, Homo sapiens
cagccagcaucuucuuuau

SEQ ID NO: 1345209 - RNA, 19 nt, Homo sapiens
cagugcagcugagaagaaa

SEQ ID NO: 1345210 - RNA, 19 nt, Homo sapiens
caggaguuauguuacuuug

SEQ ID NO: 1345211 - RNA, 19 nt, Homo sapiens
aaagagaagaugugugaga

SEQ ID NO: 1345212 - RNA, 19 nt, Homo sapiens
ucaguucgccgaugggaaa

SEQ ID NO: 1345213 - RNA, 19 nt, Homo sapiens
gagaagucguacaucgaau

SEQ ID NO: 1345214 - RNA, 19 nt, Homo sapiens
gacaagauuucuggacaag

SEQ ID NO: 1345215 - RNA, 19 nt, Homo sapiens
gcuaacagccacacaguac

SEQ ID NO: 1345216 - RNA, 19 nt, Homo sapiens
uauguuacuuugccacuuc

SEQ ID NO: 1345217 - RNA, 19 nt, Homo sapiens
agaaggcuuuauuguauca

SEQ ID NO: 1345218 - RNA, 19 nt, Homo sapiens
cagaagaugauaccaagau

SEQ ID NO: 1345219 - RNA, 19 nt, Homo sapiens
caaggaaucugaagcuuua

SEQ ID NO: 1345220 - RNA, 19 nt, Homo sapiens
ggaaauacccagacuguua

SEQ ID NO: 1345221 - RNA, 19 nt, Homo sapiens
gaagaaagcuagaacuaau

SEQ ID NO: 1345222 - RNA, 19 nt, Homo sapiens
gaaauugacucuugcaguu

SEQ ID NO: 1345223 - RNA, 19 nt, Homo sapiens
gaauugagcuuacauuugg

SEQ ID NO: 1345224 - RNA, 19 nt, Homo sapiens
ccgggaagcuguaagauua

SEQ ID NO: 1345225 - RNA, 19 nt, Homo sapiens
ucagacaacucaaauguaa

SEQ ID NO: 1345226 - RNA, 19 nt, Homo sapiens
gagcaaacauaccaagaaa

SEQ ID NO: 1345227 - RNA, 19 nt, Homo sapiens
gcacuggaauuaauaccua

SEQ ID NO: 1345228 - RNA, 19 nt, Homo sapiens
gauuauagcaccagcaaua

SEQ ID NO: 1345229 - RNA, 19 nt, Homo sapiens
gaagagaggcacuggaauu

SEQ ID NO: 1345230 - RNA, 19 nt, Homo sapiens
caaauucaauguucuggaa

SEQ ID NO: 1345231 - RNA, 19 nt, Homo sapiens
ccagacagcugccaucaga

SEQ ID NO: 1345232 - RNA, 19 nt, Homo sapiens
cuacagacauuauccagaa

SEQ ID NO: 1345233 - RNA, 19 nt, Homo sapiens
gagaggcacuggaauuaau

SEQ ID NO: 1345234 - RNA, 19 nt, Homo sapiens
gagaagaaagcuagaacua

SEQ ID NO: 1345235 - RNA, 19 nt, Homo sapiens
cgacaauacagguaauuua

SEQ ID NO: 1345236 - RNA, 19 nt, Homo sapiens
cugaggagcugcugucuuu

SEQ ID NO: 1345237 - RNA, 19 nt, Homo sapiens
ggccugggauuucucguua

SEQ ID NO: 1345238 - RNA, 19 nt, Homo sapiens
gcaauauacucuugaaugc

SEQ ID NO: 1345239 - RNA, 19 nt, Homo sapiens
ggaaaucccaggaauacaa

SEQ ID NO: 1345240 - RNA, 19 nt, Homo sapiens
ggacaagucauuagagaau

SEQ ID NO: 1345241 - RNA, 19 nt, Homo sapiens
caagaaacacuaugaaauc

SEQ ID NO: 1345242 - RNA, 19 nt, Homo sapiens
gcacucugguucugccuaa

SEQ ID NO: 1345243 - RNA, 19 nt, Homo sapiens
cauaagcgguuacuaucaa

SEQ ID NO: 1345244 - RNA, 19 nt, Homo sapiens
gcucugacuugugcaauuu

SEQ ID NO: 1345245 - RNA, 19 nt, Homo sapiens
guaauuuggcugugcuuua

SEQ ID NO: 1345246 - RNA, 19 nt, Homo sapiens
ggaacaacaugauuauacu

SEQ ID NO: 1345247 - RNA, 19 nt, Homo sapiens
ucaaggcaauuaaagcaaa

SEQ ID NO: 1345248 - RNA, 19 nt, Homo sapiens
gcaauuaaacacagaagga

SEQ ID NO: 1345249 - RNA, 19 nt, Homo sapiens
ucaaauacagccagacuuu

SEQ ID NO: 1345250 - RNA, 19 nt, Homo sapiens
caaauaaucgaaugaggaa

SEQ ID NO: 1345251 - RNA, 19 nt, Homo sapiens
ccacguggaugccuugaau

SEQ ID NO: 1345252 - RNA, 19 nt, Homo sapiens
gaagacggccacaagagaa

SEQ ID NO: 1345253 - RNA, 19 nt, Homo sapiens
gaauuacggucugcugaga

SEQ ID NO: 1345254 - RNA, 19 nt, Homo sapiens
gcaauuaaagcaaauccaa

SEQ ID NO: 1345255 - RNA, 19 nt, Homo sapiens
gcuguugaccuaaugauuu

SEQ ID NO: 1345256 - RNA, 19 nt, Homo sapiens
uaauuuggcugugcuuuau

SEQ ID NO: 1345257 - RNA, 19 nt, Homo sapiens
guggaugaaucuaggcaua

SEQ ID NO: 1345258 - RNA, 19 nt, Homo sapiens
ggccuccucuucagaauga

SEQ ID NO: 1345259 - RNA, 19 nt, Homo sapiens
caggaacuaaggagaauua

SEQ ID NO: 1345260 - RNA, 19 nt, Homo sapiens
ccaagaaacacuaugaaau

SEQ ID NO: 1345261 - RNA, 19 nt, Homo sapiens
ugaggcauaucauuaauag

SEQ ID NO: 1345262 - RNA, 19 nt, Homo sapiens
cuguugaccuaaugauuua

SEQ ID NO: 1345263 - RNA, 19 nt, Homo sapiens
ucacugugcuggguuuaaa

SEQ ID NO: 1345264 - RNA, 19 nt, Homo sapiens
caacauacugugaacuuug

SEQ ID NO: 1345265 - RNA, 19 nt, Homo sapiens
guauggacuagcacuauua

SEQ ID NO: 1345266 - RNA, 19 nt, Homo sapiens
gaaaugccaccgugcugaa

SEQ ID NO: 1345267 - RNA, 19 nt, Homo sapiens
gaacagcuuuucagaagug

SEQ ID NO: 1345268 - RNA, 19 nt, Homo sapiens
gacuagcacuauuaaacuu

SEQ ID NO: 1345269 - RNA, 19 nt, Homo sapiens
uaauuuagcccaagcugaa

SEQ ID NO: 1345270 - RNA, 19 nt, Homo sapiens
uccagaagguacuacauaa

SEQ ID NO: 1345271 - RNA, 19 nt, Homo sapiens
gggaagcuguaagauuaaa

SEQ ID NO: 1345272 - RNA, 19 nt, Homo sapiens
ggaaauuguccagaaggua

SEQ ID NO: 1345273 - RNA, 19 nt, Homo sapiens
gagcuuacauuugggaucu

SEQ ID NO: 1345274 - RNA, 19 nt, Homo sapiens
gaaauacccagacuguuac

SEQ ID NO: 1345275 - RNA, 19 nt, Homo sapiens
gaaugaggaauggaaguuu

SEQ ID NO: 1345276 - RNA, 19 nt, Homo sapiens
ggaucacugugcuggguuu

SEQ ID NO: 1345277 - RNA, 19 nt, Homo sapiens
gacaauacagguaauuuag

SEQ ID NO: 1345278 - RNA, 19 nt, Homo sapiens
gccaagcccugugcucuga

SEQ ID NO: 1345279 - RNA, 19 nt, Homo sapiens
gaaggccguuuuccauuuu

SEQ ID NO: 1345280 - RNA, 19 nt, Homo sapiens
ggacuagcacuauuaaacu

SEQ ID NO: 1345281 - RNA, 19 nt, Homo sapiens
gccaagaaacacuaugaaa

SEQ ID NO: 1345282 - RNA, 19 nt, Homo sapiens
ggugauaggcaaauucaau

SEQ ID NO: 1345283 - RNA, 19 nt, Homo sapiens
gaagagggcaacacaucug

SEQ ID NO: 1345284 - RNA, 19 nt, Homo sapiens
cagccucacaucuuuauuu

SEQ ID NO: 1345285 - RNA, 19 nt, Homo sapiens
gaauagggcaaauaaucga

SEQ ID NO: 1345286 - RNA, 19 nt, Homo sapiens
ccagcaauauacucuugaa

SEQ ID NO: 1345287 - RNA, 19 nt, Homo sapiens
caccagcaauauacucuug

SEQ ID NO: 1345288 - RNA, 19 nt, Homo sapiens
ggaauacaaggaaucugaa

SEQ ID NO: 1345289 - RNA, 19 nt, Homo sapiens
aagagaggcacuggaauua

SEQ ID NO: 1345290 - RNA, 19 nt, Homo sapiens
ucaauacacaggagauuau

SEQ ID NO: 1345291 - RNA, 19 nt, Homo sapiens
uugaaugcgugauaugauu

SEQ ID NO: 1345292 - RNA, 19 nt, Homo sapiens
agaagaaagcuagaacuaa

SEQ ID NO: 1345293 - RNA, 19 nt, Homo sapiens
guccagaagguacuacaua

SEQ ID NO: 1345294 - RNA, 19 nt, Homo sapiens
gauccuguuuccuucaugu

SEQ ID NO: 1345295 - RNA, 19 nt, Homo sapiens
caaggcaauuaaagcaaau

SEQ ID NO: 1345296 - RNA, 19 nt, Homo sapiens
ggaugaaucuaggcauagu

SEQ ID NO: 1345297 - RNA, 19 nt, Homo sapiens
cagcugccaucagaaacua

SEQ ID NO: 1345298 - RNA, 19 nt, Homo sapiens
gauaggcaaauucaauguu

SEQ ID NO: 1345299 - RNA, 19 nt, Homo sapiens
aaggacaagucauuagaga

SEQ ID NO: 1345300 - RNA, 19 nt, Homo sapiens
acaacauacugugaacuuu

SEQ ID NO: 1345301 - RNA, 19 nt, Homo sapiens
aaagcugucugauccuguu

SEQ ID NO: 1345302 - RNA, 19 nt, Homo sapiens
aagcagcagagcaaaguua

SEQ ID NO: 1345303 - RNA, 19 nt, Homo sapiens
cuucaauuaugaccaagaa

SEQ ID NO: 1345304 - RNA, 19 nt, Homo sapiens
agaauugagcuuacauuug

SEQ ID NO: 1345305 - RNA, 19 nt, Homo sapiens
caucaggaacuaaggagaa

SEQ ID NO: 1345306 - RNA, 19 nt, Homo sapiens
agaagguacuacauaagga

SEQ ID NO: 1345307 - RNA, 19 nt, Homo sapiens
gacagcaauuaaacacaga

SEQ ID NO: 1345308 - RNA, 19 nt, Homo sapiens
agacagcugccaucagaaa

SEQ ID NO: 1345309 - RNA, 19 nt, Homo sapiens
aagguucacuacaacauug

SEQ ID NO: 1345310 - RNA, 19 nt, Homo sapiens
augcuaagguucacuacaa

SEQ ID NO: 1345311 - RNA, 19 nt, Homo sapiens
ucuguaugcuguugaccua

SEQ ID NO: 1345312 - RNA, 19 nt, Homo sapiens
ggugagggccguaaacuac

SEQ ID NO: 1345313 - RNA, 19 nt, Homo sapiens
acaaggaaucugaagcuuu

SEQ ID NO: 1345314 - RNA, 19 nt, Homo sapiens
caaaguuaccggacagcaa

SEQ ID NO: 1345315 - RNA, 19 nt, Homo sapiens
acugugugcugcugacuuu

SEQ ID NO: 1345316 - RNA, 19 nt, Homo sapiens
uguauggacuagcacuauu

SEQ ID NO: 1345317 - RNA, 19 nt, Homo sapiens
uugaaugcguggagaaaug

SEQ ID NO: 1345318 - RNA, 19 nt, Homo sapiens
ugagcaaacauaccaagaa

SEQ ID NO: 1345319 - RNA, 19 nt, Homo sapiens
caaggaaacuaacaaugua

SEQ ID NO: 1345320 - RNA, 19 nt, Homo sapiens
ccaaugguuucuccaauua

SEQ ID NO: 1345321 - RNA, 19 nt, Homo sapiens
ggaugaagguggcgucuuu

SEQ ID NO: 1345322 - RNA, 19 nt, Homo sapiens
caauguagguuacuaguga

SEQ ID NO: 1345323 - RNA, 19 nt, Homo sapiens
ggacuucuuugaccugcua

SEQ ID NO: 1345324 - RNA, 19 nt, Homo sapiens
gacggaacccaguguauua

SEQ ID NO: 1345325 - RNA, 19 nt, Homo sapiens
gcagguguguaaggaaaua

SEQ ID NO: 1345326 - RNA, 19 nt, Homo sapiens
ugaaucagguguuaaggaa

SEQ ID NO: 1345327 - RNA, 19 nt, Homo sapiens
ggagaagauugaugaaagu

SEQ ID NO: 1345328 - RNA, 19 nt, Homo sapiens
gaagguggcgucuuugaga

SEQ ID NO: 1345329 - RNA, 19 nt, Homo sapiens
guacaacagccucauauuc

SEQ ID NO: 1345330 - RNA, 19 nt, Homo sapiens
ggucagugcuggucaucuu

SEQ ID NO: 1345331 - RNA, 19 nt, Homo sapiens
ccaaggaaacuaacaaugu

SEQ ID NO: 1345332 - RNA, 19 nt, Homo sapiens
gaaccaaggaaacuaacaa

SEQ ID NO: 1345333 - RNA, 19 nt, Homo sapiens
cacagaagcuggugacauc

SEQ ID NO: 1345334 - RNA, 19 nt, Homo sapiens
ugaaagugcagguguguaa

SEQ ID NO: 1345335 - RNA, 19 nt, Homo sapiens
gauaacauuccaccugaaa

SEQ ID NO: 1345336 - RNA, 19 nt, Homo sapiens
gugcagguguguaaggaaa

SEQ ID NO: 1345337 - RNA, 19 nt, Homo sapiens
ggauaacauuccaccugaa

SEQ ID NO: 1345338 - RNA, 19 nt, Homo sapiens
cacagugaaucagguguua

SEQ ID NO: 1345339 - RNA, 19 nt, Homo sapiens
ggagaugcuggacuucuuu

SEQ ID NO: 1345340 - RNA, 19 nt, Homo sapiens
aaucagguguuaaggaaga

SEQ ID NO: 1345341 - RNA, 19 nt, Homo sapiens
gaaacuaacaauguagguu

SEQ ID NO: 1345342 - RNA, 19 nt, Homo sapiens
cagcaacacggauaacauu

SEQ ID NO: 1345343 - RNA, 19 nt, Homo sapiens
caacauggaguucugaagu

SEQ ID NO: 1345344 - RNA, 19 nt, Homo sapiens
uggagaagauugaugaaag

SEQ ID NO: 1345345 - RNA, 19 nt, Homo sapiens
ugaauugucugggcagguu

SEQ ID NO: 1345346 - RNA, 19 nt, Homo sapiens
cccaaugguuucuccaauu

SEQ ID NO: 1345347 - RNA, 19 nt, Homo sapiens
ggacgugugggcggaguua

SEQ ID NO: 1345348 - RNA, 19 nt, Homo sapiens
gcaaguccuucgacaucug

SEQ ID NO: 1345349 - RNA, 19 nt, Homo sapiens
aauuggagcuggagaagau

SEQ ID NO: 1345350 - RNA, 19 nt, Homo sapiens
guagguuacuagugaauac

SEQ ID NO: 1345351 - RNA, 19 nt, Homo sapiens
ggagucagaccuggaauuc

SEQ ID NO: 1345352 - RNA, 19 nt, Homo sapiens
gggcagcagugcacagaag

SEQ ID NO: 1345353 - RNA, 19 nt, Homo sapiens
gaacacccucuaugugcuu

SEQ ID NO: 1345354 - RNA, 19 nt, Homo sapiens
caacacggauaacauucca

SEQ ID NO: 1345355 - RNA, 19 nt, Homo sapiens
cggcugugauugcugaauu

SEQ ID NO: 1345356 - RNA, 19 nt, Homo sapiens
ggugacgacuccuccaaca

SEQ ID NO: 1345357 - RNA, 19 nt, Homo sapiens
gcucuucucgggcuuauca

SEQ ID NO: 1345358 - RNA, 19 nt, Homo sapiens
gcaucccucuggagacgaa

SEQ ID NO: 1345359 - RNA, 19 nt, Homo sapiens
gaaauuggagcuggagaag

SEQ ID NO: 1345360 - RNA, 19 nt, Homo sapiens
ugacggaacccaguguauu

SEQ ID NO: 1345361 - RNA, 19 nt, Homo sapiens
gcacagaagcuggugacau

SEQ ID NO: 1345362 - RNA, 19 nt, Homo sapiens
caacuccacgcuucgagaa

SEQ ID NO: 1345363 - RNA, 19 nt, Homo sapiens
gcccugaagcuucucugua

SEQ ID NO: 1345364 - RNA, 19 nt, Homo sapiens
cagcauaagcucggcauug

SEQ ID NO: 1345365 - RNA, 19 nt, Homo sapiens
gggcagguuuggagucucu

SEQ ID NO: 1345366 - RNA, 19 nt, Homo sapiens
ugugauugcugaauugucu

SEQ ID NO: 1345367 - RNA, 19 nt, Homo sapiens
gcagcaacacggauaacau

SEQ ID NO: 1345368 - RNA, 19 nt, Homo sapiens
aaugguuucuccaauuaug

SEQ ID NO: 1345369 - RNA, 19 nt, Homo sapiens
gugaauaccccaaugguuu

SEQ ID NO: 1345370 - RNA, 19 nt, Homo sapiens
ugacaucugcgccaucugu

SEQ ID NO: 1345371 - RNA, 19 nt, Homo sapiens
ggugacaucugcgccaucu

SEQ ID NO: 1345372 - RNA, 19 nt, Homo sapiens
ccauccagcugugguacaa

SEQ ID NO: 1345373 - RNA, 19 nt, Homo sapiens
uggagaugcuggacuucuu

SEQ ID NO: 1345374 - RNA, 19 nt, Homo sapiens
ggccagcaccuucgccuau

SEQ ID NO: 1345375 - RNA, 19 nt, Homo sapiens
guaccucucagaacuaugg

SEQ ID NO: 1345376 - RNA, 19 nt, Homo sapiens
ggcugugauugcugaauug

SEQ ID NO: 1345377 - RNA, 19 nt, Homo sapiens
gggagucagaccuggaauu

SEQ ID NO: 1345378 - RNA, 19 nt, Homo sapiens
aaaguucuaucuggucauc

SEQ ID NO: 1345379 - RNA, 19 nt, Homo sapiens
caagggaaaguucuaucug

SEQ ID NO: 1345380 - RNA, 19 nt, Homo sapiens
gaugaaagugcaggugugu

SEQ ID NO: 1345381 - RNA, 19 nt, Homo sapiens
cccugaagcuucucuguac

SEQ ID NO: 1345382 - RNA, 19 nt, Homo sapiens
cagcugugguacaaauaca

SEQ ID NO: 1345383 - RNA, 19 nt, Homo sapiens
ucuuugaccugcuauggau

SEQ ID NO: 1345384 - RNA, 19 nt, Homo sapiens
gugaaucagguguuaagga

SEQ ID NO: 1345385 - RNA, 19 nt, Homo sapiens
ccagugucgucaacaugga

SEQ ID NO: 1345386 - RNA, 19 nt, Homo sapiens
ugaaggggcacaagaaauu

SEQ ID NO: 1345387 - RNA, 19 nt, Homo sapiens
gaaugccuaccuccagugu

SEQ ID NO: 1345388 - RNA, 19 nt, Homo sapiens
cacagcagcaacacggaua

SEQ ID NO: 1345389 - RNA, 19 nt, Homo sapiens
uggccaaacugugcuuuca

SEQ ID NO: 1345390 - RNA, 19 nt, Homo sapiens
ccaccaccauuuccaccau

SEQ ID NO: 1345391 - RNA, 19 nt, Homo sapiens
ggaaccaaggaaacuaaca

SEQ ID NO: 1345392 - RNA, 19 nt, Homo sapiens
ggaacccaguguauuaccu

SEQ ID NO: 1345393 - RNA, 19 nt, Homo sapiens
gagaagauugaugaaagug

SEQ ID NO: 1345394 - RNA, 19 nt, Homo sapiens
ccaagggaaaguucuaucu

SEQ ID NO: 1345395 - RNA, 19 nt, Homo sapiens
ggaaacuaacaauguaggu

SEQ ID NO: 1345396 - RNA, 19 nt, Homo sapiens
gcuggaaccaaggaaacua

SEQ ID NO: 1345397 - RNA, 19 nt, Homo sapiens
agaaauuggagcuggagaa

SEQ ID NO: 1345398 - RNA, 19 nt, Homo sapiens
gggauccauuggucacauc

SEQ ID NO: 1345399 - RNA, 19 nt, Homo sapiens
gagaugcuggacuucuuug

SEQ ID NO: 1345400 - RNA, 19 nt, Homo sapiens
gccagcaccuucgccuaug

SEQ ID NO: 1345401 - RNA, 19 nt, Homo sapiens
gagcuggagaagauugaug

SEQ ID NO: 1345402 - RNA, 19 nt, Homo sapiens
uaacauuccaccugaaagc

SEQ ID NO: 1345403 - RNA, 19 nt, Homo sapiens
ggugacggaacccagugua

SEQ ID NO: 1345404 - RNA, 19 nt, Homo sapiens
ugugccagaugcuguugaa

SEQ ID NO: 1345405 - RNA, 19 nt, Homo sapiens
ggaguucugaaguccaugu

SEQ ID NO: 1345406 - RNA, 19 nt, Homo sapiens
ugaaguccauguggcucuu

SEQ ID NO: 1345407 - RNA, 19 nt, Homo sapiens
gaaagugcagguguguaag

SEQ ID NO: 1345408 - RNA, 19 nt, Homo sapiens
gaauugucugggcagguuu

SEQ ID NO: 1345409 - RNA, 19 nt, Homo sapiens
ggaaaugucugcuuuauga

SEQ ID NO: 1345410 - RNA, 19 nt, Homo sapiens
gaaagugaguugaaacaaa

SEQ ID NO: 1345411 - RNA, 19 nt, Homo sapiens
agacaaagcugaggacuaa

SEQ ID NO: 1345412 - RNA, 19 nt, Homo sapiens
gcacccaugucuuugaaua

SEQ ID NO: 1345413 - RNA, 19 nt, Homo sapiens
gacauuugcuugaggcuua

SEQ ID NO: 1345414 - RNA, 19 nt, Homo sapiens
gaaaugcaguauugcuuug

SEQ ID NO: 1345415 - RNA, 19 nt, Homo sapiens
gagccacccuuucuaguuu

SEQ ID NO: 1345416 - RNA, 19 nt, Homo sapiens
guauggagguucacuggua

SEQ ID NO: 1345417 - RNA, 19 nt, Homo sapiens
cgacagcgaugaggaaauu

SEQ ID NO: 1345418 - RNA, 19 nt, Homo sapiens
ggaugaaggugguggauuc

SEQ ID NO: 1345419 - RNA, 19 nt, Homo sapiens
ggacuaaggauaaagaaga

SEQ ID NO: 1345420 - RNA, 19 nt, Homo sapiens
gcacacauuuaaggcauaa

SEQ ID NO: 1345421 - RNA, 19 nt, Homo sapiens
ggaauacagucccaugcaa

SEQ ID NO: 1345422 - RNA, 19 nt, Homo sapiens
caauaggucuuaugcuguu

SEQ ID NO: 1345423 - RNA, 19 nt, Homo sapiens
ucacuuagccuuucugguu

SEQ ID NO: 1345424 - RNA, 19 nt, Homo sapiens
cauaagcacccaugucuuu

SEQ ID NO: 1345425 - RNA, 19 nt, Homo sapiens
gagaaugacuuucccuuuu

SEQ ID NO: 1345426 - RNA, 19 nt, Homo sapiens
cggaguggcugacaucauu

SEQ ID NO: 1345427 - RNA, 19 nt, Homo sapiens
caucugaucagcauuaauu

SEQ ID NO: 1345428 - RNA, 19 nt, Homo sapiens
gagguagaacuuaucuuua

SEQ ID NO: 1345429 - RNA, 19 nt, Homo sapiens
ggagaaugacuuucccuuu

SEQ ID NO: 1345430 - RNA, 19 nt, Homo sapiens
ggauacaggccacgauaaa

SEQ ID NO: 1345431 - RNA, 19 nt, Homo sapiens
aggcagagcuggcagauuc

SEQ ID NO: 1345432 - RNA, 19 nt, Homo sapiens
gaucuccguuccugucuga

SEQ ID NO: 1345433 - RNA, 19 nt, Homo sapiens
ugacugacccuccuacuug

SEQ ID NO: 1345434 - RNA, 19 nt, Homo sapiens
gaauacagucccaugcaaa

SEQ ID NO: 1345435 - RNA, 19 nt, Homo sapiens
ucauggaaaugucugcuuu

SEQ ID NO: 1345436 - RNA, 19 nt, Homo sapiens
ugagguagaacuuaucuuu

SEQ ID NO: 1345437 - RNA, 19 nt, Homo sapiens
ggauaaagaagagaagaaa

SEQ ID NO: 1345438 - RNA, 19 nt, Homo sapiens
caugcuggcugaagcguaa

SEQ ID NO: 1345439 - RNA, 19 nt, Homo sapiens
gaaguuaagugaggugaac

SEQ ID NO: 1345440 - RNA, 19 nt, Homo sapiens
gcacuuguauugccagacu

SEQ ID NO: 1345441 - RNA, 19 nt, Homo sapiens
caacugagguacucuuuug

SEQ ID NO: 1345442 - RNA, 19 nt, Homo sapiens
gaacaagcgccuccaggau

SEQ ID NO: 1345443 - RNA, 19 nt, Homo sapiens
cauggaguuucuuaucuuu

SEQ ID NO: 1345444 - RNA, 19 nt, Homo sapiens
gugcagugcuuuaacauac

SEQ ID NO: 1345445 - RNA, 19 nt, Homo sapiens
caaagauucucugguuuua

SEQ ID NO: 1345446 - RNA, 19 nt, Homo sapiens
gcagacaacugagguacuc

SEQ ID NO: 1345447 - RNA, 19 nt, Homo sapiens
gcacauucaucccuuuggu

SEQ ID NO: 1345448 - RNA, 19 nt, Homo sapiens
ccacagagacgucccaaca

SEQ ID NO: 1345449 - RNA, 19 nt, Homo sapiens
guacauucuugggcaauug

SEQ ID NO: 1345450 - RNA, 19 nt, Homo sapiens
uaaacauccuuucgugugu

SEQ ID NO: 1345451 - RNA, 19 nt, Homo sapiens
cccauugacucuucuagaa

SEQ ID NO: 1345452 - RNA, 19 nt, Homo sapiens
gcugaggacuaaggauaaa

SEQ ID NO: 1345453 - RNA, 19 nt, Homo sapiens
uuacacacauugccuaaag

SEQ ID NO: 1345454 - RNA, 19 nt, Homo sapiens
cacaagucaugcugaguuu

SEQ ID NO: 1345455 - RNA, 19 nt, Homo sapiens
augcaaagauucucugguu

SEQ ID NO: 1345456 - RNA, 19 nt, Homo sapiens
ccacaagucaugcugaguu

SEQ ID NO: 1345457 - RNA, 19 nt, Homo sapiens
cauaagggcuagcauaagc

SEQ ID NO: 1345458 - RNA, 19 nt, Homo sapiens
acaccauccucucccauaa

SEQ ID NO: 1345459 - RNA, 19 nt, Homo sapiens
caucauugacuguguggua

SEQ ID NO: 1345460 - RNA, 19 nt, Homo sapiens
gauaacagcaacagugaca

SEQ ID NO: 1345461 - RNA, 19 nt, Homo sapiens
ugaaggugguggauucuca

SEQ ID NO: 1345462 - RNA, 19 nt, Homo sapiens
ggaguugcuuguacauucu

SEQ ID NO: 1345463 - RNA, 19 nt, Homo sapiens
gucaguuucucuuugguuu

SEQ ID NO: 1345464 - RNA, 19 nt, Homo sapiens
caauugcaguuuacacaca

SEQ ID NO: 1345465 - RNA, 19 nt, Homo sapiens
cauugacucuucuagaaau

SEQ ID NO: 1345466 - RNA, 19 nt, Homo sapiens
gggauaacagcaacaguga

SEQ ID NO: 1345467 - RNA, 19 nt, Homo sapiens
aagcugagguagaacuuau

SEQ ID NO: 1345468 - RNA, 19 nt, Homo sapiens
gaggucaguuucucuuugg

SEQ ID NO: 1345469 - RNA, 19 nt, Homo sapiens
gcaaagauucucugguuuu

SEQ ID NO: 1345470 - RNA, 19 nt, Homo sapiens
uauggagguucacugguaa

SEQ ID NO: 1345471 - RNA, 19 nt, Homo sapiens
ucauggaguuucuuaucuu

SEQ ID NO: 1345472 - RNA, 19 nt, Homo sapiens
gacugacccuccuacuuga

SEQ ID NO: 1345473 - RNA, 19 nt, Homo sapiens
ggagugacauuugcuugag

SEQ ID NO: 1345474 - RNA, 19 nt, Homo sapiens
ucacagaggucaguuucuc

SEQ ID NO: 1345475 - RNA, 19 nt, Homo sapiens
agcauaagcugagguagaa

SEQ ID NO: 1345476 - RNA, 19 nt, Homo sapiens
gcaggauccuuuugcuuuu

SEQ ID NO: 1345477 - RNA, 19 nt, Homo sapiens
aaaagcagccuucgccuua

SEQ ID NO: 1345478 - RNA, 19 nt, Homo sapiens
agaaaugcaguauugcuuu

SEQ ID NO: 1345479 - RNA, 19 nt, Homo sapiens
gaaaugucugcuuuaugaa

SEQ ID NO: 1345480 - RNA, 19 nt, Homo sapiens
cacuuagccuuucugguuu

SEQ ID NO: 1345481 - RNA, 19 nt, Homo sapiens
gcagugcuuuaacauacau

SEQ ID NO: 1345482 - RNA, 19 nt, Homo sapiens
cguagugucuguggacuug

SEQ ID NO: 1345483 - RNA, 19 nt, Homo sapiens
ggaaaugaccaagcucaca

SEQ ID NO: 1345484 - RNA, 19 nt, Homo sapiens
gcacauauugaaagugagu

SEQ ID NO: 1345485 - RNA, 19 nt, Homo sapiens
augcacauauugaaaguga

SEQ ID NO: 1345486 - RNA, 19 nt, Homo sapiens
ccacauggccacccaccuu

SEQ ID NO: 1345487 - RNA, 19 nt, Homo sapiens
ccaugucuuugaauaugaa

SEQ ID NO: 1345488 - RNA, 19 nt, Homo sapiens
gagguacucuuuugaagga

SEQ ID NO: 1345489 - RNA, 19 nt, Homo sapiens
aagcugaggacuaaggaua

SEQ ID NO: 1345490 - RNA, 19 nt, Homo sapiens
cagcugaccugggcaugga

SEQ ID NO: 1345491 - RNA, 19 nt, Homo sapiens
gcuuuaacauacauucauc

SEQ ID NO: 1345492 - RNA, 19 nt, Homo sapiens
uaaaauaccacguuucaug

SEQ ID NO: 1345493 - RNA, 19 nt, Homo sapiens
gggagugacauuugcuuga

SEQ ID NO: 1345494 - RNA, 19 nt, Homo sapiens
cuugggcaauugcagauaa

SEQ ID NO: 1345495 - RNA, 19 nt, Homo sapiens
aggaguugcuuguacauuc

SEQ ID NO: 1345496 - RNA, 19 nt, Homo sapiens
ggugcagugcuuuaacaua

SEQ ID NO: 1345497 - RNA, 19 nt, Homo sapiens
uugccagacuaccuaauuu

SEQ ID NO: 1345498 - RNA, 19 nt, Homo sapiens
gugcuuguguggcaugugu

SEQ ID NO: 1345499 - RNA, 19 nt, Homo sapiens
caaugugugcuaagaucua

SEQ ID NO: 1345500 - RNA, 19 nt, Homo sapiens
gacuaaggauaaagaagag

SEQ ID NO: 1345501 - RNA, 19 nt, Homo sapiens
gcuagcauaagcugaggua

SEQ ID NO: 1345502 - RNA, 19 nt, Homo sapiens
acagagcuaucaccuacug

SEQ ID NO: 1345503 - RNA, 19 nt, Homo sapiens
gagacagagcuaucaccua

SEQ ID NO: 1345504 - RNA, 19 nt, Homo sapiens
gcccaggaguucgagacua

SEQ ID NO: 1345505 - RNA, 19 nt, Homo sapiens
gacaacugagguacucuuu

SEQ ID NO: 1345506 - RNA, 19 nt, Homo sapiens
cauggaaaugucugcuuua

SEQ ID NO: 1345507 - RNA, 19 nt, Homo sapiens
uagcauaagcugagguaga

SEQ ID NO: 1345508 - RNA, 19 nt, Homo sapiens
gcaacagggccaagaggau

SEQ ID NO: 1345509 - RNA, 19 nt, Homo sapiens
gaagagagcuuaaauauug

SEQ ID NO: 1345510 - RNA, 19 nt, Homo sapiens
gaaaucaggugccauuguu

SEQ ID NO: 1345511 - RNA, 19 nt, Homo sapiens
uaaaguaccugucaccauu

SEQ ID NO: 1345512 - RNA, 19 nt, Homo sapiens
gaaaugagaauguuuagga

SEQ ID NO: 1345513 - RNA, 19 nt, Homo sapiens
ggacgaagaggacauuuaa

SEQ ID NO: 1345514 - RNA, 19 nt, Homo sapiens
gaaucuaccuucagggaaa

SEQ ID NO: 1345515 - RNA, 19 nt, Homo sapiens
ccagaaagaaugagauaua

SEQ ID NO: 1345516 - RNA, 19 nt, Homo sapiens
gaagauaugaugaaagaga

SEQ ID NO: 1345517 - RNA, 19 nt, Homo sapiens
cgucaaagauauacagaaa

SEQ ID NO: 1345518 - RNA, 19 nt, Homo sapiens
gaaguuauuugggaaucua

SEQ ID NO: 1345519 - RNA, 19 nt, Homo sapiens
gaagaagagccugcuguua

SEQ ID NO: 1345520 - RNA, 19 nt, Homo sapiens
ggaaguugcugcaccugaa

SEQ ID NO: 1345521 - RNA, 19 nt, Homo sapiens
gaggaaaugagaauguuua

SEQ ID NO: 1345522 - RNA, 19 nt, Homo sapiens
gaacgugacagucuuaugu

SEQ ID NO: 1345523 - RNA, 19 nt, Homo sapiens
gggcugagauggaggaguu

SEQ ID NO: 1345524 - RNA, 19 nt, Homo sapiens
ggaagagagcuuaaauauu

SEQ ID NO: 1345525 - RNA, 19 nt, Homo sapiens
ggacaggcgugcaggacaa

SEQ ID NO: 1345526 - RNA, 19 nt, Homo sapiens
gaacucagucgauaucaga

SEQ ID NO: 1345527 - RNA, 19 nt, Homo sapiens
gaacuaaacacaaugaaac

SEQ ID NO: 1345528 - RNA, 19 nt, Homo sapiens
guagagcacgucaaagaua

SEQ ID NO: 1345529 - RNA, 19 nt, Homo sapiens
gggaacagcuggagauuuu

SEQ ID NO: 1345530 - RNA, 19 nt, Homo sapiens
gaaacaagcaaugaaagaa

SEQ ID NO: 1345531 - RNA, 19 nt, Homo sapiens
gugacagucuuauguguuu

SEQ ID NO: 1345532 - RNA, 19 nt, Homo sapiens
gaaagaaagggcugagaug

SEQ ID NO: 1345533 - RNA, 19 nt, Homo sapiens
gaaggaagaagagaaagaa

SEQ ID NO: 1345534 - RNA, 19 nt, Homo sapiens
guagugcuguuaccaguga

SEQ ID NO: 1345535 - RNA, 19 nt, Homo sapiens
caccaagaguuaaauaaga

SEQ ID NO: 1345536 - RNA, 19 nt, Homo sapiens
gaaauaaauggucucauag

SEQ ID NO: 1345537 - RNA, 19 nt, Homo sapiens
uaagcugacuaaacaacua

SEQ ID NO: 1345538 - RNA, 19 nt, Homo sapiens
gcaccugaauuacuuuauc

SEQ ID NO: 1345539 - RNA, 19 nt, Homo sapiens
gaacagugaagacgaugaa

SEQ ID NO: 1345540 - RNA, 19 nt, Homo sapiens
ccuaugaccugaagucuca

SEQ ID NO: 1345541 - RNA, 19 nt, Homo sapiens
uuucuaagcugacuaaaca

SEQ ID NO: 1345542 - RNA, 19 nt, Homo sapiens
gcagggcagggaagaaaua

SEQ ID NO: 1345543 - RNA, 19 nt, Homo sapiens
gaagagaaagcucaaagag

SEQ ID NO: 1345544 - RNA, 19 nt, Homo sapiens
gagaaaaguuugaggcauu

SEQ ID NO: 1345545 - RNA, 19 nt, Homo sapiens
agaagagccugcuguuaga

SEQ ID NO: 1345546 - RNA, 19 nt, Homo sapiens
agaauugcaccaagaguua

SEQ ID NO: 1345547 - RNA, 19 nt, Homo sapiens
cucaagaacugguggauga

SEQ ID NO: 1345548 - RNA, 19 nt, Homo sapiens
gcugaggccucgaccaaau

SEQ ID NO: 1345549 - RNA, 19 nt, Homo sapiens
gaagaggacauuuaaacuc

SEQ ID NO: 1345550 - RNA, 19 nt, Homo sapiens
cccaagaaguggugaaaga

SEQ ID NO: 1345551 - RNA, 19 nt, Homo sapiens
cauuguugcuggcuuauga

SEQ ID NO: 1345552 - RNA, 19 nt, Homo sapiens
aggauggagugcuuaauaa

SEQ ID NO: 1345553 - RNA, 19 nt, Homo sapiens
ugagaaggauggagugcuu

SEQ ID NO: 1345554 - RNA, 19 nt, Homo sapiens
aagaggacauuuaaacuca

SEQ ID NO: 1345555 - RNA, 19 nt, Homo sapiens
cgaaaugucugcucaucag

SEQ ID NO: 1345556 - RNA, 19 nt, Homo sapiens
ggacagaggaggccacagu

SEQ ID NO: 1345557 - RNA, 19 nt, Homo sapiens
aauggaaggugaacuugaa

SEQ ID NO: 1345558 - RNA, 19 nt, Homo sapiens
caagaaguggugaaagaaa

SEQ ID NO: 1345559 - RNA, 19 nt, Homo sapiens
caccauuguugcuggcuua

SEQ ID NO: 1345560 - RNA, 19 nt, Homo sapiens
auacagaaauaaccagaga

SEQ ID NO: 1345561 - RNA, 19 nt, Homo sapiens
caaaugccaagaacucaaa

SEQ ID NO: 1345562 - RNA, 19 nt, Homo sapiens
aaaaggagcuggcggagaa

SEQ ID NO: 1345563 - RNA, 19 nt, Homo sapiens
ggauauaaaguaccuguca

SEQ ID NO: 1345564 - RNA, 19 nt, Homo sapiens
ccacagcggacacaacaaa

SEQ ID NO: 1345565 - RNA, 19 nt, Homo sapiens
gaaauggaaggugaacuug

SEQ ID NO: 1345566 - RNA, 19 nt, Homo sapiens
ggauggagugcuuaauaaa

SEQ ID NO: 1345567 - RNA, 19 nt, Homo sapiens
ggcgucagcuucagacuca

SEQ ID NO: 1345568 - RNA, 19 nt, Homo sapiens
gcaccaagaguuaaauaag

SEQ ID NO: 1345569 - RNA, 19 nt, Homo sapiens
gaugcgagcccaagaagug

SEQ ID NO: 1345570 - RNA, 19 nt, Homo sapiens
gggacgaagaggacauuua

SEQ ID NO: 1345571 - RNA, 19 nt, Homo sapiens
gaucuucuuugccauccuu

SEQ ID NO: 1345572 - RNA, 19 nt, Homo sapiens
uagagcacgucaaagauau

SEQ ID NO: 1345573 - RNA, 19 nt, Homo sapiens
aaaccuccauuaugugaga

SEQ ID NO: 1345574 - RNA, 19 nt, Homo sapiens
gggcagggaagaaauaaau

SEQ ID NO: 1345575 - RNA, 19 nt, Homo sapiens
gaacagagaaauggaaggu

SEQ ID NO: 1345576 - RNA, 19 nt, Homo sapiens
gcagaacagagaaauggaa

SEQ ID NO: 1345577 - RNA, 19 nt, Homo sapiens
gaacuugaacgagcacaga

SEQ ID NO: 1345578 - RNA, 19 nt, Homo sapiens
gaaaaugacuguccaucgu

SEQ ID NO: 1345579 - RNA, 19 nt, Homo sapiens
ggaccuaaacaauaugaau

SEQ ID NO: 1345580 - RNA, 19 nt, Homo sapiens
ggaagaagagaaagaaagg

SEQ ID NO: 1345581 - RNA, 19 nt, Homo sapiens
ggaggaaaugagaauguuu

SEQ ID NO: 1345582 - RNA, 19 nt, Homo sapiens
caaggaagagagcuuaaau

SEQ ID NO: 1345583 - RNA, 19 nt, Homo sapiens
aaaugacuguccaucguuu

SEQ ID NO: 1345584 - RNA, 19 nt, Homo sapiens
ggaugaaaaugauggauug

SEQ ID NO: 1345585 - RNA, 19 nt, Homo sapiens
gaagaaauaaauggucuca

SEQ ID NO: 1345586 - RNA, 19 nt, Homo sapiens
aaggauggagugcuuaaua

SEQ ID NO: 1345587 - RNA, 19 nt, Homo sapiens
gcaguggaaguucauaaau

SEQ ID NO: 1345588 - RNA, 19 nt, Homo sapiens
aaacuuaagggaauggaaa

SEQ ID NO: 1345589 - RNA, 19 nt, Homo sapiens
ugaaacaagcaaugaaaga

SEQ ID NO: 1345590 - RNA, 19 nt, Homo sapiens
gaaugagauauaacuggua

SEQ ID NO: 1345591 - RNA, 19 nt, Homo sapiens
caguggaaguucauaaauc

SEQ ID NO: 1345592 - RNA, 19 nt, Homo sapiens
ggugaacagugaagacgau

SEQ ID NO: 1345593 - RNA, 19 nt, Homo sapiens
guugcuggcuuaugaagau

SEQ ID NO: 1345594 - RNA, 19 nt, Homo sapiens
aggaagagagcuuaaauau

SEQ ID NO: 1345595 - RNA, 19 nt, Homo sapiens
gagaagagaaagcucaaag

SEQ ID NO: 1345596 - RNA, 19 nt, Homo sapiens
aagaagagccugcuguuag

SEQ ID NO: 1345597 - RNA, 19 nt, Homo sapiens
uggaggaguugauggagaa

SEQ ID NO: 1345598 - RNA, 19 nt, Homo sapiens
aauaagaguagugcuguua

SEQ ID NO: 1345599 - RNA, 19 nt, Homo sapiens
gaauugcaccaagaguuaa

SEQ ID NO: 1345600 - RNA, 19 nt, Homo sapiens
ccaggaacgugacagucuu

SEQ ID NO: 1345601 - RNA, 19 nt, Homo sapiens
aguggaaguucauaaauca

SEQ ID NO: 1345602 - RNA, 19 nt, Homo sapiens
ccacccugguuguuggaua

SEQ ID NO: 1345603 - RNA, 19 nt, Homo sapiens
acagaaauaaccagagaaa

SEQ ID NO: 1345604 - RNA, 19 nt, Homo sapiens
cauuuaaacucagcuguca

SEQ ID NO: 1345605 - RNA, 19 nt, Homo sapiens
gagaaggacgagcucaaug

SEQ ID NO: 1345606 - RNA, 19 nt, Homo sapiens
guaccugucaccauuguug

SEQ ID NO: 1345607 - RNA, 19 nt, Homo sapiens
guccaucguuugaauguag

SEQ ID NO: 1345608 - RNA, 19 nt, Homo sapiens
aaaacaagcucaagaacug

SEQ ID NO: 1345609 - RNA, 19 nt, Homo sapiens
ggacaaaccugaugccuua

SEQ ID NO: 1345610 - RNA, 19 nt, Homo sapiens
ggaguaacauucaacauuu

SEQ ID NO: 1345611 - RNA, 19 nt, Homo sapiens
gagaaaccaucacaagauu

SEQ ID NO: 1345612 - RNA, 19 nt, Homo sapiens
uccaggaggugaucaauua

SEQ ID NO: 1345613 - RNA, 19 nt, Homo sapiens
gaaaugaggacguuauuag

SEQ ID NO: 1345614 - RNA, 19 nt, Homo sapiens
cgagaaggguggaucauga

SEQ ID NO: 1345615 - RNA, 19 nt, Homo sapiens
gcagagcccucacgaaugg

SEQ ID NO: 1345616 - RNA, 19 nt, Homo sapiens
gaaaccucaucucuacuaa

SEQ ID NO: 1345617 - RNA, 19 nt, Homo sapiens
ggugaaaccucaucucuac

SEQ ID NO: 1345618 - RNA, 19 nt, Homo sapiens
ggagaaaccaucacaagau

SEQ ID NO: 1345619 - RNA, 19 nt, Homo sapiens
gcagugaucuguuguucca

SEQ ID NO: 1345620 - RNA, 19 nt, Homo sapiens
uaacuugcuugcucagaaa

SEQ ID NO: 1345621 - RNA, 19 nt, Homo sapiens
gcuuaaauccugaauguga

SEQ ID NO: 1345622 - RNA, 19 nt, Homo sapiens
ccugauagguggauuagga

SEQ ID NO: 1345623 - RNA, 19 nt, Homo sapiens
gggaguaacauucaacauu

SEQ ID NO: 1345624 - RNA, 19 nt, Homo sapiens
gcaccucuguguuucucua

SEQ ID NO: 1345625 - RNA, 19 nt, Homo sapiens
cagcaucucugccuuucaa

SEQ ID NO: 1345626 - RNA, 19 nt, Homo sapiens
guuaggaccuuugcauuug

SEQ ID NO: 1345627 - RNA, 19 nt, Homo sapiens
gggcgaggguuguuccaaa

SEQ ID NO: 1345628 - RNA, 19 nt, Homo sapiens
aaugagauauccauagcua

SEQ ID NO: 1345629 - RNA, 19 nt, Homo sapiens
ggaagguuauuaggucuug

SEQ ID NO: 1345630 - RNA, 19 nt, Homo sapiens
aagcuuaaauccugaaugu

SEQ ID NO: 1345631 - RNA, 19 nt, Homo sapiens
cagcuucccucaugucaga

SEQ ID NO: 1345632 - RNA, 19 nt, Homo sapiens
ggaauugggaccuuuggaa

SEQ ID NO: 1345633 - RNA, 19 nt, Homo sapiens
caugaucacugacuaacug

SEQ ID NO: 1345634 - RNA, 19 nt, Homo sapiens
gcagaaaugaggacguuau

SEQ ID NO: 1345635 - RNA, 19 nt, Homo sapiens
gagcagugaucuguuguuc

SEQ ID NO: 1345636 - RNA, 19 nt, Homo sapiens
ucugggcaaucauuuauuu

SEQ ID NO: 1345637 - RNA, 19 nt, Homo sapiens
auaccaagcuuauaguuag

SEQ ID NO: 1345638 - RNA, 19 nt, Homo sapiens
uaaacgacaugccuuggau

SEQ ID NO: 1345639 - RNA, 19 nt, Homo sapiens
gcaccgucuuccuccauuu

SEQ ID NO: 1345640 - RNA, 19 nt, Homo sapiens
uaacugggaccuugaacaa

SEQ ID NO: 1345641 - RNA, 19 nt, Homo sapiens
cauaccaagcuuauaguua

SEQ ID NO: 1345642 - RNA, 19 nt, Homo sapiens
gggccuuccuauuauguaa

SEQ ID NO: 1345643 - RNA, 19 nt, Homo sapiens
gggccugucugcugugcua

SEQ ID NO: 1345644 - RNA, 19 nt, Homo sapiens
gggaaacauucaggcagua

SEQ ID NO: 1345645 - RNA, 19 nt, Homo sapiens
gaaugcagggcuacacuga

SEQ ID NO: 1345646 - RNA, 19 nt, Homo sapiens
ucucgacacugcagaaaug

SEQ ID NO: 1345647 - RNA, 19 nt, Homo sapiens
cuaacuugcuugcucagaa

SEQ ID NO: 1345648 - RNA, 19 nt, Homo sapiens
ccaagugaaugaugcaucu

SEQ ID NO: 1345649 - RNA, 19 nt, Homo sapiens
ugaaaccucaucucuacua

SEQ ID NO: 1345650 - RNA, 19 nt, Homo sapiens
gaccuuugcauuugauaaa

SEQ ID NO: 1345651 - RNA, 19 nt, Homo sapiens
ugccugugcugcuacuuua

SEQ ID NO: 1345652 - RNA, 19 nt, Homo sapiens
gaaacauucaggcaguaaa

SEQ ID NO: 1345653 - RNA, 19 nt, Homo sapiens
guaauugaaugagaugaag

SEQ ID NO: 1345654 - RNA, 19 nt, Homo sapiens
gaaaagcugaguuaagaaa

SEQ ID NO: 1345655 - RNA, 19 nt, Homo sapiens
cacugaaccuccagaauca

SEQ ID NO: 1345656 - RNA, 19 nt, Homo sapiens
ccaaugagauauccauagc

SEQ ID NO: 1345657 - RNA, 19 nt, Homo sapiens
uaucugggcucgucucucu

SEQ ID NO: 1345658 - RNA, 19 nt, Homo sapiens
ggaaacauucaggcaguaa

SEQ ID NO: 1345659 - RNA, 19 nt, Homo sapiens
gcagagaaagaaagacugu

SEQ ID NO: 1345660 - RNA, 19 nt, Homo sapiens
gcaggagaaucgcuugaac

SEQ ID NO: 1345661 - RNA, 19 nt, Homo sapiens
ugugaugguucuuggaauu

SEQ ID NO: 1345662 - RNA, 19 nt, Homo sapiens
ggagugggcaccucugugu

SEQ ID NO: 1345663 - RNA, 19 nt, Homo sapiens
gaggagaaaccaucacaag

SEQ ID NO: 1345664 - RNA, 19 nt, Homo sapiens
cuuuacaacuucaggcuaa

SEQ ID NO: 1345665 - RNA, 19 nt, Homo sapiens
gcuuauaguuaggaccuuu

SEQ ID NO: 1345666 - RNA, 19 nt, Homo sapiens
cgacaugccuuggauugag

SEQ ID NO: 1345667 - RNA, 19 nt, Homo sapiens
gagaugaagaaauauguca

SEQ ID NO: 1345668 - RNA, 19 nt, Homo sapiens
ucaauuacaugugcacagu

SEQ ID NO: 1345669 - RNA, 19 nt, Homo sapiens
acgaagaguuggccaagug

SEQ ID NO: 1345670 - RNA, 19 nt, Homo sapiens
ggaccuuugcauuugauaa

SEQ ID NO: 1345671 - RNA, 19 nt, Homo sapiens
gaggugaucaauuacaugu

SEQ ID NO: 1345672 - RNA, 19 nt, Homo sapiens
agaaaugaggacguuauua

SEQ ID NO: 1345673 - RNA, 19 nt, Homo sapiens
ucagcugccuguacucaug

SEQ ID NO: 1345674 - RNA, 19 nt, Homo sapiens
ugucugcugugcuauuuau

SEQ ID NO: 1345675 - RNA, 19 nt, Homo sapiens
gcgugucggugcuuaggaa

SEQ ID NO: 1345676 - RNA, 19 nt, Homo sapiens
acacugaaccuccagaauc

SEQ ID NO: 1345677 - RNA, 19 nt, Homo sapiens
ugaggacguuauuaggaaa

SEQ ID NO: 1345678 - RNA, 19 nt, Homo sapiens
gcuuagcacugggaggaaa

SEQ ID NO: 1345679 - RNA, 19 nt, Homo sapiens
cugcugugcuauuuauuug

SEQ ID NO: 1345680 - RNA, 19 nt, Homo sapiens
gaaccaggcagucggaacu

SEQ ID NO: 1345681 - RNA, 19 nt, Homo sapiens
ugccuuggauugaguguau

SEQ ID NO: 1345682 - RNA, 19 nt, Homo sapiens
caucugggcaaucauuuau

SEQ ID NO: 1345683 - RNA, 19 nt, Homo sapiens
cuuaggaaaucuaggacuu

SEQ ID NO: 1345684 - RNA, 19 nt, Homo sapiens
ugccaagucauacaacaua

SEQ ID NO: 1345685 - RNA, 19 nt, Homo sapiens
cagaaaugaggacguuauu

SEQ ID NO: 1345686 - RNA, 19 nt, Homo sapiens
ccaucugggcaaucauuua

SEQ ID NO: 1345687 - RNA, 19 nt, Homo sapiens
uuaggaccuuugcauuuga

SEQ ID NO: 1345688 - RNA, 19 nt, Homo sapiens
gaagaguuggccaagugaa

SEQ ID NO: 1345689 - RNA, 19 nt, Homo sapiens
aaagggagcggcagcuaga

SEQ ID NO: 1345690 - RNA, 19 nt, Homo sapiens
uuauuugccuuccgucuuc

SEQ ID NO: 1345691 - RNA, 19 nt, Homo sapiens
caccuguaaucccaacauu

SEQ ID NO: 1345692 - RNA, 19 nt, Homo sapiens
gaagguuauuaggucuuga

SEQ ID NO: 1345693 - RNA, 19 nt, Homo sapiens
guauaugucuuccccaaau

SEQ ID NO: 1345694 - RNA, 19 nt, Homo sapiens
ggauucauuccuuuaacuu

SEQ ID NO: 1345695 - RNA, 19 nt, Homo sapiens
uaguuaaugugucaugauc

SEQ ID NO: 1345696 - RNA, 19 nt, Homo sapiens
ccugucugcugugcuauuu

SEQ ID NO: 1345697 - RNA, 19 nt, Homo sapiens
caaaacagcagagaaagaa

SEQ ID NO: 1345698 - RNA, 19 nt, Homo sapiens
gaucaugaggucaggagau

SEQ ID NO: 1345699 - RNA, 19 nt, Homo sapiens
gacaugccuuggauugagu

SEQ ID NO: 1345700 - RNA, 19 nt, Homo sapiens
cauacaacauacugaaugc

SEQ ID NO: 1345701 - RNA, 19 nt, Homo sapiens
aaucccagcuggacagaca

SEQ ID NO: 1345702 - RNA, 19 nt, Homo sapiens
ugacagaugcuuucagacu

SEQ ID NO: 1345703 - RNA, 19 nt, Homo sapiens
aggaaaagcugaguuaaga

SEQ ID NO: 1345704 - RNA, 19 nt, Homo sapiens
ggaaaagguuaagaugaga

SEQ ID NO: 1345705 - RNA, 19 nt, Homo sapiens
gcagucggaacuuguagug

SEQ ID NO: 1345706 - RNA, 19 nt, Homo sapiens
ucauacaacauacugaaug

SEQ ID NO: 1345707 - RNA, 19 nt, Homo sapiens
auccauagcuaacuugcuu

SEQ ID NO: 1345708 - RNA, 19 nt, Homo sapiens
agauauccauagcuaacuu

SEQ ID NO: 1345709 - RNA, 19 nt, Homo sapiens
gaaccgcaguuucaucuuu

SEQ ID NO: 1345710 - RNA, 19 nt, Homo sapiens
gaagaaauguccacucagu

SEQ ID NO: 1345711 - RNA, 19 nt, Homo sapiens
gggcagaagugguuaugua

SEQ ID NO: 1345712 - RNA, 19 nt, Homo sapiens
caacuaaaccucaaaugaa

SEQ ID NO: 1345713 - RNA, 19 nt, Homo sapiens
acagaacccuucaugauuu

SEQ ID NO: 1345714 - RNA, 19 nt, Homo sapiens
caacagcccugaccaucaa

SEQ ID NO: 1345715 - RNA, 19 nt, Homo sapiens
ugaaacaccuccaggaaug

SEQ ID NO: 1345716 - RNA, 19 nt, Homo sapiens
ggaccaagcuacuccagau

SEQ ID NO: 1345717 - RNA, 19 nt, Homo sapiens
ggagcucuauaaccaauuu

SEQ ID NO: 1345718 - RNA, 19 nt, Homo sapiens
uaucaaggcugcagcuuug

SEQ ID NO: 1345719 - RNA, 19 nt, Homo sapiens
caagagagagugcaauuug

SEQ ID NO: 1345720 - RNA, 19 nt, Homo sapiens
guccauagcuucauguuca

SEQ ID NO: 1345721 - RNA, 19 nt, Homo sapiens
ggagagaucaggaauguuc

SEQ ID NO: 1345722 - RNA, 19 nt, Homo sapiens
gauaagcucugugcugugu

SEQ ID NO: 1345723 - RNA, 19 nt, Homo sapiens
aaaggaaucuucaguacug

SEQ ID NO: 1345724 - RNA, 19 nt, Homo sapiens
ccaauuugcugccaacuca

SEQ ID NO: 1345725 - RNA, 19 nt, Homo sapiens
gagcaacucccuccgguuu

SEQ ID NO: 1345726 - RNA, 19 nt, Homo sapiens
guccauggcccgucauuua

SEQ ID NO: 1345727 - RNA, 19 nt, Homo sapiens
cuucauaucuggaacucua

SEQ ID NO: 1345728 - RNA, 19 nt, Homo sapiens
gcaacucccuccgguuuga

SEQ ID NO: 1345729 - RNA, 19 nt, Homo sapiens
ggaaagggcaguacugaag

SEQ ID NO: 1345730 - RNA, 19 nt, Homo sapiens
gcugguggccucaggaaua

SEQ ID NO: 1345731 - RNA, 19 nt, Homo sapiens
ccaacuaaaccucaaauga

SEQ ID NO: 1345732 - RNA, 19 nt, Homo sapiens
aaacagaacccuucaugau

SEQ ID NO: 1345733 - RNA, 19 nt, Homo sapiens
gaaucacaauccuagucua

SEQ ID NO: 1345734 - RNA, 19 nt, Homo sapiens
cagaagugguuauguaucu

SEQ ID NO: 1345735 - RNA, 19 nt, Homo sapiens
gggcaguacugaagcaaca

SEQ ID NO: 1345736 - RNA, 19 nt, Homo sapiens
guagcuagguuccaugucu

SEQ ID NO: 1345737 - RNA, 19 nt, Homo sapiens
gaagaaggaaagggcagua

SEQ ID NO: 1345738 - RNA, 19 nt, Homo sapiens
cugaagaaauguccacuca

SEQ ID NO: 1345739 - RNA, 19 nt, Homo sapiens
acaaaggaaucuucaguac

SEQ ID NO: 1345740 - RNA, 19 nt, Homo sapiens
caggauaccucagggauag

SEQ ID NO: 1345741 - RNA, 19 nt, Homo sapiens
ucacaauccuagucuaucu

SEQ ID NO: 1345742 - RNA, 19 nt, Homo sapiens
aagagagagugcaauuuga

SEQ ID NO: 1345743 - RNA, 19 nt, Homo sapiens
ccacuggauuugaguaaag

SEQ ID NO: 1345744 - RNA, 19 nt, Homo sapiens
uaucuucucugcugucaca

SEQ ID NO: 1345745 - RNA, 19 nt, Homo sapiens
caacccaacuaaaccucaa

SEQ ID NO: 1345746 - RNA, 19 nt, Homo sapiens
guacaaaggaaucuucagu

SEQ ID NO: 1345747 - RNA, 19 nt, Homo sapiens
cgucguagcuuuggcugaa

SEQ ID NO: 1345748 - RNA, 19 nt, Homo sapiens
guacugaagcaacaagguu

SEQ ID NO: 1345749 - RNA, 19 nt, Homo sapiens
gaaggaaagggcaguacug

SEQ ID NO: 1345750 - RNA, 19 nt, Homo sapiens
gacccugucucuauuuaag

SEQ ID NO: 1345751 - RNA, 19 nt, Homo sapiens
ugcaacggcuccagcagua

SEQ ID NO: 1345752 - RNA, 19 nt, Homo sapiens
cagaacccuucaugauuug

SEQ ID NO: 1345753 - RNA, 19 nt, Homo sapiens
gcaggagcagcuaaagaaa

SEQ ID NO: 1345754 - RNA, 19 nt, Homo sapiens
gcugaaacaccuccaggaa

SEQ ID NO: 1345755 - RNA, 19 nt, Homo sapiens
ucccacacauggucaguuu

SEQ ID NO: 1345756 - RNA, 19 nt, Homo sapiens
ggagcucccucuaucuucu

SEQ ID NO: 1345757 - RNA, 19 nt, Homo sapiens
ccaaguccaacccaacuaa

SEQ ID NO: 1345758 - RNA, 19 nt, Homo sapiens
gagaacaugagaccacuuc

SEQ ID NO: 1345759 - RNA, 19 nt, Homo sapiens
gaaacaccuccaggaauga

SEQ ID NO: 1345760 - RNA, 19 nt, Homo sapiens
cauaugaagcgacguccua

SEQ ID NO: 1345761 - RNA, 19 nt, Homo sapiens
ggagacagugauuggguuu

SEQ ID NO: 1345762 - RNA, 19 nt, Homo sapiens
acaagguucugcuccauca

SEQ ID NO: 1345763 - RNA, 19 nt, Homo sapiens
caacaagguucugcuccau

SEQ ID NO: 1345764 - RNA, 19 nt, Homo sapiens
caucugaccaacucuuaaa

SEQ ID NO: 1345765 - RNA, 19 nt, Homo sapiens
aaucccagcuccagcaguu

SEQ ID NO: 1345766 - RNA, 19 nt, Homo sapiens
caaggcugcagcuuuguaa

SEQ ID NO: 1345767 - RNA, 19 nt, Homo sapiens
gggagaacuaaaugugaua

SEQ ID NO: 1345768 - RNA, 19 nt, Homo sapiens
ugagaccacuucauaucug

SEQ ID NO: 1345769 - RNA, 19 nt, Homo sapiens
gccaagagagagugcaauu

SEQ ID NO: 1345770 - RNA, 19 nt, Homo sapiens
gagaaccgcaguuucaucu

SEQ ID NO: 1345771 - RNA, 19 nt, Homo sapiens
guggagaaccgcaguuuca

SEQ ID NO: 1345772 - RNA, 19 nt, Homo sapiens
gagaaucacaauccuaguc

SEQ ID NO: 1345773 - RNA, 19 nt, Homo sapiens
ccagaguagucacacugaa

SEQ ID NO: 1345774 - RNA, 19 nt, Homo sapiens
uacaaaggaaucuucagua

SEQ ID NO: 1345775 - RNA, 19 nt, Homo sapiens
ugggugaccucgaguaagu

SEQ ID NO: 1345776 - RNA, 19 nt, Homo sapiens
ggcugcagcuuuguaaaug

SEQ ID NO: 1345777 - RNA, 19 nt, Homo sapiens
aacagaacccuucaugauu

SEQ ID NO: 1345778 - RNA, 19 nt, Homo sapiens
gagagugcaauuugagaug

SEQ ID NO: 1345779 - RNA, 19 nt, Homo sapiens
gagagagugcaauuugaga

SEQ ID NO: 1345780 - RNA, 19 nt, Homo sapiens
ccaagagagagugcaauuu

SEQ ID NO: 1345781 - RNA, 19 nt, Homo sapiens
agaagaaucaggaaaccaa

SEQ ID NO: 1345782 - RNA, 19 nt, Homo sapiens
cucaguggcucccaaccua

SEQ ID NO: 1345783 - RNA, 19 nt, Homo sapiens
guagucacacugaagaaau

SEQ ID NO: 1345784 - RNA, 19 nt, Homo sapiens
ucucugugcuccaguuugu

SEQ ID NO: 1345785 - RNA, 19 nt, Homo sapiens
uagucacacugaagaaaug

SEQ ID NO: 1345786 - RNA, 19 nt, Homo sapiens
caaaugaaccagccccuaa

SEQ ID NO: 1345787 - RNA, 19 nt, Homo sapiens
gcagaagugguuauguauc

SEQ ID NO: 1345788 - RNA, 19 nt, Homo sapiens
cauggcccgucauuuauca

SEQ ID NO: 1345789 - RNA, 19 nt, Homo sapiens
uaacacagaugaggggauu

SEQ ID NO: 1345790 - RNA, 19 nt, Homo sapiens
caacggcuccagcaguaug

SEQ ID NO: 1345791 - RNA, 19 nt, Homo sapiens
gauugugggagaacuaaau

SEQ ID NO: 1345792 - RNA, 19 nt, Homo sapiens
gaaucucgucguagcuuug

SEQ ID NO: 1345793 - RNA, 19 nt, Homo sapiens
ggagaaccgcaguuucauc

SEQ ID NO: 1345794 - RNA, 19 nt, Homo sapiens
ggcagaagugguuauguau

SEQ ID NO: 1345795 - RNA, 19 nt, Homo sapiens
ucaagaaggcccaguuguc

SEQ ID NO: 1345796 - RNA, 19 nt, Homo sapiens
gcugcagcuuuguaaaugu

SEQ ID NO: 1345797 - RNA, 19 nt, Homo sapiens
ucaggauaccucagggaua

SEQ ID NO: 1345798 - RNA, 19 nt, Homo sapiens
ugggagaacuaaaugugau

SEQ ID NO: 1345799 - RNA, 19 nt, Homo sapiens
ugacuacuccucacuggau

SEQ ID NO: 1345800 - RNA, 19 nt, Homo sapiens
gcugggugaccucgaguaa

SEQ ID NO: 1345801 - RNA, 19 nt, Homo sapiens
agaaucucgucguagcuuu

SEQ ID NO: 1345802 - RNA, 19 nt, Homo sapiens
ucagagaaucacaauccua

SEQ ID NO: 1345803 - RNA, 19 nt, Homo sapiens
gagugcaauuugagaugga

SEQ ID NO: 1345804 - RNA, 19 nt, Homo sapiens
ccaacagcccugaccauca

SEQ ID NO: 1345805 - RNA, 19 nt, Homo sapiens
caaccaacuaggaucgaaa

SEQ ID NO: 1345806 - RNA, 19 nt, Homo sapiens
ccuguaaucccagcacuuu

SEQ ID NO: 1345807 - RNA, 19 nt, Homo sapiens
gacuacuccucacuggauu

SEQ ID NO: 1345808 - RNA, 19 nt, Homo sapiens
acugcuagcuggguucaaa

SEQ ID NO: 1345809 - RNA, 19 nt, Homo sapiens
gcaugaagcuccacaaaug

SEQ ID NO: 1345810 - RNA, 19 nt, Homo sapiens
gcccagaagucuaauguua

SEQ ID NO: 1345811 - RNA, 19 nt, Homo sapiens
acaaauaccucaaagauca

SEQ ID NO: 1345812 - RNA, 19 nt, Homo sapiens
ugucaaaugugucaacaaa

SEQ ID NO: 1345813 - RNA, 19 nt, Homo sapiens
ucccaaagcucgacacauu

SEQ ID NO: 1345814 - RNA, 19 nt, Homo sapiens
guacaaguguguggucaaa

SEQ ID NO: 1345815 - RNA, 19 nt, Homo sapiens
cuacaagugugucaaaugu

SEQ ID NO: 1345816 - RNA, 19 nt, Homo sapiens
ggagggcacugacaagcuu

SEQ ID NO: 1345817 - RNA, 19 nt, Homo sapiens
gugagaagcccuacaaaug

SEQ ID NO: 1345818 - RNA, 19 nt, Homo sapiens
gaaggacaaugccgucuac

SEQ ID NO: 1345819 - RNA, 19 nt, Homo sapiens
ccacaaauaccucaaagau

SEQ ID NO: 1345820 - RNA, 19 nt, Homo sapiens
ggaugacgaggauguauuu

SEQ ID NO: 1345821 - RNA, 19 nt, Homo sapiens
guacagcccuggcaaacag

SEQ ID NO: 1345822 - RNA, 19 nt, Homo sapiens
ggacaaugccgucuacaag

SEQ ID NO: 1345823 - RNA, 19 nt, Homo sapiens
guccacagcuggugaggaa

SEQ ID NO: 1345824 - RNA, 19 nt, Homo sapiens
ggaaguguaagaagcaauu

SEQ ID NO: 1345825 - RNA, 19 nt, Homo sapiens
cagcucaagucucacauga

SEQ ID NO: 1345826 - RNA, 19 nt, Homo sapiens
gaaacucugugaccguaca

SEQ ID NO: 1345827 - RNA, 19 nt, Homo sapiens
gcuccuaccugugccaauu

SEQ ID NO: 1345828 - RNA, 19 nt, Homo sapiens
ccacgagcccuucaagaaa

SEQ ID NO: 1345829 - RNA, 19 nt, Homo sapiens
gcgggagcauuaucucaaa

SEQ ID NO: 1345830 - RNA, 19 nt, Homo sapiens
ccagaagucuaauguuaag

SEQ ID NO: 1345831 - RNA, 19 nt, Homo sapiens
agaaugagcagguguacaa

SEQ ID NO: 1345832 - RNA, 19 nt, Homo sapiens
ugacccagcauaagaauga

SEQ ID NO: 1345833 - RNA, 19 nt, Homo sapiens
caaacugcaugcucacauc

SEQ ID NO: 1345834 - RNA, 19 nt, Homo sapiens
gcacacaggcugcaguaag

SEQ ID NO: 1345835 - RNA, 19 nt, Homo sapiens
gaccgccacucacaacuuc

SEQ ID NO: 1345836 - RNA, 19 nt, Homo sapiens
acaagugugucaaaugugu

SEQ ID NO: 1345837 - RNA, 19 nt, Homo sapiens
gcaccuacuuccagcucaa

SEQ ID NO: 1345838 - RNA, 19 nt, Homo sapiens
cgccagaucuccacauaca

SEQ ID NO: 1345839 - RNA, 19 nt, Homo sapiens
gagaagcccuacaaaugcu

SEQ ID NO: 1345840 - RNA, 19 nt, Homo sapiens
guaagaagcaauucaacuc

SEQ ID NO: 1345841 - RNA, 19 nt, Homo sapiens
cacgagcccuucaagaaau

SEQ ID NO: 1345842 - RNA, 19 nt, Homo sapiens
acaaugccgucuacaagug

SEQ ID NO: 1345843 - RNA, 19 nt, Homo sapiens
gaagagacacauguugauc

SEQ ID NO: 1345844 - RNA, 19 nt, Homo sapiens
gcaaauucagcaccuacuu

SEQ ID NO: 1345845 - RNA, 19 nt, Homo sapiens
ggugagaagcccuacaaau

SEQ ID NO: 1345846 - RNA, 19 nt, Homo sapiens
ugacgaggauguauuucuc

SEQ ID NO: 1345847 - RNA, 19 nt, Homo sapiens
gccaaaggcucagaaacuc

SEQ ID NO: 1345848 - RNA, 19 nt, Homo sapiens
gccauuggaugacgaggau

SEQ ID NO: 1345849 - RNA, 19 nt, Homo sapiens
caaauucagcaccuacuuc

SEQ ID NO: 1345850 - RNA, 19 nt, Homo sapiens
gaagacccgacgagcuaaa

SEQ ID NO: 1345851 - RNA, 19 nt, Homo sapiens
aaauacaaaugcccuuucu

SEQ ID NO: 1345852 - RNA, 19 nt, Homo sapiens
ggagcauuaucucaaacug

SEQ ID NO: 1345853 - RNA, 19 nt, Homo sapiens
ccaaagcucgacacauuuc

SEQ ID NO: 1345854 - RNA, 19 nt, Homo sapiens
aaacucaagugcucauacu

SEQ ID NO: 1345855 - RNA, 19 nt, Homo sapiens
caaaggcucagaaacucaa

SEQ ID NO: 1345856 - RNA, 19 nt, Homo sapiens
cauccaggccuccgaguga

SEQ ID NO: 1345857 - RNA, 19 nt, Homo sapiens
aaacugaagagacacaugu

SEQ ID NO: 1345858 - RNA, 19 nt, Homo sapiens
acacauuucuggagcacau

SEQ ID NO: 1345859 - RNA, 19 nt, Homo sapiens
ccaaggagcagucccugau

SEQ ID NO: 1345860 - RNA, 19 nt, Homo sapiens
gcccagacguucccaaagc

SEQ ID NO: 1345861 - RNA, 19 nt, Homo sapiens
cacaugacccagcauaaga

SEQ ID NO: 1345862 - RNA, 19 nt, Homo sapiens
ccaagcaggugguccucau

SEQ ID NO: 1345863 - RNA, 19 nt, Homo sapiens
gaaacucaagugcucauac

SEQ ID NO: 1345864 - RNA, 19 nt, Homo sapiens
cugaagacccgacgagcua

SEQ ID NO: 1345865 - RNA, 19 nt, Homo sapiens
ggaaacugagcugguggua

SEQ ID NO: 1345866 - RNA, 19 nt, Homo sapiens
gcaaggacaaacugaagag

SEQ ID NO: 1345867 - RNA, 19 nt, Homo sapiens
gacaaugccgucuacaagu

SEQ ID NO: 1345868 - RNA, 19 nt, Homo sapiens
acgagcccuucaagaaaua

SEQ ID NO: 1345869 - RNA, 19 nt, Homo sapiens
ccacagcuggugaggaaga

SEQ ID NO: 1345870 - RNA, 19 nt, Homo sapiens
caccgugucucgaaacucu

SEQ ID NO: 1345871 - RNA, 19 nt, Homo sapiens
cccagaagucuaauguuaa

SEQ ID NO: 1345872 - RNA, 19 nt, Homo sapiens
uggcaaacagggauucaaa

SEQ ID NO: 1345873 - RNA, 19 nt, Homo sapiens
aggacaaacugaagagaca

SEQ ID NO: 1345874 - RNA, 19 nt, Homo sapiens
ugagaagcccuacaaaugc

SEQ ID NO: 1345875 - RNA, 19 nt, Homo sapiens
gcauguggccgugccuuug

SEQ ID NO: 1345876 - RNA, 19 nt, Homo sapiens
ccagaucuccacauacauc

SEQ ID NO: 1345877 - RNA, 19 nt, Homo sapiens
ggcaugaagcuccacaaau

SEQ ID NO: 1345878 - RNA, 19 nt, Homo sapiens
cacacaggcugcaguaagg

SEQ ID NO: 1345879 - RNA, 19 nt, Homo sapiens
gacaagucauucaccaaaa

SEQ ID NO: 1345880 - RNA, 19 nt, Homo sapiens
cugaagagacacauguuga

SEQ ID NO: 1345881 - RNA, 19 nt, Homo sapiens
guauuucucugcgggaagu

SEQ ID NO: 1345882 - RNA, 19 nt, Homo sapiens
ccagcaaauucagcaccua

SEQ ID NO: 1345883 - RNA, 19 nt, Homo sapiens
gaucuccacauacaucaca

SEQ ID NO: 1345884 - RNA, 19 nt, Homo sapiens
cagcguuuaugacccacaa

SEQ ID NO: 1345885 - RNA, 19 nt, Homo sapiens
caaaugugucaacaaauac

SEQ ID NO: 1345886 - RNA, 19 nt, Homo sapiens
cagcacauccgaagguaca

SEQ ID NO: 1345887 - RNA, 19 nt, Homo sapiens
gcucauacugugacaaguc

SEQ ID NO: 1345888 - RNA, 19 nt, Homo sapiens
ugaagagacacauguugau

SEQ ID NO: 1345889 - RNA, 19 nt, Homo sapiens
gcaggugccaaaccagugu

SEQ ID NO: 1345890 - RNA, 19 nt, Homo sapiens
uccacgagcccuucaagaa

SEQ ID NO: 1345891 - RNA, 19 nt, Homo sapiens
gcagaccgccacucacaac

SEQ ID NO: 1345892 - RNA, 19 nt, Homo sapiens
gggauucaaacccaaagga

SEQ ID NO: 1345893 - RNA, 19 nt, Homo sapiens
agaaauacaaaugcccuuu

SEQ ID NO: 1345894 - RNA, 19 nt, Homo sapiens
gcuguccagucauuauugg

SEQ ID NO: 1345895 - RNA, 19 nt, Homo sapiens
ccaaaggcucagaaacuca

SEQ ID NO: 1345896 - RNA, 19 nt, Homo sapiens
gcaaacagggauucaaacc

SEQ ID NO: 1345897 - RNA, 19 nt, Homo sapiens
agagacacauguugaucca

SEQ ID NO: 1345898 - RNA, 19 nt, Homo sapiens
auaagaaugagcaggugua

SEQ ID NO: 1345899 - RNA, 19 nt, Homo sapiens
ucacaugacccagcauaag

SEQ ID NO: 1345900 - RNA, 19 nt, Homo sapiens
ggacaaggaccugcaaacc

SEQ ID NO: 1345901 - RNA, 19 nt, Homo sapiens
cacaaauaccucaaagauc

SEQ ID NO: 1345902 - RNA, 19 nt, Homo sapiens
augagcagguguacaagug

SEQ ID NO: 1345903 - RNA, 19 nt, Homo sapiens
agaaggacaaugccgucua

SEQ ID NO: 1345904 - RNA, 19 nt, Homo sapiens
ucucacaugacccagcaua

SEQ ID NO: 1345905 - RNA, 19 nt, Homo sapiens
ucaagugcucauacuguga

SEQ ID NO: 1345906 - RNA, 19 nt, Homo sapiens
ggcgggagcauuaucucaa

SEQ ID NO: 1345907 - RNA, 19 nt, Homo sapiens
cgucuacaagugugucaaa

SEQ ID NO: 1345908 - RNA, 19 nt, Homo sapiens
cccaaagcucgacacauuu

SEQ ID NO: 1345909 - RNA, 19 nt, Homo sapiens
gaaacuacgcgcugaauua

SEQ ID NO: 1345910 - RNA, 19 nt, Homo sapiens
uaaagaaucugccucauug

SEQ ID NO: 1345911 - RNA, 19 nt, Homo sapiens
ggaaauauuugaagugaga

SEQ ID NO: 1345912 - RNA, 19 nt, Homo sapiens
cgaaauaucuggagaaucu

SEQ ID NO: 1345913 - RNA, 19 nt, Homo sapiens
ggaaaggcaucgccauuau

SEQ ID NO: 1345914 - RNA, 19 nt, Homo sapiens
gauauaaccucaucagauc

SEQ ID NO: 1345915 - RNA, 19 nt, Homo sapiens
gaaugaagaggaagauaua

SEQ ID NO: 1345916 - RNA, 19 nt, Homo sapiens
gagcauauauacauucuca

SEQ ID NO: 1345917 - RNA, 19 nt, Homo sapiens
ggaguuguauuucugcuuu

SEQ ID NO: 1345918 - RNA, 19 nt, Homo sapiens
agaaacacaugccgaagua

SEQ ID NO: 1345919 - RNA, 19 nt, Homo sapiens
ccauugggcuuaagugaaa

SEQ ID NO: 1345920 - RNA, 19 nt, Homo sapiens
ucaaagagauaaagaaguc

SEQ ID NO: 1345921 - RNA, 19 nt, Homo sapiens
gaucagggaaccuccaaua

SEQ ID NO: 1345922 - RNA, 19 nt, Homo sapiens
guaaagaaucugccucauu

SEQ ID NO: 1345923 - RNA, 19 nt, Homo sapiens
gaugaacgcuuugcugaca

SEQ ID NO: 1345924 - RNA, 19 nt, Homo sapiens
gaucagcaguaucucauag

SEQ ID NO: 1345925 - RNA, 19 nt, Homo sapiens
gaaucugccucauugugaa

SEQ ID NO: 1345926 - RNA, 19 nt, Homo sapiens
caucagggcugccauagag

SEQ ID NO: 1345927 - RNA, 19 nt, Homo sapiens
gagccacgccuggaauuua

SEQ ID NO: 1345928 - RNA, 19 nt, Homo sapiens
cuauucagcuuuccaauca

SEQ ID NO: 1345929 - RNA, 19 nt, Homo sapiens
agaggaggcugcugaguga

SEQ ID NO: 1345930 - RNA, 19 nt, Homo sapiens
aaaccuaccuagaggaaga

SEQ ID NO: 1345931 - RNA, 19 nt, Homo sapiens
gcugggaaguucuaugaug

SEQ ID NO: 1345932 - RNA, 19 nt, Homo sapiens
ccucaccucugcccuguaa

SEQ ID NO: 1345933 - RNA, 19 nt, Homo sapiens
gcccauuucuggagucuug

SEQ ID NO: 1345934 - RNA, 19 nt, Homo sapiens
gagacaggauucaguacug

SEQ ID NO: 1345935 - RNA, 19 nt, Homo sapiens
gguggaaacuauucagcuu

SEQ ID NO: 1345936 - RNA, 19 nt, Homo sapiens
ggaagaggaggaugaggaa

SEQ ID NO: 1345937 - RNA, 19 nt, Homo sapiens
gagcaucgacuccauugug

SEQ ID NO: 1345938 - RNA, 19 nt, Homo sapiens
ugagcuagaucguguaaag

SEQ ID NO: 1345939 - RNA, 19 nt, Homo sapiens
agacacggaucuucgaaau

SEQ ID NO: 1345940 - RNA, 19 nt, Homo sapiens
aaacuacgcgcugaauuaa

SEQ ID NO: 1345941 - RNA, 19 nt, Homo sapiens
ccgaaguacuuaagacaga

SEQ ID NO: 1345942 - RNA, 19 nt, Homo sapiens
ggacagugccugguggaaa

SEQ ID NO: 1345943 - RNA, 19 nt, Homo sapiens
ccauagagcaguccaugaa

SEQ ID NO: 1345944 - RNA, 19 nt, Homo sapiens
cagggaaccuccaauagca

SEQ ID NO: 1345945 - RNA, 19 nt, Homo sapiens
gcgcugaauuaaagccaaa

SEQ ID NO: 1345946 - RNA, 19 nt, Homo sapiens
guacuuaagacagaaacua

SEQ ID NO: 1345947 - RNA, 19 nt, Homo sapiens
caacauggcccaggauuac

SEQ ID NO: 1345948 - RNA, 19 nt, Homo sapiens
cggaaaggcaucgccauua

SEQ ID NO: 1345949 - RNA, 19 nt, Homo sapiens
gcaucgccauuaucauuca

SEQ ID NO: 1345950 - RNA, 19 nt, Homo sapiens
ucagcaguaucucauagaa

SEQ ID NO: 1345951 - RNA, 19 nt, Homo sapiens
caugagacaggauucagua

SEQ ID NO: 1345952 - RNA, 19 nt, Homo sapiens
gaaaggcaucgccauuauc

SEQ ID NO: 1345953 - RNA, 19 nt, Homo sapiens
gaagauauaaccucaucag

SEQ ID NO: 1345954 - RNA, 19 nt, Homo sapiens
agcaguaucucauagaaga

SEQ ID NO: 1345955 - RNA, 19 nt, Homo sapiens
gcuagaucguguaaagaau

SEQ ID NO: 1345956 - RNA, 19 nt, Homo sapiens
gaaacuuugacauuugcua

SEQ ID NO: 1345957 - RNA, 19 nt, Homo sapiens
gagaaacacaugccgaagu

SEQ ID NO: 1345958 - RNA, 19 nt, Homo sapiens
gaagucauucugcccauca

SEQ ID NO: 1345959 - RNA, 19 nt, Homo sapiens
agugaaacuuugacauuug

SEQ ID NO: 1345960 - RNA, 19 nt, Homo sapiens
ucaacauggcccaggauua

SEQ ID NO: 1345961 - RNA, 19 nt, Homo sapiens
gagaaugaagaggaagaua

SEQ ID NO: 1345962 - RNA, 19 nt, Homo sapiens
agacgaggccgaggugaua

SEQ ID NO: 1345963 - RNA, 19 nt, Homo sapiens
acaagcguguccuucauga

SEQ ID NO: 1345964 - RNA, 19 nt, Homo sapiens
uugacaagcuggagaaaca

SEQ ID NO: 1345965 - RNA, 19 nt, Homo sapiens
cugggaaguucuaugauga

SEQ ID NO: 1345966 - RNA, 19 nt, Homo sapiens
gaaacggaaauauuugaag

SEQ ID NO: 1345967 - RNA, 19 nt, Homo sapiens
gaaguacuuaagacagaaa

SEQ ID NO: 1345968 - RNA, 19 nt, Homo sapiens
cgaaguacuuaagacagaa

SEQ ID NO: 1345969 - RNA, 19 nt, Homo sapiens
gccaggaguuguauuucug

SEQ ID NO: 1345970 - RNA, 19 nt, Homo sapiens
acaggagaaugaagaggaa

SEQ ID NO: 1345971 - RNA, 19 nt, Homo sapiens
gcagaugagggcgaaauau

SEQ ID NO: 1345972 - RNA, 19 nt, Homo sapiens
ugaagaaucccugcaacuu

SEQ ID NO: 1345973 - RNA, 19 nt, Homo sapiens
gacagugccugguggaaac

SEQ ID NO: 1345974 - RNA, 19 nt, Homo sapiens
ggccaggaguuguauuucu

SEQ ID NO: 1345975 - RNA, 19 nt, Homo sapiens
acggaaauauuugaaguga

SEQ ID NO: 1345976 - RNA, 19 nt, Homo sapiens
ggcgaaauaucuggagaau

SEQ ID NO: 1345977 - RNA, 19 nt, Homo sapiens
agaauuugaucagcaguau

SEQ ID NO: 1345978 - RNA, 19 nt, Homo sapiens
acacaugccgaaguacuua

SEQ ID NO: 1345979 - RNA, 19 nt, Homo sapiens
caugaaggcccaggagaaa

SEQ ID NO: 1345980 - RNA, 19 nt, Homo sapiens
gcagccgggagcauauaua

SEQ ID NO: 1345981 - RNA, 19 nt, Homo sapiens
ucaggaaagucagccaaug

SEQ ID NO: 1345982 - RNA, 19 nt, Homo sapiens
ugacaagcuucagagcauu

SEQ ID NO: 1345983 - RNA, 19 nt, Homo sapiens
gaaccuccaauagcacaaa

SEQ ID NO: 1345984 - RNA, 19 nt, Homo sapiens
gugaaacggaaauauuuga

SEQ ID NO: 1345985 - RNA, 19 nt, Homo sapiens
agaaugaagaggaagauau

SEQ ID NO: 1345986 - RNA, 19 nt, Homo sapiens
ccuccuaccuuuccauugg

SEQ ID NO: 1345987 - RNA, 19 nt, Homo sapiens
gggagcauauauacauucu

SEQ ID NO: 1345988 - RNA, 19 nt, Homo sapiens
aaaggcaucgccauuauca

SEQ ID NO: 1345989 - RNA, 19 nt, Homo sapiens
cgagggaucucugucacau

SEQ ID NO: 1345990 - RNA, 19 nt, Homo sapiens
uacgaguacuucaaagaga

SEQ ID NO: 1345991 - RNA, 19 nt, Homo sapiens
ccccagaacuguacgagua

SEQ ID NO: 1345992 - RNA, 19 nt, Homo sapiens
ccaaaagccuguugacaag

SEQ ID NO: 1345993 - RNA, 19 nt, Homo sapiens
gcauauauacauucucaac

SEQ ID NO: 1345994 - RNA, 19 nt, Homo sapiens
gaugaggaaagccuggaaa

SEQ ID NO: 1345995 - RNA, 19 nt, Homo sapiens
agauauaaccucaucagau

SEQ ID NO: 1345996 - RNA, 19 nt, Homo sapiens
ggccaacaguucacaucug

SEQ ID NO: 1345997 - RNA, 19 nt, Homo sapiens
acuacgcgcugaauuaaag

SEQ ID NO: 1345998 - RNA, 19 nt, Homo sapiens
agaaucugccucauuguga

SEQ ID NO: 1345999 - RNA, 19 nt, Homo sapiens
ccaugaaggcccaggagaa

SEQ ID NO: 1346000 - RNA, 19 nt, Homo sapiens
aggcaucgccauuaucauu

SEQ ID NO: 1346001 - RNA, 19 nt, Homo sapiens
cgaguacuucaaagagaua

SEQ ID NO: 1346002 - RNA, 19 nt, Homo sapiens
gggcuaugauuccuacaac

SEQ ID NO: 1346003 - RNA, 19 nt, Homo sapiens
ugaauuaaagccaaagaca

SEQ ID NO: 1346004 - RNA, 19 nt, Homo sapiens
cauccuuucugcaauuaca

SEQ ID NO: 1346005 - RNA, 19 nt, Homo sapiens
ggauuacgcagccaugaag

SEQ ID NO: 1346006 - RNA, 19 nt, Homo sapiens
aaacaacccagugagcaaa

SEQ ID NO: 1346007 - RNA, 19 nt, Homo sapiens
aggaagauauaaccucauc

SEQ ID NO: 1346008 - RNA, 19 nt, Homo sapiens
gaggugauagugaagaauc

SEQ ID NO: 1346009 - RNA, 19 nt, Homo sapiens
gcaguuggcuacuugauua

SEQ ID NO: 1346010 - RNA, 19 nt, Homo sapiens
gaaggaggcucucuuauca

SEQ ID NO: 1346011 - RNA, 19 nt, Homo sapiens
uaacagagcccaauugaga

SEQ ID NO: 1346012 - RNA, 19 nt, Homo sapiens
aagcaaaguuuacgaauga

SEQ ID NO: 1346013 - RNA, 19 nt, Homo sapiens
ucaaugaggucacuaacuu

SEQ ID NO: 1346014 - RNA, 19 nt, Homo sapiens
ggugaugacacacuaauua

SEQ ID NO: 1346015 - RNA, 19 nt, Homo sapiens
uaauauagccuguccguuu

SEQ ID NO: 1346016 - RNA, 19 nt, Homo sapiens
caacagaguaaaugaagua

SEQ ID NO: 1346017 - RNA, 19 nt, Homo sapiens
gaggcucucuuaucaauug

SEQ ID NO: 1346018 - RNA, 19 nt, Homo sapiens
gaugaaggaggcucucuua

SEQ ID NO: 1346019 - RNA, 19 nt, Homo sapiens
ugaagagucuggaaagaga

SEQ ID NO: 1346020 - RNA, 19 nt, Homo sapiens
gagaggugaugacacacua

SEQ ID NO: 1346021 - RNA, 19 nt, Homo sapiens
ugacaaagccaaagauuca

SEQ ID NO: 1346022 - RNA, 19 nt, Homo sapiens
gcauggcaccuuauuguuu

SEQ ID NO: 1346023 - RNA, 19 nt, Homo sapiens
gaaugaaagccuacaccua

SEQ ID NO: 1346024 - RNA, 19 nt, Homo sapiens
ggacaaucuugcaguaaca

SEQ ID NO: 1346025 - RNA, 19 nt, Homo sapiens
cuaaaucgagucagagaua

SEQ ID NO: 1346026 - RNA, 19 nt, Homo sapiens
uaagcaaaguuuacgaaug

SEQ ID NO: 1346027 - RNA, 19 nt, Homo sapiens
ccuagugguuugacuuuaa

SEQ ID NO: 1346028 - RNA, 19 nt, Homo sapiens
caugagaggugaugacaca

SEQ ID NO: 1346029 - RNA, 19 nt, Homo sapiens
ggauaagaacuuugaaaug

SEQ ID NO: 1346030 - RNA, 19 nt, Homo sapiens
gaacugggagguagacuag

SEQ ID NO: 1346031 - RNA, 19 nt, Homo sapiens
gagagaacauccggaagau

SEQ ID NO: 1346032 - RNA, 19 nt, Homo sapiens
gcaaugacaaagccaaaga

SEQ ID NO: 1346033 - RNA, 19 nt, Homo sapiens
guaaggcucuccccuguaa

SEQ ID NO: 1346034 - RNA, 19 nt, Homo sapiens
caaagccaaagauucaaua

SEQ ID NO: 1346035 - RNA, 19 nt, Homo sapiens
guaaaugaaguacuggauu

SEQ ID NO: 1346036 - RNA, 19 nt, Homo sapiens
agacuaguuuggauaagaa

SEQ ID NO: 1346037 - RNA, 19 nt, Homo sapiens
uaacuuagaagggaaagaa

SEQ ID NO: 1346038 - RNA, 19 nt, Homo sapiens
gaagaugcagggucucaug

SEQ ID NO: 1346039 - RNA, 19 nt, Homo sapiens
gaacauauggaaugaaagc

SEQ ID NO: 1346040 - RNA, 19 nt, Homo sapiens
acaggacaaucuugcagua

SEQ ID NO: 1346041 - RNA, 19 nt, Homo sapiens
gaugcagggucucauguuc

SEQ ID NO: 1346042 - RNA, 19 nt, Homo sapiens
caauagaugcugggaguaa

SEQ ID NO: 1346043 - RNA, 19 nt, Homo sapiens
gccaaagauucaauagaug

SEQ ID NO: 1346044 - RNA, 19 nt, Homo sapiens
aauauagccuguccguuug

SEQ ID NO: 1346045 - RNA, 19 nt, Homo sapiens
gcuacuugauuacaacaga

SEQ ID NO: 1346046 - RNA, 19 nt, Homo sapiens
gagguagacuaguuuggau

SEQ ID NO: 1346047 - RNA, 19 nt, Homo sapiens
caaugaggucacuaacuua

SEQ ID NO: 1346048 - RNA, 19 nt, Homo sapiens
gcugagggcaagaauauau

SEQ ID NO: 1346049 - RNA, 19 nt, Homo sapiens
agccaaagauucaauagau

SEQ ID NO: 1346050 - RNA, 19 nt, Homo sapiens
uccaggcugugauauauuu

SEQ ID NO: 1346051 - RNA, 19 nt, Homo sapiens
ggugaagagucuggaaaga

SEQ ID NO: 1346052 - RNA, 19 nt, Homo sapiens
gguagacuaguuuggauaa

SEQ ID NO: 1346053 - RNA, 19 nt, Homo sapiens
ggugcuaaaucgagucaga

SEQ ID NO: 1346054 - RNA, 19 nt, Homo sapiens
gaugacacacuaauuaugg

SEQ ID NO: 1346055 - RNA, 19 nt, Homo sapiens
uaaaucgagucagagauau

SEQ ID NO: 1346056 - RNA, 19 nt, Homo sapiens
uagaguugguggagucuga

SEQ ID NO: 1346057 - RNA, 19 nt, Homo sapiens
guaccagacucuucuuacu

SEQ ID NO: 1346058 - RNA, 19 nt, Homo sapiens
gccacaagcguaaggcaua

SEQ ID NO: 1346059 - RNA, 19 nt, Homo sapiens
caacuaugaccaagaagau

SEQ ID NO: 1346060 - RNA, 19 nt, Homo sapiens
cuagugguuugacuuuaaa

SEQ ID NO: 1346061 - RNA, 19 nt, Homo sapiens
gaggagcaguuggcuacuu

SEQ ID NO: 1346062 - RNA, 19 nt, Homo sapiens
ggagguagacuaguuugga

SEQ ID NO: 1346063 - RNA, 19 nt, Homo sapiens
ggaacugggagguagacua

SEQ ID NO: 1346064 - RNA, 19 nt, Homo sapiens
uccauaagcugugaaacaa

SEQ ID NO: 1346065 - RNA, 19 nt, Homo sapiens
ccacaagcguaaggcauau

SEQ ID NO: 1346066 - RNA, 19 nt, Homo sapiens
caaaguuuacgaaugaaga

SEQ ID NO: 1346067 - RNA, 19 nt, Homo sapiens
cagcauggcaccuuauugu

SEQ ID NO: 1346068 - RNA, 19 nt, Homo sapiens
uagacuaguuuggauaaga

SEQ ID NO: 1346069 - RNA, 19 nt, Homo sapiens
aaucgagucagagauauua

SEQ ID NO: 1346070 - RNA, 19 nt, Homo sapiens
ggacacugguuauuuuaug

SEQ ID NO: 1346071 - RNA, 19 nt, Homo sapiens
ugaaggaggcucucuuauc

SEQ ID NO: 1346072 - RNA, 19 nt, Homo sapiens
ucaccaacuuauuacuuga

SEQ ID NO: 1346073 - RNA, 19 nt, Homo sapiens
uaucuaggaaugaacagua

SEQ ID NO: 1346074 - RNA, 19 nt, Homo sapiens
uagaagggaaagaaaguuu

SEQ ID NO: 1346075 - RNA, 19 nt, Homo sapiens
cauaagcugugaaacaaaa

SEQ ID NO: 1346076 - RNA, 19 nt, Homo sapiens
uacaagggcauacaaguug

SEQ ID NO: 1346077 - RNA, 19 nt, Homo sapiens
ucccaacuaugaccaagaa

SEQ ID NO: 1346078 - RNA, 19 nt, Homo sapiens
gcucucuuaucaauuggaa

SEQ ID NO: 1346079 - RNA, 19 nt, Homo sapiens
agagagaacauccggaaga

SEQ ID NO: 1346080 - RNA, 19 nt, Homo sapiens
acaagggcauacaaguuga

SEQ ID NO: 1346081 - RNA, 19 nt, Homo sapiens
gguggagucugaggagaga

SEQ ID NO: 1346082 - RNA, 19 nt, Homo sapiens
gccagagcccuccaaggua

SEQ ID NO: 1346083 - RNA, 19 nt, Homo sapiens
guuuacgaaugaagaaaug

SEQ ID NO: 1346084 - RNA, 19 nt, Homo sapiens
gcaccuuauuguuuugaua

SEQ ID NO: 1346085 - RNA, 19 nt, Homo sapiens
gcaacuugggcuaggauga

SEQ ID NO: 1346086 - RNA, 19 nt, Homo sapiens
caccuagcauugccuacuu

SEQ ID NO: 1346087 - RNA, 19 nt, Homo sapiens
cuaauuaugggaagcagaa

SEQ ID NO: 1346088 - RNA, 19 nt, Homo sapiens
acaguugugugaccaagug

SEQ ID NO: 1346089 - RNA, 19 nt, Homo sapiens
uaccagacucuucuuacua

SEQ ID NO: 1346090 - RNA, 19 nt, Homo sapiens
cgaaugaagaaaugaagga

SEQ ID NO: 1346091 - RNA, 19 nt, Homo sapiens
aggaggcucucuuaucaau

SEQ ID NO: 1346092 - RNA, 19 nt, Homo sapiens
auuaugggaagcagaauua

SEQ ID NO: 1346093 - RNA, 19 nt, Homo sapiens
gugaugacacacuaauuau

SEQ ID NO: 1346094 - RNA, 19 nt, Homo sapiens
agacugugcagaaacauga

SEQ ID NO: 1346095 - RNA, 19 nt, Homo sapiens
ugaccaagaagaugaagga

SEQ ID NO: 1346096 - RNA, 19 nt, Homo sapiens
cagcuggacaguuguguga

SEQ ID NO: 1346097 - RNA, 19 nt, Homo sapiens
caucuuccauaagcuguga

SEQ ID NO: 1346098 - RNA, 19 nt, Homo sapiens
guaaggcauaugucacuug

SEQ ID NO: 1346099 - RNA, 19 nt, Homo sapiens
acugggagguagacuaguu

SEQ ID NO: 1346100 - RNA, 19 nt, Homo sapiens
auacaagggcauacaaguu

SEQ ID NO: 1346101 - RNA, 19 nt, Homo sapiens
ccaacuaugaccaagaaga

SEQ ID NO: 1346102 - RNA, 19 nt, Homo sapiens
aaugaaggauggccacaag

SEQ ID NO: 1346103 - RNA, 19 nt, Homo sapiens
ugagggcaagaauauauuu

SEQ ID NO: 1346104 - RNA, 19 nt, Homo sapiens
uuuccaggcugugauauau

SEQ ID NO: 1346105 - RNA, 19 nt, Homo sapiens
cauggcaccuuauuguuuu

SEQ ID NO: 1346106 - RNA, 19 nt, Homo sapiens
ccuggagacugugcagaaa

SEQ ID NO: 1346107 - RNA, 19 nt, Homo sapiens
gggcauacaaguugauuuu

SEQ ID NO: 1346108 - RNA, 19 nt, Homo sapiens
gugcuuguccuggcaguaa

SEQ ID NO: 1346109 - RNA, 19 nt, Homo sapiens
aaacaaagccugcaaauuu

SEQ ID NO: 1346110 - RNA, 19 nt, Homo sapiens
cugcagagaugauuaaaua

SEQ ID NO: 1346111 - RNA, 19 nt, Homo sapiens
ggacagaaaugaagaugga

SEQ ID NO: 1346112 - RNA, 19 nt, Homo sapiens
gaacaugcuucugggauuu

SEQ ID NO: 1346113 - RNA, 19 nt, Homo sapiens
ggugugaacucauuguuaa

SEQ ID NO: 1346114 - RNA, 19 nt, Homo sapiens
ggaaacagauucaagaaac

SEQ ID NO: 1346115 - RNA, 19 nt, Homo sapiens
gggagcaguuagacuauua

SEQ ID NO: 1346116 - RNA, 19 nt, Homo sapiens
gaaaggaaccauaauuugu

SEQ ID NO: 1346117 - RNA, 19 nt, Homo sapiens
ggagaacauuccagaagaa

SEQ ID NO: 1346118 - RNA, 19 nt, Homo sapiens
gggauuauguggcugcuaa

SEQ ID NO: 1346119 - RNA, 19 nt, Homo sapiens
gcggauauuucuauaauuc

SEQ ID NO: 1346120 - RNA, 19 nt, Homo sapiens
ggaacaugcuucugggauu

SEQ ID NO: 1346121 - RNA, 19 nt, Homo sapiens
caacgcagcuuugggaaga

SEQ ID NO: 1346122 - RNA, 19 nt, Homo sapiens
ggacugcugugauuuaucu

SEQ ID NO: 1346123 - RNA, 19 nt, Homo sapiens
ggugguggccgaaauguua

SEQ ID NO: 1346124 - RNA, 19 nt, Homo sapiens
caucgucccugccaacuuu

SEQ ID NO: 1346125 - RNA, 19 nt, Homo sapiens
gaaacagauucaagaaaca

SEQ ID NO: 1346126 - RNA, 19 nt, Homo sapiens
ggagggagcaguuagacua

SEQ ID NO: 1346127 - RNA, 19 nt, Homo sapiens
gcaggugcauuauuuaaag

SEQ ID NO: 1346128 - RNA, 19 nt, Homo sapiens
gagcaucuguuaucaagca

SEQ ID NO: 1346129 - RNA, 19 nt, Homo sapiens
gaacugacccuggacauca

SEQ ID NO: 1346130 - RNA, 19 nt, Homo sapiens
gaacaggaugagaaucuaa

SEQ ID NO: 1346131 - RNA, 19 nt, Homo sapiens
uacgugaacuugugacuuu

SEQ ID NO: 1346132 - RNA, 19 nt, Homo sapiens
gaaagaccacagcaagauu

SEQ ID NO: 1346133 - RNA, 19 nt, Homo sapiens
gcgccgaggucacgaaaug

SEQ ID NO: 1346134 - RNA, 19 nt, Homo sapiens
ggaugcggauauuucuaua

SEQ ID NO: 1346135 - RNA, 19 nt, Homo sapiens
aaaggcagauucucguaaa

SEQ ID NO: 1346136 - RNA, 19 nt, Homo sapiens
aaaugaagauggagacaug

SEQ ID NO: 1346137 - RNA, 19 nt, Homo sapiens
gagacauggucaucaaaug

SEQ ID NO: 1346138 - RNA, 19 nt, Homo sapiens
gaaauggauuggagugaac

SEQ ID NO: 1346139 - RNA, 19 nt, Homo sapiens
cgaaauggauuggagugaa

SEQ ID NO: 1346140 - RNA, 19 nt, Homo sapiens
ggaaagaccacagcaagau

SEQ ID NO: 1346141 - RNA, 19 nt, Homo sapiens
gggagcaucuguuaucaag

SEQ ID NO: 1346142 - RNA, 19 nt, Homo sapiens
gcuacugacuuuccucaug

SEQ ID NO: 1346143 - RNA, 19 nt, Homo sapiens
acuuggagcuugcagauaa

SEQ ID NO: 1346144 - RNA, 19 nt, Homo sapiens
ugaggaagccugccaauca

SEQ ID NO: 1346145 - RNA, 19 nt, Homo sapiens
gaagcacuauguacuggau

SEQ ID NO: 1346146 - RNA, 19 nt, Homo sapiens
ggcuugagcugucuguuga

SEQ ID NO: 1346147 - RNA, 19 nt, Homo sapiens
ugaaaggaaccauaauuug

SEQ ID NO: 1346148 - RNA, 19 nt, Homo sapiens
ccaaucagaaucaaacaaa

SEQ ID NO: 1346149 - RNA, 19 nt, Homo sapiens
gauggaaacagauucaaga

SEQ ID NO: 1346150 - RNA, 19 nt, Homo sapiens
ccaaggagcagauggauag

SEQ ID NO: 1346151 - RNA, 19 nt, Homo sapiens
gaaggaagagguguuugaa

SEQ ID NO: 1346152 - RNA, 19 nt, Homo sapiens
gcuugagaguuccggaaua

SEQ ID NO: 1346153 - RNA, 19 nt, Homo sapiens
aagcugguauuacuaugua

SEQ ID NO: 1346154 - RNA, 19 nt, Homo sapiens
gaagggcgaucgguuacau

SEQ ID NO: 1346155 - RNA, 19 nt, Homo sapiens
guacaaaacuaaaccugaa

SEQ ID NO: 1346156 - RNA, 19 nt, Homo sapiens
ccugaacccugccauauuc

SEQ ID NO: 1346157 - RNA, 19 nt, Homo sapiens
gacaggagacugaaaggaa

SEQ ID NO: 1346158 - RNA, 19 nt, Homo sapiens
ggacaucaaaggagggauu

SEQ ID NO: 1346159 - RNA, 19 nt, Homo sapiens
ggagaaggaagagguguuu

SEQ ID NO: 1346160 - RNA, 19 nt, Homo sapiens
uaucaagcauggacuuaau

SEQ ID NO: 1346161 - RNA, 19 nt, Homo sapiens
caacauggcaggcuacagu

SEQ ID NO: 1346162 - RNA, 19 nt, Homo sapiens
ggccauguguuuauacugu

SEQ ID NO: 1346163 - RNA, 19 nt, Homo sapiens
ucaaaguacugcugugaca

SEQ ID NO: 1346164 - RNA, 19 nt, Homo sapiens
aagcagcuauuuaugauuc

SEQ ID NO: 1346165 - RNA, 19 nt, Homo sapiens
gauuaaggcagauaggaaa

SEQ ID NO: 1346166 - RNA, 19 nt, Homo sapiens
ggaucaggaugcagagguu

SEQ ID NO: 1346167 - RNA, 19 nt, Homo sapiens
caaaagacuuggagaugaa

SEQ ID NO: 1346168 - RNA, 19 nt, Homo sapiens
gauuguacgugaacuugug

SEQ ID NO: 1346169 - RNA, 19 nt, Homo sapiens
ggauuucuagcucaaagua

SEQ ID NO: 1346170 - RNA, 19 nt, Homo sapiens
caaacaaagccugcaaauu

SEQ ID NO: 1346171 - RNA, 19 nt, Homo sapiens
gaaaaccugcugaacauuu

SEQ ID NO: 1346172 - RNA, 19 nt, Homo sapiens
caauaaaccacaucaugga

SEQ ID NO: 1346173 - RNA, 19 nt, Homo sapiens
cuacuuccuucuucgguuu

SEQ ID NO: 1346174 - RNA, 19 nt, Homo sapiens
gugggaugcuggacagaaa

SEQ ID NO: 1346175 - RNA, 19 nt, Homo sapiens
agacugaaaggaaccauaa

SEQ ID NO: 1346176 - RNA, 19 nt, Homo sapiens
gcucugagauuuugaguuc

SEQ ID NO: 1346177 - RNA, 19 nt, Homo sapiens
gaaaacaucuaccaagacu

SEQ ID NO: 1346178 - RNA, 19 nt, Homo sapiens
ggcaggccauguguuuaua

SEQ ID NO: 1346179 - RNA, 19 nt, Homo sapiens
cuucucaucugaaauggaa

SEQ ID NO: 1346180 - RNA, 19 nt, Homo sapiens
ccucgaggauggaaacaga

SEQ ID NO: 1346181 - RNA, 19 nt, Homo sapiens
cugaaaggaaccauaauuu

SEQ ID NO: 1346182 - RNA, 19 nt, Homo sapiens
ggccaacaccagccacaua

SEQ ID NO: 1346183 - RNA, 19 nt, Homo sapiens
cauaccaccuccaggauca

SEQ ID NO: 1346184 - RNA, 19 nt, Homo sapiens
aagacuggcuugagaguuc

SEQ ID NO: 1346185 - RNA, 19 nt, Homo sapiens
ggagacauggucaucaaau

SEQ ID NO: 1346186 - RNA, 19 nt, Homo sapiens
gacaucaguuguuuucuuu

SEQ ID NO: 1346187 - RNA, 19 nt, Homo sapiens
gaccuucucaucugaaaug

SEQ ID NO: 1346188 - RNA, 19 nt, Homo sapiens
gggagcugauggugaguga

SEQ ID NO: 1346189 - RNA, 19 nt, Homo sapiens
aaacuggccacacaaguga

SEQ ID NO: 1346190 - RNA, 19 nt, Homo sapiens
caacaccagccacauacuu

SEQ ID NO: 1346191 - RNA, 19 nt, Homo sapiens
gaggaagccugccaaucag

SEQ ID NO: 1346192 - RNA, 19 nt, Homo sapiens
cauaauuugugacaucagu

SEQ ID NO: 1346193 - RNA, 19 nt, Homo sapiens
guuggacugcugugauuua

SEQ ID NO: 1346194 - RNA, 19 nt, Homo sapiens
guguuggacugcugugauu

SEQ ID NO: 1346195 - RNA, 19 nt, Homo sapiens
ggaccaaggagcagaugga

SEQ ID NO: 1346196 - RNA, 19 nt, Homo sapiens
gagaacauuccagaagaaa

SEQ ID NO: 1346197 - RNA, 19 nt, Homo sapiens
aaggaaccauaauuuguga

SEQ ID NO: 1346198 - RNA, 19 nt, Homo sapiens
ggacuuaauccggagaaga

SEQ ID NO: 1346199 - RNA, 19 nt, Homo sapiens
ccugaagggcgaucgguua

SEQ ID NO: 1346200 - RNA, 19 nt, Homo sapiens
ggaagccugccaaucagaa

SEQ ID NO: 1346201 - RNA, 19 nt, Homo sapiens
cauauucccgugacaaaug

SEQ ID NO: 1346202 - RNA, 19 nt, Homo sapiens
uaaaagaacaggaugagaa

SEQ ID NO: 1346203 - RNA, 19 nt, Homo sapiens
gggauggccagacccagua

SEQ ID NO: 1346204 - RNA, 19 nt, Homo sapiens
gcucaagcugguauuacua

SEQ ID NO: 1346205 - RNA, 19 nt, Homo sapiens
aaaggaaccauaauuugug

SEQ ID NO: 1346206 - RNA, 19 nt, Homo sapiens
agaacaggaugagaaucua

SEQ ID NO: 1346207 - RNA, 19 nt, Homo sapiens
gagacugaaaggaaccaua

SEQ ID NO: 1346208 - RNA, 19 nt, Homo sapiens
gacaucaaaggagggauua

SEQ ID NO: 1346209 - RNA, 19 nt, Homo sapiens
guacugaagugauuugaua

SEQ ID NO: 1346210 - RNA, 19 nt, Homo sapiens
gaacuuugaugaagauuug

SEQ ID NO: 1346211 - RNA, 19 nt, Homo sapiens
gaaagaacacugugaaauu

SEQ ID NO: 1346212 - RNA, 19 nt, Homo sapiens
ggaguuaggucuucucuga

SEQ ID NO: 1346213 - RNA, 19 nt, Homo sapiens
gaacacaagugcacagaga

SEQ ID NO: 1346214 - RNA, 19 nt, Homo sapiens
gaaauaaccugaggaaagu

SEQ ID NO: 1346215 - RNA, 19 nt, Homo sapiens
caaguuaucuguuaaguca

SEQ ID NO: 1346216 - RNA, 19 nt, Homo sapiens
gaugcaagcuggaauuuga

SEQ ID NO: 1346217 - RNA, 19 nt, Homo sapiens
ggaaauaaccugaggaaag

SEQ ID NO: 1346218 - RNA, 19 nt, Homo sapiens
ggacuauccuucaucaaga

SEQ ID NO: 1346219 - RNA, 19 nt, Homo sapiens
uaucauaccugucacaaug

SEQ ID NO: 1346220 - RNA, 19 nt, Homo sapiens
gcaauaauacuucucuuug

SEQ ID NO: 1346221 - RNA, 19 nt, Homo sapiens
aaacuuagauugcaacagu

SEQ ID NO: 1346222 - RNA, 19 nt, Homo sapiens
ccaaagaauuacccucauu

SEQ ID NO: 1346223 - RNA, 19 nt, Homo sapiens
gagcuuugauuugauauug

SEQ ID NO: 1346224 - RNA, 19 nt, Homo sapiens
ccauuuagcuguuguucuu

SEQ ID NO: 1346225 - RNA, 19 nt, Homo sapiens
ugagguagauauugugauu

SEQ ID NO: 1346226 - RNA, 19 nt, Homo sapiens
gguaggagguucuauaguc

SEQ ID NO: 1346227 - RNA, 19 nt, Homo sapiens
ucaggaccuuugauauuua

SEQ ID NO: 1346228 - RNA, 19 nt, Homo sapiens
ucagagauaugccuucaug

SEQ ID NO: 1346229 - RNA, 19 nt, Homo sapiens
gaauguuucucuuucuaug

SEQ ID NO: 1346230 - RNA, 19 nt, Homo sapiens
gagggucacuaccaaagaa

SEQ ID NO: 1346231 - RNA, 19 nt, Homo sapiens
cagcaacacuggacuguca

SEQ ID NO: 1346232 - RNA, 19 nt, Homo sapiens
gaguugauuucugcgauua

SEQ ID NO: 1346233 - RNA, 19 nt, Homo sapiens
cagcaaacaaucagagaua

SEQ ID NO: 1346234 - RNA, 19 nt, Homo sapiens
guguuucccucuuugaaua

SEQ ID NO: 1346235 - RNA, 19 nt, Homo sapiens
ccagagcacuuccuaacug

SEQ ID NO: 1346236 - RNA, 19 nt, Homo sapiens
ggucacuaccaaagaauua

SEQ ID NO: 1346237 - RNA, 19 nt, Homo sapiens
gaugguaggagguucuaua

SEQ ID NO: 1346238 - RNA, 19 nt, Homo sapiens
ggaguugauuucugcgauu

SEQ ID NO: 1346239 - RNA, 19 nt, Homo sapiens
gauugggccucauggauau

SEQ ID NO: 1346240 - RNA, 19 nt, Homo sapiens
ucgcuuauccuuauuguaa

SEQ ID NO: 1346241 - RNA, 19 nt, Homo sapiens
gauuggaacccguauaaga

SEQ ID NO: 1346242 - RNA, 19 nt, Homo sapiens
ggaagucuguguaucaaaa

SEQ ID NO: 1346243 - RNA, 19 nt, Homo sapiens
gaucugaaauggcugaaaa

SEQ ID NO: 1346244 - RNA, 19 nt, Homo sapiens
ggugauguguauuguuuau

SEQ ID NO: 1346245 - RNA, 19 nt, Homo sapiens
uaaauacccuuggucuuuc

SEQ ID NO: 1346246 - RNA, 19 nt, Homo sapiens
ggaaagaucaauggauguu

SEQ ID NO: 1346247 - RNA, 19 nt, Homo sapiens
acccaaggcuuauugauau

SEQ ID NO: 1346248 - RNA, 19 nt, Homo sapiens
aauauucccucuucauuca

SEQ ID NO: 1346249 - RNA, 19 nt, Homo sapiens
cagcuaagccugccacuuc

SEQ ID NO: 1346250 - RNA, 19 nt, Homo sapiens
uaagaaagaacacugugaa

SEQ ID NO: 1346251 - RNA, 19 nt, Homo sapiens
ugacguggucugccuguua

SEQ ID NO: 1346252 - RNA, 19 nt, Homo sapiens
caaagaauuacccucauug

SEQ ID NO: 1346253 - RNA, 19 nt, Homo sapiens
auaaauacccuuggucuuu

SEQ ID NO: 1346254 - RNA, 19 nt, Homo sapiens
aaagaucaauggauguugu

SEQ ID NO: 1346255 - RNA, 19 nt, Homo sapiens
gaacuuuguggaaauuaga

SEQ ID NO: 1346256 - RNA, 19 nt, Homo sapiens
uaaccugaggaaaguauua

SEQ ID NO: 1346257 - RNA, 19 nt, Homo sapiens
caaggcuuauugauauuug

SEQ ID NO: 1346258 - RNA, 19 nt, Homo sapiens
ggugaacuuuguggaaauu

SEQ ID NO: 1346259 - RNA, 19 nt, Homo sapiens
gcacagaugccucuuagcu

SEQ ID NO: 1346260 - RNA, 19 nt, Homo sapiens
ccauuaaguuggauuugga

SEQ ID NO: 1346261 - RNA, 19 nt, Homo sapiens
guggacaacuaagacauuu

SEQ ID NO: 1346262 - RNA, 19 nt, Homo sapiens
gaccuuugauauuuaggaa

SEQ ID NO: 1346263 - RNA, 19 nt, Homo sapiens
gcagcuuccugaucaagau

SEQ ID NO: 1346264 - RNA, 19 nt, Homo sapiens
gcacagagagagaugucuu

SEQ ID NO: 1346265 - RNA, 19 nt, Homo sapiens
gaggaaaucaugaccagau

SEQ ID NO: 1346266 - RNA, 19 nt, Homo sapiens
gacguggucugccuguuau

SEQ ID NO: 1346267 - RNA, 19 nt, Homo sapiens
ggauauaucucugcaucag

SEQ ID NO: 1346268 - RNA, 19 nt, Homo sapiens
gacaauuccagauuaaaga

SEQ ID NO: 1346269 - RNA, 19 nt, Homo sapiens
gugauuggaacccguauaa

SEQ ID NO: 1346270 - RNA, 19 nt, Homo sapiens
gcaaacaaucagagauaug

SEQ ID NO: 1346271 - RNA, 19 nt, Homo sapiens
gcaguuauugacuccauuu

SEQ ID NO: 1346272 - RNA, 19 nt, Homo sapiens
guuaagucauuccauuguu

SEQ ID NO: 1346273 - RNA, 19 nt, Homo sapiens
guucugggccugugaaguu

SEQ ID NO: 1346274 - RNA, 19 nt, Homo sapiens
ugagaacuuugaugaagau

SEQ ID NO: 1346275 - RNA, 19 nt, Homo sapiens
caaaaucaguuuccaaugg

SEQ ID NO: 1346276 - RNA, 19 nt, Homo sapiens
gcuggaauuugaauguuuc

SEQ ID NO: 1346277 - RNA, 19 nt, Homo sapiens
gaacccguauaagaaaugu

SEQ ID NO: 1346278 - RNA, 19 nt, Homo sapiens
cauaugacaauuccagauu

SEQ ID NO: 1346279 - RNA, 19 nt, Homo sapiens
gggcuucuauacuuaaucu

SEQ ID NO: 1346280 - RNA, 19 nt, Homo sapiens
ugugaagccucguuuagga

SEQ ID NO: 1346281 - RNA, 19 nt, Homo sapiens
ugauugggccucauggaua

SEQ ID NO: 1346282 - RNA, 19 nt, Homo sapiens
ucacagguguuucccucuu

SEQ ID NO: 1346283 - RNA, 19 nt, Homo sapiens
ucuguuaagucauuccauu

SEQ ID NO: 1346284 - RNA, 19 nt, Homo sapiens
cacaucaaaucauggaguu

SEQ ID NO: 1346285 - RNA, 19 nt, Homo sapiens
cauuuguacugaagugauu

SEQ ID NO: 1346286 - RNA, 19 nt, Homo sapiens
agugagcuuugauuugaua

SEQ ID NO: 1346287 - RNA, 19 nt, Homo sapiens
ugacauuuguacugaagug

SEQ ID NO: 1346288 - RNA, 19 nt, Homo sapiens
uagcuguuguucuugauga

SEQ ID NO: 1346289 - RNA, 19 nt, Homo sapiens
cauccuggcuccuaucucu

SEQ ID NO: 1346290 - RNA, 19 nt, Homo sapiens
ccugugaaguuuaccauag

SEQ ID NO: 1346291 - RNA, 19 nt, Homo sapiens
gacagucaacgacaaauca

SEQ ID NO: 1346292 - RNA, 19 nt, Homo sapiens
gaaaucaugaccagaucug

SEQ ID NO: 1346293 - RNA, 19 nt, Homo sapiens
caugguaacuucugaaaau

SEQ ID NO: 1346294 - RNA, 19 nt, Homo sapiens
gcuggcuucuauaguguuu

SEQ ID NO: 1346295 - RNA, 19 nt, Homo sapiens
caaacuaugaagacccuaa

SEQ ID NO: 1346296 - RNA, 19 nt, Homo sapiens
gauauuugcggaguugauu

SEQ ID NO: 1346297 - RNA, 19 nt, Homo sapiens
uaguguugaugaagacuuu

SEQ ID NO: 1346298 - RNA, 19 nt, Homo sapiens
cucuacagauaucaaguua

SEQ ID NO: 1346299 - RNA, 19 nt, Homo sapiens
uuaagucauuccauuguuc

SEQ ID NO: 1346300 - RNA, 19 nt, Homo sapiens
gaaaagauaaugugauugg

SEQ ID NO: 1346301 - RNA, 19 nt, Homo sapiens
uagaugauucugaugauga

SEQ ID NO: 1346302 - RNA, 19 nt, Homo sapiens
gaccaucagcaaacaauca

SEQ ID NO: 1346303 - RNA, 19 nt, Homo sapiens
auggugauguguauuguuu

SEQ ID NO: 1346304 - RNA, 19 nt, Homo sapiens
gaaagaucaauggauguug

SEQ ID NO: 1346305 - RNA, 19 nt, Homo sapiens
guuaguggauucagaugag

SEQ ID NO: 1346306 - RNA, 19 nt, Homo sapiens
ggaauuugaauguuucucu

SEQ ID NO: 1346307 - RNA, 19 nt, Homo sapiens
cacagguguuucccucuuu

SEQ ID NO: 1346308 - RNA, 19 nt, Homo sapiens
caucaugcacaucaaauca

SEQ ID NO: 1346309 - RNA, 19 nt, Homo sapiens
ggaaugcuauuuacacaua

SEQ ID NO: 1346310 - RNA, 19 nt, Homo sapiens
ggaauugccuucauagaaa

SEQ ID NO: 1346311 - RNA, 19 nt, Homo sapiens
gggaauaacuuuagaagga

SEQ ID NO: 1346312 - RNA, 19 nt, Homo sapiens
ggagaaagccuaugaaugu

SEQ ID NO: 1346313 - RNA, 19 nt, Homo sapiens
gggaaacccuuuauuugua

SEQ ID NO: 1346314 - RNA, 19 nt, Homo sapiens
ggagagaaacccuauauuu

SEQ ID NO: 1346315 - RNA, 19 nt, Homo sapiens
ggaagugccuuuaggaaga

SEQ ID NO: 1346316 - RNA, 19 nt, Homo sapiens
caacaaauaugggaaauuc

SEQ ID NO: 1346317 - RNA, 19 nt, Homo sapiens
gaagagcuauggacacaga

SEQ ID NO: 1346318 - RNA, 19 nt, Homo sapiens
gaacuagaguaugcccuua

SEQ ID NO: 1346319 - RNA, 19 nt, Homo sapiens
gagagaaacccuauauuug

SEQ ID NO: 1346320 - RNA, 19 nt, Homo sapiens
gaaaguucaucuagaaauc

SEQ ID NO: 1346321 - RNA, 19 nt, Homo sapiens
gaagaagucauaccucauu

SEQ ID NO: 1346322 - RNA, 19 nt, Homo sapiens
ucagagaccucaaacagaa

SEQ ID NO: 1346323 - RNA, 19 nt, Homo sapiens
ggaaacccuuuauuuguau

SEQ ID NO: 1346324 - RNA, 19 nt, Homo sapiens
gggaaacagcuauaaauuu

SEQ ID NO: 1346325 - RNA, 19 nt, Homo sapiens
gggaaagccuucaguagga

SEQ ID NO: 1346326 - RNA, 19 nt, Homo sapiens
gagcaaccauuugaccaua

SEQ ID NO: 1346327 - RNA, 19 nt, Homo sapiens
agagaaaguucaucuagaa

SEQ ID NO: 1346328 - RNA, 19 nt, Homo sapiens
ggaauaacuuuagaaggaa

SEQ ID NO: 1346329 - RNA, 19 nt, Homo sapiens
gcagacaauucagaacuuu

SEQ ID NO: 1346330 - RNA, 19 nt, Homo sapiens
gcaagaaccguauuacaau

SEQ ID NO: 1346331 - RNA, 19 nt, Homo sapiens
gagaagagcuauggacaca

SEQ ID NO: 1346332 - RNA, 19 nt, Homo sapiens
ggaaggcauuuauccagaa

SEQ ID NO: 1346333 - RNA, 19 nt, Homo sapiens
gagaaaccguaucagugua

SEQ ID NO: 1346334 - RNA, 19 nt, Homo sapiens
gaaagaguucucaguggua

SEQ ID NO: 1346335 - RNA, 19 nt, Homo sapiens
gaagggaaacagcuauaaa

SEQ ID NO: 1346336 - RNA, 19 nt, Homo sapiens
cagcuuagggucauaauaa

SEQ ID NO: 1346337 - RNA, 19 nt, Homo sapiens
cguaauauccaacaguuua

SEQ ID NO: 1346338 - RNA, 19 nt, Homo sapiens
gagaaaccauaugaaugua

SEQ ID NO: 1346339 - RNA, 19 nt, Homo sapiens
gaagacaacccucacuguu

SEQ ID NO: 1346340 - RNA, 19 nt, Homo sapiens
agaaaucacuccucaauac

SEQ ID NO: 1346341 - RNA, 19 nt, Homo sapiens
gaacaucagcgaauucaca

SEQ ID NO: 1346342 - RNA, 19 nt, Homo sapiens
ggaaacucaaucaauguua

SEQ ID NO: 1346343 - RNA, 19 nt, Homo sapiens
cagggaaacucaaucaaug

SEQ ID NO: 1346344 - RNA, 19 nt, Homo sapiens
gagcauguguguauucagu

SEQ ID NO: 1346345 - RNA, 19 nt, Homo sapiens
gaguagagguucuuuaaaa

SEQ ID NO: 1346346 - RNA, 19 nt, Homo sapiens
cagaauacauacaggagaa

SEQ ID NO: 1346347 - RNA, 19 nt, Homo sapiens
gagaaacccuauauuugca

SEQ ID NO: 1346348 - RNA, 19 nt, Homo sapiens
gagaaaucacuccucaaua

SEQ ID NO: 1346349 - RNA, 19 nt, Homo sapiens
ggagguaugaacuguauuu

SEQ ID NO: 1346350 - RNA, 19 nt, Homo sapiens
gauucugacuucuaacauu

SEQ ID NO: 1346351 - RNA, 19 nt, Homo sapiens
gguaugaacuguauuucuc

SEQ ID NO: 1346352 - RNA, 19 nt, Homo sapiens
ggaauucaguaaguaaugu

SEQ ID NO: 1346353 - RNA, 19 nt, Homo sapiens
guucaucacagaauacaua

SEQ ID NO: 1346354 - RNA, 19 nt, Homo sapiens
agucauaccucauugauca

SEQ ID NO: 1346355 - RNA, 19 nt, Homo sapiens
cgagaaaccauaugaaugu

SEQ ID NO: 1346356 - RNA, 19 nt, Homo sapiens
gaagugccuuuaggaagaa

SEQ ID NO: 1346357 - RNA, 19 nt, Homo sapiens
gaagucauaccucauugaa

SEQ ID NO: 1346358 - RNA, 19 nt, Homo sapiens
ccaugauucugacuucuaa

SEQ ID NO: 1346359 - RNA, 19 nt, Homo sapiens
ucagaaaacucacaaggua

SEQ ID NO: 1346360 - RNA, 19 nt, Homo sapiens
ggaaagccuucaguaggaa

SEQ ID NO: 1346361 - RNA, 19 nt, Homo sapiens
gaugaaaggaaugcuauuu

SEQ ID NO: 1346362 - RNA, 19 nt, Homo sapiens
gaauauaaaccugauggaa

SEQ ID NO: 1346363 - RNA, 19 nt, Homo sapiens
ggcaagaaccguauuacaa

SEQ ID NO: 1346364 - RNA, 19 nt, Homo sapiens
ggaacaaggagaagagcua

SEQ ID NO: 1346365 - RNA, 19 nt, Homo sapiens
ugaacuguauuucucauug

SEQ ID NO: 1346366 - RNA, 19 nt, Homo sapiens
ugaaaggaaugcuauuuac

SEQ ID NO: 1346367 - RNA, 19 nt, Homo sapiens
cuuauuaccuucaucaugu

SEQ ID NO: 1346368 - RNA, 19 nt, Homo sapiens
agacaacccucacuguuca

SEQ ID NO: 1346369 - RNA, 19 nt, Homo sapiens
gaaaggccuuccgucagaa

SEQ ID NO: 1346370 - RNA, 19 nt, Homo sapiens
ggugaggcuuggacuguuu

SEQ ID NO: 1346371 - RNA, 19 nt, Homo sapiens
gcagggaaacucaaucaau

SEQ ID NO: 1346372 - RNA, 19 nt, Homo sapiens
ugagauaauugacacugaa

SEQ ID NO: 1346373 - RNA, 19 nt, Homo sapiens
gugaguagagguucuuuaa

SEQ ID NO: 1346374 - RNA, 19 nt, Homo sapiens
gaaaggaaugcuauuuaca

SEQ ID NO: 1346375 - RNA, 19 nt, Homo sapiens
gcaaccauuugaccauaau

SEQ ID NO: 1346376 - RNA, 19 nt, Homo sapiens
guaaacaggagcuuauuca

SEQ ID NO: 1346377 - RNA, 19 nt, Homo sapiens
cagugaaucuccauaaaca

SEQ ID NO: 1346378 - RNA, 19 nt, Homo sapiens
gaacuuucaccacaugaga

SEQ ID NO: 1346379 - RNA, 19 nt, Homo sapiens
ccacgggaauucaguaagu

SEQ ID NO: 1346380 - RNA, 19 nt, Homo sapiens
ggagagaaaccguaucagu

SEQ ID NO: 1346381 - RNA, 19 nt, Homo sapiens
agucauaccucauugaaca

SEQ ID NO: 1346382 - RNA, 19 nt, Homo sapiens
ggaaaacuauugccacuuc

SEQ ID NO: 1346383 - RNA, 19 nt, Homo sapiens
acacacacacacacaaaua

SEQ ID NO: 1346384 - RNA, 19 nt, Homo sapiens
uuacagggaugugauguug

SEQ ID NO: 1346385 - RNA, 19 nt, Homo sapiens
gaaggagguaugaacugua

SEQ ID NO: 1346386 - RNA, 19 nt, Homo sapiens
aaagaguucucagugguaa

SEQ ID NO: 1346387 - RNA, 19 nt, Homo sapiens
agauggaauugccuucaua

SEQ ID NO: 1346388 - RNA, 19 nt, Homo sapiens
caucaguaauaacuaguug

SEQ ID NO: 1346389 - RNA, 19 nt, Homo sapiens
cacacacacacaaauauua

SEQ ID NO: 1346390 - RNA, 19 nt, Homo sapiens
gcgagaaaccauaugaaug

SEQ ID NO: 1346391 - RNA, 19 nt, Homo sapiens
gaaacccuauauuugcaau

SEQ ID NO: 1346392 - RNA, 19 nt, Homo sapiens
agacagcccucacccuuca

SEQ ID NO: 1346393 - RNA, 19 nt, Homo sapiens
ccaaguaaucuuauggaaa

SEQ ID NO: 1346394 - RNA, 19 nt, Homo sapiens
gaaucuccauaaacaaaca

SEQ ID NO: 1346395 - RNA, 19 nt, Homo sapiens
gugaaucuccauaaacaaa

SEQ ID NO: 1346396 - RNA, 19 nt, Homo sapiens
cagaacuagucauuagaaa

SEQ ID NO: 1346397 - RNA, 19 nt, Homo sapiens
gaacuguauuucucauugc

SEQ ID NO: 1346398 - RNA, 19 nt, Homo sapiens
gagaaaguucaucuagaaa

SEQ ID NO: 1346399 - RNA, 19 nt, Homo sapiens
guucuucaguuguaaguca

SEQ ID NO: 1346400 - RNA, 19 nt, Homo sapiens
ggaugugacuguggacuuc

SEQ ID NO: 1346401 - RNA, 19 nt, Homo sapiens
gaagucauaccucauugau

SEQ ID NO: 1346402 - RNA, 19 nt, Homo sapiens
aagagaaaguucaucuaga

SEQ ID NO: 1346403 - RNA, 19 nt, Homo sapiens
guucaucaguaauaacuag

SEQ ID NO: 1346404 - RNA, 19 nt, Homo sapiens
gaaguucaaagaauaccaa

SEQ ID NO: 1346405 - RNA, 19 nt, Homo sapiens
ggcagacaauucagaacuu

SEQ ID NO: 1346406 - RNA, 19 nt, Homo sapiens
gcauguguguauucaguca

SEQ ID NO: 1346407 - RNA, 19 nt, Homo sapiens
guuguuaccuccucacagu

SEQ ID NO: 1346408 - RNA, 19 nt, Homo sapiens
uaguaaacccuguagauga

SEQ ID NO: 1346409 - RNA, 19 nt, Homo sapiens
gaacaacuaugcccugaau

SEQ ID NO: 1346410 - RNA, 19 nt, Homo sapiens
gaacagcccauucauuuau

SEQ ID NO: 1346411 - RNA, 19 nt, Homo sapiens
gaaggaagccaccagcuau

SEQ ID NO: 1346412 - RNA, 19 nt, Homo sapiens
ggaaggaagccaccagcua

SEQ ID NO: 1346413 - RNA, 19 nt, Homo sapiens
ccugugaccuuaucccuuu

SEQ ID NO: 1346414 - RNA, 19 nt, Homo sapiens
ugacacauguagacuaaau

SEQ ID NO: 1346415 - RNA, 19 nt, Homo sapiens
cuucuuggcuucugauauu

SEQ ID NO: 1346416 - RNA, 19 nt, Homo sapiens
gccaccagcuaucccaaua

SEQ ID NO: 1346417 - RNA, 19 nt, Homo sapiens
caccaggaguggccaagua

SEQ ID NO: 1346418 - RNA, 19 nt, Homo sapiens
ggagugacccugcccauca

SEQ ID NO: 1346419 - RNA, 19 nt, Homo sapiens
accgacauauucaguauua

SEQ ID NO: 1346420 - RNA, 19 nt, Homo sapiens
ggaccuuaauguacacaga

SEQ ID NO: 1346421 - RNA, 19 nt, Homo sapiens
cagcaaagcaggugacuuc

SEQ ID NO: 1346422 - RNA, 19 nt, Homo sapiens
gugggaacauugugacauu

SEQ ID NO: 1346423 - RNA, 19 nt, Homo sapiens
ggacuccucuuucccacau

SEQ ID NO: 1346424 - RNA, 19 nt, Homo sapiens
ccaaggaggcuuuguuuua

SEQ ID NO: 1346425 - RNA, 19 nt, Homo sapiens
gagcugaggucgugcuacu

SEQ ID NO: 1346426 - RNA, 19 nt, Homo sapiens
gcaggagaaucacuugaac

SEQ ID NO: 1346427 - RNA, 19 nt, Homo sapiens
gaaaccccaucucuacuaa

SEQ ID NO: 1346428 - RNA, 19 nt, Homo sapiens
ucagaugcuucuauccauu

SEQ ID NO: 1346429 - RNA, 19 nt, Homo sapiens
gguucuaccuccucaugaa

SEQ ID NO: 1346430 - RNA, 19 nt, Homo sapiens
ccauugcuuucugugauua

SEQ ID NO: 1346431 - RNA, 19 nt, Homo sapiens
acugacacauguagacuaa

SEQ ID NO: 1346432 - RNA, 19 nt, Homo sapiens
gaagcugacugcgaacuac

SEQ ID NO: 1346433 - RNA, 19 nt, Homo sapiens
aaagucagaugcuucuauc

SEQ ID NO: 1346434 - RNA, 19 nt, Homo sapiens
ugaacaucaucacucagua

SEQ ID NO: 1346435 - RNA, 19 nt, Homo sapiens
guaacgugaucuuccuaga

SEQ ID NO: 1346436 - RNA, 19 nt, Homo sapiens
agaccaaucuggccaacau

SEQ ID NO: 1346437 - RNA, 19 nt, Homo sapiens
ugagguggguguaucacuu

SEQ ID NO: 1346438 - RNA, 19 nt, Homo sapiens
cagcagcaccuuacaguca

SEQ ID NO: 1346439 - RNA, 19 nt, Homo sapiens
gaacaucaucacucaguac

SEQ ID NO: 1346440 - RNA, 19 nt, Homo sapiens
ugacagugcagcaagacua

SEQ ID NO: 1346441 - RNA, 19 nt, Homo sapiens
guaaaccgagacaccagua

SEQ ID NO: 1346442 - RNA, 19 nt, Homo sapiens
uuaccgacauauucaguau

SEQ ID NO: 1346443 - RNA, 19 nt, Homo sapiens
ccaugcaguucuauucaau

SEQ ID NO: 1346444 - RNA, 19 nt, Homo sapiens
caaggaggcuuuguuuuau

SEQ ID NO: 1346445 - RNA, 19 nt, Homo sapiens
ccauugcccuggugucugu

SEQ ID NO: 1346446 - RNA, 19 nt, Homo sapiens
gcaguaacgugaucuuccu

SEQ ID NO: 1346447 - RNA, 19 nt, Homo sapiens
caccuuguuugucuucauu

SEQ ID NO: 1346448 - RNA, 19 nt, Homo sapiens
gaagcugauuugggaagga

SEQ ID NO: 1346449 - RNA, 19 nt, Homo sapiens
gagaugaagguugcaguga

SEQ ID NO: 1346450 - RNA, 19 nt, Homo sapiens
ggaggggacuucucacguu

SEQ ID NO: 1346451 - RNA, 19 nt, Homo sapiens
cagaaggacagcaagaaga

SEQ ID NO: 1346452 - RNA, 19 nt, Homo sapiens
ugagugagaaugauggauu

SEQ ID NO: 1346453 - RNA, 19 nt, Homo sapiens
ugagcguggugaacaacua

SEQ ID NO: 1346454 - RNA, 19 nt, Homo sapiens
ucaaauauaccuccauugc

SEQ ID NO: 1346455 - RNA, 19 nt, Homo sapiens
gucaggaguucaagaccaa

SEQ ID NO: 1346456 - RNA, 19 nt, Homo sapiens
gaagaacugaggccugucu

SEQ ID NO: 1346457 - RNA, 19 nt, Homo sapiens
ggacagcaagaagaacuga

SEQ ID NO: 1346458 - RNA, 19 nt, Homo sapiens
agaaggacagcaagaagaa

SEQ ID NO: 1346459 - RNA, 19 nt, Homo sapiens
gcauuuguguggugguuac

SEQ ID NO: 1346460 - RNA, 19 nt, Homo sapiens
caguccagcuugagugaga

SEQ ID NO: 1346461 - RNA, 19 nt, Homo sapiens
gcacuuuuaugucagcaaa

SEQ ID NO: 1346462 - RNA, 19 nt, Homo sapiens
ggaacauugugacauuugc

SEQ ID NO: 1346463 - RNA, 19 nt, Homo sapiens
ggcaggagaaucacuugaa

SEQ ID NO: 1346464 - RNA, 19 nt, Homo sapiens
ugauggcgcaugccuguaa

SEQ ID NO: 1346465 - RNA, 19 nt, Homo sapiens
acagcccauucauuuauuu

SEQ ID NO: 1346466 - RNA, 19 nt, Homo sapiens
gggaacauugugacauuug

SEQ ID NO: 1346467 - RNA, 19 nt, Homo sapiens
gcaccuuguuugucuucau

SEQ ID NO: 1346468 - RNA, 19 nt, Homo sapiens
gacacauguagacuaaaua

SEQ ID NO: 1346469 - RNA, 19 nt, Homo sapiens
gaccaugcaguucuauuca

SEQ ID NO: 1346470 - RNA, 19 nt, Homo sapiens
ucuaauugccaacaugauu

SEQ ID NO: 1346471 - RNA, 19 nt, Homo sapiens
caccagcuaucccaauaag

SEQ ID NO: 1346472 - RNA, 19 nt, Homo sapiens
gagcugauucccagugaca

SEQ ID NO: 1346473 - RNA, 19 nt, Homo sapiens
gaacaaaaggcuuacuauc

SEQ ID NO: 1346474 - RNA, 19 nt, Homo sapiens
guguggugguuacuaggua

SEQ ID NO: 1346475 - RNA, 19 nt, Homo sapiens
gcccugaaucucaacauug

SEQ ID NO: 1346476 - RNA, 19 nt, Homo sapiens
cgaagcugacugcgaacua

SEQ ID NO: 1346477 - RNA, 19 nt, Homo sapiens
gcccauucauuuauuucug

SEQ ID NO: 1346478 - RNA, 19 nt, Homo sapiens
gagguggguguaucacuug

SEQ ID NO: 1346479 - RNA, 19 nt, Homo sapiens
cagcuaucccaauaaggua

SEQ ID NO: 1346480 - RNA, 19 nt, Homo sapiens
ccagcuaucccaauaaggu

SEQ ID NO: 1346481 - RNA, 19 nt, Homo sapiens
gagugacccugcccaucau

SEQ ID NO: 1346482 - RNA, 19 nt, Homo sapiens
gauggcgcaugccuguaau

SEQ ID NO: 1346483 - RNA, 19 nt, Homo sapiens
ggaguacguagaccagugu

SEQ ID NO: 1346484 - RNA, 19 nt, Homo sapiens
ugucuucauugggaccuua

SEQ ID NO: 1346485 - RNA, 19 nt, Homo sapiens
uuaugaccaugcaguucua

SEQ ID NO: 1346486 - RNA, 19 nt, Homo sapiens
ccaccagcuaucccaauaa

SEQ ID NO: 1346487 - RNA, 19 nt, Homo sapiens
gaacauugugacauuugca

SEQ ID NO: 1346488 - RNA, 19 nt, Homo sapiens
cagaugcuucuauccauug

SEQ ID NO: 1346489 - RNA, 19 nt, Homo sapiens
gauugucccuucucuugcu

SEQ ID NO: 1346490 - RNA, 19 nt, Homo sapiens
ggugggacccugugaaggu

SEQ ID NO: 1346491 - RNA, 19 nt, Homo sapiens
ugaccaugcaguucuauuc

SEQ ID NO: 1346492 - RNA, 19 nt, Homo sapiens
gagcguggugaacaacuau

SEQ ID NO: 1346493 - RNA, 19 nt, Homo sapiens
aacagcccauucauuuauu

SEQ ID NO: 1346494 - RNA, 19 nt, Homo sapiens
ccucaggccuaaaauagaa

SEQ ID NO: 1346495 - RNA, 19 nt, Homo sapiens
cgucgcauccugagguaaa

SEQ ID NO: 1346496 - RNA, 19 nt, Homo sapiens
ugggaacauugugacauuu

SEQ ID NO: 1346497 - RNA, 19 nt, Homo sapiens
gccaacaugauucuaggaa

SEQ ID NO: 1346498 - RNA, 19 nt, Homo sapiens
aaaauuagcugggugugau

SEQ ID NO: 1346499 - RNA, 19 nt, Homo sapiens
acuaugcccugaaucucaa

SEQ ID NO: 1346500 - RNA, 19 nt, Homo sapiens
gucagaugcuucuauccau

SEQ ID NO: 1346501 - RNA, 19 nt, Homo sapiens
cagugacagugcagcaaga

SEQ ID NO: 1346502 - RNA, 19 nt, Homo sapiens
uaaaccgagacaccaguaa

SEQ ID NO: 1346503 - RNA, 19 nt, Homo sapiens
gcugcaggcaccacuauca

SEQ ID NO: 1346504 - RNA, 19 nt, Homo sapiens
acacauguagacuaaauag

SEQ ID NO: 1346505 - RNA, 19 nt, Homo sapiens
uggcuucugauauuuauga

SEQ ID NO: 1346506 - RNA, 19 nt, Homo sapiens
acaaaaggcuuacuaucca

SEQ ID NO: 1346507 - RNA, 19 nt, Homo sapiens
cccauucauuuauuucugu

SEQ ID NO: 1346508 - RNA, 19 nt, Homo sapiens
cgucgugacccuacgcaaa

SEQ ID NO: 1346509 - RNA, 19 nt, Homo sapiens
gaacuagucuucuguguaa

SEQ ID NO: 1346510 - RNA, 19 nt, Homo sapiens
ggagggcgguggucuguua

SEQ ID NO: 1346511 - RNA, 19 nt, Homo sapiens
gaaauucguugccaaagau

SEQ ID NO: 1346512 - RNA, 19 nt, Homo sapiens
gcuaggaacucauggaaug

SEQ ID NO: 1346513 - RNA, 19 nt, Homo sapiens
ggacagagacaccgaagga

SEQ ID NO: 1346514 - RNA, 19 nt, Homo sapiens
gagcugaacggccuuaaga

SEQ ID NO: 1346515 - RNA, 19 nt, Homo sapiens
gaaaguuccuacucgucaa

SEQ ID NO: 1346516 - RNA, 19 nt, Homo sapiens
gcagaaauucguugccaaa

SEQ ID NO: 1346517 - RNA, 19 nt, Homo sapiens
ggcagaagcuguccaaacu

SEQ ID NO: 1346518 - RNA, 19 nt, Homo sapiens
ucaaccaucugcuucaaau

SEQ ID NO: 1346519 - RNA, 19 nt, Homo sapiens
agggagagaagcaauauua

SEQ ID NO: 1346520 - RNA, 19 nt, Homo sapiens
agaaauucguugccaaaga

SEQ ID NO: 1346521 - RNA, 19 nt, Homo sapiens
gcaaggaggcagcgacuuc

SEQ ID NO: 1346522 - RNA, 19 nt, Homo sapiens
ggaguaagcagggagagaa

SEQ ID NO: 1346523 - RNA, 19 nt, Homo sapiens
gaggaucgccuguaacuac

SEQ ID NO: 1346524 - RNA, 19 nt, Homo sapiens
gagagaagcaauauuacuc

SEQ ID NO: 1346525 - RNA, 19 nt, Homo sapiens
ggaagaccgugugcgugaa

SEQ ID NO: 1346526 - RNA, 19 nt, Homo sapiens
ucaaauggccaaagcuguu

SEQ ID NO: 1346527 - RNA, 19 nt, Homo sapiens
gcccugccauggacagaaa

SEQ ID NO: 1346528 - RNA, 19 nt, Homo sapiens
gcccuaagcaucaccagaa

SEQ ID NO: 1346529 - RNA, 19 nt, Homo sapiens
ugagaucccugcccacucu

SEQ ID NO: 1346530 - RNA, 19 nt, Homo sapiens
gcucaaccaucugcuucaa

SEQ ID NO: 1346531 - RNA, 19 nt, Homo sapiens
aaacugaggcuaaacaaac

SEQ ID NO: 1346532 - RNA, 19 nt, Homo sapiens
gcagggagagaagcaauau

SEQ ID NO: 1346533 - RNA, 19 nt, Homo sapiens
caaagcuguucacgucugu

SEQ ID NO: 1346534 - RNA, 19 nt, Homo sapiens
agucuucuguguaaacuga

SEQ ID NO: 1346535 - RNA, 19 nt, Homo sapiens
cgaggcugcuucgcacuuu

SEQ ID NO: 1346536 - RNA, 19 nt, Homo sapiens
cgagggacgugccaagaag

SEQ ID NO: 1346537 - RNA, 19 nt, Homo sapiens
acaauaaccaccaggauuc

SEQ ID NO: 1346538 - RNA, 19 nt, Homo sapiens
ggagagaagcaauauuacu

SEQ ID NO: 1346539 - RNA, 19 nt, Homo sapiens
gaacggcuauaaaacuuuc

SEQ ID NO: 1346540 - RNA, 19 nt, Homo sapiens
caaagaugagucagugguu

SEQ ID NO: 1346541 - RNA, 19 nt, Homo sapiens
gcaggugccgugcuacuca

SEQ ID NO: 1346542 - RNA, 19 nt, Homo sapiens
uguguaaacugaggcuaaa

SEQ ID NO: 1346543 - RNA, 19 nt, Homo sapiens
uaaacugaggcuaaacaaa

SEQ ID NO: 1346544 - RNA, 19 nt, Homo sapiens
acagagacaccgaaggaaa

SEQ ID NO: 1346545 - RNA, 19 nt, Homo sapiens
uacaauaaccaccaggauu

SEQ ID NO: 1346546 - RNA, 19 nt, Homo sapiens
guaaacugaggcuaaacaa

SEQ ID NO: 1346547 - RNA, 19 nt, Homo sapiens
cagagacaccgaaggaaau

SEQ ID NO: 1346548 - RNA, 19 nt, Homo sapiens
gcagcuaccuaugggucuu

SEQ ID NO: 1346549 - RNA, 19 nt, Homo sapiens
gagugcaagacaagccuua

SEQ ID NO: 1346550 - RNA, 19 nt, Homo sapiens
gcgaacggcuauaaaacuu

SEQ ID NO: 1346551 - RNA, 19 nt, Homo sapiens
gaaguaaaagccccaaaau

SEQ ID NO: 1346552 - RNA, 19 nt, Homo sapiens
gccagccucuccucacugu

SEQ ID NO: 1346553 - RNA, 19 nt, Homo sapiens
uggcugaccuugacuacag

SEQ ID NO: 1346554 - RNA, 19 nt, Homo sapiens
aaccaucugcuucaaauug

SEQ ID NO: 1346555 - RNA, 19 nt, Homo sapiens
cgucugugcucaaccaucu

SEQ ID NO: 1346556 - RNA, 19 nt, Homo sapiens
ucacgucugugcucaacca

SEQ ID NO: 1346557 - RNA, 19 nt, Homo sapiens
cuguccagcugcagaaauu

SEQ ID NO: 1346558 - RNA, 19 nt, Homo sapiens
ugaacggccuuaagaagcu

SEQ ID NO: 1346559 - RNA, 19 nt, Homo sapiens
gcugaacggccuuaagaag

SEQ ID NO: 1346560 - RNA, 19 nt, Homo sapiens
ggaggcagcgacuucagau

SEQ ID NO: 1346561 - RNA, 19 nt, Homo sapiens
gcagcgacuucagaugaca

SEQ ID NO: 1346562 - RNA, 19 nt, Homo sapiens
gaaaugggguggugaaacc

SEQ ID NO: 1346563 - RNA, 19 nt, Homo sapiens
gggcagaagcuguccaaac

SEQ ID NO: 1346564 - RNA, 19 nt, Homo sapiens
gaggcuaaacaaacacaga

SEQ ID NO: 1346565 - RNA, 19 nt, Homo sapiens
gaggcugcuucgcacuuug

SEQ ID NO: 1346566 - RNA, 19 nt, Homo sapiens
aggcagcgacuucagauga

SEQ ID NO: 1346567 - RNA, 19 nt, Homo sapiens
ggucaucuuggcccucuga

SEQ ID NO: 1346568 - RNA, 19 nt, Homo sapiens
gaagaccgugugcgugaag

SEQ ID NO: 1346569 - RNA, 19 nt, Homo sapiens
caagaagcgcaaggaguga

SEQ ID NO: 1346570 - RNA, 19 nt, Homo sapiens
gugccgugcuacucauaug

SEQ ID NO: 1346571 - RNA, 19 nt, Homo sapiens
gaagcgggagagccagaga

SEQ ID NO: 1346572 - RNA, 19 nt, Homo sapiens
gcagaagcuguccaaacug

SEQ ID NO: 1346573 - RNA, 19 nt, Homo sapiens
caaccaucugcuucaaauu

SEQ ID NO: 1346574 - RNA, 19 nt, Homo sapiens
cuaaacaaacacagaugga

SEQ ID NO: 1346575 - RNA, 19 nt, Homo sapiens
agaccaaggccaccacugu

SEQ ID NO: 1346576 - RNA, 19 nt, Homo sapiens
gccccaaaaugucaagaaa

SEQ ID NO: 1346577 - RNA, 19 nt, Homo sapiens
aguaaaagccccaaaaugu

SEQ ID NO: 1346578 - RNA, 19 nt, Homo sapiens
caaauggccaaagcuguuc

SEQ ID NO: 1346579 - RNA, 19 nt, Homo sapiens
uaaaagccccaaaauguca

SEQ ID NO: 1346580 - RNA, 19 nt, Homo sapiens
gugcucaaauggccaaagc

SEQ ID NO: 1346581 - RNA, 19 nt, Homo sapiens
ccacuguccagcugcagaa

SEQ ID NO: 1346582 - RNA, 19 nt, Homo sapiens
guaagcagggagagaagca

SEQ ID NO: 1346583 - RNA, 19 nt, Homo sapiens
cuacucauaugggcagaag

SEQ ID NO: 1346584 - RNA, 19 nt, Homo sapiens
caccguugcucugugacuu

SEQ ID NO: 1346585 - RNA, 19 nt, Homo sapiens
caaggaggcagcgacuuca

SEQ ID NO: 1346586 - RNA, 19 nt, Homo sapiens
ccgagggacgugccaagaa

SEQ ID NO: 1346587 - RNA, 19 nt, Homo sapiens
ucgaggcgcucaggaagca

SEQ ID NO: 1346588 - RNA, 19 nt, Homo sapiens
ggaaagaccuuacaauugu

SEQ ID NO: 1346589 - RNA, 19 nt, Homo sapiens
gaacugaccucaagugauc

SEQ ID NO: 1346590 - RNA, 19 nt, Homo sapiens
ggaguuagguggcaugauu

SEQ ID NO: 1346591 - RNA, 19 nt, Homo sapiens
gagaaaggccuuaugagua

SEQ ID NO: 1346592 - RNA, 19 nt, Homo sapiens
gaggaguggugucuucuua

SEQ ID NO: 1346593 - RNA, 19 nt, Homo sapiens
ggagaaaugucaucccuau

SEQ ID NO: 1346594 - RNA, 19 nt, Homo sapiens
gaacaggaguggagcaugu

SEQ ID NO: 1346595 - RNA, 19 nt, Homo sapiens
ugacaaacauggagaaaug

SEQ ID NO: 1346596 - RNA, 19 nt, Homo sapiens
gaaugcaguuguucaugua

SEQ ID NO: 1346597 - RNA, 19 nt, Homo sapiens
gagaaaggccuuaugaaug

SEQ ID NO: 1346598 - RNA, 19 nt, Homo sapiens
ugagguaugugggaaauua

SEQ ID NO: 1346599 - RNA, 19 nt, Homo sapiens
agagagagcuuaucacugu

SEQ ID NO: 1346600 - RNA, 19 nt, Homo sapiens
cgaaagagcagccuuauuc

SEQ ID NO: 1346601 - RNA, 19 nt, Homo sapiens
ugagucacgugauagauua

SEQ ID NO: 1346602 - RNA, 19 nt, Homo sapiens
cagaguagcuggaaauaca

SEQ ID NO: 1346603 - RNA, 19 nt, Homo sapiens
ggagaaaggccuuaugaau

SEQ ID NO: 1346604 - RNA, 19 nt, Homo sapiens
gagaaaggccguaugaaug

SEQ ID NO: 1346605 - RNA, 19 nt, Homo sapiens
gagaaaggccuuacaagug

SEQ ID NO: 1346606 - RNA, 19 nt, Homo sapiens
ccaaagugcugaaauuaca

SEQ ID NO: 1346607 - RNA, 19 nt, Homo sapiens
gggaaagaccuuacaauug

SEQ ID NO: 1346608 - RNA, 19 nt, Homo sapiens
ggagaaaggccguaugaau

SEQ ID NO: 1346609 - RNA, 19 nt, Homo sapiens
gaaccuggcucucauaucc

SEQ ID NO: 1346610 - RNA, 19 nt, Homo sapiens
gcaccaccaugccuggaua

SEQ ID NO: 1346611 - RNA, 19 nt, Homo sapiens
gggcagguguuucuccuaa

SEQ ID NO: 1346612 - RNA, 19 nt, Homo sapiens
caugaugccuggugacaaa

SEQ ID NO: 1346613 - RNA, 19 nt, Homo sapiens
gccaaacuaugacuuaaga

SEQ ID NO: 1346614 - RNA, 19 nt, Homo sapiens
uagggaaugugggaaauua

SEQ ID NO: 1346615 - RNA, 19 nt, Homo sapiens
agaagaagcugcuguagag

SEQ ID NO: 1346616 - RNA, 19 nt, Homo sapiens
agagaagcaucguuuguaa

SEQ ID NO: 1346617 - RNA, 19 nt, Homo sapiens
caacauugauagcccuuug

SEQ ID NO: 1346618 - RNA, 19 nt, Homo sapiens
gcucugcgcuucauguuca

SEQ ID NO: 1346619 - RNA, 19 nt, Homo sapiens
agaaaggccuuacaagugu

SEQ ID NO: 1346620 - RNA, 19 nt, Homo sapiens
gggaguaugguuaguauuu

SEQ ID NO: 1346621 - RNA, 19 nt, Homo sapiens
guagguauguuucacuaug

SEQ ID NO: 1346622 - RNA, 19 nt, Homo sapiens
gcagggcacugugaccuuu

SEQ ID NO: 1346623 - RNA, 19 nt, Homo sapiens
ggagaaaggccuuaugagu

SEQ ID NO: 1346624 - RNA, 19 nt, Homo sapiens
gagaaugugggaaaucuuu

SEQ ID NO: 1346625 - RNA, 19 nt, Homo sapiens
ggagaaaggccuuacaagu

SEQ ID NO: 1346626 - RNA, 19 nt, Homo sapiens
gagaaugugggaaaucuuu

SEQ ID NO: 1346627 - RNA, 19 nt, Homo sapiens
gagagugugggaaaucuua

SEQ ID NO: 1346628 - RNA, 19 nt, Homo sapiens
gcagguguuucuccuaaga

SEQ ID NO: 1346629 - RNA, 19 nt, Homo sapiens
gaauuucuguacaaagaga

SEQ ID NO: 1346630 - RNA, 19 nt, Homo sapiens
ggaccauccugcucucuau

SEQ ID NO: 1346631 - RNA, 19 nt, Homo sapiens
caccuggccuucauucuuu

SEQ ID NO: 1346632 - RNA, 19 nt, Homo sapiens
gcucuacccuccuucauca

SEQ ID NO: 1346633 - RNA, 19 nt, Homo sapiens
caaggaaugugggaaauca

SEQ ID NO: 1346634 - RNA, 19 nt, Homo sapiens
gaaaauccuuuagcagaua

SEQ ID NO: 1346635 - RNA, 19 nt, Homo sapiens
gauguuaugugugcaguga

SEQ ID NO: 1346636 - RNA, 19 nt, Homo sapiens
gagggaguaugguuaguau

SEQ ID NO: 1346637 - RNA, 19 nt, Homo sapiens
ccaggaaacucaucacaag

SEQ ID NO: 1346638 - RNA, 19 nt, Homo sapiens
augaagaucugagguauaa

SEQ ID NO: 1346639 - RNA, 19 nt, Homo sapiens
cugaaagccuuaucaaaug

SEQ ID NO: 1346640 - RNA, 19 nt, Homo sapiens
ggaguaugguuaguauuug

SEQ ID NO: 1346641 - RNA, 19 nt, Homo sapiens
guauaucuaucuaccauca

SEQ ID NO: 1346642 - RNA, 19 nt, Homo sapiens
ggagaaaggcccuaugagu

SEQ ID NO: 1346643 - RNA, 19 nt, Homo sapiens
cagaaagagugucagagaa

SEQ ID NO: 1346644 - RNA, 19 nt, Homo sapiens
gaguaugguuaguauuuga

SEQ ID NO: 1346645 - RNA, 19 nt, Homo sapiens
aagcaucguuuguaaagaa

SEQ ID NO: 1346646 - RNA, 19 nt, Homo sapiens
ggaugacacugcauaccuu

SEQ ID NO: 1346647 - RNA, 19 nt, Homo sapiens
guuaugaacugaccucaag

SEQ ID NO: 1346648 - RNA, 19 nt, Homo sapiens
uaugucagcuucaguaauc

SEQ ID NO: 1346649 - RNA, 19 nt, Homo sapiens
ccaagagggaguaugguua

SEQ ID NO: 1346650 - RNA, 19 nt, Homo sapiens
agaaaggccuuaugaguac

SEQ ID NO: 1346651 - RNA, 19 nt, Homo sapiens
agaaaggccuuaugaaugc

SEQ ID NO: 1346652 - RNA, 19 nt, Homo sapiens
uuacaaguguggagaaugu

SEQ ID NO: 1346653 - RNA, 19 nt, Homo sapiens
agagauggauguuaugugu

SEQ ID NO: 1346654 - RNA, 19 nt, Homo sapiens
ccuagaagguggagaggaa

SEQ ID NO: 1346655 - RNA, 19 nt, Homo sapiens
ggauggaucaccugacgua

SEQ ID NO: 1346656 - RNA, 19 nt, Homo sapiens
caccaugccuggauaacuu

SEQ ID NO: 1346657 - RNA, 19 nt, Homo sapiens
ggccagaccuccucucuac

SEQ ID NO: 1346658 - RNA, 19 nt, Homo sapiens
gaaagagcagccuuauuca

SEQ ID NO: 1346659 - RNA, 19 nt, Homo sapiens
gcaccaaacacucaguuau

SEQ ID NO: 1346660 - RNA, 19 nt, Homo sapiens
ggaguggugucuucuuagu

SEQ ID NO: 1346661 - RNA, 19 nt, Homo sapiens
gagaagacagacagugaaa

SEQ ID NO: 1346662 - RNA, 19 nt, Homo sapiens
ggaaaaccccauagcuuua

SEQ ID NO: 1346663 - RNA, 19 nt, Homo sapiens
ccugaaagccuuaucaaau

SEQ ID NO: 1346664 - RNA, 19 nt, Homo sapiens
cgugauagauuaaaguaca

SEQ ID NO: 1346665 - RNA, 19 nt, Homo sapiens
gcaccuggccuucauucuu

SEQ ID NO: 1346666 - RNA, 19 nt, Homo sapiens
gaucccaccucacugaaca

SEQ ID NO: 1346667 - RNA, 19 nt, Homo sapiens
ccaagaagaagcugcugua

SEQ ID NO: 1346668 - RNA, 19 nt, Homo sapiens
guaugaagaucugagguau

SEQ ID NO: 1346669 - RNA, 19 nt, Homo sapiens
gggaaugugggaaaucuuu

SEQ ID NO: 1346670 - RNA, 19 nt, Homo sapiens
ugaaauguguggccucauc

SEQ ID NO: 1346671 - RNA, 19 nt, Homo sapiens
gcacugugaccuuugaaga

SEQ ID NO: 1346672 - RNA, 19 nt, Homo sapiens
gcgaagcucuacccuccuu

SEQ ID NO: 1346673 - RNA, 19 nt, Homo sapiens
gaagacagacagugaaacu

SEQ ID NO: 1346674 - RNA, 19 nt, Homo sapiens
caucaguguccaagaauuu

SEQ ID NO: 1346675 - RNA, 19 nt, Homo sapiens
guacagaucccaccucacu

SEQ ID NO: 1346676 - RNA, 19 nt, Homo sapiens
gaagcaucguuuguaaaga

SEQ ID NO: 1346677 - RNA, 19 nt, Homo sapiens
caaugacuacccaccuuua

SEQ ID NO: 1346678 - RNA, 19 nt, Homo sapiens
uaccaucaguguccaagaa

SEQ ID NO: 1346679 - RNA, 19 nt, Homo sapiens
uuuaagcaaugccaaacua

SEQ ID NO: 1346680 - RNA, 19 nt, Homo sapiens
agauguggcugugaacuuu

SEQ ID NO: 1346681 - RNA, 19 nt, Homo sapiens
guuccagucucauuaaaca

SEQ ID NO: 1346682 - RNA, 19 nt, Homo sapiens
cacuagagauggauguuau

SEQ ID NO: 1346683 - RNA, 19 nt, Homo sapiens
gacagacagugaaacuaug

SEQ ID NO: 1346684 - RNA, 19 nt, Homo sapiens
gagaagcaucguuuguaaa

SEQ ID NO: 1346685 - RNA, 19 nt, Homo sapiens
cagagaagcaucguuugua

SEQ ID NO: 1346686 - RNA, 19 nt, Homo sapiens
ggugugaccuacugugcuu

SEQ ID NO: 1346687 - RNA, 19 nt, Homo sapiens
gugccugagucacgugaua

SEQ ID NO: 1346688 - RNA, 19 nt, Homo sapiens
guggaaagcuggagacuga

SEQ ID NO: 1346689 - RNA, 19 nt, Homo sapiens
cacccaaacuuguauauuu

SEQ ID NO: 1346690 - RNA, 19 nt, Homo sapiens
ggaagucacugggcccaaa

SEQ ID NO: 1346691 - RNA, 19 nt, Homo sapiens
cagugggccugcaaucuua

SEQ ID NO: 1346692 - RNA, 19 nt, Homo sapiens
aaacaggaaugguucuuuc

SEQ ID NO: 1346693 - RNA, 19 nt, Homo sapiens
gcagacagcggccuggauu

SEQ ID NO: 1346694 - RNA, 19 nt, Homo sapiens
ggugaagaccacucugaua

SEQ ID NO: 1346695 - RNA, 19 nt, Homo sapiens
gcccaugccuuccuuuauc

SEQ ID NO: 1346696 - RNA, 19 nt, Homo sapiens
aaacgaagagaaagaagaa

SEQ ID NO: 1346697 - RNA, 19 nt, Homo sapiens
uggaguaucucaucaacga

SEQ ID NO: 1346698 - RNA, 19 nt, Homo sapiens
gaaacaggcgcaccagagu

SEQ ID NO: 1346699 - RNA, 19 nt, Homo sapiens
gaucaaggcagggaaagau

SEQ ID NO: 1346700 - RNA, 19 nt, Homo sapiens
gagagagaaaccacucaaa

SEQ ID NO: 1346701 - RNA, 19 nt, Homo sapiens
ggacgccuaugccgagaag

SEQ ID NO: 1346702 - RNA, 19 nt, Homo sapiens
ucacuggaguaucucauca

SEQ ID NO: 1346703 - RNA, 19 nt, Homo sapiens
gugaagaccacucugauag

SEQ ID NO: 1346704 - RNA, 19 nt, Homo sapiens
ggagagagaaaccacucaa

SEQ ID NO: 1346705 - RNA, 19 nt, Homo sapiens
gcacagucaauggcuauga

SEQ ID NO: 1346706 - RNA, 19 nt, Homo sapiens
ccaacuccuuuccugcaaa

SEQ ID NO: 1346707 - RNA, 19 nt, Homo sapiens
ggagcucccugaccauagg

SEQ ID NO: 1346708 - RNA, 19 nt, Homo sapiens
caaggagacaccacuuuca

SEQ ID NO: 1346709 - RNA, 19 nt, Homo sapiens
gccuacccgucuacagaua

SEQ ID NO: 1346710 - RNA, 19 nt, Homo sapiens
ccaaggagacaccacuuuc

SEQ ID NO: 1346711 - RNA, 19 nt, Homo sapiens
gcagaggcagggagagaga

SEQ ID NO: 1346712 - RNA, 19 nt, Homo sapiens
ccauuauauucuacuguga

SEQ ID NO: 1346713 - RNA, 19 nt, Homo sapiens
gacaccacuuucacccaaa

SEQ ID NO: 1346714 - RNA, 19 nt, Homo sapiens
ugaagaccacucugauaga

SEQ ID NO: 1346715 - RNA, 19 nt, Homo sapiens
uggaagcgguacuguaucu

SEQ ID NO: 1346716 - RNA, 19 nt, Homo sapiens
ccacuuucacccaaacuug

SEQ ID NO: 1346717 - RNA, 19 nt, Homo sapiens
caccguaggccaguacuuu

SEQ ID NO: 1346718 - RNA, 19 nt, Homo sapiens
ggaggccgauaggaaguca

SEQ ID NO: 1346719 - RNA, 19 nt, Homo sapiens
ccgagaagguggccaacag

SEQ ID NO: 1346720 - RNA, 19 nt, Homo sapiens
gaagcgguacuguaucucu

SEQ ID NO: 1346721 - RNA, 19 nt, Homo sapiens
gcugcuggguacaguuguu

SEQ ID NO: 1346722 - RNA, 19 nt, Homo sapiens
ccaccagcaugcccacauc

SEQ ID NO: 1346723 - RNA, 19 nt, Homo sapiens
ucuggaagcgguacuguau

SEQ ID NO: 1346724 - RNA, 19 nt, Homo sapiens
caacuccuuuccugcaaac

SEQ ID NO: 1346725 - RNA, 19 nt, Homo sapiens
gcagggcaaccucacauac

SEQ ID NO: 1346726 - RNA, 19 nt, Homo sapiens
uacaggaggccgauaggaa

SEQ ID NO: 1346727 - RNA, 19 nt, Homo sapiens
cagacagcggccuggauua

SEQ ID NO: 1346728 - RNA, 19 nt, Homo sapiens
caccucagccgcacaguca

SEQ ID NO: 1346729 - RNA, 19 nt, Homo sapiens
uccaaggccuggucaagca

SEQ ID NO: 1346730 - RNA, 19 nt, Homo sapiens
ugacgcccaugccuuccuu

SEQ ID NO: 1346731 - RNA, 19 nt, Homo sapiens
ggcagggcaaccucacaua

SEQ ID NO: 1346732 - RNA, 19 nt, Homo sapiens
acagugggccugcaaucuu

SEQ ID NO: 1346733 - RNA, 19 nt, Homo sapiens
uaacagugggccugcaauc

SEQ ID NO: 1346734 - RNA, 19 nt, Homo sapiens
caggugaagaccacucuga

SEQ ID NO: 1346735 - RNA, 19 nt, Homo sapiens
gggcugcuggguacaguug

SEQ ID NO: 1346736 - RNA, 19 nt, Homo sapiens
ccaccauuccuuccuaaca

SEQ ID NO: 1346737 - RNA, 19 nt, Homo sapiens
ccaaaagugugcucaagag

SEQ ID NO: 1346738 - RNA, 19 nt, Homo sapiens
gaacagugugcuggugaca

SEQ ID NO: 1346739 - RNA, 19 nt, Homo sapiens
cuugggacccuccugguuu

SEQ ID NO: 1346740 - RNA, 19 nt, Homo sapiens
gcuaacagugggccugcaa

SEQ ID NO: 1346741 - RNA, 19 nt, Homo sapiens
gaggaaggggcgucauuuu

SEQ ID NO: 1346742 - RNA, 19 nt, Homo sapiens
acaauuuucugcaucuuga

SEQ ID NO: 1346743 - RNA, 19 nt, Homo sapiens
acccuggacuaccauauuc

SEQ ID NO: 1346744 - RNA, 19 nt, Homo sapiens
guacaggaggccgauagga

SEQ ID NO: 1346745 - RNA, 19 nt, Homo sapiens
ccgccuacccgucuacaga

SEQ ID NO: 1346746 - RNA, 19 nt, Homo sapiens
gcccagaccaacuccuuuc

SEQ ID NO: 1346747 - RNA, 19 nt, Homo sapiens
ccagcaagagugugugcaa

SEQ ID NO: 1346748 - RNA, 19 nt, Homo sapiens
ucacccaaacuuguauauu

SEQ ID NO: 1346749 - RNA, 19 nt, Homo sapiens
gaagaaauuuggaaccuaa

SEQ ID NO: 1346750 - RNA, 19 nt, Homo sapiens
ccaguuugcucaucacuua

SEQ ID NO: 1346751 - RNA, 19 nt, Homo sapiens
gcucaucacuuagaacuuu

SEQ ID NO: 1346752 - RNA, 19 nt, Homo sapiens
ucaaggagcucugcauauu

SEQ ID NO: 1346753 - RNA, 19 nt, Homo sapiens
gaaggacagcgacucuuua

SEQ ID NO: 1346754 - RNA, 19 nt, Homo sapiens
cgaguacguuucuuuaauu

SEQ ID NO: 1346755 - RNA, 19 nt, Homo sapiens
ggacagcgacucuuuagug

SEQ ID NO: 1346756 - RNA, 19 nt, Homo sapiens
gacaaacaguauacagauu

SEQ ID NO: 1346757 - RNA, 19 nt, Homo sapiens
caaacuacuuucaggagaa

SEQ ID NO: 1346758 - RNA, 19 nt, Homo sapiens
ucuaucggcugaauuauga

SEQ ID NO: 1346759 - RNA, 19 nt, Homo sapiens
gcacauccuucuccaugau

SEQ ID NO: 1346760 - RNA, 19 nt, Homo sapiens
cauugcagcugguuccaua

SEQ ID NO: 1346761 - RNA, 19 nt, Homo sapiens
gcacuguggaaauuuauaa

SEQ ID NO: 1346762 - RNA, 19 nt, Homo sapiens
cccaguggcucucaacuuu

SEQ ID NO: 1346763 - RNA, 19 nt, Homo sapiens
gcgagauuauggaguauga

SEQ ID NO: 1346764 - RNA, 19 nt, Homo sapiens
aacauuaucuguagcugua

SEQ ID NO: 1346765 - RNA, 19 nt, Homo sapiens
gaacacucguggcaguaga

SEQ ID NO: 1346766 - RNA, 19 nt, Homo sapiens
gcgcacagcucaugcuuuu

SEQ ID NO: 1346767 - RNA, 19 nt, Homo sapiens
caaaaggguuuccaaaaug

SEQ ID NO: 1346768 - RNA, 19 nt, Homo sapiens
gaagguggaaguaaagaau

SEQ ID NO: 1346769 - RNA, 19 nt, Homo sapiens
uggagaagguggaaguaaa

SEQ ID NO: 1346770 - RNA, 19 nt, Homo sapiens
guccaugucuacaacguaa

SEQ ID NO: 1346771 - RNA, 19 nt, Homo sapiens
gaucauuuacugcaccuaa

SEQ ID NO: 1346772 - RNA, 19 nt, Homo sapiens
uuacaggcguuaaacauca

SEQ ID NO: 1346773 - RNA, 19 nt, Homo sapiens
caucgaguacguuucuuua

SEQ ID NO: 1346774 - RNA, 19 nt, Homo sapiens
caucaaguaugcuauggau

SEQ ID NO: 1346775 - RNA, 19 nt, Homo sapiens
gcagcgcuguucauaagau

SEQ ID NO: 1346776 - RNA, 19 nt, Homo sapiens
gagauuauggaguaugauu

SEQ ID NO: 1346777 - RNA, 19 nt, Homo sapiens
gcacagcucaugcuuuuaa

SEQ ID NO: 1346778 - RNA, 19 nt, Homo sapiens
gacaaaggguccugagaac

SEQ ID NO: 1346779 - RNA, 19 nt, Homo sapiens
ugucucaucuccuguucua

SEQ ID NO: 1346780 - RNA, 19 nt, Homo sapiens
gcacugacacccacuuagu

SEQ ID NO: 1346781 - RNA, 19 nt, Homo sapiens
ugaacugucuacccuguug

SEQ ID NO: 1346782 - RNA, 19 nt, Homo sapiens
guacagcaucccagacaaa

SEQ ID NO: 1346783 - RNA, 19 nt, Homo sapiens
ucaaaaggguuuccaaaau

SEQ ID NO: 1346784 - RNA, 19 nt, Homo sapiens
agguggaaguaaagaauua

SEQ ID NO: 1346785 - RNA, 19 nt, Homo sapiens
gcuguguggcuuacaauaa

SEQ ID NO: 1346786 - RNA, 19 nt, Homo sapiens
uauauaagccucuacucuu

SEQ ID NO: 1346787 - RNA, 19 nt, Homo sapiens
gcuuacaauuucccaguga

SEQ ID NO: 1346788 - RNA, 19 nt, Homo sapiens
caaaggguccugagaacau

SEQ ID NO: 1346789 - RNA, 19 nt, Homo sapiens
ucgaguacguuucuuuaau

SEQ ID NO: 1346790 - RNA, 19 nt, Homo sapiens
agacaaaggguccugagaa

SEQ ID NO: 1346791 - RNA, 19 nt, Homo sapiens
ugacacccacuuagucuuu

SEQ ID NO: 1346792 - RNA, 19 nt, Homo sapiens
agagccaucucaucgcuaa

SEQ ID NO: 1346793 - RNA, 19 nt, Homo sapiens
agaagaaauuuggaaccua

SEQ ID NO: 1346794 - RNA, 19 nt, Homo sapiens
uagaacggccucuggauga

SEQ ID NO: 1346795 - RNA, 19 nt, Homo sapiens
gaacaguggaggccaugug

SEQ ID NO: 1346796 - RNA, 19 nt, Homo sapiens
aaggagcucugcauauugu

SEQ ID NO: 1346797 - RNA, 19 nt, Homo sapiens
uggaaugggugaauuuaag

SEQ ID NO: 1346798 - RNA, 19 nt, Homo sapiens
gacaaaaccuuacucuaca

SEQ ID NO: 1346799 - RNA, 19 nt, Homo sapiens
uacauguucugcaucauug

SEQ ID NO: 1346800 - RNA, 19 nt, Homo sapiens
gcagggcuuucaccaccuu

SEQ ID NO: 1346801 - RNA, 19 nt, Homo sapiens
caaggagcucugcauauug

SEQ ID NO: 1346802 - RNA, 19 nt, Homo sapiens
ccugagaacauuaucugua

SEQ ID NO: 1346803 - RNA, 19 nt, Homo sapiens
caaacaguauacagauugg

SEQ ID NO: 1346804 - RNA, 19 nt, Homo sapiens
cugagaacauuaucuguag

SEQ ID NO: 1346805 - RNA, 19 nt, Homo sapiens
ggagaagguggaaguaaag

SEQ ID NO: 1346806 - RNA, 19 nt, Homo sapiens
gaacagucuuccauuuuca

SEQ ID NO: 1346807 - RNA, 19 nt, Homo sapiens
ugcuguagcugaccaagaa

SEQ ID NO: 1346808 - RNA, 19 nt, Homo sapiens
gcuggaaugggugaauuua

SEQ ID NO: 1346809 - RNA, 19 nt, Homo sapiens
auauaagccucuacucuuc

SEQ ID NO: 1346810 - RNA, 19 nt, Homo sapiens
acaaacaguauacagauug

SEQ ID NO: 1346811 - RNA, 19 nt, Homo sapiens
aggcagcgcuguucauaag

SEQ ID NO: 1346812 - RNA, 19 nt, Homo sapiens
agaaggacagcgacucuuu

SEQ ID NO: 1346813 - RNA, 19 nt, Homo sapiens
cgauggcacuaucauaagu

SEQ ID NO: 1346814 - RNA, 19 nt, Homo sapiens
cuacauguucugcaucauu

SEQ ID NO: 1346815 - RNA, 19 nt, Homo sapiens
gcauauuguucagcuguca

SEQ ID NO: 1346816 - RNA, 19 nt, Homo sapiens
aaucaaggagcucugcaua

SEQ ID NO: 1346817 - RNA, 19 nt, Homo sapiens
aaaggguccugagaacauu

SEQ ID NO: 1346818 - RNA, 19 nt, Homo sapiens
ucucaucuccuguucuaaa

SEQ ID NO: 1346819 - RNA, 19 nt, Homo sapiens
uaucauaaguguggacucu

SEQ ID NO: 1346820 - RNA, 19 nt, Homo sapiens
agauggcacuguggaaauu

SEQ ID NO: 1346821 - RNA, 19 nt, Homo sapiens
cagacaaacaguauacaga

SEQ ID NO: 1346822 - RNA, 19 nt, Homo sapiens
uacaauaaccagucaaaca

SEQ ID NO: 1346823 - RNA, 19 nt, Homo sapiens
uaacuugucagcaaacuac

SEQ ID NO: 1346824 - RNA, 19 nt, Homo sapiens
cagcucccaccacccauua

SEQ ID NO: 1346825 - RNA, 19 nt, Homo sapiens
guggaggccaugugucuuu

SEQ ID NO: 1346826 - RNA, 19 nt, Homo sapiens
caaauuaccccagacaaaa

SEQ ID NO: 1346827 - RNA, 19 nt, Homo sapiens
guucagcugucaggaggaa

SEQ ID NO: 1346828 - RNA, 19 nt, Homo sapiens
caauaaccagucaaacaga

SEQ ID NO: 1346829 - RNA, 19 nt, Homo sapiens
caucaggaauccgcugugu

SEQ ID NO: 1346830 - RNA, 19 nt, Homo sapiens
ccacugggacgcuugugaa

SEQ ID NO: 1346831 - RNA, 19 nt, Homo sapiens
ucaggcagcgcuguucaua

SEQ ID NO: 1346832 - RNA, 19 nt, Homo sapiens
caaaucaggcagcgcuguu

SEQ ID NO: 1346833 - RNA, 19 nt, Homo sapiens
aaacaucaaguaugcuaug

SEQ ID NO: 1346834 - RNA, 19 nt, Homo sapiens
cguuaaacaucaaguaugc

SEQ ID NO: 1346835 - RNA, 19 nt, Homo sapiens
uaaccagucaaacagauug

SEQ ID NO: 1346836 - RNA, 19 nt, Homo sapiens
agacaaacaguauacagau

SEQ ID NO: 1346837 - RNA, 19 nt, Homo sapiens
gcagaaggacagcgacucu

SEQ ID NO: 1346838 - RNA, 19 nt, Homo sapiens
gccuacauguucugcauca

SEQ ID NO: 1346839 - RNA, 19 nt, Homo sapiens
gaguacagcaucccagaca

SEQ ID NO: 1346840 - RNA, 19 nt, Homo sapiens
ugacugcuauggcuauugc

SEQ ID NO: 1346841 - RNA, 19 nt, Homo sapiens
ggugccugcuuacaauuuc

SEQ ID NO: 1346842 - RNA, 19 nt, Homo sapiens
cacggugccugcuuacaau

SEQ ID NO: 1346843 - RNA, 19 nt, Homo sapiens
uaagguccaucgaguacgu

SEQ ID NO: 1346844 - RNA, 19 nt, Homo sapiens
caaaaccguuccagcauca

SEQ ID NO: 1346845 - RNA, 19 nt, Homo sapiens
gcagcugguuccauagacu

SEQ ID NO: 1346846 - RNA, 19 nt, Homo sapiens
uuacugcaccuaaagacaa

SEQ ID NO: 1346847 - RNA, 19 nt, Homo sapiens
aauaaccagucaaacagau

SEQ ID NO: 1346848 - RNA, 19 nt, Homo sapiens
uccgauggcacuaucauaa

SEQ ID NO: 1346849 - RNA, 19 nt, Homo sapiens
ggaaagaugucaacuauag

SEQ ID NO: 1346850 - RNA, 19 nt, Homo sapiens
gcaaagaaauuggguauca

SEQ ID NO: 1346851 - RNA, 19 nt, Homo sapiens
gagaggaauucaugauuaa

SEQ ID NO: 1346852 - RNA, 19 nt, Homo sapiens
gcacagcaacucauuuaua

SEQ ID NO: 1346853 - RNA, 19 nt, Homo sapiens
uaagaugucuguacucuau

SEQ ID NO: 1346854 - RNA, 19 nt, Homo sapiens
ggauguaucuauaguaaug

SEQ ID NO: 1346855 - RNA, 19 nt, Homo sapiens
gagcacagcaacucauuua

SEQ ID NO: 1346856 - RNA, 19 nt, Homo sapiens
ggagaacguuuaauacuuc

SEQ ID NO: 1346857 - RNA, 19 nt, Homo sapiens
agagaggaauucaugauua

SEQ ID NO: 1346858 - RNA, 19 nt, Homo sapiens
gcuaggagaacguuuaaua

SEQ ID NO: 1346859 - RNA, 19 nt, Homo sapiens
gcaaagagagcuaggagaa

SEQ ID NO: 1346860 - RNA, 19 nt, Homo sapiens
gacgauggcugcugcauug

SEQ ID NO: 1346861 - RNA, 19 nt, Homo sapiens
gaugucaacuauagccaua

SEQ ID NO: 1346862 - RNA, 19 nt, Homo sapiens
gauaggaaaucaagaugga

SEQ ID NO: 1346863 - RNA, 19 nt, Homo sapiens
gaaucggacuaccucauaa

SEQ ID NO: 1346864 - RNA, 19 nt, Homo sapiens
aaacaagccaccugcauua

SEQ ID NO: 1346865 - RNA, 19 nt, Homo sapiens
ggaaucggacuaccucaua

SEQ ID NO: 1346866 - RNA, 19 nt, Homo sapiens
gcagugagauaggaaauca

SEQ ID NO: 1346867 - RNA, 19 nt, Homo sapiens
ugaaugaacuuaagauguc

SEQ ID NO: 1346868 - RNA, 19 nt, Homo sapiens
cacagcaacucauuuauau

SEQ ID NO: 1346869 - RNA, 19 nt, Homo sapiens
guucaugccuucaaucaga

SEQ ID NO: 1346870 - RNA, 19 nt, Homo sapiens
agaaacaggugcagugcua

SEQ ID NO: 1346871 - RNA, 19 nt, Homo sapiens
gauguucuguaucuaugua

SEQ ID NO: 1346872 - RNA, 19 nt, Homo sapiens
gaauugagcaaagauguaa

SEQ ID NO: 1346873 - RNA, 19 nt, Homo sapiens
caagccaccugcauuauca

SEQ ID NO: 1346874 - RNA, 19 nt, Homo sapiens
uauccaagauguucuguau

SEQ ID NO: 1346875 - RNA, 19 nt, Homo sapiens
gaagcucccaguauucuuu

SEQ ID NO: 1346876 - RNA, 19 nt, Homo sapiens
aaccauaaguggcaaauau

SEQ ID NO: 1346877 - RNA, 19 nt, Homo sapiens
auagguggcugccuccuua

SEQ ID NO: 1346878 - RNA, 19 nt, Homo sapiens
guacuuagcugagagaaaa

SEQ ID NO: 1346879 - RNA, 19 nt, Homo sapiens
gcagggacauguuuuguuu

SEQ ID NO: 1346880 - RNA, 19 nt, Homo sapiens
gaggauguuugcacacuug

SEQ ID NO: 1346881 - RNA, 19 nt, Homo sapiens
guugaaauauccaagaugu

SEQ ID NO: 1346882 - RNA, 19 nt, Homo sapiens
ugagaggaguguauaguau

SEQ ID NO: 1346883 - RNA, 19 nt, Homo sapiens
caccauggcuuucauccaa

SEQ ID NO: 1346884 - RNA, 19 nt, Homo sapiens
gagaggacguugaguggau

SEQ ID NO: 1346885 - RNA, 19 nt, Homo sapiens
gcaaguucaugccuucaau

SEQ ID NO: 1346886 - RNA, 19 nt, Homo sapiens
uauguaagcugucccugaa

SEQ ID NO: 1346887 - RNA, 19 nt, Homo sapiens
gcacaucuuuuauacauga

SEQ ID NO: 1346888 - RNA, 19 nt, Homo sapiens
gaacuuaagaugucuguac

SEQ ID NO: 1346889 - RNA, 19 nt, Homo sapiens
gcucuaagauggucaugca

SEQ ID NO: 1346890 - RNA, 19 nt, Homo sapiens
gaguguggguccuuccuaa

SEQ ID NO: 1346891 - RNA, 19 nt, Homo sapiens
ucaaucagauguuacuuag

SEQ ID NO: 1346892 - RNA, 19 nt, Homo sapiens
ugacuguguuaacccauua

SEQ ID NO: 1346893 - RNA, 19 nt, Homo sapiens
cugcaaaucccaaaucuuu

SEQ ID NO: 1346894 - RNA, 19 nt, Homo sapiens
caaacaagccaccugcauu

SEQ ID NO: 1346895 - RNA, 19 nt, Homo sapiens
cuauagccauaaccaauaa

SEQ ID NO: 1346896 - RNA, 19 nt, Homo sapiens
gcaucuagcuuagcaucuu

SEQ ID NO: 1346897 - RNA, 19 nt, Homo sapiens
uauauaggcuuuguugaug

SEQ ID NO: 1346898 - RNA, 19 nt, Homo sapiens
gaguggaucucaagcaagu

SEQ ID NO: 1346899 - RNA, 19 nt, Homo sapiens
ugggauguaucuauaguaa

SEQ ID NO: 1346900 - RNA, 19 nt, Homo sapiens
gcuaugguguugaaauauc

SEQ ID NO: 1346901 - RNA, 19 nt, Homo sapiens
gaugaggcaugcagcuuuc

SEQ ID NO: 1346902 - RNA, 19 nt, Homo sapiens
agacugaccuuugggagaa

SEQ ID NO: 1346903 - RNA, 19 nt, Homo sapiens
ccucauaaaugggauguau

SEQ ID NO: 1346904 - RNA, 19 nt, Homo sapiens
cagaaucuaguacgcuuua

SEQ ID NO: 1346905 - RNA, 19 nt, Homo sapiens
guauuaggaugacuguguu

SEQ ID NO: 1346906 - RNA, 19 nt, Homo sapiens
uugcuaugguguugaaaua

SEQ ID NO: 1346907 - RNA, 19 nt, Homo sapiens
gaacaaauggaaaguuacu

SEQ ID NO: 1346908 - RNA, 19 nt, Homo sapiens
gagcuaggagaacguuuaa

SEQ ID NO: 1346909 - RNA, 19 nt, Homo sapiens
ccuugaagcucccaguauu

SEQ ID NO: 1346910 - RNA, 19 nt, Homo sapiens
uaacaaaggguuuaauucg

SEQ ID NO: 1346911 - RNA, 19 nt, Homo sapiens
gaaucuaguacgcuuuauu

SEQ ID NO: 1346912 - RNA, 19 nt, Homo sapiens
ccauaaguggcaaauauuu

SEQ ID NO: 1346913 - RNA, 19 nt, Homo sapiens
ccaccugcauuaucaaaca

SEQ ID NO: 1346914 - RNA, 19 nt, Homo sapiens
caucuagcuuagcaucuuu

SEQ ID NO: 1346915 - RNA, 19 nt, Homo sapiens
augccaggcuuacguauuu

SEQ ID NO: 1346916 - RNA, 19 nt, Homo sapiens
cggacuaccucauaaaugg

SEQ ID NO: 1346917 - RNA, 19 nt, Homo sapiens
gcugcuaccucuucaacug

SEQ ID NO: 1346918 - RNA, 19 nt, Homo sapiens
auggaaagaugucaacuau

SEQ ID NO: 1346919 - RNA, 19 nt, Homo sapiens
gcaaaucccaaaucuuucu

SEQ ID NO: 1346920 - RNA, 19 nt, Homo sapiens
ugaaauauccaagauguuc

SEQ ID NO: 1346921 - RNA, 19 nt, Homo sapiens
ggaggauguuugcacacuu

SEQ ID NO: 1346922 - RNA, 19 nt, Homo sapiens
acacucacaugauauucuu

SEQ ID NO: 1346923 - RNA, 19 nt, Homo sapiens
caagauggaagcagagaau

SEQ ID NO: 1346924 - RNA, 19 nt, Homo sapiens
gguauuaggaugacugugu

SEQ ID NO: 1346925 - RNA, 19 nt, Homo sapiens
gugcagcaguguccugaug

SEQ ID NO: 1346926 - RNA, 19 nt, Homo sapiens
aggagaacguuuaauacuu

SEQ ID NO: 1346927 - RNA, 19 nt, Homo sapiens
ggaggugguauuaggauga

SEQ ID NO: 1346928 - RNA, 19 nt, Homo sapiens
ccacagggccgagugaaga

SEQ ID NO: 1346929 - RNA, 19 nt, Homo sapiens
caaagaaauuggguaucau

SEQ ID NO: 1346930 - RNA, 19 nt, Homo sapiens
cccagacuuugaauuagua

SEQ ID NO: 1346931 - RNA, 19 nt, Homo sapiens
gcuaccacuucuucuguga

SEQ ID NO: 1346932 - RNA, 19 nt, Homo sapiens
guuaacccauuaccuuuua

SEQ ID NO: 1346933 - RNA, 19 nt, Homo sapiens
ggauauuuacagcuucuuu

SEQ ID NO: 1346934 - RNA, 19 nt, Homo sapiens
gagaacguuuaauacuuca

SEQ ID NO: 1346935 - RNA, 19 nt, Homo sapiens
gaaccacagggccgaguga

SEQ ID NO: 1346936 - RNA, 19 nt, Homo sapiens
gagaggaguguauaguaug

SEQ ID NO: 1346937 - RNA, 19 nt, Homo sapiens
gagagcacagcaacucauu

SEQ ID NO: 1346938 - RNA, 19 nt, Homo sapiens
gauggcugcugcauugaca

SEQ ID NO: 1346939 - RNA, 19 nt, Homo sapiens
ggguggguauaccuaaauu

SEQ ID NO: 1346940 - RNA, 19 nt, Homo sapiens
uuaccaugcuggacugcua

SEQ ID NO: 1346941 - RNA, 19 nt, Homo sapiens
gacuacgacuggugaaaca

SEQ ID NO: 1346942 - RNA, 19 nt, Homo sapiens
agucaaaucauuccuguga

SEQ ID NO: 1346943 - RNA, 19 nt, Homo sapiens
ccagagagucaaaucauuc

SEQ ID NO: 1346944 - RNA, 19 nt, Homo sapiens
uauaggcuuuguugaugaa

SEQ ID NO: 1346945 - RNA, 19 nt, Homo sapiens
ggugaaacagaaacugaaa

SEQ ID NO: 1346946 - RNA, 19 nt, Homo sapiens
gugaugcugugcaguuugu

SEQ ID NO: 1346947 - RNA, 19 nt, Homo sapiens
caaaucauucccaccauca

SEQ ID NO: 1346948 - RNA, 19 nt, Homo sapiens
gagauaggaaaucaagaug

SEQ ID NO: 1346949 - RNA, 19 nt, Homo sapiens
gaacuagugugauuucuaa

SEQ ID NO: 1346950 - RNA, 19 nt, Homo sapiens
ggauauugcuugacauuug

SEQ ID NO: 1346951 - RNA, 19 nt, Homo sapiens
caacauaucccacucagaa

SEQ ID NO: 1346952 - RNA, 19 nt, Homo sapiens
gaaacgaauucaagaaaca

SEQ ID NO: 1346953 - RNA, 19 nt, Homo sapiens
gaagucagcuaucagaaca

SEQ ID NO: 1346954 - RNA, 19 nt, Homo sapiens
gaaaggcugucgugacuca

SEQ ID NO: 1346955 - RNA, 19 nt, Homo sapiens
gcgcagaaaucuuugaguu

SEQ ID NO: 1346956 - RNA, 19 nt, Homo sapiens
ccacagcgcagaaaucuuu

SEQ ID NO: 1346957 - RNA, 19 nt, Homo sapiens
uagcauacacuaccucuua

SEQ ID NO: 1346958 - RNA, 19 nt, Homo sapiens
gaacacagagaaagaaugu

SEQ ID NO: 1346959 - RNA, 19 nt, Homo sapiens
gauauugcuugacauuuga

SEQ ID NO: 1346960 - RNA, 19 nt, Homo sapiens
gagaaaggcugucgugacu

SEQ ID NO: 1346961 - RNA, 19 nt, Homo sapiens
ggagagggccgaauaagug

SEQ ID NO: 1346962 - RNA, 19 nt, Homo sapiens
gaacuuuacagcaacaauu

SEQ ID NO: 1346963 - RNA, 19 nt, Homo sapiens
ccaaaacacugcagagaua

SEQ ID NO: 1346964 - RNA, 19 nt, Homo sapiens
gaaagugaauguccagacu

SEQ ID NO: 1346965 - RNA, 19 nt, Homo sapiens
gaacagugauggaaauagc

SEQ ID NO: 1346966 - RNA, 19 nt, Homo sapiens
cagaagaugcuauuggaua

SEQ ID NO: 1346967 - RNA, 19 nt, Homo sapiens
caagcaggcucuucuaagu

SEQ ID NO: 1346968 - RNA, 19 nt, Homo sapiens
gauaaugaaggaugaacua

SEQ ID NO: 1346969 - RNA, 19 nt, Homo sapiens
ggaaacaaguucugaucca

SEQ ID NO: 1346970 - RNA, 19 nt, Homo sapiens
gcuauuggauauugcuuga

SEQ ID NO: 1346971 - RNA, 19 nt, Homo sapiens
ucaaaggacuuaauguucu

SEQ ID NO: 1346972 - RNA, 19 nt, Homo sapiens
ccuacaacccuuuaaauuu

SEQ ID NO: 1346973 - RNA, 19 nt, Homo sapiens
gaggaaauguaacuuggau

SEQ ID NO: 1346974 - RNA, 19 nt, Homo sapiens
gagauaacccaacacaguu

SEQ ID NO: 1346975 - RNA, 19 nt, Homo sapiens
acacagagaaagaauguuu

SEQ ID NO: 1346976 - RNA, 19 nt, Homo sapiens
agaagaugcuauuggauau

SEQ ID NO: 1346977 - RNA, 19 nt, Homo sapiens
ucagacugcugccagaauu

SEQ ID NO: 1346978 - RNA, 19 nt, Homo sapiens
gcaugaaacggcuggaauu

SEQ ID NO: 1346979 - RNA, 19 nt, Homo sapiens
gcagggauguccaccucuu

SEQ ID NO: 1346980 - RNA, 19 nt, Homo sapiens
ucagugugguauccuauuu

SEQ ID NO: 1346981 - RNA, 19 nt, Homo sapiens
ggauuugucuggcaagucu

SEQ ID NO: 1346982 - RNA, 19 nt, Homo sapiens
gaaggaugaacuaguguga

SEQ ID NO: 1346983 - RNA, 19 nt, Homo sapiens
gaagccagcccugauaaug

SEQ ID NO: 1346984 - RNA, 19 nt, Homo sapiens
cagaaacgaauucaagaaa

SEQ ID NO: 1346985 - RNA, 19 nt, Homo sapiens
caguguagauccuuauaau

SEQ ID NO: 1346986 - RNA, 19 nt, Homo sapiens
ccgaauaaguguaguugau

SEQ ID NO: 1346987 - RNA, 19 nt, Homo sapiens
ucugagggcuguccaucua

SEQ ID NO: 1346988 - RNA, 19 nt, Homo sapiens
ucagaacagugauggaaau

SEQ ID NO: 1346989 - RNA, 19 nt, Homo sapiens
caaaggaccaugggaagaa

SEQ ID NO: 1346990 - RNA, 19 nt, Homo sapiens
ggaggaagacacacacaug

SEQ ID NO: 1346991 - RNA, 19 nt, Homo sapiens
ggaacucauucuguaauuc

SEQ ID NO: 1346992 - RNA, 19 nt, Homo sapiens
ucuaaacauucaacgcaua

SEQ ID NO: 1346993 - RNA, 19 nt, Homo sapiens
gaagggauccacuggcaau

SEQ ID NO: 1346994 - RNA, 19 nt, Homo sapiens
gcaguguagauccuuauaa

SEQ ID NO: 1346995 - RNA, 19 nt, Homo sapiens
uaaauuaugugugccuauc

SEQ ID NO: 1346996 - RNA, 19 nt, Homo sapiens
aggaugaacuagugugauu

SEQ ID NO: 1346997 - RNA, 19 nt, Homo sapiens
aaugaaggaugaacuagug

SEQ ID NO: 1346998 - RNA, 19 nt, Homo sapiens
ccagggaacaugcuucaaa

SEQ ID NO: 1346999 - RNA, 19 nt, Homo sapiens
ugucacaccuuacuuucuu

SEQ ID NO: 1347000 - RNA, 19 nt, Homo sapiens
agucugaucuagagaauuc

SEQ ID NO: 1347001 - RNA, 19 nt, Homo sapiens
ccagaauuguuccugaaga

SEQ ID NO: 1347002 - RNA, 19 nt, Homo sapiens
cugagagacugucaagaaa

SEQ ID NO: 1347003 - RNA, 19 nt, Homo sapiens
gaacucauucuguaauucu

SEQ ID NO: 1347004 - RNA, 19 nt, Homo sapiens
gcaagucugaucuagagaa

SEQ ID NO: 1347005 - RNA, 19 nt, Homo sapiens
guggagcuguugcccagua

SEQ ID NO: 1347006 - RNA, 19 nt, Homo sapiens
aaauguaacuuggaucuag

SEQ ID NO: 1347007 - RNA, 19 nt, Homo sapiens
gaaauguaacuuggaucua

SEQ ID NO: 1347008 - RNA, 19 nt, Homo sapiens
uuaauguucucaagcaaug

SEQ ID NO: 1347009 - RNA, 19 nt, Homo sapiens
ugaggaagcugaggaugau

SEQ ID NO: 1347010 - RNA, 19 nt, Homo sapiens
ggaaggccuaccagaaauu

SEQ ID NO: 1347011 - RNA, 19 nt, Homo sapiens
ggaaauguaacuuggaucu

SEQ ID NO: 1347012 - RNA, 19 nt, Homo sapiens
gcaaaggaccaugggaaga

SEQ ID NO: 1347013 - RNA, 19 nt, Homo sapiens
caagucugaucuagagaau

SEQ ID NO: 1347014 - RNA, 19 nt, Homo sapiens
ccugagagacugucaagaa

SEQ ID NO: 1347015 - RNA, 19 nt, Homo sapiens
gcagagauaacccaacaca

SEQ ID NO: 1347016 - RNA, 19 nt, Homo sapiens
ugauggaaauagcgaggua

SEQ ID NO: 1347017 - RNA, 19 nt, Homo sapiens
cuuggcagcuguccuuuga

SEQ ID NO: 1347018 - RNA, 19 nt, Homo sapiens
ccugagaggugucuuuuaa

SEQ ID NO: 1347019 - RNA, 19 nt, Homo sapiens
gggaacaugcuucaaagga

SEQ ID NO: 1347020 - RNA, 19 nt, Homo sapiens
gggcuguucuucccugugu

SEQ ID NO: 1347021 - RNA, 19 nt, Homo sapiens
cuagugagauaccuaugga

SEQ ID NO: 1347022 - RNA, 19 nt, Homo sapiens
gcauagacgauuucagugu

SEQ ID NO: 1347023 - RNA, 19 nt, Homo sapiens
gaagaugcuauuggauauu

SEQ ID NO: 1347024 - RNA, 19 nt, Homo sapiens
aacagaagaugcuauugga

SEQ ID NO: 1347025 - RNA, 19 nt, Homo sapiens
ggaugcagguuccagaaac

SEQ ID NO: 1347026 - RNA, 19 nt, Homo sapiens
ugagaggugucuuuuaaaa

SEQ ID NO: 1347027 - RNA, 19 nt, Homo sapiens
gacuuaauguucucaagca

SEQ ID NO: 1347028 - RNA, 19 nt, Homo sapiens
aagaugcuauuggauauug

SEQ ID NO: 1347029 - RNA, 19 nt, Homo sapiens
ccagaaacgaauucaagaa

SEQ ID NO: 1347030 - RNA, 19 nt, Homo sapiens
ugaugaggaucgcaaagga

SEQ ID NO: 1347031 - RNA, 19 nt, Homo sapiens
gaggaagacacacacaugu

SEQ ID NO: 1347032 - RNA, 19 nt, Homo sapiens
uaccagaaauucaccaucu

SEQ ID NO: 1347033 - RNA, 19 nt, Homo sapiens
gcaagcaggcucuucuaag

SEQ ID NO: 1347034 - RNA, 19 nt, Homo sapiens
gcaaggccgagacucugua

SEQ ID NO: 1347035 - RNA, 19 nt, Homo sapiens
uucagaaggugcuaauuug

SEQ ID NO: 1347036 - RNA, 19 nt, Homo sapiens
aaucccgucuguacucuaa

SEQ ID NO: 1347037 - RNA, 19 nt, Homo sapiens
gaccuaaaauuggagcuua

SEQ ID NO: 1347038 - RNA, 19 nt, Homo sapiens
gaauguuuccgaccagaug

SEQ ID NO: 1347039 - RNA, 19 nt, Homo sapiens
caaaggacuuaauguucuc

SEQ ID NO: 1347040 - RNA, 19 nt, Homo sapiens
agaaacagaagaugcuauu

SEQ ID NO: 1347041 - RNA, 19 nt, Homo sapiens
uauaaguggugaugaggau

SEQ ID NO: 1347042 - RNA, 19 nt, Homo sapiens
uggcaagucugaucuagag

SEQ ID NO: 1347043 - RNA, 19 nt, Homo sapiens
cgaauaaguguaguugauu

SEQ ID NO: 1347044 - RNA, 19 nt, Homo sapiens
cggaaggccuaccagaaau

SEQ ID NO: 1347045 - RNA, 19 nt, Homo sapiens
ccgaccagauggcuagauu

SEQ ID NO: 1347046 - RNA, 19 nt, Homo sapiens
gaugaacuagugugauuuc

SEQ ID NO: 1347047 - RNA, 19 nt, Homo sapiens
ugagagaggaccauuguca

SEQ ID NO: 1347048 - RNA, 19 nt, Homo sapiens
cagggaacaugcuucaaag

SEQ ID NO: 1347049 - RNA, 19 nt, Homo sapiens
gaaauuaaguggcaaagaa

SEQ ID NO: 1347050 - RNA, 19 nt, Homo sapiens
gaaacaaaguggcauuaug

SEQ ID NO: 1347051 - RNA, 19 nt, Homo sapiens
gcuaugcaguuguuaauuu

SEQ ID NO: 1347052 - RNA, 19 nt, Homo sapiens
caaaguggcauuaugauuu

SEQ ID NO: 1347053 - RNA, 19 nt, Homo sapiens
gacaucaaauuguugguua

SEQ ID NO: 1347054 - RNA, 19 nt, Homo sapiens
gaaauucacuuaugcucau

SEQ ID NO: 1347055 - RNA, 19 nt, Homo sapiens
ggaauuucguuacuucauu

SEQ ID NO: 1347056 - RNA, 19 nt, Homo sapiens
gaacugagaaagcuuaaga

SEQ ID NO: 1347057 - RNA, 19 nt, Homo sapiens
ggaagaauccauaaacaga

SEQ ID NO: 1347058 - RNA, 19 nt, Homo sapiens
cauaacaaaugacgacaaa

SEQ ID NO: 1347059 - RNA, 19 nt, Homo sapiens
gcaaagaacugagaaagcu

SEQ ID NO: 1347060 - RNA, 19 nt, Homo sapiens
cgacaaacuugggugcuua

SEQ ID NO: 1347061 - RNA, 19 nt, Homo sapiens
aaacaaaguggcauuauga

SEQ ID NO: 1347062 - RNA, 19 nt, Homo sapiens
ucauaucacucucauaaug

SEQ ID NO: 1347063 - RNA, 19 nt, Homo sapiens
gaagcucuuucacuaauuc

SEQ ID NO: 1347064 - RNA, 19 nt, Homo sapiens
caggugauauucuugauug

SEQ ID NO: 1347065 - RNA, 19 nt, Homo sapiens
gggcuuccauaacaaauga

SEQ ID NO: 1347066 - RNA, 19 nt, Homo sapiens
caucugggcugucuucugu

SEQ ID NO: 1347067 - RNA, 19 nt, Homo sapiens
ccaaguaaguuuguauuca

SEQ ID NO: 1347068 - RNA, 19 nt, Homo sapiens
cuaugucuguuuccuaaua

SEQ ID NO: 1347069 - RNA, 19 nt, Homo sapiens
gcagacaauagacauuaua

SEQ ID NO: 1347070 - RNA, 19 nt, Homo sapiens
caaauggucaggugauauu

SEQ ID NO: 1347071 - RNA, 19 nt, Homo sapiens
cauccagacucauuuguga

SEQ ID NO: 1347072 - RNA, 19 nt, Homo sapiens
gagaaacaaaguggcauua

SEQ ID NO: 1347073 - RNA, 19 nt, Homo sapiens
uaaaggaccauuugcagaa

SEQ ID NO: 1347074 - RNA, 19 nt, Homo sapiens
aaacugagcuacaaaagaa

SEQ ID NO: 1347075 - RNA, 19 nt, Homo sapiens
guuaaugguggaauuguua

SEQ ID NO: 1347076 - RNA, 19 nt, Homo sapiens
gacagacuuccaccuauua

SEQ ID NO: 1347077 - RNA, 19 nt, Homo sapiens
ggauagucuucauaugauu

SEQ ID NO: 1347078 - RNA, 19 nt, Homo sapiens
ucucauaucacucucauaa

SEQ ID NO: 1347079 - RNA, 19 nt, Homo sapiens
caaagugucagcagaguug

SEQ ID NO: 1347080 - RNA, 19 nt, Homo sapiens
agacagacuuccaccuauu

SEQ ID NO: 1347081 - RNA, 19 nt, Homo sapiens
uaggauagucuucauauga

SEQ ID NO: 1347082 - RNA, 19 nt, Homo sapiens
gaagcaggaucuauguuuu

SEQ ID NO: 1347083 - RNA, 19 nt, Homo sapiens
ugaugugucuuuauggaaa

SEQ ID NO: 1347084 - RNA, 19 nt, Homo sapiens
uggagacccuuaauuaugu

SEQ ID NO: 1347085 - RNA, 19 nt, Homo sapiens
caaauagucaggacauuca

SEQ ID NO: 1347086 - RNA, 19 nt, Homo sapiens
agacccauguuccaaguaa

SEQ ID NO: 1347087 - RNA, 19 nt, Homo sapiens
aaagaacugagaaagcuua

SEQ ID NO: 1347088 - RNA, 19 nt, Homo sapiens
cuacaaagaacaacugaau

SEQ ID NO: 1347089 - RNA, 19 nt, Homo sapiens
gcuggaauuucguuacuuc

SEQ ID NO: 1347090 - RNA, 19 nt, Homo sapiens
cuuauuccauguccuuuaa

SEQ ID NO: 1347091 - RNA, 19 nt, Homo sapiens
aauauuagguuggugcaaa

SEQ ID NO: 1347092 - RNA, 19 nt, Homo sapiens
uagcagacaauagacauua

SEQ ID NO: 1347093 - RNA, 19 nt, Homo sapiens
guaaguuuguauucacaug

SEQ ID NO: 1347094 - RNA, 19 nt, Homo sapiens
ggagacccuuaauuauguu

SEQ ID NO: 1347095 - RNA, 19 nt, Homo sapiens
gauaaaguagagacucauu

SEQ ID NO: 1347096 - RNA, 19 nt, Homo sapiens
cguauuugaugugucuuua

SEQ ID NO: 1347097 - RNA, 19 nt, Homo sapiens
cucagaaacugcuggaauu

SEQ ID NO: 1347098 - RNA, 19 nt, Homo sapiens
uguuauaguuccucagaaa

SEQ ID NO: 1347099 - RNA, 19 nt, Homo sapiens
aaacuugggugcuuacaac

SEQ ID NO: 1347100 - RNA, 19 nt, Homo sapiens
acaaagaacaacugaauag

SEQ ID NO: 1347101 - RNA, 19 nt, Homo sapiens
gcuuaagaccugcuucaaa

SEQ ID NO: 1347102 - RNA, 19 nt, Homo sapiens
ucaggacauucaaagguuu

SEQ ID NO: 1347103 - RNA, 19 nt, Homo sapiens
gucaggacauucaaagguu

SEQ ID NO: 1347104 - RNA, 19 nt, Homo sapiens
cuuguucacuguuauaguu

SEQ ID NO: 1347105 - RNA, 19 nt, Homo sapiens
guuccagccuauauauuug

SEQ ID NO: 1347106 - RNA, 19 nt, Homo sapiens
caaguaaguuuguauucac

SEQ ID NO: 1347107 - RNA, 19 nt, Homo sapiens
ucccagggcuuccauaaca

SEQ ID NO: 1347108 - RNA, 19 nt, Homo sapiens
caugacaguuacuaaagga

SEQ ID NO: 1347109 - RNA, 19 nt, Homo sapiens
ccagaagucuaaaaucaaa

SEQ ID NO: 1347110 - RNA, 19 nt, Homo sapiens
uaacaaaugacgacaaacu

SEQ ID NO: 1347111 - RNA, 19 nt, Homo sapiens
uaugauggccaaagacaaa

SEQ ID NO: 1347112 - RNA, 19 nt, Homo sapiens
uacaaauggucaggugaua

SEQ ID NO: 1347113 - RNA, 19 nt, Homo sapiens
agaagcaggaucuauguuu

SEQ ID NO: 1347114 - RNA, 19 nt, Homo sapiens
guacagcugacucauugaa

SEQ ID NO: 1347115 - RNA, 19 nt, Homo sapiens
gcaaaaccacaauuacuuu

SEQ ID NO: 1347116 - RNA, 19 nt, Homo sapiens
guuuggaaauucacuuaug

SEQ ID NO: 1347117 - RNA, 19 nt, Homo sapiens
ucaaagguuuaugugguaa

SEQ ID NO: 1347118 - RNA, 19 nt, Homo sapiens
gcaauucuuggaguucuuu

SEQ ID NO: 1347119 - RNA, 19 nt, Homo sapiens
aaggaagaauccauaaaca

SEQ ID NO: 1347120 - RNA, 19 nt, Homo sapiens
gucuagacaucaaauuguu

SEQ ID NO: 1347121 - RNA, 19 nt, Homo sapiens
cagugguggucuucaaauu

SEQ ID NO: 1347122 - RNA, 19 nt, Homo sapiens
gauagucuucauaugauug

SEQ ID NO: 1347123 - RNA, 19 nt, Homo sapiens
ggccagaagucuaaaauca

SEQ ID NO: 1347124 - RNA, 19 nt, Homo sapiens
uagaaaugaugaagcucuu

SEQ ID NO: 1347125 - RNA, 19 nt, Homo sapiens
cuuaagaccugcuucaaaa

SEQ ID NO: 1347126 - RNA, 19 nt, Homo sapiens
uaccuuagucucuguguuu

SEQ ID NO: 1347127 - RNA, 19 nt, Homo sapiens
ccucaucuccugucuccua

SEQ ID NO: 1347128 - RNA, 19 nt, Homo sapiens
cacaugaucugaguagaca

SEQ ID NO: 1347129 - RNA, 19 nt, Homo sapiens
guauucacaugaucugagu

SEQ ID NO: 1347130 - RNA, 19 nt, Homo sapiens
uaaggaagaauccauaaac

SEQ ID NO: 1347131 - RNA, 19 nt, Homo sapiens
acaaaugacgacaaacuug

SEQ ID NO: 1347132 - RNA, 19 nt, Homo sapiens
uucaaagguuuauguggua

SEQ ID NO: 1347133 - RNA, 19 nt, Homo sapiens
acagcugacucauugaaau

SEQ ID NO: 1347134 - RNA, 19 nt, Homo sapiens
gaugugucuuuauggaaau

SEQ ID NO: 1347135 - RNA, 19 nt, Homo sapiens
ggucaggugauauucuuga

SEQ ID NO: 1347136 - RNA, 19 nt, Homo sapiens
gugguggucuucaaauuac

SEQ ID NO: 1347137 - RNA, 19 nt, Homo sapiens
gugcagugguggucuucaa

SEQ ID NO: 1347138 - RNA, 19 nt, Homo sapiens
gcuuauuccauguccuuua

SEQ ID NO: 1347139 - RNA, 19 nt, Homo sapiens
guuauuggcgaucggagua

SEQ ID NO: 1347140 - RNA, 19 nt, Homo sapiens
aaucuucacuccagucucu

SEQ ID NO: 1347141 - RNA, 19 nt, Homo sapiens
aauguaugauggccaaaga

SEQ ID NO: 1347142 - RNA, 19 nt, Homo sapiens
cuaugcaguuguuaauuuc

SEQ ID NO: 1347143 - RNA, 19 nt, Homo sapiens
gccuauauauuugcugguu

SEQ ID NO: 1347144 - RNA, 19 nt, Homo sapiens
guuaguuccagccuauaua

SEQ ID NO: 1347145 - RNA, 19 nt, Homo sapiens
acaaaguggcauuaugauu

SEQ ID NO: 1347146 - RNA, 19 nt, Homo sapiens
aggauagucuucauaugau

SEQ ID NO: 1347147 - RNA, 19 nt, Homo sapiens
aaagacccauguuccaagu

SEQ ID NO: 1347148 - RNA, 19 nt, Homo sapiens
gcagacagcaaucuucacu

SEQ ID NO: 1347149 - RNA, 19 nt, Homo sapiens
caaugggucuccacaagua

SEQ ID NO: 1347150 - RNA, 19 nt, Homo sapiens
gcaauucuuuauccuguga

SEQ ID NO: 1347151 - RNA, 19 nt, Homo sapiens
agaauagacuggccugaaa

SEQ ID NO: 1347152 - RNA, 19 nt, Homo sapiens
agaauggacugaucuaugu

SEQ ID NO: 1347153 - RNA, 19 nt, Homo sapiens
ugagagccaucauuccuaa

SEQ ID NO: 1347154 - RNA, 19 nt, Homo sapiens
gaaauccccuugcccagua

SEQ ID NO: 1347155 - RNA, 19 nt, Homo sapiens
uggaauggaucgacccuaa

SEQ ID NO: 1347156 - RNA, 19 nt, Homo sapiens
ugagagcccuaauacuaaa

SEQ ID NO: 1347157 - RNA, 19 nt, Homo sapiens
caaacaaacaggguccuua

SEQ ID NO: 1347158 - RNA, 19 nt, Homo sapiens
ggcggacacuccucucuuu

SEQ ID NO: 1347159 - RNA, 19 nt, Homo sapiens
cuugagagcccuaauacua

SEQ ID NO: 1347160 - RNA, 19 nt, Homo sapiens
gcccaaaucuagggagaga

SEQ ID NO: 1347161 - RNA, 19 nt, Homo sapiens
caucuugagagcccuaaua

SEQ ID NO: 1347162 - RNA, 19 nt, Homo sapiens
cguccacacuggugagaaa

SEQ ID NO: 1347163 - RNA, 19 nt, Homo sapiens
gaauagacuggccugaaau

SEQ ID NO: 1347164 - RNA, 19 nt, Homo sapiens
ggagcaugucccugaauuu

SEQ ID NO: 1347165 - RNA, 19 nt, Homo sapiens
caucauuccuaacgaccuu

SEQ ID NO: 1347166 - RNA, 19 nt, Homo sapiens
gcaaugggucuccacaagu

SEQ ID NO: 1347167 - RNA, 19 nt, Homo sapiens
ugaggucccuggaaugagu

SEQ ID NO: 1347168 - RNA, 19 nt, Homo sapiens
aaauggauauagccgaaau

SEQ ID NO: 1347169 - RNA, 19 nt, Homo sapiens
gcccuucccuugccacauc

SEQ ID NO: 1347170 - RNA, 19 nt, Homo sapiens
gaauguggagggagcaugu

SEQ ID NO: 1347171 - RNA, 19 nt, Homo sapiens
cuccaucucuguugguuug

SEQ ID NO: 1347172 - RNA, 19 nt, Homo sapiens
aaacaaacaggguccuuag

SEQ ID NO: 1347173 - RNA, 19 nt, Homo sapiens
cgacugcgggaccuucuuu

SEQ ID NO: 1347174 - RNA, 19 nt, Homo sapiens
uuuccuagaucccuccaaa

SEQ ID NO: 1347175 - RNA, 19 nt, Homo sapiens
gagccaucauuccuaacga

SEQ ID NO: 1347176 - RNA, 19 nt, Homo sapiens
ccacaaguaccucucaucu

SEQ ID NO: 1347177 - RNA, 19 nt, Homo sapiens
gagcaugucccugaauuuu

SEQ ID NO: 1347178 - RNA, 19 nt, Homo sapiens
uugagagcccuaauacuaa

SEQ ID NO: 1347179 - RNA, 19 nt, Homo sapiens
gguccacgcaauucuuuau

SEQ ID NO: 1347180 - RNA, 19 nt, Homo sapiens
uagaauagacuggccugaa

SEQ ID NO: 1347181 - RNA, 19 nt, Homo sapiens
gagcaaugggucuccacaa

SEQ ID NO: 1347182 - RNA, 19 nt, Homo sapiens
ggugcacacuggcgagaag

SEQ ID NO: 1347183 - RNA, 19 nt, Homo sapiens
uagcauccguuggucuuuc

SEQ ID NO: 1347184 - RNA, 19 nt, Homo sapiens
ccaccuuccuuagagugaa

SEQ ID NO: 1347185 - RNA, 19 nt, Homo sapiens
cgaccuugaucuggagaau

SEQ ID NO: 1347186 - RNA, 19 nt, Homo sapiens
accuugaucuggagaaugu

SEQ ID NO: 1347187 - RNA, 19 nt, Homo sapiens
ccugaggucccuggaauga

SEQ ID NO: 1347188 - RNA, 19 nt, Homo sapiens
cccaaacacuagaauagac

SEQ ID NO: 1347189 - RNA, 19 nt, Homo sapiens
gaauggaucgacccuaacg

SEQ ID NO: 1347190 - RNA, 19 nt, Homo sapiens
ggagugcggcaaguucuuc

SEQ ID NO: 1347191 - RNA, 19 nt, Homo sapiens
gcugcgagcgcgacuucaa

SEQ ID NO: 1347192 - RNA, 19 nt, Homo sapiens
gggcggacacuccucucuu

SEQ ID NO: 1347193 - RNA, 19 nt, Homo sapiens
gaauggacugaucuaugug

SEQ ID NO: 1347194 - RNA, 19 nt, Homo sapiens
ccacgagugcuaccucaag

SEQ ID NO: 1347195 - RNA, 19 nt, Homo sapiens
gaaauuaacugccauacua

SEQ ID NO: 1347196 - RNA, 19 nt, Homo sapiens
gaagcacacucccuaauaa

SEQ ID NO: 1347197 - RNA, 19 nt, Homo sapiens
gaacugaugucuaaagcaa

SEQ ID NO: 1347198 - RNA, 19 nt, Homo sapiens
ggaagaggcugcaacauag

SEQ ID NO: 1347199 - RNA, 19 nt, Homo sapiens
gggcagaacugaaagauca

SEQ ID NO: 1347200 - RNA, 19 nt, Homo sapiens
gcacaguucugcaaguaaa

SEQ ID NO: 1347201 - RNA, 19 nt, Homo sapiens
ccaaacaaguacaaugaua

SEQ ID NO: 1347202 - RNA, 19 nt, Homo sapiens
ccaaaucugucaacuagaa

SEQ ID NO: 1347203 - RNA, 19 nt, Homo sapiens
ucaaaucuaugucaaggua

SEQ ID NO: 1347204 - RNA, 19 nt, Homo sapiens
caauuaagguguuguugaa

SEQ ID NO: 1347205 - RNA, 19 nt, Homo sapiens
caacauagcccaugcuuag

SEQ ID NO: 1347206 - RNA, 19 nt, Homo sapiens
aggauuaacuugaugcuua

SEQ ID NO: 1347207 - RNA, 19 nt, Homo sapiens
gcacacagcacaauucaga

SEQ ID NO: 1347208 - RNA, 19 nt, Homo sapiens
uaccugaacugaugucuaa

SEQ ID NO: 1347209 - RNA, 19 nt, Homo sapiens
gagaaggaauggcaacgaa

SEQ ID NO: 1347210 - RNA, 19 nt, Homo sapiens
gaagcuugauucagucuug

SEQ ID NO: 1347211 - RNA, 19 nt, Homo sapiens
uaacuucugugucacuauu

SEQ ID NO: 1347212 - RNA, 19 nt, Homo sapiens
uaagcuaccugaacugaug

SEQ ID NO: 1347213 - RNA, 19 nt, Homo sapiens
gaaauacccaggaggauuc

SEQ ID NO: 1347214 - RNA, 19 nt, Homo sapiens
gccauuggauguagagaaa

SEQ ID NO: 1347215 - RNA, 19 nt, Homo sapiens
cagauguguugccauguua

SEQ ID NO: 1347216 - RNA, 19 nt, Homo sapiens
cugcuaauauugugucuaa

SEQ ID NO: 1347217 - RNA, 19 nt, Homo sapiens
gggaggguaucaaaucuau

SEQ ID NO: 1347218 - RNA, 19 nt, Homo sapiens
caagcugucugaacaagga

SEQ ID NO: 1347219 - RNA, 19 nt, Homo sapiens
cagccaaguuugaauaaug

SEQ ID NO: 1347220 - RNA, 19 nt, Homo sapiens
gugcagauuugauauuuca

SEQ ID NO: 1347221 - RNA, 19 nt, Homo sapiens
acagcacaauucagaaaua

SEQ ID NO: 1347222 - RNA, 19 nt, Homo sapiens
uggaagaggcugcaacaua

SEQ ID NO: 1347223 - RNA, 19 nt, Homo sapiens
gaaaagugccuuagaguug

SEQ ID NO: 1347224 - RNA, 19 nt, Homo sapiens
agaggcaccuuuagaagaa

SEQ ID NO: 1347225 - RNA, 19 nt, Homo sapiens
gagcagaggcaccuuuaga

SEQ ID NO: 1347226 - RNA, 19 nt, Homo sapiens
cuacaaacuuggucaguca

SEQ ID NO: 1347227 - RNA, 19 nt, Homo sapiens
ugaagcacacucccuaaua

SEQ ID NO: 1347228 - RNA, 19 nt, Homo sapiens
gcaucguacugaaaugaaa

SEQ ID NO: 1347229 - RNA, 19 nt, Homo sapiens
guaagaagacaagcuguuu

SEQ ID NO: 1347230 - RNA, 19 nt, Homo sapiens
gaaaggauacacugcuaau

SEQ ID NO: 1347231 - RNA, 19 nt, Homo sapiens
gaaggaauggcaacgaaga

SEQ ID NO: 1347232 - RNA, 19 nt, Homo sapiens
gcacacucccuaauaauag

SEQ ID NO: 1347233 - RNA, 19 nt, Homo sapiens
cacgauggcucuagucaga

SEQ ID NO: 1347234 - RNA, 19 nt, Homo sapiens
gauaacuucugugucacua

SEQ ID NO: 1347235 - RNA, 19 nt, Homo sapiens
ggagaacaaucagauccaa

SEQ ID NO: 1347236 - RNA, 19 nt, Homo sapiens
uagcagaaacccugucuuu

SEQ ID NO: 1347237 - RNA, 19 nt, Homo sapiens
aaaguacucucuccugugu

SEQ ID NO: 1347238 - RNA, 19 nt, Homo sapiens
ggaaaggauacacugcuaa

SEQ ID NO: 1347239 - RNA, 19 nt, Homo sapiens
gaagaaauaaugugguagu

SEQ ID NO: 1347240 - RNA, 19 nt, Homo sapiens
acaacucgaugcuguaaga

SEQ ID NO: 1347241 - RNA, 19 nt, Homo sapiens
gggacaaccugccauugga

SEQ ID NO: 1347242 - RNA, 19 nt, Homo sapiens
uaggaaacauggcacaguu

SEQ ID NO: 1347243 - RNA, 19 nt, Homo sapiens
gauguucuauugaaaguac

SEQ ID NO: 1347244 - RNA, 19 nt, Homo sapiens
guaaagaguaucuaguuuc

SEQ ID NO: 1347245 - RNA, 19 nt, Homo sapiens
gguuggcaguuaacucuuu

SEQ ID NO: 1347246 - RNA, 19 nt, Homo sapiens
aggauacacugcuaauauu

SEQ ID NO: 1347247 - RNA, 19 nt, Homo sapiens
gaagcacgauggcucuagu

SEQ ID NO: 1347248 - RNA, 19 nt, Homo sapiens
gaacaaucagauccaauuc

SEQ ID NO: 1347249 - RNA, 19 nt, Homo sapiens
auaggaagcuugauucagu

SEQ ID NO: 1347250 - RNA, 19 nt, Homo sapiens
gcgcugugcagauuugaua

SEQ ID NO: 1347251 - RNA, 19 nt, Homo sapiens
cuuaacaguuggcaucgua

SEQ ID NO: 1347252 - RNA, 19 nt, Homo sapiens
cggaaaggauacacugcua

SEQ ID NO: 1347253 - RNA, 19 nt, Homo sapiens
ggaaaugaggacugucuug

SEQ ID NO: 1347254 - RNA, 19 nt, Homo sapiens
cuagagagccagccaaguu

SEQ ID NO: 1347255 - RNA, 19 nt, Homo sapiens
gaacgcugauaaaauguaa

SEQ ID NO: 1347256 - RNA, 19 nt, Homo sapiens
aaugcgggaucuucaauuu

SEQ ID NO: 1347257 - RNA, 19 nt, Homo sapiens
gguaucaaaucuaugucaa

SEQ ID NO: 1347258 - RNA, 19 nt, Homo sapiens
gcaacauagcccaugcuua

SEQ ID NO: 1347259 - RNA, 19 nt, Homo sapiens
gaacaaggagccaggaacu

SEQ ID NO: 1347260 - RNA, 19 nt, Homo sapiens
gagagaaugucuuuuagau

SEQ ID NO: 1347261 - RNA, 19 nt, Homo sapiens
ccagagagaaugucuuuua

SEQ ID NO: 1347262 - RNA, 19 nt, Homo sapiens
gagggaggguaucaaaucu

SEQ ID NO: 1347263 - RNA, 19 nt, Homo sapiens
gcacuauugcaauuucaaa

SEQ ID NO: 1347264 - RNA, 19 nt, Homo sapiens
cuuagggacuggaugguuu

SEQ ID NO: 1347265 - RNA, 19 nt, Homo sapiens
acagauguguugccauguu

SEQ ID NO: 1347266 - RNA, 19 nt, Homo sapiens
ccacauuccaucagugaaa

SEQ ID NO: 1347267 - RNA, 19 nt, Homo sapiens
gucagcagcuuacaugauc

SEQ ID NO: 1347268 - RNA, 19 nt, Homo sapiens
gaggguaucaaaucuaugu

SEQ ID NO: 1347269 - RNA, 19 nt, Homo sapiens
acaggcaguuguuuacuug

SEQ ID NO: 1347270 - RNA, 19 nt, Homo sapiens
ccugcaggcuuaacaguug

SEQ ID NO: 1347271 - RNA, 19 nt, Homo sapiens
ggauacacugcuaauauug

SEQ ID NO: 1347272 - RNA, 19 nt, Homo sapiens
cuuaauggguucgauggua

SEQ ID NO: 1347273 - RNA, 19 nt, Homo sapiens
ggaacagcaugagccuuug

SEQ ID NO: 1347274 - RNA, 19 nt, Homo sapiens
ggaauggcaacgaagaaga

SEQ ID NO: 1347275 - RNA, 19 nt, Homo sapiens
guugaacgcugauaaaaug

SEQ ID NO: 1347276 - RNA, 19 nt, Homo sapiens
caaacaacucgaugcugua

SEQ ID NO: 1347277 - RNA, 19 nt, Homo sapiens
uggaaacuguucuggaaga

SEQ ID NO: 1347278 - RNA, 19 nt, Homo sapiens
aguacucucuccuguguaa

SEQ ID NO: 1347279 - RNA, 19 nt, Homo sapiens
caaacaaguacaaugauag

SEQ ID NO: 1347280 - RNA, 19 nt, Homo sapiens
gcuaauauugugucuaaca

SEQ ID NO: 1347281 - RNA, 19 nt, Homo sapiens
aaggauacacugcuaauau

SEQ ID NO: 1347282 - RNA, 19 nt, Homo sapiens
aaagccagauucuugacaa

SEQ ID NO: 1347283 - RNA, 19 nt, Homo sapiens
acuaccaucucccaacuuu

SEQ ID NO: 1347284 - RNA, 19 nt, Homo sapiens
aguggaaacuguucuggaa

SEQ ID NO: 1347285 - RNA, 19 nt, Homo sapiens
ugaggacugucuugggaaa

SEQ ID NO: 1347286 - RNA, 19 nt, Homo sapiens
cggaacagcaugagccuuu

SEQ ID NO: 1347287 - RNA, 19 nt, Homo sapiens
uggcacaguucugcaagua

SEQ ID NO: 1347288 - RNA, 19 nt, Homo sapiens
uuccaaaucugucaacuag

SEQ ID NO: 1347289 - RNA, 19 nt, Homo sapiens
caacgaagaagacaaccau

SEQ ID NO: 1347290 - RNA, 19 nt, Homo sapiens
agaacaaucagauccaauu

SEQ ID NO: 1347291 - RNA, 19 nt, Homo sapiens
cacccuguccuguauauuu

SEQ ID NO: 1347292 - RNA, 19 nt, Homo sapiens
caacuaaaagggaagauaa

SEQ ID NO: 1347293 - RNA, 19 nt, Homo sapiens
gggagagacagauguguug

SEQ ID NO: 1347294 - RNA, 19 nt, Homo sapiens
uaaagaguaucuaguuucc

SEQ ID NO: 1347295 - RNA, 19 nt, Homo sapiens
agucagagcucacaacuua

SEQ ID NO: 1347296 - RNA, 19 nt, Homo sapiens
gaaauucugugcaucuaaa

SEQ ID NO: 1347297 - RNA, 19 nt, Homo sapiens
gaagugaccucuuuauuuu

SEQ ID NO: 1347298 - RNA, 19 nt, Homo sapiens
gcacaucuuuguaucauau

SEQ ID NO: 1347299 - RNA, 19 nt, Homo sapiens
gagaaacccuaugaauaua

SEQ ID NO: 1347300 - RNA, 19 nt, Homo sapiens
gaaauaauccuagguguug

SEQ ID NO: 1347301 - RNA, 19 nt, Homo sapiens
gggaaugccugaaugauga

SEQ ID NO: 1347302 - RNA, 19 nt, Homo sapiens
gaaauguaguccugugauu

SEQ ID NO: 1347303 - RNA, 19 nt, Homo sapiens
ggagaaacccuaugaaugu

SEQ ID NO: 1347304 - RNA, 19 nt, Homo sapiens
ugagaaaccuuacgaaugu

SEQ ID NO: 1347305 - RNA, 19 nt, Homo sapiens
gcucacaacuuauuaaaca

SEQ ID NO: 1347306 - RNA, 19 nt, Homo sapiens
ucagagagauuuauacaga

SEQ ID NO: 1347307 - RNA, 19 nt, Homo sapiens
gcaagaaacccuuugaaug

SEQ ID NO: 1347308 - RNA, 19 nt, Homo sapiens
gcccuuaacuaaacgcuua

SEQ ID NO: 1347309 - RNA, 19 nt, Homo sapiens
guucacagcuuauuaguca

SEQ ID NO: 1347310 - RNA, 19 nt, Homo sapiens
caagaaacccuuugaaugu

SEQ ID NO: 1347311 - RNA, 19 nt, Homo sapiens
gcucagaccuuacuagaca

SEQ ID NO: 1347312 - RNA, 19 nt, Homo sapiens
gauaaagugcuuagaauug

SEQ ID NO: 1347313 - RNA, 19 nt, Homo sapiens
gagaaacccuaugaaugua

SEQ ID NO: 1347314 - RNA, 19 nt, Homo sapiens
gagaaacccuaugaaugua

SEQ ID NO: 1347315 - RNA, 19 nt, Homo sapiens
agacauggcucacaguuug

SEQ ID NO: 1347316 - RNA, 19 nt, Homo sapiens
gaugugagaccaagaaauu

SEQ ID NO: 1347317 - RNA, 19 nt, Homo sapiens
ucucagaguucacagcuua

SEQ ID NO: 1347318 - RNA, 19 nt, Homo sapiens
caacaucagagaauucaua

SEQ ID NO: 1347319 - RNA, 19 nt, Homo sapiens
ugagaaacccuaugaauau

SEQ ID NO: 1347320 - RNA, 19 nt, Homo sapiens
gggaaggccuuuaguagug

SEQ ID NO: 1347321 - RNA, 19 nt, Homo sapiens
ugagaagccuuaugaaugu

SEQ ID NO: 1347322 - RNA, 19 nt, Homo sapiens
gaaaguacugugaauaaug

SEQ ID NO: 1347323 - RNA, 19 nt, Homo sapiens
ggaaaguacugugaauaau

SEQ ID NO: 1347324 - RNA, 19 nt, Homo sapiens
gggaaaguacugugaauaa

SEQ ID NO: 1347325 - RNA, 19 nt, Homo sapiens
aguaguggcucaaacuuua

SEQ ID NO: 1347326 - RNA, 19 nt, Homo sapiens
guaauaggcaguuuaagaa

SEQ ID NO: 1347327 - RNA, 19 nt, Homo sapiens
ggagaaauacucuaugaau

SEQ ID NO: 1347328 - RNA, 19 nt, Homo sapiens
gugagaaacccuaugaaua

SEQ ID NO: 1347329 - RNA, 19 nt, Homo sapiens
cagcaaaucauuaacagua

SEQ ID NO: 1347330 - RNA, 19 nt, Homo sapiens
gaagaucugcccacuuuga

SEQ ID NO: 1347331 - RNA, 19 nt, Homo sapiens
caaaugugaucuccuacuu

SEQ ID NO: 1347332 - RNA, 19 nt, Homo sapiens
agaagugaccucuuuauuu

SEQ ID NO: 1347333 - RNA, 19 nt, Homo sapiens
gagaugugauguuggagaa

SEQ ID NO: 1347334 - RNA, 19 nt, Homo sapiens
agacaucccucaagacuca

SEQ ID NO: 1347335 - RNA, 19 nt, Homo sapiens
gaugugauguuggagaauu

SEQ ID NO: 1347336 - RNA, 19 nt, Homo sapiens
gcucaaacuuuacucaaca

SEQ ID NO: 1347337 - RNA, 19 nt, Homo sapiens
ugagaaacccuaugaaugu

SEQ ID NO: 1347338 - RNA, 19 nt, Homo sapiens
gaauguaauaggcaguuua

SEQ ID NO: 1347339 - RNA, 19 nt, Homo sapiens
augaagaucugcccacuuu

SEQ ID NO: 1347340 - RNA, 19 nt, Homo sapiens
uaagaucgauaaagugcuu

SEQ ID NO: 1347341 - RNA, 19 nt, Homo sapiens
gagaagugaccucuuuauu

SEQ ID NO: 1347342 - RNA, 19 nt, Homo sapiens
guagggaggcuuuuaauua

SEQ ID NO: 1347343 - RNA, 19 nt, Homo sapiens
gaauauagggaauguggaa

SEQ ID NO: 1347344 - RNA, 19 nt, Homo sapiens
auacagagaugugauguug

SEQ ID NO: 1347345 - RNA, 19 nt, Homo sapiens
caucauguacuuacuauug

SEQ ID NO: 1347346 - RNA, 19 nt, Homo sapiens
aagaaacccuuugaaugua

SEQ ID NO: 1347347 - RNA, 19 nt, Homo sapiens
agaaagaacucggcucuca

SEQ ID NO: 1347348 - RNA, 19 nt, Homo sapiens
gauaauucagucugucaua

SEQ ID NO: 1347349 - RNA, 19 nt, Homo sapiens
gugagaagccuuaugaaug

SEQ ID NO: 1347350 - RNA, 19 nt, Homo sapiens
ccucaagacucacucauca

SEQ ID NO: 1347351 - RNA, 19 nt, Homo sapiens
gauagauaauucagucugu

SEQ ID NO: 1347352 - RNA, 19 nt, Homo sapiens
gggagaaacccuaugaaug

SEQ ID NO: 1347353 - RNA, 19 nt, Homo sapiens
agaaacccuuugaauguaa

SEQ ID NO: 1347354 - RNA, 19 nt, Homo sapiens
gagaugauugggaauguaa

SEQ ID NO: 1347355 - RNA, 19 nt, Homo sapiens
ucagugauguucagugaug

SEQ ID NO: 1347356 - RNA, 19 nt, Homo sapiens
gaauguuagucaucguuau

SEQ ID NO: 1347357 - RNA, 19 nt, Homo sapiens
auacaugcgugucucagua

SEQ ID NO: 1347358 - RNA, 19 nt, Homo sapiens
cagaaguaaugugugaaua

SEQ ID NO: 1347359 - RNA, 19 nt, Homo sapiens
ugggagaagugaccucuuu

SEQ ID NO: 1347360 - RNA, 19 nt, Homo sapiens
ggaauguaauaggcaguuu

SEQ ID NO: 1347361 - RNA, 19 nt, Homo sapiens
ugagaagccuuaugaaugc

SEQ ID NO: 1347362 - RNA, 19 nt, Homo sapiens
gcucacaguuugcuacaca

SEQ ID NO: 1347363 - RNA, 19 nt, Homo sapiens
gaugauugggaauguaaua

SEQ ID NO: 1347364 - RNA, 19 nt, Homo sapiens
ugacagagagcuaacaaga

SEQ ID NO: 1347365 - RNA, 19 nt, Homo sapiens
guagucuccucuagauauu

SEQ ID NO: 1347366 - RNA, 19 nt, Homo sapiens
caacuuauucagcaucaaa

SEQ ID NO: 1347367 - RNA, 19 nt, Homo sapiens
gagaaaccuuacgaaugua

SEQ ID NO: 1347368 - RNA, 19 nt, Homo sapiens
gagaagccuuaugaaugua

SEQ ID NO: 1347369 - RNA, 19 nt, Homo sapiens
caauugguauucacucaug

SEQ ID NO: 1347370 - RNA, 19 nt, Homo sapiens
gaucagagagauuuauaca

SEQ ID NO: 1347371 - RNA, 19 nt, Homo sapiens
aaccaaaugugaucuccua

SEQ ID NO: 1347372 - RNA, 19 nt, Homo sapiens
gaauguaaggaaugugaaa

SEQ ID NO: 1347373 - RNA, 19 nt, Homo sapiens
acagagaugugauguugga

SEQ ID NO: 1347374 - RNA, 19 nt, Homo sapiens
aauugugccugacaugaua

SEQ ID NO: 1347375 - RNA, 19 nt, Homo sapiens
ggcuauaaauuucaucugu

SEQ ID NO: 1347376 - RNA, 19 nt, Homo sapiens
agacaucagagaauucaua

SEQ ID NO: 1347377 - RNA, 19 nt, Homo sapiens
gagauaauucauaccauug

SEQ ID NO: 1347378 - RNA, 19 nt, Homo sapiens
guguuugacugaagaaaga

SEQ ID NO: 1347379 - RNA, 19 nt, Homo sapiens
ggagaagugaccucuuuau

SEQ ID NO: 1347380 - RNA, 19 nt, Homo sapiens
aauuaugacccacaacuua

SEQ ID NO: 1347381 - RNA, 19 nt, Homo sapiens
gaaacccuaugaauguaag

SEQ ID NO: 1347382 - RNA, 19 nt, Homo sapiens
gagcucacaacuuauuaaa

SEQ ID NO: 1347383 - RNA, 19 nt, Homo sapiens
gaaacccuaugaauguaag

SEQ ID NO: 1347384 - RNA, 19 nt, Homo sapiens
acuaaacgcuuacuucucu

SEQ ID NO: 1347385 - RNA, 19 nt, Homo sapiens
gugagaaaccuuacgaaug

SEQ ID NO: 1347386 - RNA, 19 nt, Homo sapiens
gugagaaacccuaugaaug

SEQ ID NO: 1347387 - RNA, 19 nt, Homo sapiens
ccauccauccuucacauua

SEQ ID NO: 1347388 - RNA, 19 nt, Homo sapiens
gaacuuagucaccauuagg

SEQ ID NO: 1347389 - RNA, 19 nt, Homo sapiens
ucgauaaagugcuuagaau

SEQ ID NO: 1347390 - RNA, 19 nt, Homo sapiens
cauccugauuuguauacua

SEQ ID NO: 1347391 - RNA, 19 nt, Homo sapiens
gaagccuuaugaaugcaaa

SEQ ID NO: 1347392 - RNA, 19 nt, Homo sapiens
ccauugagaagccuuauga

SEQ ID NO: 1347393 - RNA, 19 nt, Homo sapiens
caagaugugagaccaagaa

SEQ ID NO: 1347394 - RNA, 19 nt, Homo sapiens
gcagaaguaaugugugaau

SEQ ID NO: 1347395 - RNA, 19 nt, Homo sapiens
gaaagaaacuucauucaga

SEQ ID NO: 1347396 - RNA, 19 nt, Homo sapiens
gagaagcguuuguagauua

SEQ ID NO: 1347397 - RNA, 19 nt, Homo sapiens
ggaguugucugcuuaauau

SEQ ID NO: 1347398 - RNA, 19 nt, Homo sapiens
ggacagauguuaaauggau

SEQ ID NO: 1347399 - RNA, 19 nt, Homo sapiens
gcacagacuugaaggaguu

SEQ ID NO: 1347400 - RNA, 19 nt, Homo sapiens
gcauagaggcuguguuaua

SEQ ID NO: 1347401 - RNA, 19 nt, Homo sapiens
ggucuaagaugcauaccua

SEQ ID NO: 1347402 - RNA, 19 nt, Homo sapiens
gaagauaugccacuaacuu

SEQ ID NO: 1347403 - RNA, 19 nt, Homo sapiens
gaauagcuauggcaagguu

SEQ ID NO: 1347404 - RNA, 19 nt, Homo sapiens
gaaauuagccacauguaca

SEQ ID NO: 1347405 - RNA, 19 nt, Homo sapiens
gaggacagauguuaaaugg

SEQ ID NO: 1347406 - RNA, 19 nt, Homo sapiens
uaaagggugucuaucauau

SEQ ID NO: 1347407 - RNA, 19 nt, Homo sapiens
ggaauuacuuguggaguug

SEQ ID NO: 1347408 - RNA, 19 nt, Homo sapiens
auaaagcacuaccuaagua

SEQ ID NO: 1347409 - RNA, 19 nt, Homo sapiens
gguuacagauuaucacauu

SEQ ID NO: 1347410 - RNA, 19 nt, Homo sapiens
cauagaggcuguguuauau

SEQ ID NO: 1347411 - RNA, 19 nt, Homo sapiens
gauaacgccuucccuaagu

SEQ ID NO: 1347412 - RNA, 19 nt, Homo sapiens
ggagaagcguuuguagauu

SEQ ID NO: 1347413 - RNA, 19 nt, Homo sapiens
guauaucgaugauggaaau

SEQ ID NO: 1347414 - RNA, 19 nt, Homo sapiens
gaaacuucauucagagguu

SEQ ID NO: 1347415 - RNA, 19 nt, Homo sapiens
uaaccacagugacauugua

SEQ ID NO: 1347416 - RNA, 19 nt, Homo sapiens
gcagggcgcauauuaaaga

SEQ ID NO: 1347417 - RNA, 19 nt, Homo sapiens
cugcaacacuagcuuauuu

SEQ ID NO: 1347418 - RNA, 19 nt, Homo sapiens
ucacauaucagaauaggaa

SEQ ID NO: 1347419 - RNA, 19 nt, Homo sapiens
caaacccuguauccaauuu

SEQ ID NO: 1347420 - RNA, 19 nt, Homo sapiens
aaaggaggcuggaaaucaa

SEQ ID NO: 1347421 - RNA, 19 nt, Homo sapiens
cuaaacuacugauuacuug

SEQ ID NO: 1347422 - RNA, 19 nt, Homo sapiens
uaacugugcuccugacauc

SEQ ID NO: 1347423 - RNA, 19 nt, Homo sapiens
ggaguguucuugaauagca

SEQ ID NO: 1347424 - RNA, 19 nt, Homo sapiens
guaauucucucucuguuuu

SEQ ID NO: 1347425 - RNA, 19 nt, Homo sapiens
auacagaguugucuugguu

SEQ ID NO: 1347426 - RNA, 19 nt, Homo sapiens
gacagacucuaucuugaug

SEQ ID NO: 1347427 - RNA, 19 nt, Homo sapiens
caucacacaccuaccuuua

SEQ ID NO: 1347428 - RNA, 19 nt, Homo sapiens
ucgcauagaggcuguguua

SEQ ID NO: 1347429 - RNA, 19 nt, Homo sapiens
gaacagcaucacacaccua

SEQ ID NO: 1347430 - RNA, 19 nt, Homo sapiens
cagcagggcgcauauuaaa

SEQ ID NO: 1347431 - RNA, 19 nt, Homo sapiens
gcagcagggcgcauauuaa

SEQ ID NO: 1347432 - RNA, 19 nt, Homo sapiens
gaacuggucuaagaugcau

SEQ ID NO: 1347433 - RNA, 19 nt, Homo sapiens
gauaugccacuaacuucua

SEQ ID NO: 1347434 - RNA, 19 nt, Homo sapiens
ggaguucuggacuuaauuu

SEQ ID NO: 1347435 - RNA, 19 nt, Homo sapiens
gcuaaacuacugauuacuu

SEQ ID NO: 1347436 - RNA, 19 nt, Homo sapiens
gaugcuggcuggauuggau

SEQ ID NO: 1347437 - RNA, 19 nt, Homo sapiens
gcagcaccauuucucucua

SEQ ID NO: 1347438 - RNA, 19 nt, Homo sapiens
caagagguauaucgaugau

SEQ ID NO: 1347439 - RNA, 19 nt, Homo sapiens
guucaaacccuguauccaa

SEQ ID NO: 1347440 - RNA, 19 nt, Homo sapiens
gugcuaaacuacugauuac

SEQ ID NO: 1347441 - RNA, 19 nt, Homo sapiens
caucaaugcucaguuaucu

SEQ ID NO: 1347442 - RNA, 19 nt, Homo sapiens
uaagaugcauaccuauauc

SEQ ID NO: 1347443 - RNA, 19 nt, Homo sapiens
gauggaaauuagccacaug

SEQ ID NO: 1347444 - RNA, 19 nt, Homo sapiens
aaauaaagggugucuauca

SEQ ID NO: 1347445 - RNA, 19 nt, Homo sapiens
uauuaaagaucgcauagag

SEQ ID NO: 1347446 - RNA, 19 nt, Homo sapiens
aagggugucuaucauauga

SEQ ID NO: 1347447 - RNA, 19 nt, Homo sapiens
agaaauaaagggugucuau

SEQ ID NO: 1347448 - RNA, 19 nt, Homo sapiens
gguucacccugaccuguuu

SEQ ID NO: 1347449 - RNA, 19 nt, Homo sapiens
cuccugacauccuuccuua

SEQ ID NO: 1347450 - RNA, 19 nt, Homo sapiens
ucaaugcucaguuaucuug

SEQ ID NO: 1347451 - RNA, 19 nt, Homo sapiens
acacauaaagcacuaccua

SEQ ID NO: 1347452 - RNA, 19 nt, Homo sapiens
guuggaggcuguguuguug

SEQ ID NO: 1347453 - RNA, 19 nt, Homo sapiens
ggaggacagauguuaaaug

SEQ ID NO: 1347454 - RNA, 19 nt, Homo sapiens
uaaagcacuaccuaaguaa

SEQ ID NO: 1347455 - RNA, 19 nt, Homo sapiens
ucacacaccuaccuuuaac

SEQ ID NO: 1347456 - RNA, 19 nt, Homo sapiens
ggucuggaguucuggacuu

SEQ ID NO: 1347457 - RNA, 19 nt, Homo sapiens
uuugggaacuggucuaaga

SEQ ID NO: 1347458 - RNA, 19 nt, Homo sapiens
cuaagaugcauaccuauau

SEQ ID NO: 1347459 - RNA, 19 nt, Homo sapiens
ucauguggcuccuggacaa

SEQ ID NO: 1347460 - RNA, 19 nt, Homo sapiens
uaugacagacucuaucuug

SEQ ID NO: 1347461 - RNA, 19 nt, Homo sapiens
uagcagcgugccuauauuu

SEQ ID NO: 1347462 - RNA, 19 nt, Homo sapiens
ggaaauuagccacauguac

SEQ ID NO: 1347463 - RNA, 19 nt, Homo sapiens
uaucgaugauggaaauuag

SEQ ID NO: 1347464 - RNA, 19 nt, Homo sapiens
aauaaagggugucuaucau

SEQ ID NO: 1347465 - RNA, 19 nt, Homo sapiens
cagggaauccuaugacaga

SEQ ID NO: 1347466 - RNA, 19 nt, Homo sapiens
gcauauuaaagaucgcaua

SEQ ID NO: 1347467 - RNA, 19 nt, Homo sapiens
gagagcagcagggcgcaua

SEQ ID NO: 1347468 - RNA, 19 nt, Homo sapiens
gaaauaaagggugucuauc

SEQ ID NO: 1347469 - RNA, 19 nt, Homo sapiens
gcauaccuauaucagacuu

SEQ ID NO: 1347470 - RNA, 19 nt, Homo sapiens
ccaagagguauaucgauga

SEQ ID NO: 1347471 - RNA, 19 nt, Homo sapiens
auaaagggugucuaucaua

SEQ ID NO: 1347472 - RNA, 19 nt, Homo sapiens
ucuaagaugcauaccuaua

SEQ ID NO: 1347473 - RNA, 19 nt, Homo sapiens
cugggaguguucuugaaua

SEQ ID NO: 1347474 - RNA, 19 nt, Homo sapiens
aggaauuacuuguggaguu

SEQ ID NO: 1347475 - RNA, 19 nt, Homo sapiens
gacagauguuaaauggauu

SEQ ID NO: 1347476 - RNA, 19 nt, Homo sapiens
uaaguaauucucucucugu

SEQ ID NO: 1347477 - RNA, 19 nt, Homo sapiens
cauaaagcacuaccuaagu

SEQ ID NO: 1347478 - RNA, 19 nt, Homo sapiens
augggagacuugagugaua

SEQ ID NO: 1347479 - RNA, 19 nt, Homo sapiens
cggagaagcguuuguagau

SEQ ID NO: 1347480 - RNA, 19 nt, Homo sapiens
ggagacuugagugauaaua

SEQ ID NO: 1347481 - RNA, 19 nt, Homo sapiens
uugcacaucuaacaggaaa

SEQ ID NO: 1347482 - RNA, 19 nt, Homo sapiens
cggcugaguuaucggagaa

SEQ ID NO: 1347483 - RNA, 19 nt, Homo sapiens
gacaucaccucuucuugcu

SEQ ID NO: 1347484 - RNA, 19 nt, Homo sapiens
aagauaacgccuucccuaa

SEQ ID NO: 1347485 - RNA, 19 nt, Homo sapiens
gcagguccaacuguaauga

SEQ ID NO: 1347486 - RNA, 19 nt, Homo sapiens
ugggagacuugagugauaa

SEQ ID NO: 1347487 - RNA, 19 nt, Homo sapiens
cuuguggaguugucacuuu

SEQ ID NO: 1347488 - RNA, 19 nt, Homo sapiens
gcgcaugucagccaaguag

SEQ ID NO: 1347489 - RNA, 19 nt, Homo sapiens
agaagcguuuguagauuau

SEQ ID NO: 1347490 - RNA, 19 nt, Homo sapiens
aaugggacaucaccucuuc

SEQ ID NO: 1347491 - RNA, 19 nt, Homo sapiens
ggccacagccacagcuauu

SEQ ID NO: 1347492 - RNA, 19 nt, Homo sapiens
ugacauccuuccuuauggu

SEQ ID NO: 1347493 - RNA, 19 nt, Homo sapiens
ugacagacucuaucuugau

SEQ ID NO: 1347494 - RNA, 19 nt, Homo sapiens
gucuggaguucuggacuua

SEQ ID NO: 1347495 - RNA, 19 nt, Homo sapiens
gaagaaggaugcuguuguu

SEQ ID NO: 1347496 - RNA, 19 nt, Homo sapiens
caggagagguucaaacaua

SEQ ID NO: 1347497 - RNA, 19 nt, Homo sapiens
gaauuccucuuucuuguuu

SEQ ID NO: 1347498 - RNA, 19 nt, Homo sapiens
ggacaggaauggacccaaa

SEQ ID NO: 1347499 - RNA, 19 nt, Homo sapiens
gaccagagauguuuauaca

SEQ ID NO: 1347500 - RNA, 19 nt, Homo sapiens
gguccgagcuuuccgauau

SEQ ID NO: 1347501 - RNA, 19 nt, Homo sapiens
guucaaacauauccuugua

SEQ ID NO: 1347502 - RNA, 19 nt, Homo sapiens
ggacagugaugacaguugu

SEQ ID NO: 1347503 - RNA, 19 nt, Homo sapiens
gaaagcgggugagcuguug

SEQ ID NO: 1347504 - RNA, 19 nt, Homo sapiens
ccaaggacagcaauuauuu

SEQ ID NO: 1347505 - RNA, 19 nt, Homo sapiens
guacagaccagagauguuu

SEQ ID NO: 1347506 - RNA, 19 nt, Homo sapiens
ggaauggacccaaagaaug

SEQ ID NO: 1347507 - RNA, 19 nt, Homo sapiens
gggagaaagucaaaguaga

SEQ ID NO: 1347508 - RNA, 19 nt, Homo sapiens
ucaaacauauccuuguaga

SEQ ID NO: 1347509 - RNA, 19 nt, Homo sapiens
ggguagggcuguagggaaa

SEQ ID NO: 1347510 - RNA, 19 nt, Homo sapiens
caagauggaugaccucaac

SEQ ID NO: 1347511 - RNA, 19 nt, Homo sapiens
aaacauauccuuguagaug

SEQ ID NO: 1347512 - RNA, 19 nt, Homo sapiens
gcacccaguuccugacuuc

SEQ ID NO: 1347513 - RNA, 19 nt, Homo sapiens
gcaagaucauugggaagaa

SEQ ID NO: 1347514 - RNA, 19 nt, Homo sapiens
gcaggaagguggugguuuu

SEQ ID NO: 1347515 - RNA, 19 nt, Homo sapiens
gagggucuguggcuuauca

SEQ ID NO: 1347516 - RNA, 19 nt, Homo sapiens
ucaugaugguggacaguua

SEQ ID NO: 1347517 - RNA, 19 nt, Homo sapiens
ggagaaagucaaaguagau

SEQ ID NO: 1347518 - RNA, 19 nt, Homo sapiens
gaaggacuaucccaagaac

SEQ ID NO: 1347519 - RNA, 19 nt, Homo sapiens
gcauugagccuguguccuu

SEQ ID NO: 1347520 - RNA, 19 nt, Homo sapiens
guagauggagauacuuuaa

SEQ ID NO: 1347521 - RNA, 19 nt, Homo sapiens
ggaggaagaggaagaggaa

SEQ ID NO: 1347522 - RNA, 19 nt, Homo sapiens
ggaagaaggaugcuguugu

SEQ ID NO: 1347523 - RNA, 19 nt, Homo sapiens
ggaagaggaggaagaggaa

SEQ ID NO: 1347524 - RNA, 19 nt, Homo sapiens
ggaaggacuaucccaagaa

SEQ ID NO: 1347525 - RNA, 19 nt, Homo sapiens
caaagaaugguguugguau

SEQ ID NO: 1347526 - RNA, 19 nt, Homo sapiens
gaauggacccaaagaaugg

SEQ ID NO: 1347527 - RNA, 19 nt, Homo sapiens
agauagagccggagcauga

SEQ ID NO: 1347528 - RNA, 19 nt, Homo sapiens
ugaccaaggacagcaauua

SEQ ID NO: 1347529 - RNA, 19 nt, Homo sapiens
ggaaagcgggugagcuguu

SEQ ID NO: 1347530 - RNA, 19 nt, Homo sapiens
gagccuguguccuuugaug

SEQ ID NO: 1347531 - RNA, 19 nt, Homo sapiens
ccucuaggcucuccaucuu

SEQ ID NO: 1347532 - RNA, 19 nt, Homo sapiens
aaagaaugguguugguaug

SEQ ID NO: 1347533 - RNA, 19 nt, Homo sapiens
gggccacgcuguuacaaag

SEQ ID NO: 1347534 - RNA, 19 nt, Homo sapiens
cuguuucgcuucaguguuu

SEQ ID NO: 1347535 - RNA, 19 nt, Homo sapiens
caugguauuucuccuugaa

SEQ ID NO: 1347536 - RNA, 19 nt, Homo sapiens
cggaaggacuaucccaaga

SEQ ID NO: 1347537 - RNA, 19 nt, Homo sapiens
cggauuggcuguggcauug

SEQ ID NO: 1347538 - RNA, 19 nt, Homo sapiens
gaccaaggacagcaauuau

SEQ ID NO: 1347539 - RNA, 19 nt, Homo sapiens
gaaagucaaaguagaucug

SEQ ID NO: 1347540 - RNA, 19 nt, Homo sapiens
cguggacccuggagagaaa

SEQ ID NO: 1347541 - RNA, 19 nt, Homo sapiens
gucccuagcucccggguau

SEQ ID NO: 1347542 - RNA, 19 nt, Homo sapiens
accaguugcugcugucaua

SEQ ID NO: 1347543 - RNA, 19 nt, Homo sapiens
gcacuaccgguuucugaau

SEQ ID NO: 1347544 - RNA, 19 nt, Homo sapiens
ggugggcucuaccaucaug

SEQ ID NO: 1347545 - RNA, 19 nt, Homo sapiens
cgggugggcucuaccauca

SEQ ID NO: 1347546 - RNA, 19 nt, Homo sapiens
gaacgugcggaaugucaug

SEQ ID NO: 1347547 - RNA, 19 nt, Homo sapiens
gcagaccgcccagaucuuc

SEQ ID NO: 1347548 - RNA, 19 nt, Homo sapiens
gauucuagcacuuacaugu

SEQ ID NO: 1347549 - RNA, 19 nt, Homo sapiens
ggagguguguagucacucu

SEQ ID NO: 1347550 - RNA, 19 nt, Homo sapiens
ggacagcaauuauuuugag

SEQ ID NO: 1347551 - RNA, 19 nt, Homo sapiens
gugggugccuguugcaugu

SEQ ID NO: 1347552 - RNA, 19 nt, Homo sapiens
ggaagaggaagaggaggaa

SEQ ID NO: 1347553 - RNA, 19 nt, Homo sapiens
gcaagaccccagagccuua

SEQ ID NO: 1347554 - RNA, 19 nt, Homo sapiens
gggugccuguugcauguuu

SEQ ID NO: 1347555 - RNA, 19 nt, Homo sapiens
ucuaggcucuccaucuuuc

SEQ ID NO: 1347556 - RNA, 19 nt, Homo sapiens
ugguauuucuccuugaauu

SEQ ID NO: 1347557 - RNA, 19 nt, Homo sapiens
cauggaaacucuggugaag

SEQ ID NO: 1347558 - RNA, 19 nt, Homo sapiens
ucgcuucaguguuugauuc

SEQ ID NO: 1347559 - RNA, 19 nt, Homo sapiens
cacccuaucucagcugcua

SEQ ID NO: 1347560 - RNA, 19 nt, Homo sapiens
caagaucauugggaagaag

SEQ ID NO: 1347561 - RNA, 19 nt, Homo sapiens
caucaugggcuguggaauc

SEQ ID NO: 1347562 - RNA, 19 nt, Homo sapiens
cacuaccgguuucugaauu

SEQ ID NO: 1347563 - RNA, 19 nt, Homo sapiens
aggagagguucaaacauau

SEQ ID NO: 1347564 - RNA, 19 nt, Homo sapiens
ggacaguuacgaggaugaa

SEQ ID NO: 1347565 - RNA, 19 nt, Homo sapiens
gauggcaagcuguacaaug

SEQ ID NO: 1347566 - RNA, 19 nt, Homo sapiens
cugagaggccuauggauga

SEQ ID NO: 1347567 - RNA, 19 nt, Homo sapiens
cuagggccuucacuccuuu

SEQ ID NO: 1347568 - RNA, 19 nt, Homo sapiens
gguggacaguuacgaggau

SEQ ID NO: 1347569 - RNA, 19 nt, Homo sapiens
ccagaucuucuucaccaaa

SEQ ID NO: 1347570 - RNA, 19 nt, Homo sapiens
cauugagccuguguccuuu

SEQ ID NO: 1347571 - RNA, 19 nt, Homo sapiens
ggcaagaucauugggaaga

SEQ ID NO: 1347572 - RNA, 19 nt, Homo sapiens
cugguugccugacucugua

SEQ ID NO: 1347573 - RNA, 19 nt, Homo sapiens
ccaccaagcccucuaucuc

SEQ ID NO: 1347574 - RNA, 19 nt, Homo sapiens
ggugccuguugcauguuua

SEQ ID NO: 1347575 - RNA, 19 nt, Homo sapiens
ggaagguggugguuuucuu

SEQ ID NO: 1347576 - RNA, 19 nt, Homo sapiens
uagccuaccaugcugauga

SEQ ID NO: 1347577 - RNA, 19 nt, Homo sapiens
ugaauuccucuuucuuguu

SEQ ID NO: 1347578 - RNA, 19 nt, Homo sapiens
guacuuagggaagggcaaa

SEQ ID NO: 1347579 - RNA, 19 nt, Homo sapiens
ggagagguucaaacauauc

SEQ ID NO: 1347580 - RNA, 19 nt, Homo sapiens
gaugauggcaagcuguaca

SEQ ID NO: 1347581 - RNA, 19 nt, Homo sapiens
gagaaagucaaaguagauc

SEQ ID NO: 1347582 - RNA, 19 nt, Homo sapiens
acccuacgauguaugaaau

SEQ ID NO: 1347583 - RNA, 19 nt, Homo sapiens
gagcuguuggccuugguuu

SEQ ID NO: 1347584 - RNA, 19 nt, Homo sapiens
cuucaguguuugauucuag

SEQ ID NO: 1347585 - RNA, 19 nt, Homo sapiens
gcuggucccucaguacuac

SEQ ID NO: 1347586 - RNA, 19 nt, Homo sapiens
acuagggccuucacuccuu

SEQ ID NO: 1347587 - RNA, 19 nt, Homo sapiens
uguagauggagauacuuua

SEQ ID NO: 1347588 - RNA, 19 nt, Homo sapiens
uugaauuccucuuucuugu

SEQ ID NO: 1347589 - RNA, 19 nt, Homo sapiens
gguauuucuccuugaauuc

SEQ ID NO: 1347590 - RNA, 19 nt, Homo sapiens
agaaugguguugguaugug

SEQ ID NO: 1347591 - RNA, 19 nt, Homo sapiens
ggaagaggaagaggaagag

SEQ ID NO: 1347592 - RNA, 19 nt, Homo sapiens
gcugguugccugacucugu

SEQ ID NO: 1347593 - RNA, 19 nt, Homo sapiens
cuacgauguaugaaaugua

SEQ ID NO: 1347594 - RNA, 19 nt, Homo sapiens
gaagcugagaggccuaugg

SEQ ID NO: 1347595 - RNA, 19 nt, Homo sapiens
gaacagagguggcgacuuc

SEQ ID NO: 1347596 - RNA, 19 nt, Homo sapiens
gaaacaagcugcccugguu

SEQ ID NO: 1347597 - RNA, 19 nt, Homo sapiens
uaaaggagguuugaaagua

SEQ ID NO: 1347598 - RNA, 19 nt, Homo sapiens
ggaaacagcugaaacuagu

SEQ ID NO: 1347599 - RNA, 19 nt, Homo sapiens
ccaaagggcagaaauaaua

SEQ ID NO: 1347600 - RNA, 19 nt, Homo sapiens
gggcagaaauaauauguuu

SEQ ID NO: 1347601 - RNA, 19 nt, Homo sapiens
gaucuuagcucacuacaac

SEQ ID NO: 1347602 - RNA, 19 nt, Homo sapiens
caacucaccuacugacaaa

SEQ ID NO: 1347603 - RNA, 19 nt, Homo sapiens
ccaaauaaaccagauguua

SEQ ID NO: 1347604 - RNA, 19 nt, Homo sapiens
gaucucagcucuaaacaag

SEQ ID NO: 1347605 - RNA, 19 nt, Homo sapiens
gcuaugauauucuagaaga

SEQ ID NO: 1347606 - RNA, 19 nt, Homo sapiens
ggugagaaguuaccaaguu

SEQ ID NO: 1347607 - RNA, 19 nt, Homo sapiens
gcaucucucuucagccuua

SEQ ID NO: 1347608 - RNA, 19 nt, Homo sapiens
ggagagcaguggauugaga

SEQ ID NO: 1347609 - RNA, 19 nt, Homo sapiens
cagaguguguugaguuaua

SEQ ID NO: 1347610 - RNA, 19 nt, Homo sapiens
gaaguuaccaaguuuguau

SEQ ID NO: 1347611 - RNA, 19 nt, Homo sapiens
gcgaguagcaagucauaua

SEQ ID NO: 1347612 - RNA, 19 nt, Homo sapiens
aaccagauguuacaaauga

SEQ ID NO: 1347613 - RNA, 19 nt, Homo sapiens
gcacacagaugagacgaau

SEQ ID NO: 1347614 - RNA, 19 nt, Homo sapiens
gcaagaguggcuaugaaua

SEQ ID NO: 1347615 - RNA, 19 nt, Homo sapiens
gcaguaugguuuaacaugu

SEQ ID NO: 1347616 - RNA, 19 nt, Homo sapiens
cugaguagcugggauuaua

SEQ ID NO: 1347617 - RNA, 19 nt, Homo sapiens
cuaccuugauuccagauua

SEQ ID NO: 1347618 - RNA, 19 nt, Homo sapiens
gugagaaguuaccaaguuu

SEQ ID NO: 1347619 - RNA, 19 nt, Homo sapiens
aaccagaagucgaaacuaa

SEQ ID NO: 1347620 - RNA, 19 nt, Homo sapiens
caggaauacuuguuugaaa

SEQ ID NO: 1347621 - RNA, 19 nt, Homo sapiens
gagaaacagcauaggguua

SEQ ID NO: 1347622 - RNA, 19 nt, Homo sapiens
ugacucaccaucuuuauuu

SEQ ID NO: 1347623 - RNA, 19 nt, Homo sapiens
gaaaggaucaaagaacuau

SEQ ID NO: 1347624 - RNA, 19 nt, Homo sapiens
gacaacuucuugaucauau

SEQ ID NO: 1347625 - RNA, 19 nt, Homo sapiens
gaagaggucugggcaagag

SEQ ID NO: 1347626 - RNA, 19 nt, Homo sapiens
ugaaaugacuggaaaauug

SEQ ID NO: 1347627 - RNA, 19 nt, Homo sapiens
ggaaugcuugggagaguua

SEQ ID NO: 1347628 - RNA, 19 nt, Homo sapiens
ggauuaugcacaaacuuua

SEQ ID NO: 1347629 - RNA, 19 nt, Homo sapiens
gucagaguguguugaguua

SEQ ID NO: 1347630 - RNA, 19 nt, Homo sapiens
guuacagacucuuuagauu

SEQ ID NO: 1347631 - RNA, 19 nt, Homo sapiens
cacugacucuucugaaaua

SEQ ID NO: 1347632 - RNA, 19 nt, Homo sapiens
gggcaagaguggcuaugaa

SEQ ID NO: 1347633 - RNA, 19 nt, Homo sapiens
cugaggaugucuuggaaua

SEQ ID NO: 1347634 - RNA, 19 nt, Homo sapiens
gugaauauauuguggaucu

SEQ ID NO: 1347635 - RNA, 19 nt, Homo sapiens
ggacacaaucguucaguau

SEQ ID NO: 1347636 - RNA, 19 nt, Homo sapiens
gaaccguguaucaguguua

SEQ ID NO: 1347637 - RNA, 19 nt, Homo sapiens
cgaaguaucccgacggaaa

SEQ ID NO: 1347638 - RNA, 19 nt, Homo sapiens
caguaugguuuaacaugua

SEQ ID NO: 1347639 - RNA, 19 nt, Homo sapiens
ggaagagaaauguaaguau

SEQ ID NO: 1347640 - RNA, 19 nt, Homo sapiens
aaaggagguuugaaaguau

SEQ ID NO: 1347641 - RNA, 19 nt, Homo sapiens
gauaggagaggcuaguauu

SEQ ID NO: 1347642 - RNA, 19 nt, Homo sapiens
gaagaggagaaacagcaua

SEQ ID NO: 1347643 - RNA, 19 nt, Homo sapiens
gaagugaagaggagaaaca

SEQ ID NO: 1347644 - RNA, 19 nt, Homo sapiens
ugacaaagaagacuacaug

SEQ ID NO: 1347645 - RNA, 19 nt, Homo sapiens
gggauuaugcacaaacuuu

SEQ ID NO: 1347646 - RNA, 19 nt, Homo sapiens
gaauaacaauugucaugcu

SEQ ID NO: 1347647 - RNA, 19 nt, Homo sapiens
ggccaaagcccacauucaa

SEQ ID NO: 1347648 - RNA, 19 nt, Homo sapiens
gagaguuaaucuuggucua

SEQ ID NO: 1347649 - RNA, 19 nt, Homo sapiens
gguuaaagcgccucucauu

SEQ ID NO: 1347650 - RNA, 19 nt, Homo sapiens
auacugaaaugacuggaaa

SEQ ID NO: 1347651 - RNA, 19 nt, Homo sapiens
gccacugacucuucugaaa

SEQ ID NO: 1347652 - RNA, 19 nt, Homo sapiens
gaccaaagagucaggaaug

SEQ ID NO: 1347653 - RNA, 19 nt, Homo sapiens
auagacaacuucuugauca

SEQ ID NO: 1347654 - RNA, 19 nt, Homo sapiens
uaaaguauccccaguaauu

SEQ ID NO: 1347655 - RNA, 19 nt, Homo sapiens
caauugucaugcuguuaaa

SEQ ID NO: 1347656 - RNA, 19 nt, Homo sapiens
gaauagacaacuucuugau

SEQ ID NO: 1347657 - RNA, 19 nt, Homo sapiens
ugaccgaccuacgaacuuu

SEQ ID NO: 1347658 - RNA, 19 nt, Homo sapiens
agacuacgccuccacauga

SEQ ID NO: 1347659 - RNA, 19 nt, Homo sapiens
cagccuuaaugccuuauuu

SEQ ID NO: 1347660 - RNA, 19 nt, Homo sapiens
gagacauugccuuuaauuu

SEQ ID NO: 1347661 - RNA, 19 nt, Homo sapiens
caaauaaaccagauguuac

SEQ ID NO: 1347662 - RNA, 19 nt, Homo sapiens
uaaacaagccgcagaagag

SEQ ID NO: 1347663 - RNA, 19 nt, Homo sapiens
gcuggcaauugcauauauu

SEQ ID NO: 1347664 - RNA, 19 nt, Homo sapiens
ggacgaaagugggauacag

SEQ ID NO: 1347665 - RNA, 19 nt, Homo sapiens
gcaccauggagaaacauuu

SEQ ID NO: 1347666 - RNA, 19 nt, Homo sapiens
ugaauacagucauuacucu

SEQ ID NO: 1347667 - RNA, 19 nt, Homo sapiens
ucauggacagcuaaauuua

SEQ ID NO: 1347668 - RNA, 19 nt, Homo sapiens
gaccuacgaacuuuggaua

SEQ ID NO: 1347669 - RNA, 19 nt, Homo sapiens
auacacauaugcagacuca

SEQ ID NO: 1347670 - RNA, 19 nt, Homo sapiens
caaagggcagaaauaauau

SEQ ID NO: 1347671 - RNA, 19 nt, Homo sapiens
gcuaucaucaugcauguau

SEQ ID NO: 1347672 - RNA, 19 nt, Homo sapiens
uguaguagcuggcaauugc

SEQ ID NO: 1347673 - RNA, 19 nt, Homo sapiens
aaacagaggcuaggaaagu

SEQ ID NO: 1347674 - RNA, 19 nt, Homo sapiens
gcacgaucuuagcucacua

SEQ ID NO: 1347675 - RNA, 19 nt, Homo sapiens
aagccgaucucagcucuaa

SEQ ID NO: 1347676 - RNA, 19 nt, Homo sapiens
ggucagaguguguugaguu

SEQ ID NO: 1347677 - RNA, 19 nt, Homo sapiens
gaggaugucuuggaauaac

SEQ ID NO: 1347678 - RNA, 19 nt, Homo sapiens
gcgcccagccucaguuauu

SEQ ID NO: 1347679 - RNA, 19 nt, Homo sapiens
caaagagucaggaaugcuu

SEQ ID NO: 1347680 - RNA, 19 nt, Homo sapiens
gaauacuuguuugaaagga

SEQ ID NO: 1347681 - RNA, 19 nt, Homo sapiens
caaaucaggaauacuuguu

SEQ ID NO: 1347682 - RNA, 19 nt, Homo sapiens
ccuacuuucuggaacuaua

SEQ ID NO: 1347683 - RNA, 19 nt, Homo sapiens
acaauugucaugcuguuaa

SEQ ID NO: 1347684 - RNA, 19 nt, Homo sapiens
ucuggagggugagaaguua

SEQ ID NO: 1347685 - RNA, 19 nt, Homo sapiens
gaguuaaucuuggucuauc

SEQ ID NO: 1347686 - RNA, 19 nt, Homo sapiens
gaucauauggauucaugga

SEQ ID NO: 1347687 - RNA, 19 nt, Homo sapiens
ccuagugcuucccuuauug

SEQ ID NO: 1347688 - RNA, 19 nt, Homo sapiens
aguaucagcuugccuguag

SEQ ID NO: 1347689 - RNA, 19 nt, Homo sapiens
agaaacagcauaggguuaa

SEQ ID NO: 1347690 - RNA, 19 nt, Homo sapiens
uacgaacuuuggauacuuu

SEQ ID NO: 1347691 - RNA, 19 nt, Homo sapiens
gaaccagaagucgaaacua

SEQ ID NO: 1347692 - RNA, 19 nt, Homo sapiens
cauaaagaccaaagaguca

SEQ ID NO: 1347693 - RNA, 19 nt, Homo sapiens
aaacaagcugcccugguua

SEQ ID NO: 1347694 - RNA, 19 nt, Homo sapiens
auaauaaguuggcgagcuu

SEQ ID NO: 1347695 - RNA, 19 nt, Homo sapiens
ccacugaaguuugugcuua

SEQ ID NO: 1347696 - RNA, 19 nt, Homo sapiens
gcagcucacugaucucuug

SEQ ID NO: 1347697 - RNA, 19 nt, Homo sapiens
ccaaauacccggcauuaug

SEQ ID NO: 1347698 - RNA, 19 nt, Homo sapiens
ggccaacccuugccauuga

SEQ ID NO: 1347699 - RNA, 19 nt, Homo sapiens
ggccaaauacccggcauua

SEQ ID NO: 1347700 - RNA, 19 nt, Homo sapiens
ucauccagcuucucucuga

SEQ ID NO: 1347701 - RNA, 19 nt, Homo sapiens
ccuggacacuuucuuguug

SEQ ID NO: 1347702 - RNA, 19 nt, Homo sapiens
gggcuggacugcgcuaaug

SEQ ID NO: 1347703 - RNA, 19 nt, Homo sapiens
gcaguacucacucaaguuc

SEQ ID NO: 1347704 - RNA, 19 nt, Homo sapiens
caaauacccggcauuaugg

SEQ ID NO: 1347705 - RNA, 19 nt, Homo sapiens
gcaugagguucaccaccaa

SEQ ID NO: 1347706 - RNA, 19 nt, Homo sapiens
gucaccaccuggacacuuu

SEQ ID NO: 1347707 - RNA, 19 nt, Homo sapiens
gccggaagauggucaacga

SEQ ID NO: 1347708 - RNA, 19 nt, Homo sapiens
cacugaaguuugugcuuaa

SEQ ID NO: 1347709 - RNA, 19 nt, Homo sapiens
ucagcgcccugcagaguga

SEQ ID NO: 1347710 - RNA, 19 nt, Homo sapiens
gacacuuucuuguugaauc

SEQ ID NO: 1347711 - RNA, 19 nt, Homo sapiens
gcuuccagguguacuguga

SEQ ID NO: 1347712 - RNA, 19 nt, Homo sapiens
caacugugccgccuucuac

SEQ ID NO: 1347713 - RNA, 19 nt, Homo sapiens
gcgacucccuccugaagca

SEQ ID NO: 1347714 - RNA, 19 nt, Homo sapiens
ggcuagggcucaagaggau

SEQ ID NO: 1347715 - RNA, 19 nt, Homo sapiens
ccauuuggcagcucacuga

SEQ ID NO: 1347716 - RNA, 19 nt, Homo sapiens
gcaccucagcauccucauu

SEQ ID NO: 1347717 - RNA, 19 nt, Homo sapiens
gggcugccaucccauuucu

SEQ ID NO: 1347718 - RNA, 19 nt, Homo sapiens
gagaauggcacggccuaug

SEQ ID NO: 1347719 - RNA, 19 nt, Homo sapiens
gcaacugccacacguccaa

SEQ ID NO: 1347720 - RNA, 19 nt, Homo sapiens
caccucagcauccucauug

SEQ ID NO: 1347721 - RNA, 19 nt, Homo sapiens
gugcccaccugcucucugu

SEQ ID NO: 1347722 - RNA, 19 nt, Homo sapiens
caacagcgccguggucacu

SEQ ID NO: 1347723 - RNA, 19 nt, Homo sapiens
ccaccuggacacuuucuug

SEQ ID NO: 1347724 - RNA, 19 nt, Homo sapiens
gaggccaacccuugccauu

SEQ ID NO: 1347725 - RNA, 19 nt, Homo sapiens
gggcugggaugaggcuugu

SEQ ID NO: 1347726 - RNA, 19 nt, Homo sapiens
ccacacguccaaccucaau

SEQ ID NO: 1347727 - RNA, 19 nt, Homo sapiens
uggaggacuuugagaaugg

SEQ ID NO: 1347728 - RNA, 19 nt, Homo sapiens
gauggcgucuacucugucu

SEQ ID NO: 1347729 - RNA, 19 nt, Homo sapiens
uggcaguacucacucaagu

SEQ ID NO: 1347730 - RNA, 19 nt, Homo sapiens
gugccgugcucuuccugaa

SEQ ID NO: 1347731 - RNA, 19 nt, Homo sapiens
ccugcucucugucucaaau

SEQ ID NO: 1347732 - RNA, 19 nt, Homo sapiens
caaccucaaugggcaguac

SEQ ID NO: 1347733 - RNA, 19 nt, Homo sapiens
gaacuccgucagcgacauc

SEQ ID NO: 1347734 - RNA, 19 nt, Homo sapiens
aaugggaagcucuugguuu

SEQ ID NO: 1347735 - RNA, 19 nt, Homo sapiens
gcggacccacucuccagua

SEQ ID NO: 1347736 - RNA, 19 nt, Homo sapiens
cagcgaccauucagagaac

SEQ ID NO: 1347737 - RNA, 19 nt, Homo sapiens
ccagguguacugugacaug

SEQ ID NO: 1347738 - RNA, 19 nt, Homo sapiens
ugacuccggugcuguuugc

SEQ ID NO: 1347739 - RNA, 19 nt, Homo sapiens
ucucuugccucugcugaug

SEQ ID NO: 1347740 - RNA, 19 nt, Homo sapiens
uggcgucuacucugucuuu

SEQ ID NO: 1347741 - RNA, 19 nt, Homo sapiens
caccguggcugacuauucc

SEQ ID NO: 1347742 - RNA, 19 nt, Homo sapiens
cuggaggacuuugagaaug

SEQ ID NO: 1347743 - RNA, 19 nt, Homo sapiens
cuggacacuuucuuguuga

SEQ ID NO: 1347744 - RNA, 19 nt, Homo sapiens
ccaaggcugagaccaguuc

SEQ ID NO: 1347745 - RNA, 19 nt, Homo sapiens
ccaccucaccgggcaaaug

SEQ ID NO: 1347746 - RNA, 19 nt, Homo sapiens
ggcaguacucacucaaguu

SEQ ID NO: 1347747 - RNA, 19 nt, Homo sapiens
gacagcgaccauucagaga

SEQ ID NO: 1347748 - RNA, 19 nt, Homo sapiens
gcucaccguggcugacuau

SEQ ID NO: 1347749 - RNA, 19 nt, Homo sapiens
ugucuggacguccuccuaa

SEQ ID NO: 1347750 - RNA, 19 nt, Homo sapiens
uuuggcagcucacugaucu

SEQ ID NO: 1347751 - RNA, 19 nt, Homo sapiens
ucaccguggcugacuauuc

SEQ ID NO: 1347752 - RNA, 19 nt, Homo sapiens
ggaccuggaggacuuugag

SEQ ID NO: 1347753 - RNA, 19 nt, Homo sapiens
gaacaugacuucuuuagau

SEQ ID NO: 1347754 - RNA, 19 nt, Homo sapiens
ggacaaguguuaucgcuua

SEQ ID NO: 1347755 - RNA, 19 nt, Homo sapiens
aaagagagcuggaaugaaa

SEQ ID NO: 1347756 - RNA, 19 nt, Homo sapiens
gaaugaacaugacuucuuu

SEQ ID NO: 1347757 - RNA, 19 nt, Homo sapiens
ggaaagugaugaagcauug

SEQ ID NO: 1347758 - RNA, 19 nt, Homo sapiens
gaagauccacuuauuguaa

SEQ ID NO: 1347759 - RNA, 19 nt, Homo sapiens
gcagaaaggcggcaaauug

SEQ ID NO: 1347760 - RNA, 19 nt, Homo sapiens
aaacagauaccuccuauuu

SEQ ID NO: 1347761 - RNA, 19 nt, Homo sapiens
gaaaagaccucaccaaaag

SEQ ID NO: 1347762 - RNA, 19 nt, Homo sapiens
ggggaaagaucauuauuua

SEQ ID NO: 1347763 - RNA, 19 nt, Homo sapiens
ggaguuugcuuguuugaau

SEQ ID NO: 1347764 - RNA, 19 nt, Homo sapiens
caaaaugacugugcuaaua

SEQ ID NO: 1347765 - RNA, 19 nt, Homo sapiens
gcacaaaagucaacaaaau

SEQ ID NO: 1347766 - RNA, 19 nt, Homo sapiens
ucaaagugcaguagaaaua

SEQ ID NO: 1347767 - RNA, 19 nt, Homo sapiens
gaaagucagcccuuagauu

SEQ ID NO: 1347768 - RNA, 19 nt, Homo sapiens
ucaagucucuccuacauau

SEQ ID NO: 1347769 - RNA, 19 nt, Homo sapiens
caaauuguaugcaguaaag

SEQ ID NO: 1347770 - RNA, 19 nt, Homo sapiens
ucagaaccauccagaauga

SEQ ID NO: 1347771 - RNA, 19 nt, Homo sapiens
gcccuuagauucagauaga

SEQ ID NO: 1347772 - RNA, 19 nt, Homo sapiens
ggauuuaacacaccaauug

SEQ ID NO: 1347773 - RNA, 19 nt, Homo sapiens
gaaaggcggcaaauuguau

SEQ ID NO: 1347774 - RNA, 19 nt, Homo sapiens
gaccguaucuggauuuagu

SEQ ID NO: 1347775 - RNA, 19 nt, Homo sapiens
cgagaacccugcuguacaa

SEQ ID NO: 1347776 - RNA, 19 nt, Homo sapiens
gaaaguccauuagaaaguc

SEQ ID NO: 1347777 - RNA, 19 nt, Homo sapiens
gaaugcaguugaaaaguua

SEQ ID NO: 1347778 - RNA, 19 nt, Homo sapiens
agagauggcugugaaauau

SEQ ID NO: 1347779 - RNA, 19 nt, Homo sapiens
ugaaacaccacaacaagua

SEQ ID NO: 1347780 - RNA, 19 nt, Homo sapiens
gaucuggaguuagcucuuu

SEQ ID NO: 1347781 - RNA, 19 nt, Homo sapiens
ucacagacauggaaucauc

SEQ ID NO: 1347782 - RNA, 19 nt, Homo sapiens
ggacucguaugcccuaugu

SEQ ID NO: 1347783 - RNA, 19 nt, Homo sapiens
ugaaacagauaccuccuau

SEQ ID NO: 1347784 - RNA, 19 nt, Homo sapiens
gaaaggaauauagucagua

SEQ ID NO: 1347785 - RNA, 19 nt, Homo sapiens
aagcagacaugaucaacaa

SEQ ID NO: 1347786 - RNA, 19 nt, Homo sapiens
aauacaggcuuaacaguug

SEQ ID NO: 1347787 - RNA, 19 nt, Homo sapiens
ggaaaaggcuggccacauc

SEQ ID NO: 1347788 - RNA, 19 nt, Homo sapiens
agucuagccucguguuaua

SEQ ID NO: 1347789 - RNA, 19 nt, Homo sapiens
guauaagcauaacgaaaug

SEQ ID NO: 1347790 - RNA, 19 nt, Homo sapiens
ccacagcagucccaaaugg

SEQ ID NO: 1347791 - RNA, 19 nt, Homo sapiens
caaguguuaucgcuuauca

SEQ ID NO: 1347792 - RNA, 19 nt, Homo sapiens
gcccauucauuguccauuu

SEQ ID NO: 1347793 - RNA, 19 nt, Homo sapiens
gauuuagucuguagcacaa

SEQ ID NO: 1347794 - RNA, 19 nt, Homo sapiens
gaacccugcuguacaagag

SEQ ID NO: 1347795 - RNA, 19 nt, Homo sapiens
ucugaaacaucacagcuuu

SEQ ID NO: 1347796 - RNA, 19 nt, Homo sapiens
ggaaugcaguugaaaaguu

SEQ ID NO: 1347797 - RNA, 19 nt, Homo sapiens
gccuuauucuagcaaauua

SEQ ID NO: 1347798 - RNA, 19 nt, Homo sapiens
ucaagacccugcaaacauc

SEQ ID NO: 1347799 - RNA, 19 nt, Homo sapiens
caaacaaugucuacuuggu

SEQ ID NO: 1347800 - RNA, 19 nt, Homo sapiens
guucauaucccauggcuau

SEQ ID NO: 1347801 - RNA, 19 nt, Homo sapiens
ggaaaguccauuagaaagu

SEQ ID NO: 1347802 - RNA, 19 nt, Homo sapiens
gagaugcacuggcacuaag

SEQ ID NO: 1347803 - RNA, 19 nt, Homo sapiens
gggaaaaucugcagcauca

SEQ ID NO: 1347804 - RNA, 19 nt, Homo sapiens
gaacucugauucaucuuuu

SEQ ID NO: 1347805 - RNA, 19 nt, Homo sapiens
acuggacgcucuuguguaa

SEQ ID NO: 1347806 - RNA, 19 nt, Homo sapiens
aaucaugucuugaaacagu

SEQ ID NO: 1347807 - RNA, 19 nt, Homo sapiens
gauccuguaugccacauca

SEQ ID NO: 1347808 - RNA, 19 nt, Homo sapiens
ccaggaaagugaugaagca

SEQ ID NO: 1347809 - RNA, 19 nt, Homo sapiens
gaaacaccacaacaaguau

SEQ ID NO: 1347810 - RNA, 19 nt, Homo sapiens
gaguuugcuuguuugaauu

SEQ ID NO: 1347811 - RNA, 19 nt, Homo sapiens
gaggagggcgugaauagga

SEQ ID NO: 1347812 - RNA, 19 nt, Homo sapiens
aacaaugucuacuugguaa

SEQ ID NO: 1347813 - RNA, 19 nt, Homo sapiens
gaugaugggcgaauucuag

SEQ ID NO: 1347814 - RNA, 19 nt, Homo sapiens
ugaacucgaugaagacugu

SEQ ID NO: 1347815 - RNA, 19 nt, Homo sapiens
ugugugaacucgaugaaga

SEQ ID NO: 1347816 - RNA, 19 nt, Homo sapiens
ggaaguuucuugggaagca

SEQ ID NO: 1347817 - RNA, 19 nt, Homo sapiens
ccauugagacgaaagguuu

SEQ ID NO: 1347818 - RNA, 19 nt, Homo sapiens
gcaaauuguaugcaguaaa

SEQ ID NO: 1347819 - RNA, 19 nt, Homo sapiens
aaacaaugucuacuuggua

SEQ ID NO: 1347820 - RNA, 19 nt, Homo sapiens
uagaugcaauggauauuuc

SEQ ID NO: 1347821 - RNA, 19 nt, Homo sapiens
aauguuagguccuccuuug

SEQ ID NO: 1347822 - RNA, 19 nt, Homo sapiens
guacaagagaguaaccaaa

SEQ ID NO: 1347823 - RNA, 19 nt, Homo sapiens
aaagucagcccuuagauuc

SEQ ID NO: 1347824 - RNA, 19 nt, Homo sapiens
aaacaacaaacaccagaaa

SEQ ID NO: 1347825 - RNA, 19 nt, Homo sapiens
gcuaauaaggagaacauug

SEQ ID NO: 1347826 - RNA, 19 nt, Homo sapiens
acacaagucaguuagguuu

SEQ ID NO: 1347827 - RNA, 19 nt, Homo sapiens
cuaauuuacuccagucuag

SEQ ID NO: 1347828 - RNA, 19 nt, Homo sapiens
aaacaucacagcuuucuca

SEQ ID NO: 1347829 - RNA, 19 nt, Homo sapiens
gagauggcugugaaauaua

SEQ ID NO: 1347830 - RNA, 19 nt, Homo sapiens
gaagagauggcugugaaau

SEQ ID NO: 1347831 - RNA, 19 nt, Homo sapiens
ugaaaggaauauagucagu

SEQ ID NO: 1347832 - RNA, 19 nt, Homo sapiens
acagauaccuccuauuuug

SEQ ID NO: 1347833 - RNA, 19 nt, Homo sapiens
acaaagagagcuggaauga

SEQ ID NO: 1347834 - RNA, 19 nt, Homo sapiens
gguccaagcugagagagau

SEQ ID NO: 1347835 - RNA, 19 nt, Homo sapiens
aagagggacuacuuaaguu

SEQ ID NO: 1347836 - RNA, 19 nt, Homo sapiens
gaguuggaaugcaguugaa

SEQ ID NO: 1347837 - RNA, 19 nt, Homo sapiens
cauauuaaacugacggauu

SEQ ID NO: 1347838 - RNA, 19 nt, Homo sapiens
gcucuagacuaccuucaca

SEQ ID NO: 1347839 - RNA, 19 nt, Homo sapiens
ccagccagaugaugaaaca

SEQ ID NO: 1347840 - RNA, 19 nt, Homo sapiens
gaugaaacaccacaacaag

SEQ ID NO: 1347841 - RNA, 19 nt, Homo sapiens
ucagauagaagcauuaaag

SEQ ID NO: 1347842 - RNA, 19 nt, Homo sapiens
uaacacaccaauugcagaa

SEQ ID NO: 1347843 - RNA, 19 nt, Homo sapiens
uagacuaccuucacagaca

SEQ ID NO: 1347844 - RNA, 19 nt, Homo sapiens
guaucuggauuuagucugu

SEQ ID NO: 1347845 - RNA, 19 nt, Homo sapiens
acacuacgccuuauucuag

SEQ ID NO: 1347846 - RNA, 19 nt, Homo sapiens
uuacagcuuucacagaguu

SEQ ID NO: 1347847 - RNA, 19 nt, Homo sapiens
cagaaaggcggcaaauugu

SEQ ID NO: 1347848 - RNA, 19 nt, Homo sapiens
gcacuuggaguuugcuugu

SEQ ID NO: 1347849 - RNA, 19 nt, Homo sapiens
agauggcugugaaauauau

SEQ ID NO: 1347850 - RNA, 19 nt, Homo sapiens
gaggaauucagcauaguga

SEQ ID NO: 1347851 - RNA, 19 nt, Homo sapiens
gaaaacugaagcaucaaua

SEQ ID NO: 1347852 - RNA, 19 nt, Homo sapiens
gaguauaagcauaacgaaa

SEQ ID NO: 1347853 - RNA, 19 nt, Homo sapiens
gaagagagcuccuggcauu

SEQ ID NO: 1347854 - RNA, 19 nt, Homo sapiens
gggaauagcuggagauaca

SEQ ID NO: 1347855 - RNA, 19 nt, Homo sapiens
caucucagcacauauaaua

SEQ ID NO: 1347856 - RNA, 19 nt, Homo sapiens
uaaggcaccuauucucuuu

SEQ ID NO: 1347857 - RNA, 19 nt, Homo sapiens
gcagaaggguuccaagaag

SEQ ID NO: 1347858 - RNA, 19 nt, Homo sapiens
gcaccaagcucagccuuuc

SEQ ID NO: 1347859 - RNA, 19 nt, Homo sapiens
gcucaucucagcacauaua

SEQ ID NO: 1347860 - RNA, 19 nt, Homo sapiens
ccaagucacuguucagcuu

SEQ ID NO: 1347861 - RNA, 19 nt, Homo sapiens
ccacagagccgccuugaca

SEQ ID NO: 1347862 - RNA, 19 nt, Homo sapiens
cgauuccggucuuuccuua

SEQ ID NO: 1347863 - RNA, 19 nt, Homo sapiens
ccaccucacucuucagaug

SEQ ID NO: 1347864 - RNA, 19 nt, Homo sapiens
acaaagggcucggacgauu

SEQ ID NO: 1347865 - RNA, 19 nt, Homo sapiens
uacaggaaauggcagagua

SEQ ID NO: 1347866 - RNA, 19 nt, Homo sapiens
caagggagggcucaaagaa

SEQ ID NO: 1347867 - RNA, 19 nt, Homo sapiens
ggccauccaucaaacaaga

SEQ ID NO: 1347868 - RNA, 19 nt, Homo sapiens
aaagaaggcugguggaaaa

SEQ ID NO: 1347869 - RNA, 19 nt, Homo sapiens
caaagaaggcugguggaaa

SEQ ID NO: 1347870 - RNA, 19 nt, Homo sapiens
gcaagugacucagccucuu

SEQ ID NO: 1347871 - RNA, 19 nt, Homo sapiens
ggaaagauuaagucacaug

SEQ ID NO: 1347872 - RNA, 19 nt, Homo sapiens
ugggaaagauuaagucaca

SEQ ID NO: 1347873 - RNA, 19 nt, Homo sapiens
ggaaauggcagaguacgau

SEQ ID NO: 1347874 - RNA, 19 nt, Homo sapiens
ggaccauacacgugucuaa

SEQ ID NO: 1347875 - RNA, 19 nt, Homo sapiens
gaaagauuaagucacaugu

SEQ ID NO: 1347876 - RNA, 19 nt, Homo sapiens
caccagaggcccaaucuug

SEQ ID NO: 1347877 - RNA, 19 nt, Homo sapiens
gaaauggcagaguacgauu

SEQ ID NO: 1347878 - RNA, 19 nt, Homo sapiens
cgaguuggcugucaguuuu

SEQ ID NO: 1347879 - RNA, 19 nt, Homo sapiens
guaaggcaccuauucucuu

SEQ ID NO: 1347880 - RNA, 19 nt, Homo sapiens
ggaggagggacuaccuaaa

SEQ ID NO: 1347881 - RNA, 19 nt, Homo sapiens
aggcucaucucagcacaua

SEQ ID NO: 1347882 - RNA, 19 nt, Homo sapiens
ggcagaaggguuccaagaa

SEQ ID NO: 1347883 - RNA, 19 nt, Homo sapiens
ucaaacaagagauaagaug

SEQ ID NO: 1347884 - RNA, 19 nt, Homo sapiens
caucaaacaagagauaaga

SEQ ID NO: 1347885 - RNA, 19 nt, Homo sapiens
cuaaccaccucacucuuca

SEQ ID NO: 1347886 - RNA, 19 nt, Homo sapiens
gaggagggacuaccuaaac

SEQ ID NO: 1347887 - RNA, 19 nt, Homo sapiens
gaaaauggagacaaaagga

SEQ ID NO: 1347888 - RNA, 19 nt, Homo sapiens
uuccuuagcugcucuccuu

SEQ ID NO: 1347889 - RNA, 19 nt, Homo sapiens
gacaccaagucacuguuca

SEQ ID NO: 1347890 - RNA, 19 nt, Homo sapiens
ccacaucuacccacaaggu

SEQ ID NO: 1347891 - RNA, 19 nt, Homo sapiens
ucucagcacauauaauaga

SEQ ID NO: 1347892 - RNA, 19 nt, Homo sapiens
ggucuaaccaccucacucu

SEQ ID NO: 1347893 - RNA, 19 nt, Homo sapiens
ccaagggagggcucaaaga

SEQ ID NO: 1347894 - RNA, 19 nt, Homo sapiens
caaagggcucggacgauuc

SEQ ID NO: 1347895 - RNA, 19 nt, Homo sapiens
ccaugggucucuugaugag

SEQ ID NO: 1347896 - RNA, 19 nt, Homo sapiens
ggcccugacugagcuguga

SEQ ID NO: 1347897 - RNA, 19 nt, Homo sapiens
ucaaagaaggcugguggaa

SEQ ID NO: 1347898 - RNA, 19 nt, Homo sapiens
aagcagggaagacagugua

SEQ ID NO: 1347899 - RNA, 19 nt, Homo sapiens
gaagcagggaagacagugu

SEQ ID NO: 1347900 - RNA, 19 nt, Homo sapiens
ccaguaaggcaccuauucu

SEQ ID NO: 1347901 - RNA, 19 nt, Homo sapiens
uuucugcacuggagguuuc

SEQ ID NO: 1347902 - RNA, 19 nt, Homo sapiens
cucagcacauauaauagaa

SEQ ID NO: 1347903 - RNA, 19 nt, Homo sapiens
ccuguucccucccacaucu

SEQ ID NO: 1347904 - RNA, 19 nt, Homo sapiens
gagagcuccuggcauucca

SEQ ID NO: 1347905 - RNA, 19 nt, Homo sapiens
ggagggagacagggugaca

SEQ ID NO: 1347906 - RNA, 19 nt, Homo sapiens
ugacuccaguuugcucugu

SEQ ID NO: 1347907 - RNA, 19 nt, Homo sapiens
ggcccugggugaguuacuu

SEQ ID NO: 1347908 - RNA, 19 nt, Homo sapiens
ugaacccacucggcaggaa

SEQ ID NO: 1347909 - RNA, 19 nt, Homo sapiens
ucuaaccaccucacucuuc

SEQ ID NO: 1347910 - RNA, 19 nt, Homo sapiens
gcugucaguuuuauggauu

SEQ ID NO: 1347911 - RNA, 19 nt, Homo sapiens
uggcagaaggguuccaaga

SEQ ID NO: 1347912 - RNA, 19 nt, Homo sapiens
gugcugccgugggaagaga

SEQ ID NO: 1347913 - RNA, 19 nt, Homo sapiens
gcccagccaccauccucua

SEQ ID NO: 1347914 - RNA, 19 nt, Homo sapiens
ccaacaagacgggcaugga

SEQ ID NO: 1347915 - RNA, 19 nt, Homo sapiens
ggagggcacaggcauccau

SEQ ID NO: 1347916 - RNA, 19 nt, Homo sapiens
ggaccaaagugcuggauua

SEQ ID NO: 1347917 - RNA, 19 nt, Homo sapiens
ggacuuauauucauggaaa

SEQ ID NO: 1347918 - RNA, 19 nt, Homo sapiens
uaacacagccaaagaaaua

SEQ ID NO: 1347919 - RNA, 19 nt, Homo sapiens
gaauuugacugacauaguu

SEQ ID NO: 1347920 - RNA, 19 nt, Homo sapiens
caaacucccuucuuaacua

SEQ ID NO: 1347921 - RNA, 19 nt, Homo sapiens
gcaaauggcaucaagauug

SEQ ID NO: 1347922 - RNA, 19 nt, Homo sapiens
ccacagcccugaggucuua

SEQ ID NO: 1347923 - RNA, 19 nt, Homo sapiens
gagcauucccuauagauua

SEQ ID NO: 1347924 - RNA, 19 nt, Homo sapiens
gcggaacucucgugacaua

SEQ ID NO: 1347925 - RNA, 19 nt, Homo sapiens
ggccagaucuaacauugua

SEQ ID NO: 1347926 - RNA, 19 nt, Homo sapiens
gcuuaucucuucaaguaua

SEQ ID NO: 1347927 - RNA, 19 nt, Homo sapiens
ggagguaaguggcuauaga

SEQ ID NO: 1347928 - RNA, 19 nt, Homo sapiens
ucaucaaacucccuucuua

SEQ ID NO: 1347929 - RNA, 19 nt, Homo sapiens
ccugaggucuuacgaauuu

SEQ ID NO: 1347930 - RNA, 19 nt, Homo sapiens
guacuucucuacuauccua

SEQ ID NO: 1347931 - RNA, 19 nt, Homo sapiens
gaagaucgguagauugagu

SEQ ID NO: 1347932 - RNA, 19 nt, Homo sapiens
gcagggaugugaagagaga

SEQ ID NO: 1347933 - RNA, 19 nt, Homo sapiens
ucaauaggcuuaaugaaag

SEQ ID NO: 1347934 - RNA, 19 nt, Homo sapiens
uggaauagcuucagaucaa

SEQ ID NO: 1347935 - RNA, 19 nt, Homo sapiens
gcccuacucuccacuaauu

SEQ ID NO: 1347936 - RNA, 19 nt, Homo sapiens
gacaugagcauucccuaua

SEQ ID NO: 1347937 - RNA, 19 nt, Homo sapiens
gagagaauuugggcccuua

SEQ ID NO: 1347938 - RNA, 19 nt, Homo sapiens
guaaguggcuauagaaguc

SEQ ID NO: 1347939 - RNA, 19 nt, Homo sapiens
uagauuaggguucuucuua

SEQ ID NO: 1347940 - RNA, 19 nt, Homo sapiens
aaucuugucuuuccguaua

SEQ ID NO: 1347941 - RNA, 19 nt, Homo sapiens
cauggaaacuucagccaaa

SEQ ID NO: 1347942 - RNA, 19 nt, Homo sapiens
gagcauggacuuauauuca

SEQ ID NO: 1347943 - RNA, 19 nt, Homo sapiens
gacauguggccacuuauua

SEQ ID NO: 1347944 - RNA, 19 nt, Homo sapiens
gaacaucuggcuugaacuu

SEQ ID NO: 1347945 - RNA, 19 nt, Homo sapiens
gaauaagagugaccuagag

SEQ ID NO: 1347946 - RNA, 19 nt, Homo sapiens
caagagcacugaguacuuc

SEQ ID NO: 1347947 - RNA, 19 nt, Homo sapiens
acaauccacuucccacuaa

SEQ ID NO: 1347948 - RNA, 19 nt, Homo sapiens
augcuuaucucuucaagua

SEQ ID NO: 1347949 - RNA, 19 nt, Homo sapiens
ucacauaaguggguaccua

SEQ ID NO: 1347950 - RNA, 19 nt, Homo sapiens
guaaauaugguuugcaguu

SEQ ID NO: 1347951 - RNA, 19 nt, Homo sapiens
ggaauaagagugaccuaga

SEQ ID NO: 1347952 - RNA, 19 nt, Homo sapiens
cuaguaagcagucacauaa

SEQ ID NO: 1347953 - RNA, 19 nt, Homo sapiens
gaauuagggucaaagacau

SEQ ID NO: 1347954 - RNA, 19 nt, Homo sapiens
gaauuugggcccuuacuga

SEQ ID NO: 1347955 - RNA, 19 nt, Homo sapiens
ggauacggcugggcaagaa

SEQ ID NO: 1347956 - RNA, 19 nt, Homo sapiens
ccaugucauuccuuuauuu

SEQ ID NO: 1347957 - RNA, 19 nt, Homo sapiens
ggacauguggccacuuauu

SEQ ID NO: 1347958 - RNA, 19 nt, Homo sapiens
caccaugacuuaugcuuau

SEQ ID NO: 1347959 - RNA, 19 nt, Homo sapiens
gaauagcuucagaucaaua

SEQ ID NO: 1347960 - RNA, 19 nt, Homo sapiens
caaauggcaucaagauugg

SEQ ID NO: 1347961 - RNA, 19 nt, Homo sapiens
cagcaggguuuauuugaug

SEQ ID NO: 1347962 - RNA, 19 nt, Homo sapiens
uaaauaugguuugcaguug

SEQ ID NO: 1347963 - RNA, 19 nt, Homo sapiens
gcuucuaucucuuagugua

SEQ ID NO: 1347964 - RNA, 19 nt, Homo sapiens
cuagagaggucggagguaa

SEQ ID NO: 1347965 - RNA, 19 nt, Homo sapiens
ccaaagugcuggauuacag

SEQ ID NO: 1347966 - RNA, 19 nt, Homo sapiens
gaagauccagcaggguuua

SEQ ID NO: 1347967 - RNA, 19 nt, Homo sapiens
gcuaguaagcagucacaua

SEQ ID NO: 1347968 - RNA, 19 nt, Homo sapiens
uauuugauguccacaauga

SEQ ID NO: 1347969 - RNA, 19 nt, Homo sapiens
ggauccaugucauuccuuu

SEQ ID NO: 1347970 - RNA, 19 nt, Homo sapiens
cagcggaacucucgugaca

SEQ ID NO: 1347971 - RNA, 19 nt, Homo sapiens
ccaccugaccucaugguua

SEQ ID NO: 1347972 - RNA, 19 nt, Homo sapiens
uuacugaccuguccuccuu

SEQ ID NO: 1347973 - RNA, 19 nt, Homo sapiens
caaucaggcuaaucuacuu

SEQ ID NO: 1347974 - RNA, 19 nt, Homo sapiens
ugccuggccuaaauaaaua

SEQ ID NO: 1347975 - RNA, 19 nt, Homo sapiens
caauaggcuuaaugaaaga

SEQ ID NO: 1347976 - RNA, 19 nt, Homo sapiens
aggcuaaucuacuuacuga

SEQ ID NO: 1347977 - RNA, 19 nt, Homo sapiens
ggaauagcuucagaucaau

SEQ ID NO: 1347978 - RNA, 19 nt, Homo sapiens
uagggagcauggacuuaua

SEQ ID NO: 1347979 - RNA, 19 nt, Homo sapiens
gcccugaggucuuacgaau

SEQ ID NO: 1347980 - RNA, 19 nt, Homo sapiens
caucaaacucccuucuuaa

SEQ ID NO: 1347981 - RNA, 19 nt, Homo sapiens
gauuaggguucuucuuauc

SEQ ID NO: 1347982 - RNA, 19 nt, Homo sapiens
gcacucuaguuccaacaug

SEQ ID NO: 1347983 - RNA, 19 nt, Homo sapiens
ccacuucccacuaagaauu

SEQ ID NO: 1347984 - RNA, 19 nt, Homo sapiens
caaaucaaacugcaaaucu

SEQ ID NO: 1347985 - RNA, 19 nt, Homo sapiens
caacauugauggaaaacaa

SEQ ID NO: 1347986 - RNA, 19 nt, Homo sapiens
gacuuaugcuuaucucuuc

SEQ ID NO: 1347987 - RNA, 19 nt, Homo sapiens
gagcaggauccaugucauu

SEQ ID NO: 1347988 - RNA, 19 nt, Homo sapiens
gcuaaucuacuuacugaau

SEQ ID NO: 1347989 - RNA, 19 nt, Homo sapiens
caaagacauucugcuugaa

SEQ ID NO: 1347990 - RNA, 19 nt, Homo sapiens
ggucaaagacauucugcuu

SEQ ID NO: 1347991 - RNA, 19 nt, Homo sapiens
ggacaugagcauucccuau

SEQ ID NO: 1347992 - RNA, 19 nt, Homo sapiens
ucaaccaccugaccucaug

SEQ ID NO: 1347993 - RNA, 19 nt, Homo sapiens
agggacauguggccacuua

SEQ ID NO: 1347994 - RNA, 19 nt, Homo sapiens
gagguaaguggcuauagaa

SEQ ID NO: 1347995 - RNA, 19 nt, Homo sapiens
gauccagcaggguuuauuu

SEQ ID NO: 1347996 - RNA, 19 nt, Homo sapiens
ggaagauccagcaggguuu

SEQ ID NO: 1347997 - RNA, 19 nt, Homo sapiens
uagcuucuaucucuuagug

SEQ ID NO: 1347998 - RNA, 19 nt, Homo sapiens
cuucucuacuauccuauua

SEQ ID NO: 1347999 - RNA, 19 nt, Homo sapiens
gaaggcaguuuccucuacu

SEQ ID NO: 1348000 - RNA, 19 nt, Homo sapiens
gacgcgacaccaugacuua

SEQ ID NO: 1348001 - RNA, 19 nt, Homo sapiens
cuaaagaccaggagagaau

SEQ ID NO: 1348002 - RNA, 19 nt, Homo sapiens
caauagguguggaguuugg

SEQ ID NO: 1348003 - RNA, 19 nt, Homo sapiens
caccugaccucaugguuag

SEQ ID NO: 1348004 - RNA, 19 nt, Homo sapiens
cucauuauguguucauuga

SEQ ID NO: 1348005 - RNA, 19 nt, Homo sapiens
gccuagugcugcucauuau

SEQ ID NO: 1348006 - RNA, 19 nt, Homo sapiens
guaacagacuuagguacug

SEQ ID NO: 1348007 - RNA, 19 nt, Homo sapiens
cuaaucuacuuacugaaug

SEQ ID NO: 1348008 - RNA, 19 nt, Homo sapiens
uagauugaguggcuagaga

SEQ ID NO: 1348009 - RNA, 19 nt, Homo sapiens
cuucuacuguuucaucaaa

SEQ ID NO: 1348010 - RNA, 19 nt, Homo sapiens
uaagagcagugaaguuggu

SEQ ID NO: 1348011 - RNA, 19 nt, Homo sapiens
gcacugaguacuucucuac

SEQ ID NO: 1348012 - RNA, 19 nt, Homo sapiens
gcuugccacuuccuaagaa

SEQ ID NO: 1348013 - RNA, 19 nt, Homo sapiens
gcucguauggucaacauug

SEQ ID NO: 1348014 - RNA, 19 nt, Homo sapiens
caccgugccuggccuaaau

SEQ ID NO: 1348015 - RNA, 19 nt, Homo sapiens
gacauuacaaggcgugaaa

SEQ ID NO: 1348016 - RNA, 19 nt, Homo sapiens
gaagacaagugguucagaa

SEQ ID NO: 1348017 - RNA, 19 nt, Homo sapiens
agaaagcucugacaaauau

SEQ ID NO: 1348018 - RNA, 19 nt, Homo sapiens
gcaggaaauugaagauaaa

SEQ ID NO: 1348019 - RNA, 19 nt, Homo sapiens
gaaccaggcuucugcuuca

SEQ ID NO: 1348020 - RNA, 19 nt, Homo sapiens
gaagacacuuugcuguuga

SEQ ID NO: 1348021 - RNA, 19 nt, Homo sapiens
agaaagcacugcaggagua

SEQ ID NO: 1348022 - RNA, 19 nt, Homo sapiens
gaucaaagaccauuucugu

SEQ ID NO: 1348023 - RNA, 19 nt, Homo sapiens
ggacucagcaggaaauuga

SEQ ID NO: 1348024 - RNA, 19 nt, Homo sapiens
gagaaagcucugacaaaua

SEQ ID NO: 1348025 - RNA, 19 nt, Homo sapiens
gcacuugcgucaucucaga

SEQ ID NO: 1348026 - RNA, 19 nt, Homo sapiens
gauagagacucagcugaaa

SEQ ID NO: 1348027 - RNA, 19 nt, Homo sapiens
gaccauuucuguccauuug

SEQ ID NO: 1348028 - RNA, 19 nt, Homo sapiens
ugagaaagcucugacaaau

SEQ ID NO: 1348029 - RNA, 19 nt, Homo sapiens
gaaaagggauguccaggaa

SEQ ID NO: 1348030 - RNA, 19 nt, Homo sapiens
gacaagugguucagaaaga

SEQ ID NO: 1348031 - RNA, 19 nt, Homo sapiens
gcaaauuggcagaggcuua

SEQ ID NO: 1348032 - RNA, 19 nt, Homo sapiens
gaagcgaauagcaguaaua

SEQ ID NO: 1348033 - RNA, 19 nt, Homo sapiens
gagaagauaucccagaaaa

SEQ ID NO: 1348034 - RNA, 19 nt, Homo sapiens
guugauagcugagguuaug

SEQ ID NO: 1348035 - RNA, 19 nt, Homo sapiens
cagaagaauuugaagacaa

SEQ ID NO: 1348036 - RNA, 19 nt, Homo sapiens
ccugaaaccuugccugaga

SEQ ID NO: 1348037 - RNA, 19 nt, Homo sapiens
ccugagagcucuuuauuuu

SEQ ID NO: 1348038 - RNA, 19 nt, Homo sapiens
ggcagaggcuuaccugaau

SEQ ID NO: 1348039 - RNA, 19 nt, Homo sapiens
agaaagcagugaugauguu

SEQ ID NO: 1348040 - RNA, 19 nt, Homo sapiens
caggauccauugcuaauca

SEQ ID NO: 1348041 - RNA, 19 nt, Homo sapiens
ucaguuccauacagagaua

SEQ ID NO: 1348042 - RNA, 19 nt, Homo sapiens
cagcagcacuugcgucauc

SEQ ID NO: 1348043 - RNA, 19 nt, Homo sapiens
gaaagaucaaagaccauuu

SEQ ID NO: 1348044 - RNA, 19 nt, Homo sapiens
gaaaggguucagcuucaaa

SEQ ID NO: 1348045 - RNA, 19 nt, Homo sapiens
caaccaacacagaccauuu

SEQ ID NO: 1348046 - RNA, 19 nt, Homo sapiens
agaagacacuuugcuguug

SEQ ID NO: 1348047 - RNA, 19 nt, Homo sapiens
cagacaggauccauugcua

SEQ ID NO: 1348048 - RNA, 19 nt, Homo sapiens
gcaggaguauuccaguauc

SEQ ID NO: 1348049 - RNA, 19 nt, Homo sapiens
agcaggaaauugaagauaa

SEQ ID NO: 1348050 - RNA, 19 nt, Homo sapiens
cgacaagaguaucagaaag

SEQ ID NO: 1348051 - RNA, 19 nt, Homo sapiens
gaaaaucaguuccauacag

SEQ ID NO: 1348052 - RNA, 19 nt, Homo sapiens
auacaaaucuuggcuuagu

SEQ ID NO: 1348053 - RNA, 19 nt, Homo sapiens
gacuguauccucagaagaa

SEQ ID NO: 1348054 - RNA, 19 nt, Homo sapiens
ccauuucuguccauuugaa

SEQ ID NO: 1348055 - RNA, 19 nt, Homo sapiens
ggagaagauaucccagaaa

SEQ ID NO: 1348056 - RNA, 19 nt, Homo sapiens
gaaacagaaagcagugaug

SEQ ID NO: 1348057 - RNA, 19 nt, Homo sapiens
aagcagugaugauguugaa

SEQ ID NO: 1348058 - RNA, 19 nt, Homo sapiens
gaagugcugacucucaaga

SEQ ID NO: 1348059 - RNA, 19 nt, Homo sapiens
agaagaauuugaagacaag

SEQ ID NO: 1348060 - RNA, 19 nt, Homo sapiens
ggaagcgaauagcaguaau

SEQ ID NO: 1348061 - RNA, 19 nt, Homo sapiens
aaccaacacagaccauuua

SEQ ID NO: 1348062 - RNA, 19 nt, Homo sapiens
aaacagaaagcagugauga

SEQ ID NO: 1348063 - RNA, 19 nt, Homo sapiens
gagguuaugggagaagaua

SEQ ID NO: 1348064 - RNA, 19 nt, Homo sapiens
gaaaagagagaaacagugu

SEQ ID NO: 1348065 - RNA, 19 nt, Homo sapiens
gcagaggcuuaccugaauc

SEQ ID NO: 1348066 - RNA, 19 nt, Homo sapiens
cagcacaguuucaccucaa

SEQ ID NO: 1348067 - RNA, 19 nt, Homo sapiens
gaaaauaaagcaaccaaca

SEQ ID NO: 1348068 - RNA, 19 nt, Homo sapiens
gcugcaaacuuggaaaaua

SEQ ID NO: 1348069 - RNA, 19 nt, Homo sapiens
cuacagacgacaagaguau

SEQ ID NO: 1348070 - RNA, 19 nt, Homo sapiens
ugacaaauauccaaaacug

SEQ ID NO: 1348071 - RNA, 19 nt, Homo sapiens
caacacagaccauuuaacc

SEQ ID NO: 1348072 - RNA, 19 nt, Homo sapiens
gaaagcagugaugauguug

SEQ ID NO: 1348073 - RNA, 19 nt, Homo sapiens
gcagugaugauguugaagu

SEQ ID NO: 1348074 - RNA, 19 nt, Homo sapiens
uagcaguaauagccagaaa

SEQ ID NO: 1348075 - RNA, 19 nt, Homo sapiens
ugauuucuuugcauccuuu

SEQ ID NO: 1348076 - RNA, 19 nt, Homo sapiens
gcagugguuuuaugaagaa

SEQ ID NO: 1348077 - RNA, 19 nt, Homo sapiens
ucagaagaauuugaagaca

SEQ ID NO: 1348078 - RNA, 19 nt, Homo sapiens
acccagaggugaagugugu

SEQ ID NO: 1348079 - RNA, 19 nt, Homo sapiens
ugauagagacucagcugaa

SEQ ID NO: 1348080 - RNA, 19 nt, Homo sapiens
uaucaaauccuucuuucca

SEQ ID NO: 1348081 - RNA, 19 nt, Homo sapiens
gaacuuggagaaaacaauu

SEQ ID NO: 1348082 - RNA, 19 nt, Homo sapiens
cugcaggaguauuccagua

SEQ ID NO: 1348083 - RNA, 19 nt, Homo sapiens
gacaggauccauugcuaau

SEQ ID NO: 1348084 - RNA, 19 nt, Homo sapiens
cagcaggaaauugaagaua

SEQ ID NO: 1348085 - RNA, 19 nt, Homo sapiens
cugcaaacuuggaaaauaa

SEQ ID NO: 1348086 - RNA, 19 nt, Homo sapiens
agacaggauccauugcuaa

SEQ ID NO: 1348087 - RNA, 19 nt, Homo sapiens
ugacugccuuggugacugu

SEQ ID NO: 1348088 - RNA, 19 nt, Homo sapiens
ccaggcuucugcuucaguu

SEQ ID NO: 1348089 - RNA, 19 nt, Homo sapiens
acagaaagcagugaugaug

SEQ ID NO: 1348090 - RNA, 19 nt, Homo sapiens
aaauaaagcaaccaacaca

SEQ ID NO: 1348091 - RNA, 19 nt, Homo sapiens
cuuaaggacucagcaggaa

SEQ ID NO: 1348092 - RNA, 19 nt, Homo sapiens
gcaugugccucuuuuauac

SEQ ID NO: 1348093 - RNA, 19 nt, Homo sapiens
ugcugacucucaagaaauu

SEQ ID NO: 1348094 - RNA, 19 nt, Homo sapiens
uguauccucagaagaauuu

SEQ ID NO: 1348095 - RNA, 19 nt, Homo sapiens
gaaagcacugcaggaguau

SEQ ID NO: 1348096 - RNA, 19 nt, Homo sapiens
gcucugacaaauauccaaa

SEQ ID NO: 1348097 - RNA, 19 nt, Homo sapiens
aaaaucaguuccauacaga

SEQ ID NO: 1348098 - RNA, 19 nt, Homo sapiens
aaagaucaaagaccauuuc

SEQ ID NO: 1348099 - RNA, 19 nt, Homo sapiens
acaagugguucagaaagau

SEQ ID NO: 1348100 - RNA, 19 nt, Homo sapiens
aaggagaccuggccuacag

SEQ ID NO: 1348101 - RNA, 19 nt, Homo sapiens
caaccaauuuugccaugaa

SEQ ID NO: 1348102 - RNA, 19 nt, Homo sapiens
aagaagacacuuugcuguu

SEQ ID NO: 1348103 - RNA, 19 nt, Homo sapiens
uaaggacucagcaggaaau

SEQ ID NO: 1348104 - RNA, 19 nt, Homo sapiens
ccagcuugcuauuuguuca

SEQ ID NO: 1348105 - RNA, 19 nt, Homo sapiens
acacuuugcuguugauagc

SEQ ID NO: 1348106 - RNA, 19 nt, Homo sapiens
uggcagaggcuuaccugaa

SEQ ID NO: 1348107 - RNA, 19 nt, Homo sapiens
gcuauuuguucaaguuugc

SEQ ID NO: 1348108 - RNA, 19 nt, Homo sapiens
gcaaccaacacagaccauu

SEQ ID NO: 1348109 - RNA, 19 nt, Homo sapiens
agaaagaucaaagaccauu

SEQ ID NO: 1348110 - RNA, 19 nt, Homo sapiens
gcucaccuggguaggcaua

SEQ ID NO: 1348111 - RNA, 19 nt, Homo sapiens
ugcuaaucauggaguauaa

SEQ ID NO: 1348112 - RNA, 19 nt, Homo sapiens
agugcugacucucaagaaa

SEQ ID NO: 1348113 - RNA, 19 nt, Homo sapiens
gccugagagcucuuuauuu

SEQ ID NO: 1348114 - RNA, 19 nt, Homo sapiens
ugacaaaacuaucaaaucc

SEQ ID NO: 1348115 - RNA, 19 nt, Homo sapiens
cagugaugauguugaagug

SEQ ID NO: 1348116 - RNA, 19 nt, Homo sapiens
caaggaagaagaacaaaua

SEQ ID NO: 1348117 - RNA, 19 nt, Homo sapiens
gaagaagaacaaauacaga

SEQ ID NO: 1348118 - RNA, 19 nt, Homo sapiens
ucaaccauacuccaaauua

SEQ ID NO: 1348119 - RNA, 19 nt, Homo sapiens
gccaagaugcucagcuuua

SEQ ID NO: 1348120 - RNA, 19 nt, Homo sapiens
caaccauacuccaaauuag

SEQ ID NO: 1348121 - RNA, 19 nt, Homo sapiens
ccaagaugcucagcuuuau

SEQ ID NO: 1348122 - RNA, 19 nt, Homo sapiens
ggaagaagaacaaauacag

SEQ ID NO: 1348123 - RNA, 19 nt, Homo sapiens
gcaacugggagauuuguga

SEQ ID NO: 1348124 - RNA, 19 nt, Homo sapiens
caaaugggccucaggaucu

SEQ ID NO: 1348125 - RNA, 19 nt, Homo sapiens
caagaugcucagcuuuaua

SEQ ID NO: 1348126 - RNA, 19 nt, Homo sapiens
gguaggaggacauucauca

SEQ ID NO: 1348127 - RNA, 19 nt, Homo sapiens
gcauuucagugccaucuac

SEQ ID NO: 1348128 - RNA, 19 nt, Homo sapiens
ggcagacucccagaaguua

SEQ ID NO: 1348129 - RNA, 19 nt, Homo sapiens
guucuggguuucuggauuc

SEQ ID NO: 1348130 - RNA, 19 nt, Homo sapiens
guugagaggauuaaaugaa

SEQ ID NO: 1348131 - RNA, 19 nt, Homo sapiens
caggauuaguuuccagcua

SEQ ID NO: 1348132 - RNA, 19 nt, Homo sapiens
ggagauuugugagugaaca

SEQ ID NO: 1348133 - RNA, 19 nt, Homo sapiens
ucccagaaguuaucuaugg

SEQ ID NO: 1348134 - RNA, 19 nt, Homo sapiens
gcaaagcuccgugcucucu

SEQ ID NO: 1348135 - RNA, 19 nt, Homo sapiens
ggacaaauucgaagcuacu

SEQ ID NO: 1348136 - RNA, 19 nt, Homo sapiens
aaagcuccgugcucucuug

SEQ ID NO: 1348137 - RNA, 19 nt, Homo sapiens
ucaaggccaggacgucaua

SEQ ID NO: 1348138 - RNA, 19 nt, Homo sapiens
caacggcaacugggagauu

SEQ ID NO: 1348139 - RNA, 19 nt, Homo sapiens
gguucuggguuucuggauu

SEQ ID NO: 1348140 - RNA, 19 nt, Homo sapiens
gaccuacacaugugacuuc

SEQ ID NO: 1348141 - RNA, 19 nt, Homo sapiens
ccucccacaucauccauug

SEQ ID NO: 1348142 - RNA, 19 nt, Homo sapiens
uuccagggcucgcucaguu

SEQ ID NO: 1348143 - RNA, 19 nt, Homo sapiens
caucauccauugucuugcu

SEQ ID NO: 1348144 - RNA, 19 nt, Homo sapiens
ccuggcaccucccacauca

SEQ ID NO: 1348145 - RNA, 19 nt, Homo sapiens
ucucaaccauacuccaaau

SEQ ID NO: 1348146 - RNA, 19 nt, Homo sapiens
cugacaaucucuagucgau

SEQ ID NO: 1348147 - RNA, 19 nt, Homo sapiens
gaucugaaggcgccagcuu

SEQ ID NO: 1348148 - RNA, 19 nt, Homo sapiens
ugugaugagucgcuguuug

SEQ ID NO: 1348149 - RNA, 19 nt, Homo sapiens
gagaggauuaaaugaaaca

SEQ ID NO: 1348150 - RNA, 19 nt, Homo sapiens
ccaaggaagaagaacaaau

SEQ ID NO: 1348151 - RNA, 19 nt, Homo sapiens
ucacaccaaggaagaagaa

SEQ ID NO: 1348152 - RNA, 19 nt, Homo sapiens
cacaucauccauugucuug

SEQ ID NO: 1348153 - RNA, 19 nt, Homo sapiens
cuagucgauucuugccuuu

SEQ ID NO: 1348154 - RNA, 19 nt, Homo sapiens
auuccgggcugcagauuga

SEQ ID NO: 1348155 - RNA, 19 nt, Homo sapiens
cggcagacucccagaaguu

SEQ ID NO: 1348156 - RNA, 19 nt, Homo sapiens
caccaaggaagaagaacaa

SEQ ID NO: 1348157 - RNA, 19 nt, Homo sapiens
ugcaagcccuagaggaguu

SEQ ID NO: 1348158 - RNA, 19 nt, Homo sapiens
gcugccaagugcgaauaaa

SEQ ID NO: 1348159 - RNA, 19 nt, Homo sapiens
gcagacucccagaaguuau

SEQ ID NO: 1348160 - RNA, 19 nt, Homo sapiens
gcggcagacucccagaagu

SEQ ID NO: 1348161 - RNA, 19 nt, Homo sapiens
guggagaaggcuaacagaa

SEQ ID NO: 1348162 - RNA, 19 nt, Homo sapiens
aacggcaacugggagauuu

SEQ ID NO: 1348163 - RNA, 19 nt, Homo sapiens
ccacaucauccauugucuu

SEQ ID NO: 1348164 - RNA, 19 nt, Homo sapiens
gcaaaggggagcugugaga

SEQ ID NO: 1348165 - RNA, 19 nt, Homo sapiens
aagaugcucagcuuuauag

SEQ ID NO: 1348166 - RNA, 19 nt, Homo sapiens
gcuguugagaggauuaaau

SEQ ID NO: 1348167 - RNA, 19 nt, Homo sapiens
uuuccaggcugucugugaa

SEQ ID NO: 1348168 - RNA, 19 nt, Homo sapiens
caggguaggaggacauuca

SEQ ID NO: 1348169 - RNA, 19 nt, Homo sapiens
ucaucaggguugccuaugg

SEQ ID NO: 1348170 - RNA, 19 nt, Homo sapiens
cagggaaccccagguauua

SEQ ID NO: 1348171 - RNA, 19 nt, Homo sapiens
gaccacaggcagcaugaag

SEQ ID NO: 1348172 - RNA, 19 nt, Homo sapiens
ccuuggaaaugauacucuu

SEQ ID NO: 1348173 - RNA, 19 nt, Homo sapiens
ucgcucaguuagcauuuca

SEQ ID NO: 1348174 - RNA, 19 nt, Homo sapiens
ugagaggauuaaaugaaac

SEQ ID NO: 1348175 - RNA, 19 nt, Homo sapiens
ggccaggacgucauaugug

SEQ ID NO: 1348176 - RNA, 19 nt, Homo sapiens
gggccacccagaaaccaaa

SEQ ID NO: 1348177 - RNA, 19 nt, Homo sapiens
uggaugagacucuguuugg

SEQ ID NO: 1348178 - RNA, 19 nt, Homo sapiens
gcaagcccuagaggaguuu

SEQ ID NO: 1348179 - RNA, 19 nt, Homo sapiens
ugacuucaccucaguuuug

SEQ ID NO: 1348180 - RNA, 19 nt, Homo sapiens
gugaugagucgcuguuugg

SEQ ID NO: 1348181 - RNA, 19 nt, Homo sapiens
agugcuggguucuggguuu

SEQ ID NO: 1348182 - RNA, 19 nt, Homo sapiens
gaagaaagcuauaccauua

SEQ ID NO: 1348183 - RNA, 19 nt, Homo sapiens
gaaaugaagugguuaaugg

SEQ ID NO: 1348184 - RNA, 19 nt, Homo sapiens
auucaaagcugaugcauua

SEQ ID NO: 1348185 - RNA, 19 nt, Homo sapiens
caaagcugaugcauuauuu

SEQ ID NO: 1348186 - RNA, 19 nt, Homo sapiens
gaccgaaaguucaguguaa

SEQ ID NO: 1348187 - RNA, 19 nt, Homo sapiens
gaaggagacgauuaaguua

SEQ ID NO: 1348188 - RNA, 19 nt, Homo sapiens
gaugauccuuccacuuaua

SEQ ID NO: 1348189 - RNA, 19 nt, Homo sapiens
gcagcuacaucaagaggua

SEQ ID NO: 1348190 - RNA, 19 nt, Homo sapiens
gaaacuauauugagcaaac

SEQ ID NO: 1348191 - RNA, 19 nt, Homo sapiens
guucugaauuugucaagua

SEQ ID NO: 1348192 - RNA, 19 nt, Homo sapiens
gaccuagcaugcuucauaa

SEQ ID NO: 1348193 - RNA, 19 nt, Homo sapiens
gcugaugcauuauuugauu

SEQ ID NO: 1348194 - RNA, 19 nt, Homo sapiens
uaccacauuugcacaauua

SEQ ID NO: 1348195 - RNA, 19 nt, Homo sapiens
uagcaaaccuaacacuaaa

SEQ ID NO: 1348196 - RNA, 19 nt, Homo sapiens
gaauuaccauuuccaagug

SEQ ID NO: 1348197 - RNA, 19 nt, Homo sapiens
gcaaaccaauguuguucuu

SEQ ID NO: 1348198 - RNA, 19 nt, Homo sapiens
caaguguucuggaaucuga

SEQ ID NO: 1348199 - RNA, 19 nt, Homo sapiens
gggauauucucuacuuuga

SEQ ID NO: 1348200 - RNA, 19 nt, Homo sapiens
gaaugaaucacuacauaug

SEQ ID NO: 1348201 - RNA, 19 nt, Homo sapiens
ggacuccucucuucugcuu

SEQ ID NO: 1348202 - RNA, 19 nt, Homo sapiens
gcucaguaauuccguugua

SEQ ID NO: 1348203 - RNA, 19 nt, Homo sapiens
caagauaagaagacagaua

SEQ ID NO: 1348204 - RNA, 19 nt, Homo sapiens
gaaggaagccaggagauau

SEQ ID NO: 1348205 - RNA, 19 nt, Homo sapiens
ugaccuagcaugcuucaua

SEQ ID NO: 1348206 - RNA, 19 nt, Homo sapiens
gaagagacacccaaccaau

SEQ ID NO: 1348207 - RNA, 19 nt, Homo sapiens
gaaaagaaggagacgauua

SEQ ID NO: 1348208 - RNA, 19 nt, Homo sapiens
ggucaucuccucagugauu

SEQ ID NO: 1348209 - RNA, 19 nt, Homo sapiens
aagaggcagugaagaauuu

SEQ ID NO: 1348210 - RNA, 19 nt, Homo sapiens
uauaaagacuacagggaaa

SEQ ID NO: 1348211 - RNA, 19 nt, Homo sapiens
ugauugaacugaacauugu

SEQ ID NO: 1348212 - RNA, 19 nt, Homo sapiens
cugaugauccuuccacuua

SEQ ID NO: 1348213 - RNA, 19 nt, Homo sapiens
gcagcguccuccuuauuga

SEQ ID NO: 1348214 - RNA, 19 nt, Homo sapiens
ggagacgauuaaguuauuu

SEQ ID NO: 1348215 - RNA, 19 nt, Homo sapiens
gcagaagggccacagaguu

SEQ ID NO: 1348216 - RNA, 19 nt, Homo sapiens
agaaggagacgauuaaguu

SEQ ID NO: 1348217 - RNA, 19 nt, Homo sapiens
gauauucucuacuuugaac

SEQ ID NO: 1348218 - RNA, 19 nt, Homo sapiens
guaccacauuugcacaauu

SEQ ID NO: 1348219 - RNA, 19 nt, Homo sapiens
ucucauggcuacaauggaa

SEQ ID NO: 1348220 - RNA, 19 nt, Homo sapiens
gaagccaggagauauggua

SEQ ID NO: 1348221 - RNA, 19 nt, Homo sapiens
uagcaugcuucauaaauca

SEQ ID NO: 1348222 - RNA, 19 nt, Homo sapiens
ccaaccaauuuaucugauu

SEQ ID NO: 1348223 - RNA, 19 nt, Homo sapiens
gaaggagcaguuucucuga

SEQ ID NO: 1348224 - RNA, 19 nt, Homo sapiens
gagauaugguaccgaacaa

SEQ ID NO: 1348225 - RNA, 19 nt, Homo sapiens
gaaaaguucugaauuuguc

SEQ ID NO: 1348226 - RNA, 19 nt, Homo sapiens
ggagaaaauuuaagcuuug

SEQ ID NO: 1348227 - RNA, 19 nt, Homo sapiens
gggaaacuauauugagcaa

SEQ ID NO: 1348228 - RNA, 19 nt, Homo sapiens
gauccuuccacuuauauuu

SEQ ID NO: 1348229 - RNA, 19 nt, Homo sapiens
gagacacccaaccaauuua

SEQ ID NO: 1348230 - RNA, 19 nt, Homo sapiens
ggaaaugaagugguuaaug

SEQ ID NO: 1348231 - RNA, 19 nt, Homo sapiens
ccaacuacugugauuauaa

SEQ ID NO: 1348232 - RNA, 19 nt, Homo sapiens
gaaucacuacauaugcuua

SEQ ID NO: 1348233 - RNA, 19 nt, Homo sapiens
guuaccggcuucaguuuga

SEQ ID NO: 1348234 - RNA, 19 nt, Homo sapiens
gaaaguuaccggcuucagu

SEQ ID NO: 1348235 - RNA, 19 nt, Homo sapiens
ggacguacgcguuucuugu

SEQ ID NO: 1348236 - RNA, 19 nt, Homo sapiens
acucaaaccugucgagcaa

SEQ ID NO: 1348237 - RNA, 19 nt, Homo sapiens
aggagacgauuaaguuauu

SEQ ID NO: 1348238 - RNA, 19 nt, Homo sapiens
gaccaacuacugugauuau

SEQ ID NO: 1348239 - RNA, 19 nt, Homo sapiens
aaagacaccucaaaagaaa

SEQ ID NO: 1348240 - RNA, 19 nt, Homo sapiens
cuaagugacccauguagaa

SEQ ID NO: 1348241 - RNA, 19 nt, Homo sapiens
agagacacccaaccaauuu

SEQ ID NO: 1348242 - RNA, 19 nt, Homo sapiens
ggagauaugguaccgaaca

SEQ ID NO: 1348243 - RNA, 19 nt, Homo sapiens
uaacuaagugacccaugua

SEQ ID NO: 1348244 - RNA, 19 nt, Homo sapiens
uggccucccucuuaacuaa

SEQ ID NO: 1348245 - RNA, 19 nt, Homo sapiens
gagguucaauagaugaugu

SEQ ID NO: 1348246 - RNA, 19 nt, Homo sapiens
ugaagugguuaauggagaa

SEQ ID NO: 1348247 - RNA, 19 nt, Homo sapiens
caagaggcagugaagaauu

SEQ ID NO: 1348248 - RNA, 19 nt, Homo sapiens
gacguacgcguuucuugua

SEQ ID NO: 1348249 - RNA, 19 nt, Homo sapiens
cugcaugaaugaaucacua

SEQ ID NO: 1348250 - RNA, 19 nt, Homo sapiens
gauaugguaccgaacaaug

SEQ ID NO: 1348251 - RNA, 19 nt, Homo sapiens
ucaaguacaaguccagaaa

SEQ ID NO: 1348252 - RNA, 19 nt, Homo sapiens
agaagaaagcuauaccauu

SEQ ID NO: 1348253 - RNA, 19 nt, Homo sapiens
gcuccuccauggcuucuau

SEQ ID NO: 1348254 - RNA, 19 nt, Homo sapiens
ucaaagcugaugcauuauu

SEQ ID NO: 1348255 - RNA, 19 nt, Homo sapiens
cuacagggaaacuauauug

SEQ ID NO: 1348256 - RNA, 19 nt, Homo sapiens
caagagguauguggaacug

SEQ ID NO: 1348257 - RNA, 19 nt, Homo sapiens
agaaaggacguacgcguuu

SEQ ID NO: 1348258 - RNA, 19 nt, Homo sapiens
uuaacuaagugacccaugu

SEQ ID NO: 1348259 - RNA, 19 nt, Homo sapiens
ggccugugcuagacuauag

SEQ ID NO: 1348260 - RNA, 19 nt, Homo sapiens
gagcaaaccaauguuguuc

SEQ ID NO: 1348261 - RNA, 19 nt, Homo sapiens
aaaccugcaugaaugaauc

SEQ ID NO: 1348262 - RNA, 19 nt, Homo sapiens
ucccuuggccucccucuua

SEQ ID NO: 1348263 - RNA, 19 nt, Homo sapiens
ccagguugcuaggacagua

SEQ ID NO: 1348264 - RNA, 19 nt, Homo sapiens
cuagcaugcuucauaaauc

SEQ ID NO: 1348265 - RNA, 19 nt, Homo sapiens
ggaacugaccaacuacugu

SEQ ID NO: 1348266 - RNA, 19 nt, Homo sapiens
gcagaauuaccauuuccaa

SEQ ID NO: 1348267 - RNA, 19 nt, Homo sapiens
aaaguuaccggcuucaguu

SEQ ID NO: 1348268 - RNA, 19 nt, Homo sapiens
cagaagggccacagaguuc

SEQ ID NO: 1348269 - RNA, 19 nt, Homo sapiens
ucuggaaucugaagagaca

SEQ ID NO: 1348270 - RNA, 19 nt, Homo sapiens
uuccagagguucaauagau

SEQ ID NO: 1348271 - RNA, 19 nt, Homo sapiens
ccacauuugcacaauuaaa

SEQ ID NO: 1348272 - RNA, 19 nt, Homo sapiens
ugauaacacuacugaugau

SEQ ID NO: 1348273 - RNA, 19 nt, Homo sapiens
cugacuggcuguugaccua

SEQ ID NO: 1348274 - RNA, 19 nt, Homo sapiens
cccaggaaaugaagugguu

SEQ ID NO: 1348275 - RNA, 19 nt, Homo sapiens
agaaggaagccaggagaua

SEQ ID NO: 1348276 - RNA, 19 nt, Homo sapiens
gccacacacugccugaaau

SEQ ID NO: 1348277 - RNA, 19 nt, Homo sapiens
cuucauaaaucaggguuug

SEQ ID NO: 1348278 - RNA, 19 nt, Homo sapiens
ccaggccugugcuagacua

SEQ ID NO: 1348279 - RNA, 19 nt, Homo sapiens
agaauuaccauuuccaagu

SEQ ID NO: 1348280 - RNA, 19 nt, Homo sapiens
guaauuccguuguaaaagu

SEQ ID NO: 1348281 - RNA, 19 nt, Homo sapiens
cuacugugauuauaaagac

SEQ ID NO: 1348282 - RNA, 19 nt, Homo sapiens
gaggaaagauucuccauuc

SEQ ID NO: 1348283 - RNA, 19 nt, Homo sapiens
gaguacggcuguaagaauu

SEQ ID NO: 1348284 - RNA, 19 nt, Homo sapiens
ggagaacaagcccaaguua

SEQ ID NO: 1348285 - RNA, 19 nt, Homo sapiens
ugaagaagcugcccuggau

SEQ ID NO: 1348286 - RNA, 19 nt, Homo sapiens
ggagacagccauccaaaga

SEQ ID NO: 1348287 - RNA, 19 nt, Homo sapiens
caugaugccuuugagcuua

SEQ ID NO: 1348288 - RNA, 19 nt, Homo sapiens
gcagaguucuaccuucuca

SEQ ID NO: 1348289 - RNA, 19 nt, Homo sapiens
gaaauggaggcacgacuug

SEQ ID NO: 1348290 - RNA, 19 nt, Homo sapiens
ccaccguucucaccucuuu

SEQ ID NO: 1348291 - RNA, 19 nt, Homo sapiens
ggagagaccagacugaauc

SEQ ID NO: 1348292 - RNA, 19 nt, Homo sapiens
cgacaagaccagaugauug

SEQ ID NO: 1348293 - RNA, 19 nt, Homo sapiens
gagugacccuccaggacua

SEQ ID NO: 1348294 - RNA, 19 nt, Homo sapiens
ggaaagauucuccauucga

SEQ ID NO: 1348295 - RNA, 19 nt, Homo sapiens
ugagguggcuaucgaugaa

SEQ ID NO: 1348296 - RNA, 19 nt, Homo sapiens
ggaaauggaggcacgacuu

SEQ ID NO: 1348297 - RNA, 19 nt, Homo sapiens
ggucaccaccucagaacua

SEQ ID NO: 1348298 - RNA, 19 nt, Homo sapiens
gggcagaguucuaccuucu

SEQ ID NO: 1348299 - RNA, 19 nt, Homo sapiens
ggaguacggcuguaagaau

SEQ ID NO: 1348300 - RNA, 19 nt, Homo sapiens
cggcugcgcugucaaguuc

SEQ ID NO: 1348301 - RNA, 19 nt, Homo sapiens
uagugggucuaauaaagua

SEQ ID NO: 1348302 - RNA, 19 nt, Homo sapiens
gaacaagcccaaguuaguc

SEQ ID NO: 1348303 - RNA, 19 nt, Homo sapiens
cagcugagguggcuaucga

SEQ ID NO: 1348304 - RNA, 19 nt, Homo sapiens
uuaaagagcaccagacauc

SEQ ID NO: 1348305 - RNA, 19 nt, Homo sapiens
cgccagaccucucaagauc

SEQ ID NO: 1348306 - RNA, 19 nt, Homo sapiens
gaggagacagccauccaaa

SEQ ID NO: 1348307 - RNA, 19 nt, Homo sapiens
gagccaccauggagaguag

SEQ ID NO: 1348308 - RNA, 19 nt, Homo sapiens
ggucuaauaaaguauguug

SEQ ID NO: 1348309 - RNA, 19 nt, Homo sapiens
agacagccauccaaagagu

SEQ ID NO: 1348310 - RNA, 19 nt, Homo sapiens
ggaagugagaggcaugaug

SEQ ID NO: 1348311 - RNA, 19 nt, Homo sapiens
gagaacaagcccaaguuag

SEQ ID NO: 1348312 - RNA, 19 nt, Homo sapiens
caccaccucagaacuauaa

SEQ ID NO: 1348313 - RNA, 19 nt, Homo sapiens
caggagagcguccggauuc

SEQ ID NO: 1348314 - RNA, 19 nt, Homo sapiens
gcucuacugaugauggaua

SEQ ID NO: 1348315 - RNA, 19 nt, Homo sapiens
agagggccaugaugccuuu

SEQ ID NO: 1348316 - RNA, 19 nt, Homo sapiens
ggaugaggcaaguggcuuu

SEQ ID NO: 1348317 - RNA, 19 nt, Homo sapiens
ugcagcagcucacugaaga

SEQ ID NO: 1348318 - RNA, 19 nt, Homo sapiens
cugccucucuccagaauga

SEQ ID NO: 1348319 - RNA, 19 nt, Homo sapiens
caaguucacccucuucaag

SEQ ID NO: 1348320 - RNA, 19 nt, Homo sapiens
cgacgaggaugaggagaca

SEQ ID NO: 1348321 - RNA, 19 nt, Homo sapiens
ugaggcagcacuugaguug

SEQ ID NO: 1348322 - RNA, 19 nt, Homo sapiens
uggcugcccuaaaggauga

SEQ ID NO: 1348323 - RNA, 19 nt, Homo sapiens
gaugaggcaaguggcuuua

SEQ ID NO: 1348324 - RNA, 19 nt, Homo sapiens
agaacaagcccaaguuagu

SEQ ID NO: 1348325 - RNA, 19 nt, Homo sapiens
gacaagaccagaugauugc

SEQ ID NO: 1348326 - RNA, 19 nt, Homo sapiens
guacggcuguaagaauugu

SEQ ID NO: 1348327 - RNA, 19 nt, Homo sapiens
gcaggagagcguccggauu

SEQ ID NO: 1348328 - RNA, 19 nt, Homo sapiens
ugacggauucguacuacaa

SEQ ID NO: 1348329 - RNA, 19 nt, Homo sapiens
gcccagggagcacuaauuc

SEQ ID NO: 1348330 - RNA, 19 nt, Homo sapiens
cggauucccugcucuaggu

SEQ ID NO: 1348331 - RNA, 19 nt, Homo sapiens
ccaagaggcaggccaacug

SEQ ID NO: 1348332 - RNA, 19 nt, Homo sapiens
gaaggaguacggcuguaag

SEQ ID NO: 1348333 - RNA, 19 nt, Homo sapiens
gagaccagacugaaucuac

SEQ ID NO: 1348334 - RNA, 19 nt, Homo sapiens
guacuacaacucccaagag

SEQ ID NO: 1348335 - RNA, 19 nt, Homo sapiens
caccucagaacuauaagaa

SEQ ID NO: 1348336 - RNA, 19 nt, Homo sapiens
ggaacacccaacagaaagu

SEQ ID NO: 1348337 - RNA, 19 nt, Homo sapiens
gggaacacccaacagaaag

SEQ ID NO: 1348338 - RNA, 19 nt, Homo sapiens
ccagaccucucaagaucag

SEQ ID NO: 1348339 - RNA, 19 nt, Homo sapiens
gccuagcccucugggaauu

SEQ ID NO: 1348340 - RNA, 19 nt, Homo sapiens
ugaggaaagauucuccauu

SEQ ID NO: 1348341 - RNA, 19 nt, Homo sapiens
gugaugacgacgaggauga

SEQ ID NO: 1348342 - RNA, 19 nt, Homo sapiens
agaguucuaccuucucaaa

SEQ ID NO: 1348343 - RNA, 19 nt, Homo sapiens
gggagagaccagacugaau

SEQ ID NO: 1348344 - RNA, 19 nt, Homo sapiens
gccaagagcacugaagaca

SEQ ID NO: 1348345 - RNA, 19 nt, Homo sapiens
gacuaucgccucccagaca

SEQ ID NO: 1348346 - RNA, 19 nt, Homo sapiens
gaacacccaacagaaaguc

SEQ ID NO: 1348347 - RNA, 19 nt, Homo sapiens
gcuuaaagagcaccagaca

SEQ ID NO: 1348348 - RNA, 19 nt, Homo sapiens
aagaagcugcccuggauga

SEQ ID NO: 1348349 - RNA, 19 nt, Homo sapiens
cuuggucacugccaugguu

SEQ ID NO: 1348350 - RNA, 19 nt, Homo sapiens
ggagccaccauggagagua

SEQ ID NO: 1348351 - RNA, 19 nt, Homo sapiens
ggagaacacgaggcaggaa

SEQ ID NO: 1348352 - RNA, 19 nt, Homo sapiens
gaaagucugcaagcaaugc

SEQ ID NO: 1348353 - RNA, 19 nt, Homo sapiens
uggcagggccuucuguuca

SEQ ID NO: 1348354 - RNA, 19 nt, Homo sapiens
cuacgggugagcccuguaa

SEQ ID NO: 1348355 - RNA, 19 nt, Homo sapiens
guaccccgcuuccucuuga

SEQ ID NO: 1348356 - RNA, 19 nt, Homo sapiens
ccagggagcacuaauucca

SEQ ID NO: 1348357 - RNA, 19 nt, Homo sapiens
agaaggaguacggcuguaa

SEQ ID NO: 1348358 - RNA, 19 nt, Homo sapiens
gaggcaaguggcuuuaaca

SEQ ID NO: 1348359 - RNA, 19 nt, Homo sapiens
ugaggcaaguggcuuuaac

SEQ ID NO: 1348360 - RNA, 19 nt, Homo sapiens
ccucacaggcagagauaga

SEQ ID NO: 1348361 - RNA, 19 nt, Homo sapiens
ggcaaguggcuuuaacauc

SEQ ID NO: 1348362 - RNA, 19 nt, Homo sapiens
gucaccaccucagaacuau

SEQ ID NO: 1348363 - RNA, 19 nt, Homo sapiens
ccuggaaugaggaaagauu

SEQ ID NO: 1348364 - RNA, 19 nt, Homo sapiens
gagacagccauccaaagag

SEQ ID NO: 1348365 - RNA, 19 nt, Homo sapiens
gacccaagcccagcagaca

SEQ ID NO: 1348366 - RNA, 19 nt, Homo sapiens
ggcagggccuucuguucag

SEQ ID NO: 1348367 - RNA, 19 nt, Homo sapiens
aagaaggaguacggcugua

SEQ ID NO: 1348368 - RNA, 19 nt, Homo sapiens
ccaugaugccuuugagcuu

SEQ ID NO: 1348369 - RNA, 19 nt, Homo sapiens
ggcccagggagcacuaauu

SEQ ID NO: 1348370 - RNA, 19 nt, Homo sapiens
gacacgacaagaccagaug

SEQ ID NO: 1348371 - RNA, 19 nt, Homo sapiens
caagauagguuucuguauu

SEQ ID NO: 1348372 - RNA, 19 nt, Homo sapiens
guucaaagcuugggagaaa

SEQ ID NO: 1348373 - RNA, 19 nt, Homo sapiens
ggaaaugcacuuuauaaug

SEQ ID NO: 1348374 - RNA, 19 nt, Homo sapiens
ggagagggcugagauuugu

SEQ ID NO: 1348375 - RNA, 19 nt, Homo sapiens
ggagaaacacuaaagaaga

SEQ ID NO: 1348376 - RNA, 19 nt, Homo sapiens
gugaauugguccucagaua

SEQ ID NO: 1348377 - RNA, 19 nt, Homo sapiens
ggacagcucuccagaaucc

SEQ ID NO: 1348378 - RNA, 19 nt, Homo sapiens
gcaaggauguggguucuuc

SEQ ID NO: 1348379 - RNA, 19 nt, Homo sapiens
aaagggcacuguucuauuc

SEQ ID NO: 1348380 - RNA, 19 nt, Homo sapiens
cuacugaucccaucucuuu

SEQ ID NO: 1348381 - RNA, 19 nt, Homo sapiens
ccaccaacuucucuacuuu

SEQ ID NO: 1348382 - RNA, 19 nt, Homo sapiens
caagcuuccuaaccucuua

SEQ ID NO: 1348383 - RNA, 19 nt, Homo sapiens
guucuacccucucugcuaa

SEQ ID NO: 1348384 - RNA, 19 nt, Homo sapiens
ccaagucuguggcuucuga

SEQ ID NO: 1348385 - RNA, 19 nt, Homo sapiens
ucacaaagaccaaccauuc

SEQ ID NO: 1348386 - RNA, 19 nt, Homo sapiens
gggaaacgacuucaucuga

SEQ ID NO: 1348387 - RNA, 19 nt, Homo sapiens
gagaaacacuaaagaagac

SEQ ID NO: 1348388 - RNA, 19 nt, Homo sapiens
ugaaucaacugcuauccuu

SEQ ID NO: 1348389 - RNA, 19 nt, Homo sapiens
ggaaauggaggcuucaugu

SEQ ID NO: 1348390 - RNA, 19 nt, Homo sapiens
ccuaauaucuugacuucau

SEQ ID NO: 1348391 - RNA, 19 nt, Homo sapiens
gaugagagcaaguuugaga

SEQ ID NO: 1348392 - RNA, 19 nt, Homo sapiens
ggaacacccugcggacuga

SEQ ID NO: 1348393 - RNA, 19 nt, Homo sapiens
gagauggaaaugcacuuua

SEQ ID NO: 1348394 - RNA, 19 nt, Homo sapiens
caucagcccaugcaagaua

SEQ ID NO: 1348395 - RNA, 19 nt, Homo sapiens
aagaaugaaucaacugcua

SEQ ID NO: 1348396 - RNA, 19 nt, Homo sapiens
gcacugacuuccagaucau

SEQ ID NO: 1348397 - RNA, 19 nt, Homo sapiens
ucacgggcaugcuucauug

SEQ ID NO: 1348398 - RNA, 19 nt, Homo sapiens
gaagugaacagaucuuguc

SEQ ID NO: 1348399 - RNA, 19 nt, Homo sapiens
gcugagcgccuccuaguug

SEQ ID NO: 1348400 - RNA, 19 nt, Homo sapiens
gaacuucagauauuucaca

SEQ ID NO: 1348401 - RNA, 19 nt, Homo sapiens
cguuugaaauucugaguuu

SEQ ID NO: 1348402 - RNA, 19 nt, Homo sapiens
acgaugaugugcugacuaa

SEQ ID NO: 1348403 - RNA, 19 nt, Homo sapiens
gauggaaaugcacuuuaua

SEQ ID NO: 1348404 - RNA, 19 nt, Homo sapiens
gaccaaccauuccucuaau

SEQ ID NO: 1348405 - RNA, 19 nt, Homo sapiens
cuucagauauuucacaugu

SEQ ID NO: 1348406 - RNA, 19 nt, Homo sapiens
gcaagggcauucacaacag

SEQ ID NO: 1348407 - RNA, 19 nt, Homo sapiens
gagagcaaguuugagagaa

SEQ ID NO: 1348408 - RNA, 19 nt, Homo sapiens
gcaaaccucgccucuccua

SEQ ID NO: 1348409 - RNA, 19 nt, Homo sapiens
gcagucacccuccaucaga

SEQ ID NO: 1348410 - RNA, 19 nt, Homo sapiens
gagcaaguuugagagaaga

SEQ ID NO: 1348411 - RNA, 19 nt, Homo sapiens
ccuaaccucuuaagcauca

SEQ ID NO: 1348412 - RNA, 19 nt, Homo sapiens
gcucuagacugugcauuca

SEQ ID NO: 1348413 - RNA, 19 nt, Homo sapiens
gaaguguuauacaaucaag

SEQ ID NO: 1348414 - RNA, 19 nt, Homo sapiens
cuuaggcccucguggauuu

SEQ ID NO: 1348415 - RNA, 19 nt, Homo sapiens
caaagcaaauaaggccaaa

SEQ ID NO: 1348416 - RNA, 19 nt, Homo sapiens
caaagggcacuguucuauu

SEQ ID NO: 1348417 - RNA, 19 nt, Homo sapiens
gcaggaacgugggcucuag

SEQ ID NO: 1348418 - RNA, 19 nt, Homo sapiens
ugccugaacauuauucuua

SEQ ID NO: 1348419 - RNA, 19 nt, Homo sapiens
gaacuuucuuccuacugau

SEQ ID NO: 1348420 - RNA, 19 nt, Homo sapiens
gaaacgucacggaggagua

SEQ ID NO: 1348421 - RNA, 19 nt, Homo sapiens
uaaagaagacucggugguu

SEQ ID NO: 1348422 - RNA, 19 nt, Homo sapiens
guucagaggauuuaacaau

SEQ ID NO: 1348423 - RNA, 19 nt, Homo sapiens
agauggaaaugcacuuuau

SEQ ID NO: 1348424 - RNA, 19 nt, Homo sapiens
gaaauggaggcuucaugug

SEQ ID NO: 1348425 - RNA, 19 nt, Homo sapiens
gaauugguccucagauagu

SEQ ID NO: 1348426 - RNA, 19 nt, Homo sapiens
gcggagaaacacuaaagaa

SEQ ID NO: 1348427 - RNA, 19 nt, Homo sapiens
ggucaguucagaggauuua

SEQ ID NO: 1348428 - RNA, 19 nt, Homo sapiens
uaaagacgcgggugagugu

SEQ ID NO: 1348429 - RNA, 19 nt, Homo sapiens
gggcagcacgggacagaaa

SEQ ID NO: 1348430 - RNA, 19 nt, Homo sapiens
gggagagggcugagauuug

SEQ ID NO: 1348431 - RNA, 19 nt, Homo sapiens
agaccaaccauuccucuaa

SEQ ID NO: 1348432 - RNA, 19 nt, Homo sapiens
gcccagcccugaaggagau

SEQ ID NO: 1348433 - RNA, 19 nt, Homo sapiens
gaaccagucagcccucugu

SEQ ID NO: 1348434 - RNA, 19 nt, Homo sapiens
ucaccuaccuccuuagcau

SEQ ID NO: 1348435 - RNA, 19 nt, Homo sapiens
cauugugggucugucuuua

SEQ ID NO: 1348436 - RNA, 19 nt, Homo sapiens
caacuuuucuguauguuug

SEQ ID NO: 1348437 - RNA, 19 nt, Homo sapiens
caaauaaggccaaaauguu

SEQ ID NO: 1348438 - RNA, 19 nt, Homo sapiens
gagggcgcaucaaagaaga

SEQ ID NO: 1348439 - RNA, 19 nt, Homo sapiens
gcaaauaaggccaaaaugu

SEQ ID NO: 1348440 - RNA, 19 nt, Homo sapiens
uaacgguacugcaguucau

SEQ ID NO: 1348441 - RNA, 19 nt, Homo sapiens
gcaagauagguuucuguau

SEQ ID NO: 1348442 - RNA, 19 nt, Homo sapiens
gagagaagaaugaaucaac

SEQ ID NO: 1348443 - RNA, 19 nt, Homo sapiens
gguuugaagugaacagauc

SEQ ID NO: 1348444 - RNA, 19 nt, Homo sapiens
gaugaugugcugacuaaag

SEQ ID NO: 1348445 - RNA, 19 nt, Homo sapiens
guacuuguucuuucaacuu

SEQ ID NO: 1348446 - RNA, 19 nt, Homo sapiens
ccagguggagcucauguuu

SEQ ID NO: 1348447 - RNA, 19 nt, Homo sapiens
gguguccucugaauuugga

SEQ ID NO: 1348448 - RNA, 19 nt, Homo sapiens
guucagagccugggucuca

SEQ ID NO: 1348449 - RNA, 19 nt, Homo sapiens
gacagacgaacacagcuaa

SEQ ID NO: 1348450 - RNA, 19 nt, Homo sapiens
ugccuuggaucguuugaaa

SEQ ID NO: 1348451 - RNA, 19 nt, Homo sapiens
ggagggcgcaucaaagaag

SEQ ID NO: 1348452 - RNA, 19 nt, Homo sapiens
ugcaguggcugguauuuca

SEQ ID NO: 1348453 - RNA, 19 nt, Homo sapiens
gcagagccagcgaaggaaa

SEQ ID NO: 1348454 - RNA, 19 nt, Homo sapiens
ggaagaggcccugguuugg

SEQ ID NO: 1348455 - RNA, 19 nt, Homo sapiens
gcugugguguccucugaau

SEQ ID NO: 1348456 - RNA, 19 nt, Homo sapiens
caacugcucaggcucacaa

SEQ ID NO: 1348457 - RNA, 19 nt, Homo sapiens
aaucacaaguguccugcaa

SEQ ID NO: 1348458 - RNA, 19 nt, Homo sapiens
ugugguguccucugaauuu

SEQ ID NO: 1348459 - RNA, 19 nt, Homo sapiens
cauucaggcucuccuacuu

SEQ ID NO: 1348460 - RNA, 19 nt, Homo sapiens
ucccucaccuaccuccuua

SEQ ID NO: 1348461 - RNA, 19 nt, Homo sapiens
ucacaaguguccugcaaaa

SEQ ID NO: 1348462 - RNA, 19 nt, Homo sapiens
caacaggccagugggcaaa

SEQ ID NO: 1348463 - RNA, 19 nt, Homo sapiens
cacaaaaguuggcaaaaug

SEQ ID NO: 1348464 - RNA, 19 nt, Homo sapiens
gggucugucuuuaaagugu

SEQ ID NO: 1348465 - RNA, 19 nt, Homo sapiens
gcauugugggucugucuuu

SEQ ID NO: 1348466 - RNA, 19 nt, Homo sapiens
gaaugaaucaacugcuauc

SEQ ID NO: 1348467 - RNA, 19 nt, Homo sapiens
gcauagacucgugguuuga

SEQ ID NO: 1348468 - RNA, 19 nt, Homo sapiens
ccugugcuauauuuaauuc

SEQ ID NO: 1348469 - RNA, 19 nt, Homo sapiens
acaaagggcacuguucuau

SEQ ID NO: 1348470 - RNA, 19 nt, Homo sapiens
agauggcacugcgugauuu

SEQ ID NO: 1348471 - RNA, 19 nt, Homo sapiens
ggaacaacaugaaauauag

SEQ ID NO: 1348472 - RNA, 19 nt, Homo sapiens
ucaccaagaugcugaaauu

SEQ ID NO: 1348473 - RNA, 19 nt, Homo sapiens
gaucccagcuguacaauag

SEQ ID NO: 1348474 - RNA, 19 nt, Homo sapiens
ggaaacaauugggaaauau

SEQ ID NO: 1348475 - RNA, 19 nt, Homo sapiens
uggcuuacaucaacuaaua

SEQ ID NO: 1348476 - RNA, 19 nt, Homo sapiens
gaauauggcugaccuacag

SEQ ID NO: 1348477 - RNA, 19 nt, Homo sapiens
agaauucccucaaauagaa

SEQ ID NO: 1348478 - RNA, 19 nt, Homo sapiens
gaguuugucuugcuuuaaa

SEQ ID NO: 1348479 - RNA, 19 nt, Homo sapiens
caagaugacaguuugauuu

SEQ ID NO: 1348480 - RNA, 19 nt, Homo sapiens
gaagaauucccucaaauag

SEQ ID NO: 1348481 - RNA, 19 nt, Homo sapiens
gaaauauaguuggguguug

SEQ ID NO: 1348482 - RNA, 19 nt, Homo sapiens
uaaaggauuucccucuuga

SEQ ID NO: 1348483 - RNA, 19 nt, Homo sapiens
guagaagaauuucguaaag

SEQ ID NO: 1348484 - RNA, 19 nt, Homo sapiens
ggaccuggccugaugcuuu

SEQ ID NO: 1348485 - RNA, 19 nt, Homo sapiens
auacuacacuuucuuggua

SEQ ID NO: 1348486 - RNA, 19 nt, Homo sapiens
aauagaggaucacguaauu

SEQ ID NO: 1348487 - RNA, 19 nt, Homo sapiens
gaagaaugcaaucaaguga

SEQ ID NO: 1348488 - RNA, 19 nt, Homo sapiens
ccacugcccuucucccaaa

SEQ ID NO: 1348489 - RNA, 19 nt, Homo sapiens
caacaccgacuacuuagaa

SEQ ID NO: 1348490 - RNA, 19 nt, Homo sapiens
gaugacaguuugauuuaca

SEQ ID NO: 1348491 - RNA, 19 nt, Homo sapiens
gaaggaaacaauugggaaa

SEQ ID NO: 1348492 - RNA, 19 nt, Homo sapiens
caggaaauguagaagaauu

SEQ ID NO: 1348493 - RNA, 19 nt, Homo sapiens
gagaaacaaguauaucuga

SEQ ID NO: 1348494 - RNA, 19 nt, Homo sapiens
gaaccaacaccgacuacuu

SEQ ID NO: 1348495 - RNA, 19 nt, Homo sapiens
gaugacaaagcuguuauua

SEQ ID NO: 1348496 - RNA, 19 nt, Homo sapiens
gaacagaugaaguugacaa

SEQ ID NO: 1348497 - RNA, 19 nt, Homo sapiens
gaaaugcgaaaugaaguuu

SEQ ID NO: 1348498 - RNA, 19 nt, Homo sapiens
gauaagaagaauuccauug

SEQ ID NO: 1348499 - RNA, 19 nt, Homo sapiens
gcagaugacaaagcuguua

SEQ ID NO: 1348500 - RNA, 19 nt, Homo sapiens
gaagcaaggcauccugauu

SEQ ID NO: 1348501 - RNA, 19 nt, Homo sapiens
ggauuucccucuugagaca

SEQ ID NO: 1348502 - RNA, 19 nt, Homo sapiens
cauauuacuuugcuggauu

SEQ ID NO: 1348503 - RNA, 19 nt, Homo sapiens
gaccuggccugaugcuuug

SEQ ID NO: 1348504 - RNA, 19 nt, Homo sapiens
cauaaaggauuucccucuu

SEQ ID NO: 1348505 - RNA, 19 nt, Homo sapiens
ggaaagaagucugggaaaa

SEQ ID NO: 1348506 - RNA, 19 nt, Homo sapiens
gcaaaccuaaacagucaua

SEQ ID NO: 1348507 - RNA, 19 nt, Homo sapiens
aaacagagugcuuccauga

SEQ ID NO: 1348508 - RNA, 19 nt, Homo sapiens
gaucaugaaaugcgaaaug

SEQ ID NO: 1348509 - RNA, 19 nt, Homo sapiens
gcucagcuuugacaacaga

SEQ ID NO: 1348510 - RNA, 19 nt, Homo sapiens
cauuugugcuugauaagaa

SEQ ID NO: 1348511 - RNA, 19 nt, Homo sapiens
uggcaaaccuaaacaguca

SEQ ID NO: 1348512 - RNA, 19 nt, Homo sapiens
ucacguaauugcaggaaau

SEQ ID NO: 1348513 - RNA, 19 nt, Homo sapiens
gaugucagcauaaaggauu

SEQ ID NO: 1348514 - RNA, 19 nt, Homo sapiens
aggaaacaauugggaaaua

SEQ ID NO: 1348515 - RNA, 19 nt, Homo sapiens
uuacauggauccucauuac

SEQ ID NO: 1348516 - RNA, 19 nt, Homo sapiens
aaccaacaccgacuacuua

SEQ ID NO: 1348517 - RNA, 19 nt, Homo sapiens
gugcuuccaugacuucuga

SEQ ID NO: 1348518 - RNA, 19 nt, Homo sapiens
gaaauguucaggacuucaa

SEQ ID NO: 1348519 - RNA, 19 nt, Homo sapiens
agcaaggcauccugauuua

SEQ ID NO: 1348520 - RNA, 19 nt, Homo sapiens
aagcaaggcauccugauuu

SEQ ID NO: 1348521 - RNA, 19 nt, Homo sapiens
uuacuuugcuggauuucaa

SEQ ID NO: 1348522 - RNA, 19 nt, Homo sapiens
ccugaugcuuugaauauug

SEQ ID NO: 1348523 - RNA, 19 nt, Homo sapiens
ggacucauacuacacuuuc

SEQ ID NO: 1348524 - RNA, 19 nt, Homo sapiens
auagaaggcucagcuuuga

SEQ ID NO: 1348525 - RNA, 19 nt, Homo sapiens
gauguacaauagaggauca

SEQ ID NO: 1348526 - RNA, 19 nt, Homo sapiens
gaagagaaacaaguauauc

SEQ ID NO: 1348527 - RNA, 19 nt, Homo sapiens
cugaagaaaucaccaagau

SEQ ID NO: 1348528 - RNA, 19 nt, Homo sapiens
cuauuuauguugcacaaga

SEQ ID NO: 1348529 - RNA, 19 nt, Homo sapiens
gcuuggaccuggccugaug

SEQ ID NO: 1348530 - RNA, 19 nt, Homo sapiens
aaauauaguuggguguuga

SEQ ID NO: 1348531 - RNA, 19 nt, Homo sapiens
gagugauucugguugcaaa

SEQ ID NO: 1348532 - RNA, 19 nt, Homo sapiens
ggccugaugcuuugaauau

SEQ ID NO: 1348533 - RNA, 19 nt, Homo sapiens
uacaauagaggaucacgua

SEQ ID NO: 1348534 - RNA, 19 nt, Homo sapiens
gaagaauuccauugaaagg

SEQ ID NO: 1348535 - RNA, 19 nt, Homo sapiens
agauuaaacucuacagaag

SEQ ID NO: 1348536 - RNA, 19 nt, Homo sapiens
gaaaaucaucucuugguuu

SEQ ID NO: 1348537 - RNA, 19 nt, Homo sapiens
gaacuggccagaugcucuu

SEQ ID NO: 1348538 - RNA, 19 nt, Homo sapiens
gagucgggauguacaauag

SEQ ID NO: 1348539 - RNA, 19 nt, Homo sapiens
agaugaaguugacaagcua

SEQ ID NO: 1348540 - RNA, 19 nt, Homo sapiens
auaaaggauuucccucuug

SEQ ID NO: 1348541 - RNA, 19 nt, Homo sapiens
ugcaggaaauguagaagaa

SEQ ID NO: 1348542 - RNA, 19 nt, Homo sapiens
ggaaaaucaucucuugguu

SEQ ID NO: 1348543 - RNA, 19 nt, Homo sapiens
gauuaaacucuacagaaga

SEQ ID NO: 1348544 - RNA, 19 nt, Homo sapiens
caccgacuacuuagaauuu

SEQ ID NO: 1348545 - RNA, 19 nt, Homo sapiens
caaggcauccugauuuaca

SEQ ID NO: 1348546 - RNA, 19 nt, Homo sapiens
cguaauugcaggaaaugua

SEQ ID NO: 1348547 - RNA, 19 nt, Homo sapiens
uagaauuugugaaggguau

SEQ ID NO: 1348548 - RNA, 19 nt, Homo sapiens
aaaaucaucucuugguuug

SEQ ID NO: 1348549 - RNA, 19 nt, Homo sapiens
gcucaaggacucauacuac

SEQ ID NO: 1348550 - RNA, 19 nt, Homo sapiens
uuacaguucuccaguccuu

SEQ ID NO: 1348551 - RNA, 19 nt, Homo sapiens
ccucauuacugccaaucuu

SEQ ID NO: 1348552 - RNA, 19 nt, Homo sapiens
cagaugaaguugacaagcu

SEQ ID NO: 1348553 - RNA, 19 nt, Homo sapiens
caauagaggaucacguaau

SEQ ID NO: 1348554 - RNA, 19 nt, Homo sapiens
ugggaaauauucugaugau

SEQ ID NO: 1348555 - RNA, 19 nt, Homo sapiens
caacaauuucucugaagga

SEQ ID NO: 1348556 - RNA, 19 nt, Homo sapiens
acagaagaaugcaaucaag

SEQ ID NO: 1348557 - RNA, 19 nt, Homo sapiens
gucgaaauguucaggacuu

SEQ ID NO: 1348558 - RNA, 19 nt, Homo sapiens
gacaaagcuguuauuauuc

SEQ ID NO: 1348559 - RNA, 19 nt, Homo sapiens
agugauggcuuuuccuuua

SEQ ID NO: 1348560 - RNA, 19 nt, Homo sapiens
ggacuucccacacugucaa

SEQ ID NO: 1348561 - RNA, 19 nt, Homo sapiens
caucuacuacaaccaauga

SEQ ID NO: 1348562 - RNA, 19 nt, Homo sapiens
gauuucaagaugacaguuu

SEQ ID NO: 1348563 - RNA, 19 nt, Homo sapiens
gaauuugugaaggguauuu

SEQ ID NO: 1348564 - RNA, 19 nt, Homo sapiens
aaauagaaggcucagcuuu

SEQ ID NO: 1348565 - RNA, 19 nt, Homo sapiens
guagaugucagcauaaagg

SEQ ID NO: 1348566 - RNA, 19 nt, Homo sapiens
uagacuugguggagaaaga

SEQ ID NO: 1348567 - RNA, 19 nt, Homo sapiens
guacaguuuacaauucuga

SEQ ID NO: 1348568 - RNA, 19 nt, Homo sapiens
aauagaaggcucagcuuug

SEQ ID NO: 1348569 - RNA, 19 nt, Homo sapiens
guaauugcaggaaauguag

SEQ ID NO: 1348570 - RNA, 19 nt, Homo sapiens
acaguuugauuuacaugga

SEQ ID NO: 1348571 - RNA, 19 nt, Homo sapiens
caacaaagccugucaaguu

SEQ ID NO: 1348572 - RNA, 19 nt, Homo sapiens
gaauggaucuucccuuuca

SEQ ID NO: 1348573 - RNA, 19 nt, Homo sapiens
ggaaacagccuucguuaga

SEQ ID NO: 1348574 - RNA, 19 nt, Homo sapiens
ggaccucgguguucacuga

SEQ ID NO: 1348575 - RNA, 19 nt, Homo sapiens
ggaacacgauugucucaga

SEQ ID NO: 1348576 - RNA, 19 nt, Homo sapiens
ggaccaagcuuccucaacu

SEQ ID NO: 1348577 - RNA, 19 nt, Homo sapiens
gaaugguucuuccggguuu

SEQ ID NO: 1348578 - RNA, 19 nt, Homo sapiens
gaaccgcgacuucaacaaa

SEQ ID NO: 1348579 - RNA, 19 nt, Homo sapiens
gcaaccagaugucuuccuu

SEQ ID NO: 1348580 - RNA, 19 nt, Homo sapiens
gacgaugacuuguccauuc

SEQ ID NO: 1348581 - RNA, 19 nt, Homo sapiens
gaggaaacagccuucguua

SEQ ID NO: 1348582 - RNA, 19 nt, Homo sapiens
gaacacgauugucucagau

SEQ ID NO: 1348583 - RNA, 19 nt, Homo sapiens
gcagagagauaagaaagca

SEQ ID NO: 1348584 - RNA, 19 nt, Homo sapiens
gggaguacguugugccaaa

SEQ ID NO: 1348585 - RNA, 19 nt, Homo sapiens
caagauaccguucgggaaa

SEQ ID NO: 1348586 - RNA, 19 nt, Homo sapiens
agaccuaccuggaggauga

SEQ ID NO: 1348587 - RNA, 19 nt, Homo sapiens
ccacaugaguguaaaugau

SEQ ID NO: 1348588 - RNA, 19 nt, Homo sapiens
gcauuucccugcacugugu

SEQ ID NO: 1348589 - RNA, 19 nt, Homo sapiens
gagcaaagccacagacgau

SEQ ID NO: 1348590 - RNA, 19 nt, Homo sapiens
ggucagacgugcuguuaag

SEQ ID NO: 1348591 - RNA, 19 nt, Homo sapiens
gagaauccauuucguuaac

SEQ ID NO: 1348592 - RNA, 19 nt, Homo sapiens
gaaacagccuucguuagag

SEQ ID NO: 1348593 - RNA, 19 nt, Homo sapiens
gcaaagccacagacgauga

SEQ ID NO: 1348594 - RNA, 19 nt, Homo sapiens
ggagaauccauuucguuaa

SEQ ID NO: 1348595 - RNA, 19 nt, Homo sapiens
acaaccagcuccuugaaga

SEQ ID NO: 1348596 - RNA, 19 nt, Homo sapiens
cugaauggaucuucccuuu

SEQ ID NO: 1348597 - RNA, 19 nt, Homo sapiens
gaaaagcacugaaguugag

SEQ ID NO: 1348598 - RNA, 19 nt, Homo sapiens
cagaagcgcagccuuugua

SEQ ID NO: 1348599 - RNA, 19 nt, Homo sapiens
gagcaggacacgcaccuuu

SEQ ID NO: 1348600 - RNA, 19 nt, Homo sapiens
gguguucacugaccuuugu

SEQ ID NO: 1348601 - RNA, 19 nt, Homo sapiens
gcaugagcgugucugaaga

SEQ ID NO: 1348602 - RNA, 19 nt, Homo sapiens
ggacacauugccaugguuu

SEQ ID NO: 1348603 - RNA, 19 nt, Homo sapiens
uguggcaucugauauuaaa

SEQ ID NO: 1348604 - RNA, 19 nt, Homo sapiens
agccauugcuuccucguua

SEQ ID NO: 1348605 - RNA, 19 nt, Homo sapiens
gugcaaauccucucucuag

SEQ ID NO: 1348606 - RNA, 19 nt, Homo sapiens
ggagaaagagugccagucu

SEQ ID NO: 1348607 - RNA, 19 nt, Homo sapiens
gcacugaaguugagauccu

SEQ ID NO: 1348608 - RNA, 19 nt, Homo sapiens
gaauauuacgcggcugaua

SEQ ID NO: 1348609 - RNA, 19 nt, Homo sapiens
gaaguugagauccuagaga

SEQ ID NO: 1348610 - RNA, 19 nt, Homo sapiens
gccaaaucauugccacuug

SEQ ID NO: 1348611 - RNA, 19 nt, Homo sapiens
ucgcugagcuaccgggaaa

SEQ ID NO: 1348612 - RNA, 19 nt, Homo sapiens
gcugcucugugucguguuu

SEQ ID NO: 1348613 - RNA, 19 nt, Homo sapiens
uguguggcaucugauauua

SEQ ID NO: 1348614 - RNA, 19 nt, Homo sapiens
uaagcuauccuguccgaaa

SEQ ID NO: 1348615 - RNA, 19 nt, Homo sapiens
gagauaagaaagcaagugu

SEQ ID NO: 1348616 - RNA, 19 nt, Homo sapiens
ggaguacguugugccaaau

SEQ ID NO: 1348617 - RNA, 19 nt, Homo sapiens
gagaguggguccagaaucc

SEQ ID NO: 1348618 - RNA, 19 nt, Homo sapiens
aacaaagccugucaaguuc

SEQ ID NO: 1348619 - RNA, 19 nt, Homo sapiens
gaacuuuucugcuguugug

SEQ ID NO: 1348620 - RNA, 19 nt, Homo sapiens
caagacggcugaggagaag

SEQ ID NO: 1348621 - RNA, 19 nt, Homo sapiens
gccaguacgugaccugugu

SEQ ID NO: 1348622 - RNA, 19 nt, Homo sapiens
caagugugcuauacaucga

SEQ ID NO: 1348623 - RNA, 19 nt, Homo sapiens
uuucugcuguugugaagua

SEQ ID NO: 1348624 - RNA, 19 nt, Homo sapiens
ugcgacaguuccagaauuu

SEQ ID NO: 1348625 - RNA, 19 nt, Homo sapiens
gaaguaggaaugcuagucu

SEQ ID NO: 1348626 - RNA, 19 nt, Homo sapiens
ggaagaacuggccuacaga

SEQ ID NO: 1348627 - RNA, 19 nt, Homo sapiens
gaugagaguggguccagaa

SEQ ID NO: 1348628 - RNA, 19 nt, Homo sapiens
gaugacuuguccauucuca

SEQ ID NO: 1348629 - RNA, 19 nt, Homo sapiens
cgacuacaggguccgguua

SEQ ID NO: 1348630 - RNA, 19 nt, Homo sapiens
ggagacguguugggcaguu

SEQ ID NO: 1348631 - RNA, 19 nt, Homo sapiens
aaguugagauccuagagaa

SEQ ID NO: 1348632 - RNA, 19 nt, Homo sapiens
ggacggaagcguauucacu

SEQ ID NO: 1348633 - RNA, 19 nt, Homo sapiens
ugaccuguguggagaccua

SEQ ID NO: 1348634 - RNA, 19 nt, Homo sapiens
gaccaagcuuccucaacug

SEQ ID NO: 1348635 - RNA, 19 nt, Homo sapiens
cuaauuccaugcguucuau

SEQ ID NO: 1348636 - RNA, 19 nt, Homo sapiens
aaauuggacucuugcaagu

SEQ ID NO: 1348637 - RNA, 19 nt, Homo sapiens
uggaagaacuggccuacag

SEQ ID NO: 1348638 - RNA, 19 nt, Homo sapiens
gauuauggccugcgaaggu

SEQ ID NO: 1348639 - RNA, 19 nt, Homo sapiens
ggagugacaaaccgcauug

SEQ ID NO: 1348640 - RNA, 19 nt, Homo sapiens
ugaaaggacggaagcguau

SEQ ID NO: 1348641 - RNA, 19 nt, Homo sapiens
ggccaugugugcaacaaag

SEQ ID NO: 1348642 - RNA, 19 nt, Homo sapiens
gaaaggacggaagcguauu

SEQ ID NO: 1348643 - RNA, 19 nt, Homo sapiens
uggacgagguggacuacaa

SEQ ID NO: 1348644 - RNA, 19 nt, Homo sapiens
auuggacucuugcaaguaa

SEQ ID NO: 1348645 - RNA, 19 nt, Homo sapiens
caccaagaguccuuuuaua

SEQ ID NO: 1348646 - RNA, 19 nt, Homo sapiens
gaugcaaccagaugucuuc

SEQ ID NO: 1348647 - RNA, 19 nt, Homo sapiens
gagguggugcccaagauga

SEQ ID NO: 1348648 - RNA, 19 nt, Homo sapiens
guuguucgagguggaauua

SEQ ID NO: 1348649 - RNA, 19 nt, Homo sapiens
guauguguggcaucugaua

SEQ ID NO: 1348650 - RNA, 19 nt, Homo sapiens
gguuucacagugucucuua

SEQ ID NO: 1348651 - RNA, 19 nt, Homo sapiens
uguucgagguggaauuaaa

SEQ ID NO: 1348652 - RNA, 19 nt, Homo sapiens
ugaggaaacagccuucguu

SEQ ID NO: 1348653 - RNA, 19 nt, Homo sapiens
gguccagaauccaccacaa

SEQ ID NO: 1348654 - RNA, 19 nt, Homo sapiens
gcucagcagcguugcaugu

SEQ ID NO: 1348655 - RNA, 19 nt, Homo sapiens
gcuggaggccuugcuuuga

SEQ ID NO: 1348656 - RNA, 19 nt, Homo sapiens
cugcgacaguuccagaauu

SEQ ID NO: 1348657 - RNA, 19 nt, Homo sapiens
ggaccugucugugcguucu

SEQ ID NO: 1348658 - RNA, 19 nt, Homo sapiens
gauucgaacuccucaucuc

SEQ ID NO: 1348659 - RNA, 19 nt, Homo sapiens
gaagcgcagccuuuguaug

SEQ ID NO: 1348660 - RNA, 19 nt, Homo sapiens
gcagaagcgcagccuuugu

SEQ ID NO: 1348661 - RNA, 19 nt, Homo sapiens
gaauuugcucucccacuca

SEQ ID NO: 1348662 - RNA, 19 nt, Homo sapiens
gaggaggccaugugugcaa

SEQ ID NO: 1348663 - RNA, 19 nt, Homo sapiens
uggcagaagcgcagccuuu

SEQ ID NO: 1348664 - RNA, 19 nt, Homo sapiens
agaagcgucugccgugauc

SEQ ID NO: 1348665 - RNA, 19 nt, Homo sapiens
acaagacggcugaggagaa

SEQ ID NO: 1348666 - RNA, 19 nt, Homo sapiens
uuacgcggcugauauaagc

SEQ ID NO: 1348667 - RNA, 19 nt, Homo sapiens
cagugucucuuaaaaguuu

SEQ ID NO: 1348668 - RNA, 19 nt, Homo sapiens
gaggaaacucagcgcagaa

SEQ ID NO: 1348669 - RNA, 19 nt, Homo sapiens
ugacaaccagcuccuugaa

SEQ ID NO: 1348670 - RNA, 19 nt, Homo sapiens
agucuggcauaaacauaaa

SEQ ID NO: 1348671 - RNA, 19 nt, Homo sapiens
gaaagaaagugugaaccua

SEQ ID NO: 1348672 - RNA, 19 nt, Homo sapiens
ggaguuagguucaucacaa

SEQ ID NO: 1348673 - RNA, 19 nt, Homo sapiens
gggaaagugcuuaguauua

SEQ ID NO: 1348674 - RNA, 19 nt, Homo sapiens
ggaaagugcuuaguauuag

SEQ ID NO: 1348675 - RNA, 19 nt, Homo sapiens
ccagaacucuuggagcuua

SEQ ID NO: 1348676 - RNA, 19 nt, Homo sapiens
ugacagcgcuucuccuaau

SEQ ID NO: 1348677 - RNA, 19 nt, Homo sapiens
gcagggaaagugcuuagua

SEQ ID NO: 1348678 - RNA, 19 nt, Homo sapiens
gaguuagguucaucacaaa

SEQ ID NO: 1348679 - RNA, 19 nt, Homo sapiens
cagggaaagugcuuaguau

SEQ ID NO: 1348680 - RNA, 19 nt, Homo sapiens
aacaagacguacugaauga

SEQ ID NO: 1348681 - RNA, 19 nt, Homo sapiens
aaacaagacguacugaaug

SEQ ID NO: 1348682 - RNA, 19 nt, Homo sapiens
gacgaucuguacccggaua

SEQ ID NO: 1348683 - RNA, 19 nt, Homo sapiens
caagacguacugaaugaaa

SEQ ID NO: 1348684 - RNA, 19 nt, Homo sapiens
ucacggcucuggagaacau

SEQ ID NO: 1348685 - RNA, 19 nt, Homo sapiens
uggagacgcugcuggaaga

SEQ ID NO: 1348686 - RNA, 19 nt, Homo sapiens
guuagguucaucacaaaua

SEQ ID NO: 1348687 - RNA, 19 nt, Homo sapiens
gaacucucuuccuucuuuc

SEQ ID NO: 1348688 - RNA, 19 nt, Homo sapiens
cagcagcauucgguacuuu

SEQ ID NO: 1348689 - RNA, 19 nt, Homo sapiens
caucacaaauacacacaca

SEQ ID NO: 1348690 - RNA, 19 nt, Homo sapiens
acacauacacaacccguuu

SEQ ID NO: 1348691 - RNA, 19 nt, Homo sapiens
gaaagugcuuaguauuagc

SEQ ID NO: 1348692 - RNA, 19 nt, Homo sapiens
gccguugccucucucagaa

SEQ ID NO: 1348693 - RNA, 19 nt, Homo sapiens
gcgcgcagcggguauaugu

SEQ ID NO: 1348694 - RNA, 19 nt, Homo sapiens
aaagaaagugugaaccuau

SEQ ID NO: 1348695 - RNA, 19 nt, Homo sapiens
cugcaacucuggucacuag

SEQ ID NO: 1348696 - RNA, 19 nt, Homo sapiens
agacguacugaaugaaaua

SEQ ID NO: 1348697 - RNA, 19 nt, Homo sapiens
gugugaaccuaucaucaug

SEQ ID NO: 1348698 - RNA, 19 nt, Homo sapiens
ccaguucugcagacacaua

SEQ ID NO: 1348699 - RNA, 19 nt, Homo sapiens
gaugucagcaagugugaga

SEQ ID NO: 1348700 - RNA, 19 nt, Homo sapiens
gccgaacccgugcucauuu

SEQ ID NO: 1348701 - RNA, 19 nt, Homo sapiens
ucuacaagcuacacgaaag

SEQ ID NO: 1348702 - RNA, 19 nt, Homo sapiens
uauuggagccugagcuuga

SEQ ID NO: 1348703 - RNA, 19 nt, Homo sapiens
aagaaagugugaaccuauc

SEQ ID NO: 1348704 - RNA, 19 nt, Homo sapiens
cgggagaccagaacucuug

SEQ ID NO: 1348705 - RNA, 19 nt, Homo sapiens
ccuagaagcggacgaaugg

SEQ ID NO: 1348706 - RNA, 19 nt, Homo sapiens
ugcacuaccugaacacguu

SEQ ID NO: 1348707 - RNA, 19 nt, Homo sapiens
auucgguacuuugagauua

SEQ ID NO: 1348708 - RNA, 19 nt, Homo sapiens
gcagcauucgguacuuuga

SEQ ID NO: 1348709 - RNA, 19 nt, Homo sapiens
aaugacagcgcuucuccua

SEQ ID NO: 1348710 - RNA, 19 nt, Homo sapiens
caagcuacacgaaagaaag

SEQ ID NO: 1348711 - RNA, 19 nt, Homo sapiens
caagggcgacagcagcauu

SEQ ID NO: 1348712 - RNA, 19 nt, Homo sapiens
ccgaacccgugcucauuuc

SEQ ID NO: 1348713 - RNA, 19 nt, Homo sapiens
gaagcggacgaauggcuau

SEQ ID NO: 1348714 - RNA, 19 nt, Homo sapiens
gaaagugugaaccuaucau

SEQ ID NO: 1348715 - RNA, 19 nt, Homo sapiens
cagcaucgucuaccugugu

SEQ ID NO: 1348716 - RNA, 19 nt, Homo sapiens
gacagcgcuucuccuaauc

SEQ ID NO: 1348717 - RNA, 19 nt, Homo sapiens
gcaucacggcucuggagaa

SEQ ID NO: 1348718 - RNA, 19 nt, Homo sapiens
agacgcugcuggaagagau

SEQ ID NO: 1348719 - RNA, 19 nt, Homo sapiens
aagacguacugaaugaaau

SEQ ID NO: 1348720 - RNA, 19 nt, Homo sapiens
gcaugaggaguuagguuca

SEQ ID NO: 1348721 - RNA, 19 nt, Homo sapiens
ugcaggagauggacacaag

SEQ ID NO: 1348722 - RNA, 19 nt, Homo sapiens
caucacggcucuggagaac

SEQ ID NO: 1348723 - RNA, 19 nt, Homo sapiens
gcugagggacggcuaugug

SEQ ID NO: 1348724 - RNA, 19 nt, Homo sapiens
cuacaagcuacacgaaaga

SEQ ID NO: 1348725 - RNA, 19 nt, Homo sapiens
gacuggaugucagcaagug

SEQ ID NO: 1348726 - RNA, 19 nt, Homo sapiens
ucacaaauacacacacacu

SEQ ID NO: 1348727 - RNA, 19 nt, Homo sapiens
ucuggucacuagagguuug

SEQ ID NO: 1348728 - RNA, 19 nt, Homo sapiens
cgaaagaaagugugaaccu

SEQ ID NO: 1348729 - RNA, 19 nt, Homo sapiens
uuagguucaucacaaauac

SEQ ID NO: 1348730 - RNA, 19 nt, Homo sapiens
ggucugugguagagaacuc

SEQ ID NO: 1348731 - RNA, 19 nt, Homo sapiens
ccgcaagucagaccucuuc

SEQ ID NO: 1348732 - RNA, 19 nt, Homo sapiens
ggacuggaugucagcaagu

SEQ ID NO: 1348733 - RNA, 19 nt, Homo sapiens
ccaccccucugcccaguuu

SEQ ID NO: 1348734 - RNA, 19 nt, Homo sapiens
cagcagagaugaacagaau

SEQ ID NO: 1348735 - RNA, 19 nt, Homo sapiens
gaacuugucgucacucuug

SEQ ID NO: 1348736 - RNA, 19 nt, Homo sapiens
gcagagaugaacagaauaa

SEQ ID NO: 1348737 - RNA, 19 nt, Homo sapiens
ggaaauggaauaaagaugu

SEQ ID NO: 1348738 - RNA, 19 nt, Homo sapiens
gcaacaaucaucagaguga

SEQ ID NO: 1348739 - RNA, 19 nt, Homo sapiens
ccacugggauccuuucuca

SEQ ID NO: 1348740 - RNA, 19 nt, Homo sapiens
gagugacgcugaugguuug

SEQ ID NO: 1348741 - RNA, 19 nt, Homo sapiens
ggggugagcugguuauuuu

SEQ ID NO: 1348742 - RNA, 19 nt, Homo sapiens
gcagaaggaucccgcaaac

SEQ ID NO: 1348743 - RNA, 19 nt, Homo sapiens
caagagaggaugcugagaa

SEQ ID NO: 1348744 - RNA, 19 nt, Homo sapiens
gcuacacacucuccuacaa

SEQ ID NO: 1348745 - RNA, 19 nt, Homo sapiens
aaacguggauuacgaggau

SEQ ID NO: 1348746 - RNA, 19 nt, Homo sapiens
uggugaagcucuuggauga

SEQ ID NO: 1348747 - RNA, 19 nt, Homo sapiens
gagaggaugcugagaacuu

SEQ ID NO: 1348748 - RNA, 19 nt, Homo sapiens
cagaauaaccaccaaggaa

SEQ ID NO: 1348749 - RNA, 19 nt, Homo sapiens
caaagccaguccuguguca

SEQ ID NO: 1348750 - RNA, 19 nt, Homo sapiens
gaccaaggccacagagcua

SEQ ID NO: 1348751 - RNA, 19 nt, Homo sapiens
ccagaccuucuauucauua

SEQ ID NO: 1348752 - RNA, 19 nt, Homo sapiens
cauaucaucuguuuguucu

SEQ ID NO: 1348753 - RNA, 19 nt, Homo sapiens
gaacccgggaaauggaaua

SEQ ID NO: 1348754 - RNA, 19 nt, Homo sapiens
caacaaccgccacccuuug

SEQ ID NO: 1348755 - RNA, 19 nt, Homo sapiens
ggagagacccgccagaaac

SEQ ID NO: 1348756 - RNA, 19 nt, Homo sapiens
ccgcaaacguggauuacga

SEQ ID NO: 1348757 - RNA, 19 nt, Homo sapiens
gugaagcucuuggaugaug

SEQ ID NO: 1348758 - RNA, 19 nt, Homo sapiens
gaaaccccgucuauacuaa

SEQ ID NO: 1348759 - RNA, 19 nt, Homo sapiens
gagccgagaucgcaucacu

SEQ ID NO: 1348760 - RNA, 19 nt, Homo sapiens
gagaugaacagaauaacca

SEQ ID NO: 1348761 - RNA, 19 nt, Homo sapiens
gccagaccuucuauucauu

SEQ ID NO: 1348762 - RNA, 19 nt, Homo sapiens
uagcaacaaucaucagagu

SEQ ID NO: 1348763 - RNA, 19 nt, Homo sapiens
ccaacaaccgccacccuuu

SEQ ID NO: 1348764 - RNA, 19 nt, Homo sapiens
uaucaucuguuuguucugu

SEQ ID NO: 1348765 - RNA, 19 nt, Homo sapiens
ugucgucacucuuggaugu

SEQ ID NO: 1348766 - RNA, 19 nt, Homo sapiens
uggcagagccugagaacga

SEQ ID NO: 1348767 - RNA, 19 nt, Homo sapiens
ugaugggacuuucaugauc

SEQ ID NO: 1348768 - RNA, 19 nt, Homo sapiens
aagaagagacugagguuca

SEQ ID NO: 1348769 - RNA, 19 nt, Homo sapiens
ugucaccaaucaaaggaaa

SEQ ID NO: 1348770 - RNA, 19 nt, Homo sapiens
agaggaugcugagaacuug

SEQ ID NO: 1348771 - RNA, 19 nt, Homo sapiens
uguuuguucuguugucuaa

SEQ ID NO: 1348772 - RNA, 19 nt, Homo sapiens
ugccagaccuucuauucau

SEQ ID NO: 1348773 - RNA, 19 nt, Homo sapiens
aaagccaccucgccacugu

SEQ ID NO: 1348774 - RNA, 19 nt, Homo sapiens
ggauuacgaggaucucuuc

SEQ ID NO: 1348775 - RNA, 19 nt, Homo sapiens
cuacacacucuccuacaaa

SEQ ID NO: 1348776 - RNA, 19 nt, Homo sapiens
ugaagaagagacugagguu

SEQ ID NO: 1348777 - RNA, 19 nt, Homo sapiens
agaacuugcuggagucaca

SEQ ID NO: 1348778 - RNA, 19 nt, Homo sapiens
agagugacgcugaugguuu

SEQ ID NO: 1348779 - RNA, 19 nt, Homo sapiens
uuucccauaucaucuguuu

SEQ ID NO: 1348780 - RNA, 19 nt, Homo sapiens
ggaaaaggcagccaagauc

SEQ ID NO: 1348781 - RNA, 19 nt, Homo sapiens
gaaaaggcagccaagauca

SEQ ID NO: 1348782 - RNA, 19 nt, Homo sapiens
ugaacagaauaaccaccaa

SEQ ID NO: 1348783 - RNA, 19 nt, Homo sapiens
caacgcaguggccgaggaa

SEQ ID NO: 1348784 - RNA, 19 nt, Homo sapiens
ggcagaaggaucccgcaaa

SEQ ID NO: 1348785 - RNA, 19 nt, Homo sapiens
guuccauggugcaaucuca

SEQ ID NO: 1348786 - RNA, 19 nt, Homo sapiens
gggcaccagcuauacauca

SEQ ID NO: 1348787 - RNA, 19 nt, Homo sapiens
gaagccgucagcagagaug

SEQ ID NO: 1348788 - RNA, 19 nt, Homo sapiens
ccuggguacugcuagagaa

SEQ ID NO: 1348789 - RNA, 19 nt, Homo sapiens
cagaccuucuauucauuau

SEQ ID NO: 1348790 - RNA, 19 nt, Homo sapiens
gggaaauggaauaaagaug

SEQ ID NO: 1348791 - RNA, 19 nt, Homo sapiens
cccgggaaauggaauaaag

SEQ ID NO: 1348792 - RNA, 19 nt, Homo sapiens
ccucgccacugugaacuug

SEQ ID NO: 1348793 - RNA, 19 nt, Homo sapiens
gagagacccgccagaaacu

SEQ ID NO: 1348794 - RNA, 19 nt, Homo sapiens
gcgggagaauugcuugaac

SEQ ID NO: 1348795 - RNA, 19 nt, Homo sapiens
cgcuugaggucaggaguuu

SEQ ID NO: 1348796 - RNA, 19 nt, Homo sapiens
ucaucuguuuguucuguug

SEQ ID NO: 1348797 - RNA, 19 nt, Homo sapiens
ggauaagaggcgugaccaa

SEQ ID NO: 1348798 - RNA, 19 nt, Homo sapiens
aagagaggaugcugagaac

SEQ ID NO: 1348799 - RNA, 19 nt, Homo sapiens
ccaguccugugucaccaau

SEQ ID NO: 1348800 - RNA, 19 nt, Homo sapiens
agaaggaucccgcaaacgu

SEQ ID NO: 1348801 - RNA, 19 nt, Homo sapiens
ccauaucaucuguuuguuc

SEQ ID NO: 1348802 - RNA, 19 nt, Homo sapiens
ucccauaucaucuguuugu

SEQ ID NO: 1348803 - RNA, 19 nt, Homo sapiens
gccuuaacauuucuuccau

SEQ ID NO: 1348804 - RNA, 19 nt, Homo sapiens
gaaagguccccaccaggaa

SEQ ID NO: 1348805 - RNA, 19 nt, Homo sapiens
uggagagacccgccagaaa

SEQ ID NO: 1348806 - RNA, 19 nt, Homo sapiens
gugguuccauggugcaauc

SEQ ID NO: 1348807 - RNA, 19 nt, Homo sapiens
uacacacucuccuacaaag

SEQ ID NO: 1348808 - RNA, 19 nt, Homo sapiens
agggucauccuccauguuu

SEQ ID NO: 1348809 - RNA, 19 nt, Homo sapiens
gugccagaccuucuauuca

SEQ ID NO: 1348810 - RNA, 19 nt, Homo sapiens
gcaggcacuggcacagcua

SEQ ID NO: 1348811 - RNA, 19 nt, Homo sapiens
ggauuugaagccaggugaa

SEQ ID NO: 1348812 - RNA, 19 nt, Homo sapiens
aguccugugucaccaauca

SEQ ID NO: 1348813 - RNA, 19 nt, Homo sapiens
gaaauuaccucucagacuu

SEQ ID NO: 1348814 - RNA, 19 nt, Homo sapiens
gggaggagcugcuguagua

SEQ ID NO: 1348815 - RNA, 19 nt, Homo sapiens
ucacagaggucacaucuuc

SEQ ID NO: 1348816 - RNA, 19 nt, Homo sapiens
gaaccucucuucacucaca

SEQ ID NO: 1348817 - RNA, 19 nt, Homo sapiens
gaaacgcauggcauaauua

SEQ ID NO: 1348818 - RNA, 19 nt, Homo sapiens
gaacacaggugcacuuucc

SEQ ID NO: 1348819 - RNA, 19 nt, Homo sapiens
gagauggugugcugaaguu

SEQ ID NO: 1348820 - RNA, 19 nt, Homo sapiens
gaagaaacgcauggcauaa

SEQ ID NO: 1348821 - RNA, 19 nt, Homo sapiens
ucaguuuccuuaucuguaa

SEQ ID NO: 1348822 - RNA, 19 nt, Homo sapiens
caucugaaauuaccucuca

SEQ ID NO: 1348823 - RNA, 19 nt, Homo sapiens
agaaacgcauggcauaauu

SEQ ID NO: 1348824 - RNA, 19 nt, Homo sapiens
gauggacccugcuccuuug

SEQ ID NO: 1348825 - RNA, 19 nt, Homo sapiens
ggauggacccugcuccuuu

SEQ ID NO: 1348826 - RNA, 19 nt, Homo sapiens
gaucuggagucccggaaga

SEQ ID NO: 1348827 - RNA, 19 nt, Homo sapiens
ugaauggauugaugacaaa

SEQ ID NO: 1348828 - RNA, 19 nt, Homo sapiens
guagugauauugcgaaggu

SEQ ID NO: 1348829 - RNA, 19 nt, Homo sapiens
guacaguccaggucuauga

SEQ ID NO: 1348830 - RNA, 19 nt, Homo sapiens
cauaauuacuugguagcua

SEQ ID NO: 1348831 - RNA, 19 nt, Homo sapiens
agaagaaacgcauggcaua

SEQ ID NO: 1348832 - RNA, 19 nt, Homo sapiens
uagaaccucucuucacuca

SEQ ID NO: 1348833 - RNA, 19 nt, Homo sapiens
gaacacggagccaaguaga

SEQ ID NO: 1348834 - RNA, 19 nt, Homo sapiens
gggcccauagugaauauua

SEQ ID NO: 1348835 - RNA, 19 nt, Homo sapiens
gaucugggagugugaaaug

SEQ ID NO: 1348836 - RNA, 19 nt, Homo sapiens
gggcgucuuugucuucuug

SEQ ID NO: 1348837 - RNA, 19 nt, Homo sapiens
gcaauuaaggaaauagcaa

SEQ ID NO: 1348838 - RNA, 19 nt, Homo sapiens
gaggucacaucuuccuaga

SEQ ID NO: 1348839 - RNA, 19 nt, Homo sapiens
guaccaggauuucuaugca

SEQ ID NO: 1348840 - RNA, 19 nt, Homo sapiens
ccaaguagaaccucucuuc

SEQ ID NO: 1348841 - RNA, 19 nt, Homo sapiens
gcagacaccuuugccuucu

SEQ ID NO: 1348842 - RNA, 19 nt, Homo sapiens
uaucauagggagaaucaaa

SEQ ID NO: 1348843 - RNA, 19 nt, Homo sapiens
cuugguagcuauuguuaga

SEQ ID NO: 1348844 - RNA, 19 nt, Homo sapiens
caacaaaugaugccucucu

SEQ ID NO: 1348845 - RNA, 19 nt, Homo sapiens
ugacuagguucaagagaca

SEQ ID NO: 1348846 - RNA, 19 nt, Homo sapiens
gaccaaggacuuuguuauc

SEQ ID NO: 1348847 - RNA, 19 nt, Homo sapiens
ccacucgaguccuugaaug

SEQ ID NO: 1348848 - RNA, 19 nt, Homo sapiens
gggacuggguggaccuuug

SEQ ID NO: 1348849 - RNA, 19 nt, Homo sapiens
gagggcccauagugaauau

SEQ ID NO: 1348850 - RNA, 19 nt, Homo sapiens
caagagacauuugcuuuug

SEQ ID NO: 1348851 - RNA, 19 nt, Homo sapiens
gggcuuauucccagaaaga

SEQ ID NO: 1348852 - RNA, 19 nt, Homo sapiens
ccacguacaccucagaugu

SEQ ID NO: 1348853 - RNA, 19 nt, Homo sapiens
ggucuaucuuugaucuaaa

SEQ ID NO: 1348854 - RNA, 19 nt, Homo sapiens
ggcccauagugaauauuaa

SEQ ID NO: 1348855 - RNA, 19 nt, Homo sapiens
uugaauggauugaugacaa

SEQ ID NO: 1348856 - RNA, 19 nt, Homo sapiens
gcccauagugaauauuaaa

SEQ ID NO: 1348857 - RNA, 19 nt, Homo sapiens
gcuuggccaucucagguuu

SEQ ID NO: 1348858 - RNA, 19 nt, Homo sapiens
ccauugcugugcaugagaa

SEQ ID NO: 1348859 - RNA, 19 nt, Homo sapiens
uugcgaagguuagaagaaa

SEQ ID NO: 1348860 - RNA, 19 nt, Homo sapiens
uggcaucccugcagaccaa

SEQ ID NO: 1348861 - RNA, 19 nt, Homo sapiens
ggaaauagcaaaacaggau

SEQ ID NO: 1348862 - RNA, 19 nt, Homo sapiens
ccuaguagcaauuaaggaa

SEQ ID NO: 1348863 - RNA, 19 nt, Homo sapiens
gucccugucuucacacuau

SEQ ID NO: 1348864 - RNA, 19 nt, Homo sapiens
ccaaggacuuuguuaucag

SEQ ID NO: 1348865 - RNA, 19 nt, Homo sapiens
ggaacacggagccaagaug

SEQ ID NO: 1348866 - RNA, 19 nt, Homo sapiens
ccagagcugcugcgaguga

SEQ ID NO: 1348867 - RNA, 19 nt, Homo sapiens
guccuugaauggauugaug

SEQ ID NO: 1348868 - RNA, 19 nt, Homo sapiens
ggauuucugcuccucuuga

SEQ ID NO: 1348869 - RNA, 19 nt, Homo sapiens
gaucucugccauccuguga

SEQ ID NO: 1348870 - RNA, 19 nt, Homo sapiens
aaagugugcuggacauggu

SEQ ID NO: 1348871 - RNA, 19 nt, Homo sapiens
gcuuguaccaggauuucua

SEQ ID NO: 1348872 - RNA, 19 nt, Homo sapiens
ucacuuagccucaguuucc

SEQ ID NO: 1348873 - RNA, 19 nt, Homo sapiens
ggacuggguggaccuuugu

SEQ ID NO: 1348874 - RNA, 19 nt, Homo sapiens
acagugaugucauuaaagc

SEQ ID NO: 1348875 - RNA, 19 nt, Homo sapiens
gcagaccaaggacuuuguu

SEQ ID NO: 1348876 - RNA, 19 nt, Homo sapiens
ggaacacggagccaaguag

SEQ ID NO: 1348877 - RNA, 19 nt, Homo sapiens
ugcuugagcugaggaguuu

SEQ ID NO: 1348878 - RNA, 19 nt, Homo sapiens
accagcaucuuuccaucua

SEQ ID NO: 1348879 - RNA, 19 nt, Homo sapiens
caaguagaaccucucuuca

SEQ ID NO: 1348880 - RNA, 19 nt, Homo sapiens
ccuguaaucccagcacuuu

SEQ ID NO: 1348881 - RNA, 19 nt, Homo sapiens
ggaaaacaagggcuuauuc

SEQ ID NO: 1348882 - RNA, 19 nt, Homo sapiens
accaaggacuuuguuauca

SEQ ID NO: 1348883 - RNA, 19 nt, Homo sapiens
ucaguccagugcccaguau

SEQ ID NO: 1348884 - RNA, 19 nt, Homo sapiens
gaugggcgucuuugucuuc

SEQ ID NO: 1348885 - RNA, 19 nt, Homo sapiens
aaagagauggugugcugaa

SEQ ID NO: 1348886 - RNA, 19 nt, Homo sapiens
guacaccucagaugucagu

SEQ ID NO: 1348887 - RNA, 19 nt, Homo sapiens
gggaacacaggugcacuuu

SEQ ID NO: 1348888 - RNA, 19 nt, Homo sapiens
cugggagugugaaauggua

SEQ ID NO: 1348889 - RNA, 19 nt, Homo sapiens
acgcauggcauaauuacuu

SEQ ID NO: 1348890 - RNA, 19 nt, Homo sapiens
aguagaaccucucuucacu

SEQ ID NO: 1348891 - RNA, 19 nt, Homo sapiens
gggcaccguuggagaaucg

SEQ ID NO: 1348892 - RNA, 19 nt, Homo sapiens
acaggucuaucuuugaucu

SEQ ID NO: 1348893 - RNA, 19 nt, Homo sapiens
cgcauggcauaauuacuug

SEQ ID NO: 1348894 - RNA, 19 nt, Homo sapiens
acacggagccaagauggaa

SEQ ID NO: 1348895 - RNA, 19 nt, Homo sapiens
guggaauccuugcgcuugu

SEQ ID NO: 1348896 - RNA, 19 nt, Homo sapiens
ugagggcccauagugaaua

SEQ ID NO: 1348897 - RNA, 19 nt, Homo sapiens
aaauuaccucucagacuuu

SEQ ID NO: 1348898 - RNA, 19 nt, Homo sapiens
aggucuaucuuugaucuaa

SEQ ID NO: 1348899 - RNA, 19 nt, Homo sapiens
uggaauccuugcgcuugua

SEQ ID NO: 1348900 - RNA, 19 nt, Homo sapiens
agaccaaggacuuuguuau

SEQ ID NO: 1348901 - RNA, 19 nt, Homo sapiens
cagaccaaggacuuuguua

SEQ ID NO: 1348902 - RNA, 19 nt, Homo sapiens
aagaauugcuuggccaucu

SEQ ID NO: 1348903 - RNA, 19 nt, Homo sapiens
ucgaguccuugaauggauu

SEQ ID NO: 1348904 - RNA, 19 nt, Homo sapiens
ccuagaugcagacaccuuu

SEQ ID NO: 1348905 - RNA, 19 nt, Homo sapiens
uucaagagacauuugcuuu

SEQ ID NO: 1348906 - RNA, 19 nt, Homo sapiens
gcacuuucccacacuuguc

SEQ ID NO: 1348907 - RNA, 19 nt, Homo sapiens
ggaacacaggugcacuuuc

SEQ ID NO: 1348908 - RNA, 19 nt, Homo sapiens
gauuucugcuccucuugag

SEQ ID NO: 1348909 - RNA, 19 nt, Homo sapiens
aaaugaggauaguaagaac

SEQ ID NO: 1348910 - RNA, 19 nt, Homo sapiens
uagccucaguuuccuuauc

SEQ ID NO: 1348911 - RNA, 19 nt, Homo sapiens
gaauugcuuggccaucuca

SEQ ID NO: 1348912 - RNA, 19 nt, Homo sapiens
ccccaggccugaagaauug

SEQ ID NO: 1348913 - RNA, 19 nt, Homo sapiens
gaaauuggcuguguuaagu

SEQ ID NO: 1348914 - RNA, 19 nt, Homo sapiens
aaacagaucacaucaauga

SEQ ID NO: 1348915 - RNA, 19 nt, Homo sapiens
acacuucacucucaccuua

SEQ ID NO: 1348916 - RNA, 19 nt, Homo sapiens
gcaaaggcaucagaaauca

SEQ ID NO: 1348917 - RNA, 19 nt, Homo sapiens
gauauucucuucugugcuu

SEQ ID NO: 1348918 - RNA, 19 nt, Homo sapiens
ggagaaauacgcagaaaug

SEQ ID NO: 1348919 - RNA, 19 nt, Homo sapiens
ggaauuacccgcuuacuag

SEQ ID NO: 1348920 - RNA, 19 nt, Homo sapiens
gaauaucuguuaugaaagg

SEQ ID NO: 1348921 - RNA, 19 nt, Homo sapiens
agaaauggcucgagaaugg

SEQ ID NO: 1348922 - RNA, 19 nt, Homo sapiens
ccagcaauauccacaaauu

SEQ ID NO: 1348923 - RNA, 19 nt, Homo sapiens
gagagcaucuuggcauuug

SEQ ID NO: 1348924 - RNA, 19 nt, Homo sapiens
ccacgaggauuucgauuuc

SEQ ID NO: 1348925 - RNA, 19 nt, Homo sapiens
uaugucagcuuugucuuua

SEQ ID NO: 1348926 - RNA, 19 nt, Homo sapiens
guucaggauucucucauuu

SEQ ID NO: 1348927 - RNA, 19 nt, Homo sapiens
cuagagagcauuuccaauu

SEQ ID NO: 1348928 - RNA, 19 nt, Homo sapiens
guaauucucuggccacucu

SEQ ID NO: 1348929 - RNA, 19 nt, Homo sapiens
ggauacaaaucuuucucuu

SEQ ID NO: 1348930 - RNA, 19 nt, Homo sapiens
ccaagcaacuguguuacaa

SEQ ID NO: 1348931 - RNA, 19 nt, Homo sapiens
uggcagauuuccacaguuu

SEQ ID NO: 1348932 - RNA, 19 nt, Homo sapiens
ucacaagauuccuauuuca

SEQ ID NO: 1348933 - RNA, 19 nt, Homo sapiens
caucagaaaucaggcaaga

SEQ ID NO: 1348934 - RNA, 19 nt, Homo sapiens
gaugauagaaccagaguca

SEQ ID NO: 1348935 - RNA, 19 nt, Homo sapiens
ggauuucgauuucauuguc

SEQ ID NO: 1348936 - RNA, 19 nt, Homo sapiens
ggaacuggccaccuaucua

SEQ ID NO: 1348937 - RNA, 19 nt, Homo sapiens
cgagcuaccuccucauugu

SEQ ID NO: 1348938 - RNA, 19 nt, Homo sapiens
ggaauguuauagauugauc

SEQ ID NO: 1348939 - RNA, 19 nt, Homo sapiens
uagagagcauuuccaauuc

SEQ ID NO: 1348940 - RNA, 19 nt, Homo sapiens
ccagauaugucagcuuugu

SEQ ID NO: 1348941 - RNA, 19 nt, Homo sapiens
aggcccaacuuccuucuua

SEQ ID NO: 1348942 - RNA, 19 nt, Homo sapiens
gagagcauuuccaauucuu

SEQ ID NO: 1348943 - RNA, 19 nt, Homo sapiens
caacucuucuaaugaggaa

SEQ ID NO: 1348944 - RNA, 19 nt, Homo sapiens
gcucacagaggcucaugua

SEQ ID NO: 1348945 - RNA, 19 nt, Homo sapiens
guaccaaagcagaauguuu

SEQ ID NO: 1348946 - RNA, 19 nt, Homo sapiens
gcagaaauggcucgagaau

SEQ ID NO: 1348947 - RNA, 19 nt, Homo sapiens
caggcaagaucuacaacuu

SEQ ID NO: 1348948 - RNA, 19 nt, Homo sapiens
cugcaagucugaugauaga

SEQ ID NO: 1348949 - RNA, 19 nt, Homo sapiens
gaacuggccaccuaucuac

SEQ ID NO: 1348950 - RNA, 19 nt, Homo sapiens
ccggaaugcuuacuauuuc

SEQ ID NO: 1348951 - RNA, 19 nt, Homo sapiens
gccggaaugcuuacuauuu

SEQ ID NO: 1348952 - RNA, 19 nt, Homo sapiens
ucuaagacuuggauucgaa

SEQ ID NO: 1348953 - RNA, 19 nt, Homo sapiens
ccaccuaucuacugcaagu

SEQ ID NO: 1348954 - RNA, 19 nt, Homo sapiens
cagaucacaucaaugacaa

SEQ ID NO: 1348955 - RNA, 19 nt, Homo sapiens
caacuuccuucuuacuaca

SEQ ID NO: 1348956 - RNA, 19 nt, Homo sapiens
ccacaaauucuccaacugu

SEQ ID NO: 1348957 - RNA, 19 nt, Homo sapiens
ggcaagaucuacaacuucu

SEQ ID NO: 1348958 - RNA, 19 nt, Homo sapiens
gucacaagauuccuauuuc

SEQ ID NO: 1348959 - RNA, 19 nt, Homo sapiens
aagaggaauuacccgcuua

SEQ ID NO: 1348960 - RNA, 19 nt, Homo sapiens
ugucagcuuugucuuuaaa

SEQ ID NO: 1348961 - RNA, 19 nt, Homo sapiens
cuccagauaugucagcuuu

SEQ ID NO: 1348962 - RNA, 19 nt, Homo sapiens
acaaaucuuucucuuccuu

SEQ ID NO: 1348963 - RNA, 19 nt, Homo sapiens
ucaggauucucucauuuca

SEQ ID NO: 1348964 - RNA, 19 nt, Homo sapiens
gauuaugaggccagcaaua

SEQ ID NO: 1348965 - RNA, 19 nt, Homo sapiens
gcaaguggcaugaagaaaa

SEQ ID NO: 1348966 - RNA, 19 nt, Homo sapiens
cuuccucccuugugaaauu

SEQ ID NO: 1348967 - RNA, 19 nt, Homo sapiens
ggaguccuauaugaacaaa

SEQ ID NO: 1348968 - RNA, 19 nt, Homo sapiens
ggagagcaucuuggcauuu

SEQ ID NO: 1348969 - RNA, 19 nt, Homo sapiens
gauacaaaucuuucucuuc

SEQ ID NO: 1348970 - RNA, 19 nt, Homo sapiens
gaauuacccgcuuacuaga

SEQ ID NO: 1348971 - RNA, 19 nt, Homo sapiens
ggcaaaggcaucagaaauc

SEQ ID NO: 1348972 - RNA, 19 nt, Homo sapiens
gaagguauuauggcagauu

SEQ ID NO: 1348973 - RNA, 19 nt, Homo sapiens
caaaucuuucucuuccuua

SEQ ID NO: 1348974 - RNA, 19 nt, Homo sapiens
ggaacaaagaucaaacaca

SEQ ID NO: 1348975 - RNA, 19 nt, Homo sapiens
caaaaugguuguauuggau

SEQ ID NO: 1348976 - RNA, 19 nt, Homo sapiens
uaacaggcccaacuuccuu

SEQ ID NO: 1348977 - RNA, 19 nt, Homo sapiens
gaucaaacacacccauugg

SEQ ID NO: 1348978 - RNA, 19 nt, Homo sapiens
ggauuauucuagcaacaca

SEQ ID NO: 1348979 - RNA, 19 nt, Homo sapiens
ucaaggagcccucuaagac

SEQ ID NO: 1348980 - RNA, 19 nt, Homo sapiens
caagaucuacaacuucuca

SEQ ID NO: 1348981 - RNA, 19 nt, Homo sapiens
gcagauuuccacaguuuua

SEQ ID NO: 1348982 - RNA, 19 nt, Homo sapiens
cagccggaaugcuuacuau

SEQ ID NO: 1348983 - RNA, 19 nt, Homo sapiens
uugggaauguuauagauug

SEQ ID NO: 1348984 - RNA, 19 nt, Homo sapiens
ccaacuuccuucuuacuac

SEQ ID NO: 1348985 - RNA, 19 nt, Homo sapiens
cacagaggcucauguacca

SEQ ID NO: 1348986 - RNA, 19 nt, Homo sapiens
gaaaucaggcaagaucuac

SEQ ID NO: 1348987 - RNA, 19 nt, Homo sapiens
ucagaaaucaggcaagauc

SEQ ID NO: 1348988 - RNA, 19 nt, Homo sapiens
uaccaaagcagaauguuuc

SEQ ID NO: 1348989 - RNA, 19 nt, Homo sapiens
gaggaacaaagaucaaaca

SEQ ID NO: 1348990 - RNA, 19 nt, Homo sapiens
aaggagcccucuaagacuu

SEQ ID NO: 1348991 - RNA, 19 nt, Homo sapiens
caggcaugcuuguaccaaa

SEQ ID NO: 1348992 - RNA, 19 nt, Homo sapiens
gcuaaggguugggaguuca

SEQ ID NO: 1348993 - RNA, 19 nt, Homo sapiens
caacugguguuugaagcau

SEQ ID NO: 1348994 - RNA, 19 nt, Homo sapiens
gaggauuucgauuucauug

SEQ ID NO: 1348995 - RNA, 19 nt, Homo sapiens
aagguauuauggcagauuu

SEQ ID NO: 1348996 - RNA, 19 nt, Homo sapiens
ugugaaauuggcuguguua

SEQ ID NO: 1348997 - RNA, 19 nt, Homo sapiens
ggaaugcuuacuauuucuu

SEQ ID NO: 1348998 - RNA, 19 nt, Homo sapiens
caucuuggcauuugugcuu

SEQ ID NO: 1348999 - RNA, 19 nt, Homo sapiens
caaguggcaugaagaaaau

SEQ ID NO: 1349000 - RNA, 19 nt, Homo sapiens
gaucacaucaaugacaaau

SEQ ID NO: 1349001 - RNA, 19 nt, Homo sapiens
gauguggccaugugggauu

SEQ ID NO: 1349002 - RNA, 19 nt, Homo sapiens
agaaaucaggcaagaucua

SEQ ID NO: 1349003 - RNA, 19 nt, Homo sapiens
caagcaacuguguuacaaa

SEQ ID NO: 1349004 - RNA, 19 nt, Homo sapiens
agucacaagauuccuauuu

SEQ ID NO: 1349005 - RNA, 19 nt, Homo sapiens
uauggcagauuuccacagu

SEQ ID NO: 1349006 - RNA, 19 nt, Homo sapiens
aaggagaaauacgcagaaa

SEQ ID NO: 1349007 - RNA, 19 nt, Homo sapiens
gguugggaguucaggauuc

SEQ ID NO: 1349008 - RNA, 19 nt, Homo sapiens
ggccaccuaucuacugcaa

SEQ ID NO: 1349009 - RNA, 19 nt, Homo sapiens
gauuucgauuucauuguca

SEQ ID NO: 1349010 - RNA, 19 nt, Homo sapiens
uggagagcaucuuggcauu

SEQ ID NO: 1349011 - RNA, 19 nt, Homo sapiens
ggugcuuuguucugucuga

SEQ ID NO: 1349012 - RNA, 19 nt, Homo sapiens
uccaauucuuccagcaaua

SEQ ID NO: 1349013 - RNA, 19 nt, Homo sapiens
gaaguaggauuuagaugua

SEQ ID NO: 1349014 - RNA, 19 nt, Homo sapiens
ggacuucacugcuccuuua

SEQ ID NO: 1349015 - RNA, 19 nt, Homo sapiens
ggagauagggcuagaaaua

SEQ ID NO: 1349016 - RNA, 19 nt, Homo sapiens
ggcaagauaucauuuauug

SEQ ID NO: 1349017 - RNA, 19 nt, Homo sapiens
ggaauacgucugaaucuua

SEQ ID NO: 1349018 - RNA, 19 nt, Homo sapiens
ggaaagagauauguaaaca

SEQ ID NO: 1349019 - RNA, 19 nt, Homo sapiens
guaaauagcacuggucaua

SEQ ID NO: 1349020 - RNA, 19 nt, Homo sapiens
aaauagcacuggucauaua

SEQ ID NO: 1349021 - RNA, 19 nt, Homo sapiens
caagaaaccuuuggguauu

SEQ ID NO: 1349022 - RNA, 19 nt, Homo sapiens
ccaaaugcauuacuuaugu

SEQ ID NO: 1349023 - RNA, 19 nt, Homo sapiens
gaauacgucugaaucuuau

SEQ ID NO: 1349024 - RNA, 19 nt, Homo sapiens
ggucacagguugccaaaug

SEQ ID NO: 1349025 - RNA, 19 nt, Homo sapiens
gcagaaugauaaagaaugu

SEQ ID NO: 1349026 - RNA, 19 nt, Homo sapiens
ucaauuaauuccaccagua

SEQ ID NO: 1349027 - RNA, 19 nt, Homo sapiens
ugaagaaggacucuacuua

SEQ ID NO: 1349028 - RNA, 19 nt, Homo sapiens
gcaaguaugauuucuaaga

SEQ ID NO: 1349029 - RNA, 19 nt, Homo sapiens
guaccugucugaagaguga

SEQ ID NO: 1349030 - RNA, 19 nt, Homo sapiens
uuacacagaugaauagcua

SEQ ID NO: 1349031 - RNA, 19 nt, Homo sapiens
gagaaguaaugggucaaua

SEQ ID NO: 1349032 - RNA, 19 nt, Homo sapiens
gcagucauagugaagauua

SEQ ID NO: 1349033 - RNA, 19 nt, Homo sapiens
aaagugguguaaucuguua

SEQ ID NO: 1349034 - RNA, 19 nt, Homo sapiens
gggauucuuucauacauuu

SEQ ID NO: 1349035 - RNA, 19 nt, Homo sapiens
ggaaguaggauuuagaugu

SEQ ID NO: 1349036 - RNA, 19 nt, Homo sapiens
gaaauagaacuccuacaau

SEQ ID NO: 1349037 - RNA, 19 nt, Homo sapiens
ugaaaugcaugaugguauu

SEQ ID NO: 1349038 - RNA, 19 nt, Homo sapiens
gaaacaacuuuaugaacuc

SEQ ID NO: 1349039 - RNA, 19 nt, Homo sapiens
guaauugagcuuuguguaa

SEQ ID NO: 1349040 - RNA, 19 nt, Homo sapiens
aaauagaacuccuacaauc

SEQ ID NO: 1349041 - RNA, 19 nt, Homo sapiens
gcagguugccauugaauuu

SEQ ID NO: 1349042 - RNA, 19 nt, Homo sapiens
ggacaaucaugguaagcaa

SEQ ID NO: 1349043 - RNA, 19 nt, Homo sapiens
ggagacaauucacccuauu

SEQ ID NO: 1349044 - RNA, 19 nt, Homo sapiens
ucaaagaagucguaaagag

SEQ ID NO: 1349045 - RNA, 19 nt, Homo sapiens
cauaggauuucagccauua

SEQ ID NO: 1349046 - RNA, 19 nt, Homo sapiens
gagcaguggcuauucauuu

SEQ ID NO: 1349047 - RNA, 19 nt, Homo sapiens
gaagaaggacucuacuuag

SEQ ID NO: 1349048 - RNA, 19 nt, Homo sapiens
gcaguuaaauggcuauagg

SEQ ID NO: 1349049 - RNA, 19 nt, Homo sapiens
caacaacaacaacaacaaa

SEQ ID NO: 1349050 - RNA, 19 nt, Homo sapiens
gguaaugcauaucauggaa

SEQ ID NO: 1349051 - RNA, 19 nt, Homo sapiens
gaaguaaugggucaauaau

SEQ ID NO: 1349052 - RNA, 19 nt, Homo sapiens
caacuagaacagagaagua

SEQ ID NO: 1349053 - RNA, 19 nt, Homo sapiens
ugaaauagaacuccuacaa

SEQ ID NO: 1349054 - RNA, 19 nt, Homo sapiens
gauuagcacuacuuagaau

SEQ ID NO: 1349055 - RNA, 19 nt, Homo sapiens
gcuuugaugugcauauuug

SEQ ID NO: 1349056 - RNA, 19 nt, Homo sapiens
ggguauuguuucuuaagua

SEQ ID NO: 1349057 - RNA, 19 nt, Homo sapiens
uaucauggaaggcauauuu

SEQ ID NO: 1349058 - RNA, 19 nt, Homo sapiens
ucacugcuccuuuacgaua

SEQ ID NO: 1349059 - RNA, 19 nt, Homo sapiens
gaagagugacauuaaacuu

SEQ ID NO: 1349060 - RNA, 19 nt, Homo sapiens
agagugacauuaaacuuug

SEQ ID NO: 1349061 - RNA, 19 nt, Homo sapiens
cuaaagugguguaaucugu

SEQ ID NO: 1349062 - RNA, 19 nt, Homo sapiens
ucagugugauuauguauuc

SEQ ID NO: 1349063 - RNA, 19 nt, Homo sapiens
gcaagaagugaaauugaga

SEQ ID NO: 1349064 - RNA, 19 nt, Homo sapiens
caauuaauuccaccaguaa

SEQ ID NO: 1349065 - RNA, 19 nt, Homo sapiens
gacuagaccugaccuugau

SEQ ID NO: 1349066 - RNA, 19 nt, Homo sapiens
cuacuuagauucugaagcu

SEQ ID NO: 1349067 - RNA, 19 nt, Homo sapiens
uaauagcagucauagugaa

SEQ ID NO: 1349068 - RNA, 19 nt, Homo sapiens
gaaggaauucuggagcuuu

SEQ ID NO: 1349069 - RNA, 19 nt, Homo sapiens
caaaggcaagauaucauuu

SEQ ID NO: 1349070 - RNA, 19 nt, Homo sapiens
acaagaaaccuuuggguau

SEQ ID NO: 1349071 - RNA, 19 nt, Homo sapiens
aaagagccauucuccugaa

SEQ ID NO: 1349072 - RNA, 19 nt, Homo sapiens
cuugaaacuugcaggauuu

SEQ ID NO: 1349073 - RNA, 19 nt, Homo sapiens
caaaaccuauuaccacauu

SEQ ID NO: 1349074 - RNA, 19 nt, Homo sapiens
ggcaagaagugaaauugag

SEQ ID NO: 1349075 - RNA, 19 nt, Homo sapiens
caucaaagaagucguaaag

SEQ ID NO: 1349076 - RNA, 19 nt, Homo sapiens
agaagcaagugaagaagga

SEQ ID NO: 1349077 - RNA, 19 nt, Homo sapiens
agaaguaaugggucaauaa

SEQ ID NO: 1349078 - RNA, 19 nt, Homo sapiens
ggauuguacauacuacuuu

SEQ ID NO: 1349079 - RNA, 19 nt, Homo sapiens
guucaaaaguuucuuguug

SEQ ID NO: 1349080 - RNA, 19 nt, Homo sapiens
ucugaagagugacauuaaa

SEQ ID NO: 1349081 - RNA, 19 nt, Homo sapiens
agaaguguguuaugucugu

SEQ ID NO: 1349082 - RNA, 19 nt, Homo sapiens
aguaaugggucaauaaucu

SEQ ID NO: 1349083 - RNA, 19 nt, Homo sapiens
gaaguguguuaugucugua

SEQ ID NO: 1349084 - RNA, 19 nt, Homo sapiens
ccuugaaacuugcaggauu

SEQ ID NO: 1349085 - RNA, 19 nt, Homo sapiens
ucaaaggcaagauaucauu

SEQ ID NO: 1349086 - RNA, 19 nt, Homo sapiens
aagauuagcacuacuuaga

SEQ ID NO: 1349087 - RNA, 19 nt, Homo sapiens
acauauggccagcacuuua

SEQ ID NO: 1349088 - RNA, 19 nt, Homo sapiens
ugaagauuagcacuacuua

SEQ ID NO: 1349089 - RNA, 19 nt, Homo sapiens
gcauuacuuauguugguua

SEQ ID NO: 1349090 - RNA, 19 nt, Homo sapiens
acaaguugguaaugcauau

SEQ ID NO: 1349091 - RNA, 19 nt, Homo sapiens
uagaacuccuacaaucaaa

SEQ ID NO: 1349092 - RNA, 19 nt, Homo sapiens
gcaaagagaauuuuagcuu

SEQ ID NO: 1349093 - RNA, 19 nt, Homo sapiens
cuuuggguauuguuucuua

SEQ ID NO: 1349094 - RNA, 19 nt, Homo sapiens
ugacuagaccugaccuuga

SEQ ID NO: 1349095 - RNA, 19 nt, Homo sapiens
cugaagcuguguuagacua

SEQ ID NO: 1349096 - RNA, 19 nt, Homo sapiens
caguugcugugaaauagaa

SEQ ID NO: 1349097 - RNA, 19 nt, Homo sapiens
uuucaucucuggacucuca

SEQ ID NO: 1349098 - RNA, 19 nt, Homo sapiens
uguagaaugccuucacuuu

SEQ ID NO: 1349099 - RNA, 19 nt, Homo sapiens
gauggaauacgucugaauc

SEQ ID NO: 1349100 - RNA, 19 nt, Homo sapiens
ucauaauugugccaaguug

SEQ ID NO: 1349101 - RNA, 19 nt, Homo sapiens
cagcuuugaugugcauauu

SEQ ID NO: 1349102 - RNA, 19 nt, Homo sapiens
gcacuggucauauacugau

SEQ ID NO: 1349103 - RNA, 19 nt, Homo sapiens
gagugacauuaaacuuuga

SEQ ID NO: 1349104 - RNA, 19 nt, Homo sapiens
uggacucucagaucaauua

SEQ ID NO: 1349105 - RNA, 19 nt, Homo sapiens
gcauaucauggaaggcaua

SEQ ID NO: 1349106 - RNA, 19 nt, Homo sapiens
acagaugaauagcuagaug

SEQ ID NO: 1349107 - RNA, 19 nt, Homo sapiens
guucaucaaagaagucgua

SEQ ID NO: 1349108 - RNA, 19 nt, Homo sapiens
uagacuacgugaugacuag

SEQ ID NO: 1349109 - RNA, 19 nt, Homo sapiens
cagguugccaaaugcauua

SEQ ID NO: 1349110 - RNA, 19 nt, Homo sapiens
uuaccacauuuagcaguua

SEQ ID NO: 1349111 - RNA, 19 nt, Homo sapiens
guaggagugugggaaugaa

SEQ ID NO: 1349112 - RNA, 19 nt, Homo sapiens
ugaaggagaagcaagugaa

SEQ ID NO: 1349113 - RNA, 19 nt, Homo sapiens
ggaagauguuggauuguua

SEQ ID NO: 1349114 - RNA, 19 nt, Homo sapiens
gaauacagaugauuaaugg

SEQ ID NO: 1349115 - RNA, 19 nt, Homo sapiens
gcagugaucuuccuaaagu

SEQ ID NO: 1349116 - RNA, 19 nt, Homo sapiens
gggaagauguggaugauga

SEQ ID NO: 1349117 - RNA, 19 nt, Homo sapiens
gaggaugacuuuauucuuc

SEQ ID NO: 1349118 - RNA, 19 nt, Homo sapiens
uaaagcagcuccaguuuca

SEQ ID NO: 1349119 - RNA, 19 nt, Homo sapiens
gcaauaugaugaugaugaa

SEQ ID NO: 1349120 - RNA, 19 nt, Homo sapiens
ccaaccaucuuguaaauau

SEQ ID NO: 1349121 - RNA, 19 nt, Homo sapiens
gaucaagaccugccaauga

SEQ ID NO: 1349122 - RNA, 19 nt, Homo sapiens
gaaauuggagcucuggaua

SEQ ID NO: 1349123 - RNA, 19 nt, Homo sapiens
gggaauggauauacagaaa

SEQ ID NO: 1349124 - RNA, 19 nt, Homo sapiens
gaagggagauagcaaugau

SEQ ID NO: 1349125 - RNA, 19 nt, Homo sapiens
caagaaagcaagcuauaaa

SEQ ID NO: 1349126 - RNA, 19 nt, Homo sapiens
ucacagagcuauagcagau

SEQ ID NO: 1349127 - RNA, 19 nt, Homo sapiens
ugaggaagauguuggauug

SEQ ID NO: 1349128 - RNA, 19 nt, Homo sapiens
gaauuaaguugccuucauc

SEQ ID NO: 1349129 - RNA, 19 nt, Homo sapiens
gaauggauauacagaaauc

SEQ ID NO: 1349130 - RNA, 19 nt, Homo sapiens
ggaauuaaguugccuucau

SEQ ID NO: 1349131 - RNA, 19 nt, Homo sapiens
gaaagaagaaacgcuagua

SEQ ID NO: 1349132 - RNA, 19 nt, Homo sapiens
gaagaaacgcuaguaauuc

SEQ ID NO: 1349133 - RNA, 19 nt, Homo sapiens
gaagaaaugauuacuguag

SEQ ID NO: 1349134 - RNA, 19 nt, Homo sapiens
agaaaggacucacagcaaa

SEQ ID NO: 1349135 - RNA, 19 nt, Homo sapiens
gagcagaacagaggaagua

SEQ ID NO: 1349136 - RNA, 19 nt, Homo sapiens
gcaagaaagcaagcuauaa

SEQ ID NO: 1349137 - RNA, 19 nt, Homo sapiens
ggaagguucuauucaagug

SEQ ID NO: 1349138 - RNA, 19 nt, Homo sapiens
ggagagaggagaaagaaga

SEQ ID NO: 1349139 - RNA, 19 nt, Homo sapiens
gagcuuauucccucaagua

SEQ ID NO: 1349140 - RNA, 19 nt, Homo sapiens
acuagaaacuucagaaaga

SEQ ID NO: 1349141 - RNA, 19 nt, Homo sapiens
gaauaccucucaaugucuu

SEQ ID NO: 1349142 - RNA, 19 nt, Homo sapiens
gaggaaguauggaguguuc

SEQ ID NO: 1349143 - RNA, 19 nt, Homo sapiens
ggacagcaaucgcuuacag

SEQ ID NO: 1349144 - RNA, 19 nt, Homo sapiens
gaugagagguuugagaagu

SEQ ID NO: 1349145 - RNA, 19 nt, Homo sapiens
gaagauguuggauuguuaa

SEQ ID NO: 1349146 - RNA, 19 nt, Homo sapiens
gaacgaagaguggagaaga

SEQ ID NO: 1349147 - RNA, 19 nt, Homo sapiens
agaagaaacgcuaguaauu

SEQ ID NO: 1349148 - RNA, 19 nt, Homo sapiens
gagaagaaagcuaacaaau

SEQ ID NO: 1349149 - RNA, 19 nt, Homo sapiens
ccaacgagauccuuuagca

SEQ ID NO: 1349150 - RNA, 19 nt, Homo sapiens
caucuuugguuauugacua

SEQ ID NO: 1349151 - RNA, 19 nt, Homo sapiens
ggagaagaaagcuaacaaa

SEQ ID NO: 1349152 - RNA, 19 nt, Homo sapiens
gaacagcugacccuacaug

SEQ ID NO: 1349153 - RNA, 19 nt, Homo sapiens
caacucagccacguucuaa

SEQ ID NO: 1349154 - RNA, 19 nt, Homo sapiens
caaccaaagcccaaacaaa

SEQ ID NO: 1349155 - RNA, 19 nt, Homo sapiens
auccacagcuuaucaagua

SEQ ID NO: 1349156 - RNA, 19 nt, Homo sapiens
gcuugaggaugacuuuauu

SEQ ID NO: 1349157 - RNA, 19 nt, Homo sapiens
gaggaggaagaaaugauua

SEQ ID NO: 1349158 - RNA, 19 nt, Homo sapiens
uauagcagaucacuuguuc

SEQ ID NO: 1349159 - RNA, 19 nt, Homo sapiens
gaagaauguugagggucua

SEQ ID NO: 1349160 - RNA, 19 nt, Homo sapiens
guuauugacuagaaacuuc

SEQ ID NO: 1349161 - RNA, 19 nt, Homo sapiens
cugcugaacuugaagaaga

SEQ ID NO: 1349162 - RNA, 19 nt, Homo sapiens
ccaaacaaauucgaauauc

SEQ ID NO: 1349163 - RNA, 19 nt, Homo sapiens
ccucaucuuugguuauuga

SEQ ID NO: 1349164 - RNA, 19 nt, Homo sapiens
gagccaacgagauccuuua

SEQ ID NO: 1349165 - RNA, 19 nt, Homo sapiens
caaagcaaacugaaagaau

SEQ ID NO: 1349166 - RNA, 19 nt, Homo sapiens
gcaaagcaaacugaaagaa

SEQ ID NO: 1349167 - RNA, 19 nt, Homo sapiens
gaaggcagagaauugugua

SEQ ID NO: 1349168 - RNA, 19 nt, Homo sapiens
gcaggccuauugucagaug

SEQ ID NO: 1349169 - RNA, 19 nt, Homo sapiens
uugcagcucuugaugauga

SEQ ID NO: 1349170 - RNA, 19 nt, Homo sapiens
gggcaaggcacuuuauuag

SEQ ID NO: 1349171 - RNA, 19 nt, Homo sapiens
aggaagaaaugauuacugu

SEQ ID NO: 1349172 - RNA, 19 nt, Homo sapiens
aaauaaagcagcuccaguu

SEQ ID NO: 1349173 - RNA, 19 nt, Homo sapiens
ccaaagagaagugggauug

SEQ ID NO: 1349174 - RNA, 19 nt, Homo sapiens
ggaagaaaugauuacugua

SEQ ID NO: 1349175 - RNA, 19 nt, Homo sapiens
ggauaaugcagaauuggaa

SEQ ID NO: 1349176 - RNA, 19 nt, Homo sapiens
guucuuugaugacgacuau

SEQ ID NO: 1349177 - RNA, 19 nt, Homo sapiens
ggaagagggaauggauaua

SEQ ID NO: 1349178 - RNA, 19 nt, Homo sapiens
uacauuugcucugaaguaa

SEQ ID NO: 1349179 - RNA, 19 nt, Homo sapiens
gaaagcaagcuauaaaaga

SEQ ID NO: 1349180 - RNA, 19 nt, Homo sapiens
gcccaaacaaauucgaaua

SEQ ID NO: 1349181 - RNA, 19 nt, Homo sapiens
ccaaagcccaaacaaauuc

SEQ ID NO: 1349182 - RNA, 19 nt, Homo sapiens
uaucaaguaucaaccaaag

SEQ ID NO: 1349183 - RNA, 19 nt, Homo sapiens
gaaacaaagagucgcuuca

SEQ ID NO: 1349184 - RNA, 19 nt, Homo sapiens
caucaguguuugcuucaga

SEQ ID NO: 1349185 - RNA, 19 nt, Homo sapiens
aaagaagaaacgcuaguaa

SEQ ID NO: 1349186 - RNA, 19 nt, Homo sapiens
gaagaaaggcgagcagaac

SEQ ID NO: 1349187 - RNA, 19 nt, Homo sapiens
gaguggagaagaaagcuaa

SEQ ID NO: 1349188 - RNA, 19 nt, Homo sapiens
gaagagcgcaaggaacgaa

SEQ ID NO: 1349189 - RNA, 19 nt, Homo sapiens
gaaguauggaguguucuuu

SEQ ID NO: 1349190 - RNA, 19 nt, Homo sapiens
gaaaggcgagcagaacaga

SEQ ID NO: 1349191 - RNA, 19 nt, Homo sapiens
ggacucacagcaaagcaaa

SEQ ID NO: 1349192 - RNA, 19 nt, Homo sapiens
ugagagguuugagaaguuu

SEQ ID NO: 1349193 - RNA, 19 nt, Homo sapiens
cagcugacccuacaugaug

SEQ ID NO: 1349194 - RNA, 19 nt, Homo sapiens
gaagagggaauggauauac

SEQ ID NO: 1349195 - RNA, 19 nt, Homo sapiens
gaggaagagggaauggaua

SEQ ID NO: 1349196 - RNA, 19 nt, Homo sapiens
aaccaaagcccaaacaaau

SEQ ID NO: 1349197 - RNA, 19 nt, Homo sapiens
auaaucugcuugaggauga

SEQ ID NO: 1349198 - RNA, 19 nt, Homo sapiens
aguguuugcuucagaguuu

SEQ ID NO: 1349199 - RNA, 19 nt, Homo sapiens
ggaaccaucugggccuuca

SEQ ID NO: 1349200 - RNA, 19 nt, Homo sapiens
aagcuuacauuugcucuga

SEQ ID NO: 1349201 - RNA, 19 nt, Homo sapiens
gagaaaagaaggcaagaaa

SEQ ID NO: 1349202 - RNA, 19 nt, Homo sapiens
aggaauaccucucaauguc

SEQ ID NO: 1349203 - RNA, 19 nt, Homo sapiens
aaagagaagugggauugug

SEQ ID NO: 1349204 - RNA, 19 nt, Homo sapiens
ugaagaagccaaagagaag

SEQ ID NO: 1349205 - RNA, 19 nt, Homo sapiens
gaaugagcuugaugagucu

SEQ ID NO: 1349206 - RNA, 19 nt, Homo sapiens
gagauagcaaugaugacua

SEQ ID NO: 1349207 - RNA, 19 nt, Homo sapiens
gagagaggagaaagaagaa

SEQ ID NO: 1349208 - RNA, 19 nt, Homo sapiens
aaacaggaauaccucucaa

SEQ ID NO: 1349209 - RNA, 19 nt, Homo sapiens
caaugaaugagcuugauga

SEQ ID NO: 1349210 - RNA, 19 nt, Homo sapiens
gaagaagaaagcugugucu

SEQ ID NO: 1349211 - RNA, 19 nt, Homo sapiens
ugacuuugaugauccagau

SEQ ID NO: 1349212 - RNA, 19 nt, Homo sapiens
gaaacgcuaguaauuccaa

SEQ ID NO: 1349213 - RNA, 19 nt, Homo sapiens
gaagaaggcugugacauua

SEQ ID NO: 1349214 - RNA, 19 nt, Homo sapiens
gaaugucccuggcugcuua

SEQ ID NO: 1349215 - RNA, 19 nt, Homo sapiens
gcaacgaacuucuuaggaa

SEQ ID NO: 1349216 - RNA, 19 nt, Homo sapiens
gaacaagucagcccauuaa

SEQ ID NO: 1349217 - RNA, 19 nt, Homo sapiens
gaaauggacuuccuuaugc

SEQ ID NO: 1349218 - RNA, 19 nt, Homo sapiens
gaaauauggcuuugaauga

SEQ ID NO: 1349219 - RNA, 19 nt, Homo sapiens
gaaagaaaguccauugcau

SEQ ID NO: 1349220 - RNA, 19 nt, Homo sapiens
ggagguucuuuauuucuua

SEQ ID NO: 1349221 - RNA, 19 nt, Homo sapiens
ccaaagaccuugaaaacua

SEQ ID NO: 1349222 - RNA, 19 nt, Homo sapiens
gcugaauacucuguuaaua

SEQ ID NO: 1349223 - RNA, 19 nt, Homo sapiens
gaucacguuuggcugaaua

SEQ ID NO: 1349224 - RNA, 19 nt, Homo sapiens
ucaaagaacucagcaagga

SEQ ID NO: 1349225 - RNA, 19 nt, Homo sapiens
ccagaaaugaguacuguua

SEQ ID NO: 1349226 - RNA, 19 nt, Homo sapiens
ggaaauauggcuuugaaug

SEQ ID NO: 1349227 - RNA, 19 nt, Homo sapiens
gaaaagaacuucacaaagc

SEQ ID NO: 1349228 - RNA, 19 nt, Homo sapiens
guaucaagauucucagauu

SEQ ID NO: 1349229 - RNA, 19 nt, Homo sapiens
gacauuagauacucaagug

SEQ ID NO: 1349230 - RNA, 19 nt, Homo sapiens
caacaauaccagaggaaua

SEQ ID NO: 1349231 - RNA, 19 nt, Homo sapiens
gcacacaguuucuuuagac

SEQ ID NO: 1349232 - RNA, 19 nt, Homo sapiens
gguguucuguuucuucuuu

SEQ ID NO: 1349233 - RNA, 19 nt, Homo sapiens
uauagaagaucaugagugu

SEQ ID NO: 1349234 - RNA, 19 nt, Homo sapiens
gaaaugaguacuguuauca

SEQ ID NO: 1349235 - RNA, 19 nt, Homo sapiens
gaacaucuucauucuucua

SEQ ID NO: 1349236 - RNA, 19 nt, Homo sapiens
aagaagagcucagacaguu

SEQ ID NO: 1349237 - RNA, 19 nt, Homo sapiens
agagaagaaugaacuagaa

SEQ ID NO: 1349238 - RNA, 19 nt, Homo sapiens
gcaaagcugcugugagaga

SEQ ID NO: 1349239 - RNA, 19 nt, Homo sapiens
ggaaguggcaggcacagaa

SEQ ID NO: 1349240 - RNA, 19 nt, Homo sapiens
gaaaguccauugcauucag

SEQ ID NO: 1349241 - RNA, 19 nt, Homo sapiens
gcaaggugcccuauggaaa

SEQ ID NO: 1349242 - RNA, 19 nt, Homo sapiens
gaacuucacaaagcaguaa

SEQ ID NO: 1349243 - RNA, 19 nt, Homo sapiens
ugaagaaggcugugacauu

SEQ ID NO: 1349244 - RNA, 19 nt, Homo sapiens
ggcacacacuggagagaua

SEQ ID NO: 1349245 - RNA, 19 nt, Homo sapiens
caguggaaauguucuguuu

SEQ ID NO: 1349246 - RNA, 19 nt, Homo sapiens
gauucucuuuggcuaaaua

SEQ ID NO: 1349247 - RNA, 19 nt, Homo sapiens
gcaaacauagugaucauag

SEQ ID NO: 1349248 - RNA, 19 nt, Homo sapiens
ucagaagggugguuuaugg

SEQ ID NO: 1349249 - RNA, 19 nt, Homo sapiens
gccauuauaugaauuagca

SEQ ID NO: 1349250 - RNA, 19 nt, Homo sapiens
ugagcaggcuguaauugaa

SEQ ID NO: 1349251 - RNA, 19 nt, Homo sapiens
caaggacugcccuaaagua

SEQ ID NO: 1349252 - RNA, 19 nt, Homo sapiens
guggaaauguucuguuuag

SEQ ID NO: 1349253 - RNA, 19 nt, Homo sapiens
gauuaccaguauaggauaa

SEQ ID NO: 1349254 - RNA, 19 nt, Homo sapiens
gaauaggaaccucuacuuc

SEQ ID NO: 1349255 - RNA, 19 nt, Homo sapiens
caucauggaucacguuugg

SEQ ID NO: 1349256 - RNA, 19 nt, Homo sapiens
gcccuaaaguacagagaaa

SEQ ID NO: 1349257 - RNA, 19 nt, Homo sapiens
ucugagauauccacacauu

SEQ ID NO: 1349258 - RNA, 19 nt, Homo sapiens
gagagaagaaugaacuaga

SEQ ID NO: 1349259 - RNA, 19 nt, Homo sapiens
gagaaacugugcaagaaaa

SEQ ID NO: 1349260 - RNA, 19 nt, Homo sapiens
ccgagaaacugugcaagaa

SEQ ID NO: 1349261 - RNA, 19 nt, Homo sapiens
gcaaaucuagaccgagaaa

SEQ ID NO: 1349262 - RNA, 19 nt, Homo sapiens
ggacugcccuaaaguacag

SEQ ID NO: 1349263 - RNA, 19 nt, Homo sapiens
gaucaugagugugcugugu

SEQ ID NO: 1349264 - RNA, 19 nt, Homo sapiens
cagcguacuuuacaauuca

SEQ ID NO: 1349265 - RNA, 19 nt, Homo sapiens
uacauuggcagcaugauua

SEQ ID NO: 1349266 - RNA, 19 nt, Homo sapiens
ggauucuccugcacuuaaa

SEQ ID NO: 1349267 - RNA, 19 nt, Homo sapiens
aaagaaaguccauugcauu

SEQ ID NO: 1349268 - RNA, 19 nt, Homo sapiens
uuauaucuguggaguauga

SEQ ID NO: 1349269 - RNA, 19 nt, Homo sapiens
cgaacaagucagcccauua

SEQ ID NO: 1349270 - RNA, 19 nt, Homo sapiens
ggaagagcaagucagauga

SEQ ID NO: 1349271 - RNA, 19 nt, Homo sapiens
ggcaacaucagccaagaua

SEQ ID NO: 1349272 - RNA, 19 nt, Homo sapiens
cacaguuucuuuagacaaa

SEQ ID NO: 1349273 - RNA, 19 nt, Homo sapiens
gaucacaguaugaaguaaa

SEQ ID NO: 1349274 - RNA, 19 nt, Homo sapiens
ggaaagaaaguccauugca

SEQ ID NO: 1349275 - RNA, 19 nt, Homo sapiens
gagucuagcugcucagaag

SEQ ID NO: 1349276 - RNA, 19 nt, Homo sapiens
gaagaagagcucagacagu

SEQ ID NO: 1349277 - RNA, 19 nt, Homo sapiens
agagagugaucuucgcuuu

SEQ ID NO: 1349278 - RNA, 19 nt, Homo sapiens
cagauucucuuuggcuaaa

SEQ ID NO: 1349279 - RNA, 19 nt, Homo sapiens
caucuucauucuucuauag

SEQ ID NO: 1349280 - RNA, 19 nt, Homo sapiens
ccuaaaguacagagaaaua

SEQ ID NO: 1349281 - RNA, 19 nt, Homo sapiens
gacaguugcuggcuuccuu

SEQ ID NO: 1349282 - RNA, 19 nt, Homo sapiens
caaagaccuugaaaacuaa

SEQ ID NO: 1349283 - RNA, 19 nt, Homo sapiens
guacagagaaauauaaugc

SEQ ID NO: 1349284 - RNA, 19 nt, Homo sapiens
cacaaggacugcccuaaag

SEQ ID NO: 1349285 - RNA, 19 nt, Homo sapiens
ggacuuccuuaugcugaaa

SEQ ID NO: 1349286 - RNA, 19 nt, Homo sapiens
uaucaagauucucagauuc

SEQ ID NO: 1349287 - RNA, 19 nt, Homo sapiens
ucgugaagcuuuagccaaa

SEQ ID NO: 1349288 - RNA, 19 nt, Homo sapiens
uggaaacacuaccaaccua

SEQ ID NO: 1349289 - RNA, 19 nt, Homo sapiens
ucacaaggacugcccuaaa

SEQ ID NO: 1349290 - RNA, 19 nt, Homo sapiens
gaaagcagucagagucuag

SEQ ID NO: 1349291 - RNA, 19 nt, Homo sapiens
gaagaaugaacuagaacau

SEQ ID NO: 1349292 - RNA, 19 nt, Homo sapiens
ccagcguacuuuacaauuc

SEQ ID NO: 1349293 - RNA, 19 nt, Homo sapiens
gaggaugaagacagauaua

SEQ ID NO: 1349294 - RNA, 19 nt, Homo sapiens
caucauggcagaagcaaug

SEQ ID NO: 1349295 - RNA, 19 nt, Homo sapiens
agaaggcugugacauuaga

SEQ ID NO: 1349296 - RNA, 19 nt, Homo sapiens
uaagcucuaugcaaucaug

SEQ ID NO: 1349297 - RNA, 19 nt, Homo sapiens
uaauuccuguggauguuaa

SEQ ID NO: 1349298 - RNA, 19 nt, Homo sapiens
ucacaaagcaguaagaaaa

SEQ ID NO: 1349299 - RNA, 19 nt, Homo sapiens
ccuuuuaucugacacauua

SEQ ID NO: 1349300 - RNA, 19 nt, Homo sapiens
gaugaagacagauauacga

SEQ ID NO: 1349301 - RNA, 19 nt, Homo sapiens
uauggaggaugaagacaga

SEQ ID NO: 1349302 - RNA, 19 nt, Homo sapiens
gagcaggcuguaauugaaa

SEQ ID NO: 1349303 - RNA, 19 nt, Homo sapiens
uaugggagcagcauucaaa

SEQ ID NO: 1349304 - RNA, 19 nt, Homo sapiens
ugagauauccacacauugu

SEQ ID NO: 1349305 - RNA, 19 nt, Homo sapiens
ugaaagcagucagagucua

SEQ ID NO: 1349306 - RNA, 19 nt, Homo sapiens
cacggcagguucugaggua

SEQ ID NO: 1349307 - RNA, 19 nt, Homo sapiens
agaaaugaguacuguuauc

SEQ ID NO: 1349308 - RNA, 19 nt, Homo sapiens
augaguguauccaguauuu

SEQ ID NO: 1349309 - RNA, 19 nt, Homo sapiens
gaaguucuggcccugaaga

SEQ ID NO: 1349310 - RNA, 19 nt, Homo sapiens
guauugauuugcuguacau

SEQ ID NO: 1349311 - RNA, 19 nt, Homo sapiens
guuaauauucgcuaucuuc

SEQ ID NO: 1349312 - RNA, 19 nt, Homo sapiens
gaauuauaucuguggagua

SEQ ID NO: 1349313 - RNA, 19 nt, Homo sapiens
gcacaccacuugauucuau

SEQ ID NO: 1349314 - RNA, 19 nt, Homo sapiens
gcacucagcgcaagaagau

SEQ ID NO: 1349315 - RNA, 19 nt, Homo sapiens
cgaaacuccugucugcuau

SEQ ID NO: 1349316 - RNA, 19 nt, Homo sapiens
ggaggaggccaccgacuau

SEQ ID NO: 1349317 - RNA, 19 nt, Homo sapiens
ucaccggccucuacuggaa

SEQ ID NO: 1349318 - RNA, 19 nt, Homo sapiens
caguugcgcucacucauca

SEQ ID NO: 1349319 - RNA, 19 nt, Homo sapiens
gaagcacaccacuugauuc

SEQ ID NO: 1349320 - RNA, 19 nt, Homo sapiens
cgaagcacaccacuugauu

SEQ ID NO: 1349321 - RNA, 19 nt, Homo sapiens
ccgaaacuccugucugcua

SEQ ID NO: 1349322 - RNA, 19 nt, Homo sapiens
gcagcuucaugcucaagga

SEQ ID NO: 1349323 - RNA, 19 nt, Homo sapiens
ccacagcacaaucaucuca

SEQ ID NO: 1349324 - RNA, 19 nt, Homo sapiens
ggcugcaccuggacgauga

SEQ ID NO: 1349325 - RNA, 19 nt, Homo sapiens
uggcgaagcacaccacuug

SEQ ID NO: 1349326 - RNA, 19 nt, Homo sapiens
ccacaaccaggacaaguuc

SEQ ID NO: 1349327 - RNA, 19 nt, Homo sapiens
uggcggcucuggccuacaa

SEQ ID NO: 1349328 - RNA, 19 nt, Homo sapiens
ucaaggacaugcucuaccu

SEQ ID NO: 1349329 - RNA, 19 nt, Homo sapiens
gcugguucuuugaggaauu

SEQ ID NO: 1349330 - RNA, 19 nt, Homo sapiens
gcaguugcgcucacucauc

SEQ ID NO: 1349331 - RNA, 19 nt, Homo sapiens
gcgaagcacaccacuugau

SEQ ID NO: 1349332 - RNA, 19 nt, Homo sapiens
ggaggccaccgacuaugga

SEQ ID NO: 1349333 - RNA, 19 nt, Homo sapiens
cgcaaggccuacuccauca

SEQ ID NO: 1349334 - RNA, 19 nt, Homo sapiens
aagcccagcugccaguaug

SEQ ID NO: 1349335 - RNA, 19 nt, Homo sapiens
gcuuggaggagcucuguug

SEQ ID NO: 1349336 - RNA, 19 nt, Homo sapiens
gggacgagcagauuuacag

SEQ ID NO: 1349337 - RNA, 19 nt, Homo sapiens
gcaaggccuacuccaucaa

SEQ ID NO: 1349338 - RNA, 19 nt, Homo sapiens
agucugcccucugccauug

SEQ ID NO: 1349339 - RNA, 19 nt, Homo sapiens
gggcugguucuuugaggaa

SEQ ID NO: 1349340 - RNA, 19 nt, Homo sapiens
cacaccacuugauucuauu

SEQ ID NO: 1349341 - RNA, 19 nt, Homo sapiens
ucucagggcaggcacaugu

SEQ ID NO: 1349342 - RNA, 19 nt, Homo sapiens
cacacagucucccaucucu

SEQ ID NO: 1349343 - RNA, 19 nt, Homo sapiens
ccuacuccaucaaggacaa

SEQ ID NO: 1349344 - RNA, 19 nt, Homo sapiens
cugguucuuugaggaauuu

SEQ ID NO: 1349345 - RNA, 19 nt, Homo sapiens
aggaggaggccaccgacua

SEQ ID NO: 1349346 - RNA, 19 nt, Homo sapiens
agaugcggcuggccaacga

SEQ ID NO: 1349347 - RNA, 19 nt, Homo sapiens
ugaagaaacuggagaauuu

SEQ ID NO: 1349348 - RNA, 19 nt, Homo sapiens
gugaauaguuugacucuaa

SEQ ID NO: 1349349 - RNA, 19 nt, Homo sapiens
ggagagcacuggcauaugu

SEQ ID NO: 1349350 - RNA, 19 nt, Homo sapiens
ggaaaugcaugucugaaug

SEQ ID NO: 1349351 - RNA, 19 nt, Homo sapiens
gaagugauuucugcuguuu

SEQ ID NO: 1349352 - RNA, 19 nt, Homo sapiens
ccaagauccuaccaaguua

SEQ ID NO: 1349353 - RNA, 19 nt, Homo sapiens
gcuguugggugaauaguuu

SEQ ID NO: 1349354 - RNA, 19 nt, Homo sapiens
ggaaaguguuguccugaau

SEQ ID NO: 1349355 - RNA, 19 nt, Homo sapiens
ggaaaaggcuucuacaaca

SEQ ID NO: 1349356 - RNA, 19 nt, Homo sapiens
ggagagaagugggaagaug

SEQ ID NO: 1349357 - RNA, 19 nt, Homo sapiens
gcaaugcugugaggaaugu

SEQ ID NO: 1349358 - RNA, 19 nt, Homo sapiens
gccaagauccuaccaaguu

SEQ ID NO: 1349359 - RNA, 19 nt, Homo sapiens
ugucuuaccuguacugaga

SEQ ID NO: 1349360 - RNA, 19 nt, Homo sapiens
gggcucagguaacuugcua

SEQ ID NO: 1349361 - RNA, 19 nt, Homo sapiens
cuagugaaguuaaacguau

SEQ ID NO: 1349362 - RNA, 19 nt, Homo sapiens
caaaugcuagugaaguuaa

SEQ ID NO: 1349363 - RNA, 19 nt, Homo sapiens
cauaucaucuacagagaau

SEQ ID NO: 1349364 - RNA, 19 nt, Homo sapiens
ccaaguuacugcagaaugg

SEQ ID NO: 1349365 - RNA, 19 nt, Homo sapiens
agaagacagugcugcauga

SEQ ID NO: 1349366 - RNA, 19 nt, Homo sapiens
gaagaaacuggagaauuug

SEQ ID NO: 1349367 - RNA, 19 nt, Homo sapiens
gaaagggaaguauuauagu

SEQ ID NO: 1349368 - RNA, 19 nt, Homo sapiens
ugaaagggaaguauuauag

SEQ ID NO: 1349369 - RNA, 19 nt, Homo sapiens
gagaugaaagggaaguauu

SEQ ID NO: 1349370 - RNA, 19 nt, Homo sapiens
uaaccaggaugagacugua

SEQ ID NO: 1349371 - RNA, 19 nt, Homo sapiens
ggugagcaguggagcgaaa

SEQ ID NO: 1349372 - RNA, 19 nt, Homo sapiens
agaugaaagggaaguauua

SEQ ID NO: 1349373 - RNA, 19 nt, Homo sapiens
ggaaugguuauuguguuua

SEQ ID NO: 1349374 - RNA, 19 nt, Homo sapiens
gaaaguguuguccugaaug

SEQ ID NO: 1349375 - RNA, 19 nt, Homo sapiens
uaguuugacucuaaagcua

SEQ ID NO: 1349376 - RNA, 19 nt, Homo sapiens
aggaaugguuauuguguuu

SEQ ID NO: 1349377 - RNA, 19 nt, Homo sapiens
gaaacuggagaauuugugu

SEQ ID NO: 1349378 - RNA, 19 nt, Homo sapiens
ugucagaauuuagaaguga

SEQ ID NO: 1349379 - RNA, 19 nt, Homo sapiens
gcuagugaaguuaaacgua

SEQ ID NO: 1349380 - RNA, 19 nt, Homo sapiens
caaggaaugguuauugugu

SEQ ID NO: 1349381 - RNA, 19 nt, Homo sapiens
gggcaaugcugugaggaau

SEQ ID NO: 1349382 - RNA, 19 nt, Homo sapiens
gcaccacguguauauguga

SEQ ID NO: 1349383 - RNA, 19 nt, Homo sapiens
gaugaaagggaaguauuau

SEQ ID NO: 1349384 - RNA, 19 nt, Homo sapiens
uaucaucuacagagaauug

SEQ ID NO: 1349385 - RNA, 19 nt, Homo sapiens
gcauaucaucuacagagaa

SEQ ID NO: 1349386 - RNA, 19 nt, Homo sapiens
gggaaaugcaugucugaau

SEQ ID NO: 1349387 - RNA, 19 nt, Homo sapiens
acuggcaggugcaaaguuu

SEQ ID NO: 1349388 - RNA, 19 nt, Homo sapiens
caagcuggcagucucugua

SEQ ID NO: 1349389 - RNA, 19 nt, Homo sapiens
cuaccaaguuacugcagaa

SEQ ID NO: 1349390 - RNA, 19 nt, Homo sapiens
ucaaaugcuagugaaguua

SEQ ID NO: 1349391 - RNA, 19 nt, Homo sapiens
guucauugccauccagauu

SEQ ID NO: 1349392 - RNA, 19 nt, Homo sapiens
ccuccugccuggcuuguau

SEQ ID NO: 1349393 - RNA, 19 nt, Homo sapiens
gcaccuguagcgcuuguga

SEQ ID NO: 1349394 - RNA, 19 nt, Homo sapiens
ggacggcuucuaccaagau

SEQ ID NO: 1349395 - RNA, 19 nt, Homo sapiens
uggaaaguguuguccugaa

SEQ ID NO: 1349396 - RNA, 19 nt, Homo sapiens
ggagaugaaagggaaguau

SEQ ID NO: 1349397 - RNA, 19 nt, Homo sapiens
ucaauagccaggccaucua

SEQ ID NO: 1349398 - RNA, 19 nt, Homo sapiens
ggcauaucaucuacagaga

SEQ ID NO: 1349399 - RNA, 19 nt, Homo sapiens
gaaaaggcuucuacaacag

SEQ ID NO: 1349400 - RNA, 19 nt, Homo sapiens
ccauccagauuguuugaca

SEQ ID NO: 1349401 - RNA, 19 nt, Homo sapiens
gggaagauggcccuugcaa

SEQ ID NO: 1349402 - RNA, 19 nt, Homo sapiens
gucaucaaaugcuagugaa

SEQ ID NO: 1349403 - RNA, 19 nt, Homo sapiens
aaggaaugguuauuguguu

SEQ ID NO: 1349404 - RNA, 19 nt, Homo sapiens
gcccacacccucucacugu

SEQ ID NO: 1349405 - RNA, 19 nt, Homo sapiens
ugugagagcagcuguggaa

SEQ ID NO: 1349406 - RNA, 19 nt, Homo sapiens
agagauggcggcugugaga

SEQ ID NO: 1349407 - RNA, 19 nt, Homo sapiens
ggugaauaguuugacucua

SEQ ID NO: 1349408 - RNA, 19 nt, Homo sapiens
gagagcagcuguggaaaag

SEQ ID NO: 1349409 - RNA, 19 nt, Homo sapiens
ucauugccauccagauugu

SEQ ID NO: 1349410 - RNA, 19 nt, Homo sapiens
cucugcagcuggccaagua

SEQ ID NO: 1349411 - RNA, 19 nt, Homo sapiens
acucuaaagcuacgugaaa

SEQ ID NO: 1349412 - RNA, 19 nt, Homo sapiens
uaugagugguugaggagau

SEQ ID NO: 1349413 - RNA, 19 nt, Homo sapiens
gggacggcuucuaccaaga

SEQ ID NO: 1349414 - RNA, 19 nt, Homo sapiens
uauaguuuccuuucuguuc

SEQ ID NO: 1349415 - RNA, 19 nt, Homo sapiens
cuacagagaauugaugaca

SEQ ID NO: 1349416 - RNA, 19 nt, Homo sapiens
ggcaaaaucuggacuucug

SEQ ID NO: 1349417 - RNA, 19 nt, Homo sapiens
guaaccaggaugagacugu

SEQ ID NO: 1349418 - RNA, 19 nt, Homo sapiens
cuguagcgcuugugaccaa

SEQ ID NO: 1349419 - RNA, 19 nt, Homo sapiens
uggagagugugccaaagug

SEQ ID NO: 1349420 - RNA, 19 nt, Homo sapiens
agggaaguauuauaguuuc

SEQ ID NO: 1349421 - RNA, 19 nt, Homo sapiens
uaagaagccagaggaagga

SEQ ID NO: 1349422 - RNA, 19 nt, Homo sapiens
cccacacccucucacugua

SEQ ID NO: 1349423 - RNA, 19 nt, Homo sapiens
gaagacagugcugcaugau

SEQ ID NO: 1349424 - RNA, 19 nt, Homo sapiens
caucaaaugcuagugaagu

SEQ ID NO: 1349425 - RNA, 19 nt, Homo sapiens
gcuggcagucucuguauag

SEQ ID NO: 1349426 - RNA, 19 nt, Homo sapiens
guguuguccugaaugcauu

SEQ ID NO: 1349427 - RNA, 19 nt, Homo sapiens
cuaccaagaucgccauucc

SEQ ID NO: 1349428 - RNA, 19 nt, Homo sapiens
aucaaaugcuagugaaguu

SEQ ID NO: 1349429 - RNA, 19 nt, Homo sapiens
ugucaucaaaugcuaguga

SEQ ID NO: 1349430 - RNA, 19 nt, Homo sapiens
cuggagaauuugugucauc

SEQ ID NO: 1349431 - RNA, 19 nt, Homo sapiens
aaaguguuguccugaaugc

SEQ ID NO: 1349432 - RNA, 19 nt, Homo sapiens
uggagaauuugugucauca

SEQ ID NO: 1349433 - RNA, 19 nt, Homo sapiens
uucaaggaaugguuauugu

SEQ ID NO: 1349434 - RNA, 19 nt, Homo sapiens
gacuggagagugugccaaa

SEQ ID NO: 1349435 - RNA, 19 nt, Homo sapiens
ccaagugaccugccagacu

SEQ ID NO: 1349436 - RNA, 19 nt, Homo sapiens
gggcaccuguagcgcuugu

SEQ ID NO: 1349437 - RNA, 19 nt, Homo sapiens
ugugaccucugccaagauc

SEQ ID NO: 1349438 - RNA, 19 nt, Homo sapiens
acugugaccucugccaaga

SEQ ID NO: 1349439 - RNA, 19 nt, Homo sapiens
ggagaauuugugucaucaa

SEQ ID NO: 1349440 - RNA, 19 nt, Homo sapiens
ucaaggaaugguuauugug

SEQ ID NO: 1349441 - RNA, 19 nt, Homo sapiens
uacagagaauugaugacau

SEQ ID NO: 1349442 - RNA, 19 nt, Homo sapiens
gagcacuggcauaugugaa

SEQ ID NO: 1349443 - RNA, 19 nt, Homo sapiens
gcaaguggagcagcugucu

SEQ ID NO: 1349444 - RNA, 19 nt, Homo sapiens
ccagauuguuugacaugcu

SEQ ID NO: 1349445 - RNA, 19 nt, Homo sapiens
ugagagauggcggcuguga

SEQ ID NO: 1349446 - RNA, 19 nt, Homo sapiens
caacuaaccuugacuguau

SEQ ID NO: 1349447 - RNA, 19 nt, Homo sapiens
ugaaggaggugcugaguuu

SEQ ID NO: 1349448 - RNA, 19 nt, Homo sapiens
gaggagugcuuuggacuua

SEQ ID NO: 1349449 - RNA, 19 nt, Homo sapiens
ccaggcagcuauaagaaua

SEQ ID NO: 1349450 - RNA, 19 nt, Homo sapiens
ggauaugacugacaaggaa

SEQ ID NO: 1349451 - RNA, 19 nt, Homo sapiens
ucaaguuucucaaccuuua

SEQ ID NO: 1349452 - RNA, 19 nt, Homo sapiens
gaaacgcuauguauuagag

SEQ ID NO: 1349453 - RNA, 19 nt, Homo sapiens
cgacggaaauagaauugaa

SEQ ID NO: 1349454 - RNA, 19 nt, Homo sapiens
cgauaaagccauggaguua

SEQ ID NO: 1349455 - RNA, 19 nt, Homo sapiens
ugaaacuucuuccaccuuu

SEQ ID NO: 1349456 - RNA, 19 nt, Homo sapiens
acacaccuguuucccauaa

SEQ ID NO: 1349457 - RNA, 19 nt, Homo sapiens
ggagagggaaugaguaaug

SEQ ID NO: 1349458 - RNA, 19 nt, Homo sapiens
gcaccaacccucaauaucu

SEQ ID NO: 1349459 - RNA, 19 nt, Homo sapiens
gaaucuaugaguccaagua

SEQ ID NO: 1349460 - RNA, 19 nt, Homo sapiens
gagaagcuaccgagacuug

SEQ ID NO: 1349461 - RNA, 19 nt, Homo sapiens
guuaagaaacgcuauguau

SEQ ID NO: 1349462 - RNA, 19 nt, Homo sapiens
ggaguccagugaagaggaa

SEQ ID NO: 1349463 - RNA, 19 nt, Homo sapiens
gauaaagccauggaguuaa

SEQ ID NO: 1349464 - RNA, 19 nt, Homo sapiens
gaugagaaguuggaaagag

SEQ ID NO: 1349465 - RNA, 19 nt, Homo sapiens
cucaauaucugguggagaa

SEQ ID NO: 1349466 - RNA, 19 nt, Homo sapiens
gaaaggcaucggagcaaga

SEQ ID NO: 1349467 - RNA, 19 nt, Homo sapiens
uauaaaggaucuggagguu

SEQ ID NO: 1349468 - RNA, 19 nt, Homo sapiens
gaagaggacauggaugaug

SEQ ID NO: 1349469 - RNA, 19 nt, Homo sapiens
cuaagaagagccacaagaa

SEQ ID NO: 1349470 - RNA, 19 nt, Homo sapiens
ggacuuacagcugaacuug

SEQ ID NO: 1349471 - RNA, 19 nt, Homo sapiens
gaugugaggcauuaaagga

SEQ ID NO: 1349472 - RNA, 19 nt, Homo sapiens
aagaagagccacaagaaga

SEQ ID NO: 1349473 - RNA, 19 nt, Homo sapiens
ggagugcuuuggacuuaca

SEQ ID NO: 1349474 - RNA, 19 nt, Homo sapiens
gagagggaaugaguaaugg

SEQ ID NO: 1349475 - RNA, 19 nt, Homo sapiens
guaauggacucaguuuggu

SEQ ID NO: 1349476 - RNA, 19 nt, Homo sapiens
ggucaucaccguagucaca

SEQ ID NO: 1349477 - RNA, 19 nt, Homo sapiens
aagaaacgcuauguauuag

SEQ ID NO: 1349478 - RNA, 19 nt, Homo sapiens
ccaacuaaccuugacugua

SEQ ID NO: 1349479 - RNA, 19 nt, Homo sapiens
agaggaagcugagcaacug

SEQ ID NO: 1349480 - RNA, 19 nt, Homo sapiens
caccaacccucaauaucug

SEQ ID NO: 1349481 - RNA, 19 nt, Homo sapiens
uaucaaguuucucaaccuu

SEQ ID NO: 1349482 - RNA, 19 nt, Homo sapiens
gaacuuguagucgauaaag

SEQ ID NO: 1349483 - RNA, 19 nt, Homo sapiens
gagaaaggcaucggagcaa

SEQ ID NO: 1349484 - RNA, 19 nt, Homo sapiens
uggaagaggacauggauga

SEQ ID NO: 1349485 - RNA, 19 nt, Homo sapiens
agaggaggaugagaaguug

SEQ ID NO: 1349486 - RNA, 19 nt, Homo sapiens
cugaugacccuuucccuuu

SEQ ID NO: 1349487 - RNA, 19 nt, Homo sapiens
uaaaauggcuaaccguaca

SEQ ID NO: 1349488 - RNA, 19 nt, Homo sapiens
guauguggaaggauuaaga

SEQ ID NO: 1349489 - RNA, 19 nt, Homo sapiens
gaagcuaccgagacuugga

SEQ ID NO: 1349490 - RNA, 19 nt, Homo sapiens
aagaagaggaggaugagaa

SEQ ID NO: 1349491 - RNA, 19 nt, Homo sapiens
auaaagccauggaguuaag

SEQ ID NO: 1349492 - RNA, 19 nt, Homo sapiens
gguggucgccuaagcuguu

SEQ ID NO: 1349493 - RNA, 19 nt, Homo sapiens
guggaaggauuaagaucuc

SEQ ID NO: 1349494 - RNA, 19 nt, Homo sapiens
cggagaagcuaccgagacu

SEQ ID NO: 1349495 - RNA, 19 nt, Homo sapiens
aagaggaggaugagaaguu

SEQ ID NO: 1349496 - RNA, 19 nt, Homo sapiens
gauaugacugacaaggaaa

SEQ ID NO: 1349497 - RNA, 19 nt, Homo sapiens
gggauaugacugacaagga

SEQ ID NO: 1349498 - RNA, 19 nt, Homo sapiens
ccggagagggaaugaguaa

SEQ ID NO: 1349499 - RNA, 19 nt, Homo sapiens
uaagaagagccacaagaag

SEQ ID NO: 1349500 - RNA, 19 nt, Homo sapiens
ccagugaagaggaagaaga

SEQ ID NO: 1349501 - RNA, 19 nt, Homo sapiens
ggaguuaagaaacgcuaug

SEQ ID NO: 1349502 - RNA, 19 nt, Homo sapiens
cacaggagccacucaaagu

SEQ ID NO: 1349503 - RNA, 19 nt, Homo sapiens
caucggagcaagaguccaa

SEQ ID NO: 1349504 - RNA, 19 nt, Homo sapiens
gaagaagaggaggaugaga

SEQ ID NO: 1349505 - RNA, 19 nt, Homo sapiens
ggaagaagaggaggaugag

SEQ ID NO: 1349506 - RNA, 19 nt, Homo sapiens
guggagaagaucauucgaa

SEQ ID NO: 1349507 - RNA, 19 nt, Homo sapiens
gacacaggagccacucaaa

SEQ ID NO: 1349508 - RNA, 19 nt, Homo sapiens
gaggaugagaaguuggaaa

SEQ ID NO: 1349509 - RNA, 19 nt, Homo sapiens
ggacucaguuugguuuuag

SEQ ID NO: 1349510 - RNA, 19 nt, Homo sapiens
gaagagccggagagggaau

SEQ ID NO: 1349511 - RNA, 19 nt, Homo sapiens
ggaagaggacauggaugau

SEQ ID NO: 1349512 - RNA, 19 nt, Homo sapiens
ucuaagaagagccacaaga

SEQ ID NO: 1349513 - RNA, 19 nt, Homo sapiens
gaguuagugcucuggaaga

SEQ ID NO: 1349514 - RNA, 19 nt, Homo sapiens
ucgauaaagccauggaguu

SEQ ID NO: 1349515 - RNA, 19 nt, Homo sapiens
ggucuaagaagagccacaa

SEQ ID NO: 1349516 - RNA, 19 nt, Homo sapiens
cggcacagaucccguucca

SEQ ID NO: 1349517 - RNA, 19 nt, Homo sapiens
gccauggaguuaagaaacg

SEQ ID NO: 1349518 - RNA, 19 nt, Homo sapiens
aggcagcuauaagaauauu

SEQ ID NO: 1349519 - RNA, 19 nt, Homo sapiens
aggaagaagaggaggauga

SEQ ID NO: 1349520 - RNA, 19 nt, Homo sapiens
cugaacuuguagucgauaa

SEQ ID NO: 1349521 - RNA, 19 nt, Homo sapiens
ccauuccucuaggugcuuu

SEQ ID NO: 1349522 - RNA, 19 nt, Homo sapiens
ggaugagaaguuggaaaga

SEQ ID NO: 1349523 - RNA, 19 nt, Homo sapiens
ugaugacccuuucccuuuu

SEQ ID NO: 1349524 - RNA, 19 nt, Homo sapiens
guggucgccuaagcuguuu

SEQ ID NO: 1349525 - RNA, 19 nt, Homo sapiens
aauggacucaguuugguuu

SEQ ID NO: 1349526 - RNA, 19 nt, Homo sapiens
cauggccuccuguggauau

SEQ ID NO: 1349527 - RNA, 19 nt, Homo sapiens
augagaaguuggaaagagu

SEQ ID NO: 1349528 - RNA, 19 nt, Homo sapiens
ucgaguuagugcucuggaa

SEQ ID NO: 1349529 - RNA, 19 nt, Homo sapiens
caacuaaccuugacuguau

SEQ ID NO: 1349530 - RNA, 19 nt, Homo sapiens
ugaaggaggugcugaguuu

SEQ ID NO: 1349531 - RNA, 19 nt, Homo sapiens
gaggagugcuuuggacuua

SEQ ID NO: 1349532 - RNA, 19 nt, Homo sapiens
ccaggcagcuauaagaaua

SEQ ID NO: 1349533 - RNA, 19 nt, Homo sapiens
gagaggaaaguaucuaaua

SEQ ID NO: 1349534 - RNA, 19 nt, Homo sapiens
ggauaugacugacaaggaa

SEQ ID NO: 1349535 - RNA, 19 nt, Homo sapiens
caacagagagcagcacuua

SEQ ID NO: 1349536 - RNA, 19 nt, Homo sapiens
ucaaguuucucaaccuuua

SEQ ID NO: 1349537 - RNA, 19 nt, Homo sapiens
ggauaucauuguagaguuu

SEQ ID NO: 1349538 - RNA, 19 nt, Homo sapiens
cagaaagacaggagaauua

SEQ ID NO: 1349539 - RNA, 19 nt, Homo sapiens
acagaaacgcuauguauua

SEQ ID NO: 1349540 - RNA, 19 nt, Homo sapiens
gagagucugugauaucauu

SEQ ID NO: 1349541 - RNA, 19 nt, Homo sapiens
ggacaucgauaaucaagag

SEQ ID NO: 1349542 - RNA, 19 nt, Homo sapiens
ccacggacaucgauaauca

SEQ ID NO: 1349543 - RNA, 19 nt, Homo sapiens
cgagaaggauaucauugua

SEQ ID NO: 1349544 - RNA, 19 nt, Homo sapiens
gcacuuaauacccuuuaua

SEQ ID NO: 1349545 - RNA, 19 nt, Homo sapiens
gcauucaguuuaacaaguu

SEQ ID NO: 1349546 - RNA, 19 nt, Homo sapiens
gagagagucugugauauca

SEQ ID NO: 1349547 - RNA, 19 nt, Homo sapiens
gaaacgcuauguauuagag

SEQ ID NO: 1349548 - RNA, 19 nt, Homo sapiens
ucaaacaguucaacagaga

SEQ ID NO: 1349549 - RNA, 19 nt, Homo sapiens
uaaagccaguuucaucaaa

SEQ ID NO: 1349550 - RNA, 19 nt, Homo sapiens
cgacggaaauagaauugaa

SEQ ID NO: 1349551 - RNA, 19 nt, Homo sapiens
ggaccagaguuuaacauag

SEQ ID NO: 1349552 - RNA, 19 nt, Homo sapiens
cgauaaagccauggaguua

SEQ ID NO: 1349553 - RNA, 19 nt, Homo sapiens
gagguuguaucuggucaua

SEQ ID NO: 1349554 - RNA, 19 nt, Homo sapiens
gcacacaacagaaccauag

SEQ ID NO: 1349555 - RNA, 19 nt, Homo sapiens
gauagggaccagaguuuaa

SEQ ID NO: 1349556 - RNA, 19 nt, Homo sapiens
gcaguaggguaacgggauu

SEQ ID NO: 1349557 - RNA, 19 nt, Homo sapiens
ugaaacuucuuccaccuuu

SEQ ID NO: 1349558 - RNA, 19 nt, Homo sapiens
caauaagacuucccagagu

SEQ ID NO: 1349559 - RNA, 19 nt, Homo sapiens
gguggaaucugucaauaag

SEQ ID NO: 1349560 - RNA, 19 nt, Homo sapiens
ggagagggaaugaguaaug

SEQ ID NO: 1349561 - RNA, 19 nt, Homo sapiens
gguuggaacugcuuugaga

SEQ ID NO: 1349562 - RNA, 19 nt, Homo sapiens
ccauuucgcuguaguuuag

SEQ ID NO: 1349563 - RNA, 19 nt, Homo sapiens
acacaccuguuucccauuu

SEQ ID NO: 1349564 - RNA, 19 nt, Homo sapiens
gcaccaacccucaauaucu

SEQ ID NO: 1349565 - RNA, 19 nt, Homo sapiens
guauccagccuuuaucaua

SEQ ID NO: 1349566 - RNA, 19 nt, Homo sapiens
agaaggauaucauuguaga

SEQ ID NO: 1349567 - RNA, 19 nt, Homo sapiens
gaaucuaugaguccaagua

SEQ ID NO: 1349568 - RNA, 19 nt, Homo sapiens
gagauagggaccagaguuu

SEQ ID NO: 1349569 - RNA, 19 nt, Homo sapiens
gagaagcuaccgagacuug

SEQ ID NO: 1349570 - RNA, 19 nt, Homo sapiens
ggucaagaaugcagaagca

SEQ ID NO: 1349571 - RNA, 19 nt, Homo sapiens
gaaagaagccaagggucaa

SEQ ID NO: 1349572 - RNA, 19 nt, Homo sapiens
cccagaguguuaauauaua

SEQ ID NO: 1349573 - RNA, 19 nt, Homo sapiens
uauccagccuuuaucauau

SEQ ID NO: 1349574 - RNA, 19 nt, Homo sapiens
cagaaacgcuauguauuag

SEQ ID NO: 1349575 - RNA, 19 nt, Homo sapiens
aaagacuucagcaguauua

SEQ ID NO: 1349576 - RNA, 19 nt, Homo sapiens
ggaaugacuucugcaacug

SEQ ID NO: 1349577 - RNA, 19 nt, Homo sapiens
ggagagagugagugaaaga

SEQ ID NO: 1349578 - RNA, 19 nt, Homo sapiens
aaacauaguugcuccuaac

SEQ ID NO: 1349579 - RNA, 19 nt, Homo sapiens
ggaguccagugaagaggaa

SEQ ID NO: 1349580 - RNA, 19 nt, Homo sapiens
guugaugaguuuauugaug

SEQ ID NO: 1349581 - RNA, 19 nt, Homo sapiens
gacaggcacugcaauugau

SEQ ID NO: 1349582 - RNA, 19 nt, Homo sapiens
gauaaagccauggaguuaa

SEQ ID NO: 1349583 - RNA, 19 nt, Homo sapiens
ggucauaagguaaacauuc

SEQ ID NO: 1349584 - RNA, 19 nt, Homo sapiens
ggagauagggaccagaguu

SEQ ID NO: 1349585 - RNA, 19 nt, Homo sapiens
gcuagacagucgugccauu

SEQ ID NO: 1349586 - RNA, 19 nt, Homo sapiens
gaugagaaguuggaaagag

SEQ ID NO: 1349587 - RNA, 19 nt, Homo sapiens
gcauguugaugaguuuauu

SEQ ID NO: 1349588 - RNA, 19 nt, Homo sapiens
gaugcauguugaugaguuu

SEQ ID NO: 1349589 - RNA, 19 nt, Homo sapiens
cucaauaucugguggagaa

SEQ ID NO: 1349590 - RNA, 19 nt, Homo sapiens
caacacaggaagaaauaga

SEQ ID NO: 1349591 - RNA, 19 nt, Homo sapiens
ucaaagaucaaaggaguaa

SEQ ID NO: 1349592 - RNA, 19 nt, Homo sapiens
gaaaggcaucggagcaaga

SEQ ID NO: 1349593 - RNA, 19 nt, Homo sapiens
gguuguaucuggucauaag

SEQ ID NO: 1349594 - RNA, 19 nt, Homo sapiens
gaaaugcacacaacagaac

SEQ ID NO: 1349595 - RNA, 19 nt, Homo sapiens
gaccagaguuuaacauagc

SEQ ID NO: 1349596 - RNA, 19 nt, Homo sapiens
uauaaaggaucuggagguu

SEQ ID NO: 1349597 - RNA, 19 nt, Homo sapiens
gaagaggacauggaugaug

SEQ ID NO: 1349598 - RNA, 19 nt, Homo sapiens
gaaccgaaauggggaguuu

SEQ ID NO: 1349599 - RNA, 19 nt, Homo sapiens
ugaccuaaauugcuagaca

SEQ ID NO: 1349600 - RNA, 19 nt, Homo sapiens
ugaaauccagguuaaggua

SEQ ID NO: 1349601 - RNA, 19 nt, Homo sapiens
cuaagaagagccacaagaa

SEQ ID NO: 1349602 - RNA, 19 nt, Homo sapiens
gaugugaggcauuaaagga

SEQ ID NO: 1349603 - RNA, 19 nt, Homo sapiens
ggacuuacagcugaacuug

SEQ ID NO: 1349604 - RNA, 19 nt, Homo sapiens
gaaagacuucagcaguauu

SEQ ID NO: 1349605 - RNA, 19 nt, Homo sapiens
gaaugcagaagcaaaggaa

SEQ ID NO: 1349606 - RNA, 19 nt, Homo sapiens
uaucagaaaugcacacaac

SEQ ID NO: 1349607 - RNA, 19 nt, Homo sapiens
uaaggcugcuucuggauca

SEQ ID NO: 1349608 - RNA, 19 nt, Homo sapiens
gcggaagcccuuuacacua

SEQ ID NO: 1349609 - RNA, 19 nt, Homo sapiens
aagaagagccacaagaaga

SEQ ID NO: 1349610 - RNA, 19 nt, Homo sapiens
cagcaguauuaaagcauuu

SEQ ID NO: 1349611 - RNA, 19 nt, Homo sapiens
gggaccagaguuuaacaua

SEQ ID NO: 1349612 - RNA, 19 nt, Homo sapiens
gaaauccagguuaagguau

SEQ ID NO: 1349613 - RNA, 19 nt, Homo sapiens
cagagagcagcacuuaaua

SEQ ID NO: 1349614 - RNA, 19 nt, Homo sapiens
caagugguaauaaacauga

SEQ ID NO: 1349615 - RNA, 19 nt, Homo sapiens
ugacaggcacugcaauuga

SEQ ID NO: 1349616 - RNA, 19 nt, Homo sapiens
ggagugcuuuggacuuaca

SEQ ID NO: 1349617 - RNA, 19 nt, Homo sapiens
cggaagcccuuuacacuac

SEQ ID NO: 1349618 - RNA, 19 nt, Homo sapiens
caucaaacaguucaacaga

SEQ ID NO: 1349619 - RNA, 19 nt, Homo sapiens
gauuugugcugcugcuguu

SEQ ID NO: 1349620 - RNA, 19 nt, Homo sapiens
gagagggaaugaguaaugg

SEQ ID NO: 1349621 - RNA, 19 nt, Homo sapiens
gauggucgccuaagcuguu

SEQ ID NO: 1349622 - RNA, 19 nt, Homo sapiens
ggauggugguaguaaugaa

SEQ ID NO: 1349623 - RNA, 19 nt, Homo sapiens
acagagagcagcacuuaau

SEQ ID NO: 1349624 - RNA, 19 nt, Homo sapiens
guaauggacucaguuuggu

SEQ ID NO: 1349625 - RNA, 19 nt, Homo sapiens
gccauggaguuaagguuug

SEQ ID NO: 1349626 - RNA, 19 nt, Homo sapiens
aagaguuccuuuaccugua

SEQ ID NO: 1349627 - RNA, 19 nt, Homo sapiens
ccauaaaguuggagauagg

SEQ ID NO: 1349628 - RNA, 19 nt, Homo sapiens
gggcagagaauuagaggau

SEQ ID NO: 1349629 - RNA, 19 nt, Homo sapiens
gaacguaugccaccucuuu

SEQ ID NO: 1349630 - RNA, 19 nt, Homo sapiens
gaaagaaggaggaaucuga

SEQ ID NO: 1349631 - RNA, 19 nt, Homo sapiens
uaucguagcugcccuaaug

SEQ ID NO: 1349632 - RNA, 19 nt, Homo sapiens
gaucagcuguucuuagaug

SEQ ID NO: 1349633 - RNA, 19 nt, Homo sapiens
gaacugcaguggugugauc

SEQ ID NO: 1349634 - RNA, 19 nt, Homo sapiens
gaugucagcuauauguuug

SEQ ID NO: 1349635 - RNA, 19 nt, Homo sapiens
gaccuugacuccuacauug

SEQ ID NO: 1349636 - RNA, 19 nt, Homo sapiens
caacucacccagcuaauuu

SEQ ID NO: 1349637 - RNA, 19 nt, Homo sapiens
gaaacccacucuugcucua

SEQ ID NO: 1349638 - RNA, 19 nt, Homo sapiens
gccaaagucugcagaaugu

SEQ ID NO: 1349639 - RNA, 19 nt, Homo sapiens
caaucgagcugcugaggaa

SEQ ID NO: 1349640 - RNA, 19 nt, Homo sapiens
gagcagggcaucacucuga

SEQ ID NO: 1349641 - RNA, 19 nt, Homo sapiens
uuccaaagcugguaucgua

SEQ ID NO: 1349642 - RNA, 19 nt, Homo sapiens
gaagaccaauagacaagau

SEQ ID NO: 1349643 - RNA, 19 nt, Homo sapiens
gaagaagaccaauagacaa

SEQ ID NO: 1349644 - RNA, 19 nt, Homo sapiens
caacggaaguggcagaagu

SEQ ID NO: 1349645 - RNA, 19 nt, Homo sapiens
caagcugggugugguauuu

SEQ ID NO: 1349646 - RNA, 19 nt, Homo sapiens
agacagagccucaggagaa

SEQ ID NO: 1349647 - RNA, 19 nt, Homo sapiens
ugacugauguccagaggaa

SEQ ID NO: 1349648 - RNA, 19 nt, Homo sapiens
gcugguggcuucuccaaga

SEQ ID NO: 1349649 - RNA, 19 nt, Homo sapiens
caaaggagugcaucucaaa

SEQ ID NO: 1349650 - RNA, 19 nt, Homo sapiens
gaucaacggcugcccagaa

SEQ ID NO: 1349651 - RNA, 19 nt, Homo sapiens
ggaaguggcagaaguacug

SEQ ID NO: 1349652 - RNA, 19 nt, Homo sapiens
uaagggacagcucuucaua

SEQ ID NO: 1349653 - RNA, 19 nt, Homo sapiens
gcaacucacccagcuaauu

SEQ ID NO: 1349654 - RNA, 19 nt, Homo sapiens
ccaaaggagugcaucucaa

SEQ ID NO: 1349655 - RNA, 19 nt, Homo sapiens
ggaagcagagagucaagaa

SEQ ID NO: 1349656 - RNA, 19 nt, Homo sapiens
ccaaagugcugggauuaca

SEQ ID NO: 1349657 - RNA, 19 nt, Homo sapiens
cuacagcuccuaucaugaa

SEQ ID NO: 1349658 - RNA, 19 nt, Homo sapiens
agacaggguuucaccaugu

SEQ ID NO: 1349659 - RNA, 19 nt, Homo sapiens
gauaggcgaguauuccaaa

SEQ ID NO: 1349660 - RNA, 19 nt, Homo sapiens
gccaggggcuuuugucaua

SEQ ID NO: 1349661 - RNA, 19 nt, Homo sapiens
caaagucugcagaauguga

SEQ ID NO: 1349662 - RNA, 19 nt, Homo sapiens
agaggccgcuucccuaaga

SEQ ID NO: 1349663 - RNA, 19 nt, Homo sapiens
cagugaggcugguugaaga

SEQ ID NO: 1349664 - RNA, 19 nt, Homo sapiens
aaacaggaauggauagacu

SEQ ID NO: 1349665 - RNA, 19 nt, Homo sapiens
gaagcaugcacaccucuga

SEQ ID NO: 1349666 - RNA, 19 nt, Homo sapiens
cauagaagaagaccaauag

SEQ ID NO: 1349667 - RNA, 19 nt, Homo sapiens
gagacugccugugcaccua

SEQ ID NO: 1349668 - RNA, 19 nt, Homo sapiens
gaucaaggugccacgauug

SEQ ID NO: 1349669 - RNA, 19 nt, Homo sapiens
ggccaucucucugugauuc

SEQ ID NO: 1349670 - RNA, 19 nt, Homo sapiens
aaacaucacccgagagcaa

SEQ ID NO: 1349671 - RNA, 19 nt, Homo sapiens
ugagaucucugggauguca

SEQ ID NO: 1349672 - RNA, 19 nt, Homo sapiens
ucugaagccuuggacauaa

SEQ ID NO: 1349673 - RNA, 19 nt, Homo sapiens
ggaccuugacuccuacauu

SEQ ID NO: 1349674 - RNA, 19 nt, Homo sapiens
gcccugcccugcaaacuca

SEQ ID NO: 1349675 - RNA, 19 nt, Homo sapiens
cgagucgucugccaaagga

SEQ ID NO: 1349676 - RNA, 19 nt, Homo sapiens
ucaguuuccucaaucauag

SEQ ID NO: 1349677 - RNA, 19 nt, Homo sapiens
acacgaagcagcagugaga

SEQ ID NO: 1349678 - RNA, 19 nt, Homo sapiens
cagagcaccaugucaauga

SEQ ID NO: 1349679 - RNA, 19 nt, Homo sapiens
ugccucagcuccugucuug

SEQ ID NO: 1349680 - RNA, 19 nt, Homo sapiens
ccgaguagcugggauuaca

SEQ ID NO: 1349681 - RNA, 19 nt, Homo sapiens
ccauaucuguuccucuguu

SEQ ID NO: 1349682 - RNA, 19 nt, Homo sapiens
gacaggguuucaccauguu

SEQ ID NO: 1349683 - RNA, 19 nt, Homo sapiens
ccugggagcuccugguuag

SEQ ID NO: 1349684 - RNA, 19 nt, Homo sapiens
gacucuauuuccuuccaua

SEQ ID NO: 1349685 - RNA, 19 nt, Homo sapiens
agaagaagaccaauagaca

SEQ ID NO: 1349686 - RNA, 19 nt, Homo sapiens
gaacugggaggugcagaug

SEQ ID NO: 1349687 - RNA, 19 nt, Homo sapiens
aaagaggccgcuucccuaa

SEQ ID NO: 1349688 - RNA, 19 nt, Homo sapiens
ggccugacgguuaugauuu

SEQ ID NO: 1349689 - RNA, 19 nt, Homo sapiens
ugccaaaguugcauuaucu

SEQ ID NO: 1349690 - RNA, 19 nt, Homo sapiens
gaugaggagcccuacuuug

SEQ ID NO: 1349691 - RNA, 19 nt, Homo sapiens
guacaagacccagugacuu

SEQ ID NO: 1349692 - RNA, 19 nt, Homo sapiens
caggaucucugugcuguca

SEQ ID NO: 1349693 - RNA, 19 nt, Homo sapiens
ccgcaggccugaguuccua

SEQ ID NO: 1349694 - RNA, 19 nt, Homo sapiens
gugcaacucacccagcuaa

SEQ ID NO: 1349695 - RNA, 19 nt, Homo sapiens
gcuccugguuagcaaguga

SEQ ID NO: 1349696 - RNA, 19 nt, Homo sapiens
gaaaguccagccaacucuu

SEQ ID NO: 1349697 - RNA, 19 nt, Homo sapiens
gcuccuccaugauucugaa

SEQ ID NO: 1349698 - RNA, 19 nt, Homo sapiens
uagacaagaucagcuguuc

SEQ ID NO: 1349699 - RNA, 19 nt, Homo sapiens
ucauagaagaagaccaaua

SEQ ID NO: 1349700 - RNA, 19 nt, Homo sapiens
agaccaaucuaugggacua

SEQ ID NO: 1349701 - RNA, 19 nt, Homo sapiens
ccaugucaaugagaaagaa

SEQ ID NO: 1349702 - RNA, 19 nt, Homo sapiens
aagcagagagucaagaaug

SEQ ID NO: 1349703 - RNA, 19 nt, Homo sapiens
cagcccagcuucuuuccau

SEQ ID NO: 1349704 - RNA, 19 nt, Homo sapiens
gggccucaguuuccucaau

SEQ ID NO: 1349705 - RNA, 19 nt, Homo sapiens
ugagaaagaaggaggaauc

SEQ ID NO: 1349706 - RNA, 19 nt, Homo sapiens
cuggagagccucaaucaga

SEQ ID NO: 1349707 - RNA, 19 nt, Homo sapiens
caacacacacacacacaca

SEQ ID NO: 1349708 - RNA, 19 nt, Homo sapiens
ucacccagcuaauuuugua

SEQ ID NO: 1349709 - RNA, 19 nt, Homo sapiens
aaucauagaagaagaccaa

SEQ ID NO: 1349710 - RNA, 19 nt, Homo sapiens
caaacccuccuggaucuuu

SEQ ID NO: 1349711 - RNA, 19 nt, Homo sapiens
aaacucaccaucccacaga

SEQ ID NO: 1349712 - RNA, 19 nt, Homo sapiens
ggaaaguccagccaacucu

SEQ ID NO: 1349713 - RNA, 19 nt, Homo sapiens
cugaagccuuggacauaaa

SEQ ID NO: 1349714 - RNA, 19 nt, Homo sapiens
gaagaccagagguaaacug

SEQ ID NO: 1349715 - RNA, 19 nt, Homo sapiens
agccagcccugccaaaguu

SEQ ID NO: 1349716 - RNA, 19 nt, Homo sapiens
gcccagagcaccaugucaa

SEQ ID NO: 1349717 - RNA, 19 nt, Homo sapiens
ugaugucagcuauauguuu

SEQ ID NO: 1349718 - RNA, 19 nt, Homo sapiens
agaucaaggugccacgauu

SEQ ID NO: 1349719 - RNA, 19 nt, Homo sapiens
gccugacgguuaugauuuc

SEQ ID NO: 1349720 - RNA, 19 nt, Homo sapiens
cagcuucuuuccauuccuu

SEQ ID NO: 1349721 - RNA, 19 nt, Homo sapiens
ucuauuuccuuccauaucu

SEQ ID NO: 1349722 - RNA, 19 nt, Homo sapiens
ggccucaguuuccucaauc

SEQ ID NO: 1349723 - RNA, 19 nt, Homo sapiens
cagaugaggagcccuacuu

SEQ ID NO: 1349724 - RNA, 19 nt, Homo sapiens
aauacugguuuaagccaaa

SEQ ID NO: 1349725 - RNA, 19 nt, Homo sapiens
aaagaaggaggaaucugaa

SEQ ID NO: 1349726 - RNA, 19 nt, Homo sapiens
uggagagccucaaucagau

SEQ ID NO: 1349727 - RNA, 19 nt, Homo sapiens
gaagcagagagucaagaau

SEQ ID NO: 1349728 - RNA, 19 nt, Homo sapiens
gcuugcagcuggugauggu

SEQ ID NO: 1349729 - RNA, 19 nt, Homo sapiens
gaacauagaugggaaaguu

SEQ ID NO: 1349730 - RNA, 19 nt, Homo sapiens
gaagaaggcaucaacaaua

SEQ ID NO: 1349731 - RNA, 19 nt, Homo sapiens
ugaagaagcugccgaguaa

SEQ ID NO: 1349732 - RNA, 19 nt, Homo sapiens
gaagggcccuggagaauga

SEQ ID NO: 1349733 - RNA, 19 nt, Homo sapiens
gaaauaaccaagcuuguaa

SEQ ID NO: 1349734 - RNA, 19 nt, Homo sapiens
ugaaggaccuggaguauga

SEQ ID NO: 1349735 - RNA, 19 nt, Homo sapiens
gcagggagcucgcagaaau

SEQ ID NO: 1349736 - RNA, 19 nt, Homo sapiens
ccacauggcuggagaggaa

SEQ ID NO: 1349737 - RNA, 19 nt, Homo sapiens
gaaguacgagggagaaaua

SEQ ID NO: 1349738 - RNA, 19 nt, Homo sapiens
gcaauaugaugcugaguug

SEQ ID NO: 1349739 - RNA, 19 nt, Homo sapiens
gaagguugcuugugucugu

SEQ ID NO: 1349740 - RNA, 19 nt, Homo sapiens
gagagaaagucaaauaaag

SEQ ID NO: 1349741 - RNA, 19 nt, Homo sapiens
ggagagagcugcgagacaa

SEQ ID NO: 1349742 - RNA, 19 nt, Homo sapiens
gagcaacacuucagagcaa

SEQ ID NO: 1349743 - RNA, 19 nt, Homo sapiens
gaguugagacugaaaguua

SEQ ID NO: 1349744 - RNA, 19 nt, Homo sapiens
ggcuaggacuuacuuaaua

SEQ ID NO: 1349745 - RNA, 19 nt, Homo sapiens
aggaaacgcugaagaagua

SEQ ID NO: 1349746 - RNA, 19 nt, Homo sapiens
ggaaauaaccaagcuugua

SEQ ID NO: 1349747 - RNA, 19 nt, Homo sapiens
ggagacagcuaagcagauu

SEQ ID NO: 1349748 - RNA, 19 nt, Homo sapiens
ggagaacagugaagaacuu

SEQ ID NO: 1349749 - RNA, 19 nt, Homo sapiens
gagcagaggugagaagaga

SEQ ID NO: 1349750 - RNA, 19 nt, Homo sapiens
ggaaagguucauagacuua

SEQ ID NO: 1349751 - RNA, 19 nt, Homo sapiens
gagcauagcaguucacaug

SEQ ID NO: 1349752 - RNA, 19 nt, Homo sapiens
acacauacauggccaaaug

SEQ ID NO: 1349753 - RNA, 19 nt, Homo sapiens
ggaacaaagugcagauuag

SEQ ID NO: 1349754 - RNA, 19 nt, Homo sapiens
gaaggaagacagagaaguu

SEQ ID NO: 1349755 - RNA, 19 nt, Homo sapiens
gaacuggacgggauauuga

SEQ ID NO: 1349756 - RNA, 19 nt, Homo sapiens
aagaaggcaucaacaauaa

SEQ ID NO: 1349757 - RNA, 19 nt, Homo sapiens
gaacuucagcuuccagaaa

SEQ ID NO: 1349758 - RNA, 19 nt, Homo sapiens
gguauaacaugcuaucguu

SEQ ID NO: 1349759 - RNA, 19 nt, Homo sapiens
gaauacagcagugaauuaa

SEQ ID NO: 1349760 - RNA, 19 nt, Homo sapiens
ccagagagcucaggaugaa

SEQ ID NO: 1349761 - RNA, 19 nt, Homo sapiens
agaacgagauggagaauga

SEQ ID NO: 1349762 - RNA, 19 nt, Homo sapiens
gaagagagagagaggauga

SEQ ID NO: 1349763 - RNA, 19 nt, Homo sapiens
ucaaagaucuauuggaaca

SEQ ID NO: 1349764 - RNA, 19 nt, Homo sapiens
uaaauaaccugccucuaca

SEQ ID NO: 1349765 - RNA, 19 nt, Homo sapiens
gcaucuauauugaguauuc

SEQ ID NO: 1349766 - RNA, 19 nt, Homo sapiens
gaaggaagcacugauaaug

SEQ ID NO: 1349767 - RNA, 19 nt, Homo sapiens
cggaguaccugauugaauu

SEQ ID NO: 1349768 - RNA, 19 nt, Homo sapiens
gaacacaggucacuuuuca

SEQ ID NO: 1349769 - RNA, 19 nt, Homo sapiens
gggaacagauggagcaguu

SEQ ID NO: 1349770 - RNA, 19 nt, Homo sapiens
gaagggagcucugauugag

SEQ ID NO: 1349771 - RNA, 19 nt, Homo sapiens
caacgucaaucgucaugaa

SEQ ID NO: 1349772 - RNA, 19 nt, Homo sapiens
caaaacacuugcaucauua

SEQ ID NO: 1349773 - RNA, 19 nt, Homo sapiens
ggugggaggugucugguaa

SEQ ID NO: 1349774 - RNA, 19 nt, Homo sapiens
aagcugagauuacagauga

SEQ ID NO: 1349775 - RNA, 19 nt, Homo sapiens
ccaagaagcugagauuaca

SEQ ID NO: 1349776 - RNA, 19 nt, Homo sapiens
guucaugcaucuauauuga

SEQ ID NO: 1349777 - RNA, 19 nt, Homo sapiens
cgaguaaagugcuggauga

SEQ ID NO: 1349778 - RNA, 19 nt, Homo sapiens
aagaaggacuuaagacuga

SEQ ID NO: 1349779 - RNA, 19 nt, Homo sapiens
uaauacagaugacaggaaa

SEQ ID NO: 1349780 - RNA, 19 nt, Homo sapiens
uaggguggcugguuuguaa

SEQ ID NO: 1349781 - RNA, 19 nt, Homo sapiens
gggaagcgaaacagaauua

SEQ ID NO: 1349782 - RNA, 19 nt, Homo sapiens
gagaggacccugugaguug

SEQ ID NO: 1349783 - RNA, 19 nt, Homo sapiens
agaaccagcuggaugagua

SEQ ID NO: 1349784 - RNA, 19 nt, Homo sapiens
caacagaacauuaaagaag

SEQ ID NO: 1349785 - RNA, 19 nt, Homo sapiens
ugugacagcuauucguuua

SEQ ID NO: 1349786 - RNA, 19 nt, Homo sapiens
gaugagagcaaaccuagaa

SEQ ID NO: 1349787 - RNA, 19 nt, Homo sapiens
ugagugaauuccuggauaa

SEQ ID NO: 1349788 - RNA, 19 nt, Homo sapiens
gagagagaaagucaaauaa

SEQ ID NO: 1349789 - RNA, 19 nt, Homo sapiens
gaagagagagagagagaga

SEQ ID NO: 1349790 - RNA, 19 nt, Homo sapiens
guaaagugcuggaugacau

SEQ ID NO: 1349791 - RNA, 19 nt, Homo sapiens
gagaaacaacucagauuug

SEQ ID NO: 1349792 - RNA, 19 nt, Homo sapiens
ggagauggcagacauuguu

SEQ ID NO: 1349793 - RNA, 19 nt, Homo sapiens
ggaagaagcaaccaagaau

SEQ ID NO: 1349794 - RNA, 19 nt, Homo sapiens
agucaaagaucuauuggaa

SEQ ID NO: 1349795 - RNA, 19 nt, Homo sapiens
ggaggaggcugaggaggaa

SEQ ID NO: 1349796 - RNA, 19 nt, Homo sapiens
ugaaggagcuggugaugca

SEQ ID NO: 1349797 - RNA, 19 nt, Homo sapiens
gaacagauggagcaguuga

SEQ ID NO: 1349798 - RNA, 19 nt, Homo sapiens
ggccaaaucuggugugaca

SEQ ID NO: 1349799 - RNA, 19 nt, Homo sapiens
ccacgguccuuuccaggua

SEQ ID NO: 1349800 - RNA, 19 nt, Homo sapiens
gaaccauggagcuguauuu

SEQ ID NO: 1349801 - RNA, 19 nt, Homo sapiens
ggaaaucgacagacuggaa

SEQ ID NO: 1349802 - RNA, 19 nt, Homo sapiens
ucucagaaaugcacgauga

SEQ ID NO: 1349803 - RNA, 19 nt, Homo sapiens
cuaagcagauucucuacaa

SEQ ID NO: 1349804 - RNA, 19 nt, Homo sapiens
gaagaaagaaacagaaguc

SEQ ID NO: 1349805 - RNA, 19 nt, Homo sapiens
gagauggaguuucauucuu

SEQ ID NO: 1349806 - RNA, 19 nt, Homo sapiens
cagcucaacuccaugaaga

SEQ ID NO: 1349807 - RNA, 19 nt, Homo sapiens
aaagacaguugaaggagaa

SEQ ID NO: 1349808 - RNA, 19 nt, Homo sapiens
gaaaugcaaagacaguuga

SEQ ID NO: 1349809 - RNA, 19 nt, Homo sapiens
ggacugaaaugcgcgugaa

SEQ ID NO: 1349810 - RNA, 19 nt, Homo sapiens
caacuuggucuuugagaaa

SEQ ID NO: 1349811 - RNA, 19 nt, Homo sapiens
gaagguagucaggaaagua

SEQ ID NO: 1349812 - RNA, 19 nt, Homo sapiens
guggaucaguuaauugaaa

SEQ ID NO: 1349813 - RNA, 19 nt, Homo sapiens
gcaagauuuccuuucaaua

SEQ ID NO: 1349814 - RNA, 19 nt, Homo sapiens
acaaucauccuguaucuuu

SEQ ID NO: 1349815 - RNA, 19 nt, Homo sapiens
ccugugaguuggugacaua

SEQ ID NO: 1349816 - RNA, 19 nt, Homo sapiens
gggaaagguucauagacuu

SEQ ID NO: 1349817 - RNA, 19 nt, Homo sapiens
gcuauggccuuguuugcuu

SEQ ID NO: 1349818 - RNA, 19 nt, Homo sapiens
agagucaccucaaagauga

SEQ ID NO: 1349819 - RNA, 19 nt, Homo sapiens
uaagaagguugaagaacga

SEQ ID NO: 1349820 - RNA, 19 nt, Homo sapiens
gcagaucgaggaccugaaa

SEQ ID NO: 1349821 - RNA, 19 nt, Homo sapiens
gagagaggaugagagcaaa

SEQ ID NO: 1349822 - RNA, 19 nt, Homo sapiens
gaacauuaaagaagagaga

SEQ ID NO: 1349823 - RNA, 19 nt, Homo sapiens
uaaccaagcuuguaauucc

SEQ ID NO: 1349824 - RNA, 19 nt, Homo sapiens
uaaugacgaugcuacuaaa

SEQ ID NO: 1349825 - RNA, 19 nt, Homo sapiens
gaaggcaucaacaauaaga

SEQ ID NO: 1349826 - RNA, 19 nt, Homo sapiens
gugagugaauuccuggaua

SEQ ID NO: 1349827 - RNA, 19 nt, Homo sapiens
uacaaugcccguugacuua

SEQ ID NO: 1349828 - RNA, 19 nt, Homo sapiens
gagcaggaucucaggguua

SEQ ID NO: 1349829 - RNA, 19 nt, Homo sapiens
gcaaauaacucauauagca

SEQ ID NO: 1349830 - RNA, 19 nt, Homo sapiens
gaacaacgcaucagagaaa

SEQ ID NO: 1349831 - RNA, 19 nt, Homo sapiens
caagagaacuucccagaug

SEQ ID NO: 1349832 - RNA, 19 nt, Homo sapiens
ggagaaaccuugagauuac

SEQ ID NO: 1349833 - RNA, 19 nt, Homo sapiens
gaaagaagcagccgcaguu

SEQ ID NO: 1349834 - RNA, 19 nt, Homo sapiens
ggaaggugcugccugaaga

SEQ ID NO: 1349835 - RNA, 19 nt, Homo sapiens
gcaaugaagcaguugguua

SEQ ID NO: 1349836 - RNA, 19 nt, Homo sapiens
gcaaugagagcuuaauaga

SEQ ID NO: 1349837 - RNA, 19 nt, Homo sapiens
gaagaagacacuuagaaga

SEQ ID NO: 1349838 - RNA, 19 nt, Homo sapiens
gaacauuugagccuuaauu

SEQ ID NO: 1349839 - RNA, 19 nt, Homo sapiens
uaaauuguguuuccagaga

SEQ ID NO: 1349840 - RNA, 19 nt, Homo sapiens
gaagacacuuagaagaaga

SEQ ID NO: 1349841 - RNA, 19 nt, Homo sapiens
aaacgaagagcaagaagua

SEQ ID NO: 1349842 - RNA, 19 nt, Homo sapiens
ugagaaggaucuaaacgaa

SEQ ID NO: 1349843 - RNA, 19 nt, Homo sapiens
ggaauuagaagaucaucaa

SEQ ID NO: 1349844 - RNA, 19 nt, Homo sapiens
gaacuggaauuagaagauc

SEQ ID NO: 1349845 - RNA, 19 nt, Homo sapiens
gagaagaagacacuuagaa

SEQ ID NO: 1349846 - RNA, 19 nt, Homo sapiens
gcaauuggcagucaacuuc

SEQ ID NO: 1349847 - RNA, 19 nt, Homo sapiens
ggacaucagggaccucuuu

SEQ ID NO: 1349848 - RNA, 19 nt, Homo sapiens
gaggagaaaccuugagauu

SEQ ID NO: 1349849 - RNA, 19 nt, Homo sapiens
gaagcugccuuuucauuaa

SEQ ID NO: 1349850 - RNA, 19 nt, Homo sapiens
agacuugacuuuccugcua

SEQ ID NO: 1349851 - RNA, 19 nt, Homo sapiens
gggacaaacucgucgauuc

SEQ ID NO: 1349852 - RNA, 19 nt, Homo sapiens
agaaggaucuaaacgaaga

SEQ ID NO: 1349853 - RNA, 19 nt, Homo sapiens
gagcagaaacugagagaga

SEQ ID NO: 1349854 - RNA, 19 nt, Homo sapiens
caaugaagcaguugguuaa

SEQ ID NO: 1349855 - RNA, 19 nt, Homo sapiens
gaugaccaguuuccaaaug

SEQ ID NO: 1349856 - RNA, 19 nt, Homo sapiens
aaagugaguuugcaagaga

SEQ ID NO: 1349857 - RNA, 19 nt, Homo sapiens
gaggagagccagaaagaug

SEQ ID NO: 1349858 - RNA, 19 nt, Homo sapiens
ccaagaauccagacaaaga

SEQ ID NO: 1349859 - RNA, 19 nt, Homo sapiens
gaaagugaguuugcaagag

SEQ ID NO: 1349860 - RNA, 19 nt, Homo sapiens
agaagcagccgcaguuuaa

SEQ ID NO: 1349861 - RNA, 19 nt, Homo sapiens
caaacucgucgauuccuua

SEQ ID NO: 1349862 - RNA, 19 nt, Homo sapiens
ucaccgagcugaugcaagu

SEQ ID NO: 1349863 - RNA, 19 nt, Homo sapiens
gaagaaagaagcuagaaaa

SEQ ID NO: 1349864 - RNA, 19 nt, Homo sapiens
aaugagagcuuaauagaac

SEQ ID NO: 1349865 - RNA, 19 nt, Homo sapiens
uauagcagguguuaauuca

SEQ ID NO: 1349866 - RNA, 19 nt, Homo sapiens
gaaagaggagaaaccuuga

SEQ ID NO: 1349867 - RNA, 19 nt, Homo sapiens
cagaugaccagcauuguuu

SEQ ID NO: 1349868 - RNA, 19 nt, Homo sapiens
cagcuuuccuugcaguuaa

SEQ ID NO: 1349869 - RNA, 19 nt, Homo sapiens
uaauuuaccaggugcauuu

SEQ ID NO: 1349870 - RNA, 19 nt, Homo sapiens
ccagaaagaugagaaggau

SEQ ID NO: 1349871 - RNA, 19 nt, Homo sapiens
uagcagguguuaauucaau

SEQ ID NO: 1349872 - RNA, 19 nt, Homo sapiens
gcagaugaccagcauuguu

SEQ ID NO: 1349873 - RNA, 19 nt, Homo sapiens
gaagaagaaagaagcuaga

SEQ ID NO: 1349874 - RNA, 19 nt, Homo sapiens
auagaacauuugagccuua

SEQ ID NO: 1349875 - RNA, 19 nt, Homo sapiens
acacuuagaagaagaaaga

SEQ ID NO: 1349876 - RNA, 19 nt, Homo sapiens
gagcuuaauagaacauuug

SEQ ID NO: 1349877 - RNA, 19 nt, Homo sapiens
accuugagauuacugauua

SEQ ID NO: 1349878 - RNA, 19 nt, Homo sapiens
gcaguugguuaagcaagaa

SEQ ID NO: 1349879 - RNA, 19 nt, Homo sapiens
aagaagacacuuagaagaa

SEQ ID NO: 1349880 - RNA, 19 nt, Homo sapiens
caagaauccagacaaagaa

SEQ ID NO: 1349881 - RNA, 19 nt, Homo sapiens
gcagaagaccauguuguug

SEQ ID NO: 1349882 - RNA, 19 nt, Homo sapiens
ccacacuccucgagaaagu

SEQ ID NO: 1349883 - RNA, 19 nt, Homo sapiens
ucauauagcagguguuaau

SEQ ID NO: 1349884 - RNA, 19 nt, Homo sapiens
agccgcaguuuaaagauua

SEQ ID NO: 1349885 - RNA, 19 nt, Homo sapiens
cagccgcaguuuaaagauu

SEQ ID NO: 1349886 - RNA, 19 nt, Homo sapiens
ccaagguucuuccagagau

SEQ ID NO: 1349887 - RNA, 19 nt, Homo sapiens
guuauaccuuacugcauuu

SEQ ID NO: 1349888 - RNA, 19 nt, Homo sapiens
gagagaaaaugcucaagga

SEQ ID NO: 1349889 - RNA, 19 nt, Homo sapiens
gcagaaacugagagagaaa

SEQ ID NO: 1349890 - RNA, 19 nt, Homo sapiens
aaagcagacuggagcagaa

SEQ ID NO: 1349891 - RNA, 19 nt, Homo sapiens
ggccugcacucgcucauuc

SEQ ID NO: 1349892 - RNA, 19 nt, Homo sapiens
uuuaccaggugcauuuaua

SEQ ID NO: 1349893 - RNA, 19 nt, Homo sapiens
caagguucuuccagagauu

SEQ ID NO: 1349894 - RNA, 19 nt, Homo sapiens
ggaacuggaauuagaagau

SEQ ID NO: 1349895 - RNA, 19 nt, Homo sapiens
ugaagcaguugguuaagca

SEQ ID NO: 1349896 - RNA, 19 nt, Homo sapiens
caaugagagcuuaauagaa

SEQ ID NO: 1349897 - RNA, 19 nt, Homo sapiens
aggagaaaccuugagauua

SEQ ID NO: 1349898 - RNA, 19 nt, Homo sapiens
ggaacaacgcaucagagaa

SEQ ID NO: 1349899 - RNA, 19 nt, Homo sapiens
gaacuucccagaugcuucu

SEQ ID NO: 1349900 - RNA, 19 nt, Homo sapiens
cauggcagcuucccaaggu

SEQ ID NO: 1349901 - RNA, 19 nt, Homo sapiens
gcaagagaacuucccagau

SEQ ID NO: 1349902 - RNA, 19 nt, Homo sapiens
gagcagaagaccauguugu

SEQ ID NO: 1349903 - RNA, 19 nt, Homo sapiens
ccuagaaagugacacaaag

SEQ ID NO: 1349904 - RNA, 19 nt, Homo sapiens
ggaaugguuuaagcugguu

SEQ ID NO: 1349905 - RNA, 19 nt, Homo sapiens
uagaacauuugagccuuaa

SEQ ID NO: 1349906 - RNA, 19 nt, Homo sapiens
agaagaccauguuguugga

SEQ ID NO: 1349907 - RNA, 19 nt, Homo sapiens
gagaguuuccuccaagaau

SEQ ID NO: 1349908 - RNA, 19 nt, Homo sapiens
caaggucuuuccugcacuu

SEQ ID NO: 1349909 - RNA, 19 nt, Homo sapiens
aaaccaguccucagccuuu

SEQ ID NO: 1349910 - RNA, 19 nt, Homo sapiens
aagaagcagccgcaguuua

SEQ ID NO: 1349911 - RNA, 19 nt, Homo sapiens
gcgaggagaagcagauuca

SEQ ID NO: 1349912 - RNA, 19 nt, Homo sapiens
gaggaggccgugugcuaaa

SEQ ID NO: 1349913 - RNA, 19 nt, Homo sapiens
uuguauggaugaccaguuu

SEQ ID NO: 1349914 - RNA, 19 nt, Homo sapiens
gcaagugauugagcaaagg

SEQ ID NO: 1349915 - RNA, 19 nt, Homo sapiens
caauccagggugaauuuaa

SEQ ID NO: 1349916 - RNA, 19 nt, Homo sapiens
gaagcagccgcaguuuaaa

SEQ ID NO: 1349917 - RNA, 19 nt, Homo sapiens
gggucuuucugcaggauuu

SEQ ID NO: 1349918 - RNA, 19 nt, Homo sapiens
cgaagagcaagaaguauuc

SEQ ID NO: 1349919 - RNA, 19 nt, Homo sapiens
agucggagcuccuaaucau

SEQ ID NO: 1349920 - RNA, 19 nt, Homo sapiens
gaaaagugcugagaauggu

SEQ ID NO: 1349921 - RNA, 19 nt, Homo sapiens
ggagaagaagacacuuaga

SEQ ID NO: 1349922 - RNA, 19 nt, Homo sapiens
uagaggaggccgugugcua

SEQ ID NO: 1349923 - RNA, 19 nt, Homo sapiens
aauccagggugaauuuaau

SEQ ID NO: 1349924 - RNA, 19 nt, Homo sapiens
agaagacacuuagaagaag

SEQ ID NO: 1349925 - RNA, 19 nt, Homo sapiens
ccagaaaagugcugagaau

SEQ ID NO: 1349926 - RNA, 19 nt, Homo sapiens
gaccggaucaggccaagug

SEQ ID NO: 1349927 - RNA, 19 nt, Homo sapiens
gagcugaugcaagugauug

SEQ ID NO: 1349928 - RNA, 19 nt, Homo sapiens
aaggagaagaagacacuua

SEQ ID NO: 1349929 - RNA, 19 nt, Homo sapiens
ggagugaggucguggguua

SEQ ID NO: 1349930 - RNA, 19 nt, Homo sapiens
cggaugggcucagguaaua

SEQ ID NO: 1349931 - RNA, 19 nt, Homo sapiens
gggcucagguaauaaagaa

SEQ ID NO: 1349932 - RNA, 19 nt, Homo sapiens
ggaagcggguggacagcaa

SEQ ID NO: 1349933 - RNA, 19 nt, Homo sapiens
ggaaguaacauccuuugca

SEQ ID NO: 1349934 - RNA, 19 nt, Homo sapiens
gacugcagcugccaucgaa

SEQ ID NO: 1349935 - RNA, 19 nt, Homo sapiens
ggugaacccugccaagaag

SEQ ID NO: 1349936 - RNA, 19 nt, Homo sapiens
guacaaaggccagaaacug

SEQ ID NO: 1349937 - RNA, 19 nt, Homo sapiens
cugcagggcuccagcaaug

SEQ ID NO: 1349938 - RNA, 19 nt, Homo sapiens
gaugggcucagguaauaaa

SEQ ID NO: 1349939 - RNA, 19 nt, Homo sapiens
aguccaagaucucgccuuu

SEQ ID NO: 1349940 - RNA, 19 nt, Homo sapiens
gggccucugucaaguacaa

SEQ ID NO: 1349941 - RNA, 19 nt, Homo sapiens
caaguacaaaggccagaaa

SEQ ID NO: 1349942 - RNA, 19 nt, Homo sapiens
uccaagaucucgccuuucu

SEQ ID NO: 1349943 - RNA, 19 nt, Homo sapiens
uugcagccaucaacaaguu

SEQ ID NO: 1349944 - RNA, 19 nt, Homo sapiens
ggacgucaacagccagaug

SEQ ID NO: 1349945 - RNA, 19 nt, Homo sapiens
gcacaccuaccucgacaag

SEQ ID NO: 1349946 - RNA, 19 nt, Homo sapiens
aggaguugcugauggaaga

SEQ ID NO: 1349947 - RNA, 19 nt, Homo sapiens
ucgacaagcuuaagaucuc

SEQ ID NO: 1349948 - RNA, 19 nt, Homo sapiens
acaccuaccucgacaagcu

SEQ ID NO: 1349949 - RNA, 19 nt, Homo sapiens
ggaggaggacgaggacgaa

SEQ ID NO: 1349950 - RNA, 19 nt, Homo sapiens
ggagccaggagcacaccua

SEQ ID NO: 1349951 - RNA, 19 nt, Homo sapiens
gaaacuggacaaguacaag

SEQ ID NO: 1349952 - RNA, 19 nt, Homo sapiens
gcugggccucugucaagua

SEQ ID NO: 1349953 - RNA, 19 nt, Homo sapiens
gguggaaguaacauccuuu

SEQ ID NO: 1349954 - RNA, 19 nt, Homo sapiens
aggaggaguugcugaugga

SEQ ID NO: 1349955 - RNA, 19 nt, Homo sapiens
ggaggaggaguugcugaug

SEQ ID NO: 1349956 - RNA, 19 nt, Homo sapiens
acgcacagauggacuacca

SEQ ID NO: 1349957 - RNA, 19 nt, Homo sapiens
gaugccuccucccgagaug

SEQ ID NO: 1349958 - RNA, 19 nt, Homo sapiens
gcucagguaauaaagaaac

SEQ ID NO: 1349959 - RNA, 19 nt, Homo sapiens
ugcgggugcuccucaaaga

SEQ ID NO: 1349960 - RNA, 19 nt, Homo sapiens
ggaggaggaggacguucug

SEQ ID NO: 1349961 - RNA, 19 nt, Homo sapiens
ggaugggcucagguaauaa

SEQ ID NO: 1349962 - RNA, 19 nt, Homo sapiens
gaucuaccagagccuguuc

SEQ ID NO: 1349963 - RNA, 19 nt, Homo sapiens
ccagacggaaggaucaugu

SEQ ID NO: 1349964 - RNA, 19 nt, Homo sapiens
gggcuccaguugucuugag

SEQ ID NO: 1349965 - RNA, 19 nt, Homo sapiens
agaugcugcugguggaguu

SEQ ID NO: 1349966 - RNA, 19 nt, Homo sapiens
ugccaucucugcaggacau

SEQ ID NO: 1349967 - RNA, 19 nt, Homo sapiens
ugagagcccagccagugaa

SEQ ID NO: 1349968 - RNA, 19 nt, Homo sapiens
gaaugaagcugcagauuua

SEQ ID NO: 1349969 - RNA, 19 nt, Homo sapiens
gaagagagcuccaguuuau

SEQ ID NO: 1349970 - RNA, 19 nt, Homo sapiens
gaaagucagugccacauua

SEQ ID NO: 1349971 - RNA, 19 nt, Homo sapiens
ucaaagaaccucuguauua

SEQ ID NO: 1349972 - RNA, 19 nt, Homo sapiens
gaagaugauuugacaguaa

SEQ ID NO: 1349973 - RNA, 19 nt, Homo sapiens
ggaaauagcgcuucugaaa

SEQ ID NO: 1349974 - RNA, 19 nt, Homo sapiens
ggaagugguuucuauguuu

SEQ ID NO: 1349975 - RNA, 19 nt, Homo sapiens
gagaacagcaggucuaaua

SEQ ID NO: 1349976 - RNA, 19 nt, Homo sapiens
cuacaagucuuucacauuu

SEQ ID NO: 1349977 - RNA, 19 nt, Homo sapiens
gaaauggucuaaugauugu

SEQ ID NO: 1349978 - RNA, 19 nt, Homo sapiens
gaaaugcccugcuucuguu

SEQ ID NO: 1349979 - RNA, 19 nt, Homo sapiens
ggaaugaagcugcagauuu

SEQ ID NO: 1349980 - RNA, 19 nt, Homo sapiens
ggaacaaucuuaccacaca

SEQ ID NO: 1349981 - RNA, 19 nt, Homo sapiens
gcuagaaucucauguuuua

SEQ ID NO: 1349982 - RNA, 19 nt, Homo sapiens
gagauuuccuugauuaaga

SEQ ID NO: 1349983 - RNA, 19 nt, Homo sapiens
gauguacaauucaguguuu

SEQ ID NO: 1349984 - RNA, 19 nt, Homo sapiens
ggacaaagcaaaucacaug

SEQ ID NO: 1349985 - RNA, 19 nt, Homo sapiens
ccacagacauagacaaaga

SEQ ID NO: 1349986 - RNA, 19 nt, Homo sapiens
ggaaauggucuaaugauug

SEQ ID NO: 1349987 - RNA, 19 nt, Homo sapiens
ggugcuagguagaaaguua

SEQ ID NO: 1349988 - RNA, 19 nt, Homo sapiens
gaacagcaggucuaauauu

SEQ ID NO: 1349989 - RNA, 19 nt, Homo sapiens
guacucuguucuuugauua

SEQ ID NO: 1349990 - RNA, 19 nt, Homo sapiens
aguaauagcuuggagauuu

SEQ ID NO: 1349991 - RNA, 19 nt, Homo sapiens
gaaagcaguacauggauaa

SEQ ID NO: 1349992 - RNA, 19 nt, Homo sapiens
gcaaguagcaagccuagaa

SEQ ID NO: 1349993 - RNA, 19 nt, Homo sapiens
aaauauggaugaagacgua

SEQ ID NO: 1349994 - RNA, 19 nt, Homo sapiens
gcuaguaauuggagauaaa

SEQ ID NO: 1349995 - RNA, 19 nt, Homo sapiens
cauaguggauccuaaagaa

SEQ ID NO: 1349996 - RNA, 19 nt, Homo sapiens
gcacugugauucaugguau

SEQ ID NO: 1349997 - RNA, 19 nt, Homo sapiens
ggcaacaaaugagagauua

SEQ ID NO: 1349998 - RNA, 19 nt, Homo sapiens
auaauuaccugcacuguga

SEQ ID NO: 1349999 - RNA, 19 nt, Homo sapiens
caacaagggcuuuauuaau

SEQ ID NO: 1350000 - RNA, 19 nt, Homo sapiens
ggaaaaguauucaguggua

SEQ ID NO: 1350001 - RNA, 19 nt, Homo sapiens
uugcaaugcucaagaguua

SEQ ID NO: 1350002 - RNA, 19 nt, Homo sapiens
gaauccaaauccagauaaa

SEQ ID NO: 1350003 - RNA, 19 nt, Homo sapiens
caaagaaccucuguauuac

SEQ ID NO: 1350004 - RNA, 19 nt, Homo sapiens
gaaugcaguuuccuagaga

SEQ ID NO: 1350005 - RNA, 19 nt, Homo sapiens
gaauagagaaagaggaauu

SEQ ID NO: 1350006 - RNA, 19 nt, Homo sapiens
agcaguacauggauaauua

SEQ ID NO: 1350007 - RNA, 19 nt, Homo sapiens
ugaaagcaguacauggaua

SEQ ID NO: 1350008 - RNA, 19 nt, Homo sapiens
gcaacagacugaagaugau

SEQ ID NO: 1350009 - RNA, 19 nt, Homo sapiens
gcuaaaugcugaagaacau

SEQ ID NO: 1350010 - RNA, 19 nt, Homo sapiens
gggagcacaucgcaacuuu

SEQ ID NO: 1350011 - RNA, 19 nt, Homo sapiens
cugaagaacugaauccaaa

SEQ ID NO: 1350012 - RNA, 19 nt, Homo sapiens
ggaauuggauaugaaagga

SEQ ID NO: 1350013 - RNA, 19 nt, Homo sapiens
ugcaauagcugaacguuug

SEQ ID NO: 1350014 - RNA, 19 nt, Homo sapiens
ggaaaacucuauucaucua

SEQ ID NO: 1350015 - RNA, 19 nt, Homo sapiens
uaaauauugucgcauguug

SEQ ID NO: 1350016 - RNA, 19 nt, Homo sapiens
auugaaagcucucaggaua

SEQ ID NO: 1350017 - RNA, 19 nt, Homo sapiens
guaaagcuguggaaugaag

SEQ ID NO: 1350018 - RNA, 19 nt, Homo sapiens
uaaggaggacauucaaaua

SEQ ID NO: 1350019 - RNA, 19 nt, Homo sapiens
gaagugguuucuauguuuc

SEQ ID NO: 1350020 - RNA, 19 nt, Homo sapiens
aacagcaggucuaauauuu

SEQ ID NO: 1350021 - RNA, 19 nt, Homo sapiens
acuguaaccucuuaaguuu

SEQ ID NO: 1350022 - RNA, 19 nt, Homo sapiens
gcacaucgcaacuuucaau

SEQ ID NO: 1350023 - RNA, 19 nt, Homo sapiens
ggaagcaaccaguaccuuu

SEQ ID NO: 1350024 - RNA, 19 nt, Homo sapiens
aaagaggaauuggauauga

SEQ ID NO: 1350025 - RNA, 19 nt, Homo sapiens
gagaaaacaucuuaagaga

SEQ ID NO: 1350026 - RNA, 19 nt, Homo sapiens
cuggaggucuggacaguua

SEQ ID NO: 1350027 - RNA, 19 nt, Homo sapiens
cuaaagaaaugcccugcuu

SEQ ID NO: 1350028 - RNA, 19 nt, Homo sapiens
gcaguuuccuagagaguau

SEQ ID NO: 1350029 - RNA, 19 nt, Homo sapiens
ggccagagcuaguaauugg

SEQ ID NO: 1350030 - RNA, 19 nt, Homo sapiens
gcgcggaccuuucaacaag

SEQ ID NO: 1350031 - RNA, 19 nt, Homo sapiens
gacaauuggaguccuaaua

SEQ ID NO: 1350032 - RNA, 19 nt, Homo sapiens
ggcagaagauuaagauaag

SEQ ID NO: 1350033 - RNA, 19 nt, Homo sapiens
caaaucacauggccaaguc

SEQ ID NO: 1350034 - RNA, 19 nt, Homo sapiens
gaagauaguacuagcaagu

SEQ ID NO: 1350035 - RNA, 19 nt, Homo sapiens
gaacaaucuuaccacacaa

SEQ ID NO: 1350036 - RNA, 19 nt, Homo sapiens
gaaucuucuuuccauagua

SEQ ID NO: 1350037 - RNA, 19 nt, Homo sapiens
cgauggagguggcggcuaa

SEQ ID NO: 1350038 - RNA, 19 nt, Homo sapiens
gcugaacguuugaugcauu

SEQ ID NO: 1350039 - RNA, 19 nt, Homo sapiens
guaauagcuuggagauuuc

SEQ ID NO: 1350040 - RNA, 19 nt, Homo sapiens
agauggaacuggaagauug

SEQ ID NO: 1350041 - RNA, 19 nt, Homo sapiens
aaagcucucaggauaauua

SEQ ID NO: 1350042 - RNA, 19 nt, Homo sapiens
ugaaagcucucaggauaau

SEQ ID NO: 1350043 - RNA, 19 nt, Homo sapiens
gagacuagauaccaaacau

SEQ ID NO: 1350044 - RNA, 19 nt, Homo sapiens
gaugaggauugcauacaug

SEQ ID NO: 1350045 - RNA, 19 nt, Homo sapiens
gcauuugaccucugaagaa

SEQ ID NO: 1350046 - RNA, 19 nt, Homo sapiens
ggaaagagagacuagauac

SEQ ID NO: 1350047 - RNA, 19 nt, Homo sapiens
gcagaagauuaagauaaga

SEQ ID NO: 1350048 - RNA, 19 nt, Homo sapiens
guauguaccuggaaauuuu

SEQ ID NO: 1350049 - RNA, 19 nt, Homo sapiens
uauaguuucuugccacaaa

SEQ ID NO: 1350050 - RNA, 19 nt, Homo sapiens
uuggagauuuccuugauua

SEQ ID NO: 1350051 - RNA, 19 nt, Homo sapiens
agacgaaucuucuuuccau

SEQ ID NO: 1350052 - RNA, 19 nt, Homo sapiens
cauuauccaucacugcaua

SEQ ID NO: 1350053 - RNA, 19 nt, Homo sapiens
ccuauaagauguacaggau

SEQ ID NO: 1350054 - RNA, 19 nt, Homo sapiens
ucaacaagggcuuuauuaa

SEQ ID NO: 1350055 - RNA, 19 nt, Homo sapiens
ugauggaaauggucuaaug

SEQ ID NO: 1350056 - RNA, 19 nt, Homo sapiens
cgagagguguuucgacuuc

SEQ ID NO: 1350057 - RNA, 19 nt, Homo sapiens
cuacaagugcuaagaauau

SEQ ID NO: 1350058 - RNA, 19 nt, Homo sapiens
gagccgugauuucaagcua

SEQ ID NO: 1350059 - RNA, 19 nt, Homo sapiens
gaacguuugaugcauuuga

SEQ ID NO: 1350060 - RNA, 19 nt, Homo sapiens
guacuaaggaggacauuca

SEQ ID NO: 1350061 - RNA, 19 nt, Homo sapiens
ugaagaugauuugacagua

SEQ ID NO: 1350062 - RNA, 19 nt, Homo sapiens
uuuaagaggcagaagauua

SEQ ID NO: 1350063 - RNA, 19 nt, Homo sapiens
gauuucacauuauccauca

SEQ ID NO: 1350064 - RNA, 19 nt, Homo sapiens
gaaaccaaugauccuauuu

SEQ ID NO: 1350065 - RNA, 19 nt, Homo sapiens
gagcacaucgcaacuuuca

SEQ ID NO: 1350066 - RNA, 19 nt, Homo sapiens
uugagccgcugccuuguua

SEQ ID NO: 1350067 - RNA, 19 nt, Homo sapiens
ggacauucaaauacaguuu

SEQ ID NO: 1350068 - RNA, 19 nt, Homo sapiens
ggacugaggaugccaauga

SEQ ID NO: 1350069 - RNA, 19 nt, Homo sapiens
uuacacaucuugauuggaa

SEQ ID NO: 1350070 - RNA, 19 nt, Homo sapiens
caagaucucaggagcuuua

SEQ ID NO: 1350071 - RNA, 19 nt, Homo sapiens
caaguucaauggugucuga

SEQ ID NO: 1350072 - RNA, 19 nt, Homo sapiens
gggauucucuguaucauca

SEQ ID NO: 1350073 - RNA, 19 nt, Homo sapiens
uggaggagcugcugaaaga

SEQ ID NO: 1350074 - RNA, 19 nt, Homo sapiens
gaaagaguaccacagcaaa

SEQ ID NO: 1350075 - RNA, 19 nt, Homo sapiens
ucacagagaagaaagagaa

SEQ ID NO: 1350076 - RNA, 19 nt, Homo sapiens
uuugaaaucuggaguguau

SEQ ID NO: 1350077 - RNA, 19 nt, Homo sapiens
agaagcaggugaacuuaau

SEQ ID NO: 1350078 - RNA, 19 nt, Homo sapiens
gacagagcgucuccaucua

SEQ ID NO: 1350079 - RNA, 19 nt, Homo sapiens
ggagacccaucaacucauc

SEQ ID NO: 1350080 - RNA, 19 nt, Homo sapiens
gaacaaggccgaggagaac

SEQ ID NO: 1350081 - RNA, 19 nt, Homo sapiens
gugagucccuggguucuaa

SEQ ID NO: 1350082 - RNA, 19 nt, Homo sapiens
gaggagacccaucaacuca

SEQ ID NO: 1350083 - RNA, 19 nt, Homo sapiens
ggccaucgcuggguccauu

SEQ ID NO: 1350084 - RNA, 19 nt, Homo sapiens
ggccuaacacaaauucaua

SEQ ID NO: 1350085 - RNA, 19 nt, Homo sapiens
cagagcgucuccaucuaaa

SEQ ID NO: 1350086 - RNA, 19 nt, Homo sapiens
cagcagcgguggugagaca

SEQ ID NO: 1350087 - RNA, 19 nt, Homo sapiens
gcgcagcaccugaggaaau

SEQ ID NO: 1350088 - RNA, 19 nt, Homo sapiens
ccacacccuugccucugua

SEQ ID NO: 1350089 - RNA, 19 nt, Homo sapiens
gaagcaggugaacuuaauu

SEQ ID NO: 1350090 - RNA, 19 nt, Homo sapiens
aaagaagcaggugaacuua

SEQ ID NO: 1350091 - RNA, 19 nt, Homo sapiens
ccuaggagcccacgggauu

SEQ ID NO: 1350092 - RNA, 19 nt, Homo sapiens
gagcagcggacaaguucaa

SEQ ID NO: 1350093 - RNA, 19 nt, Homo sapiens
cauggcaacucgagauaca

SEQ ID NO: 1350094 - RNA, 19 nt, Homo sapiens
gaauggggccuaacacaaa

SEQ ID NO: 1350095 - RNA, 19 nt, Homo sapiens
cccaucaacucaucugguu

SEQ ID NO: 1350096 - RNA, 19 nt, Homo sapiens
cccaggauauggcuuugaa

SEQ ID NO: 1350097 - RNA, 19 nt, Homo sapiens
acagagcgucuccaucuaa

SEQ ID NO: 1350098 - RNA, 19 nt, Homo sapiens
aaaucuggaguguaucuua

SEQ ID NO: 1350099 - RNA, 19 nt, Homo sapiens
gagcaaccuggucaucuga

SEQ ID NO: 1350100 - RNA, 19 nt, Homo sapiens
gggcaccucuggguacuca

SEQ ID NO: 1350101 - RNA, 19 nt, Homo sapiens
uaccaucccucccauuagu

SEQ ID NO: 1350102 - RNA, 19 nt, Homo sapiens
ucuaccaucccucccauua

SEQ ID NO: 1350103 - RNA, 19 nt, Homo sapiens
ggagguggaggcaguggaa

SEQ ID NO: 1350104 - RNA, 19 nt, Homo sapiens
ccuuccauguguugaauaa

SEQ ID NO: 1350105 - RNA, 19 nt, Homo sapiens
ggacugugaggaccgagaa

SEQ ID NO: 1350106 - RNA, 19 nt, Homo sapiens
ggcggaagccguacaaagu

SEQ ID NO: 1350107 - RNA, 19 nt, Homo sapiens
ugaaagaguaccacagcaa

SEQ ID NO: 1350108 - RNA, 19 nt, Homo sapiens
cuucagcucuuuguagguu

SEQ ID NO: 1350109 - RNA, 19 nt, Homo sapiens
guucuaaucuugggcacau

SEQ ID NO: 1350110 - RNA, 19 nt, Homo sapiens
cugaggaaaugcacugugu

SEQ ID NO: 1350111 - RNA, 19 nt, Homo sapiens
gggccucagugguuucugu

SEQ ID NO: 1350112 - RNA, 19 nt, Homo sapiens
cagcagacgagacagcaaa

SEQ ID NO: 1350113 - RNA, 19 nt, Homo sapiens
aggagcugcugaaagagua

SEQ ID NO: 1350114 - RNA, 19 nt, Homo sapiens
gcauguggcccaggauaug

SEQ ID NO: 1350115 - RNA, 19 nt, Homo sapiens
ccacagagagggacagcau

SEQ ID NO: 1350116 - RNA, 19 nt, Homo sapiens
cccaagaucucaggagcuu

SEQ ID NO: 1350117 - RNA, 19 nt, Homo sapiens
caggauauggcuuugaaug

SEQ ID NO: 1350118 - RNA, 19 nt, Homo sapiens
gggcagggcacauuaugca

SEQ ID NO: 1350119 - RNA, 19 nt, Homo sapiens
ggaacucaaauauuucaag

SEQ ID NO: 1350120 - RNA, 19 nt, Homo sapiens
gcccagaggagacccauca

SEQ ID NO: 1350121 - RNA, 19 nt, Homo sapiens
gaucccggcaggacuguga

SEQ ID NO: 1350122 - RNA, 19 nt, Homo sapiens
gccacacccuugccucugu

SEQ ID NO: 1350123 - RNA, 19 nt, Homo sapiens
gcuuugaaaucuggagugu

SEQ ID NO: 1350124 - RNA, 19 nt, Homo sapiens
aagcaggugaacuuaauuu

SEQ ID NO: 1350125 - RNA, 19 nt, Homo sapiens
ugacaucaacaacccuuug

SEQ ID NO: 1350126 - RNA, 19 nt, Homo sapiens
uauugaaacucaccauugc

SEQ ID NO: 1350127 - RNA, 19 nt, Homo sapiens
agaacaaggccgaggagaa

SEQ ID NO: 1350128 - RNA, 19 nt, Homo sapiens
gcggaagccguacaaagug

SEQ ID NO: 1350129 - RNA, 19 nt, Homo sapiens
cagcgcagcaccugaggaa

SEQ ID NO: 1350130 - RNA, 19 nt, Homo sapiens
ccacgggauucucuguauc

SEQ ID NO: 1350131 - RNA, 19 nt, Homo sapiens
gccuaacacaaauucauaa

SEQ ID NO: 1350132 - RNA, 19 nt, Homo sapiens
gcugagcaccaacacauag

SEQ ID NO: 1350133 - RNA, 19 nt, Homo sapiens
ccauugcccuauccuugug

SEQ ID NO: 1350134 - RNA, 19 nt, Homo sapiens
gauacacucuguggagacu

SEQ ID NO: 1350135 - RNA, 19 nt, Homo sapiens
ggcauggcaacucgagaua

SEQ ID NO: 1350136 - RNA, 19 nt, Homo sapiens
agagcaaccuggucaucug

SEQ ID NO: 1350137 - RNA, 19 nt, Homo sapiens
gaggagcugcugaaagagu

SEQ ID NO: 1350138 - RNA, 19 nt, Homo sapiens
aaaagaagcaggugaacuu

SEQ ID NO: 1350139 - RNA, 19 nt, Homo sapiens
ucccuggguucuaaucuug

SEQ ID NO: 1350140 - RNA, 19 nt, Homo sapiens
gcaccucuggguacucaug

SEQ ID NO: 1350141 - RNA, 19 nt, Homo sapiens
aagaagcaggugaacuuaa

SEQ ID NO: 1350142 - RNA, 19 nt, Homo sapiens
gggcauggcaacucgagau

SEQ ID NO: 1350143 - RNA, 19 nt, Homo sapiens
uuauugaaacucaccauug

SEQ ID NO: 1350144 - RNA, 19 nt, Homo sapiens
cccacgggauucucuguau

SEQ ID NO: 1350145 - RNA, 19 nt, Homo sapiens
ugcaaaggcugagcaccaa

SEQ ID NO: 1350146 - RNA, 19 nt, Homo sapiens
caaaggcugagcaccaaca

SEQ ID NO: 1350147 - RNA, 19 nt, Homo sapiens
cgcagcaccugaggaaaug

SEQ ID NO: 1350148 - RNA, 19 nt, Homo sapiens
uuaacccagucuauccaaa

SEQ ID NO: 1350149 - RNA, 19 nt, Homo sapiens
gcuguagccagaagaagug

SEQ ID NO: 1350150 - RNA, 19 nt, Homo sapiens
cagaggagacccaucaacu

SEQ ID NO: 1350151 - RNA, 19 nt, Homo sapiens
ccccauuccuugguaauua

SEQ ID NO: 1350152 - RNA, 19 nt, Homo sapiens
gagagcaaccuggucaucu

SEQ ID NO: 1350153 - RNA, 19 nt, Homo sapiens
gcuuuagggagaagacuug

SEQ ID NO: 1350154 - RNA, 19 nt, Homo sapiens
gucccuggguucuaaucuu

SEQ ID NO: 1350155 - RNA, 19 nt, Homo sapiens
gcagacgagacagcaaaga

SEQ ID NO: 1350156 - RNA, 19 nt, Homo sapiens
gcagcggacaaguucaaug

SEQ ID NO: 1350157 - RNA, 19 nt, Homo sapiens
cugcuggccugggugguuu

SEQ ID NO: 1350158 - RNA, 19 nt, Homo sapiens
gacugaggaugccaaugag

SEQ ID NO: 1350159 - RNA, 19 nt, Homo sapiens
gcuccugcuuggccagugu

SEQ ID NO: 1350160 - RNA, 19 nt, Homo sapiens
aaucuggaguguaucuuac

SEQ ID NO: 1350161 - RNA, 19 nt, Homo sapiens
gaaaucuggaguguaucuu

SEQ ID NO: 1350162 - RNA, 19 nt, Homo sapiens
aauaaaaggugggaaagug

SEQ ID NO: 1350163 - RNA, 19 nt, Homo sapiens
cagcggacaaguucaaugg

SEQ ID NO: 1350164 - RNA, 19 nt, Homo sapiens
gguggaggcaguggaauca

SEQ ID NO: 1350165 - RNA, 19 nt, Homo sapiens
gggccuaacacaaauucau

SEQ ID NO: 1350166 - RNA, 19 nt, Homo sapiens
ccgcauguggcccaggaua

SEQ ID NO: 1350167 - RNA, 19 nt, Homo sapiens
guggucaccugggccuuau

SEQ ID NO: 1350168 - RNA, 19 nt, Homo sapiens
ggacugaggaugccaauga

SEQ ID NO: 1350169 - RNA, 19 nt, Homo sapiens
uuacacaucuugauuggaa

SEQ ID NO: 1350170 - RNA, 19 nt, Homo sapiens
caagaucucaggagcuuua

SEQ ID NO: 1350171 - RNA, 19 nt, Homo sapiens
caaguucaauggugucuga

SEQ ID NO: 1350172 - RNA, 19 nt, Homo sapiens
gggauucucuguaucauca

SEQ ID NO: 1350173 - RNA, 19 nt, Homo sapiens
uggaggagcugcugaaaga

SEQ ID NO: 1350174 - RNA, 19 nt, Homo sapiens
gaaagaguaccacagcaaa

SEQ ID NO: 1350175 - RNA, 19 nt, Homo sapiens
ucacagagaagaaagagaa

SEQ ID NO: 1350176 - RNA, 19 nt, Homo sapiens
uuugaaaucuggaguguau

SEQ ID NO: 1350177 - RNA, 19 nt, Homo sapiens
agaagcaggugaacuuaau

SEQ ID NO: 1350178 - RNA, 19 nt, Homo sapiens
gacagagcgucuccaucua

SEQ ID NO: 1350179 - RNA, 19 nt, Homo sapiens
ggagacccaucaacucauc

SEQ ID NO: 1350180 - RNA, 19 nt, Homo sapiens
gaacaaggccgaggagaac

SEQ ID NO: 1350181 - RNA, 19 nt, Homo sapiens
gugagucccuggguucuaa

SEQ ID NO: 1350182 - RNA, 19 nt, Homo sapiens
gaggagacccaucaacuca

SEQ ID NO: 1350183 - RNA, 19 nt, Homo sapiens
ggccaucgcuggguccauu

SEQ ID NO: 1350184 - RNA, 19 nt, Homo sapiens
ggccuaacacaaauucaua

SEQ ID NO: 1350185 - RNA, 19 nt, Homo sapiens
cagagcgucuccaucuaaa

SEQ ID NO: 1350186 - RNA, 19 nt, Homo sapiens
cagcagcgguggugagaca

SEQ ID NO: 1350187 - RNA, 19 nt, Homo sapiens
gcgcagcaccugaggaaau

SEQ ID NO: 1350188 - RNA, 19 nt, Homo sapiens
ccacacccuugccucugua

SEQ ID NO: 1350189 - RNA, 19 nt, Homo sapiens
gaagcaggugaacuuaauu

SEQ ID NO: 1350190 - RNA, 19 nt, Homo sapiens
aaagaagcaggugaacuua

SEQ ID NO: 1350191 - RNA, 19 nt, Homo sapiens
ccuaggagcccacgggauu

SEQ ID NO: 1350192 - RNA, 19 nt, Homo sapiens
gagcagcggacaaguucaa

SEQ ID NO: 1350193 - RNA, 19 nt, Homo sapiens
cauggcaacucgagauaca

SEQ ID NO: 1350194 - RNA, 19 nt, Homo sapiens
gaauggggccuaacacaaa

SEQ ID NO: 1350195 - RNA, 19 nt, Homo sapiens
cccaucaacucaucugguu

SEQ ID NO: 1350196 - RNA, 19 nt, Homo sapiens
cccaggauauggcuuugaa

SEQ ID NO: 1350197 - RNA, 19 nt, Homo sapiens
acagagcgucuccaucuaa

SEQ ID NO: 1350198 - RNA, 19 nt, Homo sapiens
aaaucuggaguguaucuua

SEQ ID NO: 1350199 - RNA, 19 nt, Homo sapiens
gagcaaccuggucaucuga

SEQ ID NO: 1350200 - RNA, 19 nt, Homo sapiens
gggcaccucuggguacuca

SEQ ID NO: 1350201 - RNA, 19 nt, Homo sapiens
uaccaucccucccauuagu

SEQ ID NO: 1350202 - RNA, 19 nt, Homo sapiens
ucuaccaucccucccauua

SEQ ID NO: 1350203 - RNA, 19 nt, Homo sapiens
ggagguggaggcaguggaa

SEQ ID NO: 1350204 - RNA, 19 nt, Homo sapiens
ccuuccauguguugaauaa

SEQ ID NO: 1350205 - RNA, 19 nt, Homo sapiens
ggacugugaggaccgagaa

SEQ ID NO: 1350206 - RNA, 19 nt, Homo sapiens
ggcggaagccguacaaagu

SEQ ID NO: 1350207 - RNA, 19 nt, Homo sapiens
ugaaagaguaccacagcaa

SEQ ID NO: 1350208 - RNA, 19 nt, Homo sapiens
cuucagcucuuuguagguu

SEQ ID NO: 1350209 - RNA, 19 nt, Homo sapiens
guucuaaucuugggcacau

SEQ ID NO: 1350210 - RNA, 19 nt, Homo sapiens
cugaggaaaugcacugugu

SEQ ID NO: 1350211 - RNA, 19 nt, Homo sapiens
gggccucagugguuucugu

SEQ ID NO: 1350212 - RNA, 19 nt, Homo sapiens
cagcagacgagacagcaaa

SEQ ID NO: 1350213 - RNA, 19 nt, Homo sapiens
aggagcugcugaaagagua

SEQ ID NO: 1350214 - RNA, 19 nt, Homo sapiens
gcauguggcccaggauaug

SEQ ID NO: 1350215 - RNA, 19 nt, Homo sapiens
ccacagagagggacagcau

SEQ ID NO: 1350216 - RNA, 19 nt, Homo sapiens
cccaagaucucaggagcuu

SEQ ID NO: 1350217 - RNA, 19 nt, Homo sapiens
caggauauggcuuugaaug

SEQ ID NO: 1350218 - RNA, 19 nt, Homo sapiens
ggaacucaaauauuucaag

SEQ ID NO: 1350219 - RNA, 19 nt, Homo sapiens
gggcagggcacauuaugca

SEQ ID NO: 1350220 - RNA, 19 nt, Homo sapiens
gcccagaggagacccauca

SEQ ID NO: 1350221 - RNA, 19 nt, Homo sapiens
gaucccggcaggacuguga

SEQ ID NO: 1350222 - RNA, 19 nt, Homo sapiens
gccacacccuugccucugu

SEQ ID NO: 1350223 - RNA, 19 nt, Homo sapiens
gcuuugaaaucuggagugu

SEQ ID NO: 1350224 - RNA, 19 nt, Homo sapiens
aagcaggugaacuuaauuu

SEQ ID NO: 1350225 - RNA, 19 nt, Homo sapiens
uauugaaacucaccauugc

SEQ ID NO: 1350226 - RNA, 19 nt, Homo sapiens
ugacaucaacaacccuuug

SEQ ID NO: 1350227 - RNA, 19 nt, Homo sapiens
agaacaaggccgaggagaa

SEQ ID NO: 1350228 - RNA, 19 nt, Homo sapiens
gcggaagccguacaaagug

SEQ ID NO: 1350229 - RNA, 19 nt, Homo sapiens
cagcgcagcaccugaggaa

SEQ ID NO: 1350230 - RNA, 19 nt, Homo sapiens
ccacgggauucucuguauc

SEQ ID NO: 1350231 - RNA, 19 nt, Homo sapiens
gccuaacacaaauucauaa

SEQ ID NO: 1350232 - RNA, 19 nt, Homo sapiens
gcugagcaccaacacauag

SEQ ID NO: 1350233 - RNA, 19 nt, Homo sapiens
ggcauggcaacucgagaua

SEQ ID NO: 1350234 - RNA, 19 nt, Homo sapiens
ccauugcccuauccuugug

SEQ ID NO: 1350235 - RNA, 19 nt, Homo sapiens
gauacacucuguggagacu

SEQ ID NO: 1350236 - RNA, 19 nt, Homo sapiens
agagcaaccuggucaucug

SEQ ID NO: 1350237 - RNA, 19 nt, Homo sapiens
gaggagcugcugaaagagu

SEQ ID NO: 1350238 - RNA, 19 nt, Homo sapiens
aaaagaagcaggugaacuu

SEQ ID NO: 1350239 - RNA, 19 nt, Homo sapiens
gcaccucuggguacucaug

SEQ ID NO: 1350240 - RNA, 19 nt, Homo sapiens
ucccuggguucuaaucuug

SEQ ID NO: 1350241 - RNA, 19 nt, Homo sapiens
aagaagcaggugaacuuaa

SEQ ID NO: 1350242 - RNA, 19 nt, Homo sapiens
uuauugaaacucaccauug

SEQ ID NO: 1350243 - RNA, 19 nt, Homo sapiens
cccacgggauucucuguau

SEQ ID NO: 1350244 - RNA, 19 nt, Homo sapiens
gggcauggcaacucgagau

SEQ ID NO: 1350245 - RNA, 19 nt, Homo sapiens
ugcaaaggcugagcaccaa

SEQ ID NO: 1350246 - RNA, 19 nt, Homo sapiens
caaaggcugagcaccaaca

SEQ ID NO: 1350247 - RNA, 19 nt, Homo sapiens
cgcagcaccugaggaaaug

SEQ ID NO: 1350248 - RNA, 19 nt, Homo sapiens
uuaacccagucuauccaaa

SEQ ID NO: 1350249 - RNA, 19 nt, Homo sapiens
gcuguagccagaagaagug

SEQ ID NO: 1350250 - RNA, 19 nt, Homo sapiens
cagaggagacccaucaacu

SEQ ID NO: 1350251 - RNA, 19 nt, Homo sapiens
ccccauuccuugguaauua

SEQ ID NO: 1350252 - RNA, 19 nt, Homo sapiens
gagagcaaccuggucaucu

SEQ ID NO: 1350253 - RNA, 19 nt, Homo sapiens
gcuuuagggagaagacuug

SEQ ID NO: 1350254 - RNA, 19 nt, Homo sapiens
gucccuggguucuaaucuu

SEQ ID NO: 1350255 - RNA, 19 nt, Homo sapiens
gcagacgagacagcaaaga

SEQ ID NO: 1350256 - RNA, 19 nt, Homo sapiens
gcagcggacaaguucaaug

SEQ ID NO: 1350257 - RNA, 19 nt, Homo sapiens
gcuccugcuuggccagugu

SEQ ID NO: 1350258 - RNA, 19 nt, Homo sapiens
aaucuggaguguaucuuac

SEQ ID NO: 1350259 - RNA, 19 nt, Homo sapiens
gaaaucuggaguguaucuu

SEQ ID NO: 1350260 - RNA, 19 nt, Homo sapiens
gguggaggcaguggaauca

SEQ ID NO: 1350261 - RNA, 19 nt, Homo sapiens
aauaaaaggugggaaagug

SEQ ID NO: 1350262 - RNA, 19 nt, Homo sapiens
cagcggacaaguucaaugg

SEQ ID NO: 1350263 - RNA, 19 nt, Homo sapiens
gacugaggaugccaaugag

SEQ ID NO: 1350264 - RNA, 19 nt, Homo sapiens
cugcuggccugggugguuu

SEQ ID NO: 1350265 - RNA, 19 nt, Homo sapiens
gggccuaacacaaauucau

SEQ ID NO: 1350266 - RNA, 19 nt, Homo sapiens
ccgcauguggcccaggaua

SEQ ID NO: 1350267 - RNA, 19 nt, Homo sapiens
guggucaccugggccuuau

SEQ ID NO: 1350268 - RNA, 19 nt, Homo sapiens
gcgaagguguccucccaua

SEQ ID NO: 1350269 - RNA, 19 nt, Homo sapiens
ggccaaagccugagacuga

SEQ ID NO: 1350270 - RNA, 19 nt, Homo sapiens
gcaagacggcggugaagaa

SEQ ID NO: 1350271 - RNA, 19 nt, Homo sapiens
gcaccacaaugcccacuuc

SEQ ID NO: 1350272 - RNA, 19 nt, Homo sapiens
gaagaaacggaaucugaau

SEQ ID NO: 1350273 - RNA, 19 nt, Homo sapiens
gugaagaaacggaaucuga

SEQ ID NO: 1350274 - RNA, 19 nt, Homo sapiens
gcccuuggcuaaagucaau

SEQ ID NO: 1350275 - RNA, 19 nt, Homo sapiens
uggcuaaagucaauaaagu

SEQ ID NO: 1350276 - RNA, 19 nt, Homo sapiens
ggcugaggcugcugugaaa

SEQ ID NO: 1350277 - RNA, 19 nt, Homo sapiens
gugcugagccugucugugu

SEQ ID NO: 1350278 - RNA, 19 nt, Homo sapiens
ugaagaaacggaaucugaa

SEQ ID NO: 1350279 - RNA, 19 nt, Homo sapiens
uggcugggcugccuguuga

SEQ ID NO: 1350280 - RNA, 19 nt, Homo sapiens
acacuuacguacaaugcuu

SEQ ID NO: 1350281 - RNA, 19 nt, Homo sapiens
gagcgucuaugcgcaggaa

SEQ ID NO: 1350282 - RNA, 19 nt, Homo sapiens
ccuggacacuuacguacaa

SEQ ID NO: 1350283 - RNA, 19 nt, Homo sapiens
gcuaccuccucccggauaa

SEQ ID NO: 1350284 - RNA, 19 nt, Homo sapiens
gaagguguccucccauacu

SEQ ID NO: 1350285 - RNA, 19 nt, Homo sapiens
gccaaagccugagacugaa

SEQ ID NO: 1350286 - RNA, 19 nt, Homo sapiens
caagacggcggugaagaaa

SEQ ID NO: 1350287 - RNA, 19 nt, Homo sapiens
ccucagcccuguguucaau

SEQ ID NO: 1350288 - RNA, 19 nt, Homo sapiens
gcuucgugcugccugauga

SEQ ID NO: 1350289 - RNA, 19 nt, Homo sapiens
ccacuucggcucugaccuu

SEQ ID NO: 1350290 - RNA, 19 nt, Homo sapiens
gcuaaagucaauaaagucu

SEQ ID NO: 1350291 - RNA, 19 nt, Homo sapiens
aagcagagcaagcgcaaga

SEQ ID NO: 1350292 - RNA, 19 nt, Homo sapiens
gcacuucgcgcugcacuac

SEQ ID NO: 1350293 - RNA, 19 nt, Homo sapiens
ggacacuuacguacaaugc

SEQ ID NO: 1350294 - RNA, 19 nt, Homo sapiens
gaaagccugggucgcaaca

SEQ ID NO: 1350295 - RNA, 19 nt, Homo sapiens
ggccugcccuuggcuaaag

SEQ ID NO: 1350296 - RNA, 19 nt, Homo sapiens
agacggcggugaagaaacg

SEQ ID NO: 1350297 - RNA, 19 nt, Homo sapiens
caugguguacgauggcuuu

SEQ ID NO: 1350298 - RNA, 19 nt, Homo sapiens
ucagcccuguguucaauca

SEQ ID NO: 1350299 - RNA, 19 nt, Homo sapiens
aggcugcugugaaagagaa

SEQ ID NO: 1350300 - RNA, 19 nt, Homo sapiens
ucuaugcgcaggaagaaga

SEQ ID NO: 1350301 - RNA, 19 nt, Homo sapiens
cagggagacugaggcuuca

SEQ ID NO: 1350302 - RNA, 19 nt, Homo sapiens
gaccuuguccgagcgucua

SEQ ID NO: 1350303 - RNA, 19 nt, Homo sapiens
gaacaugccucauaguuua

SEQ ID NO: 1350304 - RNA, 19 nt, Homo sapiens
gaaauaacauccugauugu

SEQ ID NO: 1350305 - RNA, 19 nt, Homo sapiens
gaagauguaugcaaaguga

SEQ ID NO: 1350306 - RNA, 19 nt, Homo sapiens
caaaccaaaucaucaguua

SEQ ID NO: 1350307 - RNA, 19 nt, Homo sapiens
gagaaagacuugauucaga

SEQ ID NO: 1350308 - RNA, 19 nt, Homo sapiens
ggacagcucagaauaauuu

SEQ ID NO: 1350309 - RNA, 19 nt, Homo sapiens
gaggauggauguuguguuu

SEQ ID NO: 1350310 - RNA, 19 nt, Homo sapiens
ggaaauaacauccugauug

SEQ ID NO: 1350311 - RNA, 19 nt, Homo sapiens
caauaaaggucuuaagaga

SEQ ID NO: 1350312 - RNA, 19 nt, Homo sapiens
gaagauacccgcuuaagga

SEQ ID NO: 1350313 - RNA, 19 nt, Homo sapiens
ggaaauaacccugugauga

SEQ ID NO: 1350314 - RNA, 19 nt, Homo sapiens
gcaaauuaguuguuucaga

SEQ ID NO: 1350315 - RNA, 19 nt, Homo sapiens
gaaauaacccugugaugau

SEQ ID NO: 1350316 - RNA, 19 nt, Homo sapiens
gcaauaccauuaucgauca

SEQ ID NO: 1350317 - RNA, 19 nt, Homo sapiens
ugaaauagagucuggaaua

SEQ ID NO: 1350318 - RNA, 19 nt, Homo sapiens
guucuuagguuacacauga

SEQ ID NO: 1350319 - RNA, 19 nt, Homo sapiens
gaaauagagucuggaauag

SEQ ID NO: 1350320 - RNA, 19 nt, Homo sapiens
cacaauaucuugaaagguu

SEQ ID NO: 1350321 - RNA, 19 nt, Homo sapiens
ggcaguaucuguaauguau

SEQ ID NO: 1350322 - RNA, 19 nt, Homo sapiens
gagaguuguucuuagguua

SEQ ID NO: 1350323 - RNA, 19 nt, Homo sapiens
ccaccaauccuuccucuua

SEQ ID NO: 1350324 - RNA, 19 nt, Homo sapiens
gaacaaggcacacaacauc

SEQ ID NO: 1350325 - RNA, 19 nt, Homo sapiens
cacauuaccugcauggaua

SEQ ID NO: 1350326 - RNA, 19 nt, Homo sapiens
gcaauggucuauauaagca

SEQ ID NO: 1350327 - RNA, 19 nt, Homo sapiens
gaaaggauguauguuagau

SEQ ID NO: 1350328 - RNA, 19 nt, Homo sapiens
uaaaucauguggcaucuau

SEQ ID NO: 1350329 - RNA, 19 nt, Homo sapiens
caguagaaguuuccaagua

SEQ ID NO: 1350330 - RNA, 19 nt, Homo sapiens
guauuucucugcuuucauu

SEQ ID NO: 1350331 - RNA, 19 nt, Homo sapiens
ggugaagccuuauuagaga

SEQ ID NO: 1350332 - RNA, 19 nt, Homo sapiens
gcacugcaacugagaaauu

SEQ ID NO: 1350333 - RNA, 19 nt, Homo sapiens
ggaaagauaagauacaugu

SEQ ID NO: 1350334 - RNA, 19 nt, Homo sapiens
uaccagggauguauaguaa

SEQ ID NO: 1350335 - RNA, 19 nt, Homo sapiens
ggagaauugucuuccuaaa

SEQ ID NO: 1350336 - RNA, 19 nt, Homo sapiens
caaaagaucugaauucaca

SEQ ID NO: 1350337 - RNA, 19 nt, Homo sapiens
ugaauccacuguuuaauca

SEQ ID NO: 1350338 - RNA, 19 nt, Homo sapiens
caucuaugcuugcguuuga

SEQ ID NO: 1350339 - RNA, 19 nt, Homo sapiens
gcuuaaggaugcuaacauu

SEQ ID NO: 1350340 - RNA, 19 nt, Homo sapiens
ccacgcaucuucccuugaa

SEQ ID NO: 1350341 - RNA, 19 nt, Homo sapiens
uuagagagcaauaccauua

SEQ ID NO: 1350342 - RNA, 19 nt, Homo sapiens
guaagucagggaacuaaua

SEQ ID NO: 1350343 - RNA, 19 nt, Homo sapiens
agaauugucuuccuaaauc

SEQ ID NO: 1350344 - RNA, 19 nt, Homo sapiens
ucacaaggcuuuggagaau

SEQ ID NO: 1350345 - RNA, 19 nt, Homo sapiens
gaauauggcagcugacaga

SEQ ID NO: 1350346 - RNA, 19 nt, Homo sapiens
gucagucgcuggaaaugua

SEQ ID NO: 1350347 - RNA, 19 nt, Homo sapiens
gaaaugccagcccuuuaaa

SEQ ID NO: 1350348 - RNA, 19 nt, Homo sapiens
guacaaaugguccgaaaga

SEQ ID NO: 1350349 - RNA, 19 nt, Homo sapiens
gaucugaauucacauuaag

SEQ ID NO: 1350350 - RNA, 19 nt, Homo sapiens
gauuguauuucucugcuuu

SEQ ID NO: 1350351 - RNA, 19 nt, Homo sapiens
gacagggucucacuauaau

SEQ ID NO: 1350352 - RNA, 19 nt, Homo sapiens
uguagaagauguaugcaaa

SEQ ID NO: 1350353 - RNA, 19 nt, Homo sapiens
ggagagagaccuugcuuca

SEQ ID NO: 1350354 - RNA, 19 nt, Homo sapiens
cacagaagcuuuccgacuu

SEQ ID NO: 1350355 - RNA, 19 nt, Homo sapiens
ucagguuguuguacacuua

SEQ ID NO: 1350356 - RNA, 19 nt, Homo sapiens
ggcagcaugugacugguua

SEQ ID NO: 1350357 - RNA, 19 nt, Homo sapiens
gaugcuggcuauauauguu

SEQ ID NO: 1350358 - RNA, 19 nt, Homo sapiens
gauggucuccuaugguaua

SEQ ID NO: 1350359 - RNA, 19 nt, Homo sapiens
aguagaaguuuccaaguaa

SEQ ID NO: 1350360 - RNA, 19 nt, Homo sapiens
gcaaaaggauuauaguugu

SEQ ID NO: 1350361 - RNA, 19 nt, Homo sapiens
gugacuaucugacuguuga

SEQ ID NO: 1350362 - RNA, 19 nt, Homo sapiens
cauuaucgaucaugucuau

SEQ ID NO: 1350363 - RNA, 19 nt, Homo sapiens
gcucuaccauucauucuuc

SEQ ID NO: 1350364 - RNA, 19 nt, Homo sapiens
aaagagacauuaguuagug

SEQ ID NO: 1350365 - RNA, 19 nt, Homo sapiens
ugaaaugccagcccuuuaa

SEQ ID NO: 1350366 - RNA, 19 nt, Homo sapiens
ccacaaaugcaucaauuau

SEQ ID NO: 1350367 - RNA, 19 nt, Homo sapiens
ccaaggacuucguacaaau

SEQ ID NO: 1350368 - RNA, 19 nt, Homo sapiens
gaaugcagcaccuggauau

SEQ ID NO: 1350369 - RNA, 19 nt, Homo sapiens
caauauggacacugccuua

SEQ ID NO: 1350370 - RNA, 19 nt, Homo sapiens
auacuuacuuccugcauuu

SEQ ID NO: 1350371 - RNA, 19 nt, Homo sapiens
uaaaugagagaaagacuug

SEQ ID NO: 1350372 - RNA, 19 nt, Homo sapiens
gaugagacuguguaaauga

SEQ ID NO: 1350373 - RNA, 19 nt, Homo sapiens
cuugaaagguuuacaacaa

SEQ ID NO: 1350374 - RNA, 19 nt, Homo sapiens
gacccuggcuuaccacuuc

SEQ ID NO: 1350375 - RNA, 19 nt, Homo sapiens
cauguggcaucuauguaua

SEQ ID NO: 1350376 - RNA, 19 nt, Homo sapiens
gcaugugacugguuauucu

SEQ ID NO: 1350377 - RNA, 19 nt, Homo sapiens
agucauggcugcacugcua

SEQ ID NO: 1350378 - RNA, 19 nt, Homo sapiens
gaggaaagauaagauacau

SEQ ID NO: 1350379 - RNA, 19 nt, Homo sapiens
gcacacuuaccuauuuaaa

SEQ ID NO: 1350380 - RNA, 19 nt, Homo sapiens
acaaaucaaucaugguuuc

SEQ ID NO: 1350381 - RNA, 19 nt, Homo sapiens
gcauuuagagggaguuuau

SEQ ID NO: 1350382 - RNA, 19 nt, Homo sapiens
gguuacacaugaaauccua

SEQ ID NO: 1350383 - RNA, 19 nt, Homo sapiens
gaacuccaaggacuucgua

SEQ ID NO: 1350384 - RNA, 19 nt, Homo sapiens
ggauggauguuguguuugg

SEQ ID NO: 1350385 - RNA, 19 nt, Homo sapiens
caucuucuagguuaucuua

SEQ ID NO: 1350386 - RNA, 19 nt, Homo sapiens
ggaauuaaccauguuguag

SEQ ID NO: 1350387 - RNA, 19 nt, Homo sapiens
gcugacagauccaccaauc

SEQ ID NO: 1350388 - RNA, 19 nt, Homo sapiens
cuacagaccucacauucca

SEQ ID NO: 1350389 - RNA, 19 nt, Homo sapiens
acuagugggugaagccuua

SEQ ID NO: 1350390 - RNA, 19 nt, Homo sapiens
cacugcaacugagaaauua

SEQ ID NO: 1350391 - RNA, 19 nt, Homo sapiens
cagaagagaauguuucguu

SEQ ID NO: 1350392 - RNA, 19 nt, Homo sapiens
ccaaucagcaaauuaguug

SEQ ID NO: 1350393 - RNA, 19 nt, Homo sapiens
ggauauuucaugguucuua

SEQ ID NO: 1350394 - RNA, 19 nt, Homo sapiens
gagaaacaaaucaaucaug

SEQ ID NO: 1350395 - RNA, 19 nt, Homo sapiens
acaaggcuuuggagaauug

SEQ ID NO: 1350396 - RNA, 19 nt, Homo sapiens
acagaagcuuuccgacuuu

SEQ ID NO: 1350397 - RNA, 19 nt, Homo sapiens
gcguguaccugccaacuuc

SEQ ID NO: 1350398 - RNA, 19 nt, Homo sapiens
cagaauccuaugauacuua

SEQ ID NO: 1350399 - RNA, 19 nt, Homo sapiens
caguaucuguaauguauga

SEQ ID NO: 1350400 - RNA, 19 nt, Homo sapiens
cuaacgugcuacugcauuu

SEQ ID NO: 1350401 - RNA, 19 nt, Homo sapiens
uaaccauguuguagccuaa

SEQ ID NO: 1350402 - RNA, 19 nt, Homo sapiens
ggcugaagauacccgcuua

SEQ ID NO: 1350403 - RNA, 19 nt, Homo sapiens
gcacggagacccugaaauu

SEQ ID NO: 1350404 - RNA, 19 nt, Homo sapiens
gggagaagcugcgcaagua

SEQ ID NO: 1350405 - RNA, 19 nt, Homo sapiens
gaacuuggauggccaggau

SEQ ID NO: 1350406 - RNA, 19 nt, Homo sapiens
agaagaagcugaucgacaa

SEQ ID NO: 1350407 - RNA, 19 nt, Homo sapiens
agacagugcuggcaggaua

SEQ ID NO: 1350408 - RNA, 19 nt, Homo sapiens
gcugggagcugggaguaua

SEQ ID NO: 1350409 - RNA, 19 nt, Homo sapiens
cgacucugauggagaagua

SEQ ID NO: 1350410 - RNA, 19 nt, Homo sapiens
gagaagacaaugaucaaga

SEQ ID NO: 1350411 - RNA, 19 nt, Homo sapiens
ccaacacccucgauuugaa

SEQ ID NO: 1350412 - RNA, 19 nt, Homo sapiens
gaacauccaccugcuguau

SEQ ID NO: 1350413 - RNA, 19 nt, Homo sapiens
gcacacaccugagcuucug

SEQ ID NO: 1350414 - RNA, 19 nt, Homo sapiens
cggaugaggucaagaggaa

SEQ ID NO: 1350415 - RNA, 19 nt, Homo sapiens
cagcagaaauggaauacca

SEQ ID NO: 1350416 - RNA, 19 nt, Homo sapiens
gaacaugcacaaccuacug

SEQ ID NO: 1350417 - RNA, 19 nt, Homo sapiens
gaucgacaccuuccaguuc

SEQ ID NO: 1350418 - RNA, 19 nt, Homo sapiens
ugacagacaugcuaaaaga

SEQ ID NO: 1350419 - RNA, 19 nt, Homo sapiens
gaaaaugacagacaugcua

SEQ ID NO: 1350420 - RNA, 19 nt, Homo sapiens
ggcagaagcuggagagcau

SEQ ID NO: 1350421 - RNA, 19 nt, Homo sapiens
ucagagcugucggauauga

SEQ ID NO: 1350422 - RNA, 19 nt, Homo sapiens
ucacugcugugucccuauu

SEQ ID NO: 1350423 - RNA, 19 nt, Homo sapiens
uggauuaucugaagacagu

SEQ ID NO: 1350424 - RNA, 19 nt, Homo sapiens
acauccaccugcuguauuu

SEQ ID NO: 1350425 - RNA, 19 nt, Homo sapiens
agaagacaaugaucaagau

SEQ ID NO: 1350426 - RNA, 19 nt, Homo sapiens
ccucgacucugauggagaa

SEQ ID NO: 1350427 - RNA, 19 nt, Homo sapiens
ugacugcugugguggagaa

SEQ ID NO: 1350428 - RNA, 19 nt, Homo sapiens
ccacgucgccuccgaacuu

SEQ ID NO: 1350429 - RNA, 19 nt, Homo sapiens
ugaaggcccuggugaagca

SEQ ID NO: 1350430 - RNA, 19 nt, Homo sapiens
ccacagcagaaauggaaua

SEQ ID NO: 1350431 - RNA, 19 nt, Homo sapiens
auuuggaccugcuggauua

SEQ ID NO: 1350432 - RNA, 19 nt, Homo sapiens
caaguccguugagaagaaa

SEQ ID NO: 1350433 - RNA, 19 nt, Homo sapiens
gaagaucaugucccaagau

SEQ ID NO: 1350434 - RNA, 19 nt, Homo sapiens
gagaacaacaucgagaaga

SEQ ID NO: 1350435 - RNA, 19 nt, Homo sapiens
gaaguggugcucuccaaca

SEQ ID NO: 1350436 - RNA, 19 nt, Homo sapiens
gggcaucgacaaccucuau

SEQ ID NO: 1350437 - RNA, 19 nt, Homo sapiens
ucgacaagauccacacgaa

SEQ ID NO: 1350438 - RNA, 19 nt, Homo sapiens
gaucacggaugaggucaag

SEQ ID NO: 1350439 - RNA, 19 nt, Homo sapiens
ugaagaucaugucccaaga

SEQ ID NO: 1350440 - RNA, 19 nt, Homo sapiens
gaacaacaucgagaagaca

SEQ ID NO: 1350441 - RNA, 19 nt, Homo sapiens
gaaggucaagagugcugua

SEQ ID NO: 1350442 - RNA, 19 nt, Homo sapiens
gucccaagaugccaugaug

SEQ ID NO: 1350443 - RNA, 19 nt, Homo sapiens
gaaggagaccagcgagaag

SEQ ID NO: 1350444 - RNA, 19 nt, Homo sapiens
cgaaggagaccagcgagaa

SEQ ID NO: 1350445 - RNA, 19 nt, Homo sapiens
aagaucaugucccaagaug

SEQ ID NO: 1350446 - RNA, 19 nt, Homo sapiens
acaccaggaucagcuuuga

SEQ ID NO: 1350447 - RNA, 19 nt, Homo sapiens
acggagacccugaaauuga

SEQ ID NO: 1350448 - RNA, 19 nt, Homo sapiens
gaggucaagaggaacauga

SEQ ID NO: 1350449 - RNA, 19 nt, Homo sapiens
gggcuagcgugggauacaa

SEQ ID NO: 1350450 - RNA, 19 nt, Homo sapiens
caacaucgagaagacaaug

SEQ ID NO: 1350451 - RNA, 19 nt, Homo sapiens
caacaccaggaucagcuuu

SEQ ID NO: 1350452 - RNA, 19 nt, Homo sapiens
gagcacggagacccugaaa

SEQ ID NO: 1350453 - RNA, 19 nt, Homo sapiens
ggagaacaacaucgagaag

SEQ ID NO: 1350454 - RNA, 19 nt, Homo sapiens
gaaccuggagcugcagaug

SEQ ID NO: 1350455 - RNA, 19 nt, Homo sapiens
gaucaucaccagccagaac

SEQ ID NO: 1350456 - RNA, 19 nt, Homo sapiens
gaaccgggaggaggauaug

SEQ ID NO: 1350457 - RNA, 19 nt, Homo sapiens
aagaggaacaugaggcaaa

SEQ ID NO: 1350458 - RNA, 19 nt, Homo sapiens
acccugaaauugaggagaa

SEQ ID NO: 1350459 - RNA, 19 nt, Homo sapiens
cggagacccugaaauugag

SEQ ID NO: 1350460 - RNA, 19 nt, Homo sapiens
ccagauggacuuggacuuc

SEQ ID NO: 1350461 - RNA, 19 nt, Homo sapiens
agaagcugaucgacaagau

SEQ ID NO: 1350462 - RNA, 19 nt, Homo sapiens
gaaccucguggucaacuac

SEQ ID NO: 1350463 - RNA, 19 nt, Homo sapiens
agaacaacaucgagaagac

SEQ ID NO: 1350464 - RNA, 19 nt, Homo sapiens
gggaggaggauaugaucga

SEQ ID NO: 1350465 - RNA, 19 nt, Homo sapiens
ccgaggagggcgacacaaa

SEQ ID NO: 1350466 - RNA, 19 nt, Homo sapiens
gcaucgacaaccucuaugu

SEQ ID NO: 1350467 - RNA, 19 nt, Homo sapiens
gaccuccacagcagaaaug

SEQ ID NO: 1350468 - RNA, 19 nt, Homo sapiens
gaggaggccgugcucaagu

SEQ ID NO: 1350469 - RNA, 19 nt, Homo sapiens
gaugaggucaagaggaaca

SEQ ID NO: 1350470 - RNA, 19 nt, Homo sapiens
ugcagaaccucguggucaa

SEQ ID NO: 1350471 - RNA, 19 nt, Homo sapiens
gaggagggcgacacaaagg

SEQ ID NO: 1350472 - RNA, 19 nt, Homo sapiens
ucuccaacacccucgauuu

SEQ ID NO: 1350473 - RNA, 19 nt, Homo sapiens
aggaggccgugcucaaguu

SEQ ID NO: 1350474 - RNA, 19 nt, Homo sapiens
uggcacagcacccaacuca

SEQ ID NO: 1350475 - RNA, 19 nt, Homo sapiens
agaggaacacggaggagaa

SEQ ID NO: 1350476 - RNA, 19 nt, Homo sapiens
gcagcaccauggagguaac

SEQ ID NO: 1350477 - RNA, 19 nt, Homo sapiens
gaagaagcugaucgacaag

SEQ ID NO: 1350478 - RNA, 19 nt, Homo sapiens
gggagaaccggcucaacca

SEQ ID NO: 1350479 - RNA, 19 nt, Homo sapiens
gagaaccgggaggaggaua

SEQ ID NO: 1350480 - RNA, 19 nt, Homo sapiens
gcuucugagucccugauuc

SEQ ID NO: 1350481 - RNA, 19 nt, Homo sapiens
ucucacgucugggacauca

SEQ ID NO: 1350482 - RNA, 19 nt, Homo sapiens
uggacaagcugcagaaccu

SEQ ID NO: 1350483 - RNA, 19 nt, Homo sapiens
gaccugcuggauuaucuga

SEQ ID NO: 1350484 - RNA, 19 nt, Homo sapiens
aagcagggaucucgcuacu

SEQ ID NO: 1350485 - RNA, 19 nt, Homo sapiens
guauacccacugccaacaa

SEQ ID NO: 1350486 - RNA, 19 nt, Homo sapiens
gcugaaggcccuggugaag

SEQ ID NO: 1350487 - RNA, 19 nt, Homo sapiens
agaggaacaugaggcaaag

SEQ ID NO: 1350488 - RNA, 19 nt, Homo sapiens
agaaccucguggucaacua

SEQ ID NO: 1350489 - RNA, 19 nt, Homo sapiens
cuccaacacccucgauuug

SEQ ID NO: 1350490 - RNA, 19 nt, Homo sapiens
uauacccacugccaacaag

SEQ ID NO: 1350491 - RNA, 19 nt, Homo sapiens
ucgagaagacaaugaucaa

SEQ ID NO: 1350492 - RNA, 19 nt, Homo sapiens
gauaacagauagcacauua

SEQ ID NO: 1350493 - RNA, 19 nt, Homo sapiens
ggcaagauguucucaauua

SEQ ID NO: 1350494 - RNA, 19 nt, Homo sapiens
ggaagaguguguucagaua

SEQ ID NO: 1350495 - RNA, 19 nt, Homo sapiens
gcacgcagcuagaagauga

SEQ ID NO: 1350496 - RNA, 19 nt, Homo sapiens
cuaaagagcuucuaugcuu

SEQ ID NO: 1350497 - RNA, 19 nt, Homo sapiens
gcaagauguucucaauuaa

SEQ ID NO: 1350498 - RNA, 19 nt, Homo sapiens
gagcaaggguuacaaagug

SEQ ID NO: 1350499 - RNA, 19 nt, Homo sapiens
gcagcgaauugaccuauuu

SEQ ID NO: 1350500 - RNA, 19 nt, Homo sapiens
cuaaauggguguacaaaga

SEQ ID NO: 1350501 - RNA, 19 nt, Homo sapiens
gaacuccuguuacggauau

SEQ ID NO: 1350502 - RNA, 19 nt, Homo sapiens
gcccugaacuggugacuuu

SEQ ID NO: 1350503 - RNA, 19 nt, Homo sapiens
gcccagagguuuccuaaau

SEQ ID NO: 1350504 - RNA, 19 nt, Homo sapiens
gaaggucucauuacuauau

SEQ ID NO: 1350505 - RNA, 19 nt, Homo sapiens
aaagaaggcucguccauuc

SEQ ID NO: 1350506 - RNA, 19 nt, Homo sapiens
ggaaagacaauauaugaug

SEQ ID NO: 1350507 - RNA, 19 nt, Homo sapiens
ucucaaggccuuauucuua

SEQ ID NO: 1350508 - RNA, 19 nt, Homo sapiens
gaauugccaugaacuugaa

SEQ ID NO: 1350509 - RNA, 19 nt, Homo sapiens
cuaaaugguugccuugaaa

SEQ ID NO: 1350510 - RNA, 19 nt, Homo sapiens
gcacauuaauccaacuuuc

SEQ ID NO: 1350511 - RNA, 19 nt, Homo sapiens
guacuagccuuagcaaguu

SEQ ID NO: 1350512 - RNA, 19 nt, Homo sapiens
gggagacaaugcauuaaga

SEQ ID NO: 1350513 - RNA, 19 nt, Homo sapiens
cgaauugaccuauuugauu

SEQ ID NO: 1350514 - RNA, 19 nt, Homo sapiens
agacauucauugugacuaa

SEQ ID NO: 1350515 - RNA, 19 nt, Homo sapiens
gcacaaaacugcaggaaca

SEQ ID NO: 1350516 - RNA, 19 nt, Homo sapiens
cuuacucacucaauuguua

SEQ ID NO: 1350517 - RNA, 19 nt, Homo sapiens
gaacauugaaguacugaau

SEQ ID NO: 1350518 - RNA, 19 nt, Homo sapiens
gaagaguguguucagauaa

SEQ ID NO: 1350519 - RNA, 19 nt, Homo sapiens
ucacugugguccaaaugua

SEQ ID NO: 1350520 - RNA, 19 nt, Homo sapiens
cgaacugaguauuuaauga

SEQ ID NO: 1350521 - RNA, 19 nt, Homo sapiens
ccaaagaacuccuguuacg

SEQ ID NO: 1350522 - RNA, 19 nt, Homo sapiens
ccacacauacauacacaua

SEQ ID NO: 1350523 - RNA, 19 nt, Homo sapiens
agacagcgcuucugcagau

SEQ ID NO: 1350524 - RNA, 19 nt, Homo sapiens
ggaauugccaugaacuuga

SEQ ID NO: 1350525 - RNA, 19 nt, Homo sapiens
uuacgaaaguuaagucuuc

SEQ ID NO: 1350526 - RNA, 19 nt, Homo sapiens
caaauuaucacugucugua

SEQ ID NO: 1350527 - RNA, 19 nt, Homo sapiens
ggacaacugcccacuaauc

SEQ ID NO: 1350528 - RNA, 19 nt, Homo sapiens
gcaaaucacagaugaaggu

SEQ ID NO: 1350529 - RNA, 19 nt, Homo sapiens
ugagggauguccacuguug

SEQ ID NO: 1350530 - RNA, 19 nt, Homo sapiens
ugucuuacauucucuguug

SEQ ID NO: 1350531 - RNA, 19 nt, Homo sapiens
cuucuaugcuuccuuguuu

SEQ ID NO: 1350532 - RNA, 19 nt, Homo sapiens
ggacccauuuacccaauau

SEQ ID NO: 1350533 - RNA, 19 nt, Homo sapiens
ugauugagcuggacaacug

SEQ ID NO: 1350534 - RNA, 19 nt, Homo sapiens
ugacuuggcuuccuguaca

SEQ ID NO: 1350535 - RNA, 19 nt, Homo sapiens
uaacagaugugggcuuuac

SEQ ID NO: 1350536 - RNA, 19 nt, Homo sapiens
caacagacgcuacauguac

SEQ ID NO: 1350537 - RNA, 19 nt, Homo sapiens
guccauuccuccuguguuu

SEQ ID NO: 1350538 - RNA, 19 nt, Homo sapiens
gcccacggcuuagaauauu

SEQ ID NO: 1350539 - RNA, 19 nt, Homo sapiens
gcaccugucuuacauucuc

SEQ ID NO: 1350540 - RNA, 19 nt, Homo sapiens
gaugaagcuguaaucaaua

SEQ ID NO: 1350541 - RNA, 19 nt, Homo sapiens
ugaaaucacugugguccaa

SEQ ID NO: 1350542 - RNA, 19 nt, Homo sapiens
acacauacauacacauaca

SEQ ID NO: 1350543 - RNA, 19 nt, Homo sapiens
cagagggugccauaaguua

SEQ ID NO: 1350544 - RNA, 19 nt, Homo sapiens
aaauagugaugaagcugua

SEQ ID NO: 1350545 - RNA, 19 nt, Homo sapiens
gguccaaauguaauucuua

SEQ ID NO: 1350546 - RNA, 19 nt, Homo sapiens
caaagaaggcucguccauu

SEQ ID NO: 1350547 - RNA, 19 nt, Homo sapiens
ugaaguuugugauggcuuu

SEQ ID NO: 1350548 - RNA, 19 nt, Homo sapiens
gcaggaacauugaaguacu

SEQ ID NO: 1350549 - RNA, 19 nt, Homo sapiens
acacucaaauuaucacugu

SEQ ID NO: 1350550 - RNA, 19 nt, Homo sapiens
cuggacaacugcccacuaa

SEQ ID NO: 1350551 - RNA, 19 nt, Homo sapiens
cucaaggccuuauucuuaa

SEQ ID NO: 1350552 - RNA, 19 nt, Homo sapiens
agaugaagcucucaaguac

SEQ ID NO: 1350553 - RNA, 19 nt, Homo sapiens
ggauggcauucaagcacua

SEQ ID NO: 1350554 - RNA, 19 nt, Homo sapiens
gaaguacugaaucuaaaug

SEQ ID NO: 1350555 - RNA, 19 nt, Homo sapiens
ggagacaaugcauuaagaa

SEQ ID NO: 1350556 - RNA, 19 nt, Homo sapiens
ggagggcaguguccagauc

SEQ ID NO: 1350557 - RNA, 19 nt, Homo sapiens
ucccaaagaacuccuguua

SEQ ID NO: 1350558 - RNA, 19 nt, Homo sapiens
gcagagggugccauaaguu

SEQ ID NO: 1350559 - RNA, 19 nt, Homo sapiens
aagaugaagcucucaagua

SEQ ID NO: 1350560 - RNA, 19 nt, Homo sapiens
ccuaaaugguugccuugaa

SEQ ID NO: 1350561 - RNA, 19 nt, Homo sapiens
gaacugaguauuuaaugac

SEQ ID NO: 1350562 - RNA, 19 nt, Homo sapiens
gagcagguuugagauguuc

SEQ ID NO: 1350563 - RNA, 19 nt, Homo sapiens
gcuugcaaaucacagauga

SEQ ID NO: 1350564 - RNA, 19 nt, Homo sapiens
gacaacagacgcuacaugu

SEQ ID NO: 1350565 - RNA, 19 nt, Homo sapiens
ugguagacauucauuguga

SEQ ID NO: 1350566 - RNA, 19 nt, Homo sapiens
ccaugggacugaaguuugu

SEQ ID NO: 1350567 - RNA, 19 nt, Homo sapiens
cagaacugcccacggcuua

SEQ ID NO: 1350568 - RNA, 19 nt, Homo sapiens
gaagaugaagcucucaagu

SEQ ID NO: 1350569 - RNA, 19 nt, Homo sapiens
ucaaggccuuauucuuaaa

SEQ ID NO: 1350570 - RNA, 19 nt, Homo sapiens
ccagagguuuccuaaaugg

SEQ ID NO: 1350571 - RNA, 19 nt, Homo sapiens
gcauggaaagacaauauau

SEQ ID NO: 1350572 - RNA, 19 nt, Homo sapiens
guugucguguuuacaguuu

SEQ ID NO: 1350573 - RNA, 19 nt, Homo sapiens
gagcuaccguggagucucu

SEQ ID NO: 1350574 - RNA, 19 nt, Homo sapiens
gacaacugcccacuaauca

SEQ ID NO: 1350575 - RNA, 19 nt, Homo sapiens
guggcaagauguucucaau

SEQ ID NO: 1350576 - RNA, 19 nt, Homo sapiens
gaacugcccacggcuuaga

SEQ ID NO: 1350577 - RNA, 19 nt, Homo sapiens
gaaugauuaguugggauua

SEQ ID NO: 1350578 - RNA, 19 nt, Homo sapiens
guucucaaauagugaugaa

SEQ ID NO: 1350579 - RNA, 19 nt, Homo sapiens
gugcaccugucuuacauuc

SEQ ID NO: 1350580 - RNA, 19 nt, Homo sapiens
ugaaugcucuaggucagaa

SEQ ID NO: 1350581 - RNA, 19 nt, Homo sapiens
gccgaguaguggagaauau

SEQ ID NO: 1350582 - RNA, 19 nt, Homo sapiens
gaccaugggacugaaguuu

SEQ ID NO: 1350583 - RNA, 19 nt, Homo sapiens
ggucaaccuuggcgaacug

SEQ ID NO: 1350584 - RNA, 19 nt, Homo sapiens
caacugcccacuaaucaca

SEQ ID NO: 1350585 - RNA, 19 nt, Homo sapiens
ggauauugagggccgagua

SEQ ID NO: 1350586 - RNA, 19 nt, Homo sapiens
uuggagcaguugaacauuu

SEQ ID NO: 1350587 - RNA, 19 nt, Homo sapiens
gacaaugcauuaagaaccu

SEQ ID NO: 1350588 - RNA, 19 nt, Homo sapiens
uuggcgaacugaguauuua

SEQ ID NO: 1350589 - RNA, 19 nt, Homo sapiens
ccaacuuucuauacacugu

SEQ ID NO: 1350590 - RNA, 19 nt, Homo sapiens
gaaucuaaauggguguaca

SEQ ID NO: 1350591 - RNA, 19 nt, Homo sapiens
caagagcagguuugagaug

SEQ ID NO: 1350592 - RNA, 19 nt, Homo sapiens
caagaguacuucugaguua

SEQ ID NO: 1350593 - RNA, 19 nt, Homo sapiens
ggaccuagcuuuaaaucaa

SEQ ID NO: 1350594 - RNA, 19 nt, Homo sapiens
ggaccgggauuaucacuuu

SEQ ID NO: 1350595 - RNA, 19 nt, Homo sapiens
gaaacuaguucaccuaaag

SEQ ID NO: 1350596 - RNA, 19 nt, Homo sapiens
ccaaagugcugggauuaua

SEQ ID NO: 1350597 - RNA, 19 nt, Homo sapiens
ccaaauggauuguggaaga

SEQ ID NO: 1350598 - RNA, 19 nt, Homo sapiens
gaggaaggcugcugcuguu

SEQ ID NO: 1350599 - RNA, 19 nt, Homo sapiens
gagaagauccuacaagcaa

SEQ ID NO: 1350600 - RNA, 19 nt, Homo sapiens
aauuuaagcuccucacuuu

SEQ ID NO: 1350601 - RNA, 19 nt, Homo sapiens
gaguacuucugaguuauua

SEQ ID NO: 1350602 - RNA, 19 nt, Homo sapiens
ggaugcagcugagugauga

SEQ ID NO: 1350603 - RNA, 19 nt, Homo sapiens
gagauugcuuccuaccuuu

SEQ ID NO: 1350604 - RNA, 19 nt, Homo sapiens
uagaggaccuagcuuuaaa

SEQ ID NO: 1350605 - RNA, 19 nt, Homo sapiens
ggagagaaguucggucugu

SEQ ID NO: 1350606 - RNA, 19 nt, Homo sapiens
gcaccuauaucuggaugaa

SEQ ID NO: 1350607 - RNA, 19 nt, Homo sapiens
gcagaaagggugaaucuag

SEQ ID NO: 1350608 - RNA, 19 nt, Homo sapiens
gaaacucuggaccucauua

SEQ ID NO: 1350609 - RNA, 19 nt, Homo sapiens
gcaaggcuuucuacagugu

SEQ ID NO: 1350610 - RNA, 19 nt, Homo sapiens
gccaaaagcucaauuccua

SEQ ID NO: 1350611 - RNA, 19 nt, Homo sapiens
gaaccaggucaaaguguaa

SEQ ID NO: 1350612 - RNA, 19 nt, Homo sapiens
ggaagagaaaccuuauauu

SEQ ID NO: 1350613 - RNA, 19 nt, Homo sapiens
cugaacaucugauucugua

SEQ ID NO: 1350614 - RNA, 19 nt, Homo sapiens
acccaaagaucaugauauu

SEQ ID NO: 1350615 - RNA, 19 nt, Homo sapiens
guagaggaccuagcuuuaa

SEQ ID NO: 1350616 - RNA, 19 nt, Homo sapiens
ugagauugcuuccuaccuu

SEQ ID NO: 1350617 - RNA, 19 nt, Homo sapiens
gcuaggcaaccaaauuuaa

SEQ ID NO: 1350618 - RNA, 19 nt, Homo sapiens
cagcuaaacugacuagaac

SEQ ID NO: 1350619 - RNA, 19 nt, Homo sapiens
uaucugagcugcaaucacu

SEQ ID NO: 1350620 - RNA, 19 nt, Homo sapiens
ggaggcagcugagaaaugc

SEQ ID NO: 1350621 - RNA, 19 nt, Homo sapiens
gaacaucugauucuguauc

SEQ ID NO: 1350622 - RNA, 19 nt, Homo sapiens
gcagcugagugaugaggaa

SEQ ID NO: 1350623 - RNA, 19 nt, Homo sapiens
gcugagaaaugcugugucu

SEQ ID NO: 1350624 - RNA, 19 nt, Homo sapiens
ggaaagccgccacucguau

SEQ ID NO: 1350625 - RNA, 19 nt, Homo sapiens
uaucaaauuugcagcacuu

SEQ ID NO: 1350626 - RNA, 19 nt, Homo sapiens
cuagucaguuugcuugaaa

SEQ ID NO: 1350627 - RNA, 19 nt, Homo sapiens
gaggcuaggugggugauug

SEQ ID NO: 1350628 - RNA, 19 nt, Homo sapiens
agaaccaggucaaagugua

SEQ ID NO: 1350629 - RNA, 19 nt, Homo sapiens
gaguagaggaccuagcuuu

SEQ ID NO: 1350630 - RNA, 19 nt, Homo sapiens
ucaggucacuuguacacuu

SEQ ID NO: 1350631 - RNA, 19 nt, Homo sapiens
cgaaugauccucccaccuu

SEQ ID NO: 1350632 - RNA, 19 nt, Homo sapiens
gaccuagcuuuaaaucaau

SEQ ID NO: 1350633 - RNA, 19 nt, Homo sapiens
gaucaugauauuccaaaug

SEQ ID NO: 1350634 - RNA, 19 nt, Homo sapiens
aaauuaugcuccuaagugu

SEQ ID NO: 1350635 - RNA, 19 nt, Homo sapiens
ugucuggccuaguguauga

SEQ ID NO: 1350636 - RNA, 19 nt, Homo sapiens
gauucuguaucuucaguau

SEQ ID NO: 1350637 - RNA, 19 nt, Homo sapiens
gaagauccuacaagcaaug

SEQ ID NO: 1350638 - RNA, 19 nt, Homo sapiens
ugucaugcuuuggauauuu

SEQ ID NO: 1350639 - RNA, 19 nt, Homo sapiens
augaugagauugcuuccua

SEQ ID NO: 1350640 - RNA, 19 nt, Homo sapiens
acacuugguuuccuaguag

SEQ ID NO: 1350641 - RNA, 19 nt, Homo sapiens
cuccuuaucugucugagaa

SEQ ID NO: 1350642 - RNA, 19 nt, Homo sapiens
ggacaucgugagggugaua

SEQ ID NO: 1350643 - RNA, 19 nt, Homo sapiens
ccaauuuacugaaaacuug

SEQ ID NO: 1350644 - RNA, 19 nt, Homo sapiens
uuucuuggccuucuucuaa

SEQ ID NO: 1350645 - RNA, 19 nt, Homo sapiens
uugcaaggcuuucuacagu

SEQ ID NO: 1350646 - RNA, 19 nt, Homo sapiens
gcaacaaaggcaucuaugg

SEQ ID NO: 1350647 - RNA, 19 nt, Homo sapiens
ccaagaguacuucugaguu

SEQ ID NO: 1350648 - RNA, 19 nt, Homo sapiens
ugagaaaugcugugucugu

SEQ ID NO: 1350649 - RNA, 19 nt, Homo sapiens
caauggcucuguguacugu

SEQ ID NO: 1350650 - RNA, 19 nt, Homo sapiens
gaaagccgccacucguauc

SEQ ID NO: 1350651 - RNA, 19 nt, Homo sapiens
gcagcacuuuguaaaugau

SEQ ID NO: 1350652 - RNA, 19 nt, Homo sapiens
cauccaagaguacuucuga

SEQ ID NO: 1350653 - RNA, 19 nt, Homo sapiens
ccuaaagcuagaucucuua

SEQ ID NO: 1350654 - RNA, 19 nt, Homo sapiens
uacacuugguuuccuagua

SEQ ID NO: 1350655 - RNA, 19 nt, Homo sapiens
caaagaucaugauauucca

SEQ ID NO: 1350656 - RNA, 19 nt, Homo sapiens
ggaaggcugcugcuguuuc

SEQ ID NO: 1350657 - RNA, 19 nt, Homo sapiens
gagagcuccuuaucugucu

SEQ ID NO: 1350658 - RNA, 19 nt, Homo sapiens
uggaagagaaaccuuauau

SEQ ID NO: 1350659 - RNA, 19 nt, Homo sapiens
guacugugaggaagauuau

SEQ ID NO: 1350660 - RNA, 19 nt, Homo sapiens
uugcagcacuuuguaaaug

SEQ ID NO: 1350661 - RNA, 19 nt, Homo sapiens
uagaaacucuggaccucau

SEQ ID NO: 1350662 - RNA, 19 nt, Homo sapiens
ggguucggcugccaggaaa

SEQ ID NO: 1350663 - RNA, 19 nt, Homo sapiens
ccaaagaucaugauauucc

SEQ ID NO: 1350664 - RNA, 19 nt, Homo sapiens
gaaggcugcugcuguuucc

SEQ ID NO: 1350665 - RNA, 19 nt, Homo sapiens
ugucuguggucacuugauu

SEQ ID NO: 1350666 - RNA, 19 nt, Homo sapiens
acacugauuugauacuagu

SEQ ID NO: 1350667 - RNA, 19 nt, Homo sapiens
ccuaguagaagcucacuug

SEQ ID NO: 1350668 - RNA, 19 nt, Homo sapiens
caggucacuuguacacuug

SEQ ID NO: 1350669 - RNA, 19 nt, Homo sapiens
uagccacauucccaaguuu

SEQ ID NO: 1350670 - RNA, 19 nt, Homo sapiens
guacgugguugcucuucuc

SEQ ID NO: 1350671 - RNA, 19 nt, Homo sapiens
gaacuccugggcucgaaug

SEQ ID NO: 1350672 - RNA, 19 nt, Homo sapiens
uauacugugucaccgacua

SEQ ID NO: 1350673 - RNA, 19 nt, Homo sapiens
ccaaccaaguauacugugu

SEQ ID NO: 1350674 - RNA, 19 nt, Homo sapiens
gucgacgcgugaacagaua

SEQ ID NO: 1350675 - RNA, 19 nt, Homo sapiens
gccaccagguccuuucguu

SEQ ID NO: 1350676 - RNA, 19 nt, Homo sapiens
ggagaacccucggggauug

SEQ ID NO: 1350677 - RNA, 19 nt, Homo sapiens
gcucuagcuucgccaguag

SEQ ID NO: 1350678 - RNA, 19 nt, Homo sapiens
gcacacacacacucucucu

SEQ ID NO: 1350679 - RNA, 19 nt, Homo sapiens
ggaugaagagguagaaacu

SEQ ID NO: 1350680 - RNA, 19 nt, Homo sapiens
gaguccggcugcagggaaa

SEQ ID NO: 1350681 - RNA, 19 nt, Homo sapiens
aguagaggaccuagcuuua

SEQ ID NO: 1350682 - RNA, 19 nt, Homo sapiens
gcaugagucacgcaauguu

SEQ ID NO: 1350683 - RNA, 19 nt, Homo sapiens
ggagaagauccuacaagca

SEQ ID NO: 1350684 - RNA, 19 nt, Homo sapiens
caaagugcugggauuauag

SEQ ID NO: 1350685 - RNA, 19 nt, Homo sapiens
caucugauucuguaucuuc

SEQ ID NO: 1350686 - RNA, 19 nt, Homo sapiens
ucccaugugugcagucuga

SEQ ID NO: 1350687 - RNA, 19 nt, Homo sapiens
caaauggauuguggaagag

SEQ ID NO: 1350688 - RNA, 19 nt, Homo sapiens
ccauggaccgggauuauca

SEQ ID NO: 1350689 - RNA, 19 nt, Homo sapiens
guacuucugaguuauuauc

SEQ ID NO: 1350690 - RNA, 19 nt, Homo sapiens
ucacuuguacacuugguuu

SEQ ID NO: 1350691 - RNA, 19 nt, Homo sapiens
accuauaucuggaugaaga

SEQ ID NO: 1350692 - RNA, 19 nt, Homo sapiens
gcaaggaguugguguugau

SEQ ID NO: 1350693 - RNA, 19 nt, Homo sapiens
aagaagaggaggaguauuu

SEQ ID NO: 1350694 - RNA, 19 nt, Homo sapiens
ccaaagaagaggaggagua

SEQ ID NO: 1350695 - RNA, 19 nt, Homo sapiens
ggacgcugguggacggauu

SEQ ID NO: 1350696 - RNA, 19 nt, Homo sapiens
gaagaccccauaccaaaua

SEQ ID NO: 1350697 - RNA, 19 nt, Homo sapiens
caaagaagaggaggaguau

SEQ ID NO: 1350698 - RNA, 19 nt, Homo sapiens
ggacgaugacccuacagaa

SEQ ID NO: 1350699 - RNA, 19 nt, Homo sapiens
acaccgugcuggacuucua

SEQ ID NO: 1350700 - RNA, 19 nt, Homo sapiens
caccaccuguaaucuacua

SEQ ID NO: 1350701 - RNA, 19 nt, Homo sapiens
guauuugcuucgacagguu

SEQ ID NO: 1350702 - RNA, 19 nt, Homo sapiens
ggaggaguauuugcuucga

SEQ ID NO: 1350703 - RNA, 19 nt, Homo sapiens
ggacggaccacuguacuac

SEQ ID NO: 1350704 - RNA, 19 nt, Homo sapiens
ugacuucaucuccaaagaa

SEQ ID NO: 1350705 - RNA, 19 nt, Homo sapiens
caccuguaaucuacuaugu

SEQ ID NO: 1350706 - RNA, 19 nt, Homo sapiens
ugucaaaccucagccucuu

SEQ ID NO: 1350707 - RNA, 19 nt, Homo sapiens
cuaugucccugacuucauc

SEQ ID NO: 1350708 - RNA, 19 nt, Homo sapiens
ggcaccaccuguaaucuac

SEQ ID NO: 1350709 - RNA, 19 nt, Homo sapiens
cuaaccauguccucgugaa

SEQ ID NO: 1350710 - RNA, 19 nt, Homo sapiens
cagaagaccccauaccaaa

SEQ ID NO: 1350711 - RNA, 19 nt, Homo sapiens
ucuacuaugucccugacuu

SEQ ID NO: 1350712 - RNA, 19 nt, Homo sapiens
ugugugagcuacagaagac

SEQ ID NO: 1350713 - RNA, 19 nt, Homo sapiens
agaggacgaugacccuaca

SEQ ID NO: 1350714 - RNA, 19 nt, Homo sapiens
gaagaggaggaguauuugc

SEQ ID NO: 1350715 - RNA, 19 nt, Homo sapiens
gggcuccccuggguuauuu

SEQ ID NO: 1350716 - RNA, 19 nt, Homo sapiens
gacgaugacccuacagaac

SEQ ID NO: 1350717 - RNA, 19 nt, Homo sapiens
ggauugggugcaaggaguu

SEQ ID NO: 1350718 - RNA, 19 nt, Homo sapiens
gcugugacuccgcgaccua

SEQ ID NO: 1350719 - RNA, 19 nt, Homo sapiens
ccaggugggcuuccucauc

SEQ ID NO: 1350720 - RNA, 19 nt, Homo sapiens
gugcaaggaguugguguug

SEQ ID NO: 1350721 - RNA, 19 nt, Homo sapiens
ccuaggaaccgugggcaaa

SEQ ID NO: 1350722 - RNA, 19 nt, Homo sapiens
gcgcuacguggacaaagug

SEQ ID NO: 1350723 - RNA, 19 nt, Homo sapiens
agaagaggaggaguauuug

SEQ ID NO: 1350724 - RNA, 19 nt, Homo sapiens
ccaaauaucccaagaggaa

SEQ ID NO: 1350725 - RNA, 19 nt, Homo sapiens
cagcacccaugguuuauuu

SEQ ID NO: 1350726 - RNA, 19 nt, Homo sapiens
uaaacuauuuccagucuug

SEQ ID NO: 1350727 - RNA, 19 nt, Homo sapiens
gaacggaggacucuaaugg

SEQ ID NO: 1350728 - RNA, 19 nt, Homo sapiens
ugacggcacuguggaagua

SEQ ID NO: 1350729 - RNA, 19 nt, Homo sapiens
gaggaacggaggacucuaa

SEQ ID NO: 1350730 - RNA, 19 nt, Homo sapiens
gagacgccgugacuuugaa

SEQ ID NO: 1350731 - RNA, 19 nt, Homo sapiens
acucacacauggagaacua

SEQ ID NO: 1350732 - RNA, 19 nt, Homo sapiens
ggagacgccgugacuuuga

SEQ ID NO: 1350733 - RNA, 19 nt, Homo sapiens
acaccaagaugcagaaguc

SEQ ID NO: 1350734 - RNA, 19 nt, Homo sapiens
ggucgugagccgugaguuu

SEQ ID NO: 1350735 - RNA, 19 nt, Homo sapiens
acagagaacauaccagaga

SEQ ID NO: 1350736 - RNA, 19 nt, Homo sapiens
acccaugguuuauuucaaa

SEQ ID NO: 1350737 - RNA, 19 nt, Homo sapiens
aaacccaaauaucccaaga

SEQ ID NO: 1350738 - RNA, 19 nt, Homo sapiens
ugcgggagaucguguggua

SEQ ID NO: 1350739 - RNA, 19 nt, Homo sapiens
ucuaaacuauuuccagucu

SEQ ID NO: 1350740 - RNA, 19 nt, Homo sapiens
acggaggacucuaaugguu

SEQ ID NO: 1350741 - RNA, 19 nt, Homo sapiens
guccggaucucagacaaug

SEQ ID NO: 1350742 - RNA, 19 nt, Homo sapiens
gcacccaugguuuauuuca

SEQ ID NO: 1350743 - RNA, 19 nt, Homo sapiens
caucgugucuggaggaaaa

SEQ ID NO: 1350744 - RNA, 19 nt, Homo sapiens
cagacaauggucccuauga

SEQ ID NO: 1350745 - RNA, 19 nt, Homo sapiens
gaaggugguccuggcauca

SEQ ID NO: 1350746 - RNA, 19 nt, Homo sapiens
agacaauggucccuaugag

SEQ ID NO: 1350747 - RNA, 19 nt, Homo sapiens
gacaauggucccuaugagu

SEQ ID NO: 1350748 - RNA, 19 nt, Homo sapiens
cggcucaucguguuugaaa

SEQ ID NO: 1350749 - RNA, 19 nt, Homo sapiens
cuaccaagcccagaacuuc

SEQ ID NO: 1350750 - RNA, 19 nt, Homo sapiens
cuuagucucuuuccaucug

SEQ ID NO: 1350751 - RNA, 19 nt, Homo sapiens
ggaacggaggacucuaaug

SEQ ID NO: 1350752 - RNA, 19 nt, Homo sapiens
gcagcuagggagccgagaa

SEQ ID NO: 1350753 - RNA, 19 nt, Homo sapiens
gccaaccacagagaacaua

SEQ ID NO: 1350754 - RNA, 19 nt, Homo sapiens
ucuucagucgguuuaauua

SEQ ID NO: 1350755 - RNA, 19 nt, Homo sapiens
aguguaacuucaagacaga

SEQ ID NO: 1350756 - RNA, 19 nt, Homo sapiens
ccaaaggacccaaaauugu

SEQ ID NO: 1350757 - RNA, 19 nt, Homo sapiens
cuggagacgccgugacuuu

SEQ ID NO: 1350758 - RNA, 19 nt, Homo sapiens
caggcaacaucuuccucaa

SEQ ID NO: 1350759 - RNA, 19 nt, Homo sapiens
caccaacuacucacacaug

SEQ ID NO: 1350760 - RNA, 19 nt, Homo sapiens
gcuccucccaccuccauug

SEQ ID NO: 1350761 - RNA, 19 nt, Homo sapiens
gugcucgcccugacaguga

SEQ ID NO: 1350762 - RNA, 19 nt, Homo sapiens
acccacagaucgacaacga

SEQ ID NO: 1350763 - RNA, 19 nt, Homo sapiens
agugguggcugcugacaca

SEQ ID NO: 1350764 - RNA, 19 nt, Homo sapiens
ccucccaccuccauugaag

SEQ ID NO: 1350765 - RNA, 19 nt, Homo sapiens
gcaacaucuuccucaacgu

SEQ ID NO: 1350766 - RNA, 19 nt, Homo sapiens
gcgauucggcuccaaacuc

SEQ ID NO: 1350767 - RNA, 19 nt, Homo sapiens
guucuuagucucuuuccau

SEQ ID NO: 1350768 - RNA, 19 nt, Homo sapiens
caaaggacccaaaauugug

SEQ ID NO: 1350769 - RNA, 19 nt, Homo sapiens
cacccaugguuuauuucaa

SEQ ID NO: 1350770 - RNA, 19 nt, Homo sapiens
gauucugguccauggguuu

SEQ ID NO: 1350771 - RNA, 19 nt, Homo sapiens
gcuaccaagcccagaacuu

SEQ ID NO: 1350772 - RNA, 19 nt, Homo sapiens
gccauguucuccaccaacu

SEQ ID NO: 1350773 - RNA, 19 nt, Homo sapiens
caccuucgacgccauguuc

SEQ ID NO: 1350774 - RNA, 19 nt, Homo sapiens
ggcaucaggcaacaucuuc

SEQ ID NO: 1350775 - RNA, 19 nt, Homo sapiens
gcaggcagcugguguggaa

SEQ ID NO: 1350776 - RNA, 19 nt, Homo sapiens
gaucugaaucucugacuua

SEQ ID NO: 1350777 - RNA, 19 nt, Homo sapiens
gaaggaaugucgcgugcaa

SEQ ID NO: 1350778 - RNA, 19 nt, Homo sapiens
ccagugaucuccagagcua

SEQ ID NO: 1350779 - RNA, 19 nt, Homo sapiens
caagcuggaugaccucuuu

SEQ ID NO: 1350780 - RNA, 19 nt, Homo sapiens
cugaaucucugacuuauug

SEQ ID NO: 1350781 - RNA, 19 nt, Homo sapiens
gaacaucaccucgaccauu

SEQ ID NO: 1350782 - RNA, 19 nt, Homo sapiens
caaugucgaugcuuucaug

SEQ ID NO: 1350783 - RNA, 19 nt, Homo sapiens
uauggaaccugucaaguag

SEQ ID NO: 1350784 - RNA, 19 nt, Homo sapiens
gaacauccgccuggccaaa

SEQ ID NO: 1350785 - RNA, 19 nt, Homo sapiens
gcggugagccauucaguga

SEQ ID NO: 1350786 - RNA, 19 nt, Homo sapiens
uuauggaaccugucaagua

SEQ ID NO: 1350787 - RNA, 19 nt, Homo sapiens
gaacagccugaucauccua

SEQ ID NO: 1350788 - RNA, 19 nt, Homo sapiens
ccucacacccugucuggua

SEQ ID NO: 1350789 - RNA, 19 nt, Homo sapiens
cagcugguguggaagaaug

SEQ ID NO: 1350790 - RNA, 19 nt, Homo sapiens
aacaucaccucgaccauug

SEQ ID NO: 1350791 - RNA, 19 nt, Homo sapiens
uggaaccugucaaguaguu

SEQ ID NO: 1350792 - RNA, 19 nt, Homo sapiens
gaggauaauuaaacaugcu

SEQ ID NO: 1350793 - RNA, 19 nt, Homo sapiens
cagugaggauaauuaaaca

SEQ ID NO: 1350794 - RNA, 19 nt, Homo sapiens
ccagugaggauaauuaaac

SEQ ID NO: 1350795 - RNA, 19 nt, Homo sapiens
cuaguucccugcccucaca

SEQ ID NO: 1350796 - RNA, 19 nt, Homo sapiens
caaggccggugggaauuuc

SEQ ID NO: 1350797 - RNA, 19 nt, Homo sapiens
gugaggauaauuaaacaug

SEQ ID NO: 1350798 - RNA, 19 nt, Homo sapiens
gaagcugguguccaacaga

SEQ ID NO: 1350799 - RNA, 19 nt, Homo sapiens
ccacggacgcauagacaau

SEQ ID NO: 1350800 - RNA, 19 nt, Homo sapiens
ccaaggccggugggaauuu

SEQ ID NO: 1350801 - RNA, 19 nt, Homo sapiens
cuggaugaccucuuuguga

SEQ ID NO: 1350802 - RNA, 19 nt, Homo sapiens
ugaaggagcggaccaucuc

SEQ ID NO: 1350803 - RNA, 19 nt, Homo sapiens
gauuauggaaccugucaag

SEQ ID NO: 1350804 - RNA, 19 nt, Homo sapiens
ugucgaugcuuucaugaac

SEQ ID NO: 1350805 - RNA, 19 nt, Homo sapiens
gaaccugucaaguaguuuu

SEQ ID NO: 1350806 - RNA, 19 nt, Homo sapiens
caucgggugcgaaacuuug

SEQ ID NO: 1350807 - RNA, 19 nt, Homo sapiens
ucugagaacagccugauca

SEQ ID NO: 1350808 - RNA, 19 nt, Homo sapiens
gaaucucugacuuauugau

SEQ ID NO: 1350809 - RNA, 19 nt, Homo sapiens
ugaucugaaucucugacuu

SEQ ID NO: 1350810 - RNA, 19 nt, Homo sapiens
ggggaaagcggaaggaaug

SEQ ID NO: 1350811 - RNA, 19 nt, Homo sapiens
guacauaucucucuucaau

SEQ ID NO: 1350812 - RNA, 19 nt, Homo sapiens
ggaggaaugugauaacuag

SEQ ID NO: 1350813 - RNA, 19 nt, Homo sapiens
cagaugaccacauuuaaua

SEQ ID NO: 1350814 - RNA, 19 nt, Homo sapiens
ccagugaacuuugugcuuu

SEQ ID NO: 1350815 - RNA, 19 nt, Homo sapiens
ggaaugugauaacuagguu

SEQ ID NO: 1350816 - RNA, 19 nt, Homo sapiens
ucucucagcuuucguguug

SEQ ID NO: 1350817 - RNA, 19 nt, Homo sapiens
uuacugagccucuggauga

SEQ ID NO: 1350818 - RNA, 19 nt, Homo sapiens
cagcuucuguguugugauu

SEQ ID NO: 1350819 - RNA, 19 nt, Homo sapiens
gcgagcgucucucagcuuu

SEQ ID NO: 1350820 - RNA, 19 nt, Homo sapiens
ggaagucaacuaugcuuug

SEQ ID NO: 1350821 - RNA, 19 nt, Homo sapiens
ugacccagaugaccacauu

SEQ ID NO: 1350822 - RNA, 19 nt, Homo sapiens
gaagucaacuaugcuuugg

SEQ ID NO: 1350823 - RNA, 19 nt, Homo sapiens
gaacaggacccgggaugga

SEQ ID NO: 1350824 - RNA, 19 nt, Homo sapiens
gcucacugcucucccguau

SEQ ID NO: 1350825 - RNA, 19 nt, Homo sapiens
gaccacauuuaauaccaaa

SEQ ID NO: 1350826 - RNA, 19 nt, Homo sapiens
gcacugaggaagcugagaa

SEQ ID NO: 1350827 - RNA, 19 nt, Homo sapiens
gugauucccuucucuucaa

SEQ ID NO: 1350828 - RNA, 19 nt, Homo sapiens
ggacacucaucccgugaca

SEQ ID NO: 1350829 - RNA, 19 nt, Homo sapiens
ucacugcucucccguaucg

SEQ ID NO: 1350830 - RNA, 19 nt, Homo sapiens
agaaggccauggagaagga

SEQ ID NO: 1350831 - RNA, 19 nt, Homo sapiens
ucaacgguuucaguacaua

SEQ ID NO: 1350832 - RNA, 19 nt, Homo sapiens
ccagaugaccacauuuaau

SEQ ID NO: 1350833 - RNA, 19 nt, Homo sapiens
caguacauaucucucuuca

SEQ ID NO: 1350834 - RNA, 19 nt, Homo sapiens
gccaggggcugcuuguuuu

SEQ ID NO: 1350835 - RNA, 19 nt, Homo sapiens
ugaccacauuuaauaccaa

SEQ ID NO: 1350836 - RNA, 19 nt, Homo sapiens
gagcgucucucagcuuucg

SEQ ID NO: 1350837 - RNA, 19 nt, Homo sapiens
cguggaacguggucuuugu

SEQ ID NO: 1350838 - RNA, 19 nt, Homo sapiens
cuucaacgguuucaguaca

SEQ ID NO: 1350839 - RNA, 19 nt, Homo sapiens
guuacuuguuacugaguuu

SEQ ID NO: 1350840 - RNA, 19 nt, Homo sapiens
cagugaacuuugugcuuug

SEQ ID NO: 1350841 - RNA, 19 nt, Homo sapiens
gcagaaggccauggagaag

SEQ ID NO: 1350842 - RNA, 19 nt, Homo sapiens
acccagaugaccacauuua

SEQ ID NO: 1350843 - RNA, 19 nt, Homo sapiens
gggaagucaacuaugcuuu

SEQ ID NO: 1350844 - RNA, 19 nt, Homo sapiens
ccagggcccaccuuacuga

SEQ ID NO: 1350845 - RNA, 19 nt, Homo sapiens
guccugugguggccauuug

SEQ ID NO: 1350846 - RNA, 19 nt, Homo sapiens
uguuguuacuuguuacuga

SEQ ID NO: 1350847 - RNA, 19 nt, Homo sapiens
ccggaggacugugaugaug

SEQ ID NO: 1350848 - RNA, 19 nt, Homo sapiens
gaguggggcugucugaguu

SEQ ID NO: 1350849 - RNA, 19 nt, Homo sapiens
ugccagagccagcacuaaa

SEQ ID NO: 1350850 - RNA, 19 nt, Homo sapiens
cgaccgggaagucaacuau

SEQ ID NO: 1350851 - RNA, 19 nt, Homo sapiens
auuugcagcuucuguguug

SEQ ID NO: 1350852 - RNA, 19 nt, Homo sapiens
cguguguguucuucucuga

SEQ ID NO: 1350853 - RNA, 19 nt, Homo sapiens
gagccagcacuaaaguaga

SEQ ID NO: 1350854 - RNA, 19 nt, Homo sapiens
cagagccagcacuaaagua

SEQ ID NO: 1350855 - RNA, 19 nt, Homo sapiens
caacgguuucaguacauau

SEQ ID NO: 1350856 - RNA, 19 nt, Homo sapiens
ggagccguguguguucuuc

SEQ ID NO: 1350857 - RNA, 19 nt, Homo sapiens
gaugccgaauuccaagagu

SEQ ID NO: 1350858 - RNA, 19 nt, Homo sapiens
gcccagguguuuggagaca

SEQ ID NO: 1350859 - RNA, 19 nt, Homo sapiens
cccagaugaccacauuuaa

SEQ ID NO: 1350860 - RNA, 19 nt, Homo sapiens
ccagagccagcacuaaagu

SEQ ID NO: 1350861 - RNA, 19 nt, Homo sapiens
gaaggcaccagggcacagu

SEQ ID NO: 1350862 - RNA, 19 nt, Homo sapiens
uggaggaaugugauaacua

SEQ ID NO: 1350863 - RNA, 19 nt, Homo sapiens
gaagacaucuguaagacua

SEQ ID NO: 1350864 - RNA, 19 nt, Homo sapiens
gaagaaaccuugagaacga

SEQ ID NO: 1350865 - RNA, 19 nt, Homo sapiens
gaacgaaguuacagcuuau

SEQ ID NO: 1350866 - RNA, 19 nt, Homo sapiens
gaacugugcugaagacauc

SEQ ID NO: 1350867 - RNA, 19 nt, Homo sapiens
agaacgaaguuacagcuua

SEQ ID NO: 1350868 - RNA, 19 nt, Homo sapiens
ggaagugcauuucaagauc

SEQ ID NO: 1350869 - RNA, 19 nt, Homo sapiens
gcaaagaaggaauaucuga

SEQ ID NO: 1350870 - RNA, 19 nt, Homo sapiens
ccaagaacccgaagaagaa

SEQ ID NO: 1350871 - RNA, 19 nt, Homo sapiens
gaaguuacagcuuauccua

SEQ ID NO: 1350872 - RNA, 19 nt, Homo sapiens
gcccagugcuucucucaaa

SEQ ID NO: 1350873 - RNA, 19 nt, Homo sapiens
ggaaguggcugccuaugac

SEQ ID NO: 1350874 - RNA, 19 nt, Homo sapiens
caacgaagacuaugagauc

SEQ ID NO: 1350875 - RNA, 19 nt, Homo sapiens
gaagugcauuucaagaucu

SEQ ID NO: 1350876 - RNA, 19 nt, Homo sapiens
gaacaacgaagacuaugag

SEQ ID NO: 1350877 - RNA, 19 nt, Homo sapiens
gccaagaacccgaagaaga

SEQ ID NO: 1350878 - RNA, 19 nt, Homo sapiens
gcacugcucuccuuuuaau

SEQ ID NO: 1350879 - RNA, 19 nt, Homo sapiens
gaagacagaagcagcaaag

SEQ ID NO: 1350880 - RNA, 19 nt, Homo sapiens
gggcuagccucgucuccaa

SEQ ID NO: 1350881 - RNA, 19 nt, Homo sapiens
gcugagagcuguggaucug

SEQ ID NO: 1350882 - RNA, 19 nt, Homo sapiens
caaagaaggaauaucugaa

SEQ ID NO: 1350883 - RNA, 19 nt, Homo sapiens
gcugaagacaucuguaaga

SEQ ID NO: 1350884 - RNA, 19 nt, Homo sapiens
cagaauuugcacuucauua

SEQ ID NO: 1350885 - RNA, 19 nt, Homo sapiens
cagcaaagaaggaauaucu

SEQ ID NO: 1350886 - RNA, 19 nt, Homo sapiens
gugcuucucucaaaucucu

SEQ ID NO: 1350887 - RNA, 19 nt, Homo sapiens
uacgaaaccuagaaacugu

SEQ ID NO: 1350888 - RNA, 19 nt, Homo sapiens
gacagaagcagcaaagaag

SEQ ID NO: 1350889 - RNA, 19 nt, Homo sapiens
caaacaaauucugaaacug

SEQ ID NO: 1350890 - RNA, 19 nt, Homo sapiens
cgagaacaacgaagacuau

SEQ ID NO: 1350891 - RNA, 19 nt, Homo sapiens
cgacgacuuuugucuauuu

SEQ ID NO: 1350892 - RNA, 19 nt, Homo sapiens
uaugauccuuagcacauuu

SEQ ID NO: 1350893 - RNA, 19 nt, Homo sapiens
agacagaagcagcaaagaa

SEQ ID NO: 1350894 - RNA, 19 nt, Homo sapiens
gugcugaagacaucuguaa

SEQ ID NO: 1350895 - RNA, 19 nt, Homo sapiens
ccaagcagcccauguaugc

SEQ ID NO: 1350896 - RNA, 19 nt, Homo sapiens
caagagcacucaggcaaac

SEQ ID NO: 1350897 - RNA, 19 nt, Homo sapiens
uaagggagacgcgcacaaa

SEQ ID NO: 1350898 - RNA, 19 nt, Homo sapiens
gcgagaacaacgaagacua

SEQ ID NO: 1350899 - RNA, 19 nt, Homo sapiens
ggacuucccgcacaucucu

SEQ ID NO: 1350900 - RNA, 19 nt, Homo sapiens
aagcagcaaagaaggaaua

SEQ ID NO: 1350901 - RNA, 19 nt, Homo sapiens
gaacagaagcaggccuaca

SEQ ID NO: 1350902 - RNA, 19 nt, Homo sapiens
agacaucuguaagacuauu

SEQ ID NO: 1350903 - RNA, 19 nt, Homo sapiens
ccaagagcacucaggcaaa

SEQ ID NO: 1350904 - RNA, 19 nt, Homo sapiens
gcagaauuugcacuucauu

SEQ ID NO: 1350905 - RNA, 19 nt, Homo sapiens
ggacagccugggagaggaa

SEQ ID NO: 1350906 - RNA, 19 nt, Homo sapiens
ggaccucccagccaucaug

SEQ ID NO: 1350907 - RNA, 19 nt, Homo sapiens
gagcagugacacacccauu

SEQ ID NO: 1350908 - RNA, 19 nt, Homo sapiens
ggaagacagaagcagcaaa

SEQ ID NO: 1350909 - RNA, 19 nt, Homo sapiens
caaccagccagaccuacaa

SEQ ID NO: 1350910 - RNA, 19 nt, Homo sapiens
uauaugauccuuagcacau

SEQ ID NO: 1350911 - RNA, 19 nt, Homo sapiens
gaucaaggugagaccaaga

SEQ ID NO: 1350912 - RNA, 19 nt, Homo sapiens
ggaagaggagucggaagug

SEQ ID NO: 1350913 - RNA, 19 nt, Homo sapiens
cacccaagcagcccaugua

SEQ ID NO: 1350914 - RNA, 19 nt, Homo sapiens
cggaaguggcugccuauga

SEQ ID NO: 1350915 - RNA, 19 nt, Homo sapiens
gaauuugcacuucauuacu

SEQ ID NO: 1350916 - RNA, 19 nt, Homo sapiens
gaacaaaagauuacgaaac

SEQ ID NO: 1350917 - RNA, 19 nt, Homo sapiens
aaagaaggaauaucugaag

SEQ ID NO: 1350918 - RNA, 19 nt, Homo sapiens
agucggaagugcauuucaa

SEQ ID NO: 1350919 - RNA, 19 nt, Homo sapiens
acccagagcuccugucaac

SEQ ID NO: 1350920 - RNA, 19 nt, Homo sapiens
gcuguggaucugugcauuu

SEQ ID NO: 1350921 - RNA, 19 nt, Homo sapiens
ggcaaacccaccagccaaa

SEQ ID NO: 1350922 - RNA, 19 nt, Homo sapiens
ggccuacgcacucuucuuc

SEQ ID NO: 1350923 - RNA, 19 nt, Homo sapiens
aaaagaaggaccccaauga

SEQ ID NO: 1350924 - RNA, 19 nt, Homo sapiens
gagaacgaaguuacagcuu

SEQ ID NO: 1350925 - RNA, 19 nt, Homo sapiens
caaaagauuacgaaaccua

SEQ ID NO: 1350926 - RNA, 19 nt, Homo sapiens
cgaaaccuagaaacuguug

SEQ ID NO: 1350927 - RNA, 19 nt, Homo sapiens
ccagagcuccugucaacca

SEQ ID NO: 1350928 - RNA, 19 nt, Homo sapiens
ccagagcgagaacaacgaa

SEQ ID NO: 1350929 - RNA, 19 nt, Homo sapiens
cagaagcagcaaagaagga

SEQ ID NO: 1350930 - RNA, 19 nt, Homo sapiens
aagaaaccuugagaacgaa

SEQ ID NO: 1350931 - RNA, 19 nt, Homo sapiens
uuacgaaaccuagaaacug

SEQ ID NO: 1350932 - RNA, 19 nt, Homo sapiens
cagaagcaggccuacaaga

SEQ ID NO: 1350933 - RNA, 19 nt, Homo sapiens
aacagaagcaggccuacaa

SEQ ID NO: 1350934 - RNA, 19 nt, Homo sapiens
gagaacaacgaagacuaug

SEQ ID NO: 1350935 - RNA, 19 nt, Homo sapiens
agaacaacgaagacuauga

SEQ ID NO: 1350936 - RNA, 19 nt, Homo sapiens
cggaagugcauuucaagau

SEQ ID NO: 1350937 - RNA, 19 nt, Homo sapiens
gcacgaguucuggcugaga

SEQ ID NO: 1350938 - RNA, 19 nt, Homo sapiens
uuagaacugugcugaagac

SEQ ID NO: 1350939 - RNA, 19 nt, Homo sapiens
cgacuuuugucuauuuaug

SEQ ID NO: 1350940 - RNA, 19 nt, Homo sapiens
gacgacuuuugucuauuua

SEQ ID NO: 1350941 - RNA, 19 nt, Homo sapiens
gcuagccucgucuccaaga

SEQ ID NO: 1350942 - RNA, 19 nt, Homo sapiens
guggaucugugcauuuuga

SEQ ID NO: 1350943 - RNA, 19 nt, Homo sapiens
agaauuugcacuucauuac

SEQ ID NO: 1350944 - RNA, 19 nt, Homo sapiens
uaugaagaaaccuugagaa

SEQ ID NO: 1350945 - RNA, 19 nt, Homo sapiens
aagauuacgaaaccuagaa

SEQ ID NO: 1350946 - RNA, 19 nt, Homo sapiens
gcagugacacacccauugc

SEQ ID NO: 1350947 - RNA, 19 nt, Homo sapiens
ccuacaagaggaagacaga

SEQ ID NO: 1350948 - RNA, 19 nt, Homo sapiens
ccaccaccagcccaaagaa

SEQ ID NO: 1350949 - RNA, 19 nt, Homo sapiens
agaagcaggccuacaagag

SEQ ID NO: 1350950 - RNA, 19 nt, Homo sapiens
ggccggagcugaaauuuaa

SEQ ID NO: 1350951 - RNA, 19 nt, Homo sapiens
gagaagaacuugcucuaug

SEQ ID NO: 1350952 - RNA, 19 nt, Homo sapiens
agaagaacuugcucuauga

SEQ ID NO: 1350953 - RNA, 19 nt, Homo sapiens
ccacugaaguccacugaga

SEQ ID NO: 1350954 - RNA, 19 nt, Homo sapiens
caagggagccucuuucuca

SEQ ID NO: 1350955 - RNA, 19 nt, Homo sapiens
gaaucacucuaccuucuug

SEQ ID NO: 1350956 - RNA, 19 nt, Homo sapiens
guauuuagcuaacaugagu

SEQ ID NO: 1350957 - RNA, 19 nt, Homo sapiens
cagcagaucuuccgcucuu

SEQ ID NO: 1350958 - RNA, 19 nt, Homo sapiens
agacaagggucaccaagga

SEQ ID NO: 1350959 - RNA, 19 nt, Homo sapiens
uagcuaacaugagugauuu

SEQ ID NO: 1350960 - RNA, 19 nt, Homo sapiens
gcaagcuucugucccaguu

SEQ ID NO: 1350961 - RNA, 19 nt, Homo sapiens
cagcgaggaugcccuauca

SEQ ID NO: 1350962 - RNA, 19 nt, Homo sapiens
caaggucccugacaacaag

SEQ ID NO: 1350963 - RNA, 19 nt, Homo sapiens
gcucagcaguggcaaagau

SEQ ID NO: 1350964 - RNA, 19 nt, Homo sapiens
cccaacaggugaugccaua

SEQ ID NO: 1350965 - RNA, 19 nt, Homo sapiens
gccgagacuucgaaacaaa

SEQ ID NO: 1350966 - RNA, 19 nt, Homo sapiens
acaagaaugugcuggacaa

SEQ ID NO: 1350967 - RNA, 19 nt, Homo sapiens
ggagaggcaccacuugaug

SEQ ID NO: 1350968 - RNA, 19 nt, Homo sapiens
cauccaaggucccugacaa

SEQ ID NO: 1350969 - RNA, 19 nt, Homo sapiens
acaagaacaacccgaagua

SEQ ID NO: 1350970 - RNA, 19 nt, Homo sapiens
aaauagcccuccucacaca

SEQ ID NO: 1350971 - RNA, 19 nt, Homo sapiens
gcagcaggcaggacuguga

SEQ ID NO: 1350972 - RNA, 19 nt, Homo sapiens
ccacuuaugcaucuguauu

SEQ ID NO: 1350973 - RNA, 19 nt, Homo sapiens
ggcacaagcuacacacaca

SEQ ID NO: 1350974 - RNA, 19 nt, Homo sapiens
gaaguacacagggaauguu

SEQ ID NO: 1350975 - RNA, 19 nt, Homo sapiens
agaggcagcucccaguguu

SEQ ID NO: 1350976 - RNA, 19 nt, Homo sapiens
aaauuuaacgcaccuguga

SEQ ID NO: 1350977 - RNA, 19 nt, Homo sapiens
cccagagccuccaucauug

SEQ ID NO: 1350978 - RNA, 19 nt, Homo sapiens
acacgacccucauauucau

SEQ ID NO: 1350979 - RNA, 19 nt, Homo sapiens
acacacgacccucauauuc

SEQ ID NO: 1350980 - RNA, 19 nt, Homo sapiens
ggccaacacugacacaaaa

SEQ ID NO: 1350981 - RNA, 19 nt, Homo sapiens
acccgcagcugggauguua

SEQ ID NO: 1350982 - RNA, 19 nt, Homo sapiens
gaacaacccgaaguacaca

SEQ ID NO: 1350983 - RNA, 19 nt, Homo sapiens
ggaccgcaguaccucuuuc

SEQ ID NO: 1350984 - RNA, 19 nt, Homo sapiens
ucacgaaucacucuaccuu

SEQ ID NO: 1350985 - RNA, 19 nt, Homo sapiens
aaacaaaguggaaguggau

SEQ ID NO: 1350986 - RNA, 19 nt, Homo sapiens
caccaguguucacgaauca

SEQ ID NO: 1350987 - RNA, 19 nt, Homo sapiens
ccaccaguguucacgaauc

SEQ ID NO: 1350988 - RNA, 19 nt, Homo sapiens
gggaauggcauaaacuuuu

SEQ ID NO: 1350989 - RNA, 19 nt, Homo sapiens
caacaggugaugccauaca

SEQ ID NO: 1350990 - RNA, 19 nt, Homo sapiens
ucacacauggcacaagcua

SEQ ID NO: 1350991 - RNA, 19 nt, Homo sapiens
agaaugugcuggacaagac

SEQ ID NO: 1350992 - RNA, 19 nt, Homo sapiens
gcaaaagcuugguaugaag

SEQ ID NO: 1350993 - RNA, 19 nt, Homo sapiens
ggacuaggggcucugauuu

SEQ ID NO: 1350994 - RNA, 19 nt, Homo sapiens
cuacauguccagccgagaa

SEQ ID NO: 1350995 - RNA, 19 nt, Homo sapiens
ccaaggucccugacaacaa

SEQ ID NO: 1350996 - RNA, 19 nt, Homo sapiens
ccacugagacauccaaggu

SEQ ID NO: 1350997 - RNA, 19 nt, Homo sapiens
ggacugacuacgccagcaa

SEQ ID NO: 1350998 - RNA, 19 nt, Homo sapiens
gacaagaacaacccgaagu

SEQ ID NO: 1350999 - RNA, 19 nt, Homo sapiens
gacgguugcugacaagaac

SEQ ID NO: 1351000 - RNA, 19 nt, Homo sapiens
cagccgagacuucgaaaca

SEQ ID NO: 1351001 - RNA, 19 nt, Homo sapiens
acucuaccuucuugcagua

SEQ ID NO: 1351002 - RNA, 19 nt, Homo sapiens
gagaggaggaagggacuga

SEQ ID NO: 1351003 - RNA, 19 nt, Homo sapiens
ccaaagagcacucgauccu

SEQ ID NO: 1351004 - RNA, 19 nt, Homo sapiens
uccuaagccucaccaaaga

SEQ ID NO: 1351005 - RNA, 19 nt, Homo sapiens
cagcaagaccagauucauc

SEQ ID NO: 1351006 - RNA, 19 nt, Homo sapiens
gcccuuggaucaggacuag

SEQ ID NO: 1351007 - RNA, 19 nt, Homo sapiens
ccuaauggcaggagaugga

SEQ ID NO: 1351008 - RNA, 19 nt, Homo sapiens
gaagaacuugcucuaugag

SEQ ID NO: 1351009 - RNA, 19 nt, Homo sapiens
cgagaagaacuugcucuau

SEQ ID NO: 1351010 - RNA, 19 nt, Homo sapiens
ggaggaagggacugacuac

SEQ ID NO: 1351011 - RNA, 19 nt, Homo sapiens
ggucaagggagccucuuuc

SEQ ID NO: 1351012 - RNA, 19 nt, Homo sapiens
uuagcuaacaugagugauu

SEQ ID NO: 1351013 - RNA, 19 nt, Homo sapiens
acccucauauucauacuug

SEQ ID NO: 1351014 - RNA, 19 nt, Homo sapiens
acacauggcacaagcuaca

SEQ ID NO: 1351015 - RNA, 19 nt, Homo sapiens
aaagcuugguaugaaguuu

SEQ ID NO: 1351016 - RNA, 19 nt, Homo sapiens
ucccuuagcccuuggauca

SEQ ID NO: 1351017 - RNA, 19 nt, Homo sapiens
aauuaucccuacccucaga

SEQ ID NO: 1351018 - RNA, 19 nt, Homo sapiens
acgaaucacucuaccuucu

SEQ ID NO: 1351019 - RNA, 19 nt, Homo sapiens
cacuuaugcaucuguauuu

SEQ ID NO: 1351020 - RNA, 19 nt, Homo sapiens
cacacgacccucauauuca

SEQ ID NO: 1351021 - RNA, 19 nt, Homo sapiens
acacacacgacccucauau

SEQ ID NO: 1351022 - RNA, 19 nt, Homo sapiens
cgaaguacacagggaaugu

SEQ ID NO: 1351023 - RNA, 19 nt, Homo sapiens
ccgagaagaacuugcucua

SEQ ID NO: 1351024 - RNA, 19 nt, Homo sapiens
gcaucuguauuuagcuaac

SEQ ID NO: 1351025 - RNA, 19 nt, Homo sapiens
augcaucuguauuuagcua

SEQ ID NO: 1351026 - RNA, 19 nt, Homo sapiens
aaacagcaagaccagauuc

SEQ ID NO: 1351027 - RNA, 19 nt, Homo sapiens
ucucccuucuccucccuua

SEQ ID NO: 1351028 - RNA, 19 nt, Homo sapiens
gcagaugggacagcagauc

SEQ ID NO: 1351029 - RNA, 19 nt, Homo sapiens
ugacgguugcugacaagaa

SEQ ID NO: 1351030 - RNA, 19 nt, Homo sapiens
gggcagccgagacuucgaa

SEQ ID NO: 1351031 - RNA, 19 nt, Homo sapiens
guuccuaagccucaccaaa

SEQ ID NO: 1351032 - RNA, 19 nt, Homo sapiens
gcaggcaggacugugauuc

SEQ ID NO: 1351033 - RNA, 19 nt, Homo sapiens
caggagauggaccgcagua

SEQ ID NO: 1351034 - RNA, 19 nt, Homo sapiens
aggcaccacuugauggaau

SEQ ID NO: 1351035 - RNA, 19 nt, Homo sapiens
ugaaguccacugagacauc

SEQ ID NO: 1351036 - RNA, 19 nt, Homo sapiens
aacaggugaugccauacaa

SEQ ID NO: 1351037 - RNA, 19 nt, Homo sapiens
cgaaucacucuaccuucuu

SEQ ID NO: 1351038 - RNA, 19 nt, Homo sapiens
gagcucagcaguggcaaag

SEQ ID NO: 1351039 - RNA, 19 nt, Homo sapiens
cuaccuucuugcaguauca

SEQ ID NO: 1351040 - RNA, 19 nt, Homo sapiens
gugaggaggguugcuguga

SEQ ID NO: 1351041 - RNA, 19 nt, Homo sapiens
gaggcagcucccaguguuu

SEQ ID NO: 1351042 - RNA, 19 nt, Homo sapiens
cacacacgacccucauauu

SEQ ID NO: 1351043 - RNA, 19 nt, Homo sapiens
gguaugaaguuuggaaaag

SEQ ID NO: 1351044 - RNA, 19 nt, Homo sapiens
ugcaaaagcuugguaugaa

SEQ ID NO: 1351045 - RNA, 19 nt, Homo sapiens
ccagugggaauggcauaaa

SEQ ID NO: 1351046 - RNA, 19 nt, Homo sapiens
gagauggaccgcaguaccu

SEQ ID NO: 1351047 - RNA, 19 nt, Homo sapiens
gcagcgaggaugcccuauc

SEQ ID NO: 1351048 - RNA, 19 nt, Homo sapiens
cuggcucccugcauucuug

SEQ ID NO: 1351049 - RNA, 19 nt, Homo sapiens
aagaacaacccgaaguaca

SEQ ID NO: 1351050 - RNA, 19 nt, Homo sapiens
caauaaagcuguguaacuu

SEQ ID NO: 1351051 - RNA, 19 nt, Homo sapiens
gaaggcaggugacugguau

SEQ ID NO: 1351052 - RNA, 19 nt, Homo sapiens
gggcagagcucaggcaaga

SEQ ID NO: 1351053 - RNA, 19 nt, Homo sapiens
ggaaagauacaacacuauu

SEQ ID NO: 1351054 - RNA, 19 nt, Homo sapiens
ggaaggaguuugagacacu

SEQ ID NO: 1351055 - RNA, 19 nt, Homo sapiens
ggacgaaguggacaaguuc

SEQ ID NO: 1351056 - RNA, 19 nt, Homo sapiens
auaaagcuguguaacuuga

SEQ ID NO: 1351057 - RNA, 19 nt, Homo sapiens
ugacucacguacuguaguu

SEQ ID NO: 1351058 - RNA, 19 nt, Homo sapiens
caaguacgguugggugguu

SEQ ID NO: 1351059 - RNA, 19 nt, Homo sapiens
cggaccagcuuuagcaaga

SEQ ID NO: 1351060 - RNA, 19 nt, Homo sapiens
cggacgaaguggacaaguu

SEQ ID NO: 1351061 - RNA, 19 nt, Homo sapiens
aagaugacuuccugcugua

SEQ ID NO: 1351062 - RNA, 19 nt, Homo sapiens
ccaauaaagcuguguaacu

SEQ ID NO: 1351063 - RNA, 19 nt, Homo sapiens
gaugguacuuccuguuguc

SEQ ID NO: 1351064 - RNA, 19 nt, Homo sapiens
cgagugagccggacgaagu

SEQ ID NO: 1351065 - RNA, 19 nt, Homo sapiens
aaagcuguguaacuugaaa

SEQ ID NO: 1351066 - RNA, 19 nt, Homo sapiens
ggggaaagauacaacacua

SEQ ID NO: 1351067 - RNA, 19 nt, Homo sapiens
gagacaggaaggaguuuga

SEQ ID NO: 1351068 - RNA, 19 nt, Homo sapiens
gggccugacucacguacug

SEQ ID NO: 1351069 - RNA, 19 nt, Homo sapiens
gcagagcucaggcaagaag

SEQ ID NO: 1351070 - RNA, 19 nt, Homo sapiens
cgagggcgagggugacaua

SEQ ID NO: 1351071 - RNA, 19 nt, Homo sapiens
gcgcguccaugaacucagu

SEQ ID NO: 1351072 - RNA, 19 nt, Homo sapiens
gcucugaggacuuuguguu

SEQ ID NO: 1351073 - RNA, 19 nt, Homo sapiens
gacacucacuguacuucau

SEQ ID NO: 1351074 - RNA, 19 nt, Homo sapiens
gggcgagggugacauacag

SEQ ID NO: 1351075 - RNA, 19 nt, Homo sapiens
ggaagucuguggucauccu

SEQ ID NO: 1351076 - RNA, 19 nt, Homo sapiens
ggaccagcuuuagcaagau

SEQ ID NO: 1351077 - RNA, 19 nt, Homo sapiens
gggaaagauacaacacuau

SEQ ID NO: 1351078 - RNA, 19 nt, Homo sapiens
uuacgcagcggccagauga

SEQ ID NO: 1351079 - RNA, 19 nt, Homo sapiens
gaccagcuuuagcaagauc

SEQ ID NO: 1351080 - RNA, 19 nt, Homo sapiens
gcagugaugaugguacuuc

SEQ ID NO: 1351081 - RNA, 19 nt, Homo sapiens
gaugaugguacuuccuguu

SEQ ID NO: 1351082 - RNA, 19 nt, Homo sapiens
aagauggacccaagcugua

SEQ ID NO: 1351083 - RNA, 19 nt, Homo sapiens
ccuggaacaacgucaagua

SEQ ID NO: 1351084 - RNA, 19 nt, Homo sapiens
guggaagucuguggucauc

SEQ ID NO: 1351085 - RNA, 19 nt, Homo sapiens
caaguucaaggccaaguuc

SEQ ID NO: 1351086 - RNA, 19 nt, Homo sapiens
ggccaauaaagcuguguaa

SEQ ID NO: 1351087 - RNA, 19 nt, Homo sapiens
gcuguaccgugggcuucua

SEQ ID NO: 1351088 - RNA, 19 nt, Homo sapiens
ggcagauuguguccugguu

SEQ ID NO: 1351089 - RNA, 19 nt, Homo sapiens
ggaaaccgcgacacucacu

SEQ ID NO: 1351090 - RNA, 19 nt, Homo sapiens
gacaggaaggaguuugaga

SEQ ID NO: 1351091 - RNA, 19 nt, Homo sapiens
ggagacaggaaggaguuug

SEQ ID NO: 1351092 - RNA, 19 nt, Homo sapiens
uuagcaagaucuccagcau

SEQ ID NO: 1351093 - RNA, 19 nt, Homo sapiens
guaccuggacccucacuac

SEQ ID NO: 1351094 - RNA, 19 nt, Homo sapiens
agaaggcaggugacuggua

SEQ ID NO: 1351095 - RNA, 19 nt, Homo sapiens
agggugacauacagcguuu

SEQ ID NO: 1351096 - RNA, 19 nt, Homo sapiens
ugaugguacuuccuguugu

SEQ ID NO: 1351097 - RNA, 19 nt, Homo sapiens
aauaaagcuguguaacuug

SEQ ID NO: 1351098 - RNA, 19 nt, Homo sapiens
caggaaggaguuugagaca

SEQ ID NO: 1351099 - RNA, 19 nt, Homo sapiens
gggcaucaugggugggaaa

SEQ ID NO: 1351100 - RNA, 19 nt, Homo sapiens
ggugcaagcuaaccaaaua

SEQ ID NO: 1351101 - RNA, 19 nt, Homo sapiens
cagaauaucuugcccuaga

SEQ ID NO: 1351102 - RNA, 19 nt, Homo sapiens
gagaccagcuucggcaaua

SEQ ID NO: 1351103 - RNA, 19 nt, Homo sapiens
gaaaggucauaaaggguaa

SEQ ID NO: 1351104 - RNA, 19 nt, Homo sapiens
ccaaauagguggacaucau

SEQ ID NO: 1351105 - RNA, 19 nt, Homo sapiens
aaaguuagguugagugaau

SEQ ID NO: 1351106 - RNA, 19 nt, Homo sapiens
caugugaacuugccuguga

SEQ ID NO: 1351107 - RNA, 19 nt, Homo sapiens
gauuguggccuguguauuu

SEQ ID NO: 1351108 - RNA, 19 nt, Homo sapiens
gaaaacagauuuacuggau

SEQ ID NO: 1351109 - RNA, 19 nt, Homo sapiens
gcaaaagcauucgaucuua

SEQ ID NO: 1351110 - RNA, 19 nt, Homo sapiens
guaaugggacuaucacuga

SEQ ID NO: 1351111 - RNA, 19 nt, Homo sapiens
gaccgugaguucuuauuug

SEQ ID NO: 1351112 - RNA, 19 nt, Homo sapiens
caacuuggccuucauugga

SEQ ID NO: 1351113 - RNA, 19 nt, Homo sapiens
gauguccucuucccucuug

SEQ ID NO: 1351114 - RNA, 19 nt, Homo sapiens
gaugguaggguuaugauug

SEQ ID NO: 1351115 - RNA, 19 nt, Homo sapiens
cagauuuacuggauuuaug

SEQ ID NO: 1351116 - RNA, 19 nt, Homo sapiens
gaauugaggacucuucugu

SEQ ID NO: 1351117 - RNA, 19 nt, Homo sapiens
ccuaucaccucuacaacuu

SEQ ID NO: 1351118 - RNA, 19 nt, Homo sapiens
ggaaaguuagguugaguga

SEQ ID NO: 1351119 - RNA, 19 nt, Homo sapiens
guggugauguucuguguug

SEQ ID NO: 1351120 - RNA, 19 nt, Homo sapiens
ggguuuauauuugaaggua

SEQ ID NO: 1351121 - RNA, 19 nt, Homo sapiens
ccaggcauauuguccuauu

SEQ ID NO: 1351122 - RNA, 19 nt, Homo sapiens
ccuauagccugcuucuuug

SEQ ID NO: 1351123 - RNA, 19 nt, Homo sapiens
ggucugagggccaaguuaa

SEQ ID NO: 1351124 - RNA, 19 nt, Homo sapiens
ggaacaagaccaccuagag

SEQ ID NO: 1351125 - RNA, 19 nt, Homo sapiens
gugcuuagcugcuccuuuu

SEQ ID NO: 1351126 - RNA, 19 nt, Homo sapiens
gaacuuacugaugcucuuu

SEQ ID NO: 1351127 - RNA, 19 nt, Homo sapiens
gauuacugauuucaaguuc

SEQ ID NO: 1351128 - RNA, 19 nt, Homo sapiens
guuaauaagccuaccuuug

SEQ ID NO: 1351129 - RNA, 19 nt, Homo sapiens
ccaccuguguuaauccuau

SEQ ID NO: 1351130 - RNA, 19 nt, Homo sapiens
gcuacaaagccaaaucauu

SEQ ID NO: 1351131 - RNA, 19 nt, Homo sapiens
ggguaaaagucuauaguuu

SEQ ID NO: 1351132 - RNA, 19 nt, Homo sapiens
uuaauaagccuaccuuugg

SEQ ID NO: 1351133 - RNA, 19 nt, Homo sapiens
ugaggacucuucugugcuu

SEQ ID NO: 1351134 - RNA, 19 nt, Homo sapiens
gaggacagacacugaaugu

SEQ ID NO: 1351135 - RNA, 19 nt, Homo sapiens
ucgcuggguuuauauuuga

SEQ ID NO: 1351136 - RNA, 19 nt, Homo sapiens
caggcauauuguccuauua

SEQ ID NO: 1351137 - RNA, 19 nt, Homo sapiens
gcucacugcuuugcuuuca

SEQ ID NO: 1351138 - RNA, 19 nt, Homo sapiens
gaccuugucucuaccaaaa

SEQ ID NO: 1351139 - RNA, 19 nt, Homo sapiens
ggagguaaugggacuauca

SEQ ID NO: 1351140 - RNA, 19 nt, Homo sapiens
ggacucuucugugcuuuua

SEQ ID NO: 1351141 - RNA, 19 nt, Homo sapiens
ucauguaucugucuguagu

SEQ ID NO: 1351142 - RNA, 19 nt, Homo sapiens
gagcuacaaagccaaauca

SEQ ID NO: 1351143 - RNA, 19 nt, Homo sapiens
aagccuaccuuugguuauu

SEQ ID NO: 1351144 - RNA, 19 nt, Homo sapiens
guagcucacaccuguaauu

SEQ ID NO: 1351145 - RNA, 19 nt, Homo sapiens
aaucauguaucugucugua

SEQ ID NO: 1351146 - RNA, 19 nt, Homo sapiens
caaauagguggacaucaug

SEQ ID NO: 1351147 - RNA, 19 nt, Homo sapiens
ucauacccaucacuuaaau

SEQ ID NO: 1351148 - RNA, 19 nt, Homo sapiens
ggcuaccguucuagucaua

SEQ ID NO: 1351149 - RNA, 19 nt, Homo sapiens
ggauuacugauuucaaguu

SEQ ID NO: 1351150 - RNA, 19 nt, Homo sapiens
cuuuguggauuacugauuu

SEQ ID NO: 1351151 - RNA, 19 nt, Homo sapiens
gaugauaaugggagaacuu

SEQ ID NO: 1351152 - RNA, 19 nt, Homo sapiens
guaucugucuguagugcuu

SEQ ID NO: 1351153 - RNA, 19 nt, Homo sapiens
gguugguccuccaggcaua

SEQ ID NO: 1351154 - RNA, 19 nt, Homo sapiens
uaccuaucccuaucuguua

SEQ ID NO: 1351155 - RNA, 19 nt, Homo sapiens
ccaccuaucaccucuacaa

SEQ ID NO: 1351156 - RNA, 19 nt, Homo sapiens
gaggucagguggguuaucu

SEQ ID NO: 1351157 - RNA, 19 nt, Homo sapiens
agucauacccaucacuuaa

SEQ ID NO: 1351158 - RNA, 19 nt, Homo sapiens
uccuauagccugcuucuuu

SEQ ID NO: 1351159 - RNA, 19 nt, Homo sapiens
caaaagcauucgaucuuau

SEQ ID NO: 1351160 - RNA, 19 nt, Homo sapiens
guggauuacugauuucaag

SEQ ID NO: 1351161 - RNA, 19 nt, Homo sapiens
uaauaagccuaccuuuggu

SEQ ID NO: 1351162 - RNA, 19 nt, Homo sapiens
guggaggucagguggguua

SEQ ID NO: 1351163 - RNA, 19 nt, Homo sapiens
aaauggaggcuugggcuua

SEQ ID NO: 1351164 - RNA, 19 nt, Homo sapiens
aauaugacauuuccaacca

SEQ ID NO: 1351165 - RNA, 19 nt, Homo sapiens
uuauggaccuaguauauac

SEQ ID NO: 1351166 - RNA, 19 nt, Homo sapiens
aauuaugccaccuguguua

SEQ ID NO: 1351167 - RNA, 19 nt, Homo sapiens
gccuguguauuugcaauuu

SEQ ID NO: 1351168 - RNA, 19 nt, Homo sapiens
uuaugaccgugaguucuua

SEQ ID NO: 1351169 - RNA, 19 nt, Homo sapiens
ucagguggguuaucuucug

SEQ ID NO: 1351170 - RNA, 19 nt, Homo sapiens
gauaaugggagaacuuacu

SEQ ID NO: 1351171 - RNA, 19 nt, Homo sapiens
ggauuuauggaccuaguau

SEQ ID NO: 1351172 - RNA, 19 nt, Homo sapiens
gccaaccccugccauuaua

SEQ ID NO: 1351173 - RNA, 19 nt, Homo sapiens
aagcaugggaggaggauuu

SEQ ID NO: 1351174 - RNA, 19 nt, Homo sapiens
gcuuagugauggguaaaug

SEQ ID NO: 1351175 - RNA, 19 nt, Homo sapiens
gguucagccuauccaggua

SEQ ID NO: 1351176 - RNA, 19 nt, Homo sapiens
ucugagggccaaguuaaua

SEQ ID NO: 1351177 - RNA, 19 nt, Homo sapiens
ggaggauuuugauaaguuu

SEQ ID NO: 1351178 - RNA, 19 nt, Homo sapiens
ggaggaggauuuugauaag

SEQ ID NO: 1351179 - RNA, 19 nt, Homo sapiens
ugaccgugaguucuuauuu

SEQ ID NO: 1351180 - RNA, 19 nt, Homo sapiens
aauggacucuaucuucaga

SEQ ID NO: 1351181 - RNA, 19 nt, Homo sapiens
aaaauggacucuaucuuca

SEQ ID NO: 1351182 - RNA, 19 nt, Homo sapiens
gagcucugccugcuuguca

SEQ ID NO: 1351183 - RNA, 19 nt, Homo sapiens
gguauagaaucugggaaag

SEQ ID NO: 1351184 - RNA, 19 nt, Homo sapiens
ggaggacagacacugaaug

SEQ ID NO: 1351185 - RNA, 19 nt, Homo sapiens
uuaauuaugccaccugugu

SEQ ID NO: 1351186 - RNA, 19 nt, Homo sapiens
gaucuuaugaccgugaguu

SEQ ID NO: 1351187 - RNA, 19 nt, Homo sapiens
gauuuauggaccuaguaua

SEQ ID NO: 1351188 - RNA, 19 nt, Homo sapiens
aagaccaccuagaggcuuu

SEQ ID NO: 1351189 - RNA, 19 nt, Homo sapiens
gggaggaggauuuugauaa

SEQ ID NO: 1351190 - RNA, 19 nt, Homo sapiens
ggucagguggguuaucuuc

SEQ ID NO: 1351191 - RNA, 19 nt, Homo sapiens
guuuggaccuuguuuuaaa

SEQ ID NO: 1351192 - RNA, 19 nt, Homo sapiens
uagccugcuucuuugcuuu

SEQ ID NO: 1351193 - RNA, 19 nt, Homo sapiens
caccuguguuaauccuaua

SEQ ID NO: 1351194 - RNA, 19 nt, Homo sapiens
gggguaaucucagggagua

SEQ ID NO: 1351195 - RNA, 19 nt, Homo sapiens
cauaaaggguaaaagucua

SEQ ID NO: 1351196 - RNA, 19 nt, Homo sapiens
aggcauauuguccuauuaa

SEQ ID NO: 1351197 - RNA, 19 nt, Homo sapiens
uuaccuaucccuaucuguu

SEQ ID NO: 1351198 - RNA, 19 nt, Homo sapiens
gcuuuaaagacucgauuug

SEQ ID NO: 1351199 - RNA, 19 nt, Homo sapiens
ccuccccucuuuuauuuua

SEQ ID NO: 1351200 - RNA, 19 nt, Homo sapiens
uaaaugagcugugugugua

SEQ ID NO: 1351201 - RNA, 19 nt, Homo sapiens
gagacaguaucaagaaaga

SEQ ID NO: 1351202 - RNA, 19 nt, Homo sapiens
gaacagucgagcuggauaa

SEQ ID NO: 1351203 - RNA, 19 nt, Homo sapiens
gacauuacuugcaaccaaa

SEQ ID NO: 1351204 - RNA, 19 nt, Homo sapiens
uaagagacaguaucaagaa

SEQ ID NO: 1351205 - RNA, 19 nt, Homo sapiens
ugacauuacuugcaaccaa

SEQ ID NO: 1351206 - RNA, 19 nt, Homo sapiens
ccaggcagcauuuggauuu

SEQ ID NO: 1351207 - RNA, 19 nt, Homo sapiens
gcacugagaaugguuuaug

SEQ ID NO: 1351208 - RNA, 19 nt, Homo sapiens
caaagacgcagcugcaugu

SEQ ID NO: 1351209 - RNA, 19 nt, Homo sapiens
ccaaagccaggcagcauuu

SEQ ID NO: 1351210 - RNA, 19 nt, Homo sapiens
ggccugacauuacuugcaa

SEQ ID NO: 1351211 - RNA, 19 nt, Homo sapiens
gaaaccccaucucuacuaa

SEQ ID NO: 1351212 - RNA, 19 nt, Homo sapiens
cagucgagcuggauaaaca

SEQ ID NO: 1351213 - RNA, 19 nt, Homo sapiens
gcauuuggauuuucgcuuu

SEQ ID NO: 1351214 - RNA, 19 nt, Homo sapiens
gcuaagagacaguaucaag

SEQ ID NO: 1351215 - RNA, 19 nt, Homo sapiens
ggaauccucuccccaaaau

SEQ ID NO: 1351216 - RNA, 19 nt, Homo sapiens
gagcugccuugcccagaga

SEQ ID NO: 1351217 - RNA, 19 nt, Homo sapiens
gcaggagaaucgcuugaac

SEQ ID NO: 1351218 - RNA, 19 nt, Homo sapiens
caaguuugaucaagaacag

SEQ ID NO: 1351219 - RNA, 19 nt, Homo sapiens
gagguguagauauguauaa

SEQ ID NO: 1351220 - RNA, 19 nt, Homo sapiens
agagugauguggcccaaau

SEQ ID NO: 1351221 - RNA, 19 nt, Homo sapiens
caacuccugugcacaaagg

SEQ ID NO: 1351222 - RNA, 19 nt, Homo sapiens
uggaaacgauucuguaggu

SEQ ID NO: 1351223 - RNA, 19 nt, Homo sapiens
ccugagguguagauaugua

SEQ ID NO: 1351224 - RNA, 19 nt, Homo sapiens
ccuguaaucccagcuauuu

SEQ ID NO: 1351225 - RNA, 19 nt, Homo sapiens
aagagacaguaucaagaaa

SEQ ID NO: 1351226 - RNA, 19 nt, Homo sapiens
ucagacuccugcuaagaga

SEQ ID NO: 1351227 - RNA, 19 nt, Homo sapiens
uaggcaaguuugaucaaga

SEQ ID NO: 1351228 - RNA, 19 nt, Homo sapiens
aggcaaguuugaucaagaa

SEQ ID NO: 1351229 - RNA, 19 nt, Homo sapiens
cuaagagacaguaucaaga

SEQ ID NO: 1351230 - RNA, 19 nt, Homo sapiens
guauaaaugagcugugugu

SEQ ID NO: 1351231 - RNA, 19 nt, Homo sapiens
acccugagguguagauaug

SEQ ID NO: 1351232 - RNA, 19 nt, Homo sapiens
gaacccugagguguagaua

SEQ ID NO: 1351233 - RNA, 19 nt, Homo sapiens
ugauguggcccaaauguca

SEQ ID NO: 1351234 - RNA, 19 nt, Homo sapiens
gagcuguguguguaucuga

SEQ ID NO: 1351235 - RNA, 19 nt, Homo sapiens
gcaaguuugaucaagaaca

SEQ ID NO: 1351236 - RNA, 19 nt, Homo sapiens
cagcagugccagugucaga

SEQ ID NO: 1351237 - RNA, 19 nt, Homo sapiens
gggcacugagaaugguuua

SEQ ID NO: 1351238 - RNA, 19 nt, Homo sapiens
uaccugguuugcuccauga

SEQ ID NO: 1351239 - RNA, 19 nt, Homo sapiens
ggccaaugcauguggauca

SEQ ID NO: 1351240 - RNA, 19 nt, Homo sapiens
gguuuauggccugacauua

SEQ ID NO: 1351241 - RNA, 19 nt, Homo sapiens
guuuauggccugacauuac

SEQ ID NO: 1351242 - RNA, 19 nt, Homo sapiens
auaaaugagcugugugugu

SEQ ID NO: 1351243 - RNA, 19 nt, Homo sapiens
ugagguguagauauguaua

SEQ ID NO: 1351244 - RNA, 19 nt, Homo sapiens
gugggacucugucucaaaa

SEQ ID NO: 1351245 - RNA, 19 nt, Homo sapiens
ugaguuggcuuguggauua

SEQ ID NO: 1351246 - RNA, 19 nt, Homo sapiens
cggaauauguucagcauuu

SEQ ID NO: 1351247 - RNA, 19 nt, Homo sapiens
uaaccaaacucucucaaga

SEQ ID NO: 1351248 - RNA, 19 nt, Homo sapiens
gaaagaaggugccaaaagu

SEQ ID NO: 1351249 - RNA, 19 nt, Homo sapiens
ggaagggccugcagcaauc

SEQ ID NO: 1351250 - RNA, 19 nt, Homo sapiens
gggacagacucuugaauuc

SEQ ID NO: 1351251 - RNA, 19 nt, Homo sapiens
gcucuucccuguaccguau

SEQ ID NO: 1351252 - RNA, 19 nt, Homo sapiens
caaacucucucaagacuac

SEQ ID NO: 1351253 - RNA, 19 nt, Homo sapiens
ggaauauguucagcauuug

SEQ ID NO: 1351254 - RNA, 19 nt, Homo sapiens
uauaaacucuaccagcauu

SEQ ID NO: 1351255 - RNA, 19 nt, Homo sapiens
cauacaagcucuauuugag

SEQ ID NO: 1351256 - RNA, 19 nt, Homo sapiens
uucauagccuuucuacuua

SEQ ID NO: 1351257 - RNA, 19 nt, Homo sapiens
gguuucaacuggacuucua

SEQ ID NO: 1351258 - RNA, 19 nt, Homo sapiens
cuucauagccuuucuacuu

SEQ ID NO: 1351259 - RNA, 19 nt, Homo sapiens
caccauacaagcucuauuu

SEQ ID NO: 1351260 - RNA, 19 nt, Homo sapiens
ugacugacuuugugacugu

SEQ ID NO: 1351261 - RNA, 19 nt, Homo sapiens
cgucuucucucucuucaug

SEQ ID NO: 1351262 - RNA, 19 nt, Homo sapiens
ggacuucuaucaggucuac

SEQ ID NO: 1351263 - RNA, 19 nt, Homo sapiens
ccacagcccugcucuucuc

SEQ ID NO: 1351264 - RNA, 19 nt, Homo sapiens
ucacuaugcugcuuaacca

SEQ ID NO: 1351265 - RNA, 19 nt, Homo sapiens
ucaaauugccauccucuau

SEQ ID NO: 1351266 - RNA, 19 nt, Homo sapiens
gugauggacuggaaagaag

SEQ ID NO: 1351267 - RNA, 19 nt, Homo sapiens
gacagacucuugaauucca

SEQ ID NO: 1351268 - RNA, 19 nt, Homo sapiens
gcuuguggauuauacuuuc

SEQ ID NO: 1351269 - RNA, 19 nt, Homo sapiens
ggcuggaacugucaagaug

SEQ ID NO: 1351270 - RNA, 19 nt, Homo sapiens
gcuggugacugccuaccuu

SEQ ID NO: 1351271 - RNA, 19 nt, Homo sapiens
caaauugccauccucuaug

SEQ ID NO: 1351272 - RNA, 19 nt, Homo sapiens
gaauucuuguguccucuuc

SEQ ID NO: 1351273 - RNA, 19 nt, Homo sapiens
aaauugccauccucuaugu

SEQ ID NO: 1351274 - RNA, 19 nt, Homo sapiens
gauuauacuuucccagcau

SEQ ID NO: 1351275 - RNA, 19 nt, Homo sapiens
cauagccuuucuacuuauu

SEQ ID NO: 1351276 - RNA, 19 nt, Homo sapiens
ccauacaagcucuauuuga

SEQ ID NO: 1351277 - RNA, 19 nt, Homo sapiens
ccuccucccuuguggauug

SEQ ID NO: 1351278 - RNA, 19 nt, Homo sapiens
cauuugcucugcugucaug

SEQ ID NO: 1351279 - RNA, 19 nt, Homo sapiens
aaacaggcacucggaauau

SEQ ID NO: 1351280 - RNA, 19 nt, Homo sapiens
cuaccagcauuacuacuuc

SEQ ID NO: 1351281 - RNA, 19 nt, Homo sapiens
ggugauggacuggaaagaa

SEQ ID NO: 1351282 - RNA, 19 nt, Homo sapiens
ucauagccuuucuacuuau

SEQ ID NO: 1351283 - RNA, 19 nt, Homo sapiens
gagagugucaucuucaucu

SEQ ID NO: 1351284 - RNA, 19 nt, Homo sapiens
gcggguaccuucaccuacu

SEQ ID NO: 1351285 - RNA, 19 nt, Homo sapiens
uagccuuucuacuuauuga

SEQ ID NO: 1351286 - RNA, 19 nt, Homo sapiens
agugucaucuucaucuuug

SEQ ID NO: 1351287 - RNA, 19 nt, Homo sapiens
gagugucaucuucaucuuu

SEQ ID NO: 1351288 - RNA, 19 nt, Homo sapiens
gcucugcugucauggugau

SEQ ID NO: 1351289 - RNA, 19 nt, Homo sapiens
gaucccagcuaccuuugcu

SEQ ID NO: 1351290 - RNA, 19 nt, Homo sapiens
aaaaguucccucuguguua

SEQ ID NO: 1351291 - RNA, 19 nt, Homo sapiens
ugggacagacucuugaauu

SEQ ID NO: 1351292 - RNA, 19 nt, Homo sapiens
gcuuggcucuucccuguac

SEQ ID NO: 1351293 - RNA, 19 nt, Homo sapiens
guguuacucccauuuagaa

SEQ ID NO: 1351294 - RNA, 19 nt, Homo sapiens
guggaucccagcuaccuuu

SEQ ID NO: 1351295 - RNA, 19 nt, Homo sapiens
ggaaagaaggugccaaaag

SEQ ID NO: 1351296 - RNA, 19 nt, Homo sapiens
acucuugaauuccagcuau

SEQ ID NO: 1351297 - RNA, 19 nt, Homo sapiens
gcauuaucuucuccagcuu

SEQ ID NO: 1351298 - RNA, 19 nt, Homo sapiens
gggcuggaacugucaagau

SEQ ID NO: 1351299 - RNA, 19 nt, Homo sapiens
ccggguaccucugcacuca

SEQ ID NO: 1351300 - RNA, 19 nt, Homo sapiens
gcaggcugguguacucaac

SEQ ID NO: 1351301 - RNA, 19 nt, Homo sapiens
gcucaucgucgucuucucu

SEQ ID NO: 1351302 - RNA, 19 nt, Homo sapiens
agacuacuuugugcugcua

SEQ ID NO: 1351303 - RNA, 19 nt, Homo sapiens
aaaguucccucuguguuac

SEQ ID NO: 1351304 - RNA, 19 nt, Homo sapiens
ugccauugcuuuguguuug

SEQ ID NO: 1351305 - RNA, 19 nt, Homo sapiens
agagcaggcugguguacuc

SEQ ID NO: 1351306 - RNA, 19 nt, Homo sapiens
gaguuggcuuguggauuau

SEQ ID NO: 1351307 - RNA, 19 nt, Homo sapiens
uuacucacuaugcugcuua

SEQ ID NO: 1351308 - RNA, 19 nt, Homo sapiens
ccucuacaguccucuuugg

SEQ ID NO: 1351309 - RNA, 19 nt, Homo sapiens
gccauugcuuuguguuugg

SEQ ID NO: 1351310 - RNA, 19 nt, Homo sapiens
agaaaggugaucccugaga

SEQ ID NO: 1351311 - RNA, 19 nt, Homo sapiens
cagcaaucccuccuuccuu

SEQ ID NO: 1351312 - RNA, 19 nt, Homo sapiens
uaucuucuccagcuucaug

SEQ ID NO: 1351313 - RNA, 19 nt, Homo sapiens
caucuucaucuuugucuuc

SEQ ID NO: 1351314 - RNA, 19 nt, Homo sapiens
gcaccauacaagcucuauu

SEQ ID NO: 1351315 - RNA, 19 nt, Homo sapiens
uggaagggccugcagcaau

SEQ ID NO: 1351316 - RNA, 19 nt, Homo sapiens
uagcugggacagacucuug

SEQ ID NO: 1351317 - RNA, 19 nt, Homo sapiens
ggacucuucaccgugguaa

SEQ ID NO: 1351318 - RNA, 19 nt, Homo sapiens
aaaacaggcacucggaaua

SEQ ID NO: 1351319 - RNA, 19 nt, Homo sapiens
gugacugccuaccuugcuu

SEQ ID NO: 1351320 - RNA, 19 nt, Homo sapiens
ugugguuucuccugccauu

SEQ ID NO: 1351321 - RNA, 19 nt, Homo sapiens
gcaguggugggacucuuca

SEQ ID NO: 1351322 - RNA, 19 nt, Homo sapiens
gacagagcaggcuggugua

SEQ ID NO: 1351323 - RNA, 19 nt, Homo sapiens
ggaguccuucauagccuuu

SEQ ID NO: 1351324 - RNA, 19 nt, Homo sapiens
auacaagcucuauuugaga

SEQ ID NO: 1351325 - RNA, 19 nt, Homo sapiens
cucccugacuuacucacua

SEQ ID NO: 1351326 - RNA, 19 nt, Homo sapiens
ucuguguuacucccauuua

SEQ ID NO: 1351327 - RNA, 19 nt, Homo sapiens
ugacuguccugugguuucu

SEQ ID NO: 1351328 - RNA, 19 nt, Homo sapiens
ggauugugcagaucucucu

SEQ ID NO: 1351329 - RNA, 19 nt, Homo sapiens
cuaccucuauaaacucuac

SEQ ID NO: 1351330 - RNA, 19 nt, Homo sapiens
ggacagacucuugaauucc

SEQ ID NO: 1351331 - RNA, 19 nt, Homo sapiens
ccgguggaguccuucauag

SEQ ID NO: 1351332 - RNA, 19 nt, Homo sapiens
agaguccgguggaguccuu

SEQ ID NO: 1351333 - RNA, 19 nt, Homo sapiens
agagugucaucuucaucuu

SEQ ID NO: 1351334 - RNA, 19 nt, Homo sapiens
ccaaacucucucaagacua

SEQ ID NO: 1351335 - RNA, 19 nt, Homo sapiens
cuacugaggagcccuaugc

SEQ ID NO: 1351336 - RNA, 19 nt, Homo sapiens
gaauauguucagcauuugc

SEQ ID NO: 1351337 - RNA, 19 nt, Homo sapiens
caaugugccugcuguauua

SEQ ID NO: 1351338 - RNA, 19 nt, Homo sapiens
gcacauagccaacauaaga

SEQ ID NO: 1351339 - RNA, 19 nt, Homo sapiens
cagaagcacuggaucguua

SEQ ID NO: 1351340 - RNA, 19 nt, Homo sapiens
gaaccucacugcccucauu

SEQ ID NO: 1351341 - RNA, 19 nt, Homo sapiens
gaugauagauggucagaug

SEQ ID NO: 1351342 - RNA, 19 nt, Homo sapiens
gcaauaaucaguucuuuga

SEQ ID NO: 1351343 - RNA, 19 nt, Homo sapiens
aaagugaucuucucucuga

SEQ ID NO: 1351344 - RNA, 19 nt, Homo sapiens
gcagagccaucgucauuug

SEQ ID NO: 1351345 - RNA, 19 nt, Homo sapiens
ucagaagcaucucgaauuu

SEQ ID NO: 1351346 - RNA, 19 nt, Homo sapiens
gaagaccacuuaugaagag

SEQ ID NO: 1351347 - RNA, 19 nt, Homo sapiens
caugagcgguaucuucuua

SEQ ID NO: 1351348 - RNA, 19 nt, Homo sapiens
gcaauucuguggacuguca

SEQ ID NO: 1351349 - RNA, 19 nt, Homo sapiens
ugacuucucugauccauug

SEQ ID NO: 1351350 - RNA, 19 nt, Homo sapiens
gaaaggaccagcucaagug

SEQ ID NO: 1351351 - RNA, 19 nt, Homo sapiens
gaaacuacaucgccauucu

SEQ ID NO: 1351352 - RNA, 19 nt, Homo sapiens
aaagagaaguugacuggaa

SEQ ID NO: 1351353 - RNA, 19 nt, Homo sapiens
aagaaugccucagauguua

SEQ ID NO: 1351354 - RNA, 19 nt, Homo sapiens
ccacaucugcucugaauuu

SEQ ID NO: 1351355 - RNA, 19 nt, Homo sapiens
gcaaagugaucuucucucu

SEQ ID NO: 1351356 - RNA, 19 nt, Homo sapiens
ggacagcuauauuggugaa

SEQ ID NO: 1351357 - RNA, 19 nt, Homo sapiens
guagauaauuccaggauca

SEQ ID NO: 1351358 - RNA, 19 nt, Homo sapiens
gaacucagaacauuucaau

SEQ ID NO: 1351359 - RNA, 19 nt, Homo sapiens
aaucugaacuggagcauga

SEQ ID NO: 1351360 - RNA, 19 nt, Homo sapiens
gcugggagcucaauguguu

SEQ ID NO: 1351361 - RNA, 19 nt, Homo sapiens
gcaauggaaacaaugauuu

SEQ ID NO: 1351362 - RNA, 19 nt, Homo sapiens
ggacaaagcaaaacacaua

SEQ ID NO: 1351363 - RNA, 19 nt, Homo sapiens
gagguggacucguggauau

SEQ ID NO: 1351364 - RNA, 19 nt, Homo sapiens
cagcuauauuggugaauua

SEQ ID NO: 1351365 - RNA, 19 nt, Homo sapiens
gcaugcagcuuacaacagu

SEQ ID NO: 1351366 - RNA, 19 nt, Homo sapiens
gaacgauauuugucacugu

SEQ ID NO: 1351367 - RNA, 19 nt, Homo sapiens
guaaagggaaguugacauu

SEQ ID NO: 1351368 - RNA, 19 nt, Homo sapiens
gaaauuggagcauggcuau

SEQ ID NO: 1351369 - RNA, 19 nt, Homo sapiens
gaacaaaagugaguccaaa

SEQ ID NO: 1351370 - RNA, 19 nt, Homo sapiens
agaauucucugccuaggaa

SEQ ID NO: 1351371 - RNA, 19 nt, Homo sapiens
guuggaaucugucaccauu

SEQ ID NO: 1351372 - RNA, 19 nt, Homo sapiens
ucagcaaucuggaguucua

SEQ ID NO: 1351373 - RNA, 19 nt, Homo sapiens
gacaauguuugcaauaauc

SEQ ID NO: 1351374 - RNA, 19 nt, Homo sapiens
uguaccagauccuccauua

SEQ ID NO: 1351375 - RNA, 19 nt, Homo sapiens
gaagaaaggaccagcucaa

SEQ ID NO: 1351376 - RNA, 19 nt, Homo sapiens
gucaguugcuguugcauuu

SEQ ID NO: 1351377 - RNA, 19 nt, Homo sapiens
acaguuuguuucaggauua

SEQ ID NO: 1351378 - RNA, 19 nt, Homo sapiens
gaaguucccucuuuuaaca

SEQ ID NO: 1351379 - RNA, 19 nt, Homo sapiens
ggacuugugccaaacacua

SEQ ID NO: 1351380 - RNA, 19 nt, Homo sapiens
cagaacauuucaaucagaa

SEQ ID NO: 1351381 - RNA, 19 nt, Homo sapiens
gagcauggcuaugagcaau

SEQ ID NO: 1351382 - RNA, 19 nt, Homo sapiens
gagaagaccacuuaugaag

SEQ ID NO: 1351383 - RNA, 19 nt, Homo sapiens
gggcagugguguuagaguu

SEQ ID NO: 1351384 - RNA, 19 nt, Homo sapiens
aaagggaaguugacauuag

SEQ ID NO: 1351385 - RNA, 19 nt, Homo sapiens
gacaauggcaacccacuaa

SEQ ID NO: 1351386 - RNA, 19 nt, Homo sapiens
gauggucagaugaucauua

SEQ ID NO: 1351387 - RNA, 19 nt, Homo sapiens
gaaccaagaggaacagcaa

SEQ ID NO: 1351388 - RNA, 19 nt, Homo sapiens
ccaaaucauucaccugugu

SEQ ID NO: 1351389 - RNA, 19 nt, Homo sapiens
caaagaaugccucagaugu

SEQ ID NO: 1351390 - RNA, 19 nt, Homo sapiens
gaaccaaaaguccuauuua

SEQ ID NO: 1351391 - RNA, 19 nt, Homo sapiens
ccacaugcccaucacagua

SEQ ID NO: 1351392 - RNA, 19 nt, Homo sapiens
ccagaagugccacaaagua

SEQ ID NO: 1351393 - RNA, 19 nt, Homo sapiens
agagcaugaugaacauuua

SEQ ID NO: 1351394 - RNA, 19 nt, Homo sapiens
ugccuugguuggaguauua

SEQ ID NO: 1351395 - RNA, 19 nt, Homo sapiens
caaagaagcaacaagaaca

SEQ ID NO: 1351396 - RNA, 19 nt, Homo sapiens
cacauaccauaaaugcuua

SEQ ID NO: 1351397 - RNA, 19 nt, Homo sapiens
ccucagcaaugguugguuu

SEQ ID NO: 1351398 - RNA, 19 nt, Homo sapiens
aaacaaggcaggagggaaa

SEQ ID NO: 1351399 - RNA, 19 nt, Homo sapiens
agauguagcugcccagaug

SEQ ID NO: 1351400 - RNA, 19 nt, Homo sapiens
guaccuaccucuucacacu

SEQ ID NO: 1351401 - RNA, 19 nt, Homo sapiens
ccacuaaaucccaagagua

SEQ ID NO: 1351402 - RNA, 19 nt, Homo sapiens
cagcagcaaauauaugaua

SEQ ID NO: 1351403 - RNA, 19 nt, Homo sapiens
guucuuugauuguuuccua

SEQ ID NO: 1351404 - RNA, 19 nt, Homo sapiens
gagagcaugaugaacauuu

SEQ ID NO: 1351405 - RNA, 19 nt, Homo sapiens
ggagacauuauggaauuua

SEQ ID NO: 1351406 - RNA, 19 nt, Homo sapiens
caaagcaacauuagcaaau

SEQ ID NO: 1351407 - RNA, 19 nt, Homo sapiens
aaacaaagggaacucugua

SEQ ID NO: 1351408 - RNA, 19 nt, Homo sapiens
gugaugagccugcccugua

SEQ ID NO: 1351409 - RNA, 19 nt, Homo sapiens
cgaaaccucagaaacagua

SEQ ID NO: 1351410 - RNA, 19 nt, Homo sapiens
gaugacaauguuugcaaua

SEQ ID NO: 1351411 - RNA, 19 nt, Homo sapiens
ucagaacauuucaaucaga

SEQ ID NO: 1351412 - RNA, 19 nt, Homo sapiens
uacaaacacuugaacuaug

SEQ ID NO: 1351413 - RNA, 19 nt, Homo sapiens
ggucagauuccuuuaccua

SEQ ID NO: 1351414 - RNA, 19 nt, Homo sapiens
gaugaugcccuccacaguu

SEQ ID NO: 1351415 - RNA, 19 nt, Homo sapiens
gggccgagguuugauauca

SEQ ID NO: 1351416 - RNA, 19 nt, Homo sapiens
gagcgguaucuucuuaaua

SEQ ID NO: 1351417 - RNA, 19 nt, Homo sapiens
gcagucaguugccgcuguu

SEQ ID NO: 1351418 - RNA, 19 nt, Homo sapiens
uaucagggcagugguguua

SEQ ID NO: 1351419 - RNA, 19 nt, Homo sapiens
uaaagggaaguugacauua

SEQ ID NO: 1351420 - RNA, 19 nt, Homo sapiens
gcgguaucuucuuaauaua

SEQ ID NO: 1351421 - RNA, 19 nt, Homo sapiens
gcuggacacugggaaacua

SEQ ID NO: 1351422 - RNA, 19 nt, Homo sapiens
cacuaaaucccaagaguaa

SEQ ID NO: 1351423 - RNA, 19 nt, Homo sapiens
ugccaugcauugucauuaa

SEQ ID NO: 1351424 - RNA, 19 nt, Homo sapiens
ucacugcccucauuauuuu

SEQ ID NO: 1351425 - RNA, 19 nt, Homo sapiens
gcccauaccaucacccuuu

SEQ ID NO: 1351426 - RNA, 19 nt, Homo sapiens
caagaccaauguacacagu

SEQ ID NO: 1351427 - RNA, 19 nt, Homo sapiens
gcaaaacacauaccauaaa

SEQ ID NO: 1351428 - RNA, 19 nt, Homo sapiens
gcaaucuggaguucuauga

SEQ ID NO: 1351429 - RNA, 19 nt, Homo sapiens
ucucuaucguguaguauuu

SEQ ID NO: 1351430 - RNA, 19 nt, Homo sapiens
gggauugaguuugguauca

SEQ ID NO: 1351431 - RNA, 19 nt, Homo sapiens
acacauaccauaaaugcuu

SEQ ID NO: 1351432 - RNA, 19 nt, Homo sapiens
ccuccacaguucuagcuua

SEQ ID NO: 1351433 - RNA, 19 nt, Homo sapiens
agcgguaucuucuuaauau

SEQ ID NO: 1351434 - RNA, 19 nt, Homo sapiens
ccacgcaaauguaccaagu

SEQ ID NO: 1351435 - RNA, 19 nt, Homo sapiens
ccagagugguauuuacuuc

SEQ ID NO: 1351436 - RNA, 19 nt, Homo sapiens
ugccagagcucccugacuu

SEQ ID NO: 1351437 - RNA, 19 nt, Homo sapiens
ggaagaacauggcaacauu

SEQ ID NO: 1351438 - RNA, 19 nt, Homo sapiens
gaagagacauuccaauauc

SEQ ID NO: 1351439 - RNA, 19 nt, Homo sapiens
gaacaggaacugggauuua

SEQ ID NO: 1351440 - RNA, 19 nt, Homo sapiens
agaaagggaucaugaacua

SEQ ID NO: 1351441 - RNA, 19 nt, Homo sapiens
gacugucucucacuaauuu

SEQ ID NO: 1351442 - RNA, 19 nt, Homo sapiens
gaagaacauggcaacauuu

SEQ ID NO: 1351443 - RNA, 19 nt, Homo sapiens
gaacuagacagaaugaaca

SEQ ID NO: 1351444 - RNA, 19 nt, Homo sapiens
caaacuaguuguauaucug

SEQ ID NO: 1351445 - RNA, 19 nt, Homo sapiens
ggaugaaacagaagaaaug

SEQ ID NO: 1351446 - RNA, 19 nt, Homo sapiens
guuaucagauccuugaaga

SEQ ID NO: 1351447 - RNA, 19 nt, Homo sapiens
cgaccacucuggauuacaa

SEQ ID NO: 1351448 - RNA, 19 nt, Homo sapiens
ggagaaaccauuaguguac

SEQ ID NO: 1351449 - RNA, 19 nt, Homo sapiens
guuuagagaucacucaguu

SEQ ID NO: 1351450 - RNA, 19 nt, Homo sapiens
acaagaaaguuaucagauc

SEQ ID NO: 1351451 - RNA, 19 nt, Homo sapiens
gauguugucauucuuacua

SEQ ID NO: 1351452 - RNA, 19 nt, Homo sapiens
ucaggucccucaaagauuc

SEQ ID NO: 1351453 - RNA, 19 nt, Homo sapiens
gaacgggacggugguggua

SEQ ID NO: 1351454 - RNA, 19 nt, Homo sapiens
ugaagagacauuccaauau

SEQ ID NO: 1351455 - RNA, 19 nt, Homo sapiens
aacaggaacugggauuuaa

SEQ ID NO: 1351456 - RNA, 19 nt, Homo sapiens
caaauuuacaggaggauga

SEQ ID NO: 1351457 - RNA, 19 nt, Homo sapiens
gaugucaggucccucaaag

SEQ ID NO: 1351458 - RNA, 19 nt, Homo sapiens
ugaaacagaagaaauggaa

SEQ ID NO: 1351459 - RNA, 19 nt, Homo sapiens
acaggaggaugaaacagaa

SEQ ID NO: 1351460 - RNA, 19 nt, Homo sapiens
gaaauacuaacgcuucagu

SEQ ID NO: 1351461 - RNA, 19 nt, Homo sapiens
ccgcugaggugacuuucaa

SEQ ID NO: 1351462 - RNA, 19 nt, Homo sapiens
gcagaguguuuagagauca

SEQ ID NO: 1351463 - RNA, 19 nt, Homo sapiens
aaaguuaucagauccuuga

SEQ ID NO: 1351464 - RNA, 19 nt, Homo sapiens
gaagaagaaaucaauuguc

SEQ ID NO: 1351465 - RNA, 19 nt, Homo sapiens
uaacagaugaggaagaaca

SEQ ID NO: 1351466 - RNA, 19 nt, Homo sapiens
cacucuggauuacaaauuu

SEQ ID NO: 1351467 - RNA, 19 nt, Homo sapiens
aaacguacccacaggaaga

SEQ ID NO: 1351468 - RNA, 19 nt, Homo sapiens
aaacagugaaguugagaaa

SEQ ID NO: 1351469 - RNA, 19 nt, Homo sapiens
gaauccuauuugcugcuua

SEQ ID NO: 1351470 - RNA, 19 nt, Homo sapiens
uugaagagacauuccaaua

SEQ ID NO: 1351471 - RNA, 19 nt, Homo sapiens
gacagaaugaacagccuua

SEQ ID NO: 1351472 - RNA, 19 nt, Homo sapiens
gcuaaauauugaacaugga

SEQ ID NO: 1351473 - RNA, 19 nt, Homo sapiens
ugcagaagaugguaagguu

SEQ ID NO: 1351474 - RNA, 19 nt, Homo sapiens
aagauuccuuggaccauuu

SEQ ID NO: 1351475 - RNA, 19 nt, Homo sapiens
gaugcgauguugucauucu

SEQ ID NO: 1351476 - RNA, 19 nt, Homo sapiens
aggaugcgauguugucauu

SEQ ID NO: 1351477 - RNA, 19 nt, Homo sapiens
ggacgguggugguaugacu

SEQ ID NO: 1351478 - RNA, 19 nt, Homo sapiens
gaucaugaacuagacagaa

SEQ ID NO: 1351479 - RNA, 19 nt, Homo sapiens
ugaugggaguuaaguguga

SEQ ID NO: 1351480 - RNA, 19 nt, Homo sapiens
gcccgaccacucuggauua

SEQ ID NO: 1351481 - RNA, 19 nt, Homo sapiens
aagcagaguugauccaucu

SEQ ID NO: 1351482 - RNA, 19 nt, Homo sapiens
uaucagauccuugaagaga

SEQ ID NO: 1351483 - RNA, 19 nt, Homo sapiens
aaagauuccuuggaccauu

SEQ ID NO: 1351484 - RNA, 19 nt, Homo sapiens
ccaaggggcugaugauguu

SEQ ID NO: 1351485 - RNA, 19 nt, Homo sapiens
gcugaucaaacuaguugua

SEQ ID NO: 1351486 - RNA, 19 nt, Homo sapiens
aguaacagaugaggaagaa

SEQ ID NO: 1351487 - RNA, 19 nt, Homo sapiens
ucaaggauaagcagaguug

SEQ ID NO: 1351488 - RNA, 19 nt, Homo sapiens
auuaguagcugaucaaacu

SEQ ID NO: 1351489 - RNA, 19 nt, Homo sapiens
ugguaagguucgaaucuuu

SEQ ID NO: 1351490 - RNA, 19 nt, Homo sapiens
gcagagggcggagaucuca

SEQ ID NO: 1351491 - RNA, 19 nt, Homo sapiens
gaaauggaaggcccacagu

SEQ ID NO: 1351492 - RNA, 19 nt, Homo sapiens
gugaugcuguggagucuuc

SEQ ID NO: 1351493 - RNA, 19 nt, Homo sapiens
gaguugauccaucugagaa

SEQ ID NO: 1351494 - RNA, 19 nt, Homo sapiens
uguuaccagugucuuauuu

SEQ ID NO: 1351495 - RNA, 19 nt, Homo sapiens
ggaacuccauuaggacaca

SEQ ID NO: 1351496 - RNA, 19 nt, Homo sapiens
aaacagaagagucccacaa

SEQ ID NO: 1351497 - RNA, 19 nt, Homo sapiens
cugaugauguuaccagugu

SEQ ID NO: 1351498 - RNA, 19 nt, Homo sapiens
gaugggaguuaagugugaa

SEQ ID NO: 1351499 - RNA, 19 nt, Homo sapiens
aaagggaucaugaacuaga

SEQ ID NO: 1351500 - RNA, 19 nt, Homo sapiens
ugacuagugcagaguguuu

SEQ ID NO: 1351501 - RNA, 19 nt, Homo sapiens
uagcugaucaaacuaguug

SEQ ID NO: 1351502 - RNA, 19 nt, Homo sapiens
caagcaggguggaaauacu

SEQ ID NO: 1351503 - RNA, 19 nt, Homo sapiens
gauuuaagggccacacuuc

SEQ ID NO: 1351504 - RNA, 19 nt, Homo sapiens
ucagauccuugaagagaca

SEQ ID NO: 1351505 - RNA, 19 nt, Homo sapiens
gagaaaccauuaguguacu

SEQ ID NO: 1351506 - RNA, 19 nt, Homo sapiens
ggacgggugggcauucuuc

SEQ ID NO: 1351507 - RNA, 19 nt, Homo sapiens
gaacauggcaacauuuuac

SEQ ID NO: 1351508 - RNA, 19 nt, Homo sapiens
gagaaagggaucaugaacu

SEQ ID NO: 1351509 - RNA, 19 nt, Homo sapiens
cauguggacuggauaugca

SEQ ID NO: 1351510 - RNA, 19 nt, Homo sapiens
gauguuaccagugucuuau

SEQ ID NO: 1351511 - RNA, 19 nt, Homo sapiens
ggaugcaaacagugaaguu

SEQ ID NO: 1351512 - RNA, 19 nt, Homo sapiens
guugugggaugcaaacagu

SEQ ID NO: 1351513 - RNA, 19 nt, Homo sapiens
gaugguaagguucgaaucu

SEQ ID NO: 1351514 - RNA, 19 nt, Homo sapiens
ccacucuggauuacaaauu

SEQ ID NO: 1351515 - RNA, 19 nt, Homo sapiens
uggagaaaccauuagugua

SEQ ID NO: 1351516 - RNA, 19 nt, Homo sapiens
gcucuaugccucacaugga

SEQ ID NO: 1351517 - RNA, 19 nt, Homo sapiens
gcaaacagugaaguugaga

SEQ ID NO: 1351518 - RNA, 19 nt, Homo sapiens
gaugcaaacagugaaguug

SEQ ID NO: 1351519 - RNA, 19 nt, Homo sapiens
gaggaugaaacagaagaaa

SEQ ID NO: 1351520 - RNA, 19 nt, Homo sapiens
ggaggaugaaacagaagaa

SEQ ID NO: 1351521 - RNA, 19 nt, Homo sapiens
ggugucauguggacuggau

SEQ ID NO: 1351522 - RNA, 19 nt, Homo sapiens
ggugaugggaguuaagugu

SEQ ID NO: 1351523 - RNA, 19 nt, Homo sapiens
gaagaugguaagguucgaa

SEQ ID NO: 1351524 - RNA, 19 nt, Homo sapiens
ugauguuaccagugucuua

SEQ ID NO: 1351525 - RNA, 19 nt, Homo sapiens
ggaugucaggucccucaaa

SEQ ID NO: 1351526 - RNA, 19 nt, Homo sapiens
caugaacuagacagaauga

SEQ ID NO: 1351527 - RNA, 19 nt, Homo sapiens
ggauuuaagggccacacuu

SEQ ID NO: 1351528 - RNA, 19 nt, Homo sapiens
gguaagguucgaaucuuuc

SEQ ID NO: 1351529 - RNA, 19 nt, Homo sapiens
caagcucuaugccucacau

SEQ ID NO: 1351530 - RNA, 19 nt, Homo sapiens
agaaugaacagccuuagag

SEQ ID NO: 1351531 - RNA, 19 nt, Homo sapiens
aaagucuccgggaccauua

SEQ ID NO: 1351532 - RNA, 19 nt, Homo sapiens
cagaaugaacagccuuaga

SEQ ID NO: 1351533 - RNA, 19 nt, Homo sapiens
ccauuaguguacuggaugu

SEQ ID NO: 1351534 - RNA, 19 nt, Homo sapiens
aagcaggguggaaauacua

SEQ ID NO: 1351535 - RNA, 19 nt, Homo sapiens
gacuagugcagaguguuua

SEQ ID NO: 1351536 - RNA, 19 nt, Homo sapiens
gucucucacuaauuucuuu

SEQ ID NO: 1351537 - RNA, 19 nt, Homo sapiens
gcauaacacugaaagauaa

SEQ ID NO: 1351538 - RNA, 19 nt, Homo sapiens
ugaccaagcugaaauuuga

SEQ ID NO: 1351539 - RNA, 19 nt, Homo sapiens
gggagauacugaagauuua

SEQ ID NO: 1351540 - RNA, 19 nt, Homo sapiens
cagaagagcuguucacauc

SEQ ID NO: 1351541 - RNA, 19 nt, Homo sapiens
cagagaagcuggaaaggaa

SEQ ID NO: 1351542 - RNA, 19 nt, Homo sapiens
ucaaagggcucuggaguaa

SEQ ID NO: 1351543 - RNA, 19 nt, Homo sapiens
cagcagcaauuuauucuuu

SEQ ID NO: 1351544 - RNA, 19 nt, Homo sapiens
gaucagguauuuagucuuc

SEQ ID NO: 1351545 - RNA, 19 nt, Homo sapiens
ggaaacauauggaguggau

SEQ ID NO: 1351546 - RNA, 19 nt, Homo sapiens
guaaggacgugucaggaaa

SEQ ID NO: 1351547 - RNA, 19 nt, Homo sapiens
caacagaguggacuucuuu

SEQ ID NO: 1351548 - RNA, 19 nt, Homo sapiens
caaaggaagucauggaauc

SEQ ID NO: 1351549 - RNA, 19 nt, Homo sapiens
gaaccaagccuucuacaag

SEQ ID NO: 1351550 - RNA, 19 nt, Homo sapiens
aauggaaaguugcuucuua

SEQ ID NO: 1351551 - RNA, 19 nt, Homo sapiens
ggaaugaggugaccaagcu

SEQ ID NO: 1351552 - RNA, 19 nt, Homo sapiens
ggaaucaagugcuaagauc

SEQ ID NO: 1351553 - RNA, 19 nt, Homo sapiens
gcacagacauuggaaacau

SEQ ID NO: 1351554 - RNA, 19 nt, Homo sapiens
caaguggucuaauggauau

SEQ ID NO: 1351555 - RNA, 19 nt, Homo sapiens
caaagucuguggugaaaca

SEQ ID NO: 1351556 - RNA, 19 nt, Homo sapiens
guaagcaccucuggaaaug

SEQ ID NO: 1351557 - RNA, 19 nt, Homo sapiens
gaacaauuccacuaucaau

SEQ ID NO: 1351558 - RNA, 19 nt, Homo sapiens
ggagccaccugcagcauug

SEQ ID NO: 1351559 - RNA, 19 nt, Homo sapiens
gcuguuggaucagguauuu

SEQ ID NO: 1351560 - RNA, 19 nt, Homo sapiens
gagcugcuguccucuguau

SEQ ID NO: 1351561 - RNA, 19 nt, Homo sapiens
ggaaccaucggcacauaua

SEQ ID NO: 1351562 - RNA, 19 nt, Homo sapiens
caagaagugugaauacuac

SEQ ID NO: 1351563 - RNA, 19 nt, Homo sapiens
gagaaagacuauuuuggua

SEQ ID NO: 1351564 - RNA, 19 nt, Homo sapiens
cgauacagguaaauaguga

SEQ ID NO: 1351565 - RNA, 19 nt, Homo sapiens
ggaacugaguggucaaaca

SEQ ID NO: 1351566 - RNA, 19 nt, Homo sapiens
agaagcagccggacagaua

SEQ ID NO: 1351567 - RNA, 19 nt, Homo sapiens
gaagagcuguucacaucuc

SEQ ID NO: 1351568 - RNA, 19 nt, Homo sapiens
guuagcagcuuacauccuu

SEQ ID NO: 1351569 - RNA, 19 nt, Homo sapiens
ggcauaacacugaaagaua

SEQ ID NO: 1351570 - RNA, 19 nt, Homo sapiens
agagcuauguugcugcuua

SEQ ID NO: 1351571 - RNA, 19 nt, Homo sapiens
gcaguaguaucaccuagca

SEQ ID NO: 1351572 - RNA, 19 nt, Homo sapiens
gaacaggugaauaaguuug

SEQ ID NO: 1351573 - RNA, 19 nt, Homo sapiens
aggaacaggugaauaaguu

SEQ ID NO: 1351574 - RNA, 19 nt, Homo sapiens
gaaacaagaggguccacuu

SEQ ID NO: 1351575 - RNA, 19 nt, Homo sapiens
gcaacagaguggacuucuu

SEQ ID NO: 1351576 - RNA, 19 nt, Homo sapiens
caucugaaccuacuugaga

SEQ ID NO: 1351577 - RNA, 19 nt, Homo sapiens
gaacuggucacucucaaag

SEQ ID NO: 1351578 - RNA, 19 nt, Homo sapiens
ggcauuggcuggaauuuac

SEQ ID NO: 1351579 - RNA, 19 nt, Homo sapiens
gcgaguagcugugauugca

SEQ ID NO: 1351580 - RNA, 19 nt, Homo sapiens
caagaggguccacuucauu

SEQ ID NO: 1351581 - RNA, 19 nt, Homo sapiens
aaagauaagcugggagaua

SEQ ID NO: 1351582 - RNA, 19 nt, Homo sapiens
ccaaaggcauaacacugaa

SEQ ID NO: 1351583 - RNA, 19 nt, Homo sapiens
gccaaaggcauaacacuga

SEQ ID NO: 1351584 - RNA, 19 nt, Homo sapiens
gcucuggaguaacuaauca

SEQ ID NO: 1351585 - RNA, 19 nt, Homo sapiens
ucaagaagugugaauacua

SEQ ID NO: 1351586 - RNA, 19 nt, Homo sapiens
gcggaaccaucggcacaua

SEQ ID NO: 1351587 - RNA, 19 nt, Homo sapiens
gaccaugggacuccucuuu

SEQ ID NO: 1351588 - RNA, 19 nt, Homo sapiens
gcugaaauuugaaggaaag

SEQ ID NO: 1351589 - RNA, 19 nt, Homo sapiens
caaaggccaguaccuguuu

SEQ ID NO: 1351590 - RNA, 19 nt, Homo sapiens
cacagacauuggaaacaua

SEQ ID NO: 1351591 - RNA, 19 nt, Homo sapiens
gcugggagauacugaagau

SEQ ID NO: 1351592 - RNA, 19 nt, Homo sapiens
gagcuauguugcugcuuau

SEQ ID NO: 1351593 - RNA, 19 nt, Homo sapiens
caaaauggauaaacucugu

SEQ ID NO: 1351594 - RNA, 19 nt, Homo sapiens
ucaaguggucuaauggaua

SEQ ID NO: 1351595 - RNA, 19 nt, Homo sapiens
gcuauguugcugcuuauuu

SEQ ID NO: 1351596 - RNA, 19 nt, Homo sapiens
uacaaagucuguggugaaa

SEQ ID NO: 1351597 - RNA, 19 nt, Homo sapiens
ggaaauguggaaucgagaa

SEQ ID NO: 1351598 - RNA, 19 nt, Homo sapiens
gauuauugcaguaguauca

SEQ ID NO: 1351599 - RNA, 19 nt, Homo sapiens
gcaaaggaagucauggaau

SEQ ID NO: 1351600 - RNA, 19 nt, Homo sapiens
uuucggagguugcaaauag

SEQ ID NO: 1351601 - RNA, 19 nt, Homo sapiens
ccuaugauguugccacugu

SEQ ID NO: 1351602 - RNA, 19 nt, Homo sapiens
ucuacaagcuggagaaguc

SEQ ID NO: 1351603 - RNA, 19 nt, Homo sapiens
gaaagacuauuuugguauc

SEQ ID NO: 1351604 - RNA, 19 nt, Homo sapiens
ggaacaggugaauaaguuu

SEQ ID NO: 1351605 - RNA, 19 nt, Homo sapiens
gaggguccacuucauuaaa

SEQ ID NO: 1351606 - RNA, 19 nt, Homo sapiens
uaaacucuguggugcuguu

SEQ ID NO: 1351607 - RNA, 19 nt, Homo sapiens
ggagauacugaagauuuaa

SEQ ID NO: 1351608 - RNA, 19 nt, Homo sapiens
aauacuaccucuugaacug

SEQ ID NO: 1351609 - RNA, 19 nt, Homo sapiens
ccagugcagucgcaacaga

SEQ ID NO: 1351610 - RNA, 19 nt, Homo sapiens
gaggguguuucccagaaga

SEQ ID NO: 1351611 - RNA, 19 nt, Homo sapiens
aggcaugacuccucccaaa

SEQ ID NO: 1351612 - RNA, 19 nt, Homo sapiens
ccaugggacuccucuuugu

SEQ ID NO: 1351613 - RNA, 19 nt, Homo sapiens
gcauugaggaggagaagga

SEQ ID NO: 1351614 - RNA, 19 nt, Homo sapiens
gaaccuacuugagaaagac

SEQ ID NO: 1351615 - RNA, 19 nt, Homo sapiens
aagaggguccacuucauua

SEQ ID NO: 1351616 - RNA, 19 nt, Homo sapiens
ucaaacaccagcaacauca

SEQ ID NO: 1351617 - RNA, 19 nt, Homo sapiens
aagauaagcugggagauac

SEQ ID NO: 1351618 - RNA, 19 nt, Homo sapiens
agaguggacuucuuuccuu

SEQ ID NO: 1351619 - RNA, 19 nt, Homo sapiens
ucgaacaauuccacuauca

SEQ ID NO: 1351620 - RNA, 19 nt, Homo sapiens
aggaggaacaggugaauaa

SEQ ID NO: 1351621 - RNA, 19 nt, Homo sapiens
acagguaaauagugacaug

SEQ ID NO: 1351622 - RNA, 19 nt, Homo sapiens
ugggagauacugaagauuu

SEQ ID NO: 1351623 - RNA, 19 nt, Homo sapiens
ucuaauggauauacuugga

SEQ ID NO: 1351624 - RNA, 19 nt, Homo sapiens
aaagggcucuggaguaacu

SEQ ID NO: 1351625 - RNA, 19 nt, Homo sapiens
ugaaccuacuugagaaaga

SEQ ID NO: 1351626 - RNA, 19 nt, Homo sapiens
gcucugaaagaagaaauaa

SEQ ID NO: 1351627 - RNA, 19 nt, Homo sapiens
ggaaaguugcuucuuaaaa

SEQ ID NO: 1351628 - RNA, 19 nt, Homo sapiens
auggaaaguugcuucuuaa

SEQ ID NO: 1351629 - RNA, 19 nt, Homo sapiens
cuauguugcugcuuauuuc

SEQ ID NO: 1351630 - RNA, 19 nt, Homo sapiens
gcucaugcccugucuaaac

SEQ ID NO: 1351631 - RNA, 19 nt, Homo sapiens
gaaucaagugcuaagauca

SEQ ID NO: 1351632 - RNA, 19 nt, Homo sapiens
gucauggaaucaagugcua

SEQ ID NO: 1351633 - RNA, 19 nt, Homo sapiens
aagcugaaauuugaaggaa

SEQ ID NO: 1351634 - RNA, 19 nt, Homo sapiens
ggucuaauggauauacuug

SEQ ID NO: 1351635 - RNA, 19 nt, Homo sapiens
cugcugcucugaaagaaga

SEQ ID NO: 1351636 - RNA, 19 nt, Homo sapiens
gaucauccuuaccgagucu

SEQ ID NO: 1351637 - RNA, 19 nt, Homo sapiens
gaacaaagucacuguaauu

SEQ ID NO: 1351638 - RNA, 19 nt, Homo sapiens
aaauagagcuggaagcauu

SEQ ID NO: 1351639 - RNA, 19 nt, Homo sapiens
ggaacaaagucacuguaau

SEQ ID NO: 1351640 - RNA, 19 nt, Homo sapiens
uaacgaaaguuugcaauag

SEQ ID NO: 1351641 - RNA, 19 nt, Homo sapiens
gggaauuuauccuaagaaa

SEQ ID NO: 1351642 - RNA, 19 nt, Homo sapiens
gcaaagagacuacugaaaa

SEQ ID NO: 1351643 - RNA, 19 nt, Homo sapiens
gggaagcaaugguuugguu

SEQ ID NO: 1351644 - RNA, 19 nt, Homo sapiens
gaaaggacacacacaggaa

SEQ ID NO: 1351645 - RNA, 19 nt, Homo sapiens
guaacgaaaguuugcaaua

SEQ ID NO: 1351646 - RNA, 19 nt, Homo sapiens
gaacaucugacugaaagaa

SEQ ID NO: 1351647 - RNA, 19 nt, Homo sapiens
ggaugacaguugggugaua

SEQ ID NO: 1351648 - RNA, 19 nt, Homo sapiens
uagcaaaccauaacagaaa

SEQ ID NO: 1351649 - RNA, 19 nt, Homo sapiens
ccauuucucuccaggcuuu

SEQ ID NO: 1351650 - RNA, 19 nt, Homo sapiens
caaagucacuguaauuuuc

SEQ ID NO: 1351651 - RNA, 19 nt, Homo sapiens
gaugacaguugggugauau

SEQ ID NO: 1351652 - RNA, 19 nt, Homo sapiens
ggauuuaguuagugauaag

SEQ ID NO: 1351653 - RNA, 19 nt, Homo sapiens
ggacacugccuccguacuu

SEQ ID NO: 1351654 - RNA, 19 nt, Homo sapiens
aauagugcauguuauguga

SEQ ID NO: 1351655 - RNA, 19 nt, Homo sapiens
ccaagaaccaucugcgaaa

SEQ ID NO: 1351656 - RNA, 19 nt, Homo sapiens
gcaaauagagcuggaagca

SEQ ID NO: 1351657 - RNA, 19 nt, Homo sapiens
aagaacaucugacugaaag

SEQ ID NO: 1351658 - RNA, 19 nt, Homo sapiens
guaccgcgcagacauuaaa

SEQ ID NO: 1351659 - RNA, 19 nt, Homo sapiens
ggaauauggagaccaguga

SEQ ID NO: 1351660 - RNA, 19 nt, Homo sapiens
gacacugccuccguacuuu

SEQ ID NO: 1351661 - RNA, 19 nt, Homo sapiens
cuacuuugaucaccauuuc

SEQ ID NO: 1351662 - RNA, 19 nt, Homo sapiens
uaaaagaacaucugacuga

SEQ ID NO: 1351663 - RNA, 19 nt, Homo sapiens
acacacaggaaauucauaa

SEQ ID NO: 1351664 - RNA, 19 nt, Homo sapiens
ggaguaccgcgcagacauu

SEQ ID NO: 1351665 - RNA, 19 nt, Homo sapiens
acaguugggugauaugugu

SEQ ID NO: 1351666 - RNA, 19 nt, Homo sapiens
acucauaggcugcaacaaa

SEQ ID NO: 1351667 - RNA, 19 nt, Homo sapiens
gcgcagacauuaaaaguca

SEQ ID NO: 1351668 - RNA, 19 nt, Homo sapiens
ggacacacacaggaaauuc

SEQ ID NO: 1351669 - RNA, 19 nt, Homo sapiens
guugagugguuaucuuugu

SEQ ID NO: 1351670 - RNA, 19 nt, Homo sapiens
gaguaccgcgcagacauua

SEQ ID NO: 1351671 - RNA, 19 nt, Homo sapiens
gggauugcuuaaguaaauu

SEQ ID NO: 1351672 - RNA, 19 nt, Homo sapiens
gcaacaaaggugacucugu

SEQ ID NO: 1351673 - RNA, 19 nt, Homo sapiens
caagaaccaucugcgaaag

SEQ ID NO: 1351674 - RNA, 19 nt, Homo sapiens
aaagaacaucugacugaaa

SEQ ID NO: 1351675 - RNA, 19 nt, Homo sapiens
ggggauugcuuaaguaaau

SEQ ID NO: 1351676 - RNA, 19 nt, Homo sapiens
uaaagaaaggcaaauagag

SEQ ID NO: 1351677 - RNA, 19 nt, Homo sapiens
cgcccagccuguaauguuu

SEQ ID NO: 1351678 - RNA, 19 nt, Homo sapiens
uccgagauguggcaccaua

SEQ ID NO: 1351679 - RNA, 19 nt, Homo sapiens
gaauauggagaccagugaa

SEQ ID NO: 1351680 - RNA, 19 nt, Homo sapiens
uagugcauguuaugugauu

SEQ ID NO: 1351681 - RNA, 19 nt, Homo sapiens
aaagacggaaggcauacua

SEQ ID NO: 1351682 - RNA, 19 nt, Homo sapiens
ccuacgaauucuaucuuug

SEQ ID NO: 1351683 - RNA, 19 nt, Homo sapiens
ucauuugaccuacgaauuc

SEQ ID NO: 1351684 - RNA, 19 nt, Homo sapiens
aagccuccaugucauuuga

SEQ ID NO: 1351685 - RNA, 19 nt, Homo sapiens
ggcaaagagacuacugaaa

SEQ ID NO: 1351686 - RNA, 19 nt, Homo sapiens
ccagcccucuccuacuuug

SEQ ID NO: 1351687 - RNA, 19 nt, Homo sapiens
uggaacaaagucacuguaa

SEQ ID NO: 1351688 - RNA, 19 nt, Homo sapiens
gcccagccuguaauguuua

SEQ ID NO: 1351689 - RNA, 19 nt, Homo sapiens
agaaccaucugcgaaagga

SEQ ID NO: 1351690 - RNA, 19 nt, Homo sapiens
gugguuaucuuuguauggu

SEQ ID NO: 1351691 - RNA, 19 nt, Homo sapiens
gagugguuaucuuuguaug

SEQ ID NO: 1351692 - RNA, 19 nt, Homo sapiens
gaccuacgaauucuaucuu

SEQ ID NO: 1351693 - RNA, 19 nt, Homo sapiens
aaaggacacacacaggaaa

SEQ ID NO: 1351694 - RNA, 19 nt, Homo sapiens
uugagugguuaucuuugua

SEQ ID NO: 1351695 - RNA, 19 nt, Homo sapiens
agacggaaggcauacuaaa

SEQ ID NO: 1351696 - RNA, 19 nt, Homo sapiens
cuccagcccucuccuacuu

SEQ ID NO: 1351697 - RNA, 19 nt, Homo sapiens
ugguuugguugggaauuua

SEQ ID NO: 1351698 - RNA, 19 nt, Homo sapiens
guucaucccagcauugcaa

SEQ ID NO: 1351699 - RNA, 19 nt, Homo sapiens
cucauaggcugcaacaaag

SEQ ID NO: 1351700 - RNA, 19 nt, Homo sapiens
aauguugagugguuaucuu

SEQ ID NO: 1351701 - RNA, 19 nt, Homo sapiens
cuuugggaauuuauccuaa

SEQ ID NO: 1351702 - RNA, 19 nt, Homo sapiens
ccuaaaagccuccauguca

SEQ ID NO: 1351703 - RNA, 19 nt, Homo sapiens
uacauugcgugugggagua

SEQ ID NO: 1351704 - RNA, 19 nt, Homo sapiens
cagccuguaauguuuauau

SEQ ID NO: 1351705 - RNA, 19 nt, Homo sapiens
gagauguggcaccauagug

SEQ ID NO: 1351706 - RNA, 19 nt, Homo sapiens
gacacacacaggaaauuca

SEQ ID NO: 1351707 - RNA, 19 nt, Homo sapiens
guauacguagagcagauaa

SEQ ID NO: 1351708 - RNA, 19 nt, Homo sapiens
aaauagugcauguuaugug

SEQ ID NO: 1351709 - RNA, 19 nt, Homo sapiens
cuacgaauucuaucuuugg

SEQ ID NO: 1351710 - RNA, 19 nt, Homo sapiens
auggguguaugcuuguaua

SEQ ID NO: 1351711 - RNA, 19 nt, Homo sapiens
aacgaaaguuugcaauagg

SEQ ID NO: 1351712 - RNA, 19 nt, Homo sapiens
uuagcaaaccauaacagaa

SEQ ID NO: 1351713 - RNA, 19 nt, Homo sapiens
ccgcccagccuguaauguu

SEQ ID NO: 1351714 - RNA, 19 nt, Homo sapiens
guggaacaaagucacugua

SEQ ID NO: 1351715 - RNA, 19 nt, Homo sapiens
gcagccagccuccauugac

SEQ ID NO: 1351716 - RNA, 19 nt, Homo sapiens
cuuaaggauuuaguuagug

SEQ ID NO: 1351717 - RNA, 19 nt, Homo sapiens
cacaggaaauucauaaaag

SEQ ID NO: 1351718 - RNA, 19 nt, Homo sapiens
cuccagcccucgcuaugug

SEQ ID NO: 1351719 - RNA, 19 nt, Homo sapiens
aaaagaacaucugacugaa

SEQ ID NO: 1351720 - RNA, 19 nt, Homo sapiens
guacuacgaugucauaaug

SEQ ID NO: 1351721 - RNA, 19 nt, Homo sapiens
gaaaugggguugugauaua

SEQ ID NO: 1351722 - RNA, 19 nt, Homo sapiens
gaaacaacauggaaaugga

SEQ ID NO: 1351723 - RNA, 19 nt, Homo sapiens
gcaguaagaggaaauuaaa

SEQ ID NO: 1351724 - RNA, 19 nt, Homo sapiens
gcguagagcucaccuagug

SEQ ID NO: 1351725 - RNA, 19 nt, Homo sapiens
gauggcaaguucagaaguu

SEQ ID NO: 1351726 - RNA, 19 nt, Homo sapiens
cagcaacucuucuacaaca

SEQ ID NO: 1351727 - RNA, 19 nt, Homo sapiens
ggagaucugagaaucgaua

SEQ ID NO: 1351728 - RNA, 19 nt, Homo sapiens
ggagaaacaacauggaaau

SEQ ID NO: 1351729 - RNA, 19 nt, Homo sapiens
ggcagcaacucuucuacaa

SEQ ID NO: 1351730 - RNA, 19 nt, Homo sapiens
gagaaucgauacugaacag

SEQ ID NO: 1351731 - RNA, 19 nt, Homo sapiens
gacuggcgcucauuguaaa

SEQ ID NO: 1351732 - RNA, 19 nt, Homo sapiens
gagccacccuggaaagcaa

SEQ ID NO: 1351733 - RNA, 19 nt, Homo sapiens
aaugggagccucauaugua

SEQ ID NO: 1351734 - RNA, 19 nt, Homo sapiens
cgacuggcgcucauuguaa

SEQ ID NO: 1351735 - RNA, 19 nt, Homo sapiens
acacugggaucccggaaga

SEQ ID NO: 1351736 - RNA, 19 nt, Homo sapiens
acacagagccacccuggaa

SEQ ID NO: 1351737 - RNA, 19 nt, Homo sapiens
ggagggaugccaccagaug

SEQ ID NO: 1351738 - RNA, 19 nt, Homo sapiens
ucaguacuacgaugucaua

SEQ ID NO: 1351739 - RNA, 19 nt, Homo sapiens
ggagccagaccaagccuuu

SEQ ID NO: 1351740 - RNA, 19 nt, Homo sapiens
uaaaugcaccgacaugaca

SEQ ID NO: 1351741 - RNA, 19 nt, Homo sapiens
gggagccucauauguaauu

SEQ ID NO: 1351742 - RNA, 19 nt, Homo sapiens
agaccaagccuuucugugu

SEQ ID NO: 1351743 - RNA, 19 nt, Homo sapiens
gcgacuggcgcucauugua

SEQ ID NO: 1351744 - RNA, 19 nt, Homo sapiens
caacucuucuacaacagau

SEQ ID NO: 1351745 - RNA, 19 nt, Homo sapiens
ggaaguggucauagaaucu

SEQ ID NO: 1351746 - RNA, 19 nt, Homo sapiens
uauaaagacagggauauga

SEQ ID NO: 1351747 - RNA, 19 nt, Homo sapiens
gcugaguagggcaaaguua

SEQ ID NO: 1351748 - RNA, 19 nt, Homo sapiens
gagaaacaacauggaaaug

SEQ ID NO: 1351749 - RNA, 19 nt, Homo sapiens
gcaacucuucuacaacaga

SEQ ID NO: 1351750 - RNA, 19 nt, Homo sapiens
ccuaguggcuuccauagcu

SEQ ID NO: 1351751 - RNA, 19 nt, Homo sapiens
acagggauaugagugaaga

SEQ ID NO: 1351752 - RNA, 19 nt, Homo sapiens
agccucauauguaauugua

SEQ ID NO: 1351753 - RNA, 19 nt, Homo sapiens
augggagccucauauguaa

SEQ ID NO: 1351754 - RNA, 19 nt, Homo sapiens
gagggaugccaccagauga

SEQ ID NO: 1351755 - RNA, 19 nt, Homo sapiens
gaucugagaaucgauacug

SEQ ID NO: 1351756 - RNA, 19 nt, Homo sapiens
ucaccuaguggcuuccaua

SEQ ID NO: 1351757 - RNA, 19 nt, Homo sapiens
agacagggauaugagugaa

SEQ ID NO: 1351758 - RNA, 19 nt, Homo sapiens
acauggaaauggagaccaa

SEQ ID NO: 1351759 - RNA, 19 nt, Homo sapiens
uggaaguggucauagaauc

SEQ ID NO: 1351760 - RNA, 19 nt, Homo sapiens
ugauauaaagacagggaua

SEQ ID NO: 1351761 - RNA, 19 nt, Homo sapiens
aauaaugggagccucauau

SEQ ID NO: 1351762 - RNA, 19 nt, Homo sapiens
ggaaauggagaccaaaaga

SEQ ID NO: 1351763 - RNA, 19 nt, Homo sapiens
aaucgauacugaacagcuu

SEQ ID NO: 1351764 - RNA, 19 nt, Homo sapiens
uaauaaugggagccucaua

SEQ ID NO: 1351765 - RNA, 19 nt, Homo sapiens
aaaguuaggagucgcuguu

SEQ ID NO: 1351766 - RNA, 19 nt, Homo sapiens
ccuggaaagcaaagaauga

SEQ ID NO: 1351767 - RNA, 19 nt, Homo sapiens
ccaagccuuucugugugua

SEQ ID NO: 1351768 - RNA, 19 nt, Homo sapiens
uaaugggagccucauaugu

SEQ ID NO: 1351769 - RNA, 19 nt, Homo sapiens
gaggcggagcuuacaguga

SEQ ID NO: 1351770 - RNA, 19 nt, Homo sapiens
uaaagacagggauaugagu

SEQ ID NO: 1351771 - RNA, 19 nt, Homo sapiens
ggauaugagugaagaaaac

SEQ ID NO: 1351772 - RNA, 19 nt, Homo sapiens
guaaaugcaccgacaugac

SEQ ID NO: 1351773 - RNA, 19 nt, Homo sapiens
uagcaguaagaggaaauua

SEQ ID NO: 1351774 - RNA, 19 nt, Homo sapiens
ggagccucauauguaauug

SEQ ID NO: 1351775 - RNA, 19 nt, Homo sapiens
agaaacaacauggaaaugg

SEQ ID NO: 1351776 - RNA, 19 nt, Homo sapiens
gagcugaguagggcaaagu

SEQ ID NO: 1351777 - RNA, 19 nt, Homo sapiens
gaaguggucauagaaucuc

SEQ ID NO: 1351778 - RNA, 19 nt, Homo sapiens
cuaguggcuuccauagcuu

SEQ ID NO: 1351779 - RNA, 19 nt, Homo sapiens
uggagaaacaacauggaaa

SEQ ID NO: 1351780 - RNA, 19 nt, Homo sapiens
ggguugugauauaaagaca

SEQ ID NO: 1351781 - RNA, 19 nt, Homo sapiens
gaguagggcaaaguuagga

SEQ ID NO: 1351782 - RNA, 19 nt, Homo sapiens
guuaggagucgcuguuugg

SEQ ID NO: 1351783 - RNA, 19 nt, Homo sapiens
ggaagaagcuguaaagaau

SEQ ID NO: 1351784 - RNA, 19 nt, Homo sapiens
uagagaagcuauucaguuu

SEQ ID NO: 1351785 - RNA, 19 nt, Homo sapiens
gcauugggcuagcagaaua

SEQ ID NO: 1351786 - RNA, 19 nt, Homo sapiens
cagagcugcugaacaauua

SEQ ID NO: 1351787 - RNA, 19 nt, Homo sapiens
gccaagaaaugugggauua

SEQ ID NO: 1351788 - RNA, 19 nt, Homo sapiens
caccagagcugcugaacaa

SEQ ID NO: 1351789 - RNA, 19 nt, Homo sapiens
gaugugcacugccaagaaa

SEQ ID NO: 1351790 - RNA, 19 nt, Homo sapiens
gaagaagcuguaaagaaua

SEQ ID NO: 1351791 - RNA, 19 nt, Homo sapiens
gaugaguucugauaccaaa

SEQ ID NO: 1351792 - RNA, 19 nt, Homo sapiens
gaacaaauucaacgggaaa

SEQ ID NO: 1351793 - RNA, 19 nt, Homo sapiens
ggauugaccauguuacuuu

SEQ ID NO: 1351794 - RNA, 19 nt, Homo sapiens
acacaagaguuaccuagaa

SEQ ID NO: 1351795 - RNA, 19 nt, Homo sapiens
gagccgagaucgcgccauu

SEQ ID NO: 1351796 - RNA, 19 nt, Homo sapiens
ugacuuacccggacaugua

SEQ ID NO: 1351797 - RNA, 19 nt, Homo sapiens
cagaaacaauggaacaaau

SEQ ID NO: 1351798 - RNA, 19 nt, Homo sapiens
ggugaaaccucgccucuac

SEQ ID NO: 1351799 - RNA, 19 nt, Homo sapiens
gcacugcgguuggguggaa

SEQ ID NO: 1351800 - RNA, 19 nt, Homo sapiens
gaaacaauggaacaaauuc

SEQ ID NO: 1351801 - RNA, 19 nt, Homo sapiens
gaacaaacuagaugacaag

SEQ ID NO: 1351802 - RNA, 19 nt, Homo sapiens
agagucagcugaugaguuc

SEQ ID NO: 1351803 - RNA, 19 nt, Homo sapiens
ugacauugagguugaauuu

SEQ ID NO: 1351804 - RNA, 19 nt, Homo sapiens
ugaacaaacuagaugacaa

SEQ ID NO: 1351805 - RNA, 19 nt, Homo sapiens
gcagaaacaauggaacaaa

SEQ ID NO: 1351806 - RNA, 19 nt, Homo sapiens
gccuccagcuauuaucuua

SEQ ID NO: 1351807 - RNA, 19 nt, Homo sapiens
gaaaugugggauuagguuu

SEQ ID NO: 1351808 - RNA, 19 nt, Homo sapiens
agcagaauauccauguuua

SEQ ID NO: 1351809 - RNA, 19 nt, Homo sapiens
gagcaaaacuccaucucaa

SEQ ID NO: 1351810 - RNA, 19 nt, Homo sapiens
cagcugaugaguucugaua

SEQ ID NO: 1351811 - RNA, 19 nt, Homo sapiens
caacuuacacauauucauc

SEQ ID NO: 1351812 - RNA, 19 nt, Homo sapiens
caagaaaugugggauuagg

SEQ ID NO: 1351813 - RNA, 19 nt, Homo sapiens
ggcaggagauucgcuugaa

SEQ ID NO: 1351814 - RNA, 19 nt, Homo sapiens
aaaccucgccucuacuaaa

SEQ ID NO: 1351815 - RNA, 19 nt, Homo sapiens
gcaaaacuccaucucaaaa

SEQ ID NO: 1351816 - RNA, 19 nt, Homo sapiens
aggaagaccugaacaaacu

SEQ ID NO: 1351817 - RNA, 19 nt, Homo sapiens
uggaagaagcuguaaagaa

SEQ ID NO: 1351818 - RNA, 19 nt, Homo sapiens
aaagaaagagcaucaugga

SEQ ID NO: 1351819 - RNA, 19 nt, Homo sapiens
gacgaugucauuucuguau

SEQ ID NO: 1351820 - RNA, 19 nt, Homo sapiens
caacgggaaacaaccauug

SEQ ID NO: 1351821 - RNA, 19 nt, Homo sapiens
ccagagcugcugaacaauu

SEQ ID NO: 1351822 - RNA, 19 nt, Homo sapiens
ggacauguacgugggaaug

SEQ ID NO: 1351823 - RNA, 19 nt, Homo sapiens
gaaaccucgccucuacuaa

SEQ ID NO: 1351824 - RNA, 19 nt, Homo sapiens
gaagcuguaaagaauacua

SEQ ID NO: 1351825 - RNA, 19 nt, Homo sapiens
gcagaauauccauguuuau

SEQ ID NO: 1351826 - RNA, 19 nt, Homo sapiens
uagcagaauauccauguuu

SEQ ID NO: 1351827 - RNA, 19 nt, Homo sapiens
cuagagaagcuauucaguu

SEQ ID NO: 1351828 - RNA, 19 nt, Homo sapiens
agaguuaccuagaacaagu

SEQ ID NO: 1351829 - RNA, 19 nt, Homo sapiens
ugaaaccucgccucuacua

SEQ ID NO: 1351830 - RNA, 19 nt, Homo sapiens
guaggugcaugaggaguau

SEQ ID NO: 1351831 - RNA, 19 nt, Homo sapiens
ggacacagagucagcugau

SEQ ID NO: 1351832 - RNA, 19 nt, Homo sapiens
cgaugucauuucuguauuc

SEQ ID NO: 1351833 - RNA, 19 nt, Homo sapiens
gcaggaagucauuaugcaa

SEQ ID NO: 1351834 - RNA, 19 nt, Homo sapiens
acacagagucagcugauga

SEQ ID NO: 1351835 - RNA, 19 nt, Homo sapiens
uuuaugacauugagguuga

SEQ ID NO: 1351836 - RNA, 19 nt, Homo sapiens
caagaguuaccuagaacaa

SEQ ID NO: 1351837 - RNA, 19 nt, Homo sapiens
aaaauucgccagcgcauua

SEQ ID NO: 1351838 - RNA, 19 nt, Homo sapiens
ggcaggaagucauuaugca

SEQ ID NO: 1351839 - RNA, 19 nt, Homo sapiens
ggaagaccugaacaaacua

SEQ ID NO: 1351840 - RNA, 19 nt, Homo sapiens
gaccugaacaaacuagaug

SEQ ID NO: 1351841 - RNA, 19 nt, Homo sapiens
ugaggaagaccugaacaaa

SEQ ID NO: 1351842 - RNA, 19 nt, Homo sapiens
caaauucaacgggaaacaa

SEQ ID NO: 1351843 - RNA, 19 nt, Homo sapiens
gcaugaggaguaugggaaa

SEQ ID NO: 1351844 - RNA, 19 nt, Homo sapiens
aagaagcuguaaagaauac

SEQ ID NO: 1351845 - RNA, 19 nt, Homo sapiens
gaggaagaccugaacaaac

SEQ ID NO: 1351846 - RNA, 19 nt, Homo sapiens
gagcugcugaacaauuaaa

SEQ ID NO: 1351847 - RNA, 19 nt, Homo sapiens
gaaccugggaggcugaagu

SEQ ID NO: 1351848 - RNA, 19 nt, Homo sapiens
gcaggagauucgcuugaac

SEQ ID NO: 1351849 - RNA, 19 nt, Homo sapiens
gcuagcagaauauccaugu

SEQ ID NO: 1351850 - RNA, 19 nt, Homo sapiens
gaaaucaaggggaaaauuc

SEQ ID NO: 1351851 - RNA, 19 nt, Homo sapiens
cgagaucgcgccauuguac

SEQ ID NO: 1351852 - RNA, 19 nt, Homo sapiens
ccuguaaucccagcacuuu

SEQ ID NO: 1351853 - RNA, 19 nt, Homo sapiens
gaagaccugaacaaacuag

SEQ ID NO: 1351854 - RNA, 19 nt, Homo sapiens
ggaaacaaccauugauccu

SEQ ID NO: 1351855 - RNA, 19 nt, Homo sapiens
gaauaauccgcgacacaag

SEQ ID NO: 1351856 - RNA, 19 nt, Homo sapiens
cacaagaguuaccuagaac

SEQ ID NO: 1351857 - RNA, 19 nt, Homo sapiens
gacacaagaguuaccuaga

SEQ ID NO: 1351858 - RNA, 19 nt, Homo sapiens
gguuucagccuccagcuau

SEQ ID NO: 1351859 - RNA, 19 nt, Homo sapiens
agaaaugugggauuagguu

SEQ ID NO: 1351860 - RNA, 19 nt, Homo sapiens
acccacuccugguuguuua

SEQ ID NO: 1351861 - RNA, 19 nt, Homo sapiens
gaguuaccuagaacaagua

SEQ ID NO: 1351862 - RNA, 19 nt, Homo sapiens
uaaggcaggaagucauuau

SEQ ID NO: 1351863 - RNA, 19 nt, Homo sapiens
gauugaccauguuacuuuu

SEQ ID NO: 1351864 - RNA, 19 nt, Homo sapiens
agaauaauccgcgacacaa

SEQ ID NO: 1351865 - RNA, 19 nt, Homo sapiens
gcaccagagcugcugaaca

SEQ ID NO: 1351866 - RNA, 19 nt, Homo sapiens
cagagucagcugaugaguu

SEQ ID NO: 1351867 - RNA, 19 nt, Homo sapiens
ucauuucuguauuccucua

SEQ ID NO: 1351868 - RNA, 19 nt, Homo sapiens
ggaccuggaaucccuguac

SEQ ID NO: 1351869 - RNA, 19 nt, Homo sapiens
aauaauccgcgacacaaga

SEQ ID NO: 1351870 - RNA, 19 nt, Homo sapiens
cugcugaacaauuaaagaa

SEQ ID NO: 1351871 - RNA, 19 nt, Homo sapiens
ggacauuuaaagcaucuac

SEQ ID NO: 1351872 - RNA, 19 nt, Homo sapiens
ucuaugagagugaaaucaa

SEQ ID NO: 1351873 - RNA, 19 nt, Homo sapiens
gccgagaucgcgccauugu

SEQ ID NO: 1351874 - RNA, 19 nt, Homo sapiens
gguggcgggugccuguaau

SEQ ID NO: 1351875 - RNA, 19 nt, Homo sapiens
gagaccagccuagccaaca

SEQ ID NO: 1351876 - RNA, 19 nt, Homo sapiens
gacacagagucagcugaug

SEQ ID NO: 1351877 - RNA, 19 nt, Homo sapiens
acauugagguugaauuucc

SEQ ID NO: 1351878 - RNA, 19 nt, Homo sapiens
aaugugggauuagguuuca

SEQ ID NO: 1351879 - RNA, 19 nt, Homo sapiens
cuuaaucuaugagagugaa

SEQ ID NO: 1351880 - RNA, 19 nt, Homo sapiens
guuucagccuccagcuauu

SEQ ID NO: 1351881 - RNA, 19 nt, Homo sapiens
gggauugaccauguuacuu

SEQ ID NO: 1351882 - RNA, 19 nt, Homo sapiens
gcaacuuacacauauucau

SEQ ID NO: 1351883 - RNA, 19 nt, Homo sapiens
gaaauucacuggccaaauc

SEQ ID NO: 1351884 - RNA, 19 nt, Homo sapiens
ggacagcgguaaaucacuu

SEQ ID NO: 1351885 - RNA, 19 nt, Homo sapiens
agaagcagcucuccaguug

SEQ ID NO: 1351886 - RNA, 19 nt, Homo sapiens
ugacaaaggugcaguuucu

SEQ ID NO: 1351887 - RNA, 19 nt, Homo sapiens
ggaacauccucuccaaguu

SEQ ID NO: 1351888 - RNA, 19 nt, Homo sapiens
ggaagcgucuggaagaugu

SEQ ID NO: 1351889 - RNA, 19 nt, Homo sapiens
gauauacugugccaaguca

SEQ ID NO: 1351890 - RNA, 19 nt, Homo sapiens
guagugagcaagaaauaaa

SEQ ID NO: 1351891 - RNA, 19 nt, Homo sapiens
gagcaagaaauaaaccuuu

SEQ ID NO: 1351892 - RNA, 19 nt, Homo sapiens
gaacugacggcugagauga

SEQ ID NO: 1351893 - RNA, 19 nt, Homo sapiens
ggaaggagagauauacugu

SEQ ID NO: 1351894 - RNA, 19 nt, Homo sapiens
ggacuagccagaacauuuc

SEQ ID NO: 1351895 - RNA, 19 nt, Homo sapiens
aagcagcucuccaguugaa

SEQ ID NO: 1351896 - RNA, 19 nt, Homo sapiens
ggcugaacauuccaaauug

SEQ ID NO: 1351897 - RNA, 19 nt, Homo sapiens
gauauguagugagcaagaa

SEQ ID NO: 1351898 - RNA, 19 nt, Homo sapiens
gggcaccuguaacauguga

SEQ ID NO: 1351899 - RNA, 19 nt, Homo sapiens
cggcugaacauuccaaauu

SEQ ID NO: 1351900 - RNA, 19 nt, Homo sapiens
ggguccagguugccacaua

SEQ ID NO: 1351901 - RNA, 19 nt, Homo sapiens
gagaugagguuagaaugac

SEQ ID NO: 1351902 - RNA, 19 nt, Homo sapiens
cacaauggauauguaguga

SEQ ID NO: 1351903 - RNA, 19 nt, Homo sapiens
gaguggagcaugagcagaa

SEQ ID NO: 1351904 - RNA, 19 nt, Homo sapiens
gcugagaaaguuuaaggaa

SEQ ID NO: 1351905 - RNA, 19 nt, Homo sapiens
ugagaugagguuagaauga

SEQ ID NO: 1351906 - RNA, 19 nt, Homo sapiens
cggacuagccagaacauuu

SEQ ID NO: 1351907 - RNA, 19 nt, Homo sapiens
caucugcugagaaaguuua

SEQ ID NO: 1351908 - RNA, 19 nt, Homo sapiens
gaguguggaaggagagaua

SEQ ID NO: 1351909 - RNA, 19 nt, Homo sapiens
cggcugagaugagguuaga

SEQ ID NO: 1351910 - RNA, 19 nt, Homo sapiens
gcaagaaauaaaccuuugu

SEQ ID NO: 1351911 - RNA, 19 nt, Homo sapiens
gagauauacugugccaagu

SEQ ID NO: 1351912 - RNA, 19 nt, Homo sapiens
ggauauguagugagcaaga

SEQ ID NO: 1351913 - RNA, 19 nt, Homo sapiens
caccaacccacaauggaua

SEQ ID NO: 1351914 - RNA, 19 nt, Homo sapiens
ccuaagcgaugagcagaau

SEQ ID NO: 1351915 - RNA, 19 nt, Homo sapiens
gcucaguccugggagauag

SEQ ID NO: 1351916 - RNA, 19 nt, Homo sapiens
ccacaauggauauguagug

SEQ ID NO: 1351917 - RNA, 19 nt, Homo sapiens
cgggagaaguucaucaucu

SEQ ID NO: 1351918 - RNA, 19 nt, Homo sapiens
gguccagguugccacauag

SEQ ID NO: 1351919 - RNA, 19 nt, Homo sapiens
gcugagaugagguuagaau

SEQ ID NO: 1351920 - RNA, 19 nt, Homo sapiens
gggcugacuuuagugacaa

SEQ ID NO: 1351921 - RNA, 19 nt, Homo sapiens
gcaccuguaacaugugaug

SEQ ID NO: 1351922 - RNA, 19 nt, Homo sapiens
ggaaauucacuggccaaau

SEQ ID NO: 1351923 - RNA, 19 nt, Homo sapiens
agcaagaaauaaaccuuug

SEQ ID NO: 1351924 - RNA, 19 nt, Homo sapiens
gaagcagcucuccaguuga

SEQ ID NO: 1351925 - RNA, 19 nt, Homo sapiens
aacccacaauggauaugua

SEQ ID NO: 1351926 - RNA, 19 nt, Homo sapiens
gcucaggacagcgguaaau

SEQ ID NO: 1351927 - RNA, 19 nt, Homo sapiens
cugagaagcccuaccugaa

SEQ ID NO: 1351928 - RNA, 19 nt, Homo sapiens
uagaagcagcucuccaguu

SEQ ID NO: 1351929 - RNA, 19 nt, Homo sapiens
gcugccugcugggagguua

SEQ ID NO: 1351930 - RNA, 19 nt, Homo sapiens
caagucaggcaggaaauuc

SEQ ID NO: 1351931 - RNA, 19 nt, Homo sapiens
ugagaagcccuaccugaag

SEQ ID NO: 1351932 - RNA, 19 nt, Homo sapiens
ucaggacagcgguaaauca

SEQ ID NO: 1351933 - RNA, 19 nt, Homo sapiens
ccaagucaggcaggaaauu

SEQ ID NO: 1351934 - RNA, 19 nt, Homo sapiens
agcgguaaaucacuucuug

SEQ ID NO: 1351935 - RNA, 19 nt, Homo sapiens
cagcgccacuguguacuuc

SEQ ID NO: 1351936 - RNA, 19 nt, Homo sapiens
gacuccagcucccuacagu

SEQ ID NO: 1351937 - RNA, 19 nt, Homo sapiens
uccgugguguguuccauuu

SEQ ID NO: 1351938 - RNA, 19 nt, Homo sapiens
gccaaauccgggagaaguu

SEQ ID NO: 1351939 - RNA, 19 nt, Homo sapiens
ccaccaacccacaauggau

SEQ ID NO: 1351940 - RNA, 19 nt, Homo sapiens
ccagggcugacuuuaguga

SEQ ID NO: 1351941 - RNA, 19 nt, Homo sapiens
ggaguuccgccaccucuac

SEQ ID NO: 1351942 - RNA, 19 nt, Homo sapiens
cggaacauccucuccaagu

SEQ ID NO: 1351943 - RNA, 19 nt, Homo sapiens
cugggcaccuguaacaugu

SEQ ID NO: 1351944 - RNA, 19 nt, Homo sapiens
cgaacugacggcugagaug

SEQ ID NO: 1351945 - RNA, 19 nt, Homo sapiens
ggacacgugcaccggaaca

SEQ ID NO: 1351946 - RNA, 19 nt, Homo sapiens
aaggcgagguggacuucuu

SEQ ID NO: 1351947 - RNA, 19 nt, Homo sapiens
ggccaaauccgggagaagu

SEQ ID NO: 1351948 - RNA, 19 nt, Homo sapiens
caaggcaccugggcaaaau

SEQ ID NO: 1351949 - RNA, 19 nt, Homo sapiens
uccauuugcuucccacauc

SEQ ID NO: 1351950 - RNA, 19 nt, Homo sapiens
caccaucugcugagaaagu

SEQ ID NO: 1351951 - RNA, 19 nt, Homo sapiens
uucaccaucugcugagaaa

SEQ ID NO: 1351952 - RNA, 19 nt, Homo sapiens
caagcacaacaacaucaga

SEQ ID NO: 1351953 - RNA, 19 nt, Homo sapiens
ccaaauccgggagaaguuc

SEQ ID NO: 1351954 - RNA, 19 nt, Homo sapiens
caaaugauguugccacuuu

SEQ ID NO: 1351955 - RNA, 19 nt, Homo sapiens
caaaugaccuucaggagaa

SEQ ID NO: 1351956 - RNA, 19 nt, Homo sapiens
gaacugacauugacuugga

SEQ ID NO: 1351957 - RNA, 19 nt, Homo sapiens
gcaaagaagaaacaacuua

SEQ ID NO: 1351958 - RNA, 19 nt, Homo sapiens
gaagaacccuacuccagaa

SEQ ID NO: 1351959 - RNA, 19 nt, Homo sapiens
gaagggaaccagcaaagaa

SEQ ID NO: 1351960 - RNA, 19 nt, Homo sapiens
gcaguuugaugauaaagga

SEQ ID NO: 1351961 - RNA, 19 nt, Homo sapiens
ccacuuugcugaagauguu

SEQ ID NO: 1351962 - RNA, 19 nt, Homo sapiens
uaagggaugcucucaauaa

SEQ ID NO: 1351963 - RNA, 19 nt, Homo sapiens
caaagaaacaagacaagaa

SEQ ID NO: 1351964 - RNA, 19 nt, Homo sapiens
uauuugaccugcaguauug

SEQ ID NO: 1351965 - RNA, 19 nt, Homo sapiens
gacaaggaccggcaaauug

SEQ ID NO: 1351966 - RNA, 19 nt, Homo sapiens
gggaugcucucaauaaugg

SEQ ID NO: 1351967 - RNA, 19 nt, Homo sapiens
gaacucaggcaucaaagga

SEQ ID NO: 1351968 - RNA, 19 nt, Homo sapiens
cuagauaucuuucccucuu

SEQ ID NO: 1351969 - RNA, 19 nt, Homo sapiens
ggaagguccugggaaauca

SEQ ID NO: 1351970 - RNA, 19 nt, Homo sapiens
gaggagacccagcaccaua

SEQ ID NO: 1351971 - RNA, 19 nt, Homo sapiens
gcgaguagaggguuuguuu

SEQ ID NO: 1351972 - RNA, 19 nt, Homo sapiens
gauccagaguugucuccua

SEQ ID NO: 1351973 - RNA, 19 nt, Homo sapiens
ccucauagcuucaugucau

SEQ ID NO: 1351974 - RNA, 19 nt, Homo sapiens
gauuaaacacucccagaaa

SEQ ID NO: 1351975 - RNA, 19 nt, Homo sapiens
uaaccuugcccuuauguuu

SEQ ID NO: 1351976 - RNA, 19 nt, Homo sapiens
ggagaauaucacaaaguua

SEQ ID NO: 1351977 - RNA, 19 nt, Homo sapiens
gaugauaaaggaaacaaga

SEQ ID NO: 1351978 - RNA, 19 nt, Homo sapiens
ugaugcaguuugaugauaa

SEQ ID NO: 1351979 - RNA, 19 nt, Homo sapiens
ugaaaugugugcucaacug

SEQ ID NO: 1351980 - RNA, 19 nt, Homo sapiens
gcaaagaaacaagacaaga

SEQ ID NO: 1351981 - RNA, 19 nt, Homo sapiens
ggaaacaagaccaauauac

SEQ ID NO: 1351982 - RNA, 19 nt, Homo sapiens
guagaggguuuguuuagag

SEQ ID NO: 1351983 - RNA, 19 nt, Homo sapiens
gaacccuacuccagaaucu

SEQ ID NO: 1351984 - RNA, 19 nt, Homo sapiens
aaaggaaacaagaccaaua

SEQ ID NO: 1351985 - RNA, 19 nt, Homo sapiens
ggaaaccacuaacuaucca

SEQ ID NO: 1351986 - RNA, 19 nt, Homo sapiens
gaacaagaugucagccuau

SEQ ID NO: 1351987 - RNA, 19 nt, Homo sapiens
aggagaauaucacaaaguu

SEQ ID NO: 1351988 - RNA, 19 nt, Homo sapiens
gaugucagccuauaaccuu

SEQ ID NO: 1351989 - RNA, 19 nt, Homo sapiens
gaugcaguuugaugauaaa

SEQ ID NO: 1351990 - RNA, 19 nt, Homo sapiens
aaggagaguuucuuuguca

SEQ ID NO: 1351991 - RNA, 19 nt, Homo sapiens
gggaaaacucuuuaucuua

SEQ ID NO: 1351992 - RNA, 19 nt, Homo sapiens
ccagaacucaggcaucaaa

SEQ ID NO: 1351993 - RNA, 19 nt, Homo sapiens
ucucuucgauuuaccaaug

SEQ ID NO: 1351994 - RNA, 19 nt, Homo sapiens
gcugacacauaaacacuuc

SEQ ID NO: 1351995 - RNA, 19 nt, Homo sapiens
gagccucugcugacacaua

SEQ ID NO: 1351996 - RNA, 19 nt, Homo sapiens
aaacggaaccggguagauu

SEQ ID NO: 1351997 - RNA, 19 nt, Homo sapiens
caucagaaacuugcgagua

SEQ ID NO: 1351998 - RNA, 19 nt, Homo sapiens
cuuccugucucuucgauuu

SEQ ID NO: 1351999 - RNA, 19 nt, Homo sapiens
gaugacaccaacaagauug

SEQ ID NO: 1352000 - RNA, 19 nt, Homo sapiens
accaaugccucaucagaaa

SEQ ID NO: 1352001 - RNA, 19 nt, Homo sapiens
ucaacacguucaugauaug

SEQ ID NO: 1352002 - RNA, 19 nt, Homo sapiens
gggauggcuuuuaugauua

SEQ ID NO: 1352003 - RNA, 19 nt, Homo sapiens
acaaggaccggcaaauuga

SEQ ID NO: 1352004 - RNA, 19 nt, Homo sapiens
ggugugacaucagaguauu

SEQ ID NO: 1352005 - RNA, 19 nt, Homo sapiens
ggucugaagggaagaaaga

SEQ ID NO: 1352006 - RNA, 19 nt, Homo sapiens
gcacugagagagcuguuuc

SEQ ID NO: 1352007 - RNA, 19 nt, Homo sapiens
aacaagaugucagccuaua

SEQ ID NO: 1352008 - RNA, 19 nt, Homo sapiens
guuauugcuugaucuccua

SEQ ID NO: 1352009 - RNA, 19 nt, Homo sapiens
cucaauaccuaauuugugu

SEQ ID NO: 1352010 - RNA, 19 nt, Homo sapiens
gaguagaggguuuguuuag

SEQ ID NO: 1352011 - RNA, 19 nt, Homo sapiens
uaacuauccaaccagcuua

SEQ ID NO: 1352012 - RNA, 19 nt, Homo sapiens
ugucaaagccaacuaauac

SEQ ID NO: 1352013 - RNA, 19 nt, Homo sapiens
aaacaagacaagaacaaga

SEQ ID NO: 1352014 - RNA, 19 nt, Homo sapiens
aauugaggcucuccaguug

SEQ ID NO: 1352015 - RNA, 19 nt, Homo sapiens
gaaacaagaccaauauacc

SEQ ID NO: 1352016 - RNA, 19 nt, Homo sapiens
ccaguggauugauguuguu

SEQ ID NO: 1352017 - RNA, 19 nt, Homo sapiens
cgaguagaggguuuguuua

SEQ ID NO: 1352018 - RNA, 19 nt, Homo sapiens
gaaacaagacaagaacaag

SEQ ID NO: 1352019 - RNA, 19 nt, Homo sapiens
acacauaaacacuucaaug

SEQ ID NO: 1352020 - RNA, 19 nt, Homo sapiens
uagauaucuuucccucuuu

SEQ ID NO: 1352021 - RNA, 19 nt, Homo sapiens
guauuugaccugcaguauu

SEQ ID NO: 1352022 - RNA, 19 nt, Homo sapiens
uuuaagggaugcucucaau

SEQ ID NO: 1352023 - RNA, 19 nt, Homo sapiens
gccuauaaccuugcccuua

SEQ ID NO: 1352024 - RNA, 19 nt, Homo sapiens
caguugcucuuccucauuc

SEQ ID NO: 1352025 - RNA, 19 nt, Homo sapiens
agacaaggaccggcaaauu

SEQ ID NO: 1352026 - RNA, 19 nt, Homo sapiens
ccagaguugucuccuaugg

SEQ ID NO: 1352027 - RNA, 19 nt, Homo sapiens
ggccauuggugaauugaag

SEQ ID NO: 1352028 - RNA, 19 nt, Homo sapiens
uuucaacacguucaugaua

SEQ ID NO: 1352029 - RNA, 19 nt, Homo sapiens
aaacacucccagaaacuuu

SEQ ID NO: 1352030 - RNA, 19 nt, Homo sapiens
cugauuugaugcaguuuga

SEQ ID NO: 1352031 - RNA, 19 nt, Homo sapiens
gaccuugaccucauagcuu

SEQ ID NO: 1352032 - RNA, 19 nt, Homo sapiens
ggauggcuuuuaugauuaa

SEQ ID NO: 1352033 - RNA, 19 nt, Homo sapiens
aaauugaggcucuccaguu

SEQ ID NO: 1352034 - RNA, 19 nt, Homo sapiens
uaccgugacccgacugaua

SEQ ID NO: 1352035 - RNA, 19 nt, Homo sapiens
cagcaaagaaacaagacaa

SEQ ID NO: 1352036 - RNA, 19 nt, Homo sapiens
aaacaagaccaauauacca

SEQ ID NO: 1352037 - RNA, 19 nt, Homo sapiens
ucgcugauuugaugcaguu

SEQ ID NO: 1352038 - RNA, 19 nt, Homo sapiens
cagcuuauacagcacacua

SEQ ID NO: 1352039 - RNA, 19 nt, Homo sapiens
ugcaagcugugccuucuga

SEQ ID NO: 1352040 - RNA, 19 nt, Homo sapiens
aagggaugcucucaauaau

SEQ ID NO: 1352041 - RNA, 19 nt, Homo sapiens
gaggguuuguuuagaguac

SEQ ID NO: 1352042 - RNA, 19 nt, Homo sapiens
ugggauggcuuuuaugauu

SEQ ID NO: 1352043 - RNA, 19 nt, Homo sapiens
aaucguaauuugcugaagu

SEQ ID NO: 1352044 - RNA, 19 nt, Homo sapiens
ucagaaacuugcgaguaga

SEQ ID NO: 1352045 - RNA, 19 nt, Homo sapiens
agaccaauauaccagacaa

SEQ ID NO: 1352046 - RNA, 19 nt, Homo sapiens
aaggaaacaagaccaauau

SEQ ID NO: 1352047 - RNA, 19 nt, Homo sapiens
cagcaaagaagaaacaacu

SEQ ID NO: 1352048 - RNA, 19 nt, Homo sapiens
ugacauugacuuggaauca

SEQ ID NO: 1352049 - RNA, 19 nt, Homo sapiens
caagaugucagccuauaac

SEQ ID NO: 1352050 - RNA, 19 nt, Homo sapiens
agaaacaagacaagaacaa

SEQ ID NO: 1352051 - RNA, 19 nt, Homo sapiens
uugaugcaguuugaugaua

SEQ ID NO: 1352052 - RNA, 19 nt, Homo sapiens
uauuauuucuuggguguga

SEQ ID NO: 1352053 - RNA, 19 nt, Homo sapiens
cggaagaggcacugagaga

SEQ ID NO: 1352054 - RNA, 19 nt, Homo sapiens
gaacagaagaccucaggaa

SEQ ID NO: 1352055 - RNA, 19 nt, Homo sapiens
cagaagaccucaggaauca

SEQ ID NO: 1352056 - RNA, 19 nt, Homo sapiens
gaagaaagugcccaugguu

SEQ ID NO: 1352057 - RNA, 19 nt, Homo sapiens
ggaagaaagugcccauggu

SEQ ID NO: 1352058 - RNA, 19 nt, Homo sapiens
ccucaggaaucauguagaa

SEQ ID NO: 1352059 - RNA, 19 nt, Homo sapiens
gaagaccucaggaaucaug

SEQ ID NO: 1352060 - RNA, 19 nt, Homo sapiens
gcaaugugagggugaggua

SEQ ID NO: 1352061 - RNA, 19 nt, Homo sapiens
gacaguuuauggaggcuuu

SEQ ID NO: 1352062 - RNA, 19 nt, Homo sapiens
guacaccuacagacauuaa

SEQ ID NO: 1352063 - RNA, 19 nt, Homo sapiens
gcccaugguuucucugguu

SEQ ID NO: 1352064 - RNA, 19 nt, Homo sapiens
uauaagaccuucucuaccu

SEQ ID NO: 1352065 - RNA, 19 nt, Homo sapiens
gcuauaagaccuucucuac

SEQ ID NO: 1352066 - RNA, 19 nt, Homo sapiens
guugcuuucugcaccaaua

SEQ ID NO: 1352067 - RNA, 19 nt, Homo sapiens
ccaugaugcuucucacugu

SEQ ID NO: 1352068 - RNA, 19 nt, Homo sapiens
gacuucaccugccaccauu

SEQ ID NO: 1352069 - RNA, 19 nt, Homo sapiens
caccuacagacauuaaaua

SEQ ID NO: 1352070 - RNA, 19 nt, Homo sapiens
caaacccuguuggaagaaa

SEQ ID NO: 1352071 - RNA, 19 nt, Homo sapiens
uucaaacccuguuggaaga

SEQ ID NO: 1352072 - RNA, 19 nt, Homo sapiens
aagaaagugcccaugguuu

SEQ ID NO: 1352073 - RNA, 19 nt, Homo sapiens
guccgagucuaccacuauu

SEQ ID NO: 1352074 - RNA, 19 nt, Homo sapiens
gcugggaaguugcguagac

SEQ ID NO: 1352075 - RNA, 19 nt, Homo sapiens
cggcugugcugggaaguug

SEQ ID NO: 1352076 - RNA, 19 nt, Homo sapiens
caggaaucauguagaacug

SEQ ID NO: 1352077 - RNA, 19 nt, Homo sapiens
ucugccaguuugacaguuu

SEQ ID NO: 1352078 - RNA, 19 nt, Homo sapiens
gaaucguaauagcaaugug

SEQ ID NO: 1352079 - RNA, 19 nt, Homo sapiens
cugccaguuugacaguuua

SEQ ID NO: 1352080 - RNA, 19 nt, Homo sapiens
acagaagaccucaggaauc

SEQ ID NO: 1352081 - RNA, 19 nt, Homo sapiens
ugaugcuucucacugugua

SEQ ID NO: 1352082 - RNA, 19 nt, Homo sapiens
gcugacauuggcuauaaga

SEQ ID NO: 1352083 - RNA, 19 nt, Homo sapiens
aaucguaauagcaauguga

SEQ ID NO: 1352084 - RNA, 19 nt, Homo sapiens
ucaggaaucauguagaacu

SEQ ID NO: 1352085 - RNA, 19 nt, Homo sapiens
gaaaugaccuggaagaagu

SEQ ID NO: 1352086 - RNA, 19 nt, Homo sapiens
cuuguuaucuggguaauua

SEQ ID NO: 1352087 - RNA, 19 nt, Homo sapiens
gggccgaccugaacgcaaa

SEQ ID NO: 1352088 - RNA, 19 nt, Homo sapiens
ggaagaaguccgccaguuc

SEQ ID NO: 1352089 - RNA, 19 nt, Homo sapiens
gccaagggcuccugaagca

SEQ ID NO: 1352090 - RNA, 19 nt, Homo sapiens
ccuaugaccugugugauga

SEQ ID NO: 1352091 - RNA, 19 nt, Homo sapiens
gaacgcaaagucccugaug

SEQ ID NO: 1352092 - RNA, 19 nt, Homo sapiens
caccagugcugcauugaug

SEQ ID NO: 1352093 - RNA, 19 nt, Homo sapiens
gagccagccugagcgcuaa

SEQ ID NO: 1352094 - RNA, 19 nt, Homo sapiens
cugcaacucuugauaaagg

SEQ ID NO: 1352095 - RNA, 19 nt, Homo sapiens
acgggaacaugcccuauga

SEQ ID NO: 1352096 - RNA, 19 nt, Homo sapiens
gcugaagcaugcccagaag

SEQ ID NO: 1352097 - RNA, 19 nt, Homo sapiens
ccucuucccucccaguguu

SEQ ID NO: 1352098 - RNA, 19 nt, Homo sapiens
gugcugcauugaugauuuc

SEQ ID NO: 1352099 - RNA, 19 nt, Homo sapiens
agggaugucuggcugcaaa

SEQ ID NO: 1352100 - RNA, 19 nt, Homo sapiens
caacaccgacgggaacaug

SEQ ID NO: 1352101 - RNA, 19 nt, Homo sapiens
uggaagaaguccgccaguu

SEQ ID NO: 1352102 - RNA, 19 nt, Homo sapiens
cgaaaugaccuggaagaag

SEQ ID NO: 1352103 - RNA, 19 nt, Homo sapiens
gcacacaggagcggcugaa

SEQ ID NO: 1352104 - RNA, 19 nt, Homo sapiens
gagggugccaguccagcua

SEQ ID NO: 1352105 - RNA, 19 nt, Homo sapiens
gcccugacuuggccaacga

SEQ ID NO: 1352106 - RNA, 19 nt, Homo sapiens
caacgaugaccgccagaca

SEQ ID NO: 1352107 - RNA, 19 nt, Homo sapiens
cacccuggcugaccugaag

SEQ ID NO: 1352108 - RNA, 19 nt, Homo sapiens
gccgcacaauggccgagua

SEQ ID NO: 1352109 - RNA, 19 nt, Homo sapiens
uccugcaacucuugauaaa

SEQ ID NO: 1352110 - RNA, 19 nt, Homo sapiens
gccugggccugguuauugu

SEQ ID NO: 1352111 - RNA, 19 nt, Homo sapiens
ccaaucuccuggcggucaa

SEQ ID NO: 1352112 - RNA, 19 nt, Homo sapiens
agugcugcauugaugauuu

SEQ ID NO: 1352113 - RNA, 19 nt, Homo sapiens
cccagcaggugaagaugug

SEQ ID NO: 1352114 - RNA, 19 nt, Homo sapiens
gacgggaacaugcccuaug

SEQ ID NO: 1352115 - RNA, 19 nt, Homo sapiens
ucucaggucagaagacaug

SEQ ID NO: 1352116 - RNA, 19 nt, Homo sapiens
cacaggagcggcugaagca

SEQ ID NO: 1352117 - RNA, 19 nt, Homo sapiens
ccucucaggucagaagaca

SEQ ID NO: 1352118 - RNA, 19 nt, Homo sapiens
ggcugaagcaugcccagaa

SEQ ID NO: 1352119 - RNA, 19 nt, Homo sapiens
ccugagcgcuaaggaccaa

SEQ ID NO: 1352120 - RNA, 19 nt, Homo sapiens
gcgcccagcaggugaagau

SEQ ID NO: 1352121 - RNA, 19 nt, Homo sapiens
ugaccugugugaugaugag

SEQ ID NO: 1352122 - RNA, 19 nt, Homo sapiens
ggacaacacuucuacugaa

SEQ ID NO: 1352123 - RNA, 19 nt, Homo sapiens
gaaaguaggcgacagcuau

SEQ ID NO: 1352124 - RNA, 19 nt, Homo sapiens
gagggaagccugcaaggua

SEQ ID NO: 1352125 - RNA, 19 nt, Homo sapiens
gaugaaaccucacucuuac

SEQ ID NO: 1352126 - RNA, 19 nt, Homo sapiens
cgaugaaaccucacucuua

SEQ ID NO: 1352127 - RNA, 19 nt, Homo sapiens
gacaacacuucuacugaaa

SEQ ID NO: 1352128 - RNA, 19 nt, Homo sapiens
aaagugaaguguagugguu

SEQ ID NO: 1352129 - RNA, 19 nt, Homo sapiens
guuccacucugaucacaaa

SEQ ID NO: 1352130 - RNA, 19 nt, Homo sapiens
gaguuagccugaauuagca

SEQ ID NO: 1352131 - RNA, 19 nt, Homo sapiens
gagcaggacaacacuucua

SEQ ID NO: 1352132 - RNA, 19 nt, Homo sapiens
uguuuaagcuauucacaga

SEQ ID NO: 1352133 - RNA, 19 nt, Homo sapiens
ccacucugaucacaaaaua

SEQ ID NO: 1352134 - RNA, 19 nt, Homo sapiens
ggaaaguaggcgacagcua

SEQ ID NO: 1352135 - RNA, 19 nt, Homo sapiens
ccgcgucucuaccgccaua

SEQ ID NO: 1352136 - RNA, 19 nt, Homo sapiens
ggcaagggaugcgggcaaa

SEQ ID NO: 1352137 - RNA, 19 nt, Homo sapiens
gaaccaccgcagacggaaa

SEQ ID NO: 1352138 - RNA, 19 nt, Homo sapiens
aaacuaagccccaaaguca

SEQ ID NO: 1352139 - RNA, 19 nt, Homo sapiens
aauuagcagucccgcagua

SEQ ID NO: 1352140 - RNA, 19 nt, Homo sapiens
ggcgacagcuauucaaagc

SEQ ID NO: 1352141 - RNA, 19 nt, Homo sapiens
cagcagcggacccgaaaga

SEQ ID NO: 1352142 - RNA, 19 nt, Homo sapiens
caaagucacagcagaacca

SEQ ID NO: 1352143 - RNA, 19 nt, Homo sapiens
ccugaguuagccugaauua

SEQ ID NO: 1352144 - RNA, 19 nt, Homo sapiens
ugaguuagccugaauuagc

SEQ ID NO: 1352145 - RNA, 19 nt, Homo sapiens
ugugauccuuucauucuuc

SEQ ID NO: 1352146 - RNA, 19 nt, Homo sapiens
aaaguaggcgacagcuauu

SEQ ID NO: 1352147 - RNA, 19 nt, Homo sapiens
ccuuuggacucccagauuc

SEQ ID NO: 1352148 - RNA, 19 nt, Homo sapiens
ucauuuguggugauacuaa

SEQ ID NO: 1352149 - RNA, 19 nt, Homo sapiens
cuucucauuuguggugaua

SEQ ID NO: 1352150 - RNA, 19 nt, Homo sapiens
gauccuuucauucuucuca

SEQ ID NO: 1352151 - RNA, 19 nt, Homo sapiens
aaccaaccguucaugacuu

SEQ ID NO: 1352152 - RNA, 19 nt, Homo sapiens
cugcagcgccacacaagaa

SEQ ID NO: 1352153 - RNA, 19 nt, Homo sapiens
cagcagagcaggacaacac

SEQ ID NO: 1352154 - RNA, 19 nt, Homo sapiens
cagagcaggacaacacuuc

SEQ ID NO: 1352155 - RNA, 19 nt, Homo sapiens
gcagagcaggacaacacuu

SEQ ID NO: 1352156 - RNA, 19 nt, Homo sapiens
guggugauacuaauuacau

SEQ ID NO: 1352157 - RNA, 19 nt, Homo sapiens
cauuuguggugauacuaau

SEQ ID NO: 1352158 - RNA, 19 nt, Homo sapiens
gggaaagugaaguguagug

SEQ ID NO: 1352159 - RNA, 19 nt, Homo sapiens
ggucuaccuuuguauucgu

SEQ ID NO: 1352160 - RNA, 19 nt, Homo sapiens
ggugauacuaauuacaugu

SEQ ID NO: 1352161 - RNA, 19 nt, Homo sapiens
gaaccgaugaaaccucacu

SEQ ID NO: 1352162 - RNA, 19 nt, Homo sapiens
caggacaacacuucuacug

SEQ ID NO: 1352163 - RNA, 19 nt, Homo sapiens
uagcagucccgcaguaaca

SEQ ID NO: 1352164 - RNA, 19 nt, Homo sapiens
caaccguucaugacuucaa

SEQ ID NO: 1352165 - RNA, 19 nt, Homo sapiens
cacagcagcggacccgaaa

SEQ ID NO: 1352166 - RNA, 19 nt, Homo sapiens
cgccugaguuagccugaau

SEQ ID NO: 1352167 - RNA, 19 nt, Homo sapiens
agaauuaucuggcacauua

SEQ ID NO: 1352168 - RNA, 19 nt, Homo sapiens
ggagaaagcucgaggugaa

SEQ ID NO: 1352169 - RNA, 19 nt, Homo sapiens
ccaaagaggugguuucuga

SEQ ID NO: 1352170 - RNA, 19 nt, Homo sapiens
ggaaaaggaucccugauua

SEQ ID NO: 1352171 - RNA, 19 nt, Homo sapiens
gcaaagcuguauuaucaga

SEQ ID NO: 1352172 - RNA, 19 nt, Homo sapiens
ugaaugagguuguuuggaa

SEQ ID NO: 1352173 - RNA, 19 nt, Homo sapiens
uugcaaagcuguauuauca

SEQ ID NO: 1352174 - RNA, 19 nt, Homo sapiens
gcacauggccucccugaug

SEQ ID NO: 1352175 - RNA, 19 nt, Homo sapiens
gaaugagguuguuuggaaa

SEQ ID NO: 1352176 - RNA, 19 nt, Homo sapiens
ggaucaacuuucacacaua

SEQ ID NO: 1352177 - RNA, 19 nt, Homo sapiens
gaaguauuguaccagagua

SEQ ID NO: 1352178 - RNA, 19 nt, Homo sapiens
ccacguauauuauguaguc

SEQ ID NO: 1352179 - RNA, 19 nt, Homo sapiens
ugauuaagcugaugacuag

SEQ ID NO: 1352180 - RNA, 19 nt, Homo sapiens
ugacuagaccuacaauuaa

SEQ ID NO: 1352181 - RNA, 19 nt, Homo sapiens
gaucaacuuucacacauag

SEQ ID NO: 1352182 - RNA, 19 nt, Homo sapiens
guggaaagguuugcaauug

SEQ ID NO: 1352183 - RNA, 19 nt, Homo sapiens
ggucaucucucccacugaa

SEQ ID NO: 1352184 - RNA, 19 nt, Homo sapiens
ggaaagguuugcaauuguc

SEQ ID NO: 1352185 - RNA, 19 nt, Homo sapiens
caagagauucacuuaauug

SEQ ID NO: 1352186 - RNA, 19 nt, Homo sapiens
ggaaaauggucaagauuau

SEQ ID NO: 1352187 - RNA, 19 nt, Homo sapiens
uaaacuguaugggaacuaa

SEQ ID NO: 1352188 - RNA, 19 nt, Homo sapiens
gacuagaccuacaauuaau

SEQ ID NO: 1352189 - RNA, 19 nt, Homo sapiens
gaauggaaauaccugaucu

SEQ ID NO: 1352190 - RNA, 19 nt, Homo sapiens
gaguuuacuuuacaugaga

SEQ ID NO: 1352191 - RNA, 19 nt, Homo sapiens
ugcaguauaugaaguauug

SEQ ID NO: 1352192 - RNA, 19 nt, Homo sapiens
gaucuguauuugcccuuaa

SEQ ID NO: 1352193 - RNA, 19 nt, Homo sapiens
gaacuaauaacaucuugag

SEQ ID NO: 1352194 - RNA, 19 nt, Homo sapiens
uuucaaauguggcuaaaug

SEQ ID NO: 1352195 - RNA, 19 nt, Homo sapiens
guauuguaccagaguauua

SEQ ID NO: 1352196 - RNA, 19 nt, Homo sapiens
aagggaaacuuagacuaua

SEQ ID NO: 1352197 - RNA, 19 nt, Homo sapiens
cacauuagguauuggaguu

SEQ ID NO: 1352198 - RNA, 19 nt, Homo sapiens
ggaucuguauuugcccuua

SEQ ID NO: 1352199 - RNA, 19 nt, Homo sapiens
gggaucaacuuucacacau

SEQ ID NO: 1352200 - RNA, 19 nt, Homo sapiens
gaaaaggaucccugauuaa

SEQ ID NO: 1352201 - RNA, 19 nt, Homo sapiens
cauuagguauuggaguuua

SEQ ID NO: 1352202 - RNA, 19 nt, Homo sapiens
ucagcaaacuaucauguuc

SEQ ID NO: 1352203 - RNA, 19 nt, Homo sapiens
gaccuaauugugauucuuu

SEQ ID NO: 1352204 - RNA, 19 nt, Homo sapiens
gcaguucacacaaggcaaa

SEQ ID NO: 1352205 - RNA, 19 nt, Homo sapiens
ggacuuucuuggugugugu

SEQ ID NO: 1352206 - RNA, 19 nt, Homo sapiens
gaucuuggcuaguuuuguu

SEQ ID NO: 1352207 - RNA, 19 nt, Homo sapiens
aaaccaaggucuuuucaaa

SEQ ID NO: 1352208 - RNA, 19 nt, Homo sapiens
cagagaggcugggaugaug

SEQ ID NO: 1352209 - RNA, 19 nt, Homo sapiens
uaccugaucuuggcuaguu

SEQ ID NO: 1352210 - RNA, 19 nt, Homo sapiens
ggaauacguuuuaggaugu

SEQ ID NO: 1352211 - RNA, 19 nt, Homo sapiens
caggaugccuuuguuagga

SEQ ID NO: 1352212 - RNA, 19 nt, Homo sapiens
ggccagaguuaucauaguc

SEQ ID NO: 1352213 - RNA, 19 nt, Homo sapiens
augacuagaccuacaauua

SEQ ID NO: 1352214 - RNA, 19 nt, Homo sapiens
cagacgaguuuacuuuaca

SEQ ID NO: 1352215 - RNA, 19 nt, Homo sapiens
uggaaagguuugcaauugu

SEQ ID NO: 1352216 - RNA, 19 nt, Homo sapiens
cuuaucaugugcuugguaa

SEQ ID NO: 1352217 - RNA, 19 nt, Homo sapiens
gcagagaggcugggaugau

SEQ ID NO: 1352218 - RNA, 19 nt, Homo sapiens
ucucagacgaguuuacuuu

SEQ ID NO: 1352219 - RNA, 19 nt, Homo sapiens
gcugaugacuagaccuaca

SEQ ID NO: 1352220 - RNA, 19 nt, Homo sapiens
cuagguugcugguggguau

SEQ ID NO: 1352221 - RNA, 19 nt, Homo sapiens
ggccagagcagucaguaau

SEQ ID NO: 1352222 - RNA, 19 nt, Homo sapiens
gguguuagcgcaacugcuu

SEQ ID NO: 1352223 - RNA, 19 nt, Homo sapiens
cauuuaguguuucaagaga

SEQ ID NO: 1352224 - RNA, 19 nt, Homo sapiens
gcaaacuaucauguucuua

SEQ ID NO: 1352225 - RNA, 19 nt, Homo sapiens
uugcaauugucaaguguuu

SEQ ID NO: 1352226 - RNA, 19 nt, Homo sapiens
gguuugcaauugucaagug

SEQ ID NO: 1352227 - RNA, 19 nt, Homo sapiens
ggaaagucggugugacaga

SEQ ID NO: 1352228 - RNA, 19 nt, Homo sapiens
caaggccagaguuaucaua

SEQ ID NO: 1352229 - RNA, 19 nt, Homo sapiens
ccaaauuucacagucuuaa

SEQ ID NO: 1352230 - RNA, 19 nt, Homo sapiens
cauagucccuagguugcua

SEQ ID NO: 1352231 - RNA, 19 nt, Homo sapiens
agccucaaaucauguaauu

SEQ ID NO: 1352232 - RNA, 19 nt, Homo sapiens
gaaagguuugcaauuguca

SEQ ID NO: 1352233 - RNA, 19 nt, Homo sapiens
ccagagcagucaguaaugg

SEQ ID NO: 1352234 - RNA, 19 nt, Homo sapiens
agaggugguuucugaggaa

SEQ ID NO: 1352235 - RNA, 19 nt, Homo sapiens
cgaguuuacuuuacaugag

SEQ ID NO: 1352236 - RNA, 19 nt, Homo sapiens
cauccuaagccucaaauca

SEQ ID NO: 1352237 - RNA, 19 nt, Homo sapiens
ugacaaguuuucauccuaa

SEQ ID NO: 1352238 - RNA, 19 nt, Homo sapiens
gaaagcucgaggugaaguu

SEQ ID NO: 1352239 - RNA, 19 nt, Homo sapiens
guucuuauguaaacuuagg

SEQ ID NO: 1352240 - RNA, 19 nt, Homo sapiens
ccacgaggucagcaaacua

SEQ ID NO: 1352241 - RNA, 19 nt, Homo sapiens
ucagacgaguuuacuuuac

SEQ ID NO: 1352242 - RNA, 19 nt, Homo sapiens
cagguucucagacgaguuu

SEQ ID NO: 1352243 - RNA, 19 nt, Homo sapiens
ggucagcaaacuaucaugu

SEQ ID NO: 1352244 - RNA, 19 nt, Homo sapiens
ccacugaaaccaaggucuu

SEQ ID NO: 1352245 - RNA, 19 nt, Homo sapiens
aaagcuguauuaucagagu

SEQ ID NO: 1352246 - RNA, 19 nt, Homo sapiens
uaguugcaaagcuguauua

SEQ ID NO: 1352247 - RNA, 19 nt, Homo sapiens
ggaaacagccaggaaaaug

SEQ ID NO: 1352248 - RNA, 19 nt, Homo sapiens
uuaaagagccaaguugcuu

SEQ ID NO: 1352249 - RNA, 19 nt, Homo sapiens
aggcugggaugauggagaa

SEQ ID NO: 1352250 - RNA, 19 nt, Homo sapiens
uagagaaacauuaguggau

SEQ ID NO: 1352251 - RNA, 19 nt, Homo sapiens
gcccacguauauuauguag

SEQ ID NO: 1352252 - RNA, 19 nt, Homo sapiens
ggagacacggguaggacuu

SEQ ID NO: 1352253 - RNA, 19 nt, Homo sapiens
gccaaauuucacagucuua

SEQ ID NO: 1352254 - RNA, 19 nt, Homo sapiens
gugaaucauguaaauguug

SEQ ID NO: 1352255 - RNA, 19 nt, Homo sapiens
ugucaggaugccuuuguua

SEQ ID NO: 1352256 - RNA, 19 nt, Homo sapiens
gaugucaggaugccuuugu

SEQ ID NO: 1352257 - RNA, 19 nt, Homo sapiens
gaaacuuagacuauagaca

SEQ ID NO: 1352258 - RNA, 19 nt, Homo sapiens
gggaaacuuagacuauaga

SEQ ID NO: 1352259 - RNA, 19 nt, Homo sapiens
guuucaagagauucacuua

SEQ ID NO: 1352260 - RNA, 19 nt, Homo sapiens
uggugugugugcauucuuu

SEQ ID NO: 1352261 - RNA, 19 nt, Homo sapiens
gagacacggguaggacuuu

SEQ ID NO: 1352262 - RNA, 19 nt, Homo sapiens
guguguggcccuucugaaa

SEQ ID NO: 1352263 - RNA, 19 nt, Homo sapiens
gcuguauuaucagaguaaa

SEQ ID NO: 1352264 - RNA, 19 nt, Homo sapiens
uaguggauguuaauugucu

SEQ ID NO: 1352265 - RNA, 19 nt, Homo sapiens
cugauuaagcugaugacua

SEQ ID NO: 1352266 - RNA, 19 nt, Homo sapiens
aaggaucccugauuaagcu

SEQ ID NO: 1352267 - RNA, 19 nt, Homo sapiens
ggagguggaugaagacuug

SEQ ID NO: 1352268 - RNA, 19 nt, Homo sapiens
gagaggaggucaugcuuau

SEQ ID NO: 1352269 - RNA, 19 nt, Homo sapiens
caaauccgcugacugaaau

SEQ ID NO: 1352270 - RNA, 19 nt, Homo sapiens
agagaaagacaaagaguua

SEQ ID NO: 1352271 - RNA, 19 nt, Homo sapiens
ucccuuagcugacgaauau

SEQ ID NO: 1352272 - RNA, 19 nt, Homo sapiens
auacuuaaguguccuacua

SEQ ID NO: 1352273 - RNA, 19 nt, Homo sapiens
agaguugaaucagcaauua

SEQ ID NO: 1352274 - RNA, 19 nt, Homo sapiens
gaacaagacagaccgagau

SEQ ID NO: 1352275 - RNA, 19 nt, Homo sapiens
gacccuauguuuccuaaug

SEQ ID NO: 1352276 - RNA, 19 nt, Homo sapiens
gaauaugacccuauguuuc

SEQ ID NO: 1352277 - RNA, 19 nt, Homo sapiens
caaaggacgaaacaaagua

SEQ ID NO: 1352278 - RNA, 19 nt, Homo sapiens
ugacugaaauacuuaagug

SEQ ID NO: 1352279 - RNA, 19 nt, Homo sapiens
uaaagcgguuguugacuug

SEQ ID NO: 1352280 - RNA, 19 nt, Homo sapiens
gcaacuccuuccucgcuaa

SEQ ID NO: 1352281 - RNA, 19 nt, Homo sapiens
ggacuucuaagauauaugu

SEQ ID NO: 1352282 - RNA, 19 nt, Homo sapiens
ugacgaauaugacccuaug

SEQ ID NO: 1352283 - RNA, 19 nt, Homo sapiens
ggauuuggcagaacaaguu

SEQ ID NO: 1352284 - RNA, 19 nt, Homo sapiens
uuaaagcgguuguugacuu

SEQ ID NO: 1352285 - RNA, 19 nt, Homo sapiens
acaagaucaugcagaagua

SEQ ID NO: 1352286 - RNA, 19 nt, Homo sapiens
agacagacaugaagcaagu

SEQ ID NO: 1352287 - RNA, 19 nt, Homo sapiens
ucagaugaccggcaaauug

SEQ ID NO: 1352288 - RNA, 19 nt, Homo sapiens
cgaauaugacccuauguuu

SEQ ID NO: 1352289 - RNA, 19 nt, Homo sapiens
caucuccggugauccuuaa

SEQ ID NO: 1352290 - RNA, 19 nt, Homo sapiens
caagaagucagauucaaau

SEQ ID NO: 1352291 - RNA, 19 nt, Homo sapiens
gaaagaugcauccaagaag

SEQ ID NO: 1352292 - RNA, 19 nt, Homo sapiens
gaaauagaagaaagggaaa

SEQ ID NO: 1352293 - RNA, 19 nt, Homo sapiens
guugagucuugaagcauua

SEQ ID NO: 1352294 - RNA, 19 nt, Homo sapiens
gcaauuaaagcgguuguug

SEQ ID NO: 1352295 - RNA, 19 nt, Homo sapiens
ccaagaagucagauucaaa

SEQ ID NO: 1352296 - RNA, 19 nt, Homo sapiens
ggucuuggauuuggcagaa

SEQ ID NO: 1352297 - RNA, 19 nt, Homo sapiens
gaagaaggcagcucucacu

SEQ ID NO: 1352298 - RNA, 19 nt, Homo sapiens
gcauuaaacugaagaaaag

SEQ ID NO: 1352299 - RNA, 19 nt, Homo sapiens
ucaaauccgcugacugaaa

SEQ ID NO: 1352300 - RNA, 19 nt, Homo sapiens
ucaaacuucugcagucuca

SEQ ID NO: 1352301 - RNA, 19 nt, Homo sapiens
ggagaaugcagguggaaug

SEQ ID NO: 1352302 - RNA, 19 nt, Homo sapiens
ugaugaagcaguacggaua

SEQ ID NO: 1352303 - RNA, 19 nt, Homo sapiens
aaagaugcauccaagaagu

SEQ ID NO: 1352304 - RNA, 19 nt, Homo sapiens
gagaccagauccagauucu

SEQ ID NO: 1352305 - RNA, 19 nt, Homo sapiens
gaggaggucaugcuuaugu

SEQ ID NO: 1352306 - RNA, 19 nt, Homo sapiens
gaaauacuuaaguguccua

SEQ ID NO: 1352307 - RNA, 19 nt, Homo sapiens
agaaagaugcauccaagaa

SEQ ID NO: 1352308 - RNA, 19 nt, Homo sapiens
ggcagaacaaguuugauuu

SEQ ID NO: 1352309 - RNA, 19 nt, Homo sapiens
ggacaaauucagggucuug

SEQ ID NO: 1352310 - RNA, 19 nt, Homo sapiens
caauuaaagcgguuguuga

SEQ ID NO: 1352311 - RNA, 19 nt, Homo sapiens
uaaguguccuacuaaagug

SEQ ID NO: 1352312 - RNA, 19 nt, Homo sapiens
agaugucccuguacgauga

SEQ ID NO: 1352313 - RNA, 19 nt, Homo sapiens
ccgagaauguguaaugauc

SEQ ID NO: 1352314 - RNA, 19 nt, Homo sapiens
gagaguugaaucagcaauu

SEQ ID NO: 1352315 - RNA, 19 nt, Homo sapiens
ccugagcacugccuuguca

SEQ ID NO: 1352316 - RNA, 19 nt, Homo sapiens
guacgaggaacaagacaga

SEQ ID NO: 1352317 - RNA, 19 nt, Homo sapiens
cugaugaagaugaagauua

SEQ ID NO: 1352318 - RNA, 19 nt, Homo sapiens
gagaaugcagguggaauga

SEQ ID NO: 1352319 - RNA, 19 nt, Homo sapiens
cuacuaaaguggucuuacu

SEQ ID NO: 1352320 - RNA, 19 nt, Homo sapiens
gaugaagcaguacggauau

SEQ ID NO: 1352321 - RNA, 19 nt, Homo sapiens
acagaaggcugguccaaaa

SEQ ID NO: 1352322 - RNA, 19 nt, Homo sapiens
aagaaaagaugucccugua

SEQ ID NO: 1352323 - RNA, 19 nt, Homo sapiens
ggacucaagaccucgauca

SEQ ID NO: 1352324 - RNA, 19 nt, Homo sapiens
ggaaagacaaaaggaaaua

SEQ ID NO: 1352325 - RNA, 19 nt, Homo sapiens
uauguugauugaucccuuu

SEQ ID NO: 1352326 - RNA, 19 nt, Homo sapiens
gcauguuucuacaauuugg

SEQ ID NO: 1352327 - RNA, 19 nt, Homo sapiens
cgcacaagaucaugcagaa

SEQ ID NO: 1352328 - RNA, 19 nt, Homo sapiens
ggagaccagugacucaaaa

SEQ ID NO: 1352329 - RNA, 19 nt, Homo sapiens
gaggucaugcuuauguuga

SEQ ID NO: 1352330 - RNA, 19 nt, Homo sapiens
gaguugaaucagcaauuaa

SEQ ID NO: 1352331 - RNA, 19 nt, Homo sapiens
gagaaagaugcauccaaga

SEQ ID NO: 1352332 - RNA, 19 nt, Homo sapiens
ccaaaggacgaaacaaagu

SEQ ID NO: 1352333 - RNA, 19 nt, Homo sapiens
ccuguacgaugaccuagga

SEQ ID NO: 1352334 - RNA, 19 nt, Homo sapiens
augcuuauguugagucuug

SEQ ID NO: 1352335 - RNA, 19 nt, Homo sapiens
ugggaaagcaggcgugaaa

SEQ ID NO: 1352336 - RNA, 19 nt, Homo sapiens
aaaccaaggaagaauguga

SEQ ID NO: 1352337 - RNA, 19 nt, Homo sapiens
gcacgguggcgcacaagau

SEQ ID NO: 1352338 - RNA, 19 nt, Homo sapiens
gcguaaagacagacaugaa

SEQ ID NO: 1352339 - RNA, 19 nt, Homo sapiens
gaaguucugauucccuuag

SEQ ID NO: 1352340 - RNA, 19 nt, Homo sapiens
cagaugaccggcaaauugu

SEQ ID NO: 1352341 - RNA, 19 nt, Homo sapiens
ccggugauccuuaaaugaa

SEQ ID NO: 1352342 - RNA, 19 nt, Homo sapiens
gcagaacaaguuugauuuu

SEQ ID NO: 1352343 - RNA, 19 nt, Homo sapiens
ugacuugaaugggagguau

SEQ ID NO: 1352344 - RNA, 19 nt, Homo sapiens
uuaaguguccuacuaaagu

SEQ ID NO: 1352345 - RNA, 19 nt, Homo sapiens
auucaaauccgcugacuga

SEQ ID NO: 1352346 - RNA, 19 nt, Homo sapiens
uggcagaacaaguuugauu

SEQ ID NO: 1352347 - RNA, 19 nt, Homo sapiens
ggaaguugaaaccaaggaa

SEQ ID NO: 1352348 - RNA, 19 nt, Homo sapiens
gagaggaacgacagagaca

SEQ ID NO: 1352349 - RNA, 19 nt, Homo sapiens
ggaggucaugcuuauguug

SEQ ID NO: 1352350 - RNA, 19 nt, Homo sapiens
agagaggaggucaugcuua

SEQ ID NO: 1352351 - RNA, 19 nt, Homo sapiens
aauucagggucuuggauuu

SEQ ID NO: 1352352 - RNA, 19 nt, Homo sapiens
gaucacagucuuccaaagc

SEQ ID NO: 1352353 - RNA, 19 nt, Homo sapiens
ggacgaaacaaaguacagu

SEQ ID NO: 1352354 - RNA, 19 nt, Homo sapiens
gugcagacguuggcguuuc

SEQ ID NO: 1352355 - RNA, 19 nt, Homo sapiens
gagagaggaggucaugcuu

SEQ ID NO: 1352356 - RNA, 19 nt, Homo sapiens
cuccauggcuguugcauac

SEQ ID NO: 1352357 - RNA, 19 nt, Homo sapiens
cgagucaucuccggugauc

SEQ ID NO: 1352358 - RNA, 19 nt, Homo sapiens
guaaaagcauguuucuaca

SEQ ID NO: 1352359 - RNA, 19 nt, Homo sapiens
ugaagcaguacggauauuu

SEQ ID NO: 1352360 - RNA, 19 nt, Homo sapiens
gagaggaggaaaagaagua

SEQ ID NO: 1352361 - RNA, 19 nt, Homo sapiens
ucuugaagcauuaaacuga

SEQ ID NO: 1352362 - RNA, 19 nt, Homo sapiens
gccaaaggacgaaacaaag

SEQ ID NO: 1352363 - RNA, 19 nt, Homo sapiens
caaauucagggucuuggau

SEQ ID NO: 1352364 - RNA, 19 nt, Homo sapiens
gaagcaguacggauauuuu

SEQ ID NO: 1352365 - RNA, 19 nt, Homo sapiens
cauccaagaagucagauuc

SEQ ID NO: 1352366 - RNA, 19 nt, Homo sapiens
cacaagaucaugcagaagu

SEQ ID NO: 1352367 - RNA, 19 nt, Homo sapiens
gagcagcgcuaguucauaa

SEQ ID NO: 1352368 - RNA, 19 nt, Homo sapiens
gggaauagcuuauccaauc

SEQ ID NO: 1352369 - RNA, 19 nt, Homo sapiens
ugaaggcucugacuuauaa

SEQ ID NO: 1352370 - RNA, 19 nt, Homo sapiens
ggacuuggauggguauuaa

SEQ ID NO: 1352371 - RNA, 19 nt, Homo sapiens
ccaagaagccgcucagaua

SEQ ID NO: 1352372 - RNA, 19 nt, Homo sapiens
gaauuuaguuugcgggaaa

SEQ ID NO: 1352373 - RNA, 19 nt, Homo sapiens
gguaauaaguggaagagaa

SEQ ID NO: 1352374 - RNA, 19 nt, Homo sapiens
gaacaucccuaauugacau

SEQ ID NO: 1352375 - RNA, 19 nt, Homo sapiens
gcucagauaugaagcauca

SEQ ID NO: 1352376 - RNA, 19 nt, Homo sapiens
gaugggaucccuaauauga

SEQ ID NO: 1352377 - RNA, 19 nt, Homo sapiens
gcucuugccuauuaccaua

SEQ ID NO: 1352378 - RNA, 19 nt, Homo sapiens
ccacagggcugcacuagca

SEQ ID NO: 1352379 - RNA, 19 nt, Homo sapiens
ggaauagcuuauccaauca

SEQ ID NO: 1352380 - RNA, 19 nt, Homo sapiens
gaagaaacauuuugacagu

SEQ ID NO: 1352381 - RNA, 19 nt, Homo sapiens
gauaugaagcaucaacaaa

SEQ ID NO: 1352382 - RNA, 19 nt, Homo sapiens
ugacaugugaugacuauuu

SEQ ID NO: 1352383 - RNA, 19 nt, Homo sapiens
ucugaaagcucaaauggau

SEQ ID NO: 1352384 - RNA, 19 nt, Homo sapiens
gggcaucgaucucugaaag

SEQ ID NO: 1352385 - RNA, 19 nt, Homo sapiens
agccugcucuugccuauua

SEQ ID NO: 1352386 - RNA, 19 nt, Homo sapiens
uugguaaagucacauguua

SEQ ID NO: 1352387 - RNA, 19 nt, Homo sapiens
gcuucaaggucuuugguaa

SEQ ID NO: 1352388 - RNA, 19 nt, Homo sapiens
uauaacugcuguaucagaa

SEQ ID NO: 1352389 - RNA, 19 nt, Homo sapiens
ugggaucccuaauaugaua

SEQ ID NO: 1352390 - RNA, 19 nt, Homo sapiens
caauaaacauguugacacu

SEQ ID NO: 1352391 - RNA, 19 nt, Homo sapiens
caucuaagagucauugaaa

SEQ ID NO: 1352392 - RNA, 19 nt, Homo sapiens
uaacugcuguaucagaaga

SEQ ID NO: 1352393 - RNA, 19 nt, Homo sapiens
cauaauugaugcaacuaga

SEQ ID NO: 1352394 - RNA, 19 nt, Homo sapiens
uguugacacuuuccuauaa

SEQ ID NO: 1352395 - RNA, 19 nt, Homo sapiens
aaggagugauguuggaaua

SEQ ID NO: 1352396 - RNA, 19 nt, Homo sapiens
gacaugugaugacuauuuc

SEQ ID NO: 1352397 - RNA, 19 nt, Homo sapiens
auuaaacucuucaggcaua

SEQ ID NO: 1352398 - RNA, 19 nt, Homo sapiens
agaagccgcucagauauga

SEQ ID NO: 1352399 - RNA, 19 nt, Homo sapiens
gcgcauaucaggcuuagga

SEQ ID NO: 1352400 - RNA, 19 nt, Homo sapiens
ggagugauguuggaauagu

SEQ ID NO: 1352401 - RNA, 19 nt, Homo sapiens
gcagaugcuucuuuuauug

SEQ ID NO: 1352402 - RNA, 19 nt, Homo sapiens
caagaagccgcucagauau

SEQ ID NO: 1352403 - RNA, 19 nt, Homo sapiens
uaaagucacauguuaagga

SEQ ID NO: 1352404 - RNA, 19 nt, Homo sapiens
acuuauaacugcuguauca

SEQ ID NO: 1352405 - RNA, 19 nt, Homo sapiens
aaacgcaacagccaacuuu

SEQ ID NO: 1352406 - RNA, 19 nt, Homo sapiens
cagcgcuaguucauaauuu

SEQ ID NO: 1352407 - RNA, 19 nt, Homo sapiens
guugacacuuuccuauaaa

SEQ ID NO: 1352408 - RNA, 19 nt, Homo sapiens
guaagaagcaagaagaagu

SEQ ID NO: 1352409 - RNA, 19 nt, Homo sapiens
agucacauguuaaggauga

SEQ ID NO: 1352410 - RNA, 19 nt, Homo sapiens
gcaacuagagucaauaugc

SEQ ID NO: 1352411 - RNA, 19 nt, Homo sapiens
uauguauucuuccaccuuu

SEQ ID NO: 1352412 - RNA, 19 nt, Homo sapiens
uacguugacuguucuuauu

SEQ ID NO: 1352413 - RNA, 19 nt, Homo sapiens
ggauggguauuaaacucuu

SEQ ID NO: 1352414 - RNA, 19 nt, Homo sapiens
uugaugggaucccuaauau

SEQ ID NO: 1352415 - RNA, 19 nt, Homo sapiens
caacuagagucaauaugcu

SEQ ID NO: 1352416 - RNA, 19 nt, Homo sapiens
cuacucagccucuguggaa

SEQ ID NO: 1352417 - RNA, 19 nt, Homo sapiens
uagcaggacuguucuacuc

SEQ ID NO: 1352418 - RNA, 19 nt, Homo sapiens
caacagccaacuuuucuua

SEQ ID NO: 1352419 - RNA, 19 nt, Homo sapiens
aaaguaagaagcaagaaga

SEQ ID NO: 1352420 - RNA, 19 nt, Homo sapiens
uaaugaagaguugggaaua

SEQ ID NO: 1352421 - RNA, 19 nt, Homo sapiens
uuauuccacugguuucuuu

SEQ ID NO: 1352422 - RNA, 19 nt, Homo sapiens
aaagucacauguuaaggau

SEQ ID NO: 1352423 - RNA, 19 nt, Homo sapiens
gcagcgcuaguucauaauu

SEQ ID NO: 1352424 - RNA, 19 nt, Homo sapiens
gguaaagucacauguuaag

SEQ ID NO: 1352425 - RNA, 19 nt, Homo sapiens
gcacagccagccuuugcuu

SEQ ID NO: 1352426 - RNA, 19 nt, Homo sapiens
guaauaaguggaagagaag

SEQ ID NO: 1352427 - RNA, 19 nt, Homo sapiens
cagccaacuuuucuuaaua

SEQ ID NO: 1352428 - RNA, 19 nt, Homo sapiens
ccacaggcagcuaggauga

SEQ ID NO: 1352429 - RNA, 19 nt, Homo sapiens
agcgcuaguucauaauuua

SEQ ID NO: 1352430 - RNA, 19 nt, Homo sapiens
uaaacauguugacacuuuc

SEQ ID NO: 1352431 - RNA, 19 nt, Homo sapiens
uaagggagagaaaugcauu

SEQ ID NO: 1352432 - RNA, 19 nt, Homo sapiens
guucuuauuccacugguuu

SEQ ID NO: 1352433 - RNA, 19 nt, Homo sapiens
gcgcuaguucauaauuuaa

SEQ ID NO: 1352434 - RNA, 19 nt, Homo sapiens
gaagaguugggaauagcuu

SEQ ID NO: 1352435 - RNA, 19 nt, Homo sapiens
guuaaggaugacugaaaua

SEQ ID NO: 1352436 - RNA, 19 nt, Homo sapiens
gugggaggcuuaaguugca

SEQ ID NO: 1352437 - RNA, 19 nt, Homo sapiens
uaagaagcaagaagaagug

SEQ ID NO: 1352438 - RNA, 19 nt, Homo sapiens
uguuaaggaugacugaaau

SEQ ID NO: 1352439 - RNA, 19 nt, Homo sapiens
ggagcagcgcuaguucaua

SEQ ID NO: 1352440 - RNA, 19 nt, Homo sapiens
guuggaauagucccucuaa

SEQ ID NO: 1352441 - RNA, 19 nt, Homo sapiens
ugucuugguuggagaugaa

SEQ ID NO: 1352442 - RNA, 19 nt, Homo sapiens
ugaugcaacuagagucaau

SEQ ID NO: 1352443 - RNA, 19 nt, Homo sapiens
cugaaauaauuccaaagga

SEQ ID NO: 1352444 - RNA, 19 nt, Homo sapiens
aaacucuucaggcauaauu

SEQ ID NO: 1352445 - RNA, 19 nt, Homo sapiens
caaaguaagaagcaagaag

SEQ ID NO: 1352446 - RNA, 19 nt, Homo sapiens
gcaucgaucucugaaagcu

SEQ ID NO: 1352447 - RNA, 19 nt, Homo sapiens
ccuauuaccauaccagugu

SEQ ID NO: 1352448 - RNA, 19 nt, Homo sapiens
aggcuuugcuuugcgcaua

SEQ ID NO: 1352449 - RNA, 19 nt, Homo sapiens
gcagguaauaaguggaaga

SEQ ID NO: 1352450 - RNA, 19 nt, Homo sapiens
ugacuuauaacugcuguau

SEQ ID NO: 1352451 - RNA, 19 nt, Homo sapiens
aagcucaaauggauggaau

SEQ ID NO: 1352452 - RNA, 19 nt, Homo sapiens
uggaagagaagaauguuuc

SEQ ID NO: 1352453 - RNA, 19 nt, Homo sapiens
aaugaagaguugggaauag

SEQ ID NO: 1352454 - RNA, 19 nt, Homo sapiens
uuugaaggcucugacuuau

SEQ ID NO: 1352455 - RNA, 19 nt, Homo sapiens
gauggguauuaaacucuuc

SEQ ID NO: 1352456 - RNA, 19 nt, Homo sapiens
acacaguggcagguaauaa

SEQ ID NO: 1352457 - RNA, 19 nt, Homo sapiens
gagugauguuggaauaguc

SEQ ID NO: 1352458 - RNA, 19 nt, Homo sapiens
caaaggagugauguuggaa

SEQ ID NO: 1352459 - RNA, 19 nt, Homo sapiens
uagagucaauaugcuguau

SEQ ID NO: 1352460 - RNA, 19 nt, Homo sapiens
cuauuaccauaccagugua

SEQ ID NO: 1352461 - RNA, 19 nt, Homo sapiens
cuuccuacguugacuguuc

SEQ ID NO: 1352462 - RNA, 19 nt, Homo sapiens
auugacaugugaugacuau

SEQ ID NO: 1352463 - RNA, 19 nt, Homo sapiens
cagccagccuuugcuuuua

SEQ ID NO: 1352464 - RNA, 19 nt, Homo sapiens
uaauugacaugugaugacu

SEQ ID NO: 1352465 - RNA, 19 nt, Homo sapiens
ucauugaugggaucccuaa

SEQ ID NO: 1352466 - RNA, 19 nt, Homo sapiens
gaugcaacuagagucaaua

SEQ ID NO: 1352467 - RNA, 19 nt, Homo sapiens
gaacuuaucuugcuuugca

SEQ ID NO: 1352468 - RNA, 19 nt, Homo sapiens
agacagaacugggagaaua

SEQ ID NO: 1352469 - RNA, 19 nt, Homo sapiens
ccaauaugcuugauacguu

SEQ ID NO: 1352470 - RNA, 19 nt, Homo sapiens
ggacgcccaucaccaauga

SEQ ID NO: 1352471 - RNA, 19 nt, Homo sapiens
caauauaccugauggucaa

SEQ ID NO: 1352472 - RNA, 19 nt, Homo sapiens
gaagggcucucagaugaug

SEQ ID NO: 1352473 - RNA, 19 nt, Homo sapiens
agugagacaugguauauaa

SEQ ID NO: 1352474 - RNA, 19 nt, Homo sapiens
ucagggaccucaccaaugu

SEQ ID NO: 1352475 - RNA, 19 nt, Homo sapiens
acaaggaccucuucucugu

SEQ ID NO: 1352476 - RNA, 19 nt, Homo sapiens
gaaccguugugaggauuaa

SEQ ID NO: 1352477 - RNA, 19 nt, Homo sapiens
uugaagggcucucagauga

SEQ ID NO: 1352478 - RNA, 19 nt, Homo sapiens
gaagcaauaaugaugacua

SEQ ID NO: 1352479 - RNA, 19 nt, Homo sapiens
ggacaaggaccucuucucu

SEQ ID NO: 1352480 - RNA, 19 nt, Homo sapiens
ccagacacuugacuucuau

SEQ ID NO: 1352481 - RNA, 19 nt, Homo sapiens
gggcuauaguauuucauuu

SEQ ID NO: 1352482 - RNA, 19 nt, Homo sapiens
gcauaaacuugagguggaa

SEQ ID NO: 1352483 - RNA, 19 nt, Homo sapiens
aaagagagagcgcgaaaga

SEQ ID NO: 1352484 - RNA, 19 nt, Homo sapiens
uugcuucccucaucuuuaa

SEQ ID NO: 1352485 - RNA, 19 nt, Homo sapiens
gggaggcacucaugaaggu

SEQ ID NO: 1352486 - RNA, 19 nt, Homo sapiens
ugacuucuauggcauucaa

SEQ ID NO: 1352487 - RNA, 19 nt, Homo sapiens
acagggaggcggucuuuaa

SEQ ID NO: 1352488 - RNA, 19 nt, Homo sapiens
gcuaaaagaugaccagaca

SEQ ID NO: 1352489 - RNA, 19 nt, Homo sapiens
cacagcagcuccucuuaca

SEQ ID NO: 1352490 - RNA, 19 nt, Homo sapiens
agagagagcgcgaaagaga

SEQ ID NO: 1352491 - RNA, 19 nt, Homo sapiens
aaagaugaccagacacuug

SEQ ID NO: 1352492 - RNA, 19 nt, Homo sapiens
uaagugagacaugguauau

SEQ ID NO: 1352493 - RNA, 19 nt, Homo sapiens
ccucagcagugacccuauu

SEQ ID NO: 1352494 - RNA, 19 nt, Homo sapiens
ugucuucgcugaucccaau

SEQ ID NO: 1352495 - RNA, 19 nt, Homo sapiens
cgaaaguccuggccugaac

SEQ ID NO: 1352496 - RNA, 19 nt, Homo sapiens
gauuaagugagacauggua

SEQ ID NO: 1352497 - RNA, 19 nt, Homo sapiens
ggaaccguugugaggauua

SEQ ID NO: 1352498 - RNA, 19 nt, Homo sapiens
gaucccaauaugcuugaua

SEQ ID NO: 1352499 - RNA, 19 nt, Homo sapiens
gaccuugggccagugauuu

SEQ ID NO: 1352500 - RNA, 19 nt, Homo sapiens
gcacagcagcuccucuuac

SEQ ID NO: 1352501 - RNA, 19 nt, Homo sapiens
ugagagaguuccggguguu

SEQ ID NO: 1352502 - RNA, 19 nt, Homo sapiens
agaaagagagagcgcgaaa

SEQ ID NO: 1352503 - RNA, 19 nt, Homo sapiens
cgaccuccuucuggcauaa

SEQ ID NO: 1352504 - RNA, 19 nt, Homo sapiens
gggaaccguugugaggauu

SEQ ID NO: 1352505 - RNA, 19 nt, Homo sapiens
acccugagcugauugaucu

SEQ ID NO: 1352506 - RNA, 19 nt, Homo sapiens
aaacuugagguggaagaua

SEQ ID NO: 1352507 - RNA, 19 nt, Homo sapiens
accagacacuugacuucua

SEQ ID NO: 1352508 - RNA, 19 nt, Homo sapiens
acuccaaagucuauucuuc

SEQ ID NO: 1352509 - RNA, 19 nt, Homo sapiens
gaccagccacuuacuccaa

SEQ ID NO: 1352510 - RNA, 19 nt, Homo sapiens
uuucuuuccucuucucuau

SEQ ID NO: 1352511 - RNA, 19 nt, Homo sapiens
gagucuugcuucccucauc

SEQ ID NO: 1352512 - RNA, 19 nt, Homo sapiens
uccacacccucuagcagua

SEQ ID NO: 1352513 - RNA, 19 nt, Homo sapiens
aggaugacuuucacccaaa

SEQ ID NO: 1352514 - RNA, 19 nt, Homo sapiens
ucacccagcccucgucaau

SEQ ID NO: 1352515 - RNA, 19 nt, Homo sapiens
ggaccucuucucugucuuc

SEQ ID NO: 1352516 - RNA, 19 nt, Homo sapiens
aagaugaccagacacuuga

SEQ ID NO: 1352517 - RNA, 19 nt, Homo sapiens
gaugugugucagccaagua

SEQ ID NO: 1352518 - RNA, 19 nt, Homo sapiens
caauaaggagucucuggau

SEQ ID NO: 1352519 - RNA, 19 nt, Homo sapiens
cggaaccuguggacaaagu

SEQ ID NO: 1352520 - RNA, 19 nt, Homo sapiens
cuacuguggucggaagcua

SEQ ID NO: 1352521 - RNA, 19 nt, Homo sapiens
uuaagugagacaugguaua

SEQ ID NO: 1352522 - RNA, 19 nt, Homo sapiens
ggaugacuuucacccaaac

SEQ ID NO: 1352523 - RNA, 19 nt, Homo sapiens
gcgaaaguccuggccugaa

SEQ ID NO: 1352524 - RNA, 19 nt, Homo sapiens
auaaggagucucuggauca

SEQ ID NO: 1352525 - RNA, 19 nt, Homo sapiens
gcucagcaauaaggagucu

SEQ ID NO: 1352526 - RNA, 19 nt, Homo sapiens
gucggaagcuaaaagauga

SEQ ID NO: 1352527 - RNA, 19 nt, Homo sapiens
ucuuuccucuucucuauca

SEQ ID NO: 1352528 - RNA, 19 nt, Homo sapiens
gaggauuaagugagacaug

SEQ ID NO: 1352529 - RNA, 19 nt, Homo sapiens
cagccaagcccuacagcau

SEQ ID NO: 1352530 - RNA, 19 nt, Homo sapiens
cagggacgcccaucaccaa

SEQ ID NO: 1352531 - RNA, 19 nt, Homo sapiens
cagaugaugaggaugacuu

SEQ ID NO: 1352532 - RNA, 19 nt, Homo sapiens
uuacagggaggcggucuuu

SEQ ID NO: 1352533 - RNA, 19 nt, Homo sapiens
auucuucgguugccagaga

SEQ ID NO: 1352534 - RNA, 19 nt, Homo sapiens
agagagcgcgaaagagaga

SEQ ID NO: 1352535 - RNA, 19 nt, Homo sapiens
gaaagagagagcgcgaaag

SEQ ID NO: 1352536 - RNA, 19 nt, Homo sapiens
ugaaggugccuccaucucu

SEQ ID NO: 1352537 - RNA, 19 nt, Homo sapiens
ggucgccaccggauagugu

SEQ ID NO: 1352538 - RNA, 19 nt, Homo sapiens
ggcuauaguauuucauuuc

SEQ ID NO: 1352539 - RNA, 19 nt, Homo sapiens
uggaagauaccuugaggau

SEQ ID NO: 1352540 - RNA, 19 nt, Homo sapiens
aagcagcccuggagcucau

SEQ ID NO: 1352541 - RNA, 19 nt, Homo sapiens
aaggaccucuucucugucu

SEQ ID NO: 1352542 - RNA, 19 nt, Homo sapiens
uaaggagucucuggaucag

SEQ ID NO: 1352543 - RNA, 19 nt, Homo sapiens
ugaccagacacuugacuuc

SEQ ID NO: 1352544 - RNA, 19 nt, Homo sapiens
gugagacaugguauauaaa

SEQ ID NO: 1352545 - RNA, 19 nt, Homo sapiens
gguccacuguccauguucu

SEQ ID NO: 1352546 - RNA, 19 nt, Homo sapiens
uccagacccugagcugauu

SEQ ID NO: 1352547 - RNA, 19 nt, Homo sapiens
gacagaacugggagaauac

SEQ ID NO: 1352548 - RNA, 19 nt, Homo sapiens
ccucagggaccucaccaau

SEQ ID NO: 1352549 - RNA, 19 nt, Homo sapiens
gagagaguuccggguguug

SEQ ID NO: 1352550 - RNA, 19 nt, Homo sapiens
guccuggccugaaccugau

SEQ ID NO: 1352551 - RNA, 19 nt, Homo sapiens
uggguccacuguccauguu

SEQ ID NO: 1352552 - RNA, 19 nt, Homo sapiens
cgaaagagagaggaugucu

SEQ ID NO: 1352553 - RNA, 19 nt, Homo sapiens
ugaggucgccaccggauag

SEQ ID NO: 1352554 - RNA, 19 nt, Homo sapiens
gcauaaaucuguucuuaca

SEQ ID NO: 1352555 - RNA, 19 nt, Homo sapiens
gcaaagaccucugguuuua

SEQ ID NO: 1352556 - RNA, 19 nt, Homo sapiens
gagcagguuuggaugauaa

SEQ ID NO: 1352557 - RNA, 19 nt, Homo sapiens
ggacugcgcuaaggacuuu

SEQ ID NO: 1352558 - RNA, 19 nt, Homo sapiens
gcucacaccuguaaucuca

SEQ ID NO: 1352559 - RNA, 19 nt, Homo sapiens
gaggaguaaucaacaguaa

SEQ ID NO: 1352560 - RNA, 19 nt, Homo sapiens
guucaccacucucuacuuu

SEQ ID NO: 1352561 - RNA, 19 nt, Homo sapiens
ggaaaggcaugcacacgau

SEQ ID NO: 1352562 - RNA, 19 nt, Homo sapiens
ugucagggauggagagaua

SEQ ID NO: 1352563 - RNA, 19 nt, Homo sapiens
aaaggaugcuugugaggua

SEQ ID NO: 1352564 - RNA, 19 nt, Homo sapiens
gaaaagauuugcuugguau

SEQ ID NO: 1352565 - RNA, 19 nt, Homo sapiens
gcuaaggacuuucaacucu

SEQ ID NO: 1352566 - RNA, 19 nt, Homo sapiens
gagcuacaacaucaaguua

SEQ ID NO: 1352567 - RNA, 19 nt, Homo sapiens
uaaggacuuucaacucuuu

SEQ ID NO: 1352568 - RNA, 19 nt, Homo sapiens
gcguauacuugguaaauau

SEQ ID NO: 1352569 - RNA, 19 nt, Homo sapiens
cacauaugcucccaacuaa

SEQ ID NO: 1352570 - RNA, 19 nt, Homo sapiens
gaugaacuguugcucucua

SEQ ID NO: 1352571 - RNA, 19 nt, Homo sapiens
ucagggagcuacaacauca

SEQ ID NO: 1352572 - RNA, 19 nt, Homo sapiens
ggagacauauuacaugcau

SEQ ID NO: 1352573 - RNA, 19 nt, Homo sapiens
ucaccacucucuacuuuga

SEQ ID NO: 1352574 - RNA, 19 nt, Homo sapiens
gaagguugguuagauuaug

SEQ ID NO: 1352575 - RNA, 19 nt, Homo sapiens
acacauaugcucccaacua

SEQ ID NO: 1352576 - RNA, 19 nt, Homo sapiens
agacuuuagugaccacaua

SEQ ID NO: 1352577 - RNA, 19 nt, Homo sapiens
ccuguaaucucagcacuuu

SEQ ID NO: 1352578 - RNA, 19 nt, Homo sapiens
guaaucaacaguaacgaaa

SEQ ID NO: 1352579 - RNA, 19 nt, Homo sapiens
ccugaagccuuaacaccua

SEQ ID NO: 1352580 - RNA, 19 nt, Homo sapiens
gaguaaaggaugcuuguga

SEQ ID NO: 1352581 - RNA, 19 nt, Homo sapiens
agagaguacuggcuaaaga

SEQ ID NO: 1352582 - RNA, 19 nt, Homo sapiens
cuaaagagauagguaaugg

SEQ ID NO: 1352583 - RNA, 19 nt, Homo sapiens
aagcaaagaccucugguuu

SEQ ID NO: 1352584 - RNA, 19 nt, Homo sapiens
gcuaggugcucaggagaaa

SEQ ID NO: 1352585 - RNA, 19 nt, Homo sapiens
uaaaggaggaggaguaauc

SEQ ID NO: 1352586 - RNA, 19 nt, Homo sapiens
ggauggagagauauuuaaa

SEQ ID NO: 1352587 - RNA, 19 nt, Homo sapiens
ggaggaguaaucaacagua

SEQ ID NO: 1352588 - RNA, 19 nt, Homo sapiens
ugaagcaaguggagugguu

SEQ ID NO: 1352589 - RNA, 19 nt, Homo sapiens
ggcguauacuugguaaaua

SEQ ID NO: 1352590 - RNA, 19 nt, Homo sapiens
gaguucauguauagauuug

SEQ ID NO: 1352591 - RNA, 19 nt, Homo sapiens
aguacuggcuaaagagaua

SEQ ID NO: 1352592 - RNA, 19 nt, Homo sapiens
cauaugcucccaacuaaga

SEQ ID NO: 1352593 - RNA, 19 nt, Homo sapiens
gaagccuuaacaccuauua

SEQ ID NO: 1352594 - RNA, 19 nt, Homo sapiens
gaacuguugcucucuagau

SEQ ID NO: 1352595 - RNA, 19 nt, Homo sapiens
cuaagagaguacuggcuaa

SEQ ID NO: 1352596 - RNA, 19 nt, Homo sapiens
ggaccagccuagccuacau

SEQ ID NO: 1352597 - RNA, 19 nt, Homo sapiens
agccagagguggaaaucua

SEQ ID NO: 1352598 - RNA, 19 nt, Homo sapiens
gggauggagagauauuuaa

SEQ ID NO: 1352599 - RNA, 19 nt, Homo sapiens
ggagcuacaacaucaaguu

SEQ ID NO: 1352600 - RNA, 19 nt, Homo sapiens
gacggaagguugguuagau

SEQ ID NO: 1352601 - RNA, 19 nt, Homo sapiens
gacaucaguuagagagguu

SEQ ID NO: 1352602 - RNA, 19 nt, Homo sapiens
ccaucagacuggucaauca

SEQ ID NO: 1352603 - RNA, 19 nt, Homo sapiens
caggagaaaugucauacca

SEQ ID NO: 1352604 - RNA, 19 nt, Homo sapiens
guucauguauagauuugga

SEQ ID NO: 1352605 - RNA, 19 nt, Homo sapiens
gaagcaaagaccucugguu

SEQ ID NO: 1352606 - RNA, 19 nt, Homo sapiens
gcucaggagaaaugucaua

SEQ ID NO: 1352607 - RNA, 19 nt, Homo sapiens
aaauuaaggcacuguugua

SEQ ID NO: 1352608 - RNA, 19 nt, Homo sapiens
ugaaaccccuucucuacua

SEQ ID NO: 1352609 - RNA, 19 nt, Homo sapiens
gcucccaacuaagagagua

SEQ ID NO: 1352610 - RNA, 19 nt, Homo sapiens
ugucauaccaggugucauu

SEQ ID NO: 1352611 - RNA, 19 nt, Homo sapiens
ugagguggguggaucacuu

SEQ ID NO: 1352612 - RNA, 19 nt, Homo sapiens
cagcugaagauauaaguau

SEQ ID NO: 1352613 - RNA, 19 nt, Homo sapiens
ggaagguugguuagauuau

SEQ ID NO: 1352614 - RNA, 19 nt, Homo sapiens
ggacuuucaacucuuucua

SEQ ID NO: 1352615 - RNA, 19 nt, Homo sapiens
gagacauauuacaugcaua

SEQ ID NO: 1352616 - RNA, 19 nt, Homo sapiens
ggcucaggcuacagguuua

SEQ ID NO: 1352617 - RNA, 19 nt, Homo sapiens
agguuuggaugauaaauga

SEQ ID NO: 1352618 - RNA, 19 nt, Homo sapiens
ggagagcacggucaaaggu

SEQ ID NO: 1352619 - RNA, 19 nt, Homo sapiens
ucaguagagugacagugaa

SEQ ID NO: 1352620 - RNA, 19 nt, Homo sapiens
ugcaggcugucaacacaua

SEQ ID NO: 1352621 - RNA, 19 nt, Homo sapiens
aagguugguuagauuauga

SEQ ID NO: 1352622 - RNA, 19 nt, Homo sapiens
cuaaggacuuucaacucuu

SEQ ID NO: 1352623 - RNA, 19 nt, Homo sapiens
ugaaaagauuugcuuggua

SEQ ID NO: 1352624 - RNA, 19 nt, Homo sapiens
gaaaccccuucucuacuaa

SEQ ID NO: 1352625 - RNA, 19 nt, Homo sapiens
ggaggaggaguaaucaaca

SEQ ID NO: 1352626 - RNA, 19 nt, Homo sapiens
caaguuacgaggaaaauaa

SEQ ID NO: 1352627 - RNA, 19 nt, Homo sapiens
cggaagguugguuagauua

SEQ ID NO: 1352628 - RNA, 19 nt, Homo sapiens
gaaagccagagguggaaau

SEQ ID NO: 1352629 - RNA, 19 nt, Homo sapiens
gcacacgauguuaugagaa

SEQ ID NO: 1352630 - RNA, 19 nt, Homo sapiens
gaggaggaguaaucaacag

SEQ ID NO: 1352631 - RNA, 19 nt, Homo sapiens
gccuuaacaccuauuauau

SEQ ID NO: 1352632 - RNA, 19 nt, Homo sapiens
acggaagguugguuagauu

SEQ ID NO: 1352633 - RNA, 19 nt, Homo sapiens
ugcaugggcuggaguaaag

SEQ ID NO: 1352634 - RNA, 19 nt, Homo sapiens
gagugacagugaagcaagu

SEQ ID NO: 1352635 - RNA, 19 nt, Homo sapiens
agccuuaacaccuauuaua

SEQ ID NO: 1352636 - RNA, 19 nt, Homo sapiens
gcaugcacacgauguuaug

SEQ ID NO: 1352637 - RNA, 19 nt, Homo sapiens
ggguuugacuaauggaauc

SEQ ID NO: 1352638 - RNA, 19 nt, Homo sapiens
acagacggaagguugguua

SEQ ID NO: 1352639 - RNA, 19 nt, Homo sapiens
agagcagguuuggaugaua

SEQ ID NO: 1352640 - RNA, 19 nt, Homo sapiens
gggaauggacagaggaauc

SEQ ID NO: 1352641 - RNA, 19 nt, Homo sapiens
gcuaaagagauagguaaug

SEQ ID NO: 1352642 - RNA, 19 nt, Homo sapiens
uaagagaguacuggcuaaa

SEQ ID NO: 1352643 - RNA, 19 nt, Homo sapiens
ggaugcaugggcuggagua

SEQ ID NO: 1352644 - RNA, 19 nt, Homo sapiens
ggaguaaucaacaguaacg

SEQ ID NO: 1352645 - RNA, 19 nt, Homo sapiens
gauggagagauauuuaaag

SEQ ID NO: 1352646 - RNA, 19 nt, Homo sapiens
aacaucaaguuacgaggaa

SEQ ID NO: 1352647 - RNA, 19 nt, Homo sapiens
gcuacaacaucaaguuacg

SEQ ID NO: 1352648 - RNA, 19 nt, Homo sapiens
gaacuagagcagguuugga

SEQ ID NO: 1352649 - RNA, 19 nt, Homo sapiens
ugagugacaucaguuagag

SEQ ID NO: 1352650 - RNA, 19 nt, Homo sapiens
gcuguugcuugcuaguaug

SEQ ID NO: 1352651 - RNA, 19 nt, Homo sapiens
acucaucaguuuggccuuu

SEQ ID NO: 1352652 - RNA, 19 nt, Homo sapiens
aaucacggaugacuuucug

SEQ ID NO: 1352653 - RNA, 19 nt, Homo sapiens
ucucuacuuugauggcauu

SEQ ID NO: 1352654 - RNA, 19 nt, Homo sapiens
caacaggauucgauacuuu

SEQ ID NO: 1352655 - RNA, 19 nt, Homo sapiens
gagaagaccaaacgaagua

SEQ ID NO: 1352656 - RNA, 19 nt, Homo sapiens
uggaagaugugauugauuu

SEQ ID NO: 1352657 - RNA, 19 nt, Homo sapiens
caucuaaguuccugucauu

SEQ ID NO: 1352658 - RNA, 19 nt, Homo sapiens
gcaaacugaugggcucuuu

SEQ ID NO: 1352659 - RNA, 19 nt, Homo sapiens
gaagaacucccagaccuuu

SEQ ID NO: 1352660 - RNA, 19 nt, Homo sapiens
cuaaguuccugucauuaaa

SEQ ID NO: 1352661 - RNA, 19 nt, Homo sapiens
ccaagcagcacaaugagua

SEQ ID NO: 1352662 - RNA, 19 nt, Homo sapiens
cguaaggccuccacaucua

SEQ ID NO: 1352663 - RNA, 19 nt, Homo sapiens
caaacgaaguaacgucugu

SEQ ID NO: 1352664 - RNA, 19 nt, Homo sapiens
guaaggccuccacaucuaa

SEQ ID NO: 1352665 - RNA, 19 nt, Homo sapiens
gagcuugcuucacacacaa

SEQ ID NO: 1352666 - RNA, 19 nt, Homo sapiens
cagcaaagccgacccuauc

SEQ ID NO: 1352667 - RNA, 19 nt, Homo sapiens
gcacaaugaguaguucuug

SEQ ID NO: 1352668 - RNA, 19 nt, Homo sapiens
gaggagaagaccaaacgaa

SEQ ID NO: 1352669 - RNA, 19 nt, Homo sapiens
ggagaagaccaaacgaagu

SEQ ID NO: 1352670 - RNA, 19 nt, Homo sapiens
ggaagaacucccagaccuu

SEQ ID NO: 1352671 - RNA, 19 nt, Homo sapiens
gaagaugugauugauuugu

SEQ ID NO: 1352672 - RNA, 19 nt, Homo sapiens
gaaggugucgcaugaagag

SEQ ID NO: 1352673 - RNA, 19 nt, Homo sapiens
aaacugcuuugaggagaaa

SEQ ID NO: 1352674 - RNA, 19 nt, Homo sapiens
ucuaaguuccugucauuaa

SEQ ID NO: 1352675 - RNA, 19 nt, Homo sapiens
cacaaugaguaguucuuga

SEQ ID NO: 1352676 - RNA, 19 nt, Homo sapiens
cguccaagcagcacaauga

SEQ ID NO: 1352677 - RNA, 19 nt, Homo sapiens
cgauagggauccagagucu

SEQ ID NO: 1352678 - RNA, 19 nt, Homo sapiens
cgaaguaacgucuguaaaa

SEQ ID NO: 1352679 - RNA, 19 nt, Homo sapiens
gcagcacaaugaguaguuc

SEQ ID NO: 1352680 - RNA, 19 nt, Homo sapiens
gaacagaaaaugaugcaau

SEQ ID NO: 1352681 - RNA, 19 nt, Homo sapiens
ggaagaugugauugauuug

SEQ ID NO: 1352682 - RNA, 19 nt, Homo sapiens
acaacaggauucgauacuu

SEQ ID NO: 1352683 - RNA, 19 nt, Homo sapiens
gaaguaacgucuguaaaac

SEQ ID NO: 1352684 - RNA, 19 nt, Homo sapiens
ccagacuuccgcaaacuga

SEQ ID NO: 1352685 - RNA, 19 nt, Homo sapiens
cccugaaggugucgcauga

SEQ ID NO: 1352686 - RNA, 19 nt, Homo sapiens
gccugucacuccagacugu

SEQ ID NO: 1352687 - RNA, 19 nt, Homo sapiens
acacacaacaggauucgau

SEQ ID NO: 1352688 - RNA, 19 nt, Homo sapiens
ugauuuguaaaccgcauua

SEQ ID NO: 1352689 - RNA, 19 nt, Homo sapiens
gcguaaggccuccacaucu

SEQ ID NO: 1352690 - RNA, 19 nt, Homo sapiens
ucgauacuuugccaauuca

SEQ ID NO: 1352691 - RNA, 19 nt, Homo sapiens
cagaaaaugaugcaaugua

SEQ ID NO: 1352692 - RNA, 19 nt, Homo sapiens
agagcuugcuucacacaca

SEQ ID NO: 1352693 - RNA, 19 nt, Homo sapiens
ggugucgcaugaagagcuu

SEQ ID NO: 1352694 - RNA, 19 nt, Homo sapiens
ggugggaggagaagaccaa

SEQ ID NO: 1352695 - RNA, 19 nt, Homo sapiens
ggauucgccuuggcuaggu

SEQ ID NO: 1352696 - RNA, 19 nt, Homo sapiens
gaaaaugaugcaauguaug

SEQ ID NO: 1352697 - RNA, 19 nt, Homo sapiens
gcaaagccgacccuaucca

SEQ ID NO: 1352698 - RNA, 19 nt, Homo sapiens
auagggauccagagucuug

SEQ ID NO: 1352699 - RNA, 19 nt, Homo sapiens
uucgauacuuugccaauuc

SEQ ID NO: 1352700 - RNA, 19 nt, Homo sapiens
cacacaacaggauucgaua

SEQ ID NO: 1352701 - RNA, 19 nt, Homo sapiens
cugaaggugucgcaugaag

SEQ ID NO: 1352702 - RNA, 19 nt, Homo sapiens
ccuggccgauccacgaaga

SEQ ID NO: 1352703 - RNA, 19 nt, Homo sapiens
gaagaccaaacgaaguaac

SEQ ID NO: 1352704 - RNA, 19 nt, Homo sapiens
gauucgauacuuugccaau

SEQ ID NO: 1352705 - RNA, 19 nt, Homo sapiens
gaacaaacucugaagauga

SEQ ID NO: 1352706 - RNA, 19 nt, Homo sapiens
ucaaggaucugaaaguauu

SEQ ID NO: 1352707 - RNA, 19 nt, Homo sapiens
ggacuggccucuaggaguu

SEQ ID NO: 1352708 - RNA, 19 nt, Homo sapiens
ugacauugguggacuuuga

SEQ ID NO: 1352709 - RNA, 19 nt, Homo sapiens
cacaauaagugaagaaagu

SEQ ID NO: 1352710 - RNA, 19 nt, Homo sapiens
ggacuucuagccuccauaa

SEQ ID NO: 1352711 - RNA, 19 nt, Homo sapiens
ccugggaacuugugagaaa

SEQ ID NO: 1352712 - RNA, 19 nt, Homo sapiens
cgaacaaacucugaagaug

SEQ ID NO: 1352713 - RNA, 19 nt, Homo sapiens
gcagauggaaauaauaugu

SEQ ID NO: 1352714 - RNA, 19 nt, Homo sapiens
aaaguaaguugcagaugga

SEQ ID NO: 1352715 - RNA, 19 nt, Homo sapiens
agacuaacauugacauugg

SEQ ID NO: 1352716 - RNA, 19 nt, Homo sapiens
ggucaaacaaucuagaugu

SEQ ID NO: 1352717 - RNA, 19 nt, Homo sapiens
auaaaucucucucuguaca

SEQ ID NO: 1352718 - RNA, 19 nt, Homo sapiens
ggauuuaacagagcaaaga

SEQ ID NO: 1352719 - RNA, 19 nt, Homo sapiens
gaaguccccucauauacaa

SEQ ID NO: 1352720 - RNA, 19 nt, Homo sapiens
gaaggacugacuguacuuu

SEQ ID NO: 1352721 - RNA, 19 nt, Homo sapiens
ccaagaacccgaacaaacu

SEQ ID NO: 1352722 - RNA, 19 nt, Homo sapiens
uggaugagacuaacauuga

SEQ ID NO: 1352723 - RNA, 19 nt, Homo sapiens
ggaaauaauaugugauggu

SEQ ID NO: 1352724 - RNA, 19 nt, Homo sapiens
gagacuaacauugacauug

SEQ ID NO: 1352725 - RNA, 19 nt, Homo sapiens
ucagauggaccuaucagaa

SEQ ID NO: 1352726 - RNA, 19 nt, Homo sapiens
guacuuugcacuagugguu

SEQ ID NO: 1352727 - RNA, 19 nt, Homo sapiens
guaaguugcagauggaaau

SEQ ID NO: 1352728 - RNA, 19 nt, Homo sapiens
ccaaccugcugacacuuug

SEQ ID NO: 1352729 - RNA, 19 nt, Homo sapiens
acacuuugaucuuggacuu

SEQ ID NO: 1352730 - RNA, 19 nt, Homo sapiens
gcaggaacauuuugaaguc

SEQ ID NO: 1352731 - RNA, 19 nt, Homo sapiens
gcugagggcagagcuguuu

SEQ ID NO: 1352732 - RNA, 19 nt, Homo sapiens
gaacccgaacaaacucuga

SEQ ID NO: 1352733 - RNA, 19 nt, Homo sapiens
uaauguggguauucucauc

SEQ ID NO: 1352734 - RNA, 19 nt, Homo sapiens
aauaugugauggucaaaca

SEQ ID NO: 1352735 - RNA, 19 nt, Homo sapiens
cagauggaccuaucagaau

SEQ ID NO: 1352736 - RNA, 19 nt, Homo sapiens
gaagcuauuugaguuugag

SEQ ID NO: 1352737 - RNA, 19 nt, Homo sapiens
aaaucucucucuguacaaa

SEQ ID NO: 1352738 - RNA, 19 nt, Homo sapiens
gaauugaacgaugccaaga

SEQ ID NO: 1352739 - RNA, 19 nt, Homo sapiens
gugaaggacugacuguacu

SEQ ID NO: 1352740 - RNA, 19 nt, Homo sapiens
uguuguaaauggccucuga

SEQ ID NO: 1352741 - RNA, 19 nt, Homo sapiens
gcacuagugguucucaaag

SEQ ID NO: 1352742 - RNA, 19 nt, Homo sapiens
gccuacaucugcaaggaau

SEQ ID NO: 1352743 - RNA, 19 nt, Homo sapiens
ugacuguacuuugcacuag

SEQ ID NO: 1352744 - RNA, 19 nt, Homo sapiens
ugaagcuauuugaguuuga

SEQ ID NO: 1352745 - RNA, 19 nt, Homo sapiens
gagguccccugagaaaaua

SEQ ID NO: 1352746 - RNA, 19 nt, Homo sapiens
gccaagaacccgaacaaac

SEQ ID NO: 1352747 - RNA, 19 nt, Homo sapiens
ggaugagacuaacauugac

SEQ ID NO: 1352748 - RNA, 19 nt, Homo sapiens
gagccaauucccuaaaaua

SEQ ID NO: 1352749 - RNA, 19 nt, Homo sapiens
cauaauguggguauucuca

SEQ ID NO: 1352750 - RNA, 19 nt, Homo sapiens
agauggaccuaucagaauc

SEQ ID NO: 1352751 - RNA, 19 nt, Homo sapiens
cuucuagccuccauaacug

SEQ ID NO: 1352752 - RNA, 19 nt, Homo sapiens
aacaaacucugaagaugag

SEQ ID NO: 1352753 - RNA, 19 nt, Homo sapiens
uaaguugcagauggaaaua

SEQ ID NO: 1352754 - RNA, 19 nt, Homo sapiens
ggacugacuguacuuugca

SEQ ID NO: 1352755 - RNA, 19 nt, Homo sapiens
gccauaauguggguauucu

SEQ ID NO: 1352756 - RNA, 19 nt, Homo sapiens
uaaccugacccacuucaag

SEQ ID NO: 1352757 - RNA, 19 nt, Homo sapiens
uccugaagcuauuugaguu

SEQ ID NO: 1352758 - RNA, 19 nt, Homo sapiens
cagcaucaccugggaacuu

SEQ ID NO: 1352759 - RNA, 19 nt, Homo sapiens
acuagugguucucaaagug

SEQ ID NO: 1352760 - RNA, 19 nt, Homo sapiens
agacugagguccccugaga

SEQ ID NO: 1352761 - RNA, 19 nt, Homo sapiens
cugaagcuauuugaguuug

SEQ ID NO: 1352762 - RNA, 19 nt, Homo sapiens
ccgaacaaacucugaagau

SEQ ID NO: 1352763 - RNA, 19 nt, Homo sapiens
cuacaucugcaaggaauug

SEQ ID NO: 1352764 - RNA, 19 nt, Homo sapiens
agacagccuucagccuuga

SEQ ID NO: 1352765 - RNA, 19 nt, Homo sapiens
caaggaucugaaaguauuu

SEQ ID NO: 1352766 - RNA, 19 nt, Homo sapiens
gauggucaaacaaucuaga

SEQ ID NO: 1352767 - RNA, 19 nt, Homo sapiens
gugauggucaaacaaucua

SEQ ID NO: 1352768 - RNA, 19 nt, Homo sapiens
gugaagaaaguaaguugca

SEQ ID NO: 1352769 - RNA, 19 nt, Homo sapiens
uuucagcuccuguuucaga

SEQ ID NO: 1352770 - RNA, 19 nt, Homo sapiens
caagaacccgaacaaacuc

SEQ ID NO: 1352771 - RNA, 19 nt, Homo sapiens
caaacucugaagaugagaa

SEQ ID NO: 1352772 - RNA, 19 nt, Homo sapiens
gaugugaaggacugacugu

SEQ ID NO: 1352773 - RNA, 19 nt, Homo sapiens
uggaacccauggaugugaa

SEQ ID NO: 1352774 - RNA, 19 nt, Homo sapiens
gaugagacuaacauugaca

SEQ ID NO: 1352775 - RNA, 19 nt, Homo sapiens
aaucucugcaggaacauuu

SEQ ID NO: 1352776 - RNA, 19 nt, Homo sapiens
cacuagugguucucaaagu

SEQ ID NO: 1352777 - RNA, 19 nt, Homo sapiens
gacuaacauugacauuggu

SEQ ID NO: 1352778 - RNA, 19 nt, Homo sapiens
ggauguggaacccauggau

SEQ ID NO: 1352779 - RNA, 19 nt, Homo sapiens
auaacugugugagccaauu

SEQ ID NO: 1352780 - RNA, 19 nt, Homo sapiens
ccugaagcuauuugaguuu

SEQ ID NO: 1352781 - RNA, 19 nt, Homo sapiens
aagccuacaucugcaagga

SEQ ID NO: 1352782 - RNA, 19 nt, Homo sapiens
cagauggaaauaauaugug

SEQ ID NO: 1352783 - RNA, 19 nt, Homo sapiens
guugcagauggaaauaaua

SEQ ID NO: 1352784 - RNA, 19 nt, Homo sapiens
aguugcagauggaaauaau

SEQ ID NO: 1352785 - RNA, 19 nt, Homo sapiens
gacuguacuuugcacuagu

SEQ ID NO: 1352786 - RNA, 19 nt, Homo sapiens
ucacagagauauucuauga

SEQ ID NO: 1352787 - RNA, 19 nt, Homo sapiens
gagagaagcuggccacaga

SEQ ID NO: 1352788 - RNA, 19 nt, Homo sapiens
gaaugugacucucaucuug

SEQ ID NO: 1352789 - RNA, 19 nt, Homo sapiens
ucaagcaucuucucacuaa

SEQ ID NO: 1352790 - RNA, 19 nt, Homo sapiens
ugaaaugacugguuuaugu

SEQ ID NO: 1352791 - RNA, 19 nt, Homo sapiens
agagacaucugauuuguuu

SEQ ID NO: 1352792 - RNA, 19 nt, Homo sapiens
gcuaacaauuucuuccuuu

SEQ ID NO: 1352793 - RNA, 19 nt, Homo sapiens
gaagcuggccacagaauug

SEQ ID NO: 1352794 - RNA, 19 nt, Homo sapiens
gaaaugacugguuuauguu

SEQ ID NO: 1352795 - RNA, 19 nt, Homo sapiens
uacauuaacucacuuagga

SEQ ID NO: 1352796 - RNA, 19 nt, Homo sapiens
ggucaaacuggcaauauuu

SEQ ID NO: 1352797 - RNA, 19 nt, Homo sapiens
caucuugguuggaaacaaa

SEQ ID NO: 1352798 - RNA, 19 nt, Homo sapiens
gcuaguagaagauguagaa

SEQ ID NO: 1352799 - RNA, 19 nt, Homo sapiens
gaaacaaagcugacuugga

SEQ ID NO: 1352800 - RNA, 19 nt, Homo sapiens
ucuaauagguugggaaguu

SEQ ID NO: 1352801 - RNA, 19 nt, Homo sapiens
cuuccaagauucacaauga

SEQ ID NO: 1352802 - RNA, 19 nt, Homo sapiens
aagaaugggugauuaaagu

SEQ ID NO: 1352803 - RNA, 19 nt, Homo sapiens
gaaaagaaugggugauuaa

SEQ ID NO: 1352804 - RNA, 19 nt, Homo sapiens
uuccuuggcucaaacaaua

SEQ ID NO: 1352805 - RNA, 19 nt, Homo sapiens
gugcuggucuacgacauua

SEQ ID NO: 1352806 - RNA, 19 nt, Homo sapiens
gaagauguagaauuagaga

SEQ ID NO: 1352807 - RNA, 19 nt, Homo sapiens
gugaggauuuucugaauua

SEQ ID NO: 1352808 - RNA, 19 nt, Homo sapiens
gaacaggaaauagaaggaa

SEQ ID NO: 1352809 - RNA, 19 nt, Homo sapiens
gaacaggauuguggacucu

SEQ ID NO: 1352810 - RNA, 19 nt, Homo sapiens
caccaaacccugacuuuau

SEQ ID NO: 1352811 - RNA, 19 nt, Homo sapiens
caucuucucacuaauguuu

SEQ ID NO: 1352812 - RNA, 19 nt, Homo sapiens
caauuucagugcuaacaau

SEQ ID NO: 1352813 - RNA, 19 nt, Homo sapiens
caagucagggugauauaaa

SEQ ID NO: 1352814 - RNA, 19 nt, Homo sapiens
cuaauagguugggaaguuu

SEQ ID NO: 1352815 - RNA, 19 nt, Homo sapiens
gaaaguacagucuacaacu

SEQ ID NO: 1352816 - RNA, 19 nt, Homo sapiens
gaauuagagacaucugauu

SEQ ID NO: 1352817 - RNA, 19 nt, Homo sapiens
gagguggaccaacuaauug

SEQ ID NO: 1352818 - RNA, 19 nt, Homo sapiens
ucacuuaggagaauucaga

SEQ ID NO: 1352819 - RNA, 19 nt, Homo sapiens
ggauacauuaacucacuua

SEQ ID NO: 1352820 - RNA, 19 nt, Homo sapiens
ucauuaaguuugccacaug

SEQ ID NO: 1352821 - RNA, 19 nt, Homo sapiens
ucaccaaacccugacuuua

SEQ ID NO: 1352822 - RNA, 19 nt, Homo sapiens
uuaacaagaugcucaccaa

SEQ ID NO: 1352823 - RNA, 19 nt, Homo sapiens
agacacugcuggucaggaa

SEQ ID NO: 1352824 - RNA, 19 nt, Homo sapiens
ccaaaagacaagcaaauua

SEQ ID NO: 1352825 - RNA, 19 nt, Homo sapiens
ugagguggaccaacuaauu

SEQ ID NO: 1352826 - RNA, 19 nt, Homo sapiens
accaaacccugacuuuauu

SEQ ID NO: 1352827 - RNA, 19 nt, Homo sapiens
gcaagccauuaacaagaug

SEQ ID NO: 1352828 - RNA, 19 nt, Homo sapiens
agaauuggcuugugcuuuu

SEQ ID NO: 1352829 - RNA, 19 nt, Homo sapiens
ccaagaaugugacucucau

SEQ ID NO: 1352830 - RNA, 19 nt, Homo sapiens
cauuguuucuggccucuaa

SEQ ID NO: 1352831 - RNA, 19 nt, Homo sapiens
ccacaugacuuauuuugau

SEQ ID NO: 1352832 - RNA, 19 nt, Homo sapiens
gcuuaaccaugccuccauu

SEQ ID NO: 1352833 - RNA, 19 nt, Homo sapiens
caucuucaccuugcuuuaa

SEQ ID NO: 1352834 - RNA, 19 nt, Homo sapiens
acucagugcuuuaguuuua

SEQ ID NO: 1352835 - RNA, 19 nt, Homo sapiens
caaugcauuuggacaacuu

SEQ ID NO: 1352836 - RNA, 19 nt, Homo sapiens
cauuaaguuugccacauga

SEQ ID NO: 1352837 - RNA, 19 nt, Homo sapiens
agaaaagaaugggugauua

SEQ ID NO: 1352838 - RNA, 19 nt, Homo sapiens
acaaugauauggugaaucc

SEQ ID NO: 1352839 - RNA, 19 nt, Homo sapiens
auucugaaaugacugguuu

SEQ ID NO: 1352840 - RNA, 19 nt, Homo sapiens
cagcugagguggaccaacu

SEQ ID NO: 1352841 - RNA, 19 nt, Homo sapiens
caagcaagccauuaacaag

SEQ ID NO: 1352842 - RNA, 19 nt, Homo sapiens
gaaugggugauuaaaguuc

SEQ ID NO: 1352843 - RNA, 19 nt, Homo sapiens
uaacucacuuaggagaauu

SEQ ID NO: 1352844 - RNA, 19 nt, Homo sapiens
uuagagacaucugauuugu

SEQ ID NO: 1352845 - RNA, 19 nt, Homo sapiens
ccaagauucacaaugauau

SEQ ID NO: 1352846 - RNA, 19 nt, Homo sapiens
acaguaaauugucuaccaa

SEQ ID NO: 1352847 - RNA, 19 nt, Homo sapiens
cuaacaauuucuuccuuuc

SEQ ID NO: 1352848 - RNA, 19 nt, Homo sapiens
gcaauuucagugcuaacaa

SEQ ID NO: 1352849 - RNA, 19 nt, Homo sapiens
ucaccaaaaucaguaguua

SEQ ID NO: 1352850 - RNA, 19 nt, Homo sapiens
gcacagaagaaggagagaa

SEQ ID NO: 1352851 - RNA, 19 nt, Homo sapiens
ccaggcagguuagcacaga

SEQ ID NO: 1352852 - RNA, 19 nt, Homo sapiens
ggaggucaaacuggcaaua

SEQ ID NO: 1352853 - RNA, 19 nt, Homo sapiens
ugagccagguacaguaaga

SEQ ID NO: 1352854 - RNA, 19 nt, Homo sapiens
caaaggcaauaggacacaa

SEQ ID NO: 1352855 - RNA, 19 nt, Homo sapiens
gcauuuggacaacuugaug

SEQ ID NO: 1352856 - RNA, 19 nt, Homo sapiens
caagauuuggguacuuuau

SEQ ID NO: 1352857 - RNA, 19 nt, Homo sapiens
gcugaauaaaugugucuaa

SEQ ID NO: 1352858 - RNA, 19 nt, Homo sapiens
gauauggugaauccaaaga

SEQ ID NO: 1352859 - RNA, 19 nt, Homo sapiens
ggaacaggaaauagaagga

SEQ ID NO: 1352860 - RNA, 19 nt, Homo sapiens
uaacaagaugcucaccaaa

SEQ ID NO: 1352861 - RNA, 19 nt, Homo sapiens
ucaagcaagccauuaacaa

SEQ ID NO: 1352862 - RNA, 19 nt, Homo sapiens
gagaagcuggccacagaau

SEQ ID NO: 1352863 - RNA, 19 nt, Homo sapiens
aagauuuacucagugcuuu

SEQ ID NO: 1352864 - RNA, 19 nt, Homo sapiens
ucaagucagggugauauaa

SEQ ID NO: 1352865 - RNA, 19 nt, Homo sapiens
guucaagcaucuucucacu

SEQ ID NO: 1352866 - RNA, 19 nt, Homo sapiens
uuucagugcuaacaauuuc

SEQ ID NO: 1352867 - RNA, 19 nt, Homo sapiens
gaaguuuuagcguguuuua

SEQ ID NO: 1352868 - RNA, 19 nt, Homo sapiens
gcuuugugcuggucuacga

SEQ ID NO: 1352869 - RNA, 19 nt, Homo sapiens
uuacucagugcuuuaguuu

SEQ ID NO: 1352870 - RNA, 19 nt, Homo sapiens
gcaauaggacacaaaauuc

SEQ ID NO: 1352871 - RNA, 19 nt, Homo sapiens
uaucaagauuuggguacuu

SEQ ID NO: 1352872 - RNA, 19 nt, Homo sapiens
ccucugauucauuaaguuu

SEQ ID NO: 1352873 - RNA, 19 nt, Homo sapiens
gaaugcuaguagaagaugu

SEQ ID NO: 1352874 - RNA, 19 nt, Homo sapiens
gaggucaaacuggcaauau

SEQ ID NO: 1352875 - RNA, 19 nt, Homo sapiens
gaguugguucucucaauga

SEQ ID NO: 1352876 - RNA, 19 nt, Homo sapiens
gaagugaggauuuucugaa

SEQ ID NO: 1352877 - RNA, 19 nt, Homo sapiens
ugagauuucugaccaaacg

SEQ ID NO: 1352878 - RNA, 19 nt, Homo sapiens
gcaucuucaccuugcuuua

SEQ ID NO: 1352879 - RNA, 19 nt, Homo sapiens
uuccuuuccugcuugaaua

SEQ ID NO: 1352880 - RNA, 19 nt, Homo sapiens
gaccacuccaggcagguua

SEQ ID NO: 1352881 - RNA, 19 nt, Homo sapiens
gaaacacucuuccccuucu

SEQ ID NO: 1352882 - RNA, 19 nt, Homo sapiens
caagauucacaaugauaug

SEQ ID NO: 1352883 - RNA, 19 nt, Homo sapiens
aagcaagccauuaacaaga

SEQ ID NO: 1352884 - RNA, 19 nt, Homo sapiens
acucuuguauucugaaagu

SEQ ID NO: 1352885 - RNA, 19 nt, Homo sapiens
uuaacucacuuaggagaau

SEQ ID NO: 1352886 - RNA, 19 nt, Homo sapiens
gcacaaaggagauucauug

SEQ ID NO: 1352887 - RNA, 19 nt, Homo sapiens
gaaaagggcuuguggaaug

SEQ ID NO: 1352888 - RNA, 19 nt, Homo sapiens
ggaaugaguuggacacaag

SEQ ID NO: 1352889 - RNA, 19 nt, Homo sapiens
agaaagacauuccuucgaa

SEQ ID NO: 1352890 - RNA, 19 nt, Homo sapiens
ugaaaccgcuauugcugua

SEQ ID NO: 1352891 - RNA, 19 nt, Homo sapiens
gaagagaugaggacacaga

SEQ ID NO: 1352892 - RNA, 19 nt, Homo sapiens
gcaagaccaugcccucugu

SEQ ID NO: 1352893 - RNA, 19 nt, Homo sapiens
cacacgagcuccugguuaa

SEQ ID NO: 1352894 - RNA, 19 nt, Homo sapiens
gcuccuguccgauaaguua

SEQ ID NO: 1352895 - RNA, 19 nt, Homo sapiens
cuaagugacuguacucaau

SEQ ID NO: 1352896 - RNA, 19 nt, Homo sapiens
uguauaaacuggccaugaa

SEQ ID NO: 1352897 - RNA, 19 nt, Homo sapiens
ggacacagacacacacaga

SEQ ID NO: 1352898 - RNA, 19 nt, Homo sapiens
cuacagaggucagcagguu

SEQ ID NO: 1352899 - RNA, 19 nt, Homo sapiens
uuaaagauacgcuguuuga

SEQ ID NO: 1352900 - RNA, 19 nt, Homo sapiens
ccacaaggugcguucauuu

SEQ ID NO: 1352901 - RNA, 19 nt, Homo sapiens
uaagugacuguacucaaua

SEQ ID NO: 1352902 - RNA, 19 nt, Homo sapiens
guaaauggaaugaguugga

SEQ ID NO: 1352903 - RNA, 19 nt, Homo sapiens
ccugcugucuuaucuguaa

SEQ ID NO: 1352904 - RNA, 19 nt, Homo sapiens
gaccugcugucuuaucugu

SEQ ID NO: 1352905 - RNA, 19 nt, Homo sapiens
ccgaguggcugggacuaua

SEQ ID NO: 1352906 - RNA, 19 nt, Homo sapiens
ccgauggcacccuguauua

SEQ ID NO: 1352907 - RNA, 19 nt, Homo sapiens
gcagaggccucaggaacca

SEQ ID NO: 1352908 - RNA, 19 nt, Homo sapiens
uggaaugccuguauaaacu

SEQ ID NO: 1352909 - RNA, 19 nt, Homo sapiens
gagaaagacauuccuucga

SEQ ID NO: 1352910 - RNA, 19 nt, Homo sapiens
ugucuuaucuguaaacacu

SEQ ID NO: 1352911 - RNA, 19 nt, Homo sapiens
caccagcuccuguccgaua

SEQ ID NO: 1352912 - RNA, 19 nt, Homo sapiens
aagaagagaugaggacaca

SEQ ID NO: 1352913 - RNA, 19 nt, Homo sapiens
caugcccucuguuucgaua

SEQ ID NO: 1352914 - RNA, 19 nt, Homo sapiens
guucucacacugcuaauug

SEQ ID NO: 1352915 - RNA, 19 nt, Homo sapiens
gcugcuugguguccuugua

SEQ ID NO: 1352916 - RNA, 19 nt, Homo sapiens
aaaccgcuauugcuguaga

SEQ ID NO: 1352917 - RNA, 19 nt, Homo sapiens
gaaaauaugggacaauaag

SEQ ID NO: 1352918 - RNA, 19 nt, Homo sapiens
acacacgagcuccugguua

SEQ ID NO: 1352919 - RNA, 19 nt, Homo sapiens
guauaaacuggccaugaaa

SEQ ID NO: 1352920 - RNA, 19 nt, Homo sapiens
ggcagagccuccaccuugu

SEQ ID NO: 1352921 - RNA, 19 nt, Homo sapiens
aagugacuguacucaauaa

SEQ ID NO: 1352922 - RNA, 19 nt, Homo sapiens
ccgcuauugcuguagauua

SEQ ID NO: 1352923 - RNA, 19 nt, Homo sapiens
guucaaggagaaagacauu

SEQ ID NO: 1352924 - RNA, 19 nt, Homo sapiens
gauggcacccuguauuagu

SEQ ID NO: 1352925 - RNA, 19 nt, Homo sapiens
ccgaggaaccgcuuguuug

SEQ ID NO: 1352926 - RNA, 19 nt, Homo sapiens
acagaggucagcagguuaa

SEQ ID NO: 1352927 - RNA, 19 nt, Homo sapiens
aguuaaagauacgcuguuu

SEQ ID NO: 1352928 - RNA, 19 nt, Homo sapiens
cuuguggaaugccuguaua

SEQ ID NO: 1352929 - RNA, 19 nt, Homo sapiens
gggacuggguuuggagaug

SEQ ID NO: 1352930 - RNA, 19 nt, Homo sapiens
ggaaugccuguauaaacug

SEQ ID NO: 1352931 - RNA, 19 nt, Homo sapiens
caggacaguaggagaauug

SEQ ID NO: 1352932 - RNA, 19 nt, Homo sapiens
gaggaaacagggaggcaau

SEQ ID NO: 1352933 - RNA, 19 nt, Homo sapiens
uccgauaaguuaaagauac

SEQ ID NO: 1352934 - RNA, 19 nt, Homo sapiens
ccaggacaguaggagaauu

SEQ ID NO: 1352935 - RNA, 19 nt, Homo sapiens
uguuauggcugaauuacgu

SEQ ID NO: 1352936 - RNA, 19 nt, Homo sapiens
cacaaaggagauucauuga

SEQ ID NO: 1352937 - RNA, 19 nt, Homo sapiens
ccuccuaauugccaucaug

SEQ ID NO: 1352938 - RNA, 19 nt, Homo sapiens
aauaugggacaauaaguug

SEQ ID NO: 1352939 - RNA, 19 nt, Homo sapiens
guauuaguccguucucaca

SEQ ID NO: 1352940 - RNA, 19 nt, Homo sapiens
gcccaggacaguaggagaa

SEQ ID NO: 1352941 - RNA, 19 nt, Homo sapiens
gaaugaguuggacacaaga

SEQ ID NO: 1352942 - RNA, 19 nt, Homo sapiens
ccuaauugccaucauguuc

SEQ ID NO: 1352943 - RNA, 19 nt, Homo sapiens
uggcuguuauggcugaauu

SEQ ID NO: 1352944 - RNA, 19 nt, Homo sapiens
gcagagccuccaccuugug

SEQ ID NO: 1352945 - RNA, 19 nt, Homo sapiens
uaaacuggccaugaaaaua

SEQ ID NO: 1352946 - RNA, 19 nt, Homo sapiens
gaccaugcccucuguuucg

SEQ ID NO: 1352947 - RNA, 19 nt, Homo sapiens
guugcgcuguccuggcuuu

SEQ ID NO: 1352948 - RNA, 19 nt, Homo sapiens
gugacuguacucaauaaau

SEQ ID NO: 1352949 - RNA, 19 nt, Homo sapiens
cuccugggcugaagcaauc

SEQ ID NO: 1352950 - RNA, 19 nt, Homo sapiens
ggacaguaggagaauugga

SEQ ID NO: 1352951 - RNA, 19 nt, Homo sapiens
gaucuaagugacuguacuc

SEQ ID NO: 1352952 - RNA, 19 nt, Homo sapiens
guggaaugccuguauaaac

SEQ ID NO: 1352953 - RNA, 19 nt, Homo sapiens
cccaaauucucauguugca

SEQ ID NO: 1352954 - RNA, 19 nt, Homo sapiens
aaacuggccaugaaaauau

SEQ ID NO: 1352955 - RNA, 19 nt, Homo sapiens
uggaaugaguuggacacaa

SEQ ID NO: 1352956 - RNA, 19 nt, Homo sapiens
gggcugaagcaaucuuucu

SEQ ID NO: 1352957 - RNA, 19 nt, Homo sapiens
gggaaaagggcuuguggaa

SEQ ID NO: 1352958 - RNA, 19 nt, Homo sapiens
ggaaacagggaggcaaugc

SEQ ID NO: 1352959 - RNA, 19 nt, Homo sapiens
ccacuggucuguuggaaua

SEQ ID NO: 1352960 - RNA, 19 nt, Homo sapiens
ggaacauccugaaguuuaa

SEQ ID NO: 1352961 - RNA, 19 nt, Homo sapiens
gaagagaaggugagaaguu

SEQ ID NO: 1352962 - RNA, 19 nt, Homo sapiens
uaucaaggcugaaggagaa

SEQ ID NO: 1352963 - RNA, 19 nt, Homo sapiens
aaacucaucucauccaaau

SEQ ID NO: 1352964 - RNA, 19 nt, Homo sapiens
caccugagcucccugauug

SEQ ID NO: 1352965 - RNA, 19 nt, Homo sapiens
agaagaaacucaucucauc

SEQ ID NO: 1352966 - RNA, 19 nt, Homo sapiens
ugacugacauggaagagaa

SEQ ID NO: 1352967 - RNA, 19 nt, Homo sapiens
gagccugaccucccucuua

SEQ ID NO: 1352968 - RNA, 19 nt, Homo sapiens
uaaguguacuccagaagaa

SEQ ID NO: 1352969 - RNA, 19 nt, Homo sapiens
cgaggauccuguuaagauu

SEQ ID NO: 1352970 - RNA, 19 nt, Homo sapiens
cagaauacaucgauugcau

SEQ ID NO: 1352971 - RNA, 19 nt, Homo sapiens
ccagaccaguguauuucua

SEQ ID NO: 1352972 - RNA, 19 nt, Homo sapiens
gaaacucaucucauccaaa

SEQ ID NO: 1352973 - RNA, 19 nt, Homo sapiens
aagagaaggugagaaguug

SEQ ID NO: 1352974 - RNA, 19 nt, Homo sapiens
gaauacaucgauugcauca

SEQ ID NO: 1352975 - RNA, 19 nt, Homo sapiens
ugacaucagucccuacaag

SEQ ID NO: 1352976 - RNA, 19 nt, Homo sapiens
uaaagaaaauccugacaug

SEQ ID NO: 1352977 - RNA, 19 nt, Homo sapiens
gaucaugccaccaguguag

SEQ ID NO: 1352978 - RNA, 19 nt, Homo sapiens
gcuccugcuuaaauaaauu

SEQ ID NO: 1352979 - RNA, 19 nt, Homo sapiens
gcccugcucugccuaagug

SEQ ID NO: 1352980 - RNA, 19 nt, Homo sapiens
ugacaugcacacccauuaa

SEQ ID NO: 1352981 - RNA, 19 nt, Homo sapiens
ggugagaaguugugaaacg

SEQ ID NO: 1352982 - RNA, 19 nt, Homo sapiens
gguaugcacugcccaacuc

SEQ ID NO: 1352983 - RNA, 19 nt, Homo sapiens
gacaugcacacccauuaaa

SEQ ID NO: 1352984 - RNA, 19 nt, Homo sapiens
aaagugcuccugcuuaaau

SEQ ID NO: 1352985 - RNA, 19 nt, Homo sapiens
gguagggugggauacuuua

SEQ ID NO: 1352986 - RNA, 19 nt, Homo sapiens
caaggacaccagcaacuga

SEQ ID NO: 1352987 - RNA, 19 nt, Homo sapiens
gcacugcccaacucaacaa

SEQ ID NO: 1352988 - RNA, 19 nt, Homo sapiens
gggcagaauacaucgauug

SEQ ID NO: 1352989 - RNA, 19 nt, Homo sapiens
ugaccucccucuuacagau

SEQ ID NO: 1352990 - RNA, 19 nt, Homo sapiens
uggaugccauucugacuga

SEQ ID NO: 1352991 - RNA, 19 nt, Homo sapiens
gguguugggcucuucauug

SEQ ID NO: 1352992 - RNA, 19 nt, Homo sapiens
ccaccggcguugaguacuu

SEQ ID NO: 1352993 - RNA, 19 nt, Homo sapiens
ggacaccagcaacugaaga

SEQ ID NO: 1352994 - RNA, 19 nt, Homo sapiens
gaccagaccaguguauuuc

SEQ ID NO: 1352995 - RNA, 19 nt, Homo sapiens
agaccagaccaguguauuu

SEQ ID NO: 1352996 - RNA, 19 nt, Homo sapiens
ccgaggauccuguuaagau

SEQ ID NO: 1352997 - RNA, 19 nt, Homo sapiens
cccaagggcaguacaugua

SEQ ID NO: 1352998 - RNA, 19 nt, Homo sapiens
gaggauccuguuaagauug

SEQ ID NO: 1352999 - RNA, 19 nt, Homo sapiens
gagaaggugagaaguugug

SEQ ID NO: 1353000 - RNA, 19 nt, Homo sapiens
gcucuucauugguguggau

SEQ ID NO: 1353001 - RNA, 19 nt, Homo sapiens
caucagucccuacaaguuc

SEQ ID NO: 1353002 - RNA, 19 nt, Homo sapiens
aagugcuccugcuuaaaua

SEQ ID NO: 1353003 - RNA, 19 nt, Homo sapiens
uuuaaagugcuccugcuua

SEQ ID NO: 1353004 - RNA, 19 nt, Homo sapiens
cauucugacugacauggaa

SEQ ID NO: 1353005 - RNA, 19 nt, Homo sapiens
agaccaguguauuucuaaa

SEQ ID NO: 1353006 - RNA, 19 nt, Homo sapiens
gcccgaggccauaaugcua

SEQ ID NO: 1353007 - RNA, 19 nt, Homo sapiens
ugaaugucuuggagaagga

SEQ ID NO: 1353008 - RNA, 19 nt, Homo sapiens
accaguguauuucuaaaga

SEQ ID NO: 1353009 - RNA, 19 nt, Homo sapiens
ccucaagucagucaauuuc

SEQ ID NO: 1353010 - RNA, 19 nt, Homo sapiens
ccagugggcaagcgaagaa

SEQ ID NO: 1353011 - RNA, 19 nt, Homo sapiens
gaaggagaacuacguuuug

SEQ ID NO: 1353012 - RNA, 19 nt, Homo sapiens
guguugggcucuucauugg

SEQ ID NO: 1353013 - RNA, 19 nt, Homo sapiens
gaccucccucuuacagaua

SEQ ID NO: 1353014 - RNA, 19 nt, Homo sapiens
caacggcucaucagcucuu

SEQ ID NO: 1353015 - RNA, 19 nt, Homo sapiens
ccagaagaaacucaucuca

SEQ ID NO: 1353016 - RNA, 19 nt, Homo sapiens
cuaaguguacuccagaaga

SEQ ID NO: 1353017 - RNA, 19 nt, Homo sapiens
gaaggugagaaguugugaa

SEQ ID NO: 1353018 - RNA, 19 nt, Homo sapiens
guggcagacuccagggaaa

SEQ ID NO: 1353019 - RNA, 19 nt, Homo sapiens
cagaccaguguauuucuaa

SEQ ID NO: 1353020 - RNA, 19 nt, Homo sapiens
agaaacucaucucauccaa

SEQ ID NO: 1353021 - RNA, 19 nt, Homo sapiens
aaggugagaaguugugaaa

SEQ ID NO: 1353022 - RNA, 19 nt, Homo sapiens
cacggcaggugguggcaaa

SEQ ID NO: 1353023 - RNA, 19 nt, Homo sapiens
ucaaagaugaggccacaag

SEQ ID NO: 1353024 - RNA, 19 nt, Homo sapiens
cugagucucugcccagugu

SEQ ID NO: 1353025 - RNA, 19 nt, Homo sapiens
guagggugggauacuuuaa

SEQ ID NO: 1353026 - RNA, 19 nt, Homo sapiens
aaagcuggaugccauucug

SEQ ID NO: 1353027 - RNA, 19 nt, Homo sapiens
uaaagugcuccugcuuaaa

SEQ ID NO: 1353028 - RNA, 19 nt, Homo sapiens
cagaagaaacucaucucau

SEQ ID NO: 1353029 - RNA, 19 nt, Homo sapiens
ccaacucaacaacagauug

SEQ ID NO: 1353030 - RNA, 19 nt, Homo sapiens
ccaccugagcucccugauu

SEQ ID NO: 1353031 - RNA, 19 nt, Homo sapiens
ggguagggugggauacuuu

SEQ ID NO: 1353032 - RNA, 19 nt, Homo sapiens
caagucagucaauuuccuu

SEQ ID NO: 1353033 - RNA, 19 nt, Homo sapiens
gugcuccugcuuaaauaaa

SEQ ID NO: 1353034 - RNA, 19 nt, Homo sapiens
gucagucaauuuccuuucu

SEQ ID NO: 1353035 - RNA, 19 nt, Homo sapiens
ugagcucccugauugacau

SEQ ID NO: 1353036 - RNA, 19 nt, Homo sapiens
gcaaagcuggaugccauuc

SEQ ID NO: 1353037 - RNA, 19 nt, Homo sapiens
gcugaaggagaacuacguu

SEQ ID NO: 1353038 - RNA, 19 nt, Homo sapiens
caaggcugaaggagaacua

SEQ ID NO: 1353039 - RNA, 19 nt, Homo sapiens
aaagaugaggccacaagga

SEQ ID NO: 1353040 - RNA, 19 nt, Homo sapiens
uagggugggauacuuuaaa

SEQ ID NO: 1353041 - RNA, 19 nt, Homo sapiens
ucagucaauuuccuuucug

SEQ ID NO: 1353042 - RNA, 19 nt, Homo sapiens
gccuaaguguacuccagaa

SEQ ID NO: 1353043 - RNA, 19 nt, Homo sapiens
acagauugcagccuucuuc

SEQ ID NO: 1353044 - RNA, 19 nt, Homo sapiens
caacucaacaacagauugc

SEQ ID NO: 1353045 - RNA, 19 nt, Homo sapiens
gggcaagcgaagaaaugaa

SEQ ID NO: 1353046 - RNA, 19 nt, Homo sapiens
ggaucaugccaccagugua

SEQ ID NO: 1353047 - RNA, 19 nt, Homo sapiens
cagucaauuuccuuucugu

SEQ ID NO: 1353048 - RNA, 19 nt, Homo sapiens
ucaagucagucaauuuccu

SEQ ID NO: 1353049 - RNA, 19 nt, Homo sapiens
gacaucagucccuacaagu

SEQ ID NO: 1353050 - RNA, 19 nt, Homo sapiens
gaacauccugaaguuuaag

SEQ ID NO: 1353051 - RNA, 19 nt, Homo sapiens
ugaaggagaacuacguuuu

SEQ ID NO: 1353052 - RNA, 19 nt, Homo sapiens
cugacaugcacacccauua

SEQ ID NO: 1353053 - RNA, 19 nt, Homo sapiens
gaccaguguauuucuaaag

SEQ ID NO: 1353054 - RNA, 19 nt, Homo sapiens
uuacagauaaagucagcuu

SEQ ID NO: 1353055 - RNA, 19 nt, Homo sapiens
ggaagagaaggugagaagu

SEQ ID NO: 1353056 - RNA, 19 nt, Homo sapiens
uggaagagaaggugagaag

SEQ ID NO: 1353057 - RNA, 19 nt, Homo sapiens
gcuucagccuggacaaugc

SEQ ID NO: 1353058 - RNA, 19 nt, Homo sapiens
ccacuggucuguuggaaua

SEQ ID NO: 1353059 - RNA, 19 nt, Homo sapiens
ggaacauccugaaguuuaa

SEQ ID NO: 1353060 - RNA, 19 nt, Homo sapiens
gguauuagaucaugcguau

SEQ ID NO: 1353061 - RNA, 19 nt, Homo sapiens
gaagagaaggugagaaguu

SEQ ID NO: 1353062 - RNA, 19 nt, Homo sapiens
uaucaaggcugaaggagaa

SEQ ID NO: 1353063 - RNA, 19 nt, Homo sapiens
aaacucaucucauccaaau

SEQ ID NO: 1353064 - RNA, 19 nt, Homo sapiens
caccugagcucccugauug

SEQ ID NO: 1353065 - RNA, 19 nt, Homo sapiens
gagaagggcaggaagauug

SEQ ID NO: 1353066 - RNA, 19 nt, Homo sapiens
agaagaaacucaucucauc

SEQ ID NO: 1353067 - RNA, 19 nt, Homo sapiens
ugacugacauggaagagaa

SEQ ID NO: 1353068 - RNA, 19 nt, Homo sapiens
gagccugaccucccucuua

SEQ ID NO: 1353069 - RNA, 19 nt, Homo sapiens
uaaguguacuccagaagaa

SEQ ID NO: 1353070 - RNA, 19 nt, Homo sapiens
cgaggauccuguuaagauu

SEQ ID NO: 1353071 - RNA, 19 nt, Homo sapiens
gcgcagaggcugucagaga

SEQ ID NO: 1353072 - RNA, 19 nt, Homo sapiens
cagaauacaucgauugcau

SEQ ID NO: 1353073 - RNA, 19 nt, Homo sapiens
ccagaccaguguauuucua

SEQ ID NO: 1353074 - RNA, 19 nt, Homo sapiens
gaaacucaucucauccaaa

SEQ ID NO: 1353075 - RNA, 19 nt, Homo sapiens
aagagaaggugagaaguug

SEQ ID NO: 1353076 - RNA, 19 nt, Homo sapiens
gaauacaucgauugcauca

SEQ ID NO: 1353077 - RNA, 19 nt, Homo sapiens
ugacaucagucccuacaag

SEQ ID NO: 1353078 - RNA, 19 nt, Homo sapiens
uaaagaaaauccugacaug

SEQ ID NO: 1353079 - RNA, 19 nt, Homo sapiens
gaucaugccaccaguguag

SEQ ID NO: 1353080 - RNA, 19 nt, Homo sapiens
gcuccugcuuaaauaaauu

SEQ ID NO: 1353081 - RNA, 19 nt, Homo sapiens
gcccugcucugccuaagug

SEQ ID NO: 1353082 - RNA, 19 nt, Homo sapiens
ugacaugcacacccauuaa

SEQ ID NO: 1353083 - RNA, 19 nt, Homo sapiens
ggugagaaguugugaaacg

SEQ ID NO: 1353084 - RNA, 19 nt, Homo sapiens
caacccagcuauggccuau

SEQ ID NO: 1353085 - RNA, 19 nt, Homo sapiens
gccgguaccugcaugacaa

SEQ ID NO: 1353086 - RNA, 19 nt, Homo sapiens
gacaugcacacccauuaaa

SEQ ID NO: 1353087 - RNA, 19 nt, Homo sapiens
aaagugcuccugcuuaaau

SEQ ID NO: 1353088 - RNA, 19 nt, Homo sapiens
gguagggugggauacuuua

SEQ ID NO: 1353089 - RNA, 19 nt, Homo sapiens
caaggacaccagcaacuga

SEQ ID NO: 1353090 - RNA, 19 nt, Homo sapiens
guaccugcaugacaacauc

SEQ ID NO: 1353091 - RNA, 19 nt, Homo sapiens
gcagcucuguguguucuau

SEQ ID NO: 1353092 - RNA, 19 nt, Homo sapiens
gggcagaauacaucgauug

SEQ ID NO: 1353093 - RNA, 19 nt, Homo sapiens
ugaccucccucuuacagau

SEQ ID NO: 1353094 - RNA, 19 nt, Homo sapiens
ggagaagggcaggaagauu

SEQ ID NO: 1353095 - RNA, 19 nt, Homo sapiens
ggacguggugguauuagau

SEQ ID NO: 1353096 - RNA, 19 nt, Homo sapiens
uggaugccauucugacuga

SEQ ID NO: 1353097 - RNA, 19 nt, Homo sapiens
gguguugggcucuucauug

SEQ ID NO: 1353098 - RNA, 19 nt, Homo sapiens
ccaccggcguugaguacuu

SEQ ID NO: 1353099 - RNA, 19 nt, Homo sapiens
ggacaccagcaacugaaga

SEQ ID NO: 1353100 - RNA, 19 nt, Homo sapiens
gaccagaccaguguauuuc

SEQ ID NO: 1353101 - RNA, 19 nt, Homo sapiens
agaccagaccaguguauuu

SEQ ID NO: 1353102 - RNA, 19 nt, Homo sapiens
ccgaggauccuguuaagau

SEQ ID NO: 1353103 - RNA, 19 nt, Homo sapiens
uauuagaucaugcguauca

SEQ ID NO: 1353104 - RNA, 19 nt, Homo sapiens
gaggauccuguuaagauug

SEQ ID NO: 1353105 - RNA, 19 nt, Homo sapiens
cccaagggcaguacaugua

SEQ ID NO: 1353106 - RNA, 19 nt, Homo sapiens
gagaaggugagaaguugug

SEQ ID NO: 1353107 - RNA, 19 nt, Homo sapiens
gcucuucauugguguggau

SEQ ID NO: 1353108 - RNA, 19 nt, Homo sapiens
caucagucccuacaaguuc

SEQ ID NO: 1353109 - RNA, 19 nt, Homo sapiens
ccaggacguggugguauua

SEQ ID NO: 1353110 - RNA, 19 nt, Homo sapiens
aagugcuccugcuuaaaua

SEQ ID NO: 1353111 - RNA, 19 nt, Homo sapiens
uuuaaagugcuccugcuua

SEQ ID NO: 1353112 - RNA, 19 nt, Homo sapiens
cauucugacugacauggaa

SEQ ID NO: 1353113 - RNA, 19 nt, Homo sapiens
agaccaguguauuucuaaa

SEQ ID NO: 1353114 - RNA, 19 nt, Homo sapiens
gcccgaggccauaaugcua

SEQ ID NO: 1353115 - RNA, 19 nt, Homo sapiens
ugaaugucuuggagaagga

SEQ ID NO: 1353116 - RNA, 19 nt, Homo sapiens
accaguguauuucuaaaga

SEQ ID NO: 1353117 - RNA, 19 nt, Homo sapiens
ccucaagucagucaauuuc

SEQ ID NO: 1353118 - RNA, 19 nt, Homo sapiens
ccagugggcaagcgaagaa

SEQ ID NO: 1353119 - RNA, 19 nt, Homo sapiens
gaaggagaacuacguuuug

SEQ ID NO: 1353120 - RNA, 19 nt, Homo sapiens
guguugggcucuucauugg

SEQ ID NO: 1353121 - RNA, 19 nt, Homo sapiens
gaccucccucuuacagaua

SEQ ID NO: 1353122 - RNA, 19 nt, Homo sapiens
ccagaagaaacucaucuca

SEQ ID NO: 1353123 - RNA, 19 nt, Homo sapiens
cuaaguguacuccagaaga

SEQ ID NO: 1353124 - RNA, 19 nt, Homo sapiens
gaaggugagaaguugugaa

SEQ ID NO: 1353125 - RNA, 19 nt, Homo sapiens
caacggcucaucagcucuu

SEQ ID NO: 1353126 - RNA, 19 nt, Homo sapiens
cagaccaguguauuucuaa

SEQ ID NO: 1353127 - RNA, 19 nt, Homo sapiens
agaaacucaucucauccaa

SEQ ID NO: 1353128 - RNA, 19 nt, Homo sapiens
aaggugagaaguugugaaa

SEQ ID NO: 1353129 - RNA, 19 nt, Homo sapiens
cacggcaggugguggcaaa

SEQ ID NO: 1353130 - RNA, 19 nt, Homo sapiens
ucaaagaugaggccacaag

SEQ ID NO: 1353131 - RNA, 19 nt, Homo sapiens
ugagauccagguuggcuuu

SEQ ID NO: 1353132 - RNA, 19 nt, Homo sapiens
cugagucucugcccagugu

SEQ ID NO: 1353133 - RNA, 19 nt, Homo sapiens
guagggugggauacuuuaa

SEQ ID NO: 1353134 - RNA, 19 nt, Homo sapiens
aaagcuggaugccauucug

SEQ ID NO: 1353135 - RNA, 19 nt, Homo sapiens
uguguucuauuuccugaau

SEQ ID NO: 1353136 - RNA, 19 nt, Homo sapiens
uaaagugcuccugcuuaaa

SEQ ID NO: 1353137 - RNA, 19 nt, Homo sapiens
cagaagaaacucaucucau

SEQ ID NO: 1353138 - RNA, 19 nt, Homo sapiens
ccaccugagcucccugauu

SEQ ID NO: 1353139 - RNA, 19 nt, Homo sapiens
ggguagggugggauacuuu

SEQ ID NO: 1353140 - RNA, 19 nt, Homo sapiens
caagucagucaauuuccuu

SEQ ID NO: 1353141 - RNA, 19 nt, Homo sapiens
gugcuccugcuuaaauaaa

SEQ ID NO: 1353142 - RNA, 19 nt, Homo sapiens
gucagucaauuuccuuucu

SEQ ID NO: 1353143 - RNA, 19 nt, Homo sapiens
gcaaagcuggaugccauuc

SEQ ID NO: 1353144 - RNA, 19 nt, Homo sapiens
gcugaaggagaacuacguu

SEQ ID NO: 1353145 - RNA, 19 nt, Homo sapiens
caaggcugaaggagaacua

SEQ ID NO: 1353146 - RNA, 19 nt, Homo sapiens
aaagaugaggccacaagga

SEQ ID NO: 1353147 - RNA, 19 nt, Homo sapiens
ugagcucccugauugacau

SEQ ID NO: 1353148 - RNA, 19 nt, Homo sapiens
aagcagcacaugagcagaa

SEQ ID NO: 1353149 - RNA, 19 nt, Homo sapiens
uagggugggauacuuuaaa

SEQ ID NO: 1353150 - RNA, 19 nt, Homo sapiens
ucagucaauuuccuuucug

SEQ ID NO: 1353151 - RNA, 19 nt, Homo sapiens
gccuaaguguacuccagaa

SEQ ID NO: 1353152 - RNA, 19 nt, Homo sapiens
ggucuuuguugcagaugag

SEQ ID NO: 1353153 - RNA, 19 nt, Homo sapiens
caggagaagggcaggaaga

SEQ ID NO: 1353154 - RNA, 19 nt, Homo sapiens
gggcaagcgaagaaaugaa

SEQ ID NO: 1353155 - RNA, 19 nt, Homo sapiens
guggugguauuagaucaug

SEQ ID NO: 1353156 - RNA, 19 nt, Homo sapiens
ggaucaugccaccagugua

SEQ ID NO: 1353157 - RNA, 19 nt, Homo sapiens
caacagccgguaccugcau

SEQ ID NO: 1353158 - RNA, 19 nt, Homo sapiens
gaacuuggguuuccuuuua

SEQ ID NO: 1353159 - RNA, 19 nt, Homo sapiens
gaaaacagcuuaaggaaca

SEQ ID NO: 1353160 - RNA, 19 nt, Homo sapiens
guacaaaucuccaagaaaa

SEQ ID NO: 1353161 - RNA, 19 nt, Homo sapiens
gcaccgagcuggagacaca

SEQ ID NO: 1353162 - RNA, 19 nt, Homo sapiens
gcgcuaaacugcuggagaa

SEQ ID NO: 1353163 - RNA, 19 nt, Homo sapiens
gaacgcuccauuuguguua

SEQ ID NO: 1353164 - RNA, 19 nt, Homo sapiens
ggaacagauuaaagaauga

SEQ ID NO: 1353165 - RNA, 19 nt, Homo sapiens
guuagugucaucucuauua

SEQ ID NO: 1353166 - RNA, 19 nt, Homo sapiens
gcucuuagcuuacuuuagc

SEQ ID NO: 1353167 - RNA, 19 nt, Homo sapiens
ggaaagaugaguuguguag

SEQ ID NO: 1353168 - RNA, 19 nt, Homo sapiens
gaacaucccuuccccacaa

SEQ ID NO: 1353169 - RNA, 19 nt, Homo sapiens
auuaauagcucuugaguag

SEQ ID NO: 1353170 - RNA, 19 nt, Homo sapiens
augaaugccuuaggaauua

SEQ ID NO: 1353171 - RNA, 19 nt, Homo sapiens
gcaucaagaucauguuagu

SEQ ID NO: 1353172 - RNA, 19 nt, Homo sapiens
ugaguagacuggauggaaa

SEQ ID NO: 1353173 - RNA, 19 nt, Homo sapiens
gaauuuaagagcagacuug

SEQ ID NO: 1353174 - RNA, 19 nt, Homo sapiens
uugcagaacuuguacaaau

SEQ ID NO: 1353175 - RNA, 19 nt, Homo sapiens
uuuaagauguccugugauu

SEQ ID NO: 1353176 - RNA, 19 nt, Homo sapiens
ccuccacgcucaaugauga

SEQ ID NO: 1353177 - RNA, 19 nt, Homo sapiens
uagcuuacuuuagcagaua

SEQ ID NO: 1353178 - RNA, 19 nt, Homo sapiens
gaugaguuguguagguuau

SEQ ID NO: 1353179 - RNA, 19 nt, Homo sapiens
aggaacagauuaaagaaug

SEQ ID NO: 1353180 - RNA, 19 nt, Homo sapiens
uaagcgacauucagaagau

SEQ ID NO: 1353181 - RNA, 19 nt, Homo sapiens
gaacagcgacagcauucug

SEQ ID NO: 1353182 - RNA, 19 nt, Homo sapiens
cagcuuaaggaacagauua

SEQ ID NO: 1353183 - RNA, 19 nt, Homo sapiens
ucaguccaguugacaaauu

SEQ ID NO: 1353184 - RNA, 19 nt, Homo sapiens
cacaggugguggaauuuaa

SEQ ID NO: 1353185 - RNA, 19 nt, Homo sapiens
gagaacagcgacagcauuc

SEQ ID NO: 1353186 - RNA, 19 nt, Homo sapiens
gagaaaaguuugaagaaag

SEQ ID NO: 1353187 - RNA, 19 nt, Homo sapiens
gaaugaaugccuuaggaau

SEQ ID NO: 1353188 - RNA, 19 nt, Homo sapiens
aagaaugaaugccuuagga

SEQ ID NO: 1353189 - RNA, 19 nt, Homo sapiens
gaggaaccuugugaucauu

SEQ ID NO: 1353190 - RNA, 19 nt, Homo sapiens
ugaggaaccuugugaucau

SEQ ID NO: 1353191 - RNA, 19 nt, Homo sapiens
gagcaauucuuaccuucag

SEQ ID NO: 1353192 - RNA, 19 nt, Homo sapiens
aaagaugaguuguguaggu

SEQ ID NO: 1353193 - RNA, 19 nt, Homo sapiens
uaauagcucuugaguagac

SEQ ID NO: 1353194 - RNA, 19 nt, Homo sapiens
cccauaggguccugucuuu

SEQ ID NO: 1353195 - RNA, 19 nt, Homo sapiens
uuucacaggugguggaauu

SEQ ID NO: 1353196 - RNA, 19 nt, Homo sapiens
gcucccaggauccucauua

SEQ ID NO: 1353197 - RNA, 19 nt, Homo sapiens
ugugaacgcuccauuugug

SEQ ID NO: 1353198 - RNA, 19 nt, Homo sapiens
gcaggagccaugaauguuc

SEQ ID NO: 1353199 - RNA, 19 nt, Homo sapiens
gacccgcacucuuccaugu

SEQ ID NO: 1353200 - RNA, 19 nt, Homo sapiens
ucacguggcaguccgguaa

SEQ ID NO: 1353201 - RNA, 19 nt, Homo sapiens
cugcucugcucuuagcuua

SEQ ID NO: 1353202 - RNA, 19 nt, Homo sapiens
ucacaggugguggaauuua

SEQ ID NO: 1353203 - RNA, 19 nt, Homo sapiens
gcauuugcaucaagaucau

SEQ ID NO: 1353204 - RNA, 19 nt, Homo sapiens
uagacuggauggaaagaug

SEQ ID NO: 1353205 - RNA, 19 nt, Homo sapiens
gaagauuugggcagcaguu

SEQ ID NO: 1353206 - RNA, 19 nt, Homo sapiens
ccauuuguguuauugaauc

SEQ ID NO: 1353207 - RNA, 19 nt, Homo sapiens
gagcgucacccaagcuuca

SEQ ID NO: 1353208 - RNA, 19 nt, Homo sapiens
gcugcucgcuggcuguuuc

SEQ ID NO: 1353209 - RNA, 19 nt, Homo sapiens
guaaaccaaggcaguguga

SEQ ID NO: 1353210 - RNA, 19 nt, Homo sapiens
ugaaugccuuaggaauuaa

SEQ ID NO: 1353211 - RNA, 19 nt, Homo sapiens
cgacagcauucugcgcauu

SEQ ID NO: 1353212 - RNA, 19 nt, Homo sapiens
gguggcauuugcaucaaga

SEQ ID NO: 1353213 - RNA, 19 nt, Homo sapiens
ccuuaggaauuaaagcauu

SEQ ID NO: 1353214 - RNA, 19 nt, Homo sapiens
aaugaaugccuuaggaauu

SEQ ID NO: 1353215 - RNA, 19 nt, Homo sapiens
guaagcgacauucagaaga

SEQ ID NO: 1353216 - RNA, 19 nt, Homo sapiens
cucugacccugaugaaaua

SEQ ID NO: 1353217 - RNA, 19 nt, Homo sapiens
ccucugacccugaugaaau

SEQ ID NO: 1353218 - RNA, 19 nt, Homo sapiens
ugaaugaggaguggaaaug

SEQ ID NO: 1353219 - RNA, 19 nt, Homo sapiens
cagcaggagccaugaaugu

SEQ ID NO: 1353220 - RNA, 19 nt, Homo sapiens
aagaugaguuguguagguu

SEQ ID NO: 1353221 - RNA, 19 nt, Homo sapiens
gcagaacuuguacaaaucu

SEQ ID NO: 1353222 - RNA, 19 nt, Homo sapiens
cuucagaggugagcaaugg

SEQ ID NO: 1353223 - RNA, 19 nt, Homo sapiens
caagaaaacagcuuaagga

SEQ ID NO: 1353224 - RNA, 19 nt, Homo sapiens
ccaguugacaaauuccuuu

SEQ ID NO: 1353225 - RNA, 19 nt, Homo sapiens
aggaguaacuugccucucu

SEQ ID NO: 1353226 - RNA, 19 nt, Homo sapiens
cgagaacagcgacagcauu

SEQ ID NO: 1353227 - RNA, 19 nt, Homo sapiens
caagaucauguuaguguca

SEQ ID NO: 1353228 - RNA, 19 nt, Homo sapiens
gaugggaauuucaguacac

SEQ ID NO: 1353229 - RNA, 19 nt, Homo sapiens
gcucuugaguagacuggau

SEQ ID NO: 1353230 - RNA, 19 nt, Homo sapiens
cuacauccagggagcaauu

SEQ ID NO: 1353231 - RNA, 19 nt, Homo sapiens
gcauuaauagcucuugagu

SEQ ID NO: 1353232 - RNA, 19 nt, Homo sapiens
gucacagaauggaagguuu

SEQ ID NO: 1353233 - RNA, 19 nt, Homo sapiens
cuaaacugcuggagaagcu

SEQ ID NO: 1353234 - RNA, 19 nt, Homo sapiens
ccaaggcagugugaacauc

SEQ ID NO: 1353235 - RNA, 19 nt, Homo sapiens
uuucucugcucugcucuua

SEQ ID NO: 1353236 - RNA, 19 nt, Homo sapiens
gauggaaagaugaguugug

SEQ ID NO: 1353237 - RNA, 19 nt, Homo sapiens
cagcauguuccgugucuga

SEQ ID NO: 1353238 - RNA, 19 nt, Homo sapiens
gcguggcgcucagcauguu

SEQ ID NO: 1353239 - RNA, 19 nt, Homo sapiens
ggagcaauucuuaccuuca

SEQ ID NO: 1353240 - RNA, 19 nt, Homo sapiens
gcucugcucuuagcuuacu

SEQ ID NO: 1353241 - RNA, 19 nt, Homo sapiens
guccugugauuccagauuc

SEQ ID NO: 1353242 - RNA, 19 nt, Homo sapiens
gugaggaaccuugugauca

SEQ ID NO: 1353243 - RNA, 19 nt, Homo sapiens
aagcauuaauagcucuuga

SEQ ID NO: 1353244 - RNA, 19 nt, Homo sapiens
gaaugccuuaggaauuaaa

SEQ ID NO: 1353245 - RNA, 19 nt, Homo sapiens
cauccucucugugcuguca

SEQ ID NO: 1353246 - RNA, 19 nt, Homo sapiens
uagcuucgguggcauuugc

SEQ ID NO: 1353247 - RNA, 19 nt, Homo sapiens
gaucugcgaggaguaacuu

SEQ ID NO: 1353248 - RNA, 19 nt, Homo sapiens
caggagccaugaauguucu

SEQ ID NO: 1353249 - RNA, 19 nt, Homo sapiens
ggaaccuugugaucauuuu

SEQ ID NO: 1353250 - RNA, 19 nt, Homo sapiens
ccugugaacgcuccauuug

SEQ ID NO: 1353251 - RNA, 19 nt, Homo sapiens
ugcagaacuuguacaaauc

SEQ ID NO: 1353252 - RNA, 19 nt, Homo sapiens
caguccaguugacaaauuc

SEQ ID NO: 1353253 - RNA, 19 nt, Homo sapiens
gacagcauucugcgcauug

SEQ ID NO: 1353254 - RNA, 19 nt, Homo sapiens
uaagauguccugugauucc

SEQ ID NO: 1353255 - RNA, 19 nt, Homo sapiens
ggcgugugcugcuguugau

SEQ ID NO: 1353256 - RNA, 19 nt, Homo sapiens
uuguacaaaucuccaagaa

SEQ ID NO: 1353257 - RNA, 19 nt, Homo sapiens
ccacagcaccuggcacaca

SEQ ID NO: 1353258 - RNA, 19 nt, Homo sapiens
gcaaagagauguacaggau

SEQ ID NO: 1353259 - RNA, 19 nt, Homo sapiens
gcccaaugcuuuaaccuua

SEQ ID NO: 1353260 - RNA, 19 nt, Homo sapiens
ggagcaaccuguccagaau

SEQ ID NO: 1353261 - RNA, 19 nt, Homo sapiens
gagagaauguggagaugug

SEQ ID NO: 1353262 - RNA, 19 nt, Homo sapiens
caacuacggcgcucuauau

SEQ ID NO: 1353263 - RNA, 19 nt, Homo sapiens
gugaggagaugaugagaga

SEQ ID NO: 1353264 - RNA, 19 nt, Homo sapiens
gcugauacuuugcuuuaga

SEQ ID NO: 1353265 - RNA, 19 nt, Homo sapiens
caggaggacuuacaggaaa

SEQ ID NO: 1353266 - RNA, 19 nt, Homo sapiens
ggaaaucucgacauggaaa

SEQ ID NO: 1353267 - RNA, 19 nt, Homo sapiens
gaaagucagacgaggaaga

SEQ ID NO: 1353268 - RNA, 19 nt, Homo sapiens
gccagaagaugaaguagag

SEQ ID NO: 1353269 - RNA, 19 nt, Homo sapiens
cuacggcgcucuauauuuu

SEQ ID NO: 1353270 - RNA, 19 nt, Homo sapiens
cgauaucccauaccuuuaa

SEQ ID NO: 1353271 - RNA, 19 nt, Homo sapiens
cacgauaucccauaccuuu

SEQ ID NO: 1353272 - RNA, 19 nt, Homo sapiens
aaaggcaucugagcaguga

SEQ ID NO: 1353273 - RNA, 19 nt, Homo sapiens
uuagaugucagucucguua

SEQ ID NO: 1353274 - RNA, 19 nt, Homo sapiens
gauaucccauaccuuuaau

SEQ ID NO: 1353275 - RNA, 19 nt, Homo sapiens
gaugagagaauguggagau

SEQ ID NO: 1353276 - RNA, 19 nt, Homo sapiens
aaguagagccugaugauga

SEQ ID NO: 1353277 - RNA, 19 nt, Homo sapiens
cagaggggcuuacacgaua

SEQ ID NO: 1353278 - RNA, 19 nt, Homo sapiens
agggacaacuggaagauga

SEQ ID NO: 1353279 - RNA, 19 nt, Homo sapiens
gggaaagccagaagaugaa

SEQ ID NO: 1353280 - RNA, 19 nt, Homo sapiens
ggccuuccauucugauuuc

SEQ ID NO: 1353281 - RNA, 19 nt, Homo sapiens
gaggagaugaugagagaau

SEQ ID NO: 1353282 - RNA, 19 nt, Homo sapiens
gaugagggaagccaggaaa

SEQ ID NO: 1353283 - RNA, 19 nt, Homo sapiens
aguagagccugaugaugaa

SEQ ID NO: 1353284 - RNA, 19 nt, Homo sapiens
gaaguagagccugaugaug

SEQ ID NO: 1353285 - RNA, 19 nt, Homo sapiens
aaagccagaagaugaagua

SEQ ID NO: 1353286 - RNA, 19 nt, Homo sapiens
ccaacuacggcgcucuaua

SEQ ID NO: 1353287 - RNA, 19 nt, Homo sapiens
aaccuuaagcugauacuuu

SEQ ID NO: 1353288 - RNA, 19 nt, Homo sapiens
auacuuugcuuuagauguc

SEQ ID NO: 1353289 - RNA, 19 nt, Homo sapiens
gagauguacaggauccauu

SEQ ID NO: 1353290 - RNA, 19 nt, Homo sapiens
ucaagaggagcuaaggaaa

SEQ ID NO: 1353291 - RNA, 19 nt, Homo sapiens
ggggaaaucucgacaugga

SEQ ID NO: 1353292 - RNA, 19 nt, Homo sapiens
gcagugaggagaugaugag

SEQ ID NO: 1353293 - RNA, 19 nt, Homo sapiens
agggaaagccagaagauga

SEQ ID NO: 1353294 - RNA, 19 nt, Homo sapiens
accuuaagcugauacuuug

SEQ ID NO: 1353295 - RNA, 19 nt, Homo sapiens
ugaaguagagccugaugau

SEQ ID NO: 1353296 - RNA, 19 nt, Homo sapiens
auucugauuucucugauga

SEQ ID NO: 1353297 - RNA, 19 nt, Homo sapiens
ucaggaggacuuacaggaa

SEQ ID NO: 1353298 - RNA, 19 nt, Homo sapiens
ggagaugaugagagaaugu

SEQ ID NO: 1353299 - RNA, 19 nt, Homo sapiens
ggaaaagauguucauggua

SEQ ID NO: 1353300 - RNA, 19 nt, Homo sapiens
ccauaccuuuaaugccuuu

SEQ ID NO: 1353301 - RNA, 19 nt, Homo sapiens
gaggggaaaucucgacaug

SEQ ID NO: 1353302 - RNA, 19 nt, Homo sapiens
gcuuacacgauaucccaua

SEQ ID NO: 1353303 - RNA, 19 nt, Homo sapiens
uuacaggaaaggcaucuga

SEQ ID NO: 1353304 - RNA, 19 nt, Homo sapiens
ggacucucaggaggacuua

SEQ ID NO: 1353305 - RNA, 19 nt, Homo sapiens
aaagucagacgaggaagaa

SEQ ID NO: 1353306 - RNA, 19 nt, Homo sapiens
gagggaaagccagaagaug

SEQ ID NO: 1353307 - RNA, 19 nt, Homo sapiens
gauacuuugcuuuagaugu

SEQ ID NO: 1353308 - RNA, 19 nt, Homo sapiens
ggcccugcuuucccuggua

SEQ ID NO: 1353309 - RNA, 19 nt, Homo sapiens
uucauuggaugcaaagaga

SEQ ID NO: 1353310 - RNA, 19 nt, Homo sapiens
agaaugcgagggaaagaga

SEQ ID NO: 1353311 - RNA, 19 nt, Homo sapiens
agacagaaugcgagggaaa

SEQ ID NO: 1353312 - RNA, 19 nt, Homo sapiens
ugccaggcccaaugcuuua

SEQ ID NO: 1353313 - RNA, 19 nt, Homo sapiens
caagaggagcuaaggaaaa

SEQ ID NO: 1353314 - RNA, 19 nt, Homo sapiens
gagaugaugagagaaugug

SEQ ID NO: 1353315 - RNA, 19 nt, Homo sapiens
gaaagccagaagaugaagu

SEQ ID NO: 1353316 - RNA, 19 nt, Homo sapiens
gaugaaguagagccugaug

SEQ ID NO: 1353317 - RNA, 19 nt, Homo sapiens
cgagggaaagccagaagau

SEQ ID NO: 1353318 - RNA, 19 nt, Homo sapiens
cugauacuuugcuuuagau

SEQ ID NO: 1353319 - RNA, 19 nt, Homo sapiens
gagcaaccuguccagaauc

SEQ ID NO: 1353320 - RNA, 19 nt, Homo sapiens
guauuugccaggcccaaug

SEQ ID NO: 1353321 - RNA, 19 nt, Homo sapiens
gggaaaucucgacauggaa

SEQ ID NO: 1353322 - RNA, 19 nt, Homo sapiens
gagcagugaggagaugaug

SEQ ID NO: 1353323 - RNA, 19 nt, Homo sapiens
aaaugaaggaaaccuggaa

SEQ ID NO: 1353324 - RNA, 19 nt, Homo sapiens
aaggaaaccuggaaaacga

SEQ ID NO: 1353325 - RNA, 19 nt, Homo sapiens
gcagaaagcuguuuaagua

SEQ ID NO: 1353326 - RNA, 19 nt, Homo sapiens
ggaauuugcuucaacauug

SEQ ID NO: 1353327 - RNA, 19 nt, Homo sapiens
ggaaugguauuguggaauu

SEQ ID NO: 1353328 - RNA, 19 nt, Homo sapiens
ggaauuauguugucaugug

SEQ ID NO: 1353329 - RNA, 19 nt, Homo sapiens
gauagcaguuccuuguaua

SEQ ID NO: 1353330 - RNA, 19 nt, Homo sapiens
gagaauaugaugucaagua

SEQ ID NO: 1353331 - RNA, 19 nt, Homo sapiens
gacagggucuucuauguug

SEQ ID NO: 1353332 - RNA, 19 nt, Homo sapiens
cagcugcgcuucagaauuc

SEQ ID NO: 1353333 - RNA, 19 nt, Homo sapiens
ggauagcaguuccuuguau

SEQ ID NO: 1353334 - RNA, 19 nt, Homo sapiens
gcaagucgaauauuuaaug

SEQ ID NO: 1353335 - RNA, 19 nt, Homo sapiens
guacauagugcacuguuaa

SEQ ID NO: 1353336 - RNA, 19 nt, Homo sapiens
ggacugaguuucggcuuug

SEQ ID NO: 1353337 - RNA, 19 nt, Homo sapiens
ccauuguugugaccuauua

SEQ ID NO: 1353338 - RNA, 19 nt, Homo sapiens
uaaaaugacuggaugugua

SEQ ID NO: 1353339 - RNA, 19 nt, Homo sapiens
gcaggaauuugcuucaaca

SEQ ID NO: 1353340 - RNA, 19 nt, Homo sapiens
ggauguguauaaaggaauu

SEQ ID NO: 1353341 - RNA, 19 nt, Homo sapiens
gguacauagugcacuguua

SEQ ID NO: 1353342 - RNA, 19 nt, Homo sapiens
guugugaccuauuauguug

SEQ ID NO: 1353343 - RNA, 19 nt, Homo sapiens
ggaaaauugugacuuugua

SEQ ID NO: 1353344 - RNA, 19 nt, Homo sapiens
ugaagugaaugguuaaaca

SEQ ID NO: 1353345 - RNA, 19 nt, Homo sapiens
gugccuggcuggacaugua

SEQ ID NO: 1353346 - RNA, 19 nt, Homo sapiens
cagggaagauccuuagaau

SEQ ID NO: 1353347 - RNA, 19 nt, Homo sapiens
aaagaaaacuuccacacua

SEQ ID NO: 1353348 - RNA, 19 nt, Homo sapiens
cacaucaggucgacucgua

SEQ ID NO: 1353349 - RNA, 19 nt, Homo sapiens
cuccacagcuguugagaaa

SEQ ID NO: 1353350 - RNA, 19 nt, Homo sapiens
gggaagauccuuagaaucg

SEQ ID NO: 1353351 - RNA, 19 nt, Homo sapiens
gaaguacuauuuugcaaug

SEQ ID NO: 1353352 - RNA, 19 nt, Homo sapiens
agaagucagugauacagaa

SEQ ID NO: 1353353 - RNA, 19 nt, Homo sapiens
gcuugucaguuuaucaauu

SEQ ID NO: 1353354 - RNA, 19 nt, Homo sapiens
ggaauuggagaauaugaug

SEQ ID NO: 1353355 - RNA, 19 nt, Homo sapiens
ccuauuauguugacuucuu

SEQ ID NO: 1353356 - RNA, 19 nt, Homo sapiens
cuggagagcugauuugaca

SEQ ID NO: 1353357 - RNA, 19 nt, Homo sapiens
uggcagacccuaacagaaa

SEQ ID NO: 1353358 - RNA, 19 nt, Homo sapiens
gcaauguuaaucuguuuga

SEQ ID NO: 1353359 - RNA, 19 nt, Homo sapiens
gaaaagcuacaguguguuu

SEQ ID NO: 1353360 - RNA, 19 nt, Homo sapiens
cauucuggauucuggauuu

SEQ ID NO: 1353361 - RNA, 19 nt, Homo sapiens
cgacucguauguaccaaug

SEQ ID NO: 1353362 - RNA, 19 nt, Homo sapiens
cauagugcacuguuaauau

SEQ ID NO: 1353363 - RNA, 19 nt, Homo sapiens
gaaugguauuguggaauug

SEQ ID NO: 1353364 - RNA, 19 nt, Homo sapiens
gaccuauuauguugacuuc

SEQ ID NO: 1353365 - RNA, 19 nt, Homo sapiens
guguuucacuucaggauug

SEQ ID NO: 1353366 - RNA, 19 nt, Homo sapiens
cagaaaagcuacagugugu

SEQ ID NO: 1353367 - RNA, 19 nt, Homo sapiens
ggcuggacauguaaauuug

SEQ ID NO: 1353368 - RNA, 19 nt, Homo sapiens
cauuaccacugccuccuuu

SEQ ID NO: 1353369 - RNA, 19 nt, Homo sapiens
ccuuguugcuugucaguuu

SEQ ID NO: 1353370 - RNA, 19 nt, Homo sapiens
agucagugauacagaagua

SEQ ID NO: 1353371 - RNA, 19 nt, Homo sapiens
gaagugaaugguuaaacau

SEQ ID NO: 1353372 - RNA, 19 nt, Homo sapiens
cuuaaggauuuaccagaaa

SEQ ID NO: 1353373 - RNA, 19 nt, Homo sapiens
ucacacuccuuggaugauu

SEQ ID NO: 1353374 - RNA, 19 nt, Homo sapiens
gaauuugcuucaacauugc

SEQ ID NO: 1353375 - RNA, 19 nt, Homo sapiens
cuugucaguuuaucaauug

SEQ ID NO: 1353376 - RNA, 19 nt, Homo sapiens
gcagugccuuguugcuugu

SEQ ID NO: 1353377 - RNA, 19 nt, Homo sapiens
cagaaagcuguuuaaguaa

SEQ ID NO: 1353378 - RNA, 19 nt, Homo sapiens
ggacauguaaauuugaagu

SEQ ID NO: 1353379 - RNA, 19 nt, Homo sapiens
gcuucaacauugcuuuaug

SEQ ID NO: 1353380 - RNA, 19 nt, Homo sapiens
ucuuaaggauuuaccagaa

SEQ ID NO: 1353381 - RNA, 19 nt, Homo sapiens
uggcuggacauguaaauuu

SEQ ID NO: 1353382 - RNA, 19 nt, Homo sapiens
gaacuccugggaucaagug

SEQ ID NO: 1353383 - RNA, 19 nt, Homo sapiens
uggagaauaugaugucaag

SEQ ID NO: 1353384 - RNA, 19 nt, Homo sapiens
cuuugcaagucgaauauuu

SEQ ID NO: 1353385 - RNA, 19 nt, Homo sapiens
ccuuuaaccagcuuuagua

SEQ ID NO: 1353386 - RNA, 19 nt, Homo sapiens
gacuggauguguauaaagg

SEQ ID NO: 1353387 - RNA, 19 nt, Homo sapiens
gggauagcaguuccuugua

SEQ ID NO: 1353388 - RNA, 19 nt, Homo sapiens
ugccucagccuucgaagua

SEQ ID NO: 1353389 - RNA, 19 nt, Homo sapiens
gaugauuuccgaagagaca

SEQ ID NO: 1353390 - RNA, 19 nt, Homo sapiens
acaaugaugugcgcagugu

SEQ ID NO: 1353391 - RNA, 19 nt, Homo sapiens
gcaguuccuuguauaaaau

SEQ ID NO: 1353392 - RNA, 19 nt, Homo sapiens
ucacuccauuguuguuguu

SEQ ID NO: 1353393 - RNA, 19 nt, Homo sapiens
ggugacaggaccaaaugaa

SEQ ID NO: 1353394 - RNA, 19 nt, Homo sapiens
guuugagucuuuggagaaa

SEQ ID NO: 1353395 - RNA, 19 nt, Homo sapiens
guuguuguuuacccaguuu

SEQ ID NO: 1353396 - RNA, 19 nt, Homo sapiens
ucagggaagauccuuagaa

SEQ ID NO: 1353397 - RNA, 19 nt, Homo sapiens
cacacuccuuggaugauuu

SEQ ID NO: 1353398 - RNA, 19 nt, Homo sapiens
aauaugaugucaaguaucc

SEQ ID NO: 1353399 - RNA, 19 nt, Homo sapiens
cuuguugcuugucaguuua

SEQ ID NO: 1353400 - RNA, 19 nt, Homo sapiens
acuagcagcugguuucucu

SEQ ID NO: 1353401 - RNA, 19 nt, Homo sapiens
caggauugcuuguaauagc

SEQ ID NO: 1353402 - RNA, 19 nt, Homo sapiens
gugacaggaccaaaugaaa

SEQ ID NO: 1353403 - RNA, 19 nt, Homo sapiens
acauagugcacuguuaaua

SEQ ID NO: 1353404 - RNA, 19 nt, Homo sapiens
guuaaucuguuugagucuu

SEQ ID NO: 1353405 - RNA, 19 nt, Homo sapiens
cauccauuguugugaccua

SEQ ID NO: 1353406 - RNA, 19 nt, Homo sapiens
aaggaauuauguugucaug

SEQ ID NO: 1353407 - RNA, 19 nt, Homo sapiens
aguucacucuuccauuuaa

SEQ ID NO: 1353408 - RNA, 19 nt, Homo sapiens
aaugaugugcgcaguguuu

SEQ ID NO: 1353409 - RNA, 19 nt, Homo sapiens
uaucacacuccuuggauga

SEQ ID NO: 1353410 - RNA, 19 nt, Homo sapiens
acuccauuguuguuguuua

SEQ ID NO: 1353411 - RNA, 19 nt, Homo sapiens
cuucaacauugcuuuaugg

SEQ ID NO: 1353412 - RNA, 19 nt, Homo sapiens
accacugccuccuuuauug

SEQ ID NO: 1353413 - RNA, 19 nt, Homo sapiens
gaauuggagaauaugaugu

SEQ ID NO: 1353414 - RNA, 19 nt, Homo sapiens
caaagggaaguguggaaca

SEQ ID NO: 1353415 - RNA, 19 nt, Homo sapiens
uauguacauuacuggguuu

SEQ ID NO: 1353416 - RNA, 19 nt, Homo sapiens
uagcaguuccuuguauaaa

SEQ ID NO: 1353417 - RNA, 19 nt, Homo sapiens
ugcccaggcugucuuugaa

SEQ ID NO: 1353418 - RNA, 19 nt, Homo sapiens
gaauaugaugucaaguauc

SEQ ID NO: 1353419 - RNA, 19 nt, Homo sapiens
uauguugucaugugccuuu

SEQ ID NO: 1353420 - RNA, 19 nt, Homo sapiens
gaagucagugauacagaag

SEQ ID NO: 1353421 - RNA, 19 nt, Homo sapiens
uauuuaaugucagggaaga

SEQ ID NO: 1353422 - RNA, 19 nt, Homo sapiens
cugcauagucuaccuggaa

SEQ ID NO: 1353423 - RNA, 19 nt, Homo sapiens
ucaggucgacucguaugua

SEQ ID NO: 1353424 - RNA, 19 nt, Homo sapiens
acuucaggauugcuuguaa

SEQ ID NO: 1353425 - RNA, 19 nt, Homo sapiens
gcacagaucagagaagcua

SEQ ID NO: 1353426 - RNA, 19 nt, Homo sapiens
gcaacaaccucuggcucuu

SEQ ID NO: 1353427 - RNA, 19 nt, Homo sapiens
gaaguuuccauacccuuug

SEQ ID NO: 1353428 - RNA, 19 nt, Homo sapiens
uugcagauguucauucaga

SEQ ID NO: 1353429 - RNA, 19 nt, Homo sapiens
gcuugcagauguucauuca

SEQ ID NO: 1353430 - RNA, 19 nt, Homo sapiens
ccuguacacucugucauuu

SEQ ID NO: 1353431 - RNA, 19 nt, Homo sapiens
ccaggagguuggagcagaa

SEQ ID NO: 1353432 - RNA, 19 nt, Homo sapiens
gccuuuggcuugcagaugu

SEQ ID NO: 1353433 - RNA, 19 nt, Homo sapiens
gcuuauccuucucuccaaa

SEQ ID NO: 1353434 - RNA, 19 nt, Homo sapiens
gacaggagcacagaucaga

SEQ ID NO: 1353435 - RNA, 19 nt, Homo sapiens
gaguggagucggagaaaug

SEQ ID NO: 1353436 - RNA, 19 nt, Homo sapiens
guauugggaugcauguucu

SEQ ID NO: 1353437 - RNA, 19 nt, Homo sapiens
gaaggggccuguacacucu

SEQ ID NO: 1353438 - RNA, 19 nt, Homo sapiens
gguauugggaugcauguuc

SEQ ID NO: 1353439 - RNA, 19 nt, Homo sapiens
ugacaaacaccugcagaug

SEQ ID NO: 1353440 - RNA, 19 nt, Homo sapiens
gagaguggagucggagaaa

SEQ ID NO: 1353441 - RNA, 19 nt, Homo sapiens
caacaaguccaaggugaca

SEQ ID NO: 1353442 - RNA, 19 nt, Homo sapiens
gcaggaggagucuggaaca

SEQ ID NO: 1353443 - RNA, 19 nt, Homo sapiens
ccaaagacaggagcacaga

SEQ ID NO: 1353444 - RNA, 19 nt, Homo sapiens
ggugguguuucuccucuag

SEQ ID NO: 1353445 - RNA, 19 nt, Homo sapiens
cagcagagagggugugucu

SEQ ID NO: 1353446 - RNA, 19 nt, Homo sapiens
ugccaaccauggugaacuu

SEQ ID NO: 1353447 - RNA, 19 nt, Homo sapiens
caggagcacagaucagaga

SEQ ID NO: 1353448 - RNA, 19 nt, Homo sapiens
caacaaccucuggcucuuc

SEQ ID NO: 1353449 - RNA, 19 nt, Homo sapiens
caggcucuguggucagcua

SEQ ID NO: 1353450 - RNA, 19 nt, Homo sapiens
aaagacaggagcacagauc

SEQ ID NO: 1353451 - RNA, 19 nt, Homo sapiens
uaaauggcuuauccuucuc

SEQ ID NO: 1353452 - RNA, 19 nt, Homo sapiens
ccagucacacgccuucaug

SEQ ID NO: 1353453 - RNA, 19 nt, Homo sapiens
gccuguacacucugucauu

SEQ ID NO: 1353454 - RNA, 19 nt, Homo sapiens
ggcgugggguuaauaaaug

SEQ ID NO: 1353455 - RNA, 19 nt, Homo sapiens
agauguucauucagaggaa

SEQ ID NO: 1353456 - RNA, 19 nt, Homo sapiens
cgagaguggagucggagaa

SEQ ID NO: 1353457 - RNA, 19 nt, Homo sapiens
uaaaggaucugacuuguaa

SEQ ID NO: 1353458 - RNA, 19 nt, Homo sapiens
gcacagacuuauacucuua

SEQ ID NO: 1353459 - RNA, 19 nt, Homo sapiens
gcaaauagaguuuaaguga

SEQ ID NO: 1353460 - RNA, 19 nt, Homo sapiens
gagaaucuguggucaguuu

SEQ ID NO: 1353461 - RNA, 19 nt, Homo sapiens
uuacugaucugaugaauga

SEQ ID NO: 1353462 - RNA, 19 nt, Homo sapiens
ggugaaagauccaacuaaa

SEQ ID NO: 1353463 - RNA, 19 nt, Homo sapiens
ggagaucuguccugacuug

SEQ ID NO: 1353464 - RNA, 19 nt, Homo sapiens
cagcuuauccucauauaua

SEQ ID NO: 1353465 - RNA, 19 nt, Homo sapiens
ugauauugcuguagguuua

SEQ ID NO: 1353466 - RNA, 19 nt, Homo sapiens
ggaugccuauguuguaaua

SEQ ID NO: 1353467 - RNA, 19 nt, Homo sapiens
gaacagagccccauuguau

SEQ ID NO: 1353468 - RNA, 19 nt, Homo sapiens
gcgggugcaucuacauuua

SEQ ID NO: 1353469 - RNA, 19 nt, Homo sapiens
ugaaugagaucaaagaaag

SEQ ID NO: 1353470 - RNA, 19 nt, Homo sapiens
caugaaacuuugugaagaa

SEQ ID NO: 1353471 - RNA, 19 nt, Homo sapiens
uuaaauggcucaccuaguc

SEQ ID NO: 1353472 - RNA, 19 nt, Homo sapiens
gaaaguaccguaagauaac

SEQ ID NO: 1353473 - RNA, 19 nt, Homo sapiens
ggaaauggagacacagaaa

SEQ ID NO: 1353474 - RNA, 19 nt, Homo sapiens
ggaggaaaaugcagaaauu

SEQ ID NO: 1353475 - RNA, 19 nt, Homo sapiens
gauaacaucuaaucuagcu

SEQ ID NO: 1353476 - RNA, 19 nt, Homo sapiens
guaauaccauaaagugaga

SEQ ID NO: 1353477 - RNA, 19 nt, Homo sapiens
ugacuuggaugccuauguu

SEQ ID NO: 1353478 - RNA, 19 nt, Homo sapiens
ggaaauaaacacauaaagg

SEQ ID NO: 1353479 - RNA, 19 nt, Homo sapiens
caucuaaucuagcuuucuu

SEQ ID NO: 1353480 - RNA, 19 nt, Homo sapiens
ugaaacagaugaaauacag

SEQ ID NO: 1353481 - RNA, 19 nt, Homo sapiens
gugaauuucucaagguauu

SEQ ID NO: 1353482 - RNA, 19 nt, Homo sapiens
gaacuuggcacagacuuau

SEQ ID NO: 1353483 - RNA, 19 nt, Homo sapiens
uaauuaaucugagcacaug

SEQ ID NO: 1353484 - RNA, 19 nt, Homo sapiens
agaaaguaccguaagauaa

SEQ ID NO: 1353485 - RNA, 19 nt, Homo sapiens
uagaaaguaccguaagaua

SEQ ID NO: 1353486 - RNA, 19 nt, Homo sapiens
uguuacagcucuaugcuuu

SEQ ID NO: 1353487 - RNA, 19 nt, Homo sapiens
uuaaucagcuuugucagaa

SEQ ID NO: 1353488 - RNA, 19 nt, Homo sapiens
gaaacaugcuucuaaaaca

SEQ ID NO: 1353489 - RNA, 19 nt, Homo sapiens
ugaggcaaauagaguuuaa

SEQ ID NO: 1353490 - RNA, 19 nt, Homo sapiens
gaaauggagacacagaaau

SEQ ID NO: 1353491 - RNA, 19 nt, Homo sapiens
gaaagccaacauucauuga

SEQ ID NO: 1353492 - RNA, 19 nt, Homo sapiens
uacuguaacuuugcucuua

SEQ ID NO: 1353493 - RNA, 19 nt, Homo sapiens
agacuuauacucuuacuga

SEQ ID NO: 1353494 - RNA, 19 nt, Homo sapiens
gaucuguccugacuuggau

SEQ ID NO: 1353495 - RNA, 19 nt, Homo sapiens
gagaucaaagaaaguagua

SEQ ID NO: 1353496 - RNA, 19 nt, Homo sapiens
uaagugaauuucucaaggu

SEQ ID NO: 1353497 - RNA, 19 nt, Homo sapiens
uggcucagauaguugauuu

SEQ ID NO: 1353498 - RNA, 19 nt, Homo sapiens
uggauuauaugguguuaug

SEQ ID NO: 1353499 - RNA, 19 nt, Homo sapiens
gccuggaaauaaacacaua

SEQ ID NO: 1353500 - RNA, 19 nt, Homo sapiens
ucaugaaacuuugugaaga

SEQ ID NO: 1353501 - RNA, 19 nt, Homo sapiens
uugaagcacuuuaagaguu

SEQ ID NO: 1353502 - RNA, 19 nt, Homo sapiens
ccucauauauaaggaaaug

SEQ ID NO: 1353503 - RNA, 19 nt, Homo sapiens
gcucuaugcuuuaugaaaa

SEQ ID NO: 1353504 - RNA, 19 nt, Homo sapiens
ucaacgcauuguaauaaga

SEQ ID NO: 1353505 - RNA, 19 nt, Homo sapiens
ugaagcacuuuaagaguuc

SEQ ID NO: 1353506 - RNA, 19 nt, Homo sapiens
gcuaucagcgugaaucaug

SEQ ID NO: 1353507 - RNA, 19 nt, Homo sapiens
cauaaaggaucugacuugu

SEQ ID NO: 1353508 - RNA, 19 nt, Homo sapiens
ggagacacagaaauuaaau

SEQ ID NO: 1353509 - RNA, 19 nt, Homo sapiens
acagcucuaugcuuuauga

SEQ ID NO: 1353510 - RNA, 19 nt, Homo sapiens
cagcgugaaucauguaaag

SEQ ID NO: 1353511 - RNA, 19 nt, Homo sapiens
ucuagaaaguaccguaaga

SEQ ID NO: 1353512 - RNA, 19 nt, Homo sapiens
aaauggagacacagaaauu

SEQ ID NO: 1353513 - RNA, 19 nt, Homo sapiens
uuacagcucuaugcuuuau

SEQ ID NO: 1353514 - RNA, 19 nt, Homo sapiens
gaucaaagaaaguaguaca

SEQ ID NO: 1353515 - RNA, 19 nt, Homo sapiens
caacgcauuguaauaagaa

SEQ ID NO: 1353516 - RNA, 19 nt, Homo sapiens
gaugggcagcuaguacuua

SEQ ID NO: 1353517 - RNA, 19 nt, Homo sapiens
gaugagcugugaggcaaau

SEQ ID NO: 1353518 - RNA, 19 nt, Homo sapiens
cucagaauguuuagaagaa

SEQ ID NO: 1353519 - RNA, 19 nt, Homo sapiens
acucucagcuggacccauu

SEQ ID NO: 1353520 - RNA, 19 nt, Homo sapiens
cuagaaucaugaaacuuug

SEQ ID NO: 1353521 - RNA, 19 nt, Homo sapiens
cugagcacauggauuauau

SEQ ID NO: 1353522 - RNA, 19 nt, Homo sapiens
gcucagaauguuuagaaga

SEQ ID NO: 1353523 - RNA, 19 nt, Homo sapiens
gaguuuaagugaauuucuc

SEQ ID NO: 1353524 - RNA, 19 nt, Homo sapiens
auaaggaaauggagacaca

SEQ ID NO: 1353525 - RNA, 19 nt, Homo sapiens
ucaguuugcucagaauguu

SEQ ID NO: 1353526 - RNA, 19 nt, Homo sapiens
gaaaguaguacaaaacuca

SEQ ID NO: 1353527 - RNA, 19 nt, Homo sapiens
cagaaagccaacauucauu

SEQ ID NO: 1353528 - RNA, 19 nt, Homo sapiens
gguuuaacuugccaacaug

SEQ ID NO: 1353529 - RNA, 19 nt, Homo sapiens
ugaaagauccaacuaaagc

SEQ ID NO: 1353530 - RNA, 19 nt, Homo sapiens
ggccuacuguaccucauga

SEQ ID NO: 1353531 - RNA, 19 nt, Homo sapiens
ucagaaagccaacauucau

SEQ ID NO: 1353532 - RNA, 19 nt, Homo sapiens
acauaaaggaucugacuug

SEQ ID NO: 1353533 - RNA, 19 nt, Homo sapiens
uuauugcccugacuaugaa

SEQ ID NO: 1353534 - RNA, 19 nt, Homo sapiens
gggugcaucuacauuuaau

SEQ ID NO: 1353535 - RNA, 19 nt, Homo sapiens
gaugaaugagaucaaagaa

SEQ ID NO: 1353536 - RNA, 19 nt, Homo sapiens
agagagcaauagcugagaa

SEQ ID NO: 1353537 - RNA, 19 nt, Homo sapiens
aagugaauuucucaaggua

SEQ ID NO: 1353538 - RNA, 19 nt, Homo sapiens
cuuauugcccugacuauga

SEQ ID NO: 1353539 - RNA, 19 nt, Homo sapiens
agaaagccaacauucauug

SEQ ID NO: 1353540 - RNA, 19 nt, Homo sapiens
agaaucaaauggagaucug

SEQ ID NO: 1353541 - RNA, 19 nt, Homo sapiens
gugaaaagcugagaaucaa

SEQ ID NO: 1353542 - RNA, 19 nt, Homo sapiens
cuuauacucuuacugaucu

SEQ ID NO: 1353543 - RNA, 19 nt, Homo sapiens
gagcaauagcugagaaucu

SEQ ID NO: 1353544 - RNA, 19 nt, Homo sapiens
gagaaagccaaaagaagua

SEQ ID NO: 1353545 - RNA, 19 nt, Homo sapiens
cauggauuauaugguguua

SEQ ID NO: 1353546 - RNA, 19 nt, Homo sapiens
guggucaguuugcucagaa

SEQ ID NO: 1353547 - RNA, 19 nt, Homo sapiens
guuguaauaccauaaagug

SEQ ID NO: 1353548 - RNA, 19 nt, Homo sapiens
gaaaagcugagaaucaaau

SEQ ID NO: 1353549 - RNA, 19 nt, Homo sapiens
gggugaaagauccaacuaa

SEQ ID NO: 1353550 - RNA, 19 nt, Homo sapiens
cagaauguuuagaagaaag

SEQ ID NO: 1353551 - RNA, 19 nt, Homo sapiens
aauggagacacagaaauua

SEQ ID NO: 1353552 - RNA, 19 nt, Homo sapiens
gauauugcuguagguuuaa

SEQ ID NO: 1353553 - RNA, 19 nt, Homo sapiens
aauaacagaugcgggugaa

SEQ ID NO: 1353554 - RNA, 19 nt, Homo sapiens
ggcacagacuuauacucuu

SEQ ID NO: 1353555 - RNA, 19 nt, Homo sapiens
gaaacagaugaaauacaga

SEQ ID NO: 1353556 - RNA, 19 nt, Homo sapiens
cgugaaucauguaaagaga

SEQ ID NO: 1353557 - RNA, 19 nt, Homo sapiens
gcacacagcuuucaauguc

SEQ ID NO: 1353558 - RNA, 19 nt, Homo sapiens
gaaagaauccucaaaccaa

SEQ ID NO: 1353559 - RNA, 19 nt, Homo sapiens
gaaggaugauuucguuaug

SEQ ID NO: 1353560 - RNA, 19 nt, Homo sapiens
gauuaccucuucugucuuu

SEQ ID NO: 1353561 - RNA, 19 nt, Homo sapiens
ggacuuggguggcuacuac

SEQ ID NO: 1353562 - RNA, 19 nt, Homo sapiens
gacaguggacauauuguua

SEQ ID NO: 1353563 - RNA, 19 nt, Homo sapiens
aaauacagauuaccucuuc

SEQ ID NO: 1353564 - RNA, 19 nt, Homo sapiens
gagaagaguuccuguuuug

SEQ ID NO: 1353565 - RNA, 19 nt, Homo sapiens
guggacauauuguuaaaug

SEQ ID NO: 1353566 - RNA, 19 nt, Homo sapiens
gacaauggaucauauuagg

SEQ ID NO: 1353567 - RNA, 19 nt, Homo sapiens
gaacagacauuuucuuacu

SEQ ID NO: 1353568 - RNA, 19 nt, Homo sapiens
guggagcccuuugucaaua

SEQ ID NO: 1353569 - RNA, 19 nt, Homo sapiens
gcccauaucuggaaacaac

SEQ ID NO: 1353570 - RNA, 19 nt, Homo sapiens
ggaaggaugauuucguuau

SEQ ID NO: 1353571 - RNA, 19 nt, Homo sapiens
ucaaagacccaaauguuau

SEQ ID NO: 1353572 - RNA, 19 nt, Homo sapiens
gaaagcaaacaccaagaug

SEQ ID NO: 1353573 - RNA, 19 nt, Homo sapiens
auaaggaucuggugagugu

SEQ ID NO: 1353574 - RNA, 19 nt, Homo sapiens
ugugauccauuucucauuu

SEQ ID NO: 1353575 - RNA, 19 nt, Homo sapiens
gaagauauuguacgagaca

SEQ ID NO: 1353576 - RNA, 19 nt, Homo sapiens
auuaggaacugaagugaaa

SEQ ID NO: 1353577 - RNA, 19 nt, Homo sapiens
caaagacccaaauguuauu

SEQ ID NO: 1353578 - RNA, 19 nt, Homo sapiens
uagagaagaguuccuguuu

SEQ ID NO: 1353579 - RNA, 19 nt, Homo sapiens
ggacaauggaucauauuag

SEQ ID NO: 1353580 - RNA, 19 nt, Homo sapiens
gaugaguuacgaagaguuu

SEQ ID NO: 1353581 - RNA, 19 nt, Homo sapiens
caauggaucauauuaggaa

SEQ ID NO: 1353582 - RNA, 19 nt, Homo sapiens
gcugguaugugcuauccuu

SEQ ID NO: 1353583 - RNA, 19 nt, Homo sapiens
guacgagacaguggacaua

SEQ ID NO: 1353584 - RNA, 19 nt, Homo sapiens
gaucauauuaggaacugaa

SEQ ID NO: 1353585 - RNA, 19 nt, Homo sapiens
gauuauguaccucuacuau

SEQ ID NO: 1353586 - RNA, 19 nt, Homo sapiens
gcaaagaaucaugaacaga

SEQ ID NO: 1353587 - RNA, 19 nt, Homo sapiens
gaaacaacaaagcuuaucu

SEQ ID NO: 1353588 - RNA, 19 nt, Homo sapiens
gagccuacuuagagcagaa

SEQ ID NO: 1353589 - RNA, 19 nt, Homo sapiens
cagcaaagaaucaugaaca

SEQ ID NO: 1353590 - RNA, 19 nt, Homo sapiens
caguggacauauuguuaaa

SEQ ID NO: 1353591 - RNA, 19 nt, Homo sapiens
ugaugaagauauuguacga

SEQ ID NO: 1353592 - RNA, 19 nt, Homo sapiens
uucaaagacccaaauguua

SEQ ID NO: 1353593 - RNA, 19 nt, Homo sapiens
ucggaaggaugauuucguu

SEQ ID NO: 1353594 - RNA, 19 nt, Homo sapiens
cgagacaguggacauauug

SEQ ID NO: 1353595 - RNA, 19 nt, Homo sapiens
ccaaauguuauucccaauu

SEQ ID NO: 1353596 - RNA, 19 nt, Homo sapiens
aaagaaucaugaacagaca

SEQ ID NO: 1353597 - RNA, 19 nt, Homo sapiens
ccucuucugucuuuaaagu

SEQ ID NO: 1353598 - RNA, 19 nt, Homo sapiens
ggugaguguucgaaagaau

SEQ ID NO: 1353599 - RNA, 19 nt, Homo sapiens
ggaugugauuagcccauau

SEQ ID NO: 1353600 - RNA, 19 nt, Homo sapiens
gguuaucggugcgcucuga

SEQ ID NO: 1353601 - RNA, 19 nt, Homo sapiens
gauuagcccauaucuggaa

SEQ ID NO: 1353602 - RNA, 19 nt, Homo sapiens
ucgguuauaugaugaagau

SEQ ID NO: 1353603 - RNA, 19 nt, Homo sapiens
caaacaccaagaugccuuu

SEQ ID NO: 1353604 - RNA, 19 nt, Homo sapiens
cuacuuagagcagaagaaa

SEQ ID NO: 1353605 - RNA, 19 nt, Homo sapiens
ggaaacaacaaagcuuauc

SEQ ID NO: 1353606 - RNA, 19 nt, Homo sapiens
caauaugaggaugugauua

SEQ ID NO: 1353607 - RNA, 19 nt, Homo sapiens
uuucaaagacccaaauguu

SEQ ID NO: 1353608 - RNA, 19 nt, Homo sapiens
ccaaccagauagagaagag

SEQ ID NO: 1353609 - RNA, 19 nt, Homo sapiens
gcuaguggaagacucagaa

SEQ ID NO: 1353610 - RNA, 19 nt, Homo sapiens
gucuuaauguucuuucaga

SEQ ID NO: 1353611 - RNA, 19 nt, Homo sapiens
gcuuaugauucugcuggua

SEQ ID NO: 1353612 - RNA, 19 nt, Homo sapiens
cgaaagaauccucaaacca

SEQ ID NO: 1353613 - RNA, 19 nt, Homo sapiens
ucaauaugaggaugugauu

SEQ ID NO: 1353614 - RNA, 19 nt, Homo sapiens
acaguggacauauuguuaa

SEQ ID NO: 1353615 - RNA, 19 nt, Homo sapiens
uaccucuucugucuuuaaa

SEQ ID NO: 1353616 - RNA, 19 nt, Homo sapiens
cuggaaacaacaaagcuua

SEQ ID NO: 1353617 - RNA, 19 nt, Homo sapiens
ggagcccuuugucaauaug

SEQ ID NO: 1353618 - RNA, 19 nt, Homo sapiens
acgagacaguggacauauu

SEQ ID NO: 1353619 - RNA, 19 nt, Homo sapiens
cauauuaggaacugaagug

SEQ ID NO: 1353620 - RNA, 19 nt, Homo sapiens
uggacaauggaucauauua

SEQ ID NO: 1353621 - RNA, 19 nt, Homo sapiens
uccagucucugagcucuaa

SEQ ID NO: 1353622 - RNA, 19 nt, Homo sapiens
ucuggacaauggaucauau

SEQ ID NO: 1353623 - RNA, 19 nt, Homo sapiens
ccugaggcuuccugaguga

SEQ ID NO: 1353624 - RNA, 19 nt, Homo sapiens
aggcgucaccuucauguuu

SEQ ID NO: 1353625 - RNA, 19 nt, Homo sapiens
gagagaagaggcccuuggu

SEQ ID NO: 1353626 - RNA, 19 nt, Homo sapiens
gguggagcccuuugucaau

SEQ ID NO: 1353627 - RNA, 19 nt, Homo sapiens
cagccaaccagauagagaa

SEQ ID NO: 1353628 - RNA, 19 nt, Homo sapiens
uaucaggcgucaccuucau

SEQ ID NO: 1353629 - RNA, 19 nt, Homo sapiens
aauaugaggaugugauuag

SEQ ID NO: 1353630 - RNA, 19 nt, Homo sapiens
gagcagaagaaagcaaaca

SEQ ID NO: 1353631 - RNA, 19 nt, Homo sapiens
gaaucaugaacagacauuu

SEQ ID NO: 1353632 - RNA, 19 nt, Homo sapiens
auauucagccaaccagaua

SEQ ID NO: 1353633 - RNA, 19 nt, Homo sapiens
auccauuucucauuucuga

SEQ ID NO: 1353634 - RNA, 19 nt, Homo sapiens
gugauccauuucucauuuc

SEQ ID NO: 1353635 - RNA, 19 nt, Homo sapiens
uagagcagaagaaagcaaa

SEQ ID NO: 1353636 - RNA, 19 nt, Homo sapiens
gguccaugcugggcagaau

SEQ ID NO: 1353637 - RNA, 19 nt, Homo sapiens
gguaugugcuauccuucag

SEQ ID NO: 1353638 - RNA, 19 nt, Homo sapiens
guucgaaagaauccucaaa

SEQ ID NO: 1353639 - RNA, 19 nt, Homo sapiens
ccauuucucauuucugaug

SEQ ID NO: 1353640 - RNA, 19 nt, Homo sapiens
cagauuauguaccucuacu

SEQ ID NO: 1353641 - RNA, 19 nt, Homo sapiens
gcuuugaccagaccuuuca

SEQ ID NO: 1353642 - RNA, 19 nt, Homo sapiens
agaaagcaaacaccaagau

SEQ ID NO: 1353643 - RNA, 19 nt, Homo sapiens
gcuacuacuucagguucuu

SEQ ID NO: 1353644 - RNA, 19 nt, Homo sapiens
agagaagaguuccuguuuu

SEQ ID NO: 1353645 - RNA, 19 nt, Homo sapiens
agacaguggacauauuguu

SEQ ID NO: 1353646 - RNA, 19 nt, Homo sapiens
ccuaucggaaggaugauuu

SEQ ID NO: 1353647 - RNA, 19 nt, Homo sapiens
agaagaaagcaaacaccaa

SEQ ID NO: 1353648 - RNA, 19 nt, Homo sapiens
ccaagaaaauacagauuac

SEQ ID NO: 1353649 - RNA, 19 nt, Homo sapiens
uggagcccuuugucaauau

SEQ ID NO: 1353650 - RNA, 19 nt, Homo sapiens
ucugaugaguuacgaagag

SEQ ID NO: 1353651 - RNA, 19 nt, Homo sapiens
acacagcuuucaaugucau

SEQ ID NO: 1353652 - RNA, 19 nt, Homo sapiens
aguuucagcuuaugauucu

SEQ ID NO: 1353653 - RNA, 19 nt, Homo sapiens
cuauaaggaucuggugagu

SEQ ID NO: 1353654 - RNA, 19 nt, Homo sapiens
ggcgucaccuucauguuuu

SEQ ID NO: 1353655 - RNA, 19 nt, Homo sapiens
uuaccucuucugucuuuaa

SEQ ID NO: 1353656 - RNA, 19 nt, Homo sapiens
aggaugugauuagcccaua

SEQ ID NO: 1353657 - RNA, 19 nt, Homo sapiens
ggagaggccuugcugguuu

SEQ ID NO: 1353658 - RNA, 19 nt, Homo sapiens
gaaacccugucucuacuaa

SEQ ID NO: 1353659 - RNA, 19 nt, Homo sapiens
acacacacauacacauuua

SEQ ID NO: 1353660 - RNA, 19 nt, Homo sapiens
cggaagagcuccugaacaa

SEQ ID NO: 1353661 - RNA, 19 nt, Homo sapiens
gauaaucacagcuggcuua

SEQ ID NO: 1353662 - RNA, 19 nt, Homo sapiens
gaacaagacggucaagaga

SEQ ID NO: 1353663 - RNA, 19 nt, Homo sapiens
gaagagcuccugaacaaga

SEQ ID NO: 1353664 - RNA, 19 nt, Homo sapiens
aaucacagcuggcuuauca

SEQ ID NO: 1353665 - RNA, 19 nt, Homo sapiens
caaccugucaccuacauua

SEQ ID NO: 1353666 - RNA, 19 nt, Homo sapiens
acaagacggucaagagaaa

SEQ ID NO: 1353667 - RNA, 19 nt, Homo sapiens
agacaaaccuggccaacau

SEQ ID NO: 1353668 - RNA, 19 nt, Homo sapiens
acagcuggcuuaucaauau

SEQ ID NO: 1353669 - RNA, 19 nt, Homo sapiens
uaacagugcgcauuuauca

SEQ ID NO: 1353670 - RNA, 19 nt, Homo sapiens
ggaaguacaggauuucaug

SEQ ID NO: 1353671 - RNA, 19 nt, Homo sapiens
gaggcuugguuguauguuu

SEQ ID NO: 1353672 - RNA, 19 nt, Homo sapiens
gguuaaaucuagcucacaa

SEQ ID NO: 1353673 - RNA, 19 nt, Homo sapiens
agaaugugcagguuuguua

SEQ ID NO: 1353674 - RNA, 19 nt, Homo sapiens
ggauguguguugcguugaa

SEQ ID NO: 1353675 - RNA, 19 nt, Homo sapiens
uaugagcacugacagaugu

SEQ ID NO: 1353676 - RNA, 19 nt, Homo sapiens
gacaaggccucgcucuauc

SEQ ID NO: 1353677 - RNA, 19 nt, Homo sapiens
ccgaguagcuggaaguaca

SEQ ID NO: 1353678 - RNA, 19 nt, Homo sapiens
acaaaugcauuaccucaca

SEQ ID NO: 1353679 - RNA, 19 nt, Homo sapiens
aaaucuagcucacaaaugc

SEQ ID NO: 1353680 - RNA, 19 nt, Homo sapiens
ggagcggucuguuacaucu

SEQ ID NO: 1353681 - RNA, 19 nt, Homo sapiens
acacaaugcuuugggaaug

SEQ ID NO: 1353682 - RNA, 19 nt, Homo sapiens
cuuauaaacuugucaggau

SEQ ID NO: 1353683 - RNA, 19 nt, Homo sapiens
uaaauugacagacguaaca

SEQ ID NO: 1353684 - RNA, 19 nt, Homo sapiens
ucucauugcuccaaaauaa

SEQ ID NO: 1353685 - RNA, 19 nt, Homo sapiens
ugguugguguuacuauuua

SEQ ID NO: 1353686 - RNA, 19 nt, Homo sapiens
gcagguuuguuacauaggu

SEQ ID NO: 1353687 - RNA, 19 nt, Homo sapiens
ggucgggaguucaagacaa

SEQ ID NO: 1353688 - RNA, 19 nt, Homo sapiens
uguuacaucuucccauuug

SEQ ID NO: 1353689 - RNA, 19 nt, Homo sapiens
ggguacacgugcagaaugu

SEQ ID NO: 1353690 - RNA, 19 nt, Homo sapiens
aggcagaccaugagguuua

SEQ ID NO: 1353691 - RNA, 19 nt, Homo sapiens
gaccaugagguuuaacuga

SEQ ID NO: 1353692 - RNA, 19 nt, Homo sapiens
guagcuggaaguacagaua

SEQ ID NO: 1353693 - RNA, 19 nt, Homo sapiens
gcgcauuuaucacgcacaa

SEQ ID NO: 1353694 - RNA, 19 nt, Homo sapiens
gaaacaggaaguacaggau

SEQ ID NO: 1353695 - RNA, 19 nt, Homo sapiens
ccuauuccuugccuuugua

SEQ ID NO: 1353696 - RNA, 19 nt, Homo sapiens
ggugaaacccugucucuac

SEQ ID NO: 1353697 - RNA, 19 nt, Homo sapiens
ggaaguacagauaaucaca

SEQ ID NO: 1353698 - RNA, 19 nt, Homo sapiens
ccuauaaucccagcacuuu

SEQ ID NO: 1353699 - RNA, 19 nt, Homo sapiens
aaacuucucgugguccuua

SEQ ID NO: 1353700 - RNA, 19 nt, Homo sapiens
gagacaaggccucgcucua

SEQ ID NO: 1353701 - RNA, 19 nt, Homo sapiens
aacaggaaguacaggauuu

SEQ ID NO: 1353702 - RNA, 19 nt, Homo sapiens
gaggagcggucuguuacau

SEQ ID NO: 1353703 - RNA, 19 nt, Homo sapiens
ggcagaccaugagguuuaa

SEQ ID NO: 1353704 - RNA, 19 nt, Homo sapiens
gcacgugccauggugguuu

SEQ ID NO: 1353705 - RNA, 19 nt, Homo sapiens
gugcagguuuguuacauag

SEQ ID NO: 1353706 - RNA, 19 nt, Homo sapiens
gucgggaguucaagacaaa

SEQ ID NO: 1353707 - RNA, 19 nt, Homo sapiens
gcauuuaucacgcacaaca

SEQ ID NO: 1353708 - RNA, 19 nt, Homo sapiens
caccuuggccucaaaguau

SEQ ID NO: 1353709 - RNA, 19 nt, Homo sapiens
gacguaacagugcgcauuu

SEQ ID NO: 1353710 - RNA, 19 nt, Homo sapiens
ucuguuacaucuucccauu

SEQ ID NO: 1353711 - RNA, 19 nt, Homo sapiens
cagcuggcuuaucaauauu

SEQ ID NO: 1353712 - RNA, 19 nt, Homo sapiens
guaggagaauugcuugaac

SEQ ID NO: 1353713 - RNA, 19 nt, Homo sapiens
cauugaacacugaaguaua

SEQ ID NO: 1353714 - RNA, 19 nt, Homo sapiens
gcucacaaaugcauuaccu

SEQ ID NO: 1353715 - RNA, 19 nt, Homo sapiens
ccaccuuggccucaaagua

SEQ ID NO: 1353716 - RNA, 19 nt, Homo sapiens
caagcaauccucccaccuu

SEQ ID NO: 1353717 - RNA, 19 nt, Homo sapiens
agacaaggccucgcucuau

SEQ ID NO: 1353718 - RNA, 19 nt, Homo sapiens
aaacaggaaguacaggauu

SEQ ID NO: 1353719 - RNA, 19 nt, Homo sapiens
gcagaaacaggaaguacag

SEQ ID NO: 1353720 - RNA, 19 nt, Homo sapiens
ugugcagguuuguuacaua

SEQ ID NO: 1353721 - RNA, 19 nt, Homo sapiens
cgcaguggcucacgccuau

SEQ ID NO: 1353722 - RNA, 19 nt, Homo sapiens
uaugguugguguuacuauu

SEQ ID NO: 1353723 - RNA, 19 nt, Homo sapiens
gugaaacccugucucuacu

SEQ ID NO: 1353724 - RNA, 19 nt, Homo sapiens
gcuuaucaauauugcuguu

SEQ ID NO: 1353725 - RNA, 19 nt, Homo sapiens
uuaggaggcugagguagga

SEQ ID NO: 1353726 - RNA, 19 nt, Homo sapiens
acacacacacauacacauu

SEQ ID NO: 1353727 - RNA, 19 nt, Homo sapiens
ggugaggcuugguuguaug

SEQ ID NO: 1353728 - RNA, 19 nt, Homo sapiens
ccacaugcucucucccaaa

SEQ ID NO: 1353729 - RNA, 19 nt, Homo sapiens
gguauuuccccuaauguua

SEQ ID NO: 1353730 - RNA, 19 nt, Homo sapiens
cagguuuguuacauaggua

SEQ ID NO: 1353731 - RNA, 19 nt, Homo sapiens
gguaggagaauugcuugaa

SEQ ID NO: 1353732 - RNA, 19 nt, Homo sapiens
uaacuuauccccagaggaa

SEQ ID NO: 1353733 - RNA, 19 nt, Homo sapiens
caucuucccauuuggagaa

SEQ ID NO: 1353734 - RNA, 19 nt, Homo sapiens
cgaggcagaccaugagguu

SEQ ID NO: 1353735 - RNA, 19 nt, Homo sapiens
cagguuaagcugguacuaa

SEQ ID NO: 1353736 - RNA, 19 nt, Homo sapiens
uagcuggaaguacagauaa

SEQ ID NO: 1353737 - RNA, 19 nt, Homo sapiens
caugcuggcuugccuaagg

SEQ ID NO: 1353738 - RNA, 19 nt, Homo sapiens
ccaugagguuuaacugagu

SEQ ID NO: 1353739 - RNA, 19 nt, Homo sapiens
uaaaucuagcucacaaaug

SEQ ID NO: 1353740 - RNA, 19 nt, Homo sapiens
ugggaaugguuaaaucuag

SEQ ID NO: 1353741 - RNA, 19 nt, Homo sapiens
gagcuucacaccucuggau

SEQ ID NO: 1353742 - RNA, 19 nt, Homo sapiens
cuagcucacaaaugcauua

SEQ ID NO: 1353743 - RNA, 19 nt, Homo sapiens
ugaacaagacggucaagag

SEQ ID NO: 1353744 - RNA, 19 nt, Homo sapiens
ucccuuucauucccugaua

SEQ ID NO: 1353745 - RNA, 19 nt, Homo sapiens
cuggguccguccuuucuuu

SEQ ID NO: 1353746 - RNA, 19 nt, Homo sapiens
ucacagcuggcuuaucaau

SEQ ID NO: 1353747 - RNA, 19 nt, Homo sapiens
ugagguaggagaauugcuu

SEQ ID NO: 1353748 - RNA, 19 nt, Homo sapiens
caguggcucacgccuauaa

SEQ ID NO: 1353749 - RNA, 19 nt, Homo sapiens
cacacacacauacacauuu

SEQ ID NO: 1353750 - RNA, 19 nt, Homo sapiens
gcacaacacaaugcuuugg

SEQ ID NO: 1353751 - RNA, 19 nt, Homo sapiens
guggugaggcuugguugua

SEQ ID NO: 1353752 - RNA, 19 nt, Homo sapiens
acguaacagugcgcauuua

SEQ ID NO: 1353753 - RNA, 19 nt, Homo sapiens
cacaugcucucucccaaac

SEQ ID NO: 1353754 - RNA, 19 nt, Homo sapiens
aggcugagguaggagaauu

SEQ ID NO: 1353755 - RNA, 19 nt, Homo sapiens
uucauucccugauaucuca

SEQ ID NO: 1353756 - RNA, 19 nt, Homo sapiens
ccuguuggaugugucagaa

SEQ ID NO: 1353757 - RNA, 19 nt, Homo sapiens
gaaauucgcuucugguaau

SEQ ID NO: 1353758 - RNA, 19 nt, Homo sapiens
gaagaauggcuaugauuua

SEQ ID NO: 1353759 - RNA, 19 nt, Homo sapiens
gaacaaagacaguauuaug

SEQ ID NO: 1353760 - RNA, 19 nt, Homo sapiens
gaaaccaucugaccuuuua

SEQ ID NO: 1353761 - RNA, 19 nt, Homo sapiens
gaacagaucgggagcaaug

SEQ ID NO: 1353762 - RNA, 19 nt, Homo sapiens
ccacagcccucucauucua

SEQ ID NO: 1353763 - RNA, 19 nt, Homo sapiens
ggaagaauggcuaugauuu

SEQ ID NO: 1353764 - RNA, 19 nt, Homo sapiens
ugauaaagauggugcauug

SEQ ID NO: 1353765 - RNA, 19 nt, Homo sapiens
gcagaugguuacaguaguu

SEQ ID NO: 1353766 - RNA, 19 nt, Homo sapiens
gaugaucccuggaaaauaa

SEQ ID NO: 1353767 - RNA, 19 nt, Homo sapiens
ggaaagauaagaaagcuau

SEQ ID NO: 1353768 - RNA, 19 nt, Homo sapiens
acauucagcucacugcuua

SEQ ID NO: 1353769 - RNA, 19 nt, Homo sapiens
gauaugaaucggaccuuua

SEQ ID NO: 1353770 - RNA, 19 nt, Homo sapiens
cacaaacucugacccaauu

SEQ ID NO: 1353771 - RNA, 19 nt, Homo sapiens
ggaugccgauggccucaua

SEQ ID NO: 1353772 - RNA, 19 nt, Homo sapiens
gccguuaacugugaacaua

SEQ ID NO: 1353773 - RNA, 19 nt, Homo sapiens
ggaacaacuucgaccauuc

SEQ ID NO: 1353774 - RNA, 19 nt, Homo sapiens
gcuauucaggcaucaauua

SEQ ID NO: 1353775 - RNA, 19 nt, Homo sapiens
caauguaacucgucaaagg

SEQ ID NO: 1353776 - RNA, 19 nt, Homo sapiens
cgagaaacauccagaaguc

SEQ ID NO: 1353777 - RNA, 19 nt, Homo sapiens
ccaagaaggugguggucaa

SEQ ID NO: 1353778 - RNA, 19 nt, Homo sapiens
caauugccguuaacuguga

SEQ ID NO: 1353779 - RNA, 19 nt, Homo sapiens
gaagucaguucuacauugc

SEQ ID NO: 1353780 - RNA, 19 nt, Homo sapiens
ugucuuagcugcuguucuu

SEQ ID NO: 1353781 - RNA, 19 nt, Homo sapiens
aaucggaccuuuacaguca

SEQ ID NO: 1353782 - RNA, 19 nt, Homo sapiens
cagauugaauagcgaauug

SEQ ID NO: 1353783 - RNA, 19 nt, Homo sapiens
ugaaguauuugcugcauca

SEQ ID NO: 1353784 - RNA, 19 nt, Homo sapiens
cuacauugcuuugaaacuu

SEQ ID NO: 1353785 - RNA, 19 nt, Homo sapiens
uaccagagcaaccaaauuu

SEQ ID NO: 1353786 - RNA, 19 nt, Homo sapiens
ccucauaacucacacuagu

SEQ ID NO: 1353787 - RNA, 19 nt, Homo sapiens
gaacgucgccugauaacac

SEQ ID NO: 1353788 - RNA, 19 nt, Homo sapiens
ugacccaauuugauucuaa

SEQ ID NO: 1353789 - RNA, 19 nt, Homo sapiens
accauucucucaccuauaa

SEQ ID NO: 1353790 - RNA, 19 nt, Homo sapiens
gagcagugggagacauuua

SEQ ID NO: 1353791 - RNA, 19 nt, Homo sapiens
gaauggcuaugauuuacca

SEQ ID NO: 1353792 - RNA, 19 nt, Homo sapiens
uaaagauggugcauugaca

SEQ ID NO: 1353793 - RNA, 19 nt, Homo sapiens
ccaccaaccaguacucuuu

SEQ ID NO: 1353794 - RNA, 19 nt, Homo sapiens
uauguucaccguuguauuu

SEQ ID NO: 1353795 - RNA, 19 nt, Homo sapiens
gaucauacaaaucccacua

SEQ ID NO: 1353796 - RNA, 19 nt, Homo sapiens
ugcccaaacugauugauuu

SEQ ID NO: 1353797 - RNA, 19 nt, Homo sapiens
gaacaacuucgaccauucu

SEQ ID NO: 1353798 - RNA, 19 nt, Homo sapiens
ccagaucuguugggaaaga

SEQ ID NO: 1353799 - RNA, 19 nt, Homo sapiens
ucagucaguuugaaguauu

SEQ ID NO: 1353800 - RNA, 19 nt, Homo sapiens
gcaggaaauggaacuuaaa

SEQ ID NO: 1353801 - RNA, 19 nt, Homo sapiens
guucuacauugcuuugaaa

SEQ ID NO: 1353802 - RNA, 19 nt, Homo sapiens
caacugccauugaaauucg

SEQ ID NO: 1353803 - RNA, 19 nt, Homo sapiens
uggcagcgaucauacaaau

SEQ ID NO: 1353804 - RNA, 19 nt, Homo sapiens
gccaagauuuguugcuuca

SEQ ID NO: 1353805 - RNA, 19 nt, Homo sapiens
gugaaaccaucugaccuuu

SEQ ID NO: 1353806 - RNA, 19 nt, Homo sapiens
ggaaauggaacuuaaaaga

SEQ ID NO: 1353807 - RNA, 19 nt, Homo sapiens
gcaauccaguaguuaugau

SEQ ID NO: 1353808 - RNA, 19 nt, Homo sapiens
caacuucuccacacacaug

SEQ ID NO: 1353809 - RNA, 19 nt, Homo sapiens
ccgauggccucauaacuca

SEQ ID NO: 1353810 - RNA, 19 nt, Homo sapiens
ccaguucccauucguauga

SEQ ID NO: 1353811 - RNA, 19 nt, Homo sapiens
gaucugcagcuaaagaguu

SEQ ID NO: 1353812 - RNA, 19 nt, Homo sapiens
caucugaccuuuuagaaga

SEQ ID NO: 1353813 - RNA, 19 nt, Homo sapiens
ugcaggaaauggaacuuaa

SEQ ID NO: 1353814 - RNA, 19 nt, Homo sapiens
ggaagauucagcagauguu

SEQ ID NO: 1353815 - RNA, 19 nt, Homo sapiens
cguaggcaauccaguaguu

SEQ ID NO: 1353816 - RNA, 19 nt, Homo sapiens
ucaccguuguauuuaagua

SEQ ID NO: 1353817 - RNA, 19 nt, Homo sapiens
uaccucaccucagcagaua

SEQ ID NO: 1353818 - RNA, 19 nt, Homo sapiens
ggccacagcccucucauuc

SEQ ID NO: 1353819 - RNA, 19 nt, Homo sapiens
agacauggccugagcugaa

SEQ ID NO: 1353820 - RNA, 19 nt, Homo sapiens
gaacucucagacuuugaua

SEQ ID NO: 1353821 - RNA, 19 nt, Homo sapiens
gcucacugcuuaacucaac

SEQ ID NO: 1353822 - RNA, 19 nt, Homo sapiens
cuacagaucauggagcuuu

SEQ ID NO: 1353823 - RNA, 19 nt, Homo sapiens
cgaccauucucucaccuau

SEQ ID NO: 1353824 - RNA, 19 nt, Homo sapiens
cauugacacuggaugaguu

SEQ ID NO: 1353825 - RNA, 19 nt, Homo sapiens
uccaggaucugcagcuaaa

SEQ ID NO: 1353826 - RNA, 19 nt, Homo sapiens
gaagcacaaucagguucuu

SEQ ID NO: 1353827 - RNA, 19 nt, Homo sapiens
cgacgaacaagaugaugaa

SEQ ID NO: 1353828 - RNA, 19 nt, Homo sapiens
cgucaaaggucucauucag

SEQ ID NO: 1353829 - RNA, 19 nt, Homo sapiens
aaaucccacuagcccauua

SEQ ID NO: 1353830 - RNA, 19 nt, Homo sapiens
ggaccuuccucugccaaga

SEQ ID NO: 1353831 - RNA, 19 nt, Homo sapiens
gacauggccugagcugaau

SEQ ID NO: 1353832 - RNA, 19 nt, Homo sapiens
ugauugauuuggaagauuc

SEQ ID NO: 1353833 - RNA, 19 nt, Homo sapiens
gaugaacaaagacaguauu

SEQ ID NO: 1353834 - RNA, 19 nt, Homo sapiens
gucguauucugguguaauu

SEQ ID NO: 1353835 - RNA, 19 nt, Homo sapiens
cagaacagaucgggagcaa

SEQ ID NO: 1353836 - RNA, 19 nt, Homo sapiens
ugaaauucgcuucugguaa

SEQ ID NO: 1353837 - RNA, 19 nt, Homo sapiens
ccaagcaagucaccaucga

SEQ ID NO: 1353838 - RNA, 19 nt, Homo sapiens
gcaguguggucagggcauu

SEQ ID NO: 1353839 - RNA, 19 nt, Homo sapiens
uggaacaacuucgaccauu

SEQ ID NO: 1353840 - RNA, 19 nt, Homo sapiens
gaacuggcagcgaucauac

SEQ ID NO: 1353841 - RNA, 19 nt, Homo sapiens
caggugagguagguuauuc

SEQ ID NO: 1353842 - RNA, 19 nt, Homo sapiens
aaucaagggucguauucug

SEQ ID NO: 1353843 - RNA, 19 nt, Homo sapiens
guucuugcaucacaaccuu

SEQ ID NO: 1353844 - RNA, 19 nt, Homo sapiens
gcaaguucucuucgaguug

SEQ ID NO: 1353845 - RNA, 19 nt, Homo sapiens
acaggaaucucgccaugca

SEQ ID NO: 1353846 - RNA, 19 nt, Homo sapiens
ccacaugcaggaaauggaa

SEQ ID NO: 1353847 - RNA, 19 nt, Homo sapiens
uaacagaugaacaaagaca

SEQ ID NO: 1353848 - RNA, 19 nt, Homo sapiens
aguacgaacuguagcauca

SEQ ID NO: 1353849 - RNA, 19 nt, Homo sapiens
gccaauugccguuaacugu

SEQ ID NO: 1353850 - RNA, 19 nt, Homo sapiens
cagucaguuugaaguauuu

SEQ ID NO: 1353851 - RNA, 19 nt, Homo sapiens
guagauuucagucaguuug

SEQ ID NO: 1353852 - RNA, 19 nt, Homo sapiens
aaaacuuccugaaagcuua

SEQ ID NO: 1353853 - RNA, 19 nt, Homo sapiens
ggcuaugauuuaccagaaa

SEQ ID NO: 1353854 - RNA, 19 nt, Homo sapiens
ugaacuuucucauauuugg

SEQ ID NO: 1353855 - RNA, 19 nt, Homo sapiens
guaggcaauccaguaguua

SEQ ID NO: 1353856 - RNA, 19 nt, Homo sapiens
gaaagcuauucaggcauca

SEQ ID NO: 1353857 - RNA, 19 nt, Homo sapiens
uaacagaacucggauauaa

SEQ ID NO: 1353858 - RNA, 19 nt, Homo sapiens
gauccaaacuggcgaauuu

SEQ ID NO: 1353859 - RNA, 19 nt, Homo sapiens
cgacauggaucacacaaua

SEQ ID NO: 1353860 - RNA, 19 nt, Homo sapiens
gugagagacugacuucuaa

SEQ ID NO: 1353861 - RNA, 19 nt, Homo sapiens
caucaucuccuuucuauug

SEQ ID NO: 1353862 - RNA, 19 nt, Homo sapiens
gaacucggauauaaugucu

SEQ ID NO: 1353863 - RNA, 19 nt, Homo sapiens
gcaacagccucuuuaaacu

SEQ ID NO: 1353864 - RNA, 19 nt, Homo sapiens
gaaucuauccuaugucuuc

SEQ ID NO: 1353865 - RNA, 19 nt, Homo sapiens
gaaacuggaugagaaagca

SEQ ID NO: 1353866 - RNA, 19 nt, Homo sapiens
ccaugaaucuauccuaugu

SEQ ID NO: 1353867 - RNA, 19 nt, Homo sapiens
guucaacaaguuaccauua

SEQ ID NO: 1353868 - RNA, 19 nt, Homo sapiens
caaguuaccauuaaagugu

SEQ ID NO: 1353869 - RNA, 19 nt, Homo sapiens
cuaaguacaucaucuccuu

SEQ ID NO: 1353870 - RNA, 19 nt, Homo sapiens
ccauuaaaguguucugaau

SEQ ID NO: 1353871 - RNA, 19 nt, Homo sapiens
gcauuugaguuauugagau

SEQ ID NO: 1353872 - RNA, 19 nt, Homo sapiens
cugucaagcuucaagaaua

SEQ ID NO: 1353873 - RNA, 19 nt, Homo sapiens
uacaucaucuccuuucuau

SEQ ID NO: 1353874 - RNA, 19 nt, Homo sapiens
gaacaguuuacuaccauga

SEQ ID NO: 1353875 - RNA, 19 nt, Homo sapiens
cuagucaaccuacagcuua

SEQ ID NO: 1353876 - RNA, 19 nt, Homo sapiens
guacuacucaccuggcuuu

SEQ ID NO: 1353877 - RNA, 19 nt, Homo sapiens
guacaucaucuccuuucua

SEQ ID NO: 1353878 - RNA, 19 nt, Homo sapiens
caaccuacagcuuaauuau

SEQ ID NO: 1353879 - RNA, 19 nt, Homo sapiens
acucggauauaaugucuuu

SEQ ID NO: 1353880 - RNA, 19 nt, Homo sapiens
guccuuggcucagagagua

SEQ ID NO: 1353881 - RNA, 19 nt, Homo sapiens
uaccaugaaucuauccuau

SEQ ID NO: 1353882 - RNA, 19 nt, Homo sapiens
gccaggguauauuuccuuu

SEQ ID NO: 1353883 - RNA, 19 nt, Homo sapiens
gcgcugccaggguauauuu

SEQ ID NO: 1353884 - RNA, 19 nt, Homo sapiens
ccugguaccucauugcaau

SEQ ID NO: 1353885 - RNA, 19 nt, Homo sapiens
uguugaaacuggaugagaa

SEQ ID NO: 1353886 - RNA, 19 nt, Homo sapiens
ucacacuacucuucuugau

SEQ ID NO: 1353887 - RNA, 19 nt, Homo sapiens
accuacagcuuaauuauuc

SEQ ID NO: 1353888 - RNA, 19 nt, Homo sapiens
ccagagaacugagggaaaa

SEQ ID NO: 1353889 - RNA, 19 nt, Homo sapiens
caacaaguuaccauuaaag

SEQ ID NO: 1353890 - RNA, 19 nt, Homo sapiens
caacagccucuuuaaacug

SEQ ID NO: 1353891 - RNA, 19 nt, Homo sapiens
ucgcgucccucuccgcuuu

SEQ ID NO: 1353892 - RNA, 19 nt, Homo sapiens
ucaaccuacagcuuaauua

SEQ ID NO: 1353893 - RNA, 19 nt, Homo sapiens
acagaacucggauauaaug

SEQ ID NO: 1353894 - RNA, 19 nt, Homo sapiens
gaugagaaagcaccuugga

SEQ ID NO: 1353895 - RNA, 19 nt, Homo sapiens
ugugagagacugacuucua

SEQ ID NO: 1353896 - RNA, 19 nt, Homo sapiens
ggaaaagggcggaaaagga

SEQ ID NO: 1353897 - RNA, 19 nt, Homo sapiens
ucuauccuaugucuucauu

SEQ ID NO: 1353898 - RNA, 19 nt, Homo sapiens
cauggaucacacaauauua

SEQ ID NO: 1353899 - RNA, 19 nt, Homo sapiens
uagucaaccuacagcuuaa

SEQ ID NO: 1353900 - RNA, 19 nt, Homo sapiens
uaaaguguucugaaucugu

SEQ ID NO: 1353901 - RNA, 19 nt, Homo sapiens
aagaauaccagagaacuga

SEQ ID NO: 1353902 - RNA, 19 nt, Homo sapiens
uuacuaccaugaaucuauc

SEQ ID NO: 1353903 - RNA, 19 nt, Homo sapiens
ugaguuauugagauccuua

SEQ ID NO: 1353904 - RNA, 19 nt, Homo sapiens
gagggaaaauaccaaaugu

SEQ ID NO: 1353905 - RNA, 19 nt, Homo sapiens
cuucaagaauaccagagaa

SEQ ID NO: 1353906 - RNA, 19 nt, Homo sapiens
ugucaagcuucaagaauac

SEQ ID NO: 1353907 - RNA, 19 nt, Homo sapiens
acauggaucacacaauauu

SEQ ID NO: 1353908 - RNA, 19 nt, Homo sapiens
gagaaagcaccuuggaacu

SEQ ID NO: 1353909 - RNA, 19 nt, Homo sapiens
cauuugaguuauugagauc

SEQ ID NO: 1353910 - RNA, 19 nt, Homo sapiens
caagaauaccagagaacug

SEQ ID NO: 1353911 - RNA, 19 nt, Homo sapiens
ccuaugucuucauuccuuu

SEQ ID NO: 1353912 - RNA, 19 nt, Homo sapiens
cagcuuaauuauucagcau

SEQ ID NO: 1353913 - RNA, 19 nt, Homo sapiens
acaguuuacuaccaugaau

SEQ ID NO: 1353914 - RNA, 19 nt, Homo sapiens
gguguaagucuggcuuuga

SEQ ID NO: 1353915 - RNA, 19 nt, Homo sapiens
gucuggauauuugauacua

SEQ ID NO: 1353916 - RNA, 19 nt, Homo sapiens
guugaaacuggaugagaaa

SEQ ID NO: 1353917 - RNA, 19 nt, Homo sapiens
agaauguccuuggcucaga

SEQ ID NO: 1353918 - RNA, 19 nt, Homo sapiens
ugacgggguucuggauuua

SEQ ID NO: 1353919 - RNA, 19 nt, Homo sapiens
uggaacaguuuacuaccau

SEQ ID NO: 1353920 - RNA, 19 nt, Homo sapiens
gacauggaucacacaauau

SEQ ID NO: 1353921 - RNA, 19 nt, Homo sapiens
uaaguacaucaucuccuuu

SEQ ID NO: 1353922 - RNA, 19 nt, Homo sapiens
uggcgaauuugcugaucuu

SEQ ID NO: 1353923 - RNA, 19 nt, Homo sapiens
acucugugcuaaacuggaa

SEQ ID NO: 1353924 - RNA, 19 nt, Homo sapiens
cuucuuguccugcugauug

SEQ ID NO: 1353925 - RNA, 19 nt, Homo sapiens
gggaaaauaccaaauguag

SEQ ID NO: 1353926 - RNA, 19 nt, Homo sapiens
ugucuucauuccuuuaugg

SEQ ID NO: 1353927 - RNA, 19 nt, Homo sapiens
cugcaacagccucuuuaaa

SEQ ID NO: 1353928 - RNA, 19 nt, Homo sapiens
cuacucaccuggcuuuuca

SEQ ID NO: 1353929 - RNA, 19 nt, Homo sapiens
gauccuuauuaucucuaug

SEQ ID NO: 1353930 - RNA, 19 nt, Homo sapiens
acaaguuaccauuaaagug

SEQ ID NO: 1353931 - RNA, 19 nt, Homo sapiens
ugcaacagccucuuuaaac

SEQ ID NO: 1353932 - RNA, 19 nt, Homo sapiens
agaaagcaccuuggaacug

SEQ ID NO: 1353933 - RNA, 19 nt, Homo sapiens
gugacgggguucuggauuu

SEQ ID NO: 1353934 - RNA, 19 nt, Homo sapiens
cauuaaaguguucugaauc

SEQ ID NO: 1353935 - RNA, 19 nt, Homo sapiens
uuuaacagaacucggauau

SEQ ID NO: 1353936 - RNA, 19 nt, Homo sapiens
uccuaugucuucauuccuu

SEQ ID NO: 1353937 - RNA, 19 nt, Homo sapiens
gcuucaagaauaccagaga

SEQ ID NO: 1353938 - RNA, 19 nt, Homo sapiens
uuaacagaacucggauaua

SEQ ID NO: 1353939 - RNA, 19 nt, Homo sapiens
guacuggacugacaagaaa

SEQ ID NO: 1353940 - RNA, 19 nt, Homo sapiens
caacacaugucucauucua

SEQ ID NO: 1353941 - RNA, 19 nt, Homo sapiens
gcacaaauuuaaccaaaca

SEQ ID NO: 1353942 - RNA, 19 nt, Homo sapiens
acacaugucucauucuaaa

SEQ ID NO: 1353943 - RNA, 19 nt, Homo sapiens
ggacugaauuugagguuuc

SEQ ID NO: 1353944 - RNA, 19 nt, Homo sapiens
gagccaaggcacaaauuua

SEQ ID NO: 1353945 - RNA, 19 nt, Homo sapiens
aaggagaacuggaauuuga

SEQ ID NO: 1353946 - RNA, 19 nt, Homo sapiens
caagaagcauggacugaau

SEQ ID NO: 1353947 - RNA, 19 nt, Homo sapiens
uaaaggagaacuggaauuu

SEQ ID NO: 1353948 - RNA, 19 nt, Homo sapiens
gcccagcucuacaaauaaa

SEQ ID NO: 1353949 - RNA, 19 nt, Homo sapiens
aggcccagcucuacaaaua

SEQ ID NO: 1353950 - RNA, 19 nt, Homo sapiens
ugacaaaccuagccacagu

SEQ ID NO: 1353951 - RNA, 19 nt, Homo sapiens
gaaccugggugccuaaacg

SEQ ID NO: 1353952 - RNA, 19 nt, Homo sapiens
uagauaagguaacugacaa

SEQ ID NO: 1353953 - RNA, 19 nt, Homo sapiens
ggagccaaggcacaaauuu

SEQ ID NO: 1353954 - RNA, 19 nt, Homo sapiens
aagcauggacugaauuuga

SEQ ID NO: 1353955 - RNA, 19 nt, Homo sapiens
aggcacaaauuuaaccaaa

SEQ ID NO: 1353956 - RNA, 19 nt, Homo sapiens
ccaaaguacugggauuaca

SEQ ID NO: 1353957 - RNA, 19 nt, Homo sapiens
ggccugguccugugcauuu

SEQ ID NO: 1353958 - RNA, 19 nt, Homo sapiens
gaacccagagccuucuuca

SEQ ID NO: 1353959 - RNA, 19 nt, Homo sapiens
gguacuggacugacaagaa

SEQ ID NO: 1353960 - RNA, 19 nt, Homo sapiens
ccacagaacccugccuuuc

SEQ ID NO: 1353961 - RNA, 19 nt, Homo sapiens
cacggaaacuaccuacaug

SEQ ID NO: 1353962 - RNA, 19 nt, Homo sapiens
gcccagguaugcacaaguc

SEQ ID NO: 1353963 - RNA, 19 nt, Homo sapiens
ggccgaagaaggagaaaga

SEQ ID NO: 1353964 - RNA, 19 nt, Homo sapiens
caugucucauucuaaauug

SEQ ID NO: 1353965 - RNA, 19 nt, Homo sapiens
gccucagccucccaaagua

SEQ ID NO: 1353966 - RNA, 19 nt, Homo sapiens
ccacggaaacuaccuacau

SEQ ID NO: 1353967 - RNA, 19 nt, Homo sapiens
agccaaggcacaaauuuaa

SEQ ID NO: 1353968 - RNA, 19 nt, Homo sapiens
cacagaacccugccuuuca

SEQ ID NO: 1353969 - RNA, 19 nt, Homo sapiens
gcaccacggaaacuaccua

SEQ ID NO: 1353970 - RNA, 19 nt, Homo sapiens
uccgaccucugaccucuaa

SEQ ID NO: 1353971 - RNA, 19 nt, Homo sapiens
agaagcagcgucccucaga

SEQ ID NO: 1353972 - RNA, 19 nt, Homo sapiens
agaagcauggacugaauuu

SEQ ID NO: 1353973 - RNA, 19 nt, Homo sapiens
gaacuccugaccucaagca

SEQ ID NO: 1353974 - RNA, 19 nt, Homo sapiens
gaauuugagguuucuggau

SEQ ID NO: 1353975 - RNA, 19 nt, Homo sapiens
cuccugaccucaagcaauc

SEQ ID NO: 1353976 - RNA, 19 nt, Homo sapiens
gacggguacuggacugaca

SEQ ID NO: 1353977 - RNA, 19 nt, Homo sapiens
acaagaagcauggacugaa

SEQ ID NO: 1353978 - RNA, 19 nt, Homo sapiens
gcucuacaaauaaaguguu

SEQ ID NO: 1353979 - RNA, 19 nt, Homo sapiens
acagaacccugccuuucag

SEQ ID NO: 1353980 - RNA, 19 nt, Homo sapiens
cuaaaggagaacuggaauu

SEQ ID NO: 1353981 - RNA, 19 nt, Homo sapiens
ucaccaccaucuccguugu

SEQ ID NO: 1353982 - RNA, 19 nt, Homo sapiens
ggaguagccgucccauuuu

SEQ ID NO: 1353983 - RNA, 19 nt, Homo sapiens
uuucaacacaugucucauu

SEQ ID NO: 1353984 - RNA, 19 nt, Homo sapiens
ggcccagcucuacaaauaa

SEQ ID NO: 1353985 - RNA, 19 nt, Homo sapiens
ccacaccgcuugggaaccu

SEQ ID NO: 1353986 - RNA, 19 nt, Homo sapiens
gcuggaacgucugcaggau

SEQ ID NO: 1353987 - RNA, 19 nt, Homo sapiens
gaagcauggacugaauuug

SEQ ID NO: 1353988 - RNA, 19 nt, Homo sapiens
uucaacacaugucucauuc

SEQ ID NO: 1353989 - RNA, 19 nt, Homo sapiens
caaaguacugggauuacag

SEQ ID NO: 1353990 - RNA, 19 nt, Homo sapiens
uuggugggcuggccgaaga

SEQ ID NO: 1353991 - RNA, 19 nt, Homo sapiens
ggagggugcucugguucag

SEQ ID NO: 1353992 - RNA, 19 nt, Homo sapiens
ggcacaaauuuaaccaaac

SEQ ID NO: 1353993 - RNA, 19 nt, Homo sapiens
caccaucuccguuguuucu

SEQ ID NO: 1353994 - RNA, 19 nt, Homo sapiens
cccggacgcacuuugauuu

SEQ ID NO: 1353995 - RNA, 19 nt, Homo sapiens
aaaggagaacuggaauuug

SEQ ID NO: 1353996 - RNA, 19 nt, Homo sapiens
cgccagagucguaguagug

SEQ ID NO: 1353997 - RNA, 19 nt, Homo sapiens
ggagaacuggaauuugaac

SEQ ID NO: 1353998 - RNA, 19 nt, Homo sapiens
uggacugaauuugagguuu

SEQ ID NO: 1353999 - RNA, 19 nt, Homo sapiens
guaauuagcuccacgugua

SEQ ID NO: 1354000 - RNA, 19 nt, Homo sapiens
ggaaggcugugccaucuuu

SEQ ID NO: 1354001 - RNA, 19 nt, Homo sapiens
gaugugaucucauugaugu

SEQ ID NO: 1354002 - RNA, 19 nt, Homo sapiens
ccaauaaagugcuagaaug

SEQ ID NO: 1354003 - RNA, 19 nt, Homo sapiens
caaccaaguuccaauaaag

SEQ ID NO: 1354004 - RNA, 19 nt, Homo sapiens
guaagaagauagcacagau

SEQ ID NO: 1354005 - RNA, 19 nt, Homo sapiens
ucucacaucuguuagcuuu

SEQ ID NO: 1354006 - RNA, 19 nt, Homo sapiens
gugagaaccaccugacuua

SEQ ID NO: 1354007 - RNA, 19 nt, Homo sapiens
guaaagcuaccacagauau

SEQ ID NO: 1354008 - RNA, 19 nt, Homo sapiens
gggauauuauugugugaaa

SEQ ID NO: 1354009 - RNA, 19 nt, Homo sapiens
ucacaucuguuagcuuuga

SEQ ID NO: 1354010 - RNA, 19 nt, Homo sapiens
gcacuggagucucacaucu

SEQ ID NO: 1354011 - RNA, 19 nt, Homo sapiens
auaaagugcuagaauguga

SEQ ID NO: 1354012 - RNA, 19 nt, Homo sapiens
ggguagagcuuuccagaac

SEQ ID NO: 1354013 - RNA, 19 nt, Homo sapiens
gaaccugauugcugaugau

SEQ ID NO: 1354014 - RNA, 19 nt, Homo sapiens
ccacugcaguaaucaucua

SEQ ID NO: 1354015 - RNA, 19 nt, Homo sapiens
ugugaaagcuguuugugau

SEQ ID NO: 1354016 - RNA, 19 nt, Homo sapiens
ggacucauccgauccuuag

SEQ ID NO: 1354017 - RNA, 19 nt, Homo sapiens
cuggauaucuggguuauug

SEQ ID NO: 1354018 - RNA, 19 nt, Homo sapiens
caauaaagugcuagaaugu

SEQ ID NO: 1354019 - RNA, 19 nt, Homo sapiens
caguaaagcuaccacagau

SEQ ID NO: 1354020 - RNA, 19 nt, Homo sapiens
acaaccaaguuccaauaaa

SEQ ID NO: 1354021 - RNA, 19 nt, Homo sapiens
aggagcaucuugggauuua

SEQ ID NO: 1354022 - RNA, 19 nt, Homo sapiens
ccacucaagcucuucgaua

SEQ ID NO: 1354023 - RNA, 19 nt, Homo sapiens
gagaagcuuucaagaacca

SEQ ID NO: 1354024 - RNA, 19 nt, Homo sapiens
ugaaagcuguuugugauca

SEQ ID NO: 1354025 - RNA, 19 nt, Homo sapiens
ccagguuccuuaucuuuca

SEQ ID NO: 1354026 - RNA, 19 nt, Homo sapiens
cgagccagcugugugaauu

SEQ ID NO: 1354027 - RNA, 19 nt, Homo sapiens
acacaaccaaguuccaaua

SEQ ID NO: 1354028 - RNA, 19 nt, Homo sapiens
uaagaagauagcacagaua

SEQ ID NO: 1354029 - RNA, 19 nt, Homo sapiens
ccacagauauaaggguguu

SEQ ID NO: 1354030 - RNA, 19 nt, Homo sapiens
ugacuuaguggaugugaaa

SEQ ID NO: 1354031 - RNA, 19 nt, Homo sapiens
ggugaucccugcccuuucu

SEQ ID NO: 1354032 - RNA, 19 nt, Homo sapiens
gagcaucuugggauuuauu

SEQ ID NO: 1354033 - RNA, 19 nt, Homo sapiens
agaaccaccugacuuagug

SEQ ID NO: 1354034 - RNA, 19 nt, Homo sapiens
gccuauggcaauuauauuu

SEQ ID NO: 1354035 - RNA, 19 nt, Homo sapiens
cugagaagcuuucaagaac

SEQ ID NO: 1354036 - RNA, 19 nt, Homo sapiens
ggugauggguagagcuuuc

SEQ ID NO: 1354037 - RNA, 19 nt, Homo sapiens
uaaagcuaccacagauaua

SEQ ID NO: 1354038 - RNA, 19 nt, Homo sapiens
ucaggagcaucuugggauu

SEQ ID NO: 1354039 - RNA, 19 nt, Homo sapiens
uggagucucacaucuguua

SEQ ID NO: 1354040 - RNA, 19 nt, Homo sapiens
aaagcuaccacagauauaa

SEQ ID NO: 1354041 - RNA, 19 nt, Homo sapiens
gagaaccaccugacuuagu

SEQ ID NO: 1354042 - RNA, 19 nt, Homo sapiens
ugaguucccugcccagcuu

SEQ ID NO: 1354043 - RNA, 19 nt, Homo sapiens
ccugagaagcuuucaagaa

SEQ ID NO: 1354044 - RNA, 19 nt, Homo sapiens
caucaugaccucguuguug

SEQ ID NO: 1354045 - RNA, 19 nt, Homo sapiens
gaaaaugcagggugacuga

SEQ ID NO: 1354046 - RNA, 19 nt, Homo sapiens
gaaccagagaaccugauug

SEQ ID NO: 1354047 - RNA, 19 nt, Homo sapiens
ccacgagccagcuguguga

SEQ ID NO: 1354048 - RNA, 19 nt, Homo sapiens
uuccuuaucuuucaaaugg

SEQ ID NO: 1354049 - RNA, 19 nt, Homo sapiens
ggaccugaguucugguuuu

SEQ ID NO: 1354050 - RNA, 19 nt, Homo sapiens
aagaagauagcacagauau

SEQ ID NO: 1354051 - RNA, 19 nt, Homo sapiens
ucaguaaagcuaccacaga

SEQ ID NO: 1354052 - RNA, 19 nt, Homo sapiens
gaaagcuguuugugaucag

SEQ ID NO: 1354053 - RNA, 19 nt, Homo sapiens
cagccuauggcaauuauau

SEQ ID NO: 1354054 - RNA, 19 nt, Homo sapiens
ggagugaagcaacauggau

SEQ ID NO: 1354055 - RNA, 19 nt, Homo sapiens
gagccagcugugugaauuu

SEQ ID NO: 1354056 - RNA, 19 nt, Homo sapiens
cacaaccaaguuccaauaa

SEQ ID NO: 1354057 - RNA, 19 nt, Homo sapiens
guacacaaccaaguuccaa

SEQ ID NO: 1354058 - RNA, 19 nt, Homo sapiens
acuuugaugugaucucauu

SEQ ID NO: 1354059 - RNA, 19 nt, Homo sapiens
ggucaaaccaagccaagag

SEQ ID NO: 1354060 - RNA, 19 nt, Homo sapiens
agaaccugauugcugauga

SEQ ID NO: 1354061 - RNA, 19 nt, Homo sapiens
gcugaauccugagaagcuu

SEQ ID NO: 1354062 - RNA, 19 nt, Homo sapiens
uuucugcacuggagucuca

SEQ ID NO: 1354063 - RNA, 19 nt, Homo sapiens
uaaagguggugagggagau

SEQ ID NO: 1354064 - RNA, 19 nt, Homo sapiens
gauguacacaaccaaguuc

SEQ ID NO: 1354065 - RNA, 19 nt, Homo sapiens
uuacuuugaugugaucuca

SEQ ID NO: 1354066 - RNA, 19 nt, Homo sapiens
gagguguucccaggacuuu

SEQ ID NO: 1354067 - RNA, 19 nt, Homo sapiens
ggccaccauugucaucaug

SEQ ID NO: 1354068 - RNA, 19 nt, Homo sapiens
ucaagggaccuaacucucu

SEQ ID NO: 1354069 - RNA, 19 nt, Homo sapiens
cacucaagcucuucgauac

SEQ ID NO: 1354070 - RNA, 19 nt, Homo sapiens
gugccauuccuucauguuu

SEQ ID NO: 1354071 - RNA, 19 nt, Homo sapiens
guuccagguuccuuaucuu

SEQ ID NO: 1354072 - RNA, 19 nt, Homo sapiens
ggugaugggcuucuuucug

SEQ ID NO: 1354073 - RNA, 19 nt, Homo sapiens
ucucauugauguacacaac

SEQ ID NO: 1354074 - RNA, 19 nt, Homo sapiens
gcaucuugggauuuauuaa

SEQ ID NO: 1354075 - RNA, 19 nt, Homo sapiens
acuggagucucacaucugu

SEQ ID NO: 1354076 - RNA, 19 nt, Homo sapiens
guagagcuuuccagaaccu

SEQ ID NO: 1354077 - RNA, 19 nt, Homo sapiens
gugcccagccacugcagua

SEQ ID NO: 1354078 - RNA, 19 nt, Homo sapiens
ugauguacacaaccaaguu

SEQ ID NO: 1354079 - RNA, 19 nt, Homo sapiens
gcucuucgauaccaaaauc

SEQ ID NO: 1354080 - RNA, 19 nt, Homo sapiens
aaugcagggugacugaguu

SEQ ID NO: 1354081 - RNA, 19 nt, Homo sapiens
caagcaauguuggaaaaug

SEQ ID NO: 1354082 - RNA, 19 nt, Homo sapiens
aaggaaggcugugccaucu

SEQ ID NO: 1354083 - RNA, 19 nt, Homo sapiens
ggaugugaaagcuguuugu

SEQ ID NO: 1354084 - RNA, 19 nt, Homo sapiens
caccugacuuaguggaugu

SEQ ID NO: 1354085 - RNA, 19 nt, Homo sapiens
uaaagugcuagaaugugaa

SEQ ID NO: 1354086 - RNA, 19 nt, Homo sapiens
ggauaucuggguuauuguc

SEQ ID NO: 1354087 - RNA, 19 nt, Homo sapiens
ggagcaucuugggauuuau

SEQ ID NO: 1354088 - RNA, 19 nt, Homo sapiens
gaccugaguucugguuuug

SEQ ID NO: 1354089 - RNA, 19 nt, Homo sapiens
aaagugcuagaaugugaaa

SEQ ID NO: 1354090 - RNA, 19 nt, Homo sapiens
ucauugauguacacaacca

SEQ ID NO: 1354091 - RNA, 19 nt, Homo sapiens
cccagccacugcaguaauc

SEQ ID NO: 1354092 - RNA, 19 nt, Homo sapiens
caagcucuucgauaccaaa

SEQ ID NO: 1354093 - RNA, 19 nt, Homo sapiens
ccagcugugugaauuuggu

SEQ ID NO: 1354094 - RNA, 19 nt, Homo sapiens
cuucagaggugaucaauaa

SEQ ID NO: 1354095 - RNA, 19 nt, Homo sapiens
guaaagcuguccucauuug

SEQ ID NO: 1354096 - RNA, 19 nt, Homo sapiens
gagcugugcuuuaagauuc

SEQ ID NO: 1354097 - RNA, 19 nt, Homo sapiens
uaaugacagugaugaaaug

SEQ ID NO: 1354098 - RNA, 19 nt, Homo sapiens
agaaacaacagcaugcuaa

SEQ ID NO: 1354099 - RNA, 19 nt, Homo sapiens
guaaugacagugaugaaau

SEQ ID NO: 1354100 - RNA, 19 nt, Homo sapiens
guacuuaagcagaugaaga

SEQ ID NO: 1354101 - RNA, 19 nt, Homo sapiens
gaacuucagaggugaucaa

SEQ ID NO: 1354102 - RNA, 19 nt, Homo sapiens
gaaacaacagcaugcuaau

SEQ ID NO: 1354103 - RNA, 19 nt, Homo sapiens
auguaaagcuguccucauu

SEQ ID NO: 1354104 - RNA, 19 nt, Homo sapiens
gcuuuaagauucauguuac

SEQ ID NO: 1354105 - RNA, 19 nt, Homo sapiens
aagcuguccucauuuguga

SEQ ID NO: 1354106 - RNA, 19 nt, Homo sapiens
ggagcugugcuuuaagauu

SEQ ID NO: 1354107 - RNA, 19 nt, Homo sapiens
gguaaugacagugaugaaa

SEQ ID NO: 1354108 - RNA, 19 nt, Homo sapiens
ggaguugggacaaucucua

SEQ ID NO: 1354109 - RNA, 19 nt, Homo sapiens
uuaagcagaugaagacucu

SEQ ID NO: 1354110 - RNA, 19 nt, Homo sapiens
cuggagcugugcuuuaaga

SEQ ID NO: 1354111 - RNA, 19 nt, Homo sapiens
cuacaggaugacugacuua

SEQ ID NO: 1354112 - RNA, 19 nt, Homo sapiens
cuauggaccuauggaguug

SEQ ID NO: 1354113 - RNA, 19 nt, Homo sapiens
ccucauuugugacuaugga

SEQ ID NO: 1354114 - RNA, 19 nt, Homo sapiens
gaugacagaaggugauuuu

SEQ ID NO: 1354115 - RNA, 19 nt, Homo sapiens
ccuacaggaugacugacuu

SEQ ID NO: 1354116 - RNA, 19 nt, Homo sapiens
gaguugggacaaucucuau

SEQ ID NO: 1354117 - RNA, 19 nt, Homo sapiens
uaagaugacagaaggugau

SEQ ID NO: 1354118 - RNA, 19 nt, Homo sapiens
aaacaacagcaugcuaaug

SEQ ID NO: 1354119 - RNA, 19 nt, Homo sapiens
uagaaacaacagcaugcua

SEQ ID NO: 1354120 - RNA, 19 nt, Homo sapiens
cugaggaggugagcuuguu

SEQ ID NO: 1354121 - RNA, 19 nt, Homo sapiens
gggccuacaggaugacuga

SEQ ID NO: 1354122 - RNA, 19 nt, Homo sapiens
uucuggagcugugcuuuaa

SEQ ID NO: 1354123 - RNA, 19 nt, Homo sapiens
ggauaaaacggucccauca

SEQ ID NO: 1354124 - RNA, 19 nt, Homo sapiens
ggugaucaauaaaagaaga

SEQ ID NO: 1354125 - RNA, 19 nt, Homo sapiens
gaggaggugagcuuguuuc

SEQ ID NO: 1354126 - RNA, 19 nt, Homo sapiens
gaggugaucaauaaaagaa

SEQ ID NO: 1354127 - RNA, 19 nt, Homo sapiens
uguaaagcuguccucauuu

SEQ ID NO: 1354128 - RNA, 19 nt, Homo sapiens
gggcugacaggcggauaaa

SEQ ID NO: 1354129 - RNA, 19 nt, Homo sapiens
uguccucauuugugacuau

SEQ ID NO: 1354130 - RNA, 19 nt, Homo sapiens
aaagcuguccucauuugug

SEQ ID NO: 1354131 - RNA, 19 nt, Homo sapiens
uuucuggagcugugcuuua

SEQ ID NO: 1354132 - RNA, 19 nt, Homo sapiens
ccuauggaguugggacaau

SEQ ID NO: 1354133 - RNA, 19 nt, Homo sapiens
acuauggaccuauggaguu

SEQ ID NO: 1354134 - RNA, 19 nt, Homo sapiens
gguggugucuugcccaaua

SEQ ID NO: 1354135 - RNA, 19 nt, Homo sapiens
agacugagagccaccauaa

SEQ ID NO: 1354136 - RNA, 19 nt, Homo sapiens
caagaagacccguaucauc

SEQ ID NO: 1354137 - RNA, 19 nt, Homo sapiens
uggcugcggugcuggagua

SEQ ID NO: 1354138 - RNA, 19 nt, Homo sapiens
ccauaaggccaaauaagga

SEQ ID NO: 1354139 - RNA, 19 nt, Homo sapiens
ccaaauaaggagcgagguu

SEQ ID NO: 1354140 - RNA, 19 nt, Homo sapiens
ugugaaaacuggaaaacaa

SEQ ID NO: 1354141 - RNA, 19 nt, Homo sapiens
ccaccauaaggccaaauaa

SEQ ID NO: 1354142 - RNA, 19 nt, Homo sapiens
guaccugaccgcugagauc

SEQ ID NO: 1354143 - RNA, 19 nt, Homo sapiens
ggagcgagguugugaaaac

SEQ ID NO: 1354144 - RNA, 19 nt, Homo sapiens
gccaccauaaggccaaaua

SEQ ID NO: 1354145 - RNA, 19 nt, Homo sapiens
gagccaccauaaggccaaa

SEQ ID NO: 1354146 - RNA, 19 nt, Homo sapiens
caagcaaggcgguaaagcu

SEQ ID NO: 1354147 - RNA, 19 nt, Homo sapiens
gcaacgacgaggagcucaa

SEQ ID NO: 1354148 - RNA, 19 nt, Homo sapiens
acaacaagaagacccguau

SEQ ID NO: 1354149 - RNA, 19 nt, Homo sapiens
aaggagcgagguugugaaa

SEQ ID NO: 1354150 - RNA, 19 nt, Homo sapiens
guggugucuugcccaauau

SEQ ID NO: 1354151 - RNA, 19 nt, Homo sapiens
cgacgaggagcucaacaag

SEQ ID NO: 1354152 - RNA, 19 nt, Homo sapiens
gugcugcugccuaagaaga

SEQ ID NO: 1354153 - RNA, 19 nt, Homo sapiens
aacaagaagacccguauca

SEQ ID NO: 1354154 - RNA, 19 nt, Homo sapiens
caacaagaagacccguauc

SEQ ID NO: 1354155 - RNA, 19 nt, Homo sapiens
acaagcugcugggcaaagu

SEQ ID NO: 1354156 - RNA, 19 nt, Homo sapiens
caacaagcugcugggcaaa

SEQ ID NO: 1354157 - RNA, 19 nt, Homo sapiens
ccaaggccgucaccaagua

SEQ ID NO: 1354158 - RNA, 19 nt, Homo sapiens
gcacaauugccuucgguua

SEQ ID NO: 1354159 - RNA, 19 nt, Homo sapiens
ggagggacuuucucuggaa

SEQ ID NO: 1354160 - RNA, 19 nt, Homo sapiens
ccucagcccuguaccuuaa

SEQ ID NO: 1354161 - RNA, 19 nt, Homo sapiens
cgaagaaagccgugacuaa

SEQ ID NO: 1354162 - RNA, 19 nt, Homo sapiens
gaagaaagccgugacuaag

SEQ ID NO: 1354163 - RNA, 19 nt, Homo sapiens
agacgagaaugcaaccaua

SEQ ID NO: 1354164 - RNA, 19 nt, Homo sapiens
guccauuccuucucucuaa

SEQ ID NO: 1354165 - RNA, 19 nt, Homo sapiens
gaagaaggacggcaagaag

SEQ ID NO: 1354166 - RNA, 19 nt, Homo sapiens
ugacuaaggcgcagaagaa

SEQ ID NO: 1354167 - RNA, 19 nt, Homo sapiens
ccaaagagaaucauuuaca

SEQ ID NO: 1354168 - RNA, 19 nt, Homo sapiens
guaguucgccuucaacaug

SEQ ID NO: 1354169 - RNA, 19 nt, Homo sapiens
gcucguaguucgccuucaa

SEQ ID NO: 1354170 - RNA, 19 nt, Homo sapiens
ucgguuaccucauuaucua

SEQ ID NO: 1354171 - RNA, 19 nt, Homo sapiens
guacaccagcgcuaaguaa

SEQ ID NO: 1354172 - RNA, 19 nt, Homo sapiens
cccuguaccuuaauaaauu

SEQ ID NO: 1354173 - RNA, 19 nt, Homo sapiens
ccaagaagggcucgaagaa

SEQ ID NO: 1354174 - RNA, 19 nt, Homo sapiens
aagaagggcucgaagaaag

SEQ ID NO: 1354175 - RNA, 19 nt, Homo sapiens
gggacuuucucuggaauuu

SEQ ID NO: 1354176 - RNA, 19 nt, Homo sapiens
gagaaagaguauauaagcu

SEQ ID NO: 1354177 - RNA, 19 nt, Homo sapiens
gagaaugcaaccauaccua

SEQ ID NO: 1354178 - RNA, 19 nt, Homo sapiens
caagaagggcucgaagaaa

SEQ ID NO: 1354179 - RNA, 19 nt, Homo sapiens
aacaagcgcucgaccauca

SEQ ID NO: 1354180 - RNA, 19 nt, Homo sapiens
gaguauauaagcuucugua

SEQ ID NO: 1354181 - RNA, 19 nt, Homo sapiens
gcaccaaggccgucaccaa

SEQ ID NO: 1354182 - RNA, 19 nt, Homo sapiens
acaccggcaucuccucuaa

SEQ ID NO: 1354183 - RNA, 19 nt, Homo sapiens
gaaagcuucuuaucaaaag

SEQ ID NO: 1354184 - RNA, 19 nt, Homo sapiens
gauaugaccaagaaagcuu

SEQ ID NO: 1354185 - RNA, 19 nt, Homo sapiens
cauuacccaucuccucuuu

SEQ ID NO: 1354186 - RNA, 19 nt, Homo sapiens
gaaugcaaccauaccuaga

SEQ ID NO: 1354187 - RNA, 19 nt, Homo sapiens
ccaaguacaccagcgcuaa

SEQ ID NO: 1354188 - RNA, 19 nt, Homo sapiens
ucagcccuguaccuuaaua

SEQ ID NO: 1354189 - RNA, 19 nt, Homo sapiens
gcuacuccguauacgugua

SEQ ID NO: 1354190 - RNA, 19 nt, Homo sapiens
cauuccuucucucuaauaa

SEQ ID NO: 1354191 - RNA, 19 nt, Homo sapiens
ucauucagauuccaaagag

SEQ ID NO: 1354192 - RNA, 19 nt, Homo sapiens
ugccuucgguuaccucauu

SEQ ID NO: 1354193 - RNA, 19 nt, Homo sapiens
cuaaggcgcagaagaagga

SEQ ID NO: 1354194 - RNA, 19 nt, Homo sapiens
cucauuaucuacugcagaa

SEQ ID NO: 1354195 - RNA, 19 nt, Homo sapiens
gagggacuuucucuggaau

SEQ ID NO: 1354196 - RNA, 19 nt, Homo sapiens
ugagaaagaguauauaagc

SEQ ID NO: 1354197 - RNA, 19 nt, Homo sapiens
uuccugauaugaccaagaa

SEQ ID NO: 1354198 - RNA, 19 nt, Homo sapiens
gaaaagaagacgagaaugc

SEQ ID NO: 1354199 - RNA, 19 nt, Homo sapiens
gcccuguaccuuaauaaau

SEQ ID NO: 1354200 - RNA, 19 nt, Homo sapiens
uuccuucucucuaauaauc

SEQ ID NO: 1354201 - RNA, 19 nt, Homo sapiens
ccauuccuucucucuaaua

SEQ ID NO: 1354202 - RNA, 19 nt, Homo sapiens
gccuucgguuaccucauua

SEQ ID NO: 1354203 - RNA, 19 nt, Homo sapiens
ccguauacguguacaaggu

SEQ ID NO: 1354204 - RNA, 19 nt, Homo sapiens
uaauuucugucuccuuggu

SEQ ID NO: 1354205 - RNA, 19 nt, Homo sapiens
agaagaaggacggcaagaa

SEQ ID NO: 1354206 - RNA, 19 nt, Homo sapiens
caccagcgcuaaguaaacu

SEQ ID NO: 1354207 - RNA, 19 nt, Homo sapiens
cgucaacgacaucuucgaa

SEQ ID NO: 1354208 - RNA, 19 nt, Homo sapiens
uacuguuccucaaagaauu

SEQ ID NO: 1354209 - RNA, 19 nt, Homo sapiens
aaagaagacgagaaugcaa

SEQ ID NO: 1354210 - RNA, 19 nt, Homo sapiens
ccucuaaggccaugggaau

SEQ ID NO: 1354211 - RNA, 19 nt, Homo sapiens
cauuuacuguuccucaaag

SEQ ID NO: 1354212 - RNA, 19 nt, Homo sapiens
cucaaagaauugucuacau

SEQ ID NO: 1354213 - RNA, 19 nt, Homo sapiens
uuacuguuccucaaagaau

SEQ ID NO: 1354214 - RNA, 19 nt, Homo sapiens
gcuaaagcuggccucuuga

SEQ ID NO: 1354215 - RNA, 19 nt, Homo sapiens
ccaaggagggacuuucucu

SEQ ID NO: 1354216 - RNA, 19 nt, Homo sapiens
aaagcuggccucuugaucu

SEQ ID NO: 1354217 - RNA, 19 nt, Homo sapiens
ggacuuuuccacaagcuaa

SEQ ID NO: 1354218 - RNA, 19 nt, Homo sapiens
ucauuuacuguuccucaaa

SEQ ID NO: 1354219 - RNA, 19 nt, Homo sapiens
caugaacuccuucgucaac

SEQ ID NO: 1354220 - RNA, 19 nt, Homo sapiens
gguccauuccuucucucua

SEQ ID NO: 1354221 - RNA, 19 nt, Homo sapiens
aagcuggccucuugaucuc

SEQ ID NO: 1354222 - RNA, 19 nt, Homo sapiens
cagcagagauucuuagcua

SEQ ID NO: 1354223 - RNA, 19 nt, Homo sapiens
ugaauucucuaccuguuua

SEQ ID NO: 1354224 - RNA, 19 nt, Homo sapiens
gcagagauucuuagcuaua

SEQ ID NO: 1354225 - RNA, 19 nt, Homo sapiens
gaaccaccauccucacaca

SEQ ID NO: 1354226 - RNA, 19 nt, Homo sapiens
cuucguguguucucaauuu

SEQ ID NO: 1354227 - RNA, 19 nt, Homo sapiens
gcucaacugacuuaucuuu

SEQ ID NO: 1354228 - RNA, 19 nt, Homo sapiens
cagagauucuuagcuauau

SEQ ID NO: 1354229 - RNA, 19 nt, Homo sapiens
gcaccuguguacugcagaa

SEQ ID NO: 1354230 - RNA, 19 nt, Homo sapiens
ugaauaaacucugaaccau

SEQ ID NO: 1354231 - RNA, 19 nt, Homo sapiens
cagaagaaccugcuacuac

SEQ ID NO: 1354232 - RNA, 19 nt, Homo sapiens
cagaauacuucauccugau

SEQ ID NO: 1354233 - RNA, 19 nt, Homo sapiens
gcuggaagcccaccacugu

SEQ ID NO: 1354234 - RNA, 19 nt, Homo sapiens
guauccuucuuucuucuuu

SEQ ID NO: 1354235 - RNA, 19 nt, Homo sapiens
guucuuguauccuucuuuc

SEQ ID NO: 1354236 - RNA, 19 nt, Homo sapiens
uaugaauucucuaccuguu

SEQ ID NO: 1354237 - RNA, 19 nt, Homo sapiens
gagucauggucucagcuuu

SEQ ID NO: 1354238 - RNA, 19 nt, Homo sapiens
gagauucuuagcuauaugu

SEQ ID NO: 1354239 - RNA, 19 nt, Homo sapiens
gucauggucucagcuuuga

SEQ ID NO: 1354240 - RNA, 19 nt, Homo sapiens
ccuguguacugcagaagaa

SEQ ID NO: 1354241 - RNA, 19 nt, Homo sapiens
ucaacugacuuaucuuuug

SEQ ID NO: 1354242 - RNA, 19 nt, Homo sapiens
cugcucaacugacuuaucu

SEQ ID NO: 1354243 - RNA, 19 nt, Homo sapiens
caacaacuuucugcucaac

SEQ ID NO: 1354244 - RNA, 19 nt, Homo sapiens
gcugugagaccacuugcuu

SEQ ID NO: 1354245 - RNA, 19 nt, Homo sapiens
ucaauauccuccucauggu

SEQ ID NO: 1354246 - RNA, 19 nt, Homo sapiens
ccaccauccucacacaaca

SEQ ID NO: 1354247 - RNA, 19 nt, Homo sapiens
caugcucucacccaaauuu

SEQ ID NO: 1354248 - RNA, 19 nt, Homo sapiens
uucugcaacugaucaauaa

SEQ ID NO: 1354249 - RNA, 19 nt, Homo sapiens
ggaauuuagguuucugcaa

SEQ ID NO: 1354250 - RNA, 19 nt, Homo sapiens
gagaaccaccauccucaca

SEQ ID NO: 1354251 - RNA, 19 nt, Homo sapiens
ucaugguucuuguauccuu

SEQ ID NO: 1354252 - RNA, 19 nt, Homo sapiens
caauauccuccucaugguu

SEQ ID NO: 1354253 - RNA, 19 nt, Homo sapiens
gagggagggcagaauacuu

SEQ ID NO: 1354254 - RNA, 19 nt, Homo sapiens
aacagaagcccacccucua

SEQ ID NO: 1354255 - RNA, 19 nt, Homo sapiens
acaacuuucugcucaacug

SEQ ID NO: 1354256 - RNA, 19 nt, Homo sapiens
acucugaaccauccucaaa

SEQ ID NO: 1354257 - RNA, 19 nt, Homo sapiens
ccucaugguucuuguaucc

SEQ ID NO: 1354258 - RNA, 19 nt, Homo sapiens
uuucugcaacugaucaaua

SEQ ID NO: 1354259 - RNA, 19 nt, Homo sapiens
gagggcagaauacuucauc

SEQ ID NO: 1354260 - RNA, 19 nt, Homo sapiens
caacuuucugcucaacuga

SEQ ID NO: 1354261 - RNA, 19 nt, Homo sapiens
acaacaacuuucugcucaa

SEQ ID NO: 1354262 - RNA, 19 nt, Homo sapiens
cuaccagcagagauucuua

SEQ ID NO: 1354263 - RNA, 19 nt, Homo sapiens
ccaacuugcugucaaaaca

SEQ ID NO: 1354264 - RNA, 19 nt, Homo sapiens
cuuguauccuucuuucuuc

SEQ ID NO: 1354265 - RNA, 19 nt, Homo sapiens
uggaagcccaccacuguga

SEQ ID NO: 1354266 - RNA, 19 nt, Homo sapiens
gcaacugaucaauaaucuu

SEQ ID NO: 1354267 - RNA, 19 nt, Homo sapiens
gaauucucuaccuguuuaa

SEQ ID NO: 1354268 - RNA, 19 nt, Homo sapiens
cgcccaacuugcugucaaa

SEQ ID NO: 1354269 - RNA, 19 nt, Homo sapiens
cuugagggagggcagaaua

SEQ ID NO: 1354270 - RNA, 19 nt, Homo sapiens
uuucugcucaacugacuua

SEQ ID NO: 1354271 - RNA, 19 nt, Homo sapiens
accaugcucucacccaaau

SEQ ID NO: 1354272 - RNA, 19 nt, Homo sapiens
uaaggaauuuagguuucug

SEQ ID NO: 1354273 - RNA, 19 nt, Homo sapiens
aaagucaagagcuucauuc

SEQ ID NO: 1354274 - RNA, 19 nt, Homo sapiens
ccuuacacuuuguggauca

SEQ ID NO: 1354275 - RNA, 19 nt, Homo sapiens
caacugacuuaucuuuugg

SEQ ID NO: 1354276 - RNA, 19 nt, Homo sapiens
cauccucacacaacaacuu

SEQ ID NO: 1354277 - RNA, 19 nt, Homo sapiens
agagauucuuagcuauaug

SEQ ID NO: 1354278 - RNA, 19 nt, Homo sapiens
ccgcccaacuugcugucaa

SEQ ID NO: 1354279 - RNA, 19 nt, Homo sapiens
agaauacuucauccugauu

SEQ ID NO: 1354280 - RNA, 19 nt, Homo sapiens
guaauccacuagcuaagaa

SEQ ID NO: 1354281 - RNA, 19 nt, Homo sapiens
ccagugagguacacauuau

SEQ ID NO: 1354282 - RNA, 19 nt, Homo sapiens
cacauuaucuccauuucaa

SEQ ID NO: 1354283 - RNA, 19 nt, Homo sapiens
uccacuagcuaagaaauua

SEQ ID NO: 1354284 - RNA, 19 nt, Homo sapiens
guucaaguuugccagaauu

SEQ ID NO: 1354285 - RNA, 19 nt, Homo sapiens
guacacauuaucuccauuu

SEQ ID NO: 1354286 - RNA, 19 nt, Homo sapiens
agaauauccuucccaguga

SEQ ID NO: 1354287 - RNA, 19 nt, Homo sapiens
uaaacucccucccuugcuu

SEQ ID NO: 1354288 - RNA, 19 nt, Homo sapiens
gcucaucucucccuucacu

SEQ ID NO: 1354289 - RNA, 19 nt, Homo sapiens
ggagugggauugaugucau

SEQ ID NO: 1354290 - RNA, 19 nt, Homo sapiens
ccaaugagcccaucaccau

SEQ ID NO: 1354291 - RNA, 19 nt, Homo sapiens
ccacugcccuggcucaucu

SEQ ID NO: 1354292 - RNA, 19 nt, Homo sapiens
ccagucauggcaccaaaua

SEQ ID NO: 1354293 - RNA, 19 nt, Homo sapiens
gagugggauugaugucauu

SEQ ID NO: 1354294 - RNA, 19 nt, Homo sapiens
ccacaguuguagaccauuc

SEQ ID NO: 1354295 - RNA, 19 nt, Homo sapiens
caggguggacuucauguuu

SEQ ID NO: 1354296 - RNA, 19 nt, Homo sapiens
ugucagccuuucagucauu

SEQ ID NO: 1354297 - RNA, 19 nt, Homo sapiens
ggacacauggagugggauu

SEQ ID NO: 1354298 - RNA, 19 nt, Homo sapiens
ggcaccaaauaugaaauaa

SEQ ID NO: 1354299 - RNA, 19 nt, Homo sapiens
ggacuucauguuuccaaug

SEQ ID NO: 1354300 - RNA, 19 nt, Homo sapiens
cuucugugcugacuauuag

SEQ ID NO: 1354301 - RNA, 19 nt, Homo sapiens
uggcaccaaauaugaaaua

SEQ ID NO: 1354302 - RNA, 19 nt, Homo sapiens
gcccacaguuguagaccau

SEQ ID NO: 1354303 - RNA, 19 nt, Homo sapiens
uggcucaucucucccuuca

SEQ ID NO: 1354304 - RNA, 19 nt, Homo sapiens
gguacacauuaucuccauu

SEQ ID NO: 1354305 - RNA, 19 nt, Homo sapiens
ccaaggcuguggccaagac

SEQ ID NO: 1354306 - RNA, 19 nt, Homo sapiens
ccucugacaccaugguaaa

SEQ ID NO: 1354307 - RNA, 19 nt, Homo sapiens
guuuugagccuacagaaua

SEQ ID NO: 1354308 - RNA, 19 nt, Homo sapiens
gcaggguggacuucauguu

SEQ ID NO: 1354309 - RNA, 19 nt, Homo sapiens
agucauggcaccaaauaug

SEQ ID NO: 1354310 - RNA, 19 nt, Homo sapiens
cccaugcucuccugcuuuc

SEQ ID NO: 1354311 - RNA, 19 nt, Homo sapiens
acacauggagugggauuga

SEQ ID NO: 1354312 - RNA, 19 nt, Homo sapiens
cccagugagguacacauua

SEQ ID NO: 1354313 - RNA, 19 nt, Homo sapiens
cauggcaccaaauaugaaa

SEQ ID NO: 1354314 - RNA, 19 nt, Homo sapiens
ucugucagccuuucaguca

SEQ ID NO: 1354315 - RNA, 19 nt, Homo sapiens
augguaaacuccuguugug

SEQ ID NO: 1354316 - RNA, 19 nt, Homo sapiens
auucuucugugcugacuau

SEQ ID NO: 1354317 - RNA, 19 nt, Homo sapiens
gaaacccaacuagauccuu

SEQ ID NO: 1354318 - RNA, 19 nt, Homo sapiens
caugguaaacuccuguugu

SEQ ID NO: 1354319 - RNA, 19 nt, Homo sapiens
auuccaauccucuaaauuc

SEQ ID NO: 1354320 - RNA, 19 nt, Homo sapiens
uuuguaauccacuagcuaa

SEQ ID NO: 1354321 - RNA, 19 nt, Homo sapiens
aggguggacuucauguuuc

SEQ ID NO: 1354322 - RNA, 19 nt, Homo sapiens
cagcaggguggacuucaug

SEQ ID NO: 1354323 - RNA, 19 nt, Homo sapiens
cugcaggcccacaguugua

SEQ ID NO: 1354324 - RNA, 19 nt, Homo sapiens
gagccuacagaauauccuu

SEQ ID NO: 1354325 - RNA, 19 nt, Homo sapiens
ccacuagcuaagaaauuau

SEQ ID NO: 1354326 - RNA, 19 nt, Homo sapiens
aaacucccucccuugcuuu

SEQ ID NO: 1354327 - RNA, 19 nt, Homo sapiens
ucuucugugcugacuauua

SEQ ID NO: 1354328 - RNA, 19 nt, Homo sapiens
gaacauaaguugaauuugc

SEQ ID NO: 1354329 - RNA, 19 nt, Homo sapiens
aaucuggccuccaaauaua

SEQ ID NO: 1354330 - RNA, 19 nt, Homo sapiens
ucugaaaucugucaacuau

SEQ ID NO: 1354331 - RNA, 19 nt, Homo sapiens
gaaucuggccuccaaauau

SEQ ID NO: 1354332 - RNA, 19 nt, Homo sapiens
ugaaaucugucaacuaucu

SEQ ID NO: 1354333 - RNA, 19 nt, Homo sapiens
caaccagcauucuugaugu

SEQ ID NO: 1354334 - RNA, 19 nt, Homo sapiens
uaaguugaauuugcucuga

SEQ ID NO: 1354335 - RNA, 19 nt, Homo sapiens
uuaccucucuaccaaauga

SEQ ID NO: 1354336 - RNA, 19 nt, Homo sapiens
ucuaugagcugaguuaugg

SEQ ID NO: 1354337 - RNA, 19 nt, Homo sapiens
ccaaaugaacauaaguuga

SEQ ID NO: 1354338 - RNA, 19 nt, Homo sapiens
ugaaucuggccuccaaaua

SEQ ID NO: 1354339 - RNA, 19 nt, Homo sapiens
uauuugcucucugccauaa

SEQ ID NO: 1354340 - RNA, 19 nt, Homo sapiens
aaccagcauucuugaugua

SEQ ID NO: 1354341 - RNA, 19 nt, Homo sapiens
uagcccaucugcuggcaaa

SEQ ID NO: 1354342 - RNA, 19 nt, Homo sapiens
gaaccuccacccucugaca

SEQ ID NO: 1354343 - RNA, 19 nt, Homo sapiens
uccaaccaauucuuagauu

SEQ ID NO: 1354344 - RNA, 19 nt, Homo sapiens
ccaaccugcucuagugcuu

SEQ ID NO: 1354345 - RNA, 19 nt, Homo sapiens
gcucugaaaucugucaacu

SEQ ID NO: 1354346 - RNA, 19 nt, Homo sapiens
gcuguggccuagagaacug

SEQ ID NO: 1354347 - RNA, 19 nt, Homo sapiens
uuugcucucugccauaauu

SEQ ID NO: 1354348 - RNA, 19 nt, Homo sapiens
gcugaguuaugggaagcua

SEQ ID NO: 1354349 - RNA, 19 nt, Homo sapiens
gccagucucuaugcugcua

SEQ ID NO: 1354350 - RNA, 19 nt, Homo sapiens
augggaagcuaguuggaaa

SEQ ID NO: 1354351 - RNA, 19 nt, Homo sapiens
ggacucaccagauucucau

SEQ ID NO: 1354352 - RNA, 19 nt, Homo sapiens
cgcccaaccugcucuagug

SEQ ID NO: 1354353 - RNA, 19 nt, Homo sapiens
gaaaucugucaacuaucuu

SEQ ID NO: 1354354 - RNA, 19 nt, Homo sapiens
caguuccaaccaauucuua

SEQ ID NO: 1354355 - RNA, 19 nt, Homo sapiens
uuucucauauggagcuauu

SEQ ID NO: 1354356 - RNA, 19 nt, Homo sapiens
ucucugccauaauuucuca

SEQ ID NO: 1354357 - RNA, 19 nt, Homo sapiens
cagccuuccugcaguaucu

SEQ ID NO: 1354358 - RNA, 19 nt, Homo sapiens
ugccagccuuccugcagua

SEQ ID NO: 1354359 - RNA, 19 nt, Homo sapiens
aguugaauuugcucugaaa

SEQ ID NO: 1354360 - RNA, 19 nt, Homo sapiens
ucaucaaccagcauucuug

SEQ ID NO: 1354361 - RNA, 19 nt, Homo sapiens
gcuggcaaaccaccugcua

SEQ ID NO: 1354362 - RNA, 19 nt, Homo sapiens
cauuguggccagucucuau

SEQ ID NO: 1354363 - RNA, 19 nt, Homo sapiens
guuccaaccaauucuuaga

SEQ ID NO: 1354364 - RNA, 19 nt, Homo sapiens
ccugcugcaucuccaguug

SEQ ID NO: 1354365 - RNA, 19 nt, Homo sapiens
ggagcuauuccauuuuaaa

SEQ ID NO: 1354366 - RNA, 19 nt, Homo sapiens
cagaccacccgcugcagaa

SEQ ID NO: 1354367 - RNA, 19 nt, Homo sapiens
gggcauccaucuacauuua

SEQ ID NO: 1354368 - RNA, 19 nt, Homo sapiens
gaaagggcauccaucuaca

SEQ ID NO: 1354369 - RNA, 19 nt, Homo sapiens
ugacuguuaugcuugauuu

SEQ ID NO: 1354370 - RNA, 19 nt, Homo sapiens
cuaaguaacuggugaaagg

SEQ ID NO: 1354371 - RNA, 19 nt, Homo sapiens
ucaauuuguccauguguua

SEQ ID NO: 1354372 - RNA, 19 nt, Homo sapiens
uuaaauggccaucagcuuu

SEQ ID NO: 1354373 - RNA, 19 nt, Homo sapiens
gaccagggcugugaucaag

SEQ ID NO: 1354374 - RNA, 19 nt, Homo sapiens
gcauccaucuacauuuaau

SEQ ID NO: 1354375 - RNA, 19 nt, Homo sapiens
cagcuuuauuauccuguua

SEQ ID NO: 1354376 - RNA, 19 nt, Homo sapiens
gccaucagcuuuauuaucc

SEQ ID NO: 1354377 - RNA, 19 nt, Homo sapiens
acaccaugguuaacucuug

SEQ ID NO: 1354378 - RNA, 19 nt, Homo sapiens
ugaaagggcauccaucuac

SEQ ID NO: 1354379 - RNA, 19 nt, Homo sapiens
gaaccuccacccucugaca

SEQ ID NO: 1354380 - RNA, 19 nt, Homo sapiens
ccucugacaccaugguuaa

SEQ ID NO: 1354381 - RNA, 19 nt, Homo sapiens
ccuguuauuccacuaagua

SEQ ID NO: 1354382 - RNA, 19 nt, Homo sapiens
cagucaccaucccaugaua

SEQ ID NO: 1354383 - RNA, 19 nt, Homo sapiens
uguugaaccucauauugga

SEQ ID NO: 1354384 - RNA, 19 nt, Homo sapiens
gugaaagggcauccaucua

SEQ ID NO: 1354385 - RNA, 19 nt, Homo sapiens
ccaucuacauuuaauacca

SEQ ID NO: 1354386 - RNA, 19 nt, Homo sapiens
cuuggaaaccuaccuagaa

SEQ ID NO: 1354387 - RNA, 19 nt, Homo sapiens
gcucugaccagggcuguga

SEQ ID NO: 1354388 - RNA, 19 nt, Homo sapiens
ucagaccucagaugcauga

SEQ ID NO: 1354389 - RNA, 19 nt, Homo sapiens
ggugaaagggcauccaucu

SEQ ID NO: 1354390 - RNA, 19 nt, Homo sapiens
caauuuguccauguguuaa

SEQ ID NO: 1354391 - RNA, 19 nt, Homo sapiens
caccaucccaugauaugaa

SEQ ID NO: 1354392 - RNA, 19 nt, Homo sapiens
caccaugguuaacucuugu

SEQ ID NO: 1354393 - RNA, 19 nt, Homo sapiens
ggccaucagcuuuauuauc

SEQ ID NO: 1354394 - RNA, 19 nt, Homo sapiens
aaauggccaucagcuuuau

SEQ ID NO: 1354395 - RNA, 19 nt, Homo sapiens
gccagucaccaucccauga

SEQ ID NO: 1354396 - RNA, 19 nt, Homo sapiens
cauauuggacuaucaacca

SEQ ID NO: 1354397 - RNA, 19 nt, Homo sapiens
gaaccucauauuggacuau

SEQ ID NO: 1354398 - RNA, 19 nt, Homo sapiens
ccauccugcucucagacua

SEQ ID NO: 1354399 - RNA, 19 nt, Homo sapiens
augguuaacucuuguugug

SEQ ID NO: 1354400 - RNA, 19 nt, Homo sapiens
ccacuaaguaacuggugaa

SEQ ID NO: 1354401 - RNA, 19 nt, Homo sapiens
uguggauccucuuguugaa

SEQ ID NO: 1354402 - RNA, 19 nt, Homo sapiens
ggcauccaucuacauuuaa

SEQ ID NO: 1354403 - RNA, 19 nt, Homo sapiens
ggaaaccuaccuagaaccu

SEQ ID NO: 1354404 - RNA, 19 nt, Homo sapiens
guuaaauggccaucagcuu

SEQ ID NO: 1354405 - RNA, 19 nt, Homo sapiens
uagaaccuccacccucuga

SEQ ID NO: 1354406 - RNA, 19 nt, Homo sapiens
gcugccagaccaccuguug

SEQ ID NO: 1354407 - RNA, 19 nt, Homo sapiens
cuacauuuaauaccacuca

SEQ ID NO: 1354408 - RNA, 19 nt, Homo sapiens
ucagcuuuauuauccuguu

SEQ ID NO: 1354409 - RNA, 19 nt, Homo sapiens
gcuguggauccucuuguug

SEQ ID NO: 1354410 - RNA, 19 nt, Homo sapiens
auuggacuaucaaccauga

SEQ ID NO: 1354411 - RNA, 19 nt, Homo sapiens
ccaauuguauucuguguuu

SEQ ID NO: 1354412 - RNA, 19 nt, Homo sapiens
guaauacacuagcuaagaa

SEQ ID NO: 1354413 - RNA, 19 nt, Homo sapiens
caucucugcuuucuaauaa

SEQ ID NO: 1354414 - RNA, 19 nt, Homo sapiens
ucagugagguagauauuau

SEQ ID NO: 1354415 - RNA, 19 nt, Homo sapiens
ucaauaggauggaccuuau

SEQ ID NO: 1354416 - RNA, 19 nt, Homo sapiens
uugcaucucugcuuucuaa

SEQ ID NO: 1354417 - RNA, 19 nt, Homo sapiens
gugaauuucuuaugcuuug

SEQ ID NO: 1354418 - RNA, 19 nt, Homo sapiens
gcaucucugcuuucuaaua

SEQ ID NO: 1354419 - RNA, 19 nt, Homo sapiens
guacagauucuccuucuca

SEQ ID NO: 1354420 - RNA, 19 nt, Homo sapiens
ccaaagagcccaccaccau

SEQ ID NO: 1354421 - RNA, 19 nt, Homo sapiens
gaccuuaugcuuccaaaga

SEQ ID NO: 1354422 - RNA, 19 nt, Homo sapiens
cuacugugcugaccauuag

SEQ ID NO: 1354423 - RNA, 19 nt, Homo sapiens
aaagagcccaccaccauuu

SEQ ID NO: 1354424 - RNA, 19 nt, Homo sapiens
caaagagcccaccaccauu

SEQ ID NO: 1354425 - RNA, 19 nt, Homo sapiens
ccacuggcccacagaugua

SEQ ID NO: 1354426 - RNA, 19 nt, Homo sapiens
gcaccaaaugugaauuaau

SEQ ID NO: 1354427 - RNA, 19 nt, Homo sapiens
ggcaccaaaugugaauuaa

SEQ ID NO: 1354428 - RNA, 19 nt, Homo sapiens
ccacccaauuguauucugu

SEQ ID NO: 1354429 - RNA, 19 nt, Homo sapiens
uggcaccaaaugugaauua

SEQ ID NO: 1354430 - RNA, 19 nt, Homo sapiens
gcugucagaccaccuguug

SEQ ID NO: 1354431 - RNA, 19 nt, Homo sapiens
gggugaauuucuuaugcuu

SEQ ID NO: 1354432 - RNA, 19 nt, Homo sapiens
ccauuaggauacaugaagu

SEQ ID NO: 1354433 - RNA, 19 nt, Homo sapiens
ggugaauuucuuaugcuuu

SEQ ID NO: 1354434 - RNA, 19 nt, Homo sapiens
ucuacugugcugaccauua

SEQ ID NO: 1354435 - RNA, 19 nt, Homo sapiens
uagggugaauuucuuaugc

SEQ ID NO: 1354436 - RNA, 19 nt, Homo sapiens
gauccagccacccaauugu

SEQ ID NO: 1354437 - RNA, 19 nt, Homo sapiens
gaagugggguugaugucau

SEQ ID NO: 1354438 - RNA, 19 nt, Homo sapiens
uuuguugcaucucugcuuu

SEQ ID NO: 1354439 - RNA, 19 nt, Homo sapiens
agauucuccuucucaguga

SEQ ID NO: 1354440 - RNA, 19 nt, Homo sapiens
ucacuuuaagguacagauu

SEQ ID NO: 1354441 - RNA, 19 nt, Homo sapiens
gcggccaaguccucuguca

SEQ ID NO: 1354442 - RNA, 19 nt, Homo sapiens
uaggauggaccuuaugcuu

SEQ ID NO: 1354443 - RNA, 19 nt, Homo sapiens
gugcugaccauuaggauac

SEQ ID NO: 1354444 - RNA, 19 nt, Homo sapiens
gauguugcacccucagauc

SEQ ID NO: 1354445 - RNA, 19 nt, Homo sapiens
cuccuagggugaauuucuu

SEQ ID NO: 1354446 - RNA, 19 nt, Homo sapiens
ugaugucauucaauaggau

SEQ ID NO: 1354447 - RNA, 19 nt, Homo sapiens
ucucugcuuucuaauaaac

SEQ ID NO: 1354448 - RNA, 19 nt, Homo sapiens
cagauccagccacccaauu

SEQ ID NO: 1354449 - RNA, 19 nt, Homo sapiens
caauaggauggaccuuaug

SEQ ID NO: 1354450 - RNA, 19 nt, Homo sapiens
cagacaaucacauucauua

SEQ ID NO: 1354451 - RNA, 19 nt, Homo sapiens
gcuaaugucuccuugugau

SEQ ID NO: 1354452 - RNA, 19 nt, Homo sapiens
acacuucccugccaguuug

SEQ ID NO: 1354453 - RNA, 19 nt, Homo sapiens
gaaaugacagacaaucaca

SEQ ID NO: 1354454 - RNA, 19 nt, Homo sapiens
gacacuaacugugaugauc

SEQ ID NO: 1354455 - RNA, 19 nt, Homo sapiens
aaacagccacuucccuaaa

SEQ ID NO: 1354456 - RNA, 19 nt, Homo sapiens
ugacagacaaucacauuca

SEQ ID NO: 1354457 - RNA, 19 nt, Homo sapiens
uaaacagccacuucccuaa

SEQ ID NO: 1354458 - RNA, 19 nt, Homo sapiens
gcuguggccuggagaacug

SEQ ID NO: 1354459 - RNA, 19 nt, Homo sapiens
gaacacuucccugccaguu

SEQ ID NO: 1354460 - RNA, 19 nt, Homo sapiens
gacagacaaucacauucau

SEQ ID NO: 1354461 - RNA, 19 nt, Homo sapiens
cacccuagcugcugcaucu

SEQ ID NO: 1354462 - RNA, 19 nt, Homo sapiens
gaaccuccacccucugaca

SEQ ID NO: 1354463 - RNA, 19 nt, Homo sapiens
ggaaaugacagacaaucac

SEQ ID NO: 1354464 - RNA, 19 nt, Homo sapiens
ggacacuaacugugaugau

SEQ ID NO: 1354465 - RNA, 19 nt, Homo sapiens
agcagugucuucauucgaa

SEQ ID NO: 1354466 - RNA, 19 nt, Homo sapiens
cugcuaaugucuccuugug

SEQ ID NO: 1354467 - RNA, 19 nt, Homo sapiens
uaaugucuccuugugauau

SEQ ID NO: 1354468 - RNA, 19 nt, Homo sapiens
aaugucuccuugugauauu

SEQ ID NO: 1354469 - RNA, 19 nt, Homo sapiens
cuaaugucuccuugugaua

SEQ ID NO: 1354470 - RNA, 19 nt, Homo sapiens
ugccuccucuugcugcuaa

SEQ ID NO: 1354471 - RNA, 19 nt, Homo sapiens
gagcagugucuucauucga

SEQ ID NO: 1354472 - RNA, 19 nt, Homo sapiens
uagaugagcagugucuuca

SEQ ID NO: 1354473 - RNA, 19 nt, Homo sapiens
gcauucagaguggacauuc

SEQ ID NO: 1354474 - RNA, 19 nt, Homo sapiens
acagacaaucacauucauu

SEQ ID NO: 1354475 - RNA, 19 nt, Homo sapiens
caaauaugcucaccaaaca

SEQ ID NO: 1354476 - RNA, 19 nt, Homo sapiens
gagcuauuccucuaucuua

SEQ ID NO: 1354477 - RNA, 19 nt, Homo sapiens
cauguucccugaauugaaa

SEQ ID NO: 1354478 - RNA, 19 nt, Homo sapiens
uaaccagcauucuugauau

SEQ ID NO: 1354479 - RNA, 19 nt, Homo sapiens
ugaaauauuugcucucuac

SEQ ID NO: 1354480 - RNA, 19 nt, Homo sapiens
uauuugcucucuaccauaa

SEQ ID NO: 1354481 - RNA, 19 nt, Homo sapiens
auacucaccugccuuuauu

SEQ ID NO: 1354482 - RNA, 19 nt, Homo sapiens
gcugaugcccucaccuaua

SEQ ID NO: 1354483 - RNA, 19 nt, Homo sapiens
gauaugauccaccugugaa

SEQ ID NO: 1354484 - RNA, 19 nt, Homo sapiens
gcuacccucuaccaaauga

SEQ ID NO: 1354485 - RNA, 19 nt, Homo sapiens
caaccucaguuccaaccaa

SEQ ID NO: 1354486 - RNA, 19 nt, Homo sapiens
uuaaccagcauucuugaua

SEQ ID NO: 1354487 - RNA, 19 nt, Homo sapiens
acauggagcuauuccucua

SEQ ID NO: 1354488 - RNA, 19 nt, Homo sapiens
ccaaauaugcucaccaaac

SEQ ID NO: 1354489 - RNA, 19 nt, Homo sapiens
gcuauuccucuaucuuaaa

SEQ ID NO: 1354490 - RNA, 19 nt, Homo sapiens
gaaccuccacccucugaca

SEQ ID NO: 1354491 - RNA, 19 nt, Homo sapiens
aauauuugcucucuaccau

SEQ ID NO: 1354492 - RNA, 19 nt, Homo sapiens
gcuguggccuagagaacug

SEQ ID NO: 1354493 - RNA, 19 nt, Homo sapiens
cuccaaauaugcucaccaa

SEQ ID NO: 1354494 - RNA, 19 nt, Homo sapiens
cagcauucuugauaugauc

SEQ ID NO: 1354495 - RNA, 19 nt, Homo sapiens
ccagcauucuugauaugau

SEQ ID NO: 1354496 - RNA, 19 nt, Homo sapiens
ggaaauccacccagaaccu

SEQ ID NO: 1354497 - RNA, 19 nt, Homo sapiens
cugaugcccucaccuauac

SEQ ID NO: 1354498 - RNA, 19 nt, Homo sapiens
ggagcuauuccucuaucuu

SEQ ID NO: 1354499 - RNA, 19 nt, Homo sapiens
uugcuacccucuaccaaau

SEQ ID NO: 1354500 - RNA, 19 nt, Homo sapiens
cgcccaaccugcucuagug

SEQ ID NO: 1354501 - RNA, 19 nt, Homo sapiens
aaucaugcaaggccaauug

SEQ ID NO: 1354502 - RNA, 19 nt, Homo sapiens
uuauuaaccagcauucuug

SEQ ID NO: 1354503 - RNA, 19 nt, Homo sapiens
uauacucaccugccuuuau

SEQ ID NO: 1354504 - RNA, 19 nt, Homo sapiens
uuuaucacauggagcuauu

SEQ ID NO: 1354505 - RNA, 19 nt, Homo sapiens
ccuauacucaccugccuuu

SEQ ID NO: 1354506 - RNA, 19 nt, Homo sapiens
guugcuacccucuaccaaa

SEQ ID NO: 1354507 - RNA, 19 nt, Homo sapiens
aaccagcauucuugauaug

SEQ ID NO: 1354508 - RNA, 19 nt, Homo sapiens
ucaccugccuuuauuaacc

SEQ ID NO: 1354509 - RNA, 19 nt, Homo sapiens
ccaauuggacaaccucagu

SEQ ID NO: 1354510 - RNA, 19 nt, Homo sapiens
ugauccaccugugaacuga

SEQ ID NO: 1354511 - RNA, 19 nt, Homo sapiens
uuugcucucuaccauaauu

SEQ ID NO: 1354512 - RNA, 19 nt, Homo sapiens
acucaccugccuuuauuaa

SEQ ID NO: 1354513 - RNA, 19 nt, Homo sapiens
ccucaguuccaaccaauuc

SEQ ID NO: 1354514 - RNA, 19 nt, Homo sapiens
caauuggacaaccucaguu

SEQ ID NO: 1354515 - RNA, 19 nt, Homo sapiens
ugauaugauccaccuguga

SEQ ID NO: 1354516 - RNA, 19 nt, Homo sapiens
ccauguucccugaauugaa

SEQ ID NO: 1354517 - RNA, 19 nt, Homo sapiens
agcuauuccucuaucuuaa

SEQ ID NO: 1354518 - RNA, 19 nt, Homo sapiens
ucuaccaaaugaauacaag

SEQ ID NO: 1354519 - RNA, 19 nt, Homo sapiens
gcuaauggauggcuacuuu

SEQ ID NO: 1354520 - RNA, 19 nt, Homo sapiens
cauagaagcuuuagcauuc

SEQ ID NO: 1354521 - RNA, 19 nt, Homo sapiens
guacucugcuuuagaaauu

SEQ ID NO: 1354522 - RNA, 19 nt, Homo sapiens
gcuguucgauuccuucaua

SEQ ID NO: 1354523 - RNA, 19 nt, Homo sapiens
gcauucaccuaucucagua

SEQ ID NO: 1354524 - RNA, 19 nt, Homo sapiens
ccaagaggcugcuaaugga

SEQ ID NO: 1354525 - RNA, 19 nt, Homo sapiens
caacuaauguacucugcuu

SEQ ID NO: 1354526 - RNA, 19 nt, Homo sapiens
guucgauuccuucauauua

SEQ ID NO: 1354527 - RNA, 19 nt, Homo sapiens
caacauagaagcuuuagca

SEQ ID NO: 1354528 - RNA, 19 nt, Homo sapiens
ucaccuaucucaguaccua

SEQ ID NO: 1354529 - RNA, 19 nt, Homo sapiens
uuacaucucuggcauagca

SEQ ID NO: 1354530 - RNA, 19 nt, Homo sapiens
aauguacucugcuuuagaa

SEQ ID NO: 1354531 - RNA, 19 nt, Homo sapiens
uaaauaccacagacucuaa

SEQ ID NO: 1354532 - RNA, 19 nt, Homo sapiens
agucuugggugguaucuuu

SEQ ID NO: 1354533 - RNA, 19 nt, Homo sapiens
gagcccaccugcugugaca

SEQ ID NO: 1354534 - RNA, 19 nt, Homo sapiens
caucugcuccucugacaaa

SEQ ID NO: 1354535 - RNA, 19 nt, Homo sapiens
acuaauguacucugcuuua

SEQ ID NO: 1354536 - RNA, 19 nt, Homo sapiens
ucucaguaccuacaacuaa

SEQ ID NO: 1354537 - RNA, 19 nt, Homo sapiens
ggaauucuguuuucagucu

SEQ ID NO: 1354538 - RNA, 19 nt, Homo sapiens
uccugaagcuguucgauuc

SEQ ID NO: 1354539 - RNA, 19 nt, Homo sapiens
acauagaagcuuuagcauu

SEQ ID NO: 1354540 - RNA, 19 nt, Homo sapiens
uaauguacucugcuuuaga

SEQ ID NO: 1354541 - RNA, 19 nt, Homo sapiens
caccugcugugacaacugu

SEQ ID NO: 1354542 - RNA, 19 nt, Homo sapiens
ggaacaaggaugguacuac

SEQ ID NO: 1354543 - RNA, 19 nt, Homo sapiens
cccaagaggcugcuaaugg

SEQ ID NO: 1354544 - RNA, 19 nt, Homo sapiens
gcaguuugaaucaguggau

SEQ ID NO: 1354545 - RNA, 19 nt, Homo sapiens
auaaauaccacagacucua

SEQ ID NO: 1354546 - RNA, 19 nt, Homo sapiens
gcaccugcccacacacagu

SEQ ID NO: 1354547 - RNA, 19 nt, Homo sapiens
gcuuuagcauucaccuauc

SEQ ID NO: 1354548 - RNA, 19 nt, Homo sapiens
gugggugguuugggaauuc

SEQ ID NO: 1354549 - RNA, 19 nt, Homo sapiens
ugaagcuguucgauuccuu

SEQ ID NO: 1354550 - RNA, 19 nt, Homo sapiens
cucaguaccuacaacuaau

SEQ ID NO: 1354551 - RNA, 19 nt, Homo sapiens
ugaaucaguggaugccuau

SEQ ID NO: 1354552 - RNA, 19 nt, Homo sapiens
uuagaaauuggaacaagga

SEQ ID NO: 1354553 - RNA, 19 nt, Homo sapiens
agucaacauagaagcuuua

SEQ ID NO: 1354554 - RNA, 19 nt, Homo sapiens
aagucaacauagaagcuuu

SEQ ID NO: 1354555 - RNA, 19 nt, Homo sapiens
ugggugguaucuuucugaa

SEQ ID NO: 1354556 - RNA, 19 nt, Homo sapiens
ccacacacaguuugguuac

SEQ ID NO: 1354557 - RNA, 19 nt, Homo sapiens
gcaauacacugaagccuaa

SEQ ID NO: 1354558 - RNA, 19 nt, Homo sapiens
ccacagagcaauacacuga

SEQ ID NO: 1354559 - RNA, 19 nt, Homo sapiens
gcucacuguugucaauaaa

SEQ ID NO: 1354560 - RNA, 19 nt, Homo sapiens
ggacuuugcaaacacauuc

SEQ ID NO: 1354561 - RNA, 19 nt, Homo sapiens
caucagccuuagucauuau

SEQ ID NO: 1354562 - RNA, 19 nt, Homo sapiens
acaucagccuuagucauua

SEQ ID NO: 1354563 - RNA, 19 nt, Homo sapiens
uacaucagccuuagucauu

SEQ ID NO: 1354564 - RNA, 19 nt, Homo sapiens
caaggugacaauagugauu

SEQ ID NO: 1354565 - RNA, 19 nt, Homo sapiens
aaucgaccuuuaagaauuc

SEQ ID NO: 1354566 - RNA, 19 nt, Homo sapiens
uguaagcagacguccauua

SEQ ID NO: 1354567 - RNA, 19 nt, Homo sapiens
aagcagacguccauuacca

SEQ ID NO: 1354568 - RNA, 19 nt, Homo sapiens
acugaagccuaaacaucua

SEQ ID NO: 1354569 - RNA, 19 nt, Homo sapiens
guugcucacuguugucaau

SEQ ID NO: 1354570 - RNA, 19 nt, Homo sapiens
gcucaaacugucaccauca

SEQ ID NO: 1354571 - RNA, 19 nt, Homo sapiens
ucacuguugucaauaaacu

SEQ ID NO: 1354572 - RNA, 19 nt, Homo sapiens
cauuauggauaguaaaucg

SEQ ID NO: 1354573 - RNA, 19 nt, Homo sapiens
acacugaagccuaaacauc

SEQ ID NO: 1354574 - RNA, 19 nt, Homo sapiens
caaacugucaccaucaucu

SEQ ID NO: 1354575 - RNA, 19 nt, Homo sapiens
gguggacuuugcaaacaca

SEQ ID NO: 1354576 - RNA, 19 nt, Homo sapiens
gguguaagcagacguccau

SEQ ID NO: 1354577 - RNA, 19 nt, Homo sapiens
cacaaggugacaauaguga

SEQ ID NO: 1354578 - RNA, 19 nt, Homo sapiens
acagagcaauacacugaag

SEQ ID NO: 1354579 - RNA, 19 nt, Homo sapiens
caaacacauucuacaaccu

SEQ ID NO: 1354580 - RNA, 19 nt, Homo sapiens
gccuuagucauuauggaua

SEQ ID NO: 1354581 - RNA, 19 nt, Homo sapiens
ggugucuacaucagccuua

SEQ ID NO: 1354582 - RNA, 19 nt, Homo sapiens
cagccuuagucauuaugga

SEQ ID NO: 1354583 - RNA, 19 nt, Homo sapiens
cacugaagccuaaacaucu

SEQ ID NO: 1354584 - RNA, 19 nt, Homo sapiens
ggauaguaaaucgaccuuu

SEQ ID NO: 1354585 - RNA, 19 nt, Homo sapiens
caacauaggcaaguacuua

SEQ ID NO: 1354586 - RNA, 19 nt, Homo sapiens
aacaauggaucccagcuua

SEQ ID NO: 1354587 - RNA, 19 nt, Homo sapiens
gaaggugcuaccauuauuu

SEQ ID NO: 1354588 - RNA, 19 nt, Homo sapiens
gaaggugcguuacuauuuu

SEQ ID NO: 1354589 - RNA, 19 nt, Homo sapiens
gaaagacagaaguguauau

SEQ ID NO: 1354590 - RNA, 19 nt, Homo sapiens
ugaaggugcuaccauuauu

SEQ ID NO: 1354591 - RNA, 19 nt, Homo sapiens
caaagagccagccagagua

SEQ ID NO: 1354592 - RNA, 19 nt, Homo sapiens
gcaaguacuuagccaugug

SEQ ID NO: 1354593 - RNA, 19 nt, Homo sapiens
ggaaagacagaaguguaua

SEQ ID NO: 1354594 - RNA, 19 nt, Homo sapiens
ccacagacuuugaagaaac

SEQ ID NO: 1354595 - RNA, 19 nt, Homo sapiens
cuagggagcuauugaugug

SEQ ID NO: 1354596 - RNA, 19 nt, Homo sapiens
agaaggugcguuacuauuu

SEQ ID NO: 1354597 - RNA, 19 nt, Homo sapiens
ccaaagagccagccagagu

SEQ ID NO: 1354598 - RNA, 19 nt, Homo sapiens
gaacaauggaucccagcuu

SEQ ID NO: 1354599 - RNA, 19 nt, Homo sapiens
caacagcugcccaucauca

SEQ ID NO: 1354600 - RNA, 19 nt, Homo sapiens
guagcaacauaggcaagua

SEQ ID NO: 1354601 - RNA, 19 nt, Homo sapiens
gcuguugucugcccaguag

SEQ ID NO: 1354602 - RNA, 19 nt, Homo sapiens
ugaagaaacuuuuggaugu

SEQ ID NO: 1354603 - RNA, 19 nt, Homo sapiens
ggccuggaauggacagauu

SEQ ID NO: 1354604 - RNA, 19 nt, Homo sapiens
uuagaaaggagacaugaaa

SEQ ID NO: 1354605 - RNA, 19 nt, Homo sapiens
gggcaucauccgcaucuuu

SEQ ID NO: 1354606 - RNA, 19 nt, Homo sapiens
aaaagaaggugcguuacua

SEQ ID NO: 1354607 - RNA, 19 nt, Homo sapiens
gaugugcaauauuagaaag

SEQ ID NO: 1354608 - RNA, 19 nt, Homo sapiens
gccacagacuuugaagaaa

SEQ ID NO: 1354609 - RNA, 19 nt, Homo sapiens
auacauacaucaccuccau

SEQ ID NO: 1354610 - RNA, 19 nt, Homo sapiens
ccagcuuccugcccaaaga

SEQ ID NO: 1354611 - RNA, 19 nt, Homo sapiens
aaagagccagccagaguaa

SEQ ID NO: 1354612 - RNA, 19 nt, Homo sapiens
gaggugacccagcacauca

SEQ ID NO: 1354613 - RNA, 19 nt, Homo sapiens
ccaaagaccaaccaaagag

SEQ ID NO: 1354614 - RNA, 19 nt, Homo sapiens
gaagcaguaccgccuggaa

SEQ ID NO: 1354615 - RNA, 19 nt, Homo sapiens
aauugucucucacagugua

SEQ ID NO: 1354616 - RNA, 19 nt, Homo sapiens
gaagaaacuuuuggaugug

SEQ ID NO: 1354617 - RNA, 19 nt, Homo sapiens
ccaucgaggucuccugcaa

SEQ ID NO: 1354618 - RNA, 19 nt, Homo sapiens
ccuacuggguggauccaaa

SEQ ID NO: 1354619 - RNA, 19 nt, Homo sapiens
cgaggucuccugcaacuuc

SEQ ID NO: 1354620 - RNA, 19 nt, Homo sapiens
aaagaaggugcguuacuau

SEQ ID NO: 1354621 - RNA, 19 nt, Homo sapiens
aaggaaagacagaagugua

SEQ ID NO: 1354622 - RNA, 19 nt, Homo sapiens
ggcaaguacuuagccaugu

SEQ ID NO: 1354623 - RNA, 19 nt, Homo sapiens
cccaacagcugcccaucau

SEQ ID NO: 1354624 - RNA, 19 nt, Homo sapiens
gcaggguccaucuacagaa

SEQ ID NO: 1354625 - RNA, 19 nt, Homo sapiens
ucugaaggugcuaccauua

SEQ ID NO: 1354626 - RNA, 19 nt, Homo sapiens
cacccacccugacuucaug

SEQ ID NO: 1354627 - RNA, 19 nt, Homo sapiens
gcuagggagcuauugaugu

SEQ ID NO: 1354628 - RNA, 19 nt, Homo sapiens
gaggucuccugcaacuuca

SEQ ID NO: 1354629 - RNA, 19 nt, Homo sapiens
caaguacuuagccauguga

SEQ ID NO: 1354630 - RNA, 19 nt, Homo sapiens
gcaguaccgccuggaaguu

SEQ ID NO: 1354631 - RNA, 19 nt, Homo sapiens
ugccacagacuuugaagaa

SEQ ID NO: 1354632 - RNA, 19 nt, Homo sapiens
caaagagccccacauucua

SEQ ID NO: 1354633 - RNA, 19 nt, Homo sapiens
ccaaagagccccacauucu

SEQ ID NO: 1354634 - RNA, 19 nt, Homo sapiens
ggaggagggaagaggaaga

SEQ ID NO: 1354635 - RNA, 19 nt, Homo sapiens
gaauuuccugcaccugcua

SEQ ID NO: 1354636 - RNA, 19 nt, Homo sapiens
cuacagaaccaaggaaugg

SEQ ID NO: 1354637 - RNA, 19 nt, Homo sapiens
ucagguaaucugcuaagga

SEQ ID NO: 1354638 - RNA, 19 nt, Homo sapiens
aagaaggugcguuacuauu

SEQ ID NO: 1354639 - RNA, 19 nt, Homo sapiens
ccucaucagggaagcagua

SEQ ID NO: 1354640 - RNA, 19 nt, Homo sapiens
cccuugugcucaucaggua

SEQ ID NO: 1354641 - RNA, 19 nt, Homo sapiens
caucucgguuggaggaauc

SEQ ID NO: 1354642 - RNA, 19 nt, Homo sapiens
ggcaucauccgcaucuuuc

SEQ ID NO: 1354643 - RNA, 19 nt, Homo sapiens
ggugagaggaugggaagga

SEQ ID NO: 1354644 - RNA, 19 nt, Homo sapiens
aggaaagacagaaguguau

SEQ ID NO: 1354645 - RNA, 19 nt, Homo sapiens
gaaaaggaaagacagaagu

SEQ ID NO: 1354646 - RNA, 19 nt, Homo sapiens
cccaaagaccaaccaaaga

SEQ ID NO: 1354647 - RNA, 19 nt, Homo sapiens
gcaucgcccuugugcucau

SEQ ID NO: 1354648 - RNA, 19 nt, Homo sapiens
gcaacauaggcaaguacuu

SEQ ID NO: 1354649 - RNA, 19 nt, Homo sapiens
ucagccggguccagaugaa

SEQ ID NO: 1354650 - RNA, 19 nt, Homo sapiens
ccuccaaggucgaguuugc

SEQ ID NO: 1354651 - RNA, 19 nt, Homo sapiens
cucaucagguaaucugcua

SEQ ID NO: 1354652 - RNA, 19 nt, Homo sapiens
caucaucaguguggacaac

SEQ ID NO: 1354653 - RNA, 19 nt, Homo sapiens
gcucacccacccugacuuc

SEQ ID NO: 1354654 - RNA, 19 nt, Homo sapiens
ucgcuggugcucacaauug

SEQ ID NO: 1354655 - RNA, 19 nt, Homo sapiens
ccacauucuagccaacuug

SEQ ID NO: 1354656 - RNA, 19 nt, Homo sapiens
gccggguccagaugaauuu

SEQ ID NO: 1354657 - RNA, 19 nt, Homo sapiens
cugaaggugcuaccauuau

SEQ ID NO: 1354658 - RNA, 19 nt, Homo sapiens
gggaaagaggugagaggau

SEQ ID NO: 1354659 - RNA, 19 nt, Homo sapiens
cacagacuuugaagaaacu

SEQ ID NO: 1354660 - RNA, 19 nt, Homo sapiens
gaaaugggacugauaacuu

SEQ ID NO: 1354661 - RNA, 19 nt, Homo sapiens
gaaaacagcuccaucuuca

SEQ ID NO: 1354662 - RNA, 19 nt, Homo sapiens
gcaggucgcucacaauuac

SEQ ID NO: 1354663 - RNA, 19 nt, Homo sapiens
acaaagacaugaucuggaa

SEQ ID NO: 1354664 - RNA, 19 nt, Homo sapiens
gacaugaucuggaaacaca

SEQ ID NO: 1354665 - RNA, 19 nt, Homo sapiens
aaaugggacugauaacuuu

SEQ ID NO: 1354666 - RNA, 19 nt, Homo sapiens
aagaagagcugguuuaggu

SEQ ID NO: 1354667 - RNA, 19 nt, Homo sapiens
ggaggaagcuuggguaagg

SEQ ID NO: 1354668 - RNA, 19 nt, Homo sapiens
gaagaucacagccaccaaa

SEQ ID NO: 1354669 - RNA, 19 nt, Homo sapiens
ggaacucaaugccuucaga

SEQ ID NO: 1354670 - RNA, 19 nt, Homo sapiens
gcucaaccaucacagaaga

SEQ ID NO: 1354671 - RNA, 19 nt, Homo sapiens
gugagacccuguaucauga

SEQ ID NO: 1354672 - RNA, 19 nt, Homo sapiens
gaucggaagccucaaagaa

SEQ ID NO: 1354673 - RNA, 19 nt, Homo sapiens
cgaucuaccuucagcauga

SEQ ID NO: 1354674 - RNA, 19 nt, Homo sapiens
guaguggugugcaucugua

SEQ ID NO: 1354675 - RNA, 19 nt, Homo sapiens
cagucgggcuucaucuuua

SEQ ID NO: 1354676 - RNA, 19 nt, Homo sapiens
gaaccaugccuuccucuuc

SEQ ID NO: 1354677 - RNA, 19 nt, Homo sapiens
acagcuccaucuucauuua

SEQ ID NO: 1354678 - RNA, 19 nt, Homo sapiens
ccaccuggcugauucuugu

SEQ ID NO: 1354679 - RNA, 19 nt, Homo sapiens
caagggagacugugguuug

SEQ ID NO: 1354680 - RNA, 19 nt, Homo sapiens
aaacagcuccaucuucauu

SEQ ID NO: 1354681 - RNA, 19 nt, Homo sapiens
ggacugaggccaagauaac

SEQ ID NO: 1354682 - RNA, 19 nt, Homo sapiens
gccagggucugauggagaa

SEQ ID NO: 1354683 - RNA, 19 nt, Homo sapiens
gccaugugauguugccuaa

SEQ ID NO: 1354684 - RNA, 19 nt, Homo sapiens
ccuguaaucccaacacuuu

SEQ ID NO: 1354685 - RNA, 19 nt, Homo sapiens
gggcucugcuugcuuuaug

SEQ ID NO: 1354686 - RNA, 19 nt, Homo sapiens
gaacucaaugccuucagaa

SEQ ID NO: 1354687 - RNA, 19 nt, Homo sapiens
uaggugagacuggaauuua

SEQ ID NO: 1354688 - RNA, 19 nt, Homo sapiens
ggccagaggugggaacuca

SEQ ID NO: 1354689 - RNA, 19 nt, Homo sapiens
ugacgcaggucgcucacaa

SEQ ID NO: 1354690 - RNA, 19 nt, Homo sapiens
gggagacccuaaagaugug

SEQ ID NO: 1354691 - RNA, 19 nt, Homo sapiens
uaaccagccaugccaguaa

SEQ ID NO: 1354692 - RNA, 19 nt, Homo sapiens
gugagacgaucuaccuuca

SEQ ID NO: 1354693 - RNA, 19 nt, Homo sapiens
gagaccagcuugggcaaca

SEQ ID NO: 1354694 - RNA, 19 nt, Homo sapiens
ccugggcucugcuugcuuu

SEQ ID NO: 1354695 - RNA, 19 nt, Homo sapiens
gagacccuguaucaugaaa

SEQ ID NO: 1354696 - RNA, 19 nt, Homo sapiens
caccagcacucccagaaca

SEQ ID NO: 1354697 - RNA, 19 nt, Homo sapiens
ccuaaccgagucucaauuu

SEQ ID NO: 1354698 - RNA, 19 nt, Homo sapiens
agagugagacccuguauca

SEQ ID NO: 1354699 - RNA, 19 nt, Homo sapiens
caucuucauuuacaaaguc

SEQ ID NO: 1354700 - RNA, 19 nt, Homo sapiens
guuggcggcucuaccagaa

SEQ ID NO: 1354701 - RNA, 19 nt, Homo sapiens
ccagucgggcuucaucuuu

SEQ ID NO: 1354702 - RNA, 19 nt, Homo sapiens
guggacaggcugacacgua

SEQ ID NO: 1354703 - RNA, 19 nt, Homo sapiens
ccaaaagccucccuaccaa

SEQ ID NO: 1354704 - RNA, 19 nt, Homo sapiens
cacaaacccucaccagcau

SEQ ID NO: 1354705 - RNA, 19 nt, Homo sapiens
ugugaaaugggacugauaa

SEQ ID NO: 1354706 - RNA, 19 nt, Homo sapiens
gcccgugcauagcucauau

SEQ ID NO: 1354707 - RNA, 19 nt, Homo sapiens
uugagcagcuucuacauac

SEQ ID NO: 1354708 - RNA, 19 nt, Homo sapiens
guacccaccugaggaagca

SEQ ID NO: 1354709 - RNA, 19 nt, Homo sapiens
cauaugaacaugccaaacu

SEQ ID NO: 1354710 - RNA, 19 nt, Homo sapiens
uucaguaucuacccuguga

SEQ ID NO: 1354711 - RNA, 19 nt, Homo sapiens
ggagaaaccccaucuuuac

SEQ ID NO: 1354712 - RNA, 19 nt, Homo sapiens
cgcaugcaguccaguuuga

SEQ ID NO: 1354713 - RNA, 19 nt, Homo sapiens
ccauggcucacaccuguaa

SEQ ID NO: 1354714 - RNA, 19 nt, Homo sapiens
ucggaagccucaaagaaag

SEQ ID NO: 1354715 - RNA, 19 nt, Homo sapiens
ggugcucucugccaguuca

SEQ ID NO: 1354716 - RNA, 19 nt, Homo sapiens
ucacaccacugcacuucag

SEQ ID NO: 1354717 - RNA, 19 nt, Homo sapiens
agaagcccauccagaggaa

SEQ ID NO: 1354718 - RNA, 19 nt, Homo sapiens
ccaagaagagcugguuuag

SEQ ID NO: 1354719 - RNA, 19 nt, Homo sapiens
gcucucugccaguucagua

SEQ ID NO: 1354720 - RNA, 19 nt, Homo sapiens
caaacccucaccagcauau

SEQ ID NO: 1354721 - RNA, 19 nt, Homo sapiens
gaucacagccaccaaaauc

SEQ ID NO: 1354722 - RNA, 19 nt, Homo sapiens
gaagaugaacccgcaugca

SEQ ID NO: 1354723 - RNA, 19 nt, Homo sapiens
ucacuaggaggcagagguu

SEQ ID NO: 1354724 - RNA, 19 nt, Homo sapiens
cagaagcaagugccaccua

SEQ ID NO: 1354725 - RNA, 19 nt, Homo sapiens
gcuccaucuucauuuacaa

SEQ ID NO: 1354726 - RNA, 19 nt, Homo sapiens
uuuaugaccuuggccaugu

SEQ ID NO: 1354727 - RNA, 19 nt, Homo sapiens
agugagacccuguaucaug

SEQ ID NO: 1354728 - RNA, 19 nt, Homo sapiens
ggcaggaucuacgccuuuc

SEQ ID NO: 1354729 - RNA, 19 nt, Homo sapiens
ccacagagaagcccaucca

SEQ ID NO: 1354730 - RNA, 19 nt, Homo sapiens
agucagcccuacccacuca

SEQ ID NO: 1354731 - RNA, 19 nt, Homo sapiens
gccaguaacgcacuugauc

SEQ ID NO: 1354732 - RNA, 19 nt, Homo sapiens
gagcagcuucuacauacca

SEQ ID NO: 1354733 - RNA, 19 nt, Homo sapiens
gaaaccccaucuuuaccaa

SEQ ID NO: 1354734 - RNA, 19 nt, Homo sapiens
uaccugggcuaccuggaau

SEQ ID NO: 1354735 - RNA, 19 nt, Homo sapiens
ggaaggcagccagggaugu

SEQ ID NO: 1354736 - RNA, 19 nt, Homo sapiens
caaagacaugaucuggaaa

SEQ ID NO: 1354737 - RNA, 19 nt, Homo sapiens
gaggaagcuuggguaaggu

SEQ ID NO: 1354738 - RNA, 19 nt, Homo sapiens
gaaggcagccagggauguc

SEQ ID NO: 1354739 - RNA, 19 nt, Homo sapiens
uuugagcagcuucuacaua

SEQ ID NO: 1354740 - RNA, 19 nt, Homo sapiens
gcuuggguaaggucagaua

SEQ ID NO: 1354741 - RNA, 19 nt, Homo sapiens
cgcaggucgcucacaauua

SEQ ID NO: 1354742 - RNA, 19 nt, Homo sapiens
ggguaugccgguccuucua

SEQ ID NO: 1354743 - RNA, 19 nt, Homo sapiens
gagguugcagugagcaguu

SEQ ID NO: 1354744 - RNA, 19 nt, Homo sapiens
uggagaaaccccaucuuua

SEQ ID NO: 1354745 - RNA, 19 nt, Homo sapiens
aagaaagccggacccaaga

SEQ ID NO: 1354746 - RNA, 19 nt, Homo sapiens
caugugauguugccuaacc

SEQ ID NO: 1354747 - RNA, 19 nt, Homo sapiens
gaccuuggccaugugaugu

SEQ ID NO: 1354748 - RNA, 19 nt, Homo sapiens
gaccugggcucugcuugcu

SEQ ID NO: 1354749 - RNA, 19 nt, Homo sapiens
ccagaggugggaacucaau

SEQ ID NO: 1354750 - RNA, 19 nt, Homo sapiens
ccaccaaaauccccaaaag

SEQ ID NO: 1354751 - RNA, 19 nt, Homo sapiens
ccacugggaccucucuucu

SEQ ID NO: 1354752 - RNA, 19 nt, Homo sapiens
ugaggcggcaggaucacua

SEQ ID NO: 1354753 - RNA, 19 nt, Homo sapiens
ugccuguccugcugccuuu

SEQ ID NO: 1354754 - RNA, 19 nt, Homo sapiens
ccaucuucauuuacaaagu

SEQ ID NO: 1354755 - RNA, 19 nt, Homo sapiens
ggcucugcuugcuuuauga

SEQ ID NO: 1354756 - RNA, 19 nt, Homo sapiens
gcaugcaguccaguuugaa

SEQ ID NO: 1354757 - RNA, 19 nt, Homo sapiens
acgcaggucgcucacaauu

SEQ ID NO: 1354758 - RNA, 19 nt, Homo sapiens
cuaccugggcuaccuggaa

SEQ ID NO: 1354759 - RNA, 19 nt, Homo sapiens
ggaucggaagccucaaaga

SEQ ID NO: 1354760 - RNA, 19 nt, Homo sapiens
ggaagaagauugugagaaa

SEQ ID NO: 1354761 - RNA, 19 nt, Homo sapiens
gcaguuauauugcuugaua

SEQ ID NO: 1354762 - RNA, 19 nt, Homo sapiens
ccaaagaaguccaaagaua

SEQ ID NO: 1354763 - RNA, 19 nt, Homo sapiens
guaaauaucuguguacuca

SEQ ID NO: 1354764 - RNA, 19 nt, Homo sapiens
ccaaacagaucuuuaugaa

SEQ ID NO: 1354765 - RNA, 19 nt, Homo sapiens
ggaaauacaccaagaguga

SEQ ID NO: 1354766 - RNA, 19 nt, Homo sapiens
gaauuaagcacaagaagaa

SEQ ID NO: 1354767 - RNA, 19 nt, Homo sapiens
caaagaaguccaaagauaa

SEQ ID NO: 1354768 - RNA, 19 nt, Homo sapiens
gcuaacauauuuacucuug

SEQ ID NO: 1354769 - RNA, 19 nt, Homo sapiens
gaaagaagaugaggacuac

SEQ ID NO: 1354770 - RNA, 19 nt, Homo sapiens
caacauggaucucaguuuc

SEQ ID NO: 1354771 - RNA, 19 nt, Homo sapiens
gaauugagaggcuaacaua

SEQ ID NO: 1354772 - RNA, 19 nt, Homo sapiens
caggauaucuauagagaaa

SEQ ID NO: 1354773 - RNA, 19 nt, Homo sapiens
ugaagugacuguacuaguu

SEQ ID NO: 1354774 - RNA, 19 nt, Homo sapiens
gaagaauacauguggauuu

SEQ ID NO: 1354775 - RNA, 19 nt, Homo sapiens
gaaguuugauuaugaugug

SEQ ID NO: 1354776 - RNA, 19 nt, Homo sapiens
gaaggcauggacauaauua

SEQ ID NO: 1354777 - RNA, 19 nt, Homo sapiens
gcuuauagaugacagaaga

SEQ ID NO: 1354778 - RNA, 19 nt, Homo sapiens
gcauggacauaauuaagaa

SEQ ID NO: 1354779 - RNA, 19 nt, Homo sapiens
acaaugugcuuauagauga

SEQ ID NO: 1354780 - RNA, 19 nt, Homo sapiens
gauauuaaaccuccagaaa

SEQ ID NO: 1354781 - RNA, 19 nt, Homo sapiens
ugaugacccuccugauuua

SEQ ID NO: 1354782 - RNA, 19 nt, Homo sapiens
ggaaguagaagaaauaaag

SEQ ID NO: 1354783 - RNA, 19 nt, Homo sapiens
guauguaucuguaagugaa

SEQ ID NO: 1354784 - RNA, 19 nt, Homo sapiens
ggauaucuauagagaaaug

SEQ ID NO: 1354785 - RNA, 19 nt, Homo sapiens
ggauaaaccaccuaauuug

SEQ ID NO: 1354786 - RNA, 19 nt, Homo sapiens
ggauuauggucuuuagauu

SEQ ID NO: 1354787 - RNA, 19 nt, Homo sapiens
gaagugacuguacuaguuu

SEQ ID NO: 1354788 - RNA, 19 nt, Homo sapiens
ugacccuccugauuuauua

SEQ ID NO: 1354789 - RNA, 19 nt, Homo sapiens
ggaggagagucuaucuuug

SEQ ID NO: 1354790 - RNA, 19 nt, Homo sapiens
guacucaucagccagcuua

SEQ ID NO: 1354791 - RNA, 19 nt, Homo sapiens
gaguuaccuuuguuucaua

SEQ ID NO: 1354792 - RNA, 19 nt, Homo sapiens
ccagcaagauuacuguuau

SEQ ID NO: 1354793 - RNA, 19 nt, Homo sapiens
gauguuaagugguaucuac

SEQ ID NO: 1354794 - RNA, 19 nt, Homo sapiens
aagaucagcugaggaagua

SEQ ID NO: 1354795 - RNA, 19 nt, Homo sapiens
uugagaggcuaacauauuu

SEQ ID NO: 1354796 - RNA, 19 nt, Homo sapiens
cuaauuugguucugaaaga

SEQ ID NO: 1354797 - RNA, 19 nt, Homo sapiens
gaaacaaugcugcugugaa

SEQ ID NO: 1354798 - RNA, 19 nt, Homo sapiens
ucaagucacucacacacaa

SEQ ID NO: 1354799 - RNA, 19 nt, Homo sapiens
uugcaaagguuaaauggaa

SEQ ID NO: 1354800 - RNA, 19 nt, Homo sapiens
guaucuagcaguuauauug

SEQ ID NO: 1354801 - RNA, 19 nt, Homo sapiens
acggaaagauaaagaauug

SEQ ID NO: 1354802 - RNA, 19 nt, Homo sapiens
caaggacuuuguaccauau

SEQ ID NO: 1354803 - RNA, 19 nt, Homo sapiens
guaaagcccaaacaggaua

SEQ ID NO: 1354804 - RNA, 19 nt, Homo sapiens
caggauaaaccaccuaauu

SEQ ID NO: 1354805 - RNA, 19 nt, Homo sapiens
ugaggaaguagaagaaaua

SEQ ID NO: 1354806 - RNA, 19 nt, Homo sapiens
agagagggauggccauuau

SEQ ID NO: 1354807 - RNA, 19 nt, Homo sapiens
gagcagaugaagaaauuga

SEQ ID NO: 1354808 - RNA, 19 nt, Homo sapiens
ggaucucaguuucuuauca

SEQ ID NO: 1354809 - RNA, 19 nt, Homo sapiens
cauagcaucuccaacacuu

SEQ ID NO: 1354810 - RNA, 19 nt, Homo sapiens
aaacaaugcugcugugaac

SEQ ID NO: 1354811 - RNA, 19 nt, Homo sapiens
gggauggccauuauaguaa

SEQ ID NO: 1354812 - RNA, 19 nt, Homo sapiens
agagugauuucaaggagua

SEQ ID NO: 1354813 - RNA, 19 nt, Homo sapiens
gaagaaauaaaggcagaaa

SEQ ID NO: 1354814 - RNA, 19 nt, Homo sapiens
gaagaagauugugagaaag

SEQ ID NO: 1354815 - RNA, 19 nt, Homo sapiens
aggagcagaugaagaaauu

SEQ ID NO: 1354816 - RNA, 19 nt, Homo sapiens
cagaaggcauggacauaau

SEQ ID NO: 1354817 - RNA, 19 nt, Homo sapiens
gaagaaaacccaucacugu

SEQ ID NO: 1354818 - RNA, 19 nt, Homo sapiens
caguguccauggugaauaa

SEQ ID NO: 1354819 - RNA, 19 nt, Homo sapiens
gaagaucagcugaggaagu

SEQ ID NO: 1354820 - RNA, 19 nt, Homo sapiens
gaaguccaaagauaaagaa

SEQ ID NO: 1354821 - RNA, 19 nt, Homo sapiens
gagagagggauggccauua

SEQ ID NO: 1354822 - RNA, 19 nt, Homo sapiens
ccgcgugccugcuugaauu

SEQ ID NO: 1354823 - RNA, 19 nt, Homo sapiens
uaguggauguuaaguggua

SEQ ID NO: 1354824 - RNA, 19 nt, Homo sapiens
ccaaauuuguguucugaag

SEQ ID NO: 1354825 - RNA, 19 nt, Homo sapiens
gaugacagaagaauacaug

SEQ ID NO: 1354826 - RNA, 19 nt, Homo sapiens
acagagggauuuuaucaua

SEQ ID NO: 1354827 - RNA, 19 nt, Homo sapiens
aauaggagcagaugaagaa

SEQ ID NO: 1354828 - RNA, 19 nt, Homo sapiens
uagaugauccauuugauga

SEQ ID NO: 1354829 - RNA, 19 nt, Homo sapiens
uuaaugagaccuuuguuga

SEQ ID NO: 1354830 - RNA, 19 nt, Homo sapiens
caucagccagcuuaagaua

SEQ ID NO: 1354831 - RNA, 19 nt, Homo sapiens
agaaagcuguugggagaaa

SEQ ID NO: 1354832 - RNA, 19 nt, Homo sapiens
ccaaacaggauacaaaaua

SEQ ID NO: 1354833 - RNA, 19 nt, Homo sapiens
gaacaggauaaaccaccua

SEQ ID NO: 1354834 - RNA, 19 nt, Homo sapiens
gcacggaaagauaaagaau

SEQ ID NO: 1354835 - RNA, 19 nt, Homo sapiens
gcagaaguccaaagaaguc

SEQ ID NO: 1354836 - RNA, 19 nt, Homo sapiens
acucagaaccgaagucgua

SEQ ID NO: 1354837 - RNA, 19 nt, Homo sapiens
gauaaaccaccuaauuugg

SEQ ID NO: 1354838 - RNA, 19 nt, Homo sapiens
gacaaugugcuuauagaug

SEQ ID NO: 1354839 - RNA, 19 nt, Homo sapiens
ucagccagcuuaagauaca

SEQ ID NO: 1354840 - RNA, 19 nt, Homo sapiens
ugaagaggcagaauugaga

SEQ ID NO: 1354841 - RNA, 19 nt, Homo sapiens
ggacuacaugccaaucaaa

SEQ ID NO: 1354842 - RNA, 19 nt, Homo sapiens
aggauaaaccaccuaauuu

SEQ ID NO: 1354843 - RNA, 19 nt, Homo sapiens
aagguuaaauggaaaggaa

SEQ ID NO: 1354844 - RNA, 19 nt, Homo sapiens
gaugaggaucuggaaauaa

SEQ ID NO: 1354845 - RNA, 19 nt, Homo sapiens
cauuguaucuagcaguuau

SEQ ID NO: 1354846 - RNA, 19 nt, Homo sapiens
aagcagaaguccaaagaag

SEQ ID NO: 1354847 - RNA, 19 nt, Homo sapiens
gaagcagaaguccaaagaa

SEQ ID NO: 1354848 - RNA, 19 nt, Homo sapiens
cgaagcagaaguccaaaga

SEQ ID NO: 1354849 - RNA, 19 nt, Homo sapiens
gaccgaagcagaaguccaa

SEQ ID NO: 1354850 - RNA, 19 nt, Homo sapiens
ccaccuaauuugguucuga

SEQ ID NO: 1354851 - RNA, 19 nt, Homo sapiens
gaauacauguggauuuuag

SEQ ID NO: 1354852 - RNA, 19 nt, Homo sapiens
gaaaauguacuguuugugu

SEQ ID NO: 1354853 - RNA, 19 nt, Homo sapiens
agaccuaccugaugcagau

SEQ ID NO: 1354854 - RNA, 19 nt, Homo sapiens
gaauaggagcagaugaaga

SEQ ID NO: 1354855 - RNA, 19 nt, Homo sapiens
gacagaaggcauggacaua

SEQ ID NO: 1354856 - RNA, 19 nt, Homo sapiens
gugauuuccagcaagauua

SEQ ID NO: 1354857 - RNA, 19 nt, Homo sapiens
ugacuguacuaguuuauac

SEQ ID NO: 1354858 - RNA, 19 nt, Homo sapiens
gcaaaauguuuacuucugu

SEQ ID NO: 1354859 - RNA, 19 nt, Homo sapiens
aaauaucuguguacucauc

SEQ ID NO: 1354860 - RNA, 19 nt, Homo sapiens
gaacaggcaugaagauauu

SEQ ID NO: 1354861 - RNA, 19 nt, Homo sapiens
uaucugaacuucuguguua

SEQ ID NO: 1354862 - RNA, 19 nt, Homo sapiens
gcaaauacguuguuaguag

SEQ ID NO: 1354863 - RNA, 19 nt, Homo sapiens
gcagagaucuuuaguucaa

SEQ ID NO: 1354864 - RNA, 19 nt, Homo sapiens
gaaagaaacuucagaaagc

SEQ ID NO: 1354865 - RNA, 19 nt, Homo sapiens
caacauaucuacuggaaau

SEQ ID NO: 1354866 - RNA, 19 nt, Homo sapiens
uaaaggagauggcuuauuc

SEQ ID NO: 1354867 - RNA, 19 nt, Homo sapiens
ggaaauguaugaacacaau

SEQ ID NO: 1354868 - RNA, 19 nt, Homo sapiens
gggaagggaucuugacuaa

SEQ ID NO: 1354869 - RNA, 19 nt, Homo sapiens
gggcagagaucuuuaguuc

SEQ ID NO: 1354870 - RNA, 19 nt, Homo sapiens
ggaagaagguguaagucaa

SEQ ID NO: 1354871 - RNA, 19 nt, Homo sapiens
gcaugaagauauugccaua

SEQ ID NO: 1354872 - RNA, 19 nt, Homo sapiens
gaaaguacuucacucaaca

SEQ ID NO: 1354873 - RNA, 19 nt, Homo sapiens
caacugaagcuuuccaaua

SEQ ID NO: 1354874 - RNA, 19 nt, Homo sapiens
guacuucacucaacaacaa

SEQ ID NO: 1354875 - RNA, 19 nt, Homo sapiens
ccaaaggauuuaagaguuu

SEQ ID NO: 1354876 - RNA, 19 nt, Homo sapiens
gaaauaaacuaggaaaugc

SEQ ID NO: 1354877 - RNA, 19 nt, Homo sapiens
caggauuacuugagaguua

SEQ ID NO: 1354878 - RNA, 19 nt, Homo sapiens
caccacaccuggcuaauuu

SEQ ID NO: 1354879 - RNA, 19 nt, Homo sapiens
ggaagcuuauucucauaua

SEQ ID NO: 1354880 - RNA, 19 nt, Homo sapiens
ucaaauaucugaacuucug

SEQ ID NO: 1354881 - RNA, 19 nt, Homo sapiens
ccaguggacuacaggauua

SEQ ID NO: 1354882 - RNA, 19 nt, Homo sapiens
ggaaaugcuuggauucaug

SEQ ID NO: 1354883 - RNA, 19 nt, Homo sapiens
ggcauuggcuuuuaaauua

SEQ ID NO: 1354884 - RNA, 19 nt, Homo sapiens
ggaaaagccuucaagauga

SEQ ID NO: 1354885 - RNA, 19 nt, Homo sapiens
gagcagaacccauaaaaua

SEQ ID NO: 1354886 - RNA, 19 nt, Homo sapiens
uguuauagcugcaguguuu

SEQ ID NO: 1354887 - RNA, 19 nt, Homo sapiens
caaauacguuguuaguaga

SEQ ID NO: 1354888 - RNA, 19 nt, Homo sapiens
aaauuggacuggaaaguaa

SEQ ID NO: 1354889 - RNA, 19 nt, Homo sapiens
ggagaaaacuugauacaau

SEQ ID NO: 1354890 - RNA, 19 nt, Homo sapiens
gcagugcuuuggcucauuu

SEQ ID NO: 1354891 - RNA, 19 nt, Homo sapiens
gccaaaggauuuaagaguu

SEQ ID NO: 1354892 - RNA, 19 nt, Homo sapiens
gguuagcgcuuauuucuuc

SEQ ID NO: 1354893 - RNA, 19 nt, Homo sapiens
guaagaaacagaccuaguu

SEQ ID NO: 1354894 - RNA, 19 nt, Homo sapiens
ggaaaguacuucacucaac

SEQ ID NO: 1354895 - RNA, 19 nt, Homo sapiens
aacugaagcuuuccaauaa

SEQ ID NO: 1354896 - RNA, 19 nt, Homo sapiens
ccacuacaccuucuacuuu

SEQ ID NO: 1354897 - RNA, 19 nt, Homo sapiens
agucagagcucucccacua

SEQ ID NO: 1354898 - RNA, 19 nt, Homo sapiens
guagagcaaugaucagaug

SEQ ID NO: 1354899 - RNA, 19 nt, Homo sapiens
ccaauaagcauagauacua

SEQ ID NO: 1354900 - RNA, 19 nt, Homo sapiens
ccuaaaagcugaauggaua

SEQ ID NO: 1354901 - RNA, 19 nt, Homo sapiens
caaggcuucugucuacuaa

SEQ ID NO: 1354902 - RNA, 19 nt, Homo sapiens
ugaaugaaaugcaguguag

SEQ ID NO: 1354903 - RNA, 19 nt, Homo sapiens
gaacuggguugaacugaac

SEQ ID NO: 1354904 - RNA, 19 nt, Homo sapiens
caagaugacaugaugaauu

SEQ ID NO: 1354905 - RNA, 19 nt, Homo sapiens
uggaauggcuauccuacua

SEQ ID NO: 1354906 - RNA, 19 nt, Homo sapiens
caacaacaauauucucaag

SEQ ID NO: 1354907 - RNA, 19 nt, Homo sapiens
ugacaugcccucagaauau

SEQ ID NO: 1354908 - RNA, 19 nt, Homo sapiens
guuaguagaaggucaauuu

SEQ ID NO: 1354909 - RNA, 19 nt, Homo sapiens
gacauugaauuaaggagaa

SEQ ID NO: 1354910 - RNA, 19 nt, Homo sapiens
caucagaucuuccaugcau

SEQ ID NO: 1354911 - RNA, 19 nt, Homo sapiens
cuagggaccucauuauuuc

SEQ ID NO: 1354912 - RNA, 19 nt, Homo sapiens
gcauuucuguccaucugua

SEQ ID NO: 1354913 - RNA, 19 nt, Homo sapiens
gcacuguaguuucaaaugg

SEQ ID NO: 1354914 - RNA, 19 nt, Homo sapiens
ggaacaggcaugaagauau

SEQ ID NO: 1354915 - RNA, 19 nt, Homo sapiens
gaaagcaugcgucuuguca

SEQ ID NO: 1354916 - RNA, 19 nt, Homo sapiens
ggaccgaauuucauuugga

SEQ ID NO: 1354917 - RNA, 19 nt, Homo sapiens
ggauugacuucugcacuaa

SEQ ID NO: 1354918 - RNA, 19 nt, Homo sapiens
gaauggcuauccuacuaug

SEQ ID NO: 1354919 - RNA, 19 nt, Homo sapiens
caucacgccugcccuagaa

SEQ ID NO: 1354920 - RNA, 19 nt, Homo sapiens
agauggauuucuccuguua

SEQ ID NO: 1354921 - RNA, 19 nt, Homo sapiens
ugaaggaggcugugucaaa

SEQ ID NO: 1354922 - RNA, 19 nt, Homo sapiens
gcuuagagcagaacccaua

SEQ ID NO: 1354923 - RNA, 19 nt, Homo sapiens
ucauuuggauuucaaguug

SEQ ID NO: 1354924 - RNA, 19 nt, Homo sapiens
gcaugcgucuugucagcua

SEQ ID NO: 1354925 - RNA, 19 nt, Homo sapiens
gaaauuacagugccaagag

SEQ ID NO: 1354926 - RNA, 19 nt, Homo sapiens
caugaugaauuacucaguu

SEQ ID NO: 1354927 - RNA, 19 nt, Homo sapiens
guucuuugguaauggaaua

SEQ ID NO: 1354928 - RNA, 19 nt, Homo sapiens
ggagguagagcaaugauca

SEQ ID NO: 1354929 - RNA, 19 nt, Homo sapiens
gaaggaggcugugucaaaa

SEQ ID NO: 1354930 - RNA, 19 nt, Homo sapiens
caugagacauugaauuaag

SEQ ID NO: 1354931 - RNA, 19 nt, Homo sapiens
uuacugcacuguaguuuca

SEQ ID NO: 1354932 - RNA, 19 nt, Homo sapiens
cagcaaacaggacacauuu

SEQ ID NO: 1354933 - RNA, 19 nt, Homo sapiens
aguaugaggucccuuaguu

SEQ ID NO: 1354934 - RNA, 19 nt, Homo sapiens
gcaaugauuccugucagua

SEQ ID NO: 1354935 - RNA, 19 nt, Homo sapiens
ucaggaagcuuauucucau

SEQ ID NO: 1354936 - RNA, 19 nt, Homo sapiens
ccaaggauauguuauagcu

SEQ ID NO: 1354937 - RNA, 19 nt, Homo sapiens
acauuagguucuuugguua

SEQ ID NO: 1354938 - RNA, 19 nt, Homo sapiens
gcgugagcguuuaccaaua

SEQ ID NO: 1354939 - RNA, 19 nt, Homo sapiens
aacauuagguucuuugguu

SEQ ID NO: 1354940 - RNA, 19 nt, Homo sapiens
gcuucucucuugccuaauu

SEQ ID NO: 1354941 - RNA, 19 nt, Homo sapiens
uggaaauucugcugguuaa

SEQ ID NO: 1354942 - RNA, 19 nt, Homo sapiens
caccucagccuccuaagua

SEQ ID NO: 1354943 - RNA, 19 nt, Homo sapiens
guuaauggccugugacaug

SEQ ID NO: 1354944 - RNA, 19 nt, Homo sapiens
acuggaagcuagaaagaaa

SEQ ID NO: 1354945 - RNA, 19 nt, Homo sapiens
caacaauauucucaagagu

SEQ ID NO: 1354946 - RNA, 19 nt, Homo sapiens
guaugaggucccuuaguua

SEQ ID NO: 1354947 - RNA, 19 nt, Homo sapiens
caggaagcuuauucucaua

SEQ ID NO: 1354948 - RNA, 19 nt, Homo sapiens
caacgucuggacccauuua

SEQ ID NO: 1354949 - RNA, 19 nt, Homo sapiens
gaucuuccaugcauuucug

SEQ ID NO: 1354950 - RNA, 19 nt, Homo sapiens
cgugagcguuuaccaauau

SEQ ID NO: 1354951 - RNA, 19 nt, Homo sapiens
ucagaaagcuagaauugcu

SEQ ID NO: 1354952 - RNA, 19 nt, Homo sapiens
ccuccgaguuuacuuuauu

SEQ ID NO: 1354953 - RNA, 19 nt, Homo sapiens
aaagggacaugauuuaacu

SEQ ID NO: 1354954 - RNA, 19 nt, Homo sapiens
ggaccucauuauuucaaga

SEQ ID NO: 1354955 - RNA, 19 nt, Homo sapiens
ccagggaaucgccauauuu

SEQ ID NO: 1354956 - RNA, 19 nt, Homo sapiens
ccaaggaccgaauuucauu

SEQ ID NO: 1354957 - RNA, 19 nt, Homo sapiens
gaauuaaggagaaucaucu

SEQ ID NO: 1354958 - RNA, 19 nt, Homo sapiens
ggaauuuaaguccauagaa

SEQ ID NO: 1354959 - RNA, 19 nt, Homo sapiens
ggaauugugcaaauacguu

SEQ ID NO: 1354960 - RNA, 19 nt, Homo sapiens
gagaagcucauccaauuua

SEQ ID NO: 1354961 - RNA, 19 nt, Homo sapiens
ggacaaugcuggccuguuc

SEQ ID NO: 1354962 - RNA, 19 nt, Homo sapiens
gaagaagccugggucauug

SEQ ID NO: 1354963 - RNA, 19 nt, Homo sapiens
uaccaaagauccuggaaua

SEQ ID NO: 1354964 - RNA, 19 nt, Homo sapiens
ucaaaggucucacgaauuc

SEQ ID NO: 1354965 - RNA, 19 nt, Homo sapiens
caaagauccuggaauauuc

SEQ ID NO: 1354966 - RNA, 19 nt, Homo sapiens
caaaugcuguacugacuuu

SEQ ID NO: 1354967 - RNA, 19 nt, Homo sapiens
ucaagagacuggagaacua

SEQ ID NO: 1354968 - RNA, 19 nt, Homo sapiens
ggaaauaugcccaacuuau

SEQ ID NO: 1354969 - RNA, 19 nt, Homo sapiens
ggaagaagccugggucauu

SEQ ID NO: 1354970 - RNA, 19 nt, Homo sapiens
gagguuacauggucucuug

SEQ ID NO: 1354971 - RNA, 19 nt, Homo sapiens
ccacugugcugaacuguga

SEQ ID NO: 1354972 - RNA, 19 nt, Homo sapiens
acaacaagcucuucaacaa

SEQ ID NO: 1354973 - RNA, 19 nt, Homo sapiens
ggaaggugguagaauuuga

SEQ ID NO: 1354974 - RNA, 19 nt, Homo sapiens
cauggucucuugcauaauu

SEQ ID NO: 1354975 - RNA, 19 nt, Homo sapiens
cagcaaagauagcagagaa

SEQ ID NO: 1354976 - RNA, 19 nt, Homo sapiens
gaaauaugcccaacuuauc

SEQ ID NO: 1354977 - RNA, 19 nt, Homo sapiens
guccagagccugacaagua

SEQ ID NO: 1354978 - RNA, 19 nt, Homo sapiens
aaaggaaacuauuggagaa

SEQ ID NO: 1354979 - RNA, 19 nt, Homo sapiens
ugacugaugcgcagaauaa

SEQ ID NO: 1354980 - RNA, 19 nt, Homo sapiens
gcaggacacagcaaagaua

SEQ ID NO: 1354981 - RNA, 19 nt, Homo sapiens
gaaggaaaggaaacuauug

SEQ ID NO: 1354982 - RNA, 19 nt, Homo sapiens
ccaaagauccuggaauauu

SEQ ID NO: 1354983 - RNA, 19 nt, Homo sapiens
ccaaggccaucucaaaguu

SEQ ID NO: 1354984 - RNA, 19 nt, Homo sapiens
ggauggaaacccuggaaua

SEQ ID NO: 1354985 - RNA, 19 nt, Homo sapiens
cgacauaggcgaugacaug

SEQ ID NO: 1354986 - RNA, 19 nt, Homo sapiens
ggaagcuccuuuacacaug

SEQ ID NO: 1354987 - RNA, 19 nt, Homo sapiens
ucagugugcugucuccaua

SEQ ID NO: 1354988 - RNA, 19 nt, Homo sapiens
uacauggucucuugcauaa

SEQ ID NO: 1354989 - RNA, 19 nt, Homo sapiens
gaaaaucugugaaaaugga

SEQ ID NO: 1354990 - RNA, 19 nt, Homo sapiens
ggaaggaaaggaaacuauu

SEQ ID NO: 1354991 - RNA, 19 nt, Homo sapiens
gagcagcuguuuccuccuu

SEQ ID NO: 1354992 - RNA, 19 nt, Homo sapiens
ggacucugcuuugcccuuu

SEQ ID NO: 1354993 - RNA, 19 nt, Homo sapiens
ggaaaacgguggaaacuuc

SEQ ID NO: 1354994 - RNA, 19 nt, Homo sapiens
ccacggcccugcacaacaa

SEQ ID NO: 1354995 - RNA, 19 nt, Homo sapiens
gcgcaucgcuggucaucug

SEQ ID NO: 1354996 - RNA, 19 nt, Homo sapiens
gcauacagaugugguggaa

SEQ ID NO: 1354997 - RNA, 19 nt, Homo sapiens
uggauacacugcauuuauu

SEQ ID NO: 1354998 - RNA, 19 nt, Homo sapiens
cagcauuucuuccuacuuc

SEQ ID NO: 1354999 - RNA, 19 nt, Homo sapiens
ggaacgggcaugcuucuga

SEQ ID NO: 1355000 - RNA, 19 nt, Homo sapiens
ggagagcccuguuuucuau

SEQ ID NO: 1355001 - RNA, 19 nt, Homo sapiens
gggccaauauugauuauac

SEQ ID NO: 1355002 - RNA, 19 nt, Homo sapiens
gacaugguuucaggacuua

SEQ ID NO: 1355003 - RNA, 19 nt, Homo sapiens
cauaggcgaugacaugguu

SEQ ID NO: 1355004 - RNA, 19 nt, Homo sapiens
gcccagaguugcacaagau

SEQ ID NO: 1355005 - RNA, 19 nt, Homo sapiens
gugaugagguucaagaagu

SEQ ID NO: 1355006 - RNA, 19 nt, Homo sapiens
aguauaaccuuguucauca

SEQ ID NO: 1355007 - RNA, 19 nt, Homo sapiens
ugacaagaauggcugugaa

SEQ ID NO: 1355008 - RNA, 19 nt, Homo sapiens
gcucaugauccaaagcuua

SEQ ID NO: 1355009 - RNA, 19 nt, Homo sapiens
gacaugggauucagugauc

SEQ ID NO: 1355010 - RNA, 19 nt, Homo sapiens
guuggcaaaucauacuaua

SEQ ID NO: 1355011 - RNA, 19 nt, Homo sapiens
gguccaagcucucagugau

SEQ ID NO: 1355012 - RNA, 19 nt, Homo sapiens
ugaccaaccuugugaccuu

SEQ ID NO: 1355013 - RNA, 19 nt, Homo sapiens
ugacaugguuucaggacuu

SEQ ID NO: 1355014 - RNA, 19 nt, Homo sapiens
gaucaugugguucuccuuu

SEQ ID NO: 1355015 - RNA, 19 nt, Homo sapiens
ggugaucgccguccuguug

SEQ ID NO: 1355016 - RNA, 19 nt, Homo sapiens
gaccagcucuugcccaucu

SEQ ID NO: 1355017 - RNA, 19 nt, Homo sapiens
ggagucagcaagagagaaa

SEQ ID NO: 1355018 - RNA, 19 nt, Homo sapiens
ggaaacuauuggagaagug

SEQ ID NO: 1355019 - RNA, 19 nt, Homo sapiens
guaugaugcugccuugaga

SEQ ID NO: 1355020 - RNA, 19 nt, Homo sapiens
ucaccaaagucacgaggaa

SEQ ID NO: 1355021 - RNA, 19 nt, Homo sapiens
gggaaaaucugugaaaaug

SEQ ID NO: 1355022 - RNA, 19 nt, Homo sapiens
gguaagagcagccuguugu

SEQ ID NO: 1355023 - RNA, 19 nt, Homo sapiens
gaccagcgcauccguguga

SEQ ID NO: 1355024 - RNA, 19 nt, Homo sapiens
gaacaagguugauuuucga

SEQ ID NO: 1355025 - RNA, 19 nt, Homo sapiens
caaccuagaucccuuugac

SEQ ID NO: 1355026 - RNA, 19 nt, Homo sapiens
gaaauacagagacaacaca

SEQ ID NO: 1355027 - RNA, 19 nt, Homo sapiens
gggagaaaccauuugcaaa

SEQ ID NO: 1355028 - RNA, 19 nt, Homo sapiens
auaacuaccugcuguuguu

SEQ ID NO: 1355029 - RNA, 19 nt, Homo sapiens
caccaucccuccacuguca

SEQ ID NO: 1355030 - RNA, 19 nt, Homo sapiens
ucacugagauaaggagaug

SEQ ID NO: 1355031 - RNA, 19 nt, Homo sapiens
ggagacagaggcacaguuc

SEQ ID NO: 1355032 - RNA, 19 nt, Homo sapiens
ggagaaaccauuugcaaaa

SEQ ID NO: 1355033 - RNA, 19 nt, Homo sapiens
guacucgggccaauauuga

SEQ ID NO: 1355034 - RNA, 19 nt, Homo sapiens
cagagaacaagguugauuu

SEQ ID NO: 1355035 - RNA, 19 nt, Homo sapiens
gggauucagugaucaugug

SEQ ID NO: 1355036 - RNA, 19 nt, Homo sapiens
ugaccaaggccaucucaaa

SEQ ID NO: 1355037 - RNA, 19 nt, Homo sapiens
agucauggcugucaacauc

SEQ ID NO: 1355038 - RNA, 19 nt, Homo sapiens
gaauaacuaccugcuguug

SEQ ID NO: 1355039 - RNA, 19 nt, Homo sapiens
uagccggucuccuuuauuc

SEQ ID NO: 1355040 - RNA, 19 nt, Homo sapiens
gugcugaucgucuucuuaa

SEQ ID NO: 1355041 - RNA, 19 nt, Homo sapiens
gcagugaugagguucaaga

SEQ ID NO: 1355042 - RNA, 19 nt, Homo sapiens
gaccuaagaaggaaggaaa

SEQ ID NO: 1355043 - RNA, 19 nt, Homo sapiens
ucaggauuaucacaugaaa

SEQ ID NO: 1355044 - RNA, 19 nt, Homo sapiens
gaggagugcauuaagaaga

SEQ ID NO: 1355045 - RNA, 19 nt, Homo sapiens
agucaaaggucucacgaau

SEQ ID NO: 1355046 - RNA, 19 nt, Homo sapiens
uaagaaggaaggaaaggaa

SEQ ID NO: 1355047 - RNA, 19 nt, Homo sapiens
ggcaucugcuucugcauug

SEQ ID NO: 1355048 - RNA, 19 nt, Homo sapiens
gaauuggcaggaacugaaa

SEQ ID NO: 1355049 - RNA, 19 nt, Homo sapiens
gauggaaacccuggaauag

SEQ ID NO: 1355050 - RNA, 19 nt, Homo sapiens
gaucaugaccaaccuugug

SEQ ID NO: 1355051 - RNA, 19 nt, Homo sapiens
uuacauggucucuugcaua

SEQ ID NO: 1355052 - RNA, 19 nt, Homo sapiens
ggauacacugcauuuauug

SEQ ID NO: 1355053 - RNA, 19 nt, Homo sapiens
aaggagauguggagacuuc

SEQ ID NO: 1355054 - RNA, 19 nt, Homo sapiens
gcaaugggaaggugguaga

SEQ ID NO: 1355055 - RNA, 19 nt, Homo sapiens
uauagccggucuccuuuau

SEQ ID NO: 1355056 - RNA, 19 nt, Homo sapiens
cacuggagcuggagaggaa

SEQ ID NO: 1355057 - RNA, 19 nt, Homo sapiens
ugaugagguucaagaaguu

SEQ ID NO: 1355058 - RNA, 19 nt, Homo sapiens
cuggucaucugcagcauuu

SEQ ID NO: 1355059 - RNA, 19 nt, Homo sapiens
agaagcucauccaauuuaa

SEQ ID NO: 1355060 - RNA, 19 nt, Homo sapiens
gagaagcucauccaauuua

SEQ ID NO: 1355061 - RNA, 19 nt, Homo sapiens
ggacaaugcuggccuguuc

SEQ ID NO: 1355062 - RNA, 19 nt, Homo sapiens
gaagaagccugggucauug

SEQ ID NO: 1355063 - RNA, 19 nt, Homo sapiens
uaccaaagauccuggaaua

SEQ ID NO: 1355064 - RNA, 19 nt, Homo sapiens
ucaaaggucucacgaauuc

SEQ ID NO: 1355065 - RNA, 19 nt, Homo sapiens
caaagauccuggaauauuc

SEQ ID NO: 1355066 - RNA, 19 nt, Homo sapiens
caaaugcuguacugacuuu

SEQ ID NO: 1355067 - RNA, 19 nt, Homo sapiens
ucaagagacuggagaacua

SEQ ID NO: 1355068 - RNA, 19 nt, Homo sapiens
gaucuaagcuucuucuaac

SEQ ID NO: 1355069 - RNA, 19 nt, Homo sapiens
ggaaauaugcccaacuuau

SEQ ID NO: 1355070 - RNA, 19 nt, Homo sapiens
ggaagaagccugggucauu

SEQ ID NO: 1355071 - RNA, 19 nt, Homo sapiens
gagguuacauggucucuug

SEQ ID NO: 1355072 - RNA, 19 nt, Homo sapiens
ccacugugcugaacuguga

SEQ ID NO: 1355073 - RNA, 19 nt, Homo sapiens
acaacaagcucuucaacaa

SEQ ID NO: 1355074 - RNA, 19 nt, Homo sapiens
ggaaggugguagaauuuga

SEQ ID NO: 1355075 - RNA, 19 nt, Homo sapiens
cauggucucuugcauaauu

SEQ ID NO: 1355076 - RNA, 19 nt, Homo sapiens
cagcaaagauagcagagaa

SEQ ID NO: 1355077 - RNA, 19 nt, Homo sapiens
gaaauaugcccaacuuauc

SEQ ID NO: 1355078 - RNA, 19 nt, Homo sapiens
guccagagccugacaagua

SEQ ID NO: 1355079 - RNA, 19 nt, Homo sapiens
gaucaagggugcgguguug

SEQ ID NO: 1355080 - RNA, 19 nt, Homo sapiens
aaaggaaacuauuggagaa

SEQ ID NO: 1355081 - RNA, 19 nt, Homo sapiens
ugacugaugcgcagaauaa

SEQ ID NO: 1355082 - RNA, 19 nt, Homo sapiens
gcaggacacagcaaagaua

SEQ ID NO: 1355083 - RNA, 19 nt, Homo sapiens
gaaggaaaggaaacuauug

SEQ ID NO: 1355084 - RNA, 19 nt, Homo sapiens
ccaaagauccuggaauauu

SEQ ID NO: 1355085 - RNA, 19 nt, Homo sapiens
ccaaggccaucucaaaguu

SEQ ID NO: 1355086 - RNA, 19 nt, Homo sapiens
ggauggaaacccuggaaua

SEQ ID NO: 1355087 - RNA, 19 nt, Homo sapiens
cgacauaggcgaugacaug

SEQ ID NO: 1355088 - RNA, 19 nt, Homo sapiens
ggaagcuccuuuacacaug

SEQ ID NO: 1355089 - RNA, 19 nt, Homo sapiens
ucagugugcugucuccaua

SEQ ID NO: 1355090 - RNA, 19 nt, Homo sapiens
uacauggucucuugcauaa

SEQ ID NO: 1355091 - RNA, 19 nt, Homo sapiens
gaaaaucugugaaaaugga

SEQ ID NO: 1355092 - RNA, 19 nt, Homo sapiens
ggaaggaaaggaaacuauu

SEQ ID NO: 1355093 - RNA, 19 nt, Homo sapiens
gagcagcuguuuccuccuu

SEQ ID NO: 1355094 - RNA, 19 nt, Homo sapiens
ggacucugcuuugcccuuu

SEQ ID NO: 1355095 - RNA, 19 nt, Homo sapiens
ggaaaacgguggaaacuuc

SEQ ID NO: 1355096 - RNA, 19 nt, Homo sapiens
ccacggcccugcacaacaa

SEQ ID NO: 1355097 - RNA, 19 nt, Homo sapiens
gcgcaucgcuggucaucug

SEQ ID NO: 1355098 - RNA, 19 nt, Homo sapiens
gcauacagaugugguggaa

SEQ ID NO: 1355099 - RNA, 19 nt, Homo sapiens
uggauacacugcauuuauu

SEQ ID NO: 1355100 - RNA, 19 nt, Homo sapiens
cagcauuucuuccuacuuc

SEQ ID NO: 1355101 - RNA, 19 nt, Homo sapiens
gauaaagcaagaagacuga

SEQ ID NO: 1355102 - RNA, 19 nt, Homo sapiens
ggaacgggcaugcuucuga

SEQ ID NO: 1355103 - RNA, 19 nt, Homo sapiens
ggagagcccuguuuucuau

SEQ ID NO: 1355104 - RNA, 19 nt, Homo sapiens
gggccaauauugauuauac

SEQ ID NO: 1355105 - RNA, 19 nt, Homo sapiens
gacaugguuucaggacuua

SEQ ID NO: 1355106 - RNA, 19 nt, Homo sapiens
cauaggcgaugacaugguu

SEQ ID NO: 1355107 - RNA, 19 nt, Homo sapiens
gcccagaguugcacaagau

SEQ ID NO: 1355108 - RNA, 19 nt, Homo sapiens
gugaugagguucaagaagu

SEQ ID NO: 1355109 - RNA, 19 nt, Homo sapiens
aguauaaccuuguucauca

SEQ ID NO: 1355110 - RNA, 19 nt, Homo sapiens
ugacaagaauggcugugaa

SEQ ID NO: 1355111 - RNA, 19 nt, Homo sapiens
gcucaugauccaaagcuua

SEQ ID NO: 1355112 - RNA, 19 nt, Homo sapiens
gacaugggauucagugauc

SEQ ID NO: 1355113 - RNA, 19 nt, Homo sapiens
gguccaagcucucagugau

SEQ ID NO: 1355114 - RNA, 19 nt, Homo sapiens
ugaccaaccuugugaccuu

SEQ ID NO: 1355115 - RNA, 19 nt, Homo sapiens
caagaagacugauuuuaug

SEQ ID NO: 1355116 - RNA, 19 nt, Homo sapiens
ugacaugguuucaggacuu

SEQ ID NO: 1355117 - RNA, 19 nt, Homo sapiens
gaucaugugguucuccuuu

SEQ ID NO: 1355118 - RNA, 19 nt, Homo sapiens
ggugaucgccguccuguug

SEQ ID NO: 1355119 - RNA, 19 nt, Homo sapiens
gaccagcucuugcccaucu

SEQ ID NO: 1355120 - RNA, 19 nt, Homo sapiens
ggagucagcaagagagaaa

SEQ ID NO: 1355121 - RNA, 19 nt, Homo sapiens
gcaagaagacugauuuuau

SEQ ID NO: 1355122 - RNA, 19 nt, Homo sapiens
ggaaacuauuggagaagug

SEQ ID NO: 1355123 - RNA, 19 nt, Homo sapiens
guaugaugcugccuugaga

SEQ ID NO: 1355124 - RNA, 19 nt, Homo sapiens
ucaccaaagucacgaggaa

SEQ ID NO: 1355125 - RNA, 19 nt, Homo sapiens
gggaaaaucugugaaaaug

SEQ ID NO: 1355126 - RNA, 19 nt, Homo sapiens
gguaagagcagccuguugu

SEQ ID NO: 1355127 - RNA, 19 nt, Homo sapiens
gaccagcgcauccguguga

SEQ ID NO: 1355128 - RNA, 19 nt, Homo sapiens
gaacaagguugauuuucga

SEQ ID NO: 1355129 - RNA, 19 nt, Homo sapiens
ggccugagaagauguuuaa

SEQ ID NO: 1355130 - RNA, 19 nt, Homo sapiens
gaaagagcaggcacccaaa

SEQ ID NO: 1355131 - RNA, 19 nt, Homo sapiens
caaccuagaucccuuugac

SEQ ID NO: 1355132 - RNA, 19 nt, Homo sapiens
gaaauacagagacaacaca

SEQ ID NO: 1355133 - RNA, 19 nt, Homo sapiens
gggagaaaccauuugcaaa

SEQ ID NO: 1355134 - RNA, 19 nt, Homo sapiens
auaacuaccugcuguuguu

SEQ ID NO: 1355135 - RNA, 19 nt, Homo sapiens
caccaucccuccacuguca

SEQ ID NO: 1355136 - RNA, 19 nt, Homo sapiens
ucacugagauaaggagaug

SEQ ID NO: 1355137 - RNA, 19 nt, Homo sapiens
ggagacagaggcacaguuc

SEQ ID NO: 1355138 - RNA, 19 nt, Homo sapiens
ggagaaaccauuugcaaaa

SEQ ID NO: 1355139 - RNA, 19 nt, Homo sapiens
uagagaagguuucacuaag

SEQ ID NO: 1355140 - RNA, 19 nt, Homo sapiens
guacucgggccaauauuga

SEQ ID NO: 1355141 - RNA, 19 nt, Homo sapiens
cagagaacaagguugauuu

SEQ ID NO: 1355142 - RNA, 19 nt, Homo sapiens
gggauucagugaucaugug

SEQ ID NO: 1355143 - RNA, 19 nt, Homo sapiens
ugaccaaggccaucucaaa

SEQ ID NO: 1355144 - RNA, 19 nt, Homo sapiens
agucauggcugucaacauc

SEQ ID NO: 1355145 - RNA, 19 nt, Homo sapiens
gaauaacuaccugcuguug

SEQ ID NO: 1355146 - RNA, 19 nt, Homo sapiens
uagccggucuccuuuauuc

SEQ ID NO: 1355147 - RNA, 19 nt, Homo sapiens
gugcugaucgucuucuuaa

SEQ ID NO: 1355148 - RNA, 19 nt, Homo sapiens
gcagugaugagguucaaga

SEQ ID NO: 1355149 - RNA, 19 nt, Homo sapiens
gaccuaagaaggaaggaaa

SEQ ID NO: 1355150 - RNA, 19 nt, Homo sapiens
aaagcaagaagacugauuu

SEQ ID NO: 1355151 - RNA, 19 nt, Homo sapiens
ucaggauuaucacaugaaa

SEQ ID NO: 1355152 - RNA, 19 nt, Homo sapiens
gaggagugcauuaagaaga

SEQ ID NO: 1355153 - RNA, 19 nt, Homo sapiens
agucaaaggucucacgaau

SEQ ID NO: 1355154 - RNA, 19 nt, Homo sapiens
uaagaaggaaggaaaggaa

SEQ ID NO: 1355155 - RNA, 19 nt, Homo sapiens
ggcaucugcuucugcauug

SEQ ID NO: 1355156 - RNA, 19 nt, Homo sapiens
agagaagguuucacuaagu

SEQ ID NO: 1355157 - RNA, 19 nt, Homo sapiens
gauggaaacccuggaauag

SEQ ID NO: 1355158 - RNA, 19 nt, Homo sapiens
gaucaugaccaaccuugug

SEQ ID NO: 1355159 - RNA, 19 nt, Homo sapiens
uuacauggucucuugcaua

SEQ ID NO: 1355160 - RNA, 19 nt, Homo sapiens
gagaagcucauccaauuua

SEQ ID NO: 1355161 - RNA, 19 nt, Homo sapiens
ggacaaugcuggccuguuc

SEQ ID NO: 1355162 - RNA, 19 nt, Homo sapiens
gaagaagccugggucauug

SEQ ID NO: 1355163 - RNA, 19 nt, Homo sapiens
uaccaaagauccuggaaua

SEQ ID NO: 1355164 - RNA, 19 nt, Homo sapiens
ucaaaggucucacgaauuc

SEQ ID NO: 1355165 - RNA, 19 nt, Homo sapiens
caaagauccuggaauauuc

SEQ ID NO: 1355166 - RNA, 19 nt, Homo sapiens
caaaugcuguacugacuuu

SEQ ID NO: 1355167 - RNA, 19 nt, Homo sapiens
ucaagagacuggagaacua

SEQ ID NO: 1355168 - RNA, 19 nt, Homo sapiens
ggaaauaugcccaacuuau

SEQ ID NO: 1355169 - RNA, 19 nt, Homo sapiens
ggaagaagccugggucauu

SEQ ID NO: 1355170 - RNA, 19 nt, Homo sapiens
gagguuacauggucucuug

SEQ ID NO: 1355171 - RNA, 19 nt, Homo sapiens
ccacugugcugaacuguga

SEQ ID NO: 1355172 - RNA, 19 nt, Homo sapiens
acaacaagcucuucaacaa

SEQ ID NO: 1355173 - RNA, 19 nt, Homo sapiens
ggaaggugguagaauuuga

SEQ ID NO: 1355174 - RNA, 19 nt, Homo sapiens
cauggucucuugcauaauu

SEQ ID NO: 1355175 - RNA, 19 nt, Homo sapiens
cagcaaagauagcagagaa

SEQ ID NO: 1355176 - RNA, 19 nt, Homo sapiens
gaaauaugcccaacuuauc

SEQ ID NO: 1355177 - RNA, 19 nt, Homo sapiens
guccagagccugacaagua

SEQ ID NO: 1355178 - RNA, 19 nt, Homo sapiens
aaaggaaacuauuggagaa

SEQ ID NO: 1355179 - RNA, 19 nt, Homo sapiens
ugacugaugcgcagaauaa

SEQ ID NO: 1355180 - RNA, 19 nt, Homo sapiens
gcaggacacagcaaagaua

SEQ ID NO: 1355181 - RNA, 19 nt, Homo sapiens
gaaggaaaggaaacuauug

SEQ ID NO: 1355182 - RNA, 19 nt, Homo sapiens
ccaaagauccuggaauauu

SEQ ID NO: 1355183 - RNA, 19 nt, Homo sapiens
ggauggaaacccuggaaua

SEQ ID NO: 1355184 - RNA, 19 nt, Homo sapiens
cgacauaggcgaugacaug

SEQ ID NO: 1355185 - RNA, 19 nt, Homo sapiens
ggaagcuccuuuacacaug

SEQ ID NO: 1355186 - RNA, 19 nt, Homo sapiens
ucagugugcugucuccaua

SEQ ID NO: 1355187 - RNA, 19 nt, Homo sapiens
uacauggucucuugcauaa

SEQ ID NO: 1355188 - RNA, 19 nt, Homo sapiens
gaaaaucugugaaaaugga

SEQ ID NO: 1355189 - RNA, 19 nt, Homo sapiens
ggaaggaaaggaaacuauu

SEQ ID NO: 1355190 - RNA, 19 nt, Homo sapiens
gagcagcuguuuccuccuu

SEQ ID NO: 1355191 - RNA, 19 nt, Homo sapiens
ggacucugcuuugcccuuu

SEQ ID NO: 1355192 - RNA, 19 nt, Homo sapiens
ccacggcccugcacaacaa

SEQ ID NO: 1355193 - RNA, 19 nt, Homo sapiens
gcgcaucgcuggucaucug

SEQ ID NO: 1355194 - RNA, 19 nt, Homo sapiens
uggauacacugcauuuauu

SEQ ID NO: 1355195 - RNA, 19 nt, Homo sapiens
cagcauuucuuccuacuuc

SEQ ID NO: 1355196 - RNA, 19 nt, Homo sapiens
ggaacgggcaugcuucuga

SEQ ID NO: 1355197 - RNA, 19 nt, Homo sapiens
ggagagcccuguuuucuau

SEQ ID NO: 1355198 - RNA, 19 nt, Homo sapiens
gggccaauauugauuauac

SEQ ID NO: 1355199 - RNA, 19 nt, Homo sapiens
gacaugguuucaggacuua

SEQ ID NO: 1355200 - RNA, 19 nt, Homo sapiens
cauaggcgaugacaugguu

SEQ ID NO: 1355201 - RNA, 19 nt, Homo sapiens
gcccagaguugcacaagau

SEQ ID NO: 1355202 - RNA, 19 nt, Homo sapiens
gugaugagguucaagaagu

SEQ ID NO: 1355203 - RNA, 19 nt, Homo sapiens
aguauaaccuuguucauca

SEQ ID NO: 1355204 - RNA, 19 nt, Homo sapiens
ugacaagaauggcugugaa

SEQ ID NO: 1355205 - RNA, 19 nt, Homo sapiens
gcucaugauccaaagcuua

SEQ ID NO: 1355206 - RNA, 19 nt, Homo sapiens
gacaugggauucagugauc

SEQ ID NO: 1355207 - RNA, 19 nt, Homo sapiens
guuggcaaaucauacuaua

SEQ ID NO: 1355208 - RNA, 19 nt, Homo sapiens
gguccaagcucucagugau

SEQ ID NO: 1355209 - RNA, 19 nt, Homo sapiens
ugaccaaccuugugaccuu

SEQ ID NO: 1355210 - RNA, 19 nt, Homo sapiens
ugacaugguuucaggacuu

SEQ ID NO: 1355211 - RNA, 19 nt, Homo sapiens
gaucaugugguucuccuuu

SEQ ID NO: 1355212 - RNA, 19 nt, Homo sapiens
ggugaucgccguccuguug

SEQ ID NO: 1355213 - RNA, 19 nt, Homo sapiens
gaccagcucuugcccaucu

SEQ ID NO: 1355214 - RNA, 19 nt, Homo sapiens
ggagucagcaagagagaaa

SEQ ID NO: 1355215 - RNA, 19 nt, Homo sapiens
ggaaacuauuggagaagug

SEQ ID NO: 1355216 - RNA, 19 nt, Homo sapiens
guaugaugcugccuugaga

SEQ ID NO: 1355217 - RNA, 19 nt, Homo sapiens
ucaccaaagucacgaggaa

SEQ ID NO: 1355218 - RNA, 19 nt, Homo sapiens
gggaaaaucugugaaaaug

SEQ ID NO: 1355219 - RNA, 19 nt, Homo sapiens
gguaagagcagccuguugu

SEQ ID NO: 1355220 - RNA, 19 nt, Homo sapiens
gaccagcgcauccguguga

SEQ ID NO: 1355221 - RNA, 19 nt, Homo sapiens
gaacaagguugauuuucga

SEQ ID NO: 1355222 - RNA, 19 nt, Homo sapiens
caaccuagaucccuuugac

SEQ ID NO: 1355223 - RNA, 19 nt, Homo sapiens
gaaauacagagacaacaca

SEQ ID NO: 1355224 - RNA, 19 nt, Homo sapiens
gggagaaaccauuugcaaa

SEQ ID NO: 1355225 - RNA, 19 nt, Homo sapiens
auaacuaccugcuguuguu

SEQ ID NO: 1355226 - RNA, 19 nt, Homo sapiens
caccaucccuccacuguca

SEQ ID NO: 1355227 - RNA, 19 nt, Homo sapiens
ucacugagauaaggagaug

SEQ ID NO: 1355228 - RNA, 19 nt, Homo sapiens
ggagacagaggcacaguuc

SEQ ID NO: 1355229 - RNA, 19 nt, Homo sapiens
ggagaaaccauuugcaaaa

SEQ ID NO: 1355230 - RNA, 19 nt, Homo sapiens
guacucgggccaauauuga

SEQ ID NO: 1355231 - RNA, 19 nt, Homo sapiens
cagagaacaagguugauuu

SEQ ID NO: 1355232 - RNA, 19 nt, Homo sapiens
gggauucagugaucaugug

SEQ ID NO: 1355233 - RNA, 19 nt, Homo sapiens
agucauggcugucaacauc

SEQ ID NO: 1355234 - RNA, 19 nt, Homo sapiens
gaauaacuaccugcuguug

SEQ ID NO: 1355235 - RNA, 19 nt, Homo sapiens
uagccggucuccuuuauuc

SEQ ID NO: 1355236 - RNA, 19 nt, Homo sapiens
gugcugaucgucuucuuaa

SEQ ID NO: 1355237 - RNA, 19 nt, Homo sapiens
gcagugaugagguucaaga

SEQ ID NO: 1355238 - RNA, 19 nt, Homo sapiens
gaccuaagaaggaaggaaa

SEQ ID NO: 1355239 - RNA, 19 nt, Homo sapiens
ucaggauuaucacaugaaa

SEQ ID NO: 1355240 - RNA, 19 nt, Homo sapiens
gaggagugcauuaagaaga

SEQ ID NO: 1355241 - RNA, 19 nt, Homo sapiens
agucaaaggucucacgaau

SEQ ID NO: 1355242 - RNA, 19 nt, Homo sapiens
uaagaaggaaggaaaggaa

SEQ ID NO: 1355243 - RNA, 19 nt, Homo sapiens
ggcaucugcuucugcauug

SEQ ID NO: 1355244 - RNA, 19 nt, Homo sapiens
gauggaaacccuggaauag

SEQ ID NO: 1355245 - RNA, 19 nt, Homo sapiens
gaauuggcaggaacugaaa

SEQ ID NO: 1355246 - RNA, 19 nt, Homo sapiens
gaucaugaccaaccuugug

SEQ ID NO: 1355247 - RNA, 19 nt, Homo sapiens
uuacauggucucuugcaua

SEQ ID NO: 1355248 - RNA, 19 nt, Homo sapiens
ggauacacugcauuuauug

SEQ ID NO: 1355249 - RNA, 19 nt, Homo sapiens
aaggagauguggagacuuc

SEQ ID NO: 1355250 - RNA, 19 nt, Homo sapiens
gcaaugggaaggugguaga

SEQ ID NO: 1355251 - RNA, 19 nt, Homo sapiens
uauagccggucuccuuuau

SEQ ID NO: 1355252 - RNA, 19 nt, Homo sapiens
cacuggagcuggagaggaa

SEQ ID NO: 1355253 - RNA, 19 nt, Homo sapiens
ugaugagguucaagaaguu

SEQ ID NO: 1355254 - RNA, 19 nt, Homo sapiens
cuggucaucugcagcauuu

SEQ ID NO: 1355255 - RNA, 19 nt, Homo sapiens
agaagcucauccaauuuaa

SEQ ID NO: 1355256 - RNA, 19 nt, Homo sapiens
ccagaaccaucuaagacau

SEQ ID NO: 1355257 - RNA, 19 nt, Homo sapiens
uggaauaggcuacuugaug

SEQ ID NO: 1355258 - RNA, 19 nt, Homo sapiens
ggauuggcuuggagacaga

SEQ ID NO: 1355259 - RNA, 19 nt, Homo sapiens
acagugaguuaaugcagaa

SEQ ID NO: 1355260 - RNA, 19 nt, Homo sapiens
gaacgaggaucuacaguug

SEQ ID NO: 1355261 - RNA, 19 nt, Homo sapiens
gaacaucaauccauuugug

SEQ ID NO: 1355262 - RNA, 19 nt, Homo sapiens
gguagaggcuguuggauuc

SEQ ID NO: 1355263 - RNA, 19 nt, Homo sapiens
uacaauggcuuaaagaaug

SEQ ID NO: 1355264 - RNA, 19 nt, Homo sapiens
gaagugaaggugaguguga

SEQ ID NO: 1355265 - RNA, 19 nt, Homo sapiens
guaguuaguugguuaaugc

SEQ ID NO: 1355266 - RNA, 19 nt, Homo sapiens
ggcaaguguuguagacuaa

SEQ ID NO: 1355267 - RNA, 19 nt, Homo sapiens
gaggugcccugcucacaug

SEQ ID NO: 1355268 - RNA, 19 nt, Homo sapiens
guggguaguuaguugguua

SEQ ID NO: 1355269 - RNA, 19 nt, Homo sapiens
gauaucgccuuccacuuca

SEQ ID NO: 1355270 - RNA, 19 nt, Homo sapiens
ugcaagagccgaagcauuu

SEQ ID NO: 1355271 - RNA, 19 nt, Homo sapiens
ggacacgcuggguauauuu

SEQ ID NO: 1355272 - RNA, 19 nt, Homo sapiens
ggaacgaggaucuacaguu

SEQ ID NO: 1355273 - RNA, 19 nt, Homo sapiens
gaaggugagugugaaugga

SEQ ID NO: 1355274 - RNA, 19 nt, Homo sapiens
ggaguggucccucuagaug

SEQ ID NO: 1355275 - RNA, 19 nt, Homo sapiens
gcaaggaguggucccucua

SEQ ID NO: 1355276 - RNA, 19 nt, Homo sapiens
ggaaugaggaagugaaggu

SEQ ID NO: 1355277 - RNA, 19 nt, Homo sapiens
cggaguggguaguuaguug

SEQ ID NO: 1355278 - RNA, 19 nt, Homo sapiens
aggcaaguguuguagacua

SEQ ID NO: 1355279 - RNA, 19 nt, Homo sapiens
ggguauauuuggugacauc

SEQ ID NO: 1355280 - RNA, 19 nt, Homo sapiens
gguaguuaguugguuaaug

SEQ ID NO: 1355281 - RNA, 19 nt, Homo sapiens
caaagauacuccaaaauac

SEQ ID NO: 1355282 - RNA, 19 nt, Homo sapiens
gcacaucaggccugguuca

SEQ ID NO: 1355283 - RNA, 19 nt, Homo sapiens
ggccuggacugcacucaca

SEQ ID NO: 1355284 - RNA, 19 nt, Homo sapiens
acaauggcuuaaagaaugu

SEQ ID NO: 1355285 - RNA, 19 nt, Homo sapiens
gacagcacuuucuccacuu

SEQ ID NO: 1355286 - RNA, 19 nt, Homo sapiens
agauaucgccuuccacuuc

SEQ ID NO: 1355287 - RNA, 19 nt, Homo sapiens
ggcugaagcuggcgcucaa

SEQ ID NO: 1355288 - RNA, 19 nt, Homo sapiens
ggccagauaucgccuucca

SEQ ID NO: 1355289 - RNA, 19 nt, Homo sapiens
ggaaauaccgccagaaaac

SEQ ID NO: 1355290 - RNA, 19 nt, Homo sapiens
gaaguguccagcucuacug

SEQ ID NO: 1355291 - RNA, 19 nt, Homo sapiens
uggacacgcuggguauauu

SEQ ID NO: 1355292 - RNA, 19 nt, Homo sapiens
cagcacaucaggccugguu

SEQ ID NO: 1355293 - RNA, 19 nt, Homo sapiens
acacugaguucugcugaca

SEQ ID NO: 1355294 - RNA, 19 nt, Homo sapiens
gcagaagaaacugaucuca

SEQ ID NO: 1355295 - RNA, 19 nt, Homo sapiens
gggcaggucaucauaguac

SEQ ID NO: 1355296 - RNA, 19 nt, Homo sapiens
guacccagcuggacauccu

SEQ ID NO: 1355297 - RNA, 19 nt, Homo sapiens
acgaggaucuacaguugga

SEQ ID NO: 1355298 - RNA, 19 nt, Homo sapiens
ggaggugcccugcucacau

SEQ ID NO: 1355299 - RNA, 19 nt, Homo sapiens
cacagaggcaaguguugua

SEQ ID NO: 1355300 - RNA, 19 nt, Homo sapiens
guguccagcucuacugugu

SEQ ID NO: 1355301 - RNA, 19 nt, Homo sapiens
cuaacaaagauacuccaaa

SEQ ID NO: 1355302 - RNA, 19 nt, Homo sapiens
gagcuccggaucaguggaa

SEQ ID NO: 1355303 - RNA, 19 nt, Homo sapiens
gcaggucgcaggugagacu

SEQ ID NO: 1355304 - RNA, 19 nt, Homo sapiens
ccuuaugucacgacgauuu

SEQ ID NO: 1355305 - RNA, 19 nt, Homo sapiens
cuucaacccucgcuuccau

SEQ ID NO: 1355306 - RNA, 19 nt, Homo sapiens
ggaaguguccagcucuacu

SEQ ID NO: 1355307 - RNA, 19 nt, Homo sapiens
ucacagaggcaaguguugu

SEQ ID NO: 1355308 - RNA, 19 nt, Homo sapiens
gaauggacagcacuuucuc

SEQ ID NO: 1355309 - RNA, 19 nt, Homo sapiens
gugaauggacagcacuuuc

SEQ ID NO: 1355310 - RNA, 19 nt, Homo sapiens
caugguggacgcuggcaaa

SEQ ID NO: 1355311 - RNA, 19 nt, Homo sapiens
ugucaugucaccuggagaa

SEQ ID NO: 1355312 - RNA, 19 nt, Homo sapiens
uggcuucucucugcaaugg

SEQ ID NO: 1355313 - RNA, 19 nt, Homo sapiens
caagagccgaagcauuuua

SEQ ID NO: 1355314 - RNA, 19 nt, Homo sapiens
ugaauggacagcacuuucu

SEQ ID NO: 1355315 - RNA, 19 nt, Homo sapiens
gggcagaagaaacugaucu

SEQ ID NO: 1355316 - RNA, 19 nt, Homo sapiens
ugguagaggcuguuggauu

SEQ ID NO: 1355317 - RNA, 19 nt, Homo sapiens
cagcuuccucauccucuuu

SEQ ID NO: 1355318 - RNA, 19 nt, Homo sapiens
ucuagaugcacacagguuu

SEQ ID NO: 1355319 - RNA, 19 nt, Homo sapiens
aaggaguggucccucuaga

SEQ ID NO: 1355320 - RNA, 19 nt, Homo sapiens
ucucugcaauggccaugug

SEQ ID NO: 1355321 - RNA, 19 nt, Homo sapiens
cugaacaucaauccauuug

SEQ ID NO: 1355322 - RNA, 19 nt, Homo sapiens
gacacgcuggguauauuug

SEQ ID NO: 1355323 - RNA, 19 nt, Homo sapiens
ccagcuuccucauccucuu

SEQ ID NO: 1355324 - RNA, 19 nt, Homo sapiens
caaggaguggucccucuag

SEQ ID NO: 1355325 - RNA, 19 nt, Homo sapiens
gggcagaguucaucuucuu

SEQ ID NO: 1355326 - RNA, 19 nt, Homo sapiens
gaaauaaagaugccucagu

SEQ ID NO: 1355327 - RNA, 19 nt, Homo sapiens
gagcugaugcugcagauga

SEQ ID NO: 1355328 - RNA, 19 nt, Homo sapiens
gcagaguucaucuucuuga

SEQ ID NO: 1355329 - RNA, 19 nt, Homo sapiens
gcagcccugucccaccaua

SEQ ID NO: 1355330 - RNA, 19 nt, Homo sapiens
ggagcgacacuaccaguug

SEQ ID NO: 1355331 - RNA, 19 nt, Homo sapiens
ugugugacccagagaaaua

SEQ ID NO: 1355332 - RNA, 19 nt, Homo sapiens
uacagagccuggugaagga

SEQ ID NO: 1355333 - RNA, 19 nt, Homo sapiens
gcugucaaacccuaggaua

SEQ ID NO: 1355334 - RNA, 19 nt, Homo sapiens
acccuaggauagucucaua

SEQ ID NO: 1355335 - RNA, 19 nt, Homo sapiens
ccuaggauagucucauaaa

SEQ ID NO: 1355336 - RNA, 19 nt, Homo sapiens
ggaguugcccagcucuuuc

SEQ ID NO: 1355337 - RNA, 19 nt, Homo sapiens
ucugggacuugcugucaaa

SEQ ID NO: 1355338 - RNA, 19 nt, Homo sapiens
gcgauggaccagaagauca

SEQ ID NO: 1355339 - RNA, 19 nt, Homo sapiens
cagcagcgccuguccuaca

SEQ ID NO: 1355340 - RNA, 19 nt, Homo sapiens
cuaggauagucucauaaag

SEQ ID NO: 1355341 - RNA, 19 nt, Homo sapiens
agaugaaccugcuggaacu

SEQ ID NO: 1355342 - RNA, 19 nt, Homo sapiens
uaggauagucucauaaagg

SEQ ID NO: 1355343 - RNA, 19 nt, Homo sapiens
gcuucuacgugaccaccaa

SEQ ID NO: 1355344 - RNA, 19 nt, Homo sapiens
ugcuggaacucauccgaaa

SEQ ID NO: 1355345 - RNA, 19 nt, Homo sapiens
ugacccagagaaauaaaga

SEQ ID NO: 1355346 - RNA, 19 nt, Homo sapiens
gcagagcacacuggagaag

SEQ ID NO: 1355347 - RNA, 19 nt, Homo sapiens
gaaccugcuggaacucauc

SEQ ID NO: 1355348 - RNA, 19 nt, Homo sapiens
agaacuagaggccguggaa

SEQ ID NO: 1355349 - RNA, 19 nt, Homo sapiens
gcaccguguucgaaaucgu

SEQ ID NO: 1355350 - RNA, 19 nt, Homo sapiens
guucaucuucuugaccuuu

SEQ ID NO: 1355351 - RNA, 19 nt, Homo sapiens
gucaaacccuaggauaguc

SEQ ID NO: 1355352 - RNA, 19 nt, Homo sapiens
aaaagagccuguacaacca

SEQ ID NO: 1355353 - RNA, 19 nt, Homo sapiens
guacggaacauauuuauug

SEQ ID NO: 1355354 - RNA, 19 nt, Homo sapiens
ccaaaucaguauuagcuuu

SEQ ID NO: 1355355 - RNA, 19 nt, Homo sapiens
ugaagaagcugccggaacu

SEQ ID NO: 1355356 - RNA, 19 nt, Homo sapiens
gcacagguucugagacuga

SEQ ID NO: 1355357 - RNA, 19 nt, Homo sapiens
ccauaaagaugaagaagcu

SEQ ID NO: 1355358 - RNA, 19 nt, Homo sapiens
cagcggcagugaagaaaga

SEQ ID NO: 1355359 - RNA, 19 nt, Homo sapiens
gccaaccaaaucaguauua

SEQ ID NO: 1355360 - RNA, 19 nt, Homo sapiens
ccaggcgccucuccauaaa

SEQ ID NO: 1355361 - RNA, 19 nt, Homo sapiens
gccaggcgccucuccauaa

SEQ ID NO: 1355362 - RNA, 19 nt, Homo sapiens
uuugagcacugcacuguuu

SEQ ID NO: 1355363 - RNA, 19 nt, Homo sapiens
ggacacuaguugccaaguc

SEQ ID NO: 1355364 - RNA, 19 nt, Homo sapiens
cuccagaugucgcgccuua

SEQ ID NO: 1355365 - RNA, 19 nt, Homo sapiens
ccaucuuuguggauaauaa

SEQ ID NO: 1355366 - RNA, 19 nt, Homo sapiens
gaccagcgguugugaccau

SEQ ID NO: 1355367 - RNA, 19 nt, Homo sapiens
ccucaaggauuaucuucga

SEQ ID NO: 1355368 - RNA, 19 nt, Homo sapiens
gcaccugaaucucaaagac

SEQ ID NO: 1355369 - RNA, 19 nt, Homo sapiens
gaagugcguugggcagauc

SEQ ID NO: 1355370 - RNA, 19 nt, Homo sapiens
ggauuaucuucgagaguug

SEQ ID NO: 1355371 - RNA, 19 nt, Homo sapiens
gcucagcggcagugaagaa

SEQ ID NO: 1355372 - RNA, 19 nt, Homo sapiens
ggacuguaccgucuuugug

SEQ ID NO: 1355373 - RNA, 19 nt, Homo sapiens
gacacuaguugccaagucu

SEQ ID NO: 1355374 - RNA, 19 nt, Homo sapiens
ccagugcaguggacuucaa

SEQ ID NO: 1355375 - RNA, 19 nt, Homo sapiens
aggauuaucuucgagaguu

SEQ ID NO: 1355376 - RNA, 19 nt, Homo sapiens
guaguucucgcgcuugcua

SEQ ID NO: 1355377 - RNA, 19 nt, Homo sapiens
gagacucauucccaguuuc

SEQ ID NO: 1355378 - RNA, 19 nt, Homo sapiens
gacacaaagacuagcauga

SEQ ID NO: 1355379 - RNA, 19 nt, Homo sapiens
ccaaccaaaucaguauuag

SEQ ID NO: 1355380 - RNA, 19 nt, Homo sapiens
ggacuucaagcaccacauc

SEQ ID NO: 1355381 - RNA, 19 nt, Homo sapiens
gugggacuguaccgucuuu

SEQ ID NO: 1355382 - RNA, 19 nt, Homo sapiens
ggaccagucgcguguaugg

SEQ ID NO: 1355383 - RNA, 19 nt, Homo sapiens
ucagcugccugccagaugu

SEQ ID NO: 1355384 - RNA, 19 nt, Homo sapiens
cgauaucaaugucaucacu

SEQ ID NO: 1355385 - RNA, 19 nt, Homo sapiens
caaauggagauaacagagu

SEQ ID NO: 1355386 - RNA, 19 nt, Homo sapiens
gguauuuggacacuaguug

SEQ ID NO: 1355387 - RNA, 19 nt, Homo sapiens
ccgagccgcuacucaggaa

SEQ ID NO: 1355388 - RNA, 19 nt, Homo sapiens
aggcgccucuccauaaaga

SEQ ID NO: 1355389 - RNA, 19 nt, Homo sapiens
ccaauaauggugccucagu

SEQ ID NO: 1355390 - RNA, 19 nt, Homo sapiens
gguacggaacauauuuauu

SEQ ID NO: 1355391 - RNA, 19 nt, Homo sapiens
gcugccaaccaaaucagua

SEQ ID NO: 1355392 - RNA, 19 nt, Homo sapiens
gaguuccagugggagagua

SEQ ID NO: 1355393 - RNA, 19 nt, Homo sapiens
ucacccagccccuguauaa

SEQ ID NO: 1355394 - RNA, 19 nt, Homo sapiens
ggaccucugcugccuacug

SEQ ID NO: 1355395 - RNA, 19 nt, Homo sapiens
caucuuuccugagcaccaa

SEQ ID NO: 1355396 - RNA, 19 nt, Homo sapiens
gagucuggccuuuccaauc

SEQ ID NO: 1355397 - RNA, 19 nt, Homo sapiens
aaggagagccagaccuguu

SEQ ID NO: 1355398 - RNA, 19 nt, Homo sapiens
acacaaagacuagcaugag

SEQ ID NO: 1355399 - RNA, 19 nt, Homo sapiens
cagcgguugugaccaucuu

SEQ ID NO: 1355400 - RNA, 19 nt, Homo sapiens
guacgguucccuccugucu

SEQ ID NO: 1355401 - RNA, 19 nt, Homo sapiens
gcccagccacccugaaauc

SEQ ID NO: 1355402 - RNA, 19 nt, Homo sapiens
cagaggagggagcaguuug

SEQ ID NO: 1355403 - RNA, 19 nt, Homo sapiens
gcgccucuccauaaagaug

SEQ ID NO: 1355404 - RNA, 19 nt, Homo sapiens
cgggaccagucgcguguau

SEQ ID NO: 1355405 - RNA, 19 nt, Homo sapiens
aaucaacgugugccucuga

SEQ ID NO: 1355406 - RNA, 19 nt, Homo sapiens
uccuggaucuggagagaga

SEQ ID NO: 1355407 - RNA, 19 nt, Homo sapiens
agaugucgcgccuuacuug

SEQ ID NO: 1355408 - RNA, 19 nt, Homo sapiens
gccucagccugcaccugua

SEQ ID NO: 1355409 - RNA, 19 nt, Homo sapiens
gugcccagccacccugaaa

SEQ ID NO: 1355410 - RNA, 19 nt, Homo sapiens
gcaugaggcacuguuugug

SEQ ID NO: 1355411 - RNA, 19 nt, Homo sapiens
uagcaugaggcacuguuug

SEQ ID NO: 1355412 - RNA, 19 nt, Homo sapiens
ccucuagucggcccucuug

SEQ ID NO: 1355413 - RNA, 19 nt, Homo sapiens
agacuucgacgcccucauc

SEQ ID NO: 1355414 - RNA, 19 nt, Homo sapiens
caacaucuguccuaguaua

SEQ ID NO: 1355415 - RNA, 19 nt, Homo sapiens
gggaagagguggccuauga

SEQ ID NO: 1355416 - RNA, 19 nt, Homo sapiens
ggaaagggcuccugaagca

SEQ ID NO: 1355417 - RNA, 19 nt, Homo sapiens
uagaagagcugaacaaaca

SEQ ID NO: 1355418 - RNA, 19 nt, Homo sapiens
ugaaauagccacgaucuua

SEQ ID NO: 1355419 - RNA, 19 nt, Homo sapiens
gaaacagucucuugcuugu

SEQ ID NO: 1355420 - RNA, 19 nt, Homo sapiens
gaaagugacuguugaugac

SEQ ID NO: 1355421 - RNA, 19 nt, Homo sapiens
acacaaaccuuacaaaugc

SEQ ID NO: 1355422 - RNA, 19 nt, Homo sapiens
ggacuuaaacauuacugua

SEQ ID NO: 1355423 - RNA, 19 nt, Homo sapiens
aagaugcguugaacaaaua

SEQ ID NO: 1355424 - RNA, 19 nt, Homo sapiens
gaaggccacugcugucuca

SEQ ID NO: 1355425 - RNA, 19 nt, Homo sapiens
gcccaucccuuccuuauuc

SEQ ID NO: 1355426 - RNA, 19 nt, Homo sapiens
ggagaagucuuaguagcuu

SEQ ID NO: 1355427 - RNA, 19 nt, Homo sapiens
gcuuguaucuggagucuug

SEQ ID NO: 1355428 - RNA, 19 nt, Homo sapiens
uaagaugcguugaacaaau

SEQ ID NO: 1355429 - RNA, 19 nt, Homo sapiens
gaaaggccacgaauacaga

SEQ ID NO: 1355430 - RNA, 19 nt, Homo sapiens
gcucaagaacugcaaauga

SEQ ID NO: 1355431 - RNA, 19 nt, Homo sapiens
gaaacacaaaccuuacaaa

SEQ ID NO: 1355432 - RNA, 19 nt, Homo sapiens
agauaaggcucuagaggaa

SEQ ID NO: 1355433 - RNA, 19 nt, Homo sapiens
caucuguccuaguauaauu

SEQ ID NO: 1355434 - RNA, 19 nt, Homo sapiens
gaaagaagaaaucauucga

SEQ ID NO: 1355435 - RNA, 19 nt, Homo sapiens
gaaauagccacgaucuuag

SEQ ID NO: 1355436 - RNA, 19 nt, Homo sapiens
agcaacaucuguccuagua

SEQ ID NO: 1355437 - RNA, 19 nt, Homo sapiens
gccaagcgccuaacuuuau

SEQ ID NO: 1355438 - RNA, 19 nt, Homo sapiens
gcaguucggucaguucuca

SEQ ID NO: 1355439 - RNA, 19 nt, Homo sapiens
cgaaagugacuguugauga

SEQ ID NO: 1355440 - RNA, 19 nt, Homo sapiens
ggucaguucucaaaagaua

SEQ ID NO: 1355441 - RNA, 19 nt, Homo sapiens
uaucuggagucuugagaaa

SEQ ID NO: 1355442 - RNA, 19 nt, Homo sapiens
guaacaaaccaauuaagug

SEQ ID NO: 1355443 - RNA, 19 nt, Homo sapiens
gcaccuccguuguuagauc

SEQ ID NO: 1355444 - RNA, 19 nt, Homo sapiens
gcauucagccucagcaguu

SEQ ID NO: 1355445 - RNA, 19 nt, Homo sapiens
gaagcgaaagugacuguug

SEQ ID NO: 1355446 - RNA, 19 nt, Homo sapiens
uaaagcaacaucuguccua

SEQ ID NO: 1355447 - RNA, 19 nt, Homo sapiens
gagcaguucuucuguaucc

SEQ ID NO: 1355448 - RNA, 19 nt, Homo sapiens
gaaauugccuacggagcau

SEQ ID NO: 1355449 - RNA, 19 nt, Homo sapiens
caacaugggccaccuccuu

SEQ ID NO: 1355450 - RNA, 19 nt, Homo sapiens
gaaccuggaccucaugcuu

SEQ ID NO: 1355451 - RNA, 19 nt, Homo sapiens
aacagaagaugcuagaaga

SEQ ID NO: 1355452 - RNA, 19 nt, Homo sapiens
gccggcaccuccguuguua

SEQ ID NO: 1355453 - RNA, 19 nt, Homo sapiens
caacagaagaugcuagaag

SEQ ID NO: 1355454 - RNA, 19 nt, Homo sapiens
aagcgaaagugacuguuga

SEQ ID NO: 1355455 - RNA, 19 nt, Homo sapiens
gugaaacagucucuugcuu

SEQ ID NO: 1355456 - RNA, 19 nt, Homo sapiens
gacgauacauguaaaaguu

SEQ ID NO: 1355457 - RNA, 19 nt, Homo sapiens
acugacaucucauccguuu

SEQ ID NO: 1355458 - RNA, 19 nt, Homo sapiens
ccaagcgccuaacuuuaug

SEQ ID NO: 1355459 - RNA, 19 nt, Homo sapiens
ggccaagcgccuaacuuua

SEQ ID NO: 1355460 - RNA, 19 nt, Homo sapiens
gaagagcugaacaaacaga

SEQ ID NO: 1355461 - RNA, 19 nt, Homo sapiens
ggagagggccuucgacacu

SEQ ID NO: 1355462 - RNA, 19 nt, Homo sapiens
guuggacccuagagccaua

SEQ ID NO: 1355463 - RNA, 19 nt, Homo sapiens
gggaaacagaaacacauuu

SEQ ID NO: 1355464 - RNA, 19 nt, Homo sapiens
uaccuucacugacaucuca

SEQ ID NO: 1355465 - RNA, 19 nt, Homo sapiens
ggaaaggccacgaauacag

SEQ ID NO: 1355466 - RNA, 19 nt, Homo sapiens
ugucagacgauacauguaa

SEQ ID NO: 1355467 - RNA, 19 nt, Homo sapiens
uaaagccacguucguaaga

SEQ ID NO: 1355468 - RNA, 19 nt, Homo sapiens
gcuagaagagcugaacaaa

SEQ ID NO: 1355469 - RNA, 19 nt, Homo sapiens
acaaaccaauuaaguguac

SEQ ID NO: 1355470 - RNA, 19 nt, Homo sapiens
uugagaaacacaaaccuua

SEQ ID NO: 1355471 - RNA, 19 nt, Homo sapiens
guaagaugcguugaacaaa

SEQ ID NO: 1355472 - RNA, 19 nt, Homo sapiens
cguaagaugcguugaacaa

SEQ ID NO: 1355473 - RNA, 19 nt, Homo sapiens
gagaaacacaaaccuuaca

SEQ ID NO: 1355474 - RNA, 19 nt, Homo sapiens
ugacaucucauccguuugu

SEQ ID NO: 1355475 - RNA, 19 nt, Homo sapiens
gaauacagaaaccagacuu

SEQ ID NO: 1355476 - RNA, 19 nt, Homo sapiens
ccaccaagauucacaaacc

SEQ ID NO: 1355477 - RNA, 19 nt, Homo sapiens
guaaaaguuuguccuugaa

SEQ ID NO: 1355478 - RNA, 19 nt, Homo sapiens
ucugagcaguucuucugua

SEQ ID NO: 1355479 - RNA, 19 nt, Homo sapiens
gcaucuuucuuuugucaua

SEQ ID NO: 1355480 - RNA, 19 nt, Homo sapiens
gcauauugcuuuucagauc

SEQ ID NO: 1355481 - RNA, 19 nt, Homo sapiens
ggaaagaagaaaucauucg

SEQ ID NO: 1355482 - RNA, 19 nt, Homo sapiens
ggugcagacucucuuugga

SEQ ID NO: 1355483 - RNA, 19 nt, Homo sapiens
auaaggcucuagaggaaga

SEQ ID NO: 1355484 - RNA, 19 nt, Homo sapiens
gucagacgauacauguaaa

SEQ ID NO: 1355485 - RNA, 19 nt, Homo sapiens
gaugugugccgacgugaga

SEQ ID NO: 1355486 - RNA, 19 nt, Homo sapiens
caacugggaaacagaaaca

SEQ ID NO: 1355487 - RNA, 19 nt, Homo sapiens
ugcagacucucuuuggaaa

SEQ ID NO: 1355488 - RNA, 19 nt, Homo sapiens
agccauaccuucacugaca

SEQ ID NO: 1355489 - RNA, 19 nt, Homo sapiens
ucuggagucuugagaaaca

SEQ ID NO: 1355490 - RNA, 19 nt, Homo sapiens
uuaagggaguuucguugga

SEQ ID NO: 1355491 - RNA, 19 nt, Homo sapiens
gcagaccccuucgcgauuu

SEQ ID NO: 1355492 - RNA, 19 nt, Homo sapiens
ggacagagcaagccccauu

SEQ ID NO: 1355493 - RNA, 19 nt, Homo sapiens
caucucauccguuuguguu

SEQ ID NO: 1355494 - RNA, 19 nt, Homo sapiens
ccaagauucacaaaccaaa

SEQ ID NO: 1355495 - RNA, 19 nt, Homo sapiens
cugagcaguucuucuguau

SEQ ID NO: 1355496 - RNA, 19 nt, Homo sapiens
gugcagacucucuuuggaa

SEQ ID NO: 1355497 - RNA, 19 nt, Homo sapiens
ucacaucuuuacaauucug

SEQ ID NO: 1355498 - RNA, 19 nt, Homo sapiens
gcgggaaccuggaccucau

SEQ ID NO: 1355499 - RNA, 19 nt, Homo sapiens
uaugaggacccaagaaauc

SEQ ID NO: 1355500 - RNA, 19 nt, Homo sapiens
uacgggagaagucuuagua

SEQ ID NO: 1355501 - RNA, 19 nt, Homo sapiens
gcaaggaccggagcaagag

SEQ ID NO: 1355502 - RNA, 19 nt, Homo sapiens
gcguugaacaaauagcuuu

SEQ ID NO: 1355503 - RNA, 19 nt, Homo sapiens
guaugaggacccaagaaau

SEQ ID NO: 1355504 - RNA, 19 nt, Homo sapiens
gcuggaggagcaagaagaa

SEQ ID NO: 1355505 - RNA, 19 nt, Homo sapiens
ucaagaacugcaaaugaga

SEQ ID NO: 1355506 - RNA, 19 nt, Homo sapiens
ggaguccuugauuugaaua

SEQ ID NO: 1355507 - RNA, 19 nt, Homo sapiens
gauuuaaagcaacaucugu

SEQ ID NO: 1355508 - RNA, 19 nt, Homo sapiens
aacacaaaccuuacaaaug

SEQ ID NO: 1355509 - RNA, 19 nt, Homo sapiens
cauccuagucaguuugaaa

SEQ ID NO: 1355510 - RNA, 19 nt, Homo sapiens
uguaaaaguuuguccuuga

SEQ ID NO: 1355511 - RNA, 19 nt, Homo sapiens
gcccucaucccaaccaguu

SEQ ID NO: 1355512 - RNA, 19 nt, Homo sapiens
aacaugggccaccuccuua

SEQ ID NO: 1355513 - RNA, 19 nt, Homo sapiens
ucucuugcuugucguguau

SEQ ID NO: 1355514 - RNA, 19 nt, Homo sapiens
gcaggaagcugaagaguug

SEQ ID NO: 1355515 - RNA, 19 nt, Homo sapiens
gaacucauuugcaucauuu

SEQ ID NO: 1355516 - RNA, 19 nt, Homo sapiens
gcagaaaguugaucauugu

SEQ ID NO: 1355517 - RNA, 19 nt, Homo sapiens
gaagguguauugagugauu

SEQ ID NO: 1355518 - RNA, 19 nt, Homo sapiens
gagaguagcugcccugugu

SEQ ID NO: 1355519 - RNA, 19 nt, Homo sapiens
gaagauaagagacaaguga

SEQ ID NO: 1355520 - RNA, 19 nt, Homo sapiens
caacagccuuucuauauca

SEQ ID NO: 1355521 - RNA, 19 nt, Homo sapiens
ugaaaguucucaacacaaa

SEQ ID NO: 1355522 - RNA, 19 nt, Homo sapiens
ggaguuaaauguagugcuu

SEQ ID NO: 1355523 - RNA, 19 nt, Homo sapiens
gaacguccuucacucauca

SEQ ID NO: 1355524 - RNA, 19 nt, Homo sapiens
ugaagaagccagaaacuuu

SEQ ID NO: 1355525 - RNA, 19 nt, Homo sapiens
uuagagagcugacagaugu

SEQ ID NO: 1355526 - RNA, 19 nt, Homo sapiens
uuaaauggcugugcuuauu

SEQ ID NO: 1355527 - RNA, 19 nt, Homo sapiens
caagugagcucuccgaaac

SEQ ID NO: 1355528 - RNA, 19 nt, Homo sapiens
caacuccugucucuccaua

SEQ ID NO: 1355529 - RNA, 19 nt, Homo sapiens
ccaaguagcugggauuaca

SEQ ID NO: 1355530 - RNA, 19 nt, Homo sapiens
ugagaccgcuauuuaggua

SEQ ID NO: 1355531 - RNA, 19 nt, Homo sapiens
ggaggaagacauucugaaa

SEQ ID NO: 1355532 - RNA, 19 nt, Homo sapiens
ggcagaaaguugaucauug

SEQ ID NO: 1355533 - RNA, 19 nt, Homo sapiens
caaagaaacgacacauauu

SEQ ID NO: 1355534 - RNA, 19 nt, Homo sapiens
ucauacaccugaacucauu

SEQ ID NO: 1355535 - RNA, 19 nt, Homo sapiens
aaauacggcuacuggguua

SEQ ID NO: 1355536 - RNA, 19 nt, Homo sapiens
cgaaaccacagauaauaua

SEQ ID NO: 1355537 - RNA, 19 nt, Homo sapiens
ggaagacucaaauacagua

SEQ ID NO: 1355538 - RNA, 19 nt, Homo sapiens
auaauugccuugugccaua

SEQ ID NO: 1355539 - RNA, 19 nt, Homo sapiens
guccuucacucaucaguaa

SEQ ID NO: 1355540 - RNA, 19 nt, Homo sapiens
ggaaggaguuaaauguagu

SEQ ID NO: 1355541 - RNA, 19 nt, Homo sapiens
ucacaucagggaaacauua

SEQ ID NO: 1355542 - RNA, 19 nt, Homo sapiens
gcagaaguaggaagucuuu

SEQ ID NO: 1355543 - RNA, 19 nt, Homo sapiens
gaggaaggaguuaaaugua

SEQ ID NO: 1355544 - RNA, 19 nt, Homo sapiens
caagauaccagacauuugu

SEQ ID NO: 1355545 - RNA, 19 nt, Homo sapiens
gaaggaggaggaagacauu

SEQ ID NO: 1355546 - RNA, 19 nt, Homo sapiens
gccuguauuuccauauuua

SEQ ID NO: 1355547 - RNA, 19 nt, Homo sapiens
ggugauggauaugcuaauu

SEQ ID NO: 1355548 - RNA, 19 nt, Homo sapiens
ccauauaccagcaguguaa

SEQ ID NO: 1355549 - RNA, 19 nt, Homo sapiens
ugacuaagaagaugaagaa

SEQ ID NO: 1355550 - RNA, 19 nt, Homo sapiens
cuacuggguuauaggguua

SEQ ID NO: 1355551 - RNA, 19 nt, Homo sapiens
gaaaggaaugcuagaagug

SEQ ID NO: 1355552 - RNA, 19 nt, Homo sapiens
gacaagauaccagacauuu

SEQ ID NO: 1355553 - RNA, 19 nt, Homo sapiens
ggguguggauggcgucaua

SEQ ID NO: 1355554 - RNA, 19 nt, Homo sapiens
acaaagaaacgacacauau

SEQ ID NO: 1355555 - RNA, 19 nt, Homo sapiens
gcauguagccaacuuagug

SEQ ID NO: 1355556 - RNA, 19 nt, Homo sapiens
ggaauccugguuaauguaa

SEQ ID NO: 1355557 - RNA, 19 nt, Homo sapiens
ucgaugcccuuauuuguga

SEQ ID NO: 1355558 - RNA, 19 nt, Homo sapiens
ugaaaggaaugcuagaagu

SEQ ID NO: 1355559 - RNA, 19 nt, Homo sapiens
aagcaugccucacugcaaa

SEQ ID NO: 1355560 - RNA, 19 nt, Homo sapiens
cuaauacuuuggaucauug

SEQ ID NO: 1355561 - RNA, 19 nt, Homo sapiens
uauuugaggugauggauau

SEQ ID NO: 1355562 - RNA, 19 nt, Homo sapiens
gguaugugcuggcuuccaa

SEQ ID NO: 1355563 - RNA, 19 nt, Homo sapiens
ggacaagauaccagacauu

SEQ ID NO: 1355564 - RNA, 19 nt, Homo sapiens
gacaguggcuccaaacaac

SEQ ID NO: 1355565 - RNA, 19 nt, Homo sapiens
gugacuagaguuaacaaua

SEQ ID NO: 1355566 - RNA, 19 nt, Homo sapiens
uaucacaaaccauggauuu

SEQ ID NO: 1355567 - RNA, 19 nt, Homo sapiens
ccaaagugcugggauuaca

SEQ ID NO: 1355568 - RNA, 19 nt, Homo sapiens
gauaguuccuuccauacuc

SEQ ID NO: 1355569 - RNA, 19 nt, Homo sapiens
caugugcugucauuucuga

SEQ ID NO: 1355570 - RNA, 19 nt, Homo sapiens
ggacggagaacgugaccuu

SEQ ID NO: 1355571 - RNA, 19 nt, Homo sapiens
gagaacauacggccuaauc

SEQ ID NO: 1355572 - RNA, 19 nt, Homo sapiens
ucaacagccuuucuauauc

SEQ ID NO: 1355573 - RNA, 19 nt, Homo sapiens
ccauggauuucucaucuau

SEQ ID NO: 1355574 - RNA, 19 nt, Homo sapiens
uaccagacauuugugaauu

SEQ ID NO: 1355575 - RNA, 19 nt, Homo sapiens
ggagagcaaugagcugcaa

SEQ ID NO: 1355576 - RNA, 19 nt, Homo sapiens
cagccuguauuuccauauu

SEQ ID NO: 1355577 - RNA, 19 nt, Homo sapiens
gaacgugaccuugaagaag

SEQ ID NO: 1355578 - RNA, 19 nt, Homo sapiens
gaauccugguuaauguaaa

SEQ ID NO: 1355579 - RNA, 19 nt, Homo sapiens
caucuaauacuuuggauca

SEQ ID NO: 1355580 - RNA, 19 nt, Homo sapiens
acacuguaccacauaaaua

SEQ ID NO: 1355581 - RNA, 19 nt, Homo sapiens
acuccugucucuccauaua

SEQ ID NO: 1355582 - RNA, 19 nt, Homo sapiens
ugaacucauuugcaucauu

SEQ ID NO: 1355583 - RNA, 19 nt, Homo sapiens
gcugucauuucugaagaua

SEQ ID NO: 1355584 - RNA, 19 nt, Homo sapiens
cggagaacgugaccuugaa

SEQ ID NO: 1355585 - RNA, 19 nt, Homo sapiens
gcaaugagcugcaaaaccu

SEQ ID NO: 1355586 - RNA, 19 nt, Homo sapiens
uuaccagccugagaacaua

SEQ ID NO: 1355587 - RNA, 19 nt, Homo sapiens
gugauggauaugcuaauua

SEQ ID NO: 1355588 - RNA, 19 nt, Homo sapiens
acacauauuugaggugaug

SEQ ID NO: 1355589 - RNA, 19 nt, Homo sapiens
aaacugaccuauaccucau

SEQ ID NO: 1355590 - RNA, 19 nt, Homo sapiens
gaagaagccagaaacuuuu

SEQ ID NO: 1355591 - RNA, 19 nt, Homo sapiens
gcucagggaggucaaguug

SEQ ID NO: 1355592 - RNA, 19 nt, Homo sapiens
cuucugcacuggugucuga

SEQ ID NO: 1355593 - RNA, 19 nt, Homo sapiens
gcccuuauuugugaguuaa

SEQ ID NO: 1355594 - RNA, 19 nt, Homo sapiens
caccugaacucauuugcau

SEQ ID NO: 1355595 - RNA, 19 nt, Homo sapiens
ggaaugcuagaaguguuua

SEQ ID NO: 1355596 - RNA, 19 nt, Homo sapiens
ggacaaaacuguauuuacc

SEQ ID NO: 1355597 - RNA, 19 nt, Homo sapiens
gcccaggaguaccaaguga

SEQ ID NO: 1355598 - RNA, 19 nt, Homo sapiens
guauagagguuuuguaucu

SEQ ID NO: 1355599 - RNA, 19 nt, Homo sapiens
gaccgcuauuuagguauua

SEQ ID NO: 1355600 - RNA, 19 nt, Homo sapiens
gugauuauuuguccugauc

SEQ ID NO: 1355601 - RNA, 19 nt, Homo sapiens
ugacaucagagaagagaaa

SEQ ID NO: 1355602 - RNA, 19 nt, Homo sapiens
ggauuucucaucuauaagu

SEQ ID NO: 1355603 - RNA, 19 nt, Homo sapiens
auccugggcucucaaagua

SEQ ID NO: 1355604 - RNA, 19 nt, Homo sapiens
ccacaagaaguccaugcua

SEQ ID NO: 1355605 - RNA, 19 nt, Homo sapiens
agaaacgacacauauuuga

SEQ ID NO: 1355606 - RNA, 19 nt, Homo sapiens
ugguuaggcucgucuagaa

SEQ ID NO: 1355607 - RNA, 19 nt, Homo sapiens
ccucucagauucaagcaau

SEQ ID NO: 1355608 - RNA, 19 nt, Homo sapiens
gaaccuucuuacacacuca

SEQ ID NO: 1355609 - RNA, 19 nt, Homo sapiens
guagugcuuuccaggauag

SEQ ID NO: 1355610 - RNA, 19 nt, Homo sapiens
cauuucaugugcugucauu

SEQ ID NO: 1355611 - RNA, 19 nt, Homo sapiens
agaaguccaugcuagacaa

SEQ ID NO: 1355612 - RNA, 19 nt, Homo sapiens
ugauggauaugcuaauuac

SEQ ID NO: 1355613 - RNA, 19 nt, Homo sapiens
gaaacgacacauauuugag

SEQ ID NO: 1355614 - RNA, 19 nt, Homo sapiens
gcaggaagcugaagaguug

SEQ ID NO: 1355615 - RNA, 19 nt, Homo sapiens
gcagaaaguugaucauugu

SEQ ID NO: 1355616 - RNA, 19 nt, Homo sapiens
gaagguguauugagugauu

SEQ ID NO: 1355617 - RNA, 19 nt, Homo sapiens
gagaguagcugcccugugu

SEQ ID NO: 1355618 - RNA, 19 nt, Homo sapiens
guaaggagaagucacauua

SEQ ID NO: 1355619 - RNA, 19 nt, Homo sapiens
caagauuucucucauauca

SEQ ID NO: 1355620 - RNA, 19 nt, Homo sapiens
gaagauaagagacaaguga

SEQ ID NO: 1355621 - RNA, 19 nt, Homo sapiens
ucccuuagcugaccuguua

SEQ ID NO: 1355622 - RNA, 19 nt, Homo sapiens
ccaagacacacauaacuua

SEQ ID NO: 1355623 - RNA, 19 nt, Homo sapiens
ugaagaagccagaaacuuu

SEQ ID NO: 1355624 - RNA, 19 nt, Homo sapiens
uuagagagcugacagaugu

SEQ ID NO: 1355625 - RNA, 19 nt, Homo sapiens
caagugagcucuccgaaac

SEQ ID NO: 1355626 - RNA, 19 nt, Homo sapiens
ggaggaagacauucugaaa

SEQ ID NO: 1355627 - RNA, 19 nt, Homo sapiens
ggcagaaaguugaucauug

SEQ ID NO: 1355628 - RNA, 19 nt, Homo sapiens
cgaaaccacagauaauaua

SEQ ID NO: 1355629 - RNA, 19 nt, Homo sapiens
ggaagacucaaauacagua

SEQ ID NO: 1355630 - RNA, 19 nt, Homo sapiens
ucacaucagggaaacauua

SEQ ID NO: 1355631 - RNA, 19 nt, Homo sapiens
gcagaaguaggaagucuuu

SEQ ID NO: 1355632 - RNA, 19 nt, Homo sapiens
caagauaccagacauuugu

SEQ ID NO: 1355633 - RNA, 19 nt, Homo sapiens
gaaggaggaggaagacauu

SEQ ID NO: 1355634 - RNA, 19 nt, Homo sapiens
gaaaggaaugcuagaagug

SEQ ID NO: 1355635 - RNA, 19 nt, Homo sapiens
gacaagauaccagacauuu

SEQ ID NO: 1355636 - RNA, 19 nt, Homo sapiens
ggguguggauggcgucaua

SEQ ID NO: 1355637 - RNA, 19 nt, Homo sapiens
gagaagucacauuaucaua

SEQ ID NO: 1355638 - RNA, 19 nt, Homo sapiens
ggaauccugguuaauguaa

SEQ ID NO: 1355639 - RNA, 19 nt, Homo sapiens
ugaaaggaaugcuagaagu

SEQ ID NO: 1355640 - RNA, 19 nt, Homo sapiens
aagcaugccucacugcaaa

SEQ ID NO: 1355641 - RNA, 19 nt, Homo sapiens
gguaugugcuggcuuccaa

SEQ ID NO: 1355642 - RNA, 19 nt, Homo sapiens
ggacaagauaccagacauu

SEQ ID NO: 1355643 - RNA, 19 nt, Homo sapiens
gacaguggcuccaaacaac

SEQ ID NO: 1355644 - RNA, 19 nt, Homo sapiens
uagcugaccuguuaauuuu

SEQ ID NO: 1355645 - RNA, 19 nt, Homo sapiens
uaacuuaccccuccuuaua

SEQ ID NO: 1355646 - RNA, 19 nt, Homo sapiens
caugugcugucauuucuga

SEQ ID NO: 1355647 - RNA, 19 nt, Homo sapiens
cuauuaggcucauguuuua

SEQ ID NO: 1355648 - RNA, 19 nt, Homo sapiens
ggacggagaacgugaccuu

SEQ ID NO: 1355649 - RNA, 19 nt, Homo sapiens
gagaacauacggccuaauc

SEQ ID NO: 1355650 - RNA, 19 nt, Homo sapiens
uaccagacauuugugaauu

SEQ ID NO: 1355651 - RNA, 19 nt, Homo sapiens
ggagagcaaugagcugcaa

SEQ ID NO: 1355652 - RNA, 19 nt, Homo sapiens
gaacgugaccuugaagaag

SEQ ID NO: 1355653 - RNA, 19 nt, Homo sapiens
gaauccugguuaauguaaa

SEQ ID NO: 1355654 - RNA, 19 nt, Homo sapiens
gcugucauuucugaagaua

SEQ ID NO: 1355655 - RNA, 19 nt, Homo sapiens
cggagaacgugaccuugaa

SEQ ID NO: 1355656 - RNA, 19 nt, Homo sapiens
gcaaugagcugcaaaaccu

SEQ ID NO: 1355657 - RNA, 19 nt, Homo sapiens
uuaccagccugagaacaua

SEQ ID NO: 1355658 - RNA, 19 nt, Homo sapiens
gaagaagccagaaacuuuu

SEQ ID NO: 1355659 - RNA, 19 nt, Homo sapiens
gcucagggaggucaaguug

SEQ ID NO: 1355660 - RNA, 19 nt, Homo sapiens
cuucugcacuggugucuga

SEQ ID NO: 1355661 - RNA, 19 nt, Homo sapiens
ggaaugcuagaaguguuua

SEQ ID NO: 1355662 - RNA, 19 nt, Homo sapiens
gcccaggaguaccaaguga

SEQ ID NO: 1355663 - RNA, 19 nt, Homo sapiens
ggacaaaacuguauuuacc

SEQ ID NO: 1355664 - RNA, 19 nt, Homo sapiens
ggagaagucacauuaucau

SEQ ID NO: 1355665 - RNA, 19 nt, Homo sapiens
ugacaucagagaagagaaa

SEQ ID NO: 1355666 - RNA, 19 nt, Homo sapiens
auccugggcucucaaagua

SEQ ID NO: 1355667 - RNA, 19 nt, Homo sapiens
aaggagaagucacauuauc

SEQ ID NO: 1355668 - RNA, 19 nt, Homo sapiens
ccacaagaaguccaugcua

SEQ ID NO: 1355669 - RNA, 19 nt, Homo sapiens
cauuucaugugcugucauu

SEQ ID NO: 1355670 - RNA, 19 nt, Homo sapiens
uuagcugaccuguuaauuu

SEQ ID NO: 1355671 - RNA, 19 nt, Homo sapiens
agaaguccaugcuagacaa

SEQ ID NO: 1355672 - RNA, 19 nt, Homo sapiens
ccugaugcaauguguaaua

SEQ ID NO: 1355673 - RNA, 19 nt, Homo sapiens
gggcagaaaguugaucauu

SEQ ID NO: 1355674 - RNA, 19 nt, Homo sapiens
cuuccaaccugaugcaaug

SEQ ID NO: 1355675 - RNA, 19 nt, Homo sapiens
gaaacauuacugggaggua

SEQ ID NO: 1355676 - RNA, 19 nt, Homo sapiens
ccagacauuugugaauuuc

SEQ ID NO: 1355677 - RNA, 19 nt, Homo sapiens
guauuuaccuugggaucug

SEQ ID NO: 1355678 - RNA, 19 nt, Homo sapiens
agauuucucucauaucaca

SEQ ID NO: 1355679 - RNA, 19 nt, Homo sapiens
cuucuggaauccugguuaa

SEQ ID NO: 1355680 - RNA, 19 nt, Homo sapiens
aaccacagauaauauaugg

SEQ ID NO: 1355681 - RNA, 19 nt, Homo sapiens
ugucauuucugaagauaag

SEQ ID NO: 1355682 - RNA, 19 nt, Homo sapiens
acaagguuccucccaguuu

SEQ ID NO: 1355683 - RNA, 19 nt, Homo sapiens
cugaagguguauugaguga

SEQ ID NO: 1355684 - RNA, 19 nt, Homo sapiens
gagguagacguguccaaga

SEQ ID NO: 1355685 - RNA, 19 nt, Homo sapiens
gggacaagauaccagacau

SEQ ID NO: 1355686 - RNA, 19 nt, Homo sapiens
gggcacgagggacaagaua

SEQ ID NO: 1355687 - RNA, 19 nt, Homo sapiens
ugacaguggcuccaaacaa

SEQ ID NO: 1355688 - RNA, 19 nt, Homo sapiens
gaaguccaugcuagacaaa

SEQ ID NO: 1355689 - RNA, 19 nt, Homo sapiens
uacuauggcuucuggaauc

SEQ ID NO: 1355690 - RNA, 19 nt, Homo sapiens
accagacauuugugaauuu

SEQ ID NO: 1355691 - RNA, 19 nt, Homo sapiens
gugcugucauuucugaaga

SEQ ID NO: 1355692 - RNA, 19 nt, Homo sapiens
uuacgaacucugaaacuga

SEQ ID NO: 1355693 - RNA, 19 nt, Homo sapiens
gaucugugaacaagaggaa

SEQ ID NO: 1355694 - RNA, 19 nt, Homo sapiens
gguagacguguccaagaaa

SEQ ID NO: 1355695 - RNA, 19 nt, Homo sapiens
uaggaagucuuugggacaa

SEQ ID NO: 1355696 - RNA, 19 nt, Homo sapiens
ucucucaagucuuuaucaa

SEQ ID NO: 1355697 - RNA, 19 nt, Homo sapiens
uaaggagaagucacauuau

SEQ ID NO: 1355698 - RNA, 19 nt, Homo sapiens
gucauuugcuggcuuugug

SEQ ID NO: 1355699 - RNA, 19 nt, Homo sapiens
uagccaacauaguggagaa

SEQ ID NO: 1355700 - RNA, 19 nt, Homo sapiens
agguagacguguccaagaa

SEQ ID NO: 1355701 - RNA, 19 nt, Homo sapiens
gggcagaaguaggaagucu

SEQ ID NO: 1355702 - RNA, 19 nt, Homo sapiens
ccgaaaccacagauaauau

SEQ ID NO: 1355703 - RNA, 19 nt, Homo sapiens
gguaaggagaagucacauu

SEQ ID NO: 1355704 - RNA, 19 nt, Homo sapiens
gagaacgugaccuugaaga

SEQ ID NO: 1355705 - RNA, 19 nt, Homo sapiens
gaggaggaagacauucuga

SEQ ID NO: 1355706 - RNA, 19 nt, Homo sapiens
acuggugucugaaggugua

SEQ ID NO: 1355707 - RNA, 19 nt, Homo sapiens
gccuggaacuccugacaca

SEQ ID NO: 1355708 - RNA, 19 nt, Homo sapiens
cuggaauccugguuaaugu

SEQ ID NO: 1355709 - RNA, 19 nt, Homo sapiens
cugaugcaauguguaauau

SEQ ID NO: 1355710 - RNA, 19 nt, Homo sapiens
gauaccagacauuugugaa

SEQ ID NO: 1355711 - RNA, 19 nt, Homo sapiens
caagguuccucccaguuuu

SEQ ID NO: 1355712 - RNA, 19 nt, Homo sapiens
gaacucugaaacugagaug

SEQ ID NO: 1355713 - RNA, 19 nt, Homo sapiens
acaagaaguccaugcuaga

SEQ ID NO: 1355714 - RNA, 19 nt, Homo sapiens
gcaggaagcugaagaguug

SEQ ID NO: 1355715 - RNA, 19 nt, Homo sapiens
gcagaaaguugaucauugu

SEQ ID NO: 1355716 - RNA, 19 nt, Homo sapiens
gaagguguauugagugauu

SEQ ID NO: 1355717 - RNA, 19 nt, Homo sapiens
gagaguagcugcccugugu

SEQ ID NO: 1355718 - RNA, 19 nt, Homo sapiens
ugaaaguucucaacacaaa

SEQ ID NO: 1355719 - RNA, 19 nt, Homo sapiens
ugaagaagccagaaacuuu

SEQ ID NO: 1355720 - RNA, 19 nt, Homo sapiens
uuagagagcugacagaugu

SEQ ID NO: 1355721 - RNA, 19 nt, Homo sapiens
ccaaguagcugggauuaca

SEQ ID NO: 1355722 - RNA, 19 nt, Homo sapiens
ggaggaagacauucugaaa

SEQ ID NO: 1355723 - RNA, 19 nt, Homo sapiens
ggcagaaaguugaucauug

SEQ ID NO: 1355724 - RNA, 19 nt, Homo sapiens
ggaagacucaaauacagua

SEQ ID NO: 1355725 - RNA, 19 nt, Homo sapiens
gcagaaguaggaagucuuu

SEQ ID NO: 1355726 - RNA, 19 nt, Homo sapiens
gaaggaggaggaagacauu

SEQ ID NO: 1355727 - RNA, 19 nt, Homo sapiens
ggugauggauaugcuaauu

SEQ ID NO: 1355728 - RNA, 19 nt, Homo sapiens
gaaaggaaugcuagaagug

SEQ ID NO: 1355729 - RNA, 19 nt, Homo sapiens
ggguguggauggcgucaua

SEQ ID NO: 1355730 - RNA, 19 nt, Homo sapiens
ggaauccugguuaauguaa

SEQ ID NO: 1355731 - RNA, 19 nt, Homo sapiens
ugaaaggaaugcuagaagu

SEQ ID NO: 1355732 - RNA, 19 nt, Homo sapiens
aagcaugccucacugcaaa

SEQ ID NO: 1355733 - RNA, 19 nt, Homo sapiens
cuaauacuuuggaucauug

SEQ ID NO: 1355734 - RNA, 19 nt, Homo sapiens
uauuugaggugauggauau

SEQ ID NO: 1355735 - RNA, 19 nt, Homo sapiens
gugacuagaguuaacaaua

SEQ ID NO: 1355736 - RNA, 19 nt, Homo sapiens
ccaaagugcugggauuaca

SEQ ID NO: 1355737 - RNA, 19 nt, Homo sapiens
ggacggagaacgugaccuu

SEQ ID NO: 1355738 - RNA, 19 nt, Homo sapiens
gagaacauacggccuaauc

SEQ ID NO: 1355739 - RNA, 19 nt, Homo sapiens
ggagagcaaugagcugcaa

SEQ ID NO: 1355740 - RNA, 19 nt, Homo sapiens
gaacgugaccuugaagaag

SEQ ID NO: 1355741 - RNA, 19 nt, Homo sapiens
gaauccugguuaauguaaa

SEQ ID NO: 1355742 - RNA, 19 nt, Homo sapiens
caucuaauacuuuggauca

SEQ ID NO: 1355743 - RNA, 19 nt, Homo sapiens
acacuguaccacauaaaua

SEQ ID NO: 1355744 - RNA, 19 nt, Homo sapiens
cggagaacgugaccuugaa

SEQ ID NO: 1355745 - RNA, 19 nt, Homo sapiens
gcaaugagcugcaaaaccu

SEQ ID NO: 1355746 - RNA, 19 nt, Homo sapiens
uuaccagccugagaacaua

SEQ ID NO: 1355747 - RNA, 19 nt, Homo sapiens
gugauggauaugcuaauua

SEQ ID NO: 1355748 - RNA, 19 nt, Homo sapiens
acacauauuugaggugaug

SEQ ID NO: 1355749 - RNA, 19 nt, Homo sapiens
gaagaagccagaaacuuuu

SEQ ID NO: 1355750 - RNA, 19 nt, Homo sapiens
gcucagggaggucaaguug

SEQ ID NO: 1355751 - RNA, 19 nt, Homo sapiens
cuucugcacuggugucuga

SEQ ID NO: 1355752 - RNA, 19 nt, Homo sapiens
ggaaugcuagaaguguuua

SEQ ID NO: 1355753 - RNA, 19 nt, Homo sapiens
gcccaggaguaccaaguga

SEQ ID NO: 1355754 - RNA, 19 nt, Homo sapiens
ggacaaaacuguauuuacc

SEQ ID NO: 1355755 - RNA, 19 nt, Homo sapiens
cacaaagaaaugacacaua

SEQ ID NO: 1355756 - RNA, 19 nt, Homo sapiens
ugacaucagagaagagaaa

SEQ ID NO: 1355757 - RNA, 19 nt, Homo sapiens
ccacaagaaguccaugcua

SEQ ID NO: 1355758 - RNA, 19 nt, Homo sapiens
ugguuaggcucgucuagaa

SEQ ID NO: 1355759 - RNA, 19 nt, Homo sapiens
ccucucagauucaagcaau

SEQ ID NO: 1355760 - RNA, 19 nt, Homo sapiens
agaaguccaugcuagacaa

SEQ ID NO: 1355761 - RNA, 19 nt, Homo sapiens
ugauggauaugcuaauuac

SEQ ID NO: 1355762 - RNA, 19 nt, Homo sapiens
gggcagaaaguugaucauu

SEQ ID NO: 1355763 - RNA, 19 nt, Homo sapiens
caucacacuguaccacaua

SEQ ID NO: 1355764 - RNA, 19 nt, Homo sapiens
uacccugguucgguuauua

SEQ ID NO: 1355765 - RNA, 19 nt, Homo sapiens
gagaggauuuugaaaguuc

SEQ ID NO: 1355766 - RNA, 19 nt, Homo sapiens
guauuuaccuugggaucug

SEQ ID NO: 1355767 - RNA, 19 nt, Homo sapiens
gaggugauggauaugcuaa

SEQ ID NO: 1355768 - RNA, 19 nt, Homo sapiens
cuucuggaauccugguuaa

SEQ ID NO: 1355769 - RNA, 19 nt, Homo sapiens
gaagagaggauuuugaaag

SEQ ID NO: 1355770 - RNA, 19 nt, Homo sapiens
cugaagguguauugaguga

SEQ ID NO: 1355771 - RNA, 19 nt, Homo sapiens
gaaguccaugcuagacaaa

SEQ ID NO: 1355772 - RNA, 19 nt, Homo sapiens
uacuauggcuucuggaauc

SEQ ID NO: 1355773 - RNA, 19 nt, Homo sapiens
gguuauuacgcaauguaua

SEQ ID NO: 1355774 - RNA, 19 nt, Homo sapiens
uuacgaacucugaaacuga

SEQ ID NO: 1355775 - RNA, 19 nt, Homo sapiens
gaucugugaacaagaggaa

SEQ ID NO: 1355776 - RNA, 19 nt, Homo sapiens
guucgguuauuacgcaaug

SEQ ID NO: 1355777 - RNA, 19 nt, Homo sapiens
ugccucagccucccaagua

SEQ ID NO: 1355778 - RNA, 19 nt, Homo sapiens
gucauuugcuggcuuugug

SEQ ID NO: 1355779 - RNA, 19 nt, Homo sapiens
uagccaacauaguggagaa

SEQ ID NO: 1355780 - RNA, 19 nt, Homo sapiens
uaggaagucuuugggacaa

SEQ ID NO: 1355781 - RNA, 19 nt, Homo sapiens
acuggugucugaaggugua

SEQ ID NO: 1355782 - RNA, 19 nt, Homo sapiens
aaaguucucaacacaaaga

SEQ ID NO: 1355783 - RNA, 19 nt, Homo sapiens
gagaacgugaccuugaaga

SEQ ID NO: 1355784 - RNA, 19 nt, Homo sapiens
gaggaggaagacauucuga

SEQ ID NO: 1355785 - RNA, 19 nt, Homo sapiens
gccuggaacuccugacaca

SEQ ID NO: 1355786 - RNA, 19 nt, Homo sapiens
cuggaauccugguuaaugu

SEQ ID NO: 1355787 - RNA, 19 nt, Homo sapiens
gggcagaaguaggaagucu

SEQ ID NO: 1355788 - RNA, 19 nt, Homo sapiens
gcccagccugugcuuauuu

SEQ ID NO: 1355789 - RNA, 19 nt, Homo sapiens
gcgcccagccugugcuuau

SEQ ID NO: 1355790 - RNA, 19 nt, Homo sapiens
gaacucugaaacugagaug

SEQ ID NO: 1355791 - RNA, 19 nt, Homo sapiens
acaagaaguccaugcuaga

SEQ ID NO: 1355792 - RNA, 19 nt, Homo sapiens
ucacugcaaaccacaagaa

SEQ ID NO: 1355793 - RNA, 19 nt, Homo sapiens
aaggaaugcuagaaguguu

SEQ ID NO: 1355794 - RNA, 19 nt, Homo sapiens
cacuguaccacauaaauau

SEQ ID NO: 1355795 - RNA, 19 nt, Homo sapiens
ugacaaaaccaacgucuug

SEQ ID NO: 1355796 - RNA, 19 nt, Homo sapiens
guggagggcagaaguagga

SEQ ID NO: 1355797 - RNA, 19 nt, Homo sapiens
uggccugucuucacucuuc

SEQ ID NO: 1355798 - RNA, 19 nt, Homo sapiens
cgucuucccuggccugucu

SEQ ID NO: 1355799 - RNA, 19 nt, Homo sapiens
guuauuacgcaauguauac

SEQ ID NO: 1355800 - RNA, 19 nt, Homo sapiens
gaucaggcccguggauugg

SEQ ID NO: 1355801 - RNA, 19 nt, Homo sapiens
cgaucucgguucacugcaa

SEQ ID NO: 1355802 - RNA, 19 nt, Homo sapiens
ggcaggagcaguggaauag

SEQ ID NO: 1355803 - RNA, 19 nt, Homo sapiens
ugcuagaaguguuuagaga

SEQ ID NO: 1355804 - RNA, 19 nt, Homo sapiens
ucgagcuccugaucugaaa

SEQ ID NO: 1355805 - RNA, 19 nt, Homo sapiens
guuucgagcuccugaucug

SEQ ID NO: 1355806 - RNA, 19 nt, Homo sapiens
ugaaaagccuuacgaacuc

SEQ ID NO: 1355807 - RNA, 19 nt, Homo sapiens
gaggaagacauucugaaaa

SEQ ID NO: 1355808 - RNA, 19 nt, Homo sapiens
gcuacuauggcuucuggaa

SEQ ID NO: 1355809 - RNA, 19 nt, Homo sapiens
ggaggaggaagacauucug

SEQ ID NO: 1355810 - RNA, 19 nt, Homo sapiens
guagggugacuagaguuaa

SEQ ID NO: 1355811 - RNA, 19 nt, Homo sapiens
gcagacccagucccugaga

SEQ ID NO: 1355812 - RNA, 19 nt, Homo sapiens
aaggucauuugcuggcuuu

SEQ ID NO: 1355813 - RNA, 19 nt, Homo sapiens
gucugaagguguauugagu

SEQ ID NO: 1355814 - RNA, 19 nt, Homo sapiens
ggaagaagauccuauuuua

SEQ ID NO: 1355815 - RNA, 19 nt, Homo sapiens
gaacagcucuaccgauaug

SEQ ID NO: 1355816 - RNA, 19 nt, Homo sapiens
gagcagggcuauuguaguu

SEQ ID NO: 1355817 - RNA, 19 nt, Homo sapiens
cagaacagcucuaccgaua

SEQ ID NO: 1355818 - RNA, 19 nt, Homo sapiens
gcucuucugucuauaaauu

SEQ ID NO: 1355819 - RNA, 19 nt, Homo sapiens
ugaaugauacugugccuua

SEQ ID NO: 1355820 - RNA, 19 nt, Homo sapiens
ccaaacugcugguauaauc

SEQ ID NO: 1355821 - RNA, 19 nt, Homo sapiens
aaacuugagucuugaaugu

SEQ ID NO: 1355822 - RNA, 19 nt, Homo sapiens
ggagaggguucaucugauc

SEQ ID NO: 1355823 - RNA, 19 nt, Homo sapiens
gaaugauacugugccuuaa

SEQ ID NO: 1355824 - RNA, 19 nt, Homo sapiens
gcacacugagauauaauaa

SEQ ID NO: 1355825 - RNA, 19 nt, Homo sapiens
gugagccacuuuccuauau

SEQ ID NO: 1355826 - RNA, 19 nt, Homo sapiens
acaccucccuguccacuuu

SEQ ID NO: 1355827 - RNA, 19 nt, Homo sapiens
ggaacauuaucaggaauug

SEQ ID NO: 1355828 - RNA, 19 nt, Homo sapiens
gauuauugcucuucugucu

SEQ ID NO: 1355829 - RNA, 19 nt, Homo sapiens
cuaccgauauguuaccaaa

SEQ ID NO: 1355830 - RNA, 19 nt, Homo sapiens
gaagauugacaucccaaga

SEQ ID NO: 1355831 - RNA, 19 nt, Homo sapiens
gaccuuggccaguauguga

SEQ ID NO: 1355832 - RNA, 19 nt, Homo sapiens
agauugacaucccaagauu

SEQ ID NO: 1355833 - RNA, 19 nt, Homo sapiens
gcccagucauugcuguuaa

SEQ ID NO: 1355834 - RNA, 19 nt, Homo sapiens
gaucguggcaggugguuau

SEQ ID NO: 1355835 - RNA, 19 nt, Homo sapiens
gccaguaugugaccuucuu

SEQ ID NO: 1355836 - RNA, 19 nt, Homo sapiens
agagaguccuggagaaugu

SEQ ID NO: 1355837 - RNA, 19 nt, Homo sapiens
ugagccacuuuccuauaua

SEQ ID NO: 1355838 - RNA, 19 nt, Homo sapiens
uuauugcucuucugucuau

SEQ ID NO: 1355839 - RNA, 19 nt, Homo sapiens
cagcucuaccgauauguua

SEQ ID NO: 1355840 - RNA, 19 nt, Homo sapiens
ucaagucccugucucacau

SEQ ID NO: 1355841 - RNA, 19 nt, Homo sapiens
gggagaggguucaucugau

SEQ ID NO: 1355842 - RNA, 19 nt, Homo sapiens
gagccacuuuccuauauac

SEQ ID NO: 1355843 - RNA, 19 nt, Homo sapiens
gaagagccagagugaagga

SEQ ID NO: 1355844 - RNA, 19 nt, Homo sapiens
uguggaacauuaucaggaa

SEQ ID NO: 1355845 - RNA, 19 nt, Homo sapiens
gaacauuaucaggaauuga

SEQ ID NO: 1355846 - RNA, 19 nt, Homo sapiens
cuaaaugucaccagcuuug

SEQ ID NO: 1355847 - RNA, 19 nt, Homo sapiens
cagaucugcuucucaccaa

SEQ ID NO: 1355848 - RNA, 19 nt, Homo sapiens
gcggaagaagauccuauuu

SEQ ID NO: 1355849 - RNA, 19 nt, Homo sapiens
gcuagacggcggaagaaga

SEQ ID NO: 1355850 - RNA, 19 nt, Homo sapiens
ugucaucuguuagggaauu

SEQ ID NO: 1355851 - RNA, 19 nt, Homo sapiens
uauuguaguucccagauuc

SEQ ID NO: 1355852 - RNA, 19 nt, Homo sapiens
gagagcagggcuauuguag

SEQ ID NO: 1355853 - RNA, 19 nt, Homo sapiens
gucuuugccuggauccaua

SEQ ID NO: 1355854 - RNA, 19 nt, Homo sapiens
gagagaguccuggagaaug

SEQ ID NO: 1355855 - RNA, 19 nt, Homo sapiens
augauacugugccuuaauu

SEQ ID NO: 1355856 - RNA, 19 nt, Homo sapiens
aaagcuggaugaccuaguc

SEQ ID NO: 1355857 - RNA, 19 nt, Homo sapiens
caccagcuuugacucaguu

SEQ ID NO: 1355858 - RNA, 19 nt, Homo sapiens
aaugagagcagggcuauug

SEQ ID NO: 1355859 - RNA, 19 nt, Homo sapiens
cauguucagcagaguauuu

SEQ ID NO: 1355860 - RNA, 19 nt, Homo sapiens
uaagaucuccauuaauguc

SEQ ID NO: 1355861 - RNA, 19 nt, Homo sapiens
gaucugcuucucaccaaga

SEQ ID NO: 1355862 - RNA, 19 nt, Homo sapiens
uguucacugucaucuguua

SEQ ID NO: 1355863 - RNA, 19 nt, Homo sapiens
aaugugagccacuuuccua

SEQ ID NO: 1355864 - RNA, 19 nt, Homo sapiens
ggaguucgacgugguagug

SEQ ID NO: 1355865 - RNA, 19 nt, Homo sapiens
ugagagcagggcuauugua

SEQ ID NO: 1355866 - RNA, 19 nt, Homo sapiens
acuugagucuugaauguga

SEQ ID NO: 1355867 - RNA, 19 nt, Homo sapiens
uugacuggauagaggaaua

SEQ ID NO: 1355868 - RNA, 19 nt, Homo sapiens
ucaauccaccgaaguguuc

SEQ ID NO: 1355869 - RNA, 19 nt, Homo sapiens
ggaguccauugaccacagu

SEQ ID NO: 1355870 - RNA, 19 nt, Homo sapiens
caaacugcugguauaauca

SEQ ID NO: 1355871 - RNA, 19 nt, Homo sapiens
cagaagcaauagaaaaguu

SEQ ID NO: 1355872 - RNA, 19 nt, Homo sapiens
acagcugcguggaagauug

SEQ ID NO: 1355873 - RNA, 19 nt, Homo sapiens
uuugcacacugagauauaa

SEQ ID NO: 1355874 - RNA, 19 nt, Homo sapiens
uacugugccuuaauugguu

SEQ ID NO: 1355875 - RNA, 19 nt, Homo sapiens
gagccagagugaaggaaaa

SEQ ID NO: 1355876 - RNA, 19 nt, Homo sapiens
agucauugcuguuaauucg

SEQ ID NO: 1355877 - RNA, 19 nt, Homo sapiens
gguguagcgugaagaucug

SEQ ID NO: 1355878 - RNA, 19 nt, Homo sapiens
ugggagaggguucaucuga

SEQ ID NO: 1355879 - RNA, 19 nt, Homo sapiens
guacagcugcguggaagau

SEQ ID NO: 1355880 - RNA, 19 nt, Homo sapiens
gcacuggaagcccuaguac

SEQ ID NO: 1355881 - RNA, 19 nt, Homo sapiens
cuauuguaguucccagauu

SEQ ID NO: 1355882 - RNA, 19 nt, Homo sapiens
gggauuauugcucuucugu

SEQ ID NO: 1355883 - RNA, 19 nt, Homo sapiens
uggaagagccagagugaag

SEQ ID NO: 1355884 - RNA, 19 nt, Homo sapiens
ccgugaaccuuccuuaaaa

SEQ ID NO: 1355885 - RNA, 19 nt, Homo sapiens
ccacagugucacaggguuu

SEQ ID NO: 1355886 - RNA, 19 nt, Homo sapiens
aguccgaccuuggccagua

SEQ ID NO: 1355887 - RNA, 19 nt, Homo sapiens
ugaagaaaaugguccaaca

SEQ ID NO: 1355888 - RNA, 19 nt, Homo sapiens
cugcugcucuccaucaaca

SEQ ID NO: 1355889 - RNA, 19 nt, Homo sapiens
caagucccugucucacaua

SEQ ID NO: 1355890 - RNA, 19 nt, Homo sapiens
guguuaaguuacaaaugug

SEQ ID NO: 1355891 - RNA, 19 nt, Homo sapiens
uaaacuugagucuugaaug

SEQ ID NO: 1355892 - RNA, 19 nt, Homo sapiens
cgagagaguccuggagaau

SEQ ID NO: 1355893 - RNA, 19 nt, Homo sapiens
cagcuuugacucaguuguu

SEQ ID NO: 1355894 - RNA, 19 nt, Homo sapiens
gauacugugccuuaauugg

SEQ ID NO: 1355895 - RNA, 19 nt, Homo sapiens
aaccaugucuuuuaugcua

SEQ ID NO: 1355896 - RNA, 19 nt, Homo sapiens
ugugagccacuuuccuaua

SEQ ID NO: 1355897 - RNA, 19 nt, Homo sapiens
ggcggaagaagauccuauu

SEQ ID NO: 1355898 - RNA, 19 nt, Homo sapiens
cgaggaguucgacguggua

SEQ ID NO: 1355899 - RNA, 19 nt, Homo sapiens
ucacuucccagaucugcuu

SEQ ID NO: 1355900 - RNA, 19 nt, Homo sapiens
uacaugcagugcccaguca

SEQ ID NO: 1355901 - RNA, 19 nt, Homo sapiens
accaagcaaugagcacuuu

SEQ ID NO: 1355902 - RNA, 19 nt, Homo sapiens
gauugacaucccaagauug

SEQ ID NO: 1355903 - RNA, 19 nt, Homo sapiens
ggcacuggaagcccuagua

SEQ ID NO: 1355904 - RNA, 19 nt, Homo sapiens
uaaaugucaccagcuuuga

SEQ ID NO: 1355905 - RNA, 19 nt, Homo sapiens
uugcucuucugucuauaaa

SEQ ID NO: 1355906 - RNA, 19 nt, Homo sapiens
cugaagcauuuacagaaca

SEQ ID NO: 1355907 - RNA, 19 nt, Homo sapiens
ccugaagcauuuacagaac

SEQ ID NO: 1355908 - RNA, 19 nt, Homo sapiens
uccgugaaccuuccuuaaa

SEQ ID NO: 1355909 - RNA, 19 nt, Homo sapiens
ggguguagcgugaagaucu

SEQ ID NO: 1355910 - RNA, 19 nt, Homo sapiens
cauccgugaaccuuccuua

SEQ ID NO: 1355911 - RNA, 19 nt, Homo sapiens
agacccugauguccucuau

SEQ ID NO: 1355912 - RNA, 19 nt, Homo sapiens
acgagagaguccuggagaa

SEQ ID NO: 1355913 - RNA, 19 nt, Homo sapiens
cagcugcguggaagauuga

SEQ ID NO: 1355914 - RNA, 19 nt, Homo sapiens
caucagagcucaccuuuga

SEQ ID NO: 1355915 - RNA, 19 nt, Homo sapiens
gcucggagguggcaaguuu

SEQ ID NO: 1355916 - RNA, 19 nt, Homo sapiens
gaccaaaucuccgauaaga

SEQ ID NO: 1355917 - RNA, 19 nt, Homo sapiens
gcuugugccuuguaaauaa

SEQ ID NO: 1355918 - RNA, 19 nt, Homo sapiens
gaugaacgcugcccagugu

SEQ ID NO: 1355919 - RNA, 19 nt, Homo sapiens
gaggacugcuuccagauuu

SEQ ID NO: 1355920 - RNA, 19 nt, Homo sapiens
agaaauaccucaugaagag

SEQ ID NO: 1355921 - RNA, 19 nt, Homo sapiens
cugcaacgcugauuccuaa

SEQ ID NO: 1355922 - RNA, 19 nt, Homo sapiens
gaaacagacucccaaagac

SEQ ID NO: 1355923 - RNA, 19 nt, Homo sapiens
gcaaucugauccagcugua

SEQ ID NO: 1355924 - RNA, 19 nt, Homo sapiens
cagccaaggucaucaagaa

SEQ ID NO: 1355925 - RNA, 19 nt, Homo sapiens
caacagacaaggcaccuaa

SEQ ID NO: 1355926 - RNA, 19 nt, Homo sapiens
gaaggaagugggagagaaa

SEQ ID NO: 1355927 - RNA, 19 nt, Homo sapiens
ucaccugccuuucugcaua

SEQ ID NO: 1355928 - RNA, 19 nt, Homo sapiens
gagaacauccuguguguca

SEQ ID NO: 1355929 - RNA, 19 nt, Homo sapiens
gagcaggcuuugugagaga

SEQ ID NO: 1355930 - RNA, 19 nt, Homo sapiens
ucaacaaccuggcggagaa

SEQ ID NO: 1355931 - RNA, 19 nt, Homo sapiens
acacagagacccuaaacaa

SEQ ID NO: 1355932 - RNA, 19 nt, Homo sapiens
agacagacauguggaguau

SEQ ID NO: 1355933 - RNA, 19 nt, Homo sapiens
cagagaacauccugugugu

SEQ ID NO: 1355934 - RNA, 19 nt, Homo sapiens
cuuaagaaauaccucauga

SEQ ID NO: 1355935 - RNA, 19 nt, Homo sapiens
caacugguacuuugaugaa

SEQ ID NO: 1355936 - RNA, 19 nt, Homo sapiens
ccaaaucuccgauaagaca

SEQ ID NO: 1355937 - RNA, 19 nt, Homo sapiens
agaaacagacucccaaaga

SEQ ID NO: 1355938 - RNA, 19 nt, Homo sapiens
gaagaggcgcuggaagaaa

SEQ ID NO: 1355939 - RNA, 19 nt, Homo sapiens
acgagaagcugaaggugaa

SEQ ID NO: 1355940 - RNA, 19 nt, Homo sapiens
ucgagaggauuguggauga

SEQ ID NO: 1355941 - RNA, 19 nt, Homo sapiens
gcccaacccucaacuagca

SEQ ID NO: 1355942 - RNA, 19 nt, Homo sapiens
ggaagacagagcaggcuuu

SEQ ID NO: 1355943 - RNA, 19 nt, Homo sapiens
uaagaaauaccucaugaag

SEQ ID NO: 1355944 - RNA, 19 nt, Homo sapiens
ggaggacugcuuccagauu

SEQ ID NO: 1355945 - RNA, 19 nt, Homo sapiens
gagaaagccaaacgcugua

SEQ ID NO: 1355946 - RNA, 19 nt, Homo sapiens
ggugaauuaugaccaaauc

SEQ ID NO: 1355947 - RNA, 19 nt, Homo sapiens
gcccaucccuggcucaaca

SEQ ID NO: 1355948 - RNA, 19 nt, Homo sapiens
aaagaaagcuccggaucca

SEQ ID NO: 1355949 - RNA, 19 nt, Homo sapiens
ccaaggucaucaagaaaca

SEQ ID NO: 1355950 - RNA, 19 nt, Homo sapiens
agaagcugcuggccaagaa

SEQ ID NO: 1355951 - RNA, 19 nt, Homo sapiens
gaagacagagcaggcuuug

SEQ ID NO: 1355952 - RNA, 19 nt, Homo sapiens
gcaacugguacuuugauga

SEQ ID NO: 1355953 - RNA, 19 nt, Homo sapiens
ggucacccauggccucaga

SEQ ID NO: 1355954 - RNA, 19 nt, Homo sapiens
agacagagcaggcuuugug

SEQ ID NO: 1355955 - RNA, 19 nt, Homo sapiens
caguugagcugggaauuca

SEQ ID NO: 1355956 - RNA, 19 nt, Homo sapiens
cacccacccugaagaaaga

SEQ ID NO: 1355957 - RNA, 19 nt, Homo sapiens
cugagguggugaauuauga

SEQ ID NO: 1355958 - RNA, 19 nt, Homo sapiens
caagaaacagacucccaaa

SEQ ID NO: 1355959 - RNA, 19 nt, Homo sapiens
gggcucaccugccuuucug

SEQ ID NO: 1355960 - RNA, 19 nt, Homo sapiens
acagacauguggaguaugg

SEQ ID NO: 1355961 - RNA, 19 nt, Homo sapiens
caacaccaccgggcauuug

SEQ ID NO: 1355962 - RNA, 19 nt, Homo sapiens
gggaaugucagcagugaau

SEQ ID NO: 1355963 - RNA, 19 nt, Homo sapiens
agaaggaagugggagagaa

SEQ ID NO: 1355964 - RNA, 19 nt, Homo sapiens
gcagaagaaggaaagaaca

SEQ ID NO: 1355965 - RNA, 19 nt, Homo sapiens
ccugggagaugaugacaca

SEQ ID NO: 1355966 - RNA, 19 nt, Homo sapiens
gcuguucccucagagaaau

SEQ ID NO: 1355967 - RNA, 19 nt, Homo sapiens
cgcaugagaucguccuguu

SEQ ID NO: 1355968 - RNA, 19 nt, Homo sapiens
gccaucaucuccaguucug

SEQ ID NO: 1355969 - RNA, 19 nt, Homo sapiens
uaucagacgaggccaaaga

SEQ ID NO: 1355970 - RNA, 19 nt, Homo sapiens
cagaacccaucaacagaca

SEQ ID NO: 1355971 - RNA, 19 nt, Homo sapiens
gaagcugaaggugaacuuu

SEQ ID NO: 1355972 - RNA, 19 nt, Homo sapiens
aaacagacucccaaagaca

SEQ ID NO: 1355973 - RNA, 19 nt, Homo sapiens
gaaagccacaggccucaag

SEQ ID NO: 1355974 - RNA, 19 nt, Homo sapiens
gugaagaucauugacuuug

SEQ ID NO: 1355975 - RNA, 19 nt, Homo sapiens
agcagugaauucaguauga

SEQ ID NO: 1355976 - RNA, 19 nt, Homo sapiens
cagagcaggcuuugugaga

SEQ ID NO: 1355977 - RNA, 19 nt, Homo sapiens
agucccagaucuugcuuaa

SEQ ID NO: 1355978 - RNA, 19 nt, Homo sapiens
ucuggcaacugguacuuug

SEQ ID NO: 1355979 - RNA, 19 nt, Homo sapiens
ggugaagaucauugacuuu

SEQ ID NO: 1355980 - RNA, 19 nt, Homo sapiens
gaacauccugugugucaac

SEQ ID NO: 1355981 - RNA, 19 nt, Homo sapiens
gacagaaaauggagcaguu

SEQ ID NO: 1355982 - RNA, 19 nt, Homo sapiens
gcaguugagcugggaauuc

SEQ ID NO: 1355983 - RNA, 19 nt, Homo sapiens
ugaagaucauugacuuugg

SEQ ID NO: 1355984 - RNA, 19 nt, Homo sapiens
cagcuugugccuuguaaau

SEQ ID NO: 1355985 - RNA, 19 nt, Homo sapiens
ugaagaggcgcuggaagaa

SEQ ID NO: 1355986 - RNA, 19 nt, Homo sapiens
gaacccaucaacagacaag

SEQ ID NO: 1355987 - RNA, 19 nt, Homo sapiens
gaugacacagagacccuaa

SEQ ID NO: 1355988 - RNA, 19 nt, Homo sapiens
caugagaucguccuguuca

SEQ ID NO: 1355989 - RNA, 19 nt, Homo sapiens
agauugaggucaugaacca

SEQ ID NO: 1355990 - RNA, 19 nt, Homo sapiens
ccaaagacaaggaaauggu

SEQ ID NO: 1355991 - RNA, 19 nt, Homo sapiens
ugucagcagugaauucagu

SEQ ID NO: 1355992 - RNA, 19 nt, Homo sapiens
cagcuguccugccaucauc

SEQ ID NO: 1355993 - RNA, 19 nt, Homo sapiens
aagaaauaccucaugaaga

SEQ ID NO: 1355994 - RNA, 19 nt, Homo sapiens
uggugaagaucauugacuu

SEQ ID NO: 1355995 - RNA, 19 nt, Homo sapiens
gagaagcugcuggccaaga

SEQ ID NO: 1355996 - RNA, 19 nt, Homo sapiens
gaaaggcugcaacgcugau

SEQ ID NO: 1355997 - RNA, 19 nt, Homo sapiens
aagaggcgcuggaagaaaa

SEQ ID NO: 1355998 - RNA, 19 nt, Homo sapiens
cagagacccuaaacaacgu

SEQ ID NO: 1355999 - RNA, 19 nt, Homo sapiens
ccaucgagacuccgcauga

SEQ ID NO: 1356000 - RNA, 19 nt, Homo sapiens
gaaccaccgcaaucugauc

SEQ ID NO: 1356001 - RNA, 19 nt, Homo sapiens
acaaggaaaugguguugcu

SEQ ID NO: 1356002 - RNA, 19 nt, Homo sapiens
guaccugcauggagaaagc

SEQ ID NO: 1356003 - RNA, 19 nt, Homo sapiens
gacagagcaggcuuuguga

SEQ ID NO: 1356004 - RNA, 19 nt, Homo sapiens
gauccacccacccugaaga

SEQ ID NO: 1356005 - RNA, 19 nt, Homo sapiens
ucuccaaccucaucgucaa

SEQ ID NO: 1356006 - RNA, 19 nt, Homo sapiens
cuaaacaacguucuaucug

SEQ ID NO: 1356007 - RNA, 19 nt, Homo sapiens
ggaauucagaacccaucaa

SEQ ID NO: 1356008 - RNA, 19 nt, Homo sapiens
ggcaucagagcucaccuuu

SEQ ID NO: 1356009 - RNA, 19 nt, Homo sapiens
gagcugaggaccgggaaug

SEQ ID NO: 1356010 - RNA, 19 nt, Homo sapiens
ggcaacugguacuuugaug

SEQ ID NO: 1356011 - RNA, 19 nt, Homo sapiens
gacccuaaacaacguucua

SEQ ID NO: 1356012 - RNA, 19 nt, Homo sapiens
gaauucagaacccaucaac

SEQ ID NO: 1356013 - RNA, 19 nt, Homo sapiens
gauuguggaugaggacuac

SEQ ID NO: 1356014 - RNA, 19 nt, Homo sapiens
ggacuacgcuucugaaaua

SEQ ID NO: 1356015 - RNA, 19 nt, Homo sapiens
ggagguaccugcaguauua

SEQ ID NO: 1356016 - RNA, 19 nt, Homo sapiens
ggacuggccucucaacauu

SEQ ID NO: 1356017 - RNA, 19 nt, Homo sapiens
gcacauugcccacgacaua

SEQ ID NO: 1356018 - RNA, 19 nt, Homo sapiens
aaacgagacuacuuccuua

SEQ ID NO: 1356019 - RNA, 19 nt, Homo sapiens
ugaaggagauugagaagga

SEQ ID NO: 1356020 - RNA, 19 nt, Homo sapiens
gagaaggaauuacguaugg

SEQ ID NO: 1356021 - RNA, 19 nt, Homo sapiens
ggacuguguucccguguuu

SEQ ID NO: 1356022 - RNA, 19 nt, Homo sapiens
gcaaggaggagaaggaauu

SEQ ID NO: 1356023 - RNA, 19 nt, Homo sapiens
ucaagaagguggccuacaa

SEQ ID NO: 1356024 - RNA, 19 nt, Homo sapiens
uaccucagcuuccgagaua

SEQ ID NO: 1356025 - RNA, 19 nt, Homo sapiens
ucucugggcuggcuauuaa

SEQ ID NO: 1356026 - RNA, 19 nt, Homo sapiens
gaacacccacggacacgua

SEQ ID NO: 1356027 - RNA, 19 nt, Homo sapiens
gcgugaagcugcuguccua

SEQ ID NO: 1356028 - RNA, 19 nt, Homo sapiens
ggagaaacguuccguacag

SEQ ID NO: 1356029 - RNA, 19 nt, Homo sapiens
gcaucaacuucaacaacua

SEQ ID NO: 1356030 - RNA, 19 nt, Homo sapiens
gggagaaugugucagaugu

SEQ ID NO: 1356031 - RNA, 19 nt, Homo sapiens
gggagaaugugucagaugu

SEQ ID NO: 1356032 - RNA, 19 nt, Homo sapiens
aggaggagcuggaugauga

SEQ ID NO: 1356033 - RNA, 19 nt, Homo sapiens
ggagcuggaugaugacuuc

SEQ ID NO: 1356034 - RNA, 19 nt, Homo sapiens
ggaaacacuucagguuaug

SEQ ID NO: 1356035 - RNA, 19 nt, Homo sapiens
caggaaacacuucagguua

SEQ ID NO: 1356036 - RNA, 19 nt, Homo sapiens
gagacuacuuccuuaacaa

SEQ ID NO: 1356037 - RNA, 19 nt, Homo sapiens
ccacaggaguacgacuuua

SEQ ID NO: 1356038 - RNA, 19 nt, Homo sapiens
ucagcgaccugcucuuuga

SEQ ID NO: 1356039 - RNA, 19 nt, Homo sapiens
gaaggacugugccgucuac

SEQ ID NO: 1356040 - RNA, 19 nt, Homo sapiens
gcaaagcggagccucaaga

SEQ ID NO: 1356041 - RNA, 19 nt, Homo sapiens
ggacugugccgucuacguu

SEQ ID NO: 1356042 - RNA, 19 nt, Homo sapiens
gagaagaguguuuguguca

SEQ ID NO: 1356043 - RNA, 19 nt, Homo sapiens
gaagggacgcuuucgacaa

SEQ ID NO: 1356044 - RNA, 19 nt, Homo sapiens
cagugucucugaagaacua

SEQ ID NO: 1356045 - RNA, 19 nt, Homo sapiens
caaauuggccucucaacuc

SEQ ID NO: 1356046 - RNA, 19 nt, Homo sapiens
gaaggaauuacguauggaa

SEQ ID NO: 1356047 - RNA, 19 nt, Homo sapiens
gcaagggccucguguucca

SEQ ID NO: 1356048 - RNA, 19 nt, Homo sapiens
ggacaguugugggaagaug

SEQ ID NO: 1356049 - RNA, 19 nt, Homo sapiens
aggaggagcuggagaggaa

SEQ ID NO: 1356050 - RNA, 19 nt, Homo sapiens
gaaacacauucaggagaug

SEQ ID NO: 1356051 - RNA, 19 nt, Homo sapiens
caacuugacuccugauucc

SEQ ID NO: 1356052 - RNA, 19 nt, Homo sapiens
ggagaaggaauuacguaug

SEQ ID NO: 1356053 - RNA, 19 nt, Homo sapiens
gaggagaaggaauuacgua

SEQ ID NO: 1356054 - RNA, 19 nt, Homo sapiens
aagccgcacuuaccuauga

SEQ ID NO: 1356055 - RNA, 19 nt, Homo sapiens
auaaagguguucucggaaa

SEQ ID NO: 1356056 - RNA, 19 nt, Homo sapiens
caaggccgcugucgacuac

SEQ ID NO: 1356057 - RNA, 19 nt, Homo sapiens
agaaacacauucaggagau

SEQ ID NO: 1356058 - RNA, 19 nt, Homo sapiens
gaagaugagaaacacauuc

SEQ ID NO: 1356059 - RNA, 19 nt, Homo sapiens
caaggaggagaaggaauua

SEQ ID NO: 1356060 - RNA, 19 nt, Homo sapiens
ccaguggccugaggaggua

SEQ ID NO: 1356061 - RNA, 19 nt, Homo sapiens
ggaagccgcacuuaccuau

SEQ ID NO: 1356062 - RNA, 19 nt, Homo sapiens
aaauuggccucucaacuca

SEQ ID NO: 1356063 - RNA, 19 nt, Homo sapiens
caacgagcacuacccugua

SEQ ID NO: 1356064 - RNA, 19 nt, Homo sapiens
aggaaacacuucagguuau

SEQ ID NO: 1356065 - RNA, 19 nt, Homo sapiens
cgagacuacuuccuuaaca

SEQ ID NO: 1356066 - RNA, 19 nt, Homo sapiens
gaacacccacggacaugug

SEQ ID NO: 1356067 - RNA, 19 nt, Homo sapiens
gaggacaguugugggaaga

SEQ ID NO: 1356068 - RNA, 19 nt, Homo sapiens
cagccgcacuuaugacaug

SEQ ID NO: 1356069 - RNA, 19 nt, Homo sapiens
gaagguggccuacaaugcu

SEQ ID NO: 1356070 - RNA, 19 nt, Homo sapiens
gugcugaacgucuugauug

SEQ ID NO: 1356071 - RNA, 19 nt, Homo sapiens
gcuacgugcucaucuccaa

SEQ ID NO: 1356072 - RNA, 19 nt, Homo sapiens
ccagucagcguccaacuug

SEQ ID NO: 1356073 - RNA, 19 nt, Homo sapiens
cagaacggauggccuugga

SEQ ID NO: 1356074 - RNA, 19 nt, Homo sapiens
agugcgagcuggugaaaga

SEQ ID NO: 1356075 - RNA, 19 nt, Homo sapiens
ccaggaaacacuucagguu

SEQ ID NO: 1356076 - RNA, 19 nt, Homo sapiens
acaacaccuucaaguacua

SEQ ID NO: 1356077 - RNA, 19 nt, Homo sapiens
acaaugcucuuuucacaaa

SEQ ID NO: 1356078 - RNA, 19 nt, Homo sapiens
gaggcugaaagaacaauuu

SEQ ID NO: 1356079 - RNA, 19 nt, Homo sapiens
caaagcggagccucaagaa

SEQ ID NO: 1356080 - RNA, 19 nt, Homo sapiens
ccauuaaccugcugaagcu

SEQ ID NO: 1356081 - RNA, 19 nt, Homo sapiens
acacgcgccugagucauuu

SEQ ID NO: 1356082 - RNA, 19 nt, Homo sapiens
cauguuguccuuugacuug

SEQ ID NO: 1356083 - RNA, 19 nt, Homo sapiens
ccuacaacaccuucaagua

SEQ ID NO: 1356084 - RNA, 19 nt, Homo sapiens
gcgaccugcucuuugagaa

SEQ ID NO: 1356085 - RNA, 19 nt, Homo sapiens
cuacaacaccuucaaguac

SEQ ID NO: 1356086 - RNA, 19 nt, Homo sapiens
gucgggcucuucucauuug

SEQ ID NO: 1356087 - RNA, 19 nt, Homo sapiens
cagagaagaguguuugugu

SEQ ID NO: 1356088 - RNA, 19 nt, Homo sapiens
guacagcggcuaugauugc

SEQ ID NO: 1356089 - RNA, 19 nt, Homo sapiens
ucaacccgcuggugcugaa

SEQ ID NO: 1356090 - RNA, 19 nt, Homo sapiens
caaccaugguggcccaaca

SEQ ID NO: 1356091 - RNA, 19 nt, Homo sapiens
ggccaaggcugugauucug

SEQ ID NO: 1356092 - RNA, 19 nt, Homo sapiens
gggacgcuuucgacaaguu

SEQ ID NO: 1356093 - RNA, 19 nt, Homo sapiens
gcgacgaccugaguguguu

SEQ ID NO: 1356094 - RNA, 19 nt, Homo sapiens
gagagugcacggcuucguu

SEQ ID NO: 1356095 - RNA, 19 nt, Homo sapiens
agaaggcacuguggagaau

SEQ ID NO: 1356096 - RNA, 19 nt, Homo sapiens
gcccauugcucaucuuuug

SEQ ID NO: 1356097 - RNA, 19 nt, Homo sapiens
ggaaauugcaaaacaagaa

SEQ ID NO: 1356098 - RNA, 19 nt, Homo sapiens
gagaaacaagauccucaug

SEQ ID NO: 1356099 - RNA, 19 nt, Homo sapiens
cagcaagggccucguguuc

SEQ ID NO: 1356100 - RNA, 19 nt, Homo sapiens
gaccugaguguguuugaga

SEQ ID NO: 1356101 - RNA, 19 nt, Homo sapiens
cuacaucgccaaccagauc

SEQ ID NO: 1356102 - RNA, 19 nt, Homo sapiens
gauggaggacggcgaguuc

SEQ ID NO: 1356103 - RNA, 19 nt, Homo sapiens
ccacggacacguauccaau

SEQ ID NO: 1356104 - RNA, 19 nt, Homo sapiens
ccucagcauuggagacuuc

SEQ ID NO: 1356105 - RNA, 19 nt, Homo sapiens
gcuuauggcgaguucauga

SEQ ID NO: 1356106 - RNA, 19 nt, Homo sapiens
caagaagguggccuacaau

SEQ ID NO: 1356107 - RNA, 19 nt, Homo sapiens
cagaaggcacuguggagaa

SEQ ID NO: 1356108 - RNA, 19 nt, Homo sapiens
ggcaggaggagcuggauga

SEQ ID NO: 1356109 - RNA, 19 nt, Homo sapiens
acauauacgucugcggaaa

SEQ ID NO: 1356110 - RNA, 19 nt, Homo sapiens
agacgaaggauuccaguca

SEQ ID NO: 1356111 - RNA, 19 nt, Homo sapiens
ggacgugcacaauaaaggu

SEQ ID NO: 1356112 - RNA, 19 nt, Homo sapiens
ggagugcgagcuggugaaa

SEQ ID NO: 1356113 - RNA, 19 nt, Homo sapiens
aagggacgcuuucgacaag

SEQ ID NO: 1356114 - RNA, 19 nt, Homo sapiens
gaaaaucgaagccauaaaa

SEQ ID NO: 1356115 - RNA, 19 nt, Homo sapiens
caucaacaccaacaucuuu

SEQ ID NO: 1356116 - RNA, 19 nt, Homo sapiens
ggacacaugugggccaagu

SEQ ID NO: 1356117 - RNA, 19 nt, Homo sapiens
ggaagaaaggacccgguuu

SEQ ID NO: 1356118 - RNA, 19 nt, Homo sapiens
gaugagcgcagcccagaga

SEQ ID NO: 1356119 - RNA, 19 nt, Homo sapiens
gcagaggccaagaccguuu

SEQ ID NO: 1356120 - RNA, 19 nt, Homo sapiens
gggaaggacugggcguuca

SEQ ID NO: 1356121 - RNA, 19 nt, Homo sapiens
ggacugggcguucaucaac

SEQ ID NO: 1356122 - RNA, 19 nt, Homo sapiens
caauaaauggcucugugaa

SEQ ID NO: 1356123 - RNA, 19 nt, Homo sapiens
ucaauaaauggcucuguga

SEQ ID NO: 1356124 - RNA, 19 nt, Homo sapiens
gcagaaaaucgaagccaua

SEQ ID NO: 1356125 - RNA, 19 nt, Homo sapiens
uaaauggcucugugaacuu

SEQ ID NO: 1356126 - RNA, 19 nt, Homo sapiens
ucagagcucagccggauga

SEQ ID NO: 1356127 - RNA, 19 nt, Homo sapiens
aaauggcucugugaacuuc

SEQ ID NO: 1356128 - RNA, 19 nt, Homo sapiens
auaaauggcucugugaacu

SEQ ID NO: 1356129 - RNA, 19 nt, Homo sapiens
gggcguucaucaacaccaa

SEQ ID NO: 1356130 - RNA, 19 nt, Homo sapiens
gcugaggcgugagcaaugg

SEQ ID NO: 1356131 - RNA, 19 nt, Homo sapiens
gcagaugcagcuggaagau

SEQ ID NO: 1356132 - RNA, 19 nt, Homo sapiens
ccaagaaggagaaaaugaa

SEQ ID NO: 1356133 - RNA, 19 nt, Homo sapiens
ugccagggccguucccaaa

SEQ ID NO: 1356134 - RNA, 19 nt, Homo sapiens
gacugggcguucaucaaca

SEQ ID NO: 1356135 - RNA, 19 nt, Homo sapiens
gaagcugaggcgugagcaa

SEQ ID NO: 1356136 - RNA, 19 nt, Homo sapiens
ggaaggacugggcguucau

SEQ ID NO: 1356137 - RNA, 19 nt, Homo sapiens
ccagcgccuuggugcagaa

SEQ ID NO: 1356138 - RNA, 19 nt, Homo sapiens
gaagggaacuccuggaaau

SEQ ID NO: 1356139 - RNA, 19 nt, Homo sapiens
caugaggacuggccaaaga

SEQ ID NO: 1356140 - RNA, 19 nt, Homo sapiens
gagauuaucgacagaagaa

SEQ ID NO: 1356141 - RNA, 19 nt, Homo sapiens
gugcuucucucucauaagu

SEQ ID NO: 1356142 - RNA, 19 nt, Homo sapiens
ccaagaucauauucuaaug

SEQ ID NO: 1356143 - RNA, 19 nt, Homo sapiens
gaggugggcagauuccuuu

SEQ ID NO: 1356144 - RNA, 19 nt, Homo sapiens
gcuacgaggugggcagauu

SEQ ID NO: 1356145 - RNA, 19 nt, Homo sapiens
ggagguaaacauugacuuc

SEQ ID NO: 1356146 - RNA, 19 nt, Homo sapiens
cugccaagaucauauucua

SEQ ID NO: 1356147 - RNA, 19 nt, Homo sapiens
gcuucucucucauaaguau

SEQ ID NO: 1356148 - RNA, 19 nt, Homo sapiens
gaugugcuucucucucaua

SEQ ID NO: 1356149 - RNA, 19 nt, Homo sapiens
cacgggagguaaacauuga

SEQ ID NO: 1356150 - RNA, 19 nt, Homo sapiens
cagaggaggcucaguuaga

SEQ ID NO: 1356151 - RNA, 19 nt, Homo sapiens
gccagaggaggcucaguua

SEQ ID NO: 1356152 - RNA, 19 nt, Homo sapiens
cugcaaaacuggucucuaa

SEQ ID NO: 1356153 - RNA, 19 nt, Homo sapiens
gccaagaucauauucuaau

SEQ ID NO: 1356154 - RNA, 19 nt, Homo sapiens
cagcuauucuuccagacaa

SEQ ID NO: 1356155 - RNA, 19 nt, Homo sapiens
gagaagccacgaggaagaa

SEQ ID NO: 1356156 - RNA, 19 nt, Homo sapiens
gggcagauuccuuugaugu

SEQ ID NO: 1356157 - RNA, 19 nt, Homo sapiens
gugaggagaaccuggaauu

SEQ ID NO: 1356158 - RNA, 19 nt, Homo sapiens
ucaagagauuaucgacaga

SEQ ID NO: 1356159 - RNA, 19 nt, Homo sapiens
gaagcaggcagugugaaga

SEQ ID NO: 1356160 - RNA, 19 nt, Homo sapiens
ucagacucguguagugauu

SEQ ID NO: 1356161 - RNA, 19 nt, Homo sapiens
uaggaucuuugaggaguuu

SEQ ID NO: 1356162 - RNA, 19 nt, Homo sapiens
gugaggaguucaagaagac

SEQ ID NO: 1356163 - RNA, 19 nt, Homo sapiens
ugugaggaguucaagaaga

SEQ ID NO: 1356164 - RNA, 19 nt, Homo sapiens
cgagaagccacgaggaaga

SEQ ID NO: 1356165 - RNA, 19 nt, Homo sapiens
cagaagggaacuccuggaa

SEQ ID NO: 1356166 - RNA, 19 nt, Homo sapiens
ccacgggagguaaacauug

SEQ ID NO: 1356167 - RNA, 19 nt, Homo sapiens
ugggaugccugucucacaa

SEQ ID NO: 1356168 - RNA, 19 nt, Homo sapiens
gugggcagauuccuuugau

SEQ ID NO: 1356169 - RNA, 19 nt, Homo sapiens
uacacagccucauggagaa

SEQ ID NO: 1356170 - RNA, 19 nt, Homo sapiens
uaaggcccauaggaucuuu

SEQ ID NO: 1356171 - RNA, 19 nt, Homo sapiens
gagaguccuccuucuggaa

SEQ ID NO: 1356172 - RNA, 19 nt, Homo sapiens
agacagaacaaagggauga

SEQ ID NO: 1356173 - RNA, 19 nt, Homo sapiens
ggccaaagacagaacaaag

SEQ ID NO: 1356174 - RNA, 19 nt, Homo sapiens
uugaggaguuuguggaugu

SEQ ID NO: 1356175 - RNA, 19 nt, Homo sapiens
uugaugugcuucucucuca

SEQ ID NO: 1356176 - RNA, 19 nt, Homo sapiens
caagagauuaucgacagaa

SEQ ID NO: 1356177 - RNA, 19 nt, Homo sapiens
ggaugccugucucacaagu

SEQ ID NO: 1356178 - RNA, 19 nt, Homo sapiens
gguccaaaauguacuuaga

SEQ ID NO: 1356179 - RNA, 19 nt, Homo sapiens
ccugugaggaguucaagaa

SEQ ID NO: 1356180 - RNA, 19 nt, Homo sapiens
gaagacccauguggaacac

SEQ ID NO: 1356181 - RNA, 19 nt, Homo sapiens
ggacuggccaaagacagaa

SEQ ID NO: 1356182 - RNA, 19 nt, Homo sapiens
uagaucugcugucccaaag

SEQ ID NO: 1356183 - RNA, 19 nt, Homo sapiens
ugaccaagcccaaggaaaa

SEQ ID NO: 1356184 - RNA, 19 nt, Homo sapiens
gcagugugaagacccaugu

SEQ ID NO: 1356185 - RNA, 19 nt, Homo sapiens
agaagggaacuccuggaaa

SEQ ID NO: 1356186 - RNA, 19 nt, Homo sapiens
ugcauuccgugccuucuug

SEQ ID NO: 1356187 - RNA, 19 nt, Homo sapiens
agacucguguagugauuuc

SEQ ID NO: 1356188 - RNA, 19 nt, Homo sapiens
ugugaagacccauguggaa

SEQ ID NO: 1356189 - RNA, 19 nt, Homo sapiens
agccaucccugacuugcuu

SEQ ID NO: 1356190 - RNA, 19 nt, Homo sapiens
ugaagacccauguggaaca

SEQ ID NO: 1356191 - RNA, 19 nt, Homo sapiens
gccaaagacagaacaaagg

SEQ ID NO: 1356192 - RNA, 19 nt, Homo sapiens
uuagaucugcugucccaaa

SEQ ID NO: 1356193 - RNA, 19 nt, Homo sapiens
uuucacagcuauucuucca

SEQ ID NO: 1356194 - RNA, 19 nt, Homo sapiens
gauuucacagcuauucuuc

SEQ ID NO: 1356195 - RNA, 19 nt, Homo sapiens
agaggaggcucaguuagac

SEQ ID NO: 1356196 - RNA, 19 nt, Homo sapiens
ucucuaaggcccauaggau

SEQ ID NO: 1356197 - RNA, 19 nt, Homo sapiens
uggagaaccacuacacuag

SEQ ID NO: 1356198 - RNA, 19 nt, Homo sapiens
ggugggcagauuccuuuga

SEQ ID NO: 1356199 - RNA, 19 nt, Homo sapiens
ggagaugaagucacaauua

SEQ ID NO: 1356200 - RNA, 19 nt, Homo sapiens
caaaggagaugaagucaca

SEQ ID NO: 1356201 - RNA, 19 nt, Homo sapiens
gaaagacugugugcuuauu

SEQ ID NO: 1356202 - RNA, 19 nt, Homo sapiens
cagaaagacugugugcuua

SEQ ID NO: 1356203 - RNA, 19 nt, Homo sapiens
caaacggccuuaccagaaa

SEQ ID NO: 1356204 - RNA, 19 nt, Homo sapiens
agaaaugacuugcaguuga

SEQ ID NO: 1356205 - RNA, 19 nt, Homo sapiens
gggcugaaguugacauuau

SEQ ID NO: 1356206 - RNA, 19 nt, Homo sapiens
gaaaugacuugcaguugag

SEQ ID NO: 1356207 - RNA, 19 nt, Homo sapiens
caauuacacugccacauau

SEQ ID NO: 1356208 - RNA, 19 nt, Homo sapiens
gagaugaagucacaauuac

SEQ ID NO: 1356209 - RNA, 19 nt, Homo sapiens
cagcagcccuacaacagua

SEQ ID NO: 1356210 - RNA, 19 nt, Homo sapiens
ggaagcaaccagcucauga

SEQ ID NO: 1356211 - RNA, 19 nt, Homo sapiens
ucaugacacuggugaauau

SEQ ID NO: 1356212 - RNA, 19 nt, Homo sapiens
acaauuacacugccacaua

SEQ ID NO: 1356213 - RNA, 19 nt, Homo sapiens
aaacuucucccuugaaaga

SEQ ID NO: 1356214 - RNA, 19 nt, Homo sapiens
gcaaccagcucaugaacac

SEQ ID NO: 1356215 - RNA, 19 nt, Homo sapiens
gaagcaaccagcucaugaa

SEQ ID NO: 1356216 - RNA, 19 nt, Homo sapiens
ugaacacccucagaaauga

SEQ ID NO: 1356217 - RNA, 19 nt, Homo sapiens
gacugugugcuuauuauua

SEQ ID NO: 1356218 - RNA, 19 nt, Homo sapiens
gcagugacagugaugacua

SEQ ID NO: 1356219 - RNA, 19 nt, Homo sapiens
uauagacacuuccugugaa

SEQ ID NO: 1356220 - RNA, 19 nt, Homo sapiens
ccagaaagacugugugcuu

SEQ ID NO: 1356221 - RNA, 19 nt, Homo sapiens
gaaccucaguuggaugaca

SEQ ID NO: 1356222 - RNA, 19 nt, Homo sapiens
cagcaucuauagacacuuc

SEQ ID NO: 1356223 - RNA, 19 nt, Homo sapiens
gaaguugacauuauugaac

SEQ ID NO: 1356224 - RNA, 19 nt, Homo sapiens
ggcugaaguugacauuauu

SEQ ID NO: 1356225 - RNA, 19 nt, Homo sapiens
caaaacuucucccuugaaa

SEQ ID NO: 1356226 - RNA, 19 nt, Homo sapiens
gcucggcucuccuugucuu

SEQ ID NO: 1356227 - RNA, 19 nt, Homo sapiens
gcugagggcugaaguugac

SEQ ID NO: 1356228 - RNA, 19 nt, Homo sapiens
gugaauaugugcuggaaaa

SEQ ID NO: 1356229 - RNA, 19 nt, Homo sapiens
acaaacggccuuaccagaa

SEQ ID NO: 1356230 - RNA, 19 nt, Homo sapiens
gacuagugcuggaucuuuc

SEQ ID NO: 1356231 - RNA, 19 nt, Homo sapiens
aaagacugugugcuuauua

SEQ ID NO: 1356232 - RNA, 19 nt, Homo sapiens
gagcugagggcugaaguug

SEQ ID NO: 1356233 - RNA, 19 nt, Homo sapiens
ugacacuggugaauaugug

SEQ ID NO: 1356234 - RNA, 19 nt, Homo sapiens
gauaacccgucaccugaac

SEQ ID NO: 1356235 - RNA, 19 nt, Homo sapiens
aaaccagcaucuauagaca

SEQ ID NO: 1356236 - RNA, 19 nt, Homo sapiens
ucagaaaugacuugcaguu

SEQ ID NO: 1356237 - RNA, 19 nt, Homo sapiens
caugaacacccucagaaau

SEQ ID NO: 1356238 - RNA, 19 nt, Homo sapiens
cuauagacacuuccuguga

SEQ ID NO: 1356239 - RNA, 19 nt, Homo sapiens
ggaacaaacggccuuacca

SEQ ID NO: 1356240 - RNA, 19 nt, Homo sapiens
ccacaccacccaugacugu

SEQ ID NO: 1356241 - RNA, 19 nt, Homo sapiens
gcuucaaguuggcaaagga

SEQ ID NO: 1356242 - RNA, 19 nt, Homo sapiens
aagacugugugcuuauuau

SEQ ID NO: 1356243 - RNA, 19 nt, Homo sapiens
ugacuagugcuggaucuuu

SEQ ID NO: 1356244 - RNA, 19 nt, Homo sapiens
ucaugaacacccucagaaa

SEQ ID NO: 1356245 - RNA, 19 nt, Homo sapiens
gggaagugaugacgauagc

SEQ ID NO: 1356246 - RNA, 19 nt, Homo sapiens
acuucucccuugaaagaua

SEQ ID NO: 1356247 - RNA, 19 nt, Homo sapiens
gggccuccuuccacacuau

SEQ ID NO: 1356248 - RNA, 19 nt, Homo sapiens
gcucaugaacacccucaga

SEQ ID NO: 1356249 - RNA, 19 nt, Homo sapiens
cagaaaugacuugcaguug

SEQ ID NO: 1356250 - RNA, 19 nt, Homo sapiens
ccacacuauucguuaugau

SEQ ID NO: 1356251 - RNA, 19 nt, Homo sapiens
cuucucccuugaaagauaa

SEQ ID NO: 1356252 - RNA, 19 nt, Homo sapiens
uaaaccagcaucuauagac

SEQ ID NO: 1356253 - RNA, 19 nt, Homo sapiens
gaugacuagugcuggaucu

SEQ ID NO: 1356254 - RNA, 19 nt, Homo sapiens
agaaagacugugugcuuau

SEQ ID NO: 1356255 - RNA, 19 nt, Homo sapiens
gcugaaguugacauuauug

SEQ ID NO: 1356256 - RNA, 19 nt, Homo sapiens
gaugaagucacaauuacac

SEQ ID NO: 1356257 - RNA, 19 nt, Homo sapiens
aaacucaguagcagcauuc

SEQ ID NO: 1356258 - RNA, 19 nt, Homo sapiens
ggauccacaccacccauga

SEQ ID NO: 1356259 - RNA, 19 nt, Homo sapiens
cuggaucuuucgaaaccua

SEQ ID NO: 1356260 - RNA, 19 nt, Homo sapiens
cagugacagugaugacuag

SEQ ID NO: 1356261 - RNA, 19 nt, Homo sapiens
caaguuggcaaaggagaug

SEQ ID NO: 1356262 - RNA, 19 nt, Homo sapiens
caccacccaugacuguguu

SEQ ID NO: 1356263 - RNA, 19 nt, Homo sapiens
ugagugagucuggcaguga

SEQ ID NO: 1356264 - RNA, 19 nt, Homo sapiens
gacuugcaguugagugagu

SEQ ID NO: 1356265 - RNA, 19 nt, Homo sapiens
augaacacccucagaaaug

SEQ ID NO: 1356266 - RNA, 19 nt, Homo sapiens
cacacuauucguuaugauu

SEQ ID NO: 1356267 - RNA, 19 nt, Homo sapiens
uggcaaaggagaugaaguc

SEQ ID NO: 1356268 - RNA, 19 nt, Homo sapiens
aaacggccuuaccagaaag

SEQ ID NO: 1356269 - RNA, 19 nt, Homo sapiens
gcaguggaggcgaggacaa

SEQ ID NO: 1356270 - RNA, 19 nt, Homo sapiens
agugcuggaucuuucgaaa

SEQ ID NO: 1356271 - RNA, 19 nt, Homo sapiens
cuuccacacuauucguuau

SEQ ID NO: 1356272 - RNA, 19 nt, Homo sapiens
gaggagaaaccacuacuua

SEQ ID NO: 1356273 - RNA, 19 nt, Homo sapiens
gaagaucuauggaaacaca

SEQ ID NO: 1356274 - RNA, 19 nt, Homo sapiens
ggagggaaccaaccacuua

SEQ ID NO: 1356275 - RNA, 19 nt, Homo sapiens
gcacauauauacguaccua

SEQ ID NO: 1356276 - RNA, 19 nt, Homo sapiens
agaagcagcugaaguuuga

SEQ ID NO: 1356277 - RNA, 19 nt, Homo sapiens
ggaguugucuuucaugcuu

SEQ ID NO: 1356278 - RNA, 19 nt, Homo sapiens
gaaccaaccacuuaaacaa

SEQ ID NO: 1356279 - RNA, 19 nt, Homo sapiens
ccacaaggcauuauuauuc

SEQ ID NO: 1356280 - RNA, 19 nt, Homo sapiens
aaacagcugcuaccucuua

SEQ ID NO: 1356281 - RNA, 19 nt, Homo sapiens
ggagaaaccacuacuuaga

SEQ ID NO: 1356282 - RNA, 19 nt, Homo sapiens
ccaagaagcagcugaaguu

SEQ ID NO: 1356283 - RNA, 19 nt, Homo sapiens
ggaagaggaggacgacuuu

SEQ ID NO: 1356284 - RNA, 19 nt, Homo sapiens
gcaagaugcugcggguaaa

SEQ ID NO: 1356285 - RNA, 19 nt, Homo sapiens
gagaggacaucaccagcuu

SEQ ID NO: 1356286 - RNA, 19 nt, Homo sapiens
aaacuacacgucccaauuu

SEQ ID NO: 1356287 - RNA, 19 nt, Homo sapiens
gcugcuaccucuuaguauu

SEQ ID NO: 1356288 - RNA, 19 nt, Homo sapiens
cuucuucucucucuacuuu

SEQ ID NO: 1356289 - RNA, 19 nt, Homo sapiens
ggaaaugacucugguuuug

SEQ ID NO: 1356290 - RNA, 19 nt, Homo sapiens
agaagaagauggagagagu

SEQ ID NO: 1356291 - RNA, 19 nt, Homo sapiens
gcaauugugugcuguuggu

SEQ ID NO: 1356292 - RNA, 19 nt, Homo sapiens
ggagcguccuugucaauca

SEQ ID NO: 1356293 - RNA, 19 nt, Homo sapiens
aaauauacacucucaggua

SEQ ID NO: 1356294 - RNA, 19 nt, Homo sapiens
gagaaaccacuacuuagau

SEQ ID NO: 1356295 - RNA, 19 nt, Homo sapiens
gcgaacgucuugcuguugu

SEQ ID NO: 1356296 - RNA, 19 nt, Homo sapiens
gagaugagaagaagaugga

SEQ ID NO: 1356297 - RNA, 19 nt, Homo sapiens
acacacacguauuuaagga

SEQ ID NO: 1356298 - RNA, 19 nt, Homo sapiens
gaccaucccucucauuuug

SEQ ID NO: 1356299 - RNA, 19 nt, Homo sapiens
ggaaccaaccacuuaaaca

SEQ ID NO: 1356300 - RNA, 19 nt, Homo sapiens
cagcugcuaccucuuagua

SEQ ID NO: 1356301 - RNA, 19 nt, Homo sapiens
caggagagcacccuuacuu

SEQ ID NO: 1356302 - RNA, 19 nt, Homo sapiens
gagaacaucgagaggagaa

SEQ ID NO: 1356303 - RNA, 19 nt, Homo sapiens
agagcuuucuguaucuaua

SEQ ID NO: 1356304 - RNA, 19 nt, Homo sapiens
ggacgacuuucggcuggaa

SEQ ID NO: 1356305 - RNA, 19 nt, Homo sapiens
gagggaaccaaccacuuaa

SEQ ID NO: 1356306 - RNA, 19 nt, Homo sapiens
cuagaaaccuuagcugucu

SEQ ID NO: 1356307 - RNA, 19 nt, Homo sapiens
gcagagugcgaacgucuug

SEQ ID NO: 1356308 - RNA, 19 nt, Homo sapiens
gugcgaacgucuugcuguu

SEQ ID NO: 1356309 - RNA, 19 nt, Homo sapiens
uaacuagcccaggaaauga

SEQ ID NO: 1356310 - RNA, 19 nt, Homo sapiens
acaccacaaggcauuauua

SEQ ID NO: 1356311 - RNA, 19 nt, Homo sapiens
agaaaccacuacuuagauc

SEQ ID NO: 1356312 - RNA, 19 nt, Homo sapiens
uguaugacuuugacaacaa

SEQ ID NO: 1356313 - RNA, 19 nt, Homo sapiens
ggaccuucacccuguauga

SEQ ID NO: 1356314 - RNA, 19 nt, Homo sapiens
ccauuucuauguaucuuuc

SEQ ID NO: 1356315 - RNA, 19 nt, Homo sapiens
cacaaggcauuauuauucu

SEQ ID NO: 1356316 - RNA, 19 nt, Homo sapiens
acucucagguaucuuuaaa

SEQ ID NO: 1356317 - RNA, 19 nt, Homo sapiens
caagaagcagcugaaguuu

SEQ ID NO: 1356318 - RNA, 19 nt, Homo sapiens
gaaacacagaacuaaacuu

SEQ ID NO: 1356319 - RNA, 19 nt, Homo sapiens
guaccuacacgguucucua

SEQ ID NO: 1356320 - RNA, 19 nt, Homo sapiens
ucucuacuuuacagugaua

SEQ ID NO: 1356321 - RNA, 19 nt, Homo sapiens
caggaaaugacucugguuu

SEQ ID NO: 1356322 - RNA, 19 nt, Homo sapiens
cagcggagaugagaagaag

SEQ ID NO: 1356323 - RNA, 19 nt, Homo sapiens
gugguggacuccucuguca

SEQ ID NO: 1356324 - RNA, 19 nt, Homo sapiens
ccucuuaguauuauucuga

SEQ ID NO: 1356325 - RNA, 19 nt, Homo sapiens
gaacaucaccaccauuacc

SEQ ID NO: 1356326 - RNA, 19 nt, Homo sapiens
gcaccaccaccaccaugaa

SEQ ID NO: 1356327 - RNA, 19 nt, Homo sapiens
ugccaucuguccauuucua

SEQ ID NO: 1356328 - RNA, 19 nt, Homo sapiens
ccuacacgguucucuaaca

SEQ ID NO: 1356329 - RNA, 19 nt, Homo sapiens
gaguugucuuucaugcuuu

SEQ ID NO: 1356330 - RNA, 19 nt, Homo sapiens
cugcuaccucuuaguauua

SEQ ID NO: 1356331 - RNA, 19 nt, Homo sapiens
ccagagacccucgaaaucu

SEQ ID NO: 1356332 - RNA, 19 nt, Homo sapiens
gcauaacuagcccaggaaa

SEQ ID NO: 1356333 - RNA, 19 nt, Homo sapiens
ggaaacacagaacuaaacu

SEQ ID NO: 1356334 - RNA, 19 nt, Homo sapiens
augaacaucaccaccauua

SEQ ID NO: 1356335 - RNA, 19 nt, Homo sapiens
ggacgggagcaagcacuuu

SEQ ID NO: 1356336 - RNA, 19 nt, Homo sapiens
cugcggagcugggagaaga

SEQ ID NO: 1356337 - RNA, 19 nt, Homo sapiens
ucucucuacuuuacaguga

SEQ ID NO: 1356338 - RNA, 19 nt, Homo sapiens
uauggaaacacagaacuaa

SEQ ID NO: 1356339 - RNA, 19 nt, Homo sapiens
ccgccuuggugguguauga

SEQ ID NO: 1356340 - RNA, 19 nt, Homo sapiens
acacguauuuaaggacuau

SEQ ID NO: 1356341 - RNA, 19 nt, Homo sapiens
auauuuagcuagccuacau

SEQ ID NO: 1356342 - RNA, 19 nt, Homo sapiens
gcggagaugagaagaagau

SEQ ID NO: 1356343 - RNA, 19 nt, Homo sapiens
ggacuaucccugagaccau

SEQ ID NO: 1356344 - RNA, 19 nt, Homo sapiens
ccaugaacaucaccaccau

SEQ ID NO: 1356345 - RNA, 19 nt, Homo sapiens
ccacaucccacaccgaaag

SEQ ID NO: 1356346 - RNA, 19 nt, Homo sapiens
uaccuacacgguucucuaa

SEQ ID NO: 1356347 - RNA, 19 nt, Homo sapiens
caagauccaggcaauugug

SEQ ID NO: 1356348 - RNA, 19 nt, Homo sapiens
acagugauacacacacgua

SEQ ID NO: 1356349 - RNA, 19 nt, Homo sapiens
gaaaugacucugguuuuga

SEQ ID NO: 1356350 - RNA, 19 nt, Homo sapiens
gcagcggagaugagaagaa

SEQ ID NO: 1356351 - RNA, 19 nt, Homo sapiens
cggcaggaguggaccuuca

SEQ ID NO: 1356352 - RNA, 19 nt, Homo sapiens
gggagcaagcacuuuguga

SEQ ID NO: 1356353 - RNA, 19 nt, Homo sapiens
gacgggagcaagcacuuug

SEQ ID NO: 1356354 - RNA, 19 nt, Homo sapiens
auaacuagcccaggaaaug

SEQ ID NO: 1356355 - RNA, 19 nt, Homo sapiens
gaacaucgagaggagaaac

SEQ ID NO: 1356356 - RNA, 19 nt, Homo sapiens
gaucuauggaaacacagaa

SEQ ID NO: 1356357 - RNA, 19 nt, Homo sapiens
caucuguccauuucuaugu

SEQ ID NO: 1356358 - RNA, 19 nt, Homo sapiens
cuacacgguucucuaacag

SEQ ID NO: 1356359 - RNA, 19 nt, Homo sapiens
gucccaaccuagaaaccuu

SEQ ID NO: 1356360 - RNA, 19 nt, Homo sapiens
gaacgucuugcuguugugu

SEQ ID NO: 1356361 - RNA, 19 nt, Homo sapiens
gaaaccacuacuuagaucu

SEQ ID NO: 1356362 - RNA, 19 nt, Homo sapiens
aagaagcagcugaaguuug

SEQ ID NO: 1356363 - RNA, 19 nt, Homo sapiens
gcuccaagaagcagcugaa

SEQ ID NO: 1356364 - RNA, 19 nt, Homo sapiens
gaucugcagcaucuaugug

SEQ ID NO: 1356365 - RNA, 19 nt, Homo sapiens
aagaagauggagagaguga

SEQ ID NO: 1356366 - RNA, 19 nt, Homo sapiens
caccacaaggcauuauuau

SEQ ID NO: 1356367 - RNA, 19 nt, Homo sapiens
gagcguccuugucaaucag

SEQ ID NO: 1356368 - RNA, 19 nt, Homo sapiens
uuucuggaguugucuuuca

SEQ ID NO: 1356369 - RNA, 19 nt, Homo sapiens
cuauggaaacacagaacua

SEQ ID NO: 1356370 - RNA, 19 nt, Homo sapiens
ccaagauccaggcaauugu

SEQ ID NO: 1356371 - RNA, 19 nt, Homo sapiens
gggcagcggagaugagaag

SEQ ID NO: 1356372 - RNA, 19 nt, Homo sapiens
ggaaagccuucagcuacua

SEQ ID NO: 1356373 - RNA, 19 nt, Homo sapiens
gaacuacacguccagauuc

SEQ ID NO: 1356374 - RNA, 19 nt, Homo sapiens
cauaaaaccugcuuugauu

SEQ ID NO: 1356375 - RNA, 19 nt, Homo sapiens
gggcagcgccucaacauug

SEQ ID NO: 1356376 - RNA, 19 nt, Homo sapiens
gagaagcaguuccucaagu

SEQ ID NO: 1356377 - RNA, 19 nt, Homo sapiens
gcaagacccuccgugugaa

SEQ ID NO: 1356378 - RNA, 19 nt, Homo sapiens
ggacguucacgcucuauga

SEQ ID NO: 1356379 - RNA, 19 nt, Homo sapiens
cuaaggcucgucuguguaa

SEQ ID NO: 1356380 - RNA, 19 nt, Homo sapiens
gggaaagccuucagcuacu

SEQ ID NO: 1356381 - RNA, 19 nt, Homo sapiens
ccugagcccuccagcaaga

SEQ ID NO: 1356382 - RNA, 19 nt, Homo sapiens
caucugaagccacuauguu

SEQ ID NO: 1356383 - RNA, 19 nt, Homo sapiens
ggaaacugcagucgaagca

SEQ ID NO: 1356384 - RNA, 19 nt, Homo sapiens
agaagcaguuccucaaguc

SEQ ID NO: 1356385 - RNA, 19 nt, Homo sapiens
gaacacggagcgcagaaac

SEQ ID NO: 1356386 - RNA, 19 nt, Homo sapiens
agaacuacacguccagauu

SEQ ID NO: 1356387 - RNA, 19 nt, Homo sapiens
aaaccugcuuugauuccaa

SEQ ID NO: 1356388 - RNA, 19 nt, Homo sapiens
ggagaagcaguuccucaag

SEQ ID NO: 1356389 - RNA, 19 nt, Homo sapiens
ucuaugacuuugacaacug

SEQ ID NO: 1356390 - RNA, 19 nt, Homo sapiens
gacagcaaacagcaacuga

SEQ ID NO: 1356391 - RNA, 19 nt, Homo sapiens
cacaggugcugguggaaca

SEQ ID NO: 1356392 - RNA, 19 nt, Homo sapiens
ccacauggcggugaacaca

SEQ ID NO: 1356393 - RNA, 19 nt, Homo sapiens
guucacgcucuaugacuuu

SEQ ID NO: 1356394 - RNA, 19 nt, Homo sapiens
gagaacacggagcgcagaa

SEQ ID NO: 1356395 - RNA, 19 nt, Homo sapiens
agcaagacccuccguguga

SEQ ID NO: 1356396 - RNA, 19 nt, Homo sapiens
gcuacgcggugccagugau

SEQ ID NO: 1356397 - RNA, 19 nt, Homo sapiens
gcggugaacacaucugaag

SEQ ID NO: 1356398 - RNA, 19 nt, Homo sapiens
gacccuccgugugaagcua

SEQ ID NO: 1356399 - RNA, 19 nt, Homo sapiens
acauggcggugaacacauc

SEQ ID NO: 1356400 - RNA, 19 nt, Homo sapiens
cggagaagcaguuccucaa

SEQ ID NO: 1356401 - RNA, 19 nt, Homo sapiens
ugcaggugcuggcaugaug

SEQ ID NO: 1356402 - RNA, 19 nt, Homo sapiens
cguucacgcucuaugacuu

SEQ ID NO: 1356403 - RNA, 19 nt, Homo sapiens
ccuacugcguggacgagaa

SEQ ID NO: 1356404 - RNA, 19 nt, Homo sapiens
cagcagcaaguccgggaaa

SEQ ID NO: 1356405 - RNA, 19 nt, Homo sapiens
cucuaaggcucgucugugu

SEQ ID NO: 1356406 - RNA, 19 nt, Homo sapiens
gaaagccuucagcuacuac

SEQ ID NO: 1356407 - RNA, 19 nt, Homo sapiens
gagaacuacacguccagau

SEQ ID NO: 1356408 - RNA, 19 nt, Homo sapiens
ccucaugcacaccaucuau

SEQ ID NO: 1356409 - RNA, 19 nt, Homo sapiens
gaacuugcaucaucuaauu

SEQ ID NO: 1356410 - RNA, 19 nt, Homo sapiens
gaacaaaggccauaucauu

SEQ ID NO: 1356411 - RNA, 19 nt, Homo sapiens
ggacaucacuggcuacauu

SEQ ID NO: 1356412 - RNA, 19 nt, Homo sapiens
gcaguagugucuuagauua

SEQ ID NO: 1356413 - RNA, 19 nt, Homo sapiens
guagagagguuaaauauca

SEQ ID NO: 1356414 - RNA, 19 nt, Homo sapiens
gaucuucacuucucuguug

SEQ ID NO: 1356415 - RNA, 19 nt, Homo sapiens
ggagggaugugcuucauga

SEQ ID NO: 1356416 - RNA, 19 nt, Homo sapiens
cuccaaagcuuauguguuu

SEQ ID NO: 1356417 - RNA, 19 nt, Homo sapiens
ggaaagagaagagaaacua

SEQ ID NO: 1356418 - RNA, 19 nt, Homo sapiens
ucacuucucuguugauuau

SEQ ID NO: 1356419 - RNA, 19 nt, Homo sapiens
gaaacuagcauucuaugga

SEQ ID NO: 1356420 - RNA, 19 nt, Homo sapiens
ggaaauauucucagucaug

SEQ ID NO: 1356421 - RNA, 19 nt, Homo sapiens
cagccugucuaacuuaaua

SEQ ID NO: 1356422 - RNA, 19 nt, Homo sapiens
gcaaacucuuguauggaua

SEQ ID NO: 1356423 - RNA, 19 nt, Homo sapiens
agacauaguacgaguguua

SEQ ID NO: 1356424 - RNA, 19 nt, Homo sapiens
gguuaaauaucauguguca

SEQ ID NO: 1356425 - RNA, 19 nt, Homo sapiens
ccacaugggacauuuguuu

SEQ ID NO: 1356426 - RNA, 19 nt, Homo sapiens
gagguuaaauaucaugugu

SEQ ID NO: 1356427 - RNA, 19 nt, Homo sapiens
guaaggaaauauucucagu

SEQ ID NO: 1356428 - RNA, 19 nt, Homo sapiens
ucaauggucuguaugaaca

SEQ ID NO: 1356429 - RNA, 19 nt, Homo sapiens
gauauggaaugugcucuga

SEQ ID NO: 1356430 - RNA, 19 nt, Homo sapiens
gucaaaggcauauaagaua

SEQ ID NO: 1356431 - RNA, 19 nt, Homo sapiens
uaaguuugcuugacuccaa

SEQ ID NO: 1356432 - RNA, 19 nt, Homo sapiens
guacauggcuaagaacaag

SEQ ID NO: 1356433 - RNA, 19 nt, Homo sapiens
gagaagagaaacuagcauu

SEQ ID NO: 1356434 - RNA, 19 nt, Homo sapiens
ggcaaacucuuguauggau

SEQ ID NO: 1356435 - RNA, 19 nt, Homo sapiens
ugagaaauuucacuguaga

SEQ ID NO: 1356436 - RNA, 19 nt, Homo sapiens
ggucaaaggcauauaagau

SEQ ID NO: 1356437 - RNA, 19 nt, Homo sapiens
gaugcagccugucuaacuu

SEQ ID NO: 1356438 - RNA, 19 nt, Homo sapiens
aguauaaugugcugcagua

SEQ ID NO: 1356439 - RNA, 19 nt, Homo sapiens
gaacaaguggaaucagaau

SEQ ID NO: 1356440 - RNA, 19 nt, Homo sapiens
ccacgaugcugcucuugga

SEQ ID NO: 1356441 - RNA, 19 nt, Homo sapiens
auaaugugcugcaguauca

SEQ ID NO: 1356442 - RNA, 19 nt, Homo sapiens
aaggaaauauucucaguca

SEQ ID NO: 1356443 - RNA, 19 nt, Homo sapiens
gcacagccguucacaucca

SEQ ID NO: 1356444 - RNA, 19 nt, Homo sapiens
uagggucguuuguuucuuu

SEQ ID NO: 1356445 - RNA, 19 nt, Homo sapiens
cugcuagggucguuuguuu

SEQ ID NO: 1356446 - RNA, 19 nt, Homo sapiens
aagaacaaguggaaucaga

SEQ ID NO: 1356447 - RNA, 19 nt, Homo sapiens
agauuuagcugcacauucu

SEQ ID NO: 1356448 - RNA, 19 nt, Homo sapiens
caaacgaauucaacaucug

SEQ ID NO: 1356449 - RNA, 19 nt, Homo sapiens
caucuaauuccauaacuga

SEQ ID NO: 1356450 - RNA, 19 nt, Homo sapiens
caguaucaauggucuguau

SEQ ID NO: 1356451 - RNA, 19 nt, Homo sapiens
gaaagagaagagaaacuag

SEQ ID NO: 1356452 - RNA, 19 nt, Homo sapiens
uauggaaugugcucugaga

SEQ ID NO: 1356453 - RNA, 19 nt, Homo sapiens
aacaaaggccauaucauuu

SEQ ID NO: 1356454 - RNA, 19 nt, Homo sapiens
gauucugugacauguauua

SEQ ID NO: 1356455 - RNA, 19 nt, Homo sapiens
aaaggucaaaggcauauaa

SEQ ID NO: 1356456 - RNA, 19 nt, Homo sapiens
ucaaacgaauucaacaucu

SEQ ID NO: 1356457 - RNA, 19 nt, Homo sapiens
guaggucuuugcaguagug

SEQ ID NO: 1356458 - RNA, 19 nt, Homo sapiens
ccagucaagauuacagaua

SEQ ID NO: 1356459 - RNA, 19 nt, Homo sapiens
ccagacccagucaagauua

SEQ ID NO: 1356460 - RNA, 19 nt, Homo sapiens
gcauuugucuguggaacug

SEQ ID NO: 1356461 - RNA, 19 nt, Homo sapiens
ugcaucaucuaauuccaua

SEQ ID NO: 1356462 - RNA, 19 nt, Homo sapiens
gagagaacucaucaucuau

SEQ ID NO: 1356463 - RNA, 19 nt, Homo sapiens
ggagaaccaggacaucaga

SEQ ID NO: 1356464 - RNA, 19 nt, Homo sapiens
caaacucuuguauggauaa

SEQ ID NO: 1356465 - RNA, 19 nt, Homo sapiens
agaaccuacucaucacuuu

SEQ ID NO: 1356466 - RNA, 19 nt, Homo sapiens
gcaauugcccuucuuucca

SEQ ID NO: 1356467 - RNA, 19 nt, Homo sapiens
gaaaaucagcagacagaaa

SEQ ID NO: 1356468 - RNA, 19 nt, Homo sapiens
aauggugacugaacuggaa

SEQ ID NO: 1356469 - RNA, 19 nt, Homo sapiens
gcuaagaacaaguggaauc

SEQ ID NO: 1356470 - RNA, 19 nt, Homo sapiens
ggaagccagugggacauca

SEQ ID NO: 1356471 - RNA, 19 nt, Homo sapiens
cagucaagauuacagauag

SEQ ID NO: 1356472 - RNA, 19 nt, Homo sapiens
gggaaauggugacugaacu

SEQ ID NO: 1356473 - RNA, 19 nt, Homo sapiens
uaucaauggucuguaugaa

SEQ ID NO: 1356474 - RNA, 19 nt, Homo sapiens
cacaugggacauuuguuua

SEQ ID NO: 1356475 - RNA, 19 nt, Homo sapiens
uaaauggcaaacucuugua

SEQ ID NO: 1356476 - RNA, 19 nt, Homo sapiens
aaguguacauggcuaagaa

SEQ ID NO: 1356477 - RNA, 19 nt, Homo sapiens
gguaguaagauaacuguag

SEQ ID NO: 1356478 - RNA, 19 nt, Homo sapiens
ggaugcagccugucuaacu

SEQ ID NO: 1356479 - RNA, 19 nt, Homo sapiens
ggaacuugcaucaucuaau

SEQ ID NO: 1356480 - RNA, 19 nt, Homo sapiens
gggcuuuucuuucuuggua

SEQ ID NO: 1356481 - RNA, 19 nt, Homo sapiens
gcaucuccaucuuacaagu

SEQ ID NO: 1356482 - RNA, 19 nt, Homo sapiens
ggaaauggugacugaacug

SEQ ID NO: 1356483 - RNA, 19 nt, Homo sapiens
guaucaauggucuguauga

SEQ ID NO: 1356484 - RNA, 19 nt, Homo sapiens
uagcaucuccaucuuacaa

SEQ ID NO: 1356485 - RNA, 19 nt, Homo sapiens
cgaauucaacaucuguauu

SEQ ID NO: 1356486 - RNA, 19 nt, Homo sapiens
cgucugcgcuggagaacca

SEQ ID NO: 1356487 - RNA, 19 nt, Homo sapiens
cugaguggcuacaaugugu

SEQ ID NO: 1356488 - RNA, 19 nt, Homo sapiens
guagugucuuagauuaugu

SEQ ID NO: 1356489 - RNA, 19 nt, Homo sapiens
ucuuugcaguagugucuua

SEQ ID NO: 1356490 - RNA, 19 nt, Homo sapiens
cuuaccaugugccagauuu

SEQ ID NO: 1356491 - RNA, 19 nt, Homo sapiens
accaucggcuggaauuauu

SEQ ID NO: 1356492 - RNA, 19 nt, Homo sapiens
gagauuuagcugcacauuc

SEQ ID NO: 1356493 - RNA, 19 nt, Homo sapiens
ucuguggaacugagauuua

SEQ ID NO: 1356494 - RNA, 19 nt, Homo sapiens
ggaagaaaaucagcagaca

SEQ ID NO: 1356495 - RNA, 19 nt, Homo sapiens
uugauucugugacauguau

SEQ ID NO: 1356496 - RNA, 19 nt, Homo sapiens
cuguauuccucacccauuu

SEQ ID NO: 1356497 - RNA, 19 nt, Homo sapiens
gaacuggaacuugcaucau

SEQ ID NO: 1356498 - RNA, 19 nt, Homo sapiens
ggacaucagaggaagaaaa

SEQ ID NO: 1356499 - RNA, 19 nt, Homo sapiens
caucaucuauccagaaccu

SEQ ID NO: 1356500 - RNA, 19 nt, Homo sapiens
gagaacucaucaucuaucc

SEQ ID NO: 1356501 - RNA, 19 nt, Homo sapiens
gcuuauguguuuuccagua

SEQ ID NO: 1356502 - RNA, 19 nt, Homo sapiens
aguagugucuuagauuaug

SEQ ID NO: 1356503 - RNA, 19 nt, Homo sapiens
ggucguuuguuucuuucug

SEQ ID NO: 1356504 - RNA, 19 nt, Homo sapiens
uagaggaccugcccuucag

SEQ ID NO: 1356505 - RNA, 19 nt, Homo sapiens
caugugucauugauucugu

SEQ ID NO: 1356506 - RNA, 19 nt, Homo sapiens
aaaaucagcagacagaaaa

SEQ ID NO: 1356507 - RNA, 19 nt, Homo sapiens
aaacgaauucaacaucugu

SEQ ID NO: 1356508 - RNA, 19 nt, Homo sapiens
caacaggauuuuccaacug

SEQ ID NO: 1356509 - RNA, 19 nt, Homo sapiens
gaacaucucuugugguauu

SEQ ID NO: 1356510 - RNA, 19 nt, Homo sapiens
ucuagcaccugaaauauua

SEQ ID NO: 1356511 - RNA, 19 nt, Homo sapiens
gaaagcaagucaagcaaau

SEQ ID NO: 1356512 - RNA, 19 nt, Homo sapiens
cagaacaucucuuguggua

SEQ ID NO: 1356513 - RNA, 19 nt, Homo sapiens
caaccuaucauaucuguuu

SEQ ID NO: 1356514 - RNA, 19 nt, Homo sapiens
gaacccugcugguggcuuu

SEQ ID NO: 1356515 - RNA, 19 nt, Homo sapiens
cauaaucacucuaauugga

SEQ ID NO: 1356516 - RNA, 19 nt, Homo sapiens
gcaaauuacuucucacaac

SEQ ID NO: 1356517 - RNA, 19 nt, Homo sapiens
ggaaacggcuagcaacuac

SEQ ID NO: 1356518 - RNA, 19 nt, Homo sapiens
gaacaguccuggccuacuc

SEQ ID NO: 1356519 - RNA, 19 nt, Homo sapiens
cuacuuggcuucuguguuc

SEQ ID NO: 1356520 - RNA, 19 nt, Homo sapiens
ugacagcuaugguuggaaa

SEQ ID NO: 1356521 - RNA, 19 nt, Homo sapiens
cuucauggcugcucgcuuu

SEQ ID NO: 1356522 - RNA, 19 nt, Homo sapiens
cguuugcaguugauuauua

SEQ ID NO: 1356523 - RNA, 19 nt, Homo sapiens
gagaacacaucgaguuugg

SEQ ID NO: 1356524 - RNA, 19 nt, Homo sapiens
ucaagcaaauuacuucuca

SEQ ID NO: 1356525 - RNA, 19 nt, Homo sapiens
aaaggacacuuaccguuug

SEQ ID NO: 1356526 - RNA, 19 nt, Homo sapiens
gcaagcuccuguaaacugu

SEQ ID NO: 1356527 - RNA, 19 nt, Homo sapiens
caaauuacuucucacaacu

SEQ ID NO: 1356528 - RNA, 19 nt, Homo sapiens
aggaggcaaugaauacuua

SEQ ID NO: 1356529 - RNA, 19 nt, Homo sapiens
ccagaaagauuauguuacg

SEQ ID NO: 1356530 - RNA, 19 nt, Homo sapiens
uaacuuaggaggcaaugaa

SEQ ID NO: 1356531 - RNA, 19 nt, Homo sapiens
gaaaauggcuugcaaugcu

SEQ ID NO: 1356532 - RNA, 19 nt, Homo sapiens
guggauggcuacauauaug

SEQ ID NO: 1356533 - RNA, 19 nt, Homo sapiens
ggccagaaagauuauguua

SEQ ID NO: 1356534 - RNA, 19 nt, Homo sapiens
aagcaagucaagcaaauua

SEQ ID NO: 1356535 - RNA, 19 nt, Homo sapiens
cuacauauaugaccagaac

SEQ ID NO: 1356536 - RNA, 19 nt, Homo sapiens
ucccauauguuguuuguau

SEQ ID NO: 1356537 - RNA, 19 nt, Homo sapiens
gaagcacaaccuaucauau

SEQ ID NO: 1356538 - RNA, 19 nt, Homo sapiens
cacaagcaguagcauguuu

SEQ ID NO: 1356539 - RNA, 19 nt, Homo sapiens
ggccucauuuaucuuuaua

SEQ ID NO: 1356540 - RNA, 19 nt, Homo sapiens
gcauuuggccucauuuauc

SEQ ID NO: 1356541 - RNA, 19 nt, Homo sapiens
caagguccuguuaguaaua

SEQ ID NO: 1356542 - RNA, 19 nt, Homo sapiens
uacaagguccuguuaguaa

SEQ ID NO: 1356543 - RNA, 19 nt, Homo sapiens
acacuuaccguuuggcuaa

SEQ ID NO: 1356544 - RNA, 19 nt, Homo sapiens
acacuaaagcuuccagaaa

SEQ ID NO: 1356545 - RNA, 19 nt, Homo sapiens
uguaaacugucagaacuuu

SEQ ID NO: 1356546 - RNA, 19 nt, Homo sapiens
gggagaacacaucgaguuu

SEQ ID NO: 1356547 - RNA, 19 nt, Homo sapiens
gggacgauaugaagaagca

SEQ ID NO: 1356548 - RNA, 19 nt, Homo sapiens
cuucaggccagaaagauua

SEQ ID NO: 1356549 - RNA, 19 nt, Homo sapiens
gggaaacggcuagcaacua

SEQ ID NO: 1356550 - RNA, 19 nt, Homo sapiens
guccuggccuacucucuuu

SEQ ID NO: 1356551 - RNA, 19 nt, Homo sapiens
aguggaaccuggucuguga

SEQ ID NO: 1356552 - RNA, 19 nt, Homo sapiens
ugggagcucucaaggugua

SEQ ID NO: 1356553 - RNA, 19 nt, Homo sapiens
cacuaaagcuuccagaaac

SEQ ID NO: 1356554 - RNA, 19 nt, Homo sapiens
ucucaucucccauauguug

SEQ ID NO: 1356555 - RNA, 19 nt, Homo sapiens
cagcauuuggccucauuua

SEQ ID NO: 1356556 - RNA, 19 nt, Homo sapiens
ugaauucuguuaacuuagg

SEQ ID NO: 1356557 - RNA, 19 nt, Homo sapiens
cagcggcguuugcaguuga

SEQ ID NO: 1356558 - RNA, 19 nt, Homo sapiens
aaacuggagucagagaaug

SEQ ID NO: 1356559 - RNA, 19 nt, Homo sapiens
ggaggaggcugcaaaacug

SEQ ID NO: 1356560 - RNA, 19 nt, Homo sapiens
ggugacagcuaugguugga

SEQ ID NO: 1356561 - RNA, 19 nt, Homo sapiens
cuacaagguccuguuagua

SEQ ID NO: 1356562 - RNA, 19 nt, Homo sapiens
ggagaacacaucgaguuug

SEQ ID NO: 1356563 - RNA, 19 nt, Homo sapiens
cauuuggccucauuuaucu

SEQ ID NO: 1356564 - RNA, 19 nt, Homo sapiens
gaauucuguuaacuuagga

SEQ ID NO: 1356565 - RNA, 19 nt, Homo sapiens
ggaauaagagggagaacac

SEQ ID NO: 1356566 - RNA, 19 nt, Homo sapiens
uauuuacccuaaugccuuu

SEQ ID NO: 1356567 - RNA, 19 nt, Homo sapiens
gacaaggucgggaggagaa

SEQ ID NO: 1356568 - RNA, 19 nt, Homo sapiens
agaagcacaaccuaucaua

SEQ ID NO: 1356569 - RNA, 19 nt, Homo sapiens
uauaugaccagaacacaug

SEQ ID NO: 1356570 - RNA, 19 nt, Homo sapiens
cgaguuugggcuaugaaua

SEQ ID NO: 1356571 - RNA, 19 nt, Homo sapiens
caagguguagcaggaauaa

SEQ ID NO: 1356572 - RNA, 19 nt, Homo sapiens
ugaaagcaagucaagcaaa

SEQ ID NO: 1356573 - RNA, 19 nt, Homo sapiens
ggcagcauuuggccucauu

SEQ ID NO: 1356574 - RNA, 19 nt, Homo sapiens
cacaaccuaucauaucugu

SEQ ID NO: 1356575 - RNA, 19 nt, Homo sapiens
acaagguccuguuaguaau

SEQ ID NO: 1356576 - RNA, 19 nt, Homo sapiens
gcagcggcguuugcaguug

SEQ ID NO: 1356577 - RNA, 19 nt, Homo sapiens
caucgaguuugggcuauga

SEQ ID NO: 1356578 - RNA, 19 nt, Homo sapiens
cuaaucugguucacuggaa

SEQ ID NO: 1356579 - RNA, 19 nt, Homo sapiens
ccuacaagguccuguuagu

SEQ ID NO: 1356580 - RNA, 19 nt, Homo sapiens
uccauaaucacucuaauug

SEQ ID NO: 1356581 - RNA, 19 nt, Homo sapiens
auaccacaguuguuuguug

SEQ ID NO: 1356582 - RNA, 19 nt, Homo sapiens
uaacuggagcauuacgaaa

SEQ ID NO: 1356583 - RNA, 19 nt, Homo sapiens
ccuguaaacugucagaacu

SEQ ID NO: 1356584 - RNA, 19 nt, Homo sapiens
auucucaucucccauaugu

SEQ ID NO: 1356585 - RNA, 19 nt, Homo sapiens
ggauucuggucuuggugaa

SEQ ID NO: 1356586 - RNA, 19 nt, Homo sapiens
caaugugagucagguuguu

SEQ ID NO: 1356587 - RNA, 19 nt, Homo sapiens
gagaaugaaagcaagucaa

SEQ ID NO: 1356588 - RNA, 19 nt, Homo sapiens
gaucuucauaccacaguug

SEQ ID NO: 1356589 - RNA, 19 nt, Homo sapiens
gaccucagcagcauuugga

SEQ ID NO: 1356590 - RNA, 19 nt, Homo sapiens
ugagcuguauccaaccauu

SEQ ID NO: 1356591 - RNA, 19 nt, Homo sapiens
cuucauaccacaguuguuu

SEQ ID NO: 1356592 - RNA, 19 nt, Homo sapiens
ggccuguggugucguuaug

SEQ ID NO: 1356593 - RNA, 19 nt, Homo sapiens
ggcaagcuccuguaaacug

SEQ ID NO: 1356594 - RNA, 19 nt, Homo sapiens
ggcaugaagucucggacau

SEQ ID NO: 1356595 - RNA, 19 nt, Homo sapiens
gcauuuggaucuucauacc

SEQ ID NO: 1356596 - RNA, 19 nt, Homo sapiens
ccuccuggguguaguggaa

SEQ ID NO: 1356597 - RNA, 19 nt, Homo sapiens
gggcgucuguccauuugca

SEQ ID NO: 1356598 - RNA, 19 nt, Homo sapiens
gaccagaacacauggaaaa

SEQ ID NO: 1356599 - RNA, 19 nt, Homo sapiens
gaguuugggcuaugaauac

SEQ ID NO: 1356600 - RNA, 19 nt, Homo sapiens
gcaggaauaagagggagaa

SEQ ID NO: 1356601 - RNA, 19 nt, Homo sapiens
caucucccauauguuguuu

SEQ ID NO: 1356602 - RNA, 19 nt, Homo sapiens
ugccaugccugcugucuag

SEQ ID NO: 1356603 - RNA, 19 nt, Homo sapiens
aauaauagugggcuggaaa

SEQ ID NO: 1356604 - RNA, 19 nt, Homo sapiens
cagcagcauuuggaucuuc

SEQ ID NO: 1356605 - RNA, 19 nt, Homo sapiens
gcacaaccuaucauaucug

SEQ ID NO: 1356606 - RNA, 19 nt, Homo sapiens
aagcacaaccuaucauauc

SEQ ID NO: 1356607 - RNA, 19 nt, Homo sapiens
guucagaagcacaaccuau

SEQ ID NO: 1356608 - RNA, 19 nt, Homo sapiens
uggaauagcagcggcguuu

SEQ ID NO: 1356609 - RNA, 19 nt, Homo sapiens
ccaaagggcuggcagaaau

SEQ ID NO: 1356610 - RNA, 19 nt, Homo sapiens
ugagauagcuggucauugg

SEQ ID NO: 1356611 - RNA, 19 nt, Homo sapiens
guuaacagcuagccuccua

SEQ ID NO: 1356612 - RNA, 19 nt, Homo sapiens
ggagcucccuucccuaaug

SEQ ID NO: 1356613 - RNA, 19 nt, Homo sapiens
agacacaggcauuuaaaua

SEQ ID NO: 1356614 - RNA, 19 nt, Homo sapiens
ggaauccauugcuagcuuu

SEQ ID NO: 1356615 - RNA, 19 nt, Homo sapiens
ggacucugcagguggauua

SEQ ID NO: 1356616 - RNA, 19 nt, Homo sapiens
gcaaucagaguauaauguu

SEQ ID NO: 1356617 - RNA, 19 nt, Homo sapiens
uaagugccguuugcaauaa

SEQ ID NO: 1356618 - RNA, 19 nt, Homo sapiens
uaagugagcaaucagagua

SEQ ID NO: 1356619 - RNA, 19 nt, Homo sapiens
gccaggaucugagugauga

SEQ ID NO: 1356620 - RNA, 19 nt, Homo sapiens
gggaauccauugcuagcuu

SEQ ID NO: 1356621 - RNA, 19 nt, Homo sapiens
ggauggcacucaugaccuu

SEQ ID NO: 1356622 - RNA, 19 nt, Homo sapiens
uuacuuugcuacacaggua

SEQ ID NO: 1356623 - RNA, 19 nt, Homo sapiens
guguuggugucuaauauuu

SEQ ID NO: 1356624 - RNA, 19 nt, Homo sapiens
gaucauugccagaaucuuc

SEQ ID NO: 1356625 - RNA, 19 nt, Homo sapiens
gacacaggcauuuaaauau

SEQ ID NO: 1356626 - RNA, 19 nt, Homo sapiens
gcacucgagcagucuauuu

SEQ ID NO: 1356627 - RNA, 19 nt, Homo sapiens
agaagggaauccauugcua

SEQ ID NO: 1356628 - RNA, 19 nt, Homo sapiens
uaaacucagucaccugguu

SEQ ID NO: 1356629 - RNA, 19 nt, Homo sapiens
uugcaauaaugucgucuua

SEQ ID NO: 1356630 - RNA, 19 nt, Homo sapiens
agagcgacuuggccaaaua

SEQ ID NO: 1356631 - RNA, 19 nt, Homo sapiens
ucacagagacacaggcauu

SEQ ID NO: 1356632 - RNA, 19 nt, Homo sapiens
ggucuucucucuggucaug

SEQ ID NO: 1356633 - RNA, 19 nt, Homo sapiens
uaacaaaguagaagggaau

SEQ ID NO: 1356634 - RNA, 19 nt, Homo sapiens
caaauacucagcguagaaa

SEQ ID NO: 1356635 - RNA, 19 nt, Homo sapiens
ccaaauacucagcguagaa

SEQ ID NO: 1356636 - RNA, 19 nt, Homo sapiens
cgacuuggccaaauacuca

SEQ ID NO: 1356637 - RNA, 19 nt, Homo sapiens
uuaagugccguuugcaaua

SEQ ID NO: 1356638 - RNA, 19 nt, Homo sapiens
cagagacacaggcauuuaa

SEQ ID NO: 1356639 - RNA, 19 nt, Homo sapiens
gagccgagacgaagcaguu

SEQ ID NO: 1356640 - RNA, 19 nt, Homo sapiens
caugggauuugaacauaug

SEQ ID NO: 1356641 - RNA, 19 nt, Homo sapiens
gcaugggaguuucuaggau

SEQ ID NO: 1356642 - RNA, 19 nt, Homo sapiens
ccgcaggcaucaccuaugu

SEQ ID NO: 1356643 - RNA, 19 nt, Homo sapiens
gcagcuucguuuaauguag

SEQ ID NO: 1356644 - RNA, 19 nt, Homo sapiens
uggaggcccugcucucuga

SEQ ID NO: 1356645 - RNA, 19 nt, Homo sapiens
uaaccugcagcuucguuua

SEQ ID NO: 1356646 - RNA, 19 nt, Homo sapiens
uccaugggauuugaacaua

SEQ ID NO: 1356647 - RNA, 19 nt, Homo sapiens
cccaggaccuuggaaauuc

SEQ ID NO: 1356648 - RNA, 19 nt, Homo sapiens
ccaugggauuugaacauau

SEQ ID NO: 1356649 - RNA, 19 nt, Homo sapiens
gcugaucauugccagaauc

SEQ ID NO: 1356650 - RNA, 19 nt, Homo sapiens
ccauuuacuuugcuacaca

SEQ ID NO: 1356651 - RNA, 19 nt, Homo sapiens
acagagacacaggcauuua

SEQ ID NO: 1356652 - RNA, 19 nt, Homo sapiens
agggaggucuuaucucuca

SEQ ID NO: 1356653 - RNA, 19 nt, Homo sapiens
uuugggagcugaauaaacu

SEQ ID NO: 1356654 - RNA, 19 nt, Homo sapiens
gucuaugccuucaugauca

SEQ ID NO: 1356655 - RNA, 19 nt, Homo sapiens
ucauugggcugaucauugc

SEQ ID NO: 1356656 - RNA, 19 nt, Homo sapiens
gagcaugggcugagaagcu

SEQ ID NO: 1356657 - RNA, 19 nt, Homo sapiens
cccaaaugauaauuccaaa

SEQ ID NO: 1356658 - RNA, 19 nt, Homo sapiens
ccggaaagcccagcucuug

SEQ ID NO: 1356659 - RNA, 19 nt, Homo sapiens
gagcucccuucccuaaugg

SEQ ID NO: 1356660 - RNA, 19 nt, Homo sapiens
guagaggagaaguucauga

SEQ ID NO: 1356661 - RNA, 19 nt, Homo sapiens
gagcaaucagaguauaaug

SEQ ID NO: 1356662 - RNA, 19 nt, Homo sapiens
gauaauuccaaaugcuguu

SEQ ID NO: 1356663 - RNA, 19 nt, Homo sapiens
aaauucuacucaucccaaa

SEQ ID NO: 1356664 - RNA, 19 nt, Homo sapiens
ggucaaccugcuaaccuuu

SEQ ID NO: 1356665 - RNA, 19 nt, Homo sapiens
gagacacaggcauuuaaau

SEQ ID NO: 1356666 - RNA, 19 nt, Homo sapiens
gcugauuccuaggcaguug

SEQ ID NO: 1356667 - RNA, 19 nt, Homo sapiens
gcagcuggauggcacucau

SEQ ID NO: 1356668 - RNA, 19 nt, Homo sapiens
ggaccagaagcacaaagug

SEQ ID NO: 1356669 - RNA, 19 nt, Homo sapiens
guuggugucuaauauuugg

SEQ ID NO: 1356670 - RNA, 19 nt, Homo sapiens
cagguaguauuugacaaga

SEQ ID NO: 1356671 - RNA, 19 nt, Homo sapiens
caaagggcuggcagaaaug

SEQ ID NO: 1356672 - RNA, 19 nt, Homo sapiens
gugagcaaucagaguauaa

SEQ ID NO: 1356673 - RNA, 19 nt, Homo sapiens
gggcugaucauugccagaa

SEQ ID NO: 1356674 - RNA, 19 nt, Homo sapiens
gccaaauacucagcguaga

SEQ ID NO: 1356675 - RNA, 19 nt, Homo sapiens
ggaaagcccagcucuugcu

SEQ ID NO: 1356676 - RNA, 19 nt, Homo sapiens
ucuggucgccauuuacuuu

SEQ ID NO: 1356677 - RNA, 19 nt, Homo sapiens
ugggucuggucgccauuua

SEQ ID NO: 1356678 - RNA, 19 nt, Homo sapiens
cagcucagccagucuguca

SEQ ID NO: 1356679 - RNA, 19 nt, Homo sapiens
uaacccaggaccuuggaaa

SEQ ID NO: 1356680 - RNA, 19 nt, Homo sapiens
gucauugggcugaucauug

SEQ ID NO: 1356681 - RNA, 19 nt, Homo sapiens
ggaugaaacacuccuccau

SEQ ID NO: 1356682 - RNA, 19 nt, Homo sapiens
gcucuugcaugggaguuuc

SEQ ID NO: 1356683 - RNA, 19 nt, Homo sapiens
agguguuccugcccaaaua

SEQ ID NO: 1356684 - RNA, 19 nt, Homo sapiens
ccggagacacuaugaugaa

SEQ ID NO: 1356685 - RNA, 19 nt, Homo sapiens
uuucuguguuggugucuaa

SEQ ID NO: 1356686 - RNA, 19 nt, Homo sapiens
agagacacaggcauuuaaa

SEQ ID NO: 1356687 - RNA, 19 nt, Homo sapiens
agugagcaaucagaguaua

SEQ ID NO: 1356688 - RNA, 19 nt, Homo sapiens
gggaaucucacacagaaac

SEQ ID NO: 1356689 - RNA, 19 nt, Homo sapiens
gaaaacuuccagcacauug

SEQ ID NO: 1356690 - RNA, 19 nt, Homo sapiens
gcccggagacacuaugaug

SEQ ID NO: 1356691 - RNA, 19 nt, Homo sapiens
ccaggaccuuggaaauucu

SEQ ID NO: 1356692 - RNA, 19 nt, Homo sapiens
gggcaacacacaagaacca

SEQ ID NO: 1356693 - RNA, 19 nt, Homo sapiens
ggauuugaacauaugacuu

SEQ ID NO: 1356694 - RNA, 19 nt, Homo sapiens
ggagcagagccgagacgaa

SEQ ID NO: 1356695 - RNA, 19 nt, Homo sapiens
gcagagccgagacgaagca

SEQ ID NO: 1356696 - RNA, 19 nt, Homo sapiens
ggguuuaagugccguuugc

SEQ ID NO: 1356697 - RNA, 19 nt, Homo sapiens
ggcucaggguuaacagcua

SEQ ID NO: 1356698 - RNA, 19 nt, Homo sapiens
ccugcucucugaccucuuc

SEQ ID NO: 1356699 - RNA, 19 nt, Homo sapiens
guaagugagcaaucagagu

SEQ ID NO: 1356700 - RNA, 19 nt, Homo sapiens
ccugguuucccaucucuaa

SEQ ID NO: 1356701 - RNA, 19 nt, Homo sapiens
guugagacacaccuagaga

SEQ ID NO: 1356702 - RNA, 19 nt, Homo sapiens
gucugucacugccuauaug

SEQ ID NO: 1356703 - RNA, 19 nt, Homo sapiens
ggucauugggcugaucauu

SEQ ID NO: 1356704 - RNA, 19 nt, Homo sapiens
caaaguagaagggaaucca

SEQ ID NO: 1356705 - RNA, 19 nt, Homo sapiens
acacagguaguauuugaca

SEQ ID NO: 1356706 - RNA, 19 nt, Homo sapiens
gaagcuggaccggcaccaa

SEQ ID NO: 1356707 - RNA, 19 nt, Homo sapiens
aggagaaguucaugaccau

SEQ ID NO: 1356708 - RNA, 19 nt, Homo sapiens
cuguguuggugucuaauau

SEQ ID NO: 1356709 - RNA, 19 nt, Homo sapiens
caagaaaccucuaggaauu

SEQ ID NO: 1356710 - RNA, 19 nt, Homo sapiens
gaagauggcuauuuauaug

SEQ ID NO: 1356711 - RNA, 19 nt, Homo sapiens
gcaagagguugacauuaua

SEQ ID NO: 1356712 - RNA, 19 nt, Homo sapiens
gaaggaaaguaaccaagaa

SEQ ID NO: 1356713 - RNA, 19 nt, Homo sapiens
ucagaggacuguaaugaua

SEQ ID NO: 1356714 - RNA, 19 nt, Homo sapiens
caucauccaugcauaauaa

SEQ ID NO: 1356715 - RNA, 19 nt, Homo sapiens
ggaaggagauuauauuguc

SEQ ID NO: 1356716 - RNA, 19 nt, Homo sapiens
gaagaacgacggcuacuuu

SEQ ID NO: 1356717 - RNA, 19 nt, Homo sapiens
ccaaagugcugcuuccuaa

SEQ ID NO: 1356718 - RNA, 19 nt, Homo sapiens
cuaauaagguucacuguug

SEQ ID NO: 1356719 - RNA, 19 nt, Homo sapiens
cagugaagauggcuauuua

SEQ ID NO: 1356720 - RNA, 19 nt, Homo sapiens
ggaguaaauugcagaauca

SEQ ID NO: 1356721 - RNA, 19 nt, Homo sapiens
ggacuguaaugauagaauu

SEQ ID NO: 1356722 - RNA, 19 nt, Homo sapiens
gcauugaggugcuacagaa

SEQ ID NO: 1356723 - RNA, 19 nt, Homo sapiens
caagaaagcguguuugaga

SEQ ID NO: 1356724 - RNA, 19 nt, Homo sapiens
aaagacacauuuacccaua

SEQ ID NO: 1356725 - RNA, 19 nt, Homo sapiens
gaaaguggccacaaacuca

SEQ ID NO: 1356726 - RNA, 19 nt, Homo sapiens
gaacacagaggaggcauuu

SEQ ID NO: 1356727 - RNA, 19 nt, Homo sapiens
caagguagauaauauacug

SEQ ID NO: 1356728 - RNA, 19 nt, Homo sapiens
ccaaauagcugggacuaca

SEQ ID NO: 1356729 - RNA, 19 nt, Homo sapiens
gaauaguguugaagauaug

SEQ ID NO: 1356730 - RNA, 19 nt, Homo sapiens
ccauucagcuuguggauug

SEQ ID NO: 1356731 - RNA, 19 nt, Homo sapiens
gcaagaagcugcggagcau

SEQ ID NO: 1356732 - RNA, 19 nt, Homo sapiens
ggccaugcuuguauacaua

SEQ ID NO: 1356733 - RNA, 19 nt, Homo sapiens
gaugacaccgugaaucuaa

SEQ ID NO: 1356734 - RNA, 19 nt, Homo sapiens
gaggaggcauuuacgauuc

SEQ ID NO: 1356735 - RNA, 19 nt, Homo sapiens
ccacaaccgucccacuauu

SEQ ID NO: 1356736 - RNA, 19 nt, Homo sapiens
guacuaaugugaggaaaca

SEQ ID NO: 1356737 - RNA, 19 nt, Homo sapiens
ugacauuccuacugauuga

SEQ ID NO: 1356738 - RNA, 19 nt, Homo sapiens
ccgcagggguuuuaaauua

SEQ ID NO: 1356739 - RNA, 19 nt, Homo sapiens
gugaagauggcuauuuaua

SEQ ID NO: 1356740 - RNA, 19 nt, Homo sapiens
uaauaagguucacuguuga

SEQ ID NO: 1356741 - RNA, 19 nt, Homo sapiens
uggaacugcugaugacaua

SEQ ID NO: 1356742 - RNA, 19 nt, Homo sapiens
agacaguucuugguacuaa

SEQ ID NO: 1356743 - RNA, 19 nt, Homo sapiens
ggccucaggucaagaagaa

SEQ ID NO: 1356744 - RNA, 19 nt, Homo sapiens
gauagcgucuugcuguguu

SEQ ID NO: 1356745 - RNA, 19 nt, Homo sapiens
uaaccuagaauucagauga

SEQ ID NO: 1356746 - RNA, 19 nt, Homo sapiens
gagcaagagguugacauua

SEQ ID NO: 1356747 - RNA, 19 nt, Homo sapiens
gaaggccaguguccuguuc

SEQ ID NO: 1356748 - RNA, 19 nt, Homo sapiens
cuaucuaucuguucucaaa

SEQ ID NO: 1356749 - RNA, 19 nt, Homo sapiens
gcuuagccauugaugauga

SEQ ID NO: 1356750 - RNA, 19 nt, Homo sapiens
gaugaaauugcagaucuua

SEQ ID NO: 1356751 - RNA, 19 nt, Homo sapiens
uaccucagccucccaaaua

SEQ ID NO: 1356752 - RNA, 19 nt, Homo sapiens
aaagugcugcuuccuaaua

SEQ ID NO: 1356753 - RNA, 19 nt, Homo sapiens
cagaugauccuggaauuaa

SEQ ID NO: 1356754 - RNA, 19 nt, Homo sapiens
ccacaucauccaugcauaa

SEQ ID NO: 1356755 - RNA, 19 nt, Homo sapiens
ggucagaggacuguaauga

SEQ ID NO: 1356756 - RNA, 19 nt, Homo sapiens
cuuaaacguuugugccaua

SEQ ID NO: 1356757 - RNA, 19 nt, Homo sapiens
ccaagaaaccucuaggaau

SEQ ID NO: 1356758 - RNA, 19 nt, Homo sapiens
aaacguuugugccauaaug

SEQ ID NO: 1356759 - RNA, 19 nt, Homo sapiens
gaaauccugaccucaaaug

SEQ ID NO: 1356760 - RNA, 19 nt, Homo sapiens
ggagugcaguggugugauc

SEQ ID NO: 1356761 - RNA, 19 nt, Homo sapiens
ugaagaugcugucuacaag

SEQ ID NO: 1356762 - RNA, 19 nt, Homo sapiens
auaauaagagugccacaua

SEQ ID NO: 1356763 - RNA, 19 nt, Homo sapiens
agcaagagguugacauuau

SEQ ID NO: 1356764 - RNA, 19 nt, Homo sapiens
gaacauuacagugaagaug

SEQ ID NO: 1356765 - RNA, 19 nt, Homo sapiens
ccaaagugcugggauuaca

SEQ ID NO: 1356766 - RNA, 19 nt, Homo sapiens
aaagucuagugccaaauuu

SEQ ID NO: 1356767 - RNA, 19 nt, Homo sapiens
ccaagaaaaucuccaagaa

SEQ ID NO: 1356768 - RNA, 19 nt, Homo sapiens
gaaggagauuauauugucu

SEQ ID NO: 1356769 - RNA, 19 nt, Homo sapiens
guacaaguuacauagcuaa

SEQ ID NO: 1356770 - RNA, 19 nt, Homo sapiens
ucgaaauccugaccucaaa

SEQ ID NO: 1356771 - RNA, 19 nt, Homo sapiens
ggcuaauaaucauuccuua

SEQ ID NO: 1356772 - RNA, 19 nt, Homo sapiens
aagaaagcguguuugagaa

SEQ ID NO: 1356773 - RNA, 19 nt, Homo sapiens
cauauucauuuacccgaaa

SEQ ID NO: 1356774 - RNA, 19 nt, Homo sapiens
cuagggccaugcuuguaua

SEQ ID NO: 1356775 - RNA, 19 nt, Homo sapiens
acauagcauugaagacuaa

SEQ ID NO: 1356776 - RNA, 19 nt, Homo sapiens
guuuaaagcucuauuugac

SEQ ID NO: 1356777 - RNA, 19 nt, Homo sapiens
gugccaaauuugucuuauu

SEQ ID NO: 1356778 - RNA, 19 nt, Homo sapiens
aaacugagcaagagguuga

SEQ ID NO: 1356779 - RNA, 19 nt, Homo sapiens
guaaauugcagaaucaaag

SEQ ID NO: 1356780 - RNA, 19 nt, Homo sapiens
gcaggucagaggacuguaa

SEQ ID NO: 1356781 - RNA, 19 nt, Homo sapiens
guaguuguuuccagguuug

SEQ ID NO: 1356782 - RNA, 19 nt, Homo sapiens
uggccacacugaagaauga

SEQ ID NO: 1356783 - RNA, 19 nt, Homo sapiens
gcagaugggacuccuguuc

SEQ ID NO: 1356784 - RNA, 19 nt, Homo sapiens
guugacacaguacaaguua

SEQ ID NO: 1356785 - RNA, 19 nt, Homo sapiens
gaaauugcagaucuuaugg

SEQ ID NO: 1356786 - RNA, 19 nt, Homo sapiens
ugaaauugcagaucuuaug

SEQ ID NO: 1356787 - RNA, 19 nt, Homo sapiens
ugagugagguuaugaagcu

SEQ ID NO: 1356788 - RNA, 19 nt, Homo sapiens
cggaguaaauugcagaauc

SEQ ID NO: 1356789 - RNA, 19 nt, Homo sapiens
ucagaugauccuggaauua

SEQ ID NO: 1356790 - RNA, 19 nt, Homo sapiens
aaucauuccuuaaccuaga

SEQ ID NO: 1356791 - RNA, 19 nt, Homo sapiens
uaauaagagugccacauac

SEQ ID NO: 1356792 - RNA, 19 nt, Homo sapiens
uuaugaagcugcugaagag

SEQ ID NO: 1356793 - RNA, 19 nt, Homo sapiens
uacauagcauugaagacua

SEQ ID NO: 1356794 - RNA, 19 nt, Homo sapiens
gguuuaaagcucuauuuga

SEQ ID NO: 1356795 - RNA, 19 nt, Homo sapiens
ggaauuaaggcaggucaga

SEQ ID NO: 1356796 - RNA, 19 nt, Homo sapiens
gacucggccuuaaacguuu

SEQ ID NO: 1356797 - RNA, 19 nt, Homo sapiens
cagcuuagccugcgugaag

SEQ ID NO: 1356798 - RNA, 19 nt, Homo sapiens
gggccaugcuuguauacau

SEQ ID NO: 1356799 - RNA, 19 nt, Homo sapiens
ccaggcggguuucgaaauc

SEQ ID NO: 1356800 - RNA, 19 nt, Homo sapiens
ggaucaagcgauucuccua

SEQ ID NO: 1356801 - RNA, 19 nt, Homo sapiens
gggguuaccuauaucagua

SEQ ID NO: 1356802 - RNA, 19 nt, Homo sapiens
ugacucggccuuaaacguu

SEQ ID NO: 1356803 - RNA, 19 nt, Homo sapiens
ugacaccgugaaucuaaua

SEQ ID NO: 1356804 - RNA, 19 nt, Homo sapiens
ggugugaucucagcucagu

SEQ ID NO: 1356805 - RNA, 19 nt, Homo sapiens
acuauacugcuguaaguua

SEQ ID NO: 1356806 - RNA, 19 nt, Homo sapiens
uuugagguguguuacuaua

SEQ ID NO: 1356807 - RNA, 19 nt, Homo sapiens
ugaaggaaaguaaccaaga

SEQ ID NO: 1356808 - RNA, 19 nt, Homo sapiens
ugggagaggucuaccaaca

SEQ ID NO: 1356809 - RNA, 19 nt, Homo sapiens
aaagagcgcccaauacaua

SEQ ID NO: 1356810 - RNA, 19 nt, Homo sapiens
ggaauaagcagaguuaaga

SEQ ID NO: 1356811 - RNA, 19 nt, Homo sapiens
ggacgauacauuagaauuu

SEQ ID NO: 1356812 - RNA, 19 nt, Homo sapiens
gacaggaaguuugccaaua

SEQ ID NO: 1356813 - RNA, 19 nt, Homo sapiens
gccaaucgcuggaggauag

SEQ ID NO: 1356814 - RNA, 19 nt, Homo sapiens
gacugaagaugaggaaauu

SEQ ID NO: 1356815 - RNA, 19 nt, Homo sapiens
gaacaggaauaagcagagu

SEQ ID NO: 1356816 - RNA, 19 nt, Homo sapiens
gcagugaucggaagaaaca

SEQ ID NO: 1356817 - RNA, 19 nt, Homo sapiens
caaaugugguguucacucu

SEQ ID NO: 1356818 - RNA, 19 nt, Homo sapiens
ggucuaauuagcccuauuu

SEQ ID NO: 1356819 - RNA, 19 nt, Homo sapiens
acaggaaguuugccaauag

SEQ ID NO: 1356820 - RNA, 19 nt, Homo sapiens
gagacaaacccgugacuca

SEQ ID NO: 1356821 - RNA, 19 nt, Homo sapiens
cugaagaugaggaaauuua

SEQ ID NO: 1356822 - RNA, 19 nt, Homo sapiens
acaggaauaagcagaguua

SEQ ID NO: 1356823 - RNA, 19 nt, Homo sapiens
ccucugagacugaagauga

SEQ ID NO: 1356824 - RNA, 19 nt, Homo sapiens
gaaccaccucugagacuga

SEQ ID NO: 1356825 - RNA, 19 nt, Homo sapiens
ccacaagcguacucauaca

SEQ ID NO: 1356826 - RNA, 19 nt, Homo sapiens
ccaaauacaagcucaucaa

SEQ ID NO: 1356827 - RNA, 19 nt, Homo sapiens
gcaacggaaccaccucuga

SEQ ID NO: 1356828 - RNA, 19 nt, Homo sapiens
aauacaagcucaucaacca

SEQ ID NO: 1356829 - RNA, 19 nt, Homo sapiens
ugcacgagcuggugaauca

SEQ ID NO: 1356830 - RNA, 19 nt, Homo sapiens
uuaaagagcgcccaauaca

SEQ ID NO: 1356831 - RNA, 19 nt, Homo sapiens
guuaagaggccaggacaaa

SEQ ID NO: 1356832 - RNA, 19 nt, Homo sapiens
ugaggaagcacaugaagau

SEQ ID NO: 1356833 - RNA, 19 nt, Homo sapiens
cuaugggccugauugugua

SEQ ID NO: 1356834 - RNA, 19 nt, Homo sapiens
gacaaacccgugacucaga

SEQ ID NO: 1356835 - RNA, 19 nt, Homo sapiens
uaugaaacccuaugguguu

SEQ ID NO: 1356836 - RNA, 19 nt, Homo sapiens
gauucgaggcugugacaaa

SEQ ID NO: 1356837 - RNA, 19 nt, Homo sapiens
gcucaaaugugguguucac

SEQ ID NO: 1356838 - RNA, 19 nt, Homo sapiens
uagcagugaucggaagaaa

SEQ ID NO: 1356839 - RNA, 19 nt, Homo sapiens
ucacgcggcucccuccaau

SEQ ID NO: 1356840 - RNA, 19 nt, Homo sapiens
uccagccgcuucagaauau

SEQ ID NO: 1356841 - RNA, 19 nt, Homo sapiens
gaaguugugcggacgauac

SEQ ID NO: 1356842 - RNA, 19 nt, Homo sapiens
ccacugugcagcucaaaug

SEQ ID NO: 1356843 - RNA, 19 nt, Homo sapiens
cuaugguguuuguacauuu

SEQ ID NO: 1356844 - RNA, 19 nt, Homo sapiens
cauccuaaccugagacaau

SEQ ID NO: 1356845 - RNA, 19 nt, Homo sapiens
ccagugacaagcccuacua

SEQ ID NO: 1356846 - RNA, 19 nt, Homo sapiens
ggacaaaagaaguuaaaga

SEQ ID NO: 1356847 - RNA, 19 nt, Homo sapiens
ccuaugguguuuguacauu

SEQ ID NO: 1356848 - RNA, 19 nt, Homo sapiens
cgggaacccugaaguugug

SEQ ID NO: 1356849 - RNA, 19 nt, Homo sapiens
ucaaugagugguacguuug

SEQ ID NO: 1356850 - RNA, 19 nt, Homo sapiens
guccagccgcuucagaaua

SEQ ID NO: 1356851 - RNA, 19 nt, Homo sapiens
gauagagugggaacaggaa

SEQ ID NO: 1356852 - RNA, 19 nt, Homo sapiens
ccgagaaccucaagaucca

SEQ ID NO: 1356853 - RNA, 19 nt, Homo sapiens
gugacaagcccuacuacug

SEQ ID NO: 1356854 - RNA, 19 nt, Homo sapiens
gccaagcccugcuccaaaa

SEQ ID NO: 1356855 - RNA, 19 nt, Homo sapiens
gggcagagggaauaaaguc

SEQ ID NO: 1356856 - RNA, 19 nt, Homo sapiens
cagcucaaaugugguguuc

SEQ ID NO: 1356857 - RNA, 19 nt, Homo sapiens
gguguucacucugccaauc

SEQ ID NO: 1356858 - RNA, 19 nt, Homo sapiens
gcccuacuacugcaagauu

SEQ ID NO: 1356859 - RNA, 19 nt, Homo sapiens
uagagugggaacaggaaua

SEQ ID NO: 1356860 - RNA, 19 nt, Homo sapiens
uaaagagcgcccaauacau

SEQ ID NO: 1356861 - RNA, 19 nt, Homo sapiens
cccuauuuauucaguauga

SEQ ID NO: 1356862 - RNA, 19 nt, Homo sapiens
caagcucccugaggaagca

SEQ ID NO: 1356863 - RNA, 19 nt, Homo sapiens
ucuaugggccugauugugu

SEQ ID NO: 1356864 - RNA, 19 nt, Homo sapiens
gacaaugccgagccugaga

SEQ ID NO: 1356865 - RNA, 19 nt, Homo sapiens
gaauaagcagaguuaagag

SEQ ID NO: 1356866 - RNA, 19 nt, Homo sapiens
agacugaagaugaggaaau

SEQ ID NO: 1356867 - RNA, 19 nt, Homo sapiens
gaggaagcacaugaagauu

SEQ ID NO: 1356868 - RNA, 19 nt, Homo sapiens
gcuccgagaaccucaagau

SEQ ID NO: 1356869 - RNA, 19 nt, Homo sapiens
guuaaagagcgcccaauac

SEQ ID NO: 1356870 - RNA, 19 nt, Homo sapiens
aguuaaagagcgcccaaua

SEQ ID NO: 1356871 - RNA, 19 nt, Homo sapiens
caaauacaagcucaucaac

SEQ ID NO: 1356872 - RNA, 19 nt, Homo sapiens
uuacgggaacccugaaguu

SEQ ID NO: 1356873 - RNA, 19 nt, Homo sapiens
agagugggaacaggaauaa

SEQ ID NO: 1356874 - RNA, 19 nt, Homo sapiens
gugcggacgauacauuaga

SEQ ID NO: 1356875 - RNA, 19 nt, Homo sapiens
gcaagauucgaggcuguga

SEQ ID NO: 1356876 - RNA, 19 nt, Homo sapiens
ugacaggaaguuugccaau

SEQ ID NO: 1356877 - RNA, 19 nt, Homo sapiens
ugcggacgauacauuagaa

SEQ ID NO: 1356878 - RNA, 19 nt, Homo sapiens
gaagaugaggaaauuuacg

SEQ ID NO: 1356879 - RNA, 19 nt, Homo sapiens
gaaccucaagauccacaag

SEQ ID NO: 1356880 - RNA, 19 nt, Homo sapiens
cggacgauacauuagaauu

SEQ ID NO: 1356881 - RNA, 19 nt, Homo sapiens
guugugcggacgauacauu

SEQ ID NO: 1356882 - RNA, 19 nt, Homo sapiens
gaauuugauggcugugaca

SEQ ID NO: 1356883 - RNA, 19 nt, Homo sapiens
cgccaagcccugcuccaaa

SEQ ID NO: 1356884 - RNA, 19 nt, Homo sapiens
ggagagaagucgcucauua

SEQ ID NO: 1356885 - RNA, 19 nt, Homo sapiens
ccaaggaaaucuucaguua

SEQ ID NO: 1356886 - RNA, 19 nt, Homo sapiens
gaggaacaguuuauacuua

SEQ ID NO: 1356887 - RNA, 19 nt, Homo sapiens
gaugaaacccuuaucaaua

SEQ ID NO: 1356888 - RNA, 19 nt, Homo sapiens
gaagaagagucccuuauca

SEQ ID NO: 1356889 - RNA, 19 nt, Homo sapiens
ggaggagguuuccaucuua

SEQ ID NO: 1356890 - RNA, 19 nt, Homo sapiens
gaagagucccuuaucaaua

SEQ ID NO: 1356891 - RNA, 19 nt, Homo sapiens
ggaaccaucugcauugaaa

SEQ ID NO: 1356892 - RNA, 19 nt, Homo sapiens
ggaauucucucaggaacua

SEQ ID NO: 1356893 - RNA, 19 nt, Homo sapiens
gaacacacaugcucuugga

SEQ ID NO: 1356894 - RNA, 19 nt, Homo sapiens
gggaggauaugccacuuua

SEQ ID NO: 1356895 - RNA, 19 nt, Homo sapiens
gggcuaagcaugcauguua

SEQ ID NO: 1356896 - RNA, 19 nt, Homo sapiens
ugaacaaacugcugacuuu

SEQ ID NO: 1356897 - RNA, 19 nt, Homo sapiens
caagagaagcccagcauua

SEQ ID NO: 1356898 - RNA, 19 nt, Homo sapiens
gaagcucacuuuaaggaaa

SEQ ID NO: 1356899 - RNA, 19 nt, Homo sapiens
gaagauaugauaacucuga

SEQ ID NO: 1356900 - RNA, 19 nt, Homo sapiens
gaaagagacccuccucaaa

SEQ ID NO: 1356901 - RNA, 19 nt, Homo sapiens
gaaagaagccaauaaagag

SEQ ID NO: 1356902 - RNA, 19 nt, Homo sapiens
gaacgcagccuuugaauac

SEQ ID NO: 1356903 - RNA, 19 nt, Homo sapiens
gaggaggagucauucuaua

SEQ ID NO: 1356904 - RNA, 19 nt, Homo sapiens
acaaagaaguguaccauug

SEQ ID NO: 1356905 - RNA, 19 nt, Homo sapiens
caagaagacauuauccuua

SEQ ID NO: 1356906 - RNA, 19 nt, Homo sapiens
gaagacaccuuucucaaaa

SEQ ID NO: 1356907 - RNA, 19 nt, Homo sapiens
ggaagacaccuuucucaaa

SEQ ID NO: 1356908 - RNA, 19 nt, Homo sapiens
aaagaggauucccuuguua

SEQ ID NO: 1356909 - RNA, 19 nt, Homo sapiens
ggaggcaucucucuucaga

SEQ ID NO: 1356910 - RNA, 19 nt, Homo sapiens
ccaagaagauaaacaggaa

SEQ ID NO: 1356911 - RNA, 19 nt, Homo sapiens
uaaagaggauucccuuguu

SEQ ID NO: 1356912 - RNA, 19 nt, Homo sapiens
ggaagucacaccaguagua

SEQ ID NO: 1356913 - RNA, 19 nt, Homo sapiens
caagaaagaagccaauaaa

SEQ ID NO: 1356914 - RNA, 19 nt, Homo sapiens
ugaaugagaccaucaauga

SEQ ID NO: 1356915 - RNA, 19 nt, Homo sapiens
ggaagagcccuacaacuga

SEQ ID NO: 1356916 - RNA, 19 nt, Homo sapiens
ggauuacaguuucuucuga

SEQ ID NO: 1356917 - RNA, 19 nt, Homo sapiens
ggacagcagugauccaagu

SEQ ID NO: 1356918 - RNA, 19 nt, Homo sapiens
gcagaagaccaacuuuaaa

SEQ ID NO: 1356919 - RNA, 19 nt, Homo sapiens
ggaagacaccuuucuggaa

SEQ ID NO: 1356920 - RNA, 19 nt, Homo sapiens
ugacagugaugaugcguuu

SEQ ID NO: 1356921 - RNA, 19 nt, Homo sapiens
gcuagcugcugccuccuua

SEQ ID NO: 1356922 - RNA, 19 nt, Homo sapiens
ugaagaacuuguuggcuuu

SEQ ID NO: 1356923 - RNA, 19 nt, Homo sapiens
caacucaccucguguggau

SEQ ID NO: 1356924 - RNA, 19 nt, Homo sapiens
ugaaucugcuucugauaaa

SEQ ID NO: 1356925 - RNA, 19 nt, Homo sapiens
gaggagucauucuauaaga

SEQ ID NO: 1356926 - RNA, 19 nt, Homo sapiens
caacugaggagucaccuuu

SEQ ID NO: 1356927 - RNA, 19 nt, Homo sapiens
gaggagguuuccaucuuaa

SEQ ID NO: 1356928 - RNA, 19 nt, Homo sapiens
gaagauaugauagcucuga

SEQ ID NO: 1356929 - RNA, 19 nt, Homo sapiens
acacagaagcucacuuuaa

SEQ ID NO: 1356930 - RNA, 19 nt, Homo sapiens
acacagaagcucacuuuaa

SEQ ID NO: 1356931 - RNA, 19 nt, Homo sapiens
aagaagcuguugcccuuua

SEQ ID NO: 1356932 - RNA, 19 nt, Homo sapiens
gaaaagccaucuacugaga

SEQ ID NO: 1356933 - RNA, 19 nt, Homo sapiens
gaagaucucacuaaugcuu

SEQ ID NO: 1356934 - RNA, 19 nt, Homo sapiens
ccaaaccugugccuaagaa

SEQ ID NO: 1356935 - RNA, 19 nt, Homo sapiens
guggaucucuaccuaauga

SEQ ID NO: 1356936 - RNA, 19 nt, Homo sapiens
agacgcagcugaaucucua

SEQ ID NO: 1356937 - RNA, 19 nt, Homo sapiens
acagagaaguccagcauug

SEQ ID NO: 1356938 - RNA, 19 nt, Homo sapiens
ugauaacucugaaugagaa

SEQ ID NO: 1356939 - RNA, 19 nt, Homo sapiens
caaagaaguguaccauuga

SEQ ID NO: 1356940 - RNA, 19 nt, Homo sapiens
gcaaucaugaugccaguaa

SEQ ID NO: 1356941 - RNA, 19 nt, Homo sapiens
uuaagaagccuaccacuga

SEQ ID NO: 1356942 - RNA, 19 nt, Homo sapiens
gcaagaaggauaaguuaca

SEQ ID NO: 1356943 - RNA, 19 nt, Homo sapiens
gagaagcccagcauuaaga

SEQ ID NO: 1356944 - RNA, 19 nt, Homo sapiens
ccacaaacauacagacaca

SEQ ID NO: 1356945 - RNA, 19 nt, Homo sapiens
ggagaugucccacuuaaag

SEQ ID NO: 1356946 - RNA, 19 nt, Homo sapiens
ugaagaagcucggauacug

SEQ ID NO: 1356947 - RNA, 19 nt, Homo sapiens
caagaaggauaaguuacaa

SEQ ID NO: 1356948 - RNA, 19 nt, Homo sapiens
cacagaagcucacuuuaag

SEQ ID NO: 1356949 - RNA, 19 nt, Homo sapiens
cacagaagcucacuuuaag

SEQ ID NO: 1356950 - RNA, 19 nt, Homo sapiens
ccaagaagccuuuaauuuu

SEQ ID NO: 1356951 - RNA, 19 nt, Homo sapiens
agaaagaagccaauaaaga

SEQ ID NO: 1356952 - RNA, 19 nt, Homo sapiens
gaaaucuucaguuacauga

SEQ ID NO: 1356953 - RNA, 19 nt, Homo sapiens
ugauagcucugaaugagaa

SEQ ID NO: 1356954 - RNA, 19 nt, Homo sapiens
ccacugcccuuuaaagaag

SEQ ID NO: 1356955 - RNA, 19 nt, Homo sapiens
gagagaagucgcucauuau

SEQ ID NO: 1356956 - RNA, 19 nt, Homo sapiens
ggaugaaacccuuaucaau

SEQ ID NO: 1356957 - RNA, 19 nt, Homo sapiens
uaccaaacauuauggagaa

SEQ ID NO: 1356958 - RNA, 19 nt, Homo sapiens
ggaaccagcccauaugugu

SEQ ID NO: 1356959 - RNA, 19 nt, Homo sapiens
ggaaccagcccaaaugugu

SEQ ID NO: 1356960 - RNA, 19 nt, Homo sapiens
gaugaugcguuuguuauag

SEQ ID NO: 1356961 - RNA, 19 nt, Homo sapiens
caucaugacccaucugaaa

SEQ ID NO: 1356962 - RNA, 19 nt, Homo sapiens
gcugguggaucucuaccua

SEQ ID NO: 1356963 - RNA, 19 nt, Homo sapiens
ggaagaagagucccuuauc

SEQ ID NO: 1356964 - RNA, 19 nt, Homo sapiens
ccaggaggcuuuggucuug

SEQ ID NO: 1356965 - RNA, 19 nt, Homo sapiens
agaauaagcggaaucuaaa

SEQ ID NO: 1356966 - RNA, 19 nt, Homo sapiens
aagaauaagcggaaucuaa

SEQ ID NO: 1356967 - RNA, 19 nt, Homo sapiens
gcagauaugcuagguguau

SEQ ID NO: 1356968 - RNA, 19 nt, Homo sapiens
aaggaaaucuucaguuaca

SEQ ID NO: 1356969 - RNA, 19 nt, Homo sapiens
ugacacagaagcucacuuu

SEQ ID NO: 1356970 - RNA, 19 nt, Homo sapiens
ugacacagaagcucacuuu

SEQ ID NO: 1356971 - RNA, 19 nt, Homo sapiens
ggauaugauuggugaagau

SEQ ID NO: 1356972 - RNA, 19 nt, Homo sapiens
uccaagagcuaucuguauu

SEQ ID NO: 1356973 - RNA, 19 nt, Homo sapiens
aggcaucucucuucagaaa

SEQ ID NO: 1356974 - RNA, 19 nt, Homo sapiens
ccaagaaagaagccaauaa

SEQ ID NO: 1356975 - RNA, 19 nt, Homo sapiens
agaugacccugcaggaaua

SEQ ID NO: 1356976 - RNA, 19 nt, Homo sapiens
ccauuagccuuacaagaga

SEQ ID NO: 1356977 - RNA, 19 nt, Homo sapiens
gcagcugaaucucuaagug

SEQ ID NO: 1356978 - RNA, 19 nt, Homo sapiens
gaagacugaugccgaagag

SEQ ID NO: 1356979 - RNA, 19 nt, Homo sapiens
gagguguccuuacuggaaa

SEQ ID NO: 1356980 - RNA, 19 nt, Homo sapiens
ggagguguccuuacuggaa

SEQ ID NO: 1356981 - RNA, 19 nt, Homo sapiens
gagaucagcuuuugaagau

SEQ ID NO: 1356982 - RNA, 19 nt, Homo sapiens
gagaauugccaaacgaaga

SEQ ID NO: 1356983 - RNA, 19 nt, Homo sapiens
gcagguguccuuugagaug

SEQ ID NO: 1356984 - RNA, 19 nt, Homo sapiens
gggcuaagcaugcauguua

SEQ ID NO: 1356985 - RNA, 19 nt, Homo sapiens
ugaacaaacugcugacuuu

SEQ ID NO: 1356986 - RNA, 19 nt, Homo sapiens
gaacgcagccuuugaauac

SEQ ID NO: 1356987 - RNA, 19 nt, Homo sapiens
ucacuaauguguccuuuga

SEQ ID NO: 1356988 - RNA, 19 nt, Homo sapiens
ggauuacaguuucuucuga

SEQ ID NO: 1356989 - RNA, 19 nt, Homo sapiens
gaagaucucacuaaugugu

SEQ ID NO: 1356990 - RNA, 19 nt, Homo sapiens
gcuagcugcugccuccuua

SEQ ID NO: 1356991 - RNA, 19 nt, Homo sapiens
caacucaccucguguggau

SEQ ID NO: 1356992 - RNA, 19 nt, Homo sapiens
uugaagaucucacuaaugu

SEQ ID NO: 1356993 - RNA, 19 nt, Homo sapiens
ccaaaccugugccuaagaa

SEQ ID NO: 1356994 - RNA, 19 nt, Homo sapiens
guggaucucuaccuaauga

SEQ ID NO: 1356995 - RNA, 19 nt, Homo sapiens
agacgcagcugaaucucua

SEQ ID NO: 1356996 - RNA, 19 nt, Homo sapiens
gcaagaaggauaaguuaca

SEQ ID NO: 1356997 - RNA, 19 nt, Homo sapiens
ugaagaagcucggauacug

SEQ ID NO: 1356998 - RNA, 19 nt, Homo sapiens
caagaaggauaaguuacaa

SEQ ID NO: 1356999 - RNA, 19 nt, Homo sapiens
caucaugacccaucugaaa

SEQ ID NO: 1357000 - RNA, 19 nt, Homo sapiens
gcugguggaucucuaccua

SEQ ID NO: 1357001 - RNA, 19 nt, Homo sapiens
gcagauaugcuagguguau

SEQ ID NO: 1357002 - RNA, 19 nt, Homo sapiens
agaugacccugcaggaaua

SEQ ID NO: 1357003 - RNA, 19 nt, Homo sapiens
gagaucagcuuuugaagau

SEQ ID NO: 1357004 - RNA, 19 nt, Homo sapiens
gcagcugaaucucuaagug

SEQ ID NO: 1357005 - RNA, 19 nt, Homo sapiens
gagaauugccaaacgaaga

SEQ ID NO: 1357006 - RNA, 19 nt, Homo sapiens
gccacugccuuuaugauug

SEQ ID NO: 1357007 - RNA, 19 nt, Homo sapiens
gagaugacccugcaggaau

SEQ ID NO: 1357008 - RNA, 19 nt, Homo sapiens
gcuccaaaccugugccuaa

SEQ ID NO: 1357009 - RNA, 19 nt, Homo sapiens
ugaacguccucaaauguga

SEQ ID NO: 1357010 - RNA, 19 nt, Homo sapiens
gcaguaugcaagaaggaua

SEQ ID NO: 1357011 - RNA, 19 nt, Homo sapiens
ccuuugagaugacccauga

SEQ ID NO: 1357012 - RNA, 19 nt, Homo sapiens
guacucagcauggaaauca

SEQ ID NO: 1357013 - RNA, 19 nt, Homo sapiens
uacaguuucuucugauuga

SEQ ID NO: 1357014 - RNA, 19 nt, Homo sapiens
ggcuaagcaugcauguuaa

SEQ ID NO: 1357015 - RNA, 19 nt, Homo sapiens
gaacaaacugcugacuuuc

SEQ ID NO: 1357016 - RNA, 19 nt, Homo sapiens
gcauuacaguggcuacagu

SEQ ID NO: 1357017 - RNA, 19 nt, Homo sapiens
cagugaagcugguggaucu

SEQ ID NO: 1357018 - RNA, 19 nt, Homo sapiens
gauuacaguuucuucugau

SEQ ID NO: 1357019 - RNA, 19 nt, Homo sapiens
ggacaagacgcagcugaau

SEQ ID NO: 1357020 - RNA, 19 nt, Homo sapiens
gcaggaauaccacuauguc

SEQ ID NO: 1357021 - RNA, 19 nt, Homo sapiens
acuaauguguccuuugaga

SEQ ID NO: 1357022 - RNA, 19 nt, Homo sapiens
ugaacgcagccuuugaaua

SEQ ID NO: 1357023 - RNA, 19 nt, Homo sapiens
ccacagggcuaagcaugca

SEQ ID NO: 1357024 - RNA, 19 nt, Homo sapiens
cagcugaaucucuaaguga

SEQ ID NO: 1357025 - RNA, 19 nt, Homo sapiens
ucucaaggcuguguauuac

SEQ ID NO: 1357026 - RNA, 19 nt, Homo sapiens
gucucaaggcuguguauua

SEQ ID NO: 1357027 - RNA, 19 nt, Homo sapiens
gagguacucagcauggaaa

SEQ ID NO: 1357028 - RNA, 19 nt, Homo sapiens
uaauguguccuuugagaug

SEQ ID NO: 1357029 - RNA, 19 nt, Homo sapiens
uacaguggcuacaguaucu

SEQ ID NO: 1357030 - RNA, 19 nt, Homo sapiens
ggaaaucaacauccugaac

SEQ ID NO: 1357031 - RNA, 19 nt, Homo sapiens
gcaaaauugugcccaguca

SEQ ID NO: 1357032 - RNA, 19 nt, Homo sapiens
ugaaggcaguaugcaagaa

SEQ ID NO: 1357033 - RNA, 19 nt, Homo sapiens
gaaaucucaguccagcaaa

SEQ ID NO: 1357034 - RNA, 19 nt, Homo sapiens
uguugaagcuggaggagau

SEQ ID NO: 1357035 - RNA, 19 nt, Homo sapiens
gcauggaaaucaacauccu

SEQ ID NO: 1357036 - RNA, 19 nt, Homo sapiens
gaaggcaguaugcaagaag

SEQ ID NO: 1357037 - RNA, 19 nt, Homo sapiens
ugaagcugguggaucucua

SEQ ID NO: 1357038 - RNA, 19 nt, Homo sapiens
gagucuccaucuucacuuc

SEQ ID NO: 1357039 - RNA, 19 nt, Homo sapiens
gaauugccaaacgaagaua

SEQ ID NO: 1357040 - RNA, 19 nt, Homo sapiens
cauguuaacaggguauauu

SEQ ID NO: 1357041 - RNA, 19 nt, Homo sapiens
gauugaacgcagccuuuga

SEQ ID NO: 1357042 - RNA, 19 nt, Homo sapiens
agaaaucucaguccagcaa

SEQ ID NO: 1357043 - RNA, 19 nt, Homo sapiens
acaugaagaagcucggaua

SEQ ID NO: 1357044 - RNA, 19 nt, Homo sapiens
gacaagacgcagcugaauc

SEQ ID NO: 1357045 - RNA, 19 nt, Homo sapiens
gaccuugucccgcuacauc

SEQ ID NO: 1357046 - RNA, 19 nt, Homo sapiens
ccacugccuuuaugauugc

SEQ ID NO: 1357047 - RNA, 19 nt, Homo sapiens
uucccaaacugauaauguu

SEQ ID NO: 1357048 - RNA, 19 nt, Homo sapiens
guucgaauuugucuuuuga

SEQ ID NO: 1357049 - RNA, 19 nt, Homo sapiens
gacuuucaguucuuacgau

SEQ ID NO: 1357050 - RNA, 19 nt, Homo sapiens
cgagaugacccugcaggaa

SEQ ID NO: 1357051 - RNA, 19 nt, Homo sapiens
uaaugaaggcaguaugcaa

SEQ ID NO: 1357052 - RNA, 19 nt, Homo sapiens
acaagacgcagcugaaucu

SEQ ID NO: 1357053 - RNA, 19 nt, Homo sapiens
augcaagaaggauaaguua

SEQ ID NO: 1357054 - RNA, 19 nt, Homo sapiens
caguaugcaagaaggauaa

SEQ ID NO: 1357055 - RNA, 19 nt, Homo sapiens
gggagaauugccaaacgaa

SEQ ID NO: 1357056 - RNA, 19 nt, Homo sapiens
acuuucaguucuuacgaua

SEQ ID NO: 1357057 - RNA, 19 nt, Homo sapiens
acaccaacaugaagacacu

SEQ ID NO: 1357058 - RNA, 19 nt, Homo sapiens
uggaugacuuuguguacau

SEQ ID NO: 1357059 - RNA, 19 nt, Homo sapiens
guggaugacuuuguguaca

SEQ ID NO: 1357060 - RNA, 19 nt, Homo sapiens
uaugcaagaaggauaaguu

SEQ ID NO: 1357061 - RNA, 19 nt, Homo sapiens
ucccaaacugauaauguua

SEQ ID NO: 1357062 - RNA, 19 nt, Homo sapiens
ugguggaucucuaccuaau

SEQ ID NO: 1357063 - RNA, 19 nt, Homo sapiens
uuucaguucuuacgauagu

SEQ ID NO: 1357064 - RNA, 19 nt, Homo sapiens
caaacgaagauaucuccau

SEQ ID NO: 1357065 - RNA, 19 nt, Homo sapiens
aaaccugugccuaagaaau

SEQ ID NO: 1357066 - RNA, 19 nt, Homo sapiens
gauacuggguucccuuccu

SEQ ID NO: 1357067 - RNA, 19 nt, Homo sapiens
cauccugaacguccucaaa

SEQ ID NO: 1357068 - RNA, 19 nt, Homo sapiens
cccaugagacccuguacuu

SEQ ID NO: 1357069 - RNA, 19 nt, Homo sapiens
aauguguccuuugagauga

SEQ ID NO: 1357070 - RNA, 19 nt, Homo sapiens
cauuacaguggcuacagua

SEQ ID NO: 1357071 - RNA, 19 nt, Homo sapiens
uucccuuccuggagcauua

SEQ ID NO: 1357072 - RNA, 19 nt, Homo sapiens
ccugaacguccucaaaugu

SEQ ID NO: 1357073 - RNA, 19 nt, Homo sapiens
aaaucaacauccugaacgu

SEQ ID NO: 1357074 - RNA, 19 nt, Homo sapiens
uuacaguuucuucugauug

SEQ ID NO: 1357075 - RNA, 19 nt, Homo sapiens
cagcauggaaaucaacauc

SEQ ID NO: 1357076 - RNA, 19 nt, Homo sapiens
gaagcugguggaucucuac

SEQ ID NO: 1357077 - RNA, 19 nt, Homo sapiens
gauaucuccaucuucacuu

SEQ ID NO: 1357078 - RNA, 19 nt, Homo sapiens
ccaugagacccuguacuug

SEQ ID NO: 1357079 - RNA, 19 nt, Homo sapiens
ccaaggaaaucuucaguua

SEQ ID NO: 1357080 - RNA, 19 nt, Homo sapiens
gaggaacaguuuauacuua

SEQ ID NO: 1357081 - RNA, 19 nt, Homo sapiens
gaacacacaugcucuugga

SEQ ID NO: 1357082 - RNA, 19 nt, Homo sapiens
gggcuaagcaugcauguua

SEQ ID NO: 1357083 - RNA, 19 nt, Homo sapiens
ugaacaaacugcugacuuu

SEQ ID NO: 1357084 - RNA, 19 nt, Homo sapiens
gaaagaagccaauaaagag

SEQ ID NO: 1357085 - RNA, 19 nt, Homo sapiens
gaacgcagccuuugaauac

SEQ ID NO: 1357086 - RNA, 19 nt, Homo sapiens
ccaagaagauaaacaggaa

SEQ ID NO: 1357087 - RNA, 19 nt, Homo sapiens
caagaaagaagccaauaaa

SEQ ID NO: 1357088 - RNA, 19 nt, Homo sapiens
ggauuacaguuucuucuga

SEQ ID NO: 1357089 - RNA, 19 nt, Homo sapiens
ggacagcagugauggaagu

SEQ ID NO: 1357090 - RNA, 19 nt, Homo sapiens
gcuagcugcugccuccuua

SEQ ID NO: 1357091 - RNA, 19 nt, Homo sapiens
caacucaccucguguggau

SEQ ID NO: 1357092 - RNA, 19 nt, Homo sapiens
gaagaucucacuaaugcuu

SEQ ID NO: 1357093 - RNA, 19 nt, Homo sapiens
ccaaaccugugccuaagaa

SEQ ID NO: 1357094 - RNA, 19 nt, Homo sapiens
guggaucucuaccuaauga

SEQ ID NO: 1357095 - RNA, 19 nt, Homo sapiens
agacgcagcugaaucucua

SEQ ID NO: 1357096 - RNA, 19 nt, Homo sapiens
gcaagaaggauaaguuaca

SEQ ID NO: 1357097 - RNA, 19 nt, Homo sapiens
ugaagaagcucggauacug

SEQ ID NO: 1357098 - RNA, 19 nt, Homo sapiens
caagaaggauaaguuacaa

SEQ ID NO: 1357099 - RNA, 19 nt, Homo sapiens
agaaagaagccaauaaaga

SEQ ID NO: 1357100 - RNA, 19 nt, Homo sapiens
gaaaucuucaguuacauga

SEQ ID NO: 1357101 - RNA, 19 nt, Homo sapiens
caucaugacccaucugaaa

SEQ ID NO: 1357102 - RNA, 19 nt, Homo sapiens
gcugguggaucucuaccua

SEQ ID NO: 1357103 - RNA, 19 nt, Homo sapiens
agaauaagcggaaucuaaa

SEQ ID NO: 1357104 - RNA, 19 nt, Homo sapiens
aagaauaagcggaaucuaa

SEQ ID NO: 1357105 - RNA, 19 nt, Homo sapiens
gcagauaugcuagguguau

SEQ ID NO: 1357106 - RNA, 19 nt, Homo sapiens
aaggaaaucuucaguuaca

SEQ ID NO: 1357107 - RNA, 19 nt, Homo sapiens
ccaagaaagaagccaauaa

SEQ ID NO: 1357108 - RNA, 19 nt, Homo sapiens
agaugacccugcaggaaua

SEQ ID NO: 1357109 - RNA, 19 nt, Homo sapiens
gagaucagcuuuugaagau

SEQ ID NO: 1357110 - RNA, 19 nt, Homo sapiens
gcagcugaaucucuaagug

SEQ ID NO: 1357111 - RNA, 19 nt, Homo sapiens
gcagguguccuuugagaug

SEQ ID NO: 1357112 - RNA, 19 nt, Homo sapiens
gagaauugccaaacgaaga

SEQ ID NO: 1357113 - RNA, 19 nt, Homo sapiens
gccacugccuuuaugauug

SEQ ID NO: 1357114 - RNA, 19 nt, Homo sapiens
agagagagaggaacaguuu

SEQ ID NO: 1357115 - RNA, 19 nt, Homo sapiens
gagaugacccugcaggaau

SEQ ID NO: 1357116 - RNA, 19 nt, Homo sapiens
gagagaggaacaguuuaua

SEQ ID NO: 1357117 - RNA, 19 nt, Homo sapiens
gcuccaaaccugugccuaa

SEQ ID NO: 1357118 - RNA, 19 nt, Homo sapiens
ugaacguccucaaauguga

SEQ ID NO: 1357119 - RNA, 19 nt, Homo sapiens
gugcagguguccuuugaga

SEQ ID NO: 1357120 - RNA, 19 nt, Homo sapiens
gcaguaugcaagaaggaua

SEQ ID NO: 1357121 - RNA, 19 nt, Homo sapiens
ccuuugagaugacccauga

SEQ ID NO: 1357122 - RNA, 19 nt, Homo sapiens
gacaugagggccauucuug

SEQ ID NO: 1357123 - RNA, 19 nt, Homo sapiens
ggaaaucuucaguuacaug

SEQ ID NO: 1357124 - RNA, 19 nt, Homo sapiens
gaaguuucaacccaaugua

SEQ ID NO: 1357125 - RNA, 19 nt, Homo sapiens
gccaauaaagaguuuguaa

SEQ ID NO: 1357126 - RNA, 19 nt, Homo sapiens
guacucagcauggaaauca

SEQ ID NO: 1357127 - RNA, 19 nt, Homo sapiens
ucacuaaugcuucucaaug

SEQ ID NO: 1357128 - RNA, 19 nt, Homo sapiens
agaagccaauaaagaguuu

SEQ ID NO: 1357129 - RNA, 19 nt, Homo sapiens
uugaagaucucacuaaugc

SEQ ID NO: 1357130 - RNA, 19 nt, Homo sapiens
uacaguuucuucugauuga

SEQ ID NO: 1357131 - RNA, 19 nt, Homo sapiens
gagagagaggaacaguuua

SEQ ID NO: 1357132 - RNA, 19 nt, Homo sapiens
cagcagugauggaaguuuc

SEQ ID NO: 1357133 - RNA, 19 nt, Homo sapiens
gaagauaaacaggaacaca

SEQ ID NO: 1357134 - RNA, 19 nt, Homo sapiens
aaaguuguuuccaagaaga

SEQ ID NO: 1357135 - RNA, 19 nt, Homo sapiens
ggcuaagcaugcauguuaa

SEQ ID NO: 1357136 - RNA, 19 nt, Homo sapiens
gaacaaacugcugacuuuc

SEQ ID NO: 1357137 - RNA, 19 nt, Homo sapiens
gcauuacaguggcuacagu

SEQ ID NO: 1357138 - RNA, 19 nt, Homo sapiens
cagugaagcugguggaucu

SEQ ID NO: 1357139 - RNA, 19 nt, Homo sapiens
gauuacaguuucuucugau

SEQ ID NO: 1357140 - RNA, 19 nt, Homo sapiens
cacuaaugcuucucaaugu

SEQ ID NO: 1357141 - RNA, 19 nt, Homo sapiens
ggaacaguuuauacuuaca

SEQ ID NO: 1357142 - RNA, 19 nt, Homo sapiens
ggacaagacgcagcugaau

SEQ ID NO: 1357143 - RNA, 19 nt, Homo sapiens
gaugaggacagcagugaug

SEQ ID NO: 1357144 - RNA, 19 nt, Homo sapiens
gcaggaauaccacuauguc

SEQ ID NO: 1357145 - RNA, 19 nt, Homo sapiens
ugaacgcagccuuugaaua

SEQ ID NO: 1357146 - RNA, 19 nt, Homo sapiens
gagaggaacaguuuauacu

SEQ ID NO: 1357147 - RNA, 19 nt, Homo sapiens
ccacagggcuaagcaugca

SEQ ID NO: 1357148 - RNA, 19 nt, Homo sapiens
caauguaugccaaggaaau

SEQ ID NO: 1357149 - RNA, 19 nt, Homo sapiens
cagcugaaucucuaaguga

SEQ ID NO: 1357150 - RNA, 19 nt, Homo sapiens
ggaaguuucaacccaaugu

SEQ ID NO: 1357151 - RNA, 19 nt, Homo sapiens
ucucaaggcuguguauuac

SEQ ID NO: 1357152 - RNA, 19 nt, Homo sapiens
gucucaaggcuguguauua

SEQ ID NO: 1357153 - RNA, 19 nt, Homo sapiens
gagguacucagcauggaaa

SEQ ID NO: 1357154 - RNA, 19 nt, Homo sapiens
cccaauguaugccaaggaa

SEQ ID NO: 1357155 - RNA, 19 nt, Homo sapiens
gaggacagcagugauggaa

SEQ ID NO: 1357156 - RNA, 19 nt, Homo sapiens
uacaguggcuacaguaucu

SEQ ID NO: 1357157 - RNA, 19 nt, Homo sapiens
ggaaaucaacauccugaac

SEQ ID NO: 1357158 - RNA, 19 nt, Homo sapiens
gcaaaauugugcccaguca

SEQ ID NO: 1357159 - RNA, 19 nt, Homo sapiens
ugaaggcaguaugcaagaa

SEQ ID NO: 1357160 - RNA, 19 nt, Homo sapiens
ugaaagagagagaggaaca

SEQ ID NO: 1357161 - RNA, 19 nt, Homo sapiens
gaaaucucaguccagcaaa

SEQ ID NO: 1357162 - RNA, 19 nt, Homo sapiens
uguugaagcuggaggagau

SEQ ID NO: 1357163 - RNA, 19 nt, Homo sapiens
gcauggaaaucaacauccu

SEQ ID NO: 1357164 - RNA, 19 nt, Homo sapiens
gaaggcaguaugcaagaag

SEQ ID NO: 1357165 - RNA, 19 nt, Homo sapiens
ugaagcugguggaucucua

SEQ ID NO: 1357166 - RNA, 19 nt, Homo sapiens
ugaacaggcagauugaaau

SEQ ID NO: 1357167 - RNA, 19 nt, Homo sapiens
gagucuccaucuucacuuc

SEQ ID NO: 1357168 - RNA, 19 nt, Homo sapiens
uacaugaacaggcagauug

SEQ ID NO: 1357169 - RNA, 19 nt, Homo sapiens
agagagaggaacaguuuau

SEQ ID NO: 1357170 - RNA, 19 nt, Homo sapiens
caugaaagagagagaggaa

SEQ ID NO: 1357171 - RNA, 19 nt, Homo sapiens
uaagcggaaucuaaaauga

SEQ ID NO: 1357172 - RNA, 19 nt, Homo sapiens
gaauugccaaacgaagaua

SEQ ID NO: 1357173 - RNA, 19 nt, Homo sapiens
cauguuaacaggguauauu

SEQ ID NO: 1357174 - RNA, 19 nt, Homo sapiens
cagguguccuuugagauga

SEQ ID NO: 1357175 - RNA, 19 nt, Homo sapiens
gauugaacgcagccuuuga

SEQ ID NO: 1357176 - RNA, 19 nt, Homo sapiens
agaaaucucaguccagcaa

SEQ ID NO: 1357177 - RNA, 19 nt, Homo sapiens
caaccuguccagcccaaga

SEQ ID NO: 1357178 - RNA, 19 nt, Homo sapiens
acaugaagaagcucggaua

SEQ ID NO: 1357179 - RNA, 19 nt, Homo sapiens
gcacacauguagcuaaaua

SEQ ID NO: 1357180 - RNA, 19 nt, Homo sapiens
ggaagaacuuagugauuaa

SEQ ID NO: 1357181 - RNA, 19 nt, Homo sapiens
caaggaauaugcuaugauu

SEQ ID NO: 1357182 - RNA, 19 nt, Homo sapiens
gcacauauuucagugauga

SEQ ID NO: 1357183 - RNA, 19 nt, Homo sapiens
gauaaagacucugcacaaa

SEQ ID NO: 1357184 - RNA, 19 nt, Homo sapiens
caaauuccauucccuagaa

SEQ ID NO: 1357185 - RNA, 19 nt, Homo sapiens
caugaggacuucugaaauu

SEQ ID NO: 1357186 - RNA, 19 nt, Homo sapiens
aggaagaacuuagugauua

SEQ ID NO: 1357187 - RNA, 19 nt, Homo sapiens
caacccaccugaagaaaug

SEQ ID NO: 1357188 - RNA, 19 nt, Homo sapiens
gcagguggguauaugguaa

SEQ ID NO: 1357189 - RNA, 19 nt, Homo sapiens
gaaagcuccugaaccagaa

SEQ ID NO: 1357190 - RNA, 19 nt, Homo sapiens
aaagaaagcuccugaacca

SEQ ID NO: 1357191 - RNA, 19 nt, Homo sapiens
ucaagacgcccaaggauaa

SEQ ID NO: 1357192 - RNA, 19 nt, Homo sapiens
agaagaaacuacuuacaug

SEQ ID NO: 1357193 - RNA, 19 nt, Homo sapiens
ucuccuaccuuccucaaua

SEQ ID NO: 1357194 - RNA, 19 nt, Homo sapiens
agaagaaagugaagaugaa

SEQ ID NO: 1357195 - RNA, 19 nt, Homo sapiens
ggaaguagaagaaagugaa

SEQ ID NO: 1357196 - RNA, 19 nt, Homo sapiens
aaagauaccaggaagagua

SEQ ID NO: 1357197 - RNA, 19 nt, Homo sapiens
agaaaugagugguggauug

SEQ ID NO: 1357198 - RNA, 19 nt, Homo sapiens
aggcgaaacuacuuugaua

SEQ ID NO: 1357199 - RNA, 19 nt, Homo sapiens
caauguggcuguauuaaaa

SEQ ID NO: 1357200 - RNA, 19 nt, Homo sapiens
gaagaaacuacuuacaugu

SEQ ID NO: 1357201 - RNA, 19 nt, Homo sapiens
ggauaaagacucugcacaa

SEQ ID NO: 1357202 - RNA, 19 nt, Homo sapiens
gcgaaacuacuuugauaaa

SEQ ID NO: 1357203 - RNA, 19 nt, Homo sapiens
agaagaaauugaggaagua

SEQ ID NO: 1357204 - RNA, 19 nt, Homo sapiens
gacuaaaucuucccauucu

SEQ ID NO: 1357205 - RNA, 19 nt, Homo sapiens
auucaugccugauuuguuu

SEQ ID NO: 1357206 - RNA, 19 nt, Homo sapiens
guuauuugguagagugaua

SEQ ID NO: 1357207 - RNA, 19 nt, Homo sapiens
uggcaaaguuguaaagguu

SEQ ID NO: 1357208 - RNA, 19 nt, Homo sapiens
caaguaagagcacagugua

SEQ ID NO: 1357209 - RNA, 19 nt, Homo sapiens
gaggacuucugaaauuaau

SEQ ID NO: 1357210 - RNA, 19 nt, Homo sapiens
gaggaagaacuuagugauu

SEQ ID NO: 1357211 - RNA, 19 nt, Homo sapiens
gugcacacauguagcuaaa

SEQ ID NO: 1357212 - RNA, 19 nt, Homo sapiens
gcaauaaacaacaaacagu

SEQ ID NO: 1357213 - RNA, 19 nt, Homo sapiens
gggaauccauauauaucuu

SEQ ID NO: 1357214 - RNA, 19 nt, Homo sapiens
gggauuagagagccuuuaa

SEQ ID NO: 1357215 - RNA, 19 nt, Homo sapiens
gggaggauccugcucuuga

SEQ ID NO: 1357216 - RNA, 19 nt, Homo sapiens
aagaagaaauugaggaagu

SEQ ID NO: 1357217 - RNA, 19 nt, Homo sapiens
uagaagaaagugaagauga

SEQ ID NO: 1357218 - RNA, 19 nt, Homo sapiens
gguauaugguaaugggauu

SEQ ID NO: 1357219 - RNA, 19 nt, Homo sapiens
ccaauguggcuguauuaaa

SEQ ID NO: 1357220 - RNA, 19 nt, Homo sapiens
caccguggcugcuauuauc

SEQ ID NO: 1357221 - RNA, 19 nt, Homo sapiens
caucauauuucuuguagcu

SEQ ID NO: 1357222 - RNA, 19 nt, Homo sapiens
gccaaggaauaugcuauga

SEQ ID NO: 1357223 - RNA, 19 nt, Homo sapiens
ggccauagcauuccagcaa

SEQ ID NO: 1357224 - RNA, 19 nt, Homo sapiens
gaaggcgaaacuacuuuga

SEQ ID NO: 1357225 - RNA, 19 nt, Homo sapiens
uaagagcacaguguaugua

SEQ ID NO: 1357226 - RNA, 19 nt, Homo sapiens
gaagagcagcugaguucau

SEQ ID NO: 1357227 - RNA, 19 nt, Homo sapiens
ugaaccagaagaagaaauu

SEQ ID NO: 1357228 - RNA, 19 nt, Homo sapiens
ccagggcaauaaacaacaa

SEQ ID NO: 1357229 - RNA, 19 nt, Homo sapiens
guuaccaucaugaaagaua

SEQ ID NO: 1357230 - RNA, 19 nt, Homo sapiens
ugacuuguaccggauauuu

SEQ ID NO: 1357231 - RNA, 19 nt, Homo sapiens
gaagaaaugagugguggau

SEQ ID NO: 1357232 - RNA, 19 nt, Homo sapiens
augaggacuucugaaauua

SEQ ID NO: 1357233 - RNA, 19 nt, Homo sapiens
caaguauggcaaaguugua

SEQ ID NO: 1357234 - RNA, 19 nt, Homo sapiens
gauaaagauaccaggaaga

SEQ ID NO: 1357235 - RNA, 19 nt, Homo sapiens
ggcaaaguuguaaagguua

SEQ ID NO: 1357236 - RNA, 19 nt, Homo sapiens
gucaucauauuucuuguag

SEQ ID NO: 1357237 - RNA, 19 nt, Homo sapiens
uggaagagcagcugaguuc

SEQ ID NO: 1357238 - RNA, 19 nt, Homo sapiens
gcaccguggcugcuauuau

SEQ ID NO: 1357239 - RNA, 19 nt, Homo sapiens
gaaaugagugguggauugg

SEQ ID NO: 1357240 - RNA, 19 nt, Homo sapiens
ugacuaaaucuucccauuc

SEQ ID NO: 1357241 - RNA, 19 nt, Homo sapiens
guaagagcacaguguaugu

SEQ ID NO: 1357242 - RNA, 19 nt, Homo sapiens
agaaauugaggaaguagaa

SEQ ID NO: 1357243 - RNA, 19 nt, Homo sapiens
gaaccagaagaagaaauug

SEQ ID NO: 1357244 - RNA, 19 nt, Homo sapiens
gcacaguguauguauccaa

SEQ ID NO: 1357245 - RNA, 19 nt, Homo sapiens
ggcgaaacuacuuugauaa

SEQ ID NO: 1357246 - RNA, 19 nt, Homo sapiens
ggaauaugcuaugauuacg

SEQ ID NO: 1357247 - RNA, 19 nt, Homo sapiens
ccaaguaagagcacagugu

SEQ ID NO: 1357248 - RNA, 19 nt, Homo sapiens
ugaggacuucugaaauuaa

SEQ ID NO: 1357249 - RNA, 19 nt, Homo sapiens
gcccaacccaccugaagaa

SEQ ID NO: 1357250 - RNA, 19 nt, Homo sapiens
uaaagguuaccaucaugaa

SEQ ID NO: 1357251 - RNA, 19 nt, Homo sapiens
gaagaaagugaagaugaag

SEQ ID NO: 1357252 - RNA, 19 nt, Homo sapiens
agaagaagaaauugaggaa

SEQ ID NO: 1357253 - RNA, 19 nt, Homo sapiens
caguguauguauccaacuu

SEQ ID NO: 1357254 - RNA, 19 nt, Homo sapiens
uacaugaggacuucugaaa

SEQ ID NO: 1357255 - RNA, 19 nt, Homo sapiens
aagcacauauuucagugau

SEQ ID NO: 1357256 - RNA, 19 nt, Homo sapiens
guaccagggcaauaaacaa

SEQ ID NO: 1357257 - RNA, 19 nt, Homo sapiens
uaaagacucugcacaaaac

SEQ ID NO: 1357258 - RNA, 19 nt, Homo sapiens
gagccaaggaauaugcuau

SEQ ID NO: 1357259 - RNA, 19 nt, Homo sapiens
ccaaauuccauucccuaga

SEQ ID NO: 1357260 - RNA, 19 nt, Homo sapiens
ccaaguauggcaaaguugu

SEQ ID NO: 1357261 - RNA, 19 nt, Homo sapiens
ggaggauccugcucuugac

SEQ ID NO: 1357262 - RNA, 19 nt, Homo sapiens
gaagaaauugaggaaguag

SEQ ID NO: 1357263 - RNA, 19 nt, Homo sapiens
aagagcagcugaguucauc

SEQ ID NO: 1357264 - RNA, 19 nt, Homo sapiens
aaacaguuauuugguagag

SEQ ID NO: 1357265 - RNA, 19 nt, Homo sapiens
gauucaagacgcccaagga

SEQ ID NO: 1357266 - RNA, 19 nt, Homo sapiens
ucagucaggccauagcauu

SEQ ID NO: 1357267 - RNA, 19 nt, Homo sapiens
caugaaagauaaagauacc

SEQ ID NO: 1357268 - RNA, 19 nt, Homo sapiens
uuccaaguauggcaaaguu

SEQ ID NO: 1357269 - RNA, 19 nt, Homo sapiens
gaaguagaagaaagugaag

SEQ ID NO: 1357270 - RNA, 19 nt, Homo sapiens
aaagguuaccaucaugaaa

SEQ ID NO: 1357271 - RNA, 19 nt, Homo sapiens
gaguaaagggguugcauuu

SEQ ID NO: 1357272 - RNA, 19 nt, Homo sapiens
uagagagccuuuaauuuuc

SEQ ID NO: 1357273 - RNA, 19 nt, Homo sapiens
cuaaaucuucccauucugu

SEQ ID NO: 1357274 - RNA, 19 nt, Homo sapiens
aaauauggguguuuuguca

SEQ ID NO: 1357275 - RNA, 19 nt, Homo sapiens
ugccugauuuguuuacaug

SEQ ID NO: 1357276 - RNA, 19 nt, Homo sapiens
caagacgcccaaggauaaa

SEQ ID NO: 1357277 - RNA, 19 nt, Homo sapiens
cuuuauucaugccugauuu

SEQ ID NO: 1357278 - RNA, 19 nt, Homo sapiens
gaugaggaagaacuuagug

SEQ ID NO: 1357279 - RNA, 19 nt, Homo sapiens
gaaauugaccuaaguguuu

SEQ ID NO: 1357280 - RNA, 19 nt, Homo sapiens
gaagaagauuugucugaaa

SEQ ID NO: 1357281 - RNA, 19 nt, Homo sapiens
ggacauaaaucuucauucu

SEQ ID NO: 1357282 - RNA, 19 nt, Homo sapiens
gaauaucacacucuucuua

SEQ ID NO: 1357283 - RNA, 19 nt, Homo sapiens
gaagacaccuccacaacug

SEQ ID NO: 1357284 - RNA, 19 nt, Homo sapiens
ggagagagauacugcaaau

SEQ ID NO: 1357285 - RNA, 19 nt, Homo sapiens
agacauaacugcccuugaa

SEQ ID NO: 1357286 - RNA, 19 nt, Homo sapiens
caacucaccuacagaaaga

SEQ ID NO: 1357287 - RNA, 19 nt, Homo sapiens
uaagaucacugagccauuu

SEQ ID NO: 1357288 - RNA, 19 nt, Homo sapiens
uaacugcccuugaagaaga

SEQ ID NO: 1357289 - RNA, 19 nt, Homo sapiens
ccacgucacuucaguaaau

SEQ ID NO: 1357290 - RNA, 19 nt, Homo sapiens
ggaagaaucaucuacagaa

SEQ ID NO: 1357291 - RNA, 19 nt, Homo sapiens
gggauaccauguagaauug

SEQ ID NO: 1357292 - RNA, 19 nt, Homo sapiens
gcagagaucucaauaaccu

SEQ ID NO: 1357293 - RNA, 19 nt, Homo sapiens
gaacauuucaugccaguga

SEQ ID NO: 1357294 - RNA, 19 nt, Homo sapiens
cuacaaaccuaguggaaga

SEQ ID NO: 1357295 - RNA, 19 nt, Homo sapiens
aagcugauaugagcaauua

SEQ ID NO: 1357296 - RNA, 19 nt, Homo sapiens
acaacaaacugacagcuaa

SEQ ID NO: 1357297 - RNA, 19 nt, Homo sapiens
ggaacuaccucuguauuag

SEQ ID NO: 1357298 - RNA, 19 nt, Homo sapiens
gagagauacugcaaaugaa

SEQ ID NO: 1357299 - RNA, 19 nt, Homo sapiens
ugaagucucuggcacacua

SEQ ID NO: 1357300 - RNA, 19 nt, Homo sapiens
cagcuagccuuaacaucua

SEQ ID NO: 1357301 - RNA, 19 nt, Homo sapiens
gaagaaucaucuacagaag

SEQ ID NO: 1357302 - RNA, 19 nt, Homo sapiens
ugacaaugcuauucccaaa

SEQ ID NO: 1357303 - RNA, 19 nt, Homo sapiens
agaaucaucuacagaagaa

SEQ ID NO: 1357304 - RNA, 19 nt, Homo sapiens
gcugauaugagcaauuaua

SEQ ID NO: 1357305 - RNA, 19 nt, Homo sapiens
ggucacugauuccauuauu

SEQ ID NO: 1357306 - RNA, 19 nt, Homo sapiens
ccaggucacugauuccauu

SEQ ID NO: 1357307 - RNA, 19 nt, Homo sapiens
gcuccugccuuuccacgua

SEQ ID NO: 1357308 - RNA, 19 nt, Homo sapiens
caacaacucaccuacagaa

SEQ ID NO: 1357309 - RNA, 19 nt, Homo sapiens
aagauacucugcuaacuga

SEQ ID NO: 1357310 - RNA, 19 nt, Homo sapiens
agaaagaaauuaccucucu

SEQ ID NO: 1357311 - RNA, 19 nt, Homo sapiens
gaacuaccucuguauuaga

SEQ ID NO: 1357312 - RNA, 19 nt, Homo sapiens
gaagauacucugcuaacug

SEQ ID NO: 1357313 - RNA, 19 nt, Homo sapiens
ugaaacggauaucuuugaa

SEQ ID NO: 1357314 - RNA, 19 nt, Homo sapiens
agagagauacugcaaauga

SEQ ID NO: 1357315 - RNA, 19 nt, Homo sapiens
aaagauaaacgggaagaua

SEQ ID NO: 1357316 - RNA, 19 nt, Homo sapiens
gaaagaagaacccgaugag

SEQ ID NO: 1357317 - RNA, 19 nt, Homo sapiens
caacugaaacggauaucuu

SEQ ID NO: 1357318 - RNA, 19 nt, Homo sapiens
gcacagacuacuuaaaugg

SEQ ID NO: 1357319 - RNA, 19 nt, Homo sapiens
ggucuuaaacacugaauau

SEQ ID NO: 1357320 - RNA, 19 nt, Homo sapiens
gaagauuugucugaaacug

SEQ ID NO: 1357321 - RNA, 19 nt, Homo sapiens
guauugggauggagagaga

SEQ ID NO: 1357322 - RNA, 19 nt, Homo sapiens
gaaagcuucacuacuauuc

SEQ ID NO: 1357323 - RNA, 19 nt, Homo sapiens
ggauaucuuugaacuacug

SEQ ID NO: 1357324 - RNA, 19 nt, Homo sapiens
aaacggauaucuuugaacu

SEQ ID NO: 1357325 - RNA, 19 nt, Homo sapiens
agaagaagauuugucugaa

SEQ ID NO: 1357326 - RNA, 19 nt, Homo sapiens
ccagugcuguggcuacauu

SEQ ID NO: 1357327 - RNA, 19 nt, Homo sapiens
caaacuccauaacaagaga

SEQ ID NO: 1357328 - RNA, 19 nt, Homo sapiens
ucaaggacauaaaucuuca

SEQ ID NO: 1357329 - RNA, 19 nt, Homo sapiens
ucaauaaccucugaagucu

SEQ ID NO: 1357330 - RNA, 19 nt, Homo sapiens
gaauauuucaucaccaguu

SEQ ID NO: 1357331 - RNA, 19 nt, Homo sapiens
caacaacuacagacaacaa

SEQ ID NO: 1357332 - RNA, 19 nt, Homo sapiens
cguugucccugcaucaaua

SEQ ID NO: 1357333 - RNA, 19 nt, Homo sapiens
acaaugcuauucccaaauc

SEQ ID NO: 1357334 - RNA, 19 nt, Homo sapiens
aaagggauaccauguagaa

SEQ ID NO: 1357335 - RNA, 19 nt, Homo sapiens
gcuguugaauccagauaug

SEQ ID NO: 1357336 - RNA, 19 nt, Homo sapiens
ucugcuaacugaugaagaa

SEQ ID NO: 1357337 - RNA, 19 nt, Homo sapiens
gacaacaaacugacagcua

SEQ ID NO: 1357338 - RNA, 19 nt, Homo sapiens
aagaagaacccgaugaguu

SEQ ID NO: 1357339 - RNA, 19 nt, Homo sapiens
ggaagauacucugcuaacu

SEQ ID NO: 1357340 - RNA, 19 nt, Homo sapiens
uaacugacucugaugagaa

SEQ ID NO: 1357341 - RNA, 19 nt, Homo sapiens
uaaccgaaauugaccuaag

SEQ ID NO: 1357342 - RNA, 19 nt, Homo sapiens
gagacucuauuaccgaaca

SEQ ID NO: 1357343 - RNA, 19 nt, Homo sapiens
aaacucaaaucagaagaug

SEQ ID NO: 1357344 - RNA, 19 nt, Homo sapiens
gaccacgucacuucaguaa

SEQ ID NO: 1357345 - RNA, 19 nt, Homo sapiens
uggaacuaccucuguauua

SEQ ID NO: 1357346 - RNA, 19 nt, Homo sapiens
aucaauagcuacaaaccua

SEQ ID NO: 1357347 - RNA, 19 nt, Homo sapiens
cacaggagaugcagagauc

SEQ ID NO: 1357348 - RNA, 19 nt, Homo sapiens
acuacaaacuccauaacaa

SEQ ID NO: 1357349 - RNA, 19 nt, Homo sapiens
gaaaauaaccgaaauugac

SEQ ID NO: 1357350 - RNA, 19 nt, Homo sapiens
aagaaagcuucacuacuau

SEQ ID NO: 1357351 - RNA, 19 nt, Homo sapiens
cagaaacaacuauuacuuc

SEQ ID NO: 1357352 - RNA, 19 nt, Homo sapiens
ggcacagacuacuuaaaug

SEQ ID NO: 1357353 - RNA, 19 nt, Homo sapiens
gaaguuuaucacuguguuu

SEQ ID NO: 1357354 - RNA, 19 nt, Homo sapiens
cauaacugcccuugaagaa

SEQ ID NO: 1357355 - RNA, 19 nt, Homo sapiens
cuucuuaugacucuuguua

SEQ ID NO: 1357356 - RNA, 19 nt, Homo sapiens
uaucacacucuucuuauga

SEQ ID NO: 1357357 - RNA, 19 nt, Homo sapiens
uacauuaacugacucugau

SEQ ID NO: 1357358 - RNA, 19 nt, Homo sapiens
caacaaacugacagcuaaa

SEQ ID NO: 1357359 - RNA, 19 nt, Homo sapiens
caaaagggauaccauguag

SEQ ID NO: 1357360 - RNA, 19 nt, Homo sapiens
ggaagacaccuccacaacu

SEQ ID NO: 1357361 - RNA, 19 nt, Homo sapiens
gcuaacugaugaagaaacu

SEQ ID NO: 1357362 - RNA, 19 nt, Homo sapiens
ugacucugaugagaaguuu

SEQ ID NO: 1357363 - RNA, 19 nt, Homo sapiens
cgaaauugaccuaaguguu

SEQ ID NO: 1357364 - RNA, 19 nt, Homo sapiens
gaagagaaaauaaccgaaa

SEQ ID NO: 1357365 - RNA, 19 nt, Homo sapiens
ccaaugucccugcugauga

SEQ ID NO: 1357366 - RNA, 19 nt, Homo sapiens
gaugcagagaucucaauaa

SEQ ID NO: 1357367 - RNA, 19 nt, Homo sapiens
aaagaaauuaccucucuga

SEQ ID NO: 1357368 - RNA, 19 nt, Homo sapiens
cuacuuaaaugggucuguu

SEQ ID NO: 1357369 - RNA, 19 nt, Homo sapiens
gauaccauguagaauugug

SEQ ID NO: 1357370 - RNA, 19 nt, Homo sapiens
ugaaagaagaacccgauga

SEQ ID NO: 1357371 - RNA, 19 nt, Homo sapiens
gcuauucccaaaucagaaa

SEQ ID NO: 1357372 - RNA, 19 nt, Homo sapiens
ccaaaucagaaacaacuau

SEQ ID NO: 1357373 - RNA, 19 nt, Homo sapiens
cugcaucaauagcuacaaa

SEQ ID NO: 1357374 - RNA, 19 nt, Homo sapiens
guuuaucacuguguuugaa

SEQ ID NO: 1357375 - RNA, 19 nt, Homo sapiens
gagaccacgucacuucagu

SEQ ID NO: 1357376 - RNA, 19 nt, Homo sapiens
ucacuacuauuccagacau

SEQ ID NO: 1357377 - RNA, 19 nt, Homo sapiens
uggcacagacuacuuaaau

SEQ ID NO: 1357378 - RNA, 19 nt, Homo sapiens
ccagcuagccuuaacaucu

SEQ ID NO: 1357379 - RNA, 19 nt, Homo sapiens
ucaagaagaugaagaagua

SEQ ID NO: 1357380 - RNA, 19 nt, Homo sapiens
ccaaagagauucccucauu

SEQ ID NO: 1357381 - RNA, 19 nt, Homo sapiens
ggaagugggucaauuauuc

SEQ ID NO: 1357382 - RNA, 19 nt, Homo sapiens
gagaagaccuugccuuuca

SEQ ID NO: 1357383 - RNA, 19 nt, Homo sapiens
caaagggaaugaaauaguu

SEQ ID NO: 1357384 - RNA, 19 nt, Homo sapiens
gaagucagcugcccuuuac

SEQ ID NO: 1357385 - RNA, 19 nt, Homo sapiens
ggacaugcccuuccuuuga

SEQ ID NO: 1357386 - RNA, 19 nt, Homo sapiens
gaaugggucuccuucaaug

SEQ ID NO: 1357387 - RNA, 19 nt, Homo sapiens
ggacaguguuugcugagaa

SEQ ID NO: 1357388 - RNA, 19 nt, Homo sapiens
gaagaugaccagugccuuu

SEQ ID NO: 1357389 - RNA, 19 nt, Homo sapiens
gaggaucccugagaagaaa

SEQ ID NO: 1357390 - RNA, 19 nt, Homo sapiens
caaagagauucccucauug

SEQ ID NO: 1357391 - RNA, 19 nt, Homo sapiens
agaaugugaugauccguua

SEQ ID NO: 1357392 - RNA, 19 nt, Homo sapiens
caaaggagacaaccagauu

SEQ ID NO: 1357393 - RNA, 19 nt, Homo sapiens
gaagacaccagcaguccua

SEQ ID NO: 1357394 - RNA, 19 nt, Homo sapiens
ccagucaccucuccucuga

SEQ ID NO: 1357395 - RNA, 19 nt, Homo sapiens
gaagaaauaccagcccaaa

SEQ ID NO: 1357396 - RNA, 19 nt, Homo sapiens
gugcaacucuaccugauga

SEQ ID NO: 1357397 - RNA, 19 nt, Homo sapiens
gaucccagauguaccuuau

SEQ ID NO: 1357398 - RNA, 19 nt, Homo sapiens
ccagauguaccuuauaauu

SEQ ID NO: 1357399 - RNA, 19 nt, Homo sapiens
ucaggaagugggucaauua

SEQ ID NO: 1357400 - RNA, 19 nt, Homo sapiens
cgucaaagggaaugaaaua

SEQ ID NO: 1357401 - RNA, 19 nt, Homo sapiens
ggagaugcccucugacuuc

SEQ ID NO: 1357402 - RNA, 19 nt, Homo sapiens
gcacaucuccaccucauca

SEQ ID NO: 1357403 - RNA, 19 nt, Homo sapiens
ggauagaccgugucaccua

SEQ ID NO: 1357404 - RNA, 19 nt, Homo sapiens
cagaaugggucuccuucaa

SEQ ID NO: 1357405 - RNA, 19 nt, Homo sapiens
aggcugaucugucuacauu

SEQ ID NO: 1357406 - RNA, 19 nt, Homo sapiens
ucccagauguaccuuauaa

SEQ ID NO: 1357407 - RNA, 19 nt, Homo sapiens
ccaaauacaccaccaagug

SEQ ID NO: 1357408 - RNA, 19 nt, Homo sapiens
ugagacagcccuaccauug

SEQ ID NO: 1357409 - RNA, 19 nt, Homo sapiens
guucagaagcuggauauuu

SEQ ID NO: 1357410 - RNA, 19 nt, Homo sapiens
gggaacaggugauuaagcu

SEQ ID NO: 1357411 - RNA, 19 nt, Homo sapiens
gagauucccucauugucau

SEQ ID NO: 1357412 - RNA, 19 nt, Homo sapiens
gcaagacaccuagaacaga

SEQ ID NO: 1357413 - RNA, 19 nt, Homo sapiens
aaacaacuccaaauugaug

SEQ ID NO: 1357414 - RNA, 19 nt, Homo sapiens
caaccaacccuuuccugaa

SEQ ID NO: 1357415 - RNA, 19 nt, Homo sapiens
cuggauauuuccucuuuaa

SEQ ID NO: 1357416 - RNA, 19 nt, Homo sapiens
gcacuuugaugaacuucuc

SEQ ID NO: 1357417 - RNA, 19 nt, Homo sapiens
ucacgugaaugucgaguuc

SEQ ID NO: 1357418 - RNA, 19 nt, Homo sapiens
cuggagaucugucaugaga

SEQ ID NO: 1357419 - RNA, 19 nt, Homo sapiens
ccagugaccucugcucguu

SEQ ID NO: 1357420 - RNA, 19 nt, Homo sapiens
gaugcccucugacuucuga

SEQ ID NO: 1357421 - RNA, 19 nt, Homo sapiens
gagccugucaugagaguaa

SEQ ID NO: 1357422 - RNA, 19 nt, Homo sapiens
ggaccgaucuucgucaaac

SEQ ID NO: 1357423 - RNA, 19 nt, Homo sapiens
guacagcccuccccuauca

SEQ ID NO: 1357424 - RNA, 19 nt, Homo sapiens
gaaugagacucugcaggau

SEQ ID NO: 1357425 - RNA, 19 nt, Homo sapiens
ccagcugggucaccuuuga

SEQ ID NO: 1357426 - RNA, 19 nt, Homo sapiens
caccagcaguccuagcuuu

SEQ ID NO: 1357427 - RNA, 19 nt, Homo sapiens
ccaaauugaugacccugau

SEQ ID NO: 1357428 - RNA, 19 nt, Homo sapiens
gcuggauauuuccucuuua

SEQ ID NO: 1357429 - RNA, 19 nt, Homo sapiens
caagagcacuuugaugaac

SEQ ID NO: 1357430 - RNA, 19 nt, Homo sapiens
ugaagucagcugcccuuua

SEQ ID NO: 1357431 - RNA, 19 nt, Homo sapiens
gagacagcccuaccauuga

SEQ ID NO: 1357432 - RNA, 19 nt, Homo sapiens
cccaagagcacuuugauga

SEQ ID NO: 1357433 - RNA, 19 nt, Homo sapiens
ucauggaucugccaguguu

SEQ ID NO: 1357434 - RNA, 19 nt, Homo sapiens
caacucuaccugaugauga

SEQ ID NO: 1357435 - RNA, 19 nt, Homo sapiens
uucagaagcuggauauuuc

SEQ ID NO: 1357436 - RNA, 19 nt, Homo sapiens
caaugaagagccacccuuu

SEQ ID NO: 1357437 - RNA, 19 nt, Homo sapiens
ucaauuauucugcacacua

SEQ ID NO: 1357438 - RNA, 19 nt, Homo sapiens
agagggaacaggugauuaa

SEQ ID NO: 1357439 - RNA, 19 nt, Homo sapiens
ggucagcagugugaagaug

SEQ ID NO: 1357440 - RNA, 19 nt, Homo sapiens
uacgaugacuuccugaguu

SEQ ID NO: 1357441 - RNA, 19 nt, Homo sapiens
gagaggcgcucccaaaaca

SEQ ID NO: 1357442 - RNA, 19 nt, Homo sapiens
gauauuuccucuuuaaacc

SEQ ID NO: 1357443 - RNA, 19 nt, Homo sapiens
gcugaucugucuacauucu

SEQ ID NO: 1357444 - RNA, 19 nt, Homo sapiens
uagccaugcuuacuauguu

SEQ ID NO: 1357445 - RNA, 19 nt, Homo sapiens
acgaugacuuccugaguuu

SEQ ID NO: 1357446 - RNA, 19 nt, Homo sapiens
gagagggaacaggugauua

SEQ ID NO: 1357447 - RNA, 19 nt, Homo sapiens
uagaccgugucaccuauaa

SEQ ID NO: 1357448 - RNA, 19 nt, Homo sapiens
gaucugcagcucaucaaug

SEQ ID NO: 1357449 - RNA, 19 nt, Homo sapiens
ggaccacccauucugaaga

SEQ ID NO: 1357450 - RNA, 19 nt, Homo sapiens
caauuauucugcacacuac

SEQ ID NO: 1357451 - RNA, 19 nt, Homo sapiens
aagagaggcugaucugucu

SEQ ID NO: 1357452 - RNA, 19 nt, Homo sapiens
gcaaaggagacaaccagau

SEQ ID NO: 1357453 - RNA, 19 nt, Homo sapiens
gcaccaccaauuacgauga

SEQ ID NO: 1357454 - RNA, 19 nt, Homo sapiens
cugguuaccugcagcugua

SEQ ID NO: 1357455 - RNA, 19 nt, Homo sapiens
ccaacccuuuccugaauga

SEQ ID NO: 1357456 - RNA, 19 nt, Homo sapiens
aaccaacccuuuccugaau

SEQ ID NO: 1357457 - RNA, 19 nt, Homo sapiens
cagauguaccuuauaauuc

SEQ ID NO: 1357458 - RNA, 19 nt, Homo sapiens
uuacuauguucgccuggua

SEQ ID NO: 1357459 - RNA, 19 nt, Homo sapiens
guacgagcaugccuucaac

SEQ ID NO: 1357460 - RNA, 19 nt, Homo sapiens
ccaagagcacuuugaugaa

SEQ ID NO: 1357461 - RNA, 19 nt, Homo sapiens
auacagaucugcagcucau

SEQ ID NO: 1357462 - RNA, 19 nt, Homo sapiens
uaaaccgacugccggacaa

SEQ ID NO: 1357463 - RNA, 19 nt, Homo sapiens
ggauauuuccucuuuaaac

SEQ ID NO: 1357464 - RNA, 19 nt, Homo sapiens
caccuuugaugacaaugaa

SEQ ID NO: 1357465 - RNA, 19 nt, Homo sapiens
gcuuccaacuccauuuguu

SEQ ID NO: 1357466 - RNA, 19 nt, Homo sapiens
ggccaaugauguugaggau

SEQ ID NO: 1357467 - RNA, 19 nt, Homo sapiens
gcacgccuucuguaacuga

SEQ ID NO: 1357468 - RNA, 19 nt, Homo sapiens
cagcacaucuccaccucau

SEQ ID NO: 1357469 - RNA, 19 nt, Homo sapiens
uugaugaacuucuccaaag

SEQ ID NO: 1357470 - RNA, 19 nt, Homo sapiens
ccucuccucugaagccaaa

SEQ ID NO: 1357471 - RNA, 19 nt, Homo sapiens
ugacgacuuuggaccaugu

SEQ ID NO: 1357472 - RNA, 19 nt, Homo sapiens
ugacucaacugacaauucc

SEQ ID NO: 1357473 - RNA, 19 nt, Homo sapiens
ucccaggacugucaucuuc

SEQ ID NO: 1357474 - RNA, 19 nt, Homo sapiens
ucacccacacuguuucuuu

SEQ ID NO: 1357475 - RNA, 19 nt, Homo sapiens
ccacaacucacgggucauu

SEQ ID NO: 1357476 - RNA, 19 nt, Homo sapiens
ucaaagggaaugaaauagu

SEQ ID NO: 1357477 - RNA, 19 nt, Homo sapiens
ccuauaaagagaagaagaa

SEQ ID NO: 1357478 - RNA, 19 nt, Homo sapiens
ugaucugucuacauucuga

SEQ ID NO: 1357479 - RNA, 19 nt, Homo sapiens
gcagugagcucugauggua

SEQ ID NO: 1357480 - RNA, 19 nt, Homo sapiens
ccaaggugcugcagaaaua

SEQ ID NO: 1357481 - RNA, 19 nt, Homo sapiens
gagcuguccugucaucuuu

SEQ ID NO: 1357482 - RNA, 19 nt, Homo sapiens
acacagaucuuuguccuaa

SEQ ID NO: 1357483 - RNA, 19 nt, Homo sapiens
ggagagcuguccugucauc

SEQ ID NO: 1357484 - RNA, 19 nt, Homo sapiens
ggagaacugugccgacauc

SEQ ID NO: 1357485 - RNA, 19 nt, Homo sapiens
ggaagcagguccaguuugc

SEQ ID NO: 1357486 - RNA, 19 nt, Homo sapiens
ugagaaggauggagcugaa

SEQ ID NO: 1357487 - RNA, 19 nt, Homo sapiens
ggccuguggucaagaauga

SEQ ID NO: 1357488 - RNA, 19 nt, Homo sapiens
ugaggcagauccuuguuga

SEQ ID NO: 1357489 - RNA, 19 nt, Homo sapiens
ggcacgagcuggcguuugu

SEQ ID NO: 1357490 - RNA, 19 nt, Homo sapiens
gcccuggccugaauguuga

SEQ ID NO: 1357491 - RNA, 19 nt, Homo sapiens
gaguacaugauucaguuua

SEQ ID NO: 1357492 - RNA, 19 nt, Homo sapiens
ucacugauguggccagcuu

SEQ ID NO: 1357493 - RNA, 19 nt, Homo sapiens
gagacgcagugaaggaaga

SEQ ID NO: 1357494 - RNA, 19 nt, Homo sapiens
gcacuacccgcucauguuc

SEQ ID NO: 1357495 - RNA, 19 nt, Homo sapiens
gcgcaggccucugagauca

SEQ ID NO: 1357496 - RNA, 19 nt, Homo sapiens
uggagaagguuccggaaga

SEQ ID NO: 1357497 - RNA, 19 nt, Homo sapiens
gaacugugccgacaucaac

SEQ ID NO: 1357498 - RNA, 19 nt, Homo sapiens
gauggugucuguggaguuc

SEQ ID NO: 1357499 - RNA, 19 nt, Homo sapiens
ccacaucguauucugguuu

SEQ ID NO: 1357500 - RNA, 19 nt, Homo sapiens
gcagcacggcuuccuggua

SEQ ID NO: 1357501 - RNA, 19 nt, Homo sapiens
uguggaggcugcccuuuga

SEQ ID NO: 1357502 - RNA, 19 nt, Homo sapiens
ucaaggcccugugugagaa

SEQ ID NO: 1357503 - RNA, 19 nt, Homo sapiens
ggugaaggaguacaugauu

SEQ ID NO: 1357504 - RNA, 19 nt, Homo sapiens
ucuguggaguucagguuua

SEQ ID NO: 1357505 - RNA, 19 nt, Homo sapiens
ggaccaguguaaggaaguu

SEQ ID NO: 1357506 - RNA, 19 nt, Homo sapiens
cacauaugcuggacacuca

SEQ ID NO: 1357507 - RNA, 19 nt, Homo sapiens
gugaaggaguacaugauuc

SEQ ID NO: 1357508 - RNA, 19 nt, Homo sapiens
gcaggagaaucgcuugacu

SEQ ID NO: 1357509 - RNA, 19 nt, Homo sapiens
uggcugaggugguccguau

SEQ ID NO: 1357510 - RNA, 19 nt, Homo sapiens
ggagaagguuccggaagag

SEQ ID NO: 1357511 - RNA, 19 nt, Homo sapiens
aggaguacaugauucaguu

SEQ ID NO: 1357512 - RNA, 19 nt, Homo sapiens
gaaaccccgucuccacuaa

SEQ ID NO: 1357513 - RNA, 19 nt, Homo sapiens
cugaagagccugcgcuuug

SEQ ID NO: 1357514 - RNA, 19 nt, Homo sapiens
ccacgaggacgcacauaug

SEQ ID NO: 1357515 - RNA, 19 nt, Homo sapiens
ggaagcugcucaggaagag

SEQ ID NO: 1357516 - RNA, 19 nt, Homo sapiens
ugaaaagccugcacucuuc

SEQ ID NO: 1357517 - RNA, 19 nt, Homo sapiens
guggaguucagguuuauuu

SEQ ID NO: 1357518 - RNA, 19 nt, Homo sapiens
cgagguggcugugcacauc

SEQ ID NO: 1357519 - RNA, 19 nt, Homo sapiens
gcucuucuggguccaaauu

SEQ ID NO: 1357520 - RNA, 19 nt, Homo sapiens
ucagggaggcucuggagaa

SEQ ID NO: 1357521 - RNA, 19 nt, Homo sapiens
ggaguacaugauucaguuu

SEQ ID NO: 1357522 - RNA, 19 nt, Homo sapiens
acgaacagaugguggacuu

SEQ ID NO: 1357523 - RNA, 19 nt, Homo sapiens
uagaaacacagaucuuugu

SEQ ID NO: 1357524 - RNA, 19 nt, Homo sapiens
gcacccuguucaccguuga

SEQ ID NO: 1357525 - RNA, 19 nt, Homo sapiens
ggacgaagggaaugagaac

SEQ ID NO: 1357526 - RNA, 19 nt, Homo sapiens
uacaagagcaagcugaaga

SEQ ID NO: 1357527 - RNA, 19 nt, Homo sapiens
gcacuugcccagagcuauc

SEQ ID NO: 1357528 - RNA, 19 nt, Homo sapiens
caucaccgccuguguccuu

SEQ ID NO: 1357529 - RNA, 19 nt, Homo sapiens
gcccauaauccagcacuuu

SEQ ID NO: 1357530 - RNA, 19 nt, Homo sapiens
caagugaacguggcuguca

SEQ ID NO: 1357531 - RNA, 19 nt, Homo sapiens
ccagacgggugcaccucuu

SEQ ID NO: 1357532 - RNA, 19 nt, Homo sapiens
cggacgacaugcacccauu

SEQ ID NO: 1357533 - RNA, 19 nt, Homo sapiens
ccaacuaugccuuccugaa

SEQ ID NO: 1357534 - RNA, 19 nt, Homo sapiens
gugggaggcucggaaguuc

SEQ ID NO: 1357535 - RNA, 19 nt, Homo sapiens
ccaacaagucgguggaugu

SEQ ID NO: 1357536 - RNA, 19 nt, Homo sapiens
ggcguagccuccuggacuu

SEQ ID NO: 1357537 - RNA, 19 nt, Homo sapiens
guuugcugcucacuucuga

SEQ ID NO: 1357538 - RNA, 19 nt, Homo sapiens
ggaagccgugcguggacua

SEQ ID NO: 1357539 - RNA, 19 nt, Homo sapiens
ggacgacaugcacccauuc

SEQ ID NO: 1357540 - RNA, 19 nt, Homo sapiens
gaaauaccacacggagcuu

SEQ ID NO: 1357541 - RNA, 19 nt, Homo sapiens
ggaugcagaggcugacuuc

SEQ ID NO: 1357542 - RNA, 19 nt, Homo sapiens
aggcagagccgggagauga

SEQ ID NO: 1357543 - RNA, 19 nt, Homo sapiens
auucagggcccaccaggua

SEQ ID NO: 1357544 - RNA, 19 nt, Homo sapiens
gcacccaggacuacgaaca

SEQ ID NO: 1357545 - RNA, 19 nt, Homo sapiens
gguccgacugcuucuauga

SEQ ID NO: 1357546 - RNA, 19 nt, Homo sapiens
ggccuggaguacagcuuga

SEQ ID NO: 1357547 - RNA, 19 nt, Homo sapiens
ggcacuacccgcucauguu

SEQ ID NO: 1357548 - RNA, 19 nt, Homo sapiens
gcuaccagcaggagacuca

SEQ ID NO: 1357549 - RNA, 19 nt, Homo sapiens
cugcucggcuguauguuuc

SEQ ID NO: 1357550 - RNA, 19 nt, Homo sapiens
gggcugauuucuggauugg

SEQ ID NO: 1357551 - RNA, 19 nt, Homo sapiens
gcgcgguugccgagaauga

SEQ ID NO: 1357552 - RNA, 19 nt, Homo sapiens
guaccuggacgugguguug

SEQ ID NO: 1357553 - RNA, 19 nt, Homo sapiens
gugcugggcgugcugaaga

SEQ ID NO: 1357554 - RNA, 19 nt, Homo sapiens
aggcugcccuuugaccuuu

SEQ ID NO: 1357555 - RNA, 19 nt, Homo sapiens
cguauucugguuucauaaa

SEQ ID NO: 1357556 - RNA, 19 nt, Homo sapiens
ggucaccacggacgacaug

SEQ ID NO: 1357557 - RNA, 19 nt, Homo sapiens
ccaggacuacgaacagaug

SEQ ID NO: 1357558 - RNA, 19 nt, Homo sapiens
acaucauggugaaggagua

SEQ ID NO: 1357559 - RNA, 19 nt, Homo sapiens
gcugaggugguccguauca

SEQ ID NO: 1357560 - RNA, 19 nt, Homo sapiens
caacaagucgguggauguc

SEQ ID NO: 1357561 - RNA, 19 nt, Homo sapiens
cagggaggcucuggagaag

SEQ ID NO: 1357562 - RNA, 19 nt, Homo sapiens
uaugugguuuccucugguu

SEQ ID NO: 1357563 - RNA, 19 nt, Homo sapiens
cccacccucugaaauguga

SEQ ID NO: 1357564 - RNA, 19 nt, Homo sapiens
acaaaaccagcaucuguua

SEQ ID NO: 1357565 - RNA, 19 nt, Homo sapiens
aaacaaaaccagcaucugu

SEQ ID NO: 1357566 - RNA, 19 nt, Homo sapiens
acaacgcgcaggccucuga

SEQ ID NO: 1357567 - RNA, 19 nt, Homo sapiens
ucuguggcguucuacaaga

SEQ ID NO: 1357568 - RNA, 19 nt, Homo sapiens
ccuccgugguccagucuga

SEQ ID NO: 1357569 - RNA, 19 nt, Homo sapiens
uugcgcaggucgucgagaa

SEQ ID NO: 1357570 - RNA, 19 nt, Homo sapiens
aaaccagcaucuguuacug

SEQ ID NO: 1357571 - RNA, 19 nt, Homo sapiens
agaaugagcggcugcaaaa

SEQ ID NO: 1357572 - RNA, 19 nt, Homo sapiens
aagaaugagcggcugcaaa

SEQ ID NO: 1357573 - RNA, 19 nt, Homo sapiens
agacggcccuguggaagca

SEQ ID NO: 1357574 - RNA, 19 nt, Homo sapiens
ucacgcugcaguacuguug

SEQ ID NO: 1357575 - RNA, 19 nt, Homo sapiens
ugaagagccugcgcuuugc

SEQ ID NO: 1357576 - RNA, 19 nt, Homo sapiens
auagaaacacagaucuuug

SEQ ID NO: 1357577 - RNA, 19 nt, Homo sapiens
gucaggaguucgagaccau

SEQ ID NO: 1357578 - RNA, 19 nt, Homo sapiens
uguaaucacucuggauggu

SEQ ID NO: 1357579 - RNA, 19 nt, Homo sapiens
gcagagaaaugaucaaauu

SEQ ID NO: 1357580 - RNA, 19 nt, Homo sapiens
gaacaggaguuuacuuauu

SEQ ID NO: 1357581 - RNA, 19 nt, Homo sapiens
gcacaacggcucugacuua

SEQ ID NO: 1357582 - RNA, 19 nt, Homo sapiens
gagggaaacugcauugauu

SEQ ID NO: 1357583 - RNA, 19 nt, Homo sapiens
ggagggaaaugcagagaaa

SEQ ID NO: 1357584 - RNA, 19 nt, Homo sapiens
ggaguggucuuuauagaga

SEQ ID NO: 1357585 - RNA, 19 nt, Homo sapiens
ggaaguaguaggcauauuu

SEQ ID NO: 1357586 - RNA, 19 nt, Homo sapiens
aaacauggcugauggacaa

SEQ ID NO: 1357587 - RNA, 19 nt, Homo sapiens
gaauucagcuuccuuugau

SEQ ID NO: 1357588 - RNA, 19 nt, Homo sapiens
cacagcaggugucgaauua

SEQ ID NO: 1357589 - RNA, 19 nt, Homo sapiens
uaacuaagaucgugauuac

SEQ ID NO: 1357590 - RNA, 19 nt, Homo sapiens
gcauugauucucaguauua

SEQ ID NO: 1357591 - RNA, 19 nt, Homo sapiens
gaaacugcauugauucuca

SEQ ID NO: 1357592 - RNA, 19 nt, Homo sapiens
ucugauagcuguugugauu

SEQ ID NO: 1357593 - RNA, 19 nt, Homo sapiens
caacggcucugacuuaaca

SEQ ID NO: 1357594 - RNA, 19 nt, Homo sapiens
gaaacaauaucgccaagag

SEQ ID NO: 1357595 - RNA, 19 nt, Homo sapiens
gcagaucagguacaaguua

SEQ ID NO: 1357596 - RNA, 19 nt, Homo sapiens
gaacuuagcgcggauguau

SEQ ID NO: 1357597 - RNA, 19 nt, Homo sapiens
caacuucaggccacuauua

SEQ ID NO: 1357598 - RNA, 19 nt, Homo sapiens
ggaaccauuucuucuauau

SEQ ID NO: 1357599 - RNA, 19 nt, Homo sapiens
ggaaaggacacacucguuu

SEQ ID NO: 1357600 - RNA, 19 nt, Homo sapiens
ggucuccacuugugucuaa

SEQ ID NO: 1357601 - RNA, 19 nt, Homo sapiens
caacuucaccacauaauga

SEQ ID NO: 1357602 - RNA, 19 nt, Homo sapiens
gaaguuugcagaucaggua

SEQ ID NO: 1357603 - RNA, 19 nt, Homo sapiens
ucagugaccuucagauaga

SEQ ID NO: 1357604 - RNA, 19 nt, Homo sapiens
cgaaugcucuuacacugaa

SEQ ID NO: 1357605 - RNA, 19 nt, Homo sapiens
gcucauccgugauauacaa

SEQ ID NO: 1357606 - RNA, 19 nt, Homo sapiens
cagcagcuaugggaaguua

SEQ ID NO: 1357607 - RNA, 19 nt, Homo sapiens
gcagucaaaucucugguau

SEQ ID NO: 1357608 - RNA, 19 nt, Homo sapiens
agucacggcuggucaauaa

SEQ ID NO: 1357609 - RNA, 19 nt, Homo sapiens
cagcaggugucgaauuaaa

SEQ ID NO: 1357610 - RNA, 19 nt, Homo sapiens
ucaagagccugauguuguu

SEQ ID NO: 1357611 - RNA, 19 nt, Homo sapiens
ggaaugaauggaccaauga

SEQ ID NO: 1357612 - RNA, 19 nt, Homo sapiens
ucacaucacacugcaauua

SEQ ID NO: 1357613 - RNA, 19 nt, Homo sapiens
gaacaucuuccaguaacua

SEQ ID NO: 1357614 - RNA, 19 nt, Homo sapiens
cuggauugcuugcuuauaa

SEQ ID NO: 1357615 - RNA, 19 nt, Homo sapiens
gugaacaggaguuuacuua

SEQ ID NO: 1357616 - RNA, 19 nt, Homo sapiens
gaaauacuaauccagagaa

SEQ ID NO: 1357617 - RNA, 19 nt, Homo sapiens
ggagcaccuuucauuguaa

SEQ ID NO: 1357618 - RNA, 19 nt, Homo sapiens
gcagaugacugugaugauc

SEQ ID NO: 1357619 - RNA, 19 nt, Homo sapiens
gaaaggacacacucguuug

SEQ ID NO: 1357620 - RNA, 19 nt, Homo sapiens
cauauucuccugucuuuaa

SEQ ID NO: 1357621 - RNA, 19 nt, Homo sapiens
gcagucaugugaagccuau

SEQ ID NO: 1357622 - RNA, 19 nt, Homo sapiens
gaucagcuuuggagggauu

SEQ ID NO: 1357623 - RNA, 19 nt, Homo sapiens
caacuguucugguaugauc

SEQ ID NO: 1357624 - RNA, 19 nt, Homo sapiens
ugccauagcuguucgcauu

SEQ ID NO: 1357625 - RNA, 19 nt, Homo sapiens
agucaaaucucugguauug

SEQ ID NO: 1357626 - RNA, 19 nt, Homo sapiens
ccauagcuguucgcauuua

SEQ ID NO: 1357627 - RNA, 19 nt, Homo sapiens
ggacaacuucaccacauaa

SEQ ID NO: 1357628 - RNA, 19 nt, Homo sapiens
cagaucagguacaaguuaa

SEQ ID NO: 1357629 - RNA, 19 nt, Homo sapiens
aaacuuaagucgaaucucu

SEQ ID NO: 1357630 - RNA, 19 nt, Homo sapiens
cuauauagauucagaugga

SEQ ID NO: 1357631 - RNA, 19 nt, Homo sapiens
gcagagugaugggauucua

SEQ ID NO: 1357632 - RNA, 19 nt, Homo sapiens
agaauucagugcagucaaa

SEQ ID NO: 1357633 - RNA, 19 nt, Homo sapiens
gauaauagaaggagacaag

SEQ ID NO: 1357634 - RNA, 19 nt, Homo sapiens
gaaguuaugccgcaaugga

SEQ ID NO: 1357635 - RNA, 19 nt, Homo sapiens
guaggaagaaccaaugaaa

SEQ ID NO: 1357636 - RNA, 19 nt, Homo sapiens
uaacaagagucagaaauac

SEQ ID NO: 1357637 - RNA, 19 nt, Homo sapiens
ggaugacccuggauuugga

SEQ ID NO: 1357638 - RNA, 19 nt, Homo sapiens
ugaugggcauguccuguua

SEQ ID NO: 1357639 - RNA, 19 nt, Homo sapiens
acacuggauugcuugcuua

SEQ ID NO: 1357640 - RNA, 19 nt, Homo sapiens
gcacagaggaaauacuuca

SEQ ID NO: 1357641 - RNA, 19 nt, Homo sapiens
uggagcaccuuucauugua

SEQ ID NO: 1357642 - RNA, 19 nt, Homo sapiens
gaacuucagugaccuucag

SEQ ID NO: 1357643 - RNA, 19 nt, Homo sapiens
gaucauugcuaugggaaau

SEQ ID NO: 1357644 - RNA, 19 nt, Homo sapiens
cagaagugguugaucuuga

SEQ ID NO: 1357645 - RNA, 19 nt, Homo sapiens
ccagcuaccuccugauguu

SEQ ID NO: 1357646 - RNA, 19 nt, Homo sapiens
gaacaauagaugacagaga

SEQ ID NO: 1357647 - RNA, 19 nt, Homo sapiens
ccaaugaaacgcaaaccua

SEQ ID NO: 1357648 - RNA, 19 nt, Homo sapiens
ucucauagcauucauucua

SEQ ID NO: 1357649 - RNA, 19 nt, Homo sapiens
gaagccucguccagugaua

SEQ ID NO: 1357650 - RNA, 19 nt, Homo sapiens
gauuggcagcuaugauuua

SEQ ID NO: 1357651 - RNA, 19 nt, Homo sapiens
caaauuuaguuuccgaaca

SEQ ID NO: 1357652 - RNA, 19 nt, Homo sapiens
ccaggugacuccagaagug

SEQ ID NO: 1357653 - RNA, 19 nt, Homo sapiens
ggggauugcugauuuuaua

SEQ ID NO: 1357654 - RNA, 19 nt, Homo sapiens
caauuucgaacuuggaaua

SEQ ID NO: 1357655 - RNA, 19 nt, Homo sapiens
guucggaugugcauacaga

SEQ ID NO: 1357656 - RNA, 19 nt, Homo sapiens
uggaucagcugacaccaaa

SEQ ID NO: 1357657 - RNA, 19 nt, Homo sapiens
gcaaagugguagaucugau

SEQ ID NO: 1357658 - RNA, 19 nt, Homo sapiens
acuauaauguccuugcuuu

SEQ ID NO: 1357659 - RNA, 19 nt, Homo sapiens
cuaguaagcccuggaagua

SEQ ID NO: 1357660 - RNA, 19 nt, Homo sapiens
gagauugacgauaauagaa

SEQ ID NO: 1357661 - RNA, 19 nt, Homo sapiens
cauccgugauauacaauuu

SEQ ID NO: 1357662 - RNA, 19 nt, Homo sapiens
guaacuaagaucgugauua

SEQ ID NO: 1357663 - RNA, 19 nt, Homo sapiens
ggccugagcagauuuauuc

SEQ ID NO: 1357664 - RNA, 19 nt, Homo sapiens
gaaggaguggucuuuauag

SEQ ID NO: 1357665 - RNA, 19 nt, Homo sapiens
gcaauuaagaagagcaaga

SEQ ID NO: 1357666 - RNA, 19 nt, Homo sapiens
aaauggagaucacaucaca

SEQ ID NO: 1357667 - RNA, 19 nt, Homo sapiens
gagcagagaaaugaucaaa

SEQ ID NO: 1357668 - RNA, 19 nt, Homo sapiens
ggacauugcagcagcuaug

SEQ ID NO: 1357669 - RNA, 19 nt, Homo sapiens
ucagugucauucccacaua

SEQ ID NO: 1357670 - RNA, 19 nt, Homo sapiens
cagacaguguuguguacua

SEQ ID NO: 1357671 - RNA, 19 nt, Homo sapiens
gcaaaugcagacaguguug

SEQ ID NO: 1357672 - RNA, 19 nt, Homo sapiens
agaaggaguggucuuuaua

SEQ ID NO: 1357673 - RNA, 19 nt, Homo sapiens
gaucagcugacaccaaaga

SEQ ID NO: 1357674 - RNA, 19 nt, Homo sapiens
ggaaauacuucaggguuuu

SEQ ID NO: 1357675 - RNA, 19 nt, Homo sapiens
uauaagcacagaggaaaua

SEQ ID NO: 1357676 - RNA, 19 nt, Homo sapiens
caaagugguagaucugauu

SEQ ID NO: 1357677 - RNA, 19 nt, Homo sapiens
gcaguggcauucugucucu

SEQ ID NO: 1357678 - RNA, 19 nt, Homo sapiens
cacgaaagccucagcacua

SEQ ID NO: 1357679 - RNA, 19 nt, Homo sapiens
gaacaggaguuuacuuauu

SEQ ID NO: 1357680 - RNA, 19 nt, Homo sapiens
gcacaacggcucugacuua

SEQ ID NO: 1357681 - RNA, 19 nt, Homo sapiens
gagggaaacugcauugauu

SEQ ID NO: 1357682 - RNA, 19 nt, Homo sapiens
cacagcaggugucgaauua

SEQ ID NO: 1357683 - RNA, 19 nt, Homo sapiens
gcauugauucucaguauua

SEQ ID NO: 1357684 - RNA, 19 nt, Homo sapiens
gaaacugcauugauucuca

SEQ ID NO: 1357685 - RNA, 19 nt, Homo sapiens
caacggcucugacuuaaca

SEQ ID NO: 1357686 - RNA, 19 nt, Homo sapiens
gaaacaauaucgccaagag

SEQ ID NO: 1357687 - RNA, 19 nt, Homo sapiens
caacuucaggccacuauua

SEQ ID NO: 1357688 - RNA, 19 nt, Homo sapiens
ggaaccauuucuucuauau

SEQ ID NO: 1357689 - RNA, 19 nt, Homo sapiens
ggucuccacuugugucuaa

SEQ ID NO: 1357690 - RNA, 19 nt, Homo sapiens
ucagugaccuucagauaga

SEQ ID NO: 1357691 - RNA, 19 nt, Homo sapiens
agucacggcuggucaauaa

SEQ ID NO: 1357692 - RNA, 19 nt, Homo sapiens
cagcaggugucgaauuaaa

SEQ ID NO: 1357693 - RNA, 19 nt, Homo sapiens
ucacaucacacugcaauua

SEQ ID NO: 1357694 - RNA, 19 nt, Homo sapiens
gugaacaggaguuuacuua

SEQ ID NO: 1357695 - RNA, 19 nt, Homo sapiens
gaaauacuaauccagagaa

SEQ ID NO: 1357696 - RNA, 19 nt, Homo sapiens
ggagcaccuuucauuguaa

SEQ ID NO: 1357697 - RNA, 19 nt, Homo sapiens
gcagucaugugaagccuau

SEQ ID NO: 1357698 - RNA, 19 nt, Homo sapiens
gaucagcuuuggagggauu

SEQ ID NO: 1357699 - RNA, 19 nt, Homo sapiens
aaacuuaagucgaaucucu

SEQ ID NO: 1357700 - RNA, 19 nt, Homo sapiens
cuauauagauucagaugga

SEQ ID NO: 1357701 - RNA, 19 nt, Homo sapiens
gcagagugaugggauucua

SEQ ID NO: 1357702 - RNA, 19 nt, Homo sapiens
gaacaaguuagugcaauga

SEQ ID NO: 1357703 - RNA, 19 nt, Homo sapiens
guaggaagaaccaaugaaa

SEQ ID NO: 1357704 - RNA, 19 nt, Homo sapiens
uaacaagagucagaaauac

SEQ ID NO: 1357705 - RNA, 19 nt, Homo sapiens
gcacagaggaaauacuuca

SEQ ID NO: 1357706 - RNA, 19 nt, Homo sapiens
uggagcaccuuucauugua

SEQ ID NO: 1357707 - RNA, 19 nt, Homo sapiens
gaacuucagugaccuucag

SEQ ID NO: 1357708 - RNA, 19 nt, Homo sapiens
gaucauugcuaugggaaau

SEQ ID NO: 1357709 - RNA, 19 nt, Homo sapiens
cagaagugguugaucuuga

SEQ ID NO: 1357710 - RNA, 19 nt, Homo sapiens
ccagcuaccuccugauguu

SEQ ID NO: 1357711 - RNA, 19 nt, Homo sapiens
ccaaugaaacgcaaaccua

SEQ ID NO: 1357712 - RNA, 19 nt, Homo sapiens
caauuucgaacuuggaaua

SEQ ID NO: 1357713 - RNA, 19 nt, Homo sapiens
guucggaugugcauacaga

SEQ ID NO: 1357714 - RNA, 19 nt, Homo sapiens
gaacuaugacugugaugau

SEQ ID NO: 1357715 - RNA, 19 nt, Homo sapiens
gcaaagugguagaucugau

SEQ ID NO: 1357716 - RNA, 19 nt, Homo sapiens
gccagauacugaacaaguu

SEQ ID NO: 1357717 - RNA, 19 nt, Homo sapiens
ggccugagcagauuuauuc

SEQ ID NO: 1357718 - RNA, 19 nt, Homo sapiens
ccagauacugaacaaguua

SEQ ID NO: 1357719 - RNA, 19 nt, Homo sapiens
gcaauuaagaagagcaaga

SEQ ID NO: 1357720 - RNA, 19 nt, Homo sapiens
aaauggagaucacaucaca

SEQ ID NO: 1357721 - RNA, 19 nt, Homo sapiens
ucagugucauucccacaua

SEQ ID NO: 1357722 - RNA, 19 nt, Homo sapiens
cagacaguguuguguacua

SEQ ID NO: 1357723 - RNA, 19 nt, Homo sapiens
gcaaaugcagacaguguug

SEQ ID NO: 1357724 - RNA, 19 nt, Homo sapiens
cggaaugaauggugauuuc

SEQ ID NO: 1357725 - RNA, 19 nt, Homo sapiens
ggaaauacuucaggguuuu

SEQ ID NO: 1357726 - RNA, 19 nt, Homo sapiens
uauaagcacagaggaaaua

SEQ ID NO: 1357727 - RNA, 19 nt, Homo sapiens
caaagugguagaucugauu

SEQ ID NO: 1357728 - RNA, 19 nt, Homo sapiens
gcaguggcauucugucucu

SEQ ID NO: 1357729 - RNA, 19 nt, Homo sapiens
auguauagcuagccagaua

SEQ ID NO: 1357730 - RNA, 19 nt, Homo sapiens
cacaacggcucugacuuaa

SEQ ID NO: 1357731 - RNA, 19 nt, Homo sapiens
cauuguaacuguaccaaca

SEQ ID NO: 1357732 - RNA, 19 nt, Homo sapiens
gguguuugcccaacuauug

SEQ ID NO: 1357733 - RNA, 19 nt, Homo sapiens
gaaugcgaaucgaaguguu

SEQ ID NO: 1357734 - RNA, 19 nt, Homo sapiens
gcaggugucgaauuaaaug

SEQ ID NO: 1357735 - RNA, 19 nt, Homo sapiens
ugaacaaguuagugcaaug

SEQ ID NO: 1357736 - RNA, 19 nt, Homo sapiens
ggauuugcaaggcugaaua

SEQ ID NO: 1357737 - RNA, 19 nt, Homo sapiens
acaagagucagaaauacua

SEQ ID NO: 1357738 - RNA, 19 nt, Homo sapiens
aggaaauacuucaggguuu

SEQ ID NO: 1357739 - RNA, 19 nt, Homo sapiens
gaucacaucacacugcaau

SEQ ID NO: 1357740 - RNA, 19 nt, Homo sapiens
caucacagcaggugucgaa

SEQ ID NO: 1357741 - RNA, 19 nt, Homo sapiens
ggauuucagggauguauga

SEQ ID NO: 1357742 - RNA, 19 nt, Homo sapiens
guggcauucugucucuuua

SEQ ID NO: 1357743 - RNA, 19 nt, Homo sapiens
gguauccuccucuuucuga

SEQ ID NO: 1357744 - RNA, 19 nt, Homo sapiens
aaccacagaucauugcuau

SEQ ID NO: 1357745 - RNA, 19 nt, Homo sapiens
ggugauuuccauacgauuu

SEQ ID NO: 1357746 - RNA, 19 nt, Homo sapiens
gaggagcuacuugccauaa

SEQ ID NO: 1357747 - RNA, 19 nt, Homo sapiens
agacucauguggcaucuca

SEQ ID NO: 1357748 - RNA, 19 nt, Homo sapiens
ggcuggaacuggaaacaau

SEQ ID NO: 1357749 - RNA, 19 nt, Homo sapiens
cugcauugauucucaguau

SEQ ID NO: 1357750 - RNA, 19 nt, Homo sapiens
ggagcuacuugccauaacu

SEQ ID NO: 1357751 - RNA, 19 nt, Homo sapiens
ggugucgaauuaaaugaug

SEQ ID NO: 1357752 - RNA, 19 nt, Homo sapiens
guucacaaccacaaucuau

SEQ ID NO: 1357753 - RNA, 19 nt, Homo sapiens
gaacacaggcaucauuucc

SEQ ID NO: 1357754 - RNA, 19 nt, Homo sapiens
ccagcuauguggaacuaug

SEQ ID NO: 1357755 - RNA, 19 nt, Homo sapiens
ugguugaucuugauggaaa

SEQ ID NO: 1357756 - RNA, 19 nt, Homo sapiens
uugcaaggcugaauagaag

SEQ ID NO: 1357757 - RNA, 19 nt, Homo sapiens
ccacagaucauugcuaugg

SEQ ID NO: 1357758 - RNA, 19 nt, Homo sapiens
gacgaacacaggcaucauu

SEQ ID NO: 1357759 - RNA, 19 nt, Homo sapiens
ggaacuaugacugugauga

SEQ ID NO: 1357760 - RNA, 19 nt, Homo sapiens
aaaguucccuucucuacag

SEQ ID NO: 1357761 - RNA, 19 nt, Homo sapiens
ucugaggccuucccagcua

SEQ ID NO: 1357762 - RNA, 19 nt, Homo sapiens
uggaaccauuucuucuaua

SEQ ID NO: 1357763 - RNA, 19 nt, Homo sapiens
acacugcaauuaagaagag

SEQ ID NO: 1357764 - RNA, 19 nt, Homo sapiens
auacagaucagaagugguu

SEQ ID NO: 1357765 - RNA, 19 nt, Homo sapiens
gcuggaacuggaaacaaua

SEQ ID NO: 1357766 - RNA, 19 nt, Homo sapiens
cucaaaguauguauagcua

SEQ ID NO: 1357767 - RNA, 19 nt, Homo sapiens
caagagucagaaauacuaa

SEQ ID NO: 1357768 - RNA, 19 nt, Homo sapiens
uaucagcggcaaaguggua

SEQ ID NO: 1357769 - RNA, 19 nt, Homo sapiens
ggcauucugucucuuuauc

SEQ ID NO: 1357770 - RNA, 19 nt, Homo sapiens
ggagguuucugccacuuuu

SEQ ID NO: 1357771 - RNA, 19 nt, Homo sapiens
aaucuaugcccgugacuuu

SEQ ID NO: 1357772 - RNA, 19 nt, Homo sapiens
ccaaauggagaucacauca

SEQ ID NO: 1357773 - RNA, 19 nt, Homo sapiens
ucaaaaccaugcagaguga

SEQ ID NO: 1357774 - RNA, 19 nt, Homo sapiens
agaagugguugaucuugau

SEQ ID NO: 1357775 - RNA, 19 nt, Homo sapiens
cuacuugccauaacucuau

SEQ ID NO: 1357776 - RNA, 19 nt, Homo sapiens
acacaggcaucauuuccau

SEQ ID NO: 1357777 - RNA, 19 nt, Homo sapiens
gaauuggaaugcgaaucga

SEQ ID NO: 1357778 - RNA, 19 nt, Homo sapiens
cuggaaccauuucuucuau

SEQ ID NO: 1357779 - RNA, 19 nt, Homo sapiens
gaugagaccugccuaagca

SEQ ID NO: 1357780 - RNA, 19 nt, Homo sapiens
gaagguauuucuccagauc

SEQ ID NO: 1357781 - RNA, 19 nt, Homo sapiens
gaccagauccgcucccaua

SEQ ID NO: 1357782 - RNA, 19 nt, Homo sapiens
uacaagaacuucagugaga

SEQ ID NO: 1357783 - RNA, 19 nt, Homo sapiens
guaauaauccuuuccaucu

SEQ ID NO: 1357784 - RNA, 19 nt, Homo sapiens
guuaaacccugccagaugu

SEQ ID NO: 1357785 - RNA, 19 nt, Homo sapiens
gagaagagcuaugcaaagc

SEQ ID NO: 1357786 - RNA, 19 nt, Homo sapiens
gugcuuuccuguguuaaua

SEQ ID NO: 1357787 - RNA, 19 nt, Homo sapiens
gaagaacugugggcagauc

SEQ ID NO: 1357788 - RNA, 19 nt, Homo sapiens
ccacagugcugcucuaucg

SEQ ID NO: 1357789 - RNA, 19 nt, Homo sapiens
agacccagcucuucuacaa

SEQ ID NO: 1357790 - RNA, 19 nt, Homo sapiens
gaacuucagugagacuaag

SEQ ID NO: 1357791 - RNA, 19 nt, Homo sapiens
gacaguguaugacccauca

SEQ ID NO: 1357792 - RNA, 19 nt, Homo sapiens
gaaccugcaugccauccau

SEQ ID NO: 1357793 - RNA, 19 nt, Homo sapiens
gcaaagcugguguucaugu

SEQ ID NO: 1357794 - RNA, 19 nt, Homo sapiens
gcggaacccugucauggau

SEQ ID NO: 1357795 - RNA, 19 nt, Homo sapiens
agacuucacugucaacuac

SEQ ID NO: 1357796 - RNA, 19 nt, Homo sapiens
ggaccugugcccucuacua

SEQ ID NO: 1357797 - RNA, 19 nt, Homo sapiens
ccugugcuuuccuguguua

SEQ ID NO: 1357798 - RNA, 19 nt, Homo sapiens
ugagggagacaguguauga

SEQ ID NO: 1357799 - RNA, 19 nt, Homo sapiens
cacccuggcuggacuguug

SEQ ID NO: 1357800 - RNA, 19 nt, Homo sapiens
caaggcaagggcagcaaua

SEQ ID NO: 1357801 - RNA, 19 nt, Homo sapiens
gcuggucccugggcaacua

SEQ ID NO: 1357802 - RNA, 19 nt, Homo sapiens
uccaaucucucugcuguuu

SEQ ID NO: 1357803 - RNA, 19 nt, Homo sapiens
ggucaaaugcgucaguugu

SEQ ID NO: 1357804 - RNA, 19 nt, Homo sapiens
ggacagaaggcaagagaac

SEQ ID NO: 1357805 - RNA, 19 nt, Homo sapiens
acacagacauugggagcaa

SEQ ID NO: 1357806 - RNA, 19 nt, Homo sapiens
gcuuuccuguguuaauaaa

SEQ ID NO: 1357807 - RNA, 19 nt, Homo sapiens
ggaccugggacuccgcuuu

SEQ ID NO: 1357808 - RNA, 19 nt, Homo sapiens
ggaaucagagcuucuucga

SEQ ID NO: 1357809 - RNA, 19 nt, Homo sapiens
ccaggugccuucccucaag

SEQ ID NO: 1357810 - RNA, 19 nt, Homo sapiens
gaggacagaaggcaagaga

SEQ ID NO: 1357811 - RNA, 19 nt, Homo sapiens
gaucugcagcuccaugaug

SEQ ID NO: 1357812 - RNA, 19 nt, Homo sapiens
accaagugcucccagagua

SEQ ID NO: 1357813 - RNA, 19 nt, Homo sapiens
cagaggagcccgcagcaau

SEQ ID NO: 1357814 - RNA, 19 nt, Homo sapiens
gcauggaccugggccucaa

SEQ ID NO: 1357815 - RNA, 19 nt, Homo sapiens
agacauugggagcaaguua

SEQ ID NO: 1357816 - RNA, 19 nt, Homo sapiens
ccaaauccagccauagaug

SEQ ID NO: 1357817 - RNA, 19 nt, Homo sapiens
ucaccgguuugaccagaaa

SEQ ID NO: 1357818 - RNA, 19 nt, Homo sapiens
guuacaagaacuucaguga

SEQ ID NO: 1357819 - RNA, 19 nt, Homo sapiens
caaucucucugcuguuucu

SEQ ID NO: 1357820 - RNA, 19 nt, Homo sapiens
caacuacaccucugucacu

SEQ ID NO: 1357821 - RNA, 19 nt, Homo sapiens
ugacagggacuuucugagu

SEQ ID NO: 1357822 - RNA, 19 nt, Homo sapiens
caaagcugguguucauguc

SEQ ID NO: 1357823 - RNA, 19 nt, Homo sapiens
augcaaagcugguguucau

SEQ ID NO: 1357824 - RNA, 19 nt, Homo sapiens
cagaccaacuuccggaaca

SEQ ID NO: 1357825 - RNA, 19 nt, Homo sapiens
gaggcaagcccagagagaa

SEQ ID NO: 1357826 - RNA, 19 nt, Homo sapiens
gggaaggccagauguguag

SEQ ID NO: 1357827 - RNA, 19 nt, Homo sapiens
uaagaccccuccucuagaa

SEQ ID NO: 1357828 - RNA, 19 nt, Homo sapiens
agccagaccugccagaugu

SEQ ID NO: 1357829 - RNA, 19 nt, Homo sapiens
caacuacugcaucuccuau

SEQ ID NO: 1357830 - RNA, 19 nt, Homo sapiens
caaccacacgcucaucuuc

SEQ ID NO: 1357831 - RNA, 19 nt, Homo sapiens
cagauccgcucccauacca

SEQ ID NO: 1357832 - RNA, 19 nt, Homo sapiens
uaauaauccuuuccaucuc

SEQ ID NO: 1357833 - RNA, 19 nt, Homo sapiens
uggagcaucucucaauuac

SEQ ID NO: 1357834 - RNA, 19 nt, Homo sapiens
ggucagccuuggagcaucu

SEQ ID NO: 1357835 - RNA, 19 nt, Homo sapiens
acccagcucuucuacaaug

SEQ ID NO: 1357836 - RNA, 19 nt, Homo sapiens
cugguggccuucuuccuuu

SEQ ID NO: 1357837 - RNA, 19 nt, Homo sapiens
ucagugggccucucaguag

SEQ ID NO: 1357838 - RNA, 19 nt, Homo sapiens
gcugguggccuucuuccuu

SEQ ID NO: 1357839 - RNA, 19 nt, Homo sapiens
gugcuucccucauggacau

SEQ ID NO: 1357840 - RNA, 19 nt, Homo sapiens
gcauggaacaggaccagau

SEQ ID NO: 1357841 - RNA, 19 nt, Homo sapiens
gaccugggacuccgcuuug

SEQ ID NO: 1357842 - RNA, 19 nt, Homo sapiens
gugucuggcugucaucuuc

SEQ ID NO: 1357843 - RNA, 19 nt, Homo sapiens
gcaccucgcgucugcucuu

SEQ ID NO: 1357844 - RNA, 19 nt, Homo sapiens
gcuggagcccgaagguauu

SEQ ID NO: 1357845 - RNA, 19 nt, Homo sapiens
gaccugggcagaacaaguc

SEQ ID NO: 1357846 - RNA, 19 nt, Homo sapiens
aauaauccuuuccaucucu

SEQ ID NO: 1357847 - RNA, 19 nt, Homo sapiens
ccagaugucccagccuuga

SEQ ID NO: 1357848 - RNA, 19 nt, Homo sapiens
ggccaaggcugcagauccu

SEQ ID NO: 1357849 - RNA, 19 nt, Homo sapiens
uuggagcaucucucaauua

SEQ ID NO: 1357850 - RNA, 19 nt, Homo sapiens
cuuggagcaucucucaauu

SEQ ID NO: 1357851 - RNA, 19 nt, Homo sapiens
gcccugcucuccucauacu

SEQ ID NO: 1357852 - RNA, 19 nt, Homo sapiens
cgaagguauuucuccagau

SEQ ID NO: 1357853 - RNA, 19 nt, Homo sapiens
cagugggccucucaguaga

SEQ ID NO: 1357854 - RNA, 19 nt, Homo sapiens
acagaaggcaagagaacuu

SEQ ID NO: 1357855 - RNA, 19 nt, Homo sapiens
cugcccugcucuccucaua

SEQ ID NO: 1357856 - RNA, 19 nt, Homo sapiens
ggaccucucuccccaacug

SEQ ID NO: 1357857 - RNA, 19 nt, Homo sapiens
ccacagcaccaucuaagac

SEQ ID NO: 1357858 - RNA, 19 nt, Homo sapiens
cgccgugguugguucacua

SEQ ID NO: 1357859 - RNA, 19 nt, Homo sapiens
caaccagacccagcucuuc

SEQ ID NO: 1357860 - RNA, 19 nt, Homo sapiens
gugcccagguucccaccaa

SEQ ID NO: 1357861 - RNA, 19 nt, Homo sapiens
ccacgggacacagacauug

SEQ ID NO: 1357862 - RNA, 19 nt, Homo sapiens
ugccauccauuccaugugu

SEQ ID NO: 1357863 - RNA, 19 nt, Homo sapiens
gcugagggagacaguguau

SEQ ID NO: 1357864 - RNA, 19 nt, Homo sapiens
ggaccaccaggcagucuuc

SEQ ID NO: 1357865 - RNA, 19 nt, Homo sapiens
guaccugcgcucacucuuc

SEQ ID NO: 1357866 - RNA, 19 nt, Homo sapiens
ucuaccaacuccugcacuu

SEQ ID NO: 1357867 - RNA, 19 nt, Homo sapiens
ggaccugggcagaacaagu

SEQ ID NO: 1357868 - RNA, 19 nt, Homo sapiens
cugggcaccuggaauguuc

SEQ ID NO: 1357869 - RNA, 19 nt, Homo sapiens
gaccugugcccucuacuac

SEQ ID NO: 1357870 - RNA, 19 nt, Homo sapiens
gaucuugucaggguuccuu

SEQ ID NO: 1357871 - RNA, 19 nt, Homo sapiens
uguuaaacccugccagaug

SEQ ID NO: 1357872 - RNA, 19 nt, Homo sapiens
ccagaccugccagauguuu

SEQ ID NO: 1357873 - RNA, 19 nt, Homo sapiens
gcgcugagggagacagugu

SEQ ID NO: 1357874 - RNA, 19 nt, Homo sapiens
acuacugcaucuccuauca

SEQ ID NO: 1357875 - RNA, 19 nt, Homo sapiens
gcgcuucgacgcggaguau

SEQ ID NO: 1357876 - RNA, 19 nt, Homo sapiens
ugagaagagcuaugcaaag

SEQ ID NO: 1357877 - RNA, 19 nt, Homo sapiens
cugagaagagcuaugcaaa

SEQ ID NO: 1357878 - RNA, 19 nt, Homo sapiens
gacauugggagcaaguuag

SEQ ID NO: 1357879 - RNA, 19 nt, Homo sapiens
gauggaagguggucacuuu

SEQ ID NO: 1357880 - RNA, 19 nt, Homo sapiens
agaaagaucugcagaguga

SEQ ID NO: 1357881 - RNA, 19 nt, Homo sapiens
ggacuggacuucugauguu

SEQ ID NO: 1357882 - RNA, 19 nt, Homo sapiens
gagaggagcuaucaguuug

SEQ ID NO: 1357883 - RNA, 19 nt, Homo sapiens
ggagcuaccugcugauauu

SEQ ID NO: 1357884 - RNA, 19 nt, Homo sapiens
gcaacaggaugaggaauuu

SEQ ID NO: 1357885 - RNA, 19 nt, Homo sapiens
gggaagagcgcuuggauaa

SEQ ID NO: 1357886 - RNA, 19 nt, Homo sapiens
gaacaggaguuugggaaga

SEQ ID NO: 1357887 - RNA, 19 nt, Homo sapiens
gaagagcgcuuggauaagg

SEQ ID NO: 1357888 - RNA, 19 nt, Homo sapiens
gcacauuuaugcacuuugu

SEQ ID NO: 1357889 - RNA, 19 nt, Homo sapiens
ggacagaggcucaagacuu

SEQ ID NO: 1357890 - RNA, 19 nt, Homo sapiens
gauggcagcucgcgauaug

SEQ ID NO: 1357891 - RNA, 19 nt, Homo sapiens
agaagaagauuccaagugu

SEQ ID NO: 1357892 - RNA, 19 nt, Homo sapiens
gaagagauccuggccaaga

SEQ ID NO: 1357893 - RNA, 19 nt, Homo sapiens
gagauucacuggguaccua

SEQ ID NO: 1357894 - RNA, 19 nt, Homo sapiens
gaguuuagccucaguguug

SEQ ID NO: 1357895 - RNA, 19 nt, Homo sapiens
gacagaagcuuuggaacga

SEQ ID NO: 1357896 - RNA, 19 nt, Homo sapiens
ggccugagcuugagagaca

SEQ ID NO: 1357897 - RNA, 19 nt, Homo sapiens
gcaugucccucacccagaa

SEQ ID NO: 1357898 - RNA, 19 nt, Homo sapiens
gaaagaggaggcugggaaa

SEQ ID NO: 1357899 - RNA, 19 nt, Homo sapiens
ggaagguggucacuuugug

SEQ ID NO: 1357900 - RNA, 19 nt, Homo sapiens
gaagaagaaggucugagaa

SEQ ID NO: 1357901 - RNA, 19 nt, Homo sapiens
gagaguuccuuaaaucaag

SEQ ID NO: 1357902 - RNA, 19 nt, Homo sapiens
gaaccugaccggcuguuug

SEQ ID NO: 1357903 - RNA, 19 nt, Homo sapiens
gagaagaagauuccaagug

SEQ ID NO: 1357904 - RNA, 19 nt, Homo sapiens
gaugaggaauuugagaaga

SEQ ID NO: 1357905 - RNA, 19 nt, Homo sapiens
ccaagugggucaggaaguu

SEQ ID NO: 1357906 - RNA, 19 nt, Homo sapiens
gaagaaggucugagaaguc

SEQ ID NO: 1357907 - RNA, 19 nt, Homo sapiens
gagcaggacugggaguuuc

SEQ ID NO: 1357908 - RNA, 19 nt, Homo sapiens
ggacuucugauguuaaugu

SEQ ID NO: 1357909 - RNA, 19 nt, Homo sapiens
gaccaggaauucggaaaga

SEQ ID NO: 1357910 - RNA, 19 nt, Homo sapiens
caucuucacccgccugaua

SEQ ID NO: 1357911 - RNA, 19 nt, Homo sapiens
ggagaguuccuuaaaucaa

SEQ ID NO: 1357912 - RNA, 19 nt, Homo sapiens
uggcaacgcccaacucuuu

SEQ ID NO: 1357913 - RNA, 19 nt, Homo sapiens
uauaaugggugggacugua

SEQ ID NO: 1357914 - RNA, 19 nt, Homo sapiens
gcaagucgagccagaagga

SEQ ID NO: 1357915 - RNA, 19 nt, Homo sapiens
gaaaguggagggucugaag

SEQ ID NO: 1357916 - RNA, 19 nt, Homo sapiens
ccacagagaccaaugacau

SEQ ID NO: 1357917 - RNA, 19 nt, Homo sapiens
ccggagaguuccuuaaauc

SEQ ID NO: 1357918 - RNA, 19 nt, Homo sapiens
gacuggacuucugauguua

SEQ ID NO: 1357919 - RNA, 19 nt, Homo sapiens
ggacuucuccuucauugag

SEQ ID NO: 1357920 - RNA, 19 nt, Homo sapiens
ugagaggagcuaucaguuu

SEQ ID NO: 1357921 - RNA, 19 nt, Homo sapiens
ugagggcacaccuggauua

SEQ ID NO: 1357922 - RNA, 19 nt, Homo sapiens
gaauuugggaagagagauu

SEQ ID NO: 1357923 - RNA, 19 nt, Homo sapiens
ggaucucacucggacguuu

SEQ ID NO: 1357924 - RNA, 19 nt, Homo sapiens
gcuggcaacuuggccguuu

SEQ ID NO: 1357925 - RNA, 19 nt, Homo sapiens
guucccgccucaccuuuaa

SEQ ID NO: 1357926 - RNA, 19 nt, Homo sapiens
uggcagugcugaccuggaa

SEQ ID NO: 1357927 - RNA, 19 nt, Homo sapiens
agaagaaggucugagaagu

SEQ ID NO: 1357928 - RNA, 19 nt, Homo sapiens
cccugaaacugaagaagaa

SEQ ID NO: 1357929 - RNA, 19 nt, Homo sapiens
aagaaggucugagaaguca

SEQ ID NO: 1357930 - RNA, 19 nt, Homo sapiens
cuucugauguuaaugugaa

SEQ ID NO: 1357931 - RNA, 19 nt, Homo sapiens
ggacugggaguuucagaag

SEQ ID NO: 1357932 - RNA, 19 nt, Homo sapiens
gacugggaguucagaaaga

SEQ ID NO: 1357933 - RNA, 19 nt, Homo sapiens
ggacugggaguucagaaag

SEQ ID NO: 1357934 - RNA, 19 nt, Homo sapiens
gggcacaccuggauuaccu

SEQ ID NO: 1357935 - RNA, 19 nt, Homo sapiens
ggcccuggaucgucccuuu

SEQ ID NO: 1357936 - RNA, 19 nt, Homo sapiens
ccaagagacugggaaagag

SEQ ID NO: 1357937 - RNA, 19 nt, Homo sapiens
gaagaagaagaaggucuga

SEQ ID NO: 1357938 - RNA, 19 nt, Homo sapiens
gaaauccucagggucagaa

SEQ ID NO: 1357939 - RNA, 19 nt, Homo sapiens
caucucgggugccaucuuc

SEQ ID NO: 1357940 - RNA, 19 nt, Homo sapiens
gcgcuuggauaagggacua

SEQ ID NO: 1357941 - RNA, 19 nt, Homo sapiens
ccacagcccagcaguuuca

SEQ ID NO: 1357942 - RNA, 19 nt, Homo sapiens
gcacaccuggauuaccuuu

SEQ ID NO: 1357943 - RNA, 19 nt, Homo sapiens
agaagaagaaggucugaga

SEQ ID NO: 1357944 - RNA, 19 nt, Homo sapiens
ccucgacagugccauguau

SEQ ID NO: 1357945 - RNA, 19 nt, Homo sapiens
ggccggagaguuccuuaaa

SEQ ID NO: 1357946 - RNA, 19 nt, Homo sapiens
cagcaaguaugggcaagga

SEQ ID NO: 1357947 - RNA, 19 nt, Homo sapiens
ccagcccuguguucucuuu

SEQ ID NO: 1357948 - RNA, 19 nt, Homo sapiens
gaccagcccuguguucucu

SEQ ID NO: 1357949 - RNA, 19 nt, Homo sapiens
gccggagaguuccuuaaau

SEQ ID NO: 1357950 - RNA, 19 nt, Homo sapiens
ccagcgagaggcagcauuu

SEQ ID NO: 1357951 - RNA, 19 nt, Homo sapiens
ggagagucaaccucaauuc

SEQ ID NO: 1357952 - RNA, 19 nt, Homo sapiens
caccaaggccugcgguuga

SEQ ID NO: 1357953 - RNA, 19 nt, Homo sapiens
uuucaucacuagugguuga

SEQ ID NO: 1357954 - RNA, 19 nt, Homo sapiens
gaccuugggcugagaaaca

SEQ ID NO: 1357955 - RNA, 19 nt, Homo sapiens
guucaggacugggaguuca

SEQ ID NO: 1357956 - RNA, 19 nt, Homo sapiens
gcagccaagaccagaguaa

SEQ ID NO: 1357957 - RNA, 19 nt, Homo sapiens
ucacaguccuucgaaugga

SEQ ID NO: 1357958 - RNA, 19 nt, Homo sapiens
gcccugaaacugaagaaga

SEQ ID NO: 1357959 - RNA, 19 nt, Homo sapiens
gggaaagccccucacguua

SEQ ID NO: 1357960 - RNA, 19 nt, Homo sapiens
gaucgaggugggugaguug

SEQ ID NO: 1357961 - RNA, 19 nt, Homo sapiens
ugaugaaagugucuacucu

SEQ ID NO: 1357962 - RNA, 19 nt, Homo sapiens
gaaggaucgucgcccaacu

SEQ ID NO: 1357963 - RNA, 19 nt, Homo sapiens
gcccucagcuucggagcaa

SEQ ID NO: 1357964 - RNA, 19 nt, Homo sapiens
gacugggaguuucagaaga

SEQ ID NO: 1357965 - RNA, 19 nt, Homo sapiens
gaauucggaaagagagauu

SEQ ID NO: 1357966 - RNA, 19 nt, Homo sapiens
cagagugaauuugggauca

SEQ ID NO: 1357967 - RNA, 19 nt, Homo sapiens
cacuagugguugaagguuu

SEQ ID NO: 1357968 - RNA, 19 nt, Homo sapiens
gagggucugccgcauguga

SEQ ID NO: 1357969 - RNA, 19 nt, Homo sapiens
gcagccaggaugccgauga

SEQ ID NO: 1357970 - RNA, 19 nt, Homo sapiens
gagcuaccugcugauauuu

SEQ ID NO: 1357971 - RNA, 19 nt, Homo sapiens
gauuucaucacuagugguu

SEQ ID NO: 1357972 - RNA, 19 nt, Homo sapiens
ugaaacugaagaagaagaa

SEQ ID NO: 1357973 - RNA, 19 nt, Homo sapiens
ggaauuugagaagaagauu

SEQ ID NO: 1357974 - RNA, 19 nt, Homo sapiens
agacuucucucugcuaaac

SEQ ID NO: 1357975 - RNA, 19 nt, Homo sapiens
cagcccagcuuggcacuca

SEQ ID NO: 1357976 - RNA, 19 nt, Homo sapiens
gggagagucaaccucaauu

SEQ ID NO: 1357977 - RNA, 19 nt, Homo sapiens
uuugaagaguugaggauau

SEQ ID NO: 1357978 - RNA, 19 nt, Homo sapiens
gggagggcaucaggagaga

SEQ ID NO: 1357979 - RNA, 19 nt, Homo sapiens
gaaaguggcucgucaguuu

SEQ ID NO: 1357980 - RNA, 19 nt, Homo sapiens
gaaagcaucuuacccauuu

SEQ ID NO: 1357981 - RNA, 19 nt, Homo sapiens
ggacgauucugguaacuua

SEQ ID NO: 1357982 - RNA, 19 nt, Homo sapiens
gcacagagaugaagaaagu

SEQ ID NO: 1357983 - RNA, 19 nt, Homo sapiens
gaccagaaguuaaauauga

SEQ ID NO: 1357984 - RNA, 19 nt, Homo sapiens
gaaauugacugugaaaugu

SEQ ID NO: 1357985 - RNA, 19 nt, Homo sapiens
cauaggcgcuuucagaaua

SEQ ID NO: 1357986 - RNA, 19 nt, Homo sapiens
caugaacgcagaauuauua

SEQ ID NO: 1357987 - RNA, 19 nt, Homo sapiens
gaccagaguuuccagauga

SEQ ID NO: 1357988 - RNA, 19 nt, Homo sapiens
caacaaagccagaggugua

SEQ ID NO: 1357989 - RNA, 19 nt, Homo sapiens
gcagugaccuagaagcauu

SEQ ID NO: 1357990 - RNA, 19 nt, Homo sapiens
ggaauggaauuuaaugaca

SEQ ID NO: 1357991 - RNA, 19 nt, Homo sapiens
ggacucuucuuccuagauu

SEQ ID NO: 1357992 - RNA, 19 nt, Homo sapiens
cagcaaagcuauagagaca

SEQ ID NO: 1357993 - RNA, 19 nt, Homo sapiens
gaucaaggguacaguaaca

SEQ ID NO: 1357994 - RNA, 19 nt, Homo sapiens
gcaccacucucagcucuuu

SEQ ID NO: 1357995 - RNA, 19 nt, Homo sapiens
gcaccagucaugagucuua

SEQ ID NO: 1357996 - RNA, 19 nt, Homo sapiens
ucacuuacuugaaaccuaa

SEQ ID NO: 1357997 - RNA, 19 nt, Homo sapiens
uaacguaauuggcuaugaa

SEQ ID NO: 1357998 - RNA, 19 nt, Homo sapiens
gaaucugugugguacuaua

SEQ ID NO: 1357999 - RNA, 19 nt, Homo sapiens
auaccuggcugcugucuua

SEQ ID NO: 1358000 - RNA, 19 nt, Homo sapiens
gaugaaagccacuaucaau

SEQ ID NO: 1358001 - RNA, 19 nt, Homo sapiens
gagcaacccuuaagagaac

SEQ ID NO: 1358002 - RNA, 19 nt, Homo sapiens
ccaaguagcugggauuaca

SEQ ID NO: 1358003 - RNA, 19 nt, Homo sapiens
aaacauaggcgcuuucaga

SEQ ID NO: 1358004 - RNA, 19 nt, Homo sapiens
caaguggagugcagaagaa

SEQ ID NO: 1358005 - RNA, 19 nt, Homo sapiens
gaagccagaucagcaaaug

SEQ ID NO: 1358006 - RNA, 19 nt, Homo sapiens
uaacucugcugccaucuug

SEQ ID NO: 1358007 - RNA, 19 nt, Homo sapiens
gaaauaagaggagguuguu

SEQ ID NO: 1358008 - RNA, 19 nt, Homo sapiens
gagcaaacauaggcgcuuu

SEQ ID NO: 1358009 - RNA, 19 nt, Homo sapiens
ggaaggagagauccauuga

SEQ ID NO: 1358010 - RNA, 19 nt, Homo sapiens
caacucagguagaacuaga

SEQ ID NO: 1358011 - RNA, 19 nt, Homo sapiens
gcugagaaccaaauuuauu

SEQ ID NO: 1358012 - RNA, 19 nt, Homo sapiens
uauagcagcucuacucugu

SEQ ID NO: 1358013 - RNA, 19 nt, Homo sapiens
gguguaauguugguuauau

SEQ ID NO: 1358014 - RNA, 19 nt, Homo sapiens
cuuaaucacucaacgcuuu

SEQ ID NO: 1358015 - RNA, 19 nt, Homo sapiens
gaacccaaguagagaagau

SEQ ID NO: 1358016 - RNA, 19 nt, Homo sapiens
uuacuaagaccagaaguua

SEQ ID NO: 1358017 - RNA, 19 nt, Homo sapiens
gaucuucccuugccugucu

SEQ ID NO: 1358018 - RNA, 19 nt, Homo sapiens
gcugcugucuuaacucgua

SEQ ID NO: 1358019 - RNA, 19 nt, Homo sapiens
gggcauuuguucucuguug

SEQ ID NO: 1358020 - RNA, 19 nt, Homo sapiens
gucaggagcuggacgauuc

SEQ ID NO: 1358021 - RNA, 19 nt, Homo sapiens
agacauagccggcauaucu

SEQ ID NO: 1358022 - RNA, 19 nt, Homo sapiens
agaaugugcuugucaaaca

SEQ ID NO: 1358023 - RNA, 19 nt, Homo sapiens
gagaaaguaugaaguuuug

SEQ ID NO: 1358024 - RNA, 19 nt, Homo sapiens
gcauuucccucccuguuuc

SEQ ID NO: 1358025 - RNA, 19 nt, Homo sapiens
ggaaagcaucuuacccauu

SEQ ID NO: 1358026 - RNA, 19 nt, Homo sapiens
aagacucucugccaaagua

SEQ ID NO: 1358027 - RNA, 19 nt, Homo sapiens
gaaaaucuguacugagaga

SEQ ID NO: 1358028 - RNA, 19 nt, Homo sapiens
gaaucugccuccagcugaa

SEQ ID NO: 1358029 - RNA, 19 nt, Homo sapiens
agagacaggugcauucaga

SEQ ID NO: 1358030 - RNA, 19 nt, Homo sapiens
ugacuuagaagcugaagaa

SEQ ID NO: 1358031 - RNA, 19 nt, Homo sapiens
gaagaaugugcuugucaaa

SEQ ID NO: 1358032 - RNA, 19 nt, Homo sapiens
uugcagaaauugacuguga

SEQ ID NO: 1358033 - RNA, 19 nt, Homo sapiens
guaauuggcuaugaaguac

SEQ ID NO: 1358034 - RNA, 19 nt, Homo sapiens
ugaagaaugugcuugucaa

SEQ ID NO: 1358035 - RNA, 19 nt, Homo sapiens
gcccaaggcuguaaguagu

SEQ ID NO: 1358036 - RNA, 19 nt, Homo sapiens
agaagucucuccaggcuau

SEQ ID NO: 1358037 - RNA, 19 nt, Homo sapiens
gaacuagaccagcuaaagg

SEQ ID NO: 1358038 - RNA, 19 nt, Homo sapiens
gaacaaguggagugcagaa

SEQ ID NO: 1358039 - RNA, 19 nt, Homo sapiens
gcaaaggcacagagaugaa

SEQ ID NO: 1358040 - RNA, 19 nt, Homo sapiens
acucaugaacgcagaauua

SEQ ID NO: 1358041 - RNA, 19 nt, Homo sapiens
cagauugccuauacuuugu

SEQ ID NO: 1358042 - RNA, 19 nt, Homo sapiens
agccagagguguaauguug

SEQ ID NO: 1358043 - RNA, 19 nt, Homo sapiens
uaaauacaguugucuugag

SEQ ID NO: 1358044 - RNA, 19 nt, Homo sapiens
aaggauaguuucagugguu

SEQ ID NO: 1358045 - RNA, 19 nt, Homo sapiens
gcaaagcaggagaugauug

SEQ ID NO: 1358046 - RNA, 19 nt, Homo sapiens
gggcaaagcaggagaugau

SEQ ID NO: 1358047 - RNA, 19 nt, Homo sapiens
gcuguuaccuacuccuguu

SEQ ID NO: 1358048 - RNA, 19 nt, Homo sapiens
ggaacuacuugcccauucu

SEQ ID NO: 1358049 - RNA, 19 nt, Homo sapiens
gaugggagcucggaauguc

SEQ ID NO: 1358050 - RNA, 19 nt, Homo sapiens
gcagaaauugacugugaaa

SEQ ID NO: 1358051 - RNA, 19 nt, Homo sapiens
gcuauuaccaugggcauuu

SEQ ID NO: 1358052 - RNA, 19 nt, Homo sapiens
gauuaaggcuugcauuucc

SEQ ID NO: 1358053 - RNA, 19 nt, Homo sapiens
gguaugauaaguccacaaa

SEQ ID NO: 1358054 - RNA, 19 nt, Homo sapiens
agacaaggacucuggcuuu

SEQ ID NO: 1358055 - RNA, 19 nt, Homo sapiens
gaaugagcauacagagcaa

SEQ ID NO: 1358056 - RNA, 19 nt, Homo sapiens
aauaaaccauggagaggaa

SEQ ID NO: 1358057 - RNA, 19 nt, Homo sapiens
cguaauuggcuaugaagua

SEQ ID NO: 1358058 - RNA, 19 nt, Homo sapiens
gagauggaguuucgcucuu

SEQ ID NO: 1358059 - RNA, 19 nt, Homo sapiens
gggauguaguauaaguuaa

SEQ ID NO: 1358060 - RNA, 19 nt, Homo sapiens
caaggcaucguacuaguug

SEQ ID NO: 1358061 - RNA, 19 nt, Homo sapiens
ccacuguccgcuaauuaua

SEQ ID NO: 1358062 - RNA, 19 nt, Homo sapiens
gcagaugaacccaaguaga

SEQ ID NO: 1358063 - RNA, 19 nt, Homo sapiens
acaaacgugugauuuagau

SEQ ID NO: 1358064 - RNA, 19 nt, Homo sapiens
acaguugucuugaggguau

SEQ ID NO: 1358065 - RNA, 19 nt, Homo sapiens
aaggagagauccauugagu

SEQ ID NO: 1358066 - RNA, 19 nt, Homo sapiens
ugaaaacacuugcugagaa

SEQ ID NO: 1358067 - RNA, 19 nt, Homo sapiens
guauguggcuucagauugc

SEQ ID NO: 1358068 - RNA, 19 nt, Homo sapiens
caccaugcccagcuaauuu

SEQ ID NO: 1358069 - RNA, 19 nt, Homo sapiens
guguuuccuucauguguua

SEQ ID NO: 1358070 - RNA, 19 nt, Homo sapiens
ggacaugcugagcgccuua

SEQ ID NO: 1358071 - RNA, 19 nt, Homo sapiens
uuccugggauguaguauaa

SEQ ID NO: 1358072 - RNA, 19 nt, Homo sapiens
gggcacaggauacauaugu

SEQ ID NO: 1358073 - RNA, 19 nt, Homo sapiens
uaaacuguguugugguuca

SEQ ID NO: 1358074 - RNA, 19 nt, Homo sapiens
ucaggcaacucagguagaa

SEQ ID NO: 1358075 - RNA, 19 nt, Homo sapiens
gagcaacucuccccuuuca

SEQ ID NO: 1358076 - RNA, 19 nt, Homo sapiens
gggccuagcuugucuucca

SEQ ID NO: 1358077 - RNA, 19 nt, Homo sapiens
gaaaagaguaccaaugaau

SEQ ID NO: 1358078 - RNA, 19 nt, Homo sapiens
agaaauugacugugaaaug

SEQ ID NO: 1358079 - RNA, 19 nt, Homo sapiens
caaaugaggucuaaacuaa

SEQ ID NO: 1358080 - RNA, 19 nt, Homo sapiens
gaaagugaaucgcauauau

SEQ ID NO: 1358081 - RNA, 19 nt, Homo sapiens
gaacaaagagacaguuaua

SEQ ID NO: 1358082 - RNA, 19 nt, Homo sapiens
gagaagaucccacauuuaa

SEQ ID NO: 1358083 - RNA, 19 nt, Homo sapiens
ggaagcagguuaauuggaa

SEQ ID NO: 1358084 - RNA, 19 nt, Homo sapiens
gaacuaugcuauucucaau

SEQ ID NO: 1358085 - RNA, 19 nt, Homo sapiens
gaguauggcuguccuugua

SEQ ID NO: 1358086 - RNA, 19 nt, Homo sapiens
caagaagacgucauuaaua

SEQ ID NO: 1358087 - RNA, 19 nt, Homo sapiens
gaucaaauauuccaaagca

SEQ ID NO: 1358088 - RNA, 19 nt, Homo sapiens
ggacuacacuaaauuggaa

SEQ ID NO: 1358089 - RNA, 19 nt, Homo sapiens
guggaaagaugucaauauu

SEQ ID NO: 1358090 - RNA, 19 nt, Homo sapiens
gaaacauucggaucaaaua

SEQ ID NO: 1358091 - RNA, 19 nt, Homo sapiens
ggagguaggucgauuugga

SEQ ID NO: 1358092 - RNA, 19 nt, Homo sapiens
uaacagaacgaguccuuua

SEQ ID NO: 1358093 - RNA, 19 nt, Homo sapiens
aagagaagaucccacauuu

SEQ ID NO: 1358094 - RNA, 19 nt, Homo sapiens
agacaucugugcauuguuu

SEQ ID NO: 1358095 - RNA, 19 nt, Homo sapiens
cagaauugcuucauccaaa

SEQ ID NO: 1358096 - RNA, 19 nt, Homo sapiens
gcagguaucagccauguuu

SEQ ID NO: 1358097 - RNA, 19 nt, Homo sapiens
gcagaugucccucuaaaug

SEQ ID NO: 1358098 - RNA, 19 nt, Homo sapiens
gcaaaugaggucuaaacua

SEQ ID NO: 1358099 - RNA, 19 nt, Homo sapiens
caucuaccuuccuuuguua

SEQ ID NO: 1358100 - RNA, 19 nt, Homo sapiens
gagaauacacaauggagua

SEQ ID NO: 1358101 - RNA, 19 nt, Homo sapiens
gaagaucccacauuuaaag

SEQ ID NO: 1358102 - RNA, 19 nt, Homo sapiens
ggagacaucugugcauugu

SEQ ID NO: 1358103 - RNA, 19 nt, Homo sapiens
gagcuucuguuauauucaa

SEQ ID NO: 1358104 - RNA, 19 nt, Homo sapiens
ccacugaacuuaggucaug

SEQ ID NO: 1358105 - RNA, 19 nt, Homo sapiens
gaucccacauuuaaaguau

SEQ ID NO: 1358106 - RNA, 19 nt, Homo sapiens
ggagacacauucacagaca

SEQ ID NO: 1358107 - RNA, 19 nt, Homo sapiens
gauggaggauguugaggaa

SEQ ID NO: 1358108 - RNA, 19 nt, Homo sapiens
ggcaggagcuaauugaaug

SEQ ID NO: 1358109 - RNA, 19 nt, Homo sapiens
ccuaaugaaugcuaguuaa

SEQ ID NO: 1358110 - RNA, 19 nt, Homo sapiens
uucaggagcuucuguuaua

SEQ ID NO: 1358111 - RNA, 19 nt, Homo sapiens
ccagaggacuacacuaaau

SEQ ID NO: 1358112 - RNA, 19 nt, Homo sapiens
gagaacaaagagacaguua

SEQ ID NO: 1358113 - RNA, 19 nt, Homo sapiens
gaaagggcccugagagugu

SEQ ID NO: 1358114 - RNA, 19 nt, Homo sapiens
ggaagcgccuugaagaaca

SEQ ID NO: 1358115 - RNA, 19 nt, Homo sapiens
uuacuacacuggcagaauu

SEQ ID NO: 1358116 - RNA, 19 nt, Homo sapiens
ucacauugauucugggaaa

SEQ ID NO: 1358117 - RNA, 19 nt, Homo sapiens
gcauauaucaugacacuuc

SEQ ID NO: 1358118 - RNA, 19 nt, Homo sapiens
guuaacggguuguuuauca

SEQ ID NO: 1358119 - RNA, 19 nt, Homo sapiens
ccacaugguugauucuaau

SEQ ID NO: 1358120 - RNA, 19 nt, Homo sapiens
cuaaugaacuccaguagag

SEQ ID NO: 1358121 - RNA, 19 nt, Homo sapiens
ggugaaagguaaagaugga

SEQ ID NO: 1358122 - RNA, 19 nt, Homo sapiens
gaacgaguccuuuacuaca

SEQ ID NO: 1358123 - RNA, 19 nt, Homo sapiens
ccacauacuuuccaucuac

SEQ ID NO: 1358124 - RNA, 19 nt, Homo sapiens
gaacuccaguagagacaau

SEQ ID NO: 1358125 - RNA, 19 nt, Homo sapiens
gaagacgucauuaauaagu

SEQ ID NO: 1358126 - RNA, 19 nt, Homo sapiens
agaaggugcucuuaaacaa

SEQ ID NO: 1358127 - RNA, 19 nt, Homo sapiens
cagaacgaguccuuuacua

SEQ ID NO: 1358128 - RNA, 19 nt, Homo sapiens
gaugaaacauucggaucaa

SEQ ID NO: 1358129 - RNA, 19 nt, Homo sapiens
caagagaagaucccacauu

SEQ ID NO: 1358130 - RNA, 19 nt, Homo sapiens
gguaaucacugggcaagau

SEQ ID NO: 1358131 - RNA, 19 nt, Homo sapiens
gaauuucagggacaaguaa

SEQ ID NO: 1358132 - RNA, 19 nt, Homo sapiens
ccguuugacuuuacacaua

SEQ ID NO: 1358133 - RNA, 19 nt, Homo sapiens
ggaggauguugaggaagua

SEQ ID NO: 1358134 - RNA, 19 nt, Homo sapiens
uaugaagggacaaauguua

SEQ ID NO: 1358135 - RNA, 19 nt, Homo sapiens
gaaguuguagcuccaaaug

SEQ ID NO: 1358136 - RNA, 19 nt, Homo sapiens
aggagaaggugcucuuaaa

SEQ ID NO: 1358137 - RNA, 19 nt, Homo sapiens
agaggaagcagguuaauug

SEQ ID NO: 1358138 - RNA, 19 nt, Homo sapiens
uaacaagaacgaucuggaa

SEQ ID NO: 1358139 - RNA, 19 nt, Homo sapiens
gaaagaaaguacgguugca

SEQ ID NO: 1358140 - RNA, 19 nt, Homo sapiens
ggagcuaauugaauguguu

SEQ ID NO: 1358141 - RNA, 19 nt, Homo sapiens
agacaaagaggaaucacua

SEQ ID NO: 1358142 - RNA, 19 nt, Homo sapiens
ggaacuagagagacaaaga

SEQ ID NO: 1358143 - RNA, 19 nt, Homo sapiens
gggcucuucuuucuucaaa

SEQ ID NO: 1358144 - RNA, 19 nt, Homo sapiens
gaaauucugagcccaggaa

SEQ ID NO: 1358145 - RNA, 19 nt, Homo sapiens
caacagcggccuuucuaug

SEQ ID NO: 1358146 - RNA, 19 nt, Homo sapiens
uaaagaggaugacucaaaa

SEQ ID NO: 1358147 - RNA, 19 nt, Homo sapiens
uagaauaccucccaaaucc

SEQ ID NO: 1358148 - RNA, 19 nt, Homo sapiens
gaagcgccuugaagaacaa

SEQ ID NO: 1358149 - RNA, 19 nt, Homo sapiens
guacagugccagaccauga

SEQ ID NO: 1358150 - RNA, 19 nt, Homo sapiens
uuaguuugcugaagacuug

SEQ ID NO: 1358151 - RNA, 19 nt, Homo sapiens
ccaucuaccuuccuuuguu

SEQ ID NO: 1358152 - RNA, 19 nt, Homo sapiens
gagaaggugcucuuaaaca

SEQ ID NO: 1358153 - RNA, 19 nt, Homo sapiens
caauaaagaggaugacuca

SEQ ID NO: 1358154 - RNA, 19 nt, Homo sapiens
gauggagacuuuggucaga

SEQ ID NO: 1358155 - RNA, 19 nt, Homo sapiens
ugcaugaggugaaagguaa

SEQ ID NO: 1358156 - RNA, 19 nt, Homo sapiens
caaagagacaguuauaucu

SEQ ID NO: 1358157 - RNA, 19 nt, Homo sapiens
aaagaugcaugaggugaaa

SEQ ID NO: 1358158 - RNA, 19 nt, Homo sapiens
caacucuauugauugguuu

SEQ ID NO: 1358159 - RNA, 19 nt, Homo sapiens
caaagguaauucuaugucu

SEQ ID NO: 1358160 - RNA, 19 nt, Homo sapiens
ccaaauuucucucuguuuu

SEQ ID NO: 1358161 - RNA, 19 nt, Homo sapiens
aagaguggauuccguaugu

SEQ ID NO: 1358162 - RNA, 19 nt, Homo sapiens
gugaaucgcauauaucaug

SEQ ID NO: 1358163 - RNA, 19 nt, Homo sapiens
guaauucuaugucuaucuc

SEQ ID NO: 1358164 - RNA, 19 nt, Homo sapiens
ggaaagggagaauacacaa

SEQ ID NO: 1358165 - RNA, 19 nt, Homo sapiens
guaugcagaugucccucua

SEQ ID NO: 1358166 - RNA, 19 nt, Homo sapiens
gguauuggcagguuuacaa

SEQ ID NO: 1358167 - RNA, 19 nt, Homo sapiens
ggacaauuaacuuauguuc

SEQ ID NO: 1358168 - RNA, 19 nt, Homo sapiens
aaucucagcucacauugau

SEQ ID NO: 1358169 - RNA, 19 nt, Homo sapiens
uaacggguuguuuaucaua

SEQ ID NO: 1358170 - RNA, 19 nt, Homo sapiens
acaagaagacgucauuaau

SEQ ID NO: 1358171 - RNA, 19 nt, Homo sapiens
uauuauggcuguggaaguu

SEQ ID NO: 1358172 - RNA, 19 nt, Homo sapiens
gcucugcgcuugccaugag

SEQ ID NO: 1358173 - RNA, 19 nt, Homo sapiens
agacaauucccacccauuu

SEQ ID NO: 1358174 - RNA, 19 nt, Homo sapiens
auaaagaggaugacucaaa

SEQ ID NO: 1358175 - RNA, 19 nt, Homo sapiens
ggaacgagccaucuauuuu

SEQ ID NO: 1358176 - RNA, 19 nt, Homo sapiens
uguggucuauugugaagua

SEQ ID NO: 1358177 - RNA, 19 nt, Homo sapiens
ugaaucgcauauaucauga

SEQ ID NO: 1358178 - RNA, 19 nt, Homo sapiens
aauuacaccuggaaaucua

SEQ ID NO: 1358179 - RNA, 19 nt, Homo sapiens
gaagacagcugaagaauuu

SEQ ID NO: 1358180 - RNA, 19 nt, Homo sapiens
ggagaaaccuggcaucuau

SEQ ID NO: 1358181 - RNA, 19 nt, Homo sapiens
acaaaccgcucauuauuua

SEQ ID NO: 1358182 - RNA, 19 nt, Homo sapiens
gaaaguggcucaaauaaaa

SEQ ID NO: 1358183 - RNA, 19 nt, Homo sapiens
uaagguggcuuuaacaauu

SEQ ID NO: 1358184 - RNA, 19 nt, Homo sapiens
gaaaggagcagaguaugua

SEQ ID NO: 1358185 - RNA, 19 nt, Homo sapiens
caaagagccuguucaccua

SEQ ID NO: 1358186 - RNA, 19 nt, Homo sapiens
caaagaugcuaaugaaguu

SEQ ID NO: 1358187 - RNA, 19 nt, Homo sapiens
gggaacagauauuuauuug

SEQ ID NO: 1358188 - RNA, 19 nt, Homo sapiens
gaaaggaaggucugaacua

SEQ ID NO: 1358189 - RNA, 19 nt, Homo sapiens
gaaaauggcuaaacuauac

SEQ ID NO: 1358190 - RNA, 19 nt, Homo sapiens
gaauggaacaucaaagaaa

SEQ ID NO: 1358191 - RNA, 19 nt, Homo sapiens
caaaagauguguauacuug

SEQ ID NO: 1358192 - RNA, 19 nt, Homo sapiens
gagaaaguggcucaaauaa

SEQ ID NO: 1358193 - RNA, 19 nt, Homo sapiens
gaggaaggcugcaaugaag

SEQ ID NO: 1358194 - RNA, 19 nt, Homo sapiens
aaaggaaggucugaacuaa

SEQ ID NO: 1358195 - RNA, 19 nt, Homo sapiens
uguaaugccuuggaaguua

SEQ ID NO: 1358196 - RNA, 19 nt, Homo sapiens
gggccaauauuagcucuua

SEQ ID NO: 1358197 - RNA, 19 nt, Homo sapiens
gcaaagaugcuaaugaagu

SEQ ID NO: 1358198 - RNA, 19 nt, Homo sapiens
aaacucauauggugaauuc

SEQ ID NO: 1358199 - RNA, 19 nt, Homo sapiens
ggagaaaggagcagaguau

SEQ ID NO: 1358200 - RNA, 19 nt, Homo sapiens
gacaaaccgcucauuauuu

SEQ ID NO: 1358201 - RNA, 19 nt, Homo sapiens
uggcaaagaugcuaaugaa

SEQ ID NO: 1358202 - RNA, 19 nt, Homo sapiens
gacaagaggacaccaauug

SEQ ID NO: 1358203 - RNA, 19 nt, Homo sapiens
ccucagaacuuauaaaggu

SEQ ID NO: 1358204 - RNA, 19 nt, Homo sapiens
aaagacaaaccgcucauua

SEQ ID NO: 1358205 - RNA, 19 nt, Homo sapiens
uuuaaggacuggagagaua

SEQ ID NO: 1358206 - RNA, 19 nt, Homo sapiens
aggaaggucugaacuaauu

SEQ ID NO: 1358207 - RNA, 19 nt, Homo sapiens
aaauguaccuugagacaga

SEQ ID NO: 1358208 - RNA, 19 nt, Homo sapiens
agacauaaguaacaggaaa

SEQ ID NO: 1358209 - RNA, 19 nt, Homo sapiens
gaugucauguuacuagaug

SEQ ID NO: 1358210 - RNA, 19 nt, Homo sapiens
ugauuuagcugaagaugau

SEQ ID NO: 1358211 - RNA, 19 nt, Homo sapiens
gcaaaugccacacgagaug

SEQ ID NO: 1358212 - RNA, 19 nt, Homo sapiens
agaaagauuugucagauag

SEQ ID NO: 1358213 - RNA, 19 nt, Homo sapiens
gagauaaagaucagaguga

SEQ ID NO: 1358214 - RNA, 19 nt, Homo sapiens
gucauuaacugcuaagugu

SEQ ID NO: 1358215 - RNA, 19 nt, Homo sapiens
caaggcaguuaucucauug

SEQ ID NO: 1358216 - RNA, 19 nt, Homo sapiens
agacaaaccgcucauuauu

SEQ ID NO: 1358217 - RNA, 19 nt, Homo sapiens
aaacaccaaucuucaaaca

SEQ ID NO: 1358218 - RNA, 19 nt, Homo sapiens
gaagaaugcuuuauuuugg

SEQ ID NO: 1358219 - RNA, 19 nt, Homo sapiens
acaaggcaguuaucucauu

SEQ ID NO: 1358220 - RNA, 19 nt, Homo sapiens
agagaaaguggcucaaaua

SEQ ID NO: 1358221 - RNA, 19 nt, Homo sapiens
cagagaaaguggcucaaau

SEQ ID NO: 1358222 - RNA, 19 nt, Homo sapiens
ggaaagguaaagaugcuaa

SEQ ID NO: 1358223 - RNA, 19 nt, Homo sapiens
gaaaaccccuucucaaugg

SEQ ID NO: 1358224 - RNA, 19 nt, Homo sapiens
uuacaagaauggaacauca

SEQ ID NO: 1358225 - RNA, 19 nt, Homo sapiens
gaagugaacccucagaacu

SEQ ID NO: 1358226 - RNA, 19 nt, Homo sapiens
guaaugccuuggaaguuau

SEQ ID NO: 1358227 - RNA, 19 nt, Homo sapiens
gcaucuaucaccagaauug

SEQ ID NO: 1358228 - RNA, 19 nt, Homo sapiens
gguggugacugcuacauca

SEQ ID NO: 1358229 - RNA, 19 nt, Homo sapiens
uggcaaugcugcugucuga

SEQ ID NO: 1358230 - RNA, 19 nt, Homo sapiens
ggaugaugguucuggcaaa

SEQ ID NO: 1358231 - RNA, 19 nt, Homo sapiens
acaccaaucuucaaacagu

SEQ ID NO: 1358232 - RNA, 19 nt, Homo sapiens
cuagaaagauuugucagau

SEQ ID NO: 1358233 - RNA, 19 nt, Homo sapiens
agugaacccucagaacuua

SEQ ID NO: 1358234 - RNA, 19 nt, Homo sapiens
ccagcagcaucuuguacua

SEQ ID NO: 1358235 - RNA, 19 nt, Homo sapiens
caccaauugucaucauaaa

SEQ ID NO: 1358236 - RNA, 19 nt, Homo sapiens
ugaacuaauugucguggaa

SEQ ID NO: 1358237 - RNA, 19 nt, Homo sapiens
aaauuaaccucaaccaaac

SEQ ID NO: 1358238 - RNA, 19 nt, Homo sapiens
ggaaaauggcuaaacuaua

SEQ ID NO: 1358239 - RNA, 19 nt, Homo sapiens
aaaccucgccucuacuaaa

SEQ ID NO: 1358240 - RNA, 19 nt, Homo sapiens
cgaaaccucgccucuacua

SEQ ID NO: 1358241 - RNA, 19 nt, Homo sapiens
uaccagaccucaccacuac

SEQ ID NO: 1358242 - RNA, 19 nt, Homo sapiens
gcgaggagccagaggaguu

SEQ ID NO: 1358243 - RNA, 19 nt, Homo sapiens
ggagguugauguugaugca

SEQ ID NO: 1358244 - RNA, 19 nt, Homo sapiens
ccagaauuguggagguuga

SEQ ID NO: 1358245 - RNA, 19 nt, Homo sapiens
caaugcugcugucugaaga

SEQ ID NO: 1358246 - RNA, 19 nt, Homo sapiens
gccaugagccacccacauu

SEQ ID NO: 1358247 - RNA, 19 nt, Homo sapiens
acuggaagauuuguuauug

SEQ ID NO: 1358248 - RNA, 19 nt, Homo sapiens
cuacacgccucuuucaagu

SEQ ID NO: 1358249 - RNA, 19 nt, Homo sapiens
agaaaguggcucaaauaaa

SEQ ID NO: 1358250 - RNA, 19 nt, Homo sapiens
ugacugugguggcagaaga

SEQ ID NO: 1358251 - RNA, 19 nt, Homo sapiens
uuacaaggcaguuaucuca

SEQ ID NO: 1358252 - RNA, 19 nt, Homo sapiens
cgggaaaguuuaugucaca

SEQ ID NO: 1358253 - RNA, 19 nt, Homo sapiens
gaaaccucgccucuacuaa

SEQ ID NO: 1358254 - RNA, 19 nt, Homo sapiens
ccaggaugauuuagcugaa

SEQ ID NO: 1358255 - RNA, 19 nt, Homo sapiens
ggacuggagagauaaagau

SEQ ID NO: 1358256 - RNA, 19 nt, Homo sapiens
ugaagacagcugaagaauu

SEQ ID NO: 1358257 - RNA, 19 nt, Homo sapiens
cuuggaaguuauucucuuu

SEQ ID NO: 1358258 - RNA, 19 nt, Homo sapiens
ggaaggcugagacaggaaa

SEQ ID NO: 1358259 - RNA, 19 nt, Homo sapiens
gaccauccaccucggcuuu

SEQ ID NO: 1358260 - RNA, 19 nt, Homo sapiens
gagaggaaggcugcaauga

SEQ ID NO: 1358261 - RNA, 19 nt, Homo sapiens
gcauuagccauuagucaga

SEQ ID NO: 1358262 - RNA, 19 nt, Homo sapiens
caucugcguuccugacugu

SEQ ID NO: 1358263 - RNA, 19 nt, Homo sapiens
caaugaagacagcugaaga

SEQ ID NO: 1358264 - RNA, 19 nt, Homo sapiens
aaacauuacaaggcaguua

SEQ ID NO: 1358265 - RNA, 19 nt, Homo sapiens
guucacccaggaugauuua

SEQ ID NO: 1358266 - RNA, 19 nt, Homo sapiens
caucauacucuacaccuau

SEQ ID NO: 1358267 - RNA, 19 nt, Homo sapiens
ggagauuuggcguguagaa

SEQ ID NO: 1358268 - RNA, 19 nt, Homo sapiens
gcaaugcugcugucugaag

SEQ ID NO: 1358269 - RNA, 19 nt, Homo sapiens
gcucuuauggaaacugauu

SEQ ID NO: 1358270 - RNA, 19 nt, Homo sapiens
uggcaucuaucaccagaau

SEQ ID NO: 1358271 - RNA, 19 nt, Homo sapiens
aagaauggaacaucaaaga

SEQ ID NO: 1358272 - RNA, 19 nt, Homo sapiens
uaucccagaggacagauua

SEQ ID NO: 1358273 - RNA, 19 nt, Homo sapiens
uccagcaagugguaaauug

SEQ ID NO: 1358274 - RNA, 19 nt, Homo sapiens
gaagagauuccaggagagu

SEQ ID NO: 1358275 - RNA, 19 nt, Homo sapiens
guggagauuuggcguguag

SEQ ID NO: 1358276 - RNA, 19 nt, Homo sapiens
gaugaugguucuggcaaag

SEQ ID NO: 1358277 - RNA, 19 nt, Homo sapiens
ggaaaguuuaugucacaga

SEQ ID NO: 1358278 - RNA, 19 nt, Homo sapiens
gaaagguaaagaugcuaau

SEQ ID NO: 1358279 - RNA, 19 nt, Homo sapiens
gagaagagcuccaaagaga

SEQ ID NO: 1358280 - RNA, 19 nt, Homo sapiens
gagcagaacuauauagauu

SEQ ID NO: 1358281 - RNA, 19 nt, Homo sapiens
caacugagccuccaacaua

SEQ ID NO: 1358282 - RNA, 19 nt, Homo sapiens
guagggauguugcuauuaa

SEQ ID NO: 1358283 - RNA, 19 nt, Homo sapiens
ggaaugaucucaaagacau

SEQ ID NO: 1358284 - RNA, 19 nt, Homo sapiens
ccagagaacuucauaagga

SEQ ID NO: 1358285 - RNA, 19 nt, Homo sapiens
ggagaaaguuccaggaugu

SEQ ID NO: 1358286 - RNA, 19 nt, Homo sapiens
gaagaucuguggagaaagu

SEQ ID NO: 1358287 - RNA, 19 nt, Homo sapiens
ggaggaaaguuacaacaug

SEQ ID NO: 1358288 - RNA, 19 nt, Homo sapiens
gaaaagauccuuaaacuug

SEQ ID NO: 1358289 - RNA, 19 nt, Homo sapiens
ccaaagagauugaaguaca

SEQ ID NO: 1358290 - RNA, 19 nt, Homo sapiens
gagcccagcugcuagauau

SEQ ID NO: 1358291 - RNA, 19 nt, Homo sapiens
gaagagcuccaaagagauu

SEQ ID NO: 1358292 - RNA, 19 nt, Homo sapiens
gcugaaauauguaggaaau

SEQ ID NO: 1358293 - RNA, 19 nt, Homo sapiens
uagaagaucuguggagaaa

SEQ ID NO: 1358294 - RNA, 19 nt, Homo sapiens
ccaaggaguuugagacaga

SEQ ID NO: 1358295 - RNA, 19 nt, Homo sapiens
gaagaauaaucuagaagag

SEQ ID NO: 1358296 - RNA, 19 nt, Homo sapiens
gaaacuacaggaugccaua

SEQ ID NO: 1358297 - RNA, 19 nt, Homo sapiens
gaacacaacagugcucuga

SEQ ID NO: 1358298 - RNA, 19 nt, Homo sapiens
gcucaacccacucuuuaua

SEQ ID NO: 1358299 - RNA, 19 nt, Homo sapiens
aggauguacucaagaauua

SEQ ID NO: 1358300 - RNA, 19 nt, Homo sapiens
acagaaaggaagacaauua

SEQ ID NO: 1358301 - RNA, 19 nt, Homo sapiens
acauaggaauggagaauuu

SEQ ID NO: 1358302 - RNA, 19 nt, Homo sapiens
ccuuaaacuugcugaaaua

SEQ ID NO: 1358303 - RNA, 19 nt, Homo sapiens
caacagugcucugaaccuu

SEQ ID NO: 1358304 - RNA, 19 nt, Homo sapiens
gagaaagauuguugauaag

SEQ ID NO: 1358305 - RNA, 19 nt, Homo sapiens
caacauccaaccacuuaaa

SEQ ID NO: 1358306 - RNA, 19 nt, Homo sapiens
acagugcucugaaccuuaa

SEQ ID NO: 1358307 - RNA, 19 nt, Homo sapiens
cagcucaacccacucuuua

SEQ ID NO: 1358308 - RNA, 19 nt, Homo sapiens
ggaauugguccuuguacaa

SEQ ID NO: 1358309 - RNA, 19 nt, Homo sapiens
ccaaggugaugguggacua

SEQ ID NO: 1358310 - RNA, 19 nt, Homo sapiens
gaaauuugaaaccgaagaa

SEQ ID NO: 1358311 - RNA, 19 nt, Homo sapiens
gaagaugagaaccgguaua

SEQ ID NO: 1358312 - RNA, 19 nt, Homo sapiens
caggaugccauaacuauuu

SEQ ID NO: 1358313 - RNA, 19 nt, Homo sapiens
acaaugucaucaagucuuu

SEQ ID NO: 1358314 - RNA, 19 nt, Homo sapiens
ccauggagcagaacuauau

SEQ ID NO: 1358315 - RNA, 19 nt, Homo sapiens
gaaccgguauauccguaau

SEQ ID NO: 1358316 - RNA, 19 nt, Homo sapiens
cauguggaaugaucucaaa

SEQ ID NO: 1358317 - RNA, 19 nt, Homo sapiens
agacaugaauuuagaagag

SEQ ID NO: 1358318 - RNA, 19 nt, Homo sapiens
guacaacugcgaaaacuua

SEQ ID NO: 1358319 - RNA, 19 nt, Homo sapiens
gacucacccuggaaaguaa

SEQ ID NO: 1358320 - RNA, 19 nt, Homo sapiens
gagauugaaguacagauga

SEQ ID NO: 1358321 - RNA, 19 nt, Homo sapiens
gacaugaauuuagaagaga

SEQ ID NO: 1358322 - RNA, 19 nt, Homo sapiens
gauccucagccaaacauuu

SEQ ID NO: 1358323 - RNA, 19 nt, Homo sapiens
caacuaucaaagcaacuua

SEQ ID NO: 1358324 - RNA, 19 nt, Homo sapiens
caucaguauugacuccuaa

SEQ ID NO: 1358325 - RNA, 19 nt, Homo sapiens
aaacuuaaggcccaaagaa

SEQ ID NO: 1358326 - RNA, 19 nt, Homo sapiens
cagaaaggaagacaauuau

SEQ ID NO: 1358327 - RNA, 19 nt, Homo sapiens
gaugguggacuacauagga

SEQ ID NO: 1358328 - RNA, 19 nt, Homo sapiens
gaugagaaccgguauaucc

SEQ ID NO: 1358329 - RNA, 19 nt, Homo sapiens
caaagagauugaaguacag

SEQ ID NO: 1358330 - RNA, 19 nt, Homo sapiens
gcagccacuugcacaaugu

SEQ ID NO: 1358331 - RNA, 19 nt, Homo sapiens
aacaacauccaaccacuua

SEQ ID NO: 1358332 - RNA, 19 nt, Homo sapiens
ggugaugguggacuacaua

SEQ ID NO: 1358333 - RNA, 19 nt, Homo sapiens
ugagaaagagauucacuau

SEQ ID NO: 1358334 - RNA, 19 nt, Homo sapiens
ucaaggcccugagaaagau

SEQ ID NO: 1358335 - RNA, 19 nt, Homo sapiens
ggagaacagaguagaagau

SEQ ID NO: 1358336 - RNA, 19 nt, Homo sapiens
gucaucaagucuuuagcua

SEQ ID NO: 1358337 - RNA, 19 nt, Homo sapiens
gaccagagaacuucauaag

SEQ ID NO: 1358338 - RNA, 19 nt, Homo sapiens
ccagaagaacuuagucaga

SEQ ID NO: 1358339 - RNA, 19 nt, Homo sapiens
gcaccuggagaacagagua

SEQ ID NO: 1358340 - RNA, 19 nt, Homo sapiens
ugagaaauguagggauguu

SEQ ID NO: 1358341 - RNA, 19 nt, Homo sapiens
ccauccaggugauaaacaa

SEQ ID NO: 1358342 - RNA, 19 nt, Homo sapiens
aggacaagcuggccaagga

SEQ ID NO: 1358343 - RNA, 19 nt, Homo sapiens
gagaaaguuccaggaugua

SEQ ID NO: 1358344 - RNA, 19 nt, Homo sapiens
ggcaagaucaugauacaca

SEQ ID NO: 1358345 - RNA, 19 nt, Homo sapiens
caggauguacucaagaauu

SEQ ID NO: 1358346 - RNA, 19 nt, Homo sapiens
gaucucaaagacaugaauu

SEQ ID NO: 1358347 - RNA, 19 nt, Homo sapiens
cagagcauguggaaugauc

SEQ ID NO: 1358348 - RNA, 19 nt, Homo sapiens
gaacgagugguggacugua

SEQ ID NO: 1358349 - RNA, 19 nt, Homo sapiens
agacucacccuggaaagua

SEQ ID NO: 1358350 - RNA, 19 nt, Homo sapiens
uggaagcccuaaccaagga

SEQ ID NO: 1358351 - RNA, 19 nt, Homo sapiens
caaggaguuugagacagaa

SEQ ID NO: 1358352 - RNA, 19 nt, Homo sapiens
ggaaauuugaaaccgaaga

SEQ ID NO: 1358353 - RNA, 19 nt, Homo sapiens
cagcaucccagaagaacuu

SEQ ID NO: 1358354 - RNA, 19 nt, Homo sapiens
guauauccguaaugacaag

SEQ ID NO: 1358355 - RNA, 19 nt, Homo sapiens
guagaagaucuguggagaa

SEQ ID NO: 1358356 - RNA, 19 nt, Homo sapiens
ggagcagaacuauauagau

SEQ ID NO: 1358357 - RNA, 19 nt, Homo sapiens
agacagaaaggaagacaau

SEQ ID NO: 1358358 - RNA, 19 nt, Homo sapiens
gcccuuguccauacguaua

SEQ ID NO: 1358359 - RNA, 19 nt, Homo sapiens
ucaacccacucuuuauagu

SEQ ID NO: 1358360 - RNA, 19 nt, Homo sapiens
ggaagucaagaccagagaa

SEQ ID NO: 1358361 - RNA, 19 nt, Homo sapiens
gugaaaagauccuuaaacu

SEQ ID NO: 1358362 - RNA, 19 nt, Homo sapiens
uagggauguugcuauuaaa

SEQ ID NO: 1358363 - RNA, 19 nt, Homo sapiens
acacaacagugcucugaac

SEQ ID NO: 1358364 - RNA, 19 nt, Homo sapiens
ggugauaaacaacauccaa

SEQ ID NO: 1358365 - RNA, 19 nt, Homo sapiens
gaaaagguacaacaaagug

SEQ ID NO: 1358366 - RNA, 19 nt, Homo sapiens
gggcagcaucccagaagaa

SEQ ID NO: 1358367 - RNA, 19 nt, Homo sapiens
agauugaaguacagaugaa

SEQ ID NO: 1358368 - RNA, 19 nt, Homo sapiens
aacgagugguggacuguaa

SEQ ID NO: 1358369 - RNA, 19 nt, Homo sapiens
gaugagaagagcuccaaag

SEQ ID NO: 1358370 - RNA, 19 nt, Homo sapiens
gagaacagaguagaagauc

SEQ ID NO: 1358371 - RNA, 19 nt, Homo sapiens
gagaaagagauucacuauc

SEQ ID NO: 1358372 - RNA, 19 nt, Homo sapiens
gccgugagagugaagauga

SEQ ID NO: 1358373 - RNA, 19 nt, Homo sapiens
ucagccaguucuugaagga

SEQ ID NO: 1358374 - RNA, 19 nt, Homo sapiens
cauccaaccacuuaaaaua

SEQ ID NO: 1358375 - RNA, 19 nt, Homo sapiens
gauaaacaacauccaacca

SEQ ID NO: 1358376 - RNA, 19 nt, Homo sapiens
ucaucaguauugacuccua

SEQ ID NO: 1358377 - RNA, 19 nt, Homo sapiens
gcccugagaaagauuguug

SEQ ID NO: 1358378 - RNA, 19 nt, Homo sapiens
gaacuucauaaggacauug

SEQ ID NO: 1358379 - RNA, 19 nt, Homo sapiens
ccaauuggcuggcaaagua

SEQ ID NO: 1358380 - RNA, 19 nt, Homo sapiens
uaacauaccuaaccaaaga

SEQ ID NO: 1358381 - RNA, 19 nt, Homo sapiens
gaacaggacuugccagugu

SEQ ID NO: 1358382 - RNA, 19 nt, Homo sapiens
caacaacgcccacgcaaua

SEQ ID NO: 1358383 - RNA, 19 nt, Homo sapiens
aaacacagcuaaucaaaga

SEQ ID NO: 1358384 - RNA, 19 nt, Homo sapiens
gaucaagucugacauggaa

SEQ ID NO: 1358385 - RNA, 19 nt, Homo sapiens
caagagggauaaccaauug

SEQ ID NO: 1358386 - RNA, 19 nt, Homo sapiens
aaagaaggaucucgaaguu

SEQ ID NO: 1358387 - RNA, 19 nt, Homo sapiens
gagaagcucuauacgaaau

SEQ ID NO: 1358388 - RNA, 19 nt, Homo sapiens
aaaguaaccugacucuauu

SEQ ID NO: 1358389 - RNA, 19 nt, Homo sapiens
agaaggaucucgaaguuau

SEQ ID NO: 1358390 - RNA, 19 nt, Homo sapiens
gcacagacucuugauauug

SEQ ID NO: 1358391 - RNA, 19 nt, Homo sapiens
gaaaggagcagcuguuugc

SEQ ID NO: 1358392 - RNA, 19 nt, Homo sapiens
cacagacucuugauauuga

SEQ ID NO: 1358393 - RNA, 19 nt, Homo sapiens
gaaauucuuggucugcaua

SEQ ID NO: 1358394 - RNA, 19 nt, Homo sapiens
gaaacaccauccagacaag

SEQ ID NO: 1358395 - RNA, 19 nt, Homo sapiens
aggagaagcucuauacgaa

SEQ ID NO: 1358396 - RNA, 19 nt, Homo sapiens
uaagggagcaucaaaugaa

SEQ ID NO: 1358397 - RNA, 19 nt, Homo sapiens
gaacaguuuugcagccuua

SEQ ID NO: 1358398 - RNA, 19 nt, Homo sapiens
gcagcuguuugcuuugaaa

SEQ ID NO: 1358399 - RNA, 19 nt, Homo sapiens
cuacugagaaguuuaaaga

SEQ ID NO: 1358400 - RNA, 19 nt, Homo sapiens
gaagcucuauacgaaauuc

SEQ ID NO: 1358401 - RNA, 19 nt, Homo sapiens
caaagaaggaucucgaagu

SEQ ID NO: 1358402 - RNA, 19 nt, Homo sapiens
ggagaagcucuauacgaaa

SEQ ID NO: 1358403 - RNA, 19 nt, Homo sapiens
caacaggagaagcucuaua

SEQ ID NO: 1358404 - RNA, 19 nt, Homo sapiens
ggaaaggagcagcuguuug

SEQ ID NO: 1358405 - RNA, 19 nt, Homo sapiens
gaaaacacagcuaaucaaa

SEQ ID NO: 1358406 - RNA, 19 nt, Homo sapiens
agacaagaauccagaugau

SEQ ID NO: 1358407 - RNA, 19 nt, Homo sapiens
gagcaucaaaugaagaaau

SEQ ID NO: 1358408 - RNA, 19 nt, Homo sapiens
cauaagggagcaucaaaug

SEQ ID NO: 1358409 - RNA, 19 nt, Homo sapiens
cuacaaaugcaaaugagaa

SEQ ID NO: 1358410 - RNA, 19 nt, Homo sapiens
ugucaucguuggccucuug

SEQ ID NO: 1358411 - RNA, 19 nt, Homo sapiens
gaaggaucucgaaguuauu

SEQ ID NO: 1358412 - RNA, 19 nt, Homo sapiens
ucaagagggauaaccaauu

SEQ ID NO: 1358413 - RNA, 19 nt, Homo sapiens
gcauaagggagcaucaaau

SEQ ID NO: 1358414 - RNA, 19 nt, Homo sapiens
gaaaaccuacagaaaauug

SEQ ID NO: 1358415 - RNA, 19 nt, Homo sapiens
uugaaacgguggaacaguu

SEQ ID NO: 1358416 - RNA, 19 nt, Homo sapiens
cuacguggccgagcaguuu

SEQ ID NO: 1358417 - RNA, 19 nt, Homo sapiens
gcaauacuuaccgacauuu

SEQ ID NO: 1358418 - RNA, 19 nt, Homo sapiens
ggcaaaguaacaaaugaaa

SEQ ID NO: 1358419 - RNA, 19 nt, Homo sapiens
gggcauaaagugcugugaa

SEQ ID NO: 1358420 - RNA, 19 nt, Homo sapiens
cagacaagaauccagauga

SEQ ID NO: 1358421 - RNA, 19 nt, Homo sapiens
caaagagaagcauauacga

SEQ ID NO: 1358422 - RNA, 19 nt, Homo sapiens
ugaaacaccauccagacaa

SEQ ID NO: 1358423 - RNA, 19 nt, Homo sapiens
ggcauaaagugcugugaac

SEQ ID NO: 1358424 - RNA, 19 nt, Homo sapiens
cgcaauacuuaccgacauu

SEQ ID NO: 1358425 - RNA, 19 nt, Homo sapiens
gaaaauuggcccugaaaca

SEQ ID NO: 1358426 - RNA, 19 nt, Homo sapiens
gggagcaucaaaugaagaa

SEQ ID NO: 1358427 - RNA, 19 nt, Homo sapiens
gaagcauauacgacaagua

SEQ ID NO: 1358428 - RNA, 19 nt, Homo sapiens
uagccaaggugggacacua

SEQ ID NO: 1358429 - RNA, 19 nt, Homo sapiens
aaaaguaaccugacucuau

SEQ ID NO: 1358430 - RNA, 19 nt, Homo sapiens
agucaucagugccagaaga

SEQ ID NO: 1358431 - RNA, 19 nt, Homo sapiens
uuaccgacauuucaaagag

SEQ ID NO: 1358432 - RNA, 19 nt, Homo sapiens
uuacugauauagccaaggu

SEQ ID NO: 1358433 - RNA, 19 nt, Homo sapiens
ugcacagacucuugauauu

SEQ ID NO: 1358434 - RNA, 19 nt, Homo sapiens
agagaagcauauacgacaa

SEQ ID NO: 1358435 - RNA, 19 nt, Homo sapiens
cagcugcuacugagaaguu

SEQ ID NO: 1358436 - RNA, 19 nt, Homo sapiens
ggacuugccagugucuaga

SEQ ID NO: 1358437 - RNA, 19 nt, Homo sapiens
cacagucccuccucucagu

SEQ ID NO: 1358438 - RNA, 19 nt, Homo sapiens
gagaaaacacagcuaauca

SEQ ID NO: 1358439 - RNA, 19 nt, Homo sapiens
caacgcccacgcaauacuu

SEQ ID NO: 1358440 - RNA, 19 nt, Homo sapiens
caggagaagcucuauacga

SEQ ID NO: 1358441 - RNA, 19 nt, Homo sapiens
agagaucucaagagggaua

SEQ ID NO: 1358442 - RNA, 19 nt, Homo sapiens
uguaacauaccuaaccaaa

SEQ ID NO: 1358443 - RNA, 19 nt, Homo sapiens
cuuagaaaauggcauguaa

SEQ ID NO: 1358444 - RNA, 19 nt, Homo sapiens
aagaaggaucucgaaguua

SEQ ID NO: 1358445 - RNA, 19 nt, Homo sapiens
cgaaauucuuggucugcau

SEQ ID NO: 1358446 - RNA, 19 nt, Homo sapiens
cuggcaaaguaacaaauga

SEQ ID NO: 1358447 - RNA, 19 nt, Homo sapiens
aagcauauacgacaaguac

SEQ ID NO: 1358448 - RNA, 19 nt, Homo sapiens
ucaaagagaagcauauacg

SEQ ID NO: 1358449 - RNA, 19 nt, Homo sapiens
gcucuauacgaaauucuug

SEQ ID NO: 1358450 - RNA, 19 nt, Homo sapiens
uugcacagacucuugauau

SEQ ID NO: 1358451 - RNA, 19 nt, Homo sapiens
gcuaaucaaagaaggaucu

SEQ ID NO: 1358452 - RNA, 19 nt, Homo sapiens
cgagcaguuuggagacgaa

SEQ ID NO: 1358453 - RNA, 19 nt, Homo sapiens
gcuggcaaaguaacaaaug

SEQ ID NO: 1358454 - RNA, 19 nt, Homo sapiens
uaccgacauuucaaagaga

SEQ ID NO: 1358455 - RNA, 19 nt, Homo sapiens
caauuggcuggcaaaguaa

SEQ ID NO: 1358456 - RNA, 19 nt, Homo sapiens
guaacauaccuaaccaaag

SEQ ID NO: 1358457 - RNA, 19 nt, Homo sapiens
uaaccaauuggcuggcaaa

SEQ ID NO: 1358458 - RNA, 19 nt, Homo sapiens
gagaagcauauacgacaag

SEQ ID NO: 1358459 - RNA, 19 nt, Homo sapiens
cagcggacucugucaacaa

SEQ ID NO: 1358460 - RNA, 19 nt, Homo sapiens
gccagugucuagaugaaaa

SEQ ID NO: 1358461 - RNA, 19 nt, Homo sapiens
uggcauugcuaagcucaga

SEQ ID NO: 1358462 - RNA, 19 nt, Homo sapiens
guucagguacuuggcauug

SEQ ID NO: 1358463 - RNA, 19 nt, Homo sapiens
guuauugcacagacucuug

SEQ ID NO: 1358464 - RNA, 19 nt, Homo sapiens
uggaggagcagaucaaguc

SEQ ID NO: 1358465 - RNA, 19 nt, Homo sapiens
cguuaacaccuacuucaug

SEQ ID NO: 1358466 - RNA, 19 nt, Homo sapiens
acgaaaacguuaacaccua

SEQ ID NO: 1358467 - RNA, 19 nt, Homo sapiens
gacaagaauccagaugauc

SEQ ID NO: 1358468 - RNA, 19 nt, Homo sapiens
auaagggagcaucaaauga

SEQ ID NO: 1358469 - RNA, 19 nt, Homo sapiens
acggaucgcugggacucua

SEQ ID NO: 1358470 - RNA, 19 nt, Homo sapiens
ggcccuguuugucaucguu

SEQ ID NO: 1358471 - RNA, 19 nt, Homo sapiens
guacuuggcauugcuaagc

SEQ ID NO: 1358472 - RNA, 19 nt, Homo sapiens
uggaaaggagcagcuguuu

SEQ ID NO: 1358473 - RNA, 19 nt, Homo sapiens
uggcaaaguaacaaaugaa

SEQ ID NO: 1358474 - RNA, 19 nt, Homo sapiens
cuaaagaccugauuacaua

SEQ ID NO: 1358475 - RNA, 19 nt, Homo sapiens
ggaauuggguguccacgua

SEQ ID NO: 1358476 - RNA, 19 nt, Homo sapiens
gaacaagugucacaauuac

SEQ ID NO: 1358477 - RNA, 19 nt, Homo sapiens
ggaacaagugucacaauua

SEQ ID NO: 1358478 - RNA, 19 nt, Homo sapiens
caaagaagaccacaaauag

SEQ ID NO: 1358479 - RNA, 19 nt, Homo sapiens
gcaaaguauugugaaagua

SEQ ID NO: 1358480 - RNA, 19 nt, Homo sapiens
caaucgaccuuuacugaaa

SEQ ID NO: 1358481 - RNA, 19 nt, Homo sapiens
gguguuaacuuacgacuuc

SEQ ID NO: 1358482 - RNA, 19 nt, Homo sapiens
gaaagucacaaccaauaaa

SEQ ID NO: 1358483 - RNA, 19 nt, Homo sapiens
acaaagaagaccacaaaua

SEQ ID NO: 1358484 - RNA, 19 nt, Homo sapiens
ggaagaguuuagugugaaa

SEQ ID NO: 1358485 - RNA, 19 nt, Homo sapiens
gcaacagcaugggugaaua

SEQ ID NO: 1358486 - RNA, 19 nt, Homo sapiens
ggaaagucacaaccaauaa

SEQ ID NO: 1358487 - RNA, 19 nt, Homo sapiens
agaagaaagugaaagcaaa

SEQ ID NO: 1358488 - RNA, 19 nt, Homo sapiens
ccacauugccuuacugaaa

SEQ ID NO: 1358489 - RNA, 19 nt, Homo sapiens
caagcaaaguauugugaaa

SEQ ID NO: 1358490 - RNA, 19 nt, Homo sapiens
uaacuuacgacuucacuaa

SEQ ID NO: 1358491 - RNA, 19 nt, Homo sapiens
ugacaaagaagaccacaaa

SEQ ID NO: 1358492 - RNA, 19 nt, Homo sapiens
aaagaaauguucgccauga

SEQ ID NO: 1358493 - RNA, 19 nt, Homo sapiens
gauagcaccuaaacuuaca

SEQ ID NO: 1358494 - RNA, 19 nt, Homo sapiens
caauaaaugucuggaacaa

SEQ ID NO: 1358495 - RNA, 19 nt, Homo sapiens
caacagcaugggugaauaa

SEQ ID NO: 1358496 - RNA, 19 nt, Homo sapiens
gaagaaagugaaagcaaau

SEQ ID NO: 1358497 - RNA, 19 nt, Homo sapiens
guacuacuccucaaauguu

SEQ ID NO: 1358498 - RNA, 19 nt, Homo sapiens
acaaguagauccugagaag

SEQ ID NO: 1358499 - RNA, 19 nt, Homo sapiens
agacagacauuccuucuac

SEQ ID NO: 1358500 - RNA, 19 nt, Homo sapiens
gaaacucagauaaaugcua

SEQ ID NO: 1358501 - RNA, 19 nt, Homo sapiens
gggaagaguuuagugugaa

SEQ ID NO: 1358502 - RNA, 19 nt, Homo sapiens
agacaagagugguauauac

SEQ ID NO: 1358503 - RNA, 19 nt, Homo sapiens
guaauucucggcuguaguu

SEQ ID NO: 1358504 - RNA, 19 nt, Homo sapiens
aaaggaaagucacaaccaa

SEQ ID NO: 1358505 - RNA, 19 nt, Homo sapiens
aaauguacauguuccuuug

SEQ ID NO: 1358506 - RNA, 19 nt, Homo sapiens
gagaagaaagugaaagcaa

SEQ ID NO: 1358507 - RNA, 19 nt, Homo sapiens
agagugguauauacaagua

SEQ ID NO: 1358508 - RNA, 19 nt, Homo sapiens
ucgcuucaaucgaccuuua

SEQ ID NO: 1358509 - RNA, 19 nt, Homo sapiens
uggaacaagugucacaauu

SEQ ID NO: 1358510 - RNA, 19 nt, Homo sapiens
uaaagcagccuaucucagu

SEQ ID NO: 1358511 - RNA, 19 nt, Homo sapiens
gaccacaaauaguuaucuu

SEQ ID NO: 1358512 - RNA, 19 nt, Homo sapiens
auaaaugucuggaacaagu

SEQ ID NO: 1358513 - RNA, 19 nt, Homo sapiens
aagaagaccacaaauaguu

SEQ ID NO: 1358514 - RNA, 19 nt, Homo sapiens
cacauugccuuacugaaau

SEQ ID NO: 1358515 - RNA, 19 nt, Homo sapiens
cagccuaucucaguacuau

SEQ ID NO: 1358516 - RNA, 19 nt, Homo sapiens
aaguagauccugagaagua

SEQ ID NO: 1358517 - RNA, 19 nt, Homo sapiens
gaccuuuacugaaacaaca

SEQ ID NO: 1358518 - RNA, 19 nt, Homo sapiens
aaagcagccuaucucagua

SEQ ID NO: 1358519 - RNA, 19 nt, Homo sapiens
caagagugguauauacaag

SEQ ID NO: 1358520 - RNA, 19 nt, Homo sapiens
gaagaccacaaauaguuau

SEQ ID NO: 1358521 - RNA, 19 nt, Homo sapiens
agaagaccacaaauaguua

SEQ ID NO: 1358522 - RNA, 19 nt, Homo sapiens
gcaaugaagaagaggagaa

SEQ ID NO: 1358523 - RNA, 19 nt, Homo sapiens
gaccugauuacauauauga

SEQ ID NO: 1358524 - RNA, 19 nt, Homo sapiens
gagaaguaccuuuguuaca

SEQ ID NO: 1358525 - RNA, 19 nt, Homo sapiens
aaacaacaguaaaccaucu

SEQ ID NO: 1358526 - RNA, 19 nt, Homo sapiens
cauguuccuuuguaauuga

SEQ ID NO: 1358527 - RNA, 19 nt, Homo sapiens
caaaugggguuucacaaau

SEQ ID NO: 1358528 - RNA, 19 nt, Homo sapiens
gaagcuuccauaacauuga

SEQ ID NO: 1358529 - RNA, 19 nt, Homo sapiens
uagggcugguguuaacuua

SEQ ID NO: 1358530 - RNA, 19 nt, Homo sapiens
aaugauagcaccuaaacuu

SEQ ID NO: 1358531 - RNA, 19 nt, Homo sapiens
ccacguauguucccuuuug

SEQ ID NO: 1358532 - RNA, 19 nt, Homo sapiens
ugggaagaguuuaguguga

SEQ ID NO: 1358533 - RNA, 19 nt, Homo sapiens
gaagauuaaagcagccuau

SEQ ID NO: 1358534 - RNA, 19 nt, Homo sapiens
gcaaaugggguuucacaaa

SEQ ID NO: 1358535 - RNA, 19 nt, Homo sapiens
gccuaucucaguacuauuu

SEQ ID NO: 1358536 - RNA, 19 nt, Homo sapiens
ccugagaaguaccuuuguu

SEQ ID NO: 1358537 - RNA, 19 nt, Homo sapiens
ggcaaaaccuggugcuuga

SEQ ID NO: 1358538 - RNA, 19 nt, Homo sapiens
uauauguucugucaguuuc

SEQ ID NO: 1358539 - RNA, 19 nt, Homo sapiens
agaaguaccuuuguuacag

SEQ ID NO: 1358540 - RNA, 19 nt, Homo sapiens
cugagaaguaccuuuguua

SEQ ID NO: 1358541 - RNA, 19 nt, Homo sapiens
gacaagagugguauauaca

SEQ ID NO: 1358542 - RNA, 19 nt, Homo sapiens
aggaaagucacaaccaaua

SEQ ID NO: 1358543 - RNA, 19 nt, Homo sapiens
guccacguauguucccuuu

SEQ ID NO: 1358544 - RNA, 19 nt, Homo sapiens
caccgucucuuguagcaau

SEQ ID NO: 1358545 - RNA, 19 nt, Homo sapiens
ucaacaacaccgucucuug

SEQ ID NO: 1358546 - RNA, 19 nt, Homo sapiens
cagacaagagugguauaua

SEQ ID NO: 1358547 - RNA, 19 nt, Homo sapiens
uaacagacaagagugguau

SEQ ID NO: 1358548 - RNA, 19 nt, Homo sapiens
caaugaagaagaggagaaa

SEQ ID NO: 1358549 - RNA, 19 nt, Homo sapiens
agaaauguucgccaugaaa

SEQ ID NO: 1358550 - RNA, 19 nt, Homo sapiens
uauguucccuuuugccuua

SEQ ID NO: 1358551 - RNA, 19 nt, Homo sapiens
guaccgaguucaacaacac

SEQ ID NO: 1358552 - RNA, 19 nt, Homo sapiens
aaaugggguuucacaaaua

SEQ ID NO: 1358553 - RNA, 19 nt, Homo sapiens
gcaguaauucucggcugua

SEQ ID NO: 1358554 - RNA, 19 nt, Homo sapiens
acaagugucacaauuacaa

SEQ ID NO: 1358555 - RNA, 19 nt, Homo sapiens
cuacucaggcaaugaagaa

SEQ ID NO: 1358556 - RNA, 19 nt, Homo sapiens
aagaaauguucgccaugaa

SEQ ID NO: 1358557 - RNA, 19 nt, Homo sapiens
cuuacuauauguucuguca

SEQ ID NO: 1358558 - RNA, 19 nt, Homo sapiens
gauuaaagcagccuaucuc

SEQ ID NO: 1358559 - RNA, 19 nt, Homo sapiens
acucaaugauagcaccuaa

SEQ ID NO: 1358560 - RNA, 19 nt, Homo sapiens
uaaaugcuacucaggcaau

SEQ ID NO: 1358561 - RNA, 19 nt, Homo sapiens
gaaauguucgccaugaaaa

SEQ ID NO: 1358562 - RNA, 19 nt, Homo sapiens
cauguaaugacacuucuug

SEQ ID NO: 1358563 - RNA, 19 nt, Homo sapiens
caacuuaaggcaacagcau

SEQ ID NO: 1358564 - RNA, 19 nt, Homo sapiens
acauguuccuuuguaauug

SEQ ID NO: 1358565 - RNA, 19 nt, Homo sapiens
ucucggcuguaguugcaua

SEQ ID NO: 1358566 - RNA, 19 nt, Homo sapiens
uaacucuaacugugacaaa

SEQ ID NO: 1358567 - RNA, 19 nt, Homo sapiens
ugaaacaacaguaaaccau

SEQ ID NO: 1358568 - RNA, 19 nt, Homo sapiens
uacaagagaagaaagugaa

SEQ ID NO: 1358569 - RNA, 19 nt, Homo sapiens
cuacauguaaugacacuuc

SEQ ID NO: 1358570 - RNA, 19 nt, Homo sapiens
caggaaaaucuucaucuua

SEQ ID NO: 1358571 - RNA, 19 nt, Homo sapiens
aaagaagaccacaaauagu

SEQ ID NO: 1358572 - RNA, 19 nt, Homo sapiens
gaaacauuaacucuaacug

SEQ ID NO: 1358573 - RNA, 19 nt, Homo sapiens
ucaaucgaccuuuacugaa

SEQ ID NO: 1358574 - RNA, 19 nt, Homo sapiens
gaacaagugucacaauuac

SEQ ID NO: 1358575 - RNA, 19 nt, Homo sapiens
ggaacaagugucacaauua

SEQ ID NO: 1358576 - RNA, 19 nt, Homo sapiens
caaagaagaccacaaauag

SEQ ID NO: 1358577 - RNA, 19 nt, Homo sapiens
gcaaaguauugugaaagua

SEQ ID NO: 1358578 - RNA, 19 nt, Homo sapiens
caaucgaccuuuacugaaa

SEQ ID NO: 1358579 - RNA, 19 nt, Homo sapiens
gaaagucacaaccaauaaa

SEQ ID NO: 1358580 - RNA, 19 nt, Homo sapiens
acaaagaagaccacaaaua

SEQ ID NO: 1358581 - RNA, 19 nt, Homo sapiens
ggaaagucacaaccaauaa

SEQ ID NO: 1358582 - RNA, 19 nt, Homo sapiens
agaagaaagugaaagcaaa

SEQ ID NO: 1358583 - RNA, 19 nt, Homo sapiens
ccacauugccuuacugaaa

SEQ ID NO: 1358584 - RNA, 19 nt, Homo sapiens
caagcaaaguauugugaaa

SEQ ID NO: 1358585 - RNA, 19 nt, Homo sapiens
ugacaaagaagaccacaaa

SEQ ID NO: 1358586 - RNA, 19 nt, Homo sapiens
aaagaaauguucgccauga

SEQ ID NO: 1358587 - RNA, 19 nt, Homo sapiens
gauagcaccuaaacuuaca

SEQ ID NO: 1358588 - RNA, 19 nt, Homo sapiens
caauaaaugucuggaacaa

SEQ ID NO: 1358589 - RNA, 19 nt, Homo sapiens
gaagaaagugaaagcaaau

SEQ ID NO: 1358590 - RNA, 19 nt, Homo sapiens
guacuacuccucaaauguu

SEQ ID NO: 1358591 - RNA, 19 nt, Homo sapiens
acaaguagauccugagaag

SEQ ID NO: 1358592 - RNA, 19 nt, Homo sapiens
gagcagccacauugccuua

SEQ ID NO: 1358593 - RNA, 19 nt, Homo sapiens
agacagacauuccuucuac

SEQ ID NO: 1358594 - RNA, 19 nt, Homo sapiens
gaaacucagauaaaugcua

SEQ ID NO: 1358595 - RNA, 19 nt, Homo sapiens
agacaagagugguauauac

SEQ ID NO: 1358596 - RNA, 19 nt, Homo sapiens
guaauucucggcuguaguu

SEQ ID NO: 1358597 - RNA, 19 nt, Homo sapiens
aaaggaaagucacaaccaa

SEQ ID NO: 1358598 - RNA, 19 nt, Homo sapiens
aaauguacauguuccuuug

SEQ ID NO: 1358599 - RNA, 19 nt, Homo sapiens
gagaagaaagugaaagcaa

SEQ ID NO: 1358600 - RNA, 19 nt, Homo sapiens
agagugguauauacaagua

SEQ ID NO: 1358601 - RNA, 19 nt, Homo sapiens
ucgcuucaaucgaccuuua

SEQ ID NO: 1358602 - RNA, 19 nt, Homo sapiens
uggaacaagugucacaauu

SEQ ID NO: 1358603 - RNA, 19 nt, Homo sapiens
gaccacaaauaguuaucuu

SEQ ID NO: 1358604 - RNA, 19 nt, Homo sapiens
auaaaugucuggaacaagu

SEQ ID NO: 1358605 - RNA, 19 nt, Homo sapiens
aagaagaccacaaauaguu

SEQ ID NO: 1358606 - RNA, 19 nt, Homo sapiens
cacauugccuuacugaaau

SEQ ID NO: 1358607 - RNA, 19 nt, Homo sapiens
aaguagauccugagaagua

SEQ ID NO: 1358608 - RNA, 19 nt, Homo sapiens
gaccuuuacugaaacaaca

SEQ ID NO: 1358609 - RNA, 19 nt, Homo sapiens
caagagugguauauacaag

SEQ ID NO: 1358610 - RNA, 19 nt, Homo sapiens
gaagaccacaaauaguuau

SEQ ID NO: 1358611 - RNA, 19 nt, Homo sapiens
agaagaccacaaauaguua

SEQ ID NO: 1358612 - RNA, 19 nt, Homo sapiens
gcaaugaagaagaggagaa

SEQ ID NO: 1358613 - RNA, 19 nt, Homo sapiens
gagaaguaccuuuguuaca

SEQ ID NO: 1358614 - RNA, 19 nt, Homo sapiens
aaacaacaguaaaccaucu

SEQ ID NO: 1358615 - RNA, 19 nt, Homo sapiens
cauguuccuuuguaauuga

SEQ ID NO: 1358616 - RNA, 19 nt, Homo sapiens
caaaugggguuucacaaau

SEQ ID NO: 1358617 - RNA, 19 nt, Homo sapiens
gaagcuuccauaacauuga

SEQ ID NO: 1358618 - RNA, 19 nt, Homo sapiens
ccugaccucuucucucuga

SEQ ID NO: 1358619 - RNA, 19 nt, Homo sapiens
ccuaugagcagccacauug

SEQ ID NO: 1358620 - RNA, 19 nt, Homo sapiens
aaugauagcaccuaaacuu

SEQ ID NO: 1358621 - RNA, 19 nt, Homo sapiens
gcaaaugggguuucacaaa

SEQ ID NO: 1358622 - RNA, 19 nt, Homo sapiens
acucaacccugaccucuuc

SEQ ID NO: 1358623 - RNA, 19 nt, Homo sapiens
ccugagaaguaccuuuguu

SEQ ID NO: 1358624 - RNA, 19 nt, Homo sapiens
agaaguaccuuuguuacag

SEQ ID NO: 1358625 - RNA, 19 nt, Homo sapiens
cugagaaguaccuuuguua

SEQ ID NO: 1358626 - RNA, 19 nt, Homo sapiens
gacaagagugguauauaca

SEQ ID NO: 1358627 - RNA, 19 nt, Homo sapiens
aggaaagucacaaccaaua

SEQ ID NO: 1358628 - RNA, 19 nt, Homo sapiens
cagacaagagugguauaua

SEQ ID NO: 1358629 - RNA, 19 nt, Homo sapiens
uaacagacaagagugguau

SEQ ID NO: 1358630 - RNA, 19 nt, Homo sapiens
caaugaagaagaggagaaa

SEQ ID NO: 1358631 - RNA, 19 nt, Homo sapiens
agaaauguucgccaugaaa

SEQ ID NO: 1358632 - RNA, 19 nt, Homo sapiens
aaaugggguuucacaaaua

SEQ ID NO: 1358633 - RNA, 19 nt, Homo sapiens
gcaguaauucucggcugua

SEQ ID NO: 1358634 - RNA, 19 nt, Homo sapiens
acaagugucacaauuacaa

SEQ ID NO: 1358635 - RNA, 19 nt, Homo sapiens
cuacucaggcaaugaagaa

SEQ ID NO: 1358636 - RNA, 19 nt, Homo sapiens
aagaaauguucgccaugaa

SEQ ID NO: 1358637 - RNA, 19 nt, Homo sapiens
cguaaacuuugccgccuau

SEQ ID NO: 1358638 - RNA, 19 nt, Homo sapiens
acucaaugauagcaccuaa

SEQ ID NO: 1358639 - RNA, 19 nt, Homo sapiens
uaaaugcuacucaggcaau

SEQ ID NO: 1358640 - RNA, 19 nt, Homo sapiens
gaaauguucgccaugaaaa

SEQ ID NO: 1358641 - RNA, 19 nt, Homo sapiens
cauguaaugacacuucuug

SEQ ID NO: 1358642 - RNA, 19 nt, Homo sapiens
uaaacuuugccgccuauga

SEQ ID NO: 1358643 - RNA, 19 nt, Homo sapiens
acauguuccuuuguaauug

SEQ ID NO: 1358644 - RNA, 19 nt, Homo sapiens
ucucggcuguaguugcaua

SEQ ID NO: 1358645 - RNA, 19 nt, Homo sapiens
uaacucuaacugugacaaa

SEQ ID NO: 1358646 - RNA, 19 nt, Homo sapiens
ugaaacaacaguaaaccau

SEQ ID NO: 1358647 - RNA, 19 nt, Homo sapiens
uacaagagaagaaagugaa

SEQ ID NO: 1358648 - RNA, 19 nt, Homo sapiens
cuacauguaaugacacuuc

SEQ ID NO: 1358649 - RNA, 19 nt, Homo sapiens
aaagaagaccacaaauagu

SEQ ID NO: 1358650 - RNA, 19 nt, Homo sapiens
gaaacauuaacucuaacug

SEQ ID NO: 1358651 - RNA, 19 nt, Homo sapiens
ucaaucgaccuuuacugaa

SEQ ID NO: 1358652 - RNA, 19 nt, Homo sapiens
gacagacauuccuucuaca

SEQ ID NO: 1358653 - RNA, 19 nt, Homo sapiens
gcagccacauugccuuacu

SEQ ID NO: 1358654 - RNA, 19 nt, Homo sapiens
ugucacaauuacaaggauu

SEQ ID NO: 1358655 - RNA, 19 nt, Homo sapiens
agcaaaguauugugaaagu

SEQ ID NO: 1358656 - RNA, 19 nt, Homo sapiens
acugaaauccagagccuaa

SEQ ID NO: 1358657 - RNA, 19 nt, Homo sapiens
augauagcaccuaaacuua

SEQ ID NO: 1358658 - RNA, 19 nt, Homo sapiens
gcaccaaaauaaaucaucu

SEQ ID NO: 1358659 - RNA, 19 nt, Homo sapiens
ccaauaaaugucuggaaca

SEQ ID NO: 1358660 - RNA, 19 nt, Homo sapiens
ucaaugauagcaccuaaac

SEQ ID NO: 1358661 - RNA, 19 nt, Homo sapiens
ggcuguaguugcauaagca

SEQ ID NO: 1358662 - RNA, 19 nt, Homo sapiens
guagaugaaacauuaacuc

SEQ ID NO: 1358663 - RNA, 19 nt, Homo sapiens
agucacaaccaauaaaugu

SEQ ID NO: 1358664 - RNA, 19 nt, Homo sapiens
ucacaaccaauaaaugucu

SEQ ID NO: 1358665 - RNA, 19 nt, Homo sapiens
acaagagugguauauacaa

SEQ ID NO: 1358666 - RNA, 19 nt, Homo sapiens
ucaagcaaaguauugugaa

SEQ ID NO: 1358667 - RNA, 19 nt, Homo sapiens
uuacaagagaagaaaguga

SEQ ID NO: 1358668 - RNA, 19 nt, Homo sapiens
uguaguugcauaagcauug

SEQ ID NO: 1358669 - RNA, 19 nt, Homo sapiens
gacaaagaagaccacaaau

SEQ ID NO: 1358670 - RNA, 19 nt, Homo sapiens
acauuaacucuaacuguga

SEQ ID NO: 1358671 - RNA, 19 nt, Homo sapiens
cccuuucacucaauucuca

SEQ ID NO: 1358672 - RNA, 19 nt, Homo sapiens
gauccugagaaguaccuuu

SEQ ID NO: 1358673 - RNA, 19 nt, Homo sapiens
aaacuuugccgccuaugag

SEQ ID NO: 1358674 - RNA, 19 nt, Homo sapiens
guacauagcuccugagguu

SEQ ID NO: 1358675 - RNA, 19 nt, Homo sapiens
gcagauaacucauaggaau

SEQ ID NO: 1358676 - RNA, 19 nt, Homo sapiens
caagaaaccuuuugcaaua

SEQ ID NO: 1358677 - RNA, 19 nt, Homo sapiens
gaucacauaugcuuuacuu

SEQ ID NO: 1358678 - RNA, 19 nt, Homo sapiens
caagagaaacuuaaggaua

SEQ ID NO: 1358679 - RNA, 19 nt, Homo sapiens
agacaaggcuuuacaggaa

SEQ ID NO: 1358680 - RNA, 19 nt, Homo sapiens
ggaucaaguuuacauggua

SEQ ID NO: 1358681 - RNA, 19 nt, Homo sapiens
gaaggacuuuauagacaaa

SEQ ID NO: 1358682 - RNA, 19 nt, Homo sapiens
gcgaaggacuuuauagaca

SEQ ID NO: 1358683 - RNA, 19 nt, Homo sapiens
gaucugcacagucuucuaa

SEQ ID NO: 1358684 - RNA, 19 nt, Homo sapiens
gaugguugcugaugggauu

SEQ ID NO: 1358685 - RNA, 19 nt, Homo sapiens
aagagaaacuuaaggauag

SEQ ID NO: 1358686 - RNA, 19 nt, Homo sapiens
gcagaagaccaccaagaaa

SEQ ID NO: 1358687 - RNA, 19 nt, Homo sapiens
gcucuuugaucgacucauu

SEQ ID NO: 1358688 - RNA, 19 nt, Homo sapiens
cgaaggacuuuauagacaa

SEQ ID NO: 1358689 - RNA, 19 nt, Homo sapiens
agacugaggaucaaguuua

SEQ ID NO: 1358690 - RNA, 19 nt, Homo sapiens
gcacgaaggucaaaaccaa

SEQ ID NO: 1358691 - RNA, 19 nt, Homo sapiens
ucucacaaauccaggcaua

SEQ ID NO: 1358692 - RNA, 19 nt, Homo sapiens
gaaaaccucuuauacuauc

SEQ ID NO: 1358693 - RNA, 19 nt, Homo sapiens
gguuagccaucguuacauu

SEQ ID NO: 1358694 - RNA, 19 nt, Homo sapiens
gcucagggauccuuuacag

SEQ ID NO: 1358695 - RNA, 19 nt, Homo sapiens
gaccaucccugggugauca

SEQ ID NO: 1358696 - RNA, 19 nt, Homo sapiens
gagcagaagaccaccaaga

SEQ ID NO: 1358697 - RNA, 19 nt, Homo sapiens
ggugaagagucgaaaauuu

SEQ ID NO: 1358698 - RNA, 19 nt, Homo sapiens
acaggaagauucugaaagg

SEQ ID NO: 1358699 - RNA, 19 nt, Homo sapiens
ucacauaugcuuuacuuag

SEQ ID NO: 1358700 - RNA, 19 nt, Homo sapiens
cugaugggauuagguauuu

SEQ ID NO: 1358701 - RNA, 19 nt, Homo sapiens
gcugcagggucuuccauga

SEQ ID NO: 1358702 - RNA, 19 nt, Homo sapiens
cugaaaaccucuuauacua

SEQ ID NO: 1358703 - RNA, 19 nt, Homo sapiens
aggcauauguggagcaaga

SEQ ID NO: 1358704 - RNA, 19 nt, Homo sapiens
gagaagcgugcgugucuga

SEQ ID NO: 1358705 - RNA, 19 nt, Homo sapiens
ugacaucaaagcucuuauu

SEQ ID NO: 1358706 - RNA, 19 nt, Homo sapiens
gacaucaaagcucuuauug

SEQ ID NO: 1358707 - RNA, 19 nt, Homo sapiens
aguggugacuggacaauga

SEQ ID NO: 1358708 - RNA, 19 nt, Homo sapiens
gcgcugcagauaacucaua

SEQ ID NO: 1358709 - RNA, 19 nt, Homo sapiens
ggacuuuauagacaaacua

SEQ ID NO: 1358710 - RNA, 19 nt, Homo sapiens
ggccaagcauuucccacuu

SEQ ID NO: 1358711 - RNA, 19 nt, Homo sapiens
gcaagagaaacuuaaggau

SEQ ID NO: 1358712 - RNA, 19 nt, Homo sapiens
ugccagguaugacaucaaa

SEQ ID NO: 1358713 - RNA, 19 nt, Homo sapiens
ucacaaauccaggcauaug

SEQ ID NO: 1358714 - RNA, 19 nt, Homo sapiens
cuaagucacauuauucuca

SEQ ID NO: 1358715 - RNA, 19 nt, Homo sapiens
gcugaugggauuagguauu

SEQ ID NO: 1358716 - RNA, 19 nt, Homo sapiens
ccacuuggcgaaggacuuu

SEQ ID NO: 1358717 - RNA, 19 nt, Homo sapiens
ccagugcaguggacaugug

SEQ ID NO: 1358718 - RNA, 19 nt, Homo sapiens
gauaacucauaggaaucua

SEQ ID NO: 1358719 - RNA, 19 nt, Homo sapiens
gagaaacuuaaggauagua

SEQ ID NO: 1358720 - RNA, 19 nt, Homo sapiens
gacugaggaucaaguuuac

SEQ ID NO: 1358721 - RNA, 19 nt, Homo sapiens
gcaauaaaagugauggaaa

SEQ ID NO: 1358722 - RNA, 19 nt, Homo sapiens
gaaacuuaaggauaguaga

SEQ ID NO: 1358723 - RNA, 19 nt, Homo sapiens
guggagcaagagaaacuua

SEQ ID NO: 1358724 - RNA, 19 nt, Homo sapiens
gugaagagucgaaaauuuu

SEQ ID NO: 1358725 - RNA, 19 nt, Homo sapiens
uaugacaucaaagcucuua

SEQ ID NO: 1358726 - RNA, 19 nt, Homo sapiens
agucuucuaagucacauua

SEQ ID NO: 1358727 - RNA, 19 nt, Homo sapiens
gaugaugaaagccagacaa

SEQ ID NO: 1358728 - RNA, 19 nt, Homo sapiens
cagaagaccaccaagaaac

SEQ ID NO: 1358729 - RNA, 19 nt, Homo sapiens
gagacugaggaucaaguuu

SEQ ID NO: 1358730 - RNA, 19 nt, Homo sapiens
ggacaugugggcucuuggu

SEQ ID NO: 1358731 - RNA, 19 nt, Homo sapiens
guggacaugugggcucuug

SEQ ID NO: 1358732 - RNA, 19 nt, Homo sapiens
gaagauucugaaaggcaaa

SEQ ID NO: 1358733 - RNA, 19 nt, Homo sapiens
acaaggcuuuacaggaaga

SEQ ID NO: 1358734 - RNA, 19 nt, Homo sapiens
ggagcaagagaaacuuaag

SEQ ID NO: 1358735 - RNA, 19 nt, Homo sapiens
uagagaagcgugcgugucu

SEQ ID NO: 1358736 - RNA, 19 nt, Homo sapiens
cacauuauucucacaaauc

SEQ ID NO: 1358737 - RNA, 19 nt, Homo sapiens
gucacauuauucucacaaa

SEQ ID NO: 1358738 - RNA, 19 nt, Homo sapiens
gcggauuccugccuuuuga

SEQ ID NO: 1358739 - RNA, 19 nt, Homo sapiens
cacauaugcuuuacuuagc

SEQ ID NO: 1358740 - RNA, 19 nt, Homo sapiens
caauaaaagugauggaaac

SEQ ID NO: 1358741 - RNA, 19 nt, Homo sapiens
gcauauguggagcaagaga

SEQ ID NO: 1358742 - RNA, 19 nt, Homo sapiens
ccaggcauauguggagcaa

SEQ ID NO: 1358743 - RNA, 19 nt, Homo sapiens
uggcgaaggacuuuauaga

SEQ ID NO: 1358744 - RNA, 19 nt, Homo sapiens
gcaggguugucaggguaga

SEQ ID NO: 1358745 - RNA, 19 nt, Homo sapiens
uuacaggaagauucugaaa

SEQ ID NO: 1358746 - RNA, 19 nt, Homo sapiens
agagagggaagguagagaa

SEQ ID NO: 1358747 - RNA, 19 nt, Homo sapiens
auaguagaaucgccacugu

SEQ ID NO: 1358748 - RNA, 19 nt, Homo sapiens
gagcaagagaaacuuaagg

SEQ ID NO: 1358749 - RNA, 19 nt, Homo sapiens
ugcacagucuucuaaguca

SEQ ID NO: 1358750 - RNA, 19 nt, Homo sapiens
ccaagaaaccuuuugcaau

SEQ ID NO: 1358751 - RNA, 19 nt, Homo sapiens
cuucuaagucacauuauuc

SEQ ID NO: 1358752 - RNA, 19 nt, Homo sapiens
agagggccauaucccgaaa

SEQ ID NO: 1358753 - RNA, 19 nt, Homo sapiens
gauucugaaaggcaaauau

SEQ ID NO: 1358754 - RNA, 19 nt, Homo sapiens
gacaaugaagacacucugu

SEQ ID NO: 1358755 - RNA, 19 nt, Homo sapiens
agcagaagaccaccaagaa

SEQ ID NO: 1358756 - RNA, 19 nt, Homo sapiens
cacaaauccaggcauaugu

SEQ ID NO: 1358757 - RNA, 19 nt, Homo sapiens
gagagggaagguagagaag

SEQ ID NO: 1358758 - RNA, 19 nt, Homo sapiens
cugcagauaacucauagga

SEQ ID NO: 1358759 - RNA, 19 nt, Homo sapiens
uggagaucuuugagacuga

SEQ ID NO: 1358760 - RNA, 19 nt, Homo sapiens
acaaauccaggcauaugug

SEQ ID NO: 1358761 - RNA, 19 nt, Homo sapiens
auacuaucauccaggugaa

SEQ ID NO: 1358762 - RNA, 19 nt, Homo sapiens
ucaggauccuccagauggu

SEQ ID NO: 1358763 - RNA, 19 nt, Homo sapiens
caagaaggcuguccugaaa

SEQ ID NO: 1358764 - RNA, 19 nt, Homo sapiens
gaagcaacgugacugugua

SEQ ID NO: 1358765 - RNA, 19 nt, Homo sapiens
ggaagauagugcagaugaa

SEQ ID NO: 1358766 - RNA, 19 nt, Homo sapiens
gaagauagugcagaugaaa

SEQ ID NO: 1358767 - RNA, 19 nt, Homo sapiens
gaaagugagagaccaagaa

SEQ ID NO: 1358768 - RNA, 19 nt, Homo sapiens
gcaaugaggucagauacca

SEQ ID NO: 1358769 - RNA, 19 nt, Homo sapiens
cggauggacucgcuaauga

SEQ ID NO: 1358770 - RNA, 19 nt, Homo sapiens
guaaaccaaugcaaaucaa

SEQ ID NO: 1358771 - RNA, 19 nt, Homo sapiens
ggagaacuuucaagcacuu

SEQ ID NO: 1358772 - RNA, 19 nt, Homo sapiens
ugaggaagauaucaggaaa

SEQ ID NO: 1358773 - RNA, 19 nt, Homo sapiens
gcagaugaaauaaagugua

SEQ ID NO: 1358774 - RNA, 19 nt, Homo sapiens
gaagugugauggccaagag

SEQ ID NO: 1358775 - RNA, 19 nt, Homo sapiens
gggaagauagugcagauga

SEQ ID NO: 1358776 - RNA, 19 nt, Homo sapiens
gaagacagucagagagaga

SEQ ID NO: 1358777 - RNA, 19 nt, Homo sapiens
gaggucagauaccaucaau

SEQ ID NO: 1358778 - RNA, 19 nt, Homo sapiens
cagaugcgguggagauaau

SEQ ID NO: 1358779 - RNA, 19 nt, Homo sapiens
ggaagcaacgugacugugu

SEQ ID NO: 1358780 - RNA, 19 nt, Homo sapiens
ccaagaaggcuguccugaa

SEQ ID NO: 1358781 - RNA, 19 nt, Homo sapiens
uuacagcagugcaggagaa

SEQ ID NO: 1358782 - RNA, 19 nt, Homo sapiens
gaaagugaagacagucaga

SEQ ID NO: 1358783 - RNA, 19 nt, Homo sapiens
gagaauguccaguuacaca

SEQ ID NO: 1358784 - RNA, 19 nt, Homo sapiens
agauagugcagaugaaaua

SEQ ID NO: 1358785 - RNA, 19 nt, Homo sapiens
gagagagacucgcaauagc

SEQ ID NO: 1358786 - RNA, 19 nt, Homo sapiens
aacaauuucuggucacuga

SEQ ID NO: 1358787 - RNA, 19 nt, Homo sapiens
ugcagggacuccaggcuua

SEQ ID NO: 1358788 - RNA, 19 nt, Homo sapiens
aaacaggaagggaaaguga

SEQ ID NO: 1358789 - RNA, 19 nt, Homo sapiens
cagcuccucugcaaacaau

SEQ ID NO: 1358790 - RNA, 19 nt, Homo sapiens
gggaggagagcuuggagaa

SEQ ID NO: 1358791 - RNA, 19 nt, Homo sapiens
gauagugcagaugaaauaa

SEQ ID NO: 1358792 - RNA, 19 nt, Homo sapiens
cuuugagaauguccaguua

SEQ ID NO: 1358793 - RNA, 19 nt, Homo sapiens
gaaacaggaagggaaagug

SEQ ID NO: 1358794 - RNA, 19 nt, Homo sapiens
gcuccucugcaaacaauuu

SEQ ID NO: 1358795 - RNA, 19 nt, Homo sapiens
gcaggagaacuuucaagca

SEQ ID NO: 1358796 - RNA, 19 nt, Homo sapiens
uagugcagaugaaauaaag

SEQ ID NO: 1358797 - RNA, 19 nt, Homo sapiens
cagagagagacucgcaaua

SEQ ID NO: 1358798 - RNA, 19 nt, Homo sapiens
caacgugacuguguaaacc

SEQ ID NO: 1358799 - RNA, 19 nt, Homo sapiens
cuaaugaggcagagaaagu

SEQ ID NO: 1358800 - RNA, 19 nt, Homo sapiens
gugaagacagucagagaga

SEQ ID NO: 1358801 - RNA, 19 nt, Homo sapiens
aggaagauaucaggaaaca

SEQ ID NO: 1358802 - RNA, 19 nt, Homo sapiens
agagagagacucgcaauag

SEQ ID NO: 1358803 - RNA, 19 nt, Homo sapiens
ggaaacaggaagggaaagu

SEQ ID NO: 1358804 - RNA, 19 nt, Homo sapiens
gaacuuucaagcacuuugg

SEQ ID NO: 1358805 - RNA, 19 nt, Homo sapiens
caggaaacaggaagggaaa

SEQ ID NO: 1358806 - RNA, 19 nt, Homo sapiens
cagcagugcaggagaacuu

SEQ ID NO: 1358807 - RNA, 19 nt, Homo sapiens
gcggauggacucgcuaaug

SEQ ID NO: 1358808 - RNA, 19 nt, Homo sapiens
gagcaccucaaucccuuug

SEQ ID NO: 1358809 - RNA, 19 nt, Homo sapiens
gugcagaugaaauaaagug

SEQ ID NO: 1358810 - RNA, 19 nt, Homo sapiens
aagggaaagugaagacagu

SEQ ID NO: 1358811 - RNA, 19 nt, Homo sapiens
gcaacgugacuguguaaac

SEQ ID NO: 1358812 - RNA, 19 nt, Homo sapiens
caaacaauuucuggucacu

SEQ ID NO: 1358813 - RNA, 19 nt, Homo sapiens
aagggaagauagugcagau

SEQ ID NO: 1358814 - RNA, 19 nt, Homo sapiens
uugagaauguccaguuaca

SEQ ID NO: 1358815 - RNA, 19 nt, Homo sapiens
gcagagggaguggguaucu

SEQ ID NO: 1358816 - RNA, 19 nt, Homo sapiens
gaggaagcaacgugacugu

SEQ ID NO: 1358817 - RNA, 19 nt, Homo sapiens
gugacuguguaaaccaaug

SEQ ID NO: 1358818 - RNA, 19 nt, Homo sapiens
uguaaaccaaugcaaauca

SEQ ID NO: 1358819 - RNA, 19 nt, Homo sapiens
ccaguuacacauucaagag

SEQ ID NO: 1358820 - RNA, 19 nt, Homo sapiens
gggaaagugaagacaguca

SEQ ID NO: 1358821 - RNA, 19 nt, Homo sapiens
ucagaugcgguggagauaa

SEQ ID NO: 1358822 - RNA, 19 nt, Homo sapiens
aagcaacgugacuguguaa

SEQ ID NO: 1358823 - RNA, 19 nt, Homo sapiens
ucagagagagacucgcaau

SEQ ID NO: 1358824 - RNA, 19 nt, Homo sapiens
aaaccaaugcaaaucaaag

SEQ ID NO: 1358825 - RNA, 19 nt, Homo sapiens
ggaagggaaagugaagaca

SEQ ID NO: 1358826 - RNA, 19 nt, Homo sapiens
ccaccuugccugcucuuca

SEQ ID NO: 1358827 - RNA, 19 nt, Homo sapiens
uguguaaaccaaugcaaau

SEQ ID NO: 1358828 - RNA, 19 nt, Homo sapiens
aggccaguaacgagaauua

SEQ ID NO: 1358829 - RNA, 19 nt, Homo sapiens
uaaugaggcagagaaagug

SEQ ID NO: 1358830 - RNA, 19 nt, Homo sapiens
ggaaucaucccaauuauaa

SEQ ID NO: 1358831 - RNA, 19 nt, Homo sapiens
agacuaagauccugaaguu

SEQ ID NO: 1358832 - RNA, 19 nt, Homo sapiens
gagagucugugucuuuauu

SEQ ID NO: 1358833 - RNA, 19 nt, Homo sapiens
agucauagaugucuucaaa

SEQ ID NO: 1358834 - RNA, 19 nt, Homo sapiens
ggaaugugauggagacguu

SEQ ID NO: 1358835 - RNA, 19 nt, Homo sapiens
caaauaacccucuuaaguc

SEQ ID NO: 1358836 - RNA, 19 nt, Homo sapiens
cuaagauccugaaguuaaa

SEQ ID NO: 1358837 - RNA, 19 nt, Homo sapiens
ggagacagcccuugagauc

SEQ ID NO: 1358838 - RNA, 19 nt, Homo sapiens
acaaauaacccucuuaagu

SEQ ID NO: 1358839 - RNA, 19 nt, Homo sapiens
gaauauuccugcaacacau

SEQ ID NO: 1358840 - RNA, 19 nt, Homo sapiens
ucaaaucccuguuccuauc

SEQ ID NO: 1358841 - RNA, 19 nt, Homo sapiens
ucauagaugucuucaaauc

SEQ ID NO: 1358842 - RNA, 19 nt, Homo sapiens
aagauguccugaagucaua

SEQ ID NO: 1358843 - RNA, 19 nt, Homo sapiens
caauagugcuggcuaccuu

SEQ ID NO: 1358844 - RNA, 19 nt, Homo sapiens
guacuuacuccuccauauu

SEQ ID NO: 1358845 - RNA, 19 nt, Homo sapiens
aacacgagcuauugcauaa

SEQ ID NO: 1358846 - RNA, 19 nt, Homo sapiens
uaacacgagcuauugcaua

SEQ ID NO: 1358847 - RNA, 19 nt, Homo sapiens
ccaaaugggugaccaagac

SEQ ID NO: 1358848 - RNA, 19 nt, Homo sapiens
guaauucgaggacuaguug

SEQ ID NO: 1358849 - RNA, 19 nt, Homo sapiens
gaagacauuguaaagcauu

SEQ ID NO: 1358850 - RNA, 19 nt, Homo sapiens
gcaacacauuuaaaggaau

SEQ ID NO: 1358851 - RNA, 19 nt, Homo sapiens
acuaagauccugaaguuaa

SEQ ID NO: 1358852 - RNA, 19 nt, Homo sapiens
gaagauguccugaagucau

SEQ ID NO: 1358853 - RNA, 19 nt, Homo sapiens
gagcagaauggagagaaua

SEQ ID NO: 1358854 - RNA, 19 nt, Homo sapiens
ggagcagaauggagagaau

SEQ ID NO: 1358855 - RNA, 19 nt, Homo sapiens
aaauaacccucuuaagucu

SEQ ID NO: 1358856 - RNA, 19 nt, Homo sapiens
ccaauuauaacacgagcua

SEQ ID NO: 1358857 - RNA, 19 nt, Homo sapiens
gaagugaggagaggcaguu

SEQ ID NO: 1358858 - RNA, 19 nt, Homo sapiens
gagucugugucuuuauuug

SEQ ID NO: 1358859 - RNA, 19 nt, Homo sapiens
cugagagucugugucuuua

SEQ ID NO: 1358860 - RNA, 19 nt, Homo sapiens
uaaauacccaggucucaug

SEQ ID NO: 1358861 - RNA, 19 nt, Homo sapiens
guccugaagucauagaugu

SEQ ID NO: 1358862 - RNA, 19 nt, Homo sapiens
ggaauuguguucuuuugga

SEQ ID NO: 1358863 - RNA, 19 nt, Homo sapiens
ugcaacacauuuaaaggaa

SEQ ID NO: 1358864 - RNA, 19 nt, Homo sapiens
gcagaauggagagaauaaa

SEQ ID NO: 1358865 - RNA, 19 nt, Homo sapiens
ucugagagucugugucuuu

SEQ ID NO: 1358866 - RNA, 19 nt, Homo sapiens
auaacccucuuaagucuga

SEQ ID NO: 1358867 - RNA, 19 nt, Homo sapiens
gcaugaaaauucccaagga

SEQ ID NO: 1358868 - RNA, 19 nt, Homo sapiens
uggaaucaucccaauuaua

SEQ ID NO: 1358869 - RNA, 19 nt, Homo sapiens
gucugugucuuuauuugaa

SEQ ID NO: 1358870 - RNA, 19 nt, Homo sapiens
cguacuuacuccuccauau

SEQ ID NO: 1358871 - RNA, 19 nt, Homo sapiens
augaagacauuguaaagca

SEQ ID NO: 1358872 - RNA, 19 nt, Homo sapiens
gaggcaguuuggagcagaa

SEQ ID NO: 1358873 - RNA, 19 nt, Homo sapiens
uuacuccuccauauucuuu

SEQ ID NO: 1358874 - RNA, 19 nt, Homo sapiens
ugaagacauuguaaagcau

SEQ ID NO: 1358875 - RNA, 19 nt, Homo sapiens
ccaagaggaaugugaugga

SEQ ID NO: 1358876 - RNA, 19 nt, Homo sapiens
gaggacuaguugggagauu

SEQ ID NO: 1358877 - RNA, 19 nt, Homo sapiens
ucaaauugcguacuuacuc

SEQ ID NO: 1358878 - RNA, 19 nt, Homo sapiens
cuucaaaucccuguuccua

SEQ ID NO: 1358879 - RNA, 19 nt, Homo sapiens
gaauuguguucuuuuggaa

SEQ ID NO: 1358880 - RNA, 19 nt, Homo sapiens
gacauuguaaagcauuuga

SEQ ID NO: 1358881 - RNA, 19 nt, Homo sapiens
gacuaagauccugaaguua

SEQ ID NO: 1358882 - RNA, 19 nt, Homo sapiens
gaauggagagaauaaaaug

SEQ ID NO: 1358883 - RNA, 19 nt, Homo sapiens
ucuggaguuucuuagguuu

SEQ ID NO: 1358884 - RNA, 19 nt, Homo sapiens
uacccuaugcugagacuaa

SEQ ID NO: 1358885 - RNA, 19 nt, Homo sapiens
gcaguuuggagcagaaugg

SEQ ID NO: 1358886 - RNA, 19 nt, Homo sapiens
agacagcccuugagauccu

SEQ ID NO: 1358887 - RNA, 19 nt, Homo sapiens
ucaugaagacauuguaaag

SEQ ID NO: 1358888 - RNA, 19 nt, Homo sapiens
gagacuaagauccugaagu

SEQ ID NO: 1358889 - RNA, 19 nt, Homo sapiens
cugcaacacauuuaaagga

SEQ ID NO: 1358890 - RNA, 19 nt, Homo sapiens
ucucaugaagacauuguaa

SEQ ID NO: 1358891 - RNA, 19 nt, Homo sapiens
ggaagauguccugaaguca

SEQ ID NO: 1358892 - RNA, 19 nt, Homo sapiens
ucuucaaauugcguacuua

SEQ ID NO: 1358893 - RNA, 19 nt, Homo sapiens
ggacuaguugggagauucu

SEQ ID NO: 1358894 - RNA, 19 nt, Homo sapiens
gaaugugauggagacguuu

SEQ ID NO: 1358895 - RNA, 19 nt, Homo sapiens
auacccaggucucaugaag

SEQ ID NO: 1358896 - RNA, 19 nt, Homo sapiens
ggcuggacccucaauagug

SEQ ID NO: 1358897 - RNA, 19 nt, Homo sapiens
gaaagucacugaguaaauu

SEQ ID NO: 1358898 - RNA, 19 nt, Homo sapiens
gaaagucacuggaugaaca

SEQ ID NO: 1358899 - RNA, 19 nt, Homo sapiens
gaaagauaauguacaguga

SEQ ID NO: 1358900 - RNA, 19 nt, Homo sapiens
gagaaggaaucgaagaauu

SEQ ID NO: 1358901 - RNA, 19 nt, Homo sapiens
agaaagaacuagacaacua

SEQ ID NO: 1358902 - RNA, 19 nt, Homo sapiens
caagauaaguuccaugaau

SEQ ID NO: 1358903 - RNA, 19 nt, Homo sapiens
uaggagaacucaauaaaga

SEQ ID NO: 1358904 - RNA, 19 nt, Homo sapiens
caaaagaguuggaauugua

SEQ ID NO: 1358905 - RNA, 19 nt, Homo sapiens
gagaauagaauggugguua

SEQ ID NO: 1358906 - RNA, 19 nt, Homo sapiens
gaaaccauaauacugcuua

SEQ ID NO: 1358907 - RNA, 19 nt, Homo sapiens
gauuucagcuuucuucuca

SEQ ID NO: 1358908 - RNA, 19 nt, Homo sapiens
aagaggaacuucagacaaa

SEQ ID NO: 1358909 - RNA, 19 nt, Homo sapiens
uagcugaucuuccggguuu

SEQ ID NO: 1358910 - RNA, 19 nt, Homo sapiens
guacggaaauuucaucgau

SEQ ID NO: 1358911 - RNA, 19 nt, Homo sapiens
agaaggaaucgaagaauua

SEQ ID NO: 1358912 - RNA, 19 nt, Homo sapiens
gcacguuaauuagcuauau

SEQ ID NO: 1358913 - RNA, 19 nt, Homo sapiens
ggaacaguauuuaaugcuu

SEQ ID NO: 1358914 - RNA, 19 nt, Homo sapiens
gaaggaaucgaagaauuaa

SEQ ID NO: 1358915 - RNA, 19 nt, Homo sapiens
acaaauuccucaagcauau

SEQ ID NO: 1358916 - RNA, 19 nt, Homo sapiens
gagcacauaugaacaaagg

SEQ ID NO: 1358917 - RNA, 19 nt, Homo sapiens
gaacuuggaaagauaaugu

SEQ ID NO: 1358918 - RNA, 19 nt, Homo sapiens
ggaaaauccucuuugcuaa

SEQ ID NO: 1358919 - RNA, 19 nt, Homo sapiens
gaaaggccagaaacgaaua

SEQ ID NO: 1358920 - RNA, 19 nt, Homo sapiens
gaagaaccauaccuuuuaa

SEQ ID NO: 1358921 - RNA, 19 nt, Homo sapiens
uggaggacauguuaaguaa

SEQ ID NO: 1358922 - RNA, 19 nt, Homo sapiens
ccauaauacugcuuacaaa

SEQ ID NO: 1358923 - RNA, 19 nt, Homo sapiens
ggaauggguuauccucguu

SEQ ID NO: 1358924 - RNA, 19 nt, Homo sapiens
ugacagagcuagacuccau

SEQ ID NO: 1358925 - RNA, 19 nt, Homo sapiens
caaccuggaggacauguua

SEQ ID NO: 1358926 - RNA, 19 nt, Homo sapiens
gauacaaugucuucuacug

SEQ ID NO: 1358927 - RNA, 19 nt, Homo sapiens
ggagaacucaauaaagaaa

SEQ ID NO: 1358928 - RNA, 19 nt, Homo sapiens
gaacaggccaaccaggaaa

SEQ ID NO: 1358929 - RNA, 19 nt, Homo sapiens
uaaguuccaugaauugaug

SEQ ID NO: 1358930 - RNA, 19 nt, Homo sapiens
gcacauaugaacaaaggaa

SEQ ID NO: 1358931 - RNA, 19 nt, Homo sapiens
gacaaaaccugcacucuug

SEQ ID NO: 1358932 - RNA, 19 nt, Homo sapiens
gcauugcaguugcguguug

SEQ ID NO: 1358933 - RNA, 19 nt, Homo sapiens
gaaauuucaucgauaagcu

SEQ ID NO: 1358934 - RNA, 19 nt, Homo sapiens
cagaacagaaugacuuuaa

SEQ ID NO: 1358935 - RNA, 19 nt, Homo sapiens
cugaaaggcuccaaaggaa

SEQ ID NO: 1358936 - RNA, 19 nt, Homo sapiens
cuaguaggauucccaaaug

SEQ ID NO: 1358937 - RNA, 19 nt, Homo sapiens
gaggagggcagaucacuug

SEQ ID NO: 1358938 - RNA, 19 nt, Homo sapiens
agagaggacuguagaguuc

SEQ ID NO: 1358939 - RNA, 19 nt, Homo sapiens
guacagugauuucaaacag

SEQ ID NO: 1358940 - RNA, 19 nt, Homo sapiens
uguggaaucuuaaguugaa

SEQ ID NO: 1358941 - RNA, 19 nt, Homo sapiens
gaggacauguuaaguaaaa

SEQ ID NO: 1358942 - RNA, 19 nt, Homo sapiens
cuacugagccaccaucaaa

SEQ ID NO: 1358943 - RNA, 19 nt, Homo sapiens
uaagaaagucacuggauga

SEQ ID NO: 1358944 - RNA, 19 nt, Homo sapiens
ggagcaaacagcaaaauua

SEQ ID NO: 1358945 - RNA, 19 nt, Homo sapiens
agacagguauccucggaaa

SEQ ID NO: 1358946 - RNA, 19 nt, Homo sapiens
gauggaacaguauuuaaug

SEQ ID NO: 1358947 - RNA, 19 nt, Homo sapiens
cauaagguaaugcacguua

SEQ ID NO: 1358948 - RNA, 19 nt, Homo sapiens
ggaauuguacaaagaggaa

SEQ ID NO: 1358949 - RNA, 19 nt, Homo sapiens
ccucaagcauauagaaaga

SEQ ID NO: 1358950 - RNA, 19 nt, Homo sapiens
gcagauuacgcauuuacaa

SEQ ID NO: 1358951 - RNA, 19 nt, Homo sapiens
acggaaauuucaucgauaa

SEQ ID NO: 1358952 - RNA, 19 nt, Homo sapiens
agaauagaauggugguuau

SEQ ID NO: 1358953 - RNA, 19 nt, Homo sapiens
gaaacaguugcuuaauuug

SEQ ID NO: 1358954 - RNA, 19 nt, Homo sapiens
gaaagaacuagacaacuac

SEQ ID NO: 1358955 - RNA, 19 nt, Homo sapiens
gauaauguacagugauuuc

SEQ ID NO: 1358956 - RNA, 19 nt, Homo sapiens
guggauuucugauacaaug

SEQ ID NO: 1358957 - RNA, 19 nt, Homo sapiens
gcaggagaauugcuugaac

SEQ ID NO: 1358958 - RNA, 19 nt, Homo sapiens
gggaggauccgguggaaug

SEQ ID NO: 1358959 - RNA, 19 nt, Homo sapiens
gccugaacuuggaaagaua

SEQ ID NO: 1358960 - RNA, 19 nt, Homo sapiens
aauugcagauuacgcauuu

SEQ ID NO: 1358961 - RNA, 19 nt, Homo sapiens
caaaauuagugcacugaaa

SEQ ID NO: 1358962 - RNA, 19 nt, Homo sapiens
ucagaaaguacggaaauuu

SEQ ID NO: 1358963 - RNA, 19 nt, Homo sapiens
agaacuagacaacuacuuu

SEQ ID NO: 1358964 - RNA, 19 nt, Homo sapiens
gcauauagaaagaacuaga

SEQ ID NO: 1358965 - RNA, 19 nt, Homo sapiens
caaaggaaugggccacaaa

SEQ ID NO: 1358966 - RNA, 19 nt, Homo sapiens
ugaagaaccauaccuuuua

SEQ ID NO: 1358967 - RNA, 19 nt, Homo sapiens
ggugaugucuggguuguag

SEQ ID NO: 1358968 - RNA, 19 nt, Homo sapiens
gaaaccccgucucuacuaa

SEQ ID NO: 1358969 - RNA, 19 nt, Homo sapiens
ggagguggaggauacaaug

SEQ ID NO: 1358970 - RNA, 19 nt, Homo sapiens
caucaaagcaugcuguuac

SEQ ID NO: 1358971 - RNA, 19 nt, Homo sapiens
uacggaaauuucaucgaua

SEQ ID NO: 1358972 - RNA, 19 nt, Homo sapiens
gcuccagaauccuaaagau

SEQ ID NO: 1358973 - RNA, 19 nt, Homo sapiens
guuuguggcuggaguagga

SEQ ID NO: 1358974 - RNA, 19 nt, Homo sapiens
guagaguuccaacauauca

SEQ ID NO: 1358975 - RNA, 19 nt, Homo sapiens
gauaaguuccaugaauuga

SEQ ID NO: 1358976 - RNA, 19 nt, Homo sapiens
cacaaauuccucaagcaua

SEQ ID NO: 1358977 - RNA, 19 nt, Homo sapiens
gaaaggcuccaaaggaaaa

SEQ ID NO: 1358978 - RNA, 19 nt, Homo sapiens
gcacugaaaggcuccaaag

SEQ ID NO: 1358979 - RNA, 19 nt, Homo sapiens
gaggagauauuggucaaaa

SEQ ID NO: 1358980 - RNA, 19 nt, Homo sapiens
ggaaucgaagaauuaaaga

SEQ ID NO: 1358981 - RNA, 19 nt, Homo sapiens
acuguagaguuccaacaua

SEQ ID NO: 1358982 - RNA, 19 nt, Homo sapiens
caaagaggaacuucagaca

SEQ ID NO: 1358983 - RNA, 19 nt, Homo sapiens
gaucuuccggguuuaauag

SEQ ID NO: 1358984 - RNA, 19 nt, Homo sapiens
uuagcuauauugagccauu

SEQ ID NO: 1358985 - RNA, 19 nt, Homo sapiens
guacaaagaggaacuucag

SEQ ID NO: 1358986 - RNA, 19 nt, Homo sapiens
gaguuggaauuguacaaag

SEQ ID NO: 1358987 - RNA, 19 nt, Homo sapiens
gauuacgcauuuacaacau

SEQ ID NO: 1358988 - RNA, 19 nt, Homo sapiens
guucaagagaucuguugua

SEQ ID NO: 1358989 - RNA, 19 nt, Homo sapiens
caaagcaugcuguuacuac

SEQ ID NO: 1358990 - RNA, 19 nt, Homo sapiens
ugaugcacuucauaagaaa

SEQ ID NO: 1358991 - RNA, 19 nt, Homo sapiens
aaggaggucuuggugguaa

SEQ ID NO: 1358992 - RNA, 19 nt, Homo sapiens
ugaaagucacugaguaaau

SEQ ID NO: 1358993 - RNA, 19 nt, Homo sapiens
ggagaaggaaucgaagaau

SEQ ID NO: 1358994 - RNA, 19 nt, Homo sapiens
guugauauuucuggauuuc

SEQ ID NO: 1358995 - RNA, 19 nt, Homo sapiens
gaacuagacaacuacuuuu

SEQ ID NO: 1358996 - RNA, 19 nt, Homo sapiens
caaauuccucaagcauaua

SEQ ID NO: 1358997 - RNA, 19 nt, Homo sapiens
caacagagacuaacauuua

SEQ ID NO: 1358998 - RNA, 19 nt, Homo sapiens
caacugaucugccauuaaa

SEQ ID NO: 1358999 - RNA, 19 nt, Homo sapiens
gaacuugcauagugauuaa

SEQ ID NO: 1359000 - RNA, 19 nt, Homo sapiens
gagaagaauugguguuaaa

SEQ ID NO: 1359001 - RNA, 19 nt, Homo sapiens
gauagaaucgucugucuua

SEQ ID NO: 1359002 - RNA, 19 nt, Homo sapiens
gaauggaacuugcauagug

SEQ ID NO: 1359003 - RNA, 19 nt, Homo sapiens
ggacaaauaucacccuaau

SEQ ID NO: 1359004 - RNA, 19 nt, Homo sapiens
caucaccacuggacaaaua

SEQ ID NO: 1359005 - RNA, 19 nt, Homo sapiens
caucauaucucccuuacaa

SEQ ID NO: 1359006 - RNA, 19 nt, Homo sapiens
caacgaagauuucaacaag

SEQ ID NO: 1359007 - RNA, 19 nt, Homo sapiens
gcucaaccuuuauggauuu

SEQ ID NO: 1359008 - RNA, 19 nt, Homo sapiens
uaaaucaguugaccacuau

SEQ ID NO: 1359009 - RNA, 19 nt, Homo sapiens
gggcuaacauggagaauca

SEQ ID NO: 1359010 - RNA, 19 nt, Homo sapiens
gcauagugauuaaugaaga

SEQ ID NO: 1359011 - RNA, 19 nt, Homo sapiens
gauuaugaaugacaacaga

SEQ ID NO: 1359012 - RNA, 19 nt, Homo sapiens
cagaacaaauugcaacaga

SEQ ID NO: 1359013 - RNA, 19 nt, Homo sapiens
gaacaugcuuuucagguuu

SEQ ID NO: 1359014 - RNA, 19 nt, Homo sapiens
gagacuaacauuuacauug

SEQ ID NO: 1359015 - RNA, 19 nt, Homo sapiens
gaacaaauugcaacagauc

SEQ ID NO: 1359016 - RNA, 19 nt, Homo sapiens
uuaaaucaguugaccacua

SEQ ID NO: 1359017 - RNA, 19 nt, Homo sapiens
caaccacaacuucucaaua

SEQ ID NO: 1359018 - RNA, 19 nt, Homo sapiens
caacagaucaacaugcuau

SEQ ID NO: 1359019 - RNA, 19 nt, Homo sapiens
ucagacagauaauugcaaa

SEQ ID NO: 1359020 - RNA, 19 nt, Homo sapiens
ggaacuugcauagugauua

SEQ ID NO: 1359021 - RNA, 19 nt, Homo sapiens
aaagaggaccagauuauga

SEQ ID NO: 1359022 - RNA, 19 nt, Homo sapiens
gaaugacaacagagacuaa

SEQ ID NO: 1359023 - RNA, 19 nt, Homo sapiens
gagauagaaucgucugucu

SEQ ID NO: 1359024 - RNA, 19 nt, Homo sapiens
ggaaaauaguggaaaguga

SEQ ID NO: 1359025 - RNA, 19 nt, Homo sapiens
cacacgauauccuuuggua

SEQ ID NO: 1359026 - RNA, 19 nt, Homo sapiens
ggaagaguagauaaagaaa

SEQ ID NO: 1359027 - RNA, 19 nt, Homo sapiens
acgaagauuucaacaagaa

SEQ ID NO: 1359028 - RNA, 19 nt, Homo sapiens
gaagagaagaauugguguu

SEQ ID NO: 1359029 - RNA, 19 nt, Homo sapiens
uucgacagcucaaccuuua

SEQ ID NO: 1359030 - RNA, 19 nt, Homo sapiens
gagaauggaacuugcauag

SEQ ID NO: 1359031 - RNA, 19 nt, Homo sapiens
ggaaagugaccaauucagu

SEQ ID NO: 1359032 - RNA, 19 nt, Homo sapiens
ccacaucauaucucccuua

SEQ ID NO: 1359033 - RNA, 19 nt, Homo sapiens
gauggcacauguuucuuca

SEQ ID NO: 1359034 - RNA, 19 nt, Homo sapiens
gcuaacauggagaaucaua

SEQ ID NO: 1359035 - RNA, 19 nt, Homo sapiens
ucagaagccuccacuaggu

SEQ ID NO: 1359036 - RNA, 19 nt, Homo sapiens
acaagggaaucuucuguca

SEQ ID NO: 1359037 - RNA, 19 nt, Homo sapiens
uaaauaugccucuaacaag

SEQ ID NO: 1359038 - RNA, 19 nt, Homo sapiens
agagaagaauugguguuaa

SEQ ID NO: 1359039 - RNA, 19 nt, Homo sapiens
gggaagagaauggaacuug

SEQ ID NO: 1359040 - RNA, 19 nt, Homo sapiens
aggaccagauuaugaauga

SEQ ID NO: 1359041 - RNA, 19 nt, Homo sapiens
aaccacaacuucucaauac

SEQ ID NO: 1359042 - RNA, 19 nt, Homo sapiens
caguugaccacuauucaua

SEQ ID NO: 1359043 - RNA, 19 nt, Homo sapiens
gacaacagagacuaacauu

SEQ ID NO: 1359044 - RNA, 19 nt, Homo sapiens
uggcacauguuucuucaga

SEQ ID NO: 1359045 - RNA, 19 nt, Homo sapiens
aagagaagaauugguguua

SEQ ID NO: 1359046 - RNA, 19 nt, Homo sapiens
uauuugagauggcacaugu

SEQ ID NO: 1359047 - RNA, 19 nt, Homo sapiens
caaugaggcuccauaucgu

SEQ ID NO: 1359048 - RNA, 19 nt, Homo sapiens
gaagagaauggaacuugca

SEQ ID NO: 1359049 - RNA, 19 nt, Homo sapiens
cggaagaguagauaaagaa

SEQ ID NO: 1359050 - RNA, 19 nt, Homo sapiens
guuagaaaguccaaguuac

SEQ ID NO: 1359051 - RNA, 19 nt, Homo sapiens
uacaacugaucugccauua

SEQ ID NO: 1359052 - RNA, 19 nt, Homo sapiens
caggcuagcucuucaacca

SEQ ID NO: 1359053 - RNA, 19 nt, Homo sapiens
caaccuuuauggauuuagu

SEQ ID NO: 1359054 - RNA, 19 nt, Homo sapiens
aauggaacuugcauaguga

SEQ ID NO: 1359055 - RNA, 19 nt, Homo sapiens
uaacaagggaaucuucugu

SEQ ID NO: 1359056 - RNA, 19 nt, Homo sapiens
uucagaaacucaagauguu

SEQ ID NO: 1359057 - RNA, 19 nt, Homo sapiens
guugaccacuauucauaug

SEQ ID NO: 1359058 - RNA, 19 nt, Homo sapiens
ccggaagaguagauaaaga

SEQ ID NO: 1359059 - RNA, 19 nt, Homo sapiens
agacuuacggucaaugauu

SEQ ID NO: 1359060 - RNA, 19 nt, Homo sapiens
uaaaagaggaccagauuau

SEQ ID NO: 1359061 - RNA, 19 nt, Homo sapiens
ucaaugaggcuccauaucg

SEQ ID NO: 1359062 - RNA, 19 nt, Homo sapiens
cuucaccuauaucuacuuu

SEQ ID NO: 1359063 - RNA, 19 nt, Homo sapiens
uguuagaaaguccaaguua

SEQ ID NO: 1359064 - RNA, 19 nt, Homo sapiens
agagugaagagaagaauug

SEQ ID NO: 1359065 - RNA, 19 nt, Homo sapiens
cgacagcucaaccuuuaug

SEQ ID NO: 1359066 - RNA, 19 nt, Homo sapiens
aguggaaagugaccaauuc

SEQ ID NO: 1359067 - RNA, 19 nt, Homo sapiens
guaagagugaagagaagaa

SEQ ID NO: 1359068 - RNA, 19 nt, Homo sapiens
caggaaacuuuggaaaaua

SEQ ID NO: 1359069 - RNA, 19 nt, Homo sapiens
caugcaggccggaagagua

SEQ ID NO: 1359070 - RNA, 19 nt, Homo sapiens
cuacuuuauucaacgaaga

SEQ ID NO: 1359071 - RNA, 19 nt, Homo sapiens
cacuaggucuccauugugu

SEQ ID NO: 1359072 - RNA, 19 nt, Homo sapiens
agugaccaauucagucuuu

SEQ ID NO: 1359073 - RNA, 19 nt, Homo sapiens
aguccaaguuacacaguuu

SEQ ID NO: 1359074 - RNA, 19 nt, Homo sapiens
agaacaaauugcaacagau

SEQ ID NO: 1359075 - RNA, 19 nt, Homo sapiens
ugcugaagcuagugaagaa

SEQ ID NO: 1359076 - RNA, 19 nt, Homo sapiens
aaucgucugucuuaagcaa

SEQ ID NO: 1359077 - RNA, 19 nt, Homo sapiens
ccaggaaacuuuggaaaau

SEQ ID NO: 1359078 - RNA, 19 nt, Homo sapiens
aagaggaccagauuaugaa

SEQ ID NO: 1359079 - RNA, 19 nt, Homo sapiens
cuauucauaugcacucuca

SEQ ID NO: 1359080 - RNA, 19 nt, Homo sapiens
gaagcuagugaagaaaguu

SEQ ID NO: 1359081 - RNA, 19 nt, Homo sapiens
uuaguaagagugaagagaa

SEQ ID NO: 1359082 - RNA, 19 nt, Homo sapiens
ggccggaagaguagauaaa

SEQ ID NO: 1359083 - RNA, 19 nt, Homo sapiens
ucacccuaauuacaacuga

SEQ ID NO: 1359084 - RNA, 19 nt, Homo sapiens
caaauaucacccuaauuac

SEQ ID NO: 1359085 - RNA, 19 nt, Homo sapiens
gaggcuccauaucguaaca

SEQ ID NO: 1359086 - RNA, 19 nt, Homo sapiens
ugagauggcacauguuucu

SEQ ID NO: 1359087 - RNA, 19 nt, Homo sapiens
cagcucaaccuuuauggau

SEQ ID NO: 1359088 - RNA, 19 nt, Homo sapiens
gaccagauuaugaaugaca

SEQ ID NO: 1359089 - RNA, 19 nt, Homo sapiens
gacaaauaucacccuaauu

SEQ ID NO: 1359090 - RNA, 19 nt, Homo sapiens
ugaccacuauucauaugca

SEQ ID NO: 1359091 - RNA, 19 nt, Homo sapiens
gcaacagaucaacaugcua

SEQ ID NO: 1359092 - RNA, 19 nt, Homo sapiens
guuggaccaucagaacaaa

SEQ ID NO: 1359093 - RNA, 19 nt, Homo sapiens
ucaacgaagauuucaacaa

SEQ ID NO: 1359094 - RNA, 19 nt, Homo sapiens
agaaucgucugucuuaagc

SEQ ID NO: 1359095 - RNA, 19 nt, Homo sapiens
ccagauaaagaugaugauu

SEQ ID NO: 1359096 - RNA, 19 nt, Homo sapiens
guucgacagcucaaccuuu

SEQ ID NO: 1359097 - RNA, 19 nt, Homo sapiens
gaacuugcauagugauuaa

SEQ ID NO: 1359098 - RNA, 19 nt, Homo sapiens
gcaauacaguuguuaaaga

SEQ ID NO: 1359099 - RNA, 19 nt, Homo sapiens
gaauggaacuugcauagug

SEQ ID NO: 1359100 - RNA, 19 nt, Homo sapiens
gcucaaccuuuauggauuu

SEQ ID NO: 1359101 - RNA, 19 nt, Homo sapiens
gcauagugauuaaugaaga

SEQ ID NO: 1359102 - RNA, 19 nt, Homo sapiens
gggaaagacuagauuggaa

SEQ ID NO: 1359103 - RNA, 19 nt, Homo sapiens
gaaguaggcaauacaguug

SEQ ID NO: 1359104 - RNA, 19 nt, Homo sapiens
gaacaugcuuuucagguuu

SEQ ID NO: 1359105 - RNA, 19 nt, Homo sapiens
agacuagauuggaagaaua

SEQ ID NO: 1359106 - RNA, 19 nt, Homo sapiens
gagaaagaaucgucugucu

SEQ ID NO: 1359107 - RNA, 19 nt, Homo sapiens
caagauacgcuucaccaaa

SEQ ID NO: 1359108 - RNA, 19 nt, Homo sapiens
ggaacuugcauagugauua

SEQ ID NO: 1359109 - RNA, 19 nt, Homo sapiens
gaaagugaccaauucaagu

SEQ ID NO: 1359110 - RNA, 19 nt, Homo sapiens
ccaccacaaugagguauuu

SEQ ID NO: 1359111 - RNA, 19 nt, Homo sapiens
ggaaaauaguggaaaguga

SEQ ID NO: 1359112 - RNA, 19 nt, Homo sapiens
uucgacagcucaaccuuua

SEQ ID NO: 1359113 - RNA, 19 nt, Homo sapiens
gagaauggaacuugcauag

SEQ ID NO: 1359114 - RNA, 19 nt, Homo sapiens
ggaaagugaccaauucaag

SEQ ID NO: 1359115 - RNA, 19 nt, Homo sapiens
ggaagaguagauaaagaaa

SEQ ID NO: 1359116 - RNA, 19 nt, Homo sapiens
gaaagacuagauuggaaga

SEQ ID NO: 1359117 - RNA, 19 nt, Homo sapiens
uauguuaugcugugaagua

SEQ ID NO: 1359118 - RNA, 19 nt, Homo sapiens
gaccaauucaagucuauuu

SEQ ID NO: 1359119 - RNA, 19 nt, Homo sapiens
gauggcacauguuucuuca

SEQ ID NO: 1359120 - RNA, 19 nt, Homo sapiens
ucagaagccuccacuaggu

SEQ ID NO: 1359121 - RNA, 19 nt, Homo sapiens
gcaauugacaccuguuuac

SEQ ID NO: 1359122 - RNA, 19 nt, Homo sapiens
ugaaguaggcaauacaguu

SEQ ID NO: 1359123 - RNA, 19 nt, Homo sapiens
ucaagaaaaugcucugaaa

SEQ ID NO: 1359124 - RNA, 19 nt, Homo sapiens
acaccuguuuacucaguua

SEQ ID NO: 1359125 - RNA, 19 nt, Homo sapiens
gacuagauuggaagaauaa

SEQ ID NO: 1359126 - RNA, 19 nt, Homo sapiens
uuccagaucuucaacuuau

SEQ ID NO: 1359127 - RNA, 19 nt, Homo sapiens
uggcacauguuucuucaga

SEQ ID NO: 1359128 - RNA, 19 nt, Homo sapiens
uauuugagauggcacaugu

SEQ ID NO: 1359129 - RNA, 19 nt, Homo sapiens
cggaagaguagauaaagaa

SEQ ID NO: 1359130 - RNA, 19 nt, Homo sapiens
guuagaaaguccaaguuac

SEQ ID NO: 1359131 - RNA, 19 nt, Homo sapiens
ugacaccuguuuacucagu

SEQ ID NO: 1359132 - RNA, 19 nt, Homo sapiens
aaagaugagucgaauuacu

SEQ ID NO: 1359133 - RNA, 19 nt, Homo sapiens
caaccuuuauggauuuagu

SEQ ID NO: 1359134 - RNA, 19 nt, Homo sapiens
aauggaacuugcauaguga

SEQ ID NO: 1359135 - RNA, 19 nt, Homo sapiens
ggcaaaaguccuucuguua

SEQ ID NO: 1359136 - RNA, 19 nt, Homo sapiens
uucagaaacucaagauguu

SEQ ID NO: 1359137 - RNA, 19 nt, Homo sapiens
ccggaagaguagauaaaga

SEQ ID NO: 1359138 - RNA, 19 nt, Homo sapiens
ccagaucuucaacuuauga

SEQ ID NO: 1359139 - RNA, 19 nt, Homo sapiens
agacuuacggucaaugauu

SEQ ID NO: 1359140 - RNA, 19 nt, Homo sapiens
gcaagauacgcuucaccaa

SEQ ID NO: 1359141 - RNA, 19 nt, Homo sapiens
gggaugagaauggaacuug

SEQ ID NO: 1359142 - RNA, 19 nt, Homo sapiens
uguuagaaaguccaaguua

SEQ ID NO: 1359143 - RNA, 19 nt, Homo sapiens
guccuucuguuacucaaga

SEQ ID NO: 1359144 - RNA, 19 nt, Homo sapiens
aagauacgcuucaccaaaa

SEQ ID NO: 1359145 - RNA, 19 nt, Homo sapiens
cgacagcucaaccuuuaug

SEQ ID NO: 1359146 - RNA, 19 nt, Homo sapiens
ccaauucaagucuauuuca

SEQ ID NO: 1359147 - RNA, 19 nt, Homo sapiens
aguggaaagugaccaauuc

SEQ ID NO: 1359148 - RNA, 19 nt, Homo sapiens
caggaaacuuuggaaaaua

SEQ ID NO: 1359149 - RNA, 19 nt, Homo sapiens
caugcaggccggaagagua

SEQ ID NO: 1359150 - RNA, 19 nt, Homo sapiens
cauaauccuuagaaguuag

SEQ ID NO: 1359151 - RNA, 19 nt, Homo sapiens
cucauaauccuuagaaguu

SEQ ID NO: 1359152 - RNA, 19 nt, Homo sapiens
cacuaggucuccauugugu

SEQ ID NO: 1359153 - RNA, 19 nt, Homo sapiens
aguccaaguuacacaguuu

SEQ ID NO: 1359154 - RNA, 19 nt, Homo sapiens
aagacuagauuggaagaau

SEQ ID NO: 1359155 - RNA, 19 nt, Homo sapiens
aaucgucugucuuaagcaa

SEQ ID NO: 1359156 - RNA, 19 nt, Homo sapiens
ccaggaaacuuuggaaaau

SEQ ID NO: 1359157 - RNA, 19 nt, Homo sapiens
gugaccaauucaagucuau

SEQ ID NO: 1359158 - RNA, 19 nt, Homo sapiens
guaggcaauacaguuguua

SEQ ID NO: 1359159 - RNA, 19 nt, Homo sapiens
ggccggaagaguagauaaa

SEQ ID NO: 1359160 - RNA, 19 nt, Homo sapiens
ugagauggcacauguuucu

SEQ ID NO: 1359161 - RNA, 19 nt, Homo sapiens
cagcucaaccuuuauggau

SEQ ID NO: 1359162 - RNA, 19 nt, Homo sapiens
auugacaccuguuuacuca

SEQ ID NO: 1359163 - RNA, 19 nt, Homo sapiens
cagcaauugacaccuguuu

SEQ ID NO: 1359164 - RNA, 19 nt, Homo sapiens
caccucaccaccacaauga

SEQ ID NO: 1359165 - RNA, 19 nt, Homo sapiens
agaaucgucugucuuaagc

SEQ ID NO: 1359166 - RNA, 19 nt, Homo sapiens
guucgacagcucaaccuuu

SEQ ID NO: 1359167 - RNA, 19 nt, Homo sapiens
ccagauaaagaugaugauu

SEQ ID NO: 1359168 - RNA, 19 nt, Homo sapiens
cuucagaaacucaagaugu

SEQ ID NO: 1359169 - RNA, 19 nt, Homo sapiens
uuagaaaguccaaguuaca

SEQ ID NO: 1359170 - RNA, 19 nt, Homo sapiens
gcugugaaguaggcaauac

SEQ ID NO: 1359171 - RNA, 19 nt, Homo sapiens
caaaaguccuucuguuacu

SEQ ID NO: 1359172 - RNA, 19 nt, Homo sapiens
gcaaaaguccuucuguuac

SEQ ID NO: 1359173 - RNA, 19 nt, Homo sapiens
cuaggucuccauuguguga

SEQ ID NO: 1359174 - RNA, 19 nt, Homo sapiens
ccacuaggucuccauugug

SEQ ID NO: 1359175 - RNA, 19 nt, Homo sapiens
ugaagcugcaguccugaaa

SEQ ID NO: 1359176 - RNA, 19 nt, Homo sapiens
caacuuaugaaaacaggua

SEQ ID NO: 1359177 - RNA, 19 nt, Homo sapiens
uccacuaggucuccauugu

SEQ ID NO: 1359178 - RNA, 19 nt, Homo sapiens
ugaagcagcauuugaagcu

SEQ ID NO: 1359179 - RNA, 19 nt, Homo sapiens
ucagacuuacggucaauga

SEQ ID NO: 1359180 - RNA, 19 nt, Homo sapiens
uagcuuguccgcaucugaa

SEQ ID NO: 1359181 - RNA, 19 nt, Homo sapiens
ugagaauggaacuugcaua

SEQ ID NO: 1359182 - RNA, 19 nt, Homo sapiens
aaagugaccaauucaaguc

SEQ ID NO: 1359183 - RNA, 19 nt, Homo sapiens
ugagccagauaaagaugau

SEQ ID NO: 1359184 - RNA, 19 nt, Homo sapiens
caagaaaaugcucugaaaa

SEQ ID NO: 1359185 - RNA, 19 nt, Homo sapiens
aaacuuuccagaucuucaa

SEQ ID NO: 1359186 - RNA, 19 nt, Homo sapiens
caaucugucucugggaaag

SEQ ID NO: 1359187 - RNA, 19 nt, Homo sapiens
gaugagaauggaacuugca

SEQ ID NO: 1359188 - RNA, 19 nt, Homo sapiens
ggcaauacaguuguuaaag

SEQ ID NO: 1359189 - RNA, 19 nt, Homo sapiens
gacaccuguuuacucaguu

SEQ ID NO: 1359190 - RNA, 19 nt, Homo sapiens
ccaccucaccaccacaaug

SEQ ID NO: 1359191 - RNA, 19 nt, Homo sapiens
uuugagauggcacauguuu

SEQ ID NO: 1359192 - RNA, 19 nt, Homo sapiens
ucaccaccacaaugaggua

SEQ ID NO: 1359193 - RNA, 19 nt, Homo sapiens
gacucagacuuacggucaa

SEQ ID NO: 1359194 - RNA, 19 nt, Homo sapiens
aguaggcaauacaguuguu

SEQ ID NO: 1359195 - RNA, 19 nt, Homo sapiens
ugucagaagagaaagaauc

SEQ ID NO: 1359196 - RNA, 19 nt, Homo sapiens
cuugcauagugauuaauga

SEQ ID NO: 1359197 - RNA, 19 nt, Homo sapiens
gaauguaaguugugaggua

SEQ ID NO: 1359198 - RNA, 19 nt, Homo sapiens
caaagucacugguuuaaau

SEQ ID NO: 1359199 - RNA, 19 nt, Homo sapiens
gaaacagguguaacuauua

SEQ ID NO: 1359200 - RNA, 19 nt, Homo sapiens
cgccagagauugugaaaua

SEQ ID NO: 1359201 - RNA, 19 nt, Homo sapiens
caagagacuucauuacuga

SEQ ID NO: 1359202 - RNA, 19 nt, Homo sapiens
gcaagagacuucauuacug

SEQ ID NO: 1359203 - RNA, 19 nt, Homo sapiens
ugacagaaguaguauugua

SEQ ID NO: 1359204 - RNA, 19 nt, Homo sapiens
ucaaaugggucaucuucua

SEQ ID NO: 1359205 - RNA, 19 nt, Homo sapiens
ugaaacagguguaacuauu

SEQ ID NO: 1359206 - RNA, 19 nt, Homo sapiens
uaaauuaccuggaauacca

SEQ ID NO: 1359207 - RNA, 19 nt, Homo sapiens
ugagaagggugaaauagaa

SEQ ID NO: 1359208 - RNA, 19 nt, Homo sapiens
agaugaagcuguuaacaaa

SEQ ID NO: 1359209 - RNA, 19 nt, Homo sapiens
guauauaccgccacaauaa

SEQ ID NO: 1359210 - RNA, 19 nt, Homo sapiens
uggcggaaguuuagcauua

SEQ ID NO: 1359211 - RNA, 19 nt, Homo sapiens
caaacuaucugagaagaga

SEQ ID NO: 1359212 - RNA, 19 nt, Homo sapiens
aaauggaccuguuguagaa

SEQ ID NO: 1359213 - RNA, 19 nt, Homo sapiens
caaaauagcuggcacuaau

SEQ ID NO: 1359214 - RNA, 19 nt, Homo sapiens
ucacagucaucaucuaauu

SEQ ID NO: 1359215 - RNA, 19 nt, Homo sapiens
gauggaggcuauucaacaa

SEQ ID NO: 1359216 - RNA, 19 nt, Homo sapiens
gaaaugucuucuaguacuu

SEQ ID NO: 1359217 - RNA, 19 nt, Homo sapiens
guacgaauaggaauaauug

SEQ ID NO: 1359218 - RNA, 19 nt, Homo sapiens
ugacaaaguuuccagagau

SEQ ID NO: 1359219 - RNA, 19 nt, Homo sapiens
gauggagaauauguuguua

SEQ ID NO: 1359220 - RNA, 19 nt, Homo sapiens
ggacuuaggcaacaggaaa

SEQ ID NO: 1359221 - RNA, 19 nt, Homo sapiens
aaacacaggugcuuuguac

SEQ ID NO: 1359222 - RNA, 19 nt, Homo sapiens
gaaauucuaacaagucgaa

SEQ ID NO: 1359223 - RNA, 19 nt, Homo sapiens
aaucagagauacuggugua

SEQ ID NO: 1359224 - RNA, 19 nt, Homo sapiens
ccauaagaguuacaucuga

SEQ ID NO: 1359225 - RNA, 19 nt, Homo sapiens
ggacaccucagaaguuauu

SEQ ID NO: 1359226 - RNA, 19 nt, Homo sapiens
aaagucagauugucauguu

SEQ ID NO: 1359227 - RNA, 19 nt, Homo sapiens
ggaucagcauuauuucaaa

SEQ ID NO: 1359228 - RNA, 19 nt, Homo sapiens
uguagaaacuguucagguu

SEQ ID NO: 1359229 - RNA, 19 nt, Homo sapiens
gagaugaagcuguuaacaa

SEQ ID NO: 1359230 - RNA, 19 nt, Homo sapiens
guaaugggagaaccuauuu

SEQ ID NO: 1359231 - RNA, 19 nt, Homo sapiens
gaaguuggccaagaaauuc

SEQ ID NO: 1359232 - RNA, 19 nt, Homo sapiens
cauaagaguuacaucugaa

SEQ ID NO: 1359233 - RNA, 19 nt, Homo sapiens
gaguaacccauauuuguuu

SEQ ID NO: 1359234 - RNA, 19 nt, Homo sapiens
gagcaacauuuuaguagua

SEQ ID NO: 1359235 - RNA, 19 nt, Homo sapiens
gacagaaguaguauuguaa

SEQ ID NO: 1359236 - RNA, 19 nt, Homo sapiens
gcaguacgaauaggaauaa

SEQ ID NO: 1359237 - RNA, 19 nt, Homo sapiens
guagaauucccacaaacua

SEQ ID NO: 1359238 - RNA, 19 nt, Homo sapiens
ggaaagcuggccagauuug

SEQ ID NO: 1359239 - RNA, 19 nt, Homo sapiens
ugacuucacuuaggaaugu

SEQ ID NO: 1359240 - RNA, 19 nt, Homo sapiens
ccagagauugugaaauaua

SEQ ID NO: 1359241 - RNA, 19 nt, Homo sapiens
gauggaagaaugaggcuuu

SEQ ID NO: 1359242 - RNA, 19 nt, Homo sapiens
cagagauacugguguaaug

SEQ ID NO: 1359243 - RNA, 19 nt, Homo sapiens
gaauuuggagcaguauaua

SEQ ID NO: 1359244 - RNA, 19 nt, Homo sapiens
aaacagguguaacuauuag

SEQ ID NO: 1359245 - RNA, 19 nt, Homo sapiens
gcuggcuacuucuaugaua

SEQ ID NO: 1359246 - RNA, 19 nt, Homo sapiens
ggacaaacacaggugcuuu

SEQ ID NO: 1359247 - RNA, 19 nt, Homo sapiens
gacaaaguuuccagagaug

SEQ ID NO: 1359248 - RNA, 19 nt, Homo sapiens
agauggcucugcuguagua

SEQ ID NO: 1359249 - RNA, 19 nt, Homo sapiens
gaaccuauuucacagucau

SEQ ID NO: 1359250 - RNA, 19 nt, Homo sapiens
gaggcaagagacuucauua

SEQ ID NO: 1359251 - RNA, 19 nt, Homo sapiens
ucauggaucagcauuauuu

SEQ ID NO: 1359252 - RNA, 19 nt, Homo sapiens
gauuagaaguuggccaaga

SEQ ID NO: 1359253 - RNA, 19 nt, Homo sapiens
aaggagauauuacagauca

SEQ ID NO: 1359254 - RNA, 19 nt, Homo sapiens
gauuugacuucacuuagga

SEQ ID NO: 1359255 - RNA, 19 nt, Homo sapiens
ggucacagcggucaguaaa

SEQ ID NO: 1359256 - RNA, 19 nt, Homo sapiens
aaaugagccugauguccua

SEQ ID NO: 1359257 - RNA, 19 nt, Homo sapiens
caaccguggucagaacuuu

SEQ ID NO: 1359258 - RNA, 19 nt, Homo sapiens
ccugguggcuauaacuuaa

SEQ ID NO: 1359259 - RNA, 19 nt, Homo sapiens
agggugaaauagaagauua

SEQ ID NO: 1359260 - RNA, 19 nt, Homo sapiens
ggauuugacuucacuuagg

SEQ ID NO: 1359261 - RNA, 19 nt, Homo sapiens
uuacgagcaugacaaaguu

SEQ ID NO: 1359262 - RNA, 19 nt, Homo sapiens
aaagugggagugaaauaua

SEQ ID NO: 1359263 - RNA, 19 nt, Homo sapiens
ucauuuacaugugccauuu

SEQ ID NO: 1359264 - RNA, 19 nt, Homo sapiens
ugacauggacuucaaaaua

SEQ ID NO: 1359265 - RNA, 19 nt, Homo sapiens
gaucagcauuauuucaaag

SEQ ID NO: 1359266 - RNA, 19 nt, Homo sapiens
ccugauguccuagcaauua

SEQ ID NO: 1359267 - RNA, 19 nt, Homo sapiens
caacgaaagauuaaacauc

SEQ ID NO: 1359268 - RNA, 19 nt, Homo sapiens
gagcgaugguccuuuccuu

SEQ ID NO: 1359269 - RNA, 19 nt, Homo sapiens
cauuacaggcugauauuaa

SEQ ID NO: 1359270 - RNA, 19 nt, Homo sapiens
gcauuacaggcugauauua

SEQ ID NO: 1359271 - RNA, 19 nt, Homo sapiens
guugugagguagauauguu

SEQ ID NO: 1359272 - RNA, 19 nt, Homo sapiens
gcauucagcaguugguaaa

SEQ ID NO: 1359273 - RNA, 19 nt, Homo sapiens
cagguagaauucccacaaa

SEQ ID NO: 1359274 - RNA, 19 nt, Homo sapiens
gcagguagaauucccacaa

SEQ ID NO: 1359275 - RNA, 19 nt, Homo sapiens
cagaaguaguauuguaaug

SEQ ID NO: 1359276 - RNA, 19 nt, Homo sapiens
ggcggaaguuuagcauuaa

SEQ ID NO: 1359277 - RNA, 19 nt, Homo sapiens
caggugcuuuguaccguua

SEQ ID NO: 1359278 - RNA, 19 nt, Homo sapiens
auagaauccuucaauguug

SEQ ID NO: 1359279 - RNA, 19 nt, Homo sapiens
acaaauaauucagggcauu

SEQ ID NO: 1359280 - RNA, 19 nt, Homo sapiens
uuaguaguaucuuccauug

SEQ ID NO: 1359281 - RNA, 19 nt, Homo sapiens
gcaaagucacugguuuaaa

SEQ ID NO: 1359282 - RNA, 19 nt, Homo sapiens
cuaaugaaauuggcaaagu

SEQ ID NO: 1359283 - RNA, 19 nt, Homo sapiens
acuacgaguuuccuccuua

SEQ ID NO: 1359284 - RNA, 19 nt, Homo sapiens
caaagugggagugaaauau

SEQ ID NO: 1359285 - RNA, 19 nt, Homo sapiens
ucaaagugggagugaaaua

SEQ ID NO: 1359286 - RNA, 19 nt, Homo sapiens
cgaauaggaauaauugaug

SEQ ID NO: 1359287 - RNA, 19 nt, Homo sapiens
gguugguacuucugauaaa

SEQ ID NO: 1359288 - RNA, 19 nt, Homo sapiens
cgaguaacccauauuuguu

SEQ ID NO: 1359289 - RNA, 19 nt, Homo sapiens
aguaguaucuuccauugug

SEQ ID NO: 1359290 - RNA, 19 nt, Homo sapiens
gcccuaggauuagaaguug

SEQ ID NO: 1359291 - RNA, 19 nt, Homo sapiens
gaucaaguuauaacagcua

SEQ ID NO: 1359292 - RNA, 19 nt, Homo sapiens
gguauuaagucagaucaag

SEQ ID NO: 1359293 - RNA, 19 nt, Homo sapiens
gccgauccauaugaaauaa

SEQ ID NO: 1359294 - RNA, 19 nt, Homo sapiens
agaagccgauccauaugaa

SEQ ID NO: 1359295 - RNA, 19 nt, Homo sapiens
gugguugacuacagacaaa

SEQ ID NO: 1359296 - RNA, 19 nt, Homo sapiens
uuccguagcccucucauua

SEQ ID NO: 1359297 - RNA, 19 nt, Homo sapiens
ggagaaaugugaccuguua

SEQ ID NO: 1359298 - RNA, 19 nt, Homo sapiens
ggaagaaccuaaggaauua

SEQ ID NO: 1359299 - RNA, 19 nt, Homo sapiens
ggugauaacuuguuuguaa

SEQ ID NO: 1359300 - RNA, 19 nt, Homo sapiens
gaacaaguguauacaacua

SEQ ID NO: 1359301 - RNA, 19 nt, Homo sapiens
gaauaucccuucauugaug

SEQ ID NO: 1359302 - RNA, 19 nt, Homo sapiens
gaaggugucugaccguaaa

SEQ ID NO: 1359303 - RNA, 19 nt, Homo sapiens
uaaggaaggugauaacuug

SEQ ID NO: 1359304 - RNA, 19 nt, Homo sapiens
gaacagagaccaaagaaag

SEQ ID NO: 1359305 - RNA, 19 nt, Homo sapiens
gauaaucuguucaaccauu

SEQ ID NO: 1359306 - RNA, 19 nt, Homo sapiens
ggacagcguuauucucauu

SEQ ID NO: 1359307 - RNA, 19 nt, Homo sapiens
gaaacaaaccucuucagaa

SEQ ID NO: 1359308 - RNA, 19 nt, Homo sapiens
gaagaagagagaaauagua

SEQ ID NO: 1359309 - RNA, 19 nt, Homo sapiens
ggaaggugauaacuuguuu

SEQ ID NO: 1359310 - RNA, 19 nt, Homo sapiens
ggaaucagaaugucagaua

SEQ ID NO: 1359311 - RNA, 19 nt, Homo sapiens
gaaucagaaugucagauaa

SEQ ID NO: 1359312 - RNA, 19 nt, Homo sapiens
gggaagaaccuaaggaauu

SEQ ID NO: 1359313 - RNA, 19 nt, Homo sapiens
agaauuaccucucuaagga

SEQ ID NO: 1359314 - RNA, 19 nt, Homo sapiens
gaggaugguucacauuuga

SEQ ID NO: 1359315 - RNA, 19 nt, Homo sapiens
cagaauaucccuucauuga

SEQ ID NO: 1359316 - RNA, 19 nt, Homo sapiens
caaccauucuugauaaguu

SEQ ID NO: 1359317 - RNA, 19 nt, Homo sapiens
ggaaacuucaugcuuauuu

SEQ ID NO: 1359318 - RNA, 19 nt, Homo sapiens
ggaagacacuaaagaugau

SEQ ID NO: 1359319 - RNA, 19 nt, Homo sapiens
aaagaaagauagagcaugu

SEQ ID NO: 1359320 - RNA, 19 nt, Homo sapiens
gaaaauuccuugaacuuug

SEQ ID NO: 1359321 - RNA, 19 nt, Homo sapiens
aggaaacaauccagaaaua

SEQ ID NO: 1359322 - RNA, 19 nt, Homo sapiens
gaagagagaaauaguagau

SEQ ID NO: 1359323 - RNA, 19 nt, Homo sapiens
agaagaagauugguugaaa

SEQ ID NO: 1359324 - RNA, 19 nt, Homo sapiens
ccagaaauauugacagaca

SEQ ID NO: 1359325 - RNA, 19 nt, Homo sapiens
caaaugaaaucuccguuac

SEQ ID NO: 1359326 - RNA, 19 nt, Homo sapiens
cagaagagaaucagaauau

SEQ ID NO: 1359327 - RNA, 19 nt, Homo sapiens
aaugugaccuguuaacaaa

SEQ ID NO: 1359328 - RNA, 19 nt, Homo sapiens
caaccaauuuaucugauga

SEQ ID NO: 1359329 - RNA, 19 nt, Homo sapiens
ggaaucagagaaagaguuu

SEQ ID NO: 1359330 - RNA, 19 nt, Homo sapiens
gcaauggauucaaaugauc

SEQ ID NO: 1359331 - RNA, 19 nt, Homo sapiens
ccaaaugaaaucuccguua

SEQ ID NO: 1359332 - RNA, 19 nt, Homo sapiens
caaagaauuaccucucuaa

SEQ ID NO: 1359333 - RNA, 19 nt, Homo sapiens
gcagaacagucagaauaga

SEQ ID NO: 1359334 - RNA, 19 nt, Homo sapiens
gagaggaugguucacauuu

SEQ ID NO: 1359335 - RNA, 19 nt, Homo sapiens
gaucaggacccaucucaga

SEQ ID NO: 1359336 - RNA, 19 nt, Homo sapiens
gaagaugucaguggagaaa

SEQ ID NO: 1359337 - RNA, 19 nt, Homo sapiens
ugcaggaccucauaaguuu

SEQ ID NO: 1359338 - RNA, 19 nt, Homo sapiens
ccaaagaauuaccucucua

SEQ ID NO: 1359339 - RNA, 19 nt, Homo sapiens
ucucauugccugucauuua

SEQ ID NO: 1359340 - RNA, 19 nt, Homo sapiens
gaagaggagaauaaacaaa

SEQ ID NO: 1359341 - RNA, 19 nt, Homo sapiens
gaggaaaacucauuagaau

SEQ ID NO: 1359342 - RNA, 19 nt, Homo sapiens
aagcagaacagucagaaua

SEQ ID NO: 1359343 - RNA, 19 nt, Homo sapiens
gaagaagauugguugaaaa

SEQ ID NO: 1359344 - RNA, 19 nt, Homo sapiens
gacaagaguagguaauaaa

SEQ ID NO: 1359345 - RNA, 19 nt, Homo sapiens
agacaagaguagguaauaa

SEQ ID NO: 1359346 - RNA, 19 nt, Homo sapiens
aaggugcucugcaucuuua

SEQ ID NO: 1359347 - RNA, 19 nt, Homo sapiens
ggaaacaauccagaaauau

SEQ ID NO: 1359348 - RNA, 19 nt, Homo sapiens
ggcaauggauucaaaugau

SEQ ID NO: 1359349 - RNA, 19 nt, Homo sapiens
ugcggaaacuucaugcuua

SEQ ID NO: 1359350 - RNA, 19 nt, Homo sapiens
gaagaggaagacauugaaa

SEQ ID NO: 1359351 - RNA, 19 nt, Homo sapiens
gagaaagaguuuugaagaa

SEQ ID NO: 1359352 - RNA, 19 nt, Homo sapiens
gagcuaccauuaucacaag

SEQ ID NO: 1359353 - RNA, 19 nt, Homo sapiens
aaagaaugccuuagaauca

SEQ ID NO: 1359354 - RNA, 19 nt, Homo sapiens
caaagaaugccuuagaauc

SEQ ID NO: 1359355 - RNA, 19 nt, Homo sapiens
gggaugagguucugguaca

SEQ ID NO: 1359356 - RNA, 19 nt, Homo sapiens
acaacacaccaaagaauua

SEQ ID NO: 1359357 - RNA, 19 nt, Homo sapiens
auacuagucugcaggauga

SEQ ID NO: 1359358 - RNA, 19 nt, Homo sapiens
uuacauagucauccugaua

SEQ ID NO: 1359359 - RNA, 19 nt, Homo sapiens
gcggaaacuucaugcuuau

SEQ ID NO: 1359360 - RNA, 19 nt, Homo sapiens
gauggaagaaggugucuga

SEQ ID NO: 1359361 - RNA, 19 nt, Homo sapiens
guuuauaugugaacagaga

SEQ ID NO: 1359362 - RNA, 19 nt, Homo sapiens
cagaaugucagauaaaguu

SEQ ID NO: 1359363 - RNA, 19 nt, Homo sapiens
gacaacacaccaaagaauu

SEQ ID NO: 1359364 - RNA, 19 nt, Homo sapiens
gaaaagaccagaagagaau

SEQ ID NO: 1359365 - RNA, 19 nt, Homo sapiens
aaagggagacugacacauu

SEQ ID NO: 1359366 - RNA, 19 nt, Homo sapiens
uuacugaggccaaaugaaa

SEQ ID NO: 1359367 - RNA, 19 nt, Homo sapiens
ggacugcaacuaggacuuu

SEQ ID NO: 1359368 - RNA, 19 nt, Homo sapiens
acaaacuacugauaggaaa

SEQ ID NO: 1359369 - RNA, 19 nt, Homo sapiens
gaaauaggcauaccauagc

SEQ ID NO: 1359370 - RNA, 19 nt, Homo sapiens
gaugacugcucuggcauga

SEQ ID NO: 1359371 - RNA, 19 nt, Homo sapiens
ggacagccaagacuuaaca

SEQ ID NO: 1359372 - RNA, 19 nt, Homo sapiens
gggagucacuucugauuuu

SEQ ID NO: 1359373 - RNA, 19 nt, Homo sapiens
gaaacuauggauucauuca

SEQ ID NO: 1359374 - RNA, 19 nt, Homo sapiens
ucaaggacaugaccaagag

SEQ ID NO: 1359375 - RNA, 19 nt, Homo sapiens
ggacccaucucagagugaa

SEQ ID NO: 1359376 - RNA, 19 nt, Homo sapiens
agauagagcauguaaguug

SEQ ID NO: 1359377 - RNA, 19 nt, Homo sapiens
aaagauagagcauguaagu

SEQ ID NO: 1359378 - RNA, 19 nt, Homo sapiens
uaagagaggaacaagugua

SEQ ID NO: 1359379 - RNA, 19 nt, Homo sapiens
aaugaaaucuccguuacuu

SEQ ID NO: 1359380 - RNA, 19 nt, Homo sapiens
aaacagaagaggaacagaa

SEQ ID NO: 1359381 - RNA, 19 nt, Homo sapiens
gacuuucacuggaaucaga

SEQ ID NO: 1359382 - RNA, 19 nt, Homo sapiens
ugaaagguuugauagaaag

SEQ ID NO: 1359383 - RNA, 19 nt, Homo sapiens
cucauugccugucauuuaa

SEQ ID NO: 1359384 - RNA, 19 nt, Homo sapiens
gaaaugugaccuguuaaca

SEQ ID NO: 1359385 - RNA, 19 nt, Homo sapiens
gacaaacuacugauaggaa

SEQ ID NO: 1359386 - RNA, 19 nt, Homo sapiens
gcaaccagcagacuaaugg

SEQ ID NO: 1359387 - RNA, 19 nt, Homo sapiens
gggcaauggauucaaauga

SEQ ID NO: 1359388 - RNA, 19 nt, Homo sapiens
agaaagauagagcauguaa

SEQ ID NO: 1359389 - RNA, 19 nt, Homo sapiens
ugacugcucuggcaugaag

SEQ ID NO: 1359390 - RNA, 19 nt, Homo sapiens
gugacuggauauaaagaaa

SEQ ID NO: 1359391 - RNA, 19 nt, Homo sapiens
ggaaaacucauuagaauuc

SEQ ID NO: 1359392 - RNA, 19 nt, Homo sapiens
ugaggacagccaagacuua

SEQ ID NO: 1359393 - RNA, 19 nt, Homo sapiens
gacagacaaacuacugaua

SEQ ID NO: 1359394 - RNA, 19 nt, Homo sapiens
ggugucugaccguaaauua

SEQ ID NO: 1359395 - RNA, 19 nt, Homo sapiens
ucacaaccaauuuaucuga

SEQ ID NO: 1359396 - RNA, 19 nt, Homo sapiens
ggguuugccuuucaauuag

SEQ ID NO: 1359397 - RNA, 19 nt, Homo sapiens
gaucacagcugcccuugaa

SEQ ID NO: 1359398 - RNA, 19 nt, Homo sapiens
gaaauaguccuaagaaaca

SEQ ID NO: 1359399 - RNA, 19 nt, Homo sapiens
gcaagaaauuggagaacuu

SEQ ID NO: 1359400 - RNA, 19 nt, Homo sapiens
gcacaggccucuggaaaug

SEQ ID NO: 1359401 - RNA, 19 nt, Homo sapiens
ggacuaagacguacaaaca

SEQ ID NO: 1359402 - RNA, 19 nt, Homo sapiens
caucuaacaugucauuuga

SEQ ID NO: 1359403 - RNA, 19 nt, Homo sapiens
gagcaaagaguaauaagga

SEQ ID NO: 1359404 - RNA, 19 nt, Homo sapiens
cgaaagaggcgacgaaaug

SEQ ID NO: 1359405 - RNA, 19 nt, Homo sapiens
gaauggagcagcaagaaau

SEQ ID NO: 1359406 - RNA, 19 nt, Homo sapiens
ccacacagccucagcuuga

SEQ ID NO: 1359407 - RNA, 19 nt, Homo sapiens
ggaaauaguccuaagaaac

SEQ ID NO: 1359408 - RNA, 19 nt, Homo sapiens
uugaggagcuguuggaauu

SEQ ID NO: 1359409 - RNA, 19 nt, Homo sapiens
ggaaaugucagccaagauc

SEQ ID NO: 1359410 - RNA, 19 nt, Homo sapiens
cagcugcccuugaaucuca

SEQ ID NO: 1359411 - RNA, 19 nt, Homo sapiens
caagauccgaguaccauuu

SEQ ID NO: 1359412 - RNA, 19 nt, Homo sapiens
gagaggagcaugagaaacu

SEQ ID NO: 1359413 - RNA, 19 nt, Homo sapiens
uguaggagccacuucauaa

SEQ ID NO: 1359414 - RNA, 19 nt, Homo sapiens
agagaaagagcuugugaaa

SEQ ID NO: 1359415 - RNA, 19 nt, Homo sapiens
gaagaggggccaaugaaaa

SEQ ID NO: 1359416 - RNA, 19 nt, Homo sapiens
ggcacuagcugagaaguuc

SEQ ID NO: 1359417 - RNA, 19 nt, Homo sapiens
guaggagccacuucauaaa

SEQ ID NO: 1359418 - RNA, 19 nt, Homo sapiens
uggaaauaguccuaagaaa

SEQ ID NO: 1359419 - RNA, 19 nt, Homo sapiens
uaaaccagggauucugaua

SEQ ID NO: 1359420 - RNA, 19 nt, Homo sapiens
gaaacgcagcaagaaauug

SEQ ID NO: 1359421 - RNA, 19 nt, Homo sapiens
uaagacguacaaacaauug

SEQ ID NO: 1359422 - RNA, 19 nt, Homo sapiens
caaaacauaccaauucuug

SEQ ID NO: 1359423 - RNA, 19 nt, Homo sapiens
gcagcaagaaauuggagaa

SEQ ID NO: 1359424 - RNA, 19 nt, Homo sapiens
ugaaacgcagcaagaaauu

SEQ ID NO: 1359425 - RNA, 19 nt, Homo sapiens
aaagagaaagagcuuguga

SEQ ID NO: 1359426 - RNA, 19 nt, Homo sapiens
cgaaagagaaagagcuugu

SEQ ID NO: 1359427 - RNA, 19 nt, Homo sapiens
acuaagacguacaaacaau

SEQ ID NO: 1359428 - RNA, 19 nt, Homo sapiens
aauauaauccugagguguu

SEQ ID NO: 1359429 - RNA, 19 nt, Homo sapiens
gacccucgcuuugaugauc

SEQ ID NO: 1359430 - RNA, 19 nt, Homo sapiens
aacauucucuuuacucauc

SEQ ID NO: 1359431 - RNA, 19 nt, Homo sapiens
ggagccacuucauaaacau

SEQ ID NO: 1359432 - RNA, 19 nt, Homo sapiens
cauccgagcgaaagagaaa

SEQ ID NO: 1359433 - RNA, 19 nt, Homo sapiens
gggcuacacaagaauaguu

SEQ ID NO: 1359434 - RNA, 19 nt, Homo sapiens
gaaagaggcgacgaaaugc

SEQ ID NO: 1359435 - RNA, 19 nt, Homo sapiens
gcaacugcuucagcgaaug

SEQ ID NO: 1359436 - RNA, 19 nt, Homo sapiens
caggagaggagcaugagaa

SEQ ID NO: 1359437 - RNA, 19 nt, Homo sapiens
ugacaaaacauaccaauuc

SEQ ID NO: 1359438 - RNA, 19 nt, Homo sapiens
uagcugagaaguucaagga

SEQ ID NO: 1359439 - RNA, 19 nt, Homo sapiens
cgaauggagcagcaagaaa

SEQ ID NO: 1359440 - RNA, 19 nt, Homo sapiens
gaaugacauccgagcgaaa

SEQ ID NO: 1359441 - RNA, 19 nt, Homo sapiens
cgucagguuguucccauua

SEQ ID NO: 1359442 - RNA, 19 nt, Homo sapiens
caauugguagcuggaaaua

SEQ ID NO: 1359443 - RNA, 19 nt, Homo sapiens
gaagaagaggggccaauga

SEQ ID NO: 1359444 - RNA, 19 nt, Homo sapiens
gcaccuggcccugaagcaa

SEQ ID NO: 1359445 - RNA, 19 nt, Homo sapiens
gcgaauggagcagcaagaa

SEQ ID NO: 1359446 - RNA, 19 nt, Homo sapiens
gaaagagaaagagcuugug

SEQ ID NO: 1359447 - RNA, 19 nt, Homo sapiens
cccuagggcuacacaagaa

SEQ ID NO: 1359448 - RNA, 19 nt, Homo sapiens
cuaagacguacaaacaauu

SEQ ID NO: 1359449 - RNA, 19 nt, Homo sapiens
gacguacaaacaauuggua

SEQ ID NO: 1359450 - RNA, 19 nt, Homo sapiens
auugguagcuggaaauagu

SEQ ID NO: 1359451 - RNA, 19 nt, Homo sapiens
ugaaucucauugccucaga

SEQ ID NO: 1359452 - RNA, 19 nt, Homo sapiens
gacuaagacguacaaacaa

SEQ ID NO: 1359453 - RNA, 19 nt, Homo sapiens
ggaauugcagagccaagug

SEQ ID NO: 1359454 - RNA, 19 nt, Homo sapiens
caagaaauuggagaacuuc

SEQ ID NO: 1359455 - RNA, 19 nt, Homo sapiens
agaaauggcacagcaggaa

SEQ ID NO: 1359456 - RNA, 19 nt, Homo sapiens
ucgcuuugaugaucuguca

SEQ ID NO: 1359457 - RNA, 19 nt, Homo sapiens
cagguuguucccauuagua

SEQ ID NO: 1359458 - RNA, 19 nt, Homo sapiens
uggcacagcaggaacgaaa

SEQ ID NO: 1359459 - RNA, 19 nt, Homo sapiens
auauaauccugagguguuu

SEQ ID NO: 1359460 - RNA, 19 nt, Homo sapiens
aagcacaggccucuggaaa

SEQ ID NO: 1359461 - RNA, 19 nt, Homo sapiens
cuagggcuacacaagaaua

SEQ ID NO: 1359462 - RNA, 19 nt, Homo sapiens
ucacagcugcccuugaauc

SEQ ID NO: 1359463 - RNA, 19 nt, Homo sapiens
gcuggaaauaguccuaaga

SEQ ID NO: 1359464 - RNA, 19 nt, Homo sapiens
aggagccacuucauaaaca

SEQ ID NO: 1359465 - RNA, 19 nt, Homo sapiens
ugaaaaccauggagucugu

SEQ ID NO: 1359466 - RNA, 19 nt, Homo sapiens
gaggagcuguuggaauugc

SEQ ID NO: 1359467 - RNA, 19 nt, Homo sapiens
gggauucugauaccgaaga

SEQ ID NO: 1359468 - RNA, 19 nt, Homo sapiens
caaagaguaauaaggaacu

SEQ ID NO: 1359469 - RNA, 19 nt, Homo sapiens
gaacuucuugagucgaaag

SEQ ID NO: 1359470 - RNA, 19 nt, Homo sapiens
aaacgcagcaagaaauugg

SEQ ID NO: 1359471 - RNA, 19 nt, Homo sapiens
cugaaacgcagcaagaaau

SEQ ID NO: 1359472 - RNA, 19 nt, Homo sapiens
gagccacuucauaaacauu

SEQ ID NO: 1359473 - RNA, 19 nt, Homo sapiens
aacaauugguagcuggaaa

SEQ ID NO: 1359474 - RNA, 19 nt, Homo sapiens
gcaaggacaggagacaucu

SEQ ID NO: 1359475 - RNA, 19 nt, Homo sapiens
gacaaaacauaccaauucu

SEQ ID NO: 1359476 - RNA, 19 nt, Homo sapiens
cuggaaaugucagccaaga

SEQ ID NO: 1359477 - RNA, 19 nt, Homo sapiens
agcaaagaguaauaaggaa

SEQ ID NO: 1359478 - RNA, 19 nt, Homo sapiens
cuggaaauaguccuaagaa

SEQ ID NO: 1359479 - RNA, 19 nt, Homo sapiens
guacaaacaauugguagcu

SEQ ID NO: 1359480 - RNA, 19 nt, Homo sapiens
ucucauccuugccuuaaac

SEQ ID NO: 1359481 - RNA, 19 nt, Homo sapiens
gggagacauggaucuguga

SEQ ID NO: 1359482 - RNA, 19 nt, Homo sapiens
ggcaaggacaggagacauc

SEQ ID NO: 1359483 - RNA, 19 nt, Homo sapiens
gacauccgagcgaaagaga

SEQ ID NO: 1359484 - RNA, 19 nt, Homo sapiens
ccgggacccucgcuuugau

SEQ ID NO: 1359485 - RNA, 19 nt, Homo sapiens
ucagguuguucccauuagu

SEQ ID NO: 1359486 - RNA, 19 nt, Homo sapiens
cacacagccucagcuugaa

SEQ ID NO: 1359487 - RNA, 19 nt, Homo sapiens
caacugcuucagcgaaugg

SEQ ID NO: 1359488 - RNA, 19 nt, Homo sapiens
guagcuggaaauaguccua

SEQ ID NO: 1359489 - RNA, 19 nt, Homo sapiens
auccugagguguuugacaa

SEQ ID NO: 1359490 - RNA, 19 nt, Homo sapiens
guugaacgcuuguuaaaua

SEQ ID NO: 1359491 - RNA, 19 nt, Homo sapiens
uaacugugcuguguauuua

SEQ ID NO: 1359492 - RNA, 19 nt, Homo sapiens
ugaagaaagucaugcauuu

SEQ ID NO: 1359493 - RNA, 19 nt, Homo sapiens
ccaaguggcuguaaaccua

SEQ ID NO: 1359494 - RNA, 19 nt, Homo sapiens
agaagaagcugaaugagaa

SEQ ID NO: 1359495 - RNA, 19 nt, Homo sapiens
gaauagugcugcaaugaau

SEQ ID NO: 1359496 - RNA, 19 nt, Homo sapiens
guagaaaguuuguaagaug

SEQ ID NO: 1359497 - RNA, 19 nt, Homo sapiens
gaagaaagucaugcauuua

SEQ ID NO: 1359498 - RNA, 19 nt, Homo sapiens
uaauuaggcugcucuugua

SEQ ID NO: 1359499 - RNA, 19 nt, Homo sapiens
gaacaaagaagaagaagag

SEQ ID NO: 1359500 - RNA, 19 nt, Homo sapiens
agacacagcucaucccaaa

SEQ ID NO: 1359501 - RNA, 19 nt, Homo sapiens
gauguuagcagccauauug

SEQ ID NO: 1359502 - RNA, 19 nt, Homo sapiens
gaagacagugugccagaua

SEQ ID NO: 1359503 - RNA, 19 nt, Homo sapiens
uggaagagaagacuaauua

SEQ ID NO: 1359504 - RNA, 19 nt, Homo sapiens
gugcugcaaugaauauaua

SEQ ID NO: 1359505 - RNA, 19 nt, Homo sapiens
uagaguaacuagcucagua

SEQ ID NO: 1359506 - RNA, 19 nt, Homo sapiens
gaaguugagaguagagaua

SEQ ID NO: 1359507 - RNA, 19 nt, Homo sapiens
aaaccuagcugaagacaca

SEQ ID NO: 1359508 - RNA, 19 nt, Homo sapiens
gcauaguacccaauagaua

SEQ ID NO: 1359509 - RNA, 19 nt, Homo sapiens
uaucuacucucccuuuauu

SEQ ID NO: 1359510 - RNA, 19 nt, Homo sapiens
cgaagaagaagcugaauga

SEQ ID NO: 1359511 - RNA, 19 nt, Homo sapiens
gaacugagaacacaggaau

SEQ ID NO: 1359512 - RNA, 19 nt, Homo sapiens
uuucaaagcugcacaacuu

SEQ ID NO: 1359513 - RNA, 19 nt, Homo sapiens
gaauggaagagaagacuaa

SEQ ID NO: 1359514 - RNA, 19 nt, Homo sapiens
ugagaaaacugaacucuuu

SEQ ID NO: 1359515 - RNA, 19 nt, Homo sapiens
gcauuuagguugauuccau

SEQ ID NO: 1359516 - RNA, 19 nt, Homo sapiens
caaacuaucgcuucauuga

SEQ ID NO: 1359517 - RNA, 19 nt, Homo sapiens
cauggguacucaauguuua

SEQ ID NO: 1359518 - RNA, 19 nt, Homo sapiens
gaauguugaacgcuuguua

SEQ ID NO: 1359519 - RNA, 19 nt, Homo sapiens
gcuauuaacugugcugugu

SEQ ID NO: 1359520 - RNA, 19 nt, Homo sapiens
agagagauuucagcacuua

SEQ ID NO: 1359521 - RNA, 19 nt, Homo sapiens
guaacuagcucaguauugg

SEQ ID NO: 1359522 - RNA, 19 nt, Homo sapiens
uaauuacgcccuuauugua

SEQ ID NO: 1359523 - RNA, 19 nt, Homo sapiens
ccaucugccuggacuauuu

SEQ ID NO: 1359524 - RNA, 19 nt, Homo sapiens
gauaaagagucagcgaaug

SEQ ID NO: 1359525 - RNA, 19 nt, Homo sapiens
gggaaugucuccuucuaca

SEQ ID NO: 1359526 - RNA, 19 nt, Homo sapiens
aaacauuacugggaaguug

SEQ ID NO: 1359527 - RNA, 19 nt, Homo sapiens
ugaagaagaggaccuguuu

SEQ ID NO: 1359528 - RNA, 19 nt, Homo sapiens
gcacuuacccuguguucug

SEQ ID NO: 1359529 - RNA, 19 nt, Homo sapiens
gggaacacgugcagguuug

SEQ ID NO: 1359530 - RNA, 19 nt, Homo sapiens
gggaauuacugaucguuca

SEQ ID NO: 1359531 - RNA, 19 nt, Homo sapiens
ugaaugagaacacguuaaa

SEQ ID NO: 1359532 - RNA, 19 nt, Homo sapiens
gaagaagagacgaagaaga

SEQ ID NO: 1359533 - RNA, 19 nt, Homo sapiens
caggaaugguggaaaggua

SEQ ID NO: 1359534 - RNA, 19 nt, Homo sapiens
aagaagagacgaagaagaa

SEQ ID NO: 1359535 - RNA, 19 nt, Homo sapiens
gcagguuuguucuauagau

SEQ ID NO: 1359536 - RNA, 19 nt, Homo sapiens
ggaccuguuucuucagaga

SEQ ID NO: 1359537 - RNA, 19 nt, Homo sapiens
acucugcccucagcuauua

SEQ ID NO: 1359538 - RNA, 19 nt, Homo sapiens
gugaacaucccgcaguaua

SEQ ID NO: 1359539 - RNA, 19 nt, Homo sapiens
gaggaccuguuucuucaga

SEQ ID NO: 1359540 - RNA, 19 nt, Homo sapiens
cuaaagggacguaguguga

SEQ ID NO: 1359541 - RNA, 19 nt, Homo sapiens
gcccucagcuauuaacugu

SEQ ID NO: 1359542 - RNA, 19 nt, Homo sapiens
ugagauaauuacgcccuua

SEQ ID NO: 1359543 - RNA, 19 nt, Homo sapiens
ggagaugggacaggaaauu

SEQ ID NO: 1359544 - RNA, 19 nt, Homo sapiens
gaggacgucaugggaauua

SEQ ID NO: 1359545 - RNA, 19 nt, Homo sapiens
ggaagggagauacgugaaa

SEQ ID NO: 1359546 - RNA, 19 nt, Homo sapiens
gaagagaagacuaauuagg

SEQ ID NO: 1359547 - RNA, 19 nt, Homo sapiens
ggauguugaucuuuguuuc

SEQ ID NO: 1359548 - RNA, 19 nt, Homo sapiens
uaccguaacugcacuaaag

SEQ ID NO: 1359549 - RNA, 19 nt, Homo sapiens
gagaugggacaggaaauuu

SEQ ID NO: 1359550 - RNA, 19 nt, Homo sapiens
ggaaggauaagauaaagag

SEQ ID NO: 1359551 - RNA, 19 nt, Homo sapiens
gcacuacuaacauuucaau

SEQ ID NO: 1359552 - RNA, 19 nt, Homo sapiens
ucagaagcauuuauuggau

SEQ ID NO: 1359553 - RNA, 19 nt, Homo sapiens
gcugguaaauggcaguguu

SEQ ID NO: 1359554 - RNA, 19 nt, Homo sapiens
gagauugaacaaagaagaa

SEQ ID NO: 1359555 - RNA, 19 nt, Homo sapiens
gugcagguuuguucuauag

SEQ ID NO: 1359556 - RNA, 19 nt, Homo sapiens
gcagugauuuaacgaggau

SEQ ID NO: 1359557 - RNA, 19 nt, Homo sapiens
ugacaaaggcauagaaucu

SEQ ID NO: 1359558 - RNA, 19 nt, Homo sapiens
gcagccauauuggaacuga

SEQ ID NO: 1359559 - RNA, 19 nt, Homo sapiens
gggaggacgucaugggaau

SEQ ID NO: 1359560 - RNA, 19 nt, Homo sapiens
guggaugaauggaagagaa

SEQ ID NO: 1359561 - RNA, 19 nt, Homo sapiens
gaaaguuuguaagaugcaa

SEQ ID NO: 1359562 - RNA, 19 nt, Homo sapiens
gcaucugggcgauuuauug

SEQ ID NO: 1359563 - RNA, 19 nt, Homo sapiens
ucagaagacugcuuuugua

SEQ ID NO: 1359564 - RNA, 19 nt, Homo sapiens
gaagggagauacgugaaaa

SEQ ID NO: 1359565 - RNA, 19 nt, Homo sapiens
gaagaagaagagacgaaga

SEQ ID NO: 1359566 - RNA, 19 nt, Homo sapiens
gaacacaggaaugguggaa

SEQ ID NO: 1359567 - RNA, 19 nt, Homo sapiens
gaacucccacccagcaaga

SEQ ID NO: 1359568 - RNA, 19 nt, Homo sapiens
caaucaaacuaucgcuuca

SEQ ID NO: 1359569 - RNA, 19 nt, Homo sapiens
ggguuugguguacauauua

SEQ ID NO: 1359570 - RNA, 19 nt, Homo sapiens
cauggaagcugaggacauc

SEQ ID NO: 1359571 - RNA, 19 nt, Homo sapiens
gagaacacguuaaaacuca

SEQ ID NO: 1359572 - RNA, 19 nt, Homo sapiens
aguauuccaugguguauau

SEQ ID NO: 1359573 - RNA, 19 nt, Homo sapiens
ccauuagcaucuuuaguca

SEQ ID NO: 1359574 - RNA, 19 nt, Homo sapiens
gaacuauucccuugaagcu

SEQ ID NO: 1359575 - RNA, 19 nt, Homo sapiens
guuuagcucucccuuauac

SEQ ID NO: 1359576 - RNA, 19 nt, Homo sapiens
guccauggguacucaaugu

SEQ ID NO: 1359577 - RNA, 19 nt, Homo sapiens
gugugaacaucccgcagua

SEQ ID NO: 1359578 - RNA, 19 nt, Homo sapiens
ggacugggaaugucuccuu

SEQ ID NO: 1359579 - RNA, 19 nt, Homo sapiens
aggauaagauaaagaguca

SEQ ID NO: 1359580 - RNA, 19 nt, Homo sapiens
uauuaacugugcuguguau

SEQ ID NO: 1359581 - RNA, 19 nt, Homo sapiens
acacaggaaugguggaaag

SEQ ID NO: 1359582 - RNA, 19 nt, Homo sapiens
auaaagagucagcgaauga

SEQ ID NO: 1359583 - RNA, 19 nt, Homo sapiens
cauguguacuuauuguaga

SEQ ID NO: 1359584 - RNA, 19 nt, Homo sapiens
uauuggauguugaucuuug

SEQ ID NO: 1359585 - RNA, 19 nt, Homo sapiens
guugguauguuguauguac

SEQ ID NO: 1359586 - RNA, 19 nt, Homo sapiens
ugccuauucuuuccaguaa

SEQ ID NO: 1359587 - RNA, 19 nt, Homo sapiens
gaagacugcuuuuguagag

SEQ ID NO: 1359588 - RNA, 19 nt, Homo sapiens
uccaggaugugaacuauuc

SEQ ID NO: 1359589 - RNA, 19 nt, Homo sapiens
agaaagucaugcauuuaca

SEQ ID NO: 1359590 - RNA, 19 nt, Homo sapiens
guugaacgcuuguuaaaua

SEQ ID NO: 1359591 - RNA, 19 nt, Homo sapiens
uaacugugcuguguauuua

SEQ ID NO: 1359592 - RNA, 19 nt, Homo sapiens
ugaagaaagucaugcauuu

SEQ ID NO: 1359593 - RNA, 19 nt, Homo sapiens
ccaaguggcuguaaaccua

SEQ ID NO: 1359594 - RNA, 19 nt, Homo sapiens
agaagaagcugaaugagaa

SEQ ID NO: 1359595 - RNA, 19 nt, Homo sapiens
gaauagugcugcaaugaau

SEQ ID NO: 1359596 - RNA, 19 nt, Homo sapiens
guagaaaguuuguaagaug

SEQ ID NO: 1359597 - RNA, 19 nt, Homo sapiens
gaagaaagucaugcauuua

SEQ ID NO: 1359598 - RNA, 19 nt, Homo sapiens
gaacaaagaagaagaagag

SEQ ID NO: 1359599 - RNA, 19 nt, Homo sapiens
agacacagcucaucccaaa

SEQ ID NO: 1359600 - RNA, 19 nt, Homo sapiens
gauguuagcagccauauug

SEQ ID NO: 1359601 - RNA, 19 nt, Homo sapiens
gaagacagugugccagaua

SEQ ID NO: 1359602 - RNA, 19 nt, Homo sapiens
gugcugcaaugaauauaua

SEQ ID NO: 1359603 - RNA, 19 nt, Homo sapiens
uagaguaacuagcucagua

SEQ ID NO: 1359604 - RNA, 19 nt, Homo sapiens
gaaguugagaguagagaua

SEQ ID NO: 1359605 - RNA, 19 nt, Homo sapiens
aaaccuagcugaagacaca

SEQ ID NO: 1359606 - RNA, 19 nt, Homo sapiens
gcauaguacccaauagaua

SEQ ID NO: 1359607 - RNA, 19 nt, Homo sapiens
uaucuacucucccuuuauu

SEQ ID NO: 1359608 - RNA, 19 nt, Homo sapiens
cgaagaagaagcugaauga

SEQ ID NO: 1359609 - RNA, 19 nt, Homo sapiens
gaacugagaacacaggaau

SEQ ID NO: 1359610 - RNA, 19 nt, Homo sapiens
uuucaaagcugcacaacuu

SEQ ID NO: 1359611 - RNA, 19 nt, Homo sapiens
ugagaaaacugaacucuuu

SEQ ID NO: 1359612 - RNA, 19 nt, Homo sapiens
gcauuuagguugauuccau

SEQ ID NO: 1359613 - RNA, 19 nt, Homo sapiens
caaacuaucgcuucauuga

SEQ ID NO: 1359614 - RNA, 19 nt, Homo sapiens
cauggguacucaauguuua

SEQ ID NO: 1359615 - RNA, 19 nt, Homo sapiens
gaauguugaacgcuuguua

SEQ ID NO: 1359616 - RNA, 19 nt, Homo sapiens
gcuauuaacugugcugugu

SEQ ID NO: 1359617 - RNA, 19 nt, Homo sapiens
agagagauuucagcacuua

SEQ ID NO: 1359618 - RNA, 19 nt, Homo sapiens
guaacuagcucaguauugg

SEQ ID NO: 1359619 - RNA, 19 nt, Homo sapiens
uaauuacgcccuuauugua

SEQ ID NO: 1359620 - RNA, 19 nt, Homo sapiens
ccaucugccuggacuauuu

SEQ ID NO: 1359621 - RNA, 19 nt, Homo sapiens
gauaaagagucagcgaaug

SEQ ID NO: 1359622 - RNA, 19 nt, Homo sapiens
gggaaugucuccuucuaca

SEQ ID NO: 1359623 - RNA, 19 nt, Homo sapiens
aaacauuacugggaaguug

SEQ ID NO: 1359624 - RNA, 19 nt, Homo sapiens
ugaagaagaggaccuguuu

SEQ ID NO: 1359625 - RNA, 19 nt, Homo sapiens
gcacuuacccuguguucug

SEQ ID NO: 1359626 - RNA, 19 nt, Homo sapiens
gggaacacgugcagguuug

SEQ ID NO: 1359627 - RNA, 19 nt, Homo sapiens
gggaauuacugaucguuca

SEQ ID NO: 1359628 - RNA, 19 nt, Homo sapiens
ugaaugagaacacguuaaa

SEQ ID NO: 1359629 - RNA, 19 nt, Homo sapiens
gaagaagagacgaagaaga

SEQ ID NO: 1359630 - RNA, 19 nt, Homo sapiens
caggaaugguggaaaggua

SEQ ID NO: 1359631 - RNA, 19 nt, Homo sapiens
aagaagagacgaagaagaa

SEQ ID NO: 1359632 - RNA, 19 nt, Homo sapiens
gcagguuuguucuauagau

SEQ ID NO: 1359633 - RNA, 19 nt, Homo sapiens
ggaccuguuucuucagaga

SEQ ID NO: 1359634 - RNA, 19 nt, Homo sapiens
acucugcccucagcuauua

SEQ ID NO: 1359635 - RNA, 19 nt, Homo sapiens
gugaacaucccgcaguaua

SEQ ID NO: 1359636 - RNA, 19 nt, Homo sapiens
gaggaccuguuucuucaga

SEQ ID NO: 1359637 - RNA, 19 nt, Homo sapiens
cuaaagggacguaguguga

SEQ ID NO: 1359638 - RNA, 19 nt, Homo sapiens
gcccucagcuauuaacugu

SEQ ID NO: 1359639 - RNA, 19 nt, Homo sapiens
ugagauaauuacgcccuua

SEQ ID NO: 1359640 - RNA, 19 nt, Homo sapiens
ggagaugggacaggaaauu

SEQ ID NO: 1359641 - RNA, 19 nt, Homo sapiens
gaggacgucaugggaauua

SEQ ID NO: 1359642 - RNA, 19 nt, Homo sapiens
ggaagggagauacgugaaa

SEQ ID NO: 1359643 - RNA, 19 nt, Homo sapiens
ggauguugaucuuuguuuc

SEQ ID NO: 1359644 - RNA, 19 nt, Homo sapiens
uaccguaacugcacuaaag

SEQ ID NO: 1359645 - RNA, 19 nt, Homo sapiens
gagaugggacaggaaauuu

SEQ ID NO: 1359646 - RNA, 19 nt, Homo sapiens
ggaaggauaagauaaagag

SEQ ID NO: 1359647 - RNA, 19 nt, Homo sapiens
gcacuacuaacauuucaau

SEQ ID NO: 1359648 - RNA, 19 nt, Homo sapiens
ucagaagcauuuauuggau

SEQ ID NO: 1359649 - RNA, 19 nt, Homo sapiens
gcugguaaauggcaguguu

SEQ ID NO: 1359650 - RNA, 19 nt, Homo sapiens
gagauugaacaaagaagaa

SEQ ID NO: 1359651 - RNA, 19 nt, Homo sapiens
gugcagguuuguucuauag

SEQ ID NO: 1359652 - RNA, 19 nt, Homo sapiens
gcagugauuuaacgaggau

SEQ ID NO: 1359653 - RNA, 19 nt, Homo sapiens
ugacaaaggcauagaaucu

SEQ ID NO: 1359654 - RNA, 19 nt, Homo sapiens
gcagccauauuggaacuga

SEQ ID NO: 1359655 - RNA, 19 nt, Homo sapiens
gggaggacgucaugggaau

SEQ ID NO: 1359656 - RNA, 19 nt, Homo sapiens
gaaaguuuguaagaugcaa

SEQ ID NO: 1359657 - RNA, 19 nt, Homo sapiens
gcaucugggcgauuuauug

SEQ ID NO: 1359658 - RNA, 19 nt, Homo sapiens
ucagaagacugcuuuugua

SEQ ID NO: 1359659 - RNA, 19 nt, Homo sapiens
gaagggagauacgugaaaa

SEQ ID NO: 1359660 - RNA, 19 nt, Homo sapiens
gaagaagaagagacgaaga

SEQ ID NO: 1359661 - RNA, 19 nt, Homo sapiens
gaacacaggaaugguggaa

SEQ ID NO: 1359662 - RNA, 19 nt, Homo sapiens
gaacucccacccagcaaga

SEQ ID NO: 1359663 - RNA, 19 nt, Homo sapiens
caaucaaacuaucgcuuca

SEQ ID NO: 1359664 - RNA, 19 nt, Homo sapiens
ggguuugguguacauauua

SEQ ID NO: 1359665 - RNA, 19 nt, Homo sapiens
cauggaagcugaggacauc

SEQ ID NO: 1359666 - RNA, 19 nt, Homo sapiens
gagaacacguuaaaacuca

SEQ ID NO: 1359667 - RNA, 19 nt, Homo sapiens
aguauuccaugguguauau

SEQ ID NO: 1359668 - RNA, 19 nt, Homo sapiens
ccauuagcaucuuuaguca

SEQ ID NO: 1359669 - RNA, 19 nt, Homo sapiens
gaacuauucccuugaagcu

SEQ ID NO: 1359670 - RNA, 19 nt, Homo sapiens
guuuagcucucccuuauac

SEQ ID NO: 1359671 - RNA, 19 nt, Homo sapiens
guccauggguacucaaugu

SEQ ID NO: 1359672 - RNA, 19 nt, Homo sapiens
gugugaacaucccgcagua

SEQ ID NO: 1359673 - RNA, 19 nt, Homo sapiens
ggacugggaaugucuccuu

SEQ ID NO: 1359674 - RNA, 19 nt, Homo sapiens
aggauaagauaaagaguca

SEQ ID NO: 1359675 - RNA, 19 nt, Homo sapiens
uauuaacugugcuguguau

SEQ ID NO: 1359676 - RNA, 19 nt, Homo sapiens
auaaagagucagcgaauga

SEQ ID NO: 1359677 - RNA, 19 nt, Homo sapiens
acacaggaaugguggaaag

SEQ ID NO: 1359678 - RNA, 19 nt, Homo sapiens
cauguguacuuauuguaga

SEQ ID NO: 1359679 - RNA, 19 nt, Homo sapiens
uauuggauguugaucuuug

SEQ ID NO: 1359680 - RNA, 19 nt, Homo sapiens
guugguauguuguauguac

SEQ ID NO: 1359681 - RNA, 19 nt, Homo sapiens
ugccuauucuuuccaguaa

SEQ ID NO: 1359682 - RNA, 19 nt, Homo sapiens
gaagacugcuuuuguagag

SEQ ID NO: 1359683 - RNA, 19 nt, Homo sapiens
uccaggaugugaacuauuc

SEQ ID NO: 1359684 - RNA, 19 nt, Homo sapiens
uggccaagaugaagaaagu

SEQ ID NO: 1359685 - RNA, 19 nt, Homo sapiens
cuuaucuacucucccuuua

SEQ ID NO: 1359686 - RNA, 19 nt, Homo sapiens
agaaagucaugcauuuaca

SEQ ID NO: 1359687 - RNA, 19 nt, Homo sapiens
gcuguguauuuaucaaguu

SEQ ID NO: 1359688 - RNA, 19 nt, Homo sapiens
gagaaucagcacggaguuu

SEQ ID NO: 1359689 - RNA, 19 nt, Homo sapiens
ggaggugggucuggccaau

SEQ ID NO: 1359690 - RNA, 19 nt, Homo sapiens
gagaggagaucguaucaua

SEQ ID NO: 1359691 - RNA, 19 nt, Homo sapiens
ggaagaggaggaagaauua

SEQ ID NO: 1359692 - RNA, 19 nt, Homo sapiens
ggaaagaggagaagaggaa

SEQ ID NO: 1359693 - RNA, 19 nt, Homo sapiens
ugaacaacauggugaauau

SEQ ID NO: 1359694 - RNA, 19 nt, Homo sapiens
ccagauggauccagauaug

SEQ ID NO: 1359695 - RNA, 19 nt, Homo sapiens
gaagagagccgggaguaug

SEQ ID NO: 1359696 - RNA, 19 nt, Homo sapiens
gcaaggcaccuauuuauac

SEQ ID NO: 1359697 - RNA, 19 nt, Homo sapiens
gagagugguuugcucauca

SEQ ID NO: 1359698 - RNA, 19 nt, Homo sapiens
gaaggagagugggcaaaug

SEQ ID NO: 1359699 - RNA, 19 nt, Homo sapiens
gcaggaggauugcuugagu

SEQ ID NO: 1359700 - RNA, 19 nt, Homo sapiens
agaagaaacuagacaguca

SEQ ID NO: 1359701 - RNA, 19 nt, Homo sapiens
gcacggccauggcguauac

SEQ ID NO: 1359702 - RNA, 19 nt, Homo sapiens
uuucucagcuguauguuaa

SEQ ID NO: 1359703 - RNA, 19 nt, Homo sapiens
gagaucguaucauaagaau

SEQ ID NO: 1359704 - RNA, 19 nt, Homo sapiens
ggagaucguaucauaagaa

SEQ ID NO: 1359705 - RNA, 19 nt, Homo sapiens
gaagaauuaguaacuguug

SEQ ID NO: 1359706 - RNA, 19 nt, Homo sapiens
gggcaaggcaccuauuuau

SEQ ID NO: 1359707 - RNA, 19 nt, Homo sapiens
gaagggagcuacgaauucg

SEQ ID NO: 1359708 - RNA, 19 nt, Homo sapiens
caugaggccuggagaugaa

SEQ ID NO: 1359709 - RNA, 19 nt, Homo sapiens
gugaauaucguuuaacaga

SEQ ID NO: 1359710 - RNA, 19 nt, Homo sapiens
ggagggagagaaugauauu

SEQ ID NO: 1359711 - RNA, 19 nt, Homo sapiens
gaugagggaaacauuaauu

SEQ ID NO: 1359712 - RNA, 19 nt, Homo sapiens
cggagaauauguuagaaau

SEQ ID NO: 1359713 - RNA, 19 nt, Homo sapiens
gcagugcuguguguaucua

SEQ ID NO: 1359714 - RNA, 19 nt, Homo sapiens
agggaaacauuaauucuga

SEQ ID NO: 1359715 - RNA, 19 nt, Homo sapiens
ggcaaggcaccuauuuaua

SEQ ID NO: 1359716 - RNA, 19 nt, Homo sapiens
gaggagggagagaaugaua

SEQ ID NO: 1359717 - RNA, 19 nt, Homo sapiens
gaucguaucauaagaaugc

SEQ ID NO: 1359718 - RNA, 19 nt, Homo sapiens
cauggugaauaucguuuaa

SEQ ID NO: 1359719 - RNA, 19 nt, Homo sapiens
ggauggaccuggccaagac

SEQ ID NO: 1359720 - RNA, 19 nt, Homo sapiens
caggggaucuacaaauuua

SEQ ID NO: 1359721 - RNA, 19 nt, Homo sapiens
gaggagaucguaucauaag

SEQ ID NO: 1359722 - RNA, 19 nt, Homo sapiens
gaagaagaaacuagacagu

SEQ ID NO: 1359723 - RNA, 19 nt, Homo sapiens
cuacccaaaucacugaauu

SEQ ID NO: 1359724 - RNA, 19 nt, Homo sapiens
ggaggaagaauuaguaacu

SEQ ID NO: 1359725 - RNA, 19 nt, Homo sapiens
ggaagaauuaguaacuguu

SEQ ID NO: 1359726 - RNA, 19 nt, Homo sapiens
gaggaagaauuaguaacug

SEQ ID NO: 1359727 - RNA, 19 nt, Homo sapiens
gagcuacgaauucgguaaa

SEQ ID NO: 1359728 - RNA, 19 nt, Homo sapiens
gggaaacauuaauucugaa

SEQ ID NO: 1359729 - RNA, 19 nt, Homo sapiens
ucagcuguauguuaaguug

SEQ ID NO: 1359730 - RNA, 19 nt, Homo sapiens
gaggaggaagaauuaguaa

SEQ ID NO: 1359731 - RNA, 19 nt, Homo sapiens
ggagagugguuugcucauc

SEQ ID NO: 1359732 - RNA, 19 nt, Homo sapiens
ugaagaagaagaaacuaga

SEQ ID NO: 1359733 - RNA, 19 nt, Homo sapiens
gccauggcguauacuacua

SEQ ID NO: 1359734 - RNA, 19 nt, Homo sapiens
gugaacaacauggugaaua

SEQ ID NO: 1359735 - RNA, 19 nt, Homo sapiens
ggaguuccgcuaugacaug

SEQ ID NO: 1359736 - RNA, 19 nt, Homo sapiens
gggaagagagccgggagua

SEQ ID NO: 1359737 - RNA, 19 nt, Homo sapiens
caacauggugaauaucguu

SEQ ID NO: 1359738 - RNA, 19 nt, Homo sapiens
ggagacgggcaguaaguau

SEQ ID NO: 1359739 - RNA, 19 nt, Homo sapiens
cgaagggagcuacgaauuc

SEQ ID NO: 1359740 - RNA, 19 nt, Homo sapiens
ggaaaguauguauuugaug

SEQ ID NO: 1359741 - RNA, 19 nt, Homo sapiens
uaaguugauugacaaaugc

SEQ ID NO: 1359742 - RNA, 19 nt, Homo sapiens
uaguaacuguuguuccaaa

SEQ ID NO: 1359743 - RNA, 19 nt, Homo sapiens
agaggaggaagaauuagua

SEQ ID NO: 1359744 - RNA, 19 nt, Homo sapiens
aaauggugcucgauauauc

SEQ ID NO: 1359745 - RNA, 19 nt, Homo sapiens
uaucggagaauauguuaga

SEQ ID NO: 1359746 - RNA, 19 nt, Homo sapiens
aaaugcuucugucaguuaa

SEQ ID NO: 1359747 - RNA, 19 nt, Homo sapiens
gagggaaacauuaauucug

SEQ ID NO: 1359748 - RNA, 19 nt, Homo sapiens
ggucaaggcacuuuuauau

SEQ ID NO: 1359749 - RNA, 19 nt, Homo sapiens
gaaugaggcaggcgaaagg

SEQ ID NO: 1359750 - RNA, 19 nt, Homo sapiens
ggacaugaggccuggagau

SEQ ID NO: 1359751 - RNA, 19 nt, Homo sapiens
auggaaagcuacccaaauc

SEQ ID NO: 1359752 - RNA, 19 nt, Homo sapiens
ugacauggaugagggaaac

SEQ ID NO: 1359753 - RNA, 19 nt, Homo sapiens
ggaagagagccgggaguau

SEQ ID NO: 1359754 - RNA, 19 nt, Homo sapiens
gaacaacauggugaauauc

SEQ ID NO: 1359755 - RNA, 19 nt, Homo sapiens
ggaggaggagggagagaau

SEQ ID NO: 1359756 - RNA, 19 nt, Homo sapiens
gagccgagaggagaucgua

SEQ ID NO: 1359757 - RNA, 19 nt, Homo sapiens
gccaggggaucuacaaauu

SEQ ID NO: 1359758 - RNA, 19 nt, Homo sapiens
caaggcaccuauuuauacg

SEQ ID NO: 1359759 - RNA, 19 nt, Homo sapiens
ggagcuacgaauucgguaa

SEQ ID NO: 1359760 - RNA, 19 nt, Homo sapiens
caggaggaguuccgcuaug

SEQ ID NO: 1359761 - RNA, 19 nt, Homo sapiens
gaaagcuacccaaaucacu

SEQ ID NO: 1359762 - RNA, 19 nt, Homo sapiens
aggaagaggaggaagaauu

SEQ ID NO: 1359763 - RNA, 19 nt, Homo sapiens
gagacgggcaguaaguaug

SEQ ID NO: 1359764 - RNA, 19 nt, Homo sapiens
uggaugagggaaacauuaa

SEQ ID NO: 1359765 - RNA, 19 nt, Homo sapiens
aggaggaguuccgcuauga

SEQ ID NO: 1359766 - RNA, 19 nt, Homo sapiens
gcacggccgagcucauuca

SEQ ID NO: 1359767 - RNA, 19 nt, Homo sapiens
gaagaagaagaaacuagac

SEQ ID NO: 1359768 - RNA, 19 nt, Homo sapiens
ggaaacauuaauucugaag

SEQ ID NO: 1359769 - RNA, 19 nt, Homo sapiens
gacaugaggccuggagaug

SEQ ID NO: 1359770 - RNA, 19 nt, Homo sapiens
ggaaugaggcaggcgaaag

SEQ ID NO: 1359771 - RNA, 19 nt, Homo sapiens
uauuugauguuggguguga

SEQ ID NO: 1359772 - RNA, 19 nt, Homo sapiens
aaggagagugggcaaauga

SEQ ID NO: 1359773 - RNA, 19 nt, Homo sapiens
gaggaguuccgcuaugaca

SEQ ID NO: 1359774 - RNA, 19 nt, Homo sapiens
uaacuguuguuccaaaaug

SEQ ID NO: 1359775 - RNA, 19 nt, Homo sapiens
aggaagaauuaguaacugu

SEQ ID NO: 1359776 - RNA, 19 nt, Homo sapiens
uggugaauaucguuuaaca

SEQ ID NO: 1359777 - RNA, 19 nt, Homo sapiens
ggaaagcuacccaaaucac

SEQ ID NO: 1359778 - RNA, 19 nt, Homo sapiens
ugacaaaugcaaauaaacg

SEQ ID NO: 1359779 - RNA, 19 nt, Homo sapiens
aagagagccgggaguauga

SEQ ID NO: 1359780 - RNA, 19 nt, Homo sapiens
gaauuaguaacuguuguuc

SEQ ID NO: 1359781 - RNA, 19 nt, Homo sapiens
ccuggaaaguauguauuug

SEQ ID NO: 1359782 - RNA, 19 nt, Homo sapiens
gugcagugcuguguguauc

SEQ ID NO: 1359783 - RNA, 19 nt, Homo sapiens
agaggagaucguaucauaa

SEQ ID NO: 1359784 - RNA, 19 nt, Homo sapiens
gaagaggaggaagaauuag

SEQ ID NO: 1359785 - RNA, 19 nt, Homo sapiens
uguuggcccuggaaaguau

SEQ ID NO: 1359786 - RNA, 19 nt, Homo sapiens
aaaaugcuucugucaguua

SEQ ID NO: 1359787 - RNA, 19 nt, Homo sapiens
gaaugcuucugucguuagc

SEQ ID NO: 1359788 - RNA, 19 nt, Homo sapiens
gccuggagaugaagaugca

SEQ ID NO: 1359789 - RNA, 19 nt, Homo sapiens
gggcuucgagggugagaug

SEQ ID NO: 1359790 - RNA, 19 nt, Homo sapiens
gaucuuggguggaguuuaa

SEQ ID NO: 1359791 - RNA, 19 nt, Homo sapiens
gcacagauccuggaaauga

SEQ ID NO: 1359792 - RNA, 19 nt, Homo sapiens
gaagacagcuaugaucuca

SEQ ID NO: 1359793 - RNA, 19 nt, Homo sapiens
cuacagaauuggcuucaua

SEQ ID NO: 1359794 - RNA, 19 nt, Homo sapiens
aaacauacuuugaccauga

SEQ ID NO: 1359795 - RNA, 19 nt, Homo sapiens
gaaugucaaucccaaggua

SEQ ID NO: 1359796 - RNA, 19 nt, Homo sapiens
caaagaaccugacccuugu

SEQ ID NO: 1359797 - RNA, 19 nt, Homo sapiens
uggaagagcuugaaaggaa

SEQ ID NO: 1359798 - RNA, 19 nt, Homo sapiens
gaaacgagggcugaucuua

SEQ ID NO: 1359799 - RNA, 19 nt, Homo sapiens
gacaagagauuaacuucug

SEQ ID NO: 1359800 - RNA, 19 nt, Homo sapiens
gcaccuuucugucuaaaug

SEQ ID NO: 1359801 - RNA, 19 nt, Homo sapiens
ucaaggaacucuucagcaa

SEQ ID NO: 1359802 - RNA, 19 nt, Homo sapiens
guacuacacuucaacgaau

SEQ ID NO: 1359803 - RNA, 19 nt, Homo sapiens
ggaagagcuugaaaggaaa

SEQ ID NO: 1359804 - RNA, 19 nt, Homo sapiens
auacuuagauggugugauu

SEQ ID NO: 1359805 - RNA, 19 nt, Homo sapiens
gaaccugacccuugucuga

SEQ ID NO: 1359806 - RNA, 19 nt, Homo sapiens
uuacggauaucuuugauga

SEQ ID NO: 1359807 - RNA, 19 nt, Homo sapiens
gggcugaucuuacuggaau

SEQ ID NO: 1359808 - RNA, 19 nt, Homo sapiens
ggugaaugcuguuuacuuc

SEQ ID NO: 1359809 - RNA, 19 nt, Homo sapiens
gcuaugaucucaauuccau

SEQ ID NO: 1359810 - RNA, 19 nt, Homo sapiens
gagcaggaauucccaaucu

SEQ ID NO: 1359811 - RNA, 19 nt, Homo sapiens
ggaugcaccuuucugucua

SEQ ID NO: 1359812 - RNA, 19 nt, Homo sapiens
caaaugggaaacauacuuu

SEQ ID NO: 1359813 - RNA, 19 nt, Homo sapiens
cagcuucucuccaaauuag

SEQ ID NO: 1359814 - RNA, 19 nt, Homo sapiens
gacaugggcauuacggaua

SEQ ID NO: 1359815 - RNA, 19 nt, Homo sapiens
uagauggugugauucaauu

SEQ ID NO: 1359816 - RNA, 19 nt, Homo sapiens
agacagcuaugaucucaau

SEQ ID NO: 1359817 - RNA, 19 nt, Homo sapiens
gaagugacagugcacauca

SEQ ID NO: 1359818 - RNA, 19 nt, Homo sapiens
gcaaggacgcuauuaaugc

SEQ ID NO: 1359819 - RNA, 19 nt, Homo sapiens
caaccacccuuuucucuuu

SEQ ID NO: 1359820 - RNA, 19 nt, Homo sapiens
aaacaagagugugaagaug

SEQ ID NO: 1359821 - RNA, 19 nt, Homo sapiens
gaugcaccuuucugucuaa

SEQ ID NO: 1359822 - RNA, 19 nt, Homo sapiens
gauuacacacugaguauug

SEQ ID NO: 1359823 - RNA, 19 nt, Homo sapiens
caacaaaacccaaaccauu

SEQ ID NO: 1359824 - RNA, 19 nt, Homo sapiens
ggaaaggucacuacgaucu

SEQ ID NO: 1359825 - RNA, 19 nt, Homo sapiens
aaaggccucuacagaauug

SEQ ID NO: 1359826 - RNA, 19 nt, Homo sapiens
caagagauaggcaaagaug

SEQ ID NO: 1359827 - RNA, 19 nt, Homo sapiens
gggcauuacggauaucuuu

SEQ ID NO: 1359828 - RNA, 19 nt, Homo sapiens
ggaaacauacuuugaccau

SEQ ID NO: 1359829 - RNA, 19 nt, Homo sapiens
uagacaggaucaagacuga

SEQ ID NO: 1359830 - RNA, 19 nt, Homo sapiens
acggauaucuuugaugaaa

SEQ ID NO: 1359831 - RNA, 19 nt, Homo sapiens
gaaaacaugucagaagaau

SEQ ID NO: 1359832 - RNA, 19 nt, Homo sapiens
ucagauugaugagguacua

SEQ ID NO: 1359833 - RNA, 19 nt, Homo sapiens
gcauuacggauaucuuuga

SEQ ID NO: 1359834 - RNA, 19 nt, Homo sapiens
aaaggaaaaucaccuauga

SEQ ID NO: 1359835 - RNA, 19 nt, Homo sapiens
gcugccaucucacucuaaa

SEQ ID NO: 1359836 - RNA, 19 nt, Homo sapiens
ugacagugcacaucagauu

SEQ ID NO: 1359837 - RNA, 19 nt, Homo sapiens
gcagcuucucuccaaauua

SEQ ID NO: 1359838 - RNA, 19 nt, Homo sapiens
uuacaagacaugggcauua

SEQ ID NO: 1359839 - RNA, 19 nt, Homo sapiens
ggcagcuucucuccaaauu

SEQ ID NO: 1359840 - RNA, 19 nt, Homo sapiens
gcuggguccuuaaacaaug

SEQ ID NO: 1359841 - RNA, 19 nt, Homo sapiens
gaaaggucacuacgaucuu

SEQ ID NO: 1359842 - RNA, 19 nt, Homo sapiens
caaggacgcuauuaaugcu

SEQ ID NO: 1359843 - RNA, 19 nt, Homo sapiens
cgauugaaaguguugauuu

SEQ ID NO: 1359844 - RNA, 19 nt, Homo sapiens
aaagcuggguccuuaaaca

SEQ ID NO: 1359845 - RNA, 19 nt, Homo sapiens
cagcaaggacgcuauuaau

SEQ ID NO: 1359846 - RNA, 19 nt, Homo sapiens
gcaggaauucccaaucugu

SEQ ID NO: 1359847 - RNA, 19 nt, Homo sapiens
cagaaaacaugucagaaga

SEQ ID NO: 1359848 - RNA, 19 nt, Homo sapiens
aaaggucacuacgaucuug

SEQ ID NO: 1359849 - RNA, 19 nt, Homo sapiens
ucggaaaggucacuacgau

SEQ ID NO: 1359850 - RNA, 19 nt, Homo sapiens
ccaaaugggaaacauacuu

SEQ ID NO: 1359851 - RNA, 19 nt, Homo sapiens
ggauaucuuugaugaaacg

SEQ ID NO: 1359852 - RNA, 19 nt, Homo sapiens
uuacagcaaacaccaaauu

SEQ ID NO: 1359853 - RNA, 19 nt, Homo sapiens
uaacuucuggguugaaugu

SEQ ID NO: 1359854 - RNA, 19 nt, Homo sapiens
aggcacagauccuggaaau

SEQ ID NO: 1359855 - RNA, 19 nt, Homo sapiens
acaagagugugaagaugau

SEQ ID NO: 1359856 - RNA, 19 nt, Homo sapiens
gguacuacacuucaacgaa

SEQ ID NO: 1359857 - RNA, 19 nt, Homo sapiens
ucagcaaggacgcuauuaa

SEQ ID NO: 1359858 - RNA, 19 nt, Homo sapiens
gaugagguacuacacuuca

SEQ ID NO: 1359859 - RNA, 19 nt, Homo sapiens
caacgaauuuucccagaau

SEQ ID NO: 1359860 - RNA, 19 nt, Homo sapiens
aaacaugucagaagaaucg

SEQ ID NO: 1359861 - RNA, 19 nt, Homo sapiens
gugaagaugaugacgcaaa

SEQ ID NO: 1359862 - RNA, 19 nt, Homo sapiens
caaauuagacaggaucaag

SEQ ID NO: 1359863 - RNA, 19 nt, Homo sapiens
cuggucagcugcuacuuug

SEQ ID NO: 1359864 - RNA, 19 nt, Homo sapiens
cccaaaccauucucuuuua

SEQ ID NO: 1359865 - RNA, 19 nt, Homo sapiens
gaaugcuguuuacuucaag

SEQ ID NO: 1359866 - RNA, 19 nt, Homo sapiens
ugucaggaauacuuagaug

SEQ ID NO: 1359867 - RNA, 19 nt, Homo sapiens
ggaaaaucaccuaugaaaa

SEQ ID NO: 1359868 - RNA, 19 nt, Homo sapiens
ccagacaagagauuaacuu

SEQ ID NO: 1359869 - RNA, 19 nt, Homo sapiens
ccucucagcugcccuuggu

SEQ ID NO: 1359870 - RNA, 19 nt, Homo sapiens
gaaggcacagauccuggaa

SEQ ID NO: 1359871 - RNA, 19 nt, Homo sapiens
acaugggcauuacggauau

SEQ ID NO: 1359872 - RNA, 19 nt, Homo sapiens
ggaagacagcuaugaucuc

SEQ ID NO: 1359873 - RNA, 19 nt, Homo sapiens
cuccaagucccaauuugua

SEQ ID NO: 1359874 - RNA, 19 nt, Homo sapiens
gaaaggaaaaucaccuaug

SEQ ID NO: 1359875 - RNA, 19 nt, Homo sapiens
gcuguugucucggaaaggu

SEQ ID NO: 1359876 - RNA, 19 nt, Homo sapiens
ugaagaugaugacgcaaaa

SEQ ID NO: 1359877 - RNA, 19 nt, Homo sapiens
gacagugcacaucagauug

SEQ ID NO: 1359878 - RNA, 19 nt, Homo sapiens
acagugcacaucagauuga

SEQ ID NO: 1359879 - RNA, 19 nt, Homo sapiens
agagauaggcaaagaugau

SEQ ID NO: 1359880 - RNA, 19 nt, Homo sapiens
aacaagagugugaagauga

SEQ ID NO: 1359881 - RNA, 19 nt, Homo sapiens
uugaugagguacuacacuu

SEQ ID NO: 1359882 - RNA, 19 nt, Homo sapiens
ccagaaugaaagcaaagaa

SEQ ID NO: 1359883 - RNA, 19 nt, Homo sapiens
uacagcaaacaccaaauuu

SEQ ID NO: 1359884 - RNA, 19 nt, Homo sapiens
aaucugucaggaauacuua

SEQ ID NO: 1359885 - RNA, 19 nt, Homo sapiens
ccaaaccauucucuuuuau

SEQ ID NO: 1359886 - RNA, 19 nt, Homo sapiens
uucaagagauaggcaaaga

SEQ ID NO: 1359887 - RNA, 19 nt, Homo sapiens
aaauuagacaggaucaaga

SEQ ID NO: 1359888 - RNA, 19 nt, Homo sapiens
gggcagcuucucuccaaau

SEQ ID NO: 1359889 - RNA, 19 nt, Homo sapiens
gggcuguugucucggaaag

SEQ ID NO: 1359890 - RNA, 19 nt, Homo sapiens
ucaaagagcugaacaguaa

SEQ ID NO: 1359891 - RNA, 19 nt, Homo sapiens
ggaaagagaaguugaagua

SEQ ID NO: 1359892 - RNA, 19 nt, Homo sapiens
ggacaaagacgauggcauu

SEQ ID NO: 1359893 - RNA, 19 nt, Homo sapiens
gagcuaaauucccuguuaa

SEQ ID NO: 1359894 - RNA, 19 nt, Homo sapiens
caaagacgauggcauuuca

SEQ ID NO: 1359895 - RNA, 19 nt, Homo sapiens
gacaagcucuucuaacaug

SEQ ID NO: 1359896 - RNA, 19 nt, Homo sapiens
ugagcuaaauucccuguua

SEQ ID NO: 1359897 - RNA, 19 nt, Homo sapiens
caaccaagggccuauauuu

SEQ ID NO: 1359898 - RNA, 19 nt, Homo sapiens
caaguaagagagacaguua

SEQ ID NO: 1359899 - RNA, 19 nt, Homo sapiens
ugacagaucucuucaacca

SEQ ID NO: 1359900 - RNA, 19 nt, Homo sapiens
aggcauagcuaaucugaaa

SEQ ID NO: 1359901 - RNA, 19 nt, Homo sapiens
gcugaacaguaacaacaua

SEQ ID NO: 1359902 - RNA, 19 nt, Homo sapiens
cagcacagcuaacguugaa

SEQ ID NO: 1359903 - RNA, 19 nt, Homo sapiens
caacauaggagauaacauc

SEQ ID NO: 1359904 - RNA, 19 nt, Homo sapiens
uauuuaagcuguucugaga

SEQ ID NO: 1359905 - RNA, 19 nt, Homo sapiens
gcacagcuaacguugaauu

SEQ ID NO: 1359906 - RNA, 19 nt, Homo sapiens
guaacaacauaggagauaa

SEQ ID NO: 1359907 - RNA, 19 nt, Homo sapiens
guaaugguccuggugaaua

SEQ ID NO: 1359908 - RNA, 19 nt, Homo sapiens
cgaauucucucaaaucaac

SEQ ID NO: 1359909 - RNA, 19 nt, Homo sapiens
aaagagaaguugaaguaca

SEQ ID NO: 1359910 - RNA, 19 nt, Homo sapiens
aaauguaacuguggaaaug

SEQ ID NO: 1359911 - RNA, 19 nt, Homo sapiens
gaaacgaggaaaaugauua

SEQ ID NO: 1359912 - RNA, 19 nt, Homo sapiens
ugaacagucuacagaagaa

SEQ ID NO: 1359913 - RNA, 19 nt, Homo sapiens
gaacaguaacaacauagga

SEQ ID NO: 1359914 - RNA, 19 nt, Homo sapiens
ccaagggccuauauuuauc

SEQ ID NO: 1359915 - RNA, 19 nt, Homo sapiens
uggacaagcucuucuaaca

SEQ ID NO: 1359916 - RNA, 19 nt, Homo sapiens
gagcacaauugacccuuca

SEQ ID NO: 1359917 - RNA, 19 nt, Homo sapiens
gggagagacugcagagcaa

SEQ ID NO: 1359918 - RNA, 19 nt, Homo sapiens
cauuuaaacuggccuuugu

SEQ ID NO: 1359919 - RNA, 19 nt, Homo sapiens
gauuaaugcuuggguugaa

SEQ ID NO: 1359920 - RNA, 19 nt, Homo sapiens
gaagaaacgaggaaaauga

SEQ ID NO: 1359921 - RNA, 19 nt, Homo sapiens
cagccagacucuaacugua

SEQ ID NO: 1359922 - RNA, 19 nt, Homo sapiens
cgaguuuggugucgaauuc

SEQ ID NO: 1359923 - RNA, 19 nt, Homo sapiens
aaccaagggccuauauuua

SEQ ID NO: 1359924 - RNA, 19 nt, Homo sapiens
aagcugaucuuucuggaau

SEQ ID NO: 1359925 - RNA, 19 nt, Homo sapiens
uaaaggagccgcagaugca

SEQ ID NO: 1359926 - RNA, 19 nt, Homo sapiens
ggacaaaggcaaaauaaau

SEQ ID NO: 1359927 - RNA, 19 nt, Homo sapiens
gagcugaacaguaacaaca

SEQ ID NO: 1359928 - RNA, 19 nt, Homo sapiens
caauugacccuucaucugu

SEQ ID NO: 1359929 - RNA, 19 nt, Homo sapiens
ucagcuaagugaagguaaa

SEQ ID NO: 1359930 - RNA, 19 nt, Homo sapiens
ggugacagaucucuucaac

SEQ ID NO: 1359931 - RNA, 19 nt, Homo sapiens
caagccagguugcaaacug

SEQ ID NO: 1359932 - RNA, 19 nt, Homo sapiens
ggugucgaauucucucaaa

SEQ ID NO: 1359933 - RNA, 19 nt, Homo sapiens
ucaaccagccagacucuaa

SEQ ID NO: 1359934 - RNA, 19 nt, Homo sapiens
ggacaagcucuucuaacau

SEQ ID NO: 1359935 - RNA, 19 nt, Homo sapiens
gcccuacguuaacaacaaa

SEQ ID NO: 1359936 - RNA, 19 nt, Homo sapiens
gagcugcccuacguuaaca

SEQ ID NO: 1359937 - RNA, 19 nt, Homo sapiens
gucgaauucucucaaauca

SEQ ID NO: 1359938 - RNA, 19 nt, Homo sapiens
ccaacacgauccuauucug

SEQ ID NO: 1359939 - RNA, 19 nt, Homo sapiens
gauggaaagagaaguugaa

SEQ ID NO: 1359940 - RNA, 19 nt, Homo sapiens
caagcuugccucucccuaa

SEQ ID NO: 1359941 - RNA, 19 nt, Homo sapiens
uaacuguacccucagcauu

SEQ ID NO: 1359942 - RNA, 19 nt, Homo sapiens
gggccuauauuuaucaaaa

SEQ ID NO: 1359943 - RNA, 19 nt, Homo sapiens
uaacaugauggaaagagaa

SEQ ID NO: 1359944 - RNA, 19 nt, Homo sapiens
cuaacaugauggaaagaga

SEQ ID NO: 1359945 - RNA, 19 nt, Homo sapiens
caagcuggaagaauucauu

SEQ ID NO: 1359946 - RNA, 19 nt, Homo sapiens
cagcuaacguugaauuuug

SEQ ID NO: 1359947 - RNA, 19 nt, Homo sapiens
gagagacugcagagcaauu

SEQ ID NO: 1359948 - RNA, 19 nt, Homo sapiens
ccacaagucauaccuggau

SEQ ID NO: 1359949 - RNA, 19 nt, Homo sapiens
gcauagcuaaucugaaaca

SEQ ID NO: 1359950 - RNA, 19 nt, Homo sapiens
uaaugguccuggugaauac

SEQ ID NO: 1359951 - RNA, 19 nt, Homo sapiens
gaacagucuacagaagaaa

SEQ ID NO: 1359952 - RNA, 19 nt, Homo sapiens
ucugagaaaugguaucaag

SEQ ID NO: 1359953 - RNA, 19 nt, Homo sapiens
uuuauaaggcacacucaua

SEQ ID NO: 1359954 - RNA, 19 nt, Homo sapiens
gcugaucuuucuggaaugu

SEQ ID NO: 1359955 - RNA, 19 nt, Homo sapiens
guaggcauagcuaaucuga

SEQ ID NO: 1359956 - RNA, 19 nt, Homo sapiens
aauugacccuucaucugua

SEQ ID NO: 1359957 - RNA, 19 nt, Homo sapiens
caaaagccauccacaaguc

SEQ ID NO: 1359958 - RNA, 19 nt, Homo sapiens
uaacuguggaaaugaugua

SEQ ID NO: 1359959 - RNA, 19 nt, Homo sapiens
gacaaagacgauggcauuu

SEQ ID NO: 1359960 - RNA, 19 nt, Homo sapiens
caacacgauccuauucugu

SEQ ID NO: 1359961 - RNA, 19 nt, Homo sapiens
gaaagagaaguugaaguac

SEQ ID NO: 1359962 - RNA, 19 nt, Homo sapiens
uaucaagccagguugcaaa

SEQ ID NO: 1359963 - RNA, 19 nt, Homo sapiens
caucagcaauauuuaagcu

SEQ ID NO: 1359964 - RNA, 19 nt, Homo sapiens
gucauacuguagacucauu

SEQ ID NO: 1359965 - RNA, 19 nt, Homo sapiens
cuucuaacaugauggaaag

SEQ ID NO: 1359966 - RNA, 19 nt, Homo sapiens
uggcauuucaucagcaaua

SEQ ID NO: 1359967 - RNA, 19 nt, Homo sapiens
accaagggccuauauuuau

SEQ ID NO: 1359968 - RNA, 19 nt, Homo sapiens
gcacaauugacccuucauc

SEQ ID NO: 1359969 - RNA, 19 nt, Homo sapiens
gguugcaaacuguggauuu

SEQ ID NO: 1359970 - RNA, 19 nt, Homo sapiens
ggcauuucaucagcaauau

SEQ ID NO: 1359971 - RNA, 19 nt, Homo sapiens
ccuauucuguggcaagcuu

SEQ ID NO: 1359972 - RNA, 19 nt, Homo sapiens
uagaaaagcagcugaauuc

SEQ ID NO: 1359973 - RNA, 19 nt, Homo sapiens
caagggccuauauuuauca

SEQ ID NO: 1359974 - RNA, 19 nt, Homo sapiens
aguaagagagacaguuaaa

SEQ ID NO: 1359975 - RNA, 19 nt, Homo sapiens
gugcuucauuuuagucaua

SEQ ID NO: 1359976 - RNA, 19 nt, Homo sapiens
caugauggaaagagaaguu

SEQ ID NO: 1359977 - RNA, 19 nt, Homo sapiens
cuacagaagaaacgaggaa

SEQ ID NO: 1359978 - RNA, 19 nt, Homo sapiens
gcauuucaucagcaauauu

SEQ ID NO: 1359979 - RNA, 19 nt, Homo sapiens
cugcagagcaauuggagaa

SEQ ID NO: 1359980 - RNA, 19 nt, Homo sapiens
uucaaggacucaccuaagu

SEQ ID NO: 1359981 - RNA, 19 nt, Homo sapiens
gaguggacaagcucuucua

SEQ ID NO: 1359982 - RNA, 19 nt, Homo sapiens
aguaacaacauaggagaua

SEQ ID NO: 1359983 - RNA, 19 nt, Homo sapiens
uaaggcacacucauaccaa

SEQ ID NO: 1359984 - RNA, 19 nt, Homo sapiens
ugaaacagauagaaaagca

SEQ ID NO: 1359985 - RNA, 19 nt, Homo sapiens
cagagcaauuggagaaggu

SEQ ID NO: 1359986 - RNA, 19 nt, Homo sapiens
caaaucaaccagccagacu

SEQ ID NO: 1359987 - RNA, 19 nt, Homo sapiens
acaagcucuucuaacauga

SEQ ID NO: 1359988 - RNA, 19 nt, Homo sapiens
ugaucuuucuggaauguca

SEQ ID NO: 1359989 - RNA, 19 nt, Homo sapiens
aagagaaguugaaguacac

SEQ ID NO: 1359990 - RNA, 19 nt, Homo sapiens
gaaccgcccuccugauuaa

SEQ ID NO: 1359991 - RNA, 19 nt, Homo sapiens
gagcaggacucccaccuaa

SEQ ID NO: 1359992 - RNA, 19 nt, Homo sapiens
ggaaccgcccuccugauua

SEQ ID NO: 1359993 - RNA, 19 nt, Homo sapiens
ggaacuacguggagaucau

SEQ ID NO: 1359994 - RNA, 19 nt, Homo sapiens
gcagaacuccuaccugaag

SEQ ID NO: 1359995 - RNA, 19 nt, Homo sapiens
gggaaccgcccuccugauu

SEQ ID NO: 1359996 - RNA, 19 nt, Homo sapiens
gcugcgaggugaagacaug

SEQ ID NO: 1359997 - RNA, 19 nt, Homo sapiens
cagagcugcuggucucauu

SEQ ID NO: 1359998 - RNA, 19 nt, Homo sapiens
gcgaggacaucgaguuugg

SEQ ID NO: 1359999 - RNA, 19 nt, Homo sapiens
gauggugucucgggaguuc

SEQ ID NO: 1360000 - RNA, 19 nt, Homo sapiens
gguguggccuuugcaguga

SEQ ID NO: 1360001 - RNA, 19 nt, Homo sapiens
gaagugccgcugcguguuc

SEQ ID NO: 1360002 - RNA, 19 nt, Homo sapiens
uggcgggacuggagaaaug

SEQ ID NO: 1360003 - RNA, 19 nt, Homo sapiens
gcagugacacgcucaugug

SEQ ID NO: 1360004 - RNA, 19 nt, Homo sapiens
gcaggacucccaccuaaac

SEQ ID NO: 1360005 - RNA, 19 nt, Homo sapiens
gaugcccgcucagccauga

SEQ ID NO: 1360006 - RNA, 19 nt, Homo sapiens
gaacuacguggagaucaug

SEQ ID NO: 1360007 - RNA, 19 nt, Homo sapiens
gccauccucugccucaaau

SEQ ID NO: 1360008 - RNA, 19 nt, Homo sapiens
gagcugcuggucucauuug

SEQ ID NO: 1360009 - RNA, 19 nt, Homo sapiens
uaagggaaagguaggaaga

SEQ ID NO: 1360010 - RNA, 19 nt, Homo sapiens
uggcugggcugcuccugaa

SEQ ID NO: 1360011 - RNA, 19 nt, Homo sapiens
gccgagggcaucaagauug

SEQ ID NO: 1360012 - RNA, 19 nt, Homo sapiens
gcgucgagcugggaagguu

SEQ ID NO: 1360013 - RNA, 19 nt, Homo sapiens
gcgcuacaccuacuucaag

SEQ ID NO: 1360014 - RNA, 19 nt, Homo sapiens
uagcgaggacaucgaguuu

SEQ ID NO: 1360015 - RNA, 19 nt, Homo sapiens
ugccucaaauucugcguuu

SEQ ID NO: 1360016 - RNA, 19 nt, Homo sapiens
gccaugaaccgccacaaca

SEQ ID NO: 1360017 - RNA, 19 nt, Homo sapiens
gcgccuggcuuuggaaugc

SEQ ID NO: 1360018 - RNA, 19 nt, Homo sapiens
cggagauggugguggagaa

SEQ ID NO: 1360019 - RNA, 19 nt, Homo sapiens
guagcgaggacaucgaguu

SEQ ID NO: 1360020 - RNA, 19 nt, Homo sapiens
ccaugaaccgccacaacaa

SEQ ID NO: 1360021 - RNA, 19 nt, Homo sapiens
uaucugaugcugcuauauc

SEQ ID NO: 1360022 - RNA, 19 nt, Homo sapiens
ggcacuagguaggcuucua

SEQ ID NO: 1360023 - RNA, 19 nt, Homo sapiens
ccacucggauacuucuuac

SEQ ID NO: 1360024 - RNA, 19 nt, Homo sapiens
gcucccacaccgucaggua

SEQ ID NO: 1360025 - RNA, 19 nt, Homo sapiens
ccagggagucggccuuugu

SEQ ID NO: 1360026 - RNA, 19 nt, Homo sapiens
gcaucaagauuggcaucca

SEQ ID NO: 1360027 - RNA, 19 nt, Homo sapiens
cuccagagcaggaaauuca

SEQ ID NO: 1360028 - RNA, 19 nt, Homo sapiens
cugggcugcuccugaauga

SEQ ID NO: 1360029 - RNA, 19 nt, Homo sapiens
cauccucugccucaaauuc

SEQ ID NO: 1360030 - RNA, 19 nt, Homo sapiens
cccacucggauacuucuua

SEQ ID NO: 1360031 - RNA, 19 nt, Homo sapiens
gcaggaacuacguggagau

SEQ ID NO: 1360032 - RNA, 19 nt, Homo sapiens
ggccgagggcaucaagauu

SEQ ID NO: 1360033 - RNA, 19 nt, Homo sapiens
ccgagggcaucaagauugg

SEQ ID NO: 1360034 - RNA, 19 nt, Homo sapiens
gacacgcucaugugcagaa

SEQ ID NO: 1360035 - RNA, 19 nt, Homo sapiens
ccgcuuuccuggagccaau

SEQ ID NO: 1360036 - RNA, 19 nt, Homo sapiens
agggaaagguaggaagaga

SEQ ID NO: 1360037 - RNA, 19 nt, Homo sapiens
gaacugauaucugauguuu

SEQ ID NO: 1360038 - RNA, 19 nt, Homo sapiens
gaacucgacuugucugaaa

SEQ ID NO: 1360039 - RNA, 19 nt, Homo sapiens
gggcaagccuuaauaauau

SEQ ID NO: 1360040 - RNA, 19 nt, Homo sapiens
gagcgagugucccuaaaua

SEQ ID NO: 1360041 - RNA, 19 nt, Homo sapiens
gaagggaguuugggcuuua

SEQ ID NO: 1360042 - RNA, 19 nt, Homo sapiens
gagcacaucugcccugaaa

SEQ ID NO: 1360043 - RNA, 19 nt, Homo sapiens
uaagaggcauggaaauaua

SEQ ID NO: 1360044 - RNA, 19 nt, Homo sapiens
ccagagcacuugauaaaga

SEQ ID NO: 1360045 - RNA, 19 nt, Homo sapiens
ggaugaaucucuacacuca

SEQ ID NO: 1360046 - RNA, 19 nt, Homo sapiens
gcagacagccacagugaua

SEQ ID NO: 1360047 - RNA, 19 nt, Homo sapiens
ccaaggcacugauguuuga

SEQ ID NO: 1360048 - RNA, 19 nt, Homo sapiens
ggaaggaacuagucuuucu

SEQ ID NO: 1360049 - RNA, 19 nt, Homo sapiens
gcaccuggauuaacucaga

SEQ ID NO: 1360050 - RNA, 19 nt, Homo sapiens
gaacucuacucaaaucuag

SEQ ID NO: 1360051 - RNA, 19 nt, Homo sapiens
ugacgaagcuuguccagau

SEQ ID NO: 1360052 - RNA, 19 nt, Homo sapiens
caaguucucugcugugguu

SEQ ID NO: 1360053 - RNA, 19 nt, Homo sapiens
gagacagacugcaggauga

SEQ ID NO: 1360054 - RNA, 19 nt, Homo sapiens
gccacaagcuuccaaguug

SEQ ID NO: 1360055 - RNA, 19 nt, Homo sapiens
gaagcuaggauaaauguug

SEQ ID NO: 1360056 - RNA, 19 nt, Homo sapiens
ugacaaagguaaggguuaa

SEQ ID NO: 1360057 - RNA, 19 nt, Homo sapiens
ggaguuguccgcuguguuu

SEQ ID NO: 1360058 - RNA, 19 nt, Homo sapiens
gcacaucugcccugaaaga

SEQ ID NO: 1360059 - RNA, 19 nt, Homo sapiens
caagagcuggcauuuguua

SEQ ID NO: 1360060 - RNA, 19 nt, Homo sapiens
cugcuaggauucucuguua

SEQ ID NO: 1360061 - RNA, 19 nt, Homo sapiens
gaagaaggcgauccaacaa

SEQ ID NO: 1360062 - RNA, 19 nt, Homo sapiens
cuuuagagaucccuuuaua

SEQ ID NO: 1360063 - RNA, 19 nt, Homo sapiens
ggaagggaguuugggcuuu

SEQ ID NO: 1360064 - RNA, 19 nt, Homo sapiens
ggucacagcuagggagaaa

SEQ ID NO: 1360065 - RNA, 19 nt, Homo sapiens
ggauaaauguugucuuacu

SEQ ID NO: 1360066 - RNA, 19 nt, Homo sapiens
ucagcuaguuggauucuuu

SEQ ID NO: 1360067 - RNA, 19 nt, Homo sapiens
ggaagaaggcgauccaaca

SEQ ID NO: 1360068 - RNA, 19 nt, Homo sapiens
ccucaguucuauuacguua

SEQ ID NO: 1360069 - RNA, 19 nt, Homo sapiens
ccuacaacuucacacauua

SEQ ID NO: 1360070 - RNA, 19 nt, Homo sapiens
cagcgaagacaacuuuaua

SEQ ID NO: 1360071 - RNA, 19 nt, Homo sapiens
gagcagcaccuacaacuuc

SEQ ID NO: 1360072 - RNA, 19 nt, Homo sapiens
gacaaggucucuagcaucu

SEQ ID NO: 1360073 - RNA, 19 nt, Homo sapiens
gcaagcgguuucuggauca

SEQ ID NO: 1360074 - RNA, 19 nt, Homo sapiens
gcuaggauucucuguuaua

SEQ ID NO: 1360075 - RNA, 19 nt, Homo sapiens
uagacaagcuagaaauuuc

SEQ ID NO: 1360076 - RNA, 19 nt, Homo sapiens
ccacuugguugaauucugu

SEQ ID NO: 1360077 - RNA, 19 nt, Homo sapiens
ccacagugauacuuaggaa

SEQ ID NO: 1360078 - RNA, 19 nt, Homo sapiens
gaaguccaccugaaagaga

SEQ ID NO: 1360079 - RNA, 19 nt, Homo sapiens
gaaaccagaggaauggauu

SEQ ID NO: 1360080 - RNA, 19 nt, Homo sapiens
caaagccuauccguguaua

SEQ ID NO: 1360081 - RNA, 19 nt, Homo sapiens
gagauuccauuugagaguu

SEQ ID NO: 1360082 - RNA, 19 nt, Homo sapiens
ggaaauggccucaggucau

SEQ ID NO: 1360083 - RNA, 19 nt, Homo sapiens
agaaggcgauccaacaaga

SEQ ID NO: 1360084 - RNA, 19 nt, Homo sapiens
uaugaugguuccaagguaa

SEQ ID NO: 1360085 - RNA, 19 nt, Homo sapiens
guaagaggcauggaaauau

SEQ ID NO: 1360086 - RNA, 19 nt, Homo sapiens
cgaagacaacuuuauaaug

SEQ ID NO: 1360087 - RNA, 19 nt, Homo sapiens
gauaaauguugucuuacuc

SEQ ID NO: 1360088 - RNA, 19 nt, Homo sapiens
aauaggaguuuacaagaug

SEQ ID NO: 1360089 - RNA, 19 nt, Homo sapiens
guuauugccucgcuuagau

SEQ ID NO: 1360090 - RNA, 19 nt, Homo sapiens
gcaaggaagggaaguggaa

SEQ ID NO: 1360091 - RNA, 19 nt, Homo sapiens
uccaagggcuagaaauaaa

SEQ ID NO: 1360092 - RNA, 19 nt, Homo sapiens
ggaacucuacucaaaucua

SEQ ID NO: 1360093 - RNA, 19 nt, Homo sapiens
aagaagaacucgacuuguc

SEQ ID NO: 1360094 - RNA, 19 nt, Homo sapiens
gaccaaagaggaagccauu

SEQ ID NO: 1360095 - RNA, 19 nt, Homo sapiens
aggauucucuguuauaguu

SEQ ID NO: 1360096 - RNA, 19 nt, Homo sapiens
guaaggaccgucuguuugu

SEQ ID NO: 1360097 - RNA, 19 nt, Homo sapiens
gguaaggaccgucuguuug

SEQ ID NO: 1360098 - RNA, 19 nt, Homo sapiens
ggaguucugaguaauuaaa

SEQ ID NO: 1360099 - RNA, 19 nt, Homo sapiens
cagagcacuugauaaagaa

SEQ ID NO: 1360100 - RNA, 19 nt, Homo sapiens
ugaaaaggccccucuauuu

SEQ ID NO: 1360101 - RNA, 19 nt, Homo sapiens
ccugaugcauagcgaauuu

SEQ ID NO: 1360102 - RNA, 19 nt, Homo sapiens
aaaguaaaguccugaaacu

SEQ ID NO: 1360103 - RNA, 19 nt, Homo sapiens
ggaacuagucuuucuccaa

SEQ ID NO: 1360104 - RNA, 19 nt, Homo sapiens
ccauuagucuccacgaguu

SEQ ID NO: 1360105 - RNA, 19 nt, Homo sapiens
gaaggcagcccgcauucug

SEQ ID NO: 1360106 - RNA, 19 nt, Homo sapiens
gagcuggcauuuguuacuu

SEQ ID NO: 1360107 - RNA, 19 nt, Homo sapiens
gaggaauggauuugacuuu

SEQ ID NO: 1360108 - RNA, 19 nt, Homo sapiens
uaaggaccgucuguuugua

SEQ ID NO: 1360109 - RNA, 19 nt, Homo sapiens
cuggaguucugaguaauua

SEQ ID NO: 1360110 - RNA, 19 nt, Homo sapiens
uuucauaucuccugcuguu

SEQ ID NO: 1360111 - RNA, 19 nt, Homo sapiens
ggaaauauacaugaaacug

SEQ ID NO: 1360112 - RNA, 19 nt, Homo sapiens
gcgaagacaacuuuauaau

SEQ ID NO: 1360113 - RNA, 19 nt, Homo sapiens
uguuggaacucuacucaaa

SEQ ID NO: 1360114 - RNA, 19 nt, Homo sapiens
uacuugagauuccauuuga

SEQ ID NO: 1360115 - RNA, 19 nt, Homo sapiens
gcugagcccugagaauuca

SEQ ID NO: 1360116 - RNA, 19 nt, Homo sapiens
gaggaugaaucucuacacu

SEQ ID NO: 1360117 - RNA, 19 nt, Homo sapiens
uauaaaggacugauuguca

SEQ ID NO: 1360118 - RNA, 19 nt, Homo sapiens
caacaagagcuggcauuug

SEQ ID NO: 1360119 - RNA, 19 nt, Homo sapiens
guacuugagauuccauuug

SEQ ID NO: 1360120 - RNA, 19 nt, Homo sapiens
gagccugagguauuucaua

SEQ ID NO: 1360121 - RNA, 19 nt, Homo sapiens
gccaugaucuggagagcau

SEQ ID NO: 1360122 - RNA, 19 nt, Homo sapiens
uggaucagcuaguuggauu

SEQ ID NO: 1360123 - RNA, 19 nt, Homo sapiens
uguaagaggcauggaaaua

SEQ ID NO: 1360124 - RNA, 19 nt, Homo sapiens
uauaguuucucccugaguu

SEQ ID NO: 1360125 - RNA, 19 nt, Homo sapiens
ggauuugacuuuucugcua

SEQ ID NO: 1360126 - RNA, 19 nt, Homo sapiens
ugucauuuguguugugaaa

SEQ ID NO: 1360127 - RNA, 19 nt, Homo sapiens
ggguaaggaccgucuguuu

SEQ ID NO: 1360128 - RNA, 19 nt, Homo sapiens
ugauggagauuaccuuugg

SEQ ID NO: 1360129 - RNA, 19 nt, Homo sapiens
ggacagauugcuggaguug

SEQ ID NO: 1360130 - RNA, 19 nt, Homo sapiens
ggccagcgaagacaacuuu

SEQ ID NO: 1360131 - RNA, 19 nt, Homo sapiens
uuacuccucugcuauguuc

SEQ ID NO: 1360132 - RNA, 19 nt, Homo sapiens
caggaucucugcugucucu

SEQ ID NO: 1360133 - RNA, 19 nt, Homo sapiens
ggggcaagccuuaauaaua

SEQ ID NO: 1360134 - RNA, 19 nt, Homo sapiens
gaauucuguuggaacucua

SEQ ID NO: 1360135 - RNA, 19 nt, Homo sapiens
ggaccuguuucccuagcuu

SEQ ID NO: 1360136 - RNA, 19 nt, Homo sapiens
ugucucacguugucuuuga

SEQ ID NO: 1360137 - RNA, 19 nt, Homo sapiens
gaacugauaucugauguuu

SEQ ID NO: 1360138 - RNA, 19 nt, Homo sapiens
gaacucgacuugucugaaa

SEQ ID NO: 1360139 - RNA, 19 nt, Homo sapiens
gggcaagccuuaauaauau

SEQ ID NO: 1360140 - RNA, 19 nt, Homo sapiens
gagcgagugucccuaaaua

SEQ ID NO: 1360141 - RNA, 19 nt, Homo sapiens
gaagggaguuugggcuuua

SEQ ID NO: 1360142 - RNA, 19 nt, Homo sapiens
gagcacaucugcccugaaa

SEQ ID NO: 1360143 - RNA, 19 nt, Homo sapiens
uaagaggcauggaaauaua

SEQ ID NO: 1360144 - RNA, 19 nt, Homo sapiens
ccagagcacuugauaaaga

SEQ ID NO: 1360145 - RNA, 19 nt, Homo sapiens
ggaugaaucucuacacuca

SEQ ID NO: 1360146 - RNA, 19 nt, Homo sapiens
gcagacagccacagugaua

SEQ ID NO: 1360147 - RNA, 19 nt, Homo sapiens
ccaaggcacugauguuuga

SEQ ID NO: 1360148 - RNA, 19 nt, Homo sapiens
ggaaggaacuagucuuucu

SEQ ID NO: 1360149 - RNA, 19 nt, Homo sapiens
gcaccuggauuaacucaga

SEQ ID NO: 1360150 - RNA, 19 nt, Homo sapiens
gaacucuacucaaaucuag

SEQ ID NO: 1360151 - RNA, 19 nt, Homo sapiens
ugacgaagcuuguccagau

SEQ ID NO: 1360152 - RNA, 19 nt, Homo sapiens
caaguucucugcugugguu

SEQ ID NO: 1360153 - RNA, 19 nt, Homo sapiens
gagacagacugcaggauga

SEQ ID NO: 1360154 - RNA, 19 nt, Homo sapiens
gccacaagcuuccaaguug

SEQ ID NO: 1360155 - RNA, 19 nt, Homo sapiens
gaagcuaggauaaauguug

SEQ ID NO: 1360156 - RNA, 19 nt, Homo sapiens
ugacaaagguaaggguuaa

SEQ ID NO: 1360157 - RNA, 19 nt, Homo sapiens
ggaguuguccgcuguguuu

SEQ ID NO: 1360158 - RNA, 19 nt, Homo sapiens
gcacaucugcccugaaaga

SEQ ID NO: 1360159 - RNA, 19 nt, Homo sapiens
caagagcuggcauuuguua

SEQ ID NO: 1360160 - RNA, 19 nt, Homo sapiens
cugcuaggauucucuguua

SEQ ID NO: 1360161 - RNA, 19 nt, Homo sapiens
gaagaaggcgauccaacaa

SEQ ID NO: 1360162 - RNA, 19 nt, Homo sapiens
cuuuagagaucccuuuaua

SEQ ID NO: 1360163 - RNA, 19 nt, Homo sapiens
ggaagggaguuugggcuuu

SEQ ID NO: 1360164 - RNA, 19 nt, Homo sapiens
ggucacagcuagggagaaa

SEQ ID NO: 1360165 - RNA, 19 nt, Homo sapiens
ggauaaauguugucuuacu

SEQ ID NO: 1360166 - RNA, 19 nt, Homo sapiens
ucagcuaguuggauucuuu

SEQ ID NO: 1360167 - RNA, 19 nt, Homo sapiens
ggaagaaggcgauccaaca

SEQ ID NO: 1360168 - RNA, 19 nt, Homo sapiens
ccucaguucuauuacguua

SEQ ID NO: 1360169 - RNA, 19 nt, Homo sapiens
ccuacaacuucacacauua

SEQ ID NO: 1360170 - RNA, 19 nt, Homo sapiens
cagcgaagacaacuuuaua

SEQ ID NO: 1360171 - RNA, 19 nt, Homo sapiens
gagcagcaccuacaacuuc

SEQ ID NO: 1360172 - RNA, 19 nt, Homo sapiens
gacaaggucucuagcaucu

SEQ ID NO: 1360173 - RNA, 19 nt, Homo sapiens
uagacaagcuagaaauuuc

SEQ ID NO: 1360174 - RNA, 19 nt, Homo sapiens
gcaagcgguuucuggauca

SEQ ID NO: 1360175 - RNA, 19 nt, Homo sapiens
gcuaggauucucuguuaua

SEQ ID NO: 1360176 - RNA, 19 nt, Homo sapiens
ccacuugguugaauucugu

SEQ ID NO: 1360177 - RNA, 19 nt, Homo sapiens
guacaacccuuuccccuuu

SEQ ID NO: 1360178 - RNA, 19 nt, Homo sapiens
ccacagugauacuuaggaa

SEQ ID NO: 1360179 - RNA, 19 nt, Homo sapiens
gaaguccaccugaaagaga

SEQ ID NO: 1360180 - RNA, 19 nt, Homo sapiens
gaaaccagaggaauggauu

SEQ ID NO: 1360181 - RNA, 19 nt, Homo sapiens
caaagccuauccguguaua

SEQ ID NO: 1360182 - RNA, 19 nt, Homo sapiens
gagauuccauuugagaguu

SEQ ID NO: 1360183 - RNA, 19 nt, Homo sapiens
ggaaauggccucaggucau

SEQ ID NO: 1360184 - RNA, 19 nt, Homo sapiens
agaaggcgauccaacaaga

SEQ ID NO: 1360185 - RNA, 19 nt, Homo sapiens
uaugaugguuccaagguaa

SEQ ID NO: 1360186 - RNA, 19 nt, Homo sapiens
guaagaggcauggaaauau

SEQ ID NO: 1360187 - RNA, 19 nt, Homo sapiens
cgaagacaacuuuauaaug

SEQ ID NO: 1360188 - RNA, 19 nt, Homo sapiens
gauaaauguugucuuacuc

SEQ ID NO: 1360189 - RNA, 19 nt, Homo sapiens
aauaggaguuuacaagaug

SEQ ID NO: 1360190 - RNA, 19 nt, Homo sapiens
guuauugccucgcuuagau

SEQ ID NO: 1360191 - RNA, 19 nt, Homo sapiens
gcaaggaagggaaguggaa

SEQ ID NO: 1360192 - RNA, 19 nt, Homo sapiens
uccaagggcuagaaauaaa

SEQ ID NO: 1360193 - RNA, 19 nt, Homo sapiens
ggaacucuacucaaaucua

SEQ ID NO: 1360194 - RNA, 19 nt, Homo sapiens
aagaagaacucgacuuguc

SEQ ID NO: 1360195 - RNA, 19 nt, Homo sapiens
gaccaaagaggaagccauu

SEQ ID NO: 1360196 - RNA, 19 nt, Homo sapiens
aggauucucuguuauaguu

SEQ ID NO: 1360197 - RNA, 19 nt, Homo sapiens
guaaggaccgucuguuugu

SEQ ID NO: 1360198 - RNA, 19 nt, Homo sapiens
gguaaggaccgucuguuug

SEQ ID NO: 1360199 - RNA, 19 nt, Homo sapiens
ggaguucugaguaauuaaa

SEQ ID NO: 1360200 - RNA, 19 nt, Homo sapiens
cagagcacuugauaaagaa

SEQ ID NO: 1360201 - RNA, 19 nt, Homo sapiens
ugaaaaggccccucuauuu

SEQ ID NO: 1360202 - RNA, 19 nt, Homo sapiens
ccugaugcauagcgaauuu

SEQ ID NO: 1360203 - RNA, 19 nt, Homo sapiens
aaaguaaaguccugaaacu

SEQ ID NO: 1360204 - RNA, 19 nt, Homo sapiens
ggaacuagucuuucuccaa

SEQ ID NO: 1360205 - RNA, 19 nt, Homo sapiens
ccauuagucuccacgaguu

SEQ ID NO: 1360206 - RNA, 19 nt, Homo sapiens
gaaggcagcccgcauucug

SEQ ID NO: 1360207 - RNA, 19 nt, Homo sapiens
gagcuggcauuuguuacuu

SEQ ID NO: 1360208 - RNA, 19 nt, Homo sapiens
gaggaauggauuugacuuu

SEQ ID NO: 1360209 - RNA, 19 nt, Homo sapiens
uaaggaccgucuguuugua

SEQ ID NO: 1360210 - RNA, 19 nt, Homo sapiens
cuggaguucugaguaauua

SEQ ID NO: 1360211 - RNA, 19 nt, Homo sapiens
uuucauaucuccugcuguu

SEQ ID NO: 1360212 - RNA, 19 nt, Homo sapiens
ggaaauauacaugaaacug

SEQ ID NO: 1360213 - RNA, 19 nt, Homo sapiens
gcgaagacaacuuuauaau

SEQ ID NO: 1360214 - RNA, 19 nt, Homo sapiens
uguuggaacucuacucaaa

SEQ ID NO: 1360215 - RNA, 19 nt, Homo sapiens
uacuugagauuccauuuga

SEQ ID NO: 1360216 - RNA, 19 nt, Homo sapiens
gcugagcccugagaauuca

SEQ ID NO: 1360217 - RNA, 19 nt, Homo sapiens
gaggaugaaucucuacacu

SEQ ID NO: 1360218 - RNA, 19 nt, Homo sapiens
uauaaaggacugauuguca

SEQ ID NO: 1360219 - RNA, 19 nt, Homo sapiens
caacaagagcuggcauuug

SEQ ID NO: 1360220 - RNA, 19 nt, Homo sapiens
guacuugagauuccauuug

SEQ ID NO: 1360221 - RNA, 19 nt, Homo sapiens
gagccugagguauuucaua

SEQ ID NO: 1360222 - RNA, 19 nt, Homo sapiens
gccaugaucuggagagcau

SEQ ID NO: 1360223 - RNA, 19 nt, Homo sapiens
uggaucagcuaguuggauu

SEQ ID NO: 1360224 - RNA, 19 nt, Homo sapiens
uguaagaggcauggaaaua

SEQ ID NO: 1360225 - RNA, 19 nt, Homo sapiens
ggauuugacuuuucugcua

SEQ ID NO: 1360226 - RNA, 19 nt, Homo sapiens
uauaguuucucccugaguu

SEQ ID NO: 1360227 - RNA, 19 nt, Homo sapiens
ugucauuuguguugugaaa

SEQ ID NO: 1360228 - RNA, 19 nt, Homo sapiens
ggguaaggaccgucuguuu

SEQ ID NO: 1360229 - RNA, 19 nt, Homo sapiens
ugauggagauuaccuuugg

SEQ ID NO: 1360230 - RNA, 19 nt, Homo sapiens
ggacagauugcuggaguug

SEQ ID NO: 1360231 - RNA, 19 nt, Homo sapiens
ggccagcgaagacaacuuu

SEQ ID NO: 1360232 - RNA, 19 nt, Homo sapiens
uuacuccucugcuauguuc

SEQ ID NO: 1360233 - RNA, 19 nt, Homo sapiens
caggaucucugcugucucu

SEQ ID NO: 1360234 - RNA, 19 nt, Homo sapiens
ggggcaagccuuaauaaua

SEQ ID NO: 1360235 - RNA, 19 nt, Homo sapiens
gaauucuguuggaacucua

SEQ ID NO: 1360236 - RNA, 19 nt, Homo sapiens
ggaccuguuucccuagcuu

SEQ ID NO: 1360237 - RNA, 19 nt, Homo sapiens
gaacugauaucugauguuu

SEQ ID NO: 1360238 - RNA, 19 nt, Homo sapiens
gaacucgacuugucugaaa

SEQ ID NO: 1360239 - RNA, 19 nt, Homo sapiens
gggcaagccuuaauaauau

SEQ ID NO: 1360240 - RNA, 19 nt, Homo sapiens
gagcgagugucccuaaaua

SEQ ID NO: 1360241 - RNA, 19 nt, Homo sapiens
gaagggaguuugggcuuua

SEQ ID NO: 1360242 - RNA, 19 nt, Homo sapiens
gagcacaucugcccugaaa

SEQ ID NO: 1360243 - RNA, 19 nt, Homo sapiens
ccagagcacuugauaaaga

SEQ ID NO: 1360244 - RNA, 19 nt, Homo sapiens
ggaugaaucucuacacuca

SEQ ID NO: 1360245 - RNA, 19 nt, Homo sapiens
aaacauggcuccacucugu

SEQ ID NO: 1360246 - RNA, 19 nt, Homo sapiens
ggaaggaacuagucuuucu

SEQ ID NO: 1360247 - RNA, 19 nt, Homo sapiens
gcaccuggauuaacucaga

SEQ ID NO: 1360248 - RNA, 19 nt, Homo sapiens
gaacucuacucaaaucuag

SEQ ID NO: 1360249 - RNA, 19 nt, Homo sapiens
ugacgaagcuuguccagau

SEQ ID NO: 1360250 - RNA, 19 nt, Homo sapiens
caaguucucugcugugguu

SEQ ID NO: 1360251 - RNA, 19 nt, Homo sapiens
gagacagacugcaggauga

SEQ ID NO: 1360252 - RNA, 19 nt, Homo sapiens
gccacaagcuuccaaguug

SEQ ID NO: 1360253 - RNA, 19 nt, Homo sapiens
gaagcuaggauaaauguug

SEQ ID NO: 1360254 - RNA, 19 nt, Homo sapiens
ugacaaagguaaggguuaa

SEQ ID NO: 1360255 - RNA, 19 nt, Homo sapiens
ggaguuguccgcuguguuu

SEQ ID NO: 1360256 - RNA, 19 nt, Homo sapiens
gcacaucugcccugaaaga

SEQ ID NO: 1360257 - RNA, 19 nt, Homo sapiens
caagagcuggcauuuguua

SEQ ID NO: 1360258 - RNA, 19 nt, Homo sapiens
gaagaaggcgauccaacaa

SEQ ID NO: 1360259 - RNA, 19 nt, Homo sapiens
cuuuagagaucccuuuaua

SEQ ID NO: 1360260 - RNA, 19 nt, Homo sapiens
ggaagggaguuugggcuuu

SEQ ID NO: 1360261 - RNA, 19 nt, Homo sapiens
ggauaaauguugucuuacu

SEQ ID NO: 1360262 - RNA, 19 nt, Homo sapiens
ucagcuaguuggauucuuu

SEQ ID NO: 1360263 - RNA, 19 nt, Homo sapiens
ggaagaaggcgauccaaca

SEQ ID NO: 1360264 - RNA, 19 nt, Homo sapiens
ccucaguucuauuacguua

SEQ ID NO: 1360265 - RNA, 19 nt, Homo sapiens
ccuacaacuucacacauua

SEQ ID NO: 1360266 - RNA, 19 nt, Homo sapiens
cagcgaagacaacuuuaua

SEQ ID NO: 1360267 - RNA, 19 nt, Homo sapiens
gagcagcaccuacaacuuc

SEQ ID NO: 1360268 - RNA, 19 nt, Homo sapiens
gacaaggucucuagcaucu

SEQ ID NO: 1360269 - RNA, 19 nt, Homo sapiens
gcuccacucuguucucuug

SEQ ID NO: 1360270 - RNA, 19 nt, Homo sapiens
gcaagcgguuucuggauca

SEQ ID NO: 1360271 - RNA, 19 nt, Homo sapiens
ccacuugguugaauucugu

SEQ ID NO: 1360272 - RNA, 19 nt, Homo sapiens
gaaguccaccugaaagaga

SEQ ID NO: 1360273 - RNA, 19 nt, Homo sapiens
caaagccuauccguguaua

SEQ ID NO: 1360274 - RNA, 19 nt, Homo sapiens
gagauuccauuugagaguu

SEQ ID NO: 1360275 - RNA, 19 nt, Homo sapiens
ggaaauggccucaggucau

SEQ ID NO: 1360276 - RNA, 19 nt, Homo sapiens
agaaggcgauccaacaaga

SEQ ID NO: 1360277 - RNA, 19 nt, Homo sapiens
uaugaugguuccaagguaa

SEQ ID NO: 1360278 - RNA, 19 nt, Homo sapiens
cgaagacaacuuuauaaug

SEQ ID NO: 1360279 - RNA, 19 nt, Homo sapiens
gauaaauguugucuuacuc

SEQ ID NO: 1360280 - RNA, 19 nt, Homo sapiens
aauaggaguuuacaagaug

SEQ ID NO: 1360281 - RNA, 19 nt, Homo sapiens
guuauugccucgcuuagau

SEQ ID NO: 1360282 - RNA, 19 nt, Homo sapiens
uccaagggcuagaaauaaa

SEQ ID NO: 1360283 - RNA, 19 nt, Homo sapiens
ggaacucuacucaaaucua

SEQ ID NO: 1360284 - RNA, 19 nt, Homo sapiens
aagaagaacucgacuuguc

SEQ ID NO: 1360285 - RNA, 19 nt, Homo sapiens
gaccaaagaggaagccauu

SEQ ID NO: 1360286 - RNA, 19 nt, Homo sapiens
guaaggaccgucuguuugu

SEQ ID NO: 1360287 - RNA, 19 nt, Homo sapiens
gguaaggaccgucuguuug

SEQ ID NO: 1360288 - RNA, 19 nt, Homo sapiens
ggaguucugaguaauuaaa

SEQ ID NO: 1360289 - RNA, 19 nt, Homo sapiens
cagagcacuugauaaagaa

SEQ ID NO: 1360290 - RNA, 19 nt, Homo sapiens
ugaaaaggccccucuauuu

SEQ ID NO: 1360291 - RNA, 19 nt, Homo sapiens
ccugaugcauagcgaauuu

SEQ ID NO: 1360292 - RNA, 19 nt, Homo sapiens
aaaguaaaguccugaaacu

SEQ ID NO: 1360293 - RNA, 19 nt, Homo sapiens
ggaacuagucuuucuccaa

SEQ ID NO: 1360294 - RNA, 19 nt, Homo sapiens
ccauuagucuccacgaguu

SEQ ID NO: 1360295 - RNA, 19 nt, Homo sapiens
gaaggcagcccgcauucug

SEQ ID NO: 1360296 - RNA, 19 nt, Homo sapiens
gagcuggcauuuguuacuu

SEQ ID NO: 1360297 - RNA, 19 nt, Homo sapiens
uaaggaccgucuguuugua

SEQ ID NO: 1360298 - RNA, 19 nt, Homo sapiens
cuggaguucugaguaauua

SEQ ID NO: 1360299 - RNA, 19 nt, Homo sapiens
uuucauaucuccugcuguu

SEQ ID NO: 1360300 - RNA, 19 nt, Homo sapiens
cgugaucacuggauuaaag

SEQ ID NO: 1360301 - RNA, 19 nt, Homo sapiens
gcgaagacaacuuuauaau

SEQ ID NO: 1360302 - RNA, 19 nt, Homo sapiens
uguuggaacucuacucaaa

SEQ ID NO: 1360303 - RNA, 19 nt, Homo sapiens
uacuugagauuccauuuga

SEQ ID NO: 1360304 - RNA, 19 nt, Homo sapiens
gcugagcccugagaauuca

SEQ ID NO: 1360305 - RNA, 19 nt, Homo sapiens
gaggaugaaucucuacacu

SEQ ID NO: 1360306 - RNA, 19 nt, Homo sapiens
uauaaaggacugauuguca

SEQ ID NO: 1360307 - RNA, 19 nt, Homo sapiens
caacaagagcuggcauuug

SEQ ID NO: 1360308 - RNA, 19 nt, Homo sapiens
guacuugagauuccauuug

SEQ ID NO: 1360309 - RNA, 19 nt, Homo sapiens
gagccugagguauuucaua

SEQ ID NO: 1360310 - RNA, 19 nt, Homo sapiens
gccaugaucuggagagcau

SEQ ID NO: 1360311 - RNA, 19 nt, Homo sapiens
uggaucagcuaguuggauu

SEQ ID NO: 1360312 - RNA, 19 nt, Homo sapiens
ugucauuuguguugugaaa

SEQ ID NO: 1360313 - RNA, 19 nt, Homo sapiens
ggguaaggaccgucuguuu

SEQ ID NO: 1360314 - RNA, 19 nt, Homo sapiens
ugauggagauuaccuuugg

SEQ ID NO: 1360315 - RNA, 19 nt, Homo sapiens
ggacagauugcuggaguug

SEQ ID NO: 1360316 - RNA, 19 nt, Homo sapiens
ggccagcgaagacaacuuu

SEQ ID NO: 1360317 - RNA, 19 nt, Homo sapiens
uuacuccucugcuauguuc

SEQ ID NO: 1360318 - RNA, 19 nt, Homo sapiens
caggaucucugcugucucu

SEQ ID NO: 1360319 - RNA, 19 nt, Homo sapiens
ggggcaagccuuaauaaua

SEQ ID NO: 1360320 - RNA, 19 nt, Homo sapiens
gaauucuguuggaacucua

SEQ ID NO: 1360321 - RNA, 19 nt, Homo sapiens
ggaccuguuucccuagcuu

SEQ ID NO: 1360322 - RNA, 19 nt, Homo sapiens
ugucucacguugucuuuga

SEQ ID NO: 1360323 - RNA, 19 nt, Homo sapiens
gcgcugccuuugacuacaa

SEQ ID NO: 1360324 - RNA, 19 nt, Homo sapiens
ccaaagaggaagccauuag

SEQ ID NO: 1360325 - RNA, 19 nt, Homo sapiens
gggcuugugugguacuuag

SEQ ID NO: 1360326 - RNA, 19 nt, Homo sapiens
caucccagcuugaauuggu

SEQ ID NO: 1360327 - RNA, 19 nt, Homo sapiens
gacgaagcuuguccagaug

SEQ ID NO: 1360328 - RNA, 19 nt, Homo sapiens
uaucaccucucuccaggau

SEQ ID NO: 1360329 - RNA, 19 nt, Homo sapiens
uuccugggcuuguguggua

SEQ ID NO: 1360330 - RNA, 19 nt, Homo sapiens
gcuuucaaacacaguaaua

SEQ ID NO: 1360331 - RNA, 19 nt, Homo sapiens
ccugagguauuucauaucu

SEQ ID NO: 1360332 - RNA, 19 nt, Homo sapiens
gaagcucugccuuuuauaa

SEQ ID NO: 1360333 - RNA, 19 nt, Homo sapiens
ggagacagcgcagccauag

SEQ ID NO: 1360334 - RNA, 19 nt, Homo sapiens
ggaaggagaacggaugcuu

SEQ ID NO: 1360335 - RNA, 19 nt, Homo sapiens
gcacggagugggacaccuu

SEQ ID NO: 1360336 - RNA, 19 nt, Homo sapiens
ggcaagccuuaauaauaug

SEQ ID NO: 1360337 - RNA, 19 nt, Homo sapiens
gaacugauaucugauguuu

SEQ ID NO: 1360338 - RNA, 19 nt, Homo sapiens
ggagaguuauuucgauuua

SEQ ID NO: 1360339 - RNA, 19 nt, Homo sapiens
gaacucgacuugucugaaa

SEQ ID NO: 1360340 - RNA, 19 nt, Homo sapiens
ggaaaguccuguucauauu

SEQ ID NO: 1360341 - RNA, 19 nt, Homo sapiens
gggcaagccuuaauaauau

SEQ ID NO: 1360342 - RNA, 19 nt, Homo sapiens
gagcgagugucccuaaaua

SEQ ID NO: 1360343 - RNA, 19 nt, Homo sapiens
gaagggaguuugggcuuua

SEQ ID NO: 1360344 - RNA, 19 nt, Homo sapiens
gagcacaucugcccugaaa

SEQ ID NO: 1360345 - RNA, 19 nt, Homo sapiens
ccagagcacuugauaaaga

SEQ ID NO: 1360346 - RNA, 19 nt, Homo sapiens
caagccaucugcauguuua

SEQ ID NO: 1360347 - RNA, 19 nt, Homo sapiens
ggaugaaucucuacacuca

SEQ ID NO: 1360348 - RNA, 19 nt, Homo sapiens
aaacauggcuccacucugu

SEQ ID NO: 1360349 - RNA, 19 nt, Homo sapiens
ggaaggaacuagucuuucu

SEQ ID NO: 1360350 - RNA, 19 nt, Homo sapiens
ucaaaucccugcuuucaga

SEQ ID NO: 1360351 - RNA, 19 nt, Homo sapiens
gcaccuggauuaacucaga

SEQ ID NO: 1360352 - RNA, 19 nt, Homo sapiens
gaacucuacucaaaucuag

SEQ ID NO: 1360353 - RNA, 19 nt, Homo sapiens
gcaggaacaugguaaguag

SEQ ID NO: 1360354 - RNA, 19 nt, Homo sapiens
ugacgaagcuuguccagau

SEQ ID NO: 1360355 - RNA, 19 nt, Homo sapiens
caaguucucugcugugguu

SEQ ID NO: 1360356 - RNA, 19 nt, Homo sapiens
gagacagacugcaggauga

SEQ ID NO: 1360357 - RNA, 19 nt, Homo sapiens
gccacaagcuuccaaguug

SEQ ID NO: 1360358 - RNA, 19 nt, Homo sapiens
gaagcuaggauaaauguug

SEQ ID NO: 1360359 - RNA, 19 nt, Homo sapiens
ugacaaagguaaggguuaa

SEQ ID NO: 1360360 - RNA, 19 nt, Homo sapiens
ggaguuguccgcuguguuu

SEQ ID NO: 1360361 - RNA, 19 nt, Homo sapiens
gcacaucugcccugaaaga

SEQ ID NO: 1360362 - RNA, 19 nt, Homo sapiens
caagagcuggcauuuguua

SEQ ID NO: 1360363 - RNA, 19 nt, Homo sapiens
gcuuauaucuucuucuugu

SEQ ID NO: 1360364 - RNA, 19 nt, Homo sapiens
gcagaucccuuucuuagcu

SEQ ID NO: 1360365 - RNA, 19 nt, Homo sapiens
gaaaguccuguucauauug

SEQ ID NO: 1360366 - RNA, 19 nt, Homo sapiens
gaagaaggcgauccaacaa

SEQ ID NO: 1360367 - RNA, 19 nt, Homo sapiens
cuuuagagaucccuuuaua

SEQ ID NO: 1360368 - RNA, 19 nt, Homo sapiens
ggaagggaguuugggcuuu

SEQ ID NO: 1360369 - RNA, 19 nt, Homo sapiens
gagcagaucccuuucuuag

SEQ ID NO: 1360370 - RNA, 19 nt, Homo sapiens
ggauaaauguugucuuacu

SEQ ID NO: 1360371 - RNA, 19 nt, Homo sapiens
ccagaacccuaaugguaaa

SEQ ID NO: 1360372 - RNA, 19 nt, Homo sapiens
ucagcuaguuggauucuuu

SEQ ID NO: 1360373 - RNA, 19 nt, Homo sapiens
ggaagaaggcgauccaaca

SEQ ID NO: 1360374 - RNA, 19 nt, Homo sapiens
ccucaguucuauuacguua

SEQ ID NO: 1360375 - RNA, 19 nt, Homo sapiens
gggaaaguccuguucauau

SEQ ID NO: 1360376 - RNA, 19 nt, Homo sapiens
cagcgaagacaacuuuaua

SEQ ID NO: 1360377 - RNA, 19 nt, Homo sapiens
gacaaggucucuagcaucu

SEQ ID NO: 1360378 - RNA, 19 nt, Homo sapiens
gcuccacucuguucucuug

SEQ ID NO: 1360379 - RNA, 19 nt, Homo sapiens
gcaagcgguuucuggauca

SEQ ID NO: 1360380 - RNA, 19 nt, Homo sapiens
ccacuugguugaauucugu

SEQ ID NO: 1360381 - RNA, 19 nt, Homo sapiens
gaacaucuuccuucuccaa

SEQ ID NO: 1360382 - RNA, 19 nt, Homo sapiens
aaacagcgacugccagaaa

SEQ ID NO: 1360383 - RNA, 19 nt, Homo sapiens
gcgcaugguugccucuuga

SEQ ID NO: 1360384 - RNA, 19 nt, Homo sapiens
caaagccuauccguguaua

SEQ ID NO: 1360385 - RNA, 19 nt, Homo sapiens
gagauuccauuugagaguu

SEQ ID NO: 1360386 - RNA, 19 nt, Homo sapiens
ggaaauggccucaggucau

SEQ ID NO: 1360387 - RNA, 19 nt, Homo sapiens
agaaggcgauccaacaaga

SEQ ID NO: 1360388 - RNA, 19 nt, Homo sapiens
uaugaugguuccaagguaa

SEQ ID NO: 1360389 - RNA, 19 nt, Homo sapiens
cgaagacaacuuuauaaug

SEQ ID NO: 1360390 - RNA, 19 nt, Homo sapiens
gauaaauguugucuuacuc

SEQ ID NO: 1360391 - RNA, 19 nt, Homo sapiens
aauaggaguuuacaagaug

SEQ ID NO: 1360392 - RNA, 19 nt, Homo sapiens
guuauugccucgcuuagau

SEQ ID NO: 1360393 - RNA, 19 nt, Homo sapiens
caggagaguuauuucgauu

SEQ ID NO: 1360394 - RNA, 19 nt, Homo sapiens
gcugucaaaucccugcuuu

SEQ ID NO: 1360395 - RNA, 19 nt, Homo sapiens
uccaagggcuagaaauaaa

SEQ ID NO: 1360396 - RNA, 19 nt, Homo sapiens
ggaacucuacucaaaucua

SEQ ID NO: 1360397 - RNA, 19 nt, Homo sapiens
aagaagaacucgacuuguc

SEQ ID NO: 1360398 - RNA, 19 nt, Homo sapiens
gaccaaagaggaagccauu

SEQ ID NO: 1360399 - RNA, 19 nt, Homo sapiens
guaaggaccgucuguuugu

SEQ ID NO: 1360400 - RNA, 19 nt, Homo sapiens
gguaaggaccgucuguuug

SEQ ID NO: 1360401 - RNA, 19 nt, Homo sapiens
ggaguucugaguaauuaaa

SEQ ID NO: 1360402 - RNA, 19 nt, Homo sapiens
cagagcacuugauaaagaa

SEQ ID NO: 1360403 - RNA, 19 nt, Homo sapiens
ugaaaaggccccucuauuu

SEQ ID NO: 1360404 - RNA, 19 nt, Homo sapiens
ugcagggacucuuuccuua

SEQ ID NO: 1360405 - RNA, 19 nt, Homo sapiens
aaaguaaaguccugaaacu

SEQ ID NO: 1360406 - RNA, 19 nt, Homo sapiens
ggaacuagucuuucuccaa

SEQ ID NO: 1360407 - RNA, 19 nt, Homo sapiens
ccauuagucuccacgaguu

SEQ ID NO: 1360408 - RNA, 19 nt, Homo sapiens
ggagcagaucccuuucuua

SEQ ID NO: 1360409 - RNA, 19 nt, Homo sapiens
gccaggagauugugauugg

SEQ ID NO: 1360410 - RNA, 19 nt, Homo sapiens
uuauggagcuucaagaauc

SEQ ID NO: 1360411 - RNA, 19 nt, Homo sapiens
gaaggcagcccgcauucug

SEQ ID NO: 1360412 - RNA, 19 nt, Homo sapiens
gagcuggcauuuguuacuu

SEQ ID NO: 1360413 - RNA, 19 nt, Homo sapiens
uaaggaccgucuguuugua

SEQ ID NO: 1360414 - RNA, 19 nt, Homo sapiens
cgugaucacuggauuaaag

SEQ ID NO: 1360415 - RNA, 19 nt, Homo sapiens
cuggaguucugaguaauua

SEQ ID NO: 1360416 - RNA, 19 nt, Homo sapiens
uuucauaucuccugcuguu

SEQ ID NO: 1360417 - RNA, 19 nt, Homo sapiens
gcgaagacaacuuuauaau

SEQ ID NO: 1360418 - RNA, 19 nt, Homo sapiens
uguuggaacucuacucaaa

SEQ ID NO: 1360419 - RNA, 19 nt, Homo sapiens
uacuugagauuccauuuga

SEQ ID NO: 1360420 - RNA, 19 nt, Homo sapiens
gcugagcccugagaauuca

SEQ ID NO: 1360421 - RNA, 19 nt, Homo sapiens
gaggaugaaucucuacacu

SEQ ID NO: 1360422 - RNA, 19 nt, Homo sapiens
gaacggcggucuuuuaugc

SEQ ID NO: 1360423 - RNA, 19 nt, Homo sapiens
ggaacaugguaaguaguga

SEQ ID NO: 1360424 - RNA, 19 nt, Homo sapiens
uauaaaggacugauuguca

SEQ ID NO: 1360425 - RNA, 19 nt, Homo sapiens
caacaagagcuggcauuug

SEQ ID NO: 1360426 - RNA, 19 nt, Homo sapiens
guacuugagauuccauuug

SEQ ID NO: 1360427 - RNA, 19 nt, Homo sapiens
gagccugagguauuucaua

SEQ ID NO: 1360428 - RNA, 19 nt, Homo sapiens
gccaugaucuggagagcau

SEQ ID NO: 1360429 - RNA, 19 nt, Homo sapiens
uggaucagcuaguuggauu

SEQ ID NO: 1360430 - RNA, 19 nt, Homo sapiens
ugucauuuguguugugaaa

SEQ ID NO: 1360431 - RNA, 19 nt, Homo sapiens
ggguaaggaccgucuguuu

SEQ ID NO: 1360432 - RNA, 19 nt, Homo sapiens
cuccuuaacuucauauugu

SEQ ID NO: 1360433 - RNA, 19 nt, Homo sapiens
ugauggagauuaccuuugg

SEQ ID NO: 1360434 - RNA, 19 nt, Homo sapiens
ggacagauugcuggaguug

SEQ ID NO: 1360435 - RNA, 19 nt, Homo sapiens
ggccagcgaagacaacuuu

SEQ ID NO: 1360436 - RNA, 19 nt, Homo sapiens
uuacuccucugcuauguuc

SEQ ID NO: 1360437 - RNA, 19 nt, Homo sapiens
gaacugauaucugauguuu

SEQ ID NO: 1360438 - RNA, 19 nt, Homo sapiens
gaacucgacuugucugaaa

SEQ ID NO: 1360439 - RNA, 19 nt, Homo sapiens
gagcacaucugcccugaaa

SEQ ID NO: 1360440 - RNA, 19 nt, Homo sapiens
uaagaggcauggaaauaua

SEQ ID NO: 1360441 - RNA, 19 nt, Homo sapiens
gcagacagccacagugaua

SEQ ID NO: 1360442 - RNA, 19 nt, Homo sapiens
ccaaggcacugauguuuga

SEQ ID NO: 1360443 - RNA, 19 nt, Homo sapiens
ggaaggaacuagucuuucu

SEQ ID NO: 1360444 - RNA, 19 nt, Homo sapiens
gcaccuggauuaacucaga

SEQ ID NO: 1360445 - RNA, 19 nt, Homo sapiens
ugacgaagcuuguccagau

SEQ ID NO: 1360446 - RNA, 19 nt, Homo sapiens
caaguucucugcugugguu

SEQ ID NO: 1360447 - RNA, 19 nt, Homo sapiens
gagacagacugcaggauga

SEQ ID NO: 1360448 - RNA, 19 nt, Homo sapiens
gaagcuaggauaaauguug

SEQ ID NO: 1360449 - RNA, 19 nt, Homo sapiens
ugacaaagguaaggguuaa

SEQ ID NO: 1360450 - RNA, 19 nt, Homo sapiens
ggaguuguccgcuguguuu

SEQ ID NO: 1360451 - RNA, 19 nt, Homo sapiens
gcacaucugcccugaaaga

SEQ ID NO: 1360452 - RNA, 19 nt, Homo sapiens
caagagcuggcauuuguua

SEQ ID NO: 1360453 - RNA, 19 nt, Homo sapiens
cugcuaggauucucuguua

SEQ ID NO: 1360454 - RNA, 19 nt, Homo sapiens
gaagaaggcgauccaacaa

SEQ ID NO: 1360455 - RNA, 19 nt, Homo sapiens
ggucacagcuagggagaaa

SEQ ID NO: 1360456 - RNA, 19 nt, Homo sapiens
ggauaaauguugucuuacu

SEQ ID NO: 1360457 - RNA, 19 nt, Homo sapiens
ucagcuaguuggauucuuu

SEQ ID NO: 1360458 - RNA, 19 nt, Homo sapiens
ggaagaaggcgauccaaca

SEQ ID NO: 1360459 - RNA, 19 nt, Homo sapiens
ccucaguucuauuacguua

SEQ ID NO: 1360460 - RNA, 19 nt, Homo sapiens
cagcgaagacaacuuuaua

SEQ ID NO: 1360461 - RNA, 19 nt, Homo sapiens
gacaaggucucuagcaucu

SEQ ID NO: 1360462 - RNA, 19 nt, Homo sapiens
gcaagcgguuucuggauca

SEQ ID NO: 1360463 - RNA, 19 nt, Homo sapiens
gcuaggauucucuguuaua

SEQ ID NO: 1360464 - RNA, 19 nt, Homo sapiens
uagacaagcuagaaauuuc

SEQ ID NO: 1360465 - RNA, 19 nt, Homo sapiens
ccacagugauacuuaggaa

SEQ ID NO: 1360466 - RNA, 19 nt, Homo sapiens
gaaaccagaggaauggauu

SEQ ID NO: 1360467 - RNA, 19 nt, Homo sapiens
caaagccuauccguguaua

SEQ ID NO: 1360468 - RNA, 19 nt, Homo sapiens
gagauuccauuugagaguu

SEQ ID NO: 1360469 - RNA, 19 nt, Homo sapiens
ggaaauggccucaggucau

SEQ ID NO: 1360470 - RNA, 19 nt, Homo sapiens
agaaggcgauccaacaaga

SEQ ID NO: 1360471 - RNA, 19 nt, Homo sapiens
uaugaugguuccaagguaa

SEQ ID NO: 1360472 - RNA, 19 nt, Homo sapiens
guaagaggcauggaaauau

SEQ ID NO: 1360473 - RNA, 19 nt, Homo sapiens
cgaagacaacuuuauaaug

SEQ ID NO: 1360474 - RNA, 19 nt, Homo sapiens
gauaaauguugucuuacuc

SEQ ID NO: 1360475 - RNA, 19 nt, Homo sapiens
gcaaggaagggaaguggaa

SEQ ID NO: 1360476 - RNA, 19 nt, Homo sapiens
uccaagggcuagaaauaaa

SEQ ID NO: 1360477 - RNA, 19 nt, Homo sapiens
aagaagaacucgacuuguc

SEQ ID NO: 1360478 - RNA, 19 nt, Homo sapiens
gaccaaagaggaagccauu

SEQ ID NO: 1360479 - RNA, 19 nt, Homo sapiens
aggauucucuguuauaguu

SEQ ID NO: 1360480 - RNA, 19 nt, Homo sapiens
guaaggaccgucuguuugu

SEQ ID NO: 1360481 - RNA, 19 nt, Homo sapiens
gguaaggaccgucuguuug

SEQ ID NO: 1360482 - RNA, 19 nt, Homo sapiens
ggaguucugaguaauuaaa

SEQ ID NO: 1360483 - RNA, 19 nt, Homo sapiens
aaaguaaaguccugaaacu

SEQ ID NO: 1360484 - RNA, 19 nt, Homo sapiens
ggaacuagucuuucuccaa

SEQ ID NO: 1360485 - RNA, 19 nt, Homo sapiens
ccauuagucuccacgaguu

SEQ ID NO: 1360486 - RNA, 19 nt, Homo sapiens
uuauggagcuucaagaauc

SEQ ID NO: 1360487 - RNA, 19 nt, Homo sapiens
gaaggcagcccgcauucug

SEQ ID NO: 1360488 - RNA, 19 nt, Homo sapiens
gagcuggcauuuguuacuu

SEQ ID NO: 1360489 - RNA, 19 nt, Homo sapiens
gaggaauggauuugacuuu

SEQ ID NO: 1360490 - RNA, 19 nt, Homo sapiens
uaaggaccgucuguuugua

SEQ ID NO: 1360491 - RNA, 19 nt, Homo sapiens
cuggaguucugaguaauua

SEQ ID NO: 1360492 - RNA, 19 nt, Homo sapiens
ggaaauauacaugaaacug

SEQ ID NO: 1360493 - RNA, 19 nt, Homo sapiens
gcgaagacaacuuuauaau

SEQ ID NO: 1360494 - RNA, 19 nt, Homo sapiens
uacuugagauuccauuuga

SEQ ID NO: 1360495 - RNA, 19 nt, Homo sapiens
uauaaaggacugauuguca

SEQ ID NO: 1360496 - RNA, 19 nt, Homo sapiens
caacaagagcuggcauuug

SEQ ID NO: 1360497 - RNA, 19 nt, Homo sapiens
guacuugagauuccauuug

SEQ ID NO: 1360498 - RNA, 19 nt, Homo sapiens
gccaugaucuggagagcau

SEQ ID NO: 1360499 - RNA, 19 nt, Homo sapiens
uggaucagcuaguuggauu

SEQ ID NO: 1360500 - RNA, 19 nt, Homo sapiens
uguaagaggcauggaaaua

SEQ ID NO: 1360501 - RNA, 19 nt, Homo sapiens
uauaguuucucccugaguu

SEQ ID NO: 1360502 - RNA, 19 nt, Homo sapiens
ggauuugacuuuucugcua

SEQ ID NO: 1360503 - RNA, 19 nt, Homo sapiens
ugucauuuguguugugaaa

SEQ ID NO: 1360504 - RNA, 19 nt, Homo sapiens
ggguaaggaccgucuguuu

SEQ ID NO: 1360505 - RNA, 19 nt, Homo sapiens
ugauggagauuaccuuugg

SEQ ID NO: 1360506 - RNA, 19 nt, Homo sapiens
ggacagauugcuggaguug

SEQ ID NO: 1360507 - RNA, 19 nt, Homo sapiens
ggccagcgaagacaacuuu

SEQ ID NO: 1360508 - RNA, 19 nt, Homo sapiens
uuacuccucugcuauguuc

SEQ ID NO: 1360509 - RNA, 19 nt, Homo sapiens
caggaucucugcugucucu

SEQ ID NO: 1360510 - RNA, 19 nt, Homo sapiens
ggaccuguuucccuagcuu

SEQ ID NO: 1360511 - RNA, 19 nt, Homo sapiens
ugucucacguugucuuuga

SEQ ID NO: 1360512 - RNA, 19 nt, Homo sapiens
ccaaagaggaagccauuag

SEQ ID NO: 1360513 - RNA, 19 nt, Homo sapiens
uagcaugcaucucccacuu

SEQ ID NO: 1360514 - RNA, 19 nt, Homo sapiens
gcaugcaucucccacuuuu

SEQ ID NO: 1360515 - RNA, 19 nt, Homo sapiens
gggcuugugugguacuuag

SEQ ID NO: 1360516 - RNA, 19 nt, Homo sapiens
gcaggaacauggaaaaugg

SEQ ID NO: 1360517 - RNA, 19 nt, Homo sapiens
gacgaagcuuguccagaug

SEQ ID NO: 1360518 - RNA, 19 nt, Homo sapiens
caggauggguuugaacuag

SEQ ID NO: 1360519 - RNA, 19 nt, Homo sapiens
uaucaccucucuccaggau

SEQ ID NO: 1360520 - RNA, 19 nt, Homo sapiens
uuccugggcuuguguggua

SEQ ID NO: 1360521 - RNA, 19 nt, Homo sapiens
ggaaggagaacggaugcuu

SEQ ID NO: 1360522 - RNA, 19 nt, Homo sapiens
gcacggagugggacaccuu

SEQ ID NO: 1360523 - RNA, 19 nt, Homo sapiens
cugaagaaccugcaaggaa

SEQ ID NO: 1360524 - RNA, 19 nt, Homo sapiens
ggagaacggaugcuugucu

SEQ ID NO: 1360525 - RNA, 19 nt, Homo sapiens
ggaauggauuugacuuuuc

SEQ ID NO: 1360526 - RNA, 19 nt, Homo sapiens
gagccaaggcacugauguu

SEQ ID NO: 1360527 - RNA, 19 nt, Homo sapiens
caucugcccugaaagaaaa

SEQ ID NO: 1360528 - RNA, 19 nt, Homo sapiens
caaagaggaagccauuagu

SEQ ID NO: 1360529 - RNA, 19 nt, Homo sapiens
acagauugcuggaguuguc

SEQ ID NO: 1360530 - RNA, 19 nt, Homo sapiens
ccaacaagagcuggcauuu

SEQ ID NO: 1360531 - RNA, 19 nt, Homo sapiens
ucacagcuagggagaaaga

SEQ ID NO: 1360532 - RNA, 19 nt, Homo sapiens
gugacaaagguaaggguua

SEQ ID NO: 1360533 - RNA, 19 nt, Homo sapiens
ucaccucucuccaggaucu

SEQ ID NO: 1360534 - RNA, 19 nt, Homo sapiens
cuuccaagggcuagaaaua

SEQ ID NO: 1360535 - RNA, 19 nt, Homo sapiens
ugaaagggagcgacacuca

SEQ ID NO: 1360536 - RNA, 19 nt, Homo sapiens
gaagaccauccuggccaua

SEQ ID NO: 1360537 - RNA, 19 nt, Homo sapiens
gcacugagcucaaccauug

SEQ ID NO: 1360538 - RNA, 19 nt, Homo sapiens
cagaagauuugccuuauua

SEQ ID NO: 1360539 - RNA, 19 nt, Homo sapiens
acacugaggucauaaauaa

SEQ ID NO: 1360540 - RNA, 19 nt, Homo sapiens
ggaauucaguuggcauuua

SEQ ID NO: 1360541 - RNA, 19 nt, Homo sapiens
gaauucaguuggcauuuaa

SEQ ID NO: 1360542 - RNA, 19 nt, Homo sapiens
gcauuuaaguggugaauau

SEQ ID NO: 1360543 - RNA, 19 nt, Homo sapiens
cacaagcgauuucuuauuu

SEQ ID NO: 1360544 - RNA, 19 nt, Homo sapiens
cagcucagauuguagaaua

SEQ ID NO: 1360545 - RNA, 19 nt, Homo sapiens
gaaguucccuaagccuuua

SEQ ID NO: 1360546 - RNA, 19 nt, Homo sapiens
gcuaaccuguguccaaaua

SEQ ID NO: 1360547 - RNA, 19 nt, Homo sapiens
gaaaucagcauucguuaug

SEQ ID NO: 1360548 - RNA, 19 nt, Homo sapiens
ucaauggagugauaaagua

SEQ ID NO: 1360549 - RNA, 19 nt, Homo sapiens
gcagaagauuugccuuauu

SEQ ID NO: 1360550 - RNA, 19 nt, Homo sapiens
gaaauccucucacuucaag

SEQ ID NO: 1360551 - RNA, 19 nt, Homo sapiens
ccaagauacuucauauuug

SEQ ID NO: 1360552 - RNA, 19 nt, Homo sapiens
caagagagauguugaugag

SEQ ID NO: 1360553 - RNA, 19 nt, Homo sapiens
gaauggaacuugaaaauca

SEQ ID NO: 1360554 - RNA, 19 nt, Homo sapiens
gaugagcauuuaagaauca

SEQ ID NO: 1360555 - RNA, 19 nt, Homo sapiens
gcuaucagguuucuuguuc

SEQ ID NO: 1360556 - RNA, 19 nt, Homo sapiens
gaaucacucuggcauuaau

SEQ ID NO: 1360557 - RNA, 19 nt, Homo sapiens
ucgaaucacucuggcauua

SEQ ID NO: 1360558 - RNA, 19 nt, Homo sapiens
gguccaagauacuucauau

SEQ ID NO: 1360559 - RNA, 19 nt, Homo sapiens
gugagaagaagcugaguua

SEQ ID NO: 1360560 - RNA, 19 nt, Homo sapiens
gacagaugcugagcccuua

SEQ ID NO: 1360561 - RNA, 19 nt, Homo sapiens
cagcgcagcucagauugua

SEQ ID NO: 1360562 - RNA, 19 nt, Homo sapiens
uggaauaccugcagaagau

SEQ ID NO: 1360563 - RNA, 19 nt, Homo sapiens
gcaguugccguguguaauu

SEQ ID NO: 1360564 - RNA, 19 nt, Homo sapiens
gaugcagacuuuguucuuu

SEQ ID NO: 1360565 - RNA, 19 nt, Homo sapiens
gguaacgccucguguuguu

SEQ ID NO: 1360566 - RNA, 19 nt, Homo sapiens
cagauggccucccaccuuu

SEQ ID NO: 1360567 - RNA, 19 nt, Homo sapiens
caaaucauguggucaagag

SEQ ID NO: 1360568 - RNA, 19 nt, Homo sapiens
gaagauuugccuuauuaug

SEQ ID NO: 1360569 - RNA, 19 nt, Homo sapiens
gcagauggccucccaccuu

SEQ ID NO: 1360570 - RNA, 19 nt, Homo sapiens
uaagaacuauggcgcugaa

SEQ ID NO: 1360571 - RNA, 19 nt, Homo sapiens
uaagauaguucgucacacu

SEQ ID NO: 1360572 - RNA, 19 nt, Homo sapiens
guacuuugaugaacucagu

SEQ ID NO: 1360573 - RNA, 19 nt, Homo sapiens
acaggaauaucaguacuuu

SEQ ID NO: 1360574 - RNA, 19 nt, Homo sapiens
gagagcaguugccgugugu

SEQ ID NO: 1360575 - RNA, 19 nt, Homo sapiens
gugacacgcucagaaguaa

SEQ ID NO: 1360576 - RNA, 19 nt, Homo sapiens
gugauaaaguaguucgaaa

SEQ ID NO: 1360577 - RNA, 19 nt, Homo sapiens
uaaccuguguccaaauaug

SEQ ID NO: 1360578 - RNA, 19 nt, Homo sapiens
caagcgauuucuuauuuag

SEQ ID NO: 1360579 - RNA, 19 nt, Homo sapiens
ggacuucugugagcucugu

SEQ ID NO: 1360580 - RNA, 19 nt, Homo sapiens
gaauaccugcagaagauuu

SEQ ID NO: 1360581 - RNA, 19 nt, Homo sapiens
gagcaguugccguguguaa

SEQ ID NO: 1360582 - RNA, 19 nt, Homo sapiens
augcagacuuuguucuuua

SEQ ID NO: 1360583 - RNA, 19 nt, Homo sapiens
ggcacuaucuuacuuagca

SEQ ID NO: 1360584 - RNA, 19 nt, Homo sapiens
ucagaaaucagcauucguu

SEQ ID NO: 1360585 - RNA, 19 nt, Homo sapiens
gaaaacaucaucucuuaug

SEQ ID NO: 1360586 - RNA, 19 nt, Homo sapiens
gagagaugcagccaugaaa

SEQ ID NO: 1360587 - RNA, 19 nt, Homo sapiens
ggagaagugugagaagaag

SEQ ID NO: 1360588 - RNA, 19 nt, Homo sapiens
uaugggauguucgagauaa

SEQ ID NO: 1360589 - RNA, 19 nt, Homo sapiens
ggaaauccucucacuucaa

SEQ ID NO: 1360590 - RNA, 19 nt, Homo sapiens
ccacaagcgauuucuuauu

SEQ ID NO: 1360591 - RNA, 19 nt, Homo sapiens
gaugcuaucagguuucuug

SEQ ID NO: 1360592 - RNA, 19 nt, Homo sapiens
cagcauucguuauggagaa

SEQ ID NO: 1360593 - RNA, 19 nt, Homo sapiens
uaaaguaguucgaaaagug

SEQ ID NO: 1360594 - RNA, 19 nt, Homo sapiens
guccaaauaugaucucuac

SEQ ID NO: 1360595 - RNA, 19 nt, Homo sapiens
gaagaguugcucccugaga

SEQ ID NO: 1360596 - RNA, 19 nt, Homo sapiens
guauauggcacuaggaaug

SEQ ID NO: 1360597 - RNA, 19 nt, Homo sapiens
uaucagcgcagcucagauu

SEQ ID NO: 1360598 - RNA, 19 nt, Homo sapiens
aaacauggacaggccaaua

SEQ ID NO: 1360599 - RNA, 19 nt, Homo sapiens
ugaggaacaucuccagcaa

SEQ ID NO: 1360600 - RNA, 19 nt, Homo sapiens
gcagacaaugugcaacaaa

SEQ ID NO: 1360601 - RNA, 19 nt, Homo sapiens
gaacaagcuuuucccacaa

SEQ ID NO: 1360602 - RNA, 19 nt, Homo sapiens
gagcucaaccauugggaaa

SEQ ID NO: 1360603 - RNA, 19 nt, Homo sapiens
cugcugggcuguuugcauu

SEQ ID NO: 1360604 - RNA, 19 nt, Homo sapiens
aggaacaucuccagcaaug

SEQ ID NO: 1360605 - RNA, 19 nt, Homo sapiens
ggauuucuucuguguauau

SEQ ID NO: 1360606 - RNA, 19 nt, Homo sapiens
ccucaaggucugaaaguuu

SEQ ID NO: 1360607 - RNA, 19 nt, Homo sapiens
gacacugaggucauaaaua

SEQ ID NO: 1360608 - RNA, 19 nt, Homo sapiens
uagagggaauggaacuuga

SEQ ID NO: 1360609 - RNA, 19 nt, Homo sapiens
ucauuccguuugucuaauu

SEQ ID NO: 1360610 - RNA, 19 nt, Homo sapiens
aggaauaucaguacuuuga

SEQ ID NO: 1360611 - RNA, 19 nt, Homo sapiens
aagaguugcucccugagaa

SEQ ID NO: 1360612 - RNA, 19 nt, Homo sapiens
gacccgagcucugccacuu

SEQ ID NO: 1360613 - RNA, 19 nt, Homo sapiens
gauguucgagauaauaaga

SEQ ID NO: 1360614 - RNA, 19 nt, Homo sapiens
gggauguucgagauaauaa

SEQ ID NO: 1360615 - RNA, 19 nt, Homo sapiens
gagauguugaugagcauuu

SEQ ID NO: 1360616 - RNA, 19 nt, Homo sapiens
agauguugaugagcauuua

SEQ ID NO: 1360617 - RNA, 19 nt, Homo sapiens
agacuuuguucuuuacguu

SEQ ID NO: 1360618 - RNA, 19 nt, Homo sapiens
gagcauuuaagaaucaaga

SEQ ID NO: 1360619 - RNA, 19 nt, Homo sapiens
uaaaaguguugaagaguug

SEQ ID NO: 1360620 - RNA, 19 nt, Homo sapiens
cucaaggucugaaaguuug

SEQ ID NO: 1360621 - RNA, 19 nt, Homo sapiens
cagaaaucagcauucguua

SEQ ID NO: 1360622 - RNA, 19 nt, Homo sapiens
uguguaauuugcagaaguu

SEQ ID NO: 1360623 - RNA, 19 nt, Homo sapiens
agucugggauuauaucaau

SEQ ID NO: 1360624 - RNA, 19 nt, Homo sapiens
uuacuuagcagacaaugug

SEQ ID NO: 1360625 - RNA, 19 nt, Homo sapiens
gucacgcacuccaugguaa

SEQ ID NO: 1360626 - RNA, 19 nt, Homo sapiens
cugcagaagauuugccuua

SEQ ID NO: 1360627 - RNA, 19 nt, Homo sapiens
gagagauuaugggauguuc

SEQ ID NO: 1360628 - RNA, 19 nt, Homo sapiens
ccucucacuucaagauuug

SEQ ID NO: 1360629 - RNA, 19 nt, Homo sapiens
gcugacuacugcccuuuca

SEQ ID NO: 1360630 - RNA, 19 nt, Homo sapiens
gauuauaucaauggaguga

SEQ ID NO: 1360631 - RNA, 19 nt, Homo sapiens
ucccacaagcgauuucuua

SEQ ID NO: 1360632 - RNA, 19 nt, Homo sapiens
caauaccuccggaaggaaa

SEQ ID NO: 1360633 - RNA, 19 nt, Homo sapiens
caguugccguguguaauuu

SEQ ID NO: 1360634 - RNA, 19 nt, Homo sapiens
gagggaauggaacuugaaa

SEQ ID NO: 1360635 - RNA, 19 nt, Homo sapiens
aaguucaucuuaaggcaaa

SEQ ID NO: 1360636 - RNA, 19 nt, Homo sapiens
cuggauuucuucuguguau

SEQ ID NO: 1360637 - RNA, 19 nt, Homo sapiens
gaagcuaugugagauauaa

SEQ ID NO: 1360638 - RNA, 19 nt, Homo sapiens
uaaacuugcuuucaccuua

SEQ ID NO: 1360639 - RNA, 19 nt, Homo sapiens
ggaggaagguagaguaaga

SEQ ID NO: 1360640 - RNA, 19 nt, Homo sapiens
aguaagagguugaagauaa

SEQ ID NO: 1360641 - RNA, 19 nt, Homo sapiens
gagggucucuuaggcuuua

SEQ ID NO: 1360642 - RNA, 19 nt, Homo sapiens
gaagguagaguaagagguu

SEQ ID NO: 1360643 - RNA, 19 nt, Homo sapiens
gaagauaacagagugcaaa

SEQ ID NO: 1360644 - RNA, 19 nt, Homo sapiens
uaaagaagccaaccaaauc

SEQ ID NO: 1360645 - RNA, 19 nt, Homo sapiens
gauaacagagugcaaaguu

SEQ ID NO: 1360646 - RNA, 19 nt, Homo sapiens
gccaagaggagcuccauua

SEQ ID NO: 1360647 - RNA, 19 nt, Homo sapiens
ccagagaaccugagaguga

SEQ ID NO: 1360648 - RNA, 19 nt, Homo sapiens
gaugggagauucuggauac

SEQ ID NO: 1360649 - RNA, 19 nt, Homo sapiens
guaaagaagccaaccaaau

SEQ ID NO: 1360650 - RNA, 19 nt, Homo sapiens
cuacugggcugcauucuca

SEQ ID NO: 1360651 - RNA, 19 nt, Homo sapiens
uaacugggccuuugaggaa

SEQ ID NO: 1360652 - RNA, 19 nt, Homo sapiens
aaacuugcuuucaccuuaa

SEQ ID NO: 1360653 - RNA, 19 nt, Homo sapiens
aaacauagcugggcuuggu

SEQ ID NO: 1360654 - RNA, 19 nt, Homo sapiens
ggaccucucugugcaguau

SEQ ID NO: 1360655 - RNA, 19 nt, Homo sapiens
gaagucaaguuccaaugag

SEQ ID NO: 1360656 - RNA, 19 nt, Homo sapiens
uggaauaggagcugaauaa

SEQ ID NO: 1360657 - RNA, 19 nt, Homo sapiens
gcgcugcucuugucuaugg

SEQ ID NO: 1360658 - RNA, 19 nt, Homo sapiens
aagaggagcuccauuaugc

SEQ ID NO: 1360659 - RNA, 19 nt, Homo sapiens
ccagagaccuuguuaucag

SEQ ID NO: 1360660 - RNA, 19 nt, Homo sapiens
gagaggaagcuaugugaga

SEQ ID NO: 1360661 - RNA, 19 nt, Homo sapiens
aacgauggguucuuucuaa

SEQ ID NO: 1360662 - RNA, 19 nt, Homo sapiens
ggaauaggagcugaauaaa

SEQ ID NO: 1360663 - RNA, 19 nt, Homo sapiens
gugcaaaguuuccuucucu

SEQ ID NO: 1360664 - RNA, 19 nt, Homo sapiens
ccaugacaguuuacaaaug

SEQ ID NO: 1360665 - RNA, 19 nt, Homo sapiens
gcucagaagcggaaucaga

SEQ ID NO: 1360666 - RNA, 19 nt, Homo sapiens
gcacgucucucccaguacu

SEQ ID NO: 1360667 - RNA, 19 nt, Homo sapiens
gagagaggaagcuauguga

SEQ ID NO: 1360668 - RNA, 19 nt, Homo sapiens
caagauacaggucauaaag

SEQ ID NO: 1360669 - RNA, 19 nt, Homo sapiens
cggcacgucucucccagua

SEQ ID NO: 1360670 - RNA, 19 nt, Homo sapiens
gaucagagacgcgcagaug

SEQ ID NO: 1360671 - RNA, 19 nt, Homo sapiens
guaagagguugaagauaac

SEQ ID NO: 1360672 - RNA, 19 nt, Homo sapiens
ucaggaaguuacccgauau

SEQ ID NO: 1360673 - RNA, 19 nt, Homo sapiens
gacagcaccaugacaguuu

SEQ ID NO: 1360674 - RNA, 19 nt, Homo sapiens
ccaaccaaaucccaccaaa

SEQ ID NO: 1360675 - RNA, 19 nt, Homo sapiens
gacaguggaggcauucuaa

SEQ ID NO: 1360676 - RNA, 19 nt, Homo sapiens
uaacagagugcaaaguuuc

SEQ ID NO: 1360677 - RNA, 19 nt, Homo sapiens
gaacugcuccuuggugauc

SEQ ID NO: 1360678 - RNA, 19 nt, Homo sapiens
gagacggacucagacagaa

SEQ ID NO: 1360679 - RNA, 19 nt, Homo sapiens
acagcaccaugacaguuua

SEQ ID NO: 1360680 - RNA, 19 nt, Homo sapiens
ccaggcggauuaugcagaa

SEQ ID NO: 1360681 - RNA, 19 nt, Homo sapiens
gcuuauggcuacugguuca

SEQ ID NO: 1360682 - RNA, 19 nt, Homo sapiens
auaacagagugcaaaguuu

SEQ ID NO: 1360683 - RNA, 19 nt, Homo sapiens
caagaggagcuccauuaug

SEQ ID NO: 1360684 - RNA, 19 nt, Homo sapiens
gaggaagcuaugugagaua

SEQ ID NO: 1360685 - RNA, 19 nt, Homo sapiens
gauaagaagggacucaucu

SEQ ID NO: 1360686 - RNA, 19 nt, Homo sapiens
caugacaguuuacaaaugc

SEQ ID NO: 1360687 - RNA, 19 nt, Homo sapiens
gaauaggagcugaauaaaa

SEQ ID NO: 1360688 - RNA, 19 nt, Homo sapiens
caacuucccaggcgucaga

SEQ ID NO: 1360689 - RNA, 19 nt, Homo sapiens
aaucaaagaagaaccagaa

SEQ ID NO: 1360690 - RNA, 19 nt, Homo sapiens
gaaagccacaccaaacagu

SEQ ID NO: 1360691 - RNA, 19 nt, Homo sapiens
gcaguauccuccagagaac

SEQ ID NO: 1360692 - RNA, 19 nt, Homo sapiens
ccaacgaccucccacuucu

SEQ ID NO: 1360693 - RNA, 19 nt, Homo sapiens
ggagagaggaagcuaugug

SEQ ID NO: 1360694 - RNA, 19 nt, Homo sapiens
guggaggcauucuaaguca

SEQ ID NO: 1360695 - RNA, 19 nt, Homo sapiens
aguaucaguugcccaguuu

SEQ ID NO: 1360696 - RNA, 19 nt, Homo sapiens
gaagagacggacucagaca

SEQ ID NO: 1360697 - RNA, 19 nt, Homo sapiens
ccgaagagacggacucaga

SEQ ID NO: 1360698 - RNA, 19 nt, Homo sapiens
caccaugacaguuuacaaa

SEQ ID NO: 1360699 - RNA, 19 nt, Homo sapiens
guacaagauacaggucaua

SEQ ID NO: 1360700 - RNA, 19 nt, Homo sapiens
ggagguccguacaagauac

SEQ ID NO: 1360701 - RNA, 19 nt, Homo sapiens
gacaggagguccguacaag

SEQ ID NO: 1360702 - RNA, 19 nt, Homo sapiens
ccaagaggagcuccauuau

SEQ ID NO: 1360703 - RNA, 19 nt, Homo sapiens
uaagaagggacucaucuca

SEQ ID NO: 1360704 - RNA, 19 nt, Homo sapiens
gcagaugcaggaugaguca

SEQ ID NO: 1360705 - RNA, 19 nt, Homo sapiens
gaaaccccaucucuacaaa

SEQ ID NO: 1360706 - RNA, 19 nt, Homo sapiens
gcuccuuggugaucagaga

SEQ ID NO: 1360707 - RNA, 19 nt, Homo sapiens
gcucuugucuauggaguag

SEQ ID NO: 1360708 - RNA, 19 nt, Homo sapiens
ggaaguuacccgauauguc

SEQ ID NO: 1360709 - RNA, 19 nt, Homo sapiens
gcagaagucaaguuccaau

SEQ ID NO: 1360710 - RNA, 19 nt, Homo sapiens
agaagggacucaucucaac

SEQ ID NO: 1360711 - RNA, 19 nt, Homo sapiens
ggaugggagauucuggaua

SEQ ID NO: 1360712 - RNA, 19 nt, Homo sapiens
agaagucaaguuccaauga

SEQ ID NO: 1360713 - RNA, 19 nt, Homo sapiens
caguaucaguugcccaguu

SEQ ID NO: 1360714 - RNA, 19 nt, Homo sapiens
acgcgcagaugcaggauga

SEQ ID NO: 1360715 - RNA, 19 nt, Homo sapiens
cagagaaccugagagugau

SEQ ID NO: 1360716 - RNA, 19 nt, Homo sapiens
aaacagauugcaguaaaga

SEQ ID NO: 1360717 - RNA, 19 nt, Homo sapiens
cagaaagccacaccaaaca

SEQ ID NO: 1360718 - RNA, 19 nt, Homo sapiens
ugagcuggguccugcagaa

SEQ ID NO: 1360719 - RNA, 19 nt, Homo sapiens
ggaagcuaugugagauaua

SEQ ID NO: 1360720 - RNA, 19 nt, Homo sapiens
uccugcagcugccagauaa

SEQ ID NO: 1360721 - RNA, 19 nt, Homo sapiens
ggagcugccucggguucaa

SEQ ID NO: 1360722 - RNA, 19 nt, Homo sapiens
acggucaucuguguguuua

SEQ ID NO: 1360723 - RNA, 19 nt, Homo sapiens
agaggaagcuaugugagau

SEQ ID NO: 1360724 - RNA, 19 nt, Homo sapiens
ugagucacaguacuucuuu

SEQ ID NO: 1360725 - RNA, 19 nt, Homo sapiens
gaguaagagguugaagaua

SEQ ID NO: 1360726 - RNA, 19 nt, Homo sapiens
ucagaaagccacaccaaac

SEQ ID NO: 1360727 - RNA, 19 nt, Homo sapiens
caucacggcucuucuuuuc

SEQ ID NO: 1360728 - RNA, 19 nt, Homo sapiens
gaccuuguuaucagcauuu

SEQ ID NO: 1360729 - RNA, 19 nt, Homo sapiens
caaggaaccaaaccaacga

SEQ ID NO: 1360730 - RNA, 19 nt, Homo sapiens
gcaccaugacaguuuacaa

SEQ ID NO: 1360731 - RNA, 19 nt, Homo sapiens
gauaaaacagauugcagua

SEQ ID NO: 1360732 - RNA, 19 nt, Homo sapiens
gcacccaggcggauuaugc

SEQ ID NO: 1360733 - RNA, 19 nt, Homo sapiens
ggucaucuguguguuuaac

SEQ ID NO: 1360734 - RNA, 19 nt, Homo sapiens
ucuaggcgcugcucuuguc

SEQ ID NO: 1360735 - RNA, 19 nt, Homo sapiens
agauacaggucauaaagac

SEQ ID NO: 1360736 - RNA, 19 nt, Homo sapiens
acgauggguucuuucuaaa

SEQ ID NO: 1360737 - RNA, 19 nt, Homo sapiens
agacaaggguccagagaua

SEQ ID NO: 1360738 - RNA, 19 nt, Homo sapiens
ucgagucgcucuucagcua

SEQ ID NO: 1360739 - RNA, 19 nt, Homo sapiens
gggaaaggcugcucuugcu

SEQ ID NO: 1360740 - RNA, 19 nt, Homo sapiens
gccgcaagguggacauuau

SEQ ID NO: 1360741 - RNA, 19 nt, Homo sapiens
ugaagggaguccuggauag

SEQ ID NO: 1360742 - RNA, 19 nt, Homo sapiens
acaacacgcuggccuacga

SEQ ID NO: 1360743 - RNA, 19 nt, Homo sapiens
gugaagggaguccuggaua

SEQ ID NO: 1360744 - RNA, 19 nt, Homo sapiens
cagcaggccaccaagauga

SEQ ID NO: 1360745 - RNA, 19 nt, Homo sapiens
guacucgaacuaccuguug

SEQ ID NO: 1360746 - RNA, 19 nt, Homo sapiens
caugagagcccuuucuuuu

SEQ ID NO: 1360747 - RNA, 19 nt, Homo sapiens
gcagcaggccaccaagaug

SEQ ID NO: 1360748 - RNA, 19 nt, Homo sapiens
gagcugcgagcaccaguuc

SEQ ID NO: 1360749 - RNA, 19 nt, Homo sapiens
gaagggaguccuggauagu

SEQ ID NO: 1360750 - RNA, 19 nt, Homo sapiens
gcuugaggcucccuauacu

SEQ ID NO: 1360751 - RNA, 19 nt, Homo sapiens
ccugagggcuguccagaac

SEQ ID NO: 1360752 - RNA, 19 nt, Homo sapiens
ccaugagagcccuuucuuu

SEQ ID NO: 1360753 - RNA, 19 nt, Homo sapiens
ugagagcccuuucuuuuca

SEQ ID NO: 1360754 - RNA, 19 nt, Homo sapiens
gggcuugaggcucccuaua

SEQ ID NO: 1360755 - RNA, 19 nt, Homo sapiens
gagacaaggguccagagau

SEQ ID NO: 1360756 - RNA, 19 nt, Homo sapiens
caugaucgccgaguacuuc

SEQ ID NO: 1360757 - RNA, 19 nt, Homo sapiens
gugcggauuucgagacaag

SEQ ID NO: 1360758 - RNA, 19 nt, Homo sapiens
gcucagcccuagggaaagg

SEQ ID NO: 1360759 - RNA, 19 nt, Homo sapiens
agggaguccuggauaguga

SEQ ID NO: 1360760 - RNA, 19 nt, Homo sapiens
uugaggcucccuauacuuu

SEQ ID NO: 1360761 - RNA, 19 nt, Homo sapiens
caaccugucuuuuccaagu

SEQ ID NO: 1360762 - RNA, 19 nt, Homo sapiens
ugagggcuguccagaacug

SEQ ID NO: 1360763 - RNA, 19 nt, Homo sapiens
caacuucucggcgcacuuc

SEQ ID NO: 1360764 - RNA, 19 nt, Homo sapiens
gucccucgcugaacuuugg

SEQ ID NO: 1360765 - RNA, 19 nt, Homo sapiens
cgagacaaggguccagaga

SEQ ID NO: 1360766 - RNA, 19 nt, Homo sapiens
guucuuggguugggauuuu

SEQ ID NO: 1360767 - RNA, 19 nt, Homo sapiens
ggguacgccucccuaucug

SEQ ID NO: 1360768 - RNA, 19 nt, Homo sapiens
gacaaggguccagagauag

SEQ ID NO: 1360769 - RNA, 19 nt, Homo sapiens
ccagcugguuggugauuuu

SEQ ID NO: 1360770 - RNA, 19 nt, Homo sapiens
gggaacacuggcccugcua

SEQ ID NO: 1360771 - RNA, 19 nt, Homo sapiens
gcccagcaccgucuauguc

SEQ ID NO: 1360772 - RNA, 19 nt, Homo sapiens
caaacaaacuugcugaaua

SEQ ID NO: 1360773 - RNA, 19 nt, Homo sapiens
gaaaagagcuuagggaaua

SEQ ID NO: 1360774 - RNA, 19 nt, Homo sapiens
gaaaggaacauucgcaaua

SEQ ID NO: 1360775 - RNA, 19 nt, Homo sapiens
ggacuuaaccuauauacua

SEQ ID NO: 1360776 - RNA, 19 nt, Homo sapiens
gcagaaagcuggaacaagu

SEQ ID NO: 1360777 - RNA, 19 nt, Homo sapiens
caacauagccacccgaaua

SEQ ID NO: 1360778 - RNA, 19 nt, Homo sapiens
caugagaaauucagcauua

SEQ ID NO: 1360779 - RNA, 19 nt, Homo sapiens
ggaaacaugucacagauug

SEQ ID NO: 1360780 - RNA, 19 nt, Homo sapiens
gaaauuccauccaguucua

SEQ ID NO: 1360781 - RNA, 19 nt, Homo sapiens
gcaaagagucugagaaauu

SEQ ID NO: 1360782 - RNA, 19 nt, Homo sapiens
gaagugagcugagaaguuc

SEQ ID NO: 1360783 - RNA, 19 nt, Homo sapiens
gaauaugacuggccgauug

SEQ ID NO: 1360784 - RNA, 19 nt, Homo sapiens
gcuguuagcucagauauuu

SEQ ID NO: 1360785 - RNA, 19 nt, Homo sapiens
caauaaacccucagacuua

SEQ ID NO: 1360786 - RNA, 19 nt, Homo sapiens
gcagaaagcuucccugucu

SEQ ID NO: 1360787 - RNA, 19 nt, Homo sapiens
gagagggucuucagaugua

SEQ ID NO: 1360788 - RNA, 19 nt, Homo sapiens
ugucuuagaugguguaaua

SEQ ID NO: 1360789 - RNA, 19 nt, Homo sapiens
ccagggagccucuaauuua

SEQ ID NO: 1360790 - RNA, 19 nt, Homo sapiens
caaacuugcugaauaugua

SEQ ID NO: 1360791 - RNA, 19 nt, Homo sapiens
aaacaagccuccaaauuau

SEQ ID NO: 1360792 - RNA, 19 nt, Homo sapiens
gaaagaagacagcaagauu

SEQ ID NO: 1360793 - RNA, 19 nt, Homo sapiens
gcaugcagcuugacagaaa

SEQ ID NO: 1360794 - RNA, 19 nt, Homo sapiens
gaggacagauucagagaaa

SEQ ID NO: 1360795 - RNA, 19 nt, Homo sapiens
acagagagcuccaugcuuu

SEQ ID NO: 1360796 - RNA, 19 nt, Homo sapiens
gaagacagcauuccucuga

SEQ ID NO: 1360797 - RNA, 19 nt, Homo sapiens
guucauggcucuucauuau

SEQ ID NO: 1360798 - RNA, 19 nt, Homo sapiens
cauguuagcucaaagacua

SEQ ID NO: 1360799 - RNA, 19 nt, Homo sapiens
ugacagagauggcuccaaa

SEQ ID NO: 1360800 - RNA, 19 nt, Homo sapiens
ccucaaagcuguauuaucu

SEQ ID NO: 1360801 - RNA, 19 nt, Homo sapiens
cagcaucgguucacucuuu

SEQ ID NO: 1360802 - RNA, 19 nt, Homo sapiens
uaagacauguggcgaaauu

SEQ ID NO: 1360803 - RNA, 19 nt, Homo sapiens
uguauuaucugguguguuu

SEQ ID NO: 1360804 - RNA, 19 nt, Homo sapiens
ucacagggcuucaguagug

SEQ ID NO: 1360805 - RNA, 19 nt, Homo sapiens
gaacuaagagaaaccauug

SEQ ID NO: 1360806 - RNA, 19 nt, Homo sapiens
gcagcccucucuucaauaa

SEQ ID NO: 1360807 - RNA, 19 nt, Homo sapiens
caaagagucugagaaauuc

SEQ ID NO: 1360808 - RNA, 19 nt, Homo sapiens
aaacuggacuuucuuuguu

SEQ ID NO: 1360809 - RNA, 19 nt, Homo sapiens
ggcaucaucucaacaguuu

SEQ ID NO: 1360810 - RNA, 19 nt, Homo sapiens
gaacagugcagugcugaua

SEQ ID NO: 1360811 - RNA, 19 nt, Homo sapiens
caucucagcuuucagcaaa

SEQ ID NO: 1360812 - RNA, 19 nt, Homo sapiens
gaaacaagaagaaugagaa

SEQ ID NO: 1360813 - RNA, 19 nt, Homo sapiens
cuacaaagauggacuuauc

SEQ ID NO: 1360814 - RNA, 19 nt, Homo sapiens
gcauacugcucuuccgaua

SEQ ID NO: 1360815 - RNA, 19 nt, Homo sapiens
gaagccaccugucucagaa

SEQ ID NO: 1360816 - RNA, 19 nt, Homo sapiens
gaagaaaacucauagagau

SEQ ID NO: 1360817 - RNA, 19 nt, Homo sapiens
ugugaaaucuuccucagua

SEQ ID NO: 1360818 - RNA, 19 nt, Homo sapiens
guuaagagguguuucacuu

SEQ ID NO: 1360819 - RNA, 19 nt, Homo sapiens
aaaggaacauucgcaauaa

SEQ ID NO: 1360820 - RNA, 19 nt, Homo sapiens
caaagacuacccuacaaua

SEQ ID NO: 1360821 - RNA, 19 nt, Homo sapiens
ggagaaagaucaguauuuu

SEQ ID NO: 1360822 - RNA, 19 nt, Homo sapiens
cagaagauguuggguauga

SEQ ID NO: 1360823 - RNA, 19 nt, Homo sapiens
gagagagggucuucagaug

SEQ ID NO: 1360824 - RNA, 19 nt, Homo sapiens
gcaaacaaauacagaaugc

SEQ ID NO: 1360825 - RNA, 19 nt, Homo sapiens
gaucuacucucucagaaag

SEQ ID NO: 1360826 - RNA, 19 nt, Homo sapiens
cuacagauguuauaagcuu

SEQ ID NO: 1360827 - RNA, 19 nt, Homo sapiens
aaaugaagguaccgcuuua

SEQ ID NO: 1360828 - RNA, 19 nt, Homo sapiens
cagggagccucuaauuuaa

SEQ ID NO: 1360829 - RNA, 19 nt, Homo sapiens
caagugggaugucuuagau

SEQ ID NO: 1360830 - RNA, 19 nt, Homo sapiens
uugaagagcuuacugauuc

SEQ ID NO: 1360831 - RNA, 19 nt, Homo sapiens
gcagugaccuggacauguc

SEQ ID NO: 1360832 - RNA, 19 nt, Homo sapiens
aaaccaggcucuaaaguuc

SEQ ID NO: 1360833 - RNA, 19 nt, Homo sapiens
guauaugagucacugguuu

SEQ ID NO: 1360834 - RNA, 19 nt, Homo sapiens
cuggagaagugccaauuua

SEQ ID NO: 1360835 - RNA, 19 nt, Homo sapiens
ggaaaggacccuaaugaca

SEQ ID NO: 1360836 - RNA, 19 nt, Homo sapiens
caauggaagcuuaacuuua

SEQ ID NO: 1360837 - RNA, 19 nt, Homo sapiens
gcaauggaagcuuaacuuu

SEQ ID NO: 1360838 - RNA, 19 nt, Homo sapiens
gcaaggauacuccgagcua

SEQ ID NO: 1360839 - RNA, 19 nt, Homo sapiens
gcagacagcugggaugaca

SEQ ID NO: 1360840 - RNA, 19 nt, Homo sapiens
agugguggcucaacaaaua

SEQ ID NO: 1360841 - RNA, 19 nt, Homo sapiens
gaaaauaguuuggacaguu

SEQ ID NO: 1360842 - RNA, 19 nt, Homo sapiens
guuauaagcuuaagucacu

SEQ ID NO: 1360843 - RNA, 19 nt, Homo sapiens
agacuuaacuacagauguu

SEQ ID NO: 1360844 - RNA, 19 nt, Homo sapiens
gauaugcaacucagucuaa

SEQ ID NO: 1360845 - RNA, 19 nt, Homo sapiens
guugaugucugccuuaguu

SEQ ID NO: 1360846 - RNA, 19 nt, Homo sapiens
gcucccaguuguaauaauu

SEQ ID NO: 1360847 - RNA, 19 nt, Homo sapiens
caaaaggaaucugaacuua

SEQ ID NO: 1360848 - RNA, 19 nt, Homo sapiens
gaaaucuuccucaguaaug

SEQ ID NO: 1360849 - RNA, 19 nt, Homo sapiens
gauguugugcugcauguua

SEQ ID NO: 1360850 - RNA, 19 nt, Homo sapiens
gaugacagcaguucaguga

SEQ ID NO: 1360851 - RNA, 19 nt, Homo sapiens
ugaaggcccugaaacaaga

SEQ ID NO: 1360852 - RNA, 19 nt, Homo sapiens
gcaaguccaugaaugucaa

SEQ ID NO: 1360853 - RNA, 19 nt, Homo sapiens
aaaacaagccuccaaauua

SEQ ID NO: 1360854 - RNA, 19 nt, Homo sapiens
ucuaucugcugaagaaaua

SEQ ID NO: 1360855 - RNA, 19 nt, Homo sapiens
aauggaagcuuaacuuuag

SEQ ID NO: 1360856 - RNA, 19 nt, Homo sapiens
aaauugcaauggaagcuua

SEQ ID NO: 1360857 - RNA, 19 nt, Homo sapiens
ccgccaagaugcuaaauug

SEQ ID NO: 1360858 - RNA, 19 nt, Homo sapiens
gaaauugaaaggaacauuc

SEQ ID NO: 1360859 - RNA, 19 nt, Homo sapiens
aaacaagccuuugggaaga

SEQ ID NO: 1360860 - RNA, 19 nt, Homo sapiens
uaugaugacucccagcuuu

SEQ ID NO: 1360861 - RNA, 19 nt, Homo sapiens
gaaaaccgaugaugccaaa

SEQ ID NO: 1360862 - RNA, 19 nt, Homo sapiens
gaaggaccauacccaacuu

SEQ ID NO: 1360863 - RNA, 19 nt, Homo sapiens
guacaugaagccaauauau

SEQ ID NO: 1360864 - RNA, 19 nt, Homo sapiens
gauaggagaaagaucagua

SEQ ID NO: 1360865 - RNA, 19 nt, Homo sapiens
gaagaaauggauaggagaa

SEQ ID NO: 1360866 - RNA, 19 nt, Homo sapiens
ggagcucccaguuguaaua

SEQ ID NO: 1360867 - RNA, 19 nt, Homo sapiens
gugcagugcugauaauaau

SEQ ID NO: 1360868 - RNA, 19 nt, Homo sapiens
aaccaaaucuggaaggaaa

SEQ ID NO: 1360869 - RNA, 19 nt, Homo sapiens
ggucaaagccugugcauac

SEQ ID NO: 1360870 - RNA, 19 nt, Homo sapiens
caaagauggacuuaucaua

SEQ ID NO: 1360871 - RNA, 19 nt, Homo sapiens
gcacaacuauucggcuuuc

SEQ ID NO: 1360872 - RNA, 19 nt, Homo sapiens
gaaagcagcuccaucagua

SEQ ID NO: 1360873 - RNA, 19 nt, Homo sapiens
gcacaagacuuuaucagaa

SEQ ID NO: 1360874 - RNA, 19 nt, Homo sapiens
gcaaggaucugcaacugua

SEQ ID NO: 1360875 - RNA, 19 nt, Homo sapiens
caacucagcuguaacauau

SEQ ID NO: 1360876 - RNA, 19 nt, Homo sapiens
caacaaagcguucaguaua

SEQ ID NO: 1360877 - RNA, 19 nt, Homo sapiens
caacugaucuauccauauu

SEQ ID NO: 1360878 - RNA, 19 nt, Homo sapiens
acacugagcugcuggauuu

SEQ ID NO: 1360879 - RNA, 19 nt, Homo sapiens
gcacccauccucaauauua

SEQ ID NO: 1360880 - RNA, 19 nt, Homo sapiens
gagcaaaucuacagcauuc

SEQ ID NO: 1360881 - RNA, 19 nt, Homo sapiens
ggaagacccuacaaugaaa

SEQ ID NO: 1360882 - RNA, 19 nt, Homo sapiens
gaaggacuauggaaucuug

SEQ ID NO: 1360883 - RNA, 19 nt, Homo sapiens
gcagaggguuuauuaauag

SEQ ID NO: 1360884 - RNA, 19 nt, Homo sapiens
gaagaagaccaacaaguuu

SEQ ID NO: 1360885 - RNA, 19 nt, Homo sapiens
gagcagagccuggugaaua

SEQ ID NO: 1360886 - RNA, 19 nt, Homo sapiens
ggaggucucuuccagauug

SEQ ID NO: 1360887 - RNA, 19 nt, Homo sapiens
ggagaauguuugugucuuu

SEQ ID NO: 1360888 - RNA, 19 nt, Homo sapiens
gggcugagcugguuuagug

SEQ ID NO: 1360889 - RNA, 19 nt, Homo sapiens
gagcugagucccuuaauuu

SEQ ID NO: 1360890 - RNA, 19 nt, Homo sapiens
gacaacaucuccuugaaga

SEQ ID NO: 1360891 - RNA, 19 nt, Homo sapiens
caaccuagccaaccagaua

SEQ ID NO: 1360892 - RNA, 19 nt, Homo sapiens
ucaaaggucugaaggagaa

SEQ ID NO: 1360893 - RNA, 19 nt, Homo sapiens
gggaauaagugcugaagug

SEQ ID NO: 1360894 - RNA, 19 nt, Homo sapiens
gaagacaaaucugcuacaa

SEQ ID NO: 1360895 - RNA, 19 nt, Homo sapiens
gccaaagccugaagauauu

SEQ ID NO: 1360896 - RNA, 19 nt, Homo sapiens
ugagaaggccauaguaaua

SEQ ID NO: 1360897 - RNA, 19 nt, Homo sapiens
ggaaccaguugccaaggua

SEQ ID NO: 1360898 - RNA, 19 nt, Homo sapiens
ucaagaagcugccaacuac

SEQ ID NO: 1360899 - RNA, 19 nt, Homo sapiens
gaauacaaccuucagagaa

SEQ ID NO: 1360900 - RNA, 19 nt, Homo sapiens
gaaguuaggagaauguuug

SEQ ID NO: 1360901 - RNA, 19 nt, Homo sapiens
agacaaaucugcuacaagu

SEQ ID NO: 1360902 - RNA, 19 nt, Homo sapiens
gaaggaaucacaguuauau

SEQ ID NO: 1360903 - RNA, 19 nt, Homo sapiens
gaaaugaagcuuacagaca

SEQ ID NO: 1360904 - RNA, 19 nt, Homo sapiens
gggcaaagcuacagacaag

SEQ ID NO: 1360905 - RNA, 19 nt, Homo sapiens
ugacuaagcuaaaguuaag

SEQ ID NO: 1360906 - RNA, 19 nt, Homo sapiens
gauccuaccuuugcagauu

SEQ ID NO: 1360907 - RNA, 19 nt, Homo sapiens
caucggcccuugcuucuuu

SEQ ID NO: 1360908 - RNA, 19 nt, Homo sapiens
ccaaagaacuucggaucaa

SEQ ID NO: 1360909 - RNA, 19 nt, Homo sapiens
gaagaucccuaaccaacuc

SEQ ID NO: 1360910 - RNA, 19 nt, Homo sapiens
caagucagcuuccucauac

SEQ ID NO: 1360911 - RNA, 19 nt, Homo sapiens
guagggaacuggaaucauc

SEQ ID NO: 1360912 - RNA, 19 nt, Homo sapiens
ggccaaagccugaagauau

SEQ ID NO: 1360913 - RNA, 19 nt, Homo sapiens
guugagcgcuucacucuau

SEQ ID NO: 1360914 - RNA, 19 nt, Homo sapiens
gaucuaggccucuucuaaa

SEQ ID NO: 1360915 - RNA, 19 nt, Homo sapiens
gauggagccugaaggacua

SEQ ID NO: 1360916 - RNA, 19 nt, Homo sapiens
gaucaucccaaucagaaua

SEQ ID NO: 1360917 - RNA, 19 nt, Homo sapiens
ucacagacccuucccaauu

SEQ ID NO: 1360918 - RNA, 19 nt, Homo sapiens
gcacagcaccucagacuuc

SEQ ID NO: 1360919 - RNA, 19 nt, Homo sapiens
gagaaggaaaugaagcuua

SEQ ID NO: 1360920 - RNA, 19 nt, Homo sapiens
caaggaugcugaugcgaaa

SEQ ID NO: 1360921 - RNA, 19 nt, Homo sapiens
agacaaaacuccucagaua

SEQ ID NO: 1360922 - RNA, 19 nt, Homo sapiens
gagcgaagauggcaaaucg

SEQ ID NO: 1360923 - RNA, 19 nt, Homo sapiens
gagaaggccauaguaauaa

SEQ ID NO: 1360924 - RNA, 19 nt, Homo sapiens
ccauauuccuuaaguacua

SEQ ID NO: 1360925 - RNA, 19 nt, Homo sapiens
gcaguuugcuguugcuguu

SEQ ID NO: 1360926 - RNA, 19 nt, Homo sapiens
agaagaauccagccuaaua

SEQ ID NO: 1360927 - RNA, 19 nt, Homo sapiens
cauagaaacccugcauuua

SEQ ID NO: 1360928 - RNA, 19 nt, Homo sapiens
gggaagacccuacaaugaa

SEQ ID NO: 1360929 - RNA, 19 nt, Homo sapiens
gaaucuugcuugucaggaa

SEQ ID NO: 1360930 - RNA, 19 nt, Homo sapiens
cacaagaccugggcccuua

SEQ ID NO: 1360931 - RNA, 19 nt, Homo sapiens
gccaauaccugccuuccaa

SEQ ID NO: 1360932 - RNA, 19 nt, Homo sapiens
ccaagacgcuguccaaguc

SEQ ID NO: 1360933 - RNA, 19 nt, Homo sapiens
ugcagaggguuuauuaaua

SEQ ID NO: 1360934 - RNA, 19 nt, Homo sapiens
gaccugggcccuuaaguuu

SEQ ID NO: 1360935 - RNA, 19 nt, Homo sapiens
ccagaaaacugaaaacauu

SEQ ID NO: 1360936 - RNA, 19 nt, Homo sapiens
uaugagacaugaagcauug

SEQ ID NO: 1360937 - RNA, 19 nt, Homo sapiens
guaaaugggcgcaagacua

SEQ ID NO: 1360938 - RNA, 19 nt, Homo sapiens
gaacucaacaauagugcua

SEQ ID NO: 1360939 - RNA, 19 nt, Homo sapiens
ccuuaugccuuggaaauua

SEQ ID NO: 1360940 - RNA, 19 nt, Homo sapiens
caccaucucuucacuucua

SEQ ID NO: 1360941 - RNA, 19 nt, Homo sapiens
ugaagaagaccaacaaguu

SEQ ID NO: 1360942 - RNA, 19 nt, Homo sapiens
ugaaaucacugccuuaagg

SEQ ID NO: 1360943 - RNA, 19 nt, Homo sapiens
ccaaggagccagcuagaaa

SEQ ID NO: 1360944 - RNA, 19 nt, Homo sapiens
gaucugcaacuguaucuuu

SEQ ID NO: 1360945 - RNA, 19 nt, Homo sapiens
gcgagaaaccauagacuuu

SEQ ID NO: 1360946 - RNA, 19 nt, Homo sapiens
caacuuaccaacauaguga

SEQ ID NO: 1360947 - RNA, 19 nt, Homo sapiens
aagacuagcuuagauguuu

SEQ ID NO: 1360948 - RNA, 19 nt, Homo sapiens
aauacaaccuucagagaaa

SEQ ID NO: 1360949 - RNA, 19 nt, Homo sapiens
caaccugacuacggauaua

SEQ ID NO: 1360950 - RNA, 19 nt, Homo sapiens
ucagaagaauccagccuaa

SEQ ID NO: 1360951 - RNA, 19 nt, Homo sapiens
ggcaaucccuguucuuuca

SEQ ID NO: 1360952 - RNA, 19 nt, Homo sapiens
gggcuuauaugagacauga

SEQ ID NO: 1360953 - RNA, 19 nt, Homo sapiens
ggagagagaggaaccaguu

SEQ ID NO: 1360954 - RNA, 19 nt, Homo sapiens
aacaaagcguucaguauaa

SEQ ID NO: 1360955 - RNA, 19 nt, Homo sapiens
gagcugacuuggaguggaa

SEQ ID NO: 1360956 - RNA, 19 nt, Homo sapiens
ccugagagcugugaugauu

SEQ ID NO: 1360957 - RNA, 19 nt, Homo sapiens
gaaagaggacagugcagaa

SEQ ID NO: 1360958 - RNA, 19 nt, Homo sapiens
gaucuauccauauuccuua

SEQ ID NO: 1360959 - RNA, 19 nt, Homo sapiens
ggauguuacuggcuacuug

SEQ ID NO: 1360960 - RNA, 19 nt, Homo sapiens
aaagaagcaugugguuuaa

SEQ ID NO: 1360961 - RNA, 19 nt, Homo sapiens
gcacuucccaugucucuga

SEQ ID NO: 1360962 - RNA, 19 nt, Homo sapiens
uaucuaaugucaaccaaug

SEQ ID NO: 1360963 - RNA, 19 nt, Homo sapiens
ucacugcccuagaauuuau

SEQ ID NO: 1360964 - RNA, 19 nt, Homo sapiens
uaacuuagaaggaagagaa

SEQ ID NO: 1360965 - RNA, 19 nt, Homo sapiens
gguaagcucccauggauga

SEQ ID NO: 1360966 - RNA, 19 nt, Homo sapiens
gaaagaggagggacagguu

SEQ ID NO: 1360967 - RNA, 19 nt, Homo sapiens
guacagcggcucccaaaug

SEQ ID NO: 1360968 - RNA, 19 nt, Homo sapiens
gcgcaagacuagcuuagau

SEQ ID NO: 1360969 - RNA, 19 nt, Homo sapiens
gaagaauacugggcuccaa

SEQ ID NO: 1360970 - RNA, 19 nt, Homo sapiens
cagaagauguagccuugaa

SEQ ID NO: 1360971 - RNA, 19 nt, Homo sapiens
gauauacuacucacaaguu

SEQ ID NO: 1360972 - RNA, 19 nt, Homo sapiens
gaacagaucccaaaugauu

SEQ ID NO: 1360973 - RNA, 19 nt, Homo sapiens
caaaugcccuuacauaauu

SEQ ID NO: 1360974 - RNA, 19 nt, Homo sapiens
ccacaucucuuucuuauug

SEQ ID NO: 1360975 - RNA, 19 nt, Homo sapiens
cagcauagauuccaacauu

SEQ ID NO: 1360976 - RNA, 19 nt, Homo sapiens
gaaggaggcaggcauguua

SEQ ID NO: 1360977 - RNA, 19 nt, Homo sapiens
uaagauaguugucagcuuu

SEQ ID NO: 1360978 - RNA, 19 nt, Homo sapiens
gaacaaugcuguggacaug

SEQ ID NO: 1360979 - RNA, 19 nt, Homo sapiens
gaaguacucugcccaggaa

SEQ ID NO: 1360980 - RNA, 19 nt, Homo sapiens
gagaagagcagaaccauga

SEQ ID NO: 1360981 - RNA, 19 nt, Homo sapiens
ccauugagcugcuaaagaa

SEQ ID NO: 1360982 - RNA, 19 nt, Homo sapiens
gaacugcacuaccuucugu

SEQ ID NO: 1360983 - RNA, 19 nt, Homo sapiens
gaagagaucaggaauggaa

SEQ ID NO: 1360984 - RNA, 19 nt, Homo sapiens
ccacaaaugcccuuacaua

SEQ ID NO: 1360985 - RNA, 19 nt, Homo sapiens
gagaaggacuccagcucua

SEQ ID NO: 1360986 - RNA, 19 nt, Homo sapiens
ggaggaagcucauggaaac

SEQ ID NO: 1360987 - RNA, 19 nt, Homo sapiens
gagcucaacugcaaaggaa

SEQ ID NO: 1360988 - RNA, 19 nt, Homo sapiens
gcaagaagaugcaaaagaa

SEQ ID NO: 1360989 - RNA, 19 nt, Homo sapiens
gaccacaucucuuucuuau

SEQ ID NO: 1360990 - RNA, 19 nt, Homo sapiens
gacagccgcuuccggaaua

SEQ ID NO: 1360991 - RNA, 19 nt, Homo sapiens
gagagacccugcaacgaaa

SEQ ID NO: 1360992 - RNA, 19 nt, Homo sapiens
aagaacagaucccaaauga

SEQ ID NO: 1360993 - RNA, 19 nt, Homo sapiens
gaaaugaguuaagagacaa

SEQ ID NO: 1360994 - RNA, 19 nt, Homo sapiens
gcaagaauguggaccucaa

SEQ ID NO: 1360995 - RNA, 19 nt, Homo sapiens
gcaaaucccucagcgugaa

SEQ ID NO: 1360996 - RNA, 19 nt, Homo sapiens
ggagaaggauaaggagaaa

SEQ ID NO: 1360997 - RNA, 19 nt, Homo sapiens
gaaggugacccgcugauga

SEQ ID NO: 1360998 - RNA, 19 nt, Homo sapiens
cagaaugcauggauaguga

SEQ ID NO: 1360999 - RNA, 19 nt, Homo sapiens
gaacagagucuugguaaca

SEQ ID NO: 1361000 - RNA, 19 nt, Homo sapiens
ggaacaagauucaacuuuu

SEQ ID NO: 1361001 - RNA, 19 nt, Homo sapiens
cagcaacacuuccgaaaca

SEQ ID NO: 1361002 - RNA, 19 nt, Homo sapiens
gagaugaagcugacggaua

SEQ ID NO: 1361003 - RNA, 19 nt, Homo sapiens
gaugacggauucuucuuug

SEQ ID NO: 1361004 - RNA, 19 nt, Homo sapiens
cgaaaugaguuaagagaca

SEQ ID NO: 1361005 - RNA, 19 nt, Homo sapiens
ggaacacuuugccuaagaa

SEQ ID NO: 1361006 - RNA, 19 nt, Homo sapiens
ccaaccggcugucugagua

SEQ ID NO: 1361007 - RNA, 19 nt, Homo sapiens
gcugaaagcugagaaugau

SEQ ID NO: 1361008 - RNA, 19 nt, Homo sapiens
agaugaagcugacggauau

SEQ ID NO: 1361009 - RNA, 19 nt, Homo sapiens
gcagcaacauagagaguga

SEQ ID NO: 1361010 - RNA, 19 nt, Homo sapiens
caagaagaauccugucauc

SEQ ID NO: 1361011 - RNA, 19 nt, Homo sapiens
gaagaacagaucccaaaug

SEQ ID NO: 1361012 - RNA, 19 nt, Homo sapiens
ucagggaucuccagcaaga

SEQ ID NO: 1361013 - RNA, 19 nt, Homo sapiens
ucaaugggcugcucaacug

SEQ ID NO: 1361014 - RNA, 19 nt, Homo sapiens
guucuuggcuacagcauug

SEQ ID NO: 1361015 - RNA, 19 nt, Homo sapiens
ggaagaacugggucaauga

SEQ ID NO: 1361016 - RNA, 19 nt, Homo sapiens
gcacaucgucaguuuauuc

SEQ ID NO: 1361017 - RNA, 19 nt, Homo sapiens
gcagguucaucaacacuga

SEQ ID NO: 1361018 - RNA, 19 nt, Homo sapiens
gaauguuacugccgaguca

SEQ ID NO: 1361019 - RNA, 19 nt, Homo sapiens
ugaauuuccuggcagcuaa

SEQ ID NO: 1361020 - RNA, 19 nt, Homo sapiens
uuagacggcuguucaaaga

SEQ ID NO: 1361021 - RNA, 19 nt, Homo sapiens
gcccuaagcucccggacaa

SEQ ID NO: 1361022 - RNA, 19 nt, Homo sapiens
gaaaggcaaugagaaagag

SEQ ID NO: 1361023 - RNA, 19 nt, Homo sapiens
cgacgcagccagagcuuua

SEQ ID NO: 1361024 - RNA, 19 nt, Homo sapiens
caccugagcucaacugcaa

SEQ ID NO: 1361025 - RNA, 19 nt, Homo sapiens
gaaucaggaugacggguau

SEQ ID NO: 1361026 - RNA, 19 nt, Homo sapiens
ggucggaagucaaguaugg

SEQ ID NO: 1361027 - RNA, 19 nt, Homo sapiens
gugaugaugucaagaaauc

SEQ ID NO: 1361028 - RNA, 19 nt, Homo sapiens
ugaacaggaugcagaguga

SEQ ID NO: 1361029 - RNA, 19 nt, Homo sapiens
gaacaagauucaacuuuuc

SEQ ID NO: 1361030 - RNA, 19 nt, Homo sapiens
guaacucggugaaagugaa

SEQ ID NO: 1361031 - RNA, 19 nt, Homo sapiens
gcaaugagaaagagaagga

SEQ ID NO: 1361032 - RNA, 19 nt, Homo sapiens
cagaagagaucaggaaugg

SEQ ID NO: 1361033 - RNA, 19 nt, Homo sapiens
uaccuucuguuguacuuua

SEQ ID NO: 1361034 - RNA, 19 nt, Homo sapiens
gcaggcauguuaagauagu

SEQ ID NO: 1361035 - RNA, 19 nt, Homo sapiens
gcaguccucucuacagcaa

SEQ ID NO: 1361036 - RNA, 19 nt, Homo sapiens
agaaaggcaucucaucaga

SEQ ID NO: 1361037 - RNA, 19 nt, Homo sapiens
gcaaaggugucugagaaag

SEQ ID NO: 1361038 - RNA, 19 nt, Homo sapiens
gcacugaccaacaagaaga

SEQ ID NO: 1361039 - RNA, 19 nt, Homo sapiens
auagaugccugcuugaauu

SEQ ID NO: 1361040 - RNA, 19 nt, Homo sapiens
ugaaagggcucgcagaaaa

SEQ ID NO: 1361041 - RNA, 19 nt, Homo sapiens
ccaacucucuaauuucaga

SEQ ID NO: 1361042 - RNA, 19 nt, Homo sapiens
ggacaccgcugccaauucc

SEQ ID NO: 1361043 - RNA, 19 nt, Homo sapiens
caucagggaucuccagcaa

SEQ ID NO: 1361044 - RNA, 19 nt, Homo sapiens
gcacgucgggcaagaagaa

SEQ ID NO: 1361045 - RNA, 19 nt, Homo sapiens
gaggaaaccauguccaguu

SEQ ID NO: 1361046 - RNA, 19 nt, Homo sapiens
cacaaaugcccuuacauaa

SEQ ID NO: 1361047 - RNA, 19 nt, Homo sapiens
gaagugggaugugcucgau

SEQ ID NO: 1361048 - RNA, 19 nt, Homo sapiens
aggcaggcauguuaagaua

SEQ ID NO: 1361049 - RNA, 19 nt, Homo sapiens
ggauggguuugaagaaguu

SEQ ID NO: 1361050 - RNA, 19 nt, Homo sapiens
gagcagcaguccucucuac

SEQ ID NO: 1361051 - RNA, 19 nt, Homo sapiens
acgcaaaggugucugagaa

SEQ ID NO: 1361052 - RNA, 19 nt, Homo sapiens
cgagagacccugcaacgaa

SEQ ID NO: 1361053 - RNA, 19 nt, Homo sapiens
gaaaucaagcgcagcaaca

SEQ ID NO: 1361054 - RNA, 19 nt, Homo sapiens
caacagcgggagaaggaua

SEQ ID NO: 1361055 - RNA, 19 nt, Homo sapiens
cuacgucucccuccugaua

SEQ ID NO: 1361056 - RNA, 19 nt, Homo sapiens
ggaugacacuggugaaugc

SEQ ID NO: 1361057 - RNA, 19 nt, Homo sapiens
gcagaaggacucagaacug

SEQ ID NO: 1361058 - RNA, 19 nt, Homo sapiens
uaagaaaggacucagguau

SEQ ID NO: 1361059 - RNA, 19 nt, Homo sapiens
ggaagcucauggaaacaga

SEQ ID NO: 1361060 - RNA, 19 nt, Homo sapiens
cacaauggguccacagguu

SEQ ID NO: 1361061 - RNA, 19 nt, Homo sapiens
cggaagaacugggucaaug

SEQ ID NO: 1361062 - RNA, 19 nt, Homo sapiens
gcuccuccaucagcucuua

SEQ ID NO: 1361063 - RNA, 19 nt, Homo sapiens
ugaagaacaucgcugaucu

SEQ ID NO: 1361064 - RNA, 19 nt, Homo sapiens
gagcagcugugcccgagau

SEQ ID NO: 1361065 - RNA, 19 nt, Homo sapiens
cagacugggccaaucauua

SEQ ID NO: 1361066 - RNA, 19 nt, Homo sapiens
ggagagaacacgaccaucu

SEQ ID NO: 1361067 - RNA, 19 nt, Homo sapiens
gcuccgaaaugaguuaaga

SEQ ID NO: 1361068 - RNA, 19 nt, Homo sapiens
aaaggcaucucaucagaca

SEQ ID NO: 1361069 - RNA, 19 nt, Homo sapiens
gcaauaccgucaguguuca

SEQ ID NO: 1361070 - RNA, 19 nt, Homo sapiens
gaagcaauaccgucagugu

SEQ ID NO: 1361071 - RNA, 19 nt, Homo sapiens
gaacuaacagugugaagac

SEQ ID NO: 1361072 - RNA, 19 nt, Homo sapiens
gaacagaucccaaaugauu

SEQ ID NO: 1361073 - RNA, 19 nt, Homo sapiens
caaaugcccuuacauaauu

SEQ ID NO: 1361074 - RNA, 19 nt, Homo sapiens
ccacaucucuuucuuauug

SEQ ID NO: 1361075 - RNA, 19 nt, Homo sapiens
cagcauagauuccaacauu

SEQ ID NO: 1361076 - RNA, 19 nt, Homo sapiens
gaaggaggcaggcauguua

SEQ ID NO: 1361077 - RNA, 19 nt, Homo sapiens
uaagauaguugucagcuuu

SEQ ID NO: 1361078 - RNA, 19 nt, Homo sapiens
gaacaaugcuguggacaug

SEQ ID NO: 1361079 - RNA, 19 nt, Homo sapiens
gaaguacucugcccaggaa

SEQ ID NO: 1361080 - RNA, 19 nt, Homo sapiens
gagaagagcagaaccauga

SEQ ID NO: 1361081 - RNA, 19 nt, Homo sapiens
ccauugagcugcuaaagaa

SEQ ID NO: 1361082 - RNA, 19 nt, Homo sapiens
gaacugcacuaccuucugu

SEQ ID NO: 1361083 - RNA, 19 nt, Homo sapiens
gaagagaucaggaauggaa

SEQ ID NO: 1361084 - RNA, 19 nt, Homo sapiens
ccacaaaugcccuuacaua

SEQ ID NO: 1361085 - RNA, 19 nt, Homo sapiens
gagaaggacuccagcucua

SEQ ID NO: 1361086 - RNA, 19 nt, Homo sapiens
ggaggaagcucauggaaac

SEQ ID NO: 1361087 - RNA, 19 nt, Homo sapiens
gagcucaacugcaaaggaa

SEQ ID NO: 1361088 - RNA, 19 nt, Homo sapiens
gcaagaagaugcaaaagaa

SEQ ID NO: 1361089 - RNA, 19 nt, Homo sapiens
gaccacaucucuuucuuau

SEQ ID NO: 1361090 - RNA, 19 nt, Homo sapiens
gacagccgcuuccggaaua

SEQ ID NO: 1361091 - RNA, 19 nt, Homo sapiens
aagaacagaucccaaauga

SEQ ID NO: 1361092 - RNA, 19 nt, Homo sapiens
gaaaugaguuaagagacaa

SEQ ID NO: 1361093 - RNA, 19 nt, Homo sapiens
gcaagaauguggaccucaa

SEQ ID NO: 1361094 - RNA, 19 nt, Homo sapiens
gcaaaucccucagcgugaa

SEQ ID NO: 1361095 - RNA, 19 nt, Homo sapiens
ggagaaggauaaggagaaa

SEQ ID NO: 1361096 - RNA, 19 nt, Homo sapiens
gaaggugacccgcugauga

SEQ ID NO: 1361097 - RNA, 19 nt, Homo sapiens
cagaaugcauggauaguga

SEQ ID NO: 1361098 - RNA, 19 nt, Homo sapiens
gaacagagucuugguaaca

SEQ ID NO: 1361099 - RNA, 19 nt, Homo sapiens
ggaacaagauucaacuuuu

SEQ ID NO: 1361100 - RNA, 19 nt, Homo sapiens
cagcaacacuuccgaaaca

SEQ ID NO: 1361101 - RNA, 19 nt, Homo sapiens
gagaugaagcugacggaua

SEQ ID NO: 1361102 - RNA, 19 nt, Homo sapiens
gaugacggauucuucuuug

SEQ ID NO: 1361103 - RNA, 19 nt, Homo sapiens
cgaaaugaguuaagagaca

SEQ ID NO: 1361104 - RNA, 19 nt, Homo sapiens
ggaacacuuugccuaagaa

SEQ ID NO: 1361105 - RNA, 19 nt, Homo sapiens
ccaaacagauaaggagaaa

SEQ ID NO: 1361106 - RNA, 19 nt, Homo sapiens
ccaaccggcugucugagua

SEQ ID NO: 1361107 - RNA, 19 nt, Homo sapiens
gcugaaagcugagaaugau

SEQ ID NO: 1361108 - RNA, 19 nt, Homo sapiens
agaugaagcugacggauau

SEQ ID NO: 1361109 - RNA, 19 nt, Homo sapiens
gcagcaacauagagaguga

SEQ ID NO: 1361110 - RNA, 19 nt, Homo sapiens
caagaagaauccugucauc

SEQ ID NO: 1361111 - RNA, 19 nt, Homo sapiens
gaagaacagaucccaaaug

SEQ ID NO: 1361112 - RNA, 19 nt, Homo sapiens
ucagggaucuccagcaaga

SEQ ID NO: 1361113 - RNA, 19 nt, Homo sapiens
ucaaugggcugcucaacug

SEQ ID NO: 1361114 - RNA, 19 nt, Homo sapiens
guucuuggcuacagcauug

SEQ ID NO: 1361115 - RNA, 19 nt, Homo sapiens
gcacaucgucaguuuauuc

SEQ ID NO: 1361116 - RNA, 19 nt, Homo sapiens
gggagacccugcaacgaaa

SEQ ID NO: 1361117 - RNA, 19 nt, Homo sapiens
gcagguucaucaacacuga

SEQ ID NO: 1361118 - RNA, 19 nt, Homo sapiens
gaauguuacugccgaguca

SEQ ID NO: 1361119 - RNA, 19 nt, Homo sapiens
ugaauuuccuggcagcuaa

SEQ ID NO: 1361120 - RNA, 19 nt, Homo sapiens
uuagacggcuguucaaaga

SEQ ID NO: 1361121 - RNA, 19 nt, Homo sapiens
gcccuaagcucccggacaa

SEQ ID NO: 1361122 - RNA, 19 nt, Homo sapiens
gaaaggcaaugagaaagag

SEQ ID NO: 1361123 - RNA, 19 nt, Homo sapiens
cgacgcagccagagcuuua

SEQ ID NO: 1361124 - RNA, 19 nt, Homo sapiens
caccugagcucaacugcaa

SEQ ID NO: 1361125 - RNA, 19 nt, Homo sapiens
gaaucaggaugacggguau

SEQ ID NO: 1361126 - RNA, 19 nt, Homo sapiens
ggucggaagucaaguaugg

SEQ ID NO: 1361127 - RNA, 19 nt, Homo sapiens
gugaugaugucaagaaauc

SEQ ID NO: 1361128 - RNA, 19 nt, Homo sapiens
ugaacaggaugcagaguga

SEQ ID NO: 1361129 - RNA, 19 nt, Homo sapiens
gaacaagauucaacuuuuc

SEQ ID NO: 1361130 - RNA, 19 nt, Homo sapiens
guaacucggugaaagugaa

SEQ ID NO: 1361131 - RNA, 19 nt, Homo sapiens
gcaaugagaaagagaagga

SEQ ID NO: 1361132 - RNA, 19 nt, Homo sapiens
cagaagagaucaggaaugg

SEQ ID NO: 1361133 - RNA, 19 nt, Homo sapiens
uaccuucuguuguacuuua

SEQ ID NO: 1361134 - RNA, 19 nt, Homo sapiens
gcaggcauguuaagauagu

SEQ ID NO: 1361135 - RNA, 19 nt, Homo sapiens
gcaguccucucuacagcaa

SEQ ID NO: 1361136 - RNA, 19 nt, Homo sapiens
agaaaggcaucucaucaga

SEQ ID NO: 1361137 - RNA, 19 nt, Homo sapiens
gcaaaggugucugagaaag

SEQ ID NO: 1361138 - RNA, 19 nt, Homo sapiens
gcacugaccaacaagaaga

SEQ ID NO: 1361139 - RNA, 19 nt, Homo sapiens
auagaugccugcuugaauu

SEQ ID NO: 1361140 - RNA, 19 nt, Homo sapiens
ugaaagggcucgcagaaaa

SEQ ID NO: 1361141 - RNA, 19 nt, Homo sapiens
ccaacucucuaauuucaga

SEQ ID NO: 1361142 - RNA, 19 nt, Homo sapiens
ggacaccgcugccaauucc

SEQ ID NO: 1361143 - RNA, 19 nt, Homo sapiens
caucagggaucuccagcaa

SEQ ID NO: 1361144 - RNA, 19 nt, Homo sapiens
gcacgucgggcaagaagaa

SEQ ID NO: 1361145 - RNA, 19 nt, Homo sapiens
gaggaaaccauguccaguu

SEQ ID NO: 1361146 - RNA, 19 nt, Homo sapiens
cacaaaugcccuuacauaa

SEQ ID NO: 1361147 - RNA, 19 nt, Homo sapiens
gaagugggaugugcucgau

SEQ ID NO: 1361148 - RNA, 19 nt, Homo sapiens
aggcaggcauguuaagaua

SEQ ID NO: 1361149 - RNA, 19 nt, Homo sapiens
ggauggguuugaagaaguu

SEQ ID NO: 1361150 - RNA, 19 nt, Homo sapiens
gagcagcaguccucucuac

SEQ ID NO: 1361151 - RNA, 19 nt, Homo sapiens
acgcaaaggugucugagaa

SEQ ID NO: 1361152 - RNA, 19 nt, Homo sapiens
gaaaucaagcgcagcaaca

SEQ ID NO: 1361153 - RNA, 19 nt, Homo sapiens
caacagcgggagaaggaua

SEQ ID NO: 1361154 - RNA, 19 nt, Homo sapiens
cuacgucucccuccugaua

SEQ ID NO: 1361155 - RNA, 19 nt, Homo sapiens
ggaugacacuggugaaugc

SEQ ID NO: 1361156 - RNA, 19 nt, Homo sapiens
gcagaaggacucagaacug

SEQ ID NO: 1361157 - RNA, 19 nt, Homo sapiens
uaagaaaggacucagguau

SEQ ID NO: 1361158 - RNA, 19 nt, Homo sapiens
ggaagcucauggaaacaga

SEQ ID NO: 1361159 - RNA, 19 nt, Homo sapiens
cacaauggguccacagguu

SEQ ID NO: 1361160 - RNA, 19 nt, Homo sapiens
gcuccuccaucagcucuua

SEQ ID NO: 1361161 - RNA, 19 nt, Homo sapiens
ugaagaacaucgcugaucu

SEQ ID NO: 1361162 - RNA, 19 nt, Homo sapiens
gagcagcugugcccgagau

SEQ ID NO: 1361163 - RNA, 19 nt, Homo sapiens
cagacugggccaaucauua

SEQ ID NO: 1361164 - RNA, 19 nt, Homo sapiens
ggagagaacacgaccaucu

SEQ ID NO: 1361165 - RNA, 19 nt, Homo sapiens
gcuccgaaaugaguuaaga

SEQ ID NO: 1361166 - RNA, 19 nt, Homo sapiens
aaaggcaucucaucagaca

SEQ ID NO: 1361167 - RNA, 19 nt, Homo sapiens
gcaauaccgucaguguuca

SEQ ID NO: 1361168 - RNA, 19 nt, Homo sapiens
gaagcaauaccgucagugu

SEQ ID NO: 1361169 - RNA, 19 nt, Homo sapiens
gaacuaacagugugaagac

SEQ ID NO: 1361170 - RNA, 19 nt, Homo sapiens
gcucaacagugccaagaag

SEQ ID NO: 1361171 - RNA, 19 nt, Homo sapiens
acaaaugcccuuacauaau

SEQ ID NO: 1361172 - RNA, 19 nt, Homo sapiens
gcagcuauaugauuaauuc

SEQ ID NO: 1361173 - RNA, 19 nt, Homo sapiens
gcaaggacagcuaguuaua

SEQ ID NO: 1361174 - RNA, 19 nt, Homo sapiens
gggugcagcuauaugauua

SEQ ID NO: 1361175 - RNA, 19 nt, Homo sapiens
ugaaguagcggcaauguuu

SEQ ID NO: 1361176 - RNA, 19 nt, Homo sapiens
gaucacagagccauccuaa

SEQ ID NO: 1361177 - RNA, 19 nt, Homo sapiens
ccaauaggguauacagaga

SEQ ID NO: 1361178 - RNA, 19 nt, Homo sapiens
gauuaauucugcccaauag

SEQ ID NO: 1361179 - RNA, 19 nt, Homo sapiens
ucacagagccauccuaaca

SEQ ID NO: 1361180 - RNA, 19 nt, Homo sapiens
acagagccauccuaacaaa

SEQ ID NO: 1361181 - RNA, 19 nt, Homo sapiens
gagucuggaucucugauga

SEQ ID NO: 1361182 - RNA, 19 nt, Homo sapiens
uguuugagcggcacaauua

SEQ ID NO: 1361183 - RNA, 19 nt, Homo sapiens
gcaagaccccugauuuuaa

SEQ ID NO: 1361184 - RNA, 19 nt, Homo sapiens
gggaugucguccaagcaua

SEQ ID NO: 1361185 - RNA, 19 nt, Homo sapiens
caccgacccuccuuuaugu

SEQ ID NO: 1361186 - RNA, 19 nt, Homo sapiens
gagccagccuccucagcaa

SEQ ID NO: 1361187 - RNA, 19 nt, Homo sapiens
gcacauguccacccaaacu

SEQ ID NO: 1361188 - RNA, 19 nt, Homo sapiens
agugggagcuguugcagaa

SEQ ID NO: 1361189 - RNA, 19 nt, Homo sapiens
uaucaccgacccuccuuua

SEQ ID NO: 1361190 - RNA, 19 nt, Homo sapiens
gaaguagcggcaauguuug

SEQ ID NO: 1361191 - RNA, 19 nt, Homo sapiens
uggcaaggacagcuaguua

SEQ ID NO: 1361192 - RNA, 19 nt, Homo sapiens
gcgacuacgugauuggaau

SEQ ID NO: 1361193 - RNA, 19 nt, Homo sapiens
cauccuaacaaacggaaua

SEQ ID NO: 1361194 - RNA, 19 nt, Homo sapiens
uggcauggcuggccuugau

SEQ ID NO: 1361195 - RNA, 19 nt, Homo sapiens
acacagagggcuucuacuu

SEQ ID NO: 1361196 - RNA, 19 nt, Homo sapiens
ugauuaauucugcccaaua

SEQ ID NO: 1361197 - RNA, 19 nt, Homo sapiens
ccuaacaaacggaauauca

SEQ ID NO: 1361198 - RNA, 19 nt, Homo sapiens
ucaccgacccuccuuuaug

SEQ ID NO: 1361199 - RNA, 19 nt, Homo sapiens
acaauuagauaggaagagu

SEQ ID NO: 1361200 - RNA, 19 nt, Homo sapiens
gcacaauuagauaggaaga

SEQ ID NO: 1361201 - RNA, 19 nt, Homo sapiens
cauacggcaccaugaagua

SEQ ID NO: 1361202 - RNA, 19 nt, Homo sapiens
ccacccaaacuaaagacua

SEQ ID NO: 1361203 - RNA, 19 nt, Homo sapiens
gcucgugggcuccuucuuc

SEQ ID NO: 1361204 - RNA, 19 nt, Homo sapiens
gacccuccuuuaugugaga

SEQ ID NO: 1361205 - RNA, 19 nt, Homo sapiens
ugagagagaaauaaacauc

SEQ ID NO: 1361206 - RNA, 19 nt, Homo sapiens
cgugggcuccuucuucuuu

SEQ ID NO: 1361207 - RNA, 19 nt, Homo sapiens
cggcacaauuagauaggaa

SEQ ID NO: 1361208 - RNA, 19 nt, Homo sapiens
gagcggcacaauuagauag

SEQ ID NO: 1361209 - RNA, 19 nt, Homo sapiens
aaucauacagcaucuggaa

SEQ ID NO: 1361210 - RNA, 19 nt, Homo sapiens
ccacagcucuaaggaagac

SEQ ID NO: 1361211 - RNA, 19 nt, Homo sapiens
gagagagaaauaaacaucu

SEQ ID NO: 1361212 - RNA, 19 nt, Homo sapiens
gugcagcuauaugauuaau

SEQ ID NO: 1361213 - RNA, 19 nt, Homo sapiens
cacccaaacuaaagacuac

SEQ ID NO: 1361214 - RNA, 19 nt, Homo sapiens
ggcaaggacagcuaguuau

SEQ ID NO: 1361215 - RNA, 19 nt, Homo sapiens
caucuucuuugcccuugug

SEQ ID NO: 1361216 - RNA, 19 nt, Homo sapiens
ccaaacuaaagacuacauu

SEQ ID NO: 1361217 - RNA, 19 nt, Homo sapiens
uugcacauguccacccaaa

SEQ ID NO: 1361218 - RNA, 19 nt, Homo sapiens
cuaguuauacuccauucuu

SEQ ID NO: 1361219 - RNA, 19 nt, Homo sapiens
aaggacagcuaguuauacu

SEQ ID NO: 1361220 - RNA, 19 nt, Homo sapiens
ucccagagguacccacugu

SEQ ID NO: 1361221 - RNA, 19 nt, Homo sapiens
gggagcuguugcagaacuu

SEQ ID NO: 1361222 - RNA, 19 nt, Homo sapiens
caagaccccugauuuuaag

SEQ ID NO: 1361223 - RNA, 19 nt, Homo sapiens
guagcaagaccccugauuu

SEQ ID NO: 1361224 - RNA, 19 nt, Homo sapiens
ccaccacagcucuaaggaa

SEQ ID NO: 1361225 - RNA, 19 nt, Homo sapiens
ccucuucugcaucuucuuu

SEQ ID NO: 1361226 - RNA, 19 nt, Homo sapiens
uagcaagaccccugauuuu

SEQ ID NO: 1361227 - RNA, 19 nt, Homo sapiens
cgacaagugggagcuguug

SEQ ID NO: 1361228 - RNA, 19 nt, Homo sapiens
cauguccacccaaacuaaa

SEQ ID NO: 1361229 - RNA, 19 nt, Homo sapiens
acauguccacccaaacuaa

SEQ ID NO: 1361230 - RNA, 19 nt, Homo sapiens
cacagagggcuucuacuuc

SEQ ID NO: 1361231 - RNA, 19 nt, Homo sapiens
caucaccaccauuggcuau

SEQ ID NO: 1361232 - RNA, 19 nt, Homo sapiens
gcggcacaauuagauagga

SEQ ID NO: 1361233 - RNA, 19 nt, Homo sapiens
ugagcggcacaauuagaua

SEQ ID NO: 1361234 - RNA, 19 nt, Homo sapiens
caaggacagcuaguuauac

SEQ ID NO: 1361235 - RNA, 19 nt, Homo sapiens
cagagggacccaugggaau

SEQ ID NO: 1361236 - RNA, 19 nt, Homo sapiens
cuacgugauuggaaugaac

SEQ ID NO: 1361237 - RNA, 19 nt, Homo sapiens
cuacacagagggcuucuac

SEQ ID NO: 1361238 - RNA, 19 nt, Homo sapiens
ggaugucguccaagcauac

SEQ ID NO: 1361239 - RNA, 19 nt, Homo sapiens
aauaggguauacagagaca

SEQ ID NO: 1361240 - RNA, 19 nt, Homo sapiens
ccgccucucccgcuaugua

SEQ ID NO: 1361241 - RNA, 19 nt, Homo sapiens
ggacccaugggaaucauac

SEQ ID NO: 1361242 - RNA, 19 nt, Homo sapiens
gagggacccaugggaauca

SEQ ID NO: 1361243 - RNA, 19 nt, Homo sapiens
ugugagagagaaauaaaca

SEQ ID NO: 1361244 - RNA, 19 nt, Homo sapiens
guuauacuccauucuuugg

SEQ ID NO: 1361245 - RNA, 19 nt, Homo sapiens
cuucggcgacuacgugauu

SEQ ID NO: 1361246 - RNA, 19 nt, Homo sapiens
gagcaaaucuguucuauuc

SEQ ID NO: 1361247 - RNA, 19 nt, Homo sapiens
ggacgcagguuucuguuua

SEQ ID NO: 1361248 - RNA, 19 nt, Homo sapiens
gaaagcacucugacaaaua

SEQ ID NO: 1361249 - RNA, 19 nt, Homo sapiens
gcaggacgcucuacuaugg

SEQ ID NO: 1361250 - RNA, 19 nt, Homo sapiens
caaagacgguagagagaaa

SEQ ID NO: 1361251 - RNA, 19 nt, Homo sapiens
aaagcacucugacaaauaa

SEQ ID NO: 1361252 - RNA, 19 nt, Homo sapiens
cagaugggcugauagauau

SEQ ID NO: 1361253 - RNA, 19 nt, Homo sapiens
gcaaaucuguucuauucug

SEQ ID NO: 1361254 - RNA, 19 nt, Homo sapiens
agaaaugugugcauccaua

SEQ ID NO: 1361255 - RNA, 19 nt, Homo sapiens
gcacuggaguuaauuaguc

SEQ ID NO: 1361256 - RNA, 19 nt, Homo sapiens
caccaucgguuaaauuuga

SEQ ID NO: 1361257 - RNA, 19 nt, Homo sapiens
aaacccagauugaagcuaa

SEQ ID NO: 1361258 - RNA, 19 nt, Homo sapiens
ggaguuaauuagucuuaga

SEQ ID NO: 1361259 - RNA, 19 nt, Homo sapiens
gcuuacgguuucuuuguua

SEQ ID NO: 1361260 - RNA, 19 nt, Homo sapiens
ggagugaaagguucuauga

SEQ ID NO: 1361261 - RNA, 19 nt, Homo sapiens
gcagauaucaguggcuaua

SEQ ID NO: 1361262 - RNA, 19 nt, Homo sapiens
caaauaagaguucuacuag

SEQ ID NO: 1361263 - RNA, 19 nt, Homo sapiens
ugagagagcuuaucuacac

SEQ ID NO: 1361264 - RNA, 19 nt, Homo sapiens
cgaaguuacuggccucuau

SEQ ID NO: 1361265 - RNA, 19 nt, Homo sapiens
aaaccagacucacuaaauc

SEQ ID NO: 1361266 - RNA, 19 nt, Homo sapiens
gcagguuucuguuuauucu

SEQ ID NO: 1361267 - RNA, 19 nt, Homo sapiens
gcacuuuguuucauauucu

SEQ ID NO: 1361268 - RNA, 19 nt, Homo sapiens
gcugcaaacugcgauauug

SEQ ID NO: 1361269 - RNA, 19 nt, Homo sapiens
cacuaaauccuuuccaaua

SEQ ID NO: 1361270 - RNA, 19 nt, Homo sapiens
gaggagguccgcuacauug

SEQ ID NO: 1361271 - RNA, 19 nt, Homo sapiens
guacaaacccagauugaag

SEQ ID NO: 1361272 - RNA, 19 nt, Homo sapiens
gcucguggcugagaucaug

SEQ ID NO: 1361273 - RNA, 19 nt, Homo sapiens
gcaagaggagugaaagguu

SEQ ID NO: 1361274 - RNA, 19 nt, Homo sapiens
aguagaaucucagcacuuu

SEQ ID NO: 1361275 - RNA, 19 nt, Homo sapiens
ccaggcauauucaagaguu

SEQ ID NO: 1361276 - RNA, 19 nt, Homo sapiens
cgacucagaucuuguuguc

SEQ ID NO: 1361277 - RNA, 19 nt, Homo sapiens
cagacucacuaaauccuuu

SEQ ID NO: 1361278 - RNA, 19 nt, Homo sapiens
agaaagcacucugacaaau

SEQ ID NO: 1361279 - RNA, 19 nt, Homo sapiens
aaagagcccuacccugaug

SEQ ID NO: 1361280 - RNA, 19 nt, Homo sapiens
gcacucugacaaauaauga

SEQ ID NO: 1361281 - RNA, 19 nt, Homo sapiens
caccgcaacauuaagauua

SEQ ID NO: 1361282 - RNA, 19 nt, Homo sapiens
uaaaccagacucacuaaau

SEQ ID NO: 1361283 - RNA, 19 nt, Homo sapiens
aaauaaaccagacucacua

SEQ ID NO: 1361284 - RNA, 19 nt, Homo sapiens
cuacacgacucagaucuug

SEQ ID NO: 1361285 - RNA, 19 nt, Homo sapiens
gaugagagagcuuaucuac

SEQ ID NO: 1361286 - RNA, 19 nt, Homo sapiens
cacaugcacuggaguuaau

SEQ ID NO: 1361287 - RNA, 19 nt, Homo sapiens
guagagagaaacagcuuga

SEQ ID NO: 1361288 - RNA, 19 nt, Homo sapiens
aaaccuacccugucaagga

SEQ ID NO: 1361289 - RNA, 19 nt, Homo sapiens
ggaggagguccgcuacauu

SEQ ID NO: 1361290 - RNA, 19 nt, Homo sapiens
gauaacagucuuacucucu

SEQ ID NO: 1361291 - RNA, 19 nt, Homo sapiens
guacgcugguuucccuuug

SEQ ID NO: 1361292 - RNA, 19 nt, Homo sapiens
ggacaaauaagaguucuac

SEQ ID NO: 1361293 - RNA, 19 nt, Homo sapiens
guagucauuuugcccauua

SEQ ID NO: 1361294 - RNA, 19 nt, Homo sapiens
caaaugcacaacauaaagu

SEQ ID NO: 1361295 - RNA, 19 nt, Homo sapiens
cugcaaaccuacccuguca

SEQ ID NO: 1361296 - RNA, 19 nt, Homo sapiens
gcaggaggcagauaucagu

SEQ ID NO: 1361297 - RNA, 19 nt, Homo sapiens
ccauacaaaugcacaacau

SEQ ID NO: 1361298 - RNA, 19 nt, Homo sapiens
ccuaggugcugcucucaga

SEQ ID NO: 1361299 - RNA, 19 nt, Homo sapiens
gaaucucagcacuuuguuu

SEQ ID NO: 1361300 - RNA, 19 nt, Homo sapiens
cgccacaacuccaguguuc

SEQ ID NO: 1361301 - RNA, 19 nt, Homo sapiens
ccaccgagacaguugguuu

SEQ ID NO: 1361302 - RNA, 19 nt, Homo sapiens
gcaacgggaaccugcugua

SEQ ID NO: 1361303 - RNA, 19 nt, Homo sapiens
agugaaagguucuaugagu

SEQ ID NO: 1361304 - RNA, 19 nt, Homo sapiens
ggaccagagucauccuucu

SEQ ID NO: 1361305 - RNA, 19 nt, Homo sapiens
aaacugcgauauugcugau

SEQ ID NO: 1361306 - RNA, 19 nt, Homo sapiens
gaguugagcaaaucuguuc

SEQ ID NO: 1361307 - RNA, 19 nt, Homo sapiens
uuugguggaucccagauaa

SEQ ID NO: 1361308 - RNA, 19 nt, Homo sapiens
gacgcagguuucuguuuau

SEQ ID NO: 1361309 - RNA, 19 nt, Homo sapiens
uaccauugauagcccagua

SEQ ID NO: 1361310 - RNA, 19 nt, Homo sapiens
ucaaagggacgcagguuuc

SEQ ID NO: 1361311 - RNA, 19 nt, Homo sapiens
gcaaaccuacccugucaag

SEQ ID NO: 1361312 - RNA, 19 nt, Homo sapiens
cgguuucuuuguuacuuua

SEQ ID NO: 1361313 - RNA, 19 nt, Homo sapiens
caagaguuccugcuacauc

SEQ ID NO: 1361314 - RNA, 19 nt, Homo sapiens
cauacaaaugcacaacaua

SEQ ID NO: 1361315 - RNA, 19 nt, Homo sapiens
caaagagcccuacccugau

SEQ ID NO: 1361316 - RNA, 19 nt, Homo sapiens
ccucuuagcuuuucugcaa

SEQ ID NO: 1361317 - RNA, 19 nt, Homo sapiens
caaguggacaccugaguca

SEQ ID NO: 1361318 - RNA, 19 nt, Homo sapiens
ucacaugcacuggaguuaa

SEQ ID NO: 1361319 - RNA, 19 nt, Homo sapiens
gaucaaagggacgcagguu

SEQ ID NO: 1361320 - RNA, 19 nt, Homo sapiens
gcucgggacaggcuccuuu

SEQ ID NO: 1361321 - RNA, 19 nt, Homo sapiens
ucagcacuuuguuucauau

SEQ ID NO: 1361322 - RNA, 19 nt, Homo sapiens
gcuaauccaggacagcauu

SEQ ID NO: 1361323 - RNA, 19 nt, Homo sapiens
gcgcgugguuccugcgaau

SEQ ID NO: 1361324 - RNA, 19 nt, Homo sapiens
gacgccacauuccacacua

SEQ ID NO: 1361325 - RNA, 19 nt, Homo sapiens
gaaaugugugcauccauac

SEQ ID NO: 1361326 - RNA, 19 nt, Homo sapiens
guuacuggccucuaucuuc

SEQ ID NO: 1361327 - RNA, 19 nt, Homo sapiens
cagcagggccacugaguag

SEQ ID NO: 1361328 - RNA, 19 nt, Homo sapiens
gcucuacuauggccucaac

SEQ ID NO: 1361329 - RNA, 19 nt, Homo sapiens
uagaaucucagcacuuugu

SEQ ID NO: 1361330 - RNA, 19 nt, Homo sapiens
cuaacguguuggugaauuc

SEQ ID NO: 1361331 - RNA, 19 nt, Homo sapiens
gaaguuacuggccucuauc

SEQ ID NO: 1361332 - RNA, 19 nt, Homo sapiens
ccugacuucugcaaaccua

SEQ ID NO: 1361333 - RNA, 19 nt, Homo sapiens
gcuugaugcuguuucuaca

SEQ ID NO: 1361334 - RNA, 19 nt, Homo sapiens
cucagcacuuuguuucaua

SEQ ID NO: 1361335 - RNA, 19 nt, Homo sapiens
ggaguugagcaaaucuguu

SEQ ID NO: 1361336 - RNA, 19 nt, Homo sapiens
ucaaagacgguagagagaa

SEQ ID NO: 1361337 - RNA, 19 nt, Homo sapiens
ucacuaaauccuuuccaau

SEQ ID NO: 1361338 - RNA, 19 nt, Homo sapiens
uuaccagccugccugacuu

SEQ ID NO: 1361339 - RNA, 19 nt, Homo sapiens
ucgguggagucgguuauaa

SEQ ID NO: 1361340 - RNA, 19 nt, Homo sapiens
acacugaggaguugagcaa

SEQ ID NO: 1361341 - RNA, 19 nt, Homo sapiens
acacgacucagaucuuguu

SEQ ID NO: 1361342 - RNA, 19 nt, Homo sapiens
gcagggccacugaguaguc

SEQ ID NO: 1361343 - RNA, 19 nt, Homo sapiens
caaggccaaaccgaaguua

SEQ ID NO: 1361344 - RNA, 19 nt, Homo sapiens
caaguggaccagagucauc

SEQ ID NO: 1361345 - RNA, 19 nt, Homo sapiens
uaacagucuuacucucucu

SEQ ID NO: 1361346 - RNA, 19 nt, Homo sapiens
gagcaaaucuguucuauuc

SEQ ID NO: 1361347 - RNA, 19 nt, Homo sapiens
ggacgcagguuucuguuua

SEQ ID NO: 1361348 - RNA, 19 nt, Homo sapiens
gcaggacgcucuacuaugg

SEQ ID NO: 1361349 - RNA, 19 nt, Homo sapiens
caaagacgguagagagaaa

SEQ ID NO: 1361350 - RNA, 19 nt, Homo sapiens
cagaugggcugauagauau

SEQ ID NO: 1361351 - RNA, 19 nt, Homo sapiens
gcaaaucuguucuauucug

SEQ ID NO: 1361352 - RNA, 19 nt, Homo sapiens
agaaaugugugcauccaua

SEQ ID NO: 1361353 - RNA, 19 nt, Homo sapiens
gcacuggaguuaauuaguc

SEQ ID NO: 1361354 - RNA, 19 nt, Homo sapiens
aaacccagauugaagcuaa

SEQ ID NO: 1361355 - RNA, 19 nt, Homo sapiens
ggaguuaauuagucuuaga

SEQ ID NO: 1361356 - RNA, 19 nt, Homo sapiens
gcuuacgguuucuuuguua

SEQ ID NO: 1361357 - RNA, 19 nt, Homo sapiens
ggagugaaagguucuauga

SEQ ID NO: 1361358 - RNA, 19 nt, Homo sapiens
gcagauaucaguggcuaua

SEQ ID NO: 1361359 - RNA, 19 nt, Homo sapiens
caaauaagaguucuacuag

SEQ ID NO: 1361360 - RNA, 19 nt, Homo sapiens
gaaagcacucugacaauuc

SEQ ID NO: 1361361 - RNA, 19 nt, Homo sapiens
agaaagcacucugacaauu

SEQ ID NO: 1361362 - RNA, 19 nt, Homo sapiens
ugagagagcuuaucuacac

SEQ ID NO: 1361363 - RNA, 19 nt, Homo sapiens
cgaaguuacuggccucuau

SEQ ID NO: 1361364 - RNA, 19 nt, Homo sapiens
aaaccagacucacuaaauc

SEQ ID NO: 1361365 - RNA, 19 nt, Homo sapiens
gcagguuucuguuuauucu

SEQ ID NO: 1361366 - RNA, 19 nt, Homo sapiens
gcacuuuguuucauauucu

SEQ ID NO: 1361367 - RNA, 19 nt, Homo sapiens
gcugcaaacugcgauauug

SEQ ID NO: 1361368 - RNA, 19 nt, Homo sapiens
cacuaaauccuuuccaaua

SEQ ID NO: 1361369 - RNA, 19 nt, Homo sapiens
gaggagguccgcuacauug

SEQ ID NO: 1361370 - RNA, 19 nt, Homo sapiens
guacaaacccagauugaag

SEQ ID NO: 1361371 - RNA, 19 nt, Homo sapiens
gcucguggcugagaucaug

SEQ ID NO: 1361372 - RNA, 19 nt, Homo sapiens
gcaagaggagugaaagguu

SEQ ID NO: 1361373 - RNA, 19 nt, Homo sapiens
aguagaaucucagcacuuu

SEQ ID NO: 1361374 - RNA, 19 nt, Homo sapiens
ccaggcauauucaagaguu

SEQ ID NO: 1361375 - RNA, 19 nt, Homo sapiens
cgacucagaucuuguuguc

SEQ ID NO: 1361376 - RNA, 19 nt, Homo sapiens
cagacucacuaaauccuuu

SEQ ID NO: 1361377 - RNA, 19 nt, Homo sapiens
aaagagcccuacccugaug

SEQ ID NO: 1361378 - RNA, 19 nt, Homo sapiens
caccgcaacauuaagauua

SEQ ID NO: 1361379 - RNA, 19 nt, Homo sapiens
uaaaccagacucacuaaau

SEQ ID NO: 1361380 - RNA, 19 nt, Homo sapiens
aaauaaaccagacucacua

SEQ ID NO: 1361381 - RNA, 19 nt, Homo sapiens
cuacacgacucagaucuug

SEQ ID NO: 1361382 - RNA, 19 nt, Homo sapiens
gaugagagagcuuaucuac

SEQ ID NO: 1361383 - RNA, 19 nt, Homo sapiens
cacaugcacuggaguuaau

SEQ ID NO: 1361384 - RNA, 19 nt, Homo sapiens
guagagagaaacagcuuga

SEQ ID NO: 1361385 - RNA, 19 nt, Homo sapiens
aaaccuacccugucaagga

SEQ ID NO: 1361386 - RNA, 19 nt, Homo sapiens
ggaggagguccgcuacauu

SEQ ID NO: 1361387 - RNA, 19 nt, Homo sapiens
gauaacagucuuacucucu

SEQ ID NO: 1361388 - RNA, 19 nt, Homo sapiens
guacgcugguuucccuuug

SEQ ID NO: 1361389 - RNA, 19 nt, Homo sapiens
ggacaaauaagaguucuac

SEQ ID NO: 1361390 - RNA, 19 nt, Homo sapiens
guagucauuuugcccauua

SEQ ID NO: 1361391 - RNA, 19 nt, Homo sapiens
caaaugcacaacauaaagu

SEQ ID NO: 1361392 - RNA, 19 nt, Homo sapiens
cugcaaaccuacccuguca

SEQ ID NO: 1361393 - RNA, 19 nt, Homo sapiens
gcaggaggcagauaucagu

SEQ ID NO: 1361394 - RNA, 19 nt, Homo sapiens
ccauacaaaugcacaacau

SEQ ID NO: 1361395 - RNA, 19 nt, Homo sapiens
ccuaggugcugcucucaga

SEQ ID NO: 1361396 - RNA, 19 nt, Homo sapiens
gaaucucagcacuuuguuu

SEQ ID NO: 1361397 - RNA, 19 nt, Homo sapiens
cgccacaacuccaguguuc

SEQ ID NO: 1361398 - RNA, 19 nt, Homo sapiens
ccaccgagacaguugguuu

SEQ ID NO: 1361399 - RNA, 19 nt, Homo sapiens
gcaacgggaaccugcugua

SEQ ID NO: 1361400 - RNA, 19 nt, Homo sapiens
agugaaagguucuaugagu

SEQ ID NO: 1361401 - RNA, 19 nt, Homo sapiens
ggaccagagucauccuucu

SEQ ID NO: 1361402 - RNA, 19 nt, Homo sapiens
aaacugcgauauugcugau

SEQ ID NO: 1361403 - RNA, 19 nt, Homo sapiens
gaguugagcaaaucuguuc

SEQ ID NO: 1361404 - RNA, 19 nt, Homo sapiens
uuugguggaucccagauaa

SEQ ID NO: 1361405 - RNA, 19 nt, Homo sapiens
gacgcagguuucuguuuau

SEQ ID NO: 1361406 - RNA, 19 nt, Homo sapiens
uaccauugauagcccagua

SEQ ID NO: 1361407 - RNA, 19 nt, Homo sapiens
ucaaagggacgcagguuuc

SEQ ID NO: 1361408 - RNA, 19 nt, Homo sapiens
gcaaaccuacccugucaag

SEQ ID NO: 1361409 - RNA, 19 nt, Homo sapiens
cgguuucuuuguuacuuua

SEQ ID NO: 1361410 - RNA, 19 nt, Homo sapiens
caagaguuccugcuacauc

SEQ ID NO: 1361411 - RNA, 19 nt, Homo sapiens
cauacaaaugcacaacaua

SEQ ID NO: 1361412 - RNA, 19 nt, Homo sapiens
caaagagcccuacccugau

SEQ ID NO: 1361413 - RNA, 19 nt, Homo sapiens
ccucuuagcuuuucugcaa

SEQ ID NO: 1361414 - RNA, 19 nt, Homo sapiens
caaguggacaccugaguca

SEQ ID NO: 1361415 - RNA, 19 nt, Homo sapiens
ucacaugcacuggaguuaa

SEQ ID NO: 1361416 - RNA, 19 nt, Homo sapiens
gaucaaagggacgcagguu

SEQ ID NO: 1361417 - RNA, 19 nt, Homo sapiens
ucagcacuuuguuucauau

SEQ ID NO: 1361418 - RNA, 19 nt, Homo sapiens
gcuaauccaggacagcauu

SEQ ID NO: 1361419 - RNA, 19 nt, Homo sapiens
gcgcgugguuccugcgaau

SEQ ID NO: 1361420 - RNA, 19 nt, Homo sapiens
gcucgggacaggcuccuuu

SEQ ID NO: 1361421 - RNA, 19 nt, Homo sapiens
gacgccacauuccacacua

SEQ ID NO: 1361422 - RNA, 19 nt, Homo sapiens
gaaaugugugcauccauac

SEQ ID NO: 1361423 - RNA, 19 nt, Homo sapiens
guuacuggccucuaucuuc

SEQ ID NO: 1361424 - RNA, 19 nt, Homo sapiens
cagcagggccacugaguag

SEQ ID NO: 1361425 - RNA, 19 nt, Homo sapiens
gcucuacuauggccucaac

SEQ ID NO: 1361426 - RNA, 19 nt, Homo sapiens
uagaaucucagcacuuugu

SEQ ID NO: 1361427 - RNA, 19 nt, Homo sapiens
cuaacguguuggugaauuc

SEQ ID NO: 1361428 - RNA, 19 nt, Homo sapiens
gaaguuacuggccucuauc

SEQ ID NO: 1361429 - RNA, 19 nt, Homo sapiens
ccugacuucugcaaaccua

SEQ ID NO: 1361430 - RNA, 19 nt, Homo sapiens
gcuugaugcuguuucuaca

SEQ ID NO: 1361431 - RNA, 19 nt, Homo sapiens
cucagcacuuuguuucaua

SEQ ID NO: 1361432 - RNA, 19 nt, Homo sapiens
ggaguugagcaaaucuguu

SEQ ID NO: 1361433 - RNA, 19 nt, Homo sapiens
ucaaagacgguagagagaa

SEQ ID NO: 1361434 - RNA, 19 nt, Homo sapiens
ucacuaaauccuuuccaau

SEQ ID NO: 1361435 - RNA, 19 nt, Homo sapiens
ucgguggagucgguuauaa

SEQ ID NO: 1361436 - RNA, 19 nt, Homo sapiens
uuaccagccugccugacuu

SEQ ID NO: 1361437 - RNA, 19 nt, Homo sapiens
caaggccaaaccgaaguua

SEQ ID NO: 1361438 - RNA, 19 nt, Homo sapiens
acacugaggaguugagcaa

SEQ ID NO: 1361439 - RNA, 19 nt, Homo sapiens
gcagggccacugaguaguc

SEQ ID NO: 1361440 - RNA, 19 nt, Homo sapiens
acacgacucagaucuuguu

SEQ ID NO: 1361441 - RNA, 19 nt, Homo sapiens
caaguggaccagagucauc

SEQ ID NO: 1361442 - RNA, 19 nt, Homo sapiens
uaacagucuuacucucucu

SEQ ID NO: 1361443 - RNA, 19 nt, Homo sapiens
acugcgauauugcugauga

SEQ ID NO: 1361444 - RNA, 19 nt, Homo sapiens
acaaaugcacaacauaaag

SEQ ID NO: 1361445 - RNA, 19 nt, Homo sapiens
caugcacuggaguuaauua

SEQ ID NO: 1361446 - RNA, 19 nt, Homo sapiens
gaaaugguguggguaguuu

SEQ ID NO: 1361447 - RNA, 19 nt, Homo sapiens
caaaguagcaaacguagua

SEQ ID NO: 1361448 - RNA, 19 nt, Homo sapiens
ggccggagcuuaucucuug

SEQ ID NO: 1361449 - RNA, 19 nt, Homo sapiens
gcagagccaucuacaguau

SEQ ID NO: 1361450 - RNA, 19 nt, Homo sapiens
ggugcuggcugcuuguuua

SEQ ID NO: 1361451 - RNA, 19 nt, Homo sapiens
ucaaguggcuucucuguuc

SEQ ID NO: 1361452 - RNA, 19 nt, Homo sapiens
agaggcagcuguuguguuu

SEQ ID NO: 1361453 - RNA, 19 nt, Homo sapiens
ggaguugauuccuuaggua

SEQ ID NO: 1361454 - RNA, 19 nt, Homo sapiens
guugucaucuccaucguua

SEQ ID NO: 1361455 - RNA, 19 nt, Homo sapiens
ggguuaagcuugugacaga

SEQ ID NO: 1361456 - RNA, 19 nt, Homo sapiens
cuaguuagucuucauguua

SEQ ID NO: 1361457 - RNA, 19 nt, Homo sapiens
gaacggcugcuuaacuuug

SEQ ID NO: 1361458 - RNA, 19 nt, Homo sapiens
cggcaagucuucccuguug

SEQ ID NO: 1361459 - RNA, 19 nt, Homo sapiens
gcauucgggucaucaaguu

SEQ ID NO: 1361460 - RNA, 19 nt, Homo sapiens
gguaugagguauauaaggu

SEQ ID NO: 1361461 - RNA, 19 nt, Homo sapiens
ugagugaggugauuacauc

SEQ ID NO: 1361462 - RNA, 19 nt, Homo sapiens
caaaucaaguggcuucucu

SEQ ID NO: 1361463 - RNA, 19 nt, Homo sapiens
cagcaaguguggaccagaa

SEQ ID NO: 1361464 - RNA, 19 nt, Homo sapiens
ccagugacuuucuucaaug

SEQ ID NO: 1361465 - RNA, 19 nt, Homo sapiens
ggaccucccucugagauuc

SEQ ID NO: 1361466 - RNA, 19 nt, Homo sapiens
gugcugugcugcagaauca

SEQ ID NO: 1361467 - RNA, 19 nt, Homo sapiens
aguacaaucuuaccucaaa

SEQ ID NO: 1361468 - RNA, 19 nt, Homo sapiens
ccagggcucuccucacaga

SEQ ID NO: 1361469 - RNA, 19 nt, Homo sapiens
gagacaacauccucuuugg

SEQ ID NO: 1361470 - RNA, 19 nt, Homo sapiens
caacuucccuugggugauc

SEQ ID NO: 1361471 - RNA, 19 nt, Homo sapiens
gcugguacccgucaacaaa

SEQ ID NO: 1361472 - RNA, 19 nt, Homo sapiens
guaaaguggaguagggaua

SEQ ID NO: 1361473 - RNA, 19 nt, Homo sapiens
aaacaugaaucagaaaugg

SEQ ID NO: 1361474 - RNA, 19 nt, Homo sapiens
ucagucaucucgaagugaa

SEQ ID NO: 1361475 - RNA, 19 nt, Homo sapiens
cuaccuggcucgugucuuc

SEQ ID NO: 1361476 - RNA, 19 nt, Homo sapiens
gaguccagauuacauccua

SEQ ID NO: 1361477 - RNA, 19 nt, Homo sapiens
uagcucaguuggucagaaa

SEQ ID NO: 1361478 - RNA, 19 nt, Homo sapiens
gaugacagccugcccuuca

SEQ ID NO: 1361479 - RNA, 19 nt, Homo sapiens
aaccagaggugccaguuug

SEQ ID NO: 1361480 - RNA, 19 nt, Homo sapiens
gcacccaccgcacugagua

SEQ ID NO: 1361481 - RNA, 19 nt, Homo sapiens
ucgagcggcuggaagagua

SEQ ID NO: 1361482 - RNA, 19 nt, Homo sapiens
ccauagggcuagagguguu

SEQ ID NO: 1361483 - RNA, 19 nt, Homo sapiens
ccucacagaugccaagauc

SEQ ID NO: 1361484 - RNA, 19 nt, Homo sapiens
ccucagacauccguuucua

SEQ ID NO: 1361485 - RNA, 19 nt, Homo sapiens
gacuccgggucaucaaaua

SEQ ID NO: 1361486 - RNA, 19 nt, Homo sapiens
uaaaguggaguagggauaa

SEQ ID NO: 1361487 - RNA, 19 nt, Homo sapiens
caucaccuauguccucaug

SEQ ID NO: 1361488 - RNA, 19 nt, Homo sapiens
cugaacggcugcuuaacuu

SEQ ID NO: 1361489 - RNA, 19 nt, Homo sapiens
gcuagaccuucuuccaguu

SEQ ID NO: 1361490 - RNA, 19 nt, Homo sapiens
augcacagcuguacaagga

SEQ ID NO: 1361491 - RNA, 19 nt, Homo sapiens
cccagauugugguagauua

SEQ ID NO: 1361492 - RNA, 19 nt, Homo sapiens
guauggguaugagguauau

SEQ ID NO: 1361493 - RNA, 19 nt, Homo sapiens
gcaagucuucccuguuguu

SEQ ID NO: 1361494 - RNA, 19 nt, Homo sapiens
gcuugucgcugucuuaugc

SEQ ID NO: 1361495 - RNA, 19 nt, Homo sapiens
cccaauggcuccucagaca

SEQ ID NO: 1361496 - RNA, 19 nt, Homo sapiens
caucagucaucucgaagug

SEQ ID NO: 1361497 - RNA, 19 nt, Homo sapiens
agagccaucuacaguauug

SEQ ID NO: 1361498 - RNA, 19 nt, Homo sapiens
guauauaagguaacacuuc

SEQ ID NO: 1361499 - RNA, 19 nt, Homo sapiens
gcaggaagggaguugauuc

SEQ ID NO: 1361500 - RNA, 19 nt, Homo sapiens
ggaggucccugagcccaau

SEQ ID NO: 1361501 - RNA, 19 nt, Homo sapiens
gguacaagcuguccccaaa

SEQ ID NO: 1361502 - RNA, 19 nt, Homo sapiens
ucaaugaugaccucaguau

SEQ ID NO: 1361503 - RNA, 19 nt, Homo sapiens
caccaaaguagcaaacgua

SEQ ID NO: 1361504 - RNA, 19 nt, Homo sapiens
gggaguugauuccuuaggu

SEQ ID NO: 1361505 - RNA, 19 nt, Homo sapiens
agacagugcugaccauugc

SEQ ID NO: 1361506 - RNA, 19 nt, Homo sapiens
guuucuaccucaccgugua

SEQ ID NO: 1361507 - RNA, 19 nt, Homo sapiens
cgagacaacauccucuuug

SEQ ID NO: 1361508 - RNA, 19 nt, Homo sapiens
cuucaucagucaucucgaa

SEQ ID NO: 1361509 - RNA, 19 nt, Homo sapiens
caaguggcuucucuguuca

SEQ ID NO: 1361510 - RNA, 19 nt, Homo sapiens
gaguugauuccuuagguaa

SEQ ID NO: 1361511 - RNA, 19 nt, Homo sapiens
gccaagauccuguguaucg

SEQ ID NO: 1361512 - RNA, 19 nt, Homo sapiens
ggccuuagccauccucuuc

SEQ ID NO: 1361513 - RNA, 19 nt, Homo sapiens
cauaggagcccacuugcau

SEQ ID NO: 1361514 - RNA, 19 nt, Homo sapiens
gaccaucugcaaacgcuuu

SEQ ID NO: 1361515 - RNA, 19 nt, Homo sapiens
cacccugucuccacuguau

SEQ ID NO: 1361516 - RNA, 19 nt, Homo sapiens
ggaguagggauaagaugug

SEQ ID NO: 1361517 - RNA, 19 nt, Homo sapiens
aaacguaguacccaggauu

SEQ ID NO: 1361518 - RNA, 19 nt, Homo sapiens
uaaaccgcuucuccucuga

SEQ ID NO: 1361519 - RNA, 19 nt, Homo sapiens
guacagaacccagagaaaa

SEQ ID NO: 1361520 - RNA, 19 nt, Homo sapiens
cagcccagauugugguaga

SEQ ID NO: 1361521 - RNA, 19 nt, Homo sapiens
uaggagcccacuugcauuu

SEQ ID NO: 1361522 - RNA, 19 nt, Homo sapiens
cacccuggauuacucuuug

SEQ ID NO: 1361523 - RNA, 19 nt, Homo sapiens
cccauaggcucaacacgau

SEQ ID NO: 1361524 - RNA, 19 nt, Homo sapiens
ugaacauccuguacugcaa

SEQ ID NO: 1361525 - RNA, 19 nt, Homo sapiens
ucaacacgauccugaacuc

SEQ ID NO: 1361526 - RNA, 19 nt, Homo sapiens
gcaggaagaaagcaagaag

SEQ ID NO: 1361527 - RNA, 19 nt, Homo sapiens
ggaugcggccuguguauac

SEQ ID NO: 1361528 - RNA, 19 nt, Homo sapiens
ugagguauauaagguaaca

SEQ ID NO: 1361529 - RNA, 19 nt, Homo sapiens
guaugagguauauaaggua

SEQ ID NO: 1361530 - RNA, 19 nt, Homo sapiens
cuggauuacucuuuggaaa

SEQ ID NO: 1361531 - RNA, 19 nt, Homo sapiens
gcacccuggauuacucuuu

SEQ ID NO: 1361532 - RNA, 19 nt, Homo sapiens
gaucccaguuggcuaucau

SEQ ID NO: 1361533 - RNA, 19 nt, Homo sapiens
ccucaaugaugaccucagu

SEQ ID NO: 1361534 - RNA, 19 nt, Homo sapiens
ccugcgcccucaaugauga

SEQ ID NO: 1361535 - RNA, 19 nt, Homo sapiens
gcuggcugcuuguuuacau

SEQ ID NO: 1361536 - RNA, 19 nt, Homo sapiens
gcaaguguggaccagaaga

SEQ ID NO: 1361537 - RNA, 19 nt, Homo sapiens
gggcagaggcagcuguugu

SEQ ID NO: 1361538 - RNA, 19 nt, Homo sapiens
gcugaaggcugagaauagc

SEQ ID NO: 1361539 - RNA, 19 nt, Homo sapiens
gcacguguaccaagcuuac

SEQ ID NO: 1361540 - RNA, 19 nt, Homo sapiens
gcagaaucaguauggguau

SEQ ID NO: 1361541 - RNA, 19 nt, Homo sapiens
cgaugugccuccuugucuu

SEQ ID NO: 1361542 - RNA, 19 nt, Homo sapiens
uggcauaggagcccacuug

SEQ ID NO: 1361543 - RNA, 19 nt, Homo sapiens
uaccuuggcuggccucucu

SEQ ID NO: 1361544 - RNA, 19 nt, Homo sapiens
gaucccaucaccaaaguag

SEQ ID NO: 1361545 - RNA, 19 nt, Homo sapiens
ccuaguuagucuucauguu

SEQ ID NO: 1361546 - RNA, 19 nt, Homo sapiens
caaaugagcucacuggaaa

SEQ ID NO: 1361547 - RNA, 19 nt, Homo sapiens
guaaauaggccaccaguua

SEQ ID NO: 1361548 - RNA, 19 nt, Homo sapiens
guuaagagaucacuuguuu

SEQ ID NO: 1361549 - RNA, 19 nt, Homo sapiens
ggauucagauugaguauuu

SEQ ID NO: 1361550 - RNA, 19 nt, Homo sapiens
gaacagauacaccugguua

SEQ ID NO: 1361551 - RNA, 19 nt, Homo sapiens
gagguacuguugugaguua

SEQ ID NO: 1361552 - RNA, 19 nt, Homo sapiens
caggugagauuucuguuua

SEQ ID NO: 1361553 - RNA, 19 nt, Homo sapiens
agagaucacuuguuucaua

SEQ ID NO: 1361554 - RNA, 19 nt, Homo sapiens
agaagcagguucagaguua

SEQ ID NO: 1361555 - RNA, 19 nt, Homo sapiens
gcaaggcgcugaucaccaa

SEQ ID NO: 1361556 - RNA, 19 nt, Homo sapiens
gcuauaaaccugauucuaa

SEQ ID NO: 1361557 - RNA, 19 nt, Homo sapiens
agacagaauuguaccuuua

SEQ ID NO: 1361558 - RNA, 19 nt, Homo sapiens
ccacauauaucucaaaucu

SEQ ID NO: 1361559 - RNA, 19 nt, Homo sapiens
cgucuuagcuuucaucuau

SEQ ID NO: 1361560 - RNA, 19 nt, Homo sapiens
ggauggcgguccuuugaua

SEQ ID NO: 1361561 - RNA, 19 nt, Homo sapiens
gaauaaacccagagacaaa

SEQ ID NO: 1361562 - RNA, 19 nt, Homo sapiens
gaaagaaaguucaagucau

SEQ ID NO: 1361563 - RNA, 19 nt, Homo sapiens
ggucuaggguucuguauau

SEQ ID NO: 1361564 - RNA, 19 nt, Homo sapiens
gcagcaggcucgaguuuga

SEQ ID NO: 1361565 - RNA, 19 nt, Homo sapiens
gaacugauuugugaaggaa

SEQ ID NO: 1361566 - RNA, 19 nt, Homo sapiens
guagcucaauugugacuua

SEQ ID NO: 1361567 - RNA, 19 nt, Homo sapiens
cgaggaagaguaauauuua

SEQ ID NO: 1361568 - RNA, 19 nt, Homo sapiens
gaagcaauguaacagugua

SEQ ID NO: 1361569 - RNA, 19 nt, Homo sapiens
gcaaagaaacacagcauga

SEQ ID NO: 1361570 - RNA, 19 nt, Homo sapiens
ugaaagugcucaauagaau

SEQ ID NO: 1361571 - RNA, 19 nt, Homo sapiens
ggaagcagauccucucauc

SEQ ID NO: 1361572 - RNA, 19 nt, Homo sapiens
gcaaggaacuaaggaagga

SEQ ID NO: 1361573 - RNA, 19 nt, Homo sapiens
caguguagcucaauuguga

SEQ ID NO: 1361574 - RNA, 19 nt, Homo sapiens
gaauaaggguaagggagua

SEQ ID NO: 1361575 - RNA, 19 nt, Homo sapiens
gaagagugaugaccuuuac

SEQ ID NO: 1361576 - RNA, 19 nt, Homo sapiens
cagaauaccuaaaugaauc

SEQ ID NO: 1361577 - RNA, 19 nt, Homo sapiens
ggaaacacucuuuaugauu

SEQ ID NO: 1361578 - RNA, 19 nt, Homo sapiens
gagaggaaauccaaugaca

SEQ ID NO: 1361579 - RNA, 19 nt, Homo sapiens
gaaaugcucugugccuuag

SEQ ID NO: 1361580 - RNA, 19 nt, Homo sapiens
gauaagacccauaggcaaa

SEQ ID NO: 1361581 - RNA, 19 nt, Homo sapiens
acaaguggauucagauuga

SEQ ID NO: 1361582 - RNA, 19 nt, Homo sapiens
uggcaaaucuccacugcua

SEQ ID NO: 1361583 - RNA, 19 nt, Homo sapiens
gagaucacuuguuucauau

SEQ ID NO: 1361584 - RNA, 19 nt, Homo sapiens
cagacaagacucaguguua

SEQ ID NO: 1361585 - RNA, 19 nt, Homo sapiens
ggacucuccuuaauucuuc

SEQ ID NO: 1361586 - RNA, 19 nt, Homo sapiens
guacuguugugaguuauuu

SEQ ID NO: 1361587 - RNA, 19 nt, Homo sapiens
agaagaagcuguaugugau

SEQ ID NO: 1361588 - RNA, 19 nt, Homo sapiens
caucucagguggcaaagaa

SEQ ID NO: 1361589 - RNA, 19 nt, Homo sapiens
guugugaguuauuugcuua

SEQ ID NO: 1361590 - RNA, 19 nt, Homo sapiens
gaagggugagggagaauaa

SEQ ID NO: 1361591 - RNA, 19 nt, Homo sapiens
uaaauaggccaccaguuaa

SEQ ID NO: 1361592 - RNA, 19 nt, Homo sapiens
cgaggaggcucagguguuu

SEQ ID NO: 1361593 - RNA, 19 nt, Homo sapiens
gaaauccacauauaucuca

SEQ ID NO: 1361594 - RNA, 19 nt, Homo sapiens
uaacacagggcaauagaaa

SEQ ID NO: 1361595 - RNA, 19 nt, Homo sapiens
gcgaggaagaguaauauuu

SEQ ID NO: 1361596 - RNA, 19 nt, Homo sapiens
agaaacagguuaagagauc

SEQ ID NO: 1361597 - RNA, 19 nt, Homo sapiens
gcgggacucuccuuaauuc

SEQ ID NO: 1361598 - RNA, 19 nt, Homo sapiens
ugacaaugguacuggcaua

SEQ ID NO: 1361599 - RNA, 19 nt, Homo sapiens
gaaauccaaugacaauggu

SEQ ID NO: 1361600 - RNA, 19 nt, Homo sapiens
ggaaguuaguuauuagagu

SEQ ID NO: 1361601 - RNA, 19 nt, Homo sapiens
ggagaaacagguuaagaga

SEQ ID NO: 1361602 - RNA, 19 nt, Homo sapiens
gcucuuaucacuucuaguu

SEQ ID NO: 1361603 - RNA, 19 nt, Homo sapiens
caagaagggugagggagaa

SEQ ID NO: 1361604 - RNA, 19 nt, Homo sapiens
uaagagaucacuuguuuca

SEQ ID NO: 1361605 - RNA, 19 nt, Homo sapiens
gaaagugcucaauagaauu

SEQ ID NO: 1361606 - RNA, 19 nt, Homo sapiens
gaugguacacuuucuaguu

SEQ ID NO: 1361607 - RNA, 19 nt, Homo sapiens
gagcacagcuggccuacac

SEQ ID NO: 1361608 - RNA, 19 nt, Homo sapiens
gaggaagaguaauauuuag

SEQ ID NO: 1361609 - RNA, 19 nt, Homo sapiens
gaggcuaaaugcaucaaug

SEQ ID NO: 1361610 - RNA, 19 nt, Homo sapiens
ucaacaauguggagaccua

SEQ ID NO: 1361611 - RNA, 19 nt, Homo sapiens
guucagaguuacaucauuc

SEQ ID NO: 1361612 - RNA, 19 nt, Homo sapiens
aaaugaaagugcucaauag

SEQ ID NO: 1361613 - RNA, 19 nt, Homo sapiens
gagaauaaacccagagaca

SEQ ID NO: 1361614 - RNA, 19 nt, Homo sapiens
gacccaaguuucuggacua

SEQ ID NO: 1361615 - RNA, 19 nt, Homo sapiens
gaggaaauccaaugacaau

SEQ ID NO: 1361616 - RNA, 19 nt, Homo sapiens
gugguaagcugugcaguga

SEQ ID NO: 1361617 - RNA, 19 nt, Homo sapiens
gcaaaucuccacugcuaga

SEQ ID NO: 1361618 - RNA, 19 nt, Homo sapiens
guaacaguguaaucuaguu

SEQ ID NO: 1361619 - RNA, 19 nt, Homo sapiens
ggcauaagauggugguguu

SEQ ID NO: 1361620 - RNA, 19 nt, Homo sapiens
gaaggaaaagucagucuua

SEQ ID NO: 1361621 - RNA, 19 nt, Homo sapiens
gaaauaaagacgaacacau

SEQ ID NO: 1361622 - RNA, 19 nt, Homo sapiens
gcacaagccaucagaacga

SEQ ID NO: 1361623 - RNA, 19 nt, Homo sapiens
guuauuugcuuauccuguu

SEQ ID NO: 1361624 - RNA, 19 nt, Homo sapiens
gaaacaggcagggagcuaa

SEQ ID NO: 1361625 - RNA, 19 nt, Homo sapiens
aaucuguccuucacuguaa

SEQ ID NO: 1361626 - RNA, 19 nt, Homo sapiens
cagaugagcccucccagaa

SEQ ID NO: 1361627 - RNA, 19 nt, Homo sapiens
cacgaaggaugaacgguuu

SEQ ID NO: 1361628 - RNA, 19 nt, Homo sapiens
ggucagauuuucauaugua

SEQ ID NO: 1361629 - RNA, 19 nt, Homo sapiens
gauucauguucucgucuua

SEQ ID NO: 1361630 - RNA, 19 nt, Homo sapiens
gaacaccaacagauucaug

SEQ ID NO: 1361631 - RNA, 19 nt, Homo sapiens
aagccaagcugagaauaaa

SEQ ID NO: 1361632 - RNA, 19 nt, Homo sapiens
ucauguagcugacacucaa

SEQ ID NO: 1361633 - RNA, 19 nt, Homo sapiens
ggaaauccaaugacaaugg

SEQ ID NO: 1361634 - RNA, 19 nt, Homo sapiens
gcucccaacugaagcaaug

SEQ ID NO: 1361635 - RNA, 19 nt, Homo sapiens
gaaaguaacacagggcaau

SEQ ID NO: 1361636 - RNA, 19 nt, Homo sapiens
cacuggaaauucauucuaa

SEQ ID NO: 1361637 - RNA, 19 nt, Homo sapiens
gcucaauugugacuuaaag

SEQ ID NO: 1361638 - RNA, 19 nt, Homo sapiens
cugcaacgauuuaaaggaa

SEQ ID NO: 1361639 - RNA, 19 nt, Homo sapiens
ggcaacaccauaaggauuu

SEQ ID NO: 1361640 - RNA, 19 nt, Homo sapiens
uuugugaacugauuuguga

SEQ ID NO: 1361641 - RNA, 19 nt, Homo sapiens
ugaaaugcucugugccuua

SEQ ID NO: 1361642 - RNA, 19 nt, Homo sapiens
gaaacagguuaagagauca

SEQ ID NO: 1361643 - RNA, 19 nt, Homo sapiens
gaaucuguccuucacugua

SEQ ID NO: 1361644 - RNA, 19 nt, Homo sapiens
agacaagacucaguguuau

SEQ ID NO: 1361645 - RNA, 19 nt, Homo sapiens
gaggucagguuccaaggau

SEQ ID NO: 1361646 - RNA, 19 nt, Homo sapiens
ggaaauggaacuacauaua

SEQ ID NO: 1361647 - RNA, 19 nt, Homo sapiens
caaagaagcccgagacuga

SEQ ID NO: 1361648 - RNA, 19 nt, Homo sapiens
ccucagaacuugaccauga

SEQ ID NO: 1361649 - RNA, 19 nt, Homo sapiens
ucucugaggucgacuauuu

SEQ ID NO: 1361650 - RNA, 19 nt, Homo sapiens
gaacuuauuccucuuguca

SEQ ID NO: 1361651 - RNA, 19 nt, Homo sapiens
gaaaaugcgugccugauga

SEQ ID NO: 1361652 - RNA, 19 nt, Homo sapiens
gaccaugacugucuuccaa

SEQ ID NO: 1361653 - RNA, 19 nt, Homo sapiens
ggaacuacauauaugacaa

SEQ ID NO: 1361654 - RNA, 19 nt, Homo sapiens
gcaccagccucaccuguca

SEQ ID NO: 1361655 - RNA, 19 nt, Homo sapiens
caaauauagugagaucgua

SEQ ID NO: 1361656 - RNA, 19 nt, Homo sapiens
gcccgagacugauuccuuu

SEQ ID NO: 1361657 - RNA, 19 nt, Homo sapiens
caacaggacaucagaacuu

SEQ ID NO: 1361658 - RNA, 19 nt, Homo sapiens
ggaaggagagauccaguau

SEQ ID NO: 1361659 - RNA, 19 nt, Homo sapiens
gagacugauuccuuuagaa

SEQ ID NO: 1361660 - RNA, 19 nt, Homo sapiens
ugaccaaacucucccuuuc

SEQ ID NO: 1361661 - RNA, 19 nt, Homo sapiens
gagugcaugugaaggauga

SEQ ID NO: 1361662 - RNA, 19 nt, Homo sapiens
ggagagaggaagcaggaaa

SEQ ID NO: 1361663 - RNA, 19 nt, Homo sapiens
aacaggacaucagaacuua

SEQ ID NO: 1361664 - RNA, 19 nt, Homo sapiens
ugacagcccugacucacau

SEQ ID NO: 1361665 - RNA, 19 nt, Homo sapiens
cgagacugauuccuuuaga

SEQ ID NO: 1361666 - RNA, 19 nt, Homo sapiens
ggagagauccaguaugcau

SEQ ID NO: 1361667 - RNA, 19 nt, Homo sapiens
gccgauauaccaugggaua

SEQ ID NO: 1361668 - RNA, 19 nt, Homo sapiens
gaccuacugucaagauaca

SEQ ID NO: 1361669 - RNA, 19 nt, Homo sapiens
gugagaaacugcagagacu

SEQ ID NO: 1361670 - RNA, 19 nt, Homo sapiens
aaggagagauccaguaugc

SEQ ID NO: 1361671 - RNA, 19 nt, Homo sapiens
caggaaauggaacuacaua

SEQ ID NO: 1361672 - RNA, 19 nt, Homo sapiens
acaaagcgaggccucagua

SEQ ID NO: 1361673 - RNA, 19 nt, Homo sapiens
gcacagcauccacaaccuu

SEQ ID NO: 1361674 - RNA, 19 nt, Homo sapiens
gaacuacauauaugacaag

SEQ ID NO: 1361675 - RNA, 19 nt, Homo sapiens
caggacaucagaacuuauu

SEQ ID NO: 1361676 - RNA, 19 nt, Homo sapiens
aggaauggcucggcccuuu

SEQ ID NO: 1361677 - RNA, 19 nt, Homo sapiens
cagagacucaggccuguuu

SEQ ID NO: 1361678 - RNA, 19 nt, Homo sapiens
gagaaacugcagagacuca

SEQ ID NO: 1361679 - RNA, 19 nt, Homo sapiens
ugacucacaugcccaccuu

SEQ ID NO: 1361680 - RNA, 19 nt, Homo sapiens
ggagcugccucgagugcau

SEQ ID NO: 1361681 - RNA, 19 nt, Homo sapiens
gagagaggaagcaggaaau

SEQ ID NO: 1361682 - RNA, 19 nt, Homo sapiens
gaauggcucggcccuuuca

SEQ ID NO: 1361683 - RNA, 19 nt, Homo sapiens
gaaggagagauccaguaug

SEQ ID NO: 1361684 - RNA, 19 nt, Homo sapiens
gggauucagggaaguacua

SEQ ID NO: 1361685 - RNA, 19 nt, Homo sapiens
guuuauggauccugguuca

SEQ ID NO: 1361686 - RNA, 19 nt, Homo sapiens
ccaccauucucuucucuac

SEQ ID NO: 1361687 - RNA, 19 nt, Homo sapiens
gccagucccugcaccuugu

SEQ ID NO: 1361688 - RNA, 19 nt, Homo sapiens
ccacaaccuugaggaaugg

SEQ ID NO: 1361689 - RNA, 19 nt, Homo sapiens
uauccuauccuccucagaa

SEQ ID NO: 1361690 - RNA, 19 nt, Homo sapiens
gaggaagcaggaaauggaa

SEQ ID NO: 1361691 - RNA, 19 nt, Homo sapiens
guacuucugcaucaucuuc

SEQ ID NO: 1361692 - RNA, 19 nt, Homo sapiens
ccacagcccuggucuuccu

SEQ ID NO: 1361693 - RNA, 19 nt, Homo sapiens
caagcucucugugcaugug

SEQ ID NO: 1361694 - RNA, 19 nt, Homo sapiens
uccacaaccuugaggaaug

SEQ ID NO: 1361695 - RNA, 19 nt, Homo sapiens
accauucucuucucuacuu

SEQ ID NO: 1361696 - RNA, 19 nt, Homo sapiens
gaagcaggaaauggaacua

SEQ ID NO: 1361697 - RNA, 19 nt, Homo sapiens
agaggaagcaggaaaugga

SEQ ID NO: 1361698 - RNA, 19 nt, Homo sapiens
acuuauuccucuugucaaa

SEQ ID NO: 1361699 - RNA, 19 nt, Homo sapiens
ccaaauauagugagaucgu

SEQ ID NO: 1361700 - RNA, 19 nt, Homo sapiens
caucaucuucguuguagug

SEQ ID NO: 1361701 - RNA, 19 nt, Homo sapiens
gcaggaaauggaacuacau

SEQ ID NO: 1361702 - RNA, 19 nt, Homo sapiens
gaccaaacucucccuuucu

SEQ ID NO: 1361703 - RNA, 19 nt, Homo sapiens
cagaacuuauuccucuugu

SEQ ID NO: 1361704 - RNA, 19 nt, Homo sapiens
gagacucaggccuguuuga

SEQ ID NO: 1361705 - RNA, 19 nt, Homo sapiens
ucccucagcuuccacaaag

SEQ ID NO: 1361706 - RNA, 19 nt, Homo sapiens
cgacucaacauauccuauc

SEQ ID NO: 1361707 - RNA, 19 nt, Homo sapiens
gcuguccgacucaacauau

SEQ ID NO: 1361708 - RNA, 19 nt, Homo sapiens
ggaauggcucggcccuuuc

SEQ ID NO: 1361709 - RNA, 19 nt, Homo sapiens
gcccugcaguguccuuuac

SEQ ID NO: 1361710 - RNA, 19 nt, Homo sapiens
uaugaguacuccgagauca

SEQ ID NO: 1361711 - RNA, 19 nt, Homo sapiens
caaaaugaggccuauauca

SEQ ID NO: 1361712 - RNA, 19 nt, Homo sapiens
aaacgaguacacaggcaaa

SEQ ID NO: 1361713 - RNA, 19 nt, Homo sapiens
ggauacccacggucgauuc

SEQ ID NO: 1361714 - RNA, 19 nt, Homo sapiens
ucagaacuuauuccucuug

SEQ ID NO: 1361715 - RNA, 19 nt, Homo sapiens
gcuaugaguacuccgagau

SEQ ID NO: 1361716 - RNA, 19 nt, Homo sapiens
ggccaucggcuaugaguac

SEQ ID NO: 1361717 - RNA, 19 nt, Homo sapiens
ggaccuacugucaagauac

SEQ ID NO: 1361718 - RNA, 19 nt, Homo sapiens
gcuaugggcaaaugaagag

SEQ ID NO: 1361719 - RNA, 19 nt, Homo sapiens
aggaccuacugucaagaua

SEQ ID NO: 1361720 - RNA, 19 nt, Homo sapiens
ccucuagcccuguuuaugg

SEQ ID NO: 1361721 - RNA, 19 nt, Homo sapiens
uauaugacaagcucucugu

SEQ ID NO: 1361722 - RNA, 19 nt, Homo sapiens
gaggauacccacggucgau

SEQ ID NO: 1361723 - RNA, 19 nt, Homo sapiens
cugagccucucccugcaaa

SEQ ID NO: 1361724 - RNA, 19 nt, Homo sapiens
ggaagcaggaaauggaacu

SEQ ID NO: 1361725 - RNA, 19 nt, Homo sapiens
cccaggaccuacugucaag

SEQ ID NO: 1361726 - RNA, 19 nt, Homo sapiens
gguuccaaauauagugaga

SEQ ID NO: 1361727 - RNA, 19 nt, Homo sapiens
gcaacaggacaucagaacu

SEQ ID NO: 1361728 - RNA, 19 nt, Homo sapiens
agaauuaacagcccuccau

SEQ ID NO: 1361729 - RNA, 19 nt, Homo sapiens
gcccuggucuuccuguacu

SEQ ID NO: 1361730 - RNA, 19 nt, Homo sapiens
gagaggaagcaggaaaugg

SEQ ID NO: 1361731 - RNA, 19 nt, Homo sapiens
aagaagcccgagacugauu

SEQ ID NO: 1361732 - RNA, 19 nt, Homo sapiens
cagcccuggucuuccugua

SEQ ID NO: 1361733 - RNA, 19 nt, Homo sapiens
uuccaaauauagugagauc

SEQ ID NO: 1361734 - RNA, 19 nt, Homo sapiens
ggaaaagugcaagaggaua

SEQ ID NO: 1361735 - RNA, 19 nt, Homo sapiens
gaaaagugcaagaggauac

SEQ ID NO: 1361736 - RNA, 19 nt, Homo sapiens
cugcaucaucuucguugua

SEQ ID NO: 1361737 - RNA, 19 nt, Homo sapiens
ggaaauggaacuacauaua

SEQ ID NO: 1361738 - RNA, 19 nt, Homo sapiens
gaggaaauaugaaauggaa

SEQ ID NO: 1361739 - RNA, 19 nt, Homo sapiens
caaagaagcccgagacuga

SEQ ID NO: 1361740 - RNA, 19 nt, Homo sapiens
ccucagaacuugaccauga

SEQ ID NO: 1361741 - RNA, 19 nt, Homo sapiens
ucucugaggucgacuauuu

SEQ ID NO: 1361742 - RNA, 19 nt, Homo sapiens
guagagagaggaaauauga

SEQ ID NO: 1361743 - RNA, 19 nt, Homo sapiens
cuaaggaacagaaggauua

SEQ ID NO: 1361744 - RNA, 19 nt, Homo sapiens
gaacuuauuccucuuguca

SEQ ID NO: 1361745 - RNA, 19 nt, Homo sapiens
gaaaaugcgugccugauga

SEQ ID NO: 1361746 - RNA, 19 nt, Homo sapiens
gaccaugacugucuuccaa

SEQ ID NO: 1361747 - RNA, 19 nt, Homo sapiens
ggaacuacauauaugacaa

SEQ ID NO: 1361748 - RNA, 19 nt, Homo sapiens
gcaccagccucaccuguca

SEQ ID NO: 1361749 - RNA, 19 nt, Homo sapiens
ggacauacgucuuuugugu

SEQ ID NO: 1361750 - RNA, 19 nt, Homo sapiens
caaauauagugagaucgua

SEQ ID NO: 1361751 - RNA, 19 nt, Homo sapiens
gcccgagacugauuccuuu

SEQ ID NO: 1361752 - RNA, 19 nt, Homo sapiens
caacaggacaucagaacuu

SEQ ID NO: 1361753 - RNA, 19 nt, Homo sapiens
ggaaggagagauccaguau

SEQ ID NO: 1361754 - RNA, 19 nt, Homo sapiens
gagacugauuccuuuagaa

SEQ ID NO: 1361755 - RNA, 19 nt, Homo sapiens
ugaccaaacucucccuuuc

SEQ ID NO: 1361756 - RNA, 19 nt, Homo sapiens
gaccagcucucugugaaug

SEQ ID NO: 1361757 - RNA, 19 nt, Homo sapiens
gagugcaugugaaggauga

SEQ ID NO: 1361758 - RNA, 19 nt, Homo sapiens
ggagagaggaagcaggaaa

SEQ ID NO: 1361759 - RNA, 19 nt, Homo sapiens
gagaggaaauaugaaaugg

SEQ ID NO: 1361760 - RNA, 19 nt, Homo sapiens
aacaggacaucagaacuua

SEQ ID NO: 1361761 - RNA, 19 nt, Homo sapiens
ugacagcccugacucacau

SEQ ID NO: 1361762 - RNA, 19 nt, Homo sapiens
cgagacugauuccuuuaga

SEQ ID NO: 1361763 - RNA, 19 nt, Homo sapiens
ggagagauccaguaugcau

SEQ ID NO: 1361764 - RNA, 19 nt, Homo sapiens
gccgauauaccaugggaua

SEQ ID NO: 1361765 - RNA, 19 nt, Homo sapiens
aggauuaccugcugacaau

SEQ ID NO: 1361766 - RNA, 19 nt, Homo sapiens
gaccuacugucaagauaca

SEQ ID NO: 1361767 - RNA, 19 nt, Homo sapiens
gugagaaacugcagagacu

SEQ ID NO: 1361768 - RNA, 19 nt, Homo sapiens
gauuguacccugagcauca

SEQ ID NO: 1361769 - RNA, 19 nt, Homo sapiens
aaggagagauccaguaugc

SEQ ID NO: 1361770 - RNA, 19 nt, Homo sapiens
caggaaauggaacuacaua

SEQ ID NO: 1361771 - RNA, 19 nt, Homo sapiens
acaaagcgaggccucagua

SEQ ID NO: 1361772 - RNA, 19 nt, Homo sapiens
gcacagcauccacaaccuu

SEQ ID NO: 1361773 - RNA, 19 nt, Homo sapiens
gaacuacauauaugacaag

SEQ ID NO: 1361774 - RNA, 19 nt, Homo sapiens
caggacaucagaacuuauu

SEQ ID NO: 1361775 - RNA, 19 nt, Homo sapiens
aggaauggcucggcccuuu

SEQ ID NO: 1361776 - RNA, 19 nt, Homo sapiens
agagagaggaaauaugaaa

SEQ ID NO: 1361777 - RNA, 19 nt, Homo sapiens
cagagacucaggccuguuu

SEQ ID NO: 1361778 - RNA, 19 nt, Homo sapiens
gagaaacugcagagacuca

SEQ ID NO: 1361779 - RNA, 19 nt, Homo sapiens
ugacucacaugcccaccuu

SEQ ID NO: 1361780 - RNA, 19 nt, Homo sapiens
ggagcugccucgagugcau

SEQ ID NO: 1361781 - RNA, 19 nt, Homo sapiens
gagagaggaagcaggaaau

SEQ ID NO: 1361782 - RNA, 19 nt, Homo sapiens
gaauggcucggcccuuuca

SEQ ID NO: 1361783 - RNA, 19 nt, Homo sapiens
gagagaggaaauaugaaau

SEQ ID NO: 1361784 - RNA, 19 nt, Homo sapiens
gaaggagagauccaguaug

SEQ ID NO: 1361785 - RNA, 19 nt, Homo sapiens
gggauucagggaaguacua

SEQ ID NO: 1361786 - RNA, 19 nt, Homo sapiens
guuuauggauccugguuca

SEQ ID NO: 1361787 - RNA, 19 nt, Homo sapiens
ccaccauucucuucucuac

SEQ ID NO: 1361788 - RNA, 19 nt, Homo sapiens
gcuaaggaacagaaggauu

SEQ ID NO: 1361789 - RNA, 19 nt, Homo sapiens
gccagucccugcaccuugu

SEQ ID NO: 1361790 - RNA, 19 nt, Homo sapiens
ccacaaccuugaggaaugg

SEQ ID NO: 1361791 - RNA, 19 nt, Homo sapiens
uauccuauccuccucagaa

SEQ ID NO: 1361792 - RNA, 19 nt, Homo sapiens
gaggaagcaggaaauggaa

SEQ ID NO: 1361793 - RNA, 19 nt, Homo sapiens
guacuucugcaucaucuuc

SEQ ID NO: 1361794 - RNA, 19 nt, Homo sapiens
ccacagcccuggucuuccu

SEQ ID NO: 1361795 - RNA, 19 nt, Homo sapiens
caagcucucugugcaugug

SEQ ID NO: 1361796 - RNA, 19 nt, Homo sapiens
gggcuaaggaacagaagga

SEQ ID NO: 1361797 - RNA, 19 nt, Homo sapiens
uccacaaccuugaggaaug

SEQ ID NO: 1361798 - RNA, 19 nt, Homo sapiens
accauucucuucucuacuu

SEQ ID NO: 1361799 - RNA, 19 nt, Homo sapiens
gaagcaggaaauggaacua

SEQ ID NO: 1361800 - RNA, 19 nt, Homo sapiens
agaggaagcaggaaaugga

SEQ ID NO: 1361801 - RNA, 19 nt, Homo sapiens
acuuauuccucuugucaaa

SEQ ID NO: 1361802 - RNA, 19 nt, Homo sapiens
ggaccgauuccaccuccuu

SEQ ID NO: 1361803 - RNA, 19 nt, Homo sapiens
agagaggaaauaugaaaug

SEQ ID NO: 1361804 - RNA, 19 nt, Homo sapiens
ccaaauauagugagaucgu

SEQ ID NO: 1361805 - RNA, 19 nt, Homo sapiens
caucaucuucguuguagug

SEQ ID NO: 1361806 - RNA, 19 nt, Homo sapiens
gcaggaaauggaacuacau

SEQ ID NO: 1361807 - RNA, 19 nt, Homo sapiens
gaccaaacucucccuuucu

SEQ ID NO: 1361808 - RNA, 19 nt, Homo sapiens
cagaacuuauuccucuugu

SEQ ID NO: 1361809 - RNA, 19 nt, Homo sapiens
gagacucaggccuguuuga

SEQ ID NO: 1361810 - RNA, 19 nt, Homo sapiens
ucccucagcuuccacaaag

SEQ ID NO: 1361811 - RNA, 19 nt, Homo sapiens
cgacucaacauauccuauc

SEQ ID NO: 1361812 - RNA, 19 nt, Homo sapiens
gcuguccgacucaacauau

SEQ ID NO: 1361813 - RNA, 19 nt, Homo sapiens
ggaauggcucggcccuuuc

SEQ ID NO: 1361814 - RNA, 19 nt, Homo sapiens
uaugaguacuccgagauca

SEQ ID NO: 1361815 - RNA, 19 nt, Homo sapiens
caaaaugaggccuauauca

SEQ ID NO: 1361816 - RNA, 19 nt, Homo sapiens
aaacgaguacacaggcaaa

SEQ ID NO: 1361817 - RNA, 19 nt, Homo sapiens
ggauacccacggucgauuc

SEQ ID NO: 1361818 - RNA, 19 nt, Homo sapiens
gcccugcaguguccuuuac

SEQ ID NO: 1361819 - RNA, 19 nt, Homo sapiens
aauaugaccagcucucugu

SEQ ID NO: 1361820 - RNA, 19 nt, Homo sapiens
ucagaacuuauuccucuug

SEQ ID NO: 1361821 - RNA, 19 nt, Homo sapiens
gcuaugaguacuccgagau

SEQ ID NO: 1361822 - RNA, 19 nt, Homo sapiens
ggccaucggcuaugaguac

SEQ ID NO: 1361823 - RNA, 19 nt, Homo sapiens
gcagggacauacgucuuuu

SEQ ID NO: 1361824 - RNA, 19 nt, Homo sapiens
ggaccuacugucaagauac

SEQ ID NO: 1361825 - RNA, 19 nt, Homo sapiens
ccagcucucugugaaugug

SEQ ID NO: 1361826 - RNA, 19 nt, Homo sapiens
uauaugacaagcucucugu

SEQ ID NO: 1361827 - RNA, 19 nt, Homo sapiens
ccucuagcccuguuuaugg

SEQ ID NO: 1361828 - RNA, 19 nt, Homo sapiens
aggaccuacugucaagaua

SEQ ID NO: 1361829 - RNA, 19 nt, Homo sapiens
cugagccucucccugcaaa

SEQ ID NO: 1361830 - RNA, 19 nt, Homo sapiens
ggaagcaggaaauggaacu

SEQ ID NO: 1361831 - RNA, 19 nt, Homo sapiens
gaggauacccacggucgau

SEQ ID NO: 1361832 - RNA, 19 nt, Homo sapiens
cccaggaccuacugucaag

SEQ ID NO: 1361833 - RNA, 19 nt, Homo sapiens
gguuccaaauauagugaga

SEQ ID NO: 1361834 - RNA, 19 nt, Homo sapiens
gcaacaggacaucagaacu

SEQ ID NO: 1361835 - RNA, 19 nt, Homo sapiens
agaauuaacagcccuccau

SEQ ID NO: 1361836 - RNA, 19 nt, Homo sapiens
gcccuggucuuccuguacu

SEQ ID NO: 1361837 - RNA, 19 nt, Homo sapiens
gcaagaagcuggagaagua

SEQ ID NO: 1361838 - RNA, 19 nt, Homo sapiens
ggacggaaaucuucgagua

SEQ ID NO: 1361839 - RNA, 19 nt, Homo sapiens
gcauguggcuaucaaguua

SEQ ID NO: 1361840 - RNA, 19 nt, Homo sapiens
gcauggagguuauucuuaa

SEQ ID NO: 1361841 - RNA, 19 nt, Homo sapiens
gcuaugagcucagucagua

SEQ ID NO: 1361842 - RNA, 19 nt, Homo sapiens
ggagagagguuucaccaau

SEQ ID NO: 1361843 - RNA, 19 nt, Homo sapiens
ucacuaggcugcucuacua

SEQ ID NO: 1361844 - RNA, 19 nt, Homo sapiens
gaucgaagcccaccaagaa

SEQ ID NO: 1361845 - RNA, 19 nt, Homo sapiens
guacauaagguggauauua

SEQ ID NO: 1361846 - RNA, 19 nt, Homo sapiens
ggaauaugcuuauggaagu

SEQ ID NO: 1361847 - RNA, 19 nt, Homo sapiens
caucagagcaggaagauaa

SEQ ID NO: 1361848 - RNA, 19 nt, Homo sapiens
ggaggaauaugcuuaugga

SEQ ID NO: 1361849 - RNA, 19 nt, Homo sapiens
gaacaauauucuagagcaa

SEQ ID NO: 1361850 - RNA, 19 nt, Homo sapiens
ccuaacagcuagaaucaaa

SEQ ID NO: 1361851 - RNA, 19 nt, Homo sapiens
gauuauugcugcccuuuau

SEQ ID NO: 1361852 - RNA, 19 nt, Homo sapiens
gcaaucaguuguauucaag

SEQ ID NO: 1361853 - RNA, 19 nt, Homo sapiens
ugucuggaguugacuauua

SEQ ID NO: 1361854 - RNA, 19 nt, Homo sapiens
gacaggaucucucaagaca

SEQ ID NO: 1361855 - RNA, 19 nt, Homo sapiens
gccaagaggucauuuccaa

SEQ ID NO: 1361856 - RNA, 19 nt, Homo sapiens
ugacaucgcugagcugcua

SEQ ID NO: 1361857 - RNA, 19 nt, Homo sapiens
gaggucagcuggugcaugu

SEQ ID NO: 1361858 - RNA, 19 nt, Homo sapiens
gagcaacuuugacuacuuc

SEQ ID NO: 1361859 - RNA, 19 nt, Homo sapiens
gcacaauucagucucuuaa

SEQ ID NO: 1361860 - RNA, 19 nt, Homo sapiens
ggaaggagcauacaaagag

SEQ ID NO: 1361861 - RNA, 19 nt, Homo sapiens
ccaaagcacccaugaaguu

SEQ ID NO: 1361862 - RNA, 19 nt, Homo sapiens
gagagagguuucaccaaug

SEQ ID NO: 1361863 - RNA, 19 nt, Homo sapiens
cagcuagaaucaaagauga

SEQ ID NO: 1361864 - RNA, 19 nt, Homo sapiens
uugcugcccuuuauaauuu

SEQ ID NO: 1361865 - RNA, 19 nt, Homo sapiens
acaauucagucucuuaaga

SEQ ID NO: 1361866 - RNA, 19 nt, Homo sapiens
gaaagucugggucuaauag

SEQ ID NO: 1361867 - RNA, 19 nt, Homo sapiens
ggaaagucugggucuaaua

SEQ ID NO: 1361868 - RNA, 19 nt, Homo sapiens
aagaggagaugagaaguuu

SEQ ID NO: 1361869 - RNA, 19 nt, Homo sapiens
cagagaguguuuccuuuga

SEQ ID NO: 1361870 - RNA, 19 nt, Homo sapiens
gcuagaccacgaaguauuu

SEQ ID NO: 1361871 - RNA, 19 nt, Homo sapiens
ggaacagucugggaggaaa

SEQ ID NO: 1361872 - RNA, 19 nt, Homo sapiens
ccuacucgcucagauauuu

SEQ ID NO: 1361873 - RNA, 19 nt, Homo sapiens
uuucuuagcugguccuauu

SEQ ID NO: 1361874 - RNA, 19 nt, Homo sapiens
gagacccacuuccaaucua

SEQ ID NO: 1361875 - RNA, 19 nt, Homo sapiens
aaagguagcaggagacauu

SEQ ID NO: 1361876 - RNA, 19 nt, Homo sapiens
ggaggcagcuggagcaaaa

SEQ ID NO: 1361877 - RNA, 19 nt, Homo sapiens
gggaagauguacauaaggu

SEQ ID NO: 1361878 - RNA, 19 nt, Homo sapiens
gaaggugguuaucgcaauc

SEQ ID NO: 1361879 - RNA, 19 nt, Homo sapiens
ggacaaauucagagaguca

SEQ ID NO: 1361880 - RNA, 19 nt, Homo sapiens
gcaacggaguccuuauauc

SEQ ID NO: 1361881 - RNA, 19 nt, Homo sapiens
gaauucauaucagagcuau

SEQ ID NO: 1361882 - RNA, 19 nt, Homo sapiens
aaacuuucuugcucucuuu

SEQ ID NO: 1361883 - RNA, 19 nt, Homo sapiens
ggagacaccugcgcagauc

SEQ ID NO: 1361884 - RNA, 19 nt, Homo sapiens
caacggaguccuuauaucu

SEQ ID NO: 1361885 - RNA, 19 nt, Homo sapiens
gaaugugguucagauuaau

SEQ ID NO: 1361886 - RNA, 19 nt, Homo sapiens
gcagucacccugugcuauu

SEQ ID NO: 1361887 - RNA, 19 nt, Homo sapiens
cacaguggcugcaggaaga

SEQ ID NO: 1361888 - RNA, 19 nt, Homo sapiens
gaauaugcuuauggaaguu

SEQ ID NO: 1361889 - RNA, 19 nt, Homo sapiens
ccacaaugagggaggaaua

SEQ ID NO: 1361890 - RNA, 19 nt, Homo sapiens
ccacagcacccucaaagga

SEQ ID NO: 1361891 - RNA, 19 nt, Homo sapiens
guaggaacccuuguaaaga

SEQ ID NO: 1361892 - RNA, 19 nt, Homo sapiens
caggaucucucaagacaca

SEQ ID NO: 1361893 - RNA, 19 nt, Homo sapiens
cgaaguauuucugagaguu

SEQ ID NO: 1361894 - RNA, 19 nt, Homo sapiens
gcugcuagaccacgaagua

SEQ ID NO: 1361895 - RNA, 19 nt, Homo sapiens
cagccacagucaagaguuu

SEQ ID NO: 1361896 - RNA, 19 nt, Homo sapiens
gcucacuucugcuaucuca

SEQ ID NO: 1361897 - RNA, 19 nt, Homo sapiens
gcucuugguucuccuuugu

SEQ ID NO: 1361898 - RNA, 19 nt, Homo sapiens
gaagauuaccgagagcaaa

SEQ ID NO: 1361899 - RNA, 19 nt, Homo sapiens
ggaaguuauuacuaucaug

SEQ ID NO: 1361900 - RNA, 19 nt, Homo sapiens
gaaagacgcaguggagaca

SEQ ID NO: 1361901 - RNA, 19 nt, Homo sapiens
gguaacuacugaaccuaau

SEQ ID NO: 1361902 - RNA, 19 nt, Homo sapiens
caucauauugucaugguaa

SEQ ID NO: 1361903 - RNA, 19 nt, Homo sapiens
ccucuucaaugauauuuca

SEQ ID NO: 1361904 - RNA, 19 nt, Homo sapiens
ccaaggaggaugagaagga

SEQ ID NO: 1361905 - RNA, 19 nt, Homo sapiens
ucaucaagcuagcagagaa

SEQ ID NO: 1361906 - RNA, 19 nt, Homo sapiens
cagucacccugugcuauua

SEQ ID NO: 1361907 - RNA, 19 nt, Homo sapiens
agucaaggauggaacuuug

SEQ ID NO: 1361908 - RNA, 19 nt, Homo sapiens
uagggaagauguacauaag

SEQ ID NO: 1361909 - RNA, 19 nt, Homo sapiens
caagaggagaugagaaguu

SEQ ID NO: 1361910 - RNA, 19 nt, Homo sapiens
uaacagcuagaaucaaaga

SEQ ID NO: 1361911 - RNA, 19 nt, Homo sapiens
gaccagagaguguuuccuu

SEQ ID NO: 1361912 - RNA, 19 nt, Homo sapiens
gcacgcuggcgcucaauga

SEQ ID NO: 1361913 - RNA, 19 nt, Homo sapiens
ccgaaauacugcccagaga

SEQ ID NO: 1361914 - RNA, 19 nt, Homo sapiens
ucgcugagcugcuaaugca

SEQ ID NO: 1361915 - RNA, 19 nt, Homo sapiens
aaaaguaccuugaugaaca

SEQ ID NO: 1361916 - RNA, 19 nt, Homo sapiens
ugagggaggaauaugcuua

SEQ ID NO: 1361917 - RNA, 19 nt, Homo sapiens
cgaaggugguuaucgcaau

SEQ ID NO: 1361918 - RNA, 19 nt, Homo sapiens
uaacuacugaaccuaauga

SEQ ID NO: 1361919 - RNA, 19 nt, Homo sapiens
auacauggcucuauuuagc

SEQ ID NO: 1361920 - RNA, 19 nt, Homo sapiens
aguaauagaccaauacaug

SEQ ID NO: 1361921 - RNA, 19 nt, Homo sapiens
ccacgaaguauuucugaga

SEQ ID NO: 1361922 - RNA, 19 nt, Homo sapiens
uggagguuauucuuaauga

SEQ ID NO: 1361923 - RNA, 19 nt, Homo sapiens
gagcaaaaguaccuugaug

SEQ ID NO: 1361924 - RNA, 19 nt, Homo sapiens
uugacuacuuccugucuua

SEQ ID NO: 1361925 - RNA, 19 nt, Homo sapiens
ucaagacacagcacaauuc

SEQ ID NO: 1361926 - RNA, 19 nt, Homo sapiens
gcucaucucccaggacuga

SEQ ID NO: 1361927 - RNA, 19 nt, Homo sapiens
gcucaggguuuggcugguu

SEQ ID NO: 1361928 - RNA, 19 nt, Homo sapiens
gcacaauggagagagguuu

SEQ ID NO: 1361929 - RNA, 19 nt, Homo sapiens
agacccacuuccaaucuaa

SEQ ID NO: 1361930 - RNA, 19 nt, Homo sapiens
ggagguuauucuuaaugau

SEQ ID NO: 1361931 - RNA, 19 nt, Homo sapiens
gcaucauauugucauggua

SEQ ID NO: 1361932 - RNA, 19 nt, Homo sapiens
gcacaugagcagagugaca

SEQ ID NO: 1361933 - RNA, 19 nt, Homo sapiens
ccagagaguguuuccuuug

SEQ ID NO: 1361934 - RNA, 19 nt, Homo sapiens
gggaaggagcauacaaaga

SEQ ID NO: 1361935 - RNA, 19 nt, Homo sapiens
ugucaaggcuacucugaag

SEQ ID NO: 1361936 - RNA, 19 nt, Homo sapiens
caggacaaauucagagagu

SEQ ID NO: 1361937 - RNA, 19 nt, Homo sapiens
gaauauagguugucaaaug

SEQ ID NO: 1361938 - RNA, 19 nt, Homo sapiens
gauauucggugcaguuaua

SEQ ID NO: 1361939 - RNA, 19 nt, Homo sapiens
caaguaaucuggcucaauu

SEQ ID NO: 1361940 - RNA, 19 nt, Homo sapiens
caaaggugauucauuagua

SEQ ID NO: 1361941 - RNA, 19 nt, Homo sapiens
gguaacagcugaugaguau

SEQ ID NO: 1361942 - RNA, 19 nt, Homo sapiens
gcacagagaagaaauuauu

SEQ ID NO: 1361943 - RNA, 19 nt, Homo sapiens
gaacuuagccuccugaaca

SEQ ID NO: 1361944 - RNA, 19 nt, Homo sapiens
gaaguucauuaccagaaua

SEQ ID NO: 1361945 - RNA, 19 nt, Homo sapiens
gcagcagacucguguaauu

SEQ ID NO: 1361946 - RNA, 19 nt, Homo sapiens
gagcagacucuucuaauuu

SEQ ID NO: 1361947 - RNA, 19 nt, Homo sapiens
gugaaugucuacuguuuaa

SEQ ID NO: 1361948 - RNA, 19 nt, Homo sapiens
ugucaaagauucaggauga

SEQ ID NO: 1361949 - RNA, 19 nt, Homo sapiens
ccacauuucuuaagagaga

SEQ ID NO: 1361950 - RNA, 19 nt, Homo sapiens
gaaaggaugccguuguuug

SEQ ID NO: 1361951 - RNA, 19 nt, Homo sapiens
acacauauuugguaucuga

SEQ ID NO: 1361952 - RNA, 19 nt, Homo sapiens
gaauuggcauugauacguu

SEQ ID NO: 1361953 - RNA, 19 nt, Homo sapiens
gguauccaguugccucuua

SEQ ID NO: 1361954 - RNA, 19 nt, Homo sapiens
gggcagaguuaauuguauu

SEQ ID NO: 1361955 - RNA, 19 nt, Homo sapiens
gaaauacgagccuaucgaa

SEQ ID NO: 1361956 - RNA, 19 nt, Homo sapiens
acucagagguuacuugaaa

SEQ ID NO: 1361957 - RNA, 19 nt, Homo sapiens
cagaauauaucccaaagca

SEQ ID NO: 1361958 - RNA, 19 nt, Homo sapiens
gaaagcacaccaaauguca

SEQ ID NO: 1361959 - RNA, 19 nt, Homo sapiens
cugcuucacuguuuguuua

SEQ ID NO: 1361960 - RNA, 19 nt, Homo sapiens
caauauacuuugccacuuc

SEQ ID NO: 1361961 - RNA, 19 nt, Homo sapiens
gcagacucguguaauuaaa

SEQ ID NO: 1361962 - RNA, 19 nt, Homo sapiens
ggaaguucauuaccagaau

SEQ ID NO: 1361963 - RNA, 19 nt, Homo sapiens
gagaguccuugcuuucuga

SEQ ID NO: 1361964 - RNA, 19 nt, Homo sapiens
aaagaggguaugccaauua

SEQ ID NO: 1361965 - RNA, 19 nt, Homo sapiens
uaucauggcuacacacuca

SEQ ID NO: 1361966 - RNA, 19 nt, Homo sapiens
gaacagucuucuucgaaag

SEQ ID NO: 1361967 - RNA, 19 nt, Homo sapiens
caaaugguggcuuuaaauu

SEQ ID NO: 1361968 - RNA, 19 nt, Homo sapiens
aaaggaaacccaugaaaga

SEQ ID NO: 1361969 - RNA, 19 nt, Homo sapiens
gugaaaggaugccguuguu

SEQ ID NO: 1361970 - RNA, 19 nt, Homo sapiens
caaagguuaucgucguauu

SEQ ID NO: 1361971 - RNA, 19 nt, Homo sapiens
uacgaaagcugagaaauuc

SEQ ID NO: 1361972 - RNA, 19 nt, Homo sapiens
cugauaugcuugaugauuu

SEQ ID NO: 1361973 - RNA, 19 nt, Homo sapiens
acacaaguaugcauucaug

SEQ ID NO: 1361974 - RNA, 19 nt, Homo sapiens
ugaacagucuucuucgaaa

SEQ ID NO: 1361975 - RNA, 19 nt, Homo sapiens
ggaagaaucaccauagaag

SEQ ID NO: 1361976 - RNA, 19 nt, Homo sapiens
gaaucaccauagaagaauu

SEQ ID NO: 1361977 - RNA, 19 nt, Homo sapiens
cagauaacagcuaaugaua

SEQ ID NO: 1361978 - RNA, 19 nt, Homo sapiens
cagcagacucguguaauua

SEQ ID NO: 1361979 - RNA, 19 nt, Homo sapiens
gguaugccaauuacacuua

SEQ ID NO: 1361980 - RNA, 19 nt, Homo sapiens
guggugcucucuuuagaaa

SEQ ID NO: 1361981 - RNA, 19 nt, Homo sapiens
caucuucacauaacacaua

SEQ ID NO: 1361982 - RNA, 19 nt, Homo sapiens
gaagaaucaccauagaaga

SEQ ID NO: 1361983 - RNA, 19 nt, Homo sapiens
gcucuggccuuaucugauc

SEQ ID NO: 1361984 - RNA, 19 nt, Homo sapiens
gaaggucaagguuuaauag

SEQ ID NO: 1361985 - RNA, 19 nt, Homo sapiens
aaugguggcuuuaaauuuc

SEQ ID NO: 1361986 - RNA, 19 nt, Homo sapiens
ggagaguccuugcuuucug

SEQ ID NO: 1361987 - RNA, 19 nt, Homo sapiens
ggaaacccaugaaagaaaa

SEQ ID NO: 1361988 - RNA, 19 nt, Homo sapiens
gaaguaauggcagacaauu

SEQ ID NO: 1361989 - RNA, 19 nt, Homo sapiens
ccacuucuaugcaugaaca

SEQ ID NO: 1361990 - RNA, 19 nt, Homo sapiens
gaauuucuugggcaauaua

SEQ ID NO: 1361991 - RNA, 19 nt, Homo sapiens
ggccuuaucugaucuuguc

SEQ ID NO: 1361992 - RNA, 19 nt, Homo sapiens
uaggaaagcacaccaaaug

SEQ ID NO: 1361993 - RNA, 19 nt, Homo sapiens
gucaaaugguggcuuuaaa

SEQ ID NO: 1361994 - RNA, 19 nt, Homo sapiens
ucacauaacacauauuugg

SEQ ID NO: 1361995 - RNA, 19 nt, Homo sapiens
ucacgugaaugucuacugu

SEQ ID NO: 1361996 - RNA, 19 nt, Homo sapiens
caaaugaucaaaugaagca

SEQ ID NO: 1361997 - RNA, 19 nt, Homo sapiens
caucagugguauccaguug

SEQ ID NO: 1361998 - RNA, 19 nt, Homo sapiens
gccaauuacacuuacaaua

SEQ ID NO: 1361999 - RNA, 19 nt, Homo sapiens
gcuacacacucacaagcaa

SEQ ID NO: 1362000 - RNA, 19 nt, Homo sapiens
ggaaagcacaccaaauguc

SEQ ID NO: 1362001 - RNA, 19 nt, Homo sapiens
gagccuaucgaagaaguua

SEQ ID NO: 1362002 - RNA, 19 nt, Homo sapiens
gcgaguccaugaguuuauu

SEQ ID NO: 1362003 - RNA, 19 nt, Homo sapiens
gaucuugucauuuauacga

SEQ ID NO: 1362004 - RNA, 19 nt, Homo sapiens
uuucugauaugcuugauga

SEQ ID NO: 1362005 - RNA, 19 nt, Homo sapiens
ugagaugaguaaagcuauu

SEQ ID NO: 1362006 - RNA, 19 nt, Homo sapiens
caaggaagaaucaccauag

SEQ ID NO: 1362007 - RNA, 19 nt, Homo sapiens
gauucaggaugacuucaga

SEQ ID NO: 1362008 - RNA, 19 nt, Homo sapiens
uaauggugguucuggauau

SEQ ID NO: 1362009 - RNA, 19 nt, Homo sapiens
gaaagcugagaaauucaaa

SEQ ID NO: 1362010 - RNA, 19 nt, Homo sapiens
aagaagaccaggaagcuaa

SEQ ID NO: 1362011 - RNA, 19 nt, Homo sapiens
gaguaaugcuuuucaagaa

SEQ ID NO: 1362012 - RNA, 19 nt, Homo sapiens
uauccaagcuauacacaag

SEQ ID NO: 1362013 - RNA, 19 nt, Homo sapiens
aaacuguuauccaagcuau

SEQ ID NO: 1362014 - RNA, 19 nt, Homo sapiens
cuacaggucaugaaacuau

SEQ ID NO: 1362015 - RNA, 19 nt, Homo sapiens
guugucaaaugguggcuuu

SEQ ID NO: 1362016 - RNA, 19 nt, Homo sapiens
auacgaaagcugagaaauu

SEQ ID NO: 1362017 - RNA, 19 nt, Homo sapiens
uaaaggaaacccaugaaag

SEQ ID NO: 1362018 - RNA, 19 nt, Homo sapiens
caagugaccuuuggggaua

SEQ ID NO: 1362019 - RNA, 19 nt, Homo sapiens
caccauagaagaauuuaga

SEQ ID NO: 1362020 - RNA, 19 nt, Homo sapiens
gaaaauaggaaccuuaaag

SEQ ID NO: 1362021 - RNA, 19 nt, Homo sapiens
auacgagccuaucgaagaa

SEQ ID NO: 1362022 - RNA, 19 nt, Homo sapiens
ucaugaaacuauggaaaug

SEQ ID NO: 1362023 - RNA, 19 nt, Homo sapiens
ugagccugcuucacuguuu

SEQ ID NO: 1362024 - RNA, 19 nt, Homo sapiens
gcagacucuucuaauuuua

SEQ ID NO: 1362025 - RNA, 19 nt, Homo sapiens
acaauuugcaggcuacuuu

SEQ ID NO: 1362026 - RNA, 19 nt, Homo sapiens
uccaagcuauacacaagua

SEQ ID NO: 1362027 - RNA, 19 nt, Homo sapiens
gcugagaugaguaaagcua

SEQ ID NO: 1362028 - RNA, 19 nt, Homo sapiens
ugaaggucaagguuuaaua

SEQ ID NO: 1362029 - RNA, 19 nt, Homo sapiens
ucaaaugguggcuuuaaau

SEQ ID NO: 1362030 - RNA, 19 nt, Homo sapiens
gaaacuauggaaaugagau

SEQ ID NO: 1362031 - RNA, 19 nt, Homo sapiens
cauauuugguaucugauca

SEQ ID NO: 1362032 - RNA, 19 nt, Homo sapiens
uaaucuggcucaauuucug

SEQ ID NO: 1362033 - RNA, 19 nt, Homo sapiens
ucagauaacagcuaaugau

SEQ ID NO: 1362034 - RNA, 19 nt, Homo sapiens
caaaagcuuucaacauuca

SEQ ID NO: 1362035 - RNA, 19 nt, Homo sapiens
uaucgaagaaguuaggaaa

SEQ ID NO: 1362036 - RNA, 19 nt, Homo sapiens
gaaaaccggaaaauucuuu

SEQ ID NO: 1362037 - RNA, 19 nt, Homo sapiens
caagugagcuucuacaaga

SEQ ID NO: 1362038 - RNA, 19 nt, Homo sapiens
ggugugagaugaagacuuu

SEQ ID NO: 1362039 - RNA, 19 nt, Homo sapiens
ggaaggagagggaugaaua

SEQ ID NO: 1362040 - RNA, 19 nt, Homo sapiens
gagaugagauugaggaugu

SEQ ID NO: 1362041 - RNA, 19 nt, Homo sapiens
ucaaggagcuggaggagaa

SEQ ID NO: 1362042 - RNA, 19 nt, Homo sapiens
ggagagggaugaauauauc

SEQ ID NO: 1362043 - RNA, 19 nt, Homo sapiens
ucaagaagauccgugauuu

SEQ ID NO: 1362044 - RNA, 19 nt, Homo sapiens
ccucagagccagaaguuua

SEQ ID NO: 1362045 - RNA, 19 nt, Homo sapiens
gauguaaagugucaagaag

SEQ ID NO: 1362046 - RNA, 19 nt, Homo sapiens
ggagagagaugagauugag

SEQ ID NO: 1362047 - RNA, 19 nt, Homo sapiens
gaagacaggaagucaguga

SEQ ID NO: 1362048 - RNA, 19 nt, Homo sapiens
gaaggagagggaugaauau

SEQ ID NO: 1362049 - RNA, 19 nt, Homo sapiens
ggaguaaagaacuggcuua

SEQ ID NO: 1362050 - RNA, 19 nt, Homo sapiens
ugacucagaucgaaagcaa

SEQ ID NO: 1362051 - RNA, 19 nt, Homo sapiens
gauugaggauguaaagugu

SEQ ID NO: 1362052 - RNA, 19 nt, Homo sapiens
ggaugaauauaucacaaag

SEQ ID NO: 1362053 - RNA, 19 nt, Homo sapiens
caagaagcaucagguggaa

SEQ ID NO: 1362054 - RNA, 19 nt, Homo sapiens
ggauguaaagugucaagaa

SEQ ID NO: 1362055 - RNA, 19 nt, Homo sapiens
gaaggagccaggaguaaag

SEQ ID NO: 1362056 - RNA, 19 nt, Homo sapiens
cagagcaggugugagauga

SEQ ID NO: 1362057 - RNA, 19 nt, Homo sapiens
gagacgcccuggaauuugg

SEQ ID NO: 1362058 - RNA, 19 nt, Homo sapiens
uaaagaacuggcuuacuug

SEQ ID NO: 1362059 - RNA, 19 nt, Homo sapiens
ccagaaggagccaggagua

SEQ ID NO: 1362060 - RNA, 19 nt, Homo sapiens
guccugagccucccuguga

SEQ ID NO: 1362061 - RNA, 19 nt, Homo sapiens
cgcaucaucuggaaauaga

SEQ ID NO: 1362062 - RNA, 19 nt, Homo sapiens
gagcaggugugagaugaag

SEQ ID NO: 1362063 - RNA, 19 nt, Homo sapiens
gcaagugagcuucuacaag

SEQ ID NO: 1362064 - RNA, 19 nt, Homo sapiens
gggaugaauauaucacaaa

SEQ ID NO: 1362065 - RNA, 19 nt, Homo sapiens
gcucccaccugcucaaucu

SEQ ID NO: 1362066 - RNA, 19 nt, Homo sapiens
aagaagagccugccagaca

SEQ ID NO: 1362067 - RNA, 19 nt, Homo sapiens
ggccauuucuccugaccuu

SEQ ID NO: 1362068 - RNA, 19 nt, Homo sapiens
gcacggagagagaugagau

SEQ ID NO: 1362069 - RNA, 19 nt, Homo sapiens
ucccagagaugaugaggau

SEQ ID NO: 1362070 - RNA, 19 nt, Homo sapiens
caagaagauccgugauuuc

SEQ ID NO: 1362071 - RNA, 19 nt, Homo sapiens
gaugaagacuuuugugagu

SEQ ID NO: 1362072 - RNA, 19 nt, Homo sapiens
acugggaaauucuggguaa

SEQ ID NO: 1362073 - RNA, 19 nt, Homo sapiens
ggcaacagccaaccuagga

SEQ ID NO: 1362074 - RNA, 19 nt, Homo sapiens
ucucaggagucgacuggaa

SEQ ID NO: 1362075 - RNA, 19 nt, Homo sapiens
ccagagaugaugaggaugu

SEQ ID NO: 1362076 - RNA, 19 nt, Homo sapiens
guuccugccuuacgcugaa

SEQ ID NO: 1362077 - RNA, 19 nt, Homo sapiens
ggaagucacccggcuugga

SEQ ID NO: 1362078 - RNA, 19 nt, Homo sapiens
guaagugugacucgauuuc

SEQ ID NO: 1362079 - RNA, 19 nt, Homo sapiens
ucgagacgcccuggaauuu

SEQ ID NO: 1362080 - RNA, 19 nt, Homo sapiens
aaaggucucugaggaaguc

SEQ ID NO: 1362081 - RNA, 19 nt, Homo sapiens
cagaaggagccaggaguaa

SEQ ID NO: 1362082 - RNA, 19 nt, Homo sapiens
cagagaugaugaggauguu

SEQ ID NO: 1362083 - RNA, 19 nt, Homo sapiens
gucaagaagauccgugauu

SEQ ID NO: 1362084 - RNA, 19 nt, Homo sapiens
aaccagagcaggugugaga

SEQ ID NO: 1362085 - RNA, 19 nt, Homo sapiens
ucaagaagaccagaagcuu

SEQ ID NO: 1362086 - RNA, 19 nt, Homo sapiens
gaugagauugaggauguaa

SEQ ID NO: 1362087 - RNA, 19 nt, Homo sapiens
cccugaaggugguccauga

SEQ ID NO: 1362088 - RNA, 19 nt, Homo sapiens
agaaggagccaggaguaaa

SEQ ID NO: 1362089 - RNA, 19 nt, Homo sapiens
ggaagucagugagguacac

SEQ ID NO: 1362090 - RNA, 19 nt, Homo sapiens
aaacuuggcgcaucaucug

SEQ ID NO: 1362091 - RNA, 19 nt, Homo sapiens
ccucugcgauucauguaag

SEQ ID NO: 1362092 - RNA, 19 nt, Homo sapiens
gcaggugacccuccacaac

SEQ ID NO: 1362093 - RNA, 19 nt, Homo sapiens
gccagcaagugagcuucua

SEQ ID NO: 1362094 - RNA, 19 nt, Homo sapiens
gcgagaacgaugccgaguu

SEQ ID NO: 1362095 - RNA, 19 nt, Homo sapiens
gaggaggaagggagagaug

SEQ ID NO: 1362096 - RNA, 19 nt, Homo sapiens
gguacacccggcagaagaa

SEQ ID NO: 1362097 - RNA, 19 nt, Homo sapiens
uguaaagugucaagaagac

SEQ ID NO: 1362098 - RNA, 19 nt, Homo sapiens
gcgauucauguaaguguga

SEQ ID NO: 1362099 - RNA, 19 nt, Homo sapiens
acaggaagucagugaggua

SEQ ID NO: 1362100 - RNA, 19 nt, Homo sapiens
gagaugaugaggauguucu

SEQ ID NO: 1362101 - RNA, 19 nt, Homo sapiens
gagaugaagacuuuuguga

SEQ ID NO: 1362102 - RNA, 19 nt, Homo sapiens
uacaagaugucagagucaa

SEQ ID NO: 1362103 - RNA, 19 nt, Homo sapiens
cacaaaggucucugaggaa

SEQ ID NO: 1362104 - RNA, 19 nt, Homo sapiens
gagagggaugaauauauca

SEQ ID NO: 1362105 - RNA, 19 nt, Homo sapiens
gucagcagccagcaaguga

SEQ ID NO: 1362106 - RNA, 19 nt, Homo sapiens
uucaagugcugcugacuca

SEQ ID NO: 1362107 - RNA, 19 nt, Homo sapiens
uugaggauguaaaguguca

SEQ ID NO: 1362108 - RNA, 19 nt, Homo sapiens
cgagacgcccuggaauuug

SEQ ID NO: 1362109 - RNA, 19 nt, Homo sapiens
cagaaaacuuggcgcauca

SEQ ID NO: 1362110 - RNA, 19 nt, Homo sapiens
uggagcagcagauuuggaa

SEQ ID NO: 1362111 - RNA, 19 nt, Homo sapiens
gagcacggcgagaagaucu

SEQ ID NO: 1362112 - RNA, 19 nt, Homo sapiens
ccagagcaggugugagaug

SEQ ID NO: 1362113 - RNA, 19 nt, Homo sapiens
aaggagagggaugaauaua

SEQ ID NO: 1362114 - RNA, 19 nt, Homo sapiens
gaggagcacggcgagaaga

SEQ ID NO: 1362115 - RNA, 19 nt, Homo sapiens
gcgcaucaucuggaaauag

SEQ ID NO: 1362116 - RNA, 19 nt, Homo sapiens
ggcgcaucaucuggaaaua

SEQ ID NO: 1362117 - RNA, 19 nt, Homo sapiens
auacucacccucccagaga

SEQ ID NO: 1362118 - RNA, 19 nt, Homo sapiens
gcacgccucagagccagaa

SEQ ID NO: 1362119 - RNA, 19 nt, Homo sapiens
gcagccagcaagugagcuu

SEQ ID NO: 1362120 - RNA, 19 nt, Homo sapiens
agauugaggauguaaagug

SEQ ID NO: 1362121 - RNA, 19 nt, Homo sapiens
gugagcuucuacaagaugu

SEQ ID NO: 1362122 - RNA, 19 nt, Homo sapiens
aggagagggaugaauauau

SEQ ID NO: 1362123 - RNA, 19 nt, Homo sapiens
acucagaucgaaagcaaga

SEQ ID NO: 1362124 - RNA, 19 nt, Homo sapiens
ugagauugaggauguaaag

SEQ ID NO: 1362125 - RNA, 19 nt, Homo sapiens
ggacccacuccgcugauag

SEQ ID NO: 1362126 - RNA, 19 nt, Homo sapiens
ccauuucuccugaccuugu

SEQ ID NO: 1362127 - RNA, 19 nt, Homo sapiens
gagcuucuacaagauguca

SEQ ID NO: 1362128 - RNA, 19 nt, Homo sapiens
gagggaugaauauaucaca

SEQ ID NO: 1362129 - RNA, 19 nt, Homo sapiens
ggcaacagccaaccuagga

SEQ ID NO: 1362130 - RNA, 19 nt, Homo sapiens
gaugccgaguuccucugua

SEQ ID NO: 1362131 - RNA, 19 nt, Homo sapiens
cccugaaggugguccauga

SEQ ID NO: 1362132 - RNA, 19 nt, Homo sapiens
gcgagaacgaugccgaguu

SEQ ID NO: 1362133 - RNA, 19 nt, Homo sapiens
gagcacggcgagaagaucu

SEQ ID NO: 1362134 - RNA, 19 nt, Homo sapiens
gaggagcacggcgagaaga

SEQ ID NO: 1362135 - RNA, 19 nt, Homo sapiens
gcacugggaugcugauugu

SEQ ID NO: 1362136 - RNA, 19 nt, Homo sapiens
acacaaagccucagaguug

SEQ ID NO: 1362137 - RNA, 19 nt, Homo sapiens
ggacaacccucacuucacu

SEQ ID NO: 1362138 - RNA, 19 nt, Homo sapiens
gaguugagauacagugaaa

SEQ ID NO: 1362139 - RNA, 19 nt, Homo sapiens
gagcaaggcugugaaacug

SEQ ID NO: 1362140 - RNA, 19 nt, Homo sapiens
gaauagcaauaggguguuu

SEQ ID NO: 1362141 - RNA, 19 nt, Homo sapiens
gauccuggcccucggguua

SEQ ID NO: 1362142 - RNA, 19 nt, Homo sapiens
gcacagagacagagagcaa

SEQ ID NO: 1362143 - RNA, 19 nt, Homo sapiens
ggaaaauucugguuauuca

SEQ ID NO: 1362144 - RNA, 19 nt, Homo sapiens
uggcaucccuuccuccuaa

SEQ ID NO: 1362145 - RNA, 19 nt, Homo sapiens
gaacaauggcuuccuggau

SEQ ID NO: 1362146 - RNA, 19 nt, Homo sapiens
ggaguguaagcuaugauua

SEQ ID NO: 1362147 - RNA, 19 nt, Homo sapiens
gagaaguggaggaggauaa

SEQ ID NO: 1362148 - RNA, 19 nt, Homo sapiens
caaggagaguugagauaca

SEQ ID NO: 1362149 - RNA, 19 nt, Homo sapiens
gcccacgucucuucaccua

SEQ ID NO: 1362150 - RNA, 19 nt, Homo sapiens
cugggaggcuucucuguuu

SEQ ID NO: 1362151 - RNA, 19 nt, Homo sapiens
ggugggaaccugacaguga

SEQ ID NO: 1362152 - RNA, 19 nt, Homo sapiens
ccuauguucucuaccauga

SEQ ID NO: 1362153 - RNA, 19 nt, Homo sapiens
gaaggcaguguuccucuau

SEQ ID NO: 1362154 - RNA, 19 nt, Homo sapiens
gggucaagcuccccauuua

SEQ ID NO: 1362155 - RNA, 19 nt, Homo sapiens
caacuucuucaccauguuu

SEQ ID NO: 1362156 - RNA, 19 nt, Homo sapiens
gcaacuucuucaccauguu

SEQ ID NO: 1362157 - RNA, 19 nt, Homo sapiens
ccaccuauguucucuacca

SEQ ID NO: 1362158 - RNA, 19 nt, Homo sapiens
agaaggcaguguuccucua

SEQ ID NO: 1362159 - RNA, 19 nt, Homo sapiens
ugggaggcuucucuguuua

SEQ ID NO: 1362160 - RNA, 19 nt, Homo sapiens
cucagaugcuggaguguaa

SEQ ID NO: 1362161 - RNA, 19 nt, Homo sapiens
gcucagaugcuggagugua

SEQ ID NO: 1362162 - RNA, 19 nt, Homo sapiens
ccaccauggucuucacuca

SEQ ID NO: 1362163 - RNA, 19 nt, Homo sapiens
uauguucucuaccaugaug

SEQ ID NO: 1362164 - RNA, 19 nt, Homo sapiens
ggcaacuucuucaccaugu

SEQ ID NO: 1362165 - RNA, 19 nt, Homo sapiens
gaguguaagcuaugauuag

SEQ ID NO: 1362166 - RNA, 19 nt, Homo sapiens
gaggagggagggugaagga

SEQ ID NO: 1362167 - RNA, 19 nt, Homo sapiens
guugagauacagugaaaug

SEQ ID NO: 1362168 - RNA, 19 nt, Homo sapiens
gauaagguaccaggacuca

SEQ ID NO: 1362169 - RNA, 19 nt, Homo sapiens
gcuggaguguaagcuauga

SEQ ID NO: 1362170 - RNA, 19 nt, Homo sapiens
caacacaaagccucagagu

SEQ ID NO: 1362171 - RNA, 19 nt, Homo sapiens
ggagcagugaauagcaaua

SEQ ID NO: 1362172 - RNA, 19 nt, Homo sapiens
cauucuuccucuuuguuaa

SEQ ID NO: 1362173 - RNA, 19 nt, Homo sapiens
acaauggcuuccuggauca

SEQ ID NO: 1362174 - RNA, 19 nt, Homo sapiens
gagaguugagauacaguga

SEQ ID NO: 1362175 - RNA, 19 nt, Homo sapiens
ggugcugugucguucauuc

SEQ ID NO: 1362176 - RNA, 19 nt, Homo sapiens
gaaccugggaggcuucucu

SEQ ID NO: 1362177 - RNA, 19 nt, Homo sapiens
guugcugucugcuuucugu

SEQ ID NO: 1362178 - RNA, 19 nt, Homo sapiens
gggccaccauccaguguag

SEQ ID NO: 1362179 - RNA, 19 nt, Homo sapiens
cugcagaggaugcucguuu

SEQ ID NO: 1362180 - RNA, 19 nt, Homo sapiens
gagcagugaauagcaauag

SEQ ID NO: 1362181 - RNA, 19 nt, Homo sapiens
ggaggaggauaagguacca

SEQ ID NO: 1362182 - RNA, 19 nt, Homo sapiens
ggaggcuucucuguuuauc

SEQ ID NO: 1362183 - RNA, 19 nt, Homo sapiens
gaggcaccguuccuagaca

SEQ ID NO: 1362184 - RNA, 19 nt, Homo sapiens
cagggccucucggaaugua

SEQ ID NO: 1362185 - RNA, 19 nt, Homo sapiens
gaugcuggaguguaagcua

SEQ ID NO: 1362186 - RNA, 19 nt, Homo sapiens
ccaucuacgugggugguaa

SEQ ID NO: 1362187 - RNA, 19 nt, Homo sapiens
ccucagggccucucggaau

SEQ ID NO: 1362188 - RNA, 19 nt, Homo sapiens
ggagaaguggaggaggaua

SEQ ID NO: 1362189 - RNA, 19 nt, Homo sapiens
acagagggagcagugaaua

SEQ ID NO: 1362190 - RNA, 19 nt, Homo sapiens
augaugcccuacagaacua

SEQ ID NO: 1362191 - RNA, 19 nt, Homo sapiens
guuccucuauucccuucuu

SEQ ID NO: 1362192 - RNA, 19 nt, Homo sapiens
aggcaguguuccucuauuc

SEQ ID NO: 1362193 - RNA, 19 nt, Homo sapiens
cuucucuguuuaucuguuu

SEQ ID NO: 1362194 - RNA, 19 nt, Homo sapiens
gggaggcuucucuguuuau

SEQ ID NO: 1362195 - RNA, 19 nt, Homo sapiens
gaucuggugucugcucaac

SEQ ID NO: 1362196 - RNA, 19 nt, Homo sapiens
ggguguguuuguacucaug

SEQ ID NO: 1362197 - RNA, 19 nt, Homo sapiens
gaaaccaaaggcaacuucu

SEQ ID NO: 1362198 - RNA, 19 nt, Homo sapiens
aggcuucucuguuuaucug

SEQ ID NO: 1362199 - RNA, 19 nt, Homo sapiens
ggagccaccuauguucucu

SEQ ID NO: 1362200 - RNA, 19 nt, Homo sapiens
ccaggacucaggcuucuca

SEQ ID NO: 1362201 - RNA, 19 nt, Homo sapiens
gcuucucuguuuaucuguu

SEQ ID NO: 1362202 - RNA, 19 nt, Homo sapiens
aaccaaaggcaacuucuuc

SEQ ID NO: 1362203 - RNA, 19 nt, Homo sapiens
aacccucacuucacucaug

SEQ ID NO: 1362204 - RNA, 19 nt, Homo sapiens
uaagcuaugauuaggacaa

SEQ ID NO: 1362205 - RNA, 19 nt, Homo sapiens
caaagccucagaguuggaa

SEQ ID NO: 1362206 - RNA, 19 nt, Homo sapiens
gcugugucguucauucaag

SEQ ID NO: 1362207 - RNA, 19 nt, Homo sapiens
agagagcaaggcugugaaa

SEQ ID NO: 1362208 - RNA, 19 nt, Homo sapiens
uaggacaacccucacuuca

SEQ ID NO: 1362209 - RNA, 19 nt, Homo sapiens
ggugccaacugcgggauuc

SEQ ID NO: 1362210 - RNA, 19 nt, Homo sapiens
aaaccaaaggcaacuucuu

SEQ ID NO: 1362211 - RNA, 19 nt, Homo sapiens
ccguuacgauagccaucua

SEQ ID NO: 1362212 - RNA, 19 nt, Homo sapiens
guuucuggguguguuugua

SEQ ID NO: 1362213 - RNA, 19 nt, Homo sapiens
uaucugucccugaacaaug

SEQ ID NO: 1362214 - RNA, 19 nt, Homo sapiens
ugagauacagugaaaugag

SEQ ID NO: 1362215 - RNA, 19 nt, Homo sapiens
caugggccaccuccggaua

SEQ ID NO: 1362216 - RNA, 19 nt, Homo sapiens
ggcaucccuuccuccuaaa

SEQ ID NO: 1362217 - RNA, 19 nt, Homo sapiens
ggagaaaccaaaggcaacu

SEQ ID NO: 1362218 - RNA, 19 nt, Homo sapiens
cagggaaaauucugguuau

SEQ ID NO: 1362219 - RNA, 19 nt, Homo sapiens
guucauucaaggagaguug

SEQ ID NO: 1362220 - RNA, 19 nt, Homo sapiens
gcacauaucagcucuauuu

SEQ ID NO: 1362221 - RNA, 19 nt, Homo sapiens
guagacagcuuucgaauga

SEQ ID NO: 1362222 - RNA, 19 nt, Homo sapiens
gacaauagccucagucauu

SEQ ID NO: 1362223 - RNA, 19 nt, Homo sapiens
caauaaggauccaaucuug

SEQ ID NO: 1362224 - RNA, 19 nt, Homo sapiens
ggagaaaacuguucaagaa

SEQ ID NO: 1362225 - RNA, 19 nt, Homo sapiens
ccuaagaggucuagaaaug

SEQ ID NO: 1362226 - RNA, 19 nt, Homo sapiens
ccaaaucucuucuaacaca

SEQ ID NO: 1362227 - RNA, 19 nt, Homo sapiens
caaccgauccaaacaguua

SEQ ID NO: 1362228 - RNA, 19 nt, Homo sapiens
acaauagccucagucauua

SEQ ID NO: 1362229 - RNA, 19 nt, Homo sapiens
caagagaacuggugauugc

SEQ ID NO: 1362230 - RNA, 19 nt, Homo sapiens
cagaagccauuguaguuaa

SEQ ID NO: 1362231 - RNA, 19 nt, Homo sapiens
cuucaaugcuucacaauga

SEQ ID NO: 1362232 - RNA, 19 nt, Homo sapiens
ggauugggaucuggacuaa

SEQ ID NO: 1362233 - RNA, 19 nt, Homo sapiens
acaagaaauugcugggaua

SEQ ID NO: 1362234 - RNA, 19 nt, Homo sapiens
ccaccuaucuuggcugaaa

SEQ ID NO: 1362235 - RNA, 19 nt, Homo sapiens
gcaagacaaaucauuaaga

SEQ ID NO: 1362236 - RNA, 19 nt, Homo sapiens
ggagagaucaaguacagaa

SEQ ID NO: 1362237 - RNA, 19 nt, Homo sapiens
gaaacuuugucuccugugu

SEQ ID NO: 1362238 - RNA, 19 nt, Homo sapiens
ucaagggccucaaccaguu

SEQ ID NO: 1362239 - RNA, 19 nt, Homo sapiens
gacaaaucauuaagaagga

SEQ ID NO: 1362240 - RNA, 19 nt, Homo sapiens
gcauugacauucgccauug

SEQ ID NO: 1362241 - RNA, 19 nt, Homo sapiens
ucggccagguguauaauua

SEQ ID NO: 1362242 - RNA, 19 nt, Homo sapiens
aaacaugauuccugucaau

SEQ ID NO: 1362243 - RNA, 19 nt, Homo sapiens
agaaauugcugggauaugu

SEQ ID NO: 1362244 - RNA, 19 nt, Homo sapiens
agacagcuuucgaaugauu

SEQ ID NO: 1362245 - RNA, 19 nt, Homo sapiens
cagugaugcugcugguuua

SEQ ID NO: 1362246 - RNA, 19 nt, Homo sapiens
gauugccuaugaaguguuu

SEQ ID NO: 1362247 - RNA, 19 nt, Homo sapiens
aggauuaacugcaacuuug

SEQ ID NO: 1362248 - RNA, 19 nt, Homo sapiens
auucauggcuucaagagaa

SEQ ID NO: 1362249 - RNA, 19 nt, Homo sapiens
gcaagcaaaucggaacaca

SEQ ID NO: 1362250 - RNA, 19 nt, Homo sapiens
ggagaucgcgcgacgaauc

SEQ ID NO: 1362251 - RNA, 19 nt, Homo sapiens
ccagguguauaauuaugaa

SEQ ID NO: 1362252 - RNA, 19 nt, Homo sapiens
aagcaaaucggaacacauu

SEQ ID NO: 1362253 - RNA, 19 nt, Homo sapiens
gguuucagauucagagaug

SEQ ID NO: 1362254 - RNA, 19 nt, Homo sapiens
uuccaaaucucuucuaaca

SEQ ID NO: 1362255 - RNA, 19 nt, Homo sapiens
auaggcaacuugagauuau

SEQ ID NO: 1362256 - RNA, 19 nt, Homo sapiens
ugaugcugcugguuuauga

SEQ ID NO: 1362257 - RNA, 19 nt, Homo sapiens
ggaauucugccaccuaucu

SEQ ID NO: 1362258 - RNA, 19 nt, Homo sapiens
uaacagaagccauuguagu

SEQ ID NO: 1362259 - RNA, 19 nt, Homo sapiens
cugcaggucuuguagaaau

SEQ ID NO: 1362260 - RNA, 19 nt, Homo sapiens
gguguauaauuaugaagga

SEQ ID NO: 1362261 - RNA, 19 nt, Homo sapiens
ggccagguguauaauuaug

SEQ ID NO: 1362262 - RNA, 19 nt, Homo sapiens
aacaaaggauuaacugcaa

SEQ ID NO: 1362263 - RNA, 19 nt, Homo sapiens
ggugauugccuaugaagug

SEQ ID NO: 1362264 - RNA, 19 nt, Homo sapiens
acagaagccauuguaguua

SEQ ID NO: 1362265 - RNA, 19 nt, Homo sapiens
uggaaggguuauuugguuu

SEQ ID NO: 1362266 - RNA, 19 nt, Homo sapiens
gaagaagagagacuaucga

SEQ ID NO: 1362267 - RNA, 19 nt, Homo sapiens
ucaauaaggauccaaucuu

SEQ ID NO: 1362268 - RNA, 19 nt, Homo sapiens
acaaguaggaaacaugaaa

SEQ ID NO: 1362269 - RNA, 19 nt, Homo sapiens
gcagcaccaugaagaagag

SEQ ID NO: 1362270 - RNA, 19 nt, Homo sapiens
caugauuccugucaauaag

SEQ ID NO: 1362271 - RNA, 19 nt, Homo sapiens
uaacacaaguaggaaacau

SEQ ID NO: 1362272 - RNA, 19 nt, Homo sapiens
uauaggcaacuugagauua

SEQ ID NO: 1362273 - RNA, 19 nt, Homo sapiens
ccauuguaguuaacccuuu

SEQ ID NO: 1362274 - RNA, 19 nt, Homo sapiens
gaaauugcugggauaugug

SEQ ID NO: 1362275 - RNA, 19 nt, Homo sapiens
acacaaguaggaaacauga

SEQ ID NO: 1362276 - RNA, 19 nt, Homo sapiens
uguagaaauuugccugaug

SEQ ID NO: 1362277 - RNA, 19 nt, Homo sapiens
gcaggucuuguagaaauuu

SEQ ID NO: 1362278 - RNA, 19 nt, Homo sapiens
uaagaggucuagaaaugcu

SEQ ID NO: 1362279 - RNA, 19 nt, Homo sapiens
gggccucaacaaaggauua

SEQ ID NO: 1362280 - RNA, 19 nt, Homo sapiens
ggacuaacagaagccauug

SEQ ID NO: 1362281 - RNA, 19 nt, Homo sapiens
caaaucucuucuaacacaa

SEQ ID NO: 1362282 - RNA, 19 nt, Homo sapiens
ggccugcuucccaagauua

SEQ ID NO: 1362283 - RNA, 19 nt, Homo sapiens
aagaagggauuuuagcuuu

SEQ ID NO: 1362284 - RNA, 19 nt, Homo sapiens
aacagaagccauuguaguu

SEQ ID NO: 1362285 - RNA, 19 nt, Homo sapiens
ccucuucaaugcuucacaa

SEQ ID NO: 1362286 - RNA, 19 nt, Homo sapiens
caauagccucagucauuaa

SEQ ID NO: 1362287 - RNA, 19 nt, Homo sapiens
gaugugcaaccgauccaaa

SEQ ID NO: 1362288 - RNA, 19 nt, Homo sapiens
gaucguggccggugguucu

SEQ ID NO: 1362289 - RNA, 19 nt, Homo sapiens
uaauggauauuugcuaugc

SEQ ID NO: 1362290 - RNA, 19 nt, Homo sapiens
gcugcugguuuaugaauac

SEQ ID NO: 1362291 - RNA, 19 nt, Homo sapiens
acaugauuccugucaauaa

SEQ ID NO: 1362292 - RNA, 19 nt, Homo sapiens
gguagacagcuuucgaaug

SEQ ID NO: 1362293 - RNA, 19 nt, Homo sapiens
uauaaaagcuugguagaca

SEQ ID NO: 1362294 - RNA, 19 nt, Homo sapiens
uaggcaacuugagauuaua

SEQ ID NO: 1362295 - RNA, 19 nt, Homo sapiens
ggcaacagucuaucaggaa

SEQ ID NO: 1362296 - RNA, 19 nt, Homo sapiens
caagaaauugcugggauau

SEQ ID NO: 1362297 - RNA, 19 nt, Homo sapiens
caaguaggaaacaugaaau

SEQ ID NO: 1362298 - RNA, 19 nt, Homo sapiens
caagguauuccaaaucucu

SEQ ID NO: 1362299 - RNA, 19 nt, Homo sapiens
ccuuugagcaguacaagaa

SEQ ID NO: 1362300 - RNA, 19 nt, Homo sapiens
uaucucauauugcuguaag

SEQ ID NO: 1362301 - RNA, 19 nt, Homo sapiens
uaucagcucuauuuuccua

SEQ ID NO: 1362302 - RNA, 19 nt, Homo sapiens
gcaccaugaagaagagaga

SEQ ID NO: 1362303 - RNA, 19 nt, Homo sapiens
gauuauaguuuuggcugua

SEQ ID NO: 1362304 - RNA, 19 nt, Homo sapiens
gaacuggugauugccuaug

SEQ ID NO: 1362305 - RNA, 19 nt, Homo sapiens
gaagggauuuuagcuuugu

SEQ ID NO: 1362306 - RNA, 19 nt, Homo sapiens
aaacaauggcaacagucua

SEQ ID NO: 1362307 - RNA, 19 nt, Homo sapiens
acuaacagaagccauugua

SEQ ID NO: 1362308 - RNA, 19 nt, Homo sapiens
gugauugccuaugaagugu

SEQ ID NO: 1362309 - RNA, 19 nt, Homo sapiens
gaagaagggauuuuagcuu

SEQ ID NO: 1362310 - RNA, 19 nt, Homo sapiens
cuggagagaucaaguacag

SEQ ID NO: 1362311 - RNA, 19 nt, Homo sapiens
auggaaggguuauuugguu

SEQ ID NO: 1362312 - RNA, 19 nt, Homo sapiens
gucuagaaaugcuuaaacu

SEQ ID NO: 1362313 - RNA, 19 nt, Homo sapiens
cgaucggccagguguauaa

SEQ ID NO: 1362314 - RNA, 19 nt, Homo sapiens
cccuugagauaauggauau

SEQ ID NO: 1362315 - RNA, 19 nt, Homo sapiens
gagaucaaguacagaaccu

SEQ ID NO: 1362316 - RNA, 19 nt, Homo sapiens
cacuguggguuaugcaaga

SEQ ID NO: 1362317 - RNA, 19 nt, Homo sapiens
auugggaucuggacuaaca

SEQ ID NO: 1362318 - RNA, 19 nt, Homo sapiens
caaugagguauuuaaagug

SEQ ID NO: 1362319 - RNA, 19 nt, Homo sapiens
caacagucuaucaggaaga

SEQ ID NO: 1362320 - RNA, 19 nt, Homo sapiens
gaaguaaucuguaguguuu

SEQ ID NO: 1362321 - RNA, 19 nt, Homo sapiens
caaaguagaguucuguuua

SEQ ID NO: 1362322 - RNA, 19 nt, Homo sapiens
uauauuagcuuuccugaga

SEQ ID NO: 1362323 - RNA, 19 nt, Homo sapiens
gguaaucccuccagccuaa

SEQ ID NO: 1362324 - RNA, 19 nt, Homo sapiens
ggacggugcuuguuugaau

SEQ ID NO: 1362325 - RNA, 19 nt, Homo sapiens
ugaaagagguaugaaguaa

SEQ ID NO: 1362326 - RNA, 19 nt, Homo sapiens
ggaccuaacuauacaucuu

SEQ ID NO: 1362327 - RNA, 19 nt, Homo sapiens
aaacagguauagccaaauu

SEQ ID NO: 1362328 - RNA, 19 nt, Homo sapiens
uagcagcacuucacuuaaa

SEQ ID NO: 1362329 - RNA, 19 nt, Homo sapiens
gaauggaccuaacuauaca

SEQ ID NO: 1362330 - RNA, 19 nt, Homo sapiens
uggcagcaauuccuaguua

SEQ ID NO: 1362331 - RNA, 19 nt, Homo sapiens
cuauacaucuuugcucuua

SEQ ID NO: 1362332 - RNA, 19 nt, Homo sapiens
cauagcagcacuucacuua

SEQ ID NO: 1362333 - RNA, 19 nt, Homo sapiens
ggagaaggaagcagaauau

SEQ ID NO: 1362334 - RNA, 19 nt, Homo sapiens
gaaaacagguauagccaaa

SEQ ID NO: 1362335 - RNA, 19 nt, Homo sapiens
gaaggaagcagaauauaac

SEQ ID NO: 1362336 - RNA, 19 nt, Homo sapiens
gauagagaacccaaaguuu

SEQ ID NO: 1362337 - RNA, 19 nt, Homo sapiens
gcagagacuaggacccuua

SEQ ID NO: 1362338 - RNA, 19 nt, Homo sapiens
gcacuucacuuaaaaggaa

SEQ ID NO: 1362339 - RNA, 19 nt, Homo sapiens
aaagagguaugaaguaauc

SEQ ID NO: 1362340 - RNA, 19 nt, Homo sapiens
gaacacaaacugaaauugc

SEQ ID NO: 1362341 - RNA, 19 nt, Homo sapiens
ggaagacccacuccagauu

SEQ ID NO: 1362342 - RNA, 19 nt, Homo sapiens
gguaugaaguaaucuguag

SEQ ID NO: 1362343 - RNA, 19 nt, Homo sapiens
cccaauaauucgacucuuu

SEQ ID NO: 1362344 - RNA, 19 nt, Homo sapiens
cuaagaggaugauucuguu

SEQ ID NO: 1362345 - RNA, 19 nt, Homo sapiens
agaaggaagcagaauauaa

SEQ ID NO: 1362346 - RNA, 19 nt, Homo sapiens
uuucaaaggucuggacuaa

SEQ ID NO: 1362347 - RNA, 19 nt, Homo sapiens
ucaccuggccuacaacuuu

SEQ ID NO: 1362348 - RNA, 19 nt, Homo sapiens
aaagucaccuugaaagcuu

SEQ ID NO: 1362349 - RNA, 19 nt, Homo sapiens
ugacagagcccgagcaaag

SEQ ID NO: 1362350 - RNA, 19 nt, Homo sapiens
gaacgucuguccccuguga

SEQ ID NO: 1362351 - RNA, 19 nt, Homo sapiens
ucaaaggucuggacuaagc

SEQ ID NO: 1362352 - RNA, 19 nt, Homo sapiens
aaagagagcucaaaaccaa

SEQ ID NO: 1362353 - RNA, 19 nt, Homo sapiens
gagaaggaagcagaauaua

SEQ ID NO: 1362354 - RNA, 19 nt, Homo sapiens
caacuuugccuugugcuuu

SEQ ID NO: 1362355 - RNA, 19 nt, Homo sapiens
gaaagagguaugaaguaau

SEQ ID NO: 1362356 - RNA, 19 nt, Homo sapiens
cagcaugucuuugccauag

SEQ ID NO: 1362357 - RNA, 19 nt, Homo sapiens
gaagacccacuccagauuc

SEQ ID NO: 1362358 - RNA, 19 nt, Homo sapiens
ccacucgacuucugaacug

SEQ ID NO: 1362359 - RNA, 19 nt, Homo sapiens
uaaaguuacucauguaucc

SEQ ID NO: 1362360 - RNA, 19 nt, Homo sapiens
gaccuaacuauacaucuuu

SEQ ID NO: 1362361 - RNA, 19 nt, Homo sapiens
uagccaaauucaagaaaga

SEQ ID NO: 1362362 - RNA, 19 nt, Homo sapiens
guagaguucuguuuaagcu

SEQ ID NO: 1362363 - RNA, 19 nt, Homo sapiens
acacagauauuugcugcuu

SEQ ID NO: 1362364 - RNA, 19 nt, Homo sapiens
agcaauuccuaguuaguua

SEQ ID NO: 1362365 - RNA, 19 nt, Homo sapiens
cuggagagcucaagacagu

SEQ ID NO: 1362366 - RNA, 19 nt, Homo sapiens
cgacucugcuggccaagau

SEQ ID NO: 1362367 - RNA, 19 nt, Homo sapiens
gaaagccaaaguagaguuc

SEQ ID NO: 1362368 - RNA, 19 nt, Homo sapiens
uugguaaccuugccuggua

SEQ ID NO: 1362369 - RNA, 19 nt, Homo sapiens
ucccaacccuccacagauu

SEQ ID NO: 1362370 - RNA, 19 nt, Homo sapiens
gacggugcuuguuugaauu

SEQ ID NO: 1362371 - RNA, 19 nt, Homo sapiens
gaaccuggacggugcuugu

SEQ ID NO: 1362372 - RNA, 19 nt, Homo sapiens
ugaauggaccuaacuauac

SEQ ID NO: 1362373 - RNA, 19 nt, Homo sapiens
gugcacuaauuguuacauu

SEQ ID NO: 1362374 - RNA, 19 nt, Homo sapiens
ccaaaguagaguucuguuu

SEQ ID NO: 1362375 - RNA, 19 nt, Homo sapiens
ggguugaucugcucucagu

SEQ ID NO: 1362376 - RNA, 19 nt, Homo sapiens
gagaaaagaacacagauau

SEQ ID NO: 1362377 - RNA, 19 nt, Homo sapiens
auuggaggcugaaauugua

SEQ ID NO: 1362378 - RNA, 19 nt, Homo sapiens
ccacaugccaggacagaga

SEQ ID NO: 1362379 - RNA, 19 nt, Homo sapiens
ccuggacucucuuaacgaa

SEQ ID NO: 1362380 - RNA, 19 nt, Homo sapiens
gccuugugcuuuguuuaua

SEQ ID NO: 1362381 - RNA, 19 nt, Homo sapiens
ucaggaaauugacagaauc

SEQ ID NO: 1362382 - RNA, 19 nt, Homo sapiens
gaaugagccacucccaguu

SEQ ID NO: 1362383 - RNA, 19 nt, Homo sapiens
ccuugugcuuuguuuauaa

SEQ ID NO: 1362384 - RNA, 19 nt, Homo sapiens
gaccuggacucucuuaacg

SEQ ID NO: 1362385 - RNA, 19 nt, Homo sapiens
gcuguuaugccuuugaaug

SEQ ID NO: 1362386 - RNA, 19 nt, Homo sapiens
uugcaacucugcccaacaa

SEQ ID NO: 1362387 - RNA, 19 nt, Homo sapiens
uaaccuugccugguacuaa

SEQ ID NO: 1362388 - RNA, 19 nt, Homo sapiens
guugaucugcucucaguuu

SEQ ID NO: 1362389 - RNA, 19 nt, Homo sapiens
gaucugggagccucuuuca

SEQ ID NO: 1362390 - RNA, 19 nt, Homo sapiens
ggagagcucaagacaguag

SEQ ID NO: 1362391 - RNA, 19 nt, Homo sapiens
aggaaacccuaaaggagaa

SEQ ID NO: 1362392 - RNA, 19 nt, Homo sapiens
gccaaauucaagaaagaua

SEQ ID NO: 1362393 - RNA, 19 nt, Homo sapiens
ccuaagaggaugauucugu

SEQ ID NO: 1362394 - RNA, 19 nt, Homo sapiens
uugaauggaccuaacuaua

SEQ ID NO: 1362395 - RNA, 19 nt, Homo sapiens
gauauuugcugcuuuuaag

SEQ ID NO: 1362396 - RNA, 19 nt, Homo sapiens
ccaauaauucgacucuuuc

SEQ ID NO: 1362397 - RNA, 19 nt, Homo sapiens
caagcaagcaaaccacaau

SEQ ID NO: 1362398 - RNA, 19 nt, Homo sapiens
aaccuugccugguacuaaa

SEQ ID NO: 1362399 - RNA, 19 nt, Homo sapiens
gggaagacccacuccagau

SEQ ID NO: 1362400 - RNA, 19 nt, Homo sapiens
acaaucaaguccaaagucu

SEQ ID NO: 1362401 - RNA, 19 nt, Homo sapiens
agagcuggcuugauguuca

SEQ ID NO: 1362402 - RNA, 19 nt, Homo sapiens
guacauuucaguaaucucu

SEQ ID NO: 1362403 - RNA, 19 nt, Homo sapiens
gagacuaggacccuuaugg

SEQ ID NO: 1362404 - RNA, 19 nt, Homo sapiens
gcaugucuuugccauagca

SEQ ID NO: 1362405 - RNA, 19 nt, Homo sapiens
cuucugaacuggaggaucu

SEQ ID NO: 1362406 - RNA, 19 nt, Homo sapiens
agauagagaacccaaaguu

SEQ ID NO: 1362407 - RNA, 19 nt, Homo sapiens
ggaugauucuguuuuguug

SEQ ID NO: 1362408 - RNA, 19 nt, Homo sapiens
caacagugucaguuuagga

SEQ ID NO: 1362409 - RNA, 19 nt, Homo sapiens
uuagaaagccaaaguagag

SEQ ID NO: 1362410 - RNA, 19 nt, Homo sapiens
uaagauagagaacccaaag

SEQ ID NO: 1362411 - RNA, 19 nt, Homo sapiens
gaaucccacucgacuucug

SEQ ID NO: 1362412 - RNA, 19 nt, Homo sapiens
gucgucaacucaacuguca

SEQ ID NO: 1362413 - RNA, 19 nt, Homo sapiens
uggccaagauuauuucucu

SEQ ID NO: 1362414 - RNA, 19 nt, Homo sapiens
aggaagaaauugccucucu

SEQ ID NO: 1362415 - RNA, 19 nt, Homo sapiens
cagcugcucuguccaccau

SEQ ID NO: 1362416 - RNA, 19 nt, Homo sapiens
guacuagcagccaaagaga

SEQ ID NO: 1362417 - RNA, 19 nt, Homo sapiens
uaagaggaugauucuguuu

SEQ ID NO: 1362418 - RNA, 19 nt, Homo sapiens
ccuggacggugcuuguuug

SEQ ID NO: 1362419 - RNA, 19 nt, Homo sapiens
gguauagccaaauucaaga

SEQ ID NO: 1362420 - RNA, 19 nt, Homo sapiens
gcagugccaucuucaucua

SEQ ID NO: 1362421 - RNA, 19 nt, Homo sapiens
gcaagggccacuccacaua

SEQ ID NO: 1362422 - RNA, 19 nt, Homo sapiens
ggaaugagaaggucaagga

SEQ ID NO: 1362423 - RNA, 19 nt, Homo sapiens
gcucugauccuguugauau

SEQ ID NO: 1362424 - RNA, 19 nt, Homo sapiens
cauggugacugcaauggua

SEQ ID NO: 1362425 - RNA, 19 nt, Homo sapiens
uuucuuaucuccaugaguu

SEQ ID NO: 1362426 - RNA, 19 nt, Homo sapiens
ccaugucccuggccaaaug

SEQ ID NO: 1362427 - RNA, 19 nt, Homo sapiens
guugauauaugugcugaug

SEQ ID NO: 1362428 - RNA, 19 nt, Homo sapiens
ccuguugggugguugguuu

SEQ ID NO: 1362429 - RNA, 19 nt, Homo sapiens
ucauugaggaugugacuaa

SEQ ID NO: 1362430 - RNA, 19 nt, Homo sapiens
gccaucaucagcuucauuu

SEQ ID NO: 1362431 - RNA, 19 nt, Homo sapiens
caucaucggccacuacuuc

SEQ ID NO: 1362432 - RNA, 19 nt, Homo sapiens
gaccugcuauccacucaca

SEQ ID NO: 1362433 - RNA, 19 nt, Homo sapiens
gucacgaggaguagacuua

SEQ ID NO: 1362434 - RNA, 19 nt, Homo sapiens
gcacccacaugccuaagcu

SEQ ID NO: 1362435 - RNA, 19 nt, Homo sapiens
gaaggucaaggaggucauu

SEQ ID NO: 1362436 - RNA, 19 nt, Homo sapiens
ccaccaugcugcuuaucau

SEQ ID NO: 1362437 - RNA, 19 nt, Homo sapiens
guucugcuguuugcucuga

SEQ ID NO: 1362438 - RNA, 19 nt, Homo sapiens
ugaccaccaugcugcuuau

SEQ ID NO: 1362439 - RNA, 19 nt, Homo sapiens
cuagagagcaccugacaag

SEQ ID NO: 1362440 - RNA, 19 nt, Homo sapiens
aagcuugccugcucugaca

SEQ ID NO: 1362441 - RNA, 19 nt, Homo sapiens
aaacacgacucugguucug

SEQ ID NO: 1362442 - RNA, 19 nt, Homo sapiens
cgaaugguccagugugugu

SEQ ID NO: 1362443 - RNA, 19 nt, Homo sapiens
ccugggcucugccaacuuc

SEQ ID NO: 1362444 - RNA, 19 nt, Homo sapiens
gaccaugucccuggccaaa

SEQ ID NO: 1362445 - RNA, 19 nt, Homo sapiens
guuccagguucugcuguuu

SEQ ID NO: 1362446 - RNA, 19 nt, Homo sapiens
ggaggucauugaggaugug

SEQ ID NO: 1362447 - RNA, 19 nt, Homo sapiens
ucuccuacauccucauugu

SEQ ID NO: 1362448 - RNA, 19 nt, Homo sapiens
uaacccagucuuucuuuua

SEQ ID NO: 1362449 - RNA, 19 nt, Homo sapiens
cgccuucacucacccaugu

SEQ ID NO: 1362450 - RNA, 19 nt, Homo sapiens
cauugaggaugugacuaaa

SEQ ID NO: 1362451 - RNA, 19 nt, Homo sapiens
cagcuucauuugccuugau

SEQ ID NO: 1362452 - RNA, 19 nt, Homo sapiens
ugauauaugugcugaugcu

SEQ ID NO: 1362453 - RNA, 19 nt, Homo sapiens
caucuucaccuuccggaau

SEQ ID NO: 1362454 - RNA, 19 nt, Homo sapiens
uaacaucaucggccacuac

SEQ ID NO: 1362455 - RNA, 19 nt, Homo sapiens
cacgaaugguccagugugu

SEQ ID NO: 1362456 - RNA, 19 nt, Homo sapiens
acaaggcgguggccauggu

SEQ ID NO: 1362457 - RNA, 19 nt, Homo sapiens
ggagcuccucacucucuuu

SEQ ID NO: 1362458 - RNA, 19 nt, Homo sapiens
agagagcaccugacaaguc

SEQ ID NO: 1362459 - RNA, 19 nt, Homo sapiens
ccuaacccagucuuucuuu

SEQ ID NO: 1362460 - RNA, 19 nt, Homo sapiens
ucugacacccgccacauug

SEQ ID NO: 1362461 - RNA, 19 nt, Homo sapiens
gguuuccucuccauugucu

SEQ ID NO: 1362462 - RNA, 19 nt, Homo sapiens
ccaacuuccugauacucau

SEQ ID NO: 1362463 - RNA, 19 nt, Homo sapiens
cugauccuguugauauaug

SEQ ID NO: 1362464 - RNA, 19 nt, Homo sapiens
caagggccacuccacauac

SEQ ID NO: 1362465 - RNA, 19 nt, Homo sapiens
caucggccacuacuucugu

SEQ ID NO: 1362466 - RNA, 19 nt, Homo sapiens
guugguuuccucuccauug

SEQ ID NO: 1362467 - RNA, 19 nt, Homo sapiens
caacuuccugauacucaug

SEQ ID NO: 1362468 - RNA, 19 nt, Homo sapiens
caucaucagcuucauuugc

SEQ ID NO: 1362469 - RNA, 19 nt, Homo sapiens
ccuggucccucaucuucau

SEQ ID NO: 1362470 - RNA, 19 nt, Homo sapiens
uguuugcucugauccuguu

SEQ ID NO: 1362471 - RNA, 19 nt, Homo sapiens
gccaacuuccugauacuca

SEQ ID NO: 1362472 - RNA, 19 nt, Homo sapiens
cucugauccuguugauaua

SEQ ID NO: 1362473 - RNA, 19 nt, Homo sapiens
cagaccugcuauccacuca

SEQ ID NO: 1362474 - RNA, 19 nt, Homo sapiens
ccaagcagcuggagacauu

SEQ ID NO: 1362475 - RNA, 19 nt, Homo sapiens
gagagaauaucuucaagga

SEQ ID NO: 1362476 - RNA, 19 nt, Homo sapiens
caaagggacuggaaacaga

SEQ ID NO: 1362477 - RNA, 19 nt, Homo sapiens
gaacugagacuccuaaggu

SEQ ID NO: 1362478 - RNA, 19 nt, Homo sapiens
gcucuuggcucgaugaaau

SEQ ID NO: 1362479 - RNA, 19 nt, Homo sapiens
gaaaguacgccaaugugaa

SEQ ID NO: 1362480 - RNA, 19 nt, Homo sapiens
gggagcagcuguccucaga

SEQ ID NO: 1362481 - RNA, 19 nt, Homo sapiens
gagcagcuguccucagaga

SEQ ID NO: 1362482 - RNA, 19 nt, Homo sapiens
guacagguuugguuucaga

SEQ ID NO: 1362483 - RNA, 19 nt, Homo sapiens
gaacagaagggccaaagag

SEQ ID NO: 1362484 - RNA, 19 nt, Homo sapiens
gcaaggaggacuucuucaa

SEQ ID NO: 1362485 - RNA, 19 nt, Homo sapiens
ucacagcccuugaguaaaa

SEQ ID NO: 1362486 - RNA, 19 nt, Homo sapiens
agaaacgccugaagaagga

SEQ ID NO: 1362487 - RNA, 19 nt, Homo sapiens
ggacgaauucuaccucaug

SEQ ID NO: 1362488 - RNA, 19 nt, Homo sapiens
cagaagggccaaagagaaa

SEQ ID NO: 1362489 - RNA, 19 nt, Homo sapiens
gcacagcuccugccucaag

SEQ ID NO: 1362490 - RNA, 19 nt, Homo sapiens
gcagaggacugugggguua

SEQ ID NO: 1362491 - RNA, 19 nt, Homo sapiens
gcagcaagcaggagaagga

SEQ ID NO: 1362492 - RNA, 19 nt, Homo sapiens
caaggaagacuacgagaca

SEQ ID NO: 1362493 - RNA, 19 nt, Homo sapiens
gaucgaaaguacgccaaug

SEQ ID NO: 1362494 - RNA, 19 nt, Homo sapiens
uagggacacuggcuuguug

SEQ ID NO: 1362495 - RNA, 19 nt, Homo sapiens
aaagagaaacgccugaaga

SEQ ID NO: 1362496 - RNA, 19 nt, Homo sapiens
ucaaugggcuggauuacac

SEQ ID NO: 1362497 - RNA, 19 nt, Homo sapiens
cgaaaguacgccaauguga

SEQ ID NO: 1362498 - RNA, 19 nt, Homo sapiens
uguaggcuaucccgacuuu

SEQ ID NO: 1362499 - RNA, 19 nt, Homo sapiens
gcaaggcccaggacuuugu

SEQ ID NO: 1362500 - RNA, 19 nt, Homo sapiens
gcugcucagugcuuuggua

SEQ ID NO: 1362501 - RNA, 19 nt, Homo sapiens
uaucccgacuuuccaacua

SEQ ID NO: 1362502 - RNA, 19 nt, Homo sapiens
ucugacaucuccacaggaa

SEQ ID NO: 1362503 - RNA, 19 nt, Homo sapiens
ggucguacagguuugguuu

SEQ ID NO: 1362504 - RNA, 19 nt, Homo sapiens
cagccaagcagaacgauga

SEQ ID NO: 1362505 - RNA, 19 nt, Homo sapiens
gagcagacucaucucagaa

SEQ ID NO: 1362506 - RNA, 19 nt, Homo sapiens
gcagacucaucucagaaca

SEQ ID NO: 1362507 - RNA, 19 nt, Homo sapiens
ggacccaccucugacaucu

SEQ ID NO: 1362508 - RNA, 19 nt, Homo sapiens
gacaguaauuugggcauca

SEQ ID NO: 1362509 - RNA, 19 nt, Homo sapiens
gcggacaguuaaugaaugg

SEQ ID NO: 1362510 - RNA, 19 nt, Homo sapiens
gagacaggccuggacauga

SEQ ID NO: 1362511 - RNA, 19 nt, Homo sapiens
gcacauccuggacaaguuc

SEQ ID NO: 1362512 - RNA, 19 nt, Homo sapiens
cguuacaggcggacaguua

SEQ ID NO: 1362513 - RNA, 19 nt, Homo sapiens
agacaggccuggacaugag

SEQ ID NO: 1362514 - RNA, 19 nt, Homo sapiens
guacgccaaugugaauuuc

SEQ ID NO: 1362515 - RNA, 19 nt, Homo sapiens
ccacaccaauaggauuuau

SEQ ID NO: 1362516 - RNA, 19 nt, Homo sapiens
agagcagacucaucucaga

SEQ ID NO: 1362517 - RNA, 19 nt, Homo sapiens
ggaaguccuccgcugauuc

SEQ ID NO: 1362518 - RNA, 19 nt, Homo sapiens
ggccacaccaauaggauuu

SEQ ID NO: 1362519 - RNA, 19 nt, Homo sapiens
aagagaaacgccugaagaa

SEQ ID NO: 1362520 - RNA, 19 nt, Homo sapiens
caccugcacugcuuugcuu

SEQ ID NO: 1362521 - RNA, 19 nt, Homo sapiens
ccgcaaggcccaggacuuu

SEQ ID NO: 1362522 - RNA, 19 nt, Homo sapiens
ccagaacugagacuccuaa

SEQ ID NO: 1362523 - RNA, 19 nt, Homo sapiens
aaaguacgccaaugugaau

SEQ ID NO: 1362524 - RNA, 19 nt, Homo sapiens
caaggaggacuucuucaag

SEQ ID NO: 1362525 - RNA, 19 nt, Homo sapiens
agacucaucucagaacaca

SEQ ID NO: 1362526 - RNA, 19 nt, Homo sapiens
ggcggacaguuaaugaaug

SEQ ID NO: 1362527 - RNA, 19 nt, Homo sapiens
gagaucaaagggacuggaa

SEQ ID NO: 1362528 - RNA, 19 nt, Homo sapiens
acacugcucucaccagaac

SEQ ID NO: 1362529 - RNA, 19 nt, Homo sapiens
gaucaaagggacuggaaac

SEQ ID NO: 1362530 - RNA, 19 nt, Homo sapiens
acagaagggccaaagagaa

SEQ ID NO: 1362531 - RNA, 19 nt, Homo sapiens
ggcuuucgcuccgagauga

SEQ ID NO: 1362532 - RNA, 19 nt, Homo sapiens
guuacaggcggacaguuaa

SEQ ID NO: 1362533 - RNA, 19 nt, Homo sapiens
aggaucaaauucucucaga

SEQ ID NO: 1362534 - RNA, 19 nt, Homo sapiens
aacugagacuccuaaggua

SEQ ID NO: 1362535 - RNA, 19 nt, Homo sapiens
agaauaucuucaaggauca

SEQ ID NO: 1362536 - RNA, 19 nt, Homo sapiens
aggaagcaguguaggcuau

SEQ ID NO: 1362537 - RNA, 19 nt, Homo sapiens
cagguuugguuucagaaca

SEQ ID NO: 1362538 - RNA, 19 nt, Homo sapiens
gcuggagacauuaaagaau

SEQ ID NO: 1362539 - RNA, 19 nt, Homo sapiens
gaugggagccccuauggaa

SEQ ID NO: 1362540 - RNA, 19 nt, Homo sapiens
ggacaugagggucguacag

SEQ ID NO: 1362541 - RNA, 19 nt, Homo sapiens
ccacacuagggcauuguuu

SEQ ID NO: 1362542 - RNA, 19 nt, Homo sapiens
cagcuggagacauuaaaga

SEQ ID NO: 1362543 - RNA, 19 nt, Homo sapiens
cugcuuugcuugcaucauc

SEQ ID NO: 1362544 - RNA, 19 nt, Homo sapiens
uggaaguccuccgcugauu

SEQ ID NO: 1362545 - RNA, 19 nt, Homo sapiens
ggacgggacaggacaaucc

SEQ ID NO: 1362546 - RNA, 19 nt, Homo sapiens
caaagagaaacgccugaag

SEQ ID NO: 1362547 - RNA, 19 nt, Homo sapiens
caagcagaacgaugacuca

SEQ ID NO: 1362548 - RNA, 19 nt, Homo sapiens
gcccuugaguaaaauaaaa

SEQ ID NO: 1362549 - RNA, 19 nt, Homo sapiens
ccaaagagaaacgccugaa

SEQ ID NO: 1362550 - RNA, 19 nt, Homo sapiens
agaccacacuagggcauug

SEQ ID NO: 1362551 - RNA, 19 nt, Homo sapiens
ccacgcuccuuugcucaau

SEQ ID NO: 1362552 - RNA, 19 nt, Homo sapiens
cuuccgagaggaucaaauu

SEQ ID NO: 1362553 - RNA, 19 nt, Homo sapiens
caugagggucguacagguu

SEQ ID NO: 1362554 - RNA, 19 nt, Homo sapiens
acucagaggcuggagcuaa

SEQ ID NO: 1362555 - RNA, 19 nt, Homo sapiens
cacaaugccucccaaaaca

SEQ ID NO: 1362556 - RNA, 19 nt, Homo sapiens
gcaugcagggcagggagua

SEQ ID NO: 1362557 - RNA, 19 nt, Homo sapiens
aaagaaugcauacaagaac

SEQ ID NO: 1362558 - RNA, 19 nt, Homo sapiens
ucacacaaugccucccaaa

SEQ ID NO: 1362559 - RNA, 19 nt, Homo sapiens
ucuaccaccugcacugcuu

SEQ ID NO: 1362560 - RNA, 19 nt, Homo sapiens
gaaguccuccgcugauucc

SEQ ID NO: 1362561 - RNA, 19 nt, Homo sapiens
cuucaaggaucaaaagaga

SEQ ID NO: 1362562 - RNA, 19 nt, Homo sapiens
gauuacacgguggacagua

SEQ ID NO: 1362563 - RNA, 19 nt, Homo sapiens
cagucuccauccuccauau

SEQ ID NO: 1362564 - RNA, 19 nt, Homo sapiens
aagaaugcauacaagaacu

SEQ ID NO: 1362565 - RNA, 19 nt, Homo sapiens
gcagcuggagacauuaaag

SEQ ID NO: 1362566 - RNA, 19 nt, Homo sapiens
ucaagcgcuucggcacaaa

SEQ ID NO: 1362567 - RNA, 19 nt, Homo sapiens
acacgguggacaguaauuu

SEQ ID NO: 1362568 - RNA, 19 nt, Homo sapiens
gcagcagcaagcaggagaa

SEQ ID NO: 1362569 - RNA, 19 nt, Homo sapiens
aagcagcuggagacauuaa

SEQ ID NO: 1362570 - RNA, 19 nt, Homo sapiens
caagcagcuggagacauua

SEQ ID NO: 1362571 - RNA, 19 nt, Homo sapiens
gggacgaauucuaccucau

SEQ ID NO: 1362572 - RNA, 19 nt, Homo sapiens
ggaguacgcuggcaauuuc

SEQ ID NO: 1362573 - RNA, 19 nt, Homo sapiens
gagaacagcugguugugau

SEQ ID NO: 1362574 - RNA, 19 nt, Homo sapiens
ggugauagcagaaaugaug

SEQ ID NO: 1362575 - RNA, 19 nt, Homo sapiens
agccauagcuuacaagaga

SEQ ID NO: 1362576 - RNA, 19 nt, Homo sapiens
gcagaagaacugaaucaug

SEQ ID NO: 1362577 - RNA, 19 nt, Homo sapiens
ggaaaugucccuggcagaa

SEQ ID NO: 1362578 - RNA, 19 nt, Homo sapiens
caauaaaaguucagccaua

SEQ ID NO: 1362579 - RNA, 19 nt, Homo sapiens
agacuagccuggaagaguu

SEQ ID NO: 1362580 - RNA, 19 nt, Homo sapiens
ggagauggaagucaugaga

SEQ ID NO: 1362581 - RNA, 19 nt, Homo sapiens
aggcauacguuuccauuau

SEQ ID NO: 1362582 - RNA, 19 nt, Homo sapiens
cagacaacacgcucaauaa

SEQ ID NO: 1362583 - RNA, 19 nt, Homo sapiens
aagcagaaguuggaacaaa

SEQ ID NO: 1362584 - RNA, 19 nt, Homo sapiens
agacaacacgcucaauaaa

SEQ ID NO: 1362585 - RNA, 19 nt, Homo sapiens
caagagaacagcugguugu

SEQ ID NO: 1362586 - RNA, 19 nt, Homo sapiens
acagacaacacgcucaaua

SEQ ID NO: 1362587 - RNA, 19 nt, Homo sapiens
gcacagacaacacgcucaa

SEQ ID NO: 1362588 - RNA, 19 nt, Homo sapiens
ucaauguacuggagaugga

SEQ ID NO: 1362589 - RNA, 19 nt, Homo sapiens
gaaaugauggagcuuggau

SEQ ID NO: 1362590 - RNA, 19 nt, Homo sapiens
aaaugucccuggcagaaga

SEQ ID NO: 1362591 - RNA, 19 nt, Homo sapiens
ccagaaugcugagagaauc

SEQ ID NO: 1362592 - RNA, 19 nt, Homo sapiens
agaagaagcagaaguugga

SEQ ID NO: 1362593 - RNA, 19 nt, Homo sapiens
guucagccauagcagcaaa

SEQ ID NO: 1362594 - RNA, 19 nt, Homo sapiens
caaggcauacguuuccauu

SEQ ID NO: 1362595 - RNA, 19 nt, Homo sapiens
gcugagaugccacccuuug

SEQ ID NO: 1362596 - RNA, 19 nt, Homo sapiens
gagauggaagucaugagaa

SEQ ID NO: 1362597 - RNA, 19 nt, Homo sapiens
ccacugcccuugccccuuu

SEQ ID NO: 1362598 - RNA, 19 nt, Homo sapiens
ccuggaagaguucaaugua

SEQ ID NO: 1362599 - RNA, 19 nt, Homo sapiens
ugagaugccacccuuugaa

SEQ ID NO: 1362600 - RNA, 19 nt, Homo sapiens
gaagaagcagaaguuggaa

SEQ ID NO: 1362601 - RNA, 19 nt, Homo sapiens
gaaaugucccuggcagaag

SEQ ID NO: 1362602 - RNA, 19 nt, Homo sapiens
ccaaggcggagauggaaau

SEQ ID NO: 1362603 - RNA, 19 nt, Homo sapiens
gacaacacgcucaauaaaa

SEQ ID NO: 1362604 - RNA, 19 nt, Homo sapiens
gagaugccacccuuugaag

SEQ ID NO: 1362605 - RNA, 19 nt, Homo sapiens
ggaagaguucaauguacug

SEQ ID NO: 1362606 - RNA, 19 nt, Homo sapiens
uggaagaguucaauguacu

SEQ ID NO: 1362607 - RNA, 19 nt, Homo sapiens
ccuucuuucuuuccucuuu

SEQ ID NO: 1362608 - RNA, 19 nt, Homo sapiens
agauggaagucaugagaag

SEQ ID NO: 1362609 - RNA, 19 nt, Homo sapiens
gccauagcuuacaagagaa

SEQ ID NO: 1362610 - RNA, 19 nt, Homo sapiens
aggcggagauggaaauguc

SEQ ID NO: 1362611 - RNA, 19 nt, Homo sapiens
gcagggguguggcuuuguu

SEQ ID NO: 1362612 - RNA, 19 nt, Homo sapiens
agacagcuguaugcaguca

SEQ ID NO: 1362613 - RNA, 19 nt, Homo sapiens
cauccuuagccauagcuua

SEQ ID NO: 1362614 - RNA, 19 nt, Homo sapiens
acaacacgcucaauaaaag

SEQ ID NO: 1362615 - RNA, 19 nt, Homo sapiens
ggacugcgugggcugagau

SEQ ID NO: 1362616 - RNA, 19 nt, Homo sapiens
cccagaagaagcagaaguu

SEQ ID NO: 1362617 - RNA, 19 nt, Homo sapiens
gauggaagucaugagaaga

SEQ ID NO: 1362618 - RNA, 19 nt, Homo sapiens
gagaagacagcuguaugca

SEQ ID NO: 1362619 - RNA, 19 nt, Homo sapiens
gaagcagaaguuggaacaa

SEQ ID NO: 1362620 - RNA, 19 nt, Homo sapiens
ugagaagacagcuguaugc

SEQ ID NO: 1362621 - RNA, 19 nt, Homo sapiens
ccagaagaagcagaaguug

SEQ ID NO: 1362622 - RNA, 19 nt, Homo sapiens
ccuuagccauagcuuacaa

SEQ ID NO: 1362623 - RNA, 19 nt, Homo sapiens
aggaguacgcuggcaauuu

SEQ ID NO: 1362624 - RNA, 19 nt, Homo sapiens
acaccaaggcggagaugga

SEQ ID NO: 1362625 - RNA, 19 nt, Homo sapiens
caugagaagacagcuguau

SEQ ID NO: 1362626 - RNA, 19 nt, Homo sapiens
cuggaagaguucaauguac

SEQ ID NO: 1362627 - RNA, 19 nt, Homo sapiens
cagacuagccuggaagagu

SEQ ID NO: 1362628 - RNA, 19 nt, Homo sapiens
ugaagaaacucaugagaaa

SEQ ID NO: 1362629 - RNA, 19 nt, Homo sapiens
gaaggugccugcaguaugu

SEQ ID NO: 1362630 - RNA, 19 nt, Homo sapiens
ggauagcacuuauacauuc

SEQ ID NO: 1362631 - RNA, 19 nt, Homo sapiens
ggaaauaccaccagaugaa

SEQ ID NO: 1362632 - RNA, 19 nt, Homo sapiens
caaauuaagugaccaccaa

SEQ ID NO: 1362633 - RNA, 19 nt, Homo sapiens
gcacuuauacauuccauga

SEQ ID NO: 1362634 - RNA, 19 nt, Homo sapiens
gaaacagaaugaaauugag

SEQ ID NO: 1362635 - RNA, 19 nt, Homo sapiens
gaacaucccagaucucuac

SEQ ID NO: 1362636 - RNA, 19 nt, Homo sapiens
gaaugaaauugaggaagga

SEQ ID NO: 1362637 - RNA, 19 nt, Homo sapiens
caaaggagacucuggagau

SEQ ID NO: 1362638 - RNA, 19 nt, Homo sapiens
gaagacuggcuggcaauaa

SEQ ID NO: 1362639 - RNA, 19 nt, Homo sapiens
aagacuggcuggcaauaaa

SEQ ID NO: 1362640 - RNA, 19 nt, Homo sapiens
gagaaggcaggcauggaua

SEQ ID NO: 1362641 - RNA, 19 nt, Homo sapiens
ggacauccagcuaccauca

SEQ ID NO: 1362642 - RNA, 19 nt, Homo sapiens
ggagaaggcaggcauggau

SEQ ID NO: 1362643 - RNA, 19 nt, Homo sapiens
ggaaggugccugcaguaug

SEQ ID NO: 1362644 - RNA, 19 nt, Homo sapiens
uuccucagcucucuucuuu

SEQ ID NO: 1362645 - RNA, 19 nt, Homo sapiens
gggauagcacuuauacauu

SEQ ID NO: 1362646 - RNA, 19 nt, Homo sapiens
gcauggauaugaccuacag

SEQ ID NO: 1362647 - RNA, 19 nt, Homo sapiens
gccaagggauugcucaucu

SEQ ID NO: 1362648 - RNA, 19 nt, Homo sapiens
cuaugcagauccuaacuau

SEQ ID NO: 1362649 - RNA, 19 nt, Homo sapiens
caucugguccucucacaaa

SEQ ID NO: 1362650 - RNA, 19 nt, Homo sapiens
ggaagacuggcuggcaaua

SEQ ID NO: 1362651 - RNA, 19 nt, Homo sapiens
uuaccaagcucaagucaac

SEQ ID NO: 1362652 - RNA, 19 nt, Homo sapiens
ggaagugguugcgguccuu

SEQ ID NO: 1362653 - RNA, 19 nt, Homo sapiens
gggacugacugacugaauc

SEQ ID NO: 1362654 - RNA, 19 nt, Homo sapiens
caugagaaacagaaugaaa

SEQ ID NO: 1362655 - RNA, 19 nt, Homo sapiens
ucucuaccaugcagcagua

SEQ ID NO: 1362656 - RNA, 19 nt, Homo sapiens
ggacugacugacugaauca

SEQ ID NO: 1362657 - RNA, 19 nt, Homo sapiens
guccugagcuugguuucuu

SEQ ID NO: 1362658 - RNA, 19 nt, Homo sapiens
aaaggagacucuggagaug

SEQ ID NO: 1362659 - RNA, 19 nt, Homo sapiens
caagucaaccugagaacau

SEQ ID NO: 1362660 - RNA, 19 nt, Homo sapiens
gcuauucccugcauaucag

SEQ ID NO: 1362661 - RNA, 19 nt, Homo sapiens
gagaaacagaaugaaauug

SEQ ID NO: 1362662 - RNA, 19 nt, Homo sapiens
ccaagggauugcucaucuu

SEQ ID NO: 1362663 - RNA, 19 nt, Homo sapiens
gaaauaccaccagaugaag

SEQ ID NO: 1362664 - RNA, 19 nt, Homo sapiens
ggucauccgaguccagaaa

SEQ ID NO: 1362665 - RNA, 19 nt, Homo sapiens
gauccuaacuaugcuucug

SEQ ID NO: 1362666 - RNA, 19 nt, Homo sapiens
augaagagguugagaacau

SEQ ID NO: 1362667 - RNA, 19 nt, Homo sapiens
aaagagggacauccagcua

SEQ ID NO: 1362668 - RNA, 19 nt, Homo sapiens
gaagagguugagaacauca

SEQ ID NO: 1362669 - RNA, 19 nt, Homo sapiens
ucagcaacgucaguucuug

SEQ ID NO: 1362670 - RNA, 19 nt, Homo sapiens
aaacucaugagaaacagaa

SEQ ID NO: 1362671 - RNA, 19 nt, Homo sapiens
gaaggcaggcauggauaug

SEQ ID NO: 1362672 - RNA, 19 nt, Homo sapiens
acaaaagucuugccacugu

SEQ ID NO: 1362673 - RNA, 19 nt, Homo sapiens
cagaugaagagguugagaa

SEQ ID NO: 1362674 - RNA, 19 nt, Homo sapiens
aagaaacucaugagaaaca

SEQ ID NO: 1362675 - RNA, 19 nt, Homo sapiens
ugaagagguugagaacauc

SEQ ID NO: 1362676 - RNA, 19 nt, Homo sapiens
caggagggcagccaaagga

SEQ ID NO: 1362677 - RNA, 19 nt, Homo sapiens
gaaacucaugagaaacaga

SEQ ID NO: 1362678 - RNA, 19 nt, Homo sapiens
ccaaggaugaagaaacuca

SEQ ID NO: 1362679 - RNA, 19 nt, Homo sapiens
caagggauugcucaucuuc

SEQ ID NO: 1362680 - RNA, 19 nt, Homo sapiens
gcagcaguacaaucuaugu

SEQ ID NO: 1362681 - RNA, 19 nt, Homo sapiens
ggugaccaauccacacuac

SEQ ID NO: 1362682 - RNA, 19 nt, Homo sapiens
gcugacaugugugccuuuc

SEQ ID NO: 1362683 - RNA, 19 nt, Homo sapiens
ggauucagggcuuuaccaa

SEQ ID NO: 1362684 - RNA, 19 nt, Homo sapiens
ccucagcucucuucuuucc

SEQ ID NO: 1362685 - RNA, 19 nt, Homo sapiens
ugccaaggaugaagaaacu

SEQ ID NO: 1362686 - RNA, 19 nt, Homo sapiens
agggauugcucaucuucuu

SEQ ID NO: 1362687 - RNA, 19 nt, Homo sapiens
caucccagaucucuaccau

SEQ ID NO: 1362688 - RNA, 19 nt, Homo sapiens
gaagaaacucaugagaaac

SEQ ID NO: 1362689 - RNA, 19 nt, Homo sapiens
gcucaucuucuugcucuug

SEQ ID NO: 1362690 - RNA, 19 nt, Homo sapiens
ggugugcucuguggagaag

SEQ ID NO: 1362691 - RNA, 19 nt, Homo sapiens
ggcuggcaauaaagucaaa

SEQ ID NO: 1362692 - RNA, 19 nt, Homo sapiens
gggaaggugccugcaguau

SEQ ID NO: 1362693 - RNA, 19 nt, Homo sapiens
cugagaacaucccagaucu

SEQ ID NO: 1362694 - RNA, 19 nt, Homo sapiens
gggaggauucagggcuuua

SEQ ID NO: 1362695 - RNA, 19 nt, Homo sapiens
acauccagcuaccaucaug

SEQ ID NO: 1362696 - RNA, 19 nt, Homo sapiens
ugacaugugugccuuuccu

SEQ ID NO: 1362697 - RNA, 19 nt, Homo sapiens
caucuucuugcucuuggua

SEQ ID NO: 1362698 - RNA, 19 nt, Homo sapiens
acuuauacauuccaugaag

SEQ ID NO: 1362699 - RNA, 19 nt, Homo sapiens
ccaugcagcaguacaaucu

SEQ ID NO: 1362700 - RNA, 19 nt, Homo sapiens
ccagcuauucccugcauau

SEQ ID NO: 1362701 - RNA, 19 nt, Homo sapiens
gggauugcucaucuucuug

SEQ ID NO: 1362702 - RNA, 19 nt, Homo sapiens
gacagugcccucuccuaca

SEQ ID NO: 1362703 - RNA, 19 nt, Homo sapiens
gauagcacuuauacauucc

SEQ ID NO: 1362704 - RNA, 19 nt, Homo sapiens
augcagcaguacaaucuau

SEQ ID NO: 1362705 - RNA, 19 nt, Homo sapiens
ccugagaacaucccagauc

SEQ ID NO: 1362706 - RNA, 19 nt, Homo sapiens
aaauaccaccagaugaaga

SEQ ID NO: 1362707 - RNA, 19 nt, Homo sapiens
ccagaaaagacacaaaaug

SEQ ID NO: 1362708 - RNA, 19 nt, Homo sapiens
gcagauccuaacuaugcuu

SEQ ID NO: 1362709 - RNA, 19 nt, Homo sapiens
uggaaauaccaccagauga

SEQ ID NO: 1362710 - RNA, 19 nt, Homo sapiens
ggagaccaauggauuaaua

SEQ ID NO: 1362711 - RNA, 19 nt, Homo sapiens
caaguucucuuucugauga

SEQ ID NO: 1362712 - RNA, 19 nt, Homo sapiens
ggaggcaaaugaauaauau

SEQ ID NO: 1362713 - RNA, 19 nt, Homo sapiens
ggacuuagguggauucagu

SEQ ID NO: 1362714 - RNA, 19 nt, Homo sapiens
gauuaggaauugcuagaua

SEQ ID NO: 1362715 - RNA, 19 nt, Homo sapiens
guaagcgcauguucuguua

SEQ ID NO: 1362716 - RNA, 19 nt, Homo sapiens
cggaggcgcugcuaucuua

SEQ ID NO: 1362717 - RNA, 19 nt, Homo sapiens
gaauggaggcaaaugaaua

SEQ ID NO: 1362718 - RNA, 19 nt, Homo sapiens
gaaguggaaugcuacaaug

SEQ ID NO: 1362719 - RNA, 19 nt, Homo sapiens
guggaaugcuacaauguua

SEQ ID NO: 1362720 - RNA, 19 nt, Homo sapiens
gcuacaauguuaagagaaa

SEQ ID NO: 1362721 - RNA, 19 nt, Homo sapiens
gaagaaauaccaagugagu

SEQ ID NO: 1362722 - RNA, 19 nt, Homo sapiens
ugaaggaaguggaaugcua

SEQ ID NO: 1362723 - RNA, 19 nt, Homo sapiens
gcucacgccuguaauccua

SEQ ID NO: 1362724 - RNA, 19 nt, Homo sapiens
accaacaacuacagaauua

SEQ ID NO: 1362725 - RNA, 19 nt, Homo sapiens
gaucaggacuacuuagaag

SEQ ID NO: 1362726 - RNA, 19 nt, Homo sapiens
ucuaugcucucaacaguaa

SEQ ID NO: 1362727 - RNA, 19 nt, Homo sapiens
cagcaacucucuuguaucu

SEQ ID NO: 1362728 - RNA, 19 nt, Homo sapiens
gaagugcguuucucugaag

SEQ ID NO: 1362729 - RNA, 19 nt, Homo sapiens
ggaggagacucuagcagau

SEQ ID NO: 1362730 - RNA, 19 nt, Homo sapiens
gcaccgccauccucaaguu

SEQ ID NO: 1362731 - RNA, 19 nt, Homo sapiens
guaacuagauugaaacacu

SEQ ID NO: 1362732 - RNA, 19 nt, Homo sapiens
aagaagaaauaccaaguga

SEQ ID NO: 1362733 - RNA, 19 nt, Homo sapiens
gauccuagccacaauaugu

SEQ ID NO: 1362734 - RNA, 19 nt, Homo sapiens
uagaagggcugcugaccaa

SEQ ID NO: 1362735 - RNA, 19 nt, Homo sapiens
gaaaugcacaggaucaaca

SEQ ID NO: 1362736 - RNA, 19 nt, Homo sapiens
gaagaagaaauaccaagug

SEQ ID NO: 1362737 - RNA, 19 nt, Homo sapiens
gcauggauguggcauaucu

SEQ ID NO: 1362738 - RNA, 19 nt, Homo sapiens
cuauauagcucagaacuuc

SEQ ID NO: 1362739 - RNA, 19 nt, Homo sapiens
uaacuucugguuugguuua

SEQ ID NO: 1362740 - RNA, 19 nt, Homo sapiens
gggcauggauguggcauau

SEQ ID NO: 1362741 - RNA, 19 nt, Homo sapiens
ucagaacaauguagacuuc

SEQ ID NO: 1362742 - RNA, 19 nt, Homo sapiens
gcacuguggcaauaacuuu

SEQ ID NO: 1362743 - RNA, 19 nt, Homo sapiens
gggugacuguguaugaaua

SEQ ID NO: 1362744 - RNA, 19 nt, Homo sapiens
gcaugucccuacuucaaga

SEQ ID NO: 1362745 - RNA, 19 nt, Homo sapiens
gcuaaggguccaguauuua

SEQ ID NO: 1362746 - RNA, 19 nt, Homo sapiens
gcagaauggaggcaaauga

SEQ ID NO: 1362747 - RNA, 19 nt, Homo sapiens
gaccaacaacuacagaauu

SEQ ID NO: 1362748 - RNA, 19 nt, Homo sapiens
ccaagaagauucacaaacc

SEQ ID NO: 1362749 - RNA, 19 nt, Homo sapiens
gccacugucuaaacgauaa

SEQ ID NO: 1362750 - RNA, 19 nt, Homo sapiens
ggaaguggaaugcuacaau

SEQ ID NO: 1362751 - RNA, 19 nt, Homo sapiens
gcgcuauggugaccuguug

SEQ ID NO: 1362752 - RNA, 19 nt, Homo sapiens
uugauuaacuucugguuug

SEQ ID NO: 1362753 - RNA, 19 nt, Homo sapiens
ggaaguucaaguucucuuu

SEQ ID NO: 1362754 - RNA, 19 nt, Homo sapiens
ccaagcccaucgugaagaa

SEQ ID NO: 1362755 - RNA, 19 nt, Homo sapiens
gaguuaaguugaaggaagu

SEQ ID NO: 1362756 - RNA, 19 nt, Homo sapiens
uggcacagcucaaguccuu

SEQ ID NO: 1362757 - RNA, 19 nt, Homo sapiens
gaaugggacuuagguggau

SEQ ID NO: 1362758 - RNA, 19 nt, Homo sapiens
uaaaccagcucagaauagu

SEQ ID NO: 1362759 - RNA, 19 nt, Homo sapiens
gaacaauguagacuuccaa

SEQ ID NO: 1362760 - RNA, 19 nt, Homo sapiens
cauuaggccucuugcaguu

SEQ ID NO: 1362761 - RNA, 19 nt, Homo sapiens
uuacuggaguuaaguugaa

SEQ ID NO: 1362762 - RNA, 19 nt, Homo sapiens
ugaagaagaucaggacuac

SEQ ID NO: 1362763 - RNA, 19 nt, Homo sapiens
gcaggagaauugcugaaac

SEQ ID NO: 1362764 - RNA, 19 nt, Homo sapiens
gaauugcuagauaguguuu

SEQ ID NO: 1362765 - RNA, 19 nt, Homo sapiens
ugaagugcguuucucugaa

SEQ ID NO: 1362766 - RNA, 19 nt, Homo sapiens
ugagucagccacugucuaa

SEQ ID NO: 1362767 - RNA, 19 nt, Homo sapiens
gauguggcauaucucaaug

SEQ ID NO: 1362768 - RNA, 19 nt, Homo sapiens
uauaaaccagcucagaaua

SEQ ID NO: 1362769 - RNA, 19 nt, Homo sapiens
caaguuugcagaugccuuu

SEQ ID NO: 1362770 - RNA, 19 nt, Homo sapiens
guucacagguggcauguac

SEQ ID NO: 1362771 - RNA, 19 nt, Homo sapiens
gaagaagaagaaauaccaa

SEQ ID NO: 1362772 - RNA, 19 nt, Homo sapiens
augaggagaucuauuguau

SEQ ID NO: 1362773 - RNA, 19 nt, Homo sapiens
guauaaaccagcucagaau

SEQ ID NO: 1362774 - RNA, 19 nt, Homo sapiens
cagcagcaacucucuugua

SEQ ID NO: 1362775 - RNA, 19 nt, Homo sapiens
uaaaggacacggcccauuc

SEQ ID NO: 1362776 - RNA, 19 nt, Homo sapiens
ucagugaaaugcacaggau

SEQ ID NO: 1362777 - RNA, 19 nt, Homo sapiens
caacaacuacagaauuauc

SEQ ID NO: 1362778 - RNA, 19 nt, Homo sapiens
ggauguggcauaucucaau

SEQ ID NO: 1362779 - RNA, 19 nt, Homo sapiens
gaaaccccgucucuacuaa

SEQ ID NO: 1362780 - RNA, 19 nt, Homo sapiens
gaaguucaaguucucuuuc

SEQ ID NO: 1362781 - RNA, 19 nt, Homo sapiens
gcucaaguccuucuacgau

SEQ ID NO: 1362782 - RNA, 19 nt, Homo sapiens
ugcuaaggguccaguauuu

SEQ ID NO: 1362783 - RNA, 19 nt, Homo sapiens
gaaggucuacaacccaguu

SEQ ID NO: 1362784 - RNA, 19 nt, Homo sapiens
gaccaugacaucuaucuag

SEQ ID NO: 1362785 - RNA, 19 nt, Homo sapiens
uaaggggucuuuacaaaau

SEQ ID NO: 1362786 - RNA, 19 nt, Homo sapiens
gagcagacgcggagaaagg

SEQ ID NO: 1362787 - RNA, 19 nt, Homo sapiens
gguccaguauuuauuugau

SEQ ID NO: 1362788 - RNA, 19 nt, Homo sapiens
cacugaagaagaagaaaua

SEQ ID NO: 1362789 - RNA, 19 nt, Homo sapiens
ugaccaagcccaucgugaa

SEQ ID NO: 1362790 - RNA, 19 nt, Homo sapiens
gaaauaccaagugagucua

SEQ ID NO: 1362791 - RNA, 19 nt, Homo sapiens
gaccaauggauuaauauag

SEQ ID NO: 1362792 - RNA, 19 nt, Homo sapiens
gcgcaaugacuuucaggaa

SEQ ID NO: 1362793 - RNA, 19 nt, Homo sapiens
cagaauggaggcaaaugaa

SEQ ID NO: 1362794 - RNA, 19 nt, Homo sapiens
aagaagaucaggacuacuu

SEQ ID NO: 1362795 - RNA, 19 nt, Homo sapiens
ccucucugcucguguuuau

SEQ ID NO: 1362796 - RNA, 19 nt, Homo sapiens
aaugguaauucgagacuau

SEQ ID NO: 1362797 - RNA, 19 nt, Homo sapiens
guguagcgccucagugaaa

SEQ ID NO: 1362798 - RNA, 19 nt, Homo sapiens
gcguguagcgccucaguga

SEQ ID NO: 1362799 - RNA, 19 nt, Homo sapiens
aagccugcgucuucaauga

SEQ ID NO: 1362800 - RNA, 19 nt, Homo sapiens
gaagcgcaaugacuuucag

SEQ ID NO: 1362801 - RNA, 19 nt, Homo sapiens
ggaaugcuacaauguuaag

SEQ ID NO: 1362802 - RNA, 19 nt, Homo sapiens
ugcuacagcuggaauaugu

SEQ ID NO: 1362803 - RNA, 19 nt, Homo sapiens
guucaaguucucuuucuga

SEQ ID NO: 1362804 - RNA, 19 nt, Homo sapiens
ucuugcaguuugauucuaa

SEQ ID NO: 1362805 - RNA, 19 nt, Homo sapiens
ccaauggauuaauauaggu

SEQ ID NO: 1362806 - RNA, 19 nt, Homo sapiens
cuacagaauuaucaagcau

SEQ ID NO: 1362807 - RNA, 19 nt, Homo sapiens
aauggaggcaaaugaauaa

SEQ ID NO: 1362808 - RNA, 19 nt, Homo sapiens
gcauaucucaauggcuaua

SEQ ID NO: 1362809 - RNA, 19 nt, Homo sapiens
gaucccaggcccaguccua

SEQ ID NO: 1362810 - RNA, 19 nt, Homo sapiens
gcacaggccugacggauga

SEQ ID NO: 1362811 - RNA, 19 nt, Homo sapiens
gcaccaagcucaagaagca

SEQ ID NO: 1362812 - RNA, 19 nt, Homo sapiens
gauggugucuugucuguau

SEQ ID NO: 1362813 - RNA, 19 nt, Homo sapiens
ugaaagcccugucuacugu

SEQ ID NO: 1362814 - RNA, 19 nt, Homo sapiens
ggagcacgcuuaaguccuu

SEQ ID NO: 1362815 - RNA, 19 nt, Homo sapiens
uccgagagcugaacaagaa

SEQ ID NO: 1362816 - RNA, 19 nt, Homo sapiens
guacaguggugagguguug

SEQ ID NO: 1362817 - RNA, 19 nt, Homo sapiens
gcuguuugaucuccagaaa

SEQ ID NO: 1362818 - RNA, 19 nt, Homo sapiens
ggucccaucuacucuguga

SEQ ID NO: 1362819 - RNA, 19 nt, Homo sapiens
gcagcucucccucaaguau

SEQ ID NO: 1362820 - RNA, 19 nt, Homo sapiens
ggaccgagcagcagcagau

SEQ ID NO: 1362821 - RNA, 19 nt, Homo sapiens
ucaagcaaacccaggauga

SEQ ID NO: 1362822 - RNA, 19 nt, Homo sapiens
gacccuaggcuguucauuc

SEQ ID NO: 1362823 - RNA, 19 nt, Homo sapiens
cagaaaagcucccagaaac

SEQ ID NO: 1362824 - RNA, 19 nt, Homo sapiens
ccagcagacucagcucuug

SEQ ID NO: 1362825 - RNA, 19 nt, Homo sapiens
gagagcugaacaagaauug

SEQ ID NO: 1362826 - RNA, 19 nt, Homo sapiens
gacgcaagccaaaugaaga

SEQ ID NO: 1362827 - RNA, 19 nt, Homo sapiens
caagcaaacccaggaugaa

SEQ ID NO: 1362828 - RNA, 19 nt, Homo sapiens
cagcacaguuuaccuucuc

SEQ ID NO: 1362829 - RNA, 19 nt, Homo sapiens
gaugaaagcccugucuacu

SEQ ID NO: 1362830 - RNA, 19 nt, Homo sapiens
gcuuaaguccuucgugugu

SEQ ID NO: 1362831 - RNA, 19 nt, Homo sapiens
ggaugaaagcccugucuac

SEQ ID NO: 1362832 - RNA, 19 nt, Homo sapiens
gcagcugccucugggaaag

SEQ ID NO: 1362833 - RNA, 19 nt, Homo sapiens
cugcagcucucccucaagu

SEQ ID NO: 1362834 - RNA, 19 nt, Homo sapiens
aagcaaacccaggaugaaa

SEQ ID NO: 1362835 - RNA, 19 nt, Homo sapiens
gcuucccgcucaaguguuc

SEQ ID NO: 1362836 - RNA, 19 nt, Homo sapiens
ucuacugucuggaguucaa

SEQ ID NO: 1362837 - RNA, 19 nt, Homo sapiens
gacuggagcacgcuuaagu

SEQ ID NO: 1362838 - RNA, 19 nt, Homo sapiens
agcagcagauggugucuug

SEQ ID NO: 1362839 - RNA, 19 nt, Homo sapiens
cgagagcugaacaagaauu

SEQ ID NO: 1362840 - RNA, 19 nt, Homo sapiens
gcggucccaucuacucugu

SEQ ID NO: 1362841 - RNA, 19 nt, Homo sapiens
gggacuggagcacgcuuaa

SEQ ID NO: 1362842 - RNA, 19 nt, Homo sapiens
gcccaggccaggaaucaug

SEQ ID NO: 1362843 - RNA, 19 nt, Homo sapiens
aaggugacgugcagcuguu

SEQ ID NO: 1362844 - RNA, 19 nt, Homo sapiens
gcuuccaggugcugagugu

SEQ ID NO: 1362845 - RNA, 19 nt, Homo sapiens
ccagaaaagcucccagaaa

SEQ ID NO: 1362846 - RNA, 19 nt, Homo sapiens
ggcagagccacgcguuuga

SEQ ID NO: 1362847 - RNA, 19 nt, Homo sapiens
cggaugacacccacacaga

SEQ ID NO: 1362848 - RNA, 19 nt, Homo sapiens
cagcugagcacagaguuca

SEQ ID NO: 1362849 - RNA, 19 nt, Homo sapiens
gcaaacccaggaugaaagc

SEQ ID NO: 1362850 - RNA, 19 nt, Homo sapiens
acccuaggcuguucauucu

SEQ ID NO: 1362851 - RNA, 19 nt, Homo sapiens
cgacauacccaggcuugca

SEQ ID NO: 1362852 - RNA, 19 nt, Homo sapiens
gaucaagcaaacccaggau

SEQ ID NO: 1362853 - RNA, 19 nt, Homo sapiens
gcagagccacgcguuugau

SEQ ID NO: 1362854 - RNA, 19 nt, Homo sapiens
ugacgcaagccaaaugaag

SEQ ID NO: 1362855 - RNA, 19 nt, Homo sapiens
cagcagauggugucuuguc

SEQ ID NO: 1362856 - RNA, 19 nt, Homo sapiens
gaaaggacaucuuaaaucu

SEQ ID NO: 1362857 - RNA, 19 nt, Homo sapiens
gaaauauagugccauuguu

SEQ ID NO: 1362858 - RNA, 19 nt, Homo sapiens
gcacaaauuccaccaacua

SEQ ID NO: 1362859 - RNA, 19 nt, Homo sapiens
gauuauacuugucgaguuu

SEQ ID NO: 1362860 - RNA, 19 nt, Homo sapiens
gagcuucaguagcgaauaa

SEQ ID NO: 1362861 - RNA, 19 nt, Homo sapiens
gaguaucucuccaguuauu

SEQ ID NO: 1362862 - RNA, 19 nt, Homo sapiens
gcaauacaguggauacaau

SEQ ID NO: 1362863 - RNA, 19 nt, Homo sapiens
gaagacacuuuccaucuca

SEQ ID NO: 1362864 - RNA, 19 nt, Homo sapiens
gaugacaccuguauucugu

SEQ ID NO: 1362865 - RNA, 19 nt, Homo sapiens
gcccagacauuguauaaga

SEQ ID NO: 1362866 - RNA, 19 nt, Homo sapiens
ggugauagauuauacuugu

SEQ ID NO: 1362867 - RNA, 19 nt, Homo sapiens
gcuaauggauuggaaagaa

SEQ ID NO: 1362868 - RNA, 19 nt, Homo sapiens
gaaagaauguugggaaagg

SEQ ID NO: 1362869 - RNA, 19 nt, Homo sapiens
gaagucaacuggcuuucug

SEQ ID NO: 1362870 - RNA, 19 nt, Homo sapiens
ggaaaggacaucuuaaauc

SEQ ID NO: 1362871 - RNA, 19 nt, Homo sapiens
gggcuuaaauucacuggaa

SEQ ID NO: 1362872 - RNA, 19 nt, Homo sapiens
acacagagcugaggaugaa

SEQ ID NO: 1362873 - RNA, 19 nt, Homo sapiens
gcacccaguugauauucua

SEQ ID NO: 1362874 - RNA, 19 nt, Homo sapiens
cguguuaccuugauggaua

SEQ ID NO: 1362875 - RNA, 19 nt, Homo sapiens
ggaaauauagugccauugu

SEQ ID NO: 1362876 - RNA, 19 nt, Homo sapiens
gaacucaaaggaaauauag

SEQ ID NO: 1362877 - RNA, 19 nt, Homo sapiens
gcaccuggccuccuuaaau

SEQ ID NO: 1362878 - RNA, 19 nt, Homo sapiens
cugcagaacucaaaggaaa

SEQ ID NO: 1362879 - RNA, 19 nt, Homo sapiens
gccaguacuucuaccauuu

SEQ ID NO: 1362880 - RNA, 19 nt, Homo sapiens
gggcccagcugucauucua

SEQ ID NO: 1362881 - RNA, 19 nt, Homo sapiens
gcagaacucaaaggaaaua

SEQ ID NO: 1362882 - RNA, 19 nt, Homo sapiens
gggaaauacuagugaaugu

SEQ ID NO: 1362883 - RNA, 19 nt, Homo sapiens
ccugauaccucugcuauug

SEQ ID NO: 1362884 - RNA, 19 nt, Homo sapiens
gacaaggccuaccaucguu

SEQ ID NO: 1362885 - RNA, 19 nt, Homo sapiens
gagcccagacauuguauaa

SEQ ID NO: 1362886 - RNA, 19 nt, Homo sapiens
ccagagauaagaccacuuu

SEQ ID NO: 1362887 - RNA, 19 nt, Homo sapiens
ggauauuggauuugucuaa

SEQ ID NO: 1362888 - RNA, 19 nt, Homo sapiens
auaaggacaucaucugcua

SEQ ID NO: 1362889 - RNA, 19 nt, Homo sapiens
caccuggccuccuuaaaug

SEQ ID NO: 1362890 - RNA, 19 nt, Homo sapiens
gggaaaggacaucuuaaau

SEQ ID NO: 1362891 - RNA, 19 nt, Homo sapiens
ccaaagugcugggauuaca

SEQ ID NO: 1362892 - RNA, 19 nt, Homo sapiens
gauauuggauuugucuaag

SEQ ID NO: 1362893 - RNA, 19 nt, Homo sapiens
cuugauggauauuggauuu

SEQ ID NO: 1362894 - RNA, 19 nt, Homo sapiens
ugccugaccucaagugauu

SEQ ID NO: 1362895 - RNA, 19 nt, Homo sapiens
gcccuaaacugcagaacuc

SEQ ID NO: 1362896 - RNA, 19 nt, Homo sapiens
caaauuccaccaacuaaag

SEQ ID NO: 1362897 - RNA, 19 nt, Homo sapiens
caucuccacuggugauaga

SEQ ID NO: 1362898 - RNA, 19 nt, Homo sapiens
uggaaagaauguugggaaa

SEQ ID NO: 1362899 - RNA, 19 nt, Homo sapiens
ggaaauacuagugaauguu

SEQ ID NO: 1362900 - RNA, 19 nt, Homo sapiens
gaagguccaagauuaagau

SEQ ID NO: 1362901 - RNA, 19 nt, Homo sapiens
caucaucugcuauaaccua

SEQ ID NO: 1362902 - RNA, 19 nt, Homo sapiens
guugggaaaggacaucuua

SEQ ID NO: 1362903 - RNA, 19 nt, Homo sapiens
auaagaaguuugugaaguc

SEQ ID NO: 1362904 - RNA, 19 nt, Homo sapiens
gagcugaggaugaaacaca

SEQ ID NO: 1362905 - RNA, 19 nt, Homo sapiens
gcagauacccagacaccau

SEQ ID NO: 1362906 - RNA, 19 nt, Homo sapiens
guacucagccuccuuacca

SEQ ID NO: 1362907 - RNA, 19 nt, Homo sapiens
acaagcaguuggacaguuc

SEQ ID NO: 1362908 - RNA, 19 nt, Homo sapiens
cuaagucucuucuagaaaa

SEQ ID NO: 1362909 - RNA, 19 nt, Homo sapiens
aaggaaauauagugccauu

SEQ ID NO: 1362910 - RNA, 19 nt, Homo sapiens
ggcaacaucucagggucua

SEQ ID NO: 1362911 - RNA, 19 nt, Homo sapiens
caauacaguggauacaauu

SEQ ID NO: 1362912 - RNA, 19 nt, Homo sapiens
uaagaaguuugugaaguca

SEQ ID NO: 1362913 - RNA, 19 nt, Homo sapiens
ggaagguccaagauuaaga

SEQ ID NO: 1362914 - RNA, 19 nt, Homo sapiens
caucugcuauaaccuacaa

SEQ ID NO: 1362915 - RNA, 19 nt, Homo sapiens
gauagacucguguuaccuu

SEQ ID NO: 1362916 - RNA, 19 nt, Homo sapiens
cuaauggauuggaaagaau

SEQ ID NO: 1362917 - RNA, 19 nt, Homo sapiens
gccaacacaucugucugua

SEQ ID NO: 1362918 - RNA, 19 nt, Homo sapiens
gcacaucuccacuggugau

SEQ ID NO: 1362919 - RNA, 19 nt, Homo sapiens
guaucuuuauggccuaauu

SEQ ID NO: 1362920 - RNA, 19 nt, Homo sapiens
uguuauagguucaaguuca

SEQ ID NO: 1362921 - RNA, 19 nt, Homo sapiens
cuagaugaauugggaguau

SEQ ID NO: 1362922 - RNA, 19 nt, Homo sapiens
ggaguuauucuacgcuaau

SEQ ID NO: 1362923 - RNA, 19 nt, Homo sapiens
gcccagcugucauucuaau

SEQ ID NO: 1362924 - RNA, 19 nt, Homo sapiens
gaacagugggcagugauuc

SEQ ID NO: 1362925 - RNA, 19 nt, Homo sapiens
ggccuaccaucguuucuuc

SEQ ID NO: 1362926 - RNA, 19 nt, Homo sapiens
gagauagacucguguuacc

SEQ ID NO: 1362927 - RNA, 19 nt, Homo sapiens
ggacaccaagcuucacaug

SEQ ID NO: 1362928 - RNA, 19 nt, Homo sapiens
cuccacuggugauagauua

SEQ ID NO: 1362929 - RNA, 19 nt, Homo sapiens
gacaucaucugcuauaacc

SEQ ID NO: 1362930 - RNA, 19 nt, Homo sapiens
uuauuaugcucacagaaga

SEQ ID NO: 1362931 - RNA, 19 nt, Homo sapiens
uacccagacaccauuauua

SEQ ID NO: 1362932 - RNA, 19 nt, Homo sapiens
ggacgcagcacaaauucca

SEQ ID NO: 1362933 - RNA, 19 nt, Homo sapiens
agucagagccacaagugua

SEQ ID NO: 1362934 - RNA, 19 nt, Homo sapiens
auucuacgcuaauggauug

SEQ ID NO: 1362935 - RNA, 19 nt, Homo sapiens
cuaaacugcagaacucaaa

SEQ ID NO: 1362936 - RNA, 19 nt, Homo sapiens
ccacuggugauagauuaua

SEQ ID NO: 1362937 - RNA, 19 nt, Homo sapiens
ggacaucaucugcuauaac

SEQ ID NO: 1362938 - RNA, 19 nt, Homo sapiens
cgaauaaggacaucaucug

SEQ ID NO: 1362939 - RNA, 19 nt, Homo sapiens
gaccugcuccugggacuuu

SEQ ID NO: 1362940 - RNA, 19 nt, Homo sapiens
guuauucccagauucacua

SEQ ID NO: 1362941 - RNA, 19 nt, Homo sapiens
acuagugaauguuuccaaa

SEQ ID NO: 1362942 - RNA, 19 nt, Homo sapiens
ugauaccucugcuauugau

SEQ ID NO: 1362943 - RNA, 19 nt, Homo sapiens
uauagugccauuguuagua

SEQ ID NO: 1362944 - RNA, 19 nt, Homo sapiens
ugggaaaggacaucuuaaa

SEQ ID NO: 1362945 - RNA, 19 nt, Homo sapiens
cacaaauuccaccaacuaa

SEQ ID NO: 1362946 - RNA, 19 nt, Homo sapiens
cagagauagacucguguua

SEQ ID NO: 1362947 - RNA, 19 nt, Homo sapiens
cuagugauccuuaaagucu

SEQ ID NO: 1362948 - RNA, 19 nt, Homo sapiens
ccauuauuaugcucacaga

SEQ ID NO: 1362949 - RNA, 19 nt, Homo sapiens
agauuauacuugucgaguu

SEQ ID NO: 1362950 - RNA, 19 nt, Homo sapiens
cugaaugccugaccucaag

SEQ ID NO: 1362951 - RNA, 19 nt, Homo sapiens
ggauuugucuaagucucuu

SEQ ID NO: 1362952 - RNA, 19 nt, Homo sapiens
ugauggauauuggauuugu

SEQ ID NO: 1362953 - RNA, 19 nt, Homo sapiens
aaagaauguugggaaagga

SEQ ID NO: 1362954 - RNA, 19 nt, Homo sapiens
ggaaagaauguugggaaag

SEQ ID NO: 1362955 - RNA, 19 nt, Homo sapiens
ccagacaccauuauuaugc

SEQ ID NO: 1362956 - RNA, 19 nt, Homo sapiens
ccaaacagcugcccucauu

SEQ ID NO: 1362957 - RNA, 19 nt, Homo sapiens
ggagagagauugaugacuu

SEQ ID NO: 1362958 - RNA, 19 nt, Homo sapiens
gaucugggauggaauugua

SEQ ID NO: 1362959 - RNA, 19 nt, Homo sapiens
gaacagauuucauucaaac

SEQ ID NO: 1362960 - RNA, 19 nt, Homo sapiens
gggagagagugauuuauaa

SEQ ID NO: 1362961 - RNA, 19 nt, Homo sapiens
caacagaucaagaacauuu

SEQ ID NO: 1362962 - RNA, 19 nt, Homo sapiens
guagcuaacuuauggauug

SEQ ID NO: 1362963 - RNA, 19 nt, Homo sapiens
ccacaguccuucagaguuu

SEQ ID NO: 1362964 - RNA, 19 nt, Homo sapiens
ccaaacagcugcaguucuu

SEQ ID NO: 1362965 - RNA, 19 nt, Homo sapiens
uggaagagcuggucacuau

SEQ ID NO: 1362966 - RNA, 19 nt, Homo sapiens
gggagucugucuuuccuua

SEQ ID NO: 1362967 - RNA, 19 nt, Homo sapiens
gagagagauugaugacuuu

SEQ ID NO: 1362968 - RNA, 19 nt, Homo sapiens
gguuaaagcucuucuugga

SEQ ID NO: 1362969 - RNA, 19 nt, Homo sapiens
cgaaguaugugucucagaa

SEQ ID NO: 1362970 - RNA, 19 nt, Homo sapiens
caagaucgaugccgugaug

SEQ ID NO: 1362971 - RNA, 19 nt, Homo sapiens
caaagaggauaaugagaga

SEQ ID NO: 1362972 - RNA, 19 nt, Homo sapiens
ggaacaaacacuaaccuaa

SEQ ID NO: 1362973 - RNA, 19 nt, Homo sapiens
caacacggguccauucuuc

SEQ ID NO: 1362974 - RNA, 19 nt, Homo sapiens
gcacagggcugcagaaaau

SEQ ID NO: 1362975 - RNA, 19 nt, Homo sapiens
gaacaaacacuaaccuaag

SEQ ID NO: 1362976 - RNA, 19 nt, Homo sapiens
uggaaugccugaacaauga

SEQ ID NO: 1362977 - RNA, 19 nt, Homo sapiens
ccucugcccucauucuuua

SEQ ID NO: 1362978 - RNA, 19 nt, Homo sapiens
gagcaugguucaucgauag

SEQ ID NO: 1362979 - RNA, 19 nt, Homo sapiens
cgaaugcacacucaaauaa

SEQ ID NO: 1362980 - RNA, 19 nt, Homo sapiens
aagaaaggcuugugcagaa

SEQ ID NO: 1362981 - RNA, 19 nt, Homo sapiens
gaaaauaaaccuccagauu

SEQ ID NO: 1362982 - RNA, 19 nt, Homo sapiens
uaaagaagcacacagucua

SEQ ID NO: 1362983 - RNA, 19 nt, Homo sapiens
caacaucuguguccucuac

SEQ ID NO: 1362984 - RNA, 19 nt, Homo sapiens
ggaaacauggcaaggaauu

SEQ ID NO: 1362985 - RNA, 19 nt, Homo sapiens
caacaugccaggugacauu

SEQ ID NO: 1362986 - RNA, 19 nt, Homo sapiens
gagcuauguuucugaaguu

SEQ ID NO: 1362987 - RNA, 19 nt, Homo sapiens
ugacaacucucacacagau

SEQ ID NO: 1362988 - RNA, 19 nt, Homo sapiens
ugagugagcuguguaugaa

SEQ ID NO: 1362989 - RNA, 19 nt, Homo sapiens
gaccauuccuguuacaaau

SEQ ID NO: 1362990 - RNA, 19 nt, Homo sapiens
ggucauccgugugaaguuu

SEQ ID NO: 1362991 - RNA, 19 nt, Homo sapiens
gcagaaguccagaagguuu

SEQ ID NO: 1362992 - RNA, 19 nt, Homo sapiens
ugacaugcuucguaaauuc

SEQ ID NO: 1362993 - RNA, 19 nt, Homo sapiens
gcaccaauaucaacuucau

SEQ ID NO: 1362994 - RNA, 19 nt, Homo sapiens
aaacauggcaaggaauuua

SEQ ID NO: 1362995 - RNA, 19 nt, Homo sapiens
ccaggaaacuugggucuug

SEQ ID NO: 1362996 - RNA, 19 nt, Homo sapiens
cagauggguucgugaguuu

SEQ ID NO: 1362997 - RNA, 19 nt, Homo sapiens
ggagucgacugcagagaga

SEQ ID NO: 1362998 - RNA, 19 nt, Homo sapiens
uuauuugucucacugguua

SEQ ID NO: 1362999 - RNA, 19 nt, Homo sapiens
gaagaacagauuucauuca

SEQ ID NO: 1363000 - RNA, 19 nt, Homo sapiens
ccaagagucuagagugguu

SEQ ID NO: 1363001 - RNA, 19 nt, Homo sapiens
gaaugcacacucaaauaaa

SEQ ID NO: 1363002 - RNA, 19 nt, Homo sapiens
gggauggaauuguagagaa

SEQ ID NO: 1363003 - RNA, 19 nt, Homo sapiens
gaaggaugccauacgcuuu

SEQ ID NO: 1363004 - RNA, 19 nt, Homo sapiens
gcacaguucucagacaauc

SEQ ID NO: 1363005 - RNA, 19 nt, Homo sapiens
ccucuuuccugaauucuuu

SEQ ID NO: 1363006 - RNA, 19 nt, Homo sapiens
uuaaagcucuucuuggaau

SEQ ID NO: 1363007 - RNA, 19 nt, Homo sapiens
gaaucaaagaggauaauga

SEQ ID NO: 1363008 - RNA, 19 nt, Homo sapiens
uggcagaacucggguguuu

SEQ ID NO: 1363009 - RNA, 19 nt, Homo sapiens
gaaauauugcacuaucuga

SEQ ID NO: 1363010 - RNA, 19 nt, Homo sapiens
gaaaucucuuacucaggua

SEQ ID NO: 1363011 - RNA, 19 nt, Homo sapiens
aaacugcuguuccuauuca

SEQ ID NO: 1363012 - RNA, 19 nt, Homo sapiens
gaagaccauuccuguuaca

SEQ ID NO: 1363013 - RNA, 19 nt, Homo sapiens
ggacuaaugcugggugauu

SEQ ID NO: 1363014 - RNA, 19 nt, Homo sapiens
aagcagggauugaucaaga

SEQ ID NO: 1363015 - RNA, 19 nt, Homo sapiens
gugugaaguuugucaauga

SEQ ID NO: 1363016 - RNA, 19 nt, Homo sapiens
ccucugcucuccucaaaga

SEQ ID NO: 1363017 - RNA, 19 nt, Homo sapiens
agaauuaccugcagcucuu

SEQ ID NO: 1363018 - RNA, 19 nt, Homo sapiens
gagaucaucaagagaguuu

SEQ ID NO: 1363019 - RNA, 19 nt, Homo sapiens
uaacugguguucacugaca

SEQ ID NO: 1363020 - RNA, 19 nt, Homo sapiens
ggacgguaggccuuuauaa

SEQ ID NO: 1363021 - RNA, 19 nt, Homo sapiens
gacgguaggccuuuauaaa

SEQ ID NO: 1363022 - RNA, 19 nt, Homo sapiens
ugugcaagaucacuaauga

SEQ ID NO: 1363023 - RNA, 19 nt, Homo sapiens
ggaggacggcugccuuuga

SEQ ID NO: 1363024 - RNA, 19 nt, Homo sapiens
ggauuccguuccauuauca

SEQ ID NO: 1363025 - RNA, 19 nt, Homo sapiens
gacuaaugcugggugauuu

SEQ ID NO: 1363026 - RNA, 19 nt, Homo sapiens
uggaagagaucaucaagag

SEQ ID NO: 1363027 - RNA, 19 nt, Homo sapiens
gauaaugagagauuugaga

SEQ ID NO: 1363028 - RNA, 19 nt, Homo sapiens
caagguugaugccggauuc

SEQ ID NO: 1363029 - RNA, 19 nt, Homo sapiens
cagcauggguugaguguac

SEQ ID NO: 1363030 - RNA, 19 nt, Homo sapiens
gaacacgggcuuugaacuc

SEQ ID NO: 1363031 - RNA, 19 nt, Homo sapiens
cauccuacauccaugagaa

SEQ ID NO: 1363032 - RNA, 19 nt, Homo sapiens
ucacgaugcuugucaccuu

SEQ ID NO: 1363033 - RNA, 19 nt, Homo sapiens
ggcaaggaauuuaaagaca

SEQ ID NO: 1363034 - RNA, 19 nt, Homo sapiens
gaugagagagcuauguuuc

SEQ ID NO: 1363035 - RNA, 19 nt, Homo sapiens
uaccagaccucgcugacaa

SEQ ID NO: 1363036 - RNA, 19 nt, Homo sapiens
ccagaagguuugcaacauc

SEQ ID NO: 1363037 - RNA, 19 nt, Homo sapiens
ucaagaacauuuuguggua

SEQ ID NO: 1363038 - RNA, 19 nt, Homo sapiens
ggauucaacagaucaagaa

SEQ ID NO: 1363039 - RNA, 19 nt, Homo sapiens
ugagagauuugagaaguug

SEQ ID NO: 1363040 - RNA, 19 nt, Homo sapiens
gcgggcagcuguugugauc

SEQ ID NO: 1363041 - RNA, 19 nt, Homo sapiens
gaaacauggcaaggaauuu

SEQ ID NO: 1363042 - RNA, 19 nt, Homo sapiens
cuacuuugauggaaacaug

SEQ ID NO: 1363043 - RNA, 19 nt, Homo sapiens
gaacaaugacacugaagag

SEQ ID NO: 1363044 - RNA, 19 nt, Homo sapiens
gaccagcgaugaaccacau

SEQ ID NO: 1363045 - RNA, 19 nt, Homo sapiens
caccacagcgucuucuaua

SEQ ID NO: 1363046 - RNA, 19 nt, Homo sapiens
gcacucaaucuguucaaga

SEQ ID NO: 1363047 - RNA, 19 nt, Homo sapiens
cacaauccuugaugacauu

SEQ ID NO: 1363048 - RNA, 19 nt, Homo sapiens
gcuaacuuauggauugaga

SEQ ID NO: 1363049 - RNA, 19 nt, Homo sapiens
ggacugggagagagugauu

SEQ ID NO: 1363050 - RNA, 19 nt, Homo sapiens
ucucaucucuggcgacaau

SEQ ID NO: 1363051 - RNA, 19 nt, Homo sapiens
gaagagcuggucacuaucu

SEQ ID NO: 1363052 - RNA, 19 nt, Homo sapiens
gcaaauauaaugggacauc

SEQ ID NO: 1363053 - RNA, 19 nt, Homo sapiens
ggaaauauugcacuaucug

SEQ ID NO: 1363054 - RNA, 19 nt, Homo sapiens
ugggagagagugauuuaua

SEQ ID NO: 1363055 - RNA, 19 nt, Homo sapiens
cgacagcacuacacagcau

SEQ ID NO: 1363056 - RNA, 19 nt, Homo sapiens
gaucagcgauggaauuaaa

SEQ ID NO: 1363057 - RNA, 19 nt, Homo sapiens
gaaaucagcuggacaucau

SEQ ID NO: 1363058 - RNA, 19 nt, Homo sapiens
gaaguaauccauguacaua

SEQ ID NO: 1363059 - RNA, 19 nt, Homo sapiens
ggaaagguccucccucaaa

SEQ ID NO: 1363060 - RNA, 19 nt, Homo sapiens
gcaaggacaucauggacuu

SEQ ID NO: 1363061 - RNA, 19 nt, Homo sapiens
ccacuucucucuagcugua

SEQ ID NO: 1363062 - RNA, 19 nt, Homo sapiens
gcaagaagaagacaaggaa

SEQ ID NO: 1363063 - RNA, 19 nt, Homo sapiens
uuaacuagcugccaaacaa

SEQ ID NO: 1363064 - RNA, 19 nt, Homo sapiens
gagucugucucacuguuua

SEQ ID NO: 1363065 - RNA, 19 nt, Homo sapiens
gcagagagaggaugagcua

SEQ ID NO: 1363066 - RNA, 19 nt, Homo sapiens
caacgggaauggaguaaag

SEQ ID NO: 1363067 - RNA, 19 nt, Homo sapiens
guuaaaaccucuagacaaa

SEQ ID NO: 1363068 - RNA, 19 nt, Homo sapiens
aaaccaaacugcagaagca

SEQ ID NO: 1363069 - RNA, 19 nt, Homo sapiens
gaaagguccucccucaaaa

SEQ ID NO: 1363070 - RNA, 19 nt, Homo sapiens
gagagaggaugagcuaauc

SEQ ID NO: 1363071 - RNA, 19 nt, Homo sapiens
ugaccagccuaaguaguua

SEQ ID NO: 1363072 - RNA, 19 nt, Homo sapiens
ccauguacauaguaaauca

SEQ ID NO: 1363073 - RNA, 19 nt, Homo sapiens
gaaaccacguucacagcau

SEQ ID NO: 1363074 - RNA, 19 nt, Homo sapiens
cagauugugucccgucauu

SEQ ID NO: 1363075 - RNA, 19 nt, Homo sapiens
guaaagaucgagcuugugu

SEQ ID NO: 1363076 - RNA, 19 nt, Homo sapiens
gggaucagcgauggaauua

SEQ ID NO: 1363077 - RNA, 19 nt, Homo sapiens
ccagagcaguugagaaugg

SEQ ID NO: 1363078 - RNA, 19 nt, Homo sapiens
gcgauggaauuaaagcaau

SEQ ID NO: 1363079 - RNA, 19 nt, Homo sapiens
ggaaguaauccauguacau

SEQ ID NO: 1363080 - RNA, 19 nt, Homo sapiens
ggagaaaucagcuggacau

SEQ ID NO: 1363081 - RNA, 19 nt, Homo sapiens
ggccagagcaguugagaau

SEQ ID NO: 1363082 - RNA, 19 nt, Homo sapiens
gguggcauauguuaacuag

SEQ ID NO: 1363083 - RNA, 19 nt, Homo sapiens
uaacccaccgugugaauga

SEQ ID NO: 1363084 - RNA, 19 nt, Homo sapiens
uaagggagcaagaagaaga

SEQ ID NO: 1363085 - RNA, 19 nt, Homo sapiens
aaaccacguucacagcauu

SEQ ID NO: 1363086 - RNA, 19 nt, Homo sapiens
gucauuggguggcauaugu

SEQ ID NO: 1363087 - RNA, 19 nt, Homo sapiens
cggaagcucugaugucaag

SEQ ID NO: 1363088 - RNA, 19 nt, Homo sapiens
aagcauaucuccacuucuc

SEQ ID NO: 1363089 - RNA, 19 nt, Homo sapiens
gcagucacccaucagagaa

SEQ ID NO: 1363090 - RNA, 19 nt, Homo sapiens
ggaggagacggcuuggaaa

SEQ ID NO: 1363091 - RNA, 19 nt, Homo sapiens
ucucagagcuaggcacaug

SEQ ID NO: 1363092 - RNA, 19 nt, Homo sapiens
gcacugaucaaggauuguu

SEQ ID NO: 1363093 - RNA, 19 nt, Homo sapiens
guuaagggagcaagaagaa

SEQ ID NO: 1363094 - RNA, 19 nt, Homo sapiens
ccagcaggaugccacuuug

SEQ ID NO: 1363095 - RNA, 19 nt, Homo sapiens
guaauccauguacauagua

SEQ ID NO: 1363096 - RNA, 19 nt, Homo sapiens
uaucuccacuucucucuag

SEQ ID NO: 1363097 - RNA, 19 nt, Homo sapiens
gugaccagccuaaguaguu

SEQ ID NO: 1363098 - RNA, 19 nt, Homo sapiens
uaucuaacccaccguguga

SEQ ID NO: 1363099 - RNA, 19 nt, Homo sapiens
gaagaagacaaggaaaugg

SEQ ID NO: 1363100 - RNA, 19 nt, Homo sapiens
ccuccuagcucugcucuca

SEQ ID NO: 1363101 - RNA, 19 nt, Homo sapiens
uagacaaaguaaccaaauc

SEQ ID NO: 1363102 - RNA, 19 nt, Homo sapiens
gaugagcuaauccagaaga

SEQ ID NO: 1363103 - RNA, 19 nt, Homo sapiens
uggcauauguuaacuagcu

SEQ ID NO: 1363104 - RNA, 19 nt, Homo sapiens
gacacacggaccuuuguaa

SEQ ID NO: 1363105 - RNA, 19 nt, Homo sapiens
gaaccggaagcucugaugu

SEQ ID NO: 1363106 - RNA, 19 nt, Homo sapiens
caggagaggcagcguguga

SEQ ID NO: 1363107 - RNA, 19 nt, Homo sapiens
ggccuggacuggcauggau

SEQ ID NO: 1363108 - RNA, 19 nt, Homo sapiens
ggagucugucucacuguuu

SEQ ID NO: 1363109 - RNA, 19 nt, Homo sapiens
caacccguguaauucaugu

SEQ ID NO: 1363110 - RNA, 19 nt, Homo sapiens
acacacggaccuuuguaaa

SEQ ID NO: 1363111 - RNA, 19 nt, Homo sapiens
cgacacacggaccuuugua

SEQ ID NO: 1363112 - RNA, 19 nt, Homo sapiens
ccacccucuugucuuuaua

SEQ ID NO: 1363113 - RNA, 19 nt, Homo sapiens
caagaagaagacaaggaaa

SEQ ID NO: 1363114 - RNA, 19 nt, Homo sapiens
ggagcaagaagaagacaag

SEQ ID NO: 1363115 - RNA, 19 nt, Homo sapiens
ggcagcgugugaccagauu

SEQ ID NO: 1363116 - RNA, 19 nt, Homo sapiens
aaagaucgagcuugugugu

SEQ ID NO: 1363117 - RNA, 19 nt, Homo sapiens
gagggcccaucuguaaaga

SEQ ID NO: 1363118 - RNA, 19 nt, Homo sapiens
uggcacugaucaaggauug

SEQ ID NO: 1363119 - RNA, 19 nt, Homo sapiens
uccacaaacuggugcagaa

SEQ ID NO: 1363120 - RNA, 19 nt, Homo sapiens
ggacaucauggacuugaag

SEQ ID NO: 1363121 - RNA, 19 nt, Homo sapiens
uaacucaagaugcugaugu

SEQ ID NO: 1363122 - RNA, 19 nt, Homo sapiens
ccugggcacuccaccauuc

SEQ ID NO: 1363123 - RNA, 19 nt, Homo sapiens
aguaauccauguacauagu

SEQ ID NO: 1363124 - RNA, 19 nt, Homo sapiens
gucgugaccagccuaagua

SEQ ID NO: 1363125 - RNA, 19 nt, Homo sapiens
gccagcaggaugccacuuu

SEQ ID NO: 1363126 - RNA, 19 nt, Homo sapiens
ggcuggcacugaucaagga

SEQ ID NO: 1363127 - RNA, 19 nt, Homo sapiens
uaaaaccucuagacaaagu

SEQ ID NO: 1363128 - RNA, 19 nt, Homo sapiens
uggcugauuuccugagaau

SEQ ID NO: 1363129 - RNA, 19 nt, Homo sapiens
agaagaagacaaggaaaug

SEQ ID NO: 1363130 - RNA, 19 nt, Homo sapiens
uccagaagauccacaaacu

SEQ ID NO: 1363131 - RNA, 19 nt, Homo sapiens
cuguaaagaucgagcuugu

SEQ ID NO: 1363132 - RNA, 19 nt, Homo sapiens
gggcaccacccauauagca

SEQ ID NO: 1363133 - RNA, 19 nt, Homo sapiens
gcaacgggaauggaguaaa

SEQ ID NO: 1363134 - RNA, 19 nt, Homo sapiens
cgauggaauuaaagcaauc

SEQ ID NO: 1363135 - RNA, 19 nt, Homo sapiens
cauuggguggcauauguua

SEQ ID NO: 1363136 - RNA, 19 nt, Homo sapiens
aagaagaagacaaggaaau

SEQ ID NO: 1363137 - RNA, 19 nt, Homo sapiens
acaaacuggugcagaagag

SEQ ID NO: 1363138 - RNA, 19 nt, Homo sapiens
ugucaaggccagagcaguu

SEQ ID NO: 1363139 - RNA, 19 nt, Homo sapiens
aaaagcauaucuccacuuc

SEQ ID NO: 1363140 - RNA, 19 nt, Homo sapiens
aaaccucuagacaaaguaa

SEQ ID NO: 1363141 - RNA, 19 nt, Homo sapiens
cugugugacuucucuguau

SEQ ID NO: 1363142 - RNA, 19 nt, Homo sapiens
uggaggagacggcuuggaa

SEQ ID NO: 1363143 - RNA, 19 nt, Homo sapiens
ggaaccggaagcucugaug

SEQ ID NO: 1363144 - RNA, 19 nt, Homo sapiens
agacaaaguaaccaaaucu

SEQ ID NO: 1363145 - RNA, 19 nt, Homo sapiens
gacaaggaaauggcugauu

SEQ ID NO: 1363146 - RNA, 19 nt, Homo sapiens
agagagaggaugagcuaau

SEQ ID NO: 1363147 - RNA, 19 nt, Homo sapiens
ugacuucucaacaaucuag

SEQ ID NO: 1363148 - RNA, 19 nt, Homo sapiens
gguuaagggagcaagaaga

SEQ ID NO: 1363149 - RNA, 19 nt, Homo sapiens
gcggaggucgagcgguuaa

SEQ ID NO: 1363150 - RNA, 19 nt, Homo sapiens
ggagauugagcuggagaug

SEQ ID NO: 1363151 - RNA, 19 nt, Homo sapiens
cgugacuucucaacaaucu

SEQ ID NO: 1363152 - RNA, 19 nt, Homo sapiens
gucgugacuucucaacaau

SEQ ID NO: 1363153 - RNA, 19 nt, Homo sapiens
agaagcagagagaggauga

SEQ ID NO: 1363154 - RNA, 19 nt, Homo sapiens
caacuucaacccguguaau

SEQ ID NO: 1363155 - RNA, 19 nt, Homo sapiens
caacaaucuagcaccaugu

SEQ ID NO: 1363156 - RNA, 19 nt, Homo sapiens
ggaaauggcuucagaaaug

SEQ ID NO: 1363157 - RNA, 19 nt, Homo sapiens
gagcauccauguucacuua

SEQ ID NO: 1363158 - RNA, 19 nt, Homo sapiens
gaagaggcauggauucuau

SEQ ID NO: 1363159 - RNA, 19 nt, Homo sapiens
gcagggagauguguaauga

SEQ ID NO: 1363160 - RNA, 19 nt, Homo sapiens
caccaugccuggcuaauuu

SEQ ID NO: 1363161 - RNA, 19 nt, Homo sapiens
gcagaggguuaacagcaua

SEQ ID NO: 1363162 - RNA, 19 nt, Homo sapiens
gaacugcauucccaaagug

SEQ ID NO: 1363163 - RNA, 19 nt, Homo sapiens
gaacuggaaacgcuccuua

SEQ ID NO: 1363164 - RNA, 19 nt, Homo sapiens
gauguuaagaccucaaaua

SEQ ID NO: 1363165 - RNA, 19 nt, Homo sapiens
ggagauguguaaugauuuc

SEQ ID NO: 1363166 - RNA, 19 nt, Homo sapiens
gaccaaagcucugaaaggu

SEQ ID NO: 1363167 - RNA, 19 nt, Homo sapiens
gaaaugguuugaguuggaa

SEQ ID NO: 1363168 - RNA, 19 nt, Homo sapiens
gaaauccccaguuuaauua

SEQ ID NO: 1363169 - RNA, 19 nt, Homo sapiens
ccaaacaagugugaacuga

SEQ ID NO: 1363170 - RNA, 19 nt, Homo sapiens
aaucagcgaugguucauug

SEQ ID NO: 1363171 - RNA, 19 nt, Homo sapiens
ggaaguauucugugcuaaa

SEQ ID NO: 1363172 - RNA, 19 nt, Homo sapiens
guacaauggugcgaucuug

SEQ ID NO: 1363173 - RNA, 19 nt, Homo sapiens
gaugaaacagcugcaguua

SEQ ID NO: 1363174 - RNA, 19 nt, Homo sapiens
caacauucuucaucucuca

SEQ ID NO: 1363175 - RNA, 19 nt, Homo sapiens
gaaauggcuucagaaaugg

SEQ ID NO: 1363176 - RNA, 19 nt, Homo sapiens
guaggaaucugugaagcaa

SEQ ID NO: 1363177 - RNA, 19 nt, Homo sapiens
ccaacacacuggcuggaaa

SEQ ID NO: 1363178 - RNA, 19 nt, Homo sapiens
ucuaauuccuugaugcuaa

SEQ ID NO: 1363179 - RNA, 19 nt, Homo sapiens
ucagaggacugccuaguag

SEQ ID NO: 1363180 - RNA, 19 nt, Homo sapiens
ugaaacagcugcaguuagc

SEQ ID NO: 1363181 - RNA, 19 nt, Homo sapiens
gccaaguccugcuguauca

SEQ ID NO: 1363182 - RNA, 19 nt, Homo sapiens
agaaaugguuugaguugga

SEQ ID NO: 1363183 - RNA, 19 nt, Homo sapiens
ucagucagcucuaaaucug

SEQ ID NO: 1363184 - RNA, 19 nt, Homo sapiens
gugcaucagucagcucuaa

SEQ ID NO: 1363185 - RNA, 19 nt, Homo sapiens
guucauugcucuagucucu

SEQ ID NO: 1363186 - RNA, 19 nt, Homo sapiens
ccaaagugcugggauuaca

SEQ ID NO: 1363187 - RNA, 19 nt, Homo sapiens
aaacaagugugaacugaac

SEQ ID NO: 1363188 - RNA, 19 nt, Homo sapiens
gaaguauucugugcuaaaa

SEQ ID NO: 1363189 - RNA, 19 nt, Homo sapiens
gcugucaggguuccacuua

SEQ ID NO: 1363190 - RNA, 19 nt, Homo sapiens
uagcugggauuacagguau

SEQ ID NO: 1363191 - RNA, 19 nt, Homo sapiens
gcccagccaucaaugcauu

SEQ ID NO: 1363192 - RNA, 19 nt, Homo sapiens
agggagauguguaaugauu

SEQ ID NO: 1363193 - RNA, 19 nt, Homo sapiens
agacagaguuucgcacuuc

SEQ ID NO: 1363194 - RNA, 19 nt, Homo sapiens
acagggaaauggcuucaga

SEQ ID NO: 1363195 - RNA, 19 nt, Homo sapiens
ggaugaaacagcugcaguu

SEQ ID NO: 1363196 - RNA, 19 nt, Homo sapiens
gcauccauguucacuuaug

SEQ ID NO: 1363197 - RNA, 19 nt, Homo sapiens
cuaauuccuugaugcuaaa

SEQ ID NO: 1363198 - RNA, 19 nt, Homo sapiens
ucagaaaugguuugaguug

SEQ ID NO: 1363199 - RNA, 19 nt, Homo sapiens
gagcaugaaagaacuggaa

SEQ ID NO: 1363200 - RNA, 19 nt, Homo sapiens
gagacagaguuucgcacuu

SEQ ID NO: 1363201 - RNA, 19 nt, Homo sapiens
ggaaagacgggcauuacag

SEQ ID NO: 1363202 - RNA, 19 nt, Homo sapiens
gguuugaguuggaagacaa

SEQ ID NO: 1363203 - RNA, 19 nt, Homo sapiens
cuucagaaaugguuugagu

SEQ ID NO: 1363204 - RNA, 19 nt, Homo sapiens
aguuagcacuguuaucuga

SEQ ID NO: 1363205 - RNA, 19 nt, Homo sapiens
ggaccaaagcucugaaagg

SEQ ID NO: 1363206 - RNA, 19 nt, Homo sapiens
caaagacaaaucagacugu

SEQ ID NO: 1363207 - RNA, 19 nt, Homo sapiens
cauaacccuuguuggcaaa

SEQ ID NO: 1363208 - RNA, 19 nt, Homo sapiens
guucacuuauggcugguuu

SEQ ID NO: 1363209 - RNA, 19 nt, Homo sapiens
gcgaagacaggcugagaug

SEQ ID NO: 1363210 - RNA, 19 nt, Homo sapiens
ggacuucuaauuccuugau

SEQ ID NO: 1363211 - RNA, 19 nt, Homo sapiens
gggaaauggcuucagaaau

SEQ ID NO: 1363212 - RNA, 19 nt, Homo sapiens
ugaacugcauucccaaagu

SEQ ID NO: 1363213 - RNA, 19 nt, Homo sapiens
caggguuccacuuaauuua

SEQ ID NO: 1363214 - RNA, 19 nt, Homo sapiens
caaacaagugugaacugaa

SEQ ID NO: 1363215 - RNA, 19 nt, Homo sapiens
gggaaguauucugugcuaa

SEQ ID NO: 1363216 - RNA, 19 nt, Homo sapiens
ugucaggguuccacuuaau

SEQ ID NO: 1363217 - RNA, 19 nt, Homo sapiens
cacuuuaaccuucuacaaa

SEQ ID NO: 1363218 - RNA, 19 nt, Homo sapiens
ucaggguuccacuuaauuu

SEQ ID NO: 1363219 - RNA, 19 nt, Homo sapiens
cuaaagggcaugccaaguc

SEQ ID NO: 1363220 - RNA, 19 nt, Homo sapiens
ugaccagccugcucuguac

SEQ ID NO: 1363221 - RNA, 19 nt, Homo sapiens
cugaguagcugggauuaca

SEQ ID NO: 1363222 - RNA, 19 nt, Homo sapiens
guagcugggauuacaggua

SEQ ID NO: 1363223 - RNA, 19 nt, Homo sapiens
uugaagagcauccauguuc

SEQ ID NO: 1363224 - RNA, 19 nt, Homo sapiens
gcugugacgguucaucuga

SEQ ID NO: 1363225 - RNA, 19 nt, Homo sapiens
gggagauguguaaugauuu

SEQ ID NO: 1363226 - RNA, 19 nt, Homo sapiens
cuucaucucucaggacuuc

SEQ ID NO: 1363227 - RNA, 19 nt, Homo sapiens
agggaaguauucugugcua

SEQ ID NO: 1363228 - RNA, 19 nt, Homo sapiens
ccacuuuaaccuucuacaa

SEQ ID NO: 1363229 - RNA, 19 nt, Homo sapiens
gcauggauucuaugagcuu

SEQ ID NO: 1363230 - RNA, 19 nt, Homo sapiens
gggaaggguugugggcaau

SEQ ID NO: 1363231 - RNA, 19 nt, Homo sapiens
agccugcucuguacaguga

SEQ ID NO: 1363232 - RNA, 19 nt, Homo sapiens
gcaucagucagcucuaaau

SEQ ID NO: 1363233 - RNA, 19 nt, Homo sapiens
uaucagggaaguauucugu

SEQ ID NO: 1363234 - RNA, 19 nt, Homo sapiens
ccaaaaugcugggauuaga

SEQ ID NO: 1363235 - RNA, 19 nt, Homo sapiens
ugaaauccccaguuuaauu

SEQ ID NO: 1363236 - RNA, 19 nt, Homo sapiens
ucucuacucauucaacaaa

SEQ ID NO: 1363237 - RNA, 19 nt, Homo sapiens
ccaccaugccuggcuaauu

SEQ ID NO: 1363238 - RNA, 19 nt, Homo sapiens
ucucucaggacuucuaauu

SEQ ID NO: 1363239 - RNA, 19 nt, Homo sapiens
uaucugagcaugaaagaac

SEQ ID NO: 1363240 - RNA, 19 nt, Homo sapiens
acuguuaucugagcaugaa

SEQ ID NO: 1363241 - RNA, 19 nt, Homo sapiens
gugcccagcccaucaaugu

SEQ ID NO: 1363242 - RNA, 19 nt, Homo sapiens
gaaggguugugggcaaugc

SEQ ID NO: 1363243 - RNA, 19 nt, Homo sapiens
caugccaaguccugcugua

SEQ ID NO: 1363244 - RNA, 19 nt, Homo sapiens
acaggaaagacgggcauua

SEQ ID NO: 1363245 - RNA, 19 nt, Homo sapiens
ccuaguagcaaagguuauu

SEQ ID NO: 1363246 - RNA, 19 nt, Homo sapiens
aaagaagaggcauggauuc

SEQ ID NO: 1363247 - RNA, 19 nt, Homo sapiens
ucucaggacuucuaauucc

SEQ ID NO: 1363248 - RNA, 19 nt, Homo sapiens
agacaacauucuucaucuc

SEQ ID NO: 1363249 - RNA, 19 nt, Homo sapiens
gaugguucauugcucuagu

SEQ ID NO: 1363250 - RNA, 19 nt, Homo sapiens
uaaguaggaaucugugaag

SEQ ID NO: 1363251 - RNA, 19 nt, Homo sapiens
gagccccucucuuccuuaa

SEQ ID NO: 1363252 - RNA, 19 nt, Homo sapiens
gcccaucaauguguuuuaa

SEQ ID NO: 1363253 - RNA, 19 nt, Homo sapiens
gacaacauucuucaucucu

SEQ ID NO: 1363254 - RNA, 19 nt, Homo sapiens
cagaguuucgcacuucuug

SEQ ID NO: 1363255 - RNA, 19 nt, Homo sapiens
gcccagcccaucaaugugu

SEQ ID NO: 1363256 - RNA, 19 nt, Homo sapiens
gagguuggguuccugauua

SEQ ID NO: 1363257 - RNA, 19 nt, Homo sapiens
gaagacaacuugcuuugau

SEQ ID NO: 1363258 - RNA, 19 nt, Homo sapiens
ucucagagcuguucuacua

SEQ ID NO: 1363259 - RNA, 19 nt, Homo sapiens
acgaagagcucaacgcuuu

SEQ ID NO: 1363260 - RNA, 19 nt, Homo sapiens
ggacgugcgcauccuguua

SEQ ID NO: 1363261 - RNA, 19 nt, Homo sapiens
gagaagauucgaacuaagu

SEQ ID NO: 1363262 - RNA, 19 nt, Homo sapiens
ccaagaaccugaggaacau

SEQ ID NO: 1363263 - RNA, 19 nt, Homo sapiens
gagcugccuuggacaccua

SEQ ID NO: 1363264 - RNA, 19 nt, Homo sapiens
gacguugccugcuugaugu

SEQ ID NO: 1363265 - RNA, 19 nt, Homo sapiens
uugagaagauucgaacuaa

SEQ ID NO: 1363266 - RNA, 19 nt, Homo sapiens
ggagcugacugcggacuau

SEQ ID NO: 1363267 - RNA, 19 nt, Homo sapiens
gcagugacccaaaguccuu

SEQ ID NO: 1363268 - RNA, 19 nt, Homo sapiens
gagccaguuucccgagauu

SEQ ID NO: 1363269 - RNA, 19 nt, Homo sapiens
ggacgccaccugugacguu

SEQ ID NO: 1363270 - RNA, 19 nt, Homo sapiens
gcagagaguguuugagaag

SEQ ID NO: 1363271 - RNA, 19 nt, Homo sapiens
gugcagagaguguuugaga

SEQ ID NO: 1363272 - RNA, 19 nt, Homo sapiens
caccuuggcuaccaguuug

SEQ ID NO: 1363273 - RNA, 19 nt, Homo sapiens
gccaagaaccugaggaaca

SEQ ID NO: 1363274 - RNA, 19 nt, Homo sapiens
aagacaacuugcuuugauu

SEQ ID NO: 1363275 - RNA, 19 nt, Homo sapiens
gaggaggccaccauugaga

SEQ ID NO: 1363276 - RNA, 19 nt, Homo sapiens
guccucagcuucucacucu

SEQ ID NO: 1363277 - RNA, 19 nt, Homo sapiens
cuacaagcaccauuacaug

SEQ ID NO: 1363278 - RNA, 19 nt, Homo sapiens
caucguggacuacucagaa

SEQ ID NO: 1363279 - RNA, 19 nt, Homo sapiens
aggcaaacguggugugugu

SEQ ID NO: 1363280 - RNA, 19 nt, Homo sapiens
ggagguuggguuccugauu

SEQ ID NO: 1363281 - RNA, 19 nt, Homo sapiens
ugacguugccugcuugaug

SEQ ID NO: 1363282 - RNA, 19 nt, Homo sapiens
ggaucccacuggugaaugg

SEQ ID NO: 1363283 - RNA, 19 nt, Homo sapiens
ccaccuuggcuaccaguuu

SEQ ID NO: 1363284 - RNA, 19 nt, Homo sapiens
ucacccagcucgccaccau

SEQ ID NO: 1363285 - RNA, 19 nt, Homo sapiens
ggaucccagucucugaaga

SEQ ID NO: 1363286 - RNA, 19 nt, Homo sapiens
gcgucuacaagcaccauua

SEQ ID NO: 1363287 - RNA, 19 nt, Homo sapiens
uuccagaaauccugcuuug

SEQ ID NO: 1363288 - RNA, 19 nt, Homo sapiens
ccagaaggccguccugcau

SEQ ID NO: 1363289 - RNA, 19 nt, Homo sapiens
ccaccgcugucagggauug

SEQ ID NO: 1363290 - RNA, 19 nt, Homo sapiens
ugaagacaacuugcuuuga

SEQ ID NO: 1363291 - RNA, 19 nt, Homo sapiens
gcuggaaggcagagcuuug

SEQ ID NO: 1363292 - RNA, 19 nt, Homo sapiens
ugagaagauucgaacuaag

SEQ ID NO: 1363293 - RNA, 19 nt, Homo sapiens
cugaggaggccaccauuga

SEQ ID NO: 1363294 - RNA, 19 nt, Homo sapiens
gguuuccucuuccugaaca

SEQ ID NO: 1363295 - RNA, 19 nt, Homo sapiens
ccugugacguugccugcuu

SEQ ID NO: 1363296 - RNA, 19 nt, Homo sapiens
gcccaugccaucacaguca

SEQ ID NO: 1363297 - RNA, 19 nt, Homo sapiens
gacuaucucuccccucuga

SEQ ID NO: 1363298 - RNA, 19 nt, Homo sapiens
agaccugcguggaguguuc

SEQ ID NO: 1363299 - RNA, 19 nt, Homo sapiens
gccaguuucccgagauuga

SEQ ID NO: 1363300 - RNA, 19 nt, Homo sapiens
uggugugugugguguauga

SEQ ID NO: 1363301 - RNA, 19 nt, Homo sapiens
aguggacccuggugaccua

SEQ ID NO: 1363302 - RNA, 19 nt, Homo sapiens
agagaguguuugagaagca

SEQ ID NO: 1363303 - RNA, 19 nt, Homo sapiens
gguaugaggagggcuggaa

SEQ ID NO: 1363304 - RNA, 19 nt, Homo sapiens
gcgcggaggagaucacgau

SEQ ID NO: 1363305 - RNA, 19 nt, Homo sapiens
gaaguacuugauccucugu

SEQ ID NO: 1363306 - RNA, 19 nt, Homo sapiens
ugcagagaguguuugagaa

SEQ ID NO: 1363307 - RNA, 19 nt, Homo sapiens
cugcaucccucuuccuucu

SEQ ID NO: 1363308 - RNA, 19 nt, Homo sapiens
gcccagcaccaccaucuuc

SEQ ID NO: 1363309 - RNA, 19 nt, Homo sapiens
ggccaccauugagaagauu

SEQ ID NO: 1363310 - RNA, 19 nt, Homo sapiens
ccuggaugguuuccucuuc

SEQ ID NO: 1363311 - RNA, 19 nt, Homo sapiens
agguuggguuccugauuaa

SEQ ID NO: 1363312 - RNA, 19 nt, Homo sapiens
aguacuugauccucuguga

SEQ ID NO: 1363313 - RNA, 19 nt, Homo sapiens
gacaacuugcuuugauuca

SEQ ID NO: 1363314 - RNA, 19 nt, Homo sapiens
gagcccagcaccaccaucu

SEQ ID NO: 1363315 - RNA, 19 nt, Homo sapiens
guugccugcuugauguuug

SEQ ID NO: 1363316 - RNA, 19 nt, Homo sapiens
ucuucaggcucucagauca

SEQ ID NO: 1363317 - RNA, 19 nt, Homo sapiens
agacaacuugcuuugauuc

SEQ ID NO: 1363318 - RNA, 19 nt, Homo sapiens
ccaggcccaugccaucaca

SEQ ID NO: 1363319 - RNA, 19 nt, Homo sapiens
agacgguggugugcaggaa

SEQ ID NO: 1363320 - RNA, 19 nt, Homo sapiens
cugaagacaacuugcuuug

SEQ ID NO: 1363321 - RNA, 19 nt, Homo sapiens
ggaaaucucuaucugaaug

SEQ ID NO: 1363322 - RNA, 19 nt, Homo sapiens
ggacguuacuggaacauug

SEQ ID NO: 1363323 - RNA, 19 nt, Homo sapiens
gaaugaauaugguuccuau

SEQ ID NO: 1363324 - RNA, 19 nt, Homo sapiens
gcuauaaccuugaaucaca

SEQ ID NO: 1363325 - RNA, 19 nt, Homo sapiens
gcaggaaccaguacauuaa

SEQ ID NO: 1363326 - RNA, 19 nt, Homo sapiens
guaaagcuauaaccuugaa

SEQ ID NO: 1363327 - RNA, 19 nt, Homo sapiens
gcaaaggcuuaauuggaaa

SEQ ID NO: 1363328 - RNA, 19 nt, Homo sapiens
caccugagcugacuuuguu

SEQ ID NO: 1363329 - RNA, 19 nt, Homo sapiens
gccagaaccuuggacguua

SEQ ID NO: 1363330 - RNA, 19 nt, Homo sapiens
gaugauggcuuuccuacag

SEQ ID NO: 1363331 - RNA, 19 nt, Homo sapiens
ccaagauggugauggagua

SEQ ID NO: 1363332 - RNA, 19 nt, Homo sapiens
gaacacaguauccauagga

SEQ ID NO: 1363333 - RNA, 19 nt, Homo sapiens
gcacuuccaugacuacaag

SEQ ID NO: 1363334 - RNA, 19 nt, Homo sapiens
cacauuaccugcuuucuuc

SEQ ID NO: 1363335 - RNA, 19 nt, Homo sapiens
cgcaaaggcuuaauuggaa

SEQ ID NO: 1363336 - RNA, 19 nt, Homo sapiens
ccgaagcaguggaccuuua

SEQ ID NO: 1363337 - RNA, 19 nt, Homo sapiens
ggcaggaaccaguacauua

SEQ ID NO: 1363338 - RNA, 19 nt, Homo sapiens
aaaagcaucuccuuaagua

SEQ ID NO: 1363339 - RNA, 19 nt, Homo sapiens
gcgauuacacggccaagua

SEQ ID NO: 1363340 - RNA, 19 nt, Homo sapiens
gaacucggcgugagaaaca

SEQ ID NO: 1363341 - RNA, 19 nt, Homo sapiens
gccaagggcuggaacuuca

SEQ ID NO: 1363342 - RNA, 19 nt, Homo sapiens
gcauuacaguucacggaaa

SEQ ID NO: 1363343 - RNA, 19 nt, Homo sapiens
ccagaaagaggcaaauuug

SEQ ID NO: 1363344 - RNA, 19 nt, Homo sapiens
gcgcaaaggcuuaauugga

SEQ ID NO: 1363345 - RNA, 19 nt, Homo sapiens
gcaggugucucugguguuc

SEQ ID NO: 1363346 - RNA, 19 nt, Homo sapiens
ggacucaggcgugcucuuu

SEQ ID NO: 1363347 - RNA, 19 nt, Homo sapiens
gaaccaguacauuaaguga

SEQ ID NO: 1363348 - RNA, 19 nt, Homo sapiens
gcaguaaagcuauaaccuu

SEQ ID NO: 1363349 - RNA, 19 nt, Homo sapiens
gggagcagcuaaucagauc

SEQ ID NO: 1363350 - RNA, 19 nt, Homo sapiens
ccacggaggcaccaacuuu

SEQ ID NO: 1363351 - RNA, 19 nt, Homo sapiens
gaaccugcaugagccagaa

SEQ ID NO: 1363352 - RNA, 19 nt, Homo sapiens
cacaauaucuuggauucuu

SEQ ID NO: 1363353 - RNA, 19 nt, Homo sapiens
cuacagcccugcucuugug

SEQ ID NO: 1363354 - RNA, 19 nt, Homo sapiens
ccaucaaccucuacauguu

SEQ ID NO: 1363355 - RNA, 19 nt, Homo sapiens
ugaacacccucaccaccua

SEQ ID NO: 1363356 - RNA, 19 nt, Homo sapiens
ucggguacauucucuauga

SEQ ID NO: 1363357 - RNA, 19 nt, Homo sapiens
gaguugcaguaaagcuaua

SEQ ID NO: 1363358 - RNA, 19 nt, Homo sapiens
ggacucagcccaagauggu

SEQ ID NO: 1363359 - RNA, 19 nt, Homo sapiens
gaaggaacucggcgugaga

SEQ ID NO: 1363360 - RNA, 19 nt, Homo sapiens
ucuauagccuggauaugaa

SEQ ID NO: 1363361 - RNA, 19 nt, Homo sapiens
gggagccaaucaagucuga

SEQ ID NO: 1363362 - RNA, 19 nt, Homo sapiens
gaaagaggcaaauuugacu

SEQ ID NO: 1363363 - RNA, 19 nt, Homo sapiens
agucagaugucaccagcua

SEQ ID NO: 1363364 - RNA, 19 nt, Homo sapiens
ggaggaccguggcauugug

SEQ ID NO: 1363365 - RNA, 19 nt, Homo sapiens
gcagguggagaaugaauau

SEQ ID NO: 1363366 - RNA, 19 nt, Homo sapiens
gccagaaagaggcaaauuu

SEQ ID NO: 1363367 - RNA, 19 nt, Homo sapiens
caaguuagcaggugucucu

SEQ ID NO: 1363368 - RNA, 19 nt, Homo sapiens
cccagaaacacccacauua

SEQ ID NO: 1363369 - RNA, 19 nt, Homo sapiens
uuggaaaucucuaucugaa

SEQ ID NO: 1363370 - RNA, 19 nt, Homo sapiens
ccauaggauucuuggacua

SEQ ID NO: 1363371 - RNA, 19 nt, Homo sapiens
gagccaaucaagucugaaa

SEQ ID NO: 1363372 - RNA, 19 nt, Homo sapiens
caacuuuggcuucaugaau

SEQ ID NO: 1363373 - RNA, 19 nt, Homo sapiens
gggccuggcuuuguugaug

SEQ ID NO: 1363374 - RNA, 19 nt, Homo sapiens
gaaucuauagccuggauau

SEQ ID NO: 1363375 - RNA, 19 nt, Homo sapiens
gaaaucucuaucugaauga

SEQ ID NO: 1363376 - RNA, 19 nt, Homo sapiens
ccagcuggcuacuccaaga

SEQ ID NO: 1363377 - RNA, 19 nt, Homo sapiens
gcugaaacgugcccuugca

SEQ ID NO: 1363378 - RNA, 19 nt, Homo sapiens
gcaaaagcaucuccuuaag

SEQ ID NO: 1363379 - RNA, 19 nt, Homo sapiens
uuggguagcuuguccauca

SEQ ID NO: 1363380 - RNA, 19 nt, Homo sapiens
cagaaagaggcaaauuuga

SEQ ID NO: 1363381 - RNA, 19 nt, Homo sapiens
ggccuggcuuuguugauga

SEQ ID NO: 1363382 - RNA, 19 nt, Homo sapiens
ccacauuaccugcuuucuu

SEQ ID NO: 1363383 - RNA, 19 nt, Homo sapiens
guccugaguugcaguaaag

SEQ ID NO: 1363384 - RNA, 19 nt, Homo sapiens
gugagaaacaugugacuuc

SEQ ID NO: 1363385 - RNA, 19 nt, Homo sapiens
gcccuuaacgccagucuug

SEQ ID NO: 1363386 - RNA, 19 nt, Homo sapiens
gaaggccuguggcuugaac

SEQ ID NO: 1363387 - RNA, 19 nt, Homo sapiens
aggcugggcuggagaaaca

SEQ ID NO: 1363388 - RNA, 19 nt, Homo sapiens
cagaaucuauagccuggau

SEQ ID NO: 1363389 - RNA, 19 nt, Homo sapiens
acaugaagcuucgagacuu

SEQ ID NO: 1363390 - RNA, 19 nt, Homo sapiens
gcuccuccaucaaccucua

SEQ ID NO: 1363391 - RNA, 19 nt, Homo sapiens
ccgugcagguggagaauga

SEQ ID NO: 1363392 - RNA, 19 nt, Homo sapiens
ggaaccaguacauuaagug

SEQ ID NO: 1363393 - RNA, 19 nt, Homo sapiens
ccagaaacacccacauuac

SEQ ID NO: 1363394 - RNA, 19 nt, Homo sapiens
gguucggccuggacaaaug

SEQ ID NO: 1363395 - RNA, 19 nt, Homo sapiens
uggagaaccugccagucaa

SEQ ID NO: 1363396 - RNA, 19 nt, Homo sapiens
caccagcuaugacuaugau

SEQ ID NO: 1363397 - RNA, 19 nt, Homo sapiens
gcaugaggcugaggacaac

SEQ ID NO: 1363398 - RNA, 19 nt, Homo sapiens
ugacuuuguucuuccuuca

SEQ ID NO: 1363399 - RNA, 19 nt, Homo sapiens
gagaaucgugggcgaguca

SEQ ID NO: 1363400 - RNA, 19 nt, Homo sapiens
aagcaguggaccuuuauuu

SEQ ID NO: 1363401 - RNA, 19 nt, Homo sapiens
gaugccguaugagcccuua

SEQ ID NO: 1363402 - RNA, 19 nt, Homo sapiens
uggaacugcuccugacuuc

SEQ ID NO: 1363403 - RNA, 19 nt, Homo sapiens
gcaguggaccuuuauuuug

SEQ ID NO: 1363404 - RNA, 19 nt, Homo sapiens
ggccagaaccuuggacguu

SEQ ID NO: 1363405 - RNA, 19 nt, Homo sapiens
gaacacccucaccaccuau

SEQ ID NO: 1363406 - RNA, 19 nt, Homo sapiens
uucccaagaugccguauga

SEQ ID NO: 1363407 - RNA, 19 nt, Homo sapiens
cagcgcaaaggcuuaauug

SEQ ID NO: 1363408 - RNA, 19 nt, Homo sapiens
uacaagacaacgaagauug

SEQ ID NO: 1363409 - RNA, 19 nt, Homo sapiens
caguggaccuuuauuuuga

SEQ ID NO: 1363410 - RNA, 19 nt, Homo sapiens
gaagcaguggaccuuuauu

SEQ ID NO: 1363411 - RNA, 19 nt, Homo sapiens
gggaccgccugcugaagau

SEQ ID NO: 1363412 - RNA, 19 nt, Homo sapiens
ugagcugacuuuguucuuc

SEQ ID NO: 1363413 - RNA, 19 nt, Homo sapiens
gggcaggaaccaguacauu

SEQ ID NO: 1363414 - RNA, 19 nt, Homo sapiens
ggcaugaggcugaggacaa

SEQ ID NO: 1363415 - RNA, 19 nt, Homo sapiens
gaccagcgcaaaggcuuaa

SEQ ID NO: 1363416 - RNA, 19 nt, Homo sapiens
aacuuuggcuucaugaaug

SEQ ID NO: 1363417 - RNA, 19 nt, Homo sapiens
acaauaucuuggauucuuc

SEQ ID NO: 1363418 - RNA, 19 nt, Homo sapiens
gguggagaaugaauauggu

SEQ ID NO: 1363419 - RNA, 19 nt, Homo sapiens
cgaagcaguggaccuuuau

SEQ ID NO: 1363420 - RNA, 19 nt, Homo sapiens
ucagaucgcccagccuuug

SEQ ID NO: 1363421 - RNA, 19 nt, Homo sapiens
gaugaccucuuuccuaaug

SEQ ID NO: 1363422 - RNA, 19 nt, Homo sapiens
uggaugaccucuuuccuaa

SEQ ID NO: 1363423 - RNA, 19 nt, Homo sapiens
gaaggaggcauaagaaguc

SEQ ID NO: 1363424 - RNA, 19 nt, Homo sapiens
ccacauaugauuucuacaa

SEQ ID NO: 1363425 - RNA, 19 nt, Homo sapiens
aggaagggcuggugcauga

SEQ ID NO: 1363426 - RNA, 19 nt, Homo sapiens
gcagggaggccaugaggaa

SEQ ID NO: 1363427 - RNA, 19 nt, Homo sapiens
ccagugauccuaaugauuc

SEQ ID NO: 1363428 - RNA, 19 nt, Homo sapiens
ucucuuagcucauccaucu

SEQ ID NO: 1363429 - RNA, 19 nt, Homo sapiens
ggaaggaggcauaagaagu

SEQ ID NO: 1363430 - RNA, 19 nt, Homo sapiens
gaggaaggaggcauaagaa

SEQ ID NO: 1363431 - RNA, 19 nt, Homo sapiens
ccaaggauucccuggauga

SEQ ID NO: 1363432 - RNA, 19 nt, Homo sapiens
gcacaguggagucggagaa

SEQ ID NO: 1363433 - RNA, 19 nt, Homo sapiens
auagguaaauccacauaug

SEQ ID NO: 1363434 - RNA, 19 nt, Homo sapiens
gugaccagaauaaguauaa

SEQ ID NO: 1363435 - RNA, 19 nt, Homo sapiens
gauaagucauagguaaauc

SEQ ID NO: 1363436 - RNA, 19 nt, Homo sapiens
uaagggugcugaggaagga

SEQ ID NO: 1363437 - RNA, 19 nt, Homo sapiens
caccaaggauucccuggau

SEQ ID NO: 1363438 - RNA, 19 nt, Homo sapiens
gcaguaugaugaggaugga

SEQ ID NO: 1363439 - RNA, 19 nt, Homo sapiens
ugaggaaggaggcauaaga

SEQ ID NO: 1363440 - RNA, 19 nt, Homo sapiens
gaagggcuggugcaugaga

SEQ ID NO: 1363441 - RNA, 19 nt, Homo sapiens
cagcuucgccguucuaugg

SEQ ID NO: 1363442 - RNA, 19 nt, Homo sapiens
uagguaaauccacauauga

SEQ ID NO: 1363443 - RNA, 19 nt, Homo sapiens
cugcccaccugcugaauga

SEQ ID NO: 1363444 - RNA, 19 nt, Homo sapiens
cauccuugcuuugguguau

SEQ ID NO: 1363445 - RNA, 19 nt, Homo sapiens
gaauaaguauaaggaagcu

SEQ ID NO: 1363446 - RNA, 19 nt, Homo sapiens
gaagaggaccccagcaaug

SEQ ID NO: 1363447 - RNA, 19 nt, Homo sapiens
ccuaaugauucucaauucu

SEQ ID NO: 1363448 - RNA, 19 nt, Homo sapiens
cacuaagggugcugaggaa

SEQ ID NO: 1363449 - RNA, 19 nt, Homo sapiens
gcucaacauccuugcuuug

SEQ ID NO: 1363450 - RNA, 19 nt, Homo sapiens
ggaccuggagcgcacauca

SEQ ID NO: 1363451 - RNA, 19 nt, Homo sapiens
gaugucaggccugguguug

SEQ ID NO: 1363452 - RNA, 19 nt, Homo sapiens
guccagugauccuaaugau

SEQ ID NO: 1363453 - RNA, 19 nt, Homo sapiens
gguguaucgugaccagaau

SEQ ID NO: 1363454 - RNA, 19 nt, Homo sapiens
cagcucagcaggguggaua

SEQ ID NO: 1363455 - RNA, 19 nt, Homo sapiens
ggaggcauaagaaguccuu

SEQ ID NO: 1363456 - RNA, 19 nt, Homo sapiens
uagaggcccuacgcaguga

SEQ ID NO: 1363457 - RNA, 19 nt, Homo sapiens
gcgaugccaccaaggauuc

SEQ ID NO: 1363458 - RNA, 19 nt, Homo sapiens
ucauagguaaauccacaua

SEQ ID NO: 1363459 - RNA, 19 nt, Homo sapiens
ccagaauaaguauaaggaa

SEQ ID NO: 1363460 - RNA, 19 nt, Homo sapiens
cagccacaccggcagauug

SEQ ID NO: 1363461 - RNA, 19 nt, Homo sapiens
aaaagaagcaccuggaguu

SEQ ID NO: 1363462 - RNA, 19 nt, Homo sapiens
ccauccugcugucaguauu

SEQ ID NO: 1363463 - RNA, 19 nt, Homo sapiens
cagcaggguggauaugaga

SEQ ID NO: 1363464 - RNA, 19 nt, Homo sapiens
ucaacauccuugcuuuggu

SEQ ID NO: 1363465 - RNA, 19 nt, Homo sapiens
uccuaaugauucucaauuc

SEQ ID NO: 1363466 - RNA, 19 nt, Homo sapiens
gcuucgccguucuauggaa

SEQ ID NO: 1363467 - RNA, 19 nt, Homo sapiens
gcugaggaaggaggcauaa

SEQ ID NO: 1363468 - RNA, 19 nt, Homo sapiens
gcugaaugaugcccuuagc

SEQ ID NO: 1363469 - RNA, 19 nt, Homo sapiens
uaucgugaccagaauaagu

SEQ ID NO: 1363470 - RNA, 19 nt, Homo sapiens
cuggaugaccucuuuccua

SEQ ID NO: 1363471 - RNA, 19 nt, Homo sapiens
gcccucaguccacucacua

SEQ ID NO: 1363472 - RNA, 19 nt, Homo sapiens
gcaggguggauaugagauc

SEQ ID NO: 1363473 - RNA, 19 nt, Homo sapiens
uucccuggaugaccucuuu

SEQ ID NO: 1363474 - RNA, 19 nt, Homo sapiens
gcggcaguaugaugaggau

SEQ ID NO: 1363475 - RNA, 19 nt, Homo sapiens
gagugaggcccaggugaug

SEQ ID NO: 1363476 - RNA, 19 nt, Homo sapiens
ccaguacgcagcccaaggu

SEQ ID NO: 1363477 - RNA, 19 nt, Homo sapiens
caccaggccgugcugcaaa

SEQ ID NO: 1363478 - RNA, 19 nt, Homo sapiens
gauccuaaugauucucaau

SEQ ID NO: 1363479 - RNA, 19 nt, Homo sapiens
ucagcaggguggauaugag

SEQ ID NO: 1363480 - RNA, 19 nt, Homo sapiens
ggcgaugccaccaaggauu

SEQ ID NO: 1363481 - RNA, 19 nt, Homo sapiens
accaguggcugcgggauga

SEQ ID NO: 1363482 - RNA, 19 nt, Homo sapiens
uaacacaucuucccuauga

SEQ ID NO: 1363483 - RNA, 19 nt, Homo sapiens
ccaaagcgauuuaucauuu

SEQ ID NO: 1363484 - RNA, 19 nt, Homo sapiens
gaaccuacauugacacauu

SEQ ID NO: 1363485 - RNA, 19 nt, Homo sapiens
ggaaggagcuuggauacaa

SEQ ID NO: 1363486 - RNA, 19 nt, Homo sapiens
gcauuuagguuucucugua

SEQ ID NO: 1363487 - RNA, 19 nt, Homo sapiens
aaggacagcugcuauaaua

SEQ ID NO: 1363488 - RNA, 19 nt, Homo sapiens
gaagaucucuaugagcuuu

SEQ ID NO: 1363489 - RNA, 19 nt, Homo sapiens
agaauguccuuaacucuua

SEQ ID NO: 1363490 - RNA, 19 nt, Homo sapiens
ggaauucacucuuucucuu

SEQ ID NO: 1363491 - RNA, 19 nt, Homo sapiens
gacggcauguucauuaaua

SEQ ID NO: 1363492 - RNA, 19 nt, Homo sapiens
gcagagauuucccauauac

SEQ ID NO: 1363493 - RNA, 19 nt, Homo sapiens
ggaagaauguccuuaacuc

SEQ ID NO: 1363494 - RNA, 19 nt, Homo sapiens
cagauuggcuucuuucaug

SEQ ID NO: 1363495 - RNA, 19 nt, Homo sapiens
ugacaaauguguaaugaca

SEQ ID NO: 1363496 - RNA, 19 nt, Homo sapiens
acauucagcugaugcauuu

SEQ ID NO: 1363497 - RNA, 19 nt, Homo sapiens
ggacagcugcuauaauaug

SEQ ID NO: 1363498 - RNA, 19 nt, Homo sapiens
gcuccaaucccuaccaaua

SEQ ID NO: 1363499 - RNA, 19 nt, Homo sapiens
uggcuucuuucauguauua

SEQ ID NO: 1363500 - RNA, 19 nt, Homo sapiens
caagacaaguguacaccaa

SEQ ID NO: 1363501 - RNA, 19 nt, Homo sapiens
ggaaggacagcugcuauaa

SEQ ID NO: 1363502 - RNA, 19 nt, Homo sapiens
gucaaccguuauaguauua

SEQ ID NO: 1363503 - RNA, 19 nt, Homo sapiens
gacagcugcuauaauauga

SEQ ID NO: 1363504 - RNA, 19 nt, Homo sapiens
aauggagccuuaucucaua

SEQ ID NO: 1363505 - RNA, 19 nt, Homo sapiens
ggaaaacccuggaucaaau

SEQ ID NO: 1363506 - RNA, 19 nt, Homo sapiens
ggcaucagaucguugcuuu

SEQ ID NO: 1363507 - RNA, 19 nt, Homo sapiens
caacugaucuuuucacugu

SEQ ID NO: 1363508 - RNA, 19 nt, Homo sapiens
uaccgucaaugucuuauaa

SEQ ID NO: 1363509 - RNA, 19 nt, Homo sapiens
ccaauaaugucaugaugca

SEQ ID NO: 1363510 - RNA, 19 nt, Homo sapiens
ggauugcccucuauuuaag

SEQ ID NO: 1363511 - RNA, 19 nt, Homo sapiens
gaauucacucuuucucuuu

SEQ ID NO: 1363512 - RNA, 19 nt, Homo sapiens
uaagaaguauggaguacau

SEQ ID NO: 1363513 - RNA, 19 nt, Homo sapiens
caucuaacauucaagcaau

SEQ ID NO: 1363514 - RNA, 19 nt, Homo sapiens
agagaaaccaggaagauuu

SEQ ID NO: 1363515 - RNA, 19 nt, Homo sapiens
cugaugaacuggauagcua

SEQ ID NO: 1363516 - RNA, 19 nt, Homo sapiens
uaacuauguugaccuuaga

SEQ ID NO: 1363517 - RNA, 19 nt, Homo sapiens
ccaggaagauuugcucaga

SEQ ID NO: 1363518 - RNA, 19 nt, Homo sapiens
guuaacacaucuucccuau

SEQ ID NO: 1363519 - RNA, 19 nt, Homo sapiens
gaagguggagaguaugaaa

SEQ ID NO: 1363520 - RNA, 19 nt, Homo sapiens
uggagaagguggagaguau

SEQ ID NO: 1363521 - RNA, 19 nt, Homo sapiens
cacccaaaguccauaguuu

SEQ ID NO: 1363522 - RNA, 19 nt, Homo sapiens
ccgucaaugucuuauaaua

SEQ ID NO: 1363523 - RNA, 19 nt, Homo sapiens
uggaucaaauggagccuua

SEQ ID NO: 1363524 - RNA, 19 nt, Homo sapiens
gaagauuugcucagagaga

SEQ ID NO: 1363525 - RNA, 19 nt, Homo sapiens
gugaugagguugaagaucu

SEQ ID NO: 1363526 - RNA, 19 nt, Homo sapiens
gggaaggacagcugcuaua

SEQ ID NO: 1363527 - RNA, 19 nt, Homo sapiens
caucagaaguagucauaca

SEQ ID NO: 1363528 - RNA, 19 nt, Homo sapiens
aguagcagcuuuggguuua

SEQ ID NO: 1363529 - RNA, 19 nt, Homo sapiens
gagaaaccaggaagauuug

SEQ ID NO: 1363530 - RNA, 19 nt, Homo sapiens
gugcuauacuuucugacua

SEQ ID NO: 1363531 - RNA, 19 nt, Homo sapiens
augcagagauuucccauau

SEQ ID NO: 1363532 - RNA, 19 nt, Homo sapiens
gaaggacagcugcuauaau

SEQ ID NO: 1363533 - RNA, 19 nt, Homo sapiens
guccuuaacucuuacaagu

SEQ ID NO: 1363534 - RNA, 19 nt, Homo sapiens
ggacaauuaggaagaaugu

SEQ ID NO: 1363535 - RNA, 19 nt, Homo sapiens
gauaucaguaggugcuaua

SEQ ID NO: 1363536 - RNA, 19 nt, Homo sapiens
caacugaugaaccuacauu

SEQ ID NO: 1363537 - RNA, 19 nt, Homo sapiens
cagaaguagucauacauuc

SEQ ID NO: 1363538 - RNA, 19 nt, Homo sapiens
gccuuuagcuuaucuuugg

SEQ ID NO: 1363539 - RNA, 19 nt, Homo sapiens
ugucaaccguuauaguauu

SEQ ID NO: 1363540 - RNA, 19 nt, Homo sapiens
aaccuacauugacacauua

SEQ ID NO: 1363541 - RNA, 19 nt, Homo sapiens
caaauggagccuuaucuca

SEQ ID NO: 1363542 - RNA, 19 nt, Homo sapiens
gaauaauuucacugccuua

SEQ ID NO: 1363543 - RNA, 19 nt, Homo sapiens
gauggucacuuuauuuagc

SEQ ID NO: 1363544 - RNA, 19 nt, Homo sapiens
cauuaauagugccaacuuu

SEQ ID NO: 1363545 - RNA, 19 nt, Homo sapiens
gagaagguggagaguauga

SEQ ID NO: 1363546 - RNA, 19 nt, Homo sapiens
ugauaagcaucuugggaaa

SEQ ID NO: 1363547 - RNA, 19 nt, Homo sapiens
ggguuuagauccugauaag

SEQ ID NO: 1363548 - RNA, 19 nt, Homo sapiens
uaauagagugguacauuug

SEQ ID NO: 1363549 - RNA, 19 nt, Homo sapiens
gaaguauggaguacauguu

SEQ ID NO: 1363550 - RNA, 19 nt, Homo sapiens
guauauagcuuuucaugca

SEQ ID NO: 1363551 - RNA, 19 nt, Homo sapiens
uagagugguacauuuguua

SEQ ID NO: 1363552 - RNA, 19 nt, Homo sapiens
gcaccaugccauugacuug

SEQ ID NO: 1363553 - RNA, 19 nt, Homo sapiens
gcagagaaaccaggaagau

SEQ ID NO: 1363554 - RNA, 19 nt, Homo sapiens
ugacuuguaugcagaagca

SEQ ID NO: 1363555 - RNA, 19 nt, Homo sapiens
caaaguccauaguuuacgu

SEQ ID NO: 1363556 - RNA, 19 nt, Homo sapiens
caucuucccuaugaccuuu

SEQ ID NO: 1363557 - RNA, 19 nt, Homo sapiens
guggagaguaugaaacuuu

SEQ ID NO: 1363558 - RNA, 19 nt, Homo sapiens
agacaaguguacaccaaau

SEQ ID NO: 1363559 - RNA, 19 nt, Homo sapiens
cagcugcuauaauaugaug

SEQ ID NO: 1363560 - RNA, 19 nt, Homo sapiens
gaagaauguccuuaacucu

SEQ ID NO: 1363561 - RNA, 19 nt, Homo sapiens
uggauugcccucuauuuaa

SEQ ID NO: 1363562 - RNA, 19 nt, Homo sapiens
gaacuggauagcuacaugu

SEQ ID NO: 1363563 - RNA, 19 nt, Homo sapiens
ggaaccauuuauuaauugg

SEQ ID NO: 1363564 - RNA, 19 nt, Homo sapiens
aaaccaccauuucuauaca

SEQ ID NO: 1363565 - RNA, 19 nt, Homo sapiens
cauuaaaccaccauuucua

SEQ ID NO: 1363566 - RNA, 19 nt, Homo sapiens
ugaacuggauagcuacaug

SEQ ID NO: 1363567 - RNA, 19 nt, Homo sapiens
cauuuagguuucucuguau

SEQ ID NO: 1363568 - RNA, 19 nt, Homo sapiens
ugaugaaccuacauugaca

SEQ ID NO: 1363569 - RNA, 19 nt, Homo sapiens
gguugaagaucucuaugag

SEQ ID NO: 1363570 - RNA, 19 nt, Homo sapiens
gucgacggcauguucauua

SEQ ID NO: 1363571 - RNA, 19 nt, Homo sapiens
cauuugcaccuguggcuua

SEQ ID NO: 1363572 - RNA, 19 nt, Homo sapiens
uuggauugcccucuauuua

SEQ ID NO: 1363573 - RNA, 19 nt, Homo sapiens
guacauguuuguggagaag

SEQ ID NO: 1363574 - RNA, 19 nt, Homo sapiens
aggaagauuugcucagaga

SEQ ID NO: 1363575 - RNA, 19 nt, Homo sapiens
gcuuaucuuuggcagagaa

SEQ ID NO: 1363576 - RNA, 19 nt, Homo sapiens
acccaaaguccauaguuua

SEQ ID NO: 1363577 - RNA, 19 nt, Homo sapiens
uuaacuauguugaccuuag

SEQ ID NO: 1363578 - RNA, 19 nt, Homo sapiens
ucgacggcauguucauuaa

SEQ ID NO: 1363579 - RNA, 19 nt, Homo sapiens
guuaguggaaccauuuauu

SEQ ID NO: 1363580 - RNA, 19 nt, Homo sapiens
ucagaaguagucauacauu

SEQ ID NO: 1363581 - RNA, 19 nt, Homo sapiens
gaucaaauggagccuuauc

SEQ ID NO: 1363582 - RNA, 19 nt, Homo sapiens
ggaaguggaagaagagaaa

SEQ ID NO: 1363583 - RNA, 19 nt, Homo sapiens
cagaggaaguggaagaaga

SEQ ID NO: 1363584 - RNA, 19 nt, Homo sapiens
ggaagaagcccagggacaa

SEQ ID NO: 1363585 - RNA, 19 nt, Homo sapiens
gagaaagacagccaccaaa

SEQ ID NO: 1363586 - RNA, 19 nt, Homo sapiens
ccucugggcuuccaaguuc

SEQ ID NO: 1363587 - RNA, 19 nt, Homo sapiens
gcacucagccuggccucua

SEQ ID NO: 1363588 - RNA, 19 nt, Homo sapiens
ugccaggaaugcaccuuua

SEQ ID NO: 1363589 - RNA, 19 nt, Homo sapiens
ccagagagggcuugaaauc

SEQ ID NO: 1363590 - RNA, 19 nt, Homo sapiens
ggugcaaccugauguggau

SEQ ID NO: 1363591 - RNA, 19 nt, Homo sapiens
ucaaugaggccuucaccuu

SEQ ID NO: 1363592 - RNA, 19 nt, Homo sapiens
agagagggcuugaaaucca

SEQ ID NO: 1363593 - RNA, 19 nt, Homo sapiens
ucagccagguccagaaugu

SEQ ID NO: 1363594 - RNA, 19 nt, Homo sapiens
ucacgccgcugccucagau

SEQ ID NO: 1363595 - RNA, 19 nt, Homo sapiens
ggacacagacaugagacaa

SEQ ID NO: 1363596 - RNA, 19 nt, Homo sapiens
gggauaacccagccaagug

SEQ ID NO: 1363597 - RNA, 19 nt, Homo sapiens
caaaccagcaggguagaaa

SEQ ID NO: 1363598 - RNA, 19 nt, Homo sapiens
gcucugagguccggugaag

SEQ ID NO: 1363599 - RNA, 19 nt, Homo sapiens
gcgccaauguggaggaaca

SEQ ID NO: 1363600 - RNA, 19 nt, Homo sapiens
caggaccacugcaauaaac

SEQ ID NO: 1363601 - RNA, 19 nt, Homo sapiens
guccagagagggcuugaaa

SEQ ID NO: 1363602 - RNA, 19 nt, Homo sapiens
gaugggaccgcagagauga

SEQ ID NO: 1363603 - RNA, 19 nt, Homo sapiens
gacacagacaugagacaaa

SEQ ID NO: 1363604 - RNA, 19 nt, Homo sapiens
caagagggguguggggaua

SEQ ID NO: 1363605 - RNA, 19 nt, Homo sapiens
ccagcaggguagaaagaug

SEQ ID NO: 1363606 - RNA, 19 nt, Homo sapiens
cugcauggcuggcaaacca

SEQ ID NO: 1363607 - RNA, 19 nt, Homo sapiens
ggccugaugggcagcauuu

SEQ ID NO: 1363608 - RNA, 19 nt, Homo sapiens
gcagggcguugaggaccuu

SEQ ID NO: 1363609 - RNA, 19 nt, Homo sapiens
ccucaacagcugcuuauuc

SEQ ID NO: 1363610 - RNA, 19 nt, Homo sapiens
ccguggaucugcagcaugu

SEQ ID NO: 1363611 - RNA, 19 nt, Homo sapiens
gcucugaugaggcaugaug

SEQ ID NO: 1363612 - RNA, 19 nt, Homo sapiens
agaaggaggccaugcaaca

SEQ ID NO: 1363613 - RNA, 19 nt, Homo sapiens
gugugugucuggagucaug

SEQ ID NO: 1363614 - RNA, 19 nt, Homo sapiens
gaagaagcccagggacaag

SEQ ID NO: 1363615 - RNA, 19 nt, Homo sapiens
uugcagagcccuacgugaa

SEQ ID NO: 1363616 - RNA, 19 nt, Homo sapiens
acacagacaugagacaaaa

SEQ ID NO: 1363617 - RNA, 19 nt, Homo sapiens
gcagggagggagagagcuu

SEQ ID NO: 1363618 - RNA, 19 nt, Homo sapiens
gggcucugaugaggcauga

SEQ ID NO: 1363619 - RNA, 19 nt, Homo sapiens
caguguguguggaauguuc

SEQ ID NO: 1363620 - RNA, 19 nt, Homo sapiens
agagaaagacagccaccaa

SEQ ID NO: 1363621 - RNA, 19 nt, Homo sapiens
gguagaggcaaggaaguga

SEQ ID NO: 1363622 - RNA, 19 nt, Homo sapiens
gaaggaggccaugcaacag

SEQ ID NO: 1363623 - RNA, 19 nt, Homo sapiens
cggaaagacaggccugaug

SEQ ID NO: 1363624 - RNA, 19 nt, Homo sapiens
acagcggguucuugaggaa

SEQ ID NO: 1363625 - RNA, 19 nt, Homo sapiens
cagggaaagugggugaaca

SEQ ID NO: 1363626 - RNA, 19 nt, Homo sapiens
ccugugaguugugggauuc

SEQ ID NO: 1363627 - RNA, 19 nt, Homo sapiens
gcuauaccugggcuuauuc

SEQ ID NO: 1363628 - RNA, 19 nt, Homo sapiens
ugaaccagaggaaguggaa

SEQ ID NO: 1363629 - RNA, 19 nt, Homo sapiens
ugagaaggaggccaugcaa

SEQ ID NO: 1363630 - RNA, 19 nt, Homo sapiens
gggcugcagugaacaugcu

SEQ ID NO: 1363631 - RNA, 19 nt, Homo sapiens
gucaguguguguggaaugu

SEQ ID NO: 1363632 - RNA, 19 nt, Homo sapiens
cugcagaggugaggguauc

SEQ ID NO: 1363633 - RNA, 19 nt, Homo sapiens
agcuauaccugggcuuauu

SEQ ID NO: 1363634 - RNA, 19 nt, Homo sapiens
acagcuauaccugggcuua

SEQ ID NO: 1363635 - RNA, 19 nt, Homo sapiens
gccaccaccucaccuucau

SEQ ID NO: 1363636 - RNA, 19 nt, Homo sapiens
gcaaguaccugcagaagca

SEQ ID NO: 1363637 - RNA, 19 nt, Homo sapiens
ggaagaacagcccacauua

SEQ ID NO: 1363638 - RNA, 19 nt, Homo sapiens
gaagaacagcccacauuaa

SEQ ID NO: 1363639 - RNA, 19 nt, Homo sapiens
gagccaaucucaguuguug

SEQ ID NO: 1363640 - RNA, 19 nt, Homo sapiens
gaacagcccacauuaagag

SEQ ID NO: 1363641 - RNA, 19 nt, Homo sapiens
ugaagaugcugcugaacuu

SEQ ID NO: 1363642 - RNA, 19 nt, Homo sapiens
ggaggaaugucuugcuaag

SEQ ID NO: 1363643 - RNA, 19 nt, Homo sapiens
gaaaggagagacagcuuca

SEQ ID NO: 1363644 - RNA, 19 nt, Homo sapiens
aggaaugucuugcuaagga

SEQ ID NO: 1363645 - RNA, 19 nt, Homo sapiens
cgacagugaugugaagaug

SEQ ID NO: 1363646 - RNA, 19 nt, Homo sapiens
ccacccaucuucaaugucu

SEQ ID NO: 1363647 - RNA, 19 nt, Homo sapiens
agagagacgcaucuguuua

SEQ ID NO: 1363648 - RNA, 19 nt, Homo sapiens
ucaaguguuugguggaaga

SEQ ID NO: 1363649 - RNA, 19 nt, Homo sapiens
gaggaagagcccagccuuu

SEQ ID NO: 1363650 - RNA, 19 nt, Homo sapiens
gagagacgcaucuguuuac

SEQ ID NO: 1363651 - RNA, 19 nt, Homo sapiens
ucaaggcagcccuggauaa

SEQ ID NO: 1363652 - RNA, 19 nt, Homo sapiens
gaggcuuacuacuggcuaa

SEQ ID NO: 1363653 - RNA, 19 nt, Homo sapiens
gugacgaggccuaucagua

SEQ ID NO: 1363654 - RNA, 19 nt, Homo sapiens
gcucuaaaaugucuugaug

SEQ ID NO: 1363655 - RNA, 19 nt, Homo sapiens
gccgugggaucucaaggaa

SEQ ID NO: 1363656 - RNA, 19 nt, Homo sapiens
cauagguacugggauguug

SEQ ID NO: 1363657 - RNA, 19 nt, Homo sapiens
caagggcccuggcugaaaa

SEQ ID NO: 1363658 - RNA, 19 nt, Homo sapiens
uggaagaacagcccacauu

SEQ ID NO: 1363659 - RNA, 19 nt, Homo sapiens
ugacgaggccuaucaguac

SEQ ID NO: 1363660 - RNA, 19 nt, Homo sapiens
gccaaucucaguuguuguu

SEQ ID NO: 1363661 - RNA, 19 nt, Homo sapiens
gggaggaaugucuugcuaa

SEQ ID NO: 1363662 - RNA, 19 nt, Homo sapiens
aaucucaguuguuguucuu

SEQ ID NO: 1363663 - RNA, 19 nt, Homo sapiens
ggaguggagggcaggauug

SEQ ID NO: 1363664 - RNA, 19 nt, Homo sapiens
agacuacccugguguccau

SEQ ID NO: 1363665 - RNA, 19 nt, Homo sapiens
ggagagacagcuucaugag

SEQ ID NO: 1363666 - RNA, 19 nt, Homo sapiens
aagaacagcccacauuaag

SEQ ID NO: 1363667 - RNA, 19 nt, Homo sapiens
aguguggccucuuccguuu

SEQ ID NO: 1363668 - RNA, 19 nt, Homo sapiens
ccaagggcccuggcugaaa

SEQ ID NO: 1363669 - RNA, 19 nt, Homo sapiens
aggcagcccuggauaaguc

SEQ ID NO: 1363670 - RNA, 19 nt, Homo sapiens
gcgagccaaucucaguugu

SEQ ID NO: 1363671 - RNA, 19 nt, Homo sapiens
caucaaggcagcccuggau

SEQ ID NO: 1363672 - RNA, 19 nt, Homo sapiens
ccuacccucuucauggaaa

SEQ ID NO: 1363673 - RNA, 19 nt, Homo sapiens
agggaggaaugucuugcua

SEQ ID NO: 1363674 - RNA, 19 nt, Homo sapiens
cagcccacauuaagagcuu

SEQ ID NO: 1363675 - RNA, 19 nt, Homo sapiens
gcugagcccuaccugaaaa

SEQ ID NO: 1363676 - RNA, 19 nt, Homo sapiens
ggacgagcacagcaaagca

SEQ ID NO: 1363677 - RNA, 19 nt, Homo sapiens
acauuaagagcuuuggaaa

SEQ ID NO: 1363678 - RNA, 19 nt, Homo sapiens
ggagagugacgaggccuau

SEQ ID NO: 1363679 - RNA, 19 nt, Homo sapiens
gggaguggagggcaggauu

SEQ ID NO: 1363680 - RNA, 19 nt, Homo sapiens
ucaaacagacuuuucauuc

SEQ ID NO: 1363681 - RNA, 19 nt, Homo sapiens
cugcugagcccuaccugaa

SEQ ID NO: 1363682 - RNA, 19 nt, Homo sapiens
caaggcagcccuggauaag

SEQ ID NO: 1363683 - RNA, 19 nt, Homo sapiens
aaaggacgagcacagcaaa

SEQ ID NO: 1363684 - RNA, 19 nt, Homo sapiens
guucuucuuguucuuugua

SEQ ID NO: 1363685 - RNA, 19 nt, Homo sapiens
agaacagcccacauuaaga

SEQ ID NO: 1363686 - RNA, 19 nt, Homo sapiens
cacauuaagagcuuuggaa

SEQ ID NO: 1363687 - RNA, 19 nt, Homo sapiens
gaucuucuggagagaggaa

SEQ ID NO: 1363688 - RNA, 19 nt, Homo sapiens
gagcgggcagugcagaaug

SEQ ID NO: 1363689 - RNA, 19 nt, Homo sapiens
gccaggugcccaugaggaa

SEQ ID NO: 1363690 - RNA, 19 nt, Homo sapiens
ucucaguuguuguucuugu

SEQ ID NO: 1363691 - RNA, 19 nt, Homo sapiens
caaucucaguuguuguucu

SEQ ID NO: 1363692 - RNA, 19 nt, Homo sapiens
agucaaguguuugguggaa

SEQ ID NO: 1363693 - RNA, 19 nt, Homo sapiens
gacgaggccuaucaguacu

SEQ ID NO: 1363694 - RNA, 19 nt, Homo sapiens
cugaguggcucuaaaaugu

SEQ ID NO: 1363695 - RNA, 19 nt, Homo sapiens
aaggagagacagcuucaug

SEQ ID NO: 1363696 - RNA, 19 nt, Homo sapiens
gucaaugccuggaguugcu

SEQ ID NO: 1363697 - RNA, 19 nt, Homo sapiens
caaggcccacccacagcua

SEQ ID NO: 1363698 - RNA, 19 nt, Homo sapiens
gugaagaugcugcugaacu

SEQ ID NO: 1363699 - RNA, 19 nt, Homo sapiens
acagugaugugaagaugcu

SEQ ID NO: 1363700 - RNA, 19 nt, Homo sapiens
cagaaggccuggggagaaa

SEQ ID NO: 1363701 - RNA, 19 nt, Homo sapiens
cuacagggaggaaugucuu

SEQ ID NO: 1363702 - RNA, 19 nt, Homo sapiens
gcccuuagaagagagaaga

SEQ ID NO: 1363703 - RNA, 19 nt, Homo sapiens
uugaugcccuuagaagaga

SEQ ID NO: 1363704 - RNA, 19 nt, Homo sapiens
guucuuguucuucuuguuc

SEQ ID NO: 1363705 - RNA, 19 nt, Homo sapiens
uggcgcaccucugcaagga

SEQ ID NO: 1363706 - RNA, 19 nt, Homo sapiens
gaaacuagcugcugugaug

SEQ ID NO: 1363707 - RNA, 19 nt, Homo sapiens
gcagugaggugcuguauga

SEQ ID NO: 1363708 - RNA, 19 nt, Homo sapiens
caugauagcuaaugaauug

SEQ ID NO: 1363709 - RNA, 19 nt, Homo sapiens
gagacaagguuucaccaua

SEQ ID NO: 1363710 - RNA, 19 nt, Homo sapiens
gaaaccaccuccaucagau

SEQ ID NO: 1363711 - RNA, 19 nt, Homo sapiens
gcaccaagauggaagucaa

SEQ ID NO: 1363712 - RNA, 19 nt, Homo sapiens
gcugagcgcucguuuaagu

SEQ ID NO: 1363713 - RNA, 19 nt, Homo sapiens
gaaggggauuuguauaaua

SEQ ID NO: 1363714 - RNA, 19 nt, Homo sapiens
ccauuuauguuuacaguug

SEQ ID NO: 1363715 - RNA, 19 nt, Homo sapiens
uaagugaccugacgcuaga

SEQ ID NO: 1363716 - RNA, 19 nt, Homo sapiens
ggacguaguucugcacuca

SEQ ID NO: 1363717 - RNA, 19 nt, Homo sapiens
gacaagguuucaccauauu

SEQ ID NO: 1363718 - RNA, 19 nt, Homo sapiens
ugacuuagguauucacugu

SEQ ID NO: 1363719 - RNA, 19 nt, Homo sapiens
uagcagcaauucuuuauca

SEQ ID NO: 1363720 - RNA, 19 nt, Homo sapiens
agacaagguuucaccauau

SEQ ID NO: 1363721 - RNA, 19 nt, Homo sapiens
gcacaugaccugcauuagu

SEQ ID NO: 1363722 - RNA, 19 nt, Homo sapiens
cuaaugaauuggaccauga

SEQ ID NO: 1363723 - RNA, 19 nt, Homo sapiens
gaucuggacccaagacauu

SEQ ID NO: 1363724 - RNA, 19 nt, Homo sapiens
ggaaaccaccuccaucaga

SEQ ID NO: 1363725 - RNA, 19 nt, Homo sapiens
gcccugaggugcauccaaa

SEQ ID NO: 1363726 - RNA, 19 nt, Homo sapiens
gggaaacugugaucucauc

SEQ ID NO: 1363727 - RNA, 19 nt, Homo sapiens
gcagagugcgccaaccuaa

SEQ ID NO: 1363728 - RNA, 19 nt, Homo sapiens
uaaggcagauggcgaagau

SEQ ID NO: 1363729 - RNA, 19 nt, Homo sapiens
gagacuuccucuuggacua

SEQ ID NO: 1363730 - RNA, 19 nt, Homo sapiens
gcugugcucucacucaaug

SEQ ID NO: 1363731 - RNA, 19 nt, Homo sapiens
cagcaauucuuuaucaagu

SEQ ID NO: 1363732 - RNA, 19 nt, Homo sapiens
uguguaaacugaacccaaa

SEQ ID NO: 1363733 - RNA, 19 nt, Homo sapiens
ucugauaugucccuuguug

SEQ ID NO: 1363734 - RNA, 19 nt, Homo sapiens
cacaugaccugcauuaguc

SEQ ID NO: 1363735 - RNA, 19 nt, Homo sapiens
cgaagggaaccaagacuuu

SEQ ID NO: 1363736 - RNA, 19 nt, Homo sapiens
uaugauaccugucugugau

SEQ ID NO: 1363737 - RNA, 19 nt, Homo sapiens
caaguuguguuuucuauga

SEQ ID NO: 1363738 - RNA, 19 nt, Homo sapiens
ccaaagugcugggauuaca

SEQ ID NO: 1363739 - RNA, 19 nt, Homo sapiens
gaagggaaccaagacuuug

SEQ ID NO: 1363740 - RNA, 19 nt, Homo sapiens
gggaguggcuagucaugau

SEQ ID NO: 1363741 - RNA, 19 nt, Homo sapiens
gagcaguccuccaguucug

SEQ ID NO: 1363742 - RNA, 19 nt, Homo sapiens
guuauaggcugaagaugag

SEQ ID NO: 1363743 - RNA, 19 nt, Homo sapiens
gcccugagccugaaacuuc

SEQ ID NO: 1363744 - RNA, 19 nt, Homo sapiens
gaacgcaguggccacaaga

SEQ ID NO: 1363745 - RNA, 19 nt, Homo sapiens
uguuuacaguugugacuua

SEQ ID NO: 1363746 - RNA, 19 nt, Homo sapiens
ccaccuccaucagaucuuu

SEQ ID NO: 1363747 - RNA, 19 nt, Homo sapiens
gacauuacccacacuggaa

SEQ ID NO: 1363748 - RNA, 19 nt, Homo sapiens
gcaagacucguggcuguga

SEQ ID NO: 1363749 - RNA, 19 nt, Homo sapiens
cuuccuccauuuauguuua

SEQ ID NO: 1363750 - RNA, 19 nt, Homo sapiens
gguagcagcaauucuuuau

SEQ ID NO: 1363751 - RNA, 19 nt, Homo sapiens
ugaauuggaccaugaggaa

SEQ ID NO: 1363752 - RNA, 19 nt, Homo sapiens
ggaguggcuagucaugaua

SEQ ID NO: 1363753 - RNA, 19 nt, Homo sapiens
aagcaaacccacacaaguu

SEQ ID NO: 1363754 - RNA, 19 nt, Homo sapiens
ccgaguagcugggauuaca

SEQ ID NO: 1363755 - RNA, 19 nt, Homo sapiens
caaacccucugcuguggau

SEQ ID NO: 1363756 - RNA, 19 nt, Homo sapiens
acugugaucucaucugguu

SEQ ID NO: 1363757 - RNA, 19 nt, Homo sapiens
caaguuauaggcugaagau

SEQ ID NO: 1363758 - RNA, 19 nt, Homo sapiens
gaggaagggacaucucaug

SEQ ID NO: 1363759 - RNA, 19 nt, Homo sapiens
caagauggaagucaaaggu

SEQ ID NO: 1363760 - RNA, 19 nt, Homo sapiens
ggaaggggauuuguauaau

SEQ ID NO: 1363761 - RNA, 19 nt, Homo sapiens
gcacagggucacucuacug

SEQ ID NO: 1363762 - RNA, 19 nt, Homo sapiens
gcccucagcuagcuuaaaa

SEQ ID NO: 1363763 - RNA, 19 nt, Homo sapiens
ugauaccugucugugauuu

SEQ ID NO: 1363764 - RNA, 19 nt, Homo sapiens
uaagcaaacccacacaagu

SEQ ID NO: 1363765 - RNA, 19 nt, Homo sapiens
aagggaaacugugaucuca

SEQ ID NO: 1363766 - RNA, 19 nt, Homo sapiens
uaacgagccucuuuuccuu

SEQ ID NO: 1363767 - RNA, 19 nt, Homo sapiens
guggagacuuccucuugga

SEQ ID NO: 1363768 - RNA, 19 nt, Homo sapiens
gcacugguagcagcaauuc

SEQ ID NO: 1363769 - RNA, 19 nt, Homo sapiens
gaauuggaccaugaggaaa

SEQ ID NO: 1363770 - RNA, 19 nt, Homo sapiens
gcgaagggaaccaagacuu

SEQ ID NO: 1363771 - RNA, 19 nt, Homo sapiens
gguagaugccagugaaauc

SEQ ID NO: 1363772 - RNA, 19 nt, Homo sapiens
gguagaugccagugaaauc

SEQ ID NO: 1363773 - RNA, 19 nt, Homo sapiens
agucaaaggucagcugauc

SEQ ID NO: 1363774 - RNA, 19 nt, Homo sapiens
gcagcaauucuuuaucaag

SEQ ID NO: 1363775 - RNA, 19 nt, Homo sapiens
cagccaagaggacguaguu

SEQ ID NO: 1363776 - RNA, 19 nt, Homo sapiens
gaaacugugaucucaucug

SEQ ID NO: 1363777 - RNA, 19 nt, Homo sapiens
cgacagcaccaagauggaa

SEQ ID NO: 1363778 - RNA, 19 nt, Homo sapiens
uuacaguugugacuuaggu

SEQ ID NO: 1363779 - RNA, 19 nt, Homo sapiens
cuucugauaugucccuugu

SEQ ID NO: 1363780 - RNA, 19 nt, Homo sapiens
gcgccaaccuaaucuucca

SEQ ID NO: 1363781 - RNA, 19 nt, Homo sapiens
gggaggaagggacaucuca

SEQ ID NO: 1363782 - RNA, 19 nt, Homo sapiens
aguuauaggcugaagauga

SEQ ID NO: 1363783 - RNA, 19 nt, Homo sapiens
ccaagaggacguaguucug

SEQ ID NO: 1363784 - RNA, 19 nt, Homo sapiens
caggagcuccgcaaagugu

SEQ ID NO: 1363785 - RNA, 19 nt, Homo sapiens
guguggagacuuccucuug

SEQ ID NO: 1363786 - RNA, 19 nt, Homo sapiens
cccgguagaugccagugaa

SEQ ID NO: 1363787 - RNA, 19 nt, Homo sapiens
cccgguagaugccagugaa

SEQ ID NO: 1363788 - RNA, 19 nt, Homo sapiens
cgaaggcccugaggugcau

SEQ ID NO: 1363789 - RNA, 19 nt, Homo sapiens
ucacaccuuccuuggcuuu

SEQ ID NO: 1363790 - RNA, 19 nt, Homo sapiens
agacuccggugugaacaga

SEQ ID NO: 1363791 - RNA, 19 nt, Homo sapiens
cuacgcggacuuccuguau

SEQ ID NO: 1363792 - RNA, 19 nt, Homo sapiens
gcucagccaagaggacgua

SEQ ID NO: 1363793 - RNA, 19 nt, Homo sapiens
uugcucagcucagccaaga

SEQ ID NO: 1363794 - RNA, 19 nt, Homo sapiens
ugagcgcucguuuaaguga

SEQ ID NO: 1363795 - RNA, 19 nt, Homo sapiens
ugaacgcaguggccacaag

SEQ ID NO: 1363796 - RNA, 19 nt, Homo sapiens
gaggaggcugcaugagcua

SEQ ID NO: 1363797 - RNA, 19 nt, Homo sapiens
aggcuggucuugaacucuu

SEQ ID NO: 1363798 - RNA, 19 nt, Homo sapiens
cuuaguagagacaagguuu

SEQ ID NO: 1363799 - RNA, 19 nt, Homo sapiens
acuccggugugaacagaaa

SEQ ID NO: 1363800 - RNA, 19 nt, Homo sapiens
agagugcgccaaccuaauc

SEQ ID NO: 1363801 - RNA, 19 nt, Homo sapiens
gggcacugguagcagcaau

SEQ ID NO: 1363802 - RNA, 19 nt, Homo sapiens
gacuuccucuuggacuauu

SEQ ID NO: 1363803 - RNA, 19 nt, Homo sapiens
ggccuggucgagacaacua

SEQ ID NO: 1363804 - RNA, 19 nt, Homo sapiens
ggaggcugcaugagcuaga

SEQ ID NO: 1363805 - RNA, 19 nt, Homo sapiens
cagcucuccuaccuucaau

SEQ ID NO: 1363806 - RNA, 19 nt, Homo sapiens
gaucucagguccagcagaa

SEQ ID NO: 1363807 - RNA, 19 nt, Homo sapiens
gaagaugccuccucugacu

SEQ ID NO: 1363808 - RNA, 19 nt, Homo sapiens
ggaaaacaauucaucgaaa

SEQ ID NO: 1363809 - RNA, 19 nt, Homo sapiens
gaaugaaauuuaccacucu

SEQ ID NO: 1363810 - RNA, 19 nt, Homo sapiens
ccucuaagccuaaugaaga

SEQ ID NO: 1363811 - RNA, 19 nt, Homo sapiens
caacagcccaggagacuuc

SEQ ID NO: 1363812 - RNA, 19 nt, Homo sapiens
ggaccucuaagccuaauga

SEQ ID NO: 1363813 - RNA, 19 nt, Homo sapiens
cauuggacuuaaagccuua

SEQ ID NO: 1363814 - RNA, 19 nt, Homo sapiens
caagcaggcaggaacuaaa

SEQ ID NO: 1363815 - RNA, 19 nt, Homo sapiens
ugggaucauuggacuuaaa

SEQ ID NO: 1363816 - RNA, 19 nt, Homo sapiens
uuaccacucuccucuucuu

SEQ ID NO: 1363817 - RNA, 19 nt, Homo sapiens
cccaaagaaugaaauuuac

SEQ ID NO: 1363818 - RNA, 19 nt, Homo sapiens
agccuuaaauacccuugua

SEQ ID NO: 1363819 - RNA, 19 nt, Homo sapiens
cugaagaugccuccucuga

SEQ ID NO: 1363820 - RNA, 19 nt, Homo sapiens
ucacuccucaucccaaaga

SEQ ID NO: 1363821 - RNA, 19 nt, Homo sapiens
ucaagcaggcaggaacuaa

SEQ ID NO: 1363822 - RNA, 19 nt, Homo sapiens
caucgaaaauggaagugaa

SEQ ID NO: 1363823 - RNA, 19 nt, Homo sapiens
gcaaaagcaggaaaaggaa

SEQ ID NO: 1363824 - RNA, 19 nt, Homo sapiens
ccuggucuaugcugaagau

SEQ ID NO: 1363825 - RNA, 19 nt, Homo sapiens
acucacuccucaucccaaa

SEQ ID NO: 1363826 - RNA, 19 nt, Homo sapiens
guaucuuacuaacagaaca

SEQ ID NO: 1363827 - RNA, 19 nt, Homo sapiens
guuauacucacuccucauc

SEQ ID NO: 1363828 - RNA, 19 nt, Homo sapiens
caucccaaagaaugaaauu

SEQ ID NO: 1363829 - RNA, 19 nt, Homo sapiens
caugagaagcugaaaagaa

SEQ ID NO: 1363830 - RNA, 19 nt, Homo sapiens
gagcauagcuacauacaaa

SEQ ID NO: 1363831 - RNA, 19 nt, Homo sapiens
gagcagacuuugaucauua

SEQ ID NO: 1363832 - RNA, 19 nt, Homo sapiens
gaacagaccaauuaacaua

SEQ ID NO: 1363833 - RNA, 19 nt, Homo sapiens
gaaaauagcugaacuggaa

SEQ ID NO: 1363834 - RNA, 19 nt, Homo sapiens
ccaaagaacagaccaauua

SEQ ID NO: 1363835 - RNA, 19 nt, Homo sapiens
caacugaacuuaugaagga

SEQ ID NO: 1363836 - RNA, 19 nt, Homo sapiens
aaauauagcucaaggcaua

SEQ ID NO: 1363837 - RNA, 19 nt, Homo sapiens
gugaugaccugauggauua

SEQ ID NO: 1363838 - RNA, 19 nt, Homo sapiens
gaagcaagcaguucucuua

SEQ ID NO: 1363839 - RNA, 19 nt, Homo sapiens
cuaaacagguuacagaaua

SEQ ID NO: 1363840 - RNA, 19 nt, Homo sapiens
gcaagcaguucucuuauga

SEQ ID NO: 1363841 - RNA, 19 nt, Homo sapiens
gauuagaagugucccuuua

SEQ ID NO: 1363842 - RNA, 19 nt, Homo sapiens
gguguaagcuacuauauau

SEQ ID NO: 1363843 - RNA, 19 nt, Homo sapiens
gaaggaagacuuugauuug

SEQ ID NO: 1363844 - RNA, 19 nt, Homo sapiens
gaagaagucuauuaugauc

SEQ ID NO: 1363845 - RNA, 19 nt, Homo sapiens
ggaguuggcugcaauggaa

SEQ ID NO: 1363846 - RNA, 19 nt, Homo sapiens
gaacuucucuuguggaucu

SEQ ID NO: 1363847 - RNA, 19 nt, Homo sapiens
ggaagagcauagcuacaua

SEQ ID NO: 1363848 - RNA, 19 nt, Homo sapiens
gcauugacauuauugguaa

SEQ ID NO: 1363849 - RNA, 19 nt, Homo sapiens
gaagaaacccggauaguca

SEQ ID NO: 1363850 - RNA, 19 nt, Homo sapiens
ccaauugcaugauguagua

SEQ ID NO: 1363851 - RNA, 19 nt, Homo sapiens
gaaauugacuuugcagugu

SEQ ID NO: 1363852 - RNA, 19 nt, Homo sapiens
gaagcaggcucaugcagaa

SEQ ID NO: 1363853 - RNA, 19 nt, Homo sapiens
acucagaacuccuuucaua

SEQ ID NO: 1363854 - RNA, 19 nt, Homo sapiens
gaacaaaacuuggggaaaa

SEQ ID NO: 1363855 - RNA, 19 nt, Homo sapiens
gagaauaucugguguuagg

SEQ ID NO: 1363856 - RNA, 19 nt, Homo sapiens
gagcugaccugacuucugu

SEQ ID NO: 1363857 - RNA, 19 nt, Homo sapiens
ugaaacaacugaacuuaug

SEQ ID NO: 1363858 - RNA, 19 nt, Homo sapiens
gagaagaccugccgaggau

SEQ ID NO: 1363859 - RNA, 19 nt, Homo sapiens
gcaaaugaauagauguaga

SEQ ID NO: 1363860 - RNA, 19 nt, Homo sapiens
ccaaagagcugaccugacu

SEQ ID NO: 1363861 - RNA, 19 nt, Homo sapiens
ggaaggaagacuuugauuu

SEQ ID NO: 1363862 - RNA, 19 nt, Homo sapiens
ggaggaugcucagagguua

SEQ ID NO: 1363863 - RNA, 19 nt, Homo sapiens
gaaacucucugggcaauuc

SEQ ID NO: 1363864 - RNA, 19 nt, Homo sapiens
gcaacuggaugacacaaga

SEQ ID NO: 1363865 - RNA, 19 nt, Homo sapiens
ugaaugugcucuuuccuaa

SEQ ID NO: 1363866 - RNA, 19 nt, Homo sapiens
gaagaaauggagagacuuu

SEQ ID NO: 1363867 - RNA, 19 nt, Homo sapiens
gcaguucucuuaugaugga

SEQ ID NO: 1363868 - RNA, 19 nt, Homo sapiens
uaagaguccuaauccguua

SEQ ID NO: 1363869 - RNA, 19 nt, Homo sapiens
agacauaaaugaucagaug

SEQ ID NO: 1363870 - RNA, 19 nt, Homo sapiens
uaacugcucccucaacaua

SEQ ID NO: 1363871 - RNA, 19 nt, Homo sapiens
gacaugauuucacauuuga

SEQ ID NO: 1363872 - RNA, 19 nt, Homo sapiens
gacagaaucuauuauaugg

SEQ ID NO: 1363873 - RNA, 19 nt, Homo sapiens
caaggaugcugaccuguug

SEQ ID NO: 1363874 - RNA, 19 nt, Homo sapiens
gcaagucucuuuuauaaug

SEQ ID NO: 1363875 - RNA, 19 nt, Homo sapiens
uaaaugaucagauggauga

SEQ ID NO: 1363876 - RNA, 19 nt, Homo sapiens
gaacggaaaagcaguauua

SEQ ID NO: 1363877 - RNA, 19 nt, Homo sapiens
uuacaagaaugaagccaua

SEQ ID NO: 1363878 - RNA, 19 nt, Homo sapiens
gauauggaaugugcucuuu

SEQ ID NO: 1363879 - RNA, 19 nt, Homo sapiens
caacagauccaucccuuga

SEQ ID NO: 1363880 - RNA, 19 nt, Homo sapiens
ugaaucaaaugucuacuug

SEQ ID NO: 1363881 - RNA, 19 nt, Homo sapiens
ggagaaucuuuguaauuug

SEQ ID NO: 1363882 - RNA, 19 nt, Homo sapiens
ggacaaacccgagucauuc

SEQ ID NO: 1363883 - RNA, 19 nt, Homo sapiens
ugacaugauuucacauuug

SEQ ID NO: 1363884 - RNA, 19 nt, Homo sapiens
agacggcaauaaucucuua

SEQ ID NO: 1363885 - RNA, 19 nt, Homo sapiens
aaagaaggccucuaucuga

SEQ ID NO: 1363886 - RNA, 19 nt, Homo sapiens
caaguuaacuagacacaag

SEQ ID NO: 1363887 - RNA, 19 nt, Homo sapiens
aagagaauaucugguguua

SEQ ID NO: 1363888 - RNA, 19 nt, Homo sapiens
ccagcaagauuauggaaga

SEQ ID NO: 1363889 - RNA, 19 nt, Homo sapiens
gaauaucuguauguacuug

SEQ ID NO: 1363890 - RNA, 19 nt, Homo sapiens
caagaaugcuaauaagagu

SEQ ID NO: 1363891 - RNA, 19 nt, Homo sapiens
gcacagcaucugaaucaaa

SEQ ID NO: 1363892 - RNA, 19 nt, Homo sapiens
agacaagcaugaaacuaaa

SEQ ID NO: 1363893 - RNA, 19 nt, Homo sapiens
ugacaccuguuaccaugua

SEQ ID NO: 1363894 - RNA, 19 nt, Homo sapiens
cuaaguauccuaccaaaga

SEQ ID NO: 1363895 - RNA, 19 nt, Homo sapiens
cagagaagccucccuauuc

SEQ ID NO: 1363896 - RNA, 19 nt, Homo sapiens
gcuaagauuuuguugguua

SEQ ID NO: 1363897 - RNA, 19 nt, Homo sapiens
caagugccauuuauucuag

SEQ ID NO: 1363898 - RNA, 19 nt, Homo sapiens
caaagaacagaccaauuaa

SEQ ID NO: 1363899 - RNA, 19 nt, Homo sapiens
gaauaaaggcaaccaguag

SEQ ID NO: 1363900 - RNA, 19 nt, Homo sapiens
aggcagaaguuaauagaaa

SEQ ID NO: 1363901 - RNA, 19 nt, Homo sapiens
gagaaucuuuguaauuugg

SEQ ID NO: 1363902 - RNA, 19 nt, Homo sapiens
ugaaguugcugaauaucaa

SEQ ID NO: 1363903 - RNA, 19 nt, Homo sapiens
gacaaugacaauuaccuua

SEQ ID NO: 1363904 - RNA, 19 nt, Homo sapiens
gaacugcauuucguauugu

SEQ ID NO: 1363905 - RNA, 19 nt, Homo sapiens
ugaacugcauuucguauug

SEQ ID NO: 1363906 - RNA, 19 nt, Homo sapiens
cagacaagcaugaaacuaa

SEQ ID NO: 1363907 - RNA, 19 nt, Homo sapiens
gcauaaagaaggccucuau

SEQ ID NO: 1363908 - RNA, 19 nt, Homo sapiens
gagcagugccagcuucuuu

SEQ ID NO: 1363909 - RNA, 19 nt, Homo sapiens
gaagugucccuuuauuaga

SEQ ID NO: 1363910 - RNA, 19 nt, Homo sapiens
caaaugcccaggaaauuga

SEQ ID NO: 1363911 - RNA, 19 nt, Homo sapiens
aagcgaacauucucuuauu

SEQ ID NO: 1363912 - RNA, 19 nt, Homo sapiens
gcgugaaguugcugaauau

SEQ ID NO: 1363913 - RNA, 19 nt, Homo sapiens
acagagaucucaggaguug

SEQ ID NO: 1363914 - RNA, 19 nt, Homo sapiens
caccaggaaugaugaacua

SEQ ID NO: 1363915 - RNA, 19 nt, Homo sapiens
gcauaaaucgcaugacaau

SEQ ID NO: 1363916 - RNA, 19 nt, Homo sapiens
gaacuccuuucauaucaag

SEQ ID NO: 1363917 - RNA, 19 nt, Homo sapiens
gaaacaacugaacuuauga

SEQ ID NO: 1363918 - RNA, 19 nt, Homo sapiens
ucagagaguuggauaugga

SEQ ID NO: 1363919 - RNA, 19 nt, Homo sapiens
uaaagccaauggagacuau

SEQ ID NO: 1363920 - RNA, 19 nt, Homo sapiens
uagaagugucccuuuauua

SEQ ID NO: 1363921 - RNA, 19 nt, Homo sapiens
caaaaugggugggaaaauu

SEQ ID NO: 1363922 - RNA, 19 nt, Homo sapiens
ggauagucauucugaacaa

SEQ ID NO: 1363923 - RNA, 19 nt, Homo sapiens
caugagcccugacacaaga

SEQ ID NO: 1363924 - RNA, 19 nt, Homo sapiens
aaacuaaacagguuacaga

SEQ ID NO: 1363925 - RNA, 19 nt, Homo sapiens
cagaacuccuuucauauca

SEQ ID NO: 1363926 - RNA, 19 nt, Homo sapiens
agagagagcaagaucauuu

SEQ ID NO: 1363927 - RNA, 19 nt, Homo sapiens
caugagagccgucuagaug

SEQ ID NO: 1363928 - RNA, 19 nt, Homo sapiens
aaacauggcaaaugaauag

SEQ ID NO: 1363929 - RNA, 19 nt, Homo sapiens
cgaacauucucuuauuaug

SEQ ID NO: 1363930 - RNA, 19 nt, Homo sapiens
ccucuaaccucuuuccuua

SEQ ID NO: 1363931 - RNA, 19 nt, Homo sapiens
ggaagaggauauaguggaa

SEQ ID NO: 1363932 - RNA, 19 nt, Homo sapiens
gaagagagaauaguugaaa

SEQ ID NO: 1363933 - RNA, 19 nt, Homo sapiens
gcagaucgcuguggagaau

SEQ ID NO: 1363934 - RNA, 19 nt, Homo sapiens
gaagagcugggcuuuguuu

SEQ ID NO: 1363935 - RNA, 19 nt, Homo sapiens
caacgaguuugauacaguu

SEQ ID NO: 1363936 - RNA, 19 nt, Homo sapiens
ccucuuuccuuacuccuua

SEQ ID NO: 1363937 - RNA, 19 nt, Homo sapiens
gcaaguggaagagagaaua

SEQ ID NO: 1363938 - RNA, 19 nt, Homo sapiens
ggucaggaauggugagaug

SEQ ID NO: 1363939 - RNA, 19 nt, Homo sapiens
ggagcuagaugagguggaa

SEQ ID NO: 1363940 - RNA, 19 nt, Homo sapiens
gcagaccuguggacugguu

SEQ ID NO: 1363941 - RNA, 19 nt, Homo sapiens
uagaugagguggaagacuu

SEQ ID NO: 1363942 - RNA, 19 nt, Homo sapiens
gagaauaguugaaaaugug

SEQ ID NO: 1363943 - RNA, 19 nt, Homo sapiens
gcagcaguacucagugaua

SEQ ID NO: 1363944 - RNA, 19 nt, Homo sapiens
uaagacagcuagagagacu

SEQ ID NO: 1363945 - RNA, 19 nt, Homo sapiens
gcccuuauuugcuguucua

SEQ ID NO: 1363946 - RNA, 19 nt, Homo sapiens
cagcagcaguacucaguga

SEQ ID NO: 1363947 - RNA, 19 nt, Homo sapiens
ccaacgaguuugauacagu

SEQ ID NO: 1363948 - RNA, 19 nt, Homo sapiens
uggaagagcugggcuuugu

SEQ ID NO: 1363949 - RNA, 19 nt, Homo sapiens
gggugaggcuuaagaucuu

SEQ ID NO: 1363950 - RNA, 19 nt, Homo sapiens
uaaggaagaggauauagug

SEQ ID NO: 1363951 - RNA, 19 nt, Homo sapiens
ggucacagcuacgaaugau

SEQ ID NO: 1363952 - RNA, 19 nt, Homo sapiens
ucacagccacugcacuuaa

SEQ ID NO: 1363953 - RNA, 19 nt, Homo sapiens
aagaugauguggacagugu

SEQ ID NO: 1363954 - RNA, 19 nt, Homo sapiens
uagagagacugaugaggau

SEQ ID NO: 1363955 - RNA, 19 nt, Homo sapiens
gagagacugaugaggauga

SEQ ID NO: 1363956 - RNA, 19 nt, Homo sapiens
aagaggauauaguggaaga

SEQ ID NO: 1363957 - RNA, 19 nt, Homo sapiens
ggaagagagaauaguugaa

SEQ ID NO: 1363958 - RNA, 19 nt, Homo sapiens
ggucacagccacugcacuu

SEQ ID NO: 1363959 - RNA, 19 nt, Homo sapiens
ugucuccucuaaccucuuu

SEQ ID NO: 1363960 - RNA, 19 nt, Homo sapiens
ccagacgcucagacuauua

SEQ ID NO: 1363961 - RNA, 19 nt, Homo sapiens
acagugggcagguggauuu

SEQ ID NO: 1363962 - RNA, 19 nt, Homo sapiens
uuaguuaacauccgaguga

SEQ ID NO: 1363963 - RNA, 19 nt, Homo sapiens
ggacaguguggaagagaug

SEQ ID NO: 1363964 - RNA, 19 nt, Homo sapiens
cagcaguacucagugauag

SEQ ID NO: 1363965 - RNA, 19 nt, Homo sapiens
gauccagacgcucagacua

SEQ ID NO: 1363966 - RNA, 19 nt, Homo sapiens
gaacaugcaaguggaagag

SEQ ID NO: 1363967 - RNA, 19 nt, Homo sapiens
ggaauggugagaugaacau

SEQ ID NO: 1363968 - RNA, 19 nt, Homo sapiens
cagacgcucagacuauuaa

SEQ ID NO: 1363969 - RNA, 19 nt, Homo sapiens
gagauggaggucacagcua

SEQ ID NO: 1363970 - RNA, 19 nt, Homo sapiens
ugaugaggaugaagaugau

SEQ ID NO: 1363971 - RNA, 19 nt, Homo sapiens
gaccaacgaguuugauaca

SEQ ID NO: 1363972 - RNA, 19 nt, Homo sapiens
ggggugcaguggaggauua

SEQ ID NO: 1363973 - RNA, 19 nt, Homo sapiens
gaugauuggaaauggcuuu

SEQ ID NO: 1363974 - RNA, 19 nt, Homo sapiens
gaggauauaguggaagaug

SEQ ID NO: 1363975 - RNA, 19 nt, Homo sapiens
ggaggucacagcuacgaau

SEQ ID NO: 1363976 - RNA, 19 nt, Homo sapiens
gaagccggguuccccagua

SEQ ID NO: 1363977 - RNA, 19 nt, Homo sapiens
caugcgcaaugcugacuug

SEQ ID NO: 1363978 - RNA, 19 nt, Homo sapiens
ggaagagcugggcuuuguu

SEQ ID NO: 1363979 - RNA, 19 nt, Homo sapiens
gggcugcucugagggagau

SEQ ID NO: 1363980 - RNA, 19 nt, Homo sapiens
cgaguuugauacaguugug

SEQ ID NO: 1363981 - RNA, 19 nt, Homo sapiens
gccagcaacugcagaccau

SEQ ID NO: 1363982 - RNA, 19 nt, Homo sapiens
guucuaagaguugucugua

SEQ ID NO: 1363983 - RNA, 19 nt, Homo sapiens
gaugaacaugcaaguggaa

SEQ ID NO: 1363984 - RNA, 19 nt, Homo sapiens
aguggaggauuacuucaug

SEQ ID NO: 1363985 - RNA, 19 nt, Homo sapiens
cugaugaggaugaagauga

SEQ ID NO: 1363986 - RNA, 19 nt, Homo sapiens
agacugaugaggaugaaga

SEQ ID NO: 1363987 - RNA, 19 nt, Homo sapiens
gcacuuaagacagcuagag

SEQ ID NO: 1363988 - RNA, 19 nt, Homo sapiens
uggaagagagaauaguuga

SEQ ID NO: 1363989 - RNA, 19 nt, Homo sapiens
gugcggucauugugaggaa

SEQ ID NO: 1363990 - RNA, 19 nt, Homo sapiens
aaauggcuuugggcccuua

SEQ ID NO: 1363991 - RNA, 19 nt, Homo sapiens
gaccauguuccaccacuuc

SEQ ID NO: 1363992 - RNA, 19 nt, Homo sapiens
cuuaucccaucccauuuga

SEQ ID NO: 1363993 - RNA, 19 nt, Homo sapiens
cuuggaaccucccaggaau

SEQ ID NO: 1363994 - RNA, 19 nt, Homo sapiens
ucaggaauggugagaugaa

SEQ ID NO: 1363995 - RNA, 19 nt, Homo sapiens
uugauacaguuguggaaga

SEQ ID NO: 1363996 - RNA, 19 nt, Homo sapiens
ucuaaccucuuuccuuacu

SEQ ID NO: 1363997 - RNA, 19 nt, Homo sapiens
uccagacgcucagacuauu

SEQ ID NO: 1363998 - RNA, 19 nt, Homo sapiens
cagcuagagagacugauga

SEQ ID NO: 1363999 - RNA, 19 nt, Homo sapiens
caaguggaagagagaauag

SEQ ID NO: 1364000 - RNA, 19 nt, Homo sapiens
gccaggagaaggccaagug

SEQ ID NO: 1364001 - RNA, 19 nt, Homo sapiens
ugaagaugauguggacagu

SEQ ID NO: 1364002 - RNA, 19 nt, Homo sapiens
gagcugggcuuuguuuucu

SEQ ID NO: 1364003 - RNA, 19 nt, Homo sapiens
gcuagguggugagcuugga

SEQ ID NO: 1364004 - RNA, 19 nt, Homo sapiens
guggaagagagaauaguug

SEQ ID NO: 1364005 - RNA, 19 nt, Homo sapiens
cucagacuauuaaggaaga

SEQ ID NO: 1364006 - RNA, 19 nt, Homo sapiens
gaguggggaugauuggaaa

SEQ ID NO: 1364007 - RNA, 19 nt, Homo sapiens
gaggucacagcuacgaaug

SEQ ID NO: 1364008 - RNA, 19 nt, Homo sapiens
cacagccacugcacuuaag

SEQ ID NO: 1364009 - RNA, 19 nt, Homo sapiens
agacagcuagagagacuga

SEQ ID NO: 1364010 - RNA, 19 nt, Homo sapiens
cuuaagacagcuagagaga

SEQ ID NO: 1364011 - RNA, 19 nt, Homo sapiens
gcaacugcagaccauguuc

SEQ ID NO: 1364012 - RNA, 19 nt, Homo sapiens
uauuugcuguucuaagagu

SEQ ID NO: 1364013 - RNA, 19 nt, Homo sapiens
uggcuuugggcccuuauuu

SEQ ID NO: 1364014 - RNA, 19 nt, Homo sapiens
cuauuaaggaagaggauau

SEQ ID NO: 1364015 - RNA, 19 nt, Homo sapiens
ggagacaacuguaaacuaa

SEQ ID NO: 1364016 - RNA, 19 nt, Homo sapiens
gagaaaugguucaucuuua

SEQ ID NO: 1364017 - RNA, 19 nt, Homo sapiens
gaauguaucugcaauuauc

SEQ ID NO: 1364018 - RNA, 19 nt, Homo sapiens
gggaauguaucugcaauua

SEQ ID NO: 1364019 - RNA, 19 nt, Homo sapiens
ggaaguggaacaaagauua

SEQ ID NO: 1364020 - RNA, 19 nt, Homo sapiens
gaagaaugcacauagauaa

SEQ ID NO: 1364021 - RNA, 19 nt, Homo sapiens
gaaacuggaucgauauuca

SEQ ID NO: 1364022 - RNA, 19 nt, Homo sapiens
gcaaagauaucacugacau

SEQ ID NO: 1364023 - RNA, 19 nt, Homo sapiens
agggaaagcuuauguagua

SEQ ID NO: 1364024 - RNA, 19 nt, Homo sapiens
caacuugacuucacuuuua

SEQ ID NO: 1364025 - RNA, 19 nt, Homo sapiens
gcagaacugugccaucauu

SEQ ID NO: 1364026 - RNA, 19 nt, Homo sapiens
gcagauaccauaagacauu

SEQ ID NO: 1364027 - RNA, 19 nt, Homo sapiens
ggucaucgauucaucuaaa

SEQ ID NO: 1364028 - RNA, 19 nt, Homo sapiens
caaauucccuggucugaga

SEQ ID NO: 1364029 - RNA, 19 nt, Homo sapiens
ggaagaaugcacauagaua

SEQ ID NO: 1364030 - RNA, 19 nt, Homo sapiens
gcaauuauccaaagacuau

SEQ ID NO: 1364031 - RNA, 19 nt, Homo sapiens
ggagaaaugguucaucuuu

SEQ ID NO: 1364032 - RNA, 19 nt, Homo sapiens
gcaguuaggauguaaauau

SEQ ID NO: 1364033 - RNA, 19 nt, Homo sapiens
agacagugaucucucuuua

SEQ ID NO: 1364034 - RNA, 19 nt, Homo sapiens
gaagagaauucugguuuca

SEQ ID NO: 1364035 - RNA, 19 nt, Homo sapiens
gcaauacacuacuucaaag

SEQ ID NO: 1364036 - RNA, 19 nt, Homo sapiens
ggaagagaauucugguuuc

SEQ ID NO: 1364037 - RNA, 19 nt, Homo sapiens
ccaagaacauauuuagaga

SEQ ID NO: 1364038 - RNA, 19 nt, Homo sapiens
gaacugugccaucauuuau

SEQ ID NO: 1364039 - RNA, 19 nt, Homo sapiens
aauugaagcuuguaaggua

SEQ ID NO: 1364040 - RNA, 19 nt, Homo sapiens
gaagaaggaaauugucauu

SEQ ID NO: 1364041 - RNA, 19 nt, Homo sapiens
gaaagcgggugucuagaag

SEQ ID NO: 1364042 - RNA, 19 nt, Homo sapiens
ggaaagcgggugucuagaa

SEQ ID NO: 1364043 - RNA, 19 nt, Homo sapiens
gaugagacaacaacauuaa

SEQ ID NO: 1364044 - RNA, 19 nt, Homo sapiens
acacagugaugauucagua

SEQ ID NO: 1364045 - RNA, 19 nt, Homo sapiens
gaaagcaucugggcucgau

SEQ ID NO: 1364046 - RNA, 19 nt, Homo sapiens
caacucaaauucagaugau

SEQ ID NO: 1364047 - RNA, 19 nt, Homo sapiens
acagugaucucucuuuaga

SEQ ID NO: 1364048 - RNA, 19 nt, Homo sapiens
gaaagcuuauguaguauac

SEQ ID NO: 1364049 - RNA, 19 nt, Homo sapiens
gggaagagaauucugguuu

SEQ ID NO: 1364050 - RNA, 19 nt, Homo sapiens
gaucacaauccaugaauga

SEQ ID NO: 1364051 - RNA, 19 nt, Homo sapiens
uaagagcccucacauacug

SEQ ID NO: 1364052 - RNA, 19 nt, Homo sapiens
ucacugcacuuuauuucuu

SEQ ID NO: 1364053 - RNA, 19 nt, Homo sapiens
ugacagagaagaacagaaa

SEQ ID NO: 1364054 - RNA, 19 nt, Homo sapiens
caacaaguuuacgauauug

SEQ ID NO: 1364055 - RNA, 19 nt, Homo sapiens
ugacccagguucucucuuu

SEQ ID NO: 1364056 - RNA, 19 nt, Homo sapiens
caucuucgguccaugauau

SEQ ID NO: 1364057 - RNA, 19 nt, Homo sapiens
ggaaagcuuauguaguaua

SEQ ID NO: 1364058 - RNA, 19 nt, Homo sapiens
uugaauaugugacggauaa

SEQ ID NO: 1364059 - RNA, 19 nt, Homo sapiens
gaccaucauucggaaauuu

SEQ ID NO: 1364060 - RNA, 19 nt, Homo sapiens
aaacuuacguucauccaau

SEQ ID NO: 1364061 - RNA, 19 nt, Homo sapiens
gaauauauccggaccucuu

SEQ ID NO: 1364062 - RNA, 19 nt, Homo sapiens
caacuuaacaggcuugaau

SEQ ID NO: 1364063 - RNA, 19 nt, Homo sapiens
gggaaugugucuccuaaca

SEQ ID NO: 1364064 - RNA, 19 nt, Homo sapiens
gaccauccauuaaagacaa

SEQ ID NO: 1364065 - RNA, 19 nt, Homo sapiens
gcagauguccuaccugaau

SEQ ID NO: 1364066 - RNA, 19 nt, Homo sapiens
caacaaauacagcaccauu

SEQ ID NO: 1364067 - RNA, 19 nt, Homo sapiens
uaacaaaccuagaguugac

SEQ ID NO: 1364068 - RNA, 19 nt, Homo sapiens
agagaauucugguuucaaa

SEQ ID NO: 1364069 - RNA, 19 nt, Homo sapiens
gacccagguucucucuuua

SEQ ID NO: 1364070 - RNA, 19 nt, Homo sapiens
cuaaaccaguacuucguua

SEQ ID NO: 1364071 - RNA, 19 nt, Homo sapiens
caauuaggcauccuucuuu

SEQ ID NO: 1364072 - RNA, 19 nt, Homo sapiens
gcacauagauaaaagaagu

SEQ ID NO: 1364073 - RNA, 19 nt, Homo sapiens
guacaaaugauccugaaga

SEQ ID NO: 1364074 - RNA, 19 nt, Homo sapiens
agacaacuguaaacuaaga

SEQ ID NO: 1364075 - RNA, 19 nt, Homo sapiens
cgcaaaggcugaucuccua

SEQ ID NO: 1364076 - RNA, 19 nt, Homo sapiens
ucucaaagaugacauugug

SEQ ID NO: 1364077 - RNA, 19 nt, Homo sapiens
gcucuucucaggaauagua

SEQ ID NO: 1364078 - RNA, 19 nt, Homo sapiens
gaagacuuguuagagguuu

SEQ ID NO: 1364079 - RNA, 19 nt, Homo sapiens
ccuaaaggguuucccagaa

SEQ ID NO: 1364080 - RNA, 19 nt, Homo sapiens
gguaagugaucccgccaaa

SEQ ID NO: 1364081 - RNA, 19 nt, Homo sapiens
acaaauacagcaccauuaa

SEQ ID NO: 1364082 - RNA, 19 nt, Homo sapiens
gagacacuuugaagagaaa

SEQ ID NO: 1364083 - RNA, 19 nt, Homo sapiens
cagauaccauaagacauua

SEQ ID NO: 1364084 - RNA, 19 nt, Homo sapiens
ggccuuaccugacugacaa

SEQ ID NO: 1364085 - RNA, 19 nt, Homo sapiens
gagacaacaacauuaauug

SEQ ID NO: 1364086 - RNA, 19 nt, Homo sapiens
uguccuaccugaauacaaa

SEQ ID NO: 1364087 - RNA, 19 nt, Homo sapiens
cagauguccuaccugaaua

SEQ ID NO: 1364088 - RNA, 19 nt, Homo sapiens
acaauguccugaauuucua

SEQ ID NO: 1364089 - RNA, 19 nt, Homo sapiens
gguaacagcaggaucagaa

SEQ ID NO: 1364090 - RNA, 19 nt, Homo sapiens
gaaagucuaaugcagaugu

SEQ ID NO: 1364091 - RNA, 19 nt, Homo sapiens
uaacacgaauucggagaaa

SEQ ID NO: 1364092 - RNA, 19 nt, Homo sapiens
uaaacacagugaugauuca

SEQ ID NO: 1364093 - RNA, 19 nt, Homo sapiens
gugcagaacugugccauca

SEQ ID NO: 1364094 - RNA, 19 nt, Homo sapiens
ccacagcucacucugaauu

SEQ ID NO: 1364095 - RNA, 19 nt, Homo sapiens
ggauaaaacuguucaugga

SEQ ID NO: 1364096 - RNA, 19 nt, Homo sapiens
aauaagaaaccaagggaua

SEQ ID NO: 1364097 - RNA, 19 nt, Homo sapiens
agacucuucuccaggaaua

SEQ ID NO: 1364098 - RNA, 19 nt, Homo sapiens
ccugaagacucugcagaua

SEQ ID NO: 1364099 - RNA, 19 nt, Homo sapiens
cuaaaggguuucccagaau

SEQ ID NO: 1364100 - RNA, 19 nt, Homo sapiens
caguagccaugaagcauuu

SEQ ID NO: 1364101 - RNA, 19 nt, Homo sapiens
ucugugagaugacugguuu

SEQ ID NO: 1364102 - RNA, 19 nt, Homo sapiens
ggaaucgugggucuucaua

SEQ ID NO: 1364103 - RNA, 19 nt, Homo sapiens
uaacagcaggaucagaaua

SEQ ID NO: 1364104 - RNA, 19 nt, Homo sapiens
ucugaucacuuucuaacaa

SEQ ID NO: 1364105 - RNA, 19 nt, Homo sapiens
uaaaggguuucccagaaug

SEQ ID NO: 1364106 - RNA, 19 nt, Homo sapiens
gguaugcgauugggaaugu

SEQ ID NO: 1364107 - RNA, 19 nt, Homo sapiens
caagagggcguggcuauga

SEQ ID NO: 1364108 - RNA, 19 nt, Homo sapiens
ggaccaucauucggaaauu

SEQ ID NO: 1364109 - RNA, 19 nt, Homo sapiens
ucaccuccuucuucagaua

SEQ ID NO: 1364110 - RNA, 19 nt, Homo sapiens
gcaugauauugcccaaauu

SEQ ID NO: 1364111 - RNA, 19 nt, Homo sapiens
guucauggaugcaacucaa

SEQ ID NO: 1364112 - RNA, 19 nt, Homo sapiens
gcaacgauggguucuguga

SEQ ID NO: 1364113 - RNA, 19 nt, Homo sapiens
caggaagaaugcacauaga

SEQ ID NO: 1364114 - RNA, 19 nt, Homo sapiens
ucagcgagaagacuuguua

SEQ ID NO: 1364115 - RNA, 19 nt, Homo sapiens
gaauguaucugcaauuauc

SEQ ID NO: 1364116 - RNA, 19 nt, Homo sapiens
gggaauguaucugcaauua

SEQ ID NO: 1364117 - RNA, 19 nt, Homo sapiens
gaaacuggaucgauauuca

SEQ ID NO: 1364118 - RNA, 19 nt, Homo sapiens
agggaaagcuuauguagua

SEQ ID NO: 1364119 - RNA, 19 nt, Homo sapiens
gcagaacugugccaucauu

SEQ ID NO: 1364120 - RNA, 19 nt, Homo sapiens
ggucaucgauucaucuaaa

SEQ ID NO: 1364121 - RNA, 19 nt, Homo sapiens
caaauucccuggucugaga

SEQ ID NO: 1364122 - RNA, 19 nt, Homo sapiens
gcaauuauccaaagacuau

SEQ ID NO: 1364123 - RNA, 19 nt, Homo sapiens
gaagagaauucugguuuca

SEQ ID NO: 1364124 - RNA, 19 nt, Homo sapiens
gcaauacacuacuucaaag

SEQ ID NO: 1364125 - RNA, 19 nt, Homo sapiens
ggaagagaauucugguuuc

SEQ ID NO: 1364126 - RNA, 19 nt, Homo sapiens
ccaagaacauauuuagaga

SEQ ID NO: 1364127 - RNA, 19 nt, Homo sapiens
gaacugugccaucauuuau

SEQ ID NO: 1364128 - RNA, 19 nt, Homo sapiens
gaugagacaacaacauuaa

SEQ ID NO: 1364129 - RNA, 19 nt, Homo sapiens
acacagugaugauucagua

SEQ ID NO: 1364130 - RNA, 19 nt, Homo sapiens
gaaagcgggugucuagaag

SEQ ID NO: 1364131 - RNA, 19 nt, Homo sapiens
ggaaagcgggugucuagaa

SEQ ID NO: 1364132 - RNA, 19 nt, Homo sapiens
ggaaucaccagcuuugaaa

SEQ ID NO: 1364133 - RNA, 19 nt, Homo sapiens
gaaagcuuauguaguauac

SEQ ID NO: 1364134 - RNA, 19 nt, Homo sapiens
gggaagagaauucugguuu

SEQ ID NO: 1364135 - RNA, 19 nt, Homo sapiens
ugacagagaagaacagaaa

SEQ ID NO: 1364136 - RNA, 19 nt, Homo sapiens
caacaaguuuacgauauug

SEQ ID NO: 1364137 - RNA, 19 nt, Homo sapiens
ugacccagguucucucuuu

SEQ ID NO: 1364138 - RNA, 19 nt, Homo sapiens
caucuucgguccaugauau

SEQ ID NO: 1364139 - RNA, 19 nt, Homo sapiens
ggaaagcuuauguaguaua

SEQ ID NO: 1364140 - RNA, 19 nt, Homo sapiens
uugaauaugugacggauaa

SEQ ID NO: 1364141 - RNA, 19 nt, Homo sapiens
gaccaucauucggaaauuu

SEQ ID NO: 1364142 - RNA, 19 nt, Homo sapiens
gaauauauccggaccucuu

SEQ ID NO: 1364143 - RNA, 19 nt, Homo sapiens
gggaaugugucuccuaaca

SEQ ID NO: 1364144 - RNA, 19 nt, Homo sapiens
gaccauccauuaaagacaa

SEQ ID NO: 1364145 - RNA, 19 nt, Homo sapiens
gcagauguccuaccugaau

SEQ ID NO: 1364146 - RNA, 19 nt, Homo sapiens
caacaaauacagcaccauu

SEQ ID NO: 1364147 - RNA, 19 nt, Homo sapiens
gacccagguucucucuuua

SEQ ID NO: 1364148 - RNA, 19 nt, Homo sapiens
agagaauucugguuucaaa

SEQ ID NO: 1364149 - RNA, 19 nt, Homo sapiens
gguaagugaucccgccaaa

SEQ ID NO: 1364150 - RNA, 19 nt, Homo sapiens
acaaauacagcaccauuaa

SEQ ID NO: 1364151 - RNA, 19 nt, Homo sapiens
ggccuuaccugacugacaa

SEQ ID NO: 1364152 - RNA, 19 nt, Homo sapiens
gagacaacaacauuaauug

SEQ ID NO: 1364153 - RNA, 19 nt, Homo sapiens
uguccuaccugaauacaaa

SEQ ID NO: 1364154 - RNA, 19 nt, Homo sapiens
cagauguccuaccugaaua

SEQ ID NO: 1364155 - RNA, 19 nt, Homo sapiens
uaacacgaauucggagaaa

SEQ ID NO: 1364156 - RNA, 19 nt, Homo sapiens
uaaacacagugaugauuca

SEQ ID NO: 1364157 - RNA, 19 nt, Homo sapiens
ccacagcucacucugaauu

SEQ ID NO: 1364158 - RNA, 19 nt, Homo sapiens
gugcagaacugugccauca

SEQ ID NO: 1364159 - RNA, 19 nt, Homo sapiens
caguagccaugaagcauuu

SEQ ID NO: 1364160 - RNA, 19 nt, Homo sapiens
ucugugagaugacugguuu

SEQ ID NO: 1364161 - RNA, 19 nt, Homo sapiens
gguaugcgauugggaaugu

SEQ ID NO: 1364162 - RNA, 19 nt, Homo sapiens
caagagggcguggcuauga

SEQ ID NO: 1364163 - RNA, 19 nt, Homo sapiens
ucaccuccuucuucagaua

SEQ ID NO: 1364164 - RNA, 19 nt, Homo sapiens
gcaugauauugcccaaauu

SEQ ID NO: 1364165 - RNA, 19 nt, Homo sapiens
ggaccaucauucggaaauu

SEQ ID NO: 1364166 - RNA, 19 nt, Homo sapiens
uugauuggcucacuaaugu

SEQ ID NO: 1364167 - RNA, 19 nt, Homo sapiens
ccacgcaucaacaaguuua

SEQ ID NO: 1364168 - RNA, 19 nt, Homo sapiens
gcaacgauggguucuguga

SEQ ID NO: 1364169 - RNA, 19 nt, Homo sapiens
gacagugacucaaguucug

SEQ ID NO: 1364170 - RNA, 19 nt, Homo sapiens
gaagaagugguaagugauc

SEQ ID NO: 1364171 - RNA, 19 nt, Homo sapiens
gugcaucuuugcccugauu

SEQ ID NO: 1364172 - RNA, 19 nt, Homo sapiens
caucaacaaguuuacgaua

SEQ ID NO: 1364173 - RNA, 19 nt, Homo sapiens
gggaaacguuacaaugaca

SEQ ID NO: 1364174 - RNA, 19 nt, Homo sapiens
gcucuuaaugugcaucuuu

SEQ ID NO: 1364175 - RNA, 19 nt, Homo sapiens
augaagaagugguaaguga

SEQ ID NO: 1364176 - RNA, 19 nt, Homo sapiens
cagccuuccuccucaauga

SEQ ID NO: 1364177 - RNA, 19 nt, Homo sapiens
caaugugacugagaaagug

SEQ ID NO: 1364178 - RNA, 19 nt, Homo sapiens
gagcaucuucgguccauga

SEQ ID NO: 1364179 - RNA, 19 nt, Homo sapiens
guucccagcugucccauuc

SEQ ID NO: 1364180 - RNA, 19 nt, Homo sapiens
gauggguucugugagauga

SEQ ID NO: 1364181 - RNA, 19 nt, Homo sapiens
guucuaaugcucuuaaugu

SEQ ID NO: 1364182 - RNA, 19 nt, Homo sapiens
gaauauggcgcugcuguuc

SEQ ID NO: 1364183 - RNA, 19 nt, Homo sapiens
gaaugugguagacuugauu

SEQ ID NO: 1364184 - RNA, 19 nt, Homo sapiens
gcaaugggaccgacucuac

SEQ ID NO: 1364185 - RNA, 19 nt, Homo sapiens
gcauggacuuacaccaaug

SEQ ID NO: 1364186 - RNA, 19 nt, Homo sapiens
caauuugugucauguugau

SEQ ID NO: 1364187 - RNA, 19 nt, Homo sapiens
agaaaggccuuaccugacu

SEQ ID NO: 1364188 - RNA, 19 nt, Homo sapiens
caaaggcugguuccugauu

SEQ ID NO: 1364189 - RNA, 19 nt, Homo sapiens
gggcguggcuaugauguuc

SEQ ID NO: 1364190 - RNA, 19 nt, Homo sapiens
agaacugugccaucauuua

SEQ ID NO: 1364191 - RNA, 19 nt, Homo sapiens
ggaauguaucugcaauuau

SEQ ID NO: 1364192 - RNA, 19 nt, Homo sapiens
ggucaccuacuaucacaaa

SEQ ID NO: 1364193 - RNA, 19 nt, Homo sapiens
gccaugcaccugcgacuuu

SEQ ID NO: 1364194 - RNA, 19 nt, Homo sapiens
ucgggaaugugucuccuaa

SEQ ID NO: 1364195 - RNA, 19 nt, Homo sapiens
gaacagaaaagacgagaau

SEQ ID NO: 1364196 - RNA, 19 nt, Homo sapiens
gcuaaugggaagagaauuc

SEQ ID NO: 1364197 - RNA, 19 nt, Homo sapiens
ugaagcagaugacacaaaa

SEQ ID NO: 1364198 - RNA, 19 nt, Homo sapiens
caucauuuauugcaacgau

SEQ ID NO: 1364199 - RNA, 19 nt, Homo sapiens
gaaugaagaagugguaagu

SEQ ID NO: 1364200 - RNA, 19 nt, Homo sapiens
caccacgcaucaacaaguu

SEQ ID NO: 1364201 - RNA, 19 nt, Homo sapiens
aaauacagcaccauuaaca

SEQ ID NO: 1364202 - RNA, 19 nt, Homo sapiens
gauucaaaccucaacaaau

SEQ ID NO: 1364203 - RNA, 19 nt, Homo sapiens
cagaucaagggaaagcuua

SEQ ID NO: 1364204 - RNA, 19 nt, Homo sapiens
gaccaagaggcaugauauu

SEQ ID NO: 1364205 - RNA, 19 nt, Homo sapiens
gagaccaagaggcaugaua

SEQ ID NO: 1364206 - RNA, 19 nt, Homo sapiens
caaugacagugacucaagu

SEQ ID NO: 1364207 - RNA, 19 nt, Homo sapiens
gcacuacagcccuuucaag

SEQ ID NO: 1364208 - RNA, 19 nt, Homo sapiens
caagggaaagcuuauguag

SEQ ID NO: 1364209 - RNA, 19 nt, Homo sapiens
uuacagaaagcaguccuua

SEQ ID NO: 1364210 - RNA, 19 nt, Homo sapiens
gaauaugugacggauaaug

SEQ ID NO: 1364211 - RNA, 19 nt, Homo sapiens
caugauauugcccaaauug

SEQ ID NO: 1364212 - RNA, 19 nt, Homo sapiens
uaucugcaauuauccaaag

SEQ ID NO: 1364213 - RNA, 19 nt, Homo sapiens
uagacuugauuguggauau

SEQ ID NO: 1364214 - RNA, 19 nt, Homo sapiens
aaagaucgaacacacaaug

SEQ ID NO: 1364215 - RNA, 19 nt, Homo sapiens
caacgggccugaagacuuu

SEQ ID NO: 1364216 - RNA, 19 nt, Homo sapiens
ccaagaaagugaggauuua

SEQ ID NO: 1364217 - RNA, 19 nt, Homo sapiens
gaacaagugucugcugcua

SEQ ID NO: 1364218 - RNA, 19 nt, Homo sapiens
ugaaguaucugauguuugu

SEQ ID NO: 1364219 - RNA, 19 nt, Homo sapiens
ccaaggagcucaccaagca

SEQ ID NO: 1364220 - RNA, 19 nt, Homo sapiens
gcaacaagguuuccugucu

SEQ ID NO: 1364221 - RNA, 19 nt, Homo sapiens
gaacugaggcuuggauauc

SEQ ID NO: 1364222 - RNA, 19 nt, Homo sapiens
acaagugucugcugcuauu

SEQ ID NO: 1364223 - RNA, 19 nt, Homo sapiens
ggacugcucugacuuuagc

SEQ ID NO: 1364224 - RNA, 19 nt, Homo sapiens
ccucuucucuccaggcuaa

SEQ ID NO: 1364225 - RNA, 19 nt, Homo sapiens
gcacaggcgugacaguucu

SEQ ID NO: 1364226 - RNA, 19 nt, Homo sapiens
caugaaguaucugauguuu

SEQ ID NO: 1364227 - RNA, 19 nt, Homo sapiens
ggaaggagcagugugaugu

SEQ ID NO: 1364228 - RNA, 19 nt, Homo sapiens
gaagaaauccccaagauca

SEQ ID NO: 1364229 - RNA, 19 nt, Homo sapiens
uuaccaaauucgcccuuua

SEQ ID NO: 1364230 - RNA, 19 nt, Homo sapiens
guccgcacauuucuuagua

SEQ ID NO: 1364231 - RNA, 19 nt, Homo sapiens
gcacaucacauucccuugu

SEQ ID NO: 1364232 - RNA, 19 nt, Homo sapiens
gagaauucuucaccaagga

SEQ ID NO: 1364233 - RNA, 19 nt, Homo sapiens
caaauucgcccuuuaacag

SEQ ID NO: 1364234 - RNA, 19 nt, Homo sapiens
ugucugagcugcaugaagu

SEQ ID NO: 1364235 - RNA, 19 nt, Homo sapiens
uaaguuugcaucuguguuu

SEQ ID NO: 1364236 - RNA, 19 nt, Homo sapiens
gugcaauccuaaugaguga

SEQ ID NO: 1364237 - RNA, 19 nt, Homo sapiens
gccaagaaagugaggauuu

SEQ ID NO: 1364238 - RNA, 19 nt, Homo sapiens
gguggacccuccucuaauc

SEQ ID NO: 1364239 - RNA, 19 nt, Homo sapiens
gauggaaggagcaguguga

SEQ ID NO: 1364240 - RNA, 19 nt, Homo sapiens
gacuuuagcaucagcuuaa

SEQ ID NO: 1364241 - RNA, 19 nt, Homo sapiens
gacaagagagggcaaguca

SEQ ID NO: 1364242 - RNA, 19 nt, Homo sapiens
gcagugcaauccuaaugag

SEQ ID NO: 1364243 - RNA, 19 nt, Homo sapiens
ccacaaguauucaguucuc

SEQ ID NO: 1364244 - RNA, 19 nt, Homo sapiens
uaacacggcauccaagaau

SEQ ID NO: 1364245 - RNA, 19 nt, Homo sapiens
ccaccggcauccuguauca

SEQ ID NO: 1364246 - RNA, 19 nt, Homo sapiens
ucagagaagucaucaaagc

SEQ ID NO: 1364247 - RNA, 19 nt, Homo sapiens
gcacauuucuuaguauucc

SEQ ID NO: 1364248 - RNA, 19 nt, Homo sapiens
gcuuggauaucuucuucaa

SEQ ID NO: 1364249 - RNA, 19 nt, Homo sapiens
caaguauucaguucucaaa

SEQ ID NO: 1364250 - RNA, 19 nt, Homo sapiens
ugugaugucugcucucuuc

SEQ ID NO: 1364251 - RNA, 19 nt, Homo sapiens
ccgcacauuucuuaguauu

SEQ ID NO: 1364252 - RNA, 19 nt, Homo sapiens
uuggauaucuucuucaaca

SEQ ID NO: 1364253 - RNA, 19 nt, Homo sapiens
gaaggcaucgaggccauuu

SEQ ID NO: 1364254 - RNA, 19 nt, Homo sapiens
gcagggagacucgcagaug

SEQ ID NO: 1364255 - RNA, 19 nt, Homo sapiens
gcaugaaguaucugauguu

SEQ ID NO: 1364256 - RNA, 19 nt, Homo sapiens
gaaccacccacaugcuuag

SEQ ID NO: 1364257 - RNA, 19 nt, Homo sapiens
ugaaccacccacaugcuua

SEQ ID NO: 1364258 - RNA, 19 nt, Homo sapiens
gaugucugcucucuucucu

SEQ ID NO: 1364259 - RNA, 19 nt, Homo sapiens
ggccauuucugcugcaaca

SEQ ID NO: 1364260 - RNA, 19 nt, Homo sapiens
aaacaccauuccaugacuu

SEQ ID NO: 1364261 - RNA, 19 nt, Homo sapiens
uaccaaauucgcccuuuaa

SEQ ID NO: 1364262 - RNA, 19 nt, Homo sapiens
cagguggacccuccucuaa

SEQ ID NO: 1364263 - RNA, 19 nt, Homo sapiens
gaugcacacccacaaguau

SEQ ID NO: 1364264 - RNA, 19 nt, Homo sapiens
gaccugaugccaagaaagu

SEQ ID NO: 1364265 - RNA, 19 nt, Homo sapiens
gcucugugccugcugcaaa

SEQ ID NO: 1364266 - RNA, 19 nt, Homo sapiens
gaccaaauaaucucaaagg

SEQ ID NO: 1364267 - RNA, 19 nt, Homo sapiens
gccuucaucuucagggaaa

SEQ ID NO: 1364268 - RNA, 19 nt, Homo sapiens
caccugagcuccguagaag

SEQ ID NO: 1364269 - RNA, 19 nt, Homo sapiens
ccaggcaccguaaguuuga

SEQ ID NO: 1364270 - RNA, 19 nt, Homo sapiens
gcaauccuaaugagugaug

SEQ ID NO: 1364271 - RNA, 19 nt, Homo sapiens
caagguuuccugucucuuc

SEQ ID NO: 1364272 - RNA, 19 nt, Homo sapiens
acacagaggugcacaucac

SEQ ID NO: 1364273 - RNA, 19 nt, Homo sapiens
aagaauggcccagcuggua

SEQ ID NO: 1364274 - RNA, 19 nt, Homo sapiens
ggaacucggucaugaucac

SEQ ID NO: 1364275 - RNA, 19 nt, Homo sapiens
gcuccuacccugauagauc

SEQ ID NO: 1364276 - RNA, 19 nt, Homo sapiens
cugguaggauccuugcuuu

SEQ ID NO: 1364277 - RNA, 19 nt, Homo sapiens
ggccaagagugagcugcua

SEQ ID NO: 1364278 - RNA, 19 nt, Homo sapiens
ccaaauucgcccuuuaaca

SEQ ID NO: 1364279 - RNA, 19 nt, Homo sapiens
gauggcagugcaauccuaa

SEQ ID NO: 1364280 - RNA, 19 nt, Homo sapiens
cauccuggccuucaucuuc

SEQ ID NO: 1364281 - RNA, 19 nt, Homo sapiens
ucaacaccuucgagaccua

SEQ ID NO: 1364282 - RNA, 19 nt, Homo sapiens
ccguaaguuugauuaguga

SEQ ID NO: 1364283 - RNA, 19 nt, Homo sapiens
guccauggcaucccacuug

SEQ ID NO: 1364284 - RNA, 19 nt, Homo sapiens
agcaucagcuuaauacaca

SEQ ID NO: 1364285 - RNA, 19 nt, Homo sapiens
agauucagcugccaugucu

SEQ ID NO: 1364286 - RNA, 19 nt, Homo sapiens
guacuggccaucgagcuuu

SEQ ID NO: 1364287 - RNA, 19 nt, Homo sapiens
gaaagagcucauucugucu

SEQ ID NO: 1364288 - RNA, 19 nt, Homo sapiens
ugacuuuagcaucagcuua

SEQ ID NO: 1364289 - RNA, 19 nt, Homo sapiens
ggauaucuucuucaacauc

SEQ ID NO: 1364290 - RNA, 19 nt, Homo sapiens
cagaggugcacaucacauu

SEQ ID NO: 1364291 - RNA, 19 nt, Homo sapiens
gcuaacacggcauccaaga

SEQ ID NO: 1364292 - RNA, 19 nt, Homo sapiens
gacagugaccauccacaga

SEQ ID NO: 1364293 - RNA, 19 nt, Homo sapiens
aauauggacugauguaucc

SEQ ID NO: 1364294 - RNA, 19 nt, Homo sapiens
gucaugaucacauuugguu

SEQ ID NO: 1364295 - RNA, 19 nt, Homo sapiens
uuaauacacagaagagguu

SEQ ID NO: 1364296 - RNA, 19 nt, Homo sapiens
ucagagauggccaggagaa

SEQ ID NO: 1364297 - RNA, 19 nt, Homo sapiens
ucaacgggccugaagacuu

SEQ ID NO: 1364298 - RNA, 19 nt, Homo sapiens
guaaguuugauuagugaug

SEQ ID NO: 1364299 - RNA, 19 nt, Homo sapiens
gccaggcaccguaaguuug

SEQ ID NO: 1364300 - RNA, 19 nt, Homo sapiens
ggcagugcaauccuaauga

SEQ ID NO: 1364301 - RNA, 19 nt, Homo sapiens
agauggcagugcaauccua

SEQ ID NO: 1364302 - RNA, 19 nt, Homo sapiens
agacuucuccacccucuug

SEQ ID NO: 1364303 - RNA, 19 nt, Homo sapiens
gccaagagugagcugcuaa

SEQ ID NO: 1364304 - RNA, 19 nt, Homo sapiens
ugagcugcaugaaguaucu

SEQ ID NO: 1364305 - RNA, 19 nt, Homo sapiens
guuacacggugauccucaa

SEQ ID NO: 1364306 - RNA, 19 nt, Homo sapiens
gaaggagcagugugauguc

SEQ ID NO: 1364307 - RNA, 19 nt, Homo sapiens
ccagggcaauaacgacaca

SEQ ID NO: 1364308 - RNA, 19 nt, Homo sapiens
caccguaaguuugauuagu

SEQ ID NO: 1364309 - RNA, 19 nt, Homo sapiens
aggcuuggauaucuucuuc

SEQ ID NO: 1364310 - RNA, 19 nt, Homo sapiens
uggaccaaauaaucucaaa

SEQ ID NO: 1364311 - RNA, 19 nt, Homo sapiens
gagaagggccaggggaaua

SEQ ID NO: 1364312 - RNA, 19 nt, Homo sapiens
gacccuggauagugaagag

SEQ ID NO: 1364313 - RNA, 19 nt, Homo sapiens
gcagaugcacacccacaag

SEQ ID NO: 1364314 - RNA, 19 nt, Homo sapiens
acuguccgcacauuucuua

SEQ ID NO: 1364315 - RNA, 19 nt, Homo sapiens
gcagguggcucccaaauua

SEQ ID NO: 1364316 - RNA, 19 nt, Homo sapiens
gaaggaagcucaacgauau

SEQ ID NO: 1364317 - RNA, 19 nt, Homo sapiens
gaaggaagccuaacuauug

SEQ ID NO: 1364318 - RNA, 19 nt, Homo sapiens
ggaaguagaucgagauuca

SEQ ID NO: 1364319 - RNA, 19 nt, Homo sapiens
ggaaguggguggaaguauu

SEQ ID NO: 1364320 - RNA, 19 nt, Homo sapiens
guacaagcccuccaagaua

SEQ ID NO: 1364321 - RNA, 19 nt, Homo sapiens
gagcgagacucccucuuaa

SEQ ID NO: 1364322 - RNA, 19 nt, Homo sapiens
gcacaggcaugcaauaagu

SEQ ID NO: 1364323 - RNA, 19 nt, Homo sapiens
gcuacagacuugugauuaa

SEQ ID NO: 1364324 - RNA, 19 nt, Homo sapiens
ggaaaggacuguucuugag

SEQ ID NO: 1364325 - RNA, 19 nt, Homo sapiens
ggacuguucuugagguauu

SEQ ID NO: 1364326 - RNA, 19 nt, Homo sapiens
gaacaaauaauagcaccua

SEQ ID NO: 1364327 - RNA, 19 nt, Homo sapiens
ggaaguauuuaaagcaugu

SEQ ID NO: 1364328 - RNA, 19 nt, Homo sapiens
gaaguggguggaaguauuu

SEQ ID NO: 1364329 - RNA, 19 nt, Homo sapiens
ccacacccgucucuacuaa

SEQ ID NO: 1364330 - RNA, 19 nt, Homo sapiens
gaacauuagucaaagaacu

SEQ ID NO: 1364331 - RNA, 19 nt, Homo sapiens
ucugugaugucuucaauaa

SEQ ID NO: 1364332 - RNA, 19 nt, Homo sapiens
uaaagcaugugaugaagau

SEQ ID NO: 1364333 - RNA, 19 nt, Homo sapiens
guacauaguaggugcauau

SEQ ID NO: 1364334 - RNA, 19 nt, Homo sapiens
gaauaugcccugaacuaug

SEQ ID NO: 1364335 - RNA, 19 nt, Homo sapiens
cuacagacuugugauuaaa

SEQ ID NO: 1364336 - RNA, 19 nt, Homo sapiens
cagcagagaggacuuuaaa

SEQ ID NO: 1364337 - RNA, 19 nt, Homo sapiens
cagaauacuuacuauguuc

SEQ ID NO: 1364338 - RNA, 19 nt, Homo sapiens
gauggucacgucagcuuua

SEQ ID NO: 1364339 - RNA, 19 nt, Homo sapiens
gguaucaguacucuuauuu

SEQ ID NO: 1364340 - RNA, 19 nt, Homo sapiens
guccaaaucaucacuguaa

SEQ ID NO: 1364341 - RNA, 19 nt, Homo sapiens
uaagacuucucuaagauag

SEQ ID NO: 1364342 - RNA, 19 nt, Homo sapiens
caccuacuaucguggauuu

SEQ ID NO: 1364343 - RNA, 19 nt, Homo sapiens
ucacagccuuugacaccua

SEQ ID NO: 1364344 - RNA, 19 nt, Homo sapiens
gccuaacuauugugaacua

SEQ ID NO: 1364345 - RNA, 19 nt, Homo sapiens
gaaacauuaagcgucauua

SEQ ID NO: 1364346 - RNA, 19 nt, Homo sapiens
gaaaucggcuugggcuaac

SEQ ID NO: 1364347 - RNA, 19 nt, Homo sapiens
agaaggaagcucaacgaua

SEQ ID NO: 1364348 - RNA, 19 nt, Homo sapiens
gaaguggauucugugaugu

SEQ ID NO: 1364349 - RNA, 19 nt, Homo sapiens
uaaaacugcuguuguaaug

SEQ ID NO: 1364350 - RNA, 19 nt, Homo sapiens
gaagguaauuccaaaauac

SEQ ID NO: 1364351 - RNA, 19 nt, Homo sapiens
gaacgaaguaagacacauc

SEQ ID NO: 1364352 - RNA, 19 nt, Homo sapiens
gguacaagcccuccaagau

SEQ ID NO: 1364353 - RNA, 19 nt, Homo sapiens
gaucacaaaggauaucuca

SEQ ID NO: 1364354 - RNA, 19 nt, Homo sapiens
ggccaaagcaggaggauca

SEQ ID NO: 1364355 - RNA, 19 nt, Homo sapiens
agacuucucuaagauaaug

SEQ ID NO: 1364356 - RNA, 19 nt, Homo sapiens
uacaagcccuccaagauag

SEQ ID NO: 1364357 - RNA, 19 nt, Homo sapiens
ggaaacauuaagcgucauu

SEQ ID NO: 1364358 - RNA, 19 nt, Homo sapiens
ucuacucacucacuucauu

SEQ ID NO: 1364359 - RNA, 19 nt, Homo sapiens
agacucuacucuacuaaug

SEQ ID NO: 1364360 - RNA, 19 nt, Homo sapiens
ggaagccuaacuauuguga

SEQ ID NO: 1364361 - RNA, 19 nt, Homo sapiens
aauaugcccugaacuaugg

SEQ ID NO: 1364362 - RNA, 19 nt, Homo sapiens
gcucccaaauuaccggaaa

SEQ ID NO: 1364363 - RNA, 19 nt, Homo sapiens
caugaacauuagucaaaga

SEQ ID NO: 1364364 - RNA, 19 nt, Homo sapiens
cgucagcuuuagagacuuu

SEQ ID NO: 1364365 - RNA, 19 nt, Homo sapiens
acauuaagcgucauuauca

SEQ ID NO: 1364366 - RNA, 19 nt, Homo sapiens
caccuacacauacagaaua

SEQ ID NO: 1364367 - RNA, 19 nt, Homo sapiens
ggucuaggcuugggagucu

SEQ ID NO: 1364368 - RNA, 19 nt, Homo sapiens
gcaccuacacauacagaau

SEQ ID NO: 1364369 - RNA, 19 nt, Homo sapiens
ggugccaguuuccuucauu

SEQ ID NO: 1364370 - RNA, 19 nt, Homo sapiens
ugccuuagccuccugagua

SEQ ID NO: 1364371 - RNA, 19 nt, Homo sapiens
uagugaagguaauuccaaa

SEQ ID NO: 1364372 - RNA, 19 nt, Homo sapiens
uaaugucccugaguccaaa

SEQ ID NO: 1364373 - RNA, 19 nt, Homo sapiens
ucacuugagccuaggaauu

SEQ ID NO: 1364374 - RNA, 19 nt, Homo sapiens
auaauagcaccuacacaua

SEQ ID NO: 1364375 - RNA, 19 nt, Homo sapiens
gugccaguuuccuucauuu

SEQ ID NO: 1364376 - RNA, 19 nt, Homo sapiens
ccacggugcucuacucacu

SEQ ID NO: 1364377 - RNA, 19 nt, Homo sapiens
agacuugcaucucagaauc

SEQ ID NO: 1364378 - RNA, 19 nt, Homo sapiens
agaaggaagccuaacuauu

SEQ ID NO: 1364379 - RNA, 19 nt, Homo sapiens
ucaacgauaucggaacgaa

SEQ ID NO: 1364380 - RNA, 19 nt, Homo sapiens
uaaguguacggaaugcaua

SEQ ID NO: 1364381 - RNA, 19 nt, Homo sapiens
caaaucaucacuguaaagu

SEQ ID NO: 1364382 - RNA, 19 nt, Homo sapiens
ugagguggaaggaucauuu

SEQ ID NO: 1364383 - RNA, 19 nt, Homo sapiens
caaagcaggaggaucacuu

SEQ ID NO: 1364384 - RNA, 19 nt, Homo sapiens
agcauaggcuuaagacuuc

SEQ ID NO: 1364385 - RNA, 19 nt, Homo sapiens
caucaucuccuaauaucug

SEQ ID NO: 1364386 - RNA, 19 nt, Homo sapiens
gaacuauggacagaaggaa

SEQ ID NO: 1364387 - RNA, 19 nt, Homo sapiens
gcccugaacuauggacaga

SEQ ID NO: 1364388 - RNA, 19 nt, Homo sapiens
uuagagacuuugaauaugc

SEQ ID NO: 1364389 - RNA, 19 nt, Homo sapiens
guacggaaugcauaacaug

SEQ ID NO: 1364390 - RNA, 19 nt, Homo sapiens
uuagugguguguaccugua

SEQ ID NO: 1364391 - RNA, 19 nt, Homo sapiens
ugaaucucaucaucuccua

SEQ ID NO: 1364392 - RNA, 19 nt, Homo sapiens
acagaaggaagccuaacua

SEQ ID NO: 1364393 - RNA, 19 nt, Homo sapiens
cggaaaggacuguucuuga

SEQ ID NO: 1364394 - RNA, 19 nt, Homo sapiens
gccuuagccuccugaguau

SEQ ID NO: 1364395 - RNA, 19 nt, Homo sapiens
ugcauaacaugaacauuag

SEQ ID NO: 1364396 - RNA, 19 nt, Homo sapiens
gaagaucacaaaggauauc

SEQ ID NO: 1364397 - RNA, 19 nt, Homo sapiens
ggaugcugaugauagacuu

SEQ ID NO: 1364398 - RNA, 19 nt, Homo sapiens
aaggaagccuaacuauugu

SEQ ID NO: 1364399 - RNA, 19 nt, Homo sapiens
aagugauucuccugccuua

SEQ ID NO: 1364400 - RNA, 19 nt, Homo sapiens
ggucucgcuuugucaccua

SEQ ID NO: 1364401 - RNA, 19 nt, Homo sapiens
agaaaucggcuugggcuaa

SEQ ID NO: 1364402 - RNA, 19 nt, Homo sapiens
augaagaucacaaaggaua

SEQ ID NO: 1364403 - RNA, 19 nt, Homo sapiens
uaauagcaccuacacauac

SEQ ID NO: 1364404 - RNA, 19 nt, Homo sapiens
aauaauagcaccuacacau

SEQ ID NO: 1364405 - RNA, 19 nt, Homo sapiens
uugaauaugcccugaacua

SEQ ID NO: 1364406 - RNA, 19 nt, Homo sapiens
guagaucgagauucagaug

SEQ ID NO: 1364407 - RNA, 19 nt, Homo sapiens
uggauucugugaugucuuc

SEQ ID NO: 1364408 - RNA, 19 nt, Homo sapiens
guauuuaaagcaugugaug

SEQ ID NO: 1364409 - RNA, 19 nt, Homo sapiens
ggaagaacagggugaugag

SEQ ID NO: 1364410 - RNA, 19 nt, Homo sapiens
gagacuagccugggcaaca

SEQ ID NO: 1364411 - RNA, 19 nt, Homo sapiens
guaaugcuguuuggguaca

SEQ ID NO: 1364412 - RNA, 19 nt, Homo sapiens
guggaaguauuuaaagcau

SEQ ID NO: 1364413 - RNA, 19 nt, Homo sapiens
gcauuuagugaagguaauu

SEQ ID NO: 1364414 - RNA, 19 nt, Homo sapiens
gaguccaaaucaucacugu

SEQ ID NO: 1364415 - RNA, 19 nt, Homo sapiens
gaacaggacucauaucuug

SEQ ID NO: 1364416 - RNA, 19 nt, Homo sapiens
gcuaagaaauggacuuuaa

SEQ ID NO: 1364417 - RNA, 19 nt, Homo sapiens
gcaaggagcagaaugauaa

SEQ ID NO: 1364418 - RNA, 19 nt, Homo sapiens
gaacaacgcaaauuucuga

SEQ ID NO: 1364419 - RNA, 19 nt, Homo sapiens
guagagaaauggcguuaaa

SEQ ID NO: 1364420 - RNA, 19 nt, Homo sapiens
caacugauggugaaucuua

SEQ ID NO: 1364421 - RNA, 19 nt, Homo sapiens
caccagaaauugcuguuua

SEQ ID NO: 1364422 - RNA, 19 nt, Homo sapiens
gauguugccuuuacaguug

SEQ ID NO: 1364423 - RNA, 19 nt, Homo sapiens
gagaaaaccuucaacauga

SEQ ID NO: 1364424 - RNA, 19 nt, Homo sapiens
guaaacaucuguccauugg

SEQ ID NO: 1364425 - RNA, 19 nt, Homo sapiens
ggguguaucucacauuaaa

SEQ ID NO: 1364426 - RNA, 19 nt, Homo sapiens
gaacuuuauuucgccauuu

SEQ ID NO: 1364427 - RNA, 19 nt, Homo sapiens
caggguguaucucacauua

SEQ ID NO: 1364428 - RNA, 19 nt, Homo sapiens
gcaaagauuaagugcauuu

SEQ ID NO: 1364429 - RNA, 19 nt, Homo sapiens
gaaaagauggcauagcuua

SEQ ID NO: 1364430 - RNA, 19 nt, Homo sapiens
cccaauaucuguuugagaa

SEQ ID NO: 1364431 - RNA, 19 nt, Homo sapiens
aaaccagacucaccagaaa

SEQ ID NO: 1364432 - RNA, 19 nt, Homo sapiens
guacauacuucucccaaag

SEQ ID NO: 1364433 - RNA, 19 nt, Homo sapiens
ccauuuacccaguauaaua

SEQ ID NO: 1364434 - RNA, 19 nt, Homo sapiens
gugaugcucuuccuauuug

SEQ ID NO: 1364435 - RNA, 19 nt, Homo sapiens
gaagacccaauaucuguuu

SEQ ID NO: 1364436 - RNA, 19 nt, Homo sapiens
ggacugaauuuucuggaua

SEQ ID NO: 1364437 - RNA, 19 nt, Homo sapiens
gcuguggugugcaugauuu

SEQ ID NO: 1364438 - RNA, 19 nt, Homo sapiens
guccauugguguagcuuua

SEQ ID NO: 1364439 - RNA, 19 nt, Homo sapiens
gagacaaagugaaaacaua

SEQ ID NO: 1364440 - RNA, 19 nt, Homo sapiens
uugcagagguaccaguuua

SEQ ID NO: 1364441 - RNA, 19 nt, Homo sapiens
gauuucaacuguaaacauc

SEQ ID NO: 1364442 - RNA, 19 nt, Homo sapiens
cauaggcaguguagagaaa

SEQ ID NO: 1364443 - RNA, 19 nt, Homo sapiens
aauaacaacugauggugaa

SEQ ID NO: 1364444 - RNA, 19 nt, Homo sapiens
gccuuucaauucaguguua

SEQ ID NO: 1364445 - RNA, 19 nt, Homo sapiens
acaaaccauucacugauuu

SEQ ID NO: 1364446 - RNA, 19 nt, Homo sapiens
gaaagugccaagucaaauc

SEQ ID NO: 1364447 - RNA, 19 nt, Homo sapiens
gcaauggcaccaacgacua

SEQ ID NO: 1364448 - RNA, 19 nt, Homo sapiens
uacaaaccauucacugauu

SEQ ID NO: 1364449 - RNA, 19 nt, Homo sapiens
caagggcgaugaccugauc

SEQ ID NO: 1364450 - RNA, 19 nt, Homo sapiens
guacagcuaugccaaagac

SEQ ID NO: 1364451 - RNA, 19 nt, Homo sapiens
aaacugauagguauuguug

SEQ ID NO: 1364452 - RNA, 19 nt, Homo sapiens
acaguugccuuucaauuca

SEQ ID NO: 1364453 - RNA, 19 nt, Homo sapiens
aaguuuagauguugccuuu

SEQ ID NO: 1364454 - RNA, 19 nt, Homo sapiens
agagaucaaugaggaaauu

SEQ ID NO: 1364455 - RNA, 19 nt, Homo sapiens
cccaugauuucaacuguaa

SEQ ID NO: 1364456 - RNA, 19 nt, Homo sapiens
ugauagguauuguuggaaa

SEQ ID NO: 1364457 - RNA, 19 nt, Homo sapiens
guauugagggacugaauuu

SEQ ID NO: 1364458 - RNA, 19 nt, Homo sapiens
caagguagacuucgacauc

SEQ ID NO: 1364459 - RNA, 19 nt, Homo sapiens
gggaaagcccgaagcagaa

SEQ ID NO: 1364460 - RNA, 19 nt, Homo sapiens
ucaggaacaacgcaaauuu

SEQ ID NO: 1364461 - RNA, 19 nt, Homo sapiens
gcugcuagcuuuggugaug

SEQ ID NO: 1364462 - RNA, 19 nt, Homo sapiens
ggaaaagcuuguuacagaa

SEQ ID NO: 1364463 - RNA, 19 nt, Homo sapiens
ggugaugcucuuccuauuu

SEQ ID NO: 1364464 - RNA, 19 nt, Homo sapiens
aaacacauccugcuuccuu

SEQ ID NO: 1364465 - RNA, 19 nt, Homo sapiens
gagaaauggcguuaaaugg

SEQ ID NO: 1364466 - RNA, 19 nt, Homo sapiens
uggaaaagcuuguuacaga

SEQ ID NO: 1364467 - RNA, 19 nt, Homo sapiens
gccagaauccgaaucagaa

SEQ ID NO: 1364468 - RNA, 19 nt, Homo sapiens
caaaccagacucaccagaa

SEQ ID NO: 1364469 - RNA, 19 nt, Homo sapiens
guuauacuguguguaggua

SEQ ID NO: 1364470 - RNA, 19 nt, Homo sapiens
uggcauagcuuaaaagaug

SEQ ID NO: 1364471 - RNA, 19 nt, Homo sapiens
ggaaagcaucccugcaugu

SEQ ID NO: 1364472 - RNA, 19 nt, Homo sapiens
aaagauggcauagcuuaaa

SEQ ID NO: 1364473 - RNA, 19 nt, Homo sapiens
gcgaaagcgucaggaacaa

SEQ ID NO: 1364474 - RNA, 19 nt, Homo sapiens
caaauccgaaugccaauca

SEQ ID NO: 1364475 - RNA, 19 nt, Homo sapiens
caacaugaacuuuauuucg

SEQ ID NO: 1364476 - RNA, 19 nt, Homo sapiens
agucaaaucugaagcacau

SEQ ID NO: 1364477 - RNA, 19 nt, Homo sapiens
ggaaagugccaagucaaau

SEQ ID NO: 1364478 - RNA, 19 nt, Homo sapiens
ggguuggacuaaauaugaa

SEQ ID NO: 1364479 - RNA, 19 nt, Homo sapiens
ccuacaaucuagccaacaa

SEQ ID NO: 1364480 - RNA, 19 nt, Homo sapiens
cagcgcagcgucuccgaua

SEQ ID NO: 1364481 - RNA, 19 nt, Homo sapiens
ucaagaacaggacucauau

SEQ ID NO: 1364482 - RNA, 19 nt, Homo sapiens
gaucaaugaggaaauucaa

SEQ ID NO: 1364483 - RNA, 19 nt, Homo sapiens
ugaagcacauggcguucuu

SEQ ID NO: 1364484 - RNA, 19 nt, Homo sapiens
aaauuccucuccaaacaug

SEQ ID NO: 1364485 - RNA, 19 nt, Homo sapiens
gaaagccaaaccagacuca

SEQ ID NO: 1364486 - RNA, 19 nt, Homo sapiens
ggaagacccaauaucuguu

SEQ ID NO: 1364487 - RNA, 19 nt, Homo sapiens
gcuacaaccucucugucau

SEQ ID NO: 1364488 - RNA, 19 nt, Homo sapiens
gaaagcaucccugcauguc

SEQ ID NO: 1364489 - RNA, 19 nt, Homo sapiens
agaugaaaguguccaaaca

SEQ ID NO: 1364490 - RNA, 19 nt, Homo sapiens
ggcaaggagcagaaugaua

SEQ ID NO: 1364491 - RNA, 19 nt, Homo sapiens
cgaaucagaaucagaguca

SEQ ID NO: 1364492 - RNA, 19 nt, Homo sapiens
gcaugauuugcaaagauua

SEQ ID NO: 1364493 - RNA, 19 nt, Homo sapiens
uauacuguguguagguaaa

SEQ ID NO: 1364494 - RNA, 19 nt, Homo sapiens
agagaaauggcguuaaaug

SEQ ID NO: 1364495 - RNA, 19 nt, Homo sapiens
gaaaagcuuguuacagaaa

SEQ ID NO: 1364496 - RNA, 19 nt, Homo sapiens
guuuagauguugccuuuac

SEQ ID NO: 1364497 - RNA, 19 nt, Homo sapiens
gcagagguaccaguuuaug

SEQ ID NO: 1364498 - RNA, 19 nt, Homo sapiens
gauagguauuguuggaaag

SEQ ID NO: 1364499 - RNA, 19 nt, Homo sapiens
cuucuacuguuuaaagguu

SEQ ID NO: 1364500 - RNA, 19 nt, Homo sapiens
uuaccgagcuguagaaaau

SEQ ID NO: 1364501 - RNA, 19 nt, Homo sapiens
ucccaaagcgccacugaaa

SEQ ID NO: 1364502 - RNA, 19 nt, Homo sapiens
guagagaucaaugaggaaa

SEQ ID NO: 1364503 - RNA, 19 nt, Homo sapiens
ugaacuuuauuucgccauu

SEQ ID NO: 1364504 - RNA, 19 nt, Homo sapiens
cggaagacccaauaucugu

SEQ ID NO: 1364505 - RNA, 19 nt, Homo sapiens
acugauagguauuguugga

SEQ ID NO: 1364506 - RNA, 19 nt, Homo sapiens
uucaagaacaggacucaua

SEQ ID NO: 1364507 - RNA, 19 nt, Homo sapiens
cgggaaaccuggcucuucu

SEQ ID NO: 1364508 - RNA, 19 nt, Homo sapiens
cauccugcuuccuucauug

SEQ ID NO: 1364509 - RNA, 19 nt, Homo sapiens
ucgggaacauggaugagaa

SEQ ID NO: 1364510 - RNA, 19 nt, Homo sapiens
ccgcgugggucagaagaaa

SEQ ID NO: 1364511 - RNA, 19 nt, Homo sapiens
auauggaguuguacagcua

SEQ ID NO: 1364512 - RNA, 19 nt, Homo sapiens
caaagaguuuauggacugu

SEQ ID NO: 1364513 - RNA, 19 nt, Homo sapiens
uuucuaccuucuacuguuu

SEQ ID NO: 1364514 - RNA, 19 nt, Homo sapiens
cagagguaccaguuuauga

SEQ ID NO: 1364515 - RNA, 19 nt, Homo sapiens
gaacaggacucauaucuug

SEQ ID NO: 1364516 - RNA, 19 nt, Homo sapiens
gaaaguggcauuuauguuu

SEQ ID NO: 1364517 - RNA, 19 nt, Homo sapiens
gcuaagaaauggacuuuaa

SEQ ID NO: 1364518 - RNA, 19 nt, Homo sapiens
gcaaggagcagaaugauaa

SEQ ID NO: 1364519 - RNA, 19 nt, Homo sapiens
caacaauacuggaaucauu

SEQ ID NO: 1364520 - RNA, 19 nt, Homo sapiens
gaacaacgcaaauuucuga

SEQ ID NO: 1364521 - RNA, 19 nt, Homo sapiens
guagugagguuacauauca

SEQ ID NO: 1364522 - RNA, 19 nt, Homo sapiens
guagagaaauggcguuaaa

SEQ ID NO: 1364523 - RNA, 19 nt, Homo sapiens
caaauuaacccauguauag

SEQ ID NO: 1364524 - RNA, 19 nt, Homo sapiens
gaaggacgguucugggaaa

SEQ ID NO: 1364525 - RNA, 19 nt, Homo sapiens
caacugauggugaaucuua

SEQ ID NO: 1364526 - RNA, 19 nt, Homo sapiens
caccagaaauugcuguuua

SEQ ID NO: 1364527 - RNA, 19 nt, Homo sapiens
guagaucacuaugguauuu

SEQ ID NO: 1364528 - RNA, 19 nt, Homo sapiens
gauguugccuuuacaguug

SEQ ID NO: 1364529 - RNA, 19 nt, Homo sapiens
gagaaaaccuucaacauga

SEQ ID NO: 1364530 - RNA, 19 nt, Homo sapiens
uaggaaggcuagccaguua

SEQ ID NO: 1364531 - RNA, 19 nt, Homo sapiens
guaaacaucuguccauugg

SEQ ID NO: 1364532 - RNA, 19 nt, Homo sapiens
gggcaaacccuucuacaaa

SEQ ID NO: 1364533 - RNA, 19 nt, Homo sapiens
gaauggaaauuggcaaaga

SEQ ID NO: 1364534 - RNA, 19 nt, Homo sapiens
acaagaagcuggguauuug

SEQ ID NO: 1364535 - RNA, 19 nt, Homo sapiens
guaguaauauagccacaaa

SEQ ID NO: 1364536 - RNA, 19 nt, Homo sapiens
ggguguaucucacauuaaa

SEQ ID NO: 1364537 - RNA, 19 nt, Homo sapiens
guagugagguccuaaucaa

SEQ ID NO: 1364538 - RNA, 19 nt, Homo sapiens
caaacaaggugacugaaag

SEQ ID NO: 1364539 - RNA, 19 nt, Homo sapiens
gaacuuuauuucgccauuu

SEQ ID NO: 1364540 - RNA, 19 nt, Homo sapiens
caggguguaucucacauua

SEQ ID NO: 1364541 - RNA, 19 nt, Homo sapiens
gcaaagauuaagugcauuu

SEQ ID NO: 1364542 - RNA, 19 nt, Homo sapiens
gcacuguaauuucaacaau

SEQ ID NO: 1364543 - RNA, 19 nt, Homo sapiens
gaaaagauggcauagcuua

SEQ ID NO: 1364544 - RNA, 19 nt, Homo sapiens
cccaauaucuguuugagaa

SEQ ID NO: 1364545 - RNA, 19 nt, Homo sapiens
gaaauuacgagccaaagug

SEQ ID NO: 1364546 - RNA, 19 nt, Homo sapiens
cgugaggcauuauuauaua

SEQ ID NO: 1364547 - RNA, 19 nt, Homo sapiens
aaaccagacucaccagaaa

SEQ ID NO: 1364548 - RNA, 19 nt, Homo sapiens
guacauacuucucccaaag

SEQ ID NO: 1364549 - RNA, 19 nt, Homo sapiens
ccauuuacccaguauaaua

SEQ ID NO: 1364550 - RNA, 19 nt, Homo sapiens
gugaugcucuuccuauuug

SEQ ID NO: 1364551 - RNA, 19 nt, Homo sapiens
gccacaaacuggacaagaa

SEQ ID NO: 1364552 - RNA, 19 nt, Homo sapiens
gcucauguguuucaucugu

SEQ ID NO: 1364553 - RNA, 19 nt, Homo sapiens
acaaucugcucauguguuu

SEQ ID NO: 1364554 - RNA, 19 nt, Homo sapiens
uugcagagguaucaguuua

SEQ ID NO: 1364555 - RNA, 19 nt, Homo sapiens
gaagacccaauaucuguuu

SEQ ID NO: 1364556 - RNA, 19 nt, Homo sapiens
gcaaacccuucuacaaagu

SEQ ID NO: 1364557 - RNA, 19 nt, Homo sapiens
ccuaaaaugugaacucuua

SEQ ID NO: 1364558 - RNA, 19 nt, Homo sapiens
gcagagguaucaguuuaug

SEQ ID NO: 1364559 - RNA, 19 nt, Homo sapiens
ggacugaauuuucuggaua

SEQ ID NO: 1364560 - RNA, 19 nt, Homo sapiens
cagaagcccugcucagaug

SEQ ID NO: 1364561 - RNA, 19 nt, Homo sapiens
gcuguggugugcaugauuu

SEQ ID NO: 1364562 - RNA, 19 nt, Homo sapiens
gacaagaagcuggguauuu

SEQ ID NO: 1364563 - RNA, 19 nt, Homo sapiens
gagccaaaguggagugaug

SEQ ID NO: 1364564 - RNA, 19 nt, Homo sapiens
guccauugguguagcuuua

SEQ ID NO: 1364565 - RNA, 19 nt, Homo sapiens
uaaaugguguguugcugaa

SEQ ID NO: 1364566 - RNA, 19 nt, Homo sapiens
gagacaaagugaaaacaua

SEQ ID NO: 1364567 - RNA, 19 nt, Homo sapiens
gauuucaacuguaaacauc

SEQ ID NO: 1364568 - RNA, 19 nt, Homo sapiens
cauaaagucacaucuugua

SEQ ID NO: 1364569 - RNA, 19 nt, Homo sapiens
caagggacaugcuuagaag

SEQ ID NO: 1364570 - RNA, 19 nt, Homo sapiens
gaguugagcagaguaauuu

SEQ ID NO: 1364571 - RNA, 19 nt, Homo sapiens
aauagcaccuugauaaugu

SEQ ID NO: 1364572 - RNA, 19 nt, Homo sapiens
cauaggcaguguagagaaa

SEQ ID NO: 1364573 - RNA, 19 nt, Homo sapiens
aauaacaacugauggugaa

SEQ ID NO: 1364574 - RNA, 19 nt, Homo sapiens
gccuuucaauucaguguua

SEQ ID NO: 1364575 - RNA, 19 nt, Homo sapiens
acaaaccauucacugauuu

SEQ ID NO: 1364576 - RNA, 19 nt, Homo sapiens
gaaagugccaagucaaauc

SEQ ID NO: 1364577 - RNA, 19 nt, Homo sapiens
uuagaagugugaccauaaa

SEQ ID NO: 1364578 - RNA, 19 nt, Homo sapiens
gcuuagaagugugaccaua

SEQ ID NO: 1364579 - RNA, 19 nt, Homo sapiens
ucagggcacuguaauuuca

SEQ ID NO: 1364580 - RNA, 19 nt, Homo sapiens
gcaauggcaccaacgacua

SEQ ID NO: 1364581 - RNA, 19 nt, Homo sapiens
uaggagagguugaaauuac

SEQ ID NO: 1364582 - RNA, 19 nt, Homo sapiens
uacaaaccauucacugauu

SEQ ID NO: 1364583 - RNA, 19 nt, Homo sapiens
gagcuuguaucaguauuuc

SEQ ID NO: 1364584 - RNA, 19 nt, Homo sapiens
aaagucacaucuuguacaa

SEQ ID NO: 1364585 - RNA, 19 nt, Homo sapiens
guaauuugguaguguaagu

SEQ ID NO: 1364586 - RNA, 19 nt, Homo sapiens
ggcaaacccuucuacaaag

SEQ ID NO: 1364587 - RNA, 19 nt, Homo sapiens
ccaaauuaacccauguaua

SEQ ID NO: 1364588 - RNA, 19 nt, Homo sapiens
caagggcgaugaccugauc

SEQ ID NO: 1364589 - RNA, 19 nt, Homo sapiens
ugaaguggcucgagcucuu

SEQ ID NO: 1364590 - RNA, 19 nt, Homo sapiens
gacugaaaguggcauuuau

SEQ ID NO: 1364591 - RNA, 19 nt, Homo sapiens
ucaggacuuucuuucuaua

SEQ ID NO: 1364592 - RNA, 19 nt, Homo sapiens
ggaaauuggcaaagagaga

SEQ ID NO: 1364593 - RNA, 19 nt, Homo sapiens
guacagcuaugccaaagac

SEQ ID NO: 1364594 - RNA, 19 nt, Homo sapiens
aaacugauagguauuguug

SEQ ID NO: 1364595 - RNA, 19 nt, Homo sapiens
ugugaacucuuacuuacuu

SEQ ID NO: 1364596 - RNA, 19 nt, Homo sapiens
acaguugccuuucaauuca

SEQ ID NO: 1364597 - RNA, 19 nt, Homo sapiens
aaguuuagauguugccuuu

SEQ ID NO: 1364598 - RNA, 19 nt, Homo sapiens
agagaucaaugaggaaauu

SEQ ID NO: 1364599 - RNA, 19 nt, Homo sapiens
gaaguggcucgagcucuua

SEQ ID NO: 1364600 - RNA, 19 nt, Homo sapiens
cccaugauuucaacuguaa

SEQ ID NO: 1364601 - RNA, 19 nt, Homo sapiens
ugauagguauuguuggaaa

SEQ ID NO: 1364602 - RNA, 19 nt, Homo sapiens
agaguaauuugguagugua

SEQ ID NO: 1364603 - RNA, 19 nt, Homo sapiens
ggaaggcuagccaguuauu

SEQ ID NO: 1364604 - RNA, 19 nt, Homo sapiens
gaaguuauucuugaucaga

SEQ ID NO: 1364605 - RNA, 19 nt, Homo sapiens
ggacgguucugggaaaaua

SEQ ID NO: 1364606 - RNA, 19 nt, Homo sapiens
guauugagggacugaauuu

SEQ ID NO: 1364607 - RNA, 19 nt, Homo sapiens
caagguagacuucgacauc

SEQ ID NO: 1364608 - RNA, 19 nt, Homo sapiens
gcagaguaauuugguagug

SEQ ID NO: 1364609 - RNA, 19 nt, Homo sapiens
gggaaagcccgaagcagaa

SEQ ID NO: 1364610 - RNA, 19 nt, Homo sapiens
ucaggaacaacgcaaauuu

SEQ ID NO: 1364611 - RNA, 19 nt, Homo sapiens
gcugcuagcuuuggugaug

SEQ ID NO: 1364612 - RNA, 19 nt, Homo sapiens
cagaguagaggccgaauug

SEQ ID NO: 1364613 - RNA, 19 nt, Homo sapiens
ggaaaagcuuguuacagaa

SEQ ID NO: 1364614 - RNA, 19 nt, Homo sapiens
ugacugaaaguggcauuua

SEQ ID NO: 1364615 - RNA, 19 nt, Homo sapiens
ggaagcaguuuguuaauga

SEQ ID NO: 1364616 - RNA, 19 nt, Homo sapiens
ggaauuugcugcuaagauu

SEQ ID NO: 1364617 - RNA, 19 nt, Homo sapiens
gaaggaagcaguuuguuaa

SEQ ID NO: 1364618 - RNA, 19 nt, Homo sapiens
ggacggagcucaaggagau

SEQ ID NO: 1364619 - RNA, 19 nt, Homo sapiens
caagggaacuuuaaagaau

SEQ ID NO: 1364620 - RNA, 19 nt, Homo sapiens
ggaaggaagcaguuuguua

SEQ ID NO: 1364621 - RNA, 19 nt, Homo sapiens
ggaaagcagugucuggauu

SEQ ID NO: 1364622 - RNA, 19 nt, Homo sapiens
ccacauaauucuuggguuu

SEQ ID NO: 1364623 - RNA, 19 nt, Homo sapiens
gauaggaauuugcugcuaa

SEQ ID NO: 1364624 - RNA, 19 nt, Homo sapiens
caagagagcugucaguuuu

SEQ ID NO: 1364625 - RNA, 19 nt, Homo sapiens
gaaagaacacccaucaugu

SEQ ID NO: 1364626 - RNA, 19 nt, Homo sapiens
gaaagcagugucuggauuu

SEQ ID NO: 1364627 - RNA, 19 nt, Homo sapiens
uaacaucuauugagugcuu

SEQ ID NO: 1364628 - RNA, 19 nt, Homo sapiens
cuucagagcuuucccaaga

SEQ ID NO: 1364629 - RNA, 19 nt, Homo sapiens
caugacagcugcaagaaug

SEQ ID NO: 1364630 - RNA, 19 nt, Homo sapiens
ggaagagacugggaagguu

SEQ ID NO: 1364631 - RNA, 19 nt, Homo sapiens
gcaagggaacuuuaaagaa

SEQ ID NO: 1364632 - RNA, 19 nt, Homo sapiens
gcucagacccuccagauga

SEQ ID NO: 1364633 - RNA, 19 nt, Homo sapiens
gaaauguaggugugaagua

SEQ ID NO: 1364634 - RNA, 19 nt, Homo sapiens
caauggcagugacauguuu

SEQ ID NO: 1364635 - RNA, 19 nt, Homo sapiens
gcaggcaugugacuaacuu

SEQ ID NO: 1364636 - RNA, 19 nt, Homo sapiens
gaggaacccuggaaaugug

SEQ ID NO: 1364637 - RNA, 19 nt, Homo sapiens
gcaugugacuaacuuugaa

SEQ ID NO: 1364638 - RNA, 19 nt, Homo sapiens
cugcauaucuucugugaug

SEQ ID NO: 1364639 - RNA, 19 nt, Homo sapiens
caaaugaguuuaugguaac

SEQ ID NO: 1364640 - RNA, 19 nt, Homo sapiens
caaagucuaaccaucauaa

SEQ ID NO: 1364641 - RNA, 19 nt, Homo sapiens
ggacagcuguuaccuuugc

SEQ ID NO: 1364642 - RNA, 19 nt, Homo sapiens
ugggacagcuguuaccuuu

SEQ ID NO: 1364643 - RNA, 19 nt, Homo sapiens
ggccugggcugugcugaua

SEQ ID NO: 1364644 - RNA, 19 nt, Homo sapiens
gugagggccugucaaagaa

SEQ ID NO: 1364645 - RNA, 19 nt, Homo sapiens
guuaaucaauuucccucua

SEQ ID NO: 1364646 - RNA, 19 nt, Homo sapiens
uaucuucugugaugacaaa

SEQ ID NO: 1364647 - RNA, 19 nt, Homo sapiens
gcucaaagucuaaccauca

SEQ ID NO: 1364648 - RNA, 19 nt, Homo sapiens
ucaugcagaccguguauua

SEQ ID NO: 1364649 - RNA, 19 nt, Homo sapiens
caacauagcaggccauagg

SEQ ID NO: 1364650 - RNA, 19 nt, Homo sapiens
cccaagaaccuaugacuuu

SEQ ID NO: 1364651 - RNA, 19 nt, Homo sapiens
ugaaagaacacccaucaug

SEQ ID NO: 1364652 - RNA, 19 nt, Homo sapiens
cagagucauuccuccauuu

SEQ ID NO: 1364653 - RNA, 19 nt, Homo sapiens
gaaagaaauguagguguga

SEQ ID NO: 1364654 - RNA, 19 nt, Homo sapiens
caucugaccuccugacucu

SEQ ID NO: 1364655 - RNA, 19 nt, Homo sapiens
gagaggaacccuggaaaug

SEQ ID NO: 1364656 - RNA, 19 nt, Homo sapiens
uaugugaccuuaaugagau

SEQ ID NO: 1364657 - RNA, 19 nt, Homo sapiens
cagcguugcucaaagucua

SEQ ID NO: 1364658 - RNA, 19 nt, Homo sapiens
caaccugugcccuguuaua

SEQ ID NO: 1364659 - RNA, 19 nt, Homo sapiens
ccaagagagcugucaguuu

SEQ ID NO: 1364660 - RNA, 19 nt, Homo sapiens
aaauguaggugugaaguau

SEQ ID NO: 1364661 - RNA, 19 nt, Homo sapiens
cagcuauccuuccugugua

SEQ ID NO: 1364662 - RNA, 19 nt, Homo sapiens
gcagcuauccuuccugugu

SEQ ID NO: 1364663 - RNA, 19 nt, Homo sapiens
ccaagaaccuaugacuuuc

SEQ ID NO: 1364664 - RNA, 19 nt, Homo sapiens
gcuguuaccuuugcagugu

SEQ ID NO: 1364665 - RNA, 19 nt, Homo sapiens
gaauuugcugcuaagauuu

SEQ ID NO: 1364666 - RNA, 19 nt, Homo sapiens
gaaaugugaagucucuguu

SEQ ID NO: 1364667 - RNA, 19 nt, Homo sapiens
aauccaaugucuagaauca

SEQ ID NO: 1364668 - RNA, 19 nt, Homo sapiens
aaucacagcaguuaccuuu

SEQ ID NO: 1364669 - RNA, 19 nt, Homo sapiens
ucaccagccuguuguuuua

SEQ ID NO: 1364670 - RNA, 19 nt, Homo sapiens
agaaugaccucugucuguu

SEQ ID NO: 1364671 - RNA, 19 nt, Homo sapiens
ugccugcacuuacuuugua

SEQ ID NO: 1364672 - RNA, 19 nt, Homo sapiens
ugagggagauaggaauuug

SEQ ID NO: 1364673 - RNA, 19 nt, Homo sapiens
ucaaggauaucugauugga

SEQ ID NO: 1364674 - RNA, 19 nt, Homo sapiens
gaccuucccuggguuaauc

SEQ ID NO: 1364675 - RNA, 19 nt, Homo sapiens
ccagagucauuccuccauu

SEQ ID NO: 1364676 - RNA, 19 nt, Homo sapiens
gcaauggcagugacauguu

SEQ ID NO: 1364677 - RNA, 19 nt, Homo sapiens
caauuucccucuagacaac

SEQ ID NO: 1364678 - RNA, 19 nt, Homo sapiens
auguaggugugaaguauua

SEQ ID NO: 1364679 - RNA, 19 nt, Homo sapiens
gagcgccucuuugggauuc

SEQ ID NO: 1364680 - RNA, 19 nt, Homo sapiens
aaauaugccugggaagaga

SEQ ID NO: 1364681 - RNA, 19 nt, Homo sapiens
gaguuuaugguaacacaaa

SEQ ID NO: 1364682 - RNA, 19 nt, Homo sapiens
ggcaagggaacuuuaaaga

SEQ ID NO: 1364683 - RNA, 19 nt, Homo sapiens
gaagcaguuuguuaaugag

SEQ ID NO: 1364684 - RNA, 19 nt, Homo sapiens
ucagagcuuucccaagaga

SEQ ID NO: 1364685 - RNA, 19 nt, Homo sapiens
gguggaguuuccucuguga

SEQ ID NO: 1364686 - RNA, 19 nt, Homo sapiens
cguggucgcuggagcuuug

SEQ ID NO: 1364687 - RNA, 19 nt, Homo sapiens
gcaagaaugaccucugucu

SEQ ID NO: 1364688 - RNA, 19 nt, Homo sapiens
ggaaaugugaagucucugu

SEQ ID NO: 1364689 - RNA, 19 nt, Homo sapiens
cuaaauccaaugucuagaa

SEQ ID NO: 1364690 - RNA, 19 nt, Homo sapiens
gagacugagcugcauggua

SEQ ID NO: 1364691 - RNA, 19 nt, Homo sapiens
ucaggugaaccacauaauu

SEQ ID NO: 1364692 - RNA, 19 nt, Homo sapiens
cauccugucuccuucacuu

SEQ ID NO: 1364693 - RNA, 19 nt, Homo sapiens
cgguugagauugagagaga

SEQ ID NO: 1364694 - RNA, 19 nt, Homo sapiens
aaagaaauguaggugugaa

SEQ ID NO: 1364695 - RNA, 19 nt, Homo sapiens
ucacagcaguuaccuuugc

SEQ ID NO: 1364696 - RNA, 19 nt, Homo sapiens
ggaaccaugccacucuuga

SEQ ID NO: 1364697 - RNA, 19 nt, Homo sapiens
gaaugaccucugucuguug

SEQ ID NO: 1364698 - RNA, 19 nt, Homo sapiens
aaagaacacccaucaugug

SEQ ID NO: 1364699 - RNA, 19 nt, Homo sapiens
ccucuuugguuucuucaga

SEQ ID NO: 1364700 - RNA, 19 nt, Homo sapiens
gcuagugauuucugaacau

SEQ ID NO: 1364701 - RNA, 19 nt, Homo sapiens
ggguuuccguuccuacuug

SEQ ID NO: 1364702 - RNA, 19 nt, Homo sapiens
caggugaaccacauaauuc

SEQ ID NO: 1364703 - RNA, 19 nt, Homo sapiens
cuuccuguguauacaaaua

SEQ ID NO: 1364704 - RNA, 19 nt, Homo sapiens
ggagauaccccucaacuca

SEQ ID NO: 1364705 - RNA, 19 nt, Homo sapiens
gaugaccuucccuggguua

SEQ ID NO: 1364706 - RNA, 19 nt, Homo sapiens
ucagugcagggaacucuua

SEQ ID NO: 1364707 - RNA, 19 nt, Homo sapiens
aaugaccucugucuguuga

SEQ ID NO: 1364708 - RNA, 19 nt, Homo sapiens
uuuccugccuuauuuagaa

SEQ ID NO: 1364709 - RNA, 19 nt, Homo sapiens
ucccuggguuaaucaauuu

SEQ ID NO: 1364710 - RNA, 19 nt, Homo sapiens
gugaaccacauaauucuug

SEQ ID NO: 1364711 - RNA, 19 nt, Homo sapiens
uaggccaccuucucccuuu

SEQ ID NO: 1364712 - RNA, 19 nt, Homo sapiens
uuaaucaauuucccucuag

SEQ ID NO: 1364713 - RNA, 19 nt, Homo sapiens
cacaaaugaguuuauggua

SEQ ID NO: 1364714 - RNA, 19 nt, Homo sapiens
uagacccacuuccgcauug

SEQ ID NO: 1364715 - RNA, 19 nt, Homo sapiens
gaaauguacucccuuggaa

SEQ ID NO: 1364716 - RNA, 19 nt, Homo sapiens
gaacgagucuuguuucucu

SEQ ID NO: 1364717 - RNA, 19 nt, Homo sapiens
uagcagagcucacucaguu

SEQ ID NO: 1364718 - RNA, 19 nt, Homo sapiens
ggaaacuucuguugagcua

SEQ ID NO: 1364719 - RNA, 19 nt, Homo sapiens
gaagaaaggacucagaaga

SEQ ID NO: 1364720 - RNA, 19 nt, Homo sapiens
ccaaucagguuaaucagaa

SEQ ID NO: 1364721 - RNA, 19 nt, Homo sapiens
ggaaggaccugaugagaac

SEQ ID NO: 1364722 - RNA, 19 nt, Homo sapiens
ucaaggaggugcuggacua

SEQ ID NO: 1364723 - RNA, 19 nt, Homo sapiens
ggauaccacugcuguaaug

SEQ ID NO: 1364724 - RNA, 19 nt, Homo sapiens
gaacagccaaauacacuuu

SEQ ID NO: 1364725 - RNA, 19 nt, Homo sapiens
gauaugauuugccuauugu

SEQ ID NO: 1364726 - RNA, 19 nt, Homo sapiens
gaagauaugauuugccuau

SEQ ID NO: 1364727 - RNA, 19 nt, Homo sapiens
gaacccauguccucacuuc

SEQ ID NO: 1364728 - RNA, 19 nt, Homo sapiens
gaaaaggcauccccaaaug

SEQ ID NO: 1364729 - RNA, 19 nt, Homo sapiens
ucacucaguucucacagua

SEQ ID NO: 1364730 - RNA, 19 nt, Homo sapiens
ggcccaaguuugauguuua

SEQ ID NO: 1364731 - RNA, 19 nt, Homo sapiens
caaggaaacuucuguugag

SEQ ID NO: 1364732 - RNA, 19 nt, Homo sapiens
gaaaggaggucaggguucu

SEQ ID NO: 1364733 - RNA, 19 nt, Homo sapiens
gcaaagcuuuucuucauuu

SEQ ID NO: 1364734 - RNA, 19 nt, Homo sapiens
gcgcuaacguugucaagga

SEQ ID NO: 1364735 - RNA, 19 nt, Homo sapiens
cagagagggucaggaauuu

SEQ ID NO: 1364736 - RNA, 19 nt, Homo sapiens
gaugauggccugcuucaga

SEQ ID NO: 1364737 - RNA, 19 nt, Homo sapiens
ggguugcccuuguguagua

SEQ ID NO: 1364738 - RNA, 19 nt, Homo sapiens
ucaaagaauugcucaucaa

SEQ ID NO: 1364739 - RNA, 19 nt, Homo sapiens
ugaaacagagucucacuaa

SEQ ID NO: 1364740 - RNA, 19 nt, Homo sapiens
acaagagccuccacccuuu

SEQ ID NO: 1364741 - RNA, 19 nt, Homo sapiens
gaagcuagacauugaugaa

SEQ ID NO: 1364742 - RNA, 19 nt, Homo sapiens
aagaauugcucaucaagga

SEQ ID NO: 1364743 - RNA, 19 nt, Homo sapiens
uaccacugcuguaauguaa

SEQ ID NO: 1364744 - RNA, 19 nt, Homo sapiens
ccucugaccacuuguguua

SEQ ID NO: 1364745 - RNA, 19 nt, Homo sapiens
gggaggagcucugagaaca

SEQ ID NO: 1364746 - RNA, 19 nt, Homo sapiens
gaaacagagucucacuaag

SEQ ID NO: 1364747 - RNA, 19 nt, Homo sapiens
uguccucacuucaagguua

SEQ ID NO: 1364748 - RNA, 19 nt, Homo sapiens
gacuguaacuccugucuca

SEQ ID NO: 1364749 - RNA, 19 nt, Homo sapiens
gguaucagucucuuuauug

SEQ ID NO: 1364750 - RNA, 19 nt, Homo sapiens
gggcaauguucccuuguug

SEQ ID NO: 1364751 - RNA, 19 nt, Homo sapiens
gagaauaccccuuaucuga

SEQ ID NO: 1364752 - RNA, 19 nt, Homo sapiens
agaaaggacucagaagaga

SEQ ID NO: 1364753 - RNA, 19 nt, Homo sapiens
aaacagagucucacuaagu

SEQ ID NO: 1364754 - RNA, 19 nt, Homo sapiens
ccagagagggucaggaauu

SEQ ID NO: 1364755 - RNA, 19 nt, Homo sapiens
gggaaggaccugaugagaa

SEQ ID NO: 1364756 - RNA, 19 nt, Homo sapiens
gcccaaguuugauguuuau

SEQ ID NO: 1364757 - RNA, 19 nt, Homo sapiens
ggacuaacccuugccuaga

SEQ ID NO: 1364758 - RNA, 19 nt, Homo sapiens
aauguaacccucuuuguuu

SEQ ID NO: 1364759 - RNA, 19 nt, Homo sapiens
uaauguaacccucuuuguu

SEQ ID NO: 1364760 - RNA, 19 nt, Homo sapiens
gaccagcgcuaacguuguc

SEQ ID NO: 1364761 - RNA, 19 nt, Homo sapiens
uccaagaccuacugaguga

SEQ ID NO: 1364762 - RNA, 19 nt, Homo sapiens
ugaggaugauugcugguuu

SEQ ID NO: 1364763 - RNA, 19 nt, Homo sapiens
gacuaacccuugccuagau

SEQ ID NO: 1364764 - RNA, 19 nt, Homo sapiens
ucggcucccuguauaauaa

SEQ ID NO: 1364765 - RNA, 19 nt, Homo sapiens
acacaagggugcacugagu

SEQ ID NO: 1364766 - RNA, 19 nt, Homo sapiens
agauaugauuugccuauug

SEQ ID NO: 1364767 - RNA, 19 nt, Homo sapiens
aacagagucucacuaaguu

SEQ ID NO: 1364768 - RNA, 19 nt, Homo sapiens
ucagauggaagauaugauu

SEQ ID NO: 1364769 - RNA, 19 nt, Homo sapiens
guagccaaaugaagcaguu

SEQ ID NO: 1364770 - RNA, 19 nt, Homo sapiens
gaggaugauugcugguuuc

SEQ ID NO: 1364771 - RNA, 19 nt, Homo sapiens
caaguuugauguuuaugag

SEQ ID NO: 1364772 - RNA, 19 nt, Homo sapiens
gggaagaaaggacucagaa

SEQ ID NO: 1364773 - RNA, 19 nt, Homo sapiens
acuaucggcucccuguaua

SEQ ID NO: 1364774 - RNA, 19 nt, Homo sapiens
gaggagcucugagaacagu

SEQ ID NO: 1364775 - RNA, 19 nt, Homo sapiens
caaaugaagcaguuaugug

SEQ ID NO: 1364776 - RNA, 19 nt, Homo sapiens
cgcggcagcugcaggauuu

SEQ ID NO: 1364777 - RNA, 19 nt, Homo sapiens
caagugguaauucaugaaa

SEQ ID NO: 1364778 - RNA, 19 nt, Homo sapiens
ugucguggcugcuccaaau

SEQ ID NO: 1364779 - RNA, 19 nt, Homo sapiens
ugaagcagaucaaggaaac

SEQ ID NO: 1364780 - RNA, 19 nt, Homo sapiens
ccagaucucucgccguuac

SEQ ID NO: 1364781 - RNA, 19 nt, Homo sapiens
guaacccucuuuguuuaga

SEQ ID NO: 1364782 - RNA, 19 nt, Homo sapiens
gguggaaucagaaucuauu

SEQ ID NO: 1364783 - RNA, 19 nt, Homo sapiens
uucaugagcuuauuaugga

SEQ ID NO: 1364784 - RNA, 19 nt, Homo sapiens
gcacaggucacagcuagga

SEQ ID NO: 1364785 - RNA, 19 nt, Homo sapiens
gggcccaaguuugauguuu

SEQ ID NO: 1364786 - RNA, 19 nt, Homo sapiens
gaaccccaguugacaguuu

SEQ ID NO: 1364787 - RNA, 19 nt, Homo sapiens
auguaacccucuuuguuua

SEQ ID NO: 1364788 - RNA, 19 nt, Homo sapiens
gcuagacauugaugaacga

SEQ ID NO: 1364789 - RNA, 19 nt, Homo sapiens
aaaugaagcaguuaugugu

SEQ ID NO: 1364790 - RNA, 19 nt, Homo sapiens
gaccacuuguguuaggaaa

SEQ ID NO: 1364791 - RNA, 19 nt, Homo sapiens
guauaaagaauccuugagu

SEQ ID NO: 1364792 - RNA, 19 nt, Homo sapiens
gaauuuggccccaugauga

SEQ ID NO: 1364793 - RNA, 19 nt, Homo sapiens
gaugaacgagucuuguuuc

SEQ ID NO: 1364794 - RNA, 19 nt, Homo sapiens
ccaaguuugauguuuauga

SEQ ID NO: 1364795 - RNA, 19 nt, Homo sapiens
caagccagguccuccaagu

SEQ ID NO: 1364796 - RNA, 19 nt, Homo sapiens
agaacagucuccuucaaca

SEQ ID NO: 1364797 - RNA, 19 nt, Homo sapiens
gcuacagcuugcucucuga

SEQ ID NO: 1364798 - RNA, 19 nt, Homo sapiens
guaucagucucuuuauugg

SEQ ID NO: 1364799 - RNA, 19 nt, Homo sapiens
gaucaaggaaacuucuguu

SEQ ID NO: 1364800 - RNA, 19 nt, Homo sapiens
aagagaaugugaagcagau

SEQ ID NO: 1364801 - RNA, 19 nt, Homo sapiens
ccaaguacgugcucuacac

SEQ ID NO: 1364802 - RNA, 19 nt, Homo sapiens
cagaaucacuuagagaacu

SEQ ID NO: 1364803 - RNA, 19 nt, Homo sapiens
gugaugcuauugguacuug

SEQ ID NO: 1364804 - RNA, 19 nt, Homo sapiens
uggaagaagucccggaaca

SEQ ID NO: 1364805 - RNA, 19 nt, Homo sapiens
gauggaagauaugauuugc

SEQ ID NO: 1364806 - RNA, 19 nt, Homo sapiens
ggacugcggguuuggauac

SEQ ID NO: 1364807 - RNA, 19 nt, Homo sapiens
ggaaucagaaucuauuuug

SEQ ID NO: 1364808 - RNA, 19 nt, Homo sapiens
cggcugcucuucgaaguga

SEQ ID NO: 1364809 - RNA, 19 nt, Homo sapiens
caagaccuacugagugaga

SEQ ID NO: 1364810 - RNA, 19 nt, Homo sapiens
ggauugugaugcuauuggu

SEQ ID NO: 1364811 - RNA, 19 nt, Homo sapiens
ugaaauguacucccuugga

SEQ ID NO: 1364812 - RNA, 19 nt, Homo sapiens
aaagaauccuugaguuuug

SEQ ID NO: 1364813 - RNA, 19 nt, Homo sapiens
augaagcaguuauguguug

SEQ ID NO: 1364814 - RNA, 19 nt, Homo sapiens
caccuguacuggccucuau

SEQ ID NO: 1364815 - RNA, 19 nt, Homo sapiens
gaaauguacucccuuggaa

SEQ ID NO: 1364816 - RNA, 19 nt, Homo sapiens
gaacgagucuuguuucucu

SEQ ID NO: 1364817 - RNA, 19 nt, Homo sapiens
uagcagagcucacucaguu

SEQ ID NO: 1364818 - RNA, 19 nt, Homo sapiens
gaagaaaggacucagaaga

SEQ ID NO: 1364819 - RNA, 19 nt, Homo sapiens
ccaaucagguuaaucagaa

SEQ ID NO: 1364820 - RNA, 19 nt, Homo sapiens
ggauaccacugcuguaaug

SEQ ID NO: 1364821 - RNA, 19 nt, Homo sapiens
gauaugauuugccuauugu

SEQ ID NO: 1364822 - RNA, 19 nt, Homo sapiens
gaagauaugauuugccuau

SEQ ID NO: 1364823 - RNA, 19 nt, Homo sapiens
gaacccauguccucacuuc

SEQ ID NO: 1364824 - RNA, 19 nt, Homo sapiens
gaaaaggcauccccaaaug

SEQ ID NO: 1364825 - RNA, 19 nt, Homo sapiens
ucacucaguucucacagua

SEQ ID NO: 1364826 - RNA, 19 nt, Homo sapiens
ggcccaaguuugauguuua

SEQ ID NO: 1364827 - RNA, 19 nt, Homo sapiens
gaaaggaggucaggguucu

SEQ ID NO: 1364828 - RNA, 19 nt, Homo sapiens
gcaaagcuuuucuucauuu

SEQ ID NO: 1364829 - RNA, 19 nt, Homo sapiens
gcgcuaacguugucaagga

SEQ ID NO: 1364830 - RNA, 19 nt, Homo sapiens
cagagagggucaggaauuu

SEQ ID NO: 1364831 - RNA, 19 nt, Homo sapiens
gaagcuagacauugaugaa

SEQ ID NO: 1364832 - RNA, 19 nt, Homo sapiens
uaccacugcuguaauguaa

SEQ ID NO: 1364833 - RNA, 19 nt, Homo sapiens
ccucugaccacuuguguua

SEQ ID NO: 1364834 - RNA, 19 nt, Homo sapiens
gggaggagcucugagaaca

SEQ ID NO: 1364835 - RNA, 19 nt, Homo sapiens
uguccucacuucaagguua

SEQ ID NO: 1364836 - RNA, 19 nt, Homo sapiens
gagaauaccccuuaucuga

SEQ ID NO: 1364837 - RNA, 19 nt, Homo sapiens
agaaaggacucagaagaga

SEQ ID NO: 1364838 - RNA, 19 nt, Homo sapiens
ccagagagggucaggaauu

SEQ ID NO: 1364839 - RNA, 19 nt, Homo sapiens
gcccaaguuugauguuuau

SEQ ID NO: 1364840 - RNA, 19 nt, Homo sapiens
aauguaacccucuuuguuu

SEQ ID NO: 1364841 - RNA, 19 nt, Homo sapiens
uaauguaacccucuuuguu

SEQ ID NO: 1364842 - RNA, 19 nt, Homo sapiens
gaccagcgcuaacguuguc

SEQ ID NO: 1364843 - RNA, 19 nt, Homo sapiens
uccaagaccuacugaguga

SEQ ID NO: 1364844 - RNA, 19 nt, Homo sapiens
ugaggaugauugcugguuu

SEQ ID NO: 1364845 - RNA, 19 nt, Homo sapiens
ucggcucccuguauaauaa

SEQ ID NO: 1364846 - RNA, 19 nt, Homo sapiens
acacaagggugcacugagu

SEQ ID NO: 1364847 - RNA, 19 nt, Homo sapiens
agauaugauuugccuauug

SEQ ID NO: 1364848 - RNA, 19 nt, Homo sapiens
ucagauggaagauaugauu

SEQ ID NO: 1364849 - RNA, 19 nt, Homo sapiens
guagccaaaugaagcaguu

SEQ ID NO: 1364850 - RNA, 19 nt, Homo sapiens
gaggaugauugcugguuuc

SEQ ID NO: 1364851 - RNA, 19 nt, Homo sapiens
caaguuugauguuuaugag

SEQ ID NO: 1364852 - RNA, 19 nt, Homo sapiens
gggaagaaaggacucagaa

SEQ ID NO: 1364853 - RNA, 19 nt, Homo sapiens
acuaucggcucccuguaua

SEQ ID NO: 1364854 - RNA, 19 nt, Homo sapiens
gaggagcucugagaacagu

SEQ ID NO: 1364855 - RNA, 19 nt, Homo sapiens
caaaugaagcaguuaugug

SEQ ID NO: 1364856 - RNA, 19 nt, Homo sapiens
cgcggcagcugcaggauuu

SEQ ID NO: 1364857 - RNA, 19 nt, Homo sapiens
caagugguaauucaugaaa

SEQ ID NO: 1364858 - RNA, 19 nt, Homo sapiens
ugucguggcugcuccaaau

SEQ ID NO: 1364859 - RNA, 19 nt, Homo sapiens
ccagaucucucgccguuac

SEQ ID NO: 1364860 - RNA, 19 nt, Homo sapiens
guaacccucuuuguuuaga

SEQ ID NO: 1364861 - RNA, 19 nt, Homo sapiens
gguggaaucagaaucuauu

SEQ ID NO: 1364862 - RNA, 19 nt, Homo sapiens
uucaugagcuuauuaugga

SEQ ID NO: 1364863 - RNA, 19 nt, Homo sapiens
gggcccaaguuugauguuu

SEQ ID NO: 1364864 - RNA, 19 nt, Homo sapiens
gaaccccaguugacaguuu

SEQ ID NO: 1364865 - RNA, 19 nt, Homo sapiens
auguaacccucuuuguuua

SEQ ID NO: 1364866 - RNA, 19 nt, Homo sapiens
gcuagacauugaugaacga

SEQ ID NO: 1364867 - RNA, 19 nt, Homo sapiens
aaaugaagcaguuaugugu

SEQ ID NO: 1364868 - RNA, 19 nt, Homo sapiens
gaccacuuguguuaggaaa

SEQ ID NO: 1364869 - RNA, 19 nt, Homo sapiens
guauaaagaauccuugagu

SEQ ID NO: 1364870 - RNA, 19 nt, Homo sapiens
gaauuuggccccaugauga

SEQ ID NO: 1364871 - RNA, 19 nt, Homo sapiens
gaugaacgagucuuguuuc

SEQ ID NO: 1364872 - RNA, 19 nt, Homo sapiens
ccaaguacgugcucuacac

SEQ ID NO: 1364873 - RNA, 19 nt, Homo sapiens
ccaaguuugauguuuauga

SEQ ID NO: 1364874 - RNA, 19 nt, Homo sapiens
caagccagguccuccaagu

SEQ ID NO: 1364875 - RNA, 19 nt, Homo sapiens
agaacagucuccuucaaca

SEQ ID NO: 1364876 - RNA, 19 nt, Homo sapiens
cagaaucacuuagagaacu

SEQ ID NO: 1364877 - RNA, 19 nt, Homo sapiens
gugaugcuauugguacuug

SEQ ID NO: 1364878 - RNA, 19 nt, Homo sapiens
uggaagaagucccggaaca

SEQ ID NO: 1364879 - RNA, 19 nt, Homo sapiens
gauggaagauaugauuugc

SEQ ID NO: 1364880 - RNA, 19 nt, Homo sapiens
cggcugcucuucgaaguga

SEQ ID NO: 1364881 - RNA, 19 nt, Homo sapiens
ggacugcggguuuggauac

SEQ ID NO: 1364882 - RNA, 19 nt, Homo sapiens
ggaaucagaaucuauuuug

SEQ ID NO: 1364883 - RNA, 19 nt, Homo sapiens
caagaccuacugagugaga

SEQ ID NO: 1364884 - RNA, 19 nt, Homo sapiens
ggauugugaugcuauuggu

SEQ ID NO: 1364885 - RNA, 19 nt, Homo sapiens
ugaaauguacucccuugga

SEQ ID NO: 1364886 - RNA, 19 nt, Homo sapiens
aaagaauccuugaguuuug

SEQ ID NO: 1364887 - RNA, 19 nt, Homo sapiens
augaagcaguuauguguug

SEQ ID NO: 1364888 - RNA, 19 nt, Homo sapiens
gcuguaauguaacccucuu

SEQ ID NO: 1364889 - RNA, 19 nt, Homo sapiens
gaguauaaagaauccuuga

SEQ ID NO: 1364890 - RNA, 19 nt, Homo sapiens
ggaagaaaggacucagaag

SEQ ID NO: 1364891 - RNA, 19 nt, Homo sapiens
auacaaagaaucugaacug

SEQ ID NO: 1364892 - RNA, 19 nt, Homo sapiens
acaguuuccuggaccuuau

SEQ ID NO: 1364893 - RNA, 19 nt, Homo sapiens
gaaucacuuagagaacuua

SEQ ID NO: 1364894 - RNA, 19 nt, Homo sapiens
gaauaccccuuaucugagu

SEQ ID NO: 1364895 - RNA, 19 nt, Homo sapiens
gaugggacgucaggagaag

SEQ ID NO: 1364896 - RNA, 19 nt, Homo sapiens
ggaugggacgucaggagaa

SEQ ID NO: 1364897 - RNA, 19 nt, Homo sapiens
agaaucacuuagagaacuu

SEQ ID NO: 1364898 - RNA, 19 nt, Homo sapiens
ugaugaacgagucuuguuu

SEQ ID NO: 1364899 - RNA, 19 nt, Homo sapiens
ugaugaagccaaaucugaa

SEQ ID NO: 1364900 - RNA, 19 nt, Homo sapiens
ccaaaugaagcaguuaugu

SEQ ID NO: 1364901 - RNA, 19 nt, Homo sapiens
gcagagcucacucaguucu

SEQ ID NO: 1364902 - RNA, 19 nt, Homo sapiens
uauuauggaccgucauuga

SEQ ID NO: 1364903 - RNA, 19 nt, Homo sapiens
cagauggaagauaugauuu

SEQ ID NO: 1364904 - RNA, 19 nt, Homo sapiens
gagguucagauggaagaua

SEQ ID NO: 1364905 - RNA, 19 nt, Homo sapiens
guaauguaacccucuuugu

SEQ ID NO: 1364906 - RNA, 19 nt, Homo sapiens
caaauggcagucugaugga

SEQ ID NO: 1364907 - RNA, 19 nt, Homo sapiens
caaucagguuaaucagaau

SEQ ID NO: 1364908 - RNA, 19 nt, Homo sapiens
guccagaggccgagcaguu

SEQ ID NO: 1364909 - RNA, 19 nt, Homo sapiens
gagagggucaggaauuugg

SEQ ID NO: 1364910 - RNA, 19 nt, Homo sapiens
uccaagugguaauucauga

SEQ ID NO: 1364911 - RNA, 19 nt, Homo sapiens
gaacagucuccuucaacag

SEQ ID NO: 1364912 - RNA, 19 nt, Homo sapiens
gagggaggagcucugagaa

SEQ ID NO: 1364913 - RNA, 19 nt, Homo sapiens
guucagauggaagauauga

SEQ ID NO: 1364914 - RNA, 19 nt, Homo sapiens
guucugaagcuagacauug

SEQ ID NO: 1364915 - RNA, 19 nt, Homo sapiens
ugaaugggcuccugauuaa

SEQ ID NO: 1364916 - RNA, 19 nt, Homo sapiens
cagcaaaucuuaaucuguu

SEQ ID NO: 1364917 - RNA, 19 nt, Homo sapiens
ggagugagacccuggauaa

SEQ ID NO: 1364918 - RNA, 19 nt, Homo sapiens
caacuuacuugaugcuuga

SEQ ID NO: 1364919 - RNA, 19 nt, Homo sapiens
ggucuaagauaagagauaa

SEQ ID NO: 1364920 - RNA, 19 nt, Homo sapiens
uuacucagguggccacaua

SEQ ID NO: 1364921 - RNA, 19 nt, Homo sapiens
gaacauacagauccuggaa

SEQ ID NO: 1364922 - RNA, 19 nt, Homo sapiens
gcccagauguuccaaguau

SEQ ID NO: 1364923 - RNA, 19 nt, Homo sapiens
ccauuucccugagaucuua

SEQ ID NO: 1364924 - RNA, 19 nt, Homo sapiens
gaaauccacacaccucauu

SEQ ID NO: 1364925 - RNA, 19 nt, Homo sapiens
cagcugcccugcaaagaaa

SEQ ID NO: 1364926 - RNA, 19 nt, Homo sapiens
uggcuucucuguuccguua

SEQ ID NO: 1364927 - RNA, 19 nt, Homo sapiens
gcagguccaacucugauua

SEQ ID NO: 1364928 - RNA, 19 nt, Homo sapiens
uaccagagcugcuuuaugc

SEQ ID NO: 1364929 - RNA, 19 nt, Homo sapiens
gcaccaaggaggaguuuga

SEQ ID NO: 1364930 - RNA, 19 nt, Homo sapiens
ggaggugggucagcuguug

SEQ ID NO: 1364931 - RNA, 19 nt, Homo sapiens
gcaugugucuagcucaaug

SEQ ID NO: 1364932 - RNA, 19 nt, Homo sapiens
acacucacauccacccaua

SEQ ID NO: 1364933 - RNA, 19 nt, Homo sapiens
ggacaacaaggacaagguu

SEQ ID NO: 1364934 - RNA, 19 nt, Homo sapiens
gauaagcaccuggcaguga

SEQ ID NO: 1364935 - RNA, 19 nt, Homo sapiens
ucuaucagcugucccuuga

SEQ ID NO: 1364936 - RNA, 19 nt, Homo sapiens
auacagauccuggaagaua

SEQ ID NO: 1364937 - RNA, 19 nt, Homo sapiens
ucccugagaucuuauuuau

SEQ ID NO: 1364938 - RNA, 19 nt, Homo sapiens
guggugagguugagguuug

SEQ ID NO: 1364939 - RNA, 19 nt, Homo sapiens
gcccagagaugcucaugca

SEQ ID NO: 1364940 - RNA, 19 nt, Homo sapiens
ugagaaaguuguauacacu

SEQ ID NO: 1364941 - RNA, 19 nt, Homo sapiens
cugaaugggcuccugauua

SEQ ID NO: 1364942 - RNA, 19 nt, Homo sapiens
gaaacaagguauggcuucu

SEQ ID NO: 1364943 - RNA, 19 nt, Homo sapiens
cagagcugcuuuaugcaaa

SEQ ID NO: 1364944 - RNA, 19 nt, Homo sapiens
uaacccgucuccuuuaagu

SEQ ID NO: 1364945 - RNA, 19 nt, Homo sapiens
caucuaccauggccugcua

SEQ ID NO: 1364946 - RNA, 19 nt, Homo sapiens
gggugagacuccaucuaaa

SEQ ID NO: 1364947 - RNA, 19 nt, Homo sapiens
ggagucagcaaaucuuaau

SEQ ID NO: 1364948 - RNA, 19 nt, Homo sapiens
acauacagauccuggaaga

SEQ ID NO: 1364949 - RNA, 19 nt, Homo sapiens
ccugagaucuuauuuaucc

SEQ ID NO: 1364950 - RNA, 19 nt, Homo sapiens
ucacuuaacccgucuccuu

SEQ ID NO: 1364951 - RNA, 19 nt, Homo sapiens
guccaacucugauuauucu

SEQ ID NO: 1364952 - RNA, 19 nt, Homo sapiens
cagaaaagaugaacauaca

SEQ ID NO: 1364953 - RNA, 19 nt, Homo sapiens
ccaguuagauaccuucaac

SEQ ID NO: 1364954 - RNA, 19 nt, Homo sapiens
gugagacccuggauaagca

SEQ ID NO: 1364955 - RNA, 19 nt, Homo sapiens
uggagcagcugguagaauc

SEQ ID NO: 1364956 - RNA, 19 nt, Homo sapiens
acacacacacacucccuua

SEQ ID NO: 1364957 - RNA, 19 nt, Homo sapiens
uaccauggccugcuaccua

SEQ ID NO: 1364958 - RNA, 19 nt, Homo sapiens
guggucagcugcccugcaa

SEQ ID NO: 1364959 - RNA, 19 nt, Homo sapiens
gaaaagaugaacauacaga

SEQ ID NO: 1364960 - RNA, 19 nt, Homo sapiens
uguauacacuccugagcaa

SEQ ID NO: 1364961 - RNA, 19 nt, Homo sapiens
ggacucaagcccaccuaug

SEQ ID NO: 1364962 - RNA, 19 nt, Homo sapiens
ggcagcaaguggagugaga

SEQ ID NO: 1364963 - RNA, 19 nt, Homo sapiens
ucucucagccuuccacauu

SEQ ID NO: 1364964 - RNA, 19 nt, Homo sapiens
uauccuagcuauggaguuc

SEQ ID NO: 1364965 - RNA, 19 nt, Homo sapiens
aaagaucugggaaugauug

SEQ ID NO: 1364966 - RNA, 19 nt, Homo sapiens
uagcaugugucuagcucaa

SEQ ID NO: 1364967 - RNA, 19 nt, Homo sapiens
gguggauccucauuuccuu

SEQ ID NO: 1364968 - RNA, 19 nt, Homo sapiens
ccagauguuccaaguauuc

SEQ ID NO: 1364969 - RNA, 19 nt, Homo sapiens
agacaggagucagcaaauc

SEQ ID NO: 1364970 - RNA, 19 nt, Homo sapiens
gcagacaaggcaaacuuca

SEQ ID NO: 1364971 - RNA, 19 nt, Homo sapiens
caagguauggcuucucugu

SEQ ID NO: 1364972 - RNA, 19 nt, Homo sapiens
ucucagccuuccacauuug

SEQ ID NO: 1364973 - RNA, 19 nt, Homo sapiens
ccaaguauucaagaaguuu

SEQ ID NO: 1364974 - RNA, 19 nt, Homo sapiens
acagcuggauugggccuua

SEQ ID NO: 1364975 - RNA, 19 nt, Homo sapiens
agguauggcuucucuguuc

SEQ ID NO: 1364976 - RNA, 19 nt, Homo sapiens
ccugguggauccucauuuc

SEQ ID NO: 1364977 - RNA, 19 nt, Homo sapiens
caggagucagcaaaucuua

SEQ ID NO: 1364978 - RNA, 19 nt, Homo sapiens
gguccaacucugauuauuc

SEQ ID NO: 1364979 - RNA, 19 nt, Homo sapiens
gaguuugagcggagguaua

SEQ ID NO: 1364980 - RNA, 19 nt, Homo sapiens
cacacuggcugcucaacga

SEQ ID NO: 1364981 - RNA, 19 nt, Homo sapiens
caacuaccagagcugcuuu

SEQ ID NO: 1364982 - RNA, 19 nt, Homo sapiens
gaucugggaaugauugucu

SEQ ID NO: 1364983 - RNA, 19 nt, Homo sapiens
aacaucagguggugagguu

SEQ ID NO: 1364984 - RNA, 19 nt, Homo sapiens
gcaccagguuaacaagacu

SEQ ID NO: 1364985 - RNA, 19 nt, Homo sapiens
agggugagacuccaucuaa

SEQ ID NO: 1364986 - RNA, 19 nt, Homo sapiens
ugagacaggagucagcaaa

SEQ ID NO: 1364987 - RNA, 19 nt, Homo sapiens
gagcagguccaacucugau

SEQ ID NO: 1364988 - RNA, 19 nt, Homo sapiens
ccagagcugcuuuaugcaa

SEQ ID NO: 1364989 - RNA, 19 nt, Homo sapiens
cagucucuguuguauauuc

SEQ ID NO: 1364990 - RNA, 19 nt, Homo sapiens
cacacucccuuacacuguu

SEQ ID NO: 1364991 - RNA, 19 nt, Homo sapiens
ucacauccacccauacaca

SEQ ID NO: 1364992 - RNA, 19 nt, Homo sapiens
caaacuggagcagcuggua

SEQ ID NO: 1364993 - RNA, 19 nt, Homo sapiens
caucugagaaacaagguau

SEQ ID NO: 1364994 - RNA, 19 nt, Homo sapiens
uaucagcugucccuugaac

SEQ ID NO: 1364995 - RNA, 19 nt, Homo sapiens
gagacaggagucagcaaau

SEQ ID NO: 1364996 - RNA, 19 nt, Homo sapiens
agaacaaggacaacaagga

SEQ ID NO: 1364997 - RNA, 19 nt, Homo sapiens
ccuggaagauacccauaag

SEQ ID NO: 1364998 - RNA, 19 nt, Homo sapiens
cacuuaacccgucuccuuu

SEQ ID NO: 1364999 - RNA, 19 nt, Homo sapiens
ugagagcagccacuacuuc

SEQ ID NO: 1365000 - RNA, 19 nt, Homo sapiens
ugcccgagcuucacucaca

SEQ ID NO: 1365001 - RNA, 19 nt, Homo sapiens
ucagcugcccugcaaagaa

SEQ ID NO: 1365002 - RNA, 19 nt, Homo sapiens
gacaggagucagcaaaucu

SEQ ID NO: 1365003 - RNA, 19 nt, Homo sapiens
gcugguagaaucccacauc

SEQ ID NO: 1365004 - RNA, 19 nt, Homo sapiens
gcugaaugggcuccugauu

SEQ ID NO: 1365005 - RNA, 19 nt, Homo sapiens
caucagguggugagguuga

SEQ ID NO: 1365006 - RNA, 19 nt, Homo sapiens
gagggugagacuccaucua

SEQ ID NO: 1365007 - RNA, 19 nt, Homo sapiens
ucucuguuguauauucuug

SEQ ID NO: 1365008 - RNA, 19 nt, Homo sapiens
uuggacagcucccaucucu

SEQ ID NO: 1365009 - RNA, 19 nt, Homo sapiens
acaaucaugcucccucaga

SEQ ID NO: 1365010 - RNA, 19 nt, Homo sapiens
gucagcaaaucuuaaucug

SEQ ID NO: 1365011 - RNA, 19 nt, Homo sapiens
aaagaugaacauacagauc

SEQ ID NO: 1365012 - RNA, 19 nt, Homo sapiens
uccguuacaugcagcagaa

SEQ ID NO: 1365013 - RNA, 19 nt, Homo sapiens
cagccuuccacauuuguaa

SEQ ID NO: 1365014 - RNA, 19 nt, Homo sapiens
ggucagcugcccugcaaag

SEQ ID NO: 1365015 - RNA, 19 nt, Homo sapiens
ccacagaccuaauauaugu

SEQ ID NO: 1365016 - RNA, 19 nt, Homo sapiens
ggacauuggacauugcuaa

SEQ ID NO: 1365017 - RNA, 19 nt, Homo sapiens
gcacaaaggcccgaacaca

SEQ ID NO: 1365018 - RNA, 19 nt, Homo sapiens
cauuggacauugcuaaguu

SEQ ID NO: 1365019 - RNA, 19 nt, Homo sapiens
gagccucgguuuccuuauc

SEQ ID NO: 1365020 - RNA, 19 nt, Homo sapiens
cagcaagccugugagcauu

SEQ ID NO: 1365021 - RNA, 19 nt, Homo sapiens
caaacucugucccacuuca

SEQ ID NO: 1365022 - RNA, 19 nt, Homo sapiens
ugccggagcuccaaccaaa

SEQ ID NO: 1365023 - RNA, 19 nt, Homo sapiens
aaacacaaagcgacugaaa

SEQ ID NO: 1365024 - RNA, 19 nt, Homo sapiens
aaaccugcaugaagcaaga

SEQ ID NO: 1365025 - RNA, 19 nt, Homo sapiens
ucaugcaggucauaucaga

SEQ ID NO: 1365026 - RNA, 19 nt, Homo sapiens
gcaggaggugcucaauaaa

SEQ ID NO: 1365027 - RNA, 19 nt, Homo sapiens
ucgguuuccuuaucuguaa

SEQ ID NO: 1365028 - RNA, 19 nt, Homo sapiens
gcaagccugugagcauugu

SEQ ID NO: 1365029 - RNA, 19 nt, Homo sapiens
ccauggcagccuugucuua

SEQ ID NO: 1365030 - RNA, 19 nt, Homo sapiens
ccacauggagccacuguca

SEQ ID NO: 1365031 - RNA, 19 nt, Homo sapiens
ggugcucaauaaacacaaa

SEQ ID NO: 1365032 - RNA, 19 nt, Homo sapiens
gucaucaucauguuacuuu

SEQ ID NO: 1365033 - RNA, 19 nt, Homo sapiens
cagcuccgcccucagaauu

SEQ ID NO: 1365034 - RNA, 19 nt, Homo sapiens
ccacaugcagucaucauca

SEQ ID NO: 1365035 - RNA, 19 nt, Homo sapiens
aggaggugcucaauaaaca

SEQ ID NO: 1365036 - RNA, 19 nt, Homo sapiens
uuccuuaucuguaaagcaa

SEQ ID NO: 1365037 - RNA, 19 nt, Homo sapiens
gcgccugaccucacgauga

SEQ ID NO: 1365038 - RNA, 19 nt, Homo sapiens
ugugagcauuguguauaua

SEQ ID NO: 1365039 - RNA, 19 nt, Homo sapiens
caggugugcucugcuguug

SEQ ID NO: 1365040 - RNA, 19 nt, Homo sapiens
gaccauggcagccuugucu

SEQ ID NO: 1365041 - RNA, 19 nt, Homo sapiens
gcagucaucaucauguuac

SEQ ID NO: 1365042 - RNA, 19 nt, Homo sapiens
cuuggaugcugccacguaa

SEQ ID NO: 1365043 - RNA, 19 nt, Homo sapiens
ccugugagcauuguguaua

SEQ ID NO: 1365044 - RNA, 19 nt, Homo sapiens
ucacugcuguggcgagucu

SEQ ID NO: 1365045 - RNA, 19 nt, Homo sapiens
gcuuggaugcugccacgua

SEQ ID NO: 1365046 - RNA, 19 nt, Homo sapiens
ggacagccuggacauugga

SEQ ID NO: 1365047 - RNA, 19 nt, Homo sapiens
gcaugaagcaagaacaacu

SEQ ID NO: 1365048 - RNA, 19 nt, Homo sapiens
gagcauuguguauauagca

SEQ ID NO: 1365049 - RNA, 19 nt, Homo sapiens
gagaggagugggugcuugu

SEQ ID NO: 1365050 - RNA, 19 nt, Homo sapiens
accaaacucugucccacuu

SEQ ID NO: 1365051 - RNA, 19 nt, Homo sapiens
ccagcaagccugugagcau

SEQ ID NO: 1365052 - RNA, 19 nt, Homo sapiens
gacaccagcaagccuguga

SEQ ID NO: 1365053 - RNA, 19 nt, Homo sapiens
caucaucauguuacuuuca

SEQ ID NO: 1365054 - RNA, 19 nt, Homo sapiens
uggcgagucuugcuauguc

SEQ ID NO: 1365055 - RNA, 19 nt, Homo sapiens
gccuggacauuggacauug

SEQ ID NO: 1365056 - RNA, 19 nt, Homo sapiens
ucuggacgcugccacaucu

SEQ ID NO: 1365057 - RNA, 19 nt, Homo sapiens
cugugagcauuguguauau

SEQ ID NO: 1365058 - RNA, 19 nt, Homo sapiens
ggugugcucugcuguugcu

SEQ ID NO: 1365059 - RNA, 19 nt, Homo sapiens
uggcagccuugucuuaugg

SEQ ID NO: 1365060 - RNA, 19 nt, Homo sapiens
ccauaggccaccacacaga

SEQ ID NO: 1365061 - RNA, 19 nt, Homo sapiens
gcugaugguccugauguug

SEQ ID NO: 1365062 - RNA, 19 nt, Homo sapiens
ccacaucugggcauacagu

SEQ ID NO: 1365063 - RNA, 19 nt, Homo sapiens
ccacaucugggcauacagu

SEQ ID NO: 1365064 - RNA, 19 nt, Homo sapiens
gcucgcgcauuguccuauc

SEQ ID NO: 1365065 - RNA, 19 nt, Homo sapiens
ccaucggccucuugcagau

SEQ ID NO: 1365066 - RNA, 19 nt, Homo sapiens
gaggugcucaauaaacaca

SEQ ID NO: 1365067 - RNA, 19 nt, Homo sapiens
cagcugugaguguguguga

SEQ ID NO: 1365068 - RNA, 19 nt, Homo sapiens
cauggcagccuugucuuau

SEQ ID NO: 1365069 - RNA, 19 nt, Homo sapiens
ggcugagggucacuugcuu

SEQ ID NO: 1365070 - RNA, 19 nt, Homo sapiens
cacaugcagucaucaucau

SEQ ID NO: 1365071 - RNA, 19 nt, Homo sapiens
gcuccgcccucagaauucu

SEQ ID NO: 1365072 - RNA, 19 nt, Homo sapiens
gugcucugcuguugcugau

SEQ ID NO: 1365073 - RNA, 19 nt, Homo sapiens
ugucaugcaggucauauca

SEQ ID NO: 1365074 - RNA, 19 nt, Homo sapiens
ggaaaccggugacgcagaa

SEQ ID NO: 1365075 - RNA, 19 nt, Homo sapiens
gaacuaacaguccugcuuu

SEQ ID NO: 1365076 - RNA, 19 nt, Homo sapiens
gcacaacagcuaugcauug

SEQ ID NO: 1365077 - RNA, 19 nt, Homo sapiens
cggcggagcugcuucaaga

SEQ ID NO: 1365078 - RNA, 19 nt, Homo sapiens
agucgacgcucaacuauga

SEQ ID NO: 1365079 - RNA, 19 nt, Homo sapiens
ucaaggcgcugcaggacuu

SEQ ID NO: 1365080 - RNA, 19 nt, Homo sapiens
gaguggaaaugaagaagau

SEQ ID NO: 1365081 - RNA, 19 nt, Homo sapiens
cccaaggccuucaccagua

SEQ ID NO: 1365082 - RNA, 19 nt, Homo sapiens
ccaagacgcagcuggauga

SEQ ID NO: 1365083 - RNA, 19 nt, Homo sapiens
caccagaguuugcauugga

SEQ ID NO: 1365084 - RNA, 19 nt, Homo sapiens
gggcugcaguucacagaga

SEQ ID NO: 1365085 - RNA, 19 nt, Homo sapiens
gcccaggaguggaaaugaa

SEQ ID NO: 1365086 - RNA, 19 nt, Homo sapiens
uuuguaagcuuuccacuca

SEQ ID NO: 1365087 - RNA, 19 nt, Homo sapiens
ggaagaucccagugucuga

SEQ ID NO: 1365088 - RNA, 19 nt, Homo sapiens
ggacuuggcacggaaggaa

SEQ ID NO: 1365089 - RNA, 19 nt, Homo sapiens
gcacgucucuggccccauu

SEQ ID NO: 1365090 - RNA, 19 nt, Homo sapiens
gcaaggggcuggugaaggu

SEQ ID NO: 1365091 - RNA, 19 nt, Homo sapiens
gaaccugacgcucuauuac

SEQ ID NO: 1365092 - RNA, 19 nt, Homo sapiens
aaaugaagaagaucacuga

SEQ ID NO: 1365093 - RNA, 19 nt, Homo sapiens
gcagaagugaguguggaua

SEQ ID NO: 1365094 - RNA, 19 nt, Homo sapiens
caagaacgaccauaucaac

SEQ ID NO: 1365095 - RNA, 19 nt, Homo sapiens
gcuacaagaacgaccauau

SEQ ID NO: 1365096 - RNA, 19 nt, Homo sapiens
ugaaccugacgcucuauua

SEQ ID NO: 1365097 - RNA, 19 nt, Homo sapiens
guaaggaagaucccagugu

SEQ ID NO: 1365098 - RNA, 19 nt, Homo sapiens
ucuucaagcucaucuacaa

SEQ ID NO: 1365099 - RNA, 19 nt, Homo sapiens
ggaguggaaaugaagaaga

SEQ ID NO: 1365100 - RNA, 19 nt, Homo sapiens
uaagcuuuccacucaauaa

SEQ ID NO: 1365101 - RNA, 19 nt, Homo sapiens
caagacacccagcacugaa

SEQ ID NO: 1365102 - RNA, 19 nt, Homo sapiens
cagcguggccucccuaauc

SEQ ID NO: 1365103 - RNA, 19 nt, Homo sapiens
ggagucgacgcucaacuau

SEQ ID NO: 1365104 - RNA, 19 nt, Homo sapiens
ucacgccacugcucuacau

SEQ ID NO: 1365105 - RNA, 19 nt, Homo sapiens
cagagaaccaccuccaguu

SEQ ID NO: 1365106 - RNA, 19 nt, Homo sapiens
ccucugggcucagcucuuc

SEQ ID NO: 1365107 - RNA, 19 nt, Homo sapiens
guaagcuuuccacucaaua

SEQ ID NO: 1365108 - RNA, 19 nt, Homo sapiens
gaguuugcauuggaaggaa

SEQ ID NO: 1365109 - RNA, 19 nt, Homo sapiens
gccagccugucaagaucua

SEQ ID NO: 1365110 - RNA, 19 nt, Homo sapiens
gcucaacuaugaagaucac

SEQ ID NO: 1365111 - RNA, 19 nt, Homo sapiens
ggaaaugcuggagcucuug

SEQ ID NO: 1365112 - RNA, 19 nt, Homo sapiens
uguaagcuuuccacucaau

SEQ ID NO: 1365113 - RNA, 19 nt, Homo sapiens
uacaagaacgaccauauca

SEQ ID NO: 1365114 - RNA, 19 nt, Homo sapiens
ccgugaaccugacgcucua

SEQ ID NO: 1365115 - RNA, 19 nt, Homo sapiens
ggcacacgcugcaccucaa

SEQ ID NO: 1365116 - RNA, 19 nt, Homo sapiens
ccaaggccuucaccaguac

SEQ ID NO: 1365117 - RNA, 19 nt, Homo sapiens
gaucccagugucugaguga

SEQ ID NO: 1365118 - RNA, 19 nt, Homo sapiens
cuacaagaacgaccauauc

SEQ ID NO: 1365119 - RNA, 19 nt, Homo sapiens
ugaacuaacaguccugcuu

SEQ ID NO: 1365120 - RNA, 19 nt, Homo sapiens
cauggcauccgcuacaaga

SEQ ID NO: 1365121 - RNA, 19 nt, Homo sapiens
uggagucgacgcucaacua

SEQ ID NO: 1365122 - RNA, 19 nt, Homo sapiens
aggaaaugcuggagcucuu

SEQ ID NO: 1365123 - RNA, 19 nt, Homo sapiens
acaagacacccagcacuga

SEQ ID NO: 1365124 - RNA, 19 nt, Homo sapiens
ggugaaccgccuccaagug

SEQ ID NO: 1365125 - RNA, 19 nt, Homo sapiens
ucaagcucaucuacaacga

SEQ ID NO: 1365126 - RNA, 19 nt, Homo sapiens
acaagaacgaccauaucaa

SEQ ID NO: 1365127 - RNA, 19 nt, Homo sapiens
agaagugaguguggauaca

SEQ ID NO: 1365128 - RNA, 19 nt, Homo sapiens
cacaacagcuaugcauugc

SEQ ID NO: 1365129 - RNA, 19 nt, Homo sapiens
ggcugcaguucacagagaa

SEQ ID NO: 1365130 - RNA, 19 nt, Homo sapiens
gcucaucuacaacgaguac

SEQ ID NO: 1365131 - RNA, 19 nt, Homo sapiens
ggaaugugcuauuucuuua

SEQ ID NO: 1365132 - RNA, 19 nt, Homo sapiens
gaaaucccaugucuacuaa

SEQ ID NO: 1365133 - RNA, 19 nt, Homo sapiens
gaagaaaggccuuaaaugu

SEQ ID NO: 1365134 - RNA, 19 nt, Homo sapiens
ggagaagacugcaguaaau

SEQ ID NO: 1365135 - RNA, 19 nt, Homo sapiens
agacaaaucuucaaucuca

SEQ ID NO: 1365136 - RNA, 19 nt, Homo sapiens
cuacaaaucuaaccucauu

SEQ ID NO: 1365137 - RNA, 19 nt, Homo sapiens
ggacagaaacuccagguaa

SEQ ID NO: 1365138 - RNA, 19 nt, Homo sapiens
ggucagaggucaccaugaa

SEQ ID NO: 1365139 - RNA, 19 nt, Homo sapiens
agaaaggccuuaaauguga

SEQ ID NO: 1365140 - RNA, 19 nt, Homo sapiens
gacagaaacuccagguaaa

SEQ ID NO: 1365141 - RNA, 19 nt, Homo sapiens
ggagaacuuugcacaugua

SEQ ID NO: 1365142 - RNA, 19 nt, Homo sapiens
gcaaauuuauccugauuca

SEQ ID NO: 1365143 - RNA, 19 nt, Homo sapiens
gagaaaggccuuaugaaug

SEQ ID NO: 1365144 - RNA, 19 nt, Homo sapiens
gagaaaggccuuaugaaug

SEQ ID NO: 1365145 - RNA, 19 nt, Homo sapiens
gagaaaggccuuaugaaug

SEQ ID NO: 1365146 - RNA, 19 nt, Homo sapiens
ccgcaaaucugaccucauu

SEQ ID NO: 1365147 - RNA, 19 nt, Homo sapiens
ggagaaagaccuuaugaau

SEQ ID NO: 1365148 - RNA, 19 nt, Homo sapiens
ggagaaagaccuuaugaau

SEQ ID NO: 1365149 - RNA, 19 nt, Homo sapiens
gggaaauccuuuagacaaa

SEQ ID NO: 1365150 - RNA, 19 nt, Homo sapiens
gggaaauccuuuagacaaa

SEQ ID NO: 1365151 - RNA, 19 nt, Homo sapiens
gagaaaggccuuaugaaug

SEQ ID NO: 1365152 - RNA, 19 nt, Homo sapiens
gagaaaggccuuaugaaug

SEQ ID NO: 1365153 - RNA, 19 nt, Homo sapiens
gauagggacuguuguguuc

SEQ ID NO: 1365154 - RNA, 19 nt, Homo sapiens
agaaaggccuuaugaaugu

SEQ ID NO: 1365155 - RNA, 19 nt, Homo sapiens
agaaaggccuuaugaaugu

SEQ ID NO: 1365156 - RNA, 19 nt, Homo sapiens
ggaaauccuuuagacaauu

SEQ ID NO: 1365157 - RNA, 19 nt, Homo sapiens
agaaaggccuuaugaaugu

SEQ ID NO: 1365158 - RNA, 19 nt, Homo sapiens
ggagaaaggccuuaugaau

SEQ ID NO: 1365159 - RNA, 19 nt, Homo sapiens
ggagaaaggccuuaugaau

SEQ ID NO: 1365160 - RNA, 19 nt, Homo sapiens
ggagaaaggccuuaugaau

SEQ ID NO: 1365161 - RNA, 19 nt, Homo sapiens
ggagaaaggccuuaugaau

SEQ ID NO: 1365162 - RNA, 19 nt, Homo sapiens
ggagaaaggccuuaugaau

SEQ ID NO: 1365163 - RNA, 19 nt, Homo sapiens
ggacagagaagucgcgaaa

SEQ ID NO: 1365164 - RNA, 19 nt, Homo sapiens
ccacaaaucagaccuuauu

SEQ ID NO: 1365165 - RNA, 19 nt, Homo sapiens
ccaaagugcuagccucauu

SEQ ID NO: 1365166 - RNA, 19 nt, Homo sapiens
agaaagaccuuaugaaugc

SEQ ID NO: 1365167 - RNA, 19 nt, Homo sapiens
agaaagaccuuaugaaugc

SEQ ID NO: 1365168 - RNA, 19 nt, Homo sapiens
gagaaagaccuuaugaaug

SEQ ID NO: 1365169 - RNA, 19 nt, Homo sapiens
gagaaagaccuuaugaaug

SEQ ID NO: 1365170 - RNA, 19 nt, Homo sapiens
ccgcaaaucuaaccucauu

SEQ ID NO: 1365171 - RNA, 19 nt, Homo sapiens
gaaauccuuuagacaauuc

SEQ ID NO: 1365172 - RNA, 19 nt, Homo sapiens
gagaaagccuucacuugca

SEQ ID NO: 1365173 - RNA, 19 nt, Homo sapiens
ggagaaagaccuuaugagu

SEQ ID NO: 1365174 - RNA, 19 nt, Homo sapiens
gcaagcauauacaggcauu

SEQ ID NO: 1365175 - RNA, 19 nt, Homo sapiens
gcccaaggccucaaaguaa

SEQ ID NO: 1365176 - RNA, 19 nt, Homo sapiens
cugaggagguucauuguaa

SEQ ID NO: 1365177 - RNA, 19 nt, Homo sapiens
caacaccggagaauucaua

SEQ ID NO: 1365178 - RNA, 19 nt, Homo sapiens
gaacuuugcacauguaaca

SEQ ID NO: 1365179 - RNA, 19 nt, Homo sapiens
uuacgcaccuuuaaucuug

SEQ ID NO: 1365180 - RNA, 19 nt, Homo sapiens
gaaaggccuuaugaaugua

SEQ ID NO: 1365181 - RNA, 19 nt, Homo sapiens
gaaaggccuuaugaaugua

SEQ ID NO: 1365182 - RNA, 19 nt, Homo sapiens
gggaaauccuuuagacaau

SEQ ID NO: 1365183 - RNA, 19 nt, Homo sapiens
gcagugagcugagauugca

SEQ ID NO: 1365184 - RNA, 19 nt, Homo sapiens
guauacaccugacccaguu

SEQ ID NO: 1365185 - RNA, 19 nt, Homo sapiens
gggaaugugcuauuucuuu

SEQ ID NO: 1365186 - RNA, 19 nt, Homo sapiens
ggaaauccuuuagacaaau

SEQ ID NO: 1365187 - RNA, 19 nt, Homo sapiens
ggagaaaggccuuaucagu

SEQ ID NO: 1365188 - RNA, 19 nt, Homo sapiens
gcaauacacccacccagaa

SEQ ID NO: 1365189 - RNA, 19 nt, Homo sapiens
ugaagggaaugugcuauuu

SEQ ID NO: 1365190 - RNA, 19 nt, Homo sapiens
gaaaggccuuaaaugugaa

SEQ ID NO: 1365191 - RNA, 19 nt, Homo sapiens
ccagagcucuagccucauu

SEQ ID NO: 1365192 - RNA, 19 nt, Homo sapiens
guggagaucucaaacuuuc

SEQ ID NO: 1365193 - RNA, 19 nt, Homo sapiens
acaauucucuaaccucauu

SEQ ID NO: 1365194 - RNA, 19 nt, Homo sapiens
ggacuguuguguucgaaug

SEQ ID NO: 1365195 - RNA, 19 nt, Homo sapiens
ucagugagauuaagaugug

SEQ ID NO: 1365196 - RNA, 19 nt, Homo sapiens
ccuauagccugauuuaugu

SEQ ID NO: 1365197 - RNA, 19 nt, Homo sapiens
gaaauccuuuagacaaauc

SEQ ID NO: 1365198 - RNA, 19 nt, Homo sapiens
gaagagcccuggaaaagga

SEQ ID NO: 1365199 - RNA, 19 nt, Homo sapiens
gcauauaagucaguguaga

SEQ ID NO: 1365200 - RNA, 19 nt, Homo sapiens
guagccaucuucguaaauu

SEQ ID NO: 1365201 - RNA, 19 nt, Homo sapiens
ugaaaucccaugucuacua

SEQ ID NO: 1365202 - RNA, 19 nt, Homo sapiens
gaagccauuucacauuuca

SEQ ID NO: 1365203 - RNA, 19 nt, Homo sapiens
ggagguucauuguaauuuc

SEQ ID NO: 1365204 - RNA, 19 nt, Homo sapiens
gcucuagccucauucaaca

SEQ ID NO: 1365205 - RNA, 19 nt, Homo sapiens
uugaggauguggccauuua

SEQ ID NO: 1365206 - RNA, 19 nt, Homo sapiens
ggaugaggcuacauuugug

SEQ ID NO: 1365207 - RNA, 19 nt, Homo sapiens
gaucuucuguuuacuaucg

SEQ ID NO: 1365208 - RNA, 19 nt, Homo sapiens
gauggaaugacucuucuaa

SEQ ID NO: 1365209 - RNA, 19 nt, Homo sapiens
gaaugugggaaauccuuua

SEQ ID NO: 1365210 - RNA, 19 nt, Homo sapiens
agaaaggccuuaugaaugc

SEQ ID NO: 1365211 - RNA, 19 nt, Homo sapiens
gaaugugggaaauccuuua

SEQ ID NO: 1365212 - RNA, 19 nt, Homo sapiens
gaaugugggaaauccuuua

SEQ ID NO: 1365213 - RNA, 19 nt, Homo sapiens
ggagaaaugccuuaucagu

SEQ ID NO: 1365214 - RNA, 19 nt, Homo sapiens
aaucuaaccucauugaaca

SEQ ID NO: 1365215 - RNA, 19 nt, Homo sapiens
agaaaggccuuaugaaugc

SEQ ID NO: 1365216 - RNA, 19 nt, Homo sapiens
aaucuuggguguucuauuc

SEQ ID NO: 1365217 - RNA, 19 nt, Homo sapiens
gaaauccuuuagccgcaaa

SEQ ID NO: 1365218 - RNA, 19 nt, Homo sapiens
ggaaacccuuuacccacaa

SEQ ID NO: 1365219 - RNA, 19 nt, Homo sapiens
gaaauccuuuagccgcaaa

SEQ ID NO: 1365220 - RNA, 19 nt, Homo sapiens
aaagugccaccuaaucuua

SEQ ID NO: 1365221 - RNA, 19 nt, Homo sapiens
ugaauaugguuguguagga

SEQ ID NO: 1365222 - RNA, 19 nt, Homo sapiens
gcaguaaauuagauggaau

SEQ ID NO: 1365223 - RNA, 19 nt, Homo sapiens
agaagacugcaguaaauua

SEQ ID NO: 1365224 - RNA, 19 nt, Homo sapiens
cacaggagauccacauaau

SEQ ID NO: 1365225 - RNA, 19 nt, Homo sapiens
ccacggaccuacuccaaca

SEQ ID NO: 1365226 - RNA, 19 nt, Homo sapiens
aauuacagguucaacagua

SEQ ID NO: 1365227 - RNA, 19 nt, Homo sapiens
agugggagcuccuugauga

SEQ ID NO: 1365228 - RNA, 19 nt, Homo sapiens
gggaagcucugaggagguu

SEQ ID NO: 1365229 - RNA, 19 nt, Homo sapiens
aaucugaccucauucaaca

SEQ ID NO: 1365230 - RNA, 19 nt, Homo sapiens
gcaaaucugaccucauuca

SEQ ID NO: 1365231 - RNA, 19 nt, Homo sapiens
gaaaucaaauucugcucua

SEQ ID NO: 1365232 - RNA, 19 nt, Homo sapiens
caaaugaggcggaggaaua

SEQ ID NO: 1365233 - RNA, 19 nt, Homo sapiens
gagcaaugguuuggacuua

SEQ ID NO: 1365234 - RNA, 19 nt, Homo sapiens
acagauagcuugugaugaa

SEQ ID NO: 1365235 - RNA, 19 nt, Homo sapiens
gcaauugugccuugaauaa

SEQ ID NO: 1365236 - RNA, 19 nt, Homo sapiens
guaccuagaagccaaauua

SEQ ID NO: 1365237 - RNA, 19 nt, Homo sapiens
gguuuggacuuacaucuua

SEQ ID NO: 1365238 - RNA, 19 nt, Homo sapiens
aaacagagccauugaacua

SEQ ID NO: 1365239 - RNA, 19 nt, Homo sapiens
gaaagcaacguguaugaaa

SEQ ID NO: 1365240 - RNA, 19 nt, Homo sapiens
gagaggaaauacacagaaa

SEQ ID NO: 1365241 - RNA, 19 nt, Homo sapiens
ugaauuggcucaacguuug

SEQ ID NO: 1365242 - RNA, 19 nt, Homo sapiens
caaaguggguuauuucaag

SEQ ID NO: 1365243 - RNA, 19 nt, Homo sapiens
gauaauuacugugcacuga

SEQ ID NO: 1365244 - RNA, 19 nt, Homo sapiens
ggaaccaaaggccaaauua

SEQ ID NO: 1365245 - RNA, 19 nt, Homo sapiens
gaaauuugaugggaagaau

SEQ ID NO: 1365246 - RNA, 19 nt, Homo sapiens
ggagaggaauauguucuuu

SEQ ID NO: 1365247 - RNA, 19 nt, Homo sapiens
ccggagacaucacucuuua

SEQ ID NO: 1365248 - RNA, 19 nt, Homo sapiens
guugaaauguuccuucuug

SEQ ID NO: 1365249 - RNA, 19 nt, Homo sapiens
guaaacuggcuucuaauuu

SEQ ID NO: 1365250 - RNA, 19 nt, Homo sapiens
caggacagcuucugaggaa

SEQ ID NO: 1365251 - RNA, 19 nt, Homo sapiens
gaaguacugagcuuuguuu

SEQ ID NO: 1365252 - RNA, 19 nt, Homo sapiens
guacaacacggaagaauuc

SEQ ID NO: 1365253 - RNA, 19 nt, Homo sapiens
ugcaacagauuaagaauug

SEQ ID NO: 1365254 - RNA, 19 nt, Homo sapiens
gagaggaauauguucuuua

SEQ ID NO: 1365255 - RNA, 19 nt, Homo sapiens
ggaaauacacagaaagcaa

SEQ ID NO: 1365256 - RNA, 19 nt, Homo sapiens
acagagccauugaacuaua

SEQ ID NO: 1365257 - RNA, 19 nt, Homo sapiens
agacaucacucuuuaggau

SEQ ID NO: 1365258 - RNA, 19 nt, Homo sapiens
caaauucugcucuaaaugu

SEQ ID NO: 1365259 - RNA, 19 nt, Homo sapiens
guacugagcuuuguuuuau

SEQ ID NO: 1365260 - RNA, 19 nt, Homo sapiens
gcaaugguuuggacuuaca

SEQ ID NO: 1365261 - RNA, 19 nt, Homo sapiens
aaacuuggacugaaauuug

SEQ ID NO: 1365262 - RNA, 19 nt, Homo sapiens
gacaaccucugguaaucuu

SEQ ID NO: 1365263 - RNA, 19 nt, Homo sapiens
gauagcuugugaugaacua

SEQ ID NO: 1365264 - RNA, 19 nt, Homo sapiens
ggagaggcuuuguguucuu

SEQ ID NO: 1365265 - RNA, 19 nt, Homo sapiens
gaagggaagagcaaugguu

SEQ ID NO: 1365266 - RNA, 19 nt, Homo sapiens
gcagaugguguucacauga

SEQ ID NO: 1365267 - RNA, 19 nt, Homo sapiens
cuacuugccuuugugguuu

SEQ ID NO: 1365268 - RNA, 19 nt, Homo sapiens
guaacggguuucuauagau

SEQ ID NO: 1365269 - RNA, 19 nt, Homo sapiens
gguaaacuggcuucuaauu

SEQ ID NO: 1365270 - RNA, 19 nt, Homo sapiens
augaggaccugguugauaa

SEQ ID NO: 1365271 - RNA, 19 nt, Homo sapiens
gaaacuuggacugaaauuu

SEQ ID NO: 1365272 - RNA, 19 nt, Homo sapiens
guaguaacggguuucuaua

SEQ ID NO: 1365273 - RNA, 19 nt, Homo sapiens
gaaaggaaaggaaguacca

SEQ ID NO: 1365274 - RNA, 19 nt, Homo sapiens
guauuucccugaaguacug

SEQ ID NO: 1365275 - RNA, 19 nt, Homo sapiens
cguaugcccuugauugguu

SEQ ID NO: 1365276 - RNA, 19 nt, Homo sapiens
gaaaugagaacugcugaag

SEQ ID NO: 1365277 - RNA, 19 nt, Homo sapiens
ggaccugguugauaaaauu

SEQ ID NO: 1365278 - RNA, 19 nt, Homo sapiens
gaagaaugaggaccugguu

SEQ ID NO: 1365279 - RNA, 19 nt, Homo sapiens
cuaacagucugcuuuaagu

SEQ ID NO: 1365280 - RNA, 19 nt, Homo sapiens
cuaaaugugugugaauaug

SEQ ID NO: 1365281 - RNA, 19 nt, Homo sapiens
gcacaaaacuauucagacu

SEQ ID NO: 1365282 - RNA, 19 nt, Homo sapiens
gaggugguauuucccugaa

SEQ ID NO: 1365283 - RNA, 19 nt, Homo sapiens
uaacggguuucuauagauc

SEQ ID NO: 1365284 - RNA, 19 nt, Homo sapiens
augguaaacuggcuucuaa

SEQ ID NO: 1365285 - RNA, 19 nt, Homo sapiens
ggagaggaaauacacagaa

SEQ ID NO: 1365286 - RNA, 19 nt, Homo sapiens
gagcauggucugccuuaug

SEQ ID NO: 1365287 - RNA, 19 nt, Homo sapiens
aggcuuggcugaaaugaga

SEQ ID NO: 1365288 - RNA, 19 nt, Homo sapiens
gcaaauacaacuggaucaa

SEQ ID NO: 1365289 - RNA, 19 nt, Homo sapiens
gcgaguccguggugauaau

SEQ ID NO: 1365290 - RNA, 19 nt, Homo sapiens
gaauaugagugcaaaagug

SEQ ID NO: 1365291 - RNA, 19 nt, Homo sapiens
uguaccggcucuccaagua

SEQ ID NO: 1365292 - RNA, 19 nt, Homo sapiens
acaacuggaucaagcaaug

SEQ ID NO: 1365293 - RNA, 19 nt, Homo sapiens
gacagcaaaccaucuuaaa

SEQ ID NO: 1365294 - RNA, 19 nt, Homo sapiens
gaaccaaaggccaaauuac

SEQ ID NO: 1365295 - RNA, 19 nt, Homo sapiens
guauccaccugcuuucaga

SEQ ID NO: 1365296 - RNA, 19 nt, Homo sapiens
gaagaauucaucacagucu

SEQ ID NO: 1365297 - RNA, 19 nt, Homo sapiens
ucaguaauauucaccacau

SEQ ID NO: 1365298 - RNA, 19 nt, Homo sapiens
cagaaagcaacguguauga

SEQ ID NO: 1365299 - RNA, 19 nt, Homo sapiens
gcggaagcauacgggaaua

SEQ ID NO: 1365300 - RNA, 19 nt, Homo sapiens
ccuauacagucugcuuuaa

SEQ ID NO: 1365301 - RNA, 19 nt, Homo sapiens
gaauaagaagguaccuaga

SEQ ID NO: 1365302 - RNA, 19 nt, Homo sapiens
aauugugccuugaauaaga

SEQ ID NO: 1365303 - RNA, 19 nt, Homo sapiens
ugacagcaaaccaucuuaa

SEQ ID NO: 1365304 - RNA, 19 nt, Homo sapiens
aaaacucucucuaauggua

SEQ ID NO: 1365305 - RNA, 19 nt, Homo sapiens
cagagccauugaacuauau

SEQ ID NO: 1365306 - RNA, 19 nt, Homo sapiens
gggcaggcuuggcugaaau

SEQ ID NO: 1365307 - RNA, 19 nt, Homo sapiens
ccuagaagccaaauuaaag

SEQ ID NO: 1365308 - RNA, 19 nt, Homo sapiens
ucaaaacucucucuaaugg

SEQ ID NO: 1365309 - RNA, 19 nt, Homo sapiens
cuucagagcacaccuguug

SEQ ID NO: 1365310 - RNA, 19 nt, Homo sapiens
gggcuugggcugcagguuu

SEQ ID NO: 1365311 - RNA, 19 nt, Homo sapiens
aauaagaagguaccuagaa

SEQ ID NO: 1365312 - RNA, 19 nt, Homo sapiens
gccaucgccugcccaauca

SEQ ID NO: 1365313 - RNA, 19 nt, Homo sapiens
gaaaaugggcuaugaagag

SEQ ID NO: 1365314 - RNA, 19 nt, Homo sapiens
guauaauucugggauagau

SEQ ID NO: 1365315 - RNA, 19 nt, Homo sapiens
cggaagaauucaucacagu

SEQ ID NO: 1365316 - RNA, 19 nt, Homo sapiens
ggaaaggaaguaccauuuu

SEQ ID NO: 1365317 - RNA, 19 nt, Homo sapiens
cuauucagacuguuacuuu

SEQ ID NO: 1365318 - RNA, 19 nt, Homo sapiens
agacacuacuugccuuugu

SEQ ID NO: 1365319 - RNA, 19 nt, Homo sapiens
aaucuuaccuucuccuuuu

SEQ ID NO: 1365320 - RNA, 19 nt, Homo sapiens
gugguauaauucugggaua

SEQ ID NO: 1365321 - RNA, 19 nt, Homo sapiens
caacacggaagaauucauc

SEQ ID NO: 1365322 - RNA, 19 nt, Homo sapiens
ccaaguacaacacggaaga

SEQ ID NO: 1365323 - RNA, 19 nt, Homo sapiens
gcucgggacacaucaaaug

SEQ ID NO: 1365324 - RNA, 19 nt, Homo sapiens
uaaagagaaaggaaaggaa

SEQ ID NO: 1365325 - RNA, 19 nt, Homo sapiens
gagaggcuuuguguucuuc

SEQ ID NO: 1365326 - RNA, 19 nt, Homo sapiens
cuuuagcuuucucccauua

SEQ ID NO: 1365327 - RNA, 19 nt, Homo sapiens
ggaaacuuggacugaaauu

SEQ ID NO: 1365328 - RNA, 19 nt, Homo sapiens
aguaacggguuucuauaga

SEQ ID NO: 1365329 - RNA, 19 nt, Homo sapiens
acacacugguggucuugaa

SEQ ID NO: 1365330 - RNA, 19 nt, Homo sapiens
aaagaauggagaggaaaua

SEQ ID NO: 1365331 - RNA, 19 nt, Homo sapiens
cacaggagcucauuaauua

SEQ ID NO: 1365332 - RNA, 19 nt, Homo sapiens
gcaaagcuuucucuuaaua

SEQ ID NO: 1365333 - RNA, 19 nt, Homo sapiens
ugagguaacuugcauauua

SEQ ID NO: 1365334 - RNA, 19 nt, Homo sapiens
cauagaagcugauguuuaa

SEQ ID NO: 1365335 - RNA, 19 nt, Homo sapiens
ggaaauguaucccauagaa

SEQ ID NO: 1365336 - RNA, 19 nt, Homo sapiens
gaagguggauuauaguaaa

SEQ ID NO: 1365337 - RNA, 19 nt, Homo sapiens
uaaccgaaguggauaaaua

SEQ ID NO: 1365338 - RNA, 19 nt, Homo sapiens
caugaacccucuacuuaua

SEQ ID NO: 1365339 - RNA, 19 nt, Homo sapiens
guagaaccauacagaauuu

SEQ ID NO: 1365340 - RNA, 19 nt, Homo sapiens
cugcaaagcuuucucuuaa

SEQ ID NO: 1365341 - RNA, 19 nt, Homo sapiens
gcagaaauaugauccagau

SEQ ID NO: 1365342 - RNA, 19 nt, Homo sapiens
gaauaaucguuguauggua

SEQ ID NO: 1365343 - RNA, 19 nt, Homo sapiens
ggacagaguaauuaugaua

SEQ ID NO: 1365344 - RNA, 19 nt, Homo sapiens
caaagucggucuaaggaaa

SEQ ID NO: 1365345 - RNA, 19 nt, Homo sapiens
caagaucucucguggaaga

SEQ ID NO: 1365346 - RNA, 19 nt, Homo sapiens
gaacaagugauuaugauga

SEQ ID NO: 1365347 - RNA, 19 nt, Homo sapiens
gaaaggcucuaugucauug

SEQ ID NO: 1365348 - RNA, 19 nt, Homo sapiens
ucacuaggcuucaaguaaa

SEQ ID NO: 1365349 - RNA, 19 nt, Homo sapiens
uaagugcccucaaaggaua

SEQ ID NO: 1365350 - RNA, 19 nt, Homo sapiens
gauacagucuucagauuug

SEQ ID NO: 1365351 - RNA, 19 nt, Homo sapiens
caaguugcaucuuuaaaug

SEQ ID NO: 1365352 - RNA, 19 nt, Homo sapiens
gauaagggcuagaaauuuu

SEQ ID NO: 1365353 - RNA, 19 nt, Homo sapiens
ggagaaaggcucuauguca

SEQ ID NO: 1365354 - RNA, 19 nt, Homo sapiens
guacugaacuugagcucuu

SEQ ID NO: 1365355 - RNA, 19 nt, Homo sapiens
gccaacaccuacaaucuaa

SEQ ID NO: 1365356 - RNA, 19 nt, Homo sapiens
ggaccuacacgcaucuuua

SEQ ID NO: 1365357 - RNA, 19 nt, Homo sapiens
cccaauugcugccauguua

SEQ ID NO: 1365358 - RNA, 19 nt, Homo sapiens
gagaaaggcucuaugucau

SEQ ID NO: 1365359 - RNA, 19 nt, Homo sapiens
gagguaacuugcauauuau

SEQ ID NO: 1365360 - RNA, 19 nt, Homo sapiens
guacaacugugcucacuag

SEQ ID NO: 1365361 - RNA, 19 nt, Homo sapiens
ggcaaucacuucagaggaa

SEQ ID NO: 1365362 - RNA, 19 nt, Homo sapiens
gaggagugauguauauuuc

SEQ ID NO: 1365363 - RNA, 19 nt, Homo sapiens
ggauaagggcuagaaauuu

SEQ ID NO: 1365364 - RNA, 19 nt, Homo sapiens
gauguuauuugugcucuuu

SEQ ID NO: 1365365 - RNA, 19 nt, Homo sapiens
cuaagaugcuguaguucua

SEQ ID NO: 1365366 - RNA, 19 nt, Homo sapiens
ggacugccauuaggucuga

SEQ ID NO: 1365367 - RNA, 19 nt, Homo sapiens
ugacacagaugaugcuuuc

SEQ ID NO: 1365368 - RNA, 19 nt, Homo sapiens
gauccucgauacaauaaau

SEQ ID NO: 1365369 - RNA, 19 nt, Homo sapiens
cgaaguggauaaauacguu

SEQ ID NO: 1365370 - RNA, 19 nt, Homo sapiens
gaacacaaaguuuccuaga

SEQ ID NO: 1365371 - RNA, 19 nt, Homo sapiens
ccauagaagcugauguuua

SEQ ID NO: 1365372 - RNA, 19 nt, Homo sapiens
ggaggagugauguauauuu

SEQ ID NO: 1365373 - RNA, 19 nt, Homo sapiens
ccaccuaagugcccucaaa

SEQ ID NO: 1365374 - RNA, 19 nt, Homo sapiens
guaaggaauugcgcaugua

SEQ ID NO: 1365375 - RNA, 19 nt, Homo sapiens
ccacaggagcucauuaauu

SEQ ID NO: 1365376 - RNA, 19 nt, Homo sapiens
acacaaaguuuccuagaca

SEQ ID NO: 1365377 - RNA, 19 nt, Homo sapiens
gaucaucucuacaacuaag

SEQ ID NO: 1365378 - RNA, 19 nt, Homo sapiens
uagagauagugcagaaaua

SEQ ID NO: 1365379 - RNA, 19 nt, Homo sapiens
ggaggaauuacucaugaua

SEQ ID NO: 1365380 - RNA, 19 nt, Homo sapiens
ggaaugaaagaacaagauu

SEQ ID NO: 1365381 - RNA, 19 nt, Homo sapiens
ggccuagaauguuuauaaa

SEQ ID NO: 1365382 - RNA, 19 nt, Homo sapiens
gaacaggaaacaauacaca

SEQ ID NO: 1365383 - RNA, 19 nt, Homo sapiens
caggaggaauuacucauga

SEQ ID NO: 1365384 - RNA, 19 nt, Homo sapiens
guaaaguguuucucauauc

SEQ ID NO: 1365385 - RNA, 19 nt, Homo sapiens
ggagaaguagcuuaaauuc

SEQ ID NO: 1365386 - RNA, 19 nt, Homo sapiens
gcauugagaacacaaaguu

SEQ ID NO: 1365387 - RNA, 19 nt, Homo sapiens
gaauugcgcauguaugaug

SEQ ID NO: 1365388 - RNA, 19 nt, Homo sapiens
ccuaagcugugaauacuau

SEQ ID NO: 1365389 - RNA, 19 nt, Homo sapiens
gaacaaaugaauggaccua

SEQ ID NO: 1365390 - RNA, 19 nt, Homo sapiens
gcaugaacccucuacuuau

SEQ ID NO: 1365391 - RNA, 19 nt, Homo sapiens
caggagaaguagcuuaaau

SEQ ID NO: 1365392 - RNA, 19 nt, Homo sapiens
uaacacaaccauucuggaa

SEQ ID NO: 1365393 - RNA, 19 nt, Homo sapiens
gaggaacaagugauuauga

SEQ ID NO: 1365394 - RNA, 19 nt, Homo sapiens
ccauauaugcagccaguua

SEQ ID NO: 1365395 - RNA, 19 nt, Homo sapiens
acacaaccauucuggaaau

SEQ ID NO: 1365396 - RNA, 19 nt, Homo sapiens
ggaagaccaacacaugaaa

SEQ ID NO: 1365397 - RNA, 19 nt, Homo sapiens
caugagaacugacaauacu

SEQ ID NO: 1365398 - RNA, 19 nt, Homo sapiens
gaacuugagcucuuuaagg

SEQ ID NO: 1365399 - RNA, 19 nt, Homo sapiens
gcacuguacugaacuugag

SEQ ID NO: 1365400 - RNA, 19 nt, Homo sapiens
gcacauacugaaugcauau

SEQ ID NO: 1365401 - RNA, 19 nt, Homo sapiens
ccaaguugaagguggauua

SEQ ID NO: 1365402 - RNA, 19 nt, Homo sapiens
gcggacagaguaauuauga

SEQ ID NO: 1365403 - RNA, 19 nt, Homo sapiens
agaaguagcuuaaauucac

SEQ ID NO: 1365404 - RNA, 19 nt, Homo sapiens
guaguucuaucuuugcaau

SEQ ID NO: 1365405 - RNA, 19 nt, Homo sapiens
gaggaagaccaacacauga

SEQ ID NO: 1365406 - RNA, 19 nt, Homo sapiens
caaaggauaucuguaugca

SEQ ID NO: 1365407 - RNA, 19 nt, Homo sapiens
caaaugaugccauauaugc

SEQ ID NO: 1365408 - RNA, 19 nt, Homo sapiens
ggauaaauacguuaacagu

SEQ ID NO: 1365409 - RNA, 19 nt, Homo sapiens
gaaguggauaaauacguua

SEQ ID NO: 1365410 - RNA, 19 nt, Homo sapiens
acaaaugaauggaccuaug

SEQ ID NO: 1365411 - RNA, 19 nt, Homo sapiens
gcucauuaauuacgugcaa

SEQ ID NO: 1365412 - RNA, 19 nt, Homo sapiens
aaagaugaauggcauaagg

SEQ ID NO: 1365413 - RNA, 19 nt, Homo sapiens
aaaaggagcucaugugcuu

SEQ ID NO: 1365414 - RNA, 19 nt, Homo sapiens
caaaugaauggaccuaugu

SEQ ID NO: 1365415 - RNA, 19 nt, Homo sapiens
ggauaucuguaugcaguug

SEQ ID NO: 1365416 - RNA, 19 nt, Homo sapiens
gaagccagcaauuaccaaa

SEQ ID NO: 1365417 - RNA, 19 nt, Homo sapiens
gagcaaagucggucuaagg

SEQ ID NO: 1365418 - RNA, 19 nt, Homo sapiens
ggaccuauguugccaaaau

SEQ ID NO: 1365419 - RNA, 19 nt, Homo sapiens
ccucaaaggauaucuguau

SEQ ID NO: 1365420 - RNA, 19 nt, Homo sapiens
aacauacgauuuccacuga

SEQ ID NO: 1365421 - RNA, 19 nt, Homo sapiens
gugauuacuucaaggcuau

SEQ ID NO: 1365422 - RNA, 19 nt, Homo sapiens
auacacacaugcacauaug

SEQ ID NO: 1365423 - RNA, 19 nt, Homo sapiens
ugaacccucuacuuauaaa

SEQ ID NO: 1365424 - RNA, 19 nt, Homo sapiens
gagaaguagcuuaaauuca

SEQ ID NO: 1365425 - RNA, 19 nt, Homo sapiens
guagagauagugcagaaau

SEQ ID NO: 1365426 - RNA, 19 nt, Homo sapiens
gcuuugacccugauacuga

SEQ ID NO: 1365427 - RNA, 19 nt, Homo sapiens
ggagugauguauauuucag

SEQ ID NO: 1365428 - RNA, 19 nt, Homo sapiens
agcaagaucucucguggaa

SEQ ID NO: 1365429 - RNA, 19 nt, Homo sapiens
agcaugaacccucuacuua

SEQ ID NO: 1365430 - RNA, 19 nt, Homo sapiens
ugcaaugugucauaaauuc

SEQ ID NO: 1365431 - RNA, 19 nt, Homo sapiens
ucaaucaugucgagaaaua

SEQ ID NO: 1365432 - RNA, 19 nt, Homo sapiens
gcaagagccuaauccauga

SEQ ID NO: 1365433 - RNA, 19 nt, Homo sapiens
cgauaagccucuuggaaua

SEQ ID NO: 1365434 - RNA, 19 nt, Homo sapiens
caagacaccucaaucaugu

SEQ ID NO: 1365435 - RNA, 19 nt, Homo sapiens
gcuagucgaugcagcagua

SEQ ID NO: 1365436 - RNA, 19 nt, Homo sapiens
ggccagaugucaagagaga

SEQ ID NO: 1365437 - RNA, 19 nt, Homo sapiens
gccagaagcucaccggaau

SEQ ID NO: 1365438 - RNA, 19 nt, Homo sapiens
ugucagagaagaccaauuu

SEQ ID NO: 1365439 - RNA, 19 nt, Homo sapiens
caaaugcugucagagaaga

SEQ ID NO: 1365440 - RNA, 19 nt, Homo sapiens
gcagauacaggcagaguuc

SEQ ID NO: 1365441 - RNA, 19 nt, Homo sapiens
uaccagagcacaagaagaa

SEQ ID NO: 1365442 - RNA, 19 nt, Homo sapiens
ccaagacaccucaaucaug

SEQ ID NO: 1365443 - RNA, 19 nt, Homo sapiens
agaagaagcgcaagggaaa

SEQ ID NO: 1365444 - RNA, 19 nt, Homo sapiens
agaagaagcaagagccuaa

SEQ ID NO: 1365445 - RNA, 19 nt, Homo sapiens
gcgacuggauguauaagca

SEQ ID NO: 1365446 - RNA, 19 nt, Homo sapiens
ccucaaucaugucgagaaa

SEQ ID NO: 1365447 - RNA, 19 nt, Homo sapiens
guacugugguaaaccuguu

SEQ ID NO: 1365448 - RNA, 19 nt, Homo sapiens
gauaagccucuuggaauau

SEQ ID NO: 1365449 - RNA, 19 nt, Homo sapiens
uguauaagcaucgguuuaa

SEQ ID NO: 1365450 - RNA, 19 nt, Homo sapiens
ccaaagggccagaugucaa

SEQ ID NO: 1365451 - RNA, 19 nt, Homo sapiens
gcccagugguccagacaau

SEQ ID NO: 1365452 - RNA, 19 nt, Homo sapiens
cagaagaagagaagcaaau

SEQ ID NO: 1365453 - RNA, 19 nt, Homo sapiens
gcccaagacaccucaauca

SEQ ID NO: 1365454 - RNA, 19 nt, Homo sapiens
gauacaggcagaguucuug

SEQ ID NO: 1365455 - RNA, 19 nt, Homo sapiens
ucuaacugguuuaucaaug

SEQ ID NO: 1365456 - RNA, 19 nt, Homo sapiens
cagagaagaccaauuuguc

SEQ ID NO: 1365457 - RNA, 19 nt, Homo sapiens
gagaaauaacgcagauaca

SEQ ID NO: 1365458 - RNA, 19 nt, Homo sapiens
caaagggccagaugucaag

SEQ ID NO: 1365459 - RNA, 19 nt, Homo sapiens
gaagaagagaagcaaaugc

SEQ ID NO: 1365460 - RNA, 19 nt, Homo sapiens
gcagaguucuugccuuacc

SEQ ID NO: 1365461 - RNA, 19 nt, Homo sapiens
ucagagaagaccaauuugu

SEQ ID NO: 1365462 - RNA, 19 nt, Homo sapiens
gcaaaugcugucagagaag

SEQ ID NO: 1365463 - RNA, 19 nt, Homo sapiens
ccagaagcucaccggaaua

SEQ ID NO: 1365464 - RNA, 19 nt, Homo sapiens
gacgcauucucccggauau

SEQ ID NO: 1365465 - RNA, 19 nt, Homo sapiens
gaagcaagagccuaaucca

SEQ ID NO: 1365466 - RNA, 19 nt, Homo sapiens
cgagaaauaacgcagauac

SEQ ID NO: 1365467 - RNA, 19 nt, Homo sapiens
cuaacugguuuaucaaugc

SEQ ID NO: 1365468 - RNA, 19 nt, Homo sapiens
guauaagcaucgguuuaag

SEQ ID NO: 1365469 - RNA, 19 nt, Homo sapiens
ccagugguccagacaaugu

SEQ ID NO: 1365470 - RNA, 19 nt, Homo sapiens
gaagaagcaagagccuaau

SEQ ID NO: 1365471 - RNA, 19 nt, Homo sapiens
acgauaagccucuuggaau

SEQ ID NO: 1365472 - RNA, 19 nt, Homo sapiens
gaaacgaccccaucauugg

SEQ ID NO: 1365473 - RNA, 19 nt, Homo sapiens
caugauugaugauguucca

SEQ ID NO: 1365474 - RNA, 19 nt, Homo sapiens
gauugaugauguuccaaaa

SEQ ID NO: 1365475 - RNA, 19 nt, Homo sapiens
gucgagaaauaacgcagau

SEQ ID NO: 1365476 - RNA, 19 nt, Homo sapiens
cuccgcgacuggauguaua

SEQ ID NO: 1365477 - RNA, 19 nt, Homo sapiens
ccacaaaacgggcaaagau

SEQ ID NO: 1365478 - RNA, 19 nt, Homo sapiens
gaccaauuugucuuuguug

SEQ ID NO: 1365479 - RNA, 19 nt, Homo sapiens
auaagccucuuggaauaug

SEQ ID NO: 1365480 - RNA, 19 nt, Homo sapiens
ugauugaugauguuccaaa

SEQ ID NO: 1365481 - RNA, 19 nt, Homo sapiens
cagaagcucaccggaauag

SEQ ID NO: 1365482 - RNA, 19 nt, Homo sapiens
ucccggauaugcuucaaca

SEQ ID NO: 1365483 - RNA, 19 nt, Homo sapiens
agacgcauucucccggaua

SEQ ID NO: 1365484 - RNA, 19 nt, Homo sapiens
agaagaagagaagcaaaug

SEQ ID NO: 1365485 - RNA, 19 nt, Homo sapiens
uaacugguuuaucaaugcu

SEQ ID NO: 1365486 - RNA, 19 nt, Homo sapiens
ccaaagcccagcccaagac

SEQ ID NO: 1365487 - RNA, 19 nt, Homo sapiens
agaaauaacgcagauacag

SEQ ID NO: 1365488 - RNA, 19 nt, Homo sapiens
caaucaugucgagaaauaa

SEQ ID NO: 1365489 - RNA, 19 nt, Homo sapiens
gccaaagggccagauguca

SEQ ID NO: 1365490 - RNA, 19 nt, Homo sapiens
cagccgaguccguuaagau

SEQ ID NO: 1365491 - RNA, 19 nt, Homo sapiens
gcagaacccugaccacuga

SEQ ID NO: 1365492 - RNA, 19 nt, Homo sapiens
ggucauaucucucagaaag

SEQ ID NO: 1365493 - RNA, 19 nt, Homo sapiens
gaggagagguacuuugaug

SEQ ID NO: 1365494 - RNA, 19 nt, Homo sapiens
ggaagcagcugaggcaaca

SEQ ID NO: 1365495 - RNA, 19 nt, Homo sapiens
ucacaaagguccuagaaac

SEQ ID NO: 1365496 - RNA, 19 nt, Homo sapiens
gaacccaggccuagaauca

SEQ ID NO: 1365497 - RNA, 19 nt, Homo sapiens
ccucaaaccuggcugcuau

SEQ ID NO: 1365498 - RNA, 19 nt, Homo sapiens
gcaugcagauguccucaga

SEQ ID NO: 1365499 - RNA, 19 nt, Homo sapiens
ggaaguggccaguuugguu

SEQ ID NO: 1365500 - RNA, 19 nt, Homo sapiens
caccagcgcuuccuagaug

SEQ ID NO: 1365501 - RNA, 19 nt, Homo sapiens
ggaggacagugacgaggaa

SEQ ID NO: 1365502 - RNA, 19 nt, Homo sapiens
ugacagagcaugagaaagu

SEQ ID NO: 1365503 - RNA, 19 nt, Homo sapiens
uaacaagggcuccgugcua

SEQ ID NO: 1365504 - RNA, 19 nt, Homo sapiens
guacuuugaugaggaagaa

SEQ ID NO: 1365505 - RNA, 19 nt, Homo sapiens
ugagaagggucagauggua

SEQ ID NO: 1365506 - RNA, 19 nt, Homo sapiens
uaucauggguccugaguca

SEQ ID NO: 1365507 - RNA, 19 nt, Homo sapiens
ucucuuaccugccuguauu

SEQ ID NO: 1365508 - RNA, 19 nt, Homo sapiens
caaaggaggccuggaaaga

SEQ ID NO: 1365509 - RNA, 19 nt, Homo sapiens
gggcaagggucaccaaguc

SEQ ID NO: 1365510 - RNA, 19 nt, Homo sapiens
ggaggaagcagcagcuaga

SEQ ID NO: 1365511 - RNA, 19 nt, Homo sapiens
ucagagcgacuauuaaaga

SEQ ID NO: 1365512 - RNA, 19 nt, Homo sapiens
cagagcgacuauuaaagaa

SEQ ID NO: 1365513 - RNA, 19 nt, Homo sapiens
gggaugaggaggagaggua

SEQ ID NO: 1365514 - RNA, 19 nt, Homo sapiens
ugucugggcuucuuucugu

SEQ ID NO: 1365515 - RNA, 19 nt, Homo sapiens
gagguacuuugaugaggaa

SEQ ID NO: 1365516 - RNA, 19 nt, Homo sapiens
gcgaguacuucagugauga

SEQ ID NO: 1365517 - RNA, 19 nt, Homo sapiens
ggaacauucucaggcgaaa

SEQ ID NO: 1365518 - RNA, 19 nt, Homo sapiens
gcagugcuaugcccuaggu

SEQ ID NO: 1365519 - RNA, 19 nt, Homo sapiens
caucagaggcagaaaugaa

SEQ ID NO: 1365520 - RNA, 19 nt, Homo sapiens
ggucaaaggaggccuggaa

SEQ ID NO: 1365521 - RNA, 19 nt, Homo sapiens
gagauggaauggugguauc

SEQ ID NO: 1365522 - RNA, 19 nt, Homo sapiens
caggucaucuugauaugga

SEQ ID NO: 1365523 - RNA, 19 nt, Homo sapiens
gcgcuucuguccucuguca

SEQ ID NO: 1365524 - RNA, 19 nt, Homo sapiens
ggacuccucaugccucuga

SEQ ID NO: 1365525 - RNA, 19 nt, Homo sapiens
gaacccugaccacugagua

SEQ ID NO: 1365526 - RNA, 19 nt, Homo sapiens
ccucuucuuucuacuugua

SEQ ID NO: 1365527 - RNA, 19 nt, Homo sapiens
ucagggccauccagaguga

SEQ ID NO: 1365528 - RNA, 19 nt, Homo sapiens
gauggaggcagacaagaug

SEQ ID NO: 1365529 - RNA, 19 nt, Homo sapiens
aaggaggccuggaaagaug

SEQ ID NO: 1365530 - RNA, 19 nt, Homo sapiens
gagcgcuucuguccucugu

SEQ ID NO: 1365531 - RNA, 19 nt, Homo sapiens
ggacccaggcuguggauca

SEQ ID NO: 1365532 - RNA, 19 nt, Homo sapiens
ucagugacccuuucucuag

SEQ ID NO: 1365533 - RNA, 19 nt, Homo sapiens
cccaugaacuagugaagug

SEQ ID NO: 1365534 - RNA, 19 nt, Homo sapiens
ggccucuucuuucuacuug

SEQ ID NO: 1365535 - RNA, 19 nt, Homo sapiens
ggcgaguacuucagugaug

SEQ ID NO: 1365536 - RNA, 19 nt, Homo sapiens
caguggcccuggacaguga

SEQ ID NO: 1365537 - RNA, 19 nt, Homo sapiens
guacauuuccaccucucua

SEQ ID NO: 1365538 - RNA, 19 nt, Homo sapiens
ggagaucaguccccaaauc

SEQ ID NO: 1365539 - RNA, 19 nt, Homo sapiens
cgaccaccgugcagacuuc

SEQ ID NO: 1365540 - RNA, 19 nt, Homo sapiens
gacagagcaugagaaagug

SEQ ID NO: 1365541 - RNA, 19 nt, Homo sapiens
gacaggaucaggucaucuu

SEQ ID NO: 1365542 - RNA, 19 nt, Homo sapiens
ggauggaggcagacaagau

SEQ ID NO: 1365543 - RNA, 19 nt, Homo sapiens
uuaccugccuguauuugug

SEQ ID NO: 1365544 - RNA, 19 nt, Homo sapiens
caacaaggcagcugauucc

SEQ ID NO: 1365545 - RNA, 19 nt, Homo sapiens
ggagagguacuuugaugag

SEQ ID NO: 1365546 - RNA, 19 nt, Homo sapiens
acucagagccuccuugcuu

SEQ ID NO: 1365547 - RNA, 19 nt, Homo sapiens
caagugugcaugcagaugu

SEQ ID NO: 1365548 - RNA, 19 nt, Homo sapiens
ggccuagaaucacaaaggu

SEQ ID NO: 1365549 - RNA, 19 nt, Homo sapiens
cggguuggauccucagaug

SEQ ID NO: 1365550 - RNA, 19 nt, Homo sapiens
ccaacaaggcagcugauuc

SEQ ID NO: 1365551 - RNA, 19 nt, Homo sapiens
gucuaucauuuggucauua

SEQ ID NO: 1365552 - RNA, 19 nt, Homo sapiens
gagccuccuugcuucuguu

SEQ ID NO: 1365553 - RNA, 19 nt, Homo sapiens
gcaccagcgcuuccuagau

SEQ ID NO: 1365554 - RNA, 19 nt, Homo sapiens
gcuaugcccucugggucaa

SEQ ID NO: 1365555 - RNA, 19 nt, Homo sapiens
ccugccagcuugaguguag

SEQ ID NO: 1365556 - RNA, 19 nt, Homo sapiens
uuccaggccugcucaguga

SEQ ID NO: 1365557 - RNA, 19 nt, Homo sapiens
caggaacccaggccuagaa

SEQ ID NO: 1365558 - RNA, 19 nt, Homo sapiens
gaggaggagagguacuuug

SEQ ID NO: 1365559 - RNA, 19 nt, Homo sapiens
gcuccgugcuagccacugu

SEQ ID NO: 1365560 - RNA, 19 nt, Homo sapiens
aagaggaggaggacaguga

SEQ ID NO: 1365561 - RNA, 19 nt, Homo sapiens
agccaagagugcaggauga

SEQ ID NO: 1365562 - RNA, 19 nt, Homo sapiens
gccaucagaggcagaaaug

SEQ ID NO: 1365563 - RNA, 19 nt, Homo sapiens
gucugucucucagccuuua

SEQ ID NO: 1365564 - RNA, 19 nt, Homo sapiens
cggcgaaggaacccgauaa

SEQ ID NO: 1365565 - RNA, 19 nt, Homo sapiens
gcuaugcccuagguacuac

SEQ ID NO: 1365566 - RNA, 19 nt, Homo sapiens
gaaaaguccgagagaauca

SEQ ID NO: 1365567 - RNA, 19 nt, Homo sapiens
aaucacaaagguccuagaa

SEQ ID NO: 1365568 - RNA, 19 nt, Homo sapiens
agaaaccacuuggcugucu

SEQ ID NO: 1365569 - RNA, 19 nt, Homo sapiens
aaaggaggccuggaaagau

SEQ ID NO: 1365570 - RNA, 19 nt, Homo sapiens
ccagacagggaaagugaga

SEQ ID NO: 1365571 - RNA, 19 nt, Homo sapiens
guucccaucucuccuucug

SEQ ID NO: 1365572 - RNA, 19 nt, Homo sapiens
guuuaugucugcgcugugu

SEQ ID NO: 1365573 - RNA, 19 nt, Homo sapiens
uuaccagucuaucauuugg

SEQ ID NO: 1365574 - RNA, 19 nt, Homo sapiens
accaauaucacuccucuau

SEQ ID NO: 1365575 - RNA, 19 nt, Homo sapiens
ggaggagagguacuuugau

SEQ ID NO: 1365576 - RNA, 19 nt, Homo sapiens
gcaaggacggggacuuuga

SEQ ID NO: 1365577 - RNA, 19 nt, Homo sapiens
gcucagugacccuuucucu

SEQ ID NO: 1365578 - RNA, 19 nt, Homo sapiens
aggaggagagguacuuuga

SEQ ID NO: 1365579 - RNA, 19 nt, Homo sapiens
cgauaagggcugcauagag

SEQ ID NO: 1365580 - RNA, 19 nt, Homo sapiens
ccucagacgggaagguuug

SEQ ID NO: 1365581 - RNA, 19 nt, Homo sapiens
cuagugaagugggucaaag

SEQ ID NO: 1365582 - RNA, 19 nt, Homo sapiens
ccuccgagccucagcuaug

SEQ ID NO: 1365583 - RNA, 19 nt, Homo sapiens
ucucucagccuuuaucucu

SEQ ID NO: 1365584 - RNA, 19 nt, Homo sapiens
ggaagaggaggaggacagu

SEQ ID NO: 1365585 - RNA, 19 nt, Homo sapiens
gacaccagucccaucuaaa

SEQ ID NO: 1365586 - RNA, 19 nt, Homo sapiens
ugaggaagaaccugaggau

SEQ ID NO: 1365587 - RNA, 19 nt, Homo sapiens
cagacaggaucaggucauc

SEQ ID NO: 1365588 - RNA, 19 nt, Homo sapiens
ccugaccacugaguaauac

SEQ ID NO: 1365589 - RNA, 19 nt, Homo sapiens
ucuguuagguucccaucuc

SEQ ID NO: 1365590 - RNA, 19 nt, Homo sapiens
gcaguacaucgggcaguau

SEQ ID NO: 1365591 - RNA, 19 nt, Homo sapiens
gaugcuaccugacaccuau

SEQ ID NO: 1365592 - RNA, 19 nt, Homo sapiens
ccauuuggcugaagucaug

SEQ ID NO: 1365593 - RNA, 19 nt, Homo sapiens
gaaugcaggacgagccuua

SEQ ID NO: 1365594 - RNA, 19 nt, Homo sapiens
gaggaucacuggaguucga

SEQ ID NO: 1365595 - RNA, 19 nt, Homo sapiens
caaacucccuguacagaag

SEQ ID NO: 1365596 - RNA, 19 nt, Homo sapiens
ugugugagcugcuggaaga

SEQ ID NO: 1365597 - RNA, 19 nt, Homo sapiens
ccuguaaucccaacacuuu

SEQ ID NO: 1365598 - RNA, 19 nt, Homo sapiens
gaaugcgucacagauguua

SEQ ID NO: 1365599 - RNA, 19 nt, Homo sapiens
gauagaaagacccuuagau

SEQ ID NO: 1365600 - RNA, 19 nt, Homo sapiens
caucuaugcugcugacaag

SEQ ID NO: 1365601 - RNA, 19 nt, Homo sapiens
agaaagacccuuagauguc

SEQ ID NO: 1365602 - RNA, 19 nt, Homo sapiens
uagaaagacccuuagaugu

SEQ ID NO: 1365603 - RNA, 19 nt, Homo sapiens
cuagugcucuggaccaugu

SEQ ID NO: 1365604 - RNA, 19 nt, Homo sapiens
gaugaaugcgucacagaug

SEQ ID NO: 1365605 - RNA, 19 nt, Homo sapiens
auagaaagacccuuagaug

SEQ ID NO: 1365606 - RNA, 19 nt, Homo sapiens
guacagaagggaaacaaac

SEQ ID NO: 1365607 - RNA, 19 nt, Homo sapiens
ggauagaaagacccuuaga

SEQ ID NO: 1365608 - RNA, 19 nt, Homo sapiens
acccuuagaugucuucuca

SEQ ID NO: 1365609 - RNA, 19 nt, Homo sapiens
ggcugaggcuggaggauca

SEQ ID NO: 1365610 - RNA, 19 nt, Homo sapiens
ccaaacucccuguacagaa

SEQ ID NO: 1365611 - RNA, 19 nt, Homo sapiens
cagaguuccugcagagcuu

SEQ ID NO: 1365612 - RNA, 19 nt, Homo sapiens
ggaugaaugcgucacagau

SEQ ID NO: 1365613 - RNA, 19 nt, Homo sapiens
ugggauagaaagacccuua

SEQ ID NO: 1365614 - RNA, 19 nt, Homo sapiens
ucgggaccgugccuucuuu

SEQ ID NO: 1365615 - RNA, 19 nt, Homo sapiens
ggaccgugccuucuuugca

SEQ ID NO: 1365616 - RNA, 19 nt, Homo sapiens
gagcugcagccacacuuca

SEQ ID NO: 1365617 - RNA, 19 nt, Homo sapiens
ggcccuggauggcauugug

SEQ ID NO: 1365618 - RNA, 19 nt, Homo sapiens
cuaccugacaccuauauca

SEQ ID NO: 1365619 - RNA, 19 nt, Homo sapiens
uggcagcccuccucgacau

SEQ ID NO: 1365620 - RNA, 19 nt, Homo sapiens
gaguguuggugcgcgacua

SEQ ID NO: 1365621 - RNA, 19 nt, Homo sapiens
ccaucgcccuggucaacug

SEQ ID NO: 1365622 - RNA, 19 nt, Homo sapiens
aggcugcagugagcuauga

SEQ ID NO: 1365623 - RNA, 19 nt, Homo sapiens
gguggugugugccuguagu

SEQ ID NO: 1365624 - RNA, 19 nt, Homo sapiens
ugaaugcgucacagauguu

SEQ ID NO: 1365625 - RNA, 19 nt, Homo sapiens
augaaugcgucacagaugu

SEQ ID NO: 1365626 - RNA, 19 nt, Homo sapiens
ggaggaugaaugcgucaca

SEQ ID NO: 1365627 - RNA, 19 nt, Homo sapiens
gcagccacacuucaacaag

SEQ ID NO: 1365628 - RNA, 19 nt, Homo sapiens
ccgcaucagccaggaguuu

SEQ ID NO: 1365629 - RNA, 19 nt, Homo sapiens
ggaaagaaauggucuauca

SEQ ID NO: 1365630 - RNA, 19 nt, Homo sapiens
gaaauggucuaucaacuga

SEQ ID NO: 1365631 - RNA, 19 nt, Homo sapiens
gaagaagucuggaagaaga

SEQ ID NO: 1365632 - RNA, 19 nt, Homo sapiens
ggcaagagcuucacucaaa

SEQ ID NO: 1365633 - RNA, 19 nt, Homo sapiens
gaacaaaacuccaucuaaa

SEQ ID NO: 1365634 - RNA, 19 nt, Homo sapiens
agagaaaccuuacaaauga

SEQ ID NO: 1365635 - RNA, 19 nt, Homo sapiens
gaauaacagucucugguuu

SEQ ID NO: 1365636 - RNA, 19 nt, Homo sapiens
gagagaagccuuacaaaug

SEQ ID NO: 1365637 - RNA, 19 nt, Homo sapiens
gcucaaacaucacaacuug

SEQ ID NO: 1365638 - RNA, 19 nt, Homo sapiens
gagagaagccuuacaaaug

SEQ ID NO: 1365639 - RNA, 19 nt, Homo sapiens
gcaaaucaccgaagaauuc

SEQ ID NO: 1365640 - RNA, 19 nt, Homo sapiens
gaaaucaaauaacgcaguu

SEQ ID NO: 1365641 - RNA, 19 nt, Homo sapiens
gaacucacauuaucugcuu

SEQ ID NO: 1365642 - RNA, 19 nt, Homo sapiens
ucacagauaucccuccuaa

SEQ ID NO: 1365643 - RNA, 19 nt, Homo sapiens
gaaguagaguaacauauuc

SEQ ID NO: 1365644 - RNA, 19 nt, Homo sapiens
caacagaaguagaguaaca

SEQ ID NO: 1365645 - RNA, 19 nt, Homo sapiens
guucaaaucuugcaaguca

SEQ ID NO: 1365646 - RNA, 19 nt, Homo sapiens
agagaaaccuuacaaaugu

SEQ ID NO: 1365647 - RNA, 19 nt, Homo sapiens
agagaaaccuuacaaaugu

SEQ ID NO: 1365648 - RNA, 19 nt, Homo sapiens
ggaggcagagguucuauua

SEQ ID NO: 1365649 - RNA, 19 nt, Homo sapiens
gagagaaaccuuacaaaug

SEQ ID NO: 1365650 - RNA, 19 nt, Homo sapiens
gagagaaaccuuacaaaug

SEQ ID NO: 1365651 - RNA, 19 nt, Homo sapiens
gagagaaaccuuacaaaug

SEQ ID NO: 1365652 - RNA, 19 nt, Homo sapiens
ggaguaagcuuucauucuc

SEQ ID NO: 1365653 - RNA, 19 nt, Homo sapiens
cgaaagcccugacauugaa

SEQ ID NO: 1365654 - RNA, 19 nt, Homo sapiens
ggugaaggauuauuucuau

SEQ ID NO: 1365655 - RNA, 19 nt, Homo sapiens
gaacaaaaccuuucaaaug

SEQ ID NO: 1365656 - RNA, 19 nt, Homo sapiens
ugagaaaccuuacaagugu

SEQ ID NO: 1365657 - RNA, 19 nt, Homo sapiens
cagguacgguugacauuua

SEQ ID NO: 1365658 - RNA, 19 nt, Homo sapiens
gagcaauaccuguuguuua

SEQ ID NO: 1365659 - RNA, 19 nt, Homo sapiens
uugauuaggugaaggauua

SEQ ID NO: 1365660 - RNA, 19 nt, Homo sapiens
ggcaaggucuuuacucaaa

SEQ ID NO: 1365661 - RNA, 19 nt, Homo sapiens
ccacuaggcucuuaaacga

SEQ ID NO: 1365662 - RNA, 19 nt, Homo sapiens
guacaccacuaggcucuua

SEQ ID NO: 1365663 - RNA, 19 nt, Homo sapiens
gggaaagccuucaguguuc

SEQ ID NO: 1365664 - RNA, 19 nt, Homo sapiens
gggaaagccuucaguguuc

SEQ ID NO: 1365665 - RNA, 19 nt, Homo sapiens
ggcaagcucuucacucaaa

SEQ ID NO: 1365666 - RNA, 19 nt, Homo sapiens
gcaaggcguucacucagaa

SEQ ID NO: 1365667 - RNA, 19 nt, Homo sapiens
gguaaagucuucgcucaaa

SEQ ID NO: 1365668 - RNA, 19 nt, Homo sapiens
gcaagcagaucaccugaag

SEQ ID NO: 1365669 - RNA, 19 nt, Homo sapiens
caaauaagacccaugcuau

SEQ ID NO: 1365670 - RNA, 19 nt, Homo sapiens
cauaugcaccacauuauua

SEQ ID NO: 1365671 - RNA, 19 nt, Homo sapiens
gauacuccauaacacaaua

SEQ ID NO: 1365672 - RNA, 19 nt, Homo sapiens
agagaaaccuuacaagugu

SEQ ID NO: 1365673 - RNA, 19 nt, Homo sapiens
agagaaaccuuacaagugu

SEQ ID NO: 1365674 - RNA, 19 nt, Homo sapiens
agagaaaccuuacaagugu

SEQ ID NO: 1365675 - RNA, 19 nt, Homo sapiens
agagaaaccuuacaagugu

SEQ ID NO: 1365676 - RNA, 19 nt, Homo sapiens
aaagagcccuggacuguga

SEQ ID NO: 1365677 - RNA, 19 nt, Homo sapiens
ggaaagagcccuggacugu

SEQ ID NO: 1365678 - RNA, 19 nt, Homo sapiens
gccaaucccucaugaguug

SEQ ID NO: 1365679 - RNA, 19 nt, Homo sapiens
gagagaaaccuuacaagug

SEQ ID NO: 1365680 - RNA, 19 nt, Homo sapiens
gagagaaaccuuacaagug

SEQ ID NO: 1365681 - RNA, 19 nt, Homo sapiens
gagagaaaccuuacaagug

SEQ ID NO: 1365682 - RNA, 19 nt, Homo sapiens
gagagaaaccuuacaagug

SEQ ID NO: 1365683 - RNA, 19 nt, Homo sapiens
gagagaaaccuuacaagug

SEQ ID NO: 1365684 - RNA, 19 nt, Homo sapiens
gacagaauccuuacaaaug

SEQ ID NO: 1365685 - RNA, 19 nt, Homo sapiens
ggaggagaguaauagguaa

SEQ ID NO: 1365686 - RNA, 19 nt, Homo sapiens
gccaagaccuuaggacauu

SEQ ID NO: 1365687 - RNA, 19 nt, Homo sapiens
ucaguuaccuucaccuuau

SEQ ID NO: 1365688 - RNA, 19 nt, Homo sapiens
guggugaggucauuaggua

SEQ ID NO: 1365689 - RNA, 19 nt, Homo sapiens
ggaagaagaggaagaggaa

SEQ ID NO: 1365690 - RNA, 19 nt, Homo sapiens
ggagagaaaccuuacaaau

SEQ ID NO: 1365691 - RNA, 19 nt, Homo sapiens
ggagagaaaccuuacaaau

SEQ ID NO: 1365692 - RNA, 19 nt, Homo sapiens
ggagagaaaccuuacaaau

SEQ ID NO: 1365693 - RNA, 19 nt, Homo sapiens
gagaugacacaggaaauua

SEQ ID NO: 1365694 - RNA, 19 nt, Homo sapiens
gaagagcugugugaaaaua

SEQ ID NO: 1365695 - RNA, 19 nt, Homo sapiens
cgaaacaaauguaauaugc

SEQ ID NO: 1365696 - RNA, 19 nt, Homo sapiens
agagaagccuuacaaaugu

SEQ ID NO: 1365697 - RNA, 19 nt, Homo sapiens
gcaaaucaucgaagaauuc

SEQ ID NO: 1365698 - RNA, 19 nt, Homo sapiens
ggaaaccuauaaccgcauu

SEQ ID NO: 1365699 - RNA, 19 nt, Homo sapiens
uuacaaaugucaugagugu

SEQ ID NO: 1365700 - RNA, 19 nt, Homo sapiens
gaacaaucagcuuggagua

SEQ ID NO: 1365701 - RNA, 19 nt, Homo sapiens
gugaagaguuuaaucaaca

SEQ ID NO: 1365702 - RNA, 19 nt, Homo sapiens
ggagagaagccuuacaaau

SEQ ID NO: 1365703 - RNA, 19 nt, Homo sapiens
ggagagaagccuuacaaau

SEQ ID NO: 1365704 - RNA, 19 nt, Homo sapiens
gaagagcaguacagaagca

SEQ ID NO: 1365705 - RNA, 19 nt, Homo sapiens
gagaagagcaguacagaag

SEQ ID NO: 1365706 - RNA, 19 nt, Homo sapiens
ggcaaggucuucacucaga

SEQ ID NO: 1365707 - RNA, 19 nt, Homo sapiens
caacaaauuccuucuagug

SEQ ID NO: 1365708 - RNA, 19 nt, Homo sapiens
gaagagagaguaguuguca

SEQ ID NO: 1365709 - RNA, 19 nt, Homo sapiens
gaacucacaccuugcaaau

SEQ ID NO: 1365710 - RNA, 19 nt, Homo sapiens
gcaaggcauuggagaguuc

SEQ ID NO: 1365711 - RNA, 19 nt, Homo sapiens
uagaggacauucaaaccua

SEQ ID NO: 1365712 - RNA, 19 nt, Homo sapiens
acucagaauucgaaccuua

SEQ ID NO: 1365713 - RNA, 19 nt, Homo sapiens
gaagagacauagaaaacaa

SEQ ID NO: 1365714 - RNA, 19 nt, Homo sapiens
caacugaacaugaaaugga

SEQ ID NO: 1365715 - RNA, 19 nt, Homo sapiens
ggaauaacagucucugguu

SEQ ID NO: 1365716 - RNA, 19 nt, Homo sapiens
cucaugaguugaagcauua

SEQ ID NO: 1365717 - RNA, 19 nt, Homo sapiens
gaaagaagguaaaagagau

SEQ ID NO: 1365718 - RNA, 19 nt, Homo sapiens
gggaggagaguaauaggua

SEQ ID NO: 1365719 - RNA, 19 nt, Homo sapiens
aggguaagaucaagucuaa

SEQ ID NO: 1365720 - RNA, 19 nt, Homo sapiens
cgacagaagagacauagaa

SEQ ID NO: 1365721 - RNA, 19 nt, Homo sapiens
guaagaaugcgagaaauau

SEQ ID NO: 1365722 - RNA, 19 nt, Homo sapiens
guaauuagacacugauugu

SEQ ID NO: 1365723 - RNA, 19 nt, Homo sapiens
gaaagaaauggucuaucaa

SEQ ID NO: 1365724 - RNA, 19 nt, Homo sapiens
ggagagaaaccuuacaagu

SEQ ID NO: 1365725 - RNA, 19 nt, Homo sapiens
uuacaaaugucaugaaugc

SEQ ID NO: 1365726 - RNA, 19 nt, Homo sapiens
ggagagaaaccuuacaagu

SEQ ID NO: 1365727 - RNA, 19 nt, Homo sapiens
ggagagaaaccuuacaagu

SEQ ID NO: 1365728 - RNA, 19 nt, Homo sapiens
ggagagaaaccuuacaagu

SEQ ID NO: 1365729 - RNA, 19 nt, Homo sapiens
gagaagacauggaauaaau

SEQ ID NO: 1365730 - RNA, 19 nt, Homo sapiens
gaagagaagacauggaaua

SEQ ID NO: 1365731 - RNA, 19 nt, Homo sapiens
gaucaaacagcaaacuuua

SEQ ID NO: 1365732 - RNA, 19 nt, Homo sapiens
gaaacccugugucuacuaa

SEQ ID NO: 1365733 - RNA, 19 nt, Homo sapiens
aaauaacccuguugaguuu

SEQ ID NO: 1365734 - RNA, 19 nt, Homo sapiens
gcaaugcaauggacagaau

SEQ ID NO: 1365735 - RNA, 19 nt, Homo sapiens
uaaauaacccuguugaguu

SEQ ID NO: 1365736 - RNA, 19 nt, Homo sapiens
ggagaacuauaaccaccua

SEQ ID NO: 1365737 - RNA, 19 nt, Homo sapiens
gaagagacaaagacguaua

SEQ ID NO: 1365738 - RNA, 19 nt, Homo sapiens
ggacagaauacacuuagaa

SEQ ID NO: 1365739 - RNA, 19 nt, Homo sapiens
cagcaaacuuuaucaugaa

SEQ ID NO: 1365740 - RNA, 19 nt, Homo sapiens
ggacguggaugcggcguuu

SEQ ID NO: 1365741 - RNA, 19 nt, Homo sapiens
acagcaaacuuuaucauga

SEQ ID NO: 1365742 - RNA, 19 nt, Homo sapiens
uaacucaagugaagcaaug

SEQ ID NO: 1365743 - RNA, 19 nt, Homo sapiens
ggauguggcuguggaauuc

SEQ ID NO: 1365744 - RNA, 19 nt, Homo sapiens
caaaauaacucaagugaag

SEQ ID NO: 1365745 - RNA, 19 nt, Homo sapiens
gaauaaauaacccuguuga

SEQ ID NO: 1365746 - RNA, 19 nt, Homo sapiens
gagcgcgucugaauaggaa

SEQ ID NO: 1365747 - RNA, 19 nt, Homo sapiens
ggccuuggauaucauaauu

SEQ ID NO: 1365748 - RNA, 19 nt, Homo sapiens
gacaacagaugcuaaaauu

SEQ ID NO: 1365749 - RNA, 19 nt, Homo sapiens
cagaagagacaaagacgua

SEQ ID NO: 1365750 - RNA, 19 nt, Homo sapiens
gaggcuauaugaucaaaca

SEQ ID NO: 1365751 - RNA, 19 nt, Homo sapiens
gagaaugccaucuugcaaa

SEQ ID NO: 1365752 - RNA, 19 nt, Homo sapiens
agacguauaguccauguua

SEQ ID NO: 1365753 - RNA, 19 nt, Homo sapiens
ggagguugcuggccuugga

SEQ ID NO: 1365754 - RNA, 19 nt, Homo sapiens
gaucccuucuuccaaauau

SEQ ID NO: 1365755 - RNA, 19 nt, Homo sapiens
gcaggagcgcgucugaaua

SEQ ID NO: 1365756 - RNA, 19 nt, Homo sapiens
ggacaagaaccauggacaa

SEQ ID NO: 1365757 - RNA, 19 nt, Homo sapiens
cagauguacucuccaaguu

SEQ ID NO: 1365758 - RNA, 19 nt, Homo sapiens
gugaagcaaugaaggaaga

SEQ ID NO: 1365759 - RNA, 19 nt, Homo sapiens
caagacacauuuuccuaua

SEQ ID NO: 1365760 - RNA, 19 nt, Homo sapiens
gaucaagacccaggaauca

SEQ ID NO: 1365761 - RNA, 19 nt, Homo sapiens
ccugaucccuucuuccaaa

SEQ ID NO: 1365762 - RNA, 19 nt, Homo sapiens
ucagggcccuuguccacua

SEQ ID NO: 1365763 - RNA, 19 nt, Homo sapiens
uaucaugaaugcacgaugu

SEQ ID NO: 1365764 - RNA, 19 nt, Homo sapiens
gaaggcccaugggauguga

SEQ ID NO: 1365765 - RNA, 19 nt, Homo sapiens
cagaagagaagacauggaa

SEQ ID NO: 1365766 - RNA, 19 nt, Homo sapiens
caaacuagcaaaccagaug

SEQ ID NO: 1365767 - RNA, 19 nt, Homo sapiens
gacagaauacacuuagaaa

SEQ ID NO: 1365768 - RNA, 19 nt, Homo sapiens
gggaugugaugguggagaa

SEQ ID NO: 1365769 - RNA, 19 nt, Homo sapiens
ggaauaaauaacccuguug

SEQ ID NO: 1365770 - RNA, 19 nt, Homo sapiens
caagaaccauggacaacag

SEQ ID NO: 1365771 - RNA, 19 nt, Homo sapiens
gcugagcuccuugagguua

SEQ ID NO: 1365772 - RNA, 19 nt, Homo sapiens
acauuugacuuguacagaa

SEQ ID NO: 1365773 - RNA, 19 nt, Homo sapiens
ugaagagcgugcagcaaug

SEQ ID NO: 1365774 - RNA, 19 nt, Homo sapiens
ccaggaaucgggaaaguug

SEQ ID NO: 1365775 - RNA, 19 nt, Homo sapiens
cauuugacuuguacagaaa

SEQ ID NO: 1365776 - RNA, 19 nt, Homo sapiens
ccacccgccuucucacuau

SEQ ID NO: 1365777 - RNA, 19 nt, Homo sapiens
gaugugggcaaacucauga

SEQ ID NO: 1365778 - RNA, 19 nt, Homo sapiens
ggacacugcucagaagaac

SEQ ID NO: 1365779 - RNA, 19 nt, Homo sapiens
caaguuggcacauggacaa

SEQ ID NO: 1365780 - RNA, 19 nt, Homo sapiens
ucuagagaaugccaucuug

SEQ ID NO: 1365781 - RNA, 19 nt, Homo sapiens
caaacuuuaucaugaaugc

SEQ ID NO: 1365782 - RNA, 19 nt, Homo sapiens
uggaauaaauaacccuguu

SEQ ID NO: 1365783 - RNA, 19 nt, Homo sapiens
caugauacauuugacuugu

SEQ ID NO: 1365784 - RNA, 19 nt, Homo sapiens
guuggcacauggacaagaa

SEQ ID NO: 1365785 - RNA, 19 nt, Homo sapiens
caagugaagcaaugaagga

SEQ ID NO: 1365786 - RNA, 19 nt, Homo sapiens
ucaaacagcaaacuuuauc

SEQ ID NO: 1365787 - RNA, 19 nt, Homo sapiens
caacagaugcuaaaauuca

SEQ ID NO: 1365788 - RNA, 19 nt, Homo sapiens
acaaagacguauaguccau

SEQ ID NO: 1365789 - RNA, 19 nt, Homo sapiens
caaaugcagaagagacaaa

SEQ ID NO: 1365790 - RNA, 19 nt, Homo sapiens
aagagaagacauggaauaa

SEQ ID NO: 1365791 - RNA, 19 nt, Homo sapiens
gcaauggacagaauacacu

SEQ ID NO: 1365792 - RNA, 19 nt, Homo sapiens
ccuuggauaucauaauuuc

SEQ ID NO: 1365793 - RNA, 19 nt, Homo sapiens
gaaccauggacaacagaug

SEQ ID NO: 1365794 - RNA, 19 nt, Homo sapiens
guauggugcugggcuguug

SEQ ID NO: 1365795 - RNA, 19 nt, Homo sapiens
caucucagcaagacacauu

SEQ ID NO: 1365796 - RNA, 19 nt, Homo sapiens
ccaaaccaaagacuucuga

SEQ ID NO: 1365797 - RNA, 19 nt, Homo sapiens
uccauguuauccacuauuu

SEQ ID NO: 1365798 - RNA, 19 nt, Homo sapiens
caggagcgcgucugaauag

SEQ ID NO: 1365799 - RNA, 19 nt, Homo sapiens
ugaucaaacagcaaacuuu

SEQ ID NO: 1365800 - RNA, 19 nt, Homo sapiens
gaggcaggcggaucacuug

SEQ ID NO: 1365801 - RNA, 19 nt, Homo sapiens
guaucaaacuagcaaacca

SEQ ID NO: 1365802 - RNA, 19 nt, Homo sapiens
aaagacguauaguccaugu

SEQ ID NO: 1365803 - RNA, 19 nt, Homo sapiens
caaugcaauggacagaaua

SEQ ID NO: 1365804 - RNA, 19 nt, Homo sapiens
gacguauaguccauguuau

SEQ ID NO: 1365805 - RNA, 19 nt, Homo sapiens
caugggaugugaccaacuc

SEQ ID NO: 1365806 - RNA, 19 nt, Homo sapiens
ucacugggguaucaaacua

SEQ ID NO: 1365807 - RNA, 19 nt, Homo sapiens
aaauauggagggcugugua

SEQ ID NO: 1365808 - RNA, 19 nt, Homo sapiens
caaacagcaaacuuuauca

SEQ ID NO: 1365809 - RNA, 19 nt, Homo sapiens
uuaaucaaccagaagagaa

SEQ ID NO: 1365810 - RNA, 19 nt, Homo sapiens
gaagcaaaauaacucaagu

SEQ ID NO: 1365811 - RNA, 19 nt, Homo sapiens
agaaugccaucuugcaaac

SEQ ID NO: 1365812 - RNA, 19 nt, Homo sapiens
gcaaacuuuaucaugaaug

SEQ ID NO: 1365813 - RNA, 19 nt, Homo sapiens
acuggaggcuauaugauca

SEQ ID NO: 1365814 - RNA, 19 nt, Homo sapiens
gcgaaacccugugucuacu

SEQ ID NO: 1365815 - RNA, 19 nt, Homo sapiens
ggcgaaacccugugucuac

SEQ ID NO: 1365816 - RNA, 19 nt, Homo sapiens
ggagcgcgucugaauagga

SEQ ID NO: 1365817 - RNA, 19 nt, Homo sapiens
gcacucuccaaaccaaaga

SEQ ID NO: 1365818 - RNA, 19 nt, Homo sapiens
ggacaacagaugcuaaaau

SEQ ID NO: 1365819 - RNA, 19 nt, Homo sapiens
uagcaaaccagauguacuc

SEQ ID NO: 1365820 - RNA, 19 nt, Homo sapiens
gagacaaagacguauaguc

SEQ ID NO: 1365821 - RNA, 19 nt, Homo sapiens
cgaaacccugugucuacua

SEQ ID NO: 1365822 - RNA, 19 nt, Homo sapiens
cauggcaaaugcagaagag

SEQ ID NO: 1365823 - RNA, 19 nt, Homo sapiens
aaccagauguacucuccaa

SEQ ID NO: 1365824 - RNA, 19 nt, Homo sapiens
ggcaaacucaugacugcuu

SEQ ID NO: 1365825 - RNA, 19 nt, Homo sapiens
auaaauaacccuguugagu

SEQ ID NO: 1365826 - RNA, 19 nt, Homo sapiens
agagaagacauggaauaaa

SEQ ID NO: 1365827 - RNA, 19 nt, Homo sapiens
gcaagacacauuuuccuau

SEQ ID NO: 1365828 - RNA, 19 nt, Homo sapiens
ccagauguacucuccaagu

SEQ ID NO: 1365829 - RNA, 19 nt, Homo sapiens
gaauaaacccguuaccuua

SEQ ID NO: 1365830 - RNA, 19 nt, Homo sapiens
guaaaugacacugugaaua

SEQ ID NO: 1365831 - RNA, 19 nt, Homo sapiens
agaaggagguggugcugua

SEQ ID NO: 1365832 - RNA, 19 nt, Homo sapiens
ucacaacgccgacgacaug

SEQ ID NO: 1365833 - RNA, 19 nt, Homo sapiens
ugaauaaacccguuaccuu

SEQ ID NO: 1365834 - RNA, 19 nt, Homo sapiens
gcggagaccgugcucauga

SEQ ID NO: 1365835 - RNA, 19 nt, Homo sapiens
auaaacccguuaccuuaaa

SEQ ID NO: 1365836 - RNA, 19 nt, Homo sapiens
aauaaacccguuaccuuaa

SEQ ID NO: 1365837 - RNA, 19 nt, Homo sapiens
agaccgugcucaugaacuu

SEQ ID NO: 1365838 - RNA, 19 nt, Homo sapiens
cggagaccgugcucaugaa

SEQ ID NO: 1365839 - RNA, 19 nt, Homo sapiens
gcaguucgccucgcagaag

SEQ ID NO: 1365840 - RNA, 19 nt, Homo sapiens
gaaguuggcccauaucuua

SEQ ID NO: 1365841 - RNA, 19 nt, Homo sapiens
ggagagagcuuaaaccaau

SEQ ID NO: 1365842 - RNA, 19 nt, Homo sapiens
gcacgcaacugcaaagaaa

SEQ ID NO: 1365843 - RNA, 19 nt, Homo sapiens
gaaauagaauccugucaga

SEQ ID NO: 1365844 - RNA, 19 nt, Homo sapiens
cgaaugaucacuaagauua

SEQ ID NO: 1365845 - RNA, 19 nt, Homo sapiens
caacaacaaucaaaccauu

SEQ ID NO: 1365846 - RNA, 19 nt, Homo sapiens
aaacacaacugguuaccua

SEQ ID NO: 1365847 - RNA, 19 nt, Homo sapiens
gaaauaaugcccuggguuu

SEQ ID NO: 1365848 - RNA, 19 nt, Homo sapiens
uaagagggcucacuccaaa

SEQ ID NO: 1365849 - RNA, 19 nt, Homo sapiens
uaaacuagguccacuauca

SEQ ID NO: 1365850 - RNA, 19 nt, Homo sapiens
ggagacaagugcacuaaau

SEQ ID NO: 1365851 - RNA, 19 nt, Homo sapiens
caucguaccuggaguagaa

SEQ ID NO: 1365852 - RNA, 19 nt, Homo sapiens
ggaaaguuauugaucucua

SEQ ID NO: 1365853 - RNA, 19 nt, Homo sapiens
uagaggaacucaugauuug

SEQ ID NO: 1365854 - RNA, 19 nt, Homo sapiens
gaaguacccugaccaccuu

SEQ ID NO: 1365855 - RNA, 19 nt, Homo sapiens
guaaauugcaccuuuguaa

SEQ ID NO: 1365856 - RNA, 19 nt, Homo sapiens
ggagccagcugauacagaa

SEQ ID NO: 1365857 - RNA, 19 nt, Homo sapiens
gaacucaugauuuguacua

SEQ ID NO: 1365858 - RNA, 19 nt, Homo sapiens
aaauucaccuggaacuuua

SEQ ID NO: 1365859 - RNA, 19 nt, Homo sapiens
ggaagucgauauuaaugga

SEQ ID NO: 1365860 - RNA, 19 nt, Homo sapiens
ucacuugccucaauaaugu

SEQ ID NO: 1365861 - RNA, 19 nt, Homo sapiens
gugccuacguuccuuaaua

SEQ ID NO: 1365862 - RNA, 19 nt, Homo sapiens
uaacgugcuucuacuguuu

SEQ ID NO: 1365863 - RNA, 19 nt, Homo sapiens
auacagaagugcuacagua

SEQ ID NO: 1365864 - RNA, 19 nt, Homo sapiens
ggucauuccuggugcaauu

SEQ ID NO: 1365865 - RNA, 19 nt, Homo sapiens
gugaguuucuuagguauua

SEQ ID NO: 1365866 - RNA, 19 nt, Homo sapiens
gaauggcaaacucuauuua

SEQ ID NO: 1365867 - RNA, 19 nt, Homo sapiens
gcacugguuuaauuuguug

SEQ ID NO: 1365868 - RNA, 19 nt, Homo sapiens
gguuguugcugacuugaua

SEQ ID NO: 1365869 - RNA, 19 nt, Homo sapiens
guacaugacucuucacacu

SEQ ID NO: 1365870 - RNA, 19 nt, Homo sapiens
gaauguugacuguuaguuu

SEQ ID NO: 1365871 - RNA, 19 nt, Homo sapiens
gaggaacucaugauuugua

SEQ ID NO: 1365872 - RNA, 19 nt, Homo sapiens
gaauuccacugaagcacuu

SEQ ID NO: 1365873 - RNA, 19 nt, Homo sapiens
cuguggaacuguauuauuu

SEQ ID NO: 1365874 - RNA, 19 nt, Homo sapiens
gcaccuuuguaacauauug

SEQ ID NO: 1365875 - RNA, 19 nt, Homo sapiens
ccuaggaacucuuaaucaa

SEQ ID NO: 1365876 - RNA, 19 nt, Homo sapiens
cuacguuccuuaauaauag

SEQ ID NO: 1365877 - RNA, 19 nt, Homo sapiens
gcuacuuacuguucaagaa

SEQ ID NO: 1365878 - RNA, 19 nt, Homo sapiens
cauauuguauugacgaaug

SEQ ID NO: 1365879 - RNA, 19 nt, Homo sapiens
gaaaggcggaggcagagaa

SEQ ID NO: 1365880 - RNA, 19 nt, Homo sapiens
caacguuuauuacacuuuc

SEQ ID NO: 1365881 - RNA, 19 nt, Homo sapiens
cacaagcacucacugaaau

SEQ ID NO: 1365882 - RNA, 19 nt, Homo sapiens
gagagagcuuaaaccaauu

SEQ ID NO: 1365883 - RNA, 19 nt, Homo sapiens
guaaacguuccauuucuuu

SEQ ID NO: 1365884 - RNA, 19 nt, Homo sapiens
cacauggacucuaacuauu

SEQ ID NO: 1365885 - RNA, 19 nt, Homo sapiens
ggacucauuggaaauugua

SEQ ID NO: 1365886 - RNA, 19 nt, Homo sapiens
cauggacucuaacuauuug

SEQ ID NO: 1365887 - RNA, 19 nt, Homo sapiens
gacgaaugaucacuaagau

SEQ ID NO: 1365888 - RNA, 19 nt, Homo sapiens
gagcaaaguaaguauuaga

SEQ ID NO: 1365889 - RNA, 19 nt, Homo sapiens
ucugugaguuucuuaggua

SEQ ID NO: 1365890 - RNA, 19 nt, Homo sapiens
aaacucuccuuagugcuua

SEQ ID NO: 1365891 - RNA, 19 nt, Homo sapiens
gaacuugaacauugcugaa

SEQ ID NO: 1365892 - RNA, 19 nt, Homo sapiens
cuaccucaaucuagauaaa

SEQ ID NO: 1365893 - RNA, 19 nt, Homo sapiens
acacauggacucuaacuau

SEQ ID NO: 1365894 - RNA, 19 nt, Homo sapiens
gaaauuguacagugacauc

SEQ ID NO: 1365895 - RNA, 19 nt, Homo sapiens
ccaaaucucuggacuaccu

SEQ ID NO: 1365896 - RNA, 19 nt, Homo sapiens
cacaacugguuaccuauga

SEQ ID NO: 1365897 - RNA, 19 nt, Homo sapiens
gauauguauucacccuauu

SEQ ID NO: 1365898 - RNA, 19 nt, Homo sapiens
gaaauaaaggggugaugua

SEQ ID NO: 1365899 - RNA, 19 nt, Homo sapiens
aauggagagucuagaagua

SEQ ID NO: 1365900 - RNA, 19 nt, Homo sapiens
ugccuacguuccuuaauaa

SEQ ID NO: 1365901 - RNA, 19 nt, Homo sapiens
gaaugaauggcaaacucua

SEQ ID NO: 1365902 - RNA, 19 nt, Homo sapiens
uaacacaagcacucacuga

SEQ ID NO: 1365903 - RNA, 19 nt, Homo sapiens
gaagagagcaaagcagaag

SEQ ID NO: 1365904 - RNA, 19 nt, Homo sapiens
acaaauacagcucaacuau

SEQ ID NO: 1365905 - RNA, 19 nt, Homo sapiens
agaguaaucuuucuucacu

SEQ ID NO: 1365906 - RNA, 19 nt, Homo sapiens
acaagugcacuaaaucuuu

SEQ ID NO: 1365907 - RNA, 19 nt, Homo sapiens
ugauauguauucacccuau

SEQ ID NO: 1365908 - RNA, 19 nt, Homo sapiens
gaacucuuaaucaacguuu

SEQ ID NO: 1365909 - RNA, 19 nt, Homo sapiens
cauggaaaguuauugaucu

SEQ ID NO: 1365910 - RNA, 19 nt, Homo sapiens
aauguugacuguuaguuug

SEQ ID NO: 1365911 - RNA, 19 nt, Homo sapiens
acaugacucuucacacuau

SEQ ID NO: 1365912 - RNA, 19 nt, Homo sapiens
guaccagcuucaacaccua

SEQ ID NO: 1365913 - RNA, 19 nt, Homo sapiens
gaagugcacaggaggugaa

SEQ ID NO: 1365914 - RNA, 19 nt, Homo sapiens
uaggaaacacaacugguua

SEQ ID NO: 1365915 - RNA, 19 nt, Homo sapiens
ugacaucuucugggauuua

SEQ ID NO: 1365916 - RNA, 19 nt, Homo sapiens
ugacgaaugaucacuaaga

SEQ ID NO: 1365917 - RNA, 19 nt, Homo sapiens
gaauguuaccugcuugguu

SEQ ID NO: 1365918 - RNA, 19 nt, Homo sapiens
cagaagccaugccauccuu

SEQ ID NO: 1365919 - RNA, 19 nt, Homo sapiens
uaaggcaaacuacgugaaa

SEQ ID NO: 1365920 - RNA, 19 nt, Homo sapiens
cagaaugaauggcaaacuc

SEQ ID NO: 1365921 - RNA, 19 nt, Homo sapiens
guuucgcuguuguauauuu

SEQ ID NO: 1365922 - RNA, 19 nt, Homo sapiens
acacaagcacucacugaaa

SEQ ID NO: 1365923 - RNA, 19 nt, Homo sapiens
uaauacuguuugcaucuga

SEQ ID NO: 1365924 - RNA, 19 nt, Homo sapiens
guuccucucguuuguauaa

SEQ ID NO: 1365925 - RNA, 19 nt, Homo sapiens
aauagaauccugucagaug

SEQ ID NO: 1365926 - RNA, 19 nt, Homo sapiens
ggaaguuggcccauaucuu

SEQ ID NO: 1365927 - RNA, 19 nt, Homo sapiens
acacuuucauuaaggcaaa

SEQ ID NO: 1365928 - RNA, 19 nt, Homo sapiens
auacaggaaugaaaucaca

SEQ ID NO: 1365929 - RNA, 19 nt, Homo sapiens
guaagagggcucacuccaa

SEQ ID NO: 1365930 - RNA, 19 nt, Homo sapiens
ccuacguuccuuaauaaua

SEQ ID NO: 1365931 - RNA, 19 nt, Homo sapiens
uguaaacguuccauuucuu

SEQ ID NO: 1365932 - RNA, 19 nt, Homo sapiens
cucaugauuuguacuauug

SEQ ID NO: 1365933 - RNA, 19 nt, Homo sapiens
aguaaucuuucuucacuug

SEQ ID NO: 1365934 - RNA, 19 nt, Homo sapiens
acucaaauugggaauguua

SEQ ID NO: 1365935 - RNA, 19 nt, Homo sapiens
gaauacaggaaugaaauca

SEQ ID NO: 1365936 - RNA, 19 nt, Homo sapiens
ugaauggcaaacucuauuu

SEQ ID NO: 1365937 - RNA, 19 nt, Homo sapiens
aaauaaugcccuggguuua

SEQ ID NO: 1365938 - RNA, 19 nt, Homo sapiens
cuaacgugcuucuacuguu

SEQ ID NO: 1365939 - RNA, 19 nt, Homo sapiens
caucaggucauugcaguuu

SEQ ID NO: 1365940 - RNA, 19 nt, Homo sapiens
gaaauucucuugccacuua

SEQ ID NO: 1365941 - RNA, 19 nt, Homo sapiens
cuaggaaacuguagaaaua

SEQ ID NO: 1365942 - RNA, 19 nt, Homo sapiens
guacauacuucaguuguua

SEQ ID NO: 1365943 - RNA, 19 nt, Homo sapiens
gaacagaagucaaauacca

SEQ ID NO: 1365944 - RNA, 19 nt, Homo sapiens
gauaaugacugaccaaaca

SEQ ID NO: 1365945 - RNA, 19 nt, Homo sapiens
guauacaacuucuucgaua

SEQ ID NO: 1365946 - RNA, 19 nt, Homo sapiens
gaaagacgaucagauacaa

SEQ ID NO: 1365947 - RNA, 19 nt, Homo sapiens
ccaaacagauaaugacuga

SEQ ID NO: 1365948 - RNA, 19 nt, Homo sapiens
gaaggucucccauguguaa

SEQ ID NO: 1365949 - RNA, 19 nt, Homo sapiens
caaacaagcuagagaguca

SEQ ID NO: 1365950 - RNA, 19 nt, Homo sapiens
cgaaagaaaugcuagaauc

SEQ ID NO: 1365951 - RNA, 19 nt, Homo sapiens
ugaagaacaucaucaauag

SEQ ID NO: 1365952 - RNA, 19 nt, Homo sapiens
gauuugagcuaucugaaga

SEQ ID NO: 1365953 - RNA, 19 nt, Homo sapiens
uuaaugagcugugagauga

SEQ ID NO: 1365954 - RNA, 19 nt, Homo sapiens
gaaagaaaugcuagaauca

SEQ ID NO: 1365955 - RNA, 19 nt, Homo sapiens
gaucagauacaaagaaaga

SEQ ID NO: 1365956 - RNA, 19 nt, Homo sapiens
guuaaucguuuacauguug

SEQ ID NO: 1365957 - RNA, 19 nt, Homo sapiens
ggcuaauucugacauaaua

SEQ ID NO: 1365958 - RNA, 19 nt, Homo sapiens
acagugaccuuagaaauga

SEQ ID NO: 1365959 - RNA, 19 nt, Homo sapiens
cauaauaucccucaacuuc

SEQ ID NO: 1365960 - RNA, 19 nt, Homo sapiens
guagagccuuccauucaaa

SEQ ID NO: 1365961 - RNA, 19 nt, Homo sapiens
ucaaauaccagccauauca

SEQ ID NO: 1365962 - RNA, 19 nt, Homo sapiens
ggucgagaacuacuaauuu

SEQ ID NO: 1365963 - RNA, 19 nt, Homo sapiens
gcgcuauugugucuuaauu

SEQ ID NO: 1365964 - RNA, 19 nt, Homo sapiens
cagaaggucucccaugugu

SEQ ID NO: 1365965 - RNA, 19 nt, Homo sapiens
gaaguucucagcagcacua

SEQ ID NO: 1365966 - RNA, 19 nt, Homo sapiens
gacaugaacagaagucaaa

SEQ ID NO: 1365967 - RNA, 19 nt, Homo sapiens
gagaacuacuaauuucaug

SEQ ID NO: 1365968 - RNA, 19 nt, Homo sapiens
aaggaaagacgaucagaua

SEQ ID NO: 1365969 - RNA, 19 nt, Homo sapiens
ugagcuaucugaagacaug

SEQ ID NO: 1365970 - RNA, 19 nt, Homo sapiens
ggaaagacgaucagauaca

SEQ ID NO: 1365971 - RNA, 19 nt, Homo sapiens
gaaaggaggcagcgaagca

SEQ ID NO: 1365972 - RNA, 19 nt, Homo sapiens
guaaaugcuguaagacuuu

SEQ ID NO: 1365973 - RNA, 19 nt, Homo sapiens
caagugguuugccucauug

SEQ ID NO: 1365974 - RNA, 19 nt, Homo sapiens
cugaagaacaucaucaaua

SEQ ID NO: 1365975 - RNA, 19 nt, Homo sapiens
ggguaacaaugcuacguuu

SEQ ID NO: 1365976 - RNA, 19 nt, Homo sapiens
ccacuuugccuacauguga

SEQ ID NO: 1365977 - RNA, 19 nt, Homo sapiens
guugugaggucuccuugaa

SEQ ID NO: 1365978 - RNA, 19 nt, Homo sapiens
acaagugguuugccucauu

SEQ ID NO: 1365979 - RNA, 19 nt, Homo sapiens
agacuugagugacagauau

SEQ ID NO: 1365980 - RNA, 19 nt, Homo sapiens
gacaguaacagugaccuua

SEQ ID NO: 1365981 - RNA, 19 nt, Homo sapiens
gagugaggcuugugcagau

SEQ ID NO: 1365982 - RNA, 19 nt, Homo sapiens
aaugggaucugcuaccaaa

SEQ ID NO: 1365983 - RNA, 19 nt, Homo sapiens
gugguuauauagcaucaaa

SEQ ID NO: 1365984 - RNA, 19 nt, Homo sapiens
uguaaaugcuguaagacuu

SEQ ID NO: 1365985 - RNA, 19 nt, Homo sapiens
ucuaggagguuggguguuu

SEQ ID NO: 1365986 - RNA, 19 nt, Homo sapiens
guggugagccugacguuaa

SEQ ID NO: 1365987 - RNA, 19 nt, Homo sapiens
cacagaaggucucccaugu

SEQ ID NO: 1365988 - RNA, 19 nt, Homo sapiens
gucgagaacuacuaauuuc

SEQ ID NO: 1365989 - RNA, 19 nt, Homo sapiens
uaacagugaccuuagaaau

SEQ ID NO: 1365990 - RNA, 19 nt, Homo sapiens
gacauaauaucccucaacu

SEQ ID NO: 1365991 - RNA, 19 nt, Homo sapiens
ccacagcucuucggacauc

SEQ ID NO: 1365992 - RNA, 19 nt, Homo sapiens
cagcagagagggaaaccua

SEQ ID NO: 1365993 - RNA, 19 nt, Homo sapiens
guaagacagugcguggaaa

SEQ ID NO: 1365994 - RNA, 19 nt, Homo sapiens
ggagaaaaguguaugaaag

SEQ ID NO: 1365995 - RNA, 19 nt, Homo sapiens
gaucagcucagacugugaa

SEQ ID NO: 1365996 - RNA, 19 nt, Homo sapiens
caguagagccuuccauuca

SEQ ID NO: 1365997 - RNA, 19 nt, Homo sapiens
ugacugaccaaacauagaa

SEQ ID NO: 1365998 - RNA, 19 nt, Homo sapiens
aaacguuggugguucuaug

SEQ ID NO: 1365999 - RNA, 19 nt, Homo sapiens
gugagcuucuccacucuuu

SEQ ID NO: 1366000 - RNA, 19 nt, Homo sapiens
gcgugggucucugugcuua

SEQ ID NO: 1366001 - RNA, 19 nt, Homo sapiens
gaaaugcuagaaucaucaa

SEQ ID NO: 1366002 - RNA, 19 nt, Homo sapiens
uggagagguucuucaacua

SEQ ID NO: 1366003 - RNA, 19 nt, Homo sapiens
guagaaauacaaugcuaug

SEQ ID NO: 1366004 - RNA, 19 nt, Homo sapiens
ucuguugucuugcauaugu

SEQ ID NO: 1366005 - RNA, 19 nt, Homo sapiens
aauuagggcuuugcucgua

SEQ ID NO: 1366006 - RNA, 19 nt, Homo sapiens
caaguaugaucagcucaga

SEQ ID NO: 1366007 - RNA, 19 nt, Homo sapiens
uaaaugcuguaagacuuug

SEQ ID NO: 1366008 - RNA, 19 nt, Homo sapiens
gaucuuuguuacagcucua

SEQ ID NO: 1366009 - RNA, 19 nt, Homo sapiens
uuaugugguucuuguguuu

SEQ ID NO: 1366010 - RNA, 19 nt, Homo sapiens
guggagagguucuucaacu

SEQ ID NO: 1366011 - RNA, 19 nt, Homo sapiens
gaaccagcuuguggaguca

SEQ ID NO: 1366012 - RNA, 19 nt, Homo sapiens
gcgugauucuguugucuug

SEQ ID NO: 1366013 - RNA, 19 nt, Homo sapiens
ggaagggagugaggcuugu

SEQ ID NO: 1366014 - RNA, 19 nt, Homo sapiens
gacagaaugaccacccuaa

SEQ ID NO: 1366015 - RNA, 19 nt, Homo sapiens
aagaaaugcuagaaucauc

SEQ ID NO: 1366016 - RNA, 19 nt, Homo sapiens
guaagacuuuguacauacu

SEQ ID NO: 1366017 - RNA, 19 nt, Homo sapiens
gcccuuggcgcuucaugua

SEQ ID NO: 1366018 - RNA, 19 nt, Homo sapiens
uucaugagcuaauaggaaa

SEQ ID NO: 1366019 - RNA, 19 nt, Homo sapiens
caugaacagaagucaaaua

SEQ ID NO: 1366020 - RNA, 19 nt, Homo sapiens
ugauugggauaauucagaa

SEQ ID NO: 1366021 - RNA, 19 nt, Homo sapiens
acgaucagauacaaagaaa

SEQ ID NO: 1366022 - RNA, 19 nt, Homo sapiens
uaaaugggaucugcuacca

SEQ ID NO: 1366023 - RNA, 19 nt, Homo sapiens
cggagucccugaaggucua

SEQ ID NO: 1366024 - RNA, 19 nt, Homo sapiens
gauucaguguguaaacguu

SEQ ID NO: 1366025 - RNA, 19 nt, Homo sapiens
gagcuucuccacucuuugu

SEQ ID NO: 1366026 - RNA, 19 nt, Homo sapiens
ucucugugcuuacgcaguu

SEQ ID NO: 1366027 - RNA, 19 nt, Homo sapiens
cuagaaucaucaagugguu

SEQ ID NO: 1366028 - RNA, 19 nt, Homo sapiens
caguaacagugaccuuaga

SEQ ID NO: 1366029 - RNA, 19 nt, Homo sapiens
cugaagacaugaacagaag

SEQ ID NO: 1366030 - RNA, 19 nt, Homo sapiens
caaauacugaaugccuuua

SEQ ID NO: 1366031 - RNA, 19 nt, Homo sapiens
cagcgaagcagauuaaagg

SEQ ID NO: 1366032 - RNA, 19 nt, Homo sapiens
gaaaaugguauacaacuuc

SEQ ID NO: 1366033 - RNA, 19 nt, Homo sapiens
gcacuaccuuagacuucau

SEQ ID NO: 1366034 - RNA, 19 nt, Homo sapiens
gaagacaugaacagaaguc

SEQ ID NO: 1366035 - RNA, 19 nt, Homo sapiens
uaaugacugaccaaacaua

SEQ ID NO: 1366036 - RNA, 19 nt, Homo sapiens
gcgaagcagauuaaaggaa

SEQ ID NO: 1366037 - RNA, 19 nt, Homo sapiens
gagagguucuucaacuacu

SEQ ID NO: 1366038 - RNA, 19 nt, Homo sapiens
ugguguaaaugcuguaaga

SEQ ID NO: 1366039 - RNA, 19 nt, Homo sapiens
ccuuagacuucaugagcua

SEQ ID NO: 1366040 - RNA, 19 nt, Homo sapiens
acaccaagcuguacuaugu

SEQ ID NO: 1366041 - RNA, 19 nt, Homo sapiens
ucaacaggaugaccaauga

SEQ ID NO: 1366042 - RNA, 19 nt, Homo sapiens
gacaggaguuucugccaaa

SEQ ID NO: 1366043 - RNA, 19 nt, Homo sapiens
caucaguucuguucuuuca

SEQ ID NO: 1366044 - RNA, 19 nt, Homo sapiens
gaaccaccgugacaucuac

SEQ ID NO: 1366045 - RNA, 19 nt, Homo sapiens
ccaacgggaugcucaugaa

SEQ ID NO: 1366046 - RNA, 19 nt, Homo sapiens
gcggacagcgagcgauaua

SEQ ID NO: 1366047 - RNA, 19 nt, Homo sapiens
ccaaccagguccucaucaa

SEQ ID NO: 1366048 - RNA, 19 nt, Homo sapiens
gccaucaguucuguucuuu

SEQ ID NO: 1366049 - RNA, 19 nt, Homo sapiens
acacuagacuucgaauaug

SEQ ID NO: 1366050 - RNA, 19 nt, Homo sapiens
ccaaugaggcgcugcacaa

SEQ ID NO: 1366051 - RNA, 19 nt, Homo sapiens
guuuguggcugacaucuuc

SEQ ID NO: 1366052 - RNA, 19 nt, Homo sapiens
gaugaugagugacgagaac

SEQ ID NO: 1366053 - RNA, 19 nt, Homo sapiens
ggugggaguucaacguuca

SEQ ID NO: 1366054 - RNA, 19 nt, Homo sapiens
ggccaucaguucuguucuu

SEQ ID NO: 1366055 - RNA, 19 nt, Homo sapiens
gaugacgacuucuccuucu

SEQ ID NO: 1366056 - RNA, 19 nt, Homo sapiens
ccgcuacgguccucuccua

SEQ ID NO: 1366057 - RNA, 19 nt, Homo sapiens
ggccagcuccgaccaaaga

SEQ ID NO: 1366058 - RNA, 19 nt, Homo sapiens
cacacuagacuucgaauau

SEQ ID NO: 1366059 - RNA, 19 nt, Homo sapiens
cgacuucuccuucuacauc

SEQ ID NO: 1366060 - RNA, 19 nt, Homo sapiens
cugagggucuggacgcuuu

SEQ ID NO: 1366061 - RNA, 19 nt, Homo sapiens
cacuagacuucgaauaugu

SEQ ID NO: 1366062 - RNA, 19 nt, Homo sapiens
acaugaugaugaugaguga

SEQ ID NO: 1366063 - RNA, 19 nt, Homo sapiens
ggacacugacuccaacuac

SEQ ID NO: 1366064 - RNA, 19 nt, Homo sapiens
ggcuacagcuguggacguu

SEQ ID NO: 1366065 - RNA, 19 nt, Homo sapiens
gcagcucacacuagacuuc

SEQ ID NO: 1366066 - RNA, 19 nt, Homo sapiens
cuagacuucgaauauguua

SEQ ID NO: 1366067 - RNA, 19 nt, Homo sapiens
ucacacuagacuucgaaua

SEQ ID NO: 1366068 - RNA, 19 nt, Homo sapiens
ucugccaaauccuguauga

SEQ ID NO: 1366069 - RNA, 19 nt, Homo sapiens
gcaggugacaggaguuucu

SEQ ID NO: 1366070 - RNA, 19 nt, Homo sapiens
ccuccaaggucaucgucuu

SEQ ID NO: 1366071 - RNA, 19 nt, Homo sapiens
ggacagcgagcgauauacg

SEQ ID NO: 1366072 - RNA, 19 nt, Homo sapiens
caaugaggcgcugcacaaa

SEQ ID NO: 1366073 - RNA, 19 nt, Homo sapiens
ugccaaagccaaggaguuu

SEQ ID NO: 1366074 - RNA, 19 nt, Homo sapiens
gacgagaaccaccgugaca

SEQ ID NO: 1366075 - RNA, 19 nt, Homo sapiens
ccucgugcauuugcccuuu

SEQ ID NO: 1366076 - RNA, 19 nt, Homo sapiens
cgaauauguuaucaaugag

SEQ ID NO: 1366077 - RNA, 19 nt, Homo sapiens
gacgacuucuccuucuaca

SEQ ID NO: 1366078 - RNA, 19 nt, Homo sapiens
caagagcugcguggacaug

SEQ ID NO: 1366079 - RNA, 19 nt, Homo sapiens
gggaugacgacuucuccuu

SEQ ID NO: 1366080 - RNA, 19 nt, Homo sapiens
agacuucgaauauguuauc

SEQ ID NO: 1366081 - RNA, 19 nt, Homo sapiens
gcucacacuagacuucgaa

SEQ ID NO: 1366082 - RNA, 19 nt, Homo sapiens
ugaacaugaugaugaugag

SEQ ID NO: 1366083 - RNA, 19 nt, Homo sapiens
gaccuguaccugaccguau

SEQ ID NO: 1366084 - RNA, 19 nt, Homo sapiens
gcuucaugcugcacaccaa

SEQ ID NO: 1366085 - RNA, 19 nt, Homo sapiens
cgagaaccaccgugacauc

SEQ ID NO: 1366086 - RNA, 19 nt, Homo sapiens
gccaacgggaugcucauga

SEQ ID NO: 1366087 - RNA, 19 nt, Homo sapiens
gaucuucgagacagucagu

SEQ ID NO: 1366088 - RNA, 19 nt, Homo sapiens
ggagccggaggaugaguug

SEQ ID NO: 1366089 - RNA, 19 nt, Homo sapiens
gaacaugaugaugaugagu

SEQ ID NO: 1366090 - RNA, 19 nt, Homo sapiens
gaccggcacuaguguuagc

SEQ ID NO: 1366091 - RNA, 19 nt, Homo sapiens
cgacugaugaccggcacua

SEQ ID NO: 1366092 - RNA, 19 nt, Homo sapiens
gagaaccaccgugacaucu

SEQ ID NO: 1366093 - RNA, 19 nt, Homo sapiens
cguucuucuucauguaaua

SEQ ID NO: 1366094 - RNA, 19 nt, Homo sapiens
gaugaccggcacuaguguu

SEQ ID NO: 1366095 - RNA, 19 nt, Homo sapiens
ggugcucccugaagguucu

SEQ ID NO: 1366096 - RNA, 19 nt, Homo sapiens
cccauuccguucuucuuca

SEQ ID NO: 1366097 - RNA, 19 nt, Homo sapiens
cgaccaaagaccuaucaca

SEQ ID NO: 1366098 - RNA, 19 nt, Homo sapiens
guucuuucagcgacuauga

SEQ ID NO: 1366099 - RNA, 19 nt, Homo sapiens
agaaccaccgugacaucua

SEQ ID NO: 1366100 - RNA, 19 nt, Homo sapiens
gaagacaacuccagacaua

SEQ ID NO: 1366101 - RNA, 19 nt, Homo sapiens
gaagguaccucucuugaaa

SEQ ID NO: 1366102 - RNA, 19 nt, Homo sapiens
gagagaagauucagaaguu

SEQ ID NO: 1366103 - RNA, 19 nt, Homo sapiens
gggaaacgguguagaaaga

SEQ ID NO: 1366104 - RNA, 19 nt, Homo sapiens
gaaccuggcuggaggacuu

SEQ ID NO: 1366105 - RNA, 19 nt, Homo sapiens
guagaagacucuccuuuca

SEQ ID NO: 1366106 - RNA, 19 nt, Homo sapiens
gcucaggccucacccauug

SEQ ID NO: 1366107 - RNA, 19 nt, Homo sapiens
caggagaacuggaucagaa

SEQ ID NO: 1366108 - RNA, 19 nt, Homo sapiens
ggccugagguuaacuguga

SEQ ID NO: 1366109 - RNA, 19 nt, Homo sapiens
gaaccagcccagaaacuaa

SEQ ID NO: 1366110 - RNA, 19 nt, Homo sapiens
guaccucucuugaaacgaa

SEQ ID NO: 1366111 - RNA, 19 nt, Homo sapiens
ccuauugucuuguaaauca

SEQ ID NO: 1366112 - RNA, 19 nt, Homo sapiens
guucaagccuguuguguuc

SEQ ID NO: 1366113 - RNA, 19 nt, Homo sapiens
ggugagggcugacucugaa

SEQ ID NO: 1366114 - RNA, 19 nt, Homo sapiens
gaaacgaagacaccaagaa

SEQ ID NO: 1366115 - RNA, 19 nt, Homo sapiens
gggccacucugccucauuu

SEQ ID NO: 1366116 - RNA, 19 nt, Homo sapiens
gaacuuauacacggaagaa

SEQ ID NO: 1366117 - RNA, 19 nt, Homo sapiens
cccagaaacuaaaggauaa

SEQ ID NO: 1366118 - RNA, 19 nt, Homo sapiens
gaagaguccauuuaggaaa

SEQ ID NO: 1366119 - RNA, 19 nt, Homo sapiens
ccagggaauucaacuguga

SEQ ID NO: 1366120 - RNA, 19 nt, Homo sapiens
aaucaucucuagugacuga

SEQ ID NO: 1366121 - RNA, 19 nt, Homo sapiens
ccauauacgugaaacugaa

SEQ ID NO: 1366122 - RNA, 19 nt, Homo sapiens
uguaaacugugaagccaua

SEQ ID NO: 1366123 - RNA, 19 nt, Homo sapiens
gcccagaaacuaaaggaua

SEQ ID NO: 1366124 - RNA, 19 nt, Homo sapiens
ggacuuauagccacaaaca

SEQ ID NO: 1366125 - RNA, 19 nt, Homo sapiens
ggaauucaacugugacuuc

SEQ ID NO: 1366126 - RNA, 19 nt, Homo sapiens
ggaaccagcccagaaacua

SEQ ID NO: 1366127 - RNA, 19 nt, Homo sapiens
uaugugaugucuccaagaa

SEQ ID NO: 1366128 - RNA, 19 nt, Homo sapiens
agagaagauucagaaguua

SEQ ID NO: 1366129 - RNA, 19 nt, Homo sapiens
aaaguaacgucuuaucagu

SEQ ID NO: 1366130 - RNA, 19 nt, Homo sapiens
aaacauuacugagcccaaa

SEQ ID NO: 1366131 - RNA, 19 nt, Homo sapiens
gcaugucacucuccucagu

SEQ ID NO: 1366132 - RNA, 19 nt, Homo sapiens
caagaagaguccauuuagg

SEQ ID NO: 1366133 - RNA, 19 nt, Homo sapiens
guaaaucaaacucuaagug

SEQ ID NO: 1366134 - RNA, 19 nt, Homo sapiens
ucaccuggcucaucguuuc

SEQ ID NO: 1366135 - RNA, 19 nt, Homo sapiens
gagaugaggauguggaugu

SEQ ID NO: 1366136 - RNA, 19 nt, Homo sapiens
acgaagagguguuuguuuc

SEQ ID NO: 1366137 - RNA, 19 nt, Homo sapiens
gaaguuaguaagaguaaag

SEQ ID NO: 1366138 - RNA, 19 nt, Homo sapiens
caacuccagacauaauuaa

SEQ ID NO: 1366139 - RNA, 19 nt, Homo sapiens
cauggucaguguucagauu

SEQ ID NO: 1366140 - RNA, 19 nt, Homo sapiens
agaagacucuccuuucagu

SEQ ID NO: 1366141 - RNA, 19 nt, Homo sapiens
guucuucccuccacuguag

SEQ ID NO: 1366142 - RNA, 19 nt, Homo sapiens
cagcagguccuuaagcaaa

SEQ ID NO: 1366143 - RNA, 19 nt, Homo sapiens
ccaagaagaguccauuuag

SEQ ID NO: 1366144 - RNA, 19 nt, Homo sapiens
gagagcagcagccuucaug

SEQ ID NO: 1366145 - RNA, 19 nt, Homo sapiens
ccacaggacgcccaucuug

SEQ ID NO: 1366146 - RNA, 19 nt, Homo sapiens
uggcauuggugacuugaaa

SEQ ID NO: 1366147 - RNA, 19 nt, Homo sapiens
ugugaugucuccaagaaga

SEQ ID NO: 1366148 - RNA, 19 nt, Homo sapiens
gaauucaacugugacuucu

SEQ ID NO: 1366149 - RNA, 19 nt, Homo sapiens
gagccucucuccucagucu

SEQ ID NO: 1366150 - RNA, 19 nt, Homo sapiens
guaaaaucaucucuaguga

SEQ ID NO: 1366151 - RNA, 19 nt, Homo sapiens
cuuauagccacaaacauua

SEQ ID NO: 1366152 - RNA, 19 nt, Homo sapiens
gaaacugaagagugcauug

SEQ ID NO: 1366153 - RNA, 19 nt, Homo sapiens
gcaaagaccccagagauga

SEQ ID NO: 1366154 - RNA, 19 nt, Homo sapiens
gaagauucagaaguuagua

SEQ ID NO: 1366155 - RNA, 19 nt, Homo sapiens
guuuaccucuccuuuaugu

SEQ ID NO: 1366156 - RNA, 19 nt, Homo sapiens
gaaacuaaaggauaaagcu

SEQ ID NO: 1366157 - RNA, 19 nt, Homo sapiens
guacuuggccacauucagu

SEQ ID NO: 1366158 - RNA, 19 nt, Homo sapiens
gcagcgcuuuguaaacugu

SEQ ID NO: 1366159 - RNA, 19 nt, Homo sapiens
cuccagacauaauuaaaga

SEQ ID NO: 1366160 - RNA, 19 nt, Homo sapiens
uuagaaugccuuaggguuu

SEQ ID NO: 1366161 - RNA, 19 nt, Homo sapiens
gacgaagagguguuuguuu

SEQ ID NO: 1366162 - RNA, 19 nt, Homo sapiens
gaaaaguaacgucuuauca

SEQ ID NO: 1366163 - RNA, 19 nt, Homo sapiens
ccacagacucuagagauga

SEQ ID NO: 1366164 - RNA, 19 nt, Homo sapiens
uccaagaagaguccauuua

SEQ ID NO: 1366165 - RNA, 19 nt, Homo sapiens
gaggacuuauagccacaaa

SEQ ID NO: 1366166 - RNA, 19 nt, Homo sapiens
cccaucagcagaacuuaua

SEQ ID NO: 1366167 - RNA, 19 nt, Homo sapiens
ucacagagagcuacauugg

SEQ ID NO: 1366168 - RNA, 19 nt, Homo sapiens
aagaagaguccauuuagga

SEQ ID NO: 1366169 - RNA, 19 nt, Homo sapiens
cagaaguuaguaagaguaa

SEQ ID NO: 1366170 - RNA, 19 nt, Homo sapiens
gacaacuccagacauaauu

SEQ ID NO: 1366171 - RNA, 19 nt, Homo sapiens
gccagcagguccuuaagca

SEQ ID NO: 1366172 - RNA, 19 nt, Homo sapiens
gagaacuggaucagaaaga

SEQ ID NO: 1366173 - RNA, 19 nt, Homo sapiens
cuguuuaccucuccuuuau

SEQ ID NO: 1366174 - RNA, 19 nt, Homo sapiens
gugaagccauauacgugaa

SEQ ID NO: 1366175 - RNA, 19 nt, Homo sapiens
guucagauugccauuagaa

SEQ ID NO: 1366176 - RNA, 19 nt, Homo sapiens
gagaagauucagaaguuag

SEQ ID NO: 1366177 - RNA, 19 nt, Homo sapiens
gaccagggaauucaacugu

SEQ ID NO: 1366178 - RNA, 19 nt, Homo sapiens
aaagaggggucuccaaguu

SEQ ID NO: 1366179 - RNA, 19 nt, Homo sapiens
ccaggaacagcaugccuaa

SEQ ID NO: 1366180 - RNA, 19 nt, Homo sapiens
cagcuuggcauuccacaga

SEQ ID NO: 1366181 - RNA, 19 nt, Homo sapiens
cgacacaggcagcgcuuug

SEQ ID NO: 1366182 - RNA, 19 nt, Homo sapiens
gggcacgccucagaaucaa

SEQ ID NO: 1366183 - RNA, 19 nt, Homo sapiens
acaacuccagacauaauua

SEQ ID NO: 1366184 - RNA, 19 nt, Homo sapiens
ggaagacaacuccagacau

SEQ ID NO: 1366185 - RNA, 19 nt, Homo sapiens
acaccaagaacuccuaaga

SEQ ID NO: 1366186 - RNA, 19 nt, Homo sapiens
uaaacugugaagccauaua

SEQ ID NO: 1366187 - RNA, 19 nt, Homo sapiens
ccacucugccucauuuaug

SEQ ID NO: 1366188 - RNA, 19 nt, Homo sapiens
agagguggauggcaaugug

SEQ ID NO: 1366189 - RNA, 19 nt, Homo sapiens
gaauuccaguccagaaagc

SEQ ID NO: 1366190 - RNA, 19 nt, Homo sapiens
ggacauaaagaaguuggau

SEQ ID NO: 1366191 - RNA, 19 nt, Homo sapiens
aaggaucugugaccugaga

SEQ ID NO: 1366192 - RNA, 19 nt, Homo sapiens
agacaacuccagacauaau

SEQ ID NO: 1366193 - RNA, 19 nt, Homo sapiens
cuucccaaacuucgaauua

SEQ ID NO: 1366194 - RNA, 19 nt, Homo sapiens
caagugacacagagcaugu

SEQ ID NO: 1366195 - RNA, 19 nt, Homo sapiens
gaagggaccgagccucucu

SEQ ID NO: 1366196 - RNA, 19 nt, Homo sapiens
ggagcaucguggaguguca

SEQ ID NO: 1366197 - RNA, 19 nt, Homo sapiens
uuaccucuccuuuauguga

SEQ ID NO: 1366198 - RNA, 19 nt, Homo sapiens
ccauggcauuggugacuug

SEQ ID NO: 1366199 - RNA, 19 nt, Homo sapiens
cagaggaaccagcccagaa

SEQ ID NO: 1366200 - RNA, 19 nt, Homo sapiens
uaacaaagcuacaggauaa

SEQ ID NO: 1366201 - RNA, 19 nt, Homo sapiens
gaagauggcucaaagaaug

SEQ ID NO: 1366202 - RNA, 19 nt, Homo sapiens
ggaacuaagcugauauuua

SEQ ID NO: 1366203 - RNA, 19 nt, Homo sapiens
ggauauaaaugccauguug

SEQ ID NO: 1366204 - RNA, 19 nt, Homo sapiens
ggaagaagauggcucaaag

SEQ ID NO: 1366205 - RNA, 19 nt, Homo sapiens
gaagagaggcgagaaauug

SEQ ID NO: 1366206 - RNA, 19 nt, Homo sapiens
gcgagaaauugcugaagua

SEQ ID NO: 1366207 - RNA, 19 nt, Homo sapiens
caacagcugaaacaaauua

SEQ ID NO: 1366208 - RNA, 19 nt, Homo sapiens
cgaaaucucaucugggaua

SEQ ID NO: 1366209 - RNA, 19 nt, Homo sapiens
gauaaucuucgccaacuuu

SEQ ID NO: 1366210 - RNA, 19 nt, Homo sapiens
aaucucaucugggauauaa

SEQ ID NO: 1366211 - RNA, 19 nt, Homo sapiens
ucgagcaacuuauuccaua

SEQ ID NO: 1366212 - RNA, 19 nt, Homo sapiens
gaagaagauggcucaaaga

SEQ ID NO: 1366213 - RNA, 19 nt, Homo sapiens
gaaaucucaucugggauau

SEQ ID NO: 1366214 - RNA, 19 nt, Homo sapiens
gagauugguauaugacaaa

SEQ ID NO: 1366215 - RNA, 19 nt, Homo sapiens
uuaccacacuggaacauau

SEQ ID NO: 1366216 - RNA, 19 nt, Homo sapiens
gagaaauugcugaaguaaa

SEQ ID NO: 1366217 - RNA, 19 nt, Homo sapiens
gaucaauuacgaaaucuca

SEQ ID NO: 1366218 - RNA, 19 nt, Homo sapiens
caagaccgguuaacaaagc

SEQ ID NO: 1366219 - RNA, 19 nt, Homo sapiens
uaucaagaccgguuaacaa

SEQ ID NO: 1366220 - RNA, 19 nt, Homo sapiens
gguuaaucuucaugaauug

SEQ ID NO: 1366221 - RNA, 19 nt, Homo sapiens
gaggaacuaagcugauauu

SEQ ID NO: 1366222 - RNA, 19 nt, Homo sapiens
ggcgagaaauugcugaagu

SEQ ID NO: 1366223 - RNA, 19 nt, Homo sapiens
aagcugagauugguauaug

SEQ ID NO: 1366224 - RNA, 19 nt, Homo sapiens
gaacaugcagcugccaaau

SEQ ID NO: 1366225 - RNA, 19 nt, Homo sapiens
ggauaaucuucgccaacuu

SEQ ID NO: 1366226 - RNA, 19 nt, Homo sapiens
caaaugcaaugaaaacugu

SEQ ID NO: 1366227 - RNA, 19 nt, Homo sapiens
ugccaaauggugucacuua

SEQ ID NO: 1366228 - RNA, 19 nt, Homo sapiens
ucaaacagaagaaucaaca

SEQ ID NO: 1366229 - RNA, 19 nt, Homo sapiens
ggaacaugcagcugccaaa

SEQ ID NO: 1366230 - RNA, 19 nt, Homo sapiens
gcaacuuauuccauaugug

SEQ ID NO: 1366231 - RNA, 19 nt, Homo sapiens
ugagauugguauaugacaa

SEQ ID NO: 1366232 - RNA, 19 nt, Homo sapiens
uuaacaaagcuacaggaua

SEQ ID NO: 1366233 - RNA, 19 nt, Homo sapiens
acaugcagcugccaaaugg

SEQ ID NO: 1366234 - RNA, 19 nt, Homo sapiens
aaucaacagcugaaacaaa

SEQ ID NO: 1366235 - RNA, 19 nt, Homo sapiens
gaagaaucaacagcugaaa

SEQ ID NO: 1366236 - RNA, 19 nt, Homo sapiens
cgagcaacuuauuccauau

SEQ ID NO: 1366237 - RNA, 19 nt, Homo sapiens
aucaacagcugaaacaaau

SEQ ID NO: 1366238 - RNA, 19 nt, Homo sapiens
ugaagagaggcgagaaauu

SEQ ID NO: 1366239 - RNA, 19 nt, Homo sapiens
aagaagauggcucaaagaa

SEQ ID NO: 1366240 - RNA, 19 nt, Homo sapiens
gagcaacuuauuccauaug

SEQ ID NO: 1366241 - RNA, 19 nt, Homo sapiens
cgagaaauugcugaaguaa

SEQ ID NO: 1366242 - RNA, 19 nt, Homo sapiens
augaggaacuaagcugaua

SEQ ID NO: 1366243 - RNA, 19 nt, Homo sapiens
gaagcugagauugguauau

SEQ ID NO: 1366244 - RNA, 19 nt, Homo sapiens
ggaagcugagauugguaua

SEQ ID NO: 1366245 - RNA, 19 nt, Homo sapiens
uuucaguucucuucaggaa

SEQ ID NO: 1366246 - RNA, 19 nt, Homo sapiens
guauaugacaaaugcaaug

SEQ ID NO: 1366247 - RNA, 19 nt, Homo sapiens
gccaaauggugucacuuac

SEQ ID NO: 1366248 - RNA, 19 nt, Homo sapiens
ccugugaagaagauuauuu

SEQ ID NO: 1366249 - RNA, 19 nt, Homo sapiens
cagcugaaacaaauuaugg

SEQ ID NO: 1366250 - RNA, 19 nt, Homo sapiens
agaaucaacagcugaaaca

SEQ ID NO: 1366251 - RNA, 19 nt, Homo sapiens
gaaucaacagcugaaacaa

SEQ ID NO: 1366252 - RNA, 19 nt, Homo sapiens
agaagaaucaacagcugaa

SEQ ID NO: 1366253 - RNA, 19 nt, Homo sapiens
caaagcuacaggauaaucu

SEQ ID NO: 1366254 - RNA, 19 nt, Homo sapiens
gcugaaacaaauuauggau

SEQ ID NO: 1366255 - RNA, 19 nt, Homo sapiens
aaacucaaacagaagaauc

SEQ ID NO: 1366256 - RNA, 19 nt, Homo sapiens
gugaagagaggcgagaaau

SEQ ID NO: 1366257 - RNA, 19 nt, Homo sapiens
aaacuguggugggauggau

SEQ ID NO: 1366258 - RNA, 19 nt, Homo sapiens
cugcuuuacacauguuaua

SEQ ID NO: 1366259 - RNA, 19 nt, Homo sapiens
ucucaucugggauauaaau

SEQ ID NO: 1366260 - RNA, 19 nt, Homo sapiens
ucaauuacgaaaucucauc

SEQ ID NO: 1366261 - RNA, 19 nt, Homo sapiens
agaagauggcucaaagaau

SEQ ID NO: 1366262 - RNA, 19 nt, Homo sapiens
cacauguuauaccauuguu

SEQ ID NO: 1366263 - RNA, 19 nt, Homo sapiens
auggaucaauuacgaaauc

SEQ ID NO: 1366264 - RNA, 19 nt, Homo sapiens
ggguuuguauuuugguuaa

SEQ ID NO: 1366265 - RNA, 19 nt, Homo sapiens
acacuggaacauaucaaga

SEQ ID NO: 1366266 - RNA, 19 nt, Homo sapiens
gguauaugacaaaugcaau

SEQ ID NO: 1366267 - RNA, 19 nt, Homo sapiens
gaaauccugucucuaauaa

SEQ ID NO: 1366268 - RNA, 19 nt, Homo sapiens
ggacucaguugcuuauuug

SEQ ID NO: 1366269 - RNA, 19 nt, Homo sapiens
ggugaaauccugucucuaa

SEQ ID NO: 1366270 - RNA, 19 nt, Homo sapiens
agaaacaucugcaauugaa

SEQ ID NO: 1366271 - RNA, 19 nt, Homo sapiens
caacagaugccuccuagaa

SEQ ID NO: 1366272 - RNA, 19 nt, Homo sapiens
gcaauugaaugaaacaagu

SEQ ID NO: 1366273 - RNA, 19 nt, Homo sapiens
agagaaagguggaggagaa

SEQ ID NO: 1366274 - RNA, 19 nt, Homo sapiens
caucugcaauugaaugaaa

SEQ ID NO: 1366275 - RNA, 19 nt, Homo sapiens
uaccugcucuccaguauuu

SEQ ID NO: 1366276 - RNA, 19 nt, Homo sapiens
ccacaucccuggacucagu

SEQ ID NO: 1366277 - RNA, 19 nt, Homo sapiens
gcgccuaccucuacaaaca

SEQ ID NO: 1366278 - RNA, 19 nt, Homo sapiens
gguuugaucccauauaauu

SEQ ID NO: 1366279 - RNA, 19 nt, Homo sapiens
gaaaggacacucugcucuu

SEQ ID NO: 1366280 - RNA, 19 nt, Homo sapiens
aaacaaguacugcuaauca

SEQ ID NO: 1366281 - RNA, 19 nt, Homo sapiens
ugaaauccugucucuaaua

SEQ ID NO: 1366282 - RNA, 19 nt, Homo sapiens
gcaccaggccuacguguuc

SEQ ID NO: 1366283 - RNA, 19 nt, Homo sapiens
ucucaguucuuaucgguuu

SEQ ID NO: 1366284 - RNA, 19 nt, Homo sapiens
uaauggaugugguccucua

SEQ ID NO: 1366285 - RNA, 19 nt, Homo sapiens
caaguacugcuaaucauau

SEQ ID NO: 1366286 - RNA, 19 nt, Homo sapiens
aaaggacacucugcucuug

SEQ ID NO: 1366287 - RNA, 19 nt, Homo sapiens
aaagacacaugaucuggau

SEQ ID NO: 1366288 - RNA, 19 nt, Homo sapiens
gcaggagaauugcuugaac

SEQ ID NO: 1366289 - RNA, 19 nt, Homo sapiens
uggacucaguugcuuauuu

SEQ ID NO: 1366290 - RNA, 19 nt, Homo sapiens
ucgguuugaucccauauaa

SEQ ID NO: 1366291 - RNA, 19 nt, Homo sapiens
ugaaacaaguacugcuaau

SEQ ID NO: 1366292 - RNA, 19 nt, Homo sapiens
gugaaauccugucucuaau

SEQ ID NO: 1366293 - RNA, 19 nt, Homo sapiens
gcuaaucauauacacagua

SEQ ID NO: 1366294 - RNA, 19 nt, Homo sapiens
acaaguacugcuaaucaua

SEQ ID NO: 1366295 - RNA, 19 nt, Homo sapiens
gaucccauauaauuucauc

SEQ ID NO: 1366296 - RNA, 19 nt, Homo sapiens
gcaguaagccaagaucaca

SEQ ID NO: 1366297 - RNA, 19 nt, Homo sapiens
agacacaugaucuggauuu

SEQ ID NO: 1366298 - RNA, 19 nt, Homo sapiens
gaaacaaguacugcuaauc

SEQ ID NO: 1366299 - RNA, 19 nt, Homo sapiens
uguccuacuuuccugauaa

SEQ ID NO: 1366300 - RNA, 19 nt, Homo sapiens
gcaucaaugugcagugucu

SEQ ID NO: 1366301 - RNA, 19 nt, Homo sapiens
cuaaucauauacacaguag

SEQ ID NO: 1366302 - RNA, 19 nt, Homo sapiens
gcuaccugcucuccaguau

SEQ ID NO: 1366303 - RNA, 19 nt, Homo sapiens
uggccaagauggugaaauc

SEQ ID NO: 1366304 - RNA, 19 nt, Homo sapiens
aaacaucugcaauugaaug

SEQ ID NO: 1366305 - RNA, 19 nt, Homo sapiens
uggcagagguugcaguaag

SEQ ID NO: 1366306 - RNA, 19 nt, Homo sapiens
uaggugauguggacacugu

SEQ ID NO: 1366307 - RNA, 19 nt, Homo sapiens
gcaguucuucuucucaguu

SEQ ID NO: 1366308 - RNA, 19 nt, Homo sapiens
ggagcucucugagguccuu

SEQ ID NO: 1366309 - RNA, 19 nt, Homo sapiens
ucaguugcuuauuugugua

SEQ ID NO: 1366310 - RNA, 19 nt, Homo sapiens
guccuacuuuccugauaaa

SEQ ID NO: 1366311 - RNA, 19 nt, Homo sapiens
gcaccuguaaucccagcua

SEQ ID NO: 1366312 - RNA, 19 nt, Homo sapiens
acagaugccuccuagaaaa

SEQ ID NO: 1366313 - RNA, 19 nt, Homo sapiens
gcuccagcuuccugaaugu

SEQ ID NO: 1366314 - RNA, 19 nt, Homo sapiens
ggacacugugcaucaaugu

SEQ ID NO: 1366315 - RNA, 19 nt, Homo sapiens
gagaacagaaacagcuugu

SEQ ID NO: 1366316 - RNA, 19 nt, Homo sapiens
gguggcagagguugcagua

SEQ ID NO: 1366317 - RNA, 19 nt, Homo sapiens
guacugcuaaucauauaca

SEQ ID NO: 1366318 - RNA, 19 nt, Homo sapiens
ccuguaaucccagcacuuu

SEQ ID NO: 1366319 - RNA, 19 nt, Homo sapiens
acacucugcucuugaaggu

SEQ ID NO: 1366320 - RNA, 19 nt, Homo sapiens
gcuuauuuguguaauggau

SEQ ID NO: 1366321 - RNA, 19 nt, Homo sapiens
gcugcaccuucgccuugua

SEQ ID NO: 1366322 - RNA, 19 nt, Homo sapiens
ggcuccagcuuccugaaug

SEQ ID NO: 1366323 - RNA, 19 nt, Homo sapiens
cucaguugcuuauuugugu

SEQ ID NO: 1366324 - RNA, 19 nt, Homo sapiens
gaucuggauuuucuguuug

SEQ ID NO: 1366325 - RNA, 19 nt, Homo sapiens
aaugaaacaaguacugcua

SEQ ID NO: 1366326 - RNA, 19 nt, Homo sapiens
ugucaacccuaaccucucu

SEQ ID NO: 1366327 - RNA, 19 nt, Homo sapiens
gaaagguggaggagaacag

SEQ ID NO: 1366328 - RNA, 19 nt, Homo sapiens
uugauugccuucuauaggu

SEQ ID NO: 1366329 - RNA, 19 nt, Homo sapiens
caccuucgccuuguacuug

SEQ ID NO: 1366330 - RNA, 19 nt, Homo sapiens
gcaccuucgccuuguacuu

SEQ ID NO: 1366331 - RNA, 19 nt, Homo sapiens
aggacacucugcucuugaa

SEQ ID NO: 1366332 - RNA, 19 nt, Homo sapiens
gaaacaucugcaauugaau

SEQ ID NO: 1366333 - RNA, 19 nt, Homo sapiens
ggcugaggcaggagaauug

SEQ ID NO: 1366334 - RNA, 19 nt, Homo sapiens
uggaugugguccucuaaag

SEQ ID NO: 1366335 - RNA, 19 nt, Homo sapiens
aacaguuggugguguccua

SEQ ID NO: 1366336 - RNA, 19 nt, Homo sapiens
uuuaagcuguuggccauug

SEQ ID NO: 1366337 - RNA, 19 nt, Homo sapiens
uuuagcuggugccuuguuu

SEQ ID NO: 1366338 - RNA, 19 nt, Homo sapiens
ggagaauugcuugaaccaa

SEQ ID NO: 1366339 - RNA, 19 nt, Homo sapiens
guguccuacuuuccugaua

SEQ ID NO: 1366340 - RNA, 19 nt, Homo sapiens
aacagaugccuccuagaaa

SEQ ID NO: 1366341 - RNA, 19 nt, Homo sapiens
ugaucuggauuuucuguuu

SEQ ID NO: 1366342 - RNA, 19 nt, Homo sapiens
cccauauaauuucaucugu

SEQ ID NO: 1366343 - RNA, 19 nt, Homo sapiens
uggacacugugcaucaaug

SEQ ID NO: 1366344 - RNA, 19 nt, Homo sapiens
cuucugcugugcugugugu

SEQ ID NO: 1366345 - RNA, 19 nt, Homo sapiens
aacaaguacugcuaaucau

SEQ ID NO: 1366346 - RNA, 19 nt, Homo sapiens
acacugucuuuaagcuguu

SEQ ID NO: 1366347 - RNA, 19 nt, Homo sapiens
ggcagagguugcaguaagc

SEQ ID NO: 1366348 - RNA, 19 nt, Homo sapiens
cugagguccuucgagagua

SEQ ID NO: 1366349 - RNA, 19 nt, Homo sapiens
ggcaggagaauugcuugaa

SEQ ID NO: 1366350 - RNA, 19 nt, Homo sapiens
caaggucaggaguucaaga

SEQ ID NO: 1366351 - RNA, 19 nt, Homo sapiens
cacaaggucaggaguucaa

SEQ ID NO: 1366352 - RNA, 19 nt, Homo sapiens
ccuagaaaaugcuguuugu

SEQ ID NO: 1366353 - RNA, 19 nt, Homo sapiens
cacaugaucuggauuuucu

SEQ ID NO: 1366354 - RNA, 19 nt, Homo sapiens
guuggugguguccuacuuu

SEQ ID NO: 1366355 - RNA, 19 nt, Homo sapiens
caguucuucuucucaguuc

SEQ ID NO: 1366356 - RNA, 19 nt, Homo sapiens
gaaaauaguuggugguuua

SEQ ID NO: 1366357 - RNA, 19 nt, Homo sapiens
ggaacuugcucaaaucuau

SEQ ID NO: 1366358 - RNA, 19 nt, Homo sapiens
uaauugagcuuguugauca

SEQ ID NO: 1366359 - RNA, 19 nt, Homo sapiens
ccauagagcugaaggaaga

SEQ ID NO: 1366360 - RNA, 19 nt, Homo sapiens
cacaagagguggcguguaa

SEQ ID NO: 1366361 - RNA, 19 nt, Homo sapiens
ggaaggagaagcaauaaau

SEQ ID NO: 1366362 - RNA, 19 nt, Homo sapiens
gcucggaacuugcucaaau

SEQ ID NO: 1366363 - RNA, 19 nt, Homo sapiens
gguaucggguugaauauga

SEQ ID NO: 1366364 - RNA, 19 nt, Homo sapiens
gcucaaaucuauagcaaag

SEQ ID NO: 1366365 - RNA, 19 nt, Homo sapiens
ggacaaaauuggccaguuu

SEQ ID NO: 1366366 - RNA, 19 nt, Homo sapiens
gaaggagaagcaauaaauu

SEQ ID NO: 1366367 - RNA, 19 nt, Homo sapiens
gaagacagcacuacaaguc

SEQ ID NO: 1366368 - RNA, 19 nt, Homo sapiens
gaagcugccugucuacauc

SEQ ID NO: 1366369 - RNA, 19 nt, Homo sapiens
aaagguaucggguugaaua

SEQ ID NO: 1366370 - RNA, 19 nt, Homo sapiens
aaaugcagcuagaaaggua

SEQ ID NO: 1366371 - RNA, 19 nt, Homo sapiens
gaacuugcucaaaucuaua

SEQ ID NO: 1366372 - RNA, 19 nt, Homo sapiens
aagcagggcuacacuuuga

SEQ ID NO: 1366373 - RNA, 19 nt, Homo sapiens
uaaaguagaagcagaacaa

SEQ ID NO: 1366374 - RNA, 19 nt, Homo sapiens
gaauaugaagcuuugugua

SEQ ID NO: 1366375 - RNA, 19 nt, Homo sapiens
gguugaauaugaagcuuug

SEQ ID NO: 1366376 - RNA, 19 nt, Homo sapiens
guucucaccucuuaugcuu

SEQ ID NO: 1366377 - RNA, 19 nt, Homo sapiens
aggagaagcugccugucua

SEQ ID NO: 1366378 - RNA, 19 nt, Homo sapiens
gaagcagggcuacacuuug

SEQ ID NO: 1366379 - RNA, 19 nt, Homo sapiens
ucaaaucuauagcaaagca

SEQ ID NO: 1366380 - RNA, 19 nt, Homo sapiens
uguacguucucaccucuua

SEQ ID NO: 1366381 - RNA, 19 nt, Homo sapiens
gcaacuucaagcccuaaua

SEQ ID NO: 1366382 - RNA, 19 nt, Homo sapiens
caaaagaagcagaaaauga

SEQ ID NO: 1366383 - RNA, 19 nt, Homo sapiens
gaaggaagagugcaaagac

SEQ ID NO: 1366384 - RNA, 19 nt, Homo sapiens
ugaagcagggcuacacuuu

SEQ ID NO: 1366385 - RNA, 19 nt, Homo sapiens
caacuucaagcccuaauag

SEQ ID NO: 1366386 - RNA, 19 nt, Homo sapiens
gcagagagaagcucaacag

SEQ ID NO: 1366387 - RNA, 19 nt, Homo sapiens
caucggugcucggaacuug

SEQ ID NO: 1366388 - RNA, 19 nt, Homo sapiens
gagguggcguguaaggaau

SEQ ID NO: 1366389 - RNA, 19 nt, Homo sapiens
agaaagguaucggguugaa

SEQ ID NO: 1366390 - RNA, 19 nt, Homo sapiens
guaucggguugaauaugaa

SEQ ID NO: 1366391 - RNA, 19 nt, Homo sapiens
gaccauagagcugaaggaa

SEQ ID NO: 1366392 - RNA, 19 nt, Homo sapiens
ccagcggcuugaccaauga

SEQ ID NO: 1366393 - RNA, 19 nt, Homo sapiens
aaaagaaaaugcagcuaga

SEQ ID NO: 1366394 - RNA, 19 nt, Homo sapiens
ccuaauagcagaaaagaaa

SEQ ID NO: 1366395 - RNA, 19 nt, Homo sapiens
ucucaccucuuaugcuuag

SEQ ID NO: 1366396 - RNA, 19 nt, Homo sapiens
gggcuacacuuugaugaac

SEQ ID NO: 1366397 - RNA, 19 nt, Homo sapiens
caacagcagcaacuucaag

SEQ ID NO: 1366398 - RNA, 19 nt, Homo sapiens
gcagggcuacacuuugaug

SEQ ID NO: 1366399 - RNA, 19 nt, Homo sapiens
caccucacccucccgagua

SEQ ID NO: 1366400 - RNA, 19 nt, Homo sapiens
gcuacacuuugaugaacug

SEQ ID NO: 1366401 - RNA, 19 nt, Homo sapiens
ggacauccugggugaagca

SEQ ID NO: 1366402 - RNA, 19 nt, Homo sapiens
acacuuugaugaacugaac

SEQ ID NO: 1366403 - RNA, 19 nt, Homo sapiens
gcucaacagcagcaacuuc

SEQ ID NO: 1366404 - RNA, 19 nt, Homo sapiens
gguguuggacccagagguu

SEQ ID NO: 1366405 - RNA, 19 nt, Homo sapiens
uugaugaacugaacaagcu

SEQ ID NO: 1366406 - RNA, 19 nt, Homo sapiens
ugaaggaagagugcaaaga

SEQ ID NO: 1366407 - RNA, 19 nt, Homo sapiens
uuuggaaggagaagcaaua

SEQ ID NO: 1366408 - RNA, 19 nt, Homo sapiens
ccucuuaugcuuaguugga

SEQ ID NO: 1366409 - RNA, 19 nt, Homo sapiens
agagguggcguguaaggaa

SEQ ID NO: 1366410 - RNA, 19 nt, Homo sapiens
ggagccaguuuuaacauca

SEQ ID NO: 1366411 - RNA, 19 nt, Homo sapiens
uccagcggcuugaccaaug

SEQ ID NO: 1366412 - RNA, 19 nt, Homo sapiens
guaggaaggcaaaacaaaa

SEQ ID NO: 1366413 - RNA, 19 nt, Homo sapiens
caccucuuaugcuuaguug

SEQ ID NO: 1366414 - RNA, 19 nt, Homo sapiens
ugaauaugaagcuuugugu

SEQ ID NO: 1366415 - RNA, 19 nt, Homo sapiens
gaaagguaucggguugaau

SEQ ID NO: 1366416 - RNA, 19 nt, Homo sapiens
cuugaccaaugaccuaugu

SEQ ID NO: 1366417 - RNA, 19 nt, Homo sapiens
gaaaaugcagcuagaaagg

SEQ ID NO: 1366418 - RNA, 19 nt, Homo sapiens
aaauuggccaguuucagaa

SEQ ID NO: 1366419 - RNA, 19 nt, Homo sapiens
aaaagccucucaaaaccaa

SEQ ID NO: 1366420 - RNA, 19 nt, Homo sapiens
gcagaaaaugaaaagauga

SEQ ID NO: 1366421 - RNA, 19 nt, Homo sapiens
gcugaaggaagagugcaaa

SEQ ID NO: 1366422 - RNA, 19 nt, Homo sapiens
ccugaagacagcacuacaa

SEQ ID NO: 1366423 - RNA, 19 nt, Homo sapiens
caagagguggcguguaagg

SEQ ID NO: 1366424 - RNA, 19 nt, Homo sapiens
cggcuugaccaaugaccua

SEQ ID NO: 1366425 - RNA, 19 nt, Homo sapiens
guguaaaguagaagcagaa

SEQ ID NO: 1366426 - RNA, 19 nt, Homo sapiens
ggguugaauaugaagcuuu

SEQ ID NO: 1366427 - RNA, 19 nt, Homo sapiens
uuacccagcagaccauaga

SEQ ID NO: 1366428 - RNA, 19 nt, Homo sapiens
gcaaaagaagcagaaaaug

SEQ ID NO: 1366429 - RNA, 19 nt, Homo sapiens
gaacuugacuguaguagaa

SEQ ID NO: 1366430 - RNA, 19 nt, Homo sapiens
gaaaggcacuucuuacaug

SEQ ID NO: 1366431 - RNA, 19 nt, Homo sapiens
gaauacugcuaguuucuua

SEQ ID NO: 1366432 - RNA, 19 nt, Homo sapiens
ggacauagccaaaccauau

SEQ ID NO: 1366433 - RNA, 19 nt, Homo sapiens
gaacaggcaccacuaauga

SEQ ID NO: 1366434 - RNA, 19 nt, Homo sapiens
ggagagacccugaauuuga

SEQ ID NO: 1366435 - RNA, 19 nt, Homo sapiens
cuagauacauggauucuuu

SEQ ID NO: 1366436 - RNA, 19 nt, Homo sapiens
caacaagucuguaggaagu

SEQ ID NO: 1366437 - RNA, 19 nt, Homo sapiens
gcaagucccuuccaccuau

SEQ ID NO: 1366438 - RNA, 19 nt, Homo sapiens
gcaaguggauauuuauuag

SEQ ID NO: 1366439 - RNA, 19 nt, Homo sapiens
gagugaagaugaacugauu

SEQ ID NO: 1366440 - RNA, 19 nt, Homo sapiens
guacagguauugauuaaag

SEQ ID NO: 1366441 - RNA, 19 nt, Homo sapiens
gcaaagccauucaacaagu

SEQ ID NO: 1366442 - RNA, 19 nt, Homo sapiens
gagcugacuuguaaacuau

SEQ ID NO: 1366443 - RNA, 19 nt, Homo sapiens
ugauggacguucuguaaua

SEQ ID NO: 1366444 - RNA, 19 nt, Homo sapiens
gaagagauaagagaaauga

SEQ ID NO: 1366445 - RNA, 19 nt, Homo sapiens
caagagggauauuguugaa

SEQ ID NO: 1366446 - RNA, 19 nt, Homo sapiens
gagaagagauaagagaaau

SEQ ID NO: 1366447 - RNA, 19 nt, Homo sapiens
gaugaauucuggauauaug

SEQ ID NO: 1366448 - RNA, 19 nt, Homo sapiens
gaaguggagugaauaccaa

SEQ ID NO: 1366449 - RNA, 19 nt, Homo sapiens
cagcauccuuucaagaaua

SEQ ID NO: 1366450 - RNA, 19 nt, Homo sapiens
caucagaucuugugaaacu

SEQ ID NO: 1366451 - RNA, 19 nt, Homo sapiens
gaaaugggacaucuaauag

SEQ ID NO: 1366452 - RNA, 19 nt, Homo sapiens
gcaugggccuggauaagaa

SEQ ID NO: 1366453 - RNA, 19 nt, Homo sapiens
ggacacaaccaaaccauau

SEQ ID NO: 1366454 - RNA, 19 nt, Homo sapiens
uaaaucaucucucucaagu

SEQ ID NO: 1366455 - RNA, 19 nt, Homo sapiens
gaagaugaacugauuaaca

SEQ ID NO: 1366456 - RNA, 19 nt, Homo sapiens
cuggauauaugaccaauaa

SEQ ID NO: 1366457 - RNA, 19 nt, Homo sapiens
ggagauacaauucaaguug

SEQ ID NO: 1366458 - RNA, 19 nt, Homo sapiens
gaagagaaaugggacaucu

SEQ ID NO: 1366459 - RNA, 19 nt, Homo sapiens
guucaaaguuccacaaauc

SEQ ID NO: 1366460 - RNA, 19 nt, Homo sapiens
gacauggccuggagacauu

SEQ ID NO: 1366461 - RNA, 19 nt, Homo sapiens
gauaagccaucagaucuug

SEQ ID NO: 1366462 - RNA, 19 nt, Homo sapiens
ugaugacucuuucagauuu

SEQ ID NO: 1366463 - RNA, 19 nt, Homo sapiens
gagaauagcacgggaaaga

SEQ ID NO: 1366464 - RNA, 19 nt, Homo sapiens
acacuuugcugcuuagaaa

SEQ ID NO: 1366465 - RNA, 19 nt, Homo sapiens
agaaaugggacaucuaaua

SEQ ID NO: 1366466 - RNA, 19 nt, Homo sapiens
gcagcuccauuacuucaaa

SEQ ID NO: 1366467 - RNA, 19 nt, Homo sapiens
uaggauguauacagacuua

SEQ ID NO: 1366468 - RNA, 19 nt, Homo sapiens
gggcaaagccauucaacaa

SEQ ID NO: 1366469 - RNA, 19 nt, Homo sapiens
gcacccaagucaccuguug

SEQ ID NO: 1366470 - RNA, 19 nt, Homo sapiens
gccaucagaucuugugaaa

SEQ ID NO: 1366471 - RNA, 19 nt, Homo sapiens
gaaaugaaagagaagagaa

SEQ ID NO: 1366472 - RNA, 19 nt, Homo sapiens
gcaaacauggucaguauuc

SEQ ID NO: 1366473 - RNA, 19 nt, Homo sapiens
ggguacagguauugauuaa

SEQ ID NO: 1366474 - RNA, 19 nt, Homo sapiens
caacaggcuuugccaagug

SEQ ID NO: 1366475 - RNA, 19 nt, Homo sapiens
uaacaagagucaccuuuac

SEQ ID NO: 1366476 - RNA, 19 nt, Homo sapiens
gcagcuggcuugaauuucu

SEQ ID NO: 1366477 - RNA, 19 nt, Homo sapiens
aaagacggcuguuccaaau

SEQ ID NO: 1366478 - RNA, 19 nt, Homo sapiens
caagaacaaugauggauac

SEQ ID NO: 1366479 - RNA, 19 nt, Homo sapiens
ggcaaguggauauuuauua

SEQ ID NO: 1366480 - RNA, 19 nt, Homo sapiens
gcagggcugucaaauuuua

SEQ ID NO: 1366481 - RNA, 19 nt, Homo sapiens
aaagcaagcuaguuacuuc

SEQ ID NO: 1366482 - RNA, 19 nt, Homo sapiens
ucaagcaucuguauuaguc

SEQ ID NO: 1366483 - RNA, 19 nt, Homo sapiens
ggagaugucgccacaagaa

SEQ ID NO: 1366484 - RNA, 19 nt, Homo sapiens
guagaauacugcuaguuuc

SEQ ID NO: 1366485 - RNA, 19 nt, Homo sapiens
aaucaucucucucaaguuc

SEQ ID NO: 1366486 - RNA, 19 nt, Homo sapiens
cugcaaauuuccaaacuuu

SEQ ID NO: 1366487 - RNA, 19 nt, Homo sapiens
cauaauagaugguguuuug

SEQ ID NO: 1366488 - RNA, 19 nt, Homo sapiens
ccacagccaucacucaugu

SEQ ID NO: 1366489 - RNA, 19 nt, Homo sapiens
gagaagaagcagcagauug

SEQ ID NO: 1366490 - RNA, 19 nt, Homo sapiens
ccaauuuacuguauuaguc

SEQ ID NO: 1366491 - RNA, 19 nt, Homo sapiens
gcauugaggcauuuccaua

SEQ ID NO: 1366492 - RNA, 19 nt, Homo sapiens
ccagaauaaucuccuuuga

SEQ ID NO: 1366493 - RNA, 19 nt, Homo sapiens
uaauuugcuugauggcuua

SEQ ID NO: 1366494 - RNA, 19 nt, Homo sapiens
ccacauccuuauacuuuau

SEQ ID NO: 1366495 - RNA, 19 nt, Homo sapiens
gagugaauaccaaauguuu

SEQ ID NO: 1366496 - RNA, 19 nt, Homo sapiens
gaaauuucuuccgcuaguu

SEQ ID NO: 1366497 - RNA, 19 nt, Homo sapiens
gcaagcuaguuacuuccua

SEQ ID NO: 1366498 - RNA, 19 nt, Homo sapiens
guauuaaugcugcugauaa

SEQ ID NO: 1366499 - RNA, 19 nt, Homo sapiens
cauugacuaugcugaauuu

SEQ ID NO: 1366500 - RNA, 19 nt, Homo sapiens
gagagacccugaauuugag

SEQ ID NO: 1366501 - RNA, 19 nt, Homo sapiens
gccacauccuuauacuuua

SEQ ID NO: 1366502 - RNA, 19 nt, Homo sapiens
uuccaaaucucaauucuug

SEQ ID NO: 1366503 - RNA, 19 nt, Homo sapiens
caaaaucacugcaguagau

SEQ ID NO: 1366504 - RNA, 19 nt, Homo sapiens
uaaccuaaaucaucucucu

SEQ ID NO: 1366505 - RNA, 19 nt, Homo sapiens
agaauaaucuccuuugacu

SEQ ID NO: 1366506 - RNA, 19 nt, Homo sapiens
ggacuuacaguuccacaug

SEQ ID NO: 1366507 - RNA, 19 nt, Homo sapiens
uagaaggugucaucaacaa

SEQ ID NO: 1366508 - RNA, 19 nt, Homo sapiens
gugauaaugugauugaaca

SEQ ID NO: 1366509 - RNA, 19 nt, Homo sapiens
ucacucauguccauaagga

SEQ ID NO: 1366510 - RNA, 19 nt, Homo sapiens
agagcugacuuguaaacua

SEQ ID NO: 1366511 - RNA, 19 nt, Homo sapiens
gaagaagcagcagauugua

SEQ ID NO: 1366512 - RNA, 19 nt, Homo sapiens
ccaacaaguuccucaucuu

SEQ ID NO: 1366513 - RNA, 19 nt, Homo sapiens
uaaagacggcuguuccaaa

SEQ ID NO: 1366514 - RNA, 19 nt, Homo sapiens
gaacacagugcacgaccaa

SEQ ID NO: 1366515 - RNA, 19 nt, Homo sapiens
gccaucuccugguuauaua

SEQ ID NO: 1366516 - RNA, 19 nt, Homo sapiens
aagaauugcagcuccauua

SEQ ID NO: 1366517 - RNA, 19 nt, Homo sapiens
cugaaacgaugauugaaug

SEQ ID NO: 1366518 - RNA, 19 nt, Homo sapiens
caauagugguuuagcuuuc

SEQ ID NO: 1366519 - RNA, 19 nt, Homo sapiens
ugggagagacccugaauuu

SEQ ID NO: 1366520 - RNA, 19 nt, Homo sapiens
gccaaaccauaucauucua

SEQ ID NO: 1366521 - RNA, 19 nt, Homo sapiens
uuucaaagccacagcauaa

SEQ ID NO: 1366522 - RNA, 19 nt, Homo sapiens
ucaguauucuguaaaguuc

SEQ ID NO: 1366523 - RNA, 19 nt, Homo sapiens
aggcaaacauggucaguau

SEQ ID NO: 1366524 - RNA, 19 nt, Homo sapiens
gagaugaugacaagaacaa

SEQ ID NO: 1366525 - RNA, 19 nt, Homo sapiens
ggauguauacagacuuauu

SEQ ID NO: 1366526 - RNA, 19 nt, Homo sapiens
cauggucaguauucuguaa

SEQ ID NO: 1366527 - RNA, 19 nt, Homo sapiens
ugacuaugcugaauuugca

SEQ ID NO: 1366528 - RNA, 19 nt, Homo sapiens
gauaauucaccaaacaaug

SEQ ID NO: 1366529 - RNA, 19 nt, Homo sapiens
gcacagaugucagaagaaa

SEQ ID NO: 1366530 - RNA, 19 nt, Homo sapiens
gaccagauccuguguauaa

SEQ ID NO: 1366531 - RNA, 19 nt, Homo sapiens
gaagacagaugauauugag

SEQ ID NO: 1366532 - RNA, 19 nt, Homo sapiens
ugacuacaauugcaaagua

SEQ ID NO: 1366533 - RNA, 19 nt, Homo sapiens
gcacagaggagguccagua

SEQ ID NO: 1366534 - RNA, 19 nt, Homo sapiens
gaaaguacuuggagaaacu

SEQ ID NO: 1366535 - RNA, 19 nt, Homo sapiens
gagaagaagcuaagaagaa

SEQ ID NO: 1366536 - RNA, 19 nt, Homo sapiens
cuauagacauuccauauga

SEQ ID NO: 1366537 - RNA, 19 nt, Homo sapiens
ccaggacaauaguauguua

SEQ ID NO: 1366538 - RNA, 19 nt, Homo sapiens
cagauccuguguauaauaa

SEQ ID NO: 1366539 - RNA, 19 nt, Homo sapiens
gagaaacugaggccucuua

SEQ ID NO: 1366540 - RNA, 19 nt, Homo sapiens
ggagaaauccacugaagga

SEQ ID NO: 1366541 - RNA, 19 nt, Homo sapiens
gagagcaccuuggaacauu

SEQ ID NO: 1366542 - RNA, 19 nt, Homo sapiens
gaaauccacugaaggaaaa

SEQ ID NO: 1366543 - RNA, 19 nt, Homo sapiens
gaucaaaugugaaaguacu

SEQ ID NO: 1366544 - RNA, 19 nt, Homo sapiens
uagcacagaugucagaaga

SEQ ID NO: 1366545 - RNA, 19 nt, Homo sapiens
gcagcagaacaguaaauua

SEQ ID NO: 1366546 - RNA, 19 nt, Homo sapiens
gccaaauccugaacaagaa

SEQ ID NO: 1366547 - RNA, 19 nt, Homo sapiens
ugaggccucuuauguguaa

SEQ ID NO: 1366548 - RNA, 19 nt, Homo sapiens
gaagucugcuaaagaucaa

SEQ ID NO: 1366549 - RNA, 19 nt, Homo sapiens
gguguaugcacuaauaaua

SEQ ID NO: 1366550 - RNA, 19 nt, Homo sapiens
aaacugaggccucuuaugu

SEQ ID NO: 1366551 - RNA, 19 nt, Homo sapiens
gauccuguguauaauaaug

SEQ ID NO: 1366552 - RNA, 19 nt, Homo sapiens
gcucagauuccaaaugaaa

SEQ ID NO: 1366553 - RNA, 19 nt, Homo sapiens
cagaggagguccaguaucu

SEQ ID NO: 1366554 - RNA, 19 nt, Homo sapiens
gcgagaacccauaauagaa

SEQ ID NO: 1366555 - RNA, 19 nt, Homo sapiens
agaaacacauggucaagug

SEQ ID NO: 1366556 - RNA, 19 nt, Homo sapiens
agaagaagcuaagaagaau

SEQ ID NO: 1366557 - RNA, 19 nt, Homo sapiens
uggauggacuugauucuga

SEQ ID NO: 1366558 - RNA, 19 nt, Homo sapiens
cacaagaucuggccaggau

SEQ ID NO: 1366559 - RNA, 19 nt, Homo sapiens
ucugguguaugcacuaaua

SEQ ID NO: 1366560 - RNA, 19 nt, Homo sapiens
ggacuugauucugaugaga

SEQ ID NO: 1366561 - RNA, 19 nt, Homo sapiens
ggauucagaaguguauuua

SEQ ID NO: 1366562 - RNA, 19 nt, Homo sapiens
gaagauggugccaacaaug

SEQ ID NO: 1366563 - RNA, 19 nt, Homo sapiens
gcgcuagucuugugggaau

SEQ ID NO: 1366564 - RNA, 19 nt, Homo sapiens
acgcucagauuccaaauga

SEQ ID NO: 1366565 - RNA, 19 nt, Homo sapiens
ccucuuauguguaaugugu

SEQ ID NO: 1366566 - RNA, 19 nt, Homo sapiens
ggagguggcugacuuugcu

SEQ ID NO: 1366567 - RNA, 19 nt, Homo sapiens
caaguguggugaugugugu

SEQ ID NO: 1366568 - RNA, 19 nt, Homo sapiens
ccagaagacagaugauauu

SEQ ID NO: 1366569 - RNA, 19 nt, Homo sapiens
ucucugggcugaaauuugu

SEQ ID NO: 1366570 - RNA, 19 nt, Homo sapiens
ccagauccuguguauaaua

SEQ ID NO: 1366571 - RNA, 19 nt, Homo sapiens
gcagggagaaauccacuga

SEQ ID NO: 1366572 - RNA, 19 nt, Homo sapiens
gaagcuaagaagaaucaaa

SEQ ID NO: 1366573 - RNA, 19 nt, Homo sapiens
gagagcagccugagcaaca

SEQ ID NO: 1366574 - RNA, 19 nt, Homo sapiens
ugagcgagaacccauaaua

SEQ ID NO: 1366575 - RNA, 19 nt, Homo sapiens
caaauuuccacuccacaaa

SEQ ID NO: 1366576 - RNA, 19 nt, Homo sapiens
gaggagguccaguaucuga

SEQ ID NO: 1366577 - RNA, 19 nt, Homo sapiens
gagaacccauaauagaaca

SEQ ID NO: 1366578 - RNA, 19 nt, Homo sapiens
gcugaaaacuagagaagaa

SEQ ID NO: 1366579 - RNA, 19 nt, Homo sapiens
caggaucucugggcugaaa

SEQ ID NO: 1366580 - RNA, 19 nt, Homo sapiens
ugcuaaagaucaaauguga

SEQ ID NO: 1366581 - RNA, 19 nt, Homo sapiens
caaacaacaacaacaacaa

SEQ ID NO: 1366582 - RNA, 19 nt, Homo sapiens
gagcgagaacccauaauag

SEQ ID NO: 1366583 - RNA, 19 nt, Homo sapiens
cuaagaagaaucaaagguu

SEQ ID NO: 1366584 - RNA, 19 nt, Homo sapiens
gacccugucucaaacaaca

SEQ ID NO: 1366585 - RNA, 19 nt, Homo sapiens
gacagaugauauugagguu

SEQ ID NO: 1366586 - RNA, 19 nt, Homo sapiens
cagaugauauugagguucu

SEQ ID NO: 1366587 - RNA, 19 nt, Homo sapiens
gcuccagccagauaaagua

SEQ ID NO: 1366588 - RNA, 19 nt, Homo sapiens
ggagguccaguaucugauu

SEQ ID NO: 1366589 - RNA, 19 nt, Homo sapiens
gaaacugaggccucuuaug

SEQ ID NO: 1366590 - RNA, 19 nt, Homo sapiens
agagggagguggcugacuu

SEQ ID NO: 1366591 - RNA, 19 nt, Homo sapiens
ggauggacuugauucugau

SEQ ID NO: 1366592 - RNA, 19 nt, Homo sapiens
guauuuagcaucucuagag

SEQ ID NO: 1366593 - RNA, 19 nt, Homo sapiens
agaaguguauuuagcaucu

SEQ ID NO: 1366594 - RNA, 19 nt, Homo sapiens
gcaggauucagaaguguau

SEQ ID NO: 1366595 - RNA, 19 nt, Homo sapiens
gguugaggcugcagagagu

SEQ ID NO: 1366596 - RNA, 19 nt, Homo sapiens
uaaguacgguuggcaucuu

SEQ ID NO: 1366597 - RNA, 19 nt, Homo sapiens
agaagauggugccaacaau

SEQ ID NO: 1366598 - RNA, 19 nt, Homo sapiens
gaagaaacacauggucaag

SEQ ID NO: 1366599 - RNA, 19 nt, Homo sapiens
agaaauccacugaaggaaa

SEQ ID NO: 1366600 - RNA, 19 nt, Homo sapiens
uaaauuacacacacacaca

SEQ ID NO: 1366601 - RNA, 19 nt, Homo sapiens
gaaaccggaaccuccagaa

SEQ ID NO: 1366602 - RNA, 19 nt, Homo sapiens
gcagagaguggugaucaug

SEQ ID NO: 1366603 - RNA, 19 nt, Homo sapiens
gagcagccugagcaacaua

SEQ ID NO: 1366604 - RNA, 19 nt, Homo sapiens
uauguuaccauccuucuau

SEQ ID NO: 1366605 - RNA, 19 nt, Homo sapiens
ugccaaauccugaacaaga

SEQ ID NO: 1366606 - RNA, 19 nt, Homo sapiens
ugaagaaacacauggucaa

SEQ ID NO: 1366607 - RNA, 19 nt, Homo sapiens
cccauaauagaacaacuua

SEQ ID NO: 1366608 - RNA, 19 nt, Homo sapiens
ggacaauaguauguuacca

SEQ ID NO: 1366609 - RNA, 19 nt, Homo sapiens
gacaauaguauguuaccau

SEQ ID NO: 1366610 - RNA, 19 nt, Homo sapiens
gagggagguggcugacuuu

SEQ ID NO: 1366611 - RNA, 19 nt, Homo sapiens
uaaugugugacuacaauug

SEQ ID NO: 1366612 - RNA, 19 nt, Homo sapiens
acugaggccucuuaugugu

SEQ ID NO: 1366613 - RNA, 19 nt, Homo sapiens
cagcagcagcagaacagua

SEQ ID NO: 1366614 - RNA, 19 nt, Homo sapiens
caagccagcagcagcagaa

SEQ ID NO: 1366615 - RNA, 19 nt, Homo sapiens
gagguccaguaucugauuc

SEQ ID NO: 1366616 - RNA, 19 nt, Homo sapiens
cagaagacagaugauauug

SEQ ID NO: 1366617 - RNA, 19 nt, Homo sapiens
gaacaacuuagcaaaaugu

SEQ ID NO: 1366618 - RNA, 19 nt, Homo sapiens
agagcaccuuggaacauuu

SEQ ID NO: 1366619 - RNA, 19 nt, Homo sapiens
ucaaacaacaacaacaaca

SEQ ID NO: 1366620 - RNA, 19 nt, Homo sapiens
agaagacagaugauauuga

SEQ ID NO: 1366621 - RNA, 19 nt, Homo sapiens
ugaaaguacuuggagaaac

SEQ ID NO: 1366622 - RNA, 19 nt, Homo sapiens
aaaugcugcuuuccucugu

SEQ ID NO: 1366623 - RNA, 19 nt, Homo sapiens
ccaaauuuccacuccacaa

SEQ ID NO: 1366624 - RNA, 19 nt, Homo sapiens
ccaacaaugcauucucaga

SEQ ID NO: 1366625 - RNA, 19 nt, Homo sapiens
ugccaacaaugcauucuca

SEQ ID NO: 1366626 - RNA, 19 nt, Homo sapiens
gaagaagcuaagaagaauc

SEQ ID NO: 1366627 - RNA, 19 nt, Homo sapiens
ucagaaguguauuuagcau

SEQ ID NO: 1366628 - RNA, 19 nt, Homo sapiens
cuugugggaaugaagauua

SEQ ID NO: 1366629 - RNA, 19 nt, Homo sapiens
gaaauuguccuaagucaaa

SEQ ID NO: 1366630 - RNA, 19 nt, Homo sapiens
uaacugagauucugagugu

SEQ ID NO: 1366631 - RNA, 19 nt, Homo sapiens
gaggaagaguuuaacauug

SEQ ID NO: 1366632 - RNA, 19 nt, Homo sapiens
uuggauagcuaaaguguua

SEQ ID NO: 1366633 - RNA, 19 nt, Homo sapiens
cagagacacuccugaaauu

SEQ ID NO: 1366634 - RNA, 19 nt, Homo sapiens
gcaggaagccaaugagaaa

SEQ ID NO: 1366635 - RNA, 19 nt, Homo sapiens
gacugaagauuauggagua

SEQ ID NO: 1366636 - RNA, 19 nt, Homo sapiens
ccaaauuaaugcucagaaa

SEQ ID NO: 1366637 - RNA, 19 nt, Homo sapiens
cgaaauacccuuuggauag

SEQ ID NO: 1366638 - RNA, 19 nt, Homo sapiens
caacuuaacugagauucug

SEQ ID NO: 1366639 - RNA, 19 nt, Homo sapiens
gguggaggcugcuguacaa

SEQ ID NO: 1366640 - RNA, 19 nt, Homo sapiens
aggaagaguuuaacauuga

SEQ ID NO: 1366641 - RNA, 19 nt, Homo sapiens
gcuggaaccugugaugauu

SEQ ID NO: 1366642 - RNA, 19 nt, Homo sapiens
gaaaggacgccucgugcaa

SEQ ID NO: 1366643 - RNA, 19 nt, Homo sapiens
gaaauacccuuuggauagc

SEQ ID NO: 1366644 - RNA, 19 nt, Homo sapiens
ccucuuugaugcucugaua

SEQ ID NO: 1366645 - RNA, 19 nt, Homo sapiens
gaaagcagaggaaaucgau

SEQ ID NO: 1366646 - RNA, 19 nt, Homo sapiens
gcaagggucaucuguacaa

SEQ ID NO: 1366647 - RNA, 19 nt, Homo sapiens
ucucagauuugcucaguga

SEQ ID NO: 1366648 - RNA, 19 nt, Homo sapiens
ccgaguacaugacaauuuc

SEQ ID NO: 1366649 - RNA, 19 nt, Homo sapiens
ugaggaagaguuuaacauu

SEQ ID NO: 1366650 - RNA, 19 nt, Homo sapiens
ugagugaugucgaugugaa

SEQ ID NO: 1366651 - RNA, 19 nt, Homo sapiens
gugcaaacccaacgacuga

SEQ ID NO: 1366652 - RNA, 19 nt, Homo sapiens
aggcauaccuggcugugaa

SEQ ID NO: 1366653 - RNA, 19 nt, Homo sapiens
agauagagcagcagaagaa

SEQ ID NO: 1366654 - RNA, 19 nt, Homo sapiens
ggucaucuguacaaagaag

SEQ ID NO: 1366655 - RNA, 19 nt, Homo sapiens
gugcuaacaccaacagaaa

SEQ ID NO: 1366656 - RNA, 19 nt, Homo sapiens
ccagagacacuccugaaau

SEQ ID NO: 1366657 - RNA, 19 nt, Homo sapiens
uugaaccacuaaaccauaa

SEQ ID NO: 1366658 - RNA, 19 nt, Homo sapiens
gcaaaagaugccagaaaua

SEQ ID NO: 1366659 - RNA, 19 nt, Homo sapiens
cccaacgacugaagauuau

SEQ ID NO: 1366660 - RNA, 19 nt, Homo sapiens
gagacacuccugaaauugu

SEQ ID NO: 1366661 - RNA, 19 nt, Homo sapiens
ggaagaguuuaacauugag

SEQ ID NO: 1366662 - RNA, 19 nt, Homo sapiens
gaagcaacagugccagguu

SEQ ID NO: 1366663 - RNA, 19 nt, Homo sapiens
gcucugauacuguucuguu

SEQ ID NO: 1366664 - RNA, 19 nt, Homo sapiens
guugaaccacuaaaccaua

SEQ ID NO: 1366665 - RNA, 19 nt, Homo sapiens
acccaacgacugaagauua

SEQ ID NO: 1366666 - RNA, 19 nt, Homo sapiens
caagggucaucuguacaaa

SEQ ID NO: 1366667 - RNA, 19 nt, Homo sapiens
gagcaggaagccaaugaga

SEQ ID NO: 1366668 - RNA, 19 nt, Homo sapiens
cagcgugcguuccaaguuc

SEQ ID NO: 1366669 - RNA, 19 nt, Homo sapiens
gaaauacgaauggccuugu

SEQ ID NO: 1366670 - RNA, 19 nt, Homo sapiens
gcaaucagagaauaaaggu

SEQ ID NO: 1366671 - RNA, 19 nt, Homo sapiens
ugagaaagcagaggaaauc

SEQ ID NO: 1366672 - RNA, 19 nt, Homo sapiens
ggaagccaaugagaaagca

SEQ ID NO: 1366673 - RNA, 19 nt, Homo sapiens
agggucaucuguacaaaga

SEQ ID NO: 1366674 - RNA, 19 nt, Homo sapiens
caaagaaggaagcaacagu

SEQ ID NO: 1366675 - RNA, 19 nt, Homo sapiens
aaauacgaauggccuuguu

SEQ ID NO: 1366676 - RNA, 19 nt, Homo sapiens
gcagauagagcagcagaag

SEQ ID NO: 1366677 - RNA, 19 nt, Homo sapiens
ggagguccagauugauaaa

SEQ ID NO: 1366678 - RNA, 19 nt, Homo sapiens
gcagauuaagcacaugaug

SEQ ID NO: 1366679 - RNA, 19 nt, Homo sapiens
aaagaugccagaaauacga

SEQ ID NO: 1366680 - RNA, 19 nt, Homo sapiens
caguggcaaucagagaaua

SEQ ID NO: 1366681 - RNA, 19 nt, Homo sapiens
gaaccugugaugauuguac

SEQ ID NO: 1366682 - RNA, 19 nt, Homo sapiens
ccacuaaaccauaaaaguu

SEQ ID NO: 1366683 - RNA, 19 nt, Homo sapiens
gcuaacaccaacagaaagu

SEQ ID NO: 1366684 - RNA, 19 nt, Homo sapiens
uaacaccaacagaaaguuc

SEQ ID NO: 1366685 - RNA, 19 nt, Homo sapiens
caagcugccuggucagacu

SEQ ID NO: 1366686 - RNA, 19 nt, Homo sapiens
gguuucaaauaccuuggaa

SEQ ID NO: 1366687 - RNA, 19 nt, Homo sapiens
acaugacaauuucccagaa

SEQ ID NO: 1366688 - RNA, 19 nt, Homo sapiens
guuccaaguuccacauucu

SEQ ID NO: 1366689 - RNA, 19 nt, Homo sapiens
cugcaagggucaucuguac

SEQ ID NO: 1366690 - RNA, 19 nt, Homo sapiens
acgaaauacccuuuggaua

SEQ ID NO: 1366691 - RNA, 19 nt, Homo sapiens
uugaugcucugauacuguu

SEQ ID NO: 1366692 - RNA, 19 nt, Homo sapiens
gaaagccgacuggaucucu

SEQ ID NO: 1366693 - RNA, 19 nt, Homo sapiens
gauagagcagcagaagaaa

SEQ ID NO: 1366694 - RNA, 19 nt, Homo sapiens
gaagaguuuaacauugaga

SEQ ID NO: 1366695 - RNA, 19 nt, Homo sapiens
caaggcugaggaagaguuu

SEQ ID NO: 1366696 - RNA, 19 nt, Homo sapiens
guaguguuuccuccucuuu

SEQ ID NO: 1366697 - RNA, 19 nt, Homo sapiens
uggaaccugugaugauugu

SEQ ID NO: 1366698 - RNA, 19 nt, Homo sapiens
gcaaacccaacgacugaag

SEQ ID NO: 1366699 - RNA, 19 nt, Homo sapiens
aaaggacgccucgugcaaa

SEQ ID NO: 1366700 - RNA, 19 nt, Homo sapiens
cugaaauuguccuaaguca

SEQ ID NO: 1366701 - RNA, 19 nt, Homo sapiens
gguccagauugauaaagag

SEQ ID NO: 1366702 - RNA, 19 nt, Homo sapiens
aguguuuccuccucuuuga

SEQ ID NO: 1366703 - RNA, 19 nt, Homo sapiens
ggucuacaguggcaaucag

SEQ ID NO: 1366704 - RNA, 19 nt, Homo sapiens
caacgacugaagauuaugg

SEQ ID NO: 1366705 - RNA, 19 nt, Homo sapiens
caaacccaacgacugaaga

SEQ ID NO: 1366706 - RNA, 19 nt, Homo sapiens
ccauggcccugagugaugu

SEQ ID NO: 1366707 - RNA, 19 nt, Homo sapiens
gccauggcccugagugaug

SEQ ID NO: 1366708 - RNA, 19 nt, Homo sapiens
gauuauggaguauuaugag

SEQ ID NO: 1366709 - RNA, 19 nt, Homo sapiens
ccaaggcugaggaagaguu

SEQ ID NO: 1366710 - RNA, 19 nt, Homo sapiens
ccugagugaugucgaugug

SEQ ID NO: 1366711 - RNA, 19 nt, Homo sapiens
guccugagagcccgaaaug

SEQ ID NO: 1366712 - RNA, 19 nt, Homo sapiens
gaaccacuaaaccauaaaa

SEQ ID NO: 1366713 - RNA, 19 nt, Homo sapiens
cuacaguggcaaucagaga

SEQ ID NO: 1366714 - RNA, 19 nt, Homo sapiens
ugaaauuguccuaagucaa

SEQ ID NO: 1366715 - RNA, 19 nt, Homo sapiens
auccugauguccaccauga

SEQ ID NO: 1366716 - RNA, 19 nt, Homo sapiens
aggcugaggaagaguuuaa

SEQ ID NO: 1366717 - RNA, 19 nt, Homo sapiens
caaugagaaagcagaggaa

SEQ ID NO: 1366718 - RNA, 19 nt, Homo sapiens
aaaagcagauuaagcacau

SEQ ID NO: 1366719 - RNA, 19 nt, Homo sapiens
gagugaugucgaugugaaa

SEQ ID NO: 1366720 - RNA, 19 nt, Homo sapiens
ggagccaaacgguguacga

SEQ ID NO: 1366721 - RNA, 19 nt, Homo sapiens
caaaagaugccagaaauac

SEQ ID NO: 1366722 - RNA, 19 nt, Homo sapiens
ggaggucuacaguggcaau

SEQ ID NO: 1366723 - RNA, 19 nt, Homo sapiens
cccgaguacaugacaauuu

SEQ ID NO: 1366724 - RNA, 19 nt, Homo sapiens
cgacugcuggaaccuguga

SEQ ID NO: 1366725 - RNA, 19 nt, Homo sapiens
gaguuuaacauugagaaag

SEQ ID NO: 1366726 - RNA, 19 nt, Homo sapiens
cuaagucaaaggagccaaa

SEQ ID NO: 1366727 - RNA, 19 nt, Homo sapiens
cacgaaauacccuuuggau

SEQ ID NO: 1366728 - RNA, 19 nt, Homo sapiens
aaaggagccaaacggugua

SEQ ID NO: 1366729 - RNA, 19 nt, Homo sapiens
ggagguagcuggcagagua

SEQ ID NO: 1366730 - RNA, 19 nt, Homo sapiens
gaagacggguuccugcuuu

SEQ ID NO: 1366731 - RNA, 19 nt, Homo sapiens
gaggaggucuucaguacua

SEQ ID NO: 1366732 - RNA, 19 nt, Homo sapiens
gcauauagcugcugauucu

SEQ ID NO: 1366733 - RNA, 19 nt, Homo sapiens
aaacagcccuucuaauuca

SEQ ID NO: 1366734 - RNA, 19 nt, Homo sapiens
gaacugagcccagacuuug

SEQ ID NO: 1366735 - RNA, 19 nt, Homo sapiens
gaaguaaggcccaaaggaa

SEQ ID NO: 1366736 - RNA, 19 nt, Homo sapiens
gauauuaccucuucuuggu

SEQ ID NO: 1366737 - RNA, 19 nt, Homo sapiens
ugucgaagaugauccguua

SEQ ID NO: 1366738 - RNA, 19 nt, Homo sapiens
gaauucagcuuguguucug

SEQ ID NO: 1366739 - RNA, 19 nt, Homo sapiens
gcacaaccuugcuuugaau

SEQ ID NO: 1366740 - RNA, 19 nt, Homo sapiens
gaacucacucacugucuua

SEQ ID NO: 1366741 - RNA, 19 nt, Homo sapiens
gagaggaggucuucaguac

SEQ ID NO: 1366742 - RNA, 19 nt, Homo sapiens
ggaaauaggaggagucuag

SEQ ID NO: 1366743 - RNA, 19 nt, Homo sapiens
gaggauagcagcuucacua

SEQ ID NO: 1366744 - RNA, 19 nt, Homo sapiens
guacacauuuccuaucuuc

SEQ ID NO: 1366745 - RNA, 19 nt, Homo sapiens
ggaaacaacauaccucuuc

SEQ ID NO: 1366746 - RNA, 19 nt, Homo sapiens
gagaagggccucaaacugu

SEQ ID NO: 1366747 - RNA, 19 nt, Homo sapiens
ugucagcucuucuuucaaa

SEQ ID NO: 1366748 - RNA, 19 nt, Homo sapiens
uggaggagcuggaggauga

SEQ ID NO: 1366749 - RNA, 19 nt, Homo sapiens
gagagggacuggaaaccuu

SEQ ID NO: 1366750 - RNA, 19 nt, Homo sapiens
ugaagacgguggaggcuuu

SEQ ID NO: 1366751 - RNA, 19 nt, Homo sapiens
caacauuggugcuaacagu

SEQ ID NO: 1366752 - RNA, 19 nt, Homo sapiens
gaagaugauccguuaguga

SEQ ID NO: 1366753 - RNA, 19 nt, Homo sapiens
caaaacagcccuucuaauu

SEQ ID NO: 1366754 - RNA, 19 nt, Homo sapiens
aaacauuccucaagucuag

SEQ ID NO: 1366755 - RNA, 19 nt, Homo sapiens
caagggcucugacaaguag

SEQ ID NO: 1366756 - RNA, 19 nt, Homo sapiens
gcucucugcugaccuguuu

SEQ ID NO: 1366757 - RNA, 19 nt, Homo sapiens
ggaacucacucacugucuu

SEQ ID NO: 1366758 - RNA, 19 nt, Homo sapiens
gaagggcaguggcaacauc

SEQ ID NO: 1366759 - RNA, 19 nt, Homo sapiens
gaguaacagauaacgauua

SEQ ID NO: 1366760 - RNA, 19 nt, Homo sapiens
uuucauaccuagugggaua

SEQ ID NO: 1366761 - RNA, 19 nt, Homo sapiens
gcagaagcgggaagacuuu

SEQ ID NO: 1366762 - RNA, 19 nt, Homo sapiens
gaagggaagccugauauuc

SEQ ID NO: 1366763 - RNA, 19 nt, Homo sapiens
gacgcuagaaacuaaauua

SEQ ID NO: 1366764 - RNA, 19 nt, Homo sapiens
ggagaggaggucuucagua

SEQ ID NO: 1366765 - RNA, 19 nt, Homo sapiens
agacaaagcuacccagacu

SEQ ID NO: 1366766 - RNA, 19 nt, Homo sapiens
ggaaggggcucaccuguca

SEQ ID NO: 1366767 - RNA, 19 nt, Homo sapiens
cgucaaagcuggguacaca

SEQ ID NO: 1366768 - RNA, 19 nt, Homo sapiens
gcuggaggaugauguguuc

SEQ ID NO: 1366769 - RNA, 19 nt, Homo sapiens
caagggcaccugcagcuaa

SEQ ID NO: 1366770 - RNA, 19 nt, Homo sapiens
ugaacaagcccaagucuuc

SEQ ID NO: 1366771 - RNA, 19 nt, Homo sapiens
cggcuucccuggacaaaga

SEQ ID NO: 1366772 - RNA, 19 nt, Homo sapiens
ccagcagucuugcccauug

SEQ ID NO: 1366773 - RNA, 19 nt, Homo sapiens
ggaagggaagccugauauu

SEQ ID NO: 1366774 - RNA, 19 nt, Homo sapiens
gcuaauggaggcuggaauu

SEQ ID NO: 1366775 - RNA, 19 nt, Homo sapiens
uaauuucucucugagugua

SEQ ID NO: 1366776 - RNA, 19 nt, Homo sapiens
gggagagucugaccuggau

SEQ ID NO: 1366777 - RNA, 19 nt, Homo sapiens
aaacccaccucaacaucaa

SEQ ID NO: 1366778 - RNA, 19 nt, Homo sapiens
ggagaagggccucaaacug

SEQ ID NO: 1366779 - RNA, 19 nt, Homo sapiens
ccucagggcuacccaagga

SEQ ID NO: 1366780 - RNA, 19 nt, Homo sapiens
gaaucuaccaguugucgaa

SEQ ID NO: 1366781 - RNA, 19 nt, Homo sapiens
gggacacacugaccauugu

SEQ ID NO: 1366782 - RNA, 19 nt, Homo sapiens
gaugauccguuagugaugu

SEQ ID NO: 1366783 - RNA, 19 nt, Homo sapiens
cacugugucuugugaaauu

SEQ ID NO: 1366784 - RNA, 19 nt, Homo sapiens
gaggagacccagugagaau

SEQ ID NO: 1366785 - RNA, 19 nt, Homo sapiens
cagccagccucccagcuaa

SEQ ID NO: 1366786 - RNA, 19 nt, Homo sapiens
gaggaagggaagccugaua

SEQ ID NO: 1366787 - RNA, 19 nt, Homo sapiens
guacaguugugcagguugu

SEQ ID NO: 1366788 - RNA, 19 nt, Homo sapiens
uaacagauaacgauuagag

SEQ ID NO: 1366789 - RNA, 19 nt, Homo sapiens
cuagugggauacagaagaa

SEQ ID NO: 1366790 - RNA, 19 nt, Homo sapiens
guacauacaacauacucaa

SEQ ID NO: 1366791 - RNA, 19 nt, Homo sapiens
ggacaucgggcaggacuga

SEQ ID NO: 1366792 - RNA, 19 nt, Homo sapiens
ugaguuggccuaaacauuc

SEQ ID NO: 1366793 - RNA, 19 nt, Homo sapiens
ugaggaaucuaccaguugu

SEQ ID NO: 1366794 - RNA, 19 nt, Homo sapiens
caaccuugcuuugaaugga

SEQ ID NO: 1366795 - RNA, 19 nt, Homo sapiens
uugcaaaggugccauaugg

SEQ ID NO: 1366796 - RNA, 19 nt, Homo sapiens
agacauugaucuucuggau

SEQ ID NO: 1366797 - RNA, 19 nt, Homo sapiens
gaaauaggaggagucuaga

SEQ ID NO: 1366798 - RNA, 19 nt, Homo sapiens
ggcuuuauguguuuauguu

SEQ ID NO: 1366799 - RNA, 19 nt, Homo sapiens
ccuaugagccuuccacugu

SEQ ID NO: 1366800 - RNA, 19 nt, Homo sapiens
ggagagaggaagaagaaag

SEQ ID NO: 1366801 - RNA, 19 nt, Homo sapiens
cuucagcucuucccucuca

SEQ ID NO: 1366802 - RNA, 19 nt, Homo sapiens
accagacgcuagaaacuaa

SEQ ID NO: 1366803 - RNA, 19 nt, Homo sapiens
cccaugggcucaaggauuc

SEQ ID NO: 1366804 - RNA, 19 nt, Homo sapiens
ccaagggcucugacaagua

SEQ ID NO: 1366805 - RNA, 19 nt, Homo sapiens
gccuuuggcuuuauguguu

SEQ ID NO: 1366806 - RNA, 19 nt, Homo sapiens
ucacaacccucagagucaa

SEQ ID NO: 1366807 - RNA, 19 nt, Homo sapiens
uuaauuggcuuagugaucu

SEQ ID NO: 1366808 - RNA, 19 nt, Homo sapiens
caacaaaacccaggaggua

SEQ ID NO: 1366809 - RNA, 19 nt, Homo sapiens
ugacaaacccaccucaaca

SEQ ID NO: 1366810 - RNA, 19 nt, Homo sapiens
agaagggcaugcucuggaa

SEQ ID NO: 1366811 - RNA, 19 nt, Homo sapiens
gauggucacauugcuuuaa

SEQ ID NO: 1366812 - RNA, 19 nt, Homo sapiens
ccuggauccugaccuguaa

SEQ ID NO: 1366813 - RNA, 19 nt, Homo sapiens
gcccaagucuuccaguucu

SEQ ID NO: 1366814 - RNA, 19 nt, Homo sapiens
ggguacacauuuccuaucu

SEQ ID NO: 1366815 - RNA, 19 nt, Homo sapiens
caaagcuggguacacauuu

SEQ ID NO: 1366816 - RNA, 19 nt, Homo sapiens
ggaggaugauguguuccaa

SEQ ID NO: 1366817 - RNA, 19 nt, Homo sapiens
ucaagcagagguacagauu

SEQ ID NO: 1366818 - RNA, 19 nt, Homo sapiens
gguggaagguggucugacu

SEQ ID NO: 1366819 - RNA, 19 nt, Homo sapiens
aaaccgggauuauuuacag

SEQ ID NO: 1366820 - RNA, 19 nt, Homo sapiens
ucaaagcuggguacacauu

SEQ ID NO: 1366821 - RNA, 19 nt, Homo sapiens
gaauagccagucagcaugu

SEQ ID NO: 1366822 - RNA, 19 nt, Homo sapiens
ucaaacaugucgcaaaaug

SEQ ID NO: 1366823 - RNA, 19 nt, Homo sapiens
acaucugacuggguucuua

SEQ ID NO: 1366824 - RNA, 19 nt, Homo sapiens
cgaagaugauccguuagug

SEQ ID NO: 1366825 - RNA, 19 nt, Homo sapiens
ggaccuucuuucucuguca

SEQ ID NO: 1366826 - RNA, 19 nt, Homo sapiens
gcagaguagcugucaggaa

SEQ ID NO: 1366827 - RNA, 19 nt, Homo sapiens
ugauuugucugcuaagaag

SEQ ID NO: 1366828 - RNA, 19 nt, Homo sapiens
uaccaugauuugucugcua

SEQ ID NO: 1366829 - RNA, 19 nt, Homo sapiens
gggaagauauugauucuga

SEQ ID NO: 1366830 - RNA, 19 nt, Homo sapiens
gauauuaagggacugauua

SEQ ID NO: 1366831 - RNA, 19 nt, Homo sapiens
gaaaagaacuuggaauaug

SEQ ID NO: 1366832 - RNA, 19 nt, Homo sapiens
gaccacaguuucuuuauuc

SEQ ID NO: 1366833 - RNA, 19 nt, Homo sapiens
caagugagauucugagagu

SEQ ID NO: 1366834 - RNA, 19 nt, Homo sapiens
ggacaaggaugccaugaac

SEQ ID NO: 1366835 - RNA, 19 nt, Homo sapiens
caauaaggcugaggaguug

SEQ ID NO: 1366836 - RNA, 19 nt, Homo sapiens
gaauuggaaugugaggaua

SEQ ID NO: 1366837 - RNA, 19 nt, Homo sapiens
ggaauuugcagacuucuau

SEQ ID NO: 1366838 - RNA, 19 nt, Homo sapiens
gaaaagaacuuggagaaag

SEQ ID NO: 1366839 - RNA, 19 nt, Homo sapiens
gaacuuggaauaugaugau

SEQ ID NO: 1366840 - RNA, 19 nt, Homo sapiens
cgaagaaguuggcaaagca

SEQ ID NO: 1366841 - RNA, 19 nt, Homo sapiens
agacaggaaugaagaacaa

SEQ ID NO: 1366842 - RNA, 19 nt, Homo sapiens
ccaauaaggcugaggaguu

SEQ ID NO: 1366843 - RNA, 19 nt, Homo sapiens
ggagacgauugggaagaua

SEQ ID NO: 1366844 - RNA, 19 nt, Homo sapiens
uccaaaggaugaaaucaaa

SEQ ID NO: 1366845 - RNA, 19 nt, Homo sapiens
ggaccuggauggagacgau

SEQ ID NO: 1366846 - RNA, 19 nt, Homo sapiens
aaguggagaugaugaauga

SEQ ID NO: 1366847 - RNA, 19 nt, Homo sapiens
gucaagagcuguggcaguu

SEQ ID NO: 1366848 - RNA, 19 nt, Homo sapiens
gaugaaaccauggaauuga

SEQ ID NO: 1366849 - RNA, 19 nt, Homo sapiens
uguaagcucuucacagaug

SEQ ID NO: 1366850 - RNA, 19 nt, Homo sapiens
gaccaaagaccacaguuuc

SEQ ID NO: 1366851 - RNA, 19 nt, Homo sapiens
uaucacggacugcuuauuu

SEQ ID NO: 1366852 - RNA, 19 nt, Homo sapiens
gaagauauugauucugaug

SEQ ID NO: 1366853 - RNA, 19 nt, Homo sapiens
uugcagacuucuaugauuu

SEQ ID NO: 1366854 - RNA, 19 nt, Homo sapiens
ggaaaguggagaugaugaa

SEQ ID NO: 1366855 - RNA, 19 nt, Homo sapiens
ggaggaagaggcugaggaa

SEQ ID NO: 1366856 - RNA, 19 nt, Homo sapiens
caaaggaggccaggaaugu

SEQ ID NO: 1366857 - RNA, 19 nt, Homo sapiens
ggaauaugaugaugaaacc

SEQ ID NO: 1366858 - RNA, 19 nt, Homo sapiens
aaacagcgauuuggcuugu

SEQ ID NO: 1366859 - RNA, 19 nt, Homo sapiens
ggagagaaaguugguguug

SEQ ID NO: 1366860 - RNA, 19 nt, Homo sapiens
agaccacaguuucuuuauu

SEQ ID NO: 1366861 - RNA, 19 nt, Homo sapiens
gaacagcaggcgaagaagu

SEQ ID NO: 1366862 - RNA, 19 nt, Homo sapiens
cauucguucugaccuaaua

SEQ ID NO: 1366863 - RNA, 19 nt, Homo sapiens
gaugaagaauuggaaugug

SEQ ID NO: 1366864 - RNA, 19 nt, Homo sapiens
gcaaaggaggccaggaaug

SEQ ID NO: 1366865 - RNA, 19 nt, Homo sapiens
gaaguuugccucuuucaac

SEQ ID NO: 1366866 - RNA, 19 nt, Homo sapiens
cgaugcugcuuuggaauuu

SEQ ID NO: 1366867 - RNA, 19 nt, Homo sapiens
acguugagcuggagaagaa

SEQ ID NO: 1366868 - RNA, 19 nt, Homo sapiens
ccaagcagaugcacuuucg

SEQ ID NO: 1366869 - RNA, 19 nt, Homo sapiens
uuaaauacuugggagagaa

SEQ ID NO: 1366870 - RNA, 19 nt, Homo sapiens
gcucgcugaugaagaaugu

SEQ ID NO: 1366871 - RNA, 19 nt, Homo sapiens
ugaggauacugaagcaaug

SEQ ID NO: 1366872 - RNA, 19 nt, Homo sapiens
guacaggcacauaugaaug

SEQ ID NO: 1366873 - RNA, 19 nt, Homo sapiens
ggaagauauugauucugau

SEQ ID NO: 1366874 - RNA, 19 nt, Homo sapiens
gaugagauacuacaaacag

SEQ ID NO: 1366875 - RNA, 19 nt, Homo sapiens
cagaaaagaacuuggaaua

SEQ ID NO: 1366876 - RNA, 19 nt, Homo sapiens
gcgaugcugcuuuggaauu

SEQ ID NO: 1366877 - RNA, 19 nt, Homo sapiens
augaagaauuggaauguga

SEQ ID NO: 1366878 - RNA, 19 nt, Homo sapiens
gcuccuugaugagauacua

SEQ ID NO: 1366879 - RNA, 19 nt, Homo sapiens
ggaggaagaggaccuggau

SEQ ID NO: 1366880 - RNA, 19 nt, Homo sapiens
ggacagcgaggaggaggaa

SEQ ID NO: 1366881 - RNA, 19 nt, Homo sapiens
gaaaguggagaugaugaau

SEQ ID NO: 1366882 - RNA, 19 nt, Homo sapiens
ccaccaagcagaugcacuu

SEQ ID NO: 1366883 - RNA, 19 nt, Homo sapiens
cuuggaauaugaugaugaa

SEQ ID NO: 1366884 - RNA, 19 nt, Homo sapiens
aggaguagcuauccagauc

SEQ ID NO: 1366885 - RNA, 19 nt, Homo sapiens
gcagacuucuaugauuuua

SEQ ID NO: 1366886 - RNA, 19 nt, Homo sapiens
uggcucacaugaccaaaga

SEQ ID NO: 1366887 - RNA, 19 nt, Homo sapiens
ggaaugugaggauacugaa

SEQ ID NO: 1366888 - RNA, 19 nt, Homo sapiens
guccaugucucccaagaag

SEQ ID NO: 1366889 - RNA, 19 nt, Homo sapiens
ugaaagacagaucauagga

SEQ ID NO: 1366890 - RNA, 19 nt, Homo sapiens
caaaauggaugcugaagac

SEQ ID NO: 1366891 - RNA, 19 nt, Homo sapiens
uggcgaugcugcuuuggaa

SEQ ID NO: 1366892 - RNA, 19 nt, Homo sapiens
uaaauacuugggagagaaa

SEQ ID NO: 1366893 - RNA, 19 nt, Homo sapiens
gggacugauuaaauacuug

SEQ ID NO: 1366894 - RNA, 19 nt, Homo sapiens
ugaccaaagaccacaguuu

SEQ ID NO: 1366895 - RNA, 19 nt, Homo sapiens
gauauugauucugaugaag

SEQ ID NO: 1366896 - RNA, 19 nt, Homo sapiens
gcgaagaaguuggcaaagc

SEQ ID NO: 1366897 - RNA, 19 nt, Homo sapiens
guggagaugaugaaugaaa

SEQ ID NO: 1366898 - RNA, 19 nt, Homo sapiens
gcccugaggaccagugaaa

SEQ ID NO: 1366899 - RNA, 19 nt, Homo sapiens
cugagagucugcugggauu

SEQ ID NO: 1366900 - RNA, 19 nt, Homo sapiens
gaagcuguacaggcacaua

SEQ ID NO: 1366901 - RNA, 19 nt, Homo sapiens
ggaagaggaccuggaugga

SEQ ID NO: 1366902 - RNA, 19 nt, Homo sapiens
gaccgagacccgagugaga

SEQ ID NO: 1366903 - RNA, 19 nt, Homo sapiens
agacagaucauaggagaga

SEQ ID NO: 1366904 - RNA, 19 nt, Homo sapiens
gagcgagacaugcaguaug

SEQ ID NO: 1366905 - RNA, 19 nt, Homo sapiens
aggcacauaugaaugacaa

SEQ ID NO: 1366906 - RNA, 19 nt, Homo sapiens
guuaaggucugagggucuu

SEQ ID NO: 1366907 - RNA, 19 nt, Homo sapiens
gagagucugcugggauuga

SEQ ID NO: 1366908 - RNA, 19 nt, Homo sapiens
uacaggcacauaugaauga

SEQ ID NO: 1366909 - RNA, 19 nt, Homo sapiens
gcuguacaggcacauauga

SEQ ID NO: 1366910 - RNA, 19 nt, Homo sapiens
cugaagcaauggacgaugu

SEQ ID NO: 1366911 - RNA, 19 nt, Homo sapiens
cguucugaccuaauaauaa

SEQ ID NO: 1366912 - RNA, 19 nt, Homo sapiens
gagagcgagacaugcagua

SEQ ID NO: 1366913 - RNA, 19 nt, Homo sapiens
guagcuauccagaucacaa

SEQ ID NO: 1366914 - RNA, 19 nt, Homo sapiens
agauggcgaugcugcuuug

SEQ ID NO: 1366915 - RNA, 19 nt, Homo sapiens
gagacgauugggaagauau

SEQ ID NO: 1366916 - RNA, 19 nt, Homo sapiens
cuucauucguucugaccua

SEQ ID NO: 1366917 - RNA, 19 nt, Homo sapiens
guccaaaggaugaaaucaa

SEQ ID NO: 1366918 - RNA, 19 nt, Homo sapiens
cuuggucgguucuuauuuc

SEQ ID NO: 1366919 - RNA, 19 nt, Homo sapiens
cuauccagaucacaaggaa

SEQ ID NO: 1366920 - RNA, 19 nt, Homo sapiens
caguauguccaaaggauga

SEQ ID NO: 1366921 - RNA, 19 nt, Homo sapiens
gauacuacaaacagcgauu

SEQ ID NO: 1366922 - RNA, 19 nt, Homo sapiens
gaugaugaaaccauggaau

SEQ ID NO: 1366923 - RNA, 19 nt, Homo sapiens
gaugcugcuuuggaauuug

SEQ ID NO: 1366924 - RNA, 19 nt, Homo sapiens
acguacaccugcauaacuu

SEQ ID NO: 1366925 - RNA, 19 nt, Homo sapiens
gcuacuucauucguucuga

SEQ ID NO: 1366926 - RNA, 19 nt, Homo sapiens
ugaagaacaaugccaccaa

SEQ ID NO: 1366927 - RNA, 19 nt, Homo sapiens
ugaugaaaccauggaauug

SEQ ID NO: 1366928 - RNA, 19 nt, Homo sapiens
uuugcagacuucuaugauu

SEQ ID NO: 1366929 - RNA, 19 nt, Homo sapiens
gaacaguauucguuacaua

SEQ ID NO: 1366930 - RNA, 19 nt, Homo sapiens
acacacagcugucugauuu

SEQ ID NO: 1366931 - RNA, 19 nt, Homo sapiens
acgaauggcuguauuaaua

SEQ ID NO: 1366932 - RNA, 19 nt, Homo sapiens
guaauugacuggaugaaau

SEQ ID NO: 1366933 - RNA, 19 nt, Homo sapiens
ccauguauguggugaauuu

SEQ ID NO: 1366934 - RNA, 19 nt, Homo sapiens
gaccagagauuaacacaca

SEQ ID NO: 1366935 - RNA, 19 nt, Homo sapiens
cgaggaaacucaacagugu

SEQ ID NO: 1366936 - RNA, 19 nt, Homo sapiens
gaucuuaucuagccuuugg

SEQ ID NO: 1366937 - RNA, 19 nt, Homo sapiens
caauugaaguugcuaugaa

SEQ ID NO: 1366938 - RNA, 19 nt, Homo sapiens
gaauacgcauacuuuagaa

SEQ ID NO: 1366939 - RNA, 19 nt, Homo sapiens
acaaagagauugccauuac

SEQ ID NO: 1366940 - RNA, 19 nt, Homo sapiens
cuugaugacucuaagaaua

SEQ ID NO: 1366941 - RNA, 19 nt, Homo sapiens
caaaccaaacugacaauaa

SEQ ID NO: 1366942 - RNA, 19 nt, Homo sapiens
ggaauuaggaacaaaguau

SEQ ID NO: 1366943 - RNA, 19 nt, Homo sapiens
gauaugaacaguauucguu

SEQ ID NO: 1366944 - RNA, 19 nt, Homo sapiens
gcucaaacuucauaauaca

SEQ ID NO: 1366945 - RNA, 19 nt, Homo sapiens
gaauaucgcccgaauagca

SEQ ID NO: 1366946 - RNA, 19 nt, Homo sapiens
gucaauacuuucuaccaua

SEQ ID NO: 1366947 - RNA, 19 nt, Homo sapiens
ggaccaugcuuugaaauag

SEQ ID NO: 1366948 - RNA, 19 nt, Homo sapiens
cauaagggcuguagcucaa

SEQ ID NO: 1366949 - RNA, 19 nt, Homo sapiens
gagggaccaugcuuugaaa

SEQ ID NO: 1366950 - RNA, 19 nt, Homo sapiens
gaaggaaacccaccugagu

SEQ ID NO: 1366951 - RNA, 19 nt, Homo sapiens
ugaagccacuugugaagaa

SEQ ID NO: 1366952 - RNA, 19 nt, Homo sapiens
gcuugaaacuagaggagua

SEQ ID NO: 1366953 - RNA, 19 nt, Homo sapiens
gaauggcuguauuaauaga

SEQ ID NO: 1366954 - RNA, 19 nt, Homo sapiens
cuagugaaguuagucaaua

SEQ ID NO: 1366955 - RNA, 19 nt, Homo sapiens
ggauuugguuguuugauuc

SEQ ID NO: 1366956 - RNA, 19 nt, Homo sapiens
gauuauaggguuugguuaa

SEQ ID NO: 1366957 - RNA, 19 nt, Homo sapiens
agaaauagaagacacguuu

SEQ ID NO: 1366958 - RNA, 19 nt, Homo sapiens
cuuauuggcuguucuguug

SEQ ID NO: 1366959 - RNA, 19 nt, Homo sapiens
ugauagagauagauacaug

SEQ ID NO: 1366960 - RNA, 19 nt, Homo sapiens
acagaugguucuugggaua

SEQ ID NO: 1366961 - RNA, 19 nt, Homo sapiens
caccugaguuuguacauga

SEQ ID NO: 1366962 - RNA, 19 nt, Homo sapiens
gaccaugcuuugaaauaga

SEQ ID NO: 1366963 - RNA, 19 nt, Homo sapiens
cagaaaugauuggaaggua

SEQ ID NO: 1366964 - RNA, 19 nt, Homo sapiens
ggaagaauuaugauggauu

SEQ ID NO: 1366965 - RNA, 19 nt, Homo sapiens
gaaaugauuggaagguaga

SEQ ID NO: 1366966 - RNA, 19 nt, Homo sapiens
uaguaacaguuccugcuua

SEQ ID NO: 1366967 - RNA, 19 nt, Homo sapiens
gaguguguccucuuccuua

SEQ ID NO: 1366968 - RNA, 19 nt, Homo sapiens
caggacagcuaaugagugu

SEQ ID NO: 1366969 - RNA, 19 nt, Homo sapiens
caacucagcaggcucaaau

SEQ ID NO: 1366970 - RNA, 19 nt, Homo sapiens
gcuuugaaauagacugaaa

SEQ ID NO: 1366971 - RNA, 19 nt, Homo sapiens
gaaacucaacaguguaaau

SEQ ID NO: 1366972 - RNA, 19 nt, Homo sapiens
uaacaguuccugcuuacaa

SEQ ID NO: 1366973 - RNA, 19 nt, Homo sapiens
gaguaaaggauguucuaaa

SEQ ID NO: 1366974 - RNA, 19 nt, Homo sapiens
aggaagaacucagagcuaa

SEQ ID NO: 1366975 - RNA, 19 nt, Homo sapiens
gggaccaugcuuugaaaua

SEQ ID NO: 1366976 - RNA, 19 nt, Homo sapiens
caguauucguuacauagua

SEQ ID NO: 1366977 - RNA, 19 nt, Homo sapiens
gaaggcauacugaauucuu

SEQ ID NO: 1366978 - RNA, 19 nt, Homo sapiens
ggauaugaguaaguucuug

SEQ ID NO: 1366979 - RNA, 19 nt, Homo sapiens
uauguaagaccagagauua

SEQ ID NO: 1366980 - RNA, 19 nt, Homo sapiens
ugaauacgcauacuuuaga

SEQ ID NO: 1366981 - RNA, 19 nt, Homo sapiens
uaagguacuugguauacau

SEQ ID NO: 1366982 - RNA, 19 nt, Homo sapiens
acucaacaguguaaauuug

SEQ ID NO: 1366983 - RNA, 19 nt, Homo sapiens
ggacagcuaaugagugugu

SEQ ID NO: 1366984 - RNA, 19 nt, Homo sapiens
cuaagaauaucgcccgaau

SEQ ID NO: 1366985 - RNA, 19 nt, Homo sapiens
ggaagucauauggaaauuu

SEQ ID NO: 1366986 - RNA, 19 nt, Homo sapiens
guaaaggauguucuaaaga

SEQ ID NO: 1366987 - RNA, 19 nt, Homo sapiens
ggcuguagcucaaacuuca

SEQ ID NO: 1366988 - RNA, 19 nt, Homo sapiens
gcuguucuguugaauguca

SEQ ID NO: 1366989 - RNA, 19 nt, Homo sapiens
gaaaguaacaacaguuuug

SEQ ID NO: 1366990 - RNA, 19 nt, Homo sapiens
ucaauauucggaagucaua

SEQ ID NO: 1366991 - RNA, 19 nt, Homo sapiens
aguaaaggauguucuaaag

SEQ ID NO: 1366992 - RNA, 19 nt, Homo sapiens
gaucauuccaauugaaguu

SEQ ID NO: 1366993 - RNA, 19 nt, Homo sapiens
ggugugaacuccgaaucaa

SEQ ID NO: 1366994 - RNA, 19 nt, Homo sapiens
cauacugaauucuuuguca

SEQ ID NO: 1366995 - RNA, 19 nt, Homo sapiens
gaaucucauugaauuaguc

SEQ ID NO: 1366996 - RNA, 19 nt, Homo sapiens
ugacaguuauuaugacuac

SEQ ID NO: 1366997 - RNA, 19 nt, Homo sapiens
uggauuugguuguuugauu

SEQ ID NO: 1366998 - RNA, 19 nt, Homo sapiens
uuaucuagccuuuggauuu

SEQ ID NO: 1366999 - RNA, 19 nt, Homo sapiens
uaggaaggcauacugaauu

SEQ ID NO: 1367000 - RNA, 19 nt, Homo sapiens
ucagugacccgguuuacaa

SEQ ID NO: 1367001 - RNA, 19 nt, Homo sapiens
gauaugaguaaguucuuga

SEQ ID NO: 1367002 - RNA, 19 nt, Homo sapiens
guucuugggauaugaguaa

SEQ ID NO: 1367003 - RNA, 19 nt, Homo sapiens
aaacuucauuggccacuag

SEQ ID NO: 1367004 - RNA, 19 nt, Homo sapiens
guaagguacuugguauaca

SEQ ID NO: 1367005 - RNA, 19 nt, Homo sapiens
gauuggaagguagaucuua

SEQ ID NO: 1367006 - RNA, 19 nt, Homo sapiens
augaagagguagcagauga

SEQ ID NO: 1367007 - RNA, 19 nt, Homo sapiens
uaaugaguguguccucuuc

SEQ ID NO: 1367008 - RNA, 19 nt, Homo sapiens
ugaaggaauuaggaacaaa

SEQ ID NO: 1367009 - RNA, 19 nt, Homo sapiens
gaacgcgagcccgguaauu

SEQ ID NO: 1367010 - RNA, 19 nt, Homo sapiens
ggaguaaaggauguucuaa

SEQ ID NO: 1367011 - RNA, 19 nt, Homo sapiens
gcuaagcuuucagaauuca

SEQ ID NO: 1367012 - RNA, 19 nt, Homo sapiens
gaagaaaguacuaaaagga

SEQ ID NO: 1367013 - RNA, 19 nt, Homo sapiens
uaucuagccuuuggauuuc

SEQ ID NO: 1367014 - RNA, 19 nt, Homo sapiens
guaggaaggcauacugaau

SEQ ID NO: 1367015 - RNA, 19 nt, Homo sapiens
aagaauaucgcccgaauag

SEQ ID NO: 1367016 - RNA, 19 nt, Homo sapiens
uaagaauaucgcccgaaua

SEQ ID NO: 1367017 - RNA, 19 nt, Homo sapiens
gaaggaauuaggaacaaag

SEQ ID NO: 1367018 - RNA, 19 nt, Homo sapiens
uggaugaaauugaaggaau

SEQ ID NO: 1367019 - RNA, 19 nt, Homo sapiens
gaggaaacucaacagugua

SEQ ID NO: 1367020 - RNA, 19 nt, Homo sapiens
agaagcugaugcugaaaga

SEQ ID NO: 1367021 - RNA, 19 nt, Homo sapiens
gaaacuagaggaguaaagg

SEQ ID NO: 1367022 - RNA, 19 nt, Homo sapiens
uaucguaagugagguuaau

SEQ ID NO: 1367023 - RNA, 19 nt, Homo sapiens
aauuaagggucaccaccua

SEQ ID NO: 1367024 - RNA, 19 nt, Homo sapiens
gaucaauauucggaaguca

SEQ ID NO: 1367025 - RNA, 19 nt, Homo sapiens
uagaaugaguaaggaagaa

SEQ ID NO: 1367026 - RNA, 19 nt, Homo sapiens
guaagugagguuaauaaag

SEQ ID NO: 1367027 - RNA, 19 nt, Homo sapiens
ggauuauaggguuugguua

SEQ ID NO: 1367028 - RNA, 19 nt, Homo sapiens
caacucauaauuggaagaa

SEQ ID NO: 1367029 - RNA, 19 nt, Homo sapiens
ugaagcagcuggccgaaga

SEQ ID NO: 1367030 - RNA, 19 nt, Homo sapiens
cuaagcaguucgcgcguua

SEQ ID NO: 1367031 - RNA, 19 nt, Homo sapiens
ccgaagaacgcgaauggua

SEQ ID NO: 1367032 - RNA, 19 nt, Homo sapiens
gccaagaugccacagauga

SEQ ID NO: 1367033 - RNA, 19 nt, Homo sapiens
cuuugucccuucccaauaa

SEQ ID NO: 1367034 - RNA, 19 nt, Homo sapiens
caagaugccacagaugauu

SEQ ID NO: 1367035 - RNA, 19 nt, Homo sapiens
uccaggaccuagagaagaa

SEQ ID NO: 1367036 - RNA, 19 nt, Homo sapiens
cagagugcauggccaagau

SEQ ID NO: 1367037 - RNA, 19 nt, Homo sapiens
ggagcuggaggccgaagaa

SEQ ID NO: 1367038 - RNA, 19 nt, Homo sapiens
gcuuugucccuucccaaua

SEQ ID NO: 1367039 - RNA, 19 nt, Homo sapiens
gcagagugcauggccaaga

SEQ ID NO: 1367040 - RNA, 19 nt, Homo sapiens
cugcagcuguggcucaaga

SEQ ID NO: 1367041 - RNA, 19 nt, Homo sapiens
gcuacgcggcuaagcaguu

SEQ ID NO: 1367042 - RNA, 19 nt, Homo sapiens
cuacgcggcuaagcaguuc

SEQ ID NO: 1367043 - RNA, 19 nt, Homo sapiens
ccaagaugccacagaugau

SEQ ID NO: 1367044 - RNA, 19 nt, Homo sapiens
ggagagggagcagcacauc

SEQ ID NO: 1367045 - RNA, 19 nt, Homo sapiens
gagcagcacaucgcagagu

SEQ ID NO: 1367046 - RNA, 19 nt, Homo sapiens
ggccgaagaacgcgaaugg

SEQ ID NO: 1367047 - RNA, 19 nt, Homo sapiens
aacagaaacggaagaagga

SEQ ID NO: 1367048 - RNA, 19 nt, Homo sapiens
gagaaggcccaggcugaca

SEQ ID NO: 1367049 - RNA, 19 nt, Homo sapiens
ggaaugagcuccauagauu

SEQ ID NO: 1367050 - RNA, 19 nt, Homo sapiens
gaaaucccaucauaccuua

SEQ ID NO: 1367051 - RNA, 19 nt, Homo sapiens
gaaaugaacuuaccaucug

SEQ ID NO: 1367052 - RNA, 19 nt, Homo sapiens
gaagguuucucauacuuaa

SEQ ID NO: 1367053 - RNA, 19 nt, Homo sapiens
uugaauggcugaucuaaua

SEQ ID NO: 1367054 - RNA, 19 nt, Homo sapiens
acaaauaugugaggacuua

SEQ ID NO: 1367055 - RNA, 19 nt, Homo sapiens
gaagauaugguauguuuga

SEQ ID NO: 1367056 - RNA, 19 nt, Homo sapiens
agacagagcuuguuaacug

SEQ ID NO: 1367057 - RNA, 19 nt, Homo sapiens
agacaaaucugacugaaau

SEQ ID NO: 1367058 - RNA, 19 nt, Homo sapiens
caacagaugcagaagaaua

SEQ ID NO: 1367059 - RNA, 19 nt, Homo sapiens
cgaaauagcaugccugaaa

SEQ ID NO: 1367060 - RNA, 19 nt, Homo sapiens
gaauagggcuggugaaagg

SEQ ID NO: 1367061 - RNA, 19 nt, Homo sapiens
gaacuuguuuccugcuauu

SEQ ID NO: 1367062 - RNA, 19 nt, Homo sapiens
gcagaaaacuguacaaaug

SEQ ID NO: 1367063 - RNA, 19 nt, Homo sapiens
gauaagacagagcuuguua

SEQ ID NO: 1367064 - RNA, 19 nt, Homo sapiens
ccauagaguuuguaucauu

SEQ ID NO: 1367065 - RNA, 19 nt, Homo sapiens
gaaagaagaaagacaaauc

SEQ ID NO: 1367066 - RNA, 19 nt, Homo sapiens
uaaagcagccauagaguuu

SEQ ID NO: 1367067 - RNA, 19 nt, Homo sapiens
cugaagauaugguauguuu

SEQ ID NO: 1367068 - RNA, 19 nt, Homo sapiens
aacaagaaaucccaucaua

SEQ ID NO: 1367069 - RNA, 19 nt, Homo sapiens
gcaguaugauuuaagguau

SEQ ID NO: 1367070 - RNA, 19 nt, Homo sapiens
ucacaccuauucugucuuu

SEQ ID NO: 1367071 - RNA, 19 nt, Homo sapiens
gugcaucagugguuuauau

SEQ ID NO: 1367072 - RNA, 19 nt, Homo sapiens
gaaagacaaaucugacuga

SEQ ID NO: 1367073 - RNA, 19 nt, Homo sapiens
ucagggauuugaauuguuu

SEQ ID NO: 1367074 - RNA, 19 nt, Homo sapiens
ggaaagagucuggaaguga

SEQ ID NO: 1367075 - RNA, 19 nt, Homo sapiens
gaaugagcuccauagauua

SEQ ID NO: 1367076 - RNA, 19 nt, Homo sapiens
guucaugcuucaucauuaa

SEQ ID NO: 1367077 - RNA, 19 nt, Homo sapiens
gguucaugcuucaucauua

SEQ ID NO: 1367078 - RNA, 19 nt, Homo sapiens
gaaauagcaugccugaaaa

SEQ ID NO: 1367079 - RNA, 19 nt, Homo sapiens
gauuguugcuucauugcua

SEQ ID NO: 1367080 - RNA, 19 nt, Homo sapiens
aagcaaaucuacaaagguu

SEQ ID NO: 1367081 - RNA, 19 nt, Homo sapiens
gguuguaacugaagauaug

SEQ ID NO: 1367082 - RNA, 19 nt, Homo sapiens
aaacuuaugugacccacuu

SEQ ID NO: 1367083 - RNA, 19 nt, Homo sapiens
gcuguguacuugagucuuu

SEQ ID NO: 1367084 - RNA, 19 nt, Homo sapiens
ggaaauuugucuccauucu

SEQ ID NO: 1367085 - RNA, 19 nt, Homo sapiens
ggaagaguuucauauuaag

SEQ ID NO: 1367086 - RNA, 19 nt, Homo sapiens
ggaaucaacagaugcagaa

SEQ ID NO: 1367087 - RNA, 19 nt, Homo sapiens
auacuuaaguuccagguuu

SEQ ID NO: 1367088 - RNA, 19 nt, Homo sapiens
cuucuaaacugcuguguug

SEQ ID NO: 1367089 - RNA, 19 nt, Homo sapiens
gcuaaauuauggacuacaa

SEQ ID NO: 1367090 - RNA, 19 nt, Homo sapiens
aaagugcccuuaacaggaa

SEQ ID NO: 1367091 - RNA, 19 nt, Homo sapiens
uuagugaaaugucagauga

SEQ ID NO: 1367092 - RNA, 19 nt, Homo sapiens
uuauagagguucuuguuga

SEQ ID NO: 1367093 - RNA, 19 nt, Homo sapiens
ggugauaccuugcaguaag

SEQ ID NO: 1367094 - RNA, 19 nt, Homo sapiens
aaacaggacuaguucaagu

SEQ ID NO: 1367095 - RNA, 19 nt, Homo sapiens
guaagcaaaucuacaaagg

SEQ ID NO: 1367096 - RNA, 19 nt, Homo sapiens
gcaauuguaagcaaaucua

SEQ ID NO: 1367097 - RNA, 19 nt, Homo sapiens
gaaacagaccauucuaaca

SEQ ID NO: 1367098 - RNA, 19 nt, Homo sapiens
cuaauacccugaauaugug

SEQ ID NO: 1367099 - RNA, 19 nt, Homo sapiens
uguauaaugugccagguaa

SEQ ID NO: 1367100 - RNA, 19 nt, Homo sapiens
cuauaagucuuucaguuug

SEQ ID NO: 1367101 - RNA, 19 nt, Homo sapiens
gcacaaugaggauaaacuu

SEQ ID NO: 1367102 - RNA, 19 nt, Homo sapiens
ucaagaaacuaagguuguu

SEQ ID NO: 1367103 - RNA, 19 nt, Homo sapiens
uagaaagacuagcaguuug

SEQ ID NO: 1367104 - RNA, 19 nt, Homo sapiens
gagaacuuguuuccugcua

SEQ ID NO: 1367105 - RNA, 19 nt, Homo sapiens
gaaaagucauuaaggaguu

SEQ ID NO: 1367106 - RNA, 19 nt, Homo sapiens
guaaacaaagugcccuuaa

SEQ ID NO: 1367107 - RNA, 19 nt, Homo sapiens
ggucaaaugucauaaucag

SEQ ID NO: 1367108 - RNA, 19 nt, Homo sapiens
aacaggagaucaugaauca

SEQ ID NO: 1367109 - RNA, 19 nt, Homo sapiens
ucuaauacccugaauaugu

SEQ ID NO: 1367110 - RNA, 19 nt, Homo sapiens
gaucuucacaguuccauau

SEQ ID NO: 1367111 - RNA, 19 nt, Homo sapiens
aaacugcuguguugaaagu

SEQ ID NO: 1367112 - RNA, 19 nt, Homo sapiens
uaacaggaaagaagaaaga

SEQ ID NO: 1367113 - RNA, 19 nt, Homo sapiens
guaaguaagucgaaauagc

SEQ ID NO: 1367114 - RNA, 19 nt, Homo sapiens
caauuggcauauauacuug

SEQ ID NO: 1367115 - RNA, 19 nt, Homo sapiens
ugauuuagcuggaauucau

SEQ ID NO: 1367116 - RNA, 19 nt, Homo sapiens
acaaccaagucaacuguuu

SEQ ID NO: 1367117 - RNA, 19 nt, Homo sapiens
aaagccaccugguacguuu

SEQ ID NO: 1367118 - RNA, 19 nt, Homo sapiens
cagcagcaauuguaagcaa

SEQ ID NO: 1367119 - RNA, 19 nt, Homo sapiens
caauuucagucagggauuu

SEQ ID NO: 1367120 - RNA, 19 nt, Homo sapiens
gaucaugaaucagacagau

SEQ ID NO: 1367121 - RNA, 19 nt, Homo sapiens
cuucacaguuccauaugua

SEQ ID NO: 1367122 - RNA, 19 nt, Homo sapiens
uggcugaucuaauaauguu

SEQ ID NO: 1367123 - RNA, 19 nt, Homo sapiens
ggaggcaucuguuauucag

SEQ ID NO: 1367124 - RNA, 19 nt, Homo sapiens
gaaacuaagguuguuguau

SEQ ID NO: 1367125 - RNA, 19 nt, Homo sapiens
aauaugugcuguucuuaga

SEQ ID NO: 1367126 - RNA, 19 nt, Homo sapiens
uuacauaagccguaccuuu

SEQ ID NO: 1367127 - RNA, 19 nt, Homo sapiens
cuaaacugcuguguugaaa

SEQ ID NO: 1367128 - RNA, 19 nt, Homo sapiens
uuauucagcuuauccuuug

SEQ ID NO: 1367129 - RNA, 19 nt, Homo sapiens
uauagagguucuuguugaa

SEQ ID NO: 1367130 - RNA, 19 nt, Homo sapiens
auaaauaccagcagcaauu

SEQ ID NO: 1367131 - RNA, 19 nt, Homo sapiens
ucucguuccuucuuaauau

SEQ ID NO: 1367132 - RNA, 19 nt, Homo sapiens
ccuaauaguuucagauguc

SEQ ID NO: 1367133 - RNA, 19 nt, Homo sapiens
ucaugaaucagacagauaa

SEQ ID NO: 1367134 - RNA, 19 nt, Homo sapiens
guucaagucaagaaacuaa

SEQ ID NO: 1367135 - RNA, 19 nt, Homo sapiens
uuagaaagacuagcaguuu

SEQ ID NO: 1367136 - RNA, 19 nt, Homo sapiens
gaauaugugcuguucuuag

SEQ ID NO: 1367137 - RNA, 19 nt, Homo sapiens
ucacaguuccauauguaua

SEQ ID NO: 1367138 - RNA, 19 nt, Homo sapiens
ugacuggcuuucaucuaaa

SEQ ID NO: 1367139 - RNA, 19 nt, Homo sapiens
aaacaaagugcccuuaaca

SEQ ID NO: 1367140 - RNA, 19 nt, Homo sapiens
cuagcaguuugaccuguua

SEQ ID NO: 1367141 - RNA, 19 nt, Homo sapiens
gaauuucucaguauagaca

SEQ ID NO: 1367142 - RNA, 19 nt, Homo sapiens
cuucauugcuaguuuguau

SEQ ID NO: 1367143 - RNA, 19 nt, Homo sapiens
caaaugucauaaucagcaa

SEQ ID NO: 1367144 - RNA, 19 nt, Homo sapiens
uaacucaccugccccuuaa

SEQ ID NO: 1367145 - RNA, 19 nt, Homo sapiens
cacaguauaugaagguuuc

SEQ ID NO: 1367146 - RNA, 19 nt, Homo sapiens
uaaacaaagugcccuuaac

SEQ ID NO: 1367147 - RNA, 19 nt, Homo sapiens
cauuaugcauucuguacuu

SEQ ID NO: 1367148 - RNA, 19 nt, Homo sapiens
ccacuugaauggcugaucu

SEQ ID NO: 1367149 - RNA, 19 nt, Homo sapiens
ggaauaagauccagcaaau

SEQ ID NO: 1367150 - RNA, 19 nt, Homo sapiens
gaacuugacuuucccugaa

SEQ ID NO: 1367151 - RNA, 19 nt, Homo sapiens
ucacaucaauuuacuguug

SEQ ID NO: 1367152 - RNA, 19 nt, Homo sapiens
cugaagcccuuaucacuaa

SEQ ID NO: 1367153 - RNA, 19 nt, Homo sapiens
cauugaagcuggaugaguu

SEQ ID NO: 1367154 - RNA, 19 nt, Homo sapiens
ucaauuuacuguugucuuc

SEQ ID NO: 1367155 - RNA, 19 nt, Homo sapiens
caaccuuucucuacuagug

SEQ ID NO: 1367156 - RNA, 19 nt, Homo sapiens
aauaagauccagcaaauug

SEQ ID NO: 1367157 - RNA, 19 nt, Homo sapiens
aagaaaccaugcagucuga

SEQ ID NO: 1367158 - RNA, 19 nt, Homo sapiens
uagaaggccuccagaaucu

SEQ ID NO: 1367159 - RNA, 19 nt, Homo sapiens
caagagaagcaagaaauga

SEQ ID NO: 1367160 - RNA, 19 nt, Homo sapiens
gaaagcuccaggaaacaaa

SEQ ID NO: 1367161 - RNA, 19 nt, Homo sapiens
gaaaugauucucugucaac

SEQ ID NO: 1367162 - RNA, 19 nt, Homo sapiens
gaaaccaugcagucugauu

SEQ ID NO: 1367163 - RNA, 19 nt, Homo sapiens
gaauaagauccagcaaauu

SEQ ID NO: 1367164 - RNA, 19 nt, Homo sapiens
ccagcagccuuuuauuuua

SEQ ID NO: 1367165 - RNA, 19 nt, Homo sapiens
gggaauaagauccagcaaa

SEQ ID NO: 1367166 - RNA, 19 nt, Homo sapiens
ggaagaaaccagugaaagc

SEQ ID NO: 1367167 - RNA, 19 nt, Homo sapiens
ugucaaccuuucucuacua

SEQ ID NO: 1367168 - RNA, 19 nt, Homo sapiens
ucugagaaccugauagaaa

SEQ ID NO: 1367169 - RNA, 19 nt, Homo sapiens
ugagccaccugauucuaaa

SEQ ID NO: 1367170 - RNA, 19 nt, Homo sapiens
gaaccugauagaaacauug

SEQ ID NO: 1367171 - RNA, 19 nt, Homo sapiens
gaagaaaccagugaaagcu

SEQ ID NO: 1367172 - RNA, 19 nt, Homo sapiens
aaacauugaagcuggauga

SEQ ID NO: 1367173 - RNA, 19 nt, Homo sapiens
gccaagagaagcaagaaau

SEQ ID NO: 1367174 - RNA, 19 nt, Homo sapiens
ggauuacuacuaucaggaa

SEQ ID NO: 1367175 - RNA, 19 nt, Homo sapiens
uugaugaacugcagacugu

SEQ ID NO: 1367176 - RNA, 19 nt, Homo sapiens
ccucagaccagcagccuuu

SEQ ID NO: 1367177 - RNA, 19 nt, Homo sapiens
gugagccaccugauucuaa

SEQ ID NO: 1367178 - RNA, 19 nt, Homo sapiens
agugaaagcuccaggaaac

SEQ ID NO: 1367179 - RNA, 19 nt, Homo sapiens
gagaagcaagaaaugauuc

SEQ ID NO: 1367180 - RNA, 19 nt, Homo sapiens
ccaagagaagcaagaaaug

SEQ ID NO: 1367181 - RNA, 19 nt, Homo sapiens
gacagaagcccugccacuu

SEQ ID NO: 1367182 - RNA, 19 nt, Homo sapiens
gggaggggauuacuacuau

SEQ ID NO: 1367183 - RNA, 19 nt, Homo sapiens
cugagaaccugauagaaac

SEQ ID NO: 1367184 - RNA, 19 nt, Homo sapiens
ugucagagaagauguuuca

SEQ ID NO: 1367185 - RNA, 19 nt, Homo sapiens
ucuccuaagucucugaguu

SEQ ID NO: 1367186 - RNA, 19 nt, Homo sapiens
ccagacccuucacaucaau

SEQ ID NO: 1367187 - RNA, 19 nt, Homo sapiens
uccagaaucuucacagucu

SEQ ID NO: 1367188 - RNA, 19 nt, Homo sapiens
uuagaaggccuccagaauc

SEQ ID NO: 1367189 - RNA, 19 nt, Homo sapiens
uuacuacuaucaggaacuu

SEQ ID NO: 1367190 - RNA, 19 nt, Homo sapiens
cuaagcggaacuugacuuu

SEQ ID NO: 1367191 - RNA, 19 nt, Homo sapiens
gaccagcagccuuuuauuu

SEQ ID NO: 1367192 - RNA, 19 nt, Homo sapiens
aaacuacggccaagagaag

SEQ ID NO: 1367193 - RNA, 19 nt, Homo sapiens
caaaucaggcagguggaaa

SEQ ID NO: 1367194 - RNA, 19 nt, Homo sapiens
agagaagcaagaaaugauu

SEQ ID NO: 1367195 - RNA, 19 nt, Homo sapiens
gaacugucagagaagaugu

SEQ ID NO: 1367196 - RNA, 19 nt, Homo sapiens
ggaacugucagagaagaug

SEQ ID NO: 1367197 - RNA, 19 nt, Homo sapiens
ccagugaaagcuccaggaa

SEQ ID NO: 1367198 - RNA, 19 nt, Homo sapiens
gacccuucacaucaauuua

SEQ ID NO: 1367199 - RNA, 19 nt, Homo sapiens
gauucucugucaaccuuuc

SEQ ID NO: 1367200 - RNA, 19 nt, Homo sapiens
ucagagaagauguuucaca

SEQ ID NO: 1367201 - RNA, 19 nt, Homo sapiens
ugaaagcuccaggaaacaa

SEQ ID NO: 1367202 - RNA, 19 nt, Homo sapiens
gggaagaaaccagugaaag

SEQ ID NO: 1367203 - RNA, 19 nt, Homo sapiens
gcaacagacggcccugaca

SEQ ID NO: 1367204 - RNA, 19 nt, Homo sapiens
ucacuaagcggaacuugac

SEQ ID NO: 1367205 - RNA, 19 nt, Homo sapiens
gcaauuuucucugaaucaa

SEQ ID NO: 1367206 - RNA, 19 nt, Homo sapiens
ccugaguucugccauccuu

SEQ ID NO: 1367207 - RNA, 19 nt, Homo sapiens
cacaucaauuuacuguugu

SEQ ID NO: 1367208 - RNA, 19 nt, Homo sapiens
uccagacccuucacaucaa

SEQ ID NO: 1367209 - RNA, 19 nt, Homo sapiens
gagcugaguggcccauucu

SEQ ID NO: 1367210 - RNA, 19 nt, Homo sapiens
agaaccugauagaaacauu

SEQ ID NO: 1367211 - RNA, 19 nt, Homo sapiens
uaucugcaagggaauaaga

SEQ ID NO: 1367212 - RNA, 19 nt, Homo sapiens
agaagauguuucacacucu

SEQ ID NO: 1367213 - RNA, 19 nt, Homo sapiens
augauucucugucaaccuu

SEQ ID NO: 1367214 - RNA, 19 nt, Homo sapiens
aaaccaugcagucugauuc

SEQ ID NO: 1367215 - RNA, 19 nt, Homo sapiens
cuccuaagucucugaguuu

SEQ ID NO: 1367216 - RNA, 19 nt, Homo sapiens
ucccaugccuccaguuucu

SEQ ID NO: 1367217 - RNA, 19 nt, Homo sapiens
cuaagucucugaguuucuc

SEQ ID NO: 1367218 - RNA, 19 nt, Homo sapiens
uugagaaccuggcuugcau

SEQ ID NO: 1367219 - RNA, 19 nt, Homo sapiens
acugaagcccuuaucacua

SEQ ID NO: 1367220 - RNA, 19 nt, Homo sapiens
cuccagacccuucacauca

SEQ ID NO: 1367221 - RNA, 19 nt, Homo sapiens
aagagaagcaagaaaugau

SEQ ID NO: 1367222 - RNA, 19 nt, Homo sapiens
cuuagaaggccuccagaau

SEQ ID NO: 1367223 - RNA, 19 nt, Homo sapiens
ccaagaaaccaugcagucu

SEQ ID NO: 1367224 - RNA, 19 nt, Homo sapiens
gugguggagcgcuggauuu

SEQ ID NO: 1367225 - RNA, 19 nt, Homo sapiens
ucacacucuugaugaacug

SEQ ID NO: 1367226 - RNA, 19 nt, Homo sapiens
gucaaccuuucucuacuag

SEQ ID NO: 1367227 - RNA, 19 nt, Homo sapiens
ccuccucucccaccaagaa

SEQ ID NO: 1367228 - RNA, 19 nt, Homo sapiens
ccaaaucaggcagguggaa

SEQ ID NO: 1367229 - RNA, 19 nt, Homo sapiens
cagugaaagcuccaggaaa

SEQ ID NO: 1367230 - RNA, 19 nt, Homo sapiens
ggccaagagaagcaagaaa

SEQ ID NO: 1367231 - RNA, 19 nt, Homo sapiens
guucaaaccuuucaucuuc

SEQ ID NO: 1367232 - RNA, 19 nt, Homo sapiens
gcagggugccuuugacuuu

SEQ ID NO: 1367233 - RNA, 19 nt, Homo sapiens
caggaggccuugcauguga

SEQ ID NO: 1367234 - RNA, 19 nt, Homo sapiens
ggcagcagcuccagcagaa

SEQ ID NO: 1367235 - RNA, 19 nt, Homo sapiens
caaggagagugguaucugu

SEQ ID NO: 1367236 - RNA, 19 nt, Homo sapiens
gaagacgcacgcugugauu

SEQ ID NO: 1367237 - RNA, 19 nt, Homo sapiens
ggucuguguucaaaccuuu

SEQ ID NO: 1367238 - RNA, 19 nt, Homo sapiens
ggagagugguaucuguaug

SEQ ID NO: 1367239 - RNA, 19 nt, Homo sapiens
gcgccauucuccuaccaua

SEQ ID NO: 1367240 - RNA, 19 nt, Homo sapiens
ggaggaugcugcgccauuc

SEQ ID NO: 1367241 - RNA, 19 nt, Homo sapiens
ugacuuugcucagaucuuc

SEQ ID NO: 1367242 - RNA, 19 nt, Homo sapiens
gagcauggugucugcauug

SEQ ID NO: 1367243 - RNA, 19 nt, Homo sapiens
caucccggcugugaucuuu

SEQ ID NO: 1367244 - RNA, 19 nt, Homo sapiens
ccagugcaccuacauugaa

SEQ ID NO: 1367245 - RNA, 19 nt, Homo sapiens
caggguuacuggagcacua

SEQ ID NO: 1367246 - RNA, 19 nt, Homo sapiens
gugguaaaguggagcaauc

SEQ ID NO: 1367247 - RNA, 19 nt, Homo sapiens
ugcaggaggugguguuugu

SEQ ID NO: 1367248 - RNA, 19 nt, Homo sapiens
ccugaguggugguaaagug

SEQ ID NO: 1367249 - RNA, 19 nt, Homo sapiens
cagggugccuuugacuuug

SEQ ID NO: 1367250 - RNA, 19 nt, Homo sapiens
cgagcauggugucugcauu

SEQ ID NO: 1367251 - RNA, 19 nt, Homo sapiens
caccuacauugaaguggaa

SEQ ID NO: 1367252 - RNA, 19 nt, Homo sapiens
gagagugguaucuguaugg

SEQ ID NO: 1367253 - RNA, 19 nt, Homo sapiens
ggacaucucggcccaacac

SEQ ID NO: 1367254 - RNA, 19 nt, Homo sapiens
uggaacaggugucgaagac

SEQ ID NO: 1367255 - RNA, 19 nt, Homo sapiens
gagacaaggagagugguau

SEQ ID NO: 1367256 - RNA, 19 nt, Homo sapiens
cgaagacgcacgcugugau

SEQ ID NO: 1367257 - RNA, 19 nt, Homo sapiens
aaggagagugguaucugua

SEQ ID NO: 1367258 - RNA, 19 nt, Homo sapiens
gccuuugacuuugcucaga

SEQ ID NO: 1367259 - RNA, 19 nt, Homo sapiens
gcaaggagcugguggauaa

SEQ ID NO: 1367260 - RNA, 19 nt, Homo sapiens
ucaccaagcucaaguauua

SEQ ID NO: 1367261 - RNA, 19 nt, Homo sapiens
ggaaccagcugcgcaugua

SEQ ID NO: 1367262 - RNA, 19 nt, Homo sapiens
gaacaucgaccgcuucauc

SEQ ID NO: 1367263 - RNA, 19 nt, Homo sapiens
aggcagagcugugggauga

SEQ ID NO: 1367264 - RNA, 19 nt, Homo sapiens
gcagagcugugggaugaau

SEQ ID NO: 1367265 - RNA, 19 nt, Homo sapiens
gaaacaauaaacccugaug

SEQ ID NO: 1367266 - RNA, 19 nt, Homo sapiens
ucaaagccagugucucuaa

SEQ ID NO: 1367267 - RNA, 19 nt, Homo sapiens
caaagccagugucucuaau

SEQ ID NO: 1367268 - RNA, 19 nt, Homo sapiens
caauggcuuucaucaccua

SEQ ID NO: 1367269 - RNA, 19 nt, Homo sapiens
caucaaagccagugucucu

SEQ ID NO: 1367270 - RNA, 19 nt, Homo sapiens
acaaauaugucgggaugau

SEQ ID NO: 1367271 - RNA, 19 nt, Homo sapiens
ccauguaugugggcagaaa

SEQ ID NO: 1367272 - RNA, 19 nt, Homo sapiens
caguccaucugacaucaaa

SEQ ID NO: 1367273 - RNA, 19 nt, Homo sapiens
ucgggaagauuggcuacua

SEQ ID NO: 1367274 - RNA, 19 nt, Homo sapiens
aaauaugucgggaugauug

SEQ ID NO: 1367275 - RNA, 19 nt, Homo sapiens
gcguagccaucuuuguguu

SEQ ID NO: 1367276 - RNA, 19 nt, Homo sapiens
ccaaggugcugagagaucu

SEQ ID NO: 1367277 - RNA, 19 nt, Homo sapiens
guagccaucuuuguguuca

SEQ ID NO: 1367278 - RNA, 19 nt, Homo sapiens
cuucuugggcuacaaauau

SEQ ID NO: 1367279 - RNA, 19 nt, Homo sapiens
caaauaugucgggaugauu

SEQ ID NO: 1367280 - RNA, 19 nt, Homo sapiens
acaccgaccucaccaccau

SEQ ID NO: 1367281 - RNA, 19 nt, Homo sapiens
aacccaaggugcugagaga

SEQ ID NO: 1367282 - RNA, 19 nt, Homo sapiens
gccucuaucuggucacugu

SEQ ID NO: 1367283 - RNA, 19 nt, Homo sapiens
gggaagugcaguaccaaca

SEQ ID NO: 1367284 - RNA, 19 nt, Homo sapiens
ggacgcugcggcugaagau

SEQ ID NO: 1367285 - RNA, 19 nt, Homo sapiens
gcuuucaucaccuacguuu

SEQ ID NO: 1367286 - RNA, 19 nt, Homo sapiens
gaaagcugggccugcuguu

SEQ ID NO: 1367287 - RNA, 19 nt, Homo sapiens
cgcagccuaugcucaugua

SEQ ID NO: 1367288 - RNA, 19 nt, Homo sapiens
gccaguccaucugacauca

SEQ ID NO: 1367289 - RNA, 19 nt, Homo sapiens
gugcugcguagccaucuuu

SEQ ID NO: 1367290 - RNA, 19 nt, Homo sapiens
ggaagugcaguaccaacag

SEQ ID NO: 1367291 - RNA, 19 nt, Homo sapiens
caucaccaagcucaaguau

SEQ ID NO: 1367292 - RNA, 19 nt, Homo sapiens
gcugguggauaagaacauc

SEQ ID NO: 1367293 - RNA, 19 nt, Homo sapiens
ggcaaggagcugguggaua

SEQ ID NO: 1367294 - RNA, 19 nt, Homo sapiens
aagccagugucucuaaugg

SEQ ID NO: 1367295 - RNA, 19 nt, Homo sapiens
ccagcaauggcuuucauca

SEQ ID NO: 1367296 - RNA, 19 nt, Homo sapiens
gaaauugacuuguccuuca

SEQ ID NO: 1367297 - RNA, 19 nt, Homo sapiens
gcaaaucucuccucaccaa

SEQ ID NO: 1367298 - RNA, 19 nt, Homo sapiens
gaagaaucguggguaaaua

SEQ ID NO: 1367299 - RNA, 19 nt, Homo sapiens
guaaauaggucuaaaucca

SEQ ID NO: 1367300 - RNA, 19 nt, Homo sapiens
gcaauuauauagcaucaca

SEQ ID NO: 1367301 - RNA, 19 nt, Homo sapiens
gaacaugaagcucuugauu

SEQ ID NO: 1367302 - RNA, 19 nt, Homo sapiens
gaacccaacccuuucagua

SEQ ID NO: 1367303 - RNA, 19 nt, Homo sapiens
gcuaaccacuugcuagauu

SEQ ID NO: 1367304 - RNA, 19 nt, Homo sapiens
gaacagaaggcacuagaug

SEQ ID NO: 1367305 - RNA, 19 nt, Homo sapiens
ccucugaucuucacauuug

SEQ ID NO: 1367306 - RNA, 19 nt, Homo sapiens
gacuaagccuggaguaauu

SEQ ID NO: 1367307 - RNA, 19 nt, Homo sapiens
gcaaagugaccucuucaaa

SEQ ID NO: 1367308 - RNA, 19 nt, Homo sapiens
aaagaagaaucguggguaa

SEQ ID NO: 1367309 - RNA, 19 nt, Homo sapiens
ggaauucgaagcaaacaaa

SEQ ID NO: 1367310 - RNA, 19 nt, Homo sapiens
uaaauccaaugacuacuug

SEQ ID NO: 1367311 - RNA, 19 nt, Homo sapiens
gaaagggaauucgaagcaa

SEQ ID NO: 1367312 - RNA, 19 nt, Homo sapiens
ccacuguucuagccuuuaa

SEQ ID NO: 1367313 - RNA, 19 nt, Homo sapiens
cagaaugagugcucccuuu

SEQ ID NO: 1367314 - RNA, 19 nt, Homo sapiens
uagaagagauuuaccuaca

SEQ ID NO: 1367315 - RNA, 19 nt, Homo sapiens
ccacagacccucucacaug

SEQ ID NO: 1367316 - RNA, 19 nt, Homo sapiens
gcagcaaagugaccucuuc

SEQ ID NO: 1367317 - RNA, 19 nt, Homo sapiens
gcuaacagccagcauagaa

SEQ ID NO: 1367318 - RNA, 19 nt, Homo sapiens
gaagagcucugugcuacca

SEQ ID NO: 1367319 - RNA, 19 nt, Homo sapiens
gcacagcucaggcagcaaa

SEQ ID NO: 1367320 - RNA, 19 nt, Homo sapiens
gcagccaaauaaagaagaa

SEQ ID NO: 1367321 - RNA, 19 nt, Homo sapiens
ccucuaaauuccuuguuaa

SEQ ID NO: 1367322 - RNA, 19 nt, Homo sapiens
gagauuuaccuacagcuuu

SEQ ID NO: 1367323 - RNA, 19 nt, Homo sapiens
gaaaccaaauaugcaaauc

SEQ ID NO: 1367324 - RNA, 19 nt, Homo sapiens
gcagcaaucccuacaaaca

SEQ ID NO: 1367325 - RNA, 19 nt, Homo sapiens
ccaaagagcaaugaaguug

SEQ ID NO: 1367326 - RNA, 19 nt, Homo sapiens
aaagagcaaugaaguugga

SEQ ID NO: 1367327 - RNA, 19 nt, Homo sapiens
aagagcagcuggucgagaa

SEQ ID NO: 1367328 - RNA, 19 nt, Homo sapiens
aaagggaauucgaagcaaa

SEQ ID NO: 1367329 - RNA, 19 nt, Homo sapiens
ggacaacacauuagaacca

SEQ ID NO: 1367330 - RNA, 19 nt, Homo sapiens
aaagugaccucuucaaagc

SEQ ID NO: 1367331 - RNA, 19 nt, Homo sapiens
ucacagugcucugcuaaca

SEQ ID NO: 1367332 - RNA, 19 nt, Homo sapiens
caacuucuacaguaucuga

SEQ ID NO: 1367333 - RNA, 19 nt, Homo sapiens
ucaccaacuucuacaguau

SEQ ID NO: 1367334 - RNA, 19 nt, Homo sapiens
gaaccagccaagacugaaa

SEQ ID NO: 1367335 - RNA, 19 nt, Homo sapiens
caaagugaccucuucaaag

SEQ ID NO: 1367336 - RNA, 19 nt, Homo sapiens
ggaacgauuuuacaagaaa

SEQ ID NO: 1367337 - RNA, 19 nt, Homo sapiens
gaaugagugcucccuuuau

SEQ ID NO: 1367338 - RNA, 19 nt, Homo sapiens
ugacaccucuaaauuccuu

SEQ ID NO: 1367339 - RNA, 19 nt, Homo sapiens
agaaugagugcucccuuua

SEQ ID NO: 1367340 - RNA, 19 nt, Homo sapiens
caagcugagucauccaaug

SEQ ID NO: 1367341 - RNA, 19 nt, Homo sapiens
caucuguccuucuccuuga

SEQ ID NO: 1367342 - RNA, 19 nt, Homo sapiens
ccaggacccuucagucauc

SEQ ID NO: 1367343 - RNA, 19 nt, Homo sapiens
cuaaccacuugcuagauuu

SEQ ID NO: 1367344 - RNA, 19 nt, Homo sapiens
gcccaagucucuagcuauc

SEQ ID NO: 1367345 - RNA, 19 nt, Homo sapiens
ggucuaaauccaaugacua

SEQ ID NO: 1367346 - RNA, 19 nt, Homo sapiens
aagcugaccgcaauacuaa

SEQ ID NO: 1367347 - RNA, 19 nt, Homo sapiens
uaagcugaccgcaauacua

SEQ ID NO: 1367348 - RNA, 19 nt, Homo sapiens
gcaucacagugcucugcua

SEQ ID NO: 1367349 - RNA, 19 nt, Homo sapiens
gugaugaacaggagaauuc

SEQ ID NO: 1367350 - RNA, 19 nt, Homo sapiens
acaagaauuuagaggagaa

SEQ ID NO: 1367351 - RNA, 19 nt, Homo sapiens
agagagagaccaagcgaaa

SEQ ID NO: 1367352 - RNA, 19 nt, Homo sapiens
aaugagugcucccuuuaug

SEQ ID NO: 1367353 - RNA, 19 nt, Homo sapiens
uaaccacuugcuagauuua

SEQ ID NO: 1367354 - RNA, 19 nt, Homo sapiens
ucuaugaacccaacccuuu

SEQ ID NO: 1367355 - RNA, 19 nt, Homo sapiens
uggaguaauucgcccagua

SEQ ID NO: 1367356 - RNA, 19 nt, Homo sapiens
uaacagccagcauagaaga

SEQ ID NO: 1367357 - RNA, 19 nt, Homo sapiens
ccaacccuuucaguaaaua

SEQ ID NO: 1367358 - RNA, 19 nt, Homo sapiens
gauaagaguccagaaacug

SEQ ID NO: 1367359 - RNA, 19 nt, Homo sapiens
cauagaagagauuuaccua

SEQ ID NO: 1367360 - RNA, 19 nt, Homo sapiens
gagaaaccaaauaugcaaa

SEQ ID NO: 1367361 - RNA, 19 nt, Homo sapiens
ccaaggacaacacauuaga

SEQ ID NO: 1367362 - RNA, 19 nt, Homo sapiens
agagagaccaagcgaaauu

SEQ ID NO: 1367363 - RNA, 19 nt, Homo sapiens
gcugggagccaacaagaga

SEQ ID NO: 1367364 - RNA, 19 nt, Homo sapiens
auauuaagcugaccgcaau

SEQ ID NO: 1367365 - RNA, 19 nt, Homo sapiens
gcucugugcuaccauugau

SEQ ID NO: 1367366 - RNA, 19 nt, Homo sapiens
caaggacaacacauuagaa

SEQ ID NO: 1367367 - RNA, 19 nt, Homo sapiens
guccagaaacuguaaauag

SEQ ID NO: 1367368 - RNA, 19 nt, Homo sapiens
cuuuaaugccuucuacuua

SEQ ID NO: 1367369 - RNA, 19 nt, Homo sapiens
aacacaggcugcugaaguu

SEQ ID NO: 1367370 - RNA, 19 nt, Homo sapiens
aaacacaggcugcugaagu

SEQ ID NO: 1367371 - RNA, 19 nt, Homo sapiens
ucacaacgcaugcaacaag

SEQ ID NO: 1367372 - RNA, 19 nt, Homo sapiens
cgagaaaccaaauaugcaa

SEQ ID NO: 1367373 - RNA, 19 nt, Homo sapiens
cucaagaccucaucacauc

SEQ ID NO: 1367374 - RNA, 19 nt, Homo sapiens
gaggucaguggaacgauuu

SEQ ID NO: 1367375 - RNA, 19 nt, Homo sapiens
ugacuaagccuggaguaau

SEQ ID NO: 1367376 - RNA, 19 nt, Homo sapiens
agaagacuaccaacccaua

SEQ ID NO: 1367377 - RNA, 19 nt, Homo sapiens
acagaaggcacuagaugaa

SEQ ID NO: 1367378 - RNA, 19 nt, Homo sapiens
gaauuuagaggagaaacug

SEQ ID NO: 1367379 - RNA, 19 nt, Homo sapiens
gcugacaccucuaaauucc

SEQ ID NO: 1367380 - RNA, 19 nt, Homo sapiens
uaagaguccagaaacugua

SEQ ID NO: 1367381 - RNA, 19 nt, Homo sapiens
acccaacccuuucaguaaa

SEQ ID NO: 1367382 - RNA, 19 nt, Homo sapiens
ucucagucuuucucucuuu

SEQ ID NO: 1367383 - RNA, 19 nt, Homo sapiens
ucuaugcauucuucugauu

SEQ ID NO: 1367384 - RNA, 19 nt, Homo sapiens
uggcugacaccucuaaauu

SEQ ID NO: 1367385 - RNA, 19 nt, Homo sapiens
gaaacuguaaauaggucua

SEQ ID NO: 1367386 - RNA, 19 nt, Homo sapiens
cucauucucuuucaauaug

SEQ ID NO: 1367387 - RNA, 19 nt, Homo sapiens
agacauuguuggguucuga

SEQ ID NO: 1367388 - RNA, 19 nt, Homo sapiens
cugaaagugucuccaagga

SEQ ID NO: 1367389 - RNA, 19 nt, Homo sapiens
gcaauacaagaccaaguca

SEQ ID NO: 1367390 - RNA, 19 nt, Homo sapiens
ccaagucucuagcuaucuc

SEQ ID NO: 1367391 - RNA, 19 nt, Homo sapiens
aaagcugaauauguccuua

SEQ ID NO: 1367392 - RNA, 19 nt, Homo sapiens
caucacagugcucugcuaa

SEQ ID NO: 1367393 - RNA, 19 nt, Homo sapiens
ggcuauuccugaacaugaa

SEQ ID NO: 1367394 - RNA, 19 nt, Homo sapiens
gugcuaccauugauaaggu

SEQ ID NO: 1367395 - RNA, 19 nt, Homo sapiens
agaggucaguggaacgauu

SEQ ID NO: 1367396 - RNA, 19 nt, Homo sapiens
ugaaugagaccaucaauua

SEQ ID NO: 1367397 - RNA, 19 nt, Homo sapiens
cauccuaggucuaacauua

SEQ ID NO: 1367398 - RNA, 19 nt, Homo sapiens
ccacacaccucuaaucuga

SEQ ID NO: 1367399 - RNA, 19 nt, Homo sapiens
gaacuaugcugaggaguau

SEQ ID NO: 1367400 - RNA, 19 nt, Homo sapiens
gcaaauaggguaauagaug

SEQ ID NO: 1367401 - RNA, 19 nt, Homo sapiens
gaagccaggugggaaguua

SEQ ID NO: 1367402 - RNA, 19 nt, Homo sapiens
gagcuucaguucccaaauu

SEQ ID NO: 1367403 - RNA, 19 nt, Homo sapiens
ucaccaagauggcuacuuu

SEQ ID NO: 1367404 - RNA, 19 nt, Homo sapiens
gguaauagaugugaauuca

SEQ ID NO: 1367405 - RNA, 19 nt, Homo sapiens
caaauaggguaauagaugu

SEQ ID NO: 1367406 - RNA, 19 nt, Homo sapiens
guaccuagcugagaaguuc

SEQ ID NO: 1367407 - RNA, 19 nt, Homo sapiens
ccucaucacugccaccuaa

SEQ ID NO: 1367408 - RNA, 19 nt, Homo sapiens
gagaagccaugaaaauuaa

SEQ ID NO: 1367409 - RNA, 19 nt, Homo sapiens
ucaagaugcuauucacuga

SEQ ID NO: 1367410 - RNA, 19 nt, Homo sapiens
gcacagcaacccagccuuu

SEQ ID NO: 1367411 - RNA, 19 nt, Homo sapiens
ggagaagccaugaaaauua

SEQ ID NO: 1367412 - RNA, 19 nt, Homo sapiens
gguuaguggugauacauuu

SEQ ID NO: 1367413 - RNA, 19 nt, Homo sapiens
uagcuuaucugcacagcaa

SEQ ID NO: 1367414 - RNA, 19 nt, Homo sapiens
gcugagaaguucacuccaa

SEQ ID NO: 1367415 - RNA, 19 nt, Homo sapiens
cuaagggacugaagagaug

SEQ ID NO: 1367416 - RNA, 19 nt, Homo sapiens
ugacugcacuggccacguu

SEQ ID NO: 1367417 - RNA, 19 nt, Homo sapiens
ucccaaauuugcuacauaa

SEQ ID NO: 1367418 - RNA, 19 nt, Homo sapiens
aaacaccaccucacaagaa

SEQ ID NO: 1367419 - RNA, 19 nt, Homo sapiens
ggucuaacauuaaccaacu

SEQ ID NO: 1367420 - RNA, 19 nt, Homo sapiens
ccaccaaggcauacuguaa

SEQ ID NO: 1367421 - RNA, 19 nt, Homo sapiens
gguauaugguggcuacaug

SEQ ID NO: 1367422 - RNA, 19 nt, Homo sapiens
gagaaguucacuccaagaa

SEQ ID NO: 1367423 - RNA, 19 nt, Homo sapiens
ccaaagugcugggauuaca

SEQ ID NO: 1367424 - RNA, 19 nt, Homo sapiens
ccaaauuugcuacauaaga

SEQ ID NO: 1367425 - RNA, 19 nt, Homo sapiens
aaaggaggcucuauauacu

SEQ ID NO: 1367426 - RNA, 19 nt, Homo sapiens
gggcaaauaggguaauaga

SEQ ID NO: 1367427 - RNA, 19 nt, Homo sapiens
gggaaggaguccagauugg

SEQ ID NO: 1367428 - RNA, 19 nt, Homo sapiens
gcgcggagaagccaugaaa

SEQ ID NO: 1367429 - RNA, 19 nt, Homo sapiens
gcuguuggcucugcucuuc

SEQ ID NO: 1367430 - RNA, 19 nt, Homo sapiens
acacaccucuaaucugaau

SEQ ID NO: 1367431 - RNA, 19 nt, Homo sapiens
gagccuaccccuuguguua

SEQ ID NO: 1367432 - RNA, 19 nt, Homo sapiens
cgaacauacuggagacuca

SEQ ID NO: 1367433 - RNA, 19 nt, Homo sapiens
ugaaagacagcacuggaaa

SEQ ID NO: 1367434 - RNA, 19 nt, Homo sapiens
gggccugccuucuggauca

SEQ ID NO: 1367435 - RNA, 19 nt, Homo sapiens
gaaagacgaggcuguucug

SEQ ID NO: 1367436 - RNA, 19 nt, Homo sapiens
aaccaaacuucucauccua

SEQ ID NO: 1367437 - RNA, 19 nt, Homo sapiens
gaaaggaggggaaaccaaa

SEQ ID NO: 1367438 - RNA, 19 nt, Homo sapiens
uaugguggcuacaugcuau

SEQ ID NO: 1367439 - RNA, 19 nt, Homo sapiens
gaaagacagcacuggaaag

SEQ ID NO: 1367440 - RNA, 19 nt, Homo sapiens
caaccagaguguggaugaa

SEQ ID NO: 1367441 - RNA, 19 nt, Homo sapiens
guuagggaaucaacuccaa

SEQ ID NO: 1367442 - RNA, 19 nt, Homo sapiens
uaaagccuguugccaugau

SEQ ID NO: 1367443 - RNA, 19 nt, Homo sapiens
ggaaagacgaggcuguucu

SEQ ID NO: 1367444 - RNA, 19 nt, Homo sapiens
gaacucuggccucaaacga

SEQ ID NO: 1367445 - RNA, 19 nt, Homo sapiens
ucacagcacugcggagagu

SEQ ID NO: 1367446 - RNA, 19 nt, Homo sapiens
uacauaagauugcaagacu

SEQ ID NO: 1367447 - RNA, 19 nt, Homo sapiens
ugccagacccuguguugua

SEQ ID NO: 1367448 - RNA, 19 nt, Homo sapiens
agaacuaugcugaggagua

SEQ ID NO: 1367449 - RNA, 19 nt, Homo sapiens
gaaugagaccaucaauuac

SEQ ID NO: 1367450 - RNA, 19 nt, Homo sapiens
ugggugaccugccucauca

SEQ ID NO: 1367451 - RNA, 19 nt, Homo sapiens
ggaaaccaaacuucucauc

SEQ ID NO: 1367452 - RNA, 19 nt, Homo sapiens
aggaggcucuauauacuga

SEQ ID NO: 1367453 - RNA, 19 nt, Homo sapiens
gcgcuucugugcugcauac

SEQ ID NO: 1367454 - RNA, 19 nt, Homo sapiens
ucaauuacaacgaggaguu

SEQ ID NO: 1367455 - RNA, 19 nt, Homo sapiens
caaacaccaccucacaaga

SEQ ID NO: 1367456 - RNA, 19 nt, Homo sapiens
gaggcucuauauacugaug

SEQ ID NO: 1367457 - RNA, 19 nt, Homo sapiens
gauccugauugugcuuuau

SEQ ID NO: 1367458 - RNA, 19 nt, Homo sapiens
ccaaugugaugcucuccau

SEQ ID NO: 1367459 - RNA, 19 nt, Homo sapiens
gaaagaaaggagggcaugu

SEQ ID NO: 1367460 - RNA, 19 nt, Homo sapiens
aaaccaaacuucucauccu

SEQ ID NO: 1367461 - RNA, 19 nt, Homo sapiens
ccaugccugugcugguaua

SEQ ID NO: 1367462 - RNA, 19 nt, Homo sapiens
gcgccugggugagaacuau

SEQ ID NO: 1367463 - RNA, 19 nt, Homo sapiens
guaaaauggucauaacagu

SEQ ID NO: 1367464 - RNA, 19 nt, Homo sapiens
cagagaaucagguuucaca

SEQ ID NO: 1367465 - RNA, 19 nt, Homo sapiens
uaugccacauucucuuuga

SEQ ID NO: 1367466 - RNA, 19 nt, Homo sapiens
caacuaugccacauucucu

SEQ ID NO: 1367467 - RNA, 19 nt, Homo sapiens
aaccaacuaugccacauuc

SEQ ID NO: 1367468 - RNA, 19 nt, Homo sapiens
cuucugugcugcauacuca

SEQ ID NO: 1367469 - RNA, 19 nt, Homo sapiens
uaacauuaaccaacuaugc

SEQ ID NO: 1367470 - RNA, 19 nt, Homo sapiens
cucgaacucuggccucaaa

SEQ ID NO: 1367471 - RNA, 19 nt, Homo sapiens
uaaccaacuaugccacauu

SEQ ID NO: 1367472 - RNA, 19 nt, Homo sapiens
ggugggaaguuagggaauc

SEQ ID NO: 1367473 - RNA, 19 nt, Homo sapiens
aaagccuguugccaugaua

SEQ ID NO: 1367474 - RNA, 19 nt, Homo sapiens
cucacaggcugaaggcuuu

SEQ ID NO: 1367475 - RNA, 19 nt, Homo sapiens
ggugauacauuuuaagucu

SEQ ID NO: 1367476 - RNA, 19 nt, Homo sapiens
ucaaacaccaccucacaag

SEQ ID NO: 1367477 - RNA, 19 nt, Homo sapiens
caugaaacacggcaagaca

SEQ ID NO: 1367478 - RNA, 19 nt, Homo sapiens
ucaaccagaguguggauga

SEQ ID NO: 1367479 - RNA, 19 nt, Homo sapiens
ucuccuggcugcaguccuu

SEQ ID NO: 1367480 - RNA, 19 nt, Homo sapiens
aaagaugcuagcucuggua

SEQ ID NO: 1367481 - RNA, 19 nt, Homo sapiens
ccaaucuacagacggagua

SEQ ID NO: 1367482 - RNA, 19 nt, Homo sapiens
uguuguaccuagcugagaa

SEQ ID NO: 1367483 - RNA, 19 nt, Homo sapiens
gccucgaccucccaaagug

SEQ ID NO: 1367484 - RNA, 19 nt, Homo sapiens
uucccaaauuugcuacaua

SEQ ID NO: 1367485 - RNA, 19 nt, Homo sapiens
ggacacacauuccccuucu

SEQ ID NO: 1367486 - RNA, 19 nt, Homo sapiens
cuccaugccugugcuggua

SEQ ID NO: 1367487 - RNA, 19 nt, Homo sapiens
cuacaccucagccaugcua

SEQ ID NO: 1367488 - RNA, 19 nt, Homo sapiens
ccucaaacaccaccucaca

SEQ ID NO: 1367489 - RNA, 19 nt, Homo sapiens
acauaagauugcaagacuu

SEQ ID NO: 1367490 - RNA, 19 nt, Homo sapiens
augcugggccuguccauaa

SEQ ID NO: 1367491 - RNA, 19 nt, Homo sapiens
ccuaagggacugaagagau

SEQ ID NO: 1367492 - RNA, 19 nt, Homo sapiens
aaugagaccaucaauuaca

SEQ ID NO: 1367493 - RNA, 19 nt, Homo sapiens
aaacacggcaagacaccaa

SEQ ID NO: 1367494 - RNA, 19 nt, Homo sapiens
gcgcugggccgaacauacu

SEQ ID NO: 1367495 - RNA, 19 nt, Homo sapiens
cgacgcagagaaucagguu

SEQ ID NO: 1367496 - RNA, 19 nt, Homo sapiens
gaucaggcauuguggaaua

SEQ ID NO: 1367497 - RNA, 19 nt, Homo sapiens
gaaaggaucugagggaaga

SEQ ID NO: 1367498 - RNA, 19 nt, Homo sapiens
ucaaagggcuuagugaaua

SEQ ID NO: 1367499 - RNA, 19 nt, Homo sapiens
gaauugagauuagcagaaa

SEQ ID NO: 1367500 - RNA, 19 nt, Homo sapiens
gaaauacaaucaacucaag

SEQ ID NO: 1367501 - RNA, 19 nt, Homo sapiens
guugagagauucauaaaga

SEQ ID NO: 1367502 - RNA, 19 nt, Homo sapiens
ugacagaguugcuaucuau

SEQ ID NO: 1367503 - RNA, 19 nt, Homo sapiens
ggaaccaacuuauaacugu

SEQ ID NO: 1367504 - RNA, 19 nt, Homo sapiens
ucaggaagauguaagguuu

SEQ ID NO: 1367505 - RNA, 19 nt, Homo sapiens
gaaagggagcuuauugaaa

SEQ ID NO: 1367506 - RNA, 19 nt, Homo sapiens
gcaaggaguuucuuucucu

SEQ ID NO: 1367507 - RNA, 19 nt, Homo sapiens
ggaauauguuuauccagaa

SEQ ID NO: 1367508 - RNA, 19 nt, Homo sapiens
aaagggagcuuauugaaag

SEQ ID NO: 1367509 - RNA, 19 nt, Homo sapiens
uaauugcccuccuuuauau

SEQ ID NO: 1367510 - RNA, 19 nt, Homo sapiens
caaaggaaucugugucuaa

SEQ ID NO: 1367511 - RNA, 19 nt, Homo sapiens
ggaagaagggaauguuaaa

SEQ ID NO: 1367512 - RNA, 19 nt, Homo sapiens
gagagacccauuacaagua

SEQ ID NO: 1367513 - RNA, 19 nt, Homo sapiens
ggaaagggagcuuauugaa

SEQ ID NO: 1367514 - RNA, 19 nt, Homo sapiens
caauguaccuucuggaaca

SEQ ID NO: 1367515 - RNA, 19 nt, Homo sapiens
gaaccaacuuauaacuguu

SEQ ID NO: 1367516 - RNA, 19 nt, Homo sapiens
caaaauggguuaccuguga

SEQ ID NO: 1367517 - RNA, 19 nt, Homo sapiens
gaauaauugcccuccuuua

SEQ ID NO: 1367518 - RNA, 19 nt, Homo sapiens
ucucaaagggugcaauuua

SEQ ID NO: 1367519 - RNA, 19 nt, Homo sapiens
caaagggcuuagugaauau

SEQ ID NO: 1367520 - RNA, 19 nt, Homo sapiens
ccacucgacucuauuuguu

SEQ ID NO: 1367521 - RNA, 19 nt, Homo sapiens
ugacuuaacauaccacgua

SEQ ID NO: 1367522 - RNA, 19 nt, Homo sapiens
cuacauggccacacaguuu

SEQ ID NO: 1367523 - RNA, 19 nt, Homo sapiens
gaauauuccugggacauca

SEQ ID NO: 1367524 - RNA, 19 nt, Homo sapiens
uaagaaucauggcucugua

SEQ ID NO: 1367525 - RNA, 19 nt, Homo sapiens
ggaauaauugcccuccuuu

SEQ ID NO: 1367526 - RNA, 19 nt, Homo sapiens
ggaaugaaaggaugcaugu

SEQ ID NO: 1367527 - RNA, 19 nt, Homo sapiens
gggaagaagggaauguuaa

SEQ ID NO: 1367528 - RNA, 19 nt, Homo sapiens
gcagaaauggaccuuaaga

SEQ ID NO: 1367529 - RNA, 19 nt, Homo sapiens
cuccuucccucauuuauuu

SEQ ID NO: 1367530 - RNA, 19 nt, Homo sapiens
gcuaaucugcuuuguguga

SEQ ID NO: 1367531 - RNA, 19 nt, Homo sapiens
uaucucaguuucuggauga

SEQ ID NO: 1367532 - RNA, 19 nt, Homo sapiens
aggcagaaauggaccuuaa

SEQ ID NO: 1367533 - RNA, 19 nt, Homo sapiens
gacagacaauacuuacuau

SEQ ID NO: 1367534 - RNA, 19 nt, Homo sapiens
ccaaguaucucaguuucug

SEQ ID NO: 1367535 - RNA, 19 nt, Homo sapiens
agacagacaauacuuacua

SEQ ID NO: 1367536 - RNA, 19 nt, Homo sapiens
ccauggcaauguaugcaua

SEQ ID NO: 1367537 - RNA, 19 nt, Homo sapiens
ucauggagccaguaacaua

SEQ ID NO: 1367538 - RNA, 19 nt, Homo sapiens
gcauugagcagcaccaguu

SEQ ID NO: 1367539 - RNA, 19 nt, Homo sapiens
ugacucuguugguguauuu

SEQ ID NO: 1367540 - RNA, 19 nt, Homo sapiens
aggaaucugugucuaauau

SEQ ID NO: 1367541 - RNA, 19 nt, Homo sapiens
gagagaaagagaauuaauc

SEQ ID NO: 1367542 - RNA, 19 nt, Homo sapiens
caaauuggcuaagaaucau

SEQ ID NO: 1367543 - RNA, 19 nt, Homo sapiens
uaaccaaguaucucaguuu

SEQ ID NO: 1367544 - RNA, 19 nt, Homo sapiens
guaacauacuucaucacuu

SEQ ID NO: 1367545 - RNA, 19 nt, Homo sapiens
uaacccauuuauccuguuu

SEQ ID NO: 1367546 - RNA, 19 nt, Homo sapiens
ggaugcaugucuccacuuc

SEQ ID NO: 1367547 - RNA, 19 nt, Homo sapiens
gaauuugggagcuguuuau

SEQ ID NO: 1367548 - RNA, 19 nt, Homo sapiens
ugcaugagguuguugguuu

SEQ ID NO: 1367549 - RNA, 19 nt, Homo sapiens
ccaccuaccuguaccucuu

SEQ ID NO: 1367550 - RNA, 19 nt, Homo sapiens
ggagggaggacauggagaa

SEQ ID NO: 1367551 - RNA, 19 nt, Homo sapiens
gaauauguuuauccagaag

SEQ ID NO: 1367552 - RNA, 19 nt, Homo sapiens
gagcagcaccaguuaaaca

SEQ ID NO: 1367553 - RNA, 19 nt, Homo sapiens
gugcaacgagcaaaucuuu

SEQ ID NO: 1367554 - RNA, 19 nt, Homo sapiens
aaaggaaucugugucuaau

SEQ ID NO: 1367555 - RNA, 19 nt, Homo sapiens
agaaauggaccuuaagaga

SEQ ID NO: 1367556 - RNA, 19 nt, Homo sapiens
cagagacagacaauacuua

SEQ ID NO: 1367557 - RNA, 19 nt, Homo sapiens
gcugaaugauguaaagaca

SEQ ID NO: 1367558 - RNA, 19 nt, Homo sapiens
cagaguugcuaucuauuca

SEQ ID NO: 1367559 - RNA, 19 nt, Homo sapiens
gcaaacuauugaacaugug

SEQ ID NO: 1367560 - RNA, 19 nt, Homo sapiens
agaguuaccaggaaucuuu

SEQ ID NO: 1367561 - RNA, 19 nt, Homo sapiens
gcucaaagggcuuagugaa

SEQ ID NO: 1367562 - RNA, 19 nt, Homo sapiens
gagacugagagacccauua

SEQ ID NO: 1367563 - RNA, 19 nt, Homo sapiens
gagaagaggaccacuuugg

SEQ ID NO: 1367564 - RNA, 19 nt, Homo sapiens
ggaauugacagaguugcua

SEQ ID NO: 1367565 - RNA, 19 nt, Homo sapiens
ucaaaggaaucugugucua

SEQ ID NO: 1367566 - RNA, 19 nt, Homo sapiens
gaaaagcaaauucucauga

SEQ ID NO: 1367567 - RNA, 19 nt, Homo sapiens
gaaaagguacgaauugaga

SEQ ID NO: 1367568 - RNA, 19 nt, Homo sapiens
uugcuaaucugcuuugugu

SEQ ID NO: 1367569 - RNA, 19 nt, Homo sapiens
guucagcuguacuaccaaa

SEQ ID NO: 1367570 - RNA, 19 nt, Homo sapiens
gcccuccuuuauauacuua

SEQ ID NO: 1367571 - RNA, 19 nt, Homo sapiens
guucguuucuugcaucuuc

SEQ ID NO: 1367572 - RNA, 19 nt, Homo sapiens
uacgacaacugcaagaaga

SEQ ID NO: 1367573 - RNA, 19 nt, Homo sapiens
agggugcaauuuaucuuua

SEQ ID NO: 1367574 - RNA, 19 nt, Homo sapiens
gaucucaaagggugcaauu

SEQ ID NO: 1367575 - RNA, 19 nt, Homo sapiens
acaaauuggcuaagaauca

SEQ ID NO: 1367576 - RNA, 19 nt, Homo sapiens
cagcuguacuaccaaauca

SEQ ID NO: 1367577 - RNA, 19 nt, Homo sapiens
uaaugacacgccaggaaua

SEQ ID NO: 1367578 - RNA, 19 nt, Homo sapiens
cggcuuaccuggugggaau

SEQ ID NO: 1367579 - RNA, 19 nt, Homo sapiens
gauucauccuuccucauug

SEQ ID NO: 1367580 - RNA, 19 nt, Homo sapiens
cucaaagggugcaauuuau

SEQ ID NO: 1367581 - RNA, 19 nt, Homo sapiens
gagagauucauaaagagaa

SEQ ID NO: 1367582 - RNA, 19 nt, Homo sapiens
caggcauuguggaauauaa

SEQ ID NO: 1367583 - RNA, 19 nt, Homo sapiens
ccaggaauauguuuaucca

SEQ ID NO: 1367584 - RNA, 19 nt, Homo sapiens
ggcaauguaugcauauuuu

SEQ ID NO: 1367585 - RNA, 19 nt, Homo sapiens
gacuagaggaucucaaaga

SEQ ID NO: 1367586 - RNA, 19 nt, Homo sapiens
ggagcuuauugaaagacua

SEQ ID NO: 1367587 - RNA, 19 nt, Homo sapiens
aaauggaccuuaagagacu

SEQ ID NO: 1367588 - RNA, 19 nt, Homo sapiens
guaaugacacgccaggaau

SEQ ID NO: 1367589 - RNA, 19 nt, Homo sapiens
gacuuuaagcuggucauua

SEQ ID NO: 1367590 - RNA, 19 nt, Homo sapiens
caaggaguuucuuucucuu

SEQ ID NO: 1367591 - RNA, 19 nt, Homo sapiens
ugacaucugcgcuugaaga

SEQ ID NO: 1367592 - RNA, 19 nt, Homo sapiens
ucaaguguguggaucucaa

SEQ ID NO: 1367593 - RNA, 19 nt, Homo sapiens
acacacacuuccacacugu

SEQ ID NO: 1367594 - RNA, 19 nt, Homo sapiens
caucuucuuugcagaguca

SEQ ID NO: 1367595 - RNA, 19 nt, Homo sapiens
ggaugaaaaugaugcaguu

SEQ ID NO: 1367596 - RNA, 19 nt, Homo sapiens
acaaggaucuccauuacaa

SEQ ID NO: 1367597 - RNA, 19 nt, Homo sapiens
cgaaagcccaccacacuua

SEQ ID NO: 1367598 - RNA, 19 nt, Homo sapiens
ugaagcagguaucgccuua

SEQ ID NO: 1367599 - RNA, 19 nt, Homo sapiens
gcagacagccucuccaugu

SEQ ID NO: 1367600 - RNA, 19 nt, Homo sapiens
aaacaaggaucuccauuac

SEQ ID NO: 1367601 - RNA, 19 nt, Homo sapiens
acagauaacacucaagaua

SEQ ID NO: 1367602 - RNA, 19 nt, Homo sapiens
uaaaguacuugaucuccaa

SEQ ID NO: 1367603 - RNA, 19 nt, Homo sapiens
ucaaguccaucucuaauuc

SEQ ID NO: 1367604 - RNA, 19 nt, Homo sapiens
aaucagacaucacagaaga

SEQ ID NO: 1367605 - RNA, 19 nt, Homo sapiens
ucuauagcauuuccugaua

SEQ ID NO: 1367606 - RNA, 19 nt, Homo sapiens
caagacagauaacacucaa

SEQ ID NO: 1367607 - RNA, 19 nt, Homo sapiens
agauaacacucaagauaga

SEQ ID NO: 1367608 - RNA, 19 nt, Homo sapiens
agaagaggcugcaggcaau

SEQ ID NO: 1367609 - RNA, 19 nt, Homo sapiens
gaaccuggaccuggagaaa

SEQ ID NO: 1367610 - RNA, 19 nt, Homo sapiens
cauaaugaaucagacauca

SEQ ID NO: 1367611 - RNA, 19 nt, Homo sapiens
ucaacaagcaagauucaaa

SEQ ID NO: 1367612 - RNA, 19 nt, Homo sapiens
agacaucacagaagaaaga

SEQ ID NO: 1367613 - RNA, 19 nt, Homo sapiens
uacuugaucuccaaacuga

SEQ ID NO: 1367614 - RNA, 19 nt, Homo sapiens
gcagagcgacccgcagaaa

SEQ ID NO: 1367615 - RNA, 19 nt, Homo sapiens
cccaaggucuccaccaaga

SEQ ID NO: 1367616 - RNA, 19 nt, Homo sapiens
aagcugacgucucccagaa

SEQ ID NO: 1367617 - RNA, 19 nt, Homo sapiens
cagauaacacucaagauag

SEQ ID NO: 1367618 - RNA, 19 nt, Homo sapiens
agacagauaacacucaaga

SEQ ID NO: 1367619 - RNA, 19 nt, Homo sapiens
cuaaauuccaagacagaua

SEQ ID NO: 1367620 - RNA, 19 nt, Homo sapiens
ccaagaagccacgcauuuc

SEQ ID NO: 1367621 - RNA, 19 nt, Homo sapiens
ucuccaaacugacaaacug

SEQ ID NO: 1367622 - RNA, 19 nt, Homo sapiens
gaaagcccaccacacuuag

SEQ ID NO: 1367623 - RNA, 19 nt, Homo sapiens
cgccuuaccuguugaaacu

SEQ ID NO: 1367624 - RNA, 19 nt, Homo sapiens
ugaaucagacaucacagaa

SEQ ID NO: 1367625 - RNA, 19 nt, Homo sapiens
aaaacaaggaucuccauua

SEQ ID NO: 1367626 - RNA, 19 nt, Homo sapiens
uagcauuuccugauacuuc

SEQ ID NO: 1367627 - RNA, 19 nt, Homo sapiens
ccucaagucccuccuggaa

SEQ ID NO: 1367628 - RNA, 19 nt, Homo sapiens
uacaagggcaggccagaaa

SEQ ID NO: 1367629 - RNA, 19 nt, Homo sapiens
uaaugaaucagacaucaca

SEQ ID NO: 1367630 - RNA, 19 nt, Homo sapiens
gcuguuauuuugcuauuug

SEQ ID NO: 1367631 - RNA, 19 nt, Homo sapiens
ucagacaucacagaagaaa

SEQ ID NO: 1367632 - RNA, 19 nt, Homo sapiens
ccaagacagauaacacuca

SEQ ID NO: 1367633 - RNA, 19 nt, Homo sapiens
gcgaaagcccaccacacuu

SEQ ID NO: 1367634 - RNA, 19 nt, Homo sapiens
caacaagcaagauucaaaa

SEQ ID NO: 1367635 - RNA, 19 nt, Homo sapiens
ccuuaccuguugaaacuga

SEQ ID NO: 1367636 - RNA, 19 nt, Homo sapiens
gagcaucugaagcgggaaa

SEQ ID NO: 1367637 - RNA, 19 nt, Homo sapiens
gaccaagaagccacgcauu

SEQ ID NO: 1367638 - RNA, 19 nt, Homo sapiens
guacaagggcaggccagaa

SEQ ID NO: 1367639 - RNA, 19 nt, Homo sapiens
gucaaguccaucucuaauu

SEQ ID NO: 1367640 - RNA, 19 nt, Homo sapiens
guacuugaucuccaaacug

SEQ ID NO: 1367641 - RNA, 19 nt, Homo sapiens
gacuggcucucuauagcau

SEQ ID NO: 1367642 - RNA, 19 nt, Homo sapiens
accaagaagccacgcauuu

SEQ ID NO: 1367643 - RNA, 19 nt, Homo sapiens
ugucaagcuuccagucugu

SEQ ID NO: 1367644 - RNA, 19 nt, Homo sapiens
gaaucagacaucacagaag

SEQ ID NO: 1367645 - RNA, 19 nt, Homo sapiens
cuggcucucuauagcauuu

SEQ ID NO: 1367646 - RNA, 19 nt, Homo sapiens
gaaaacaaggaucuccauu

SEQ ID NO: 1367647 - RNA, 19 nt, Homo sapiens
ccugauacuuccgcuacuu

SEQ ID NO: 1367648 - RNA, 19 nt, Homo sapiens
guaccuggcgauggcgaua

SEQ ID NO: 1367649 - RNA, 19 nt, Homo sapiens
gaagaggcugcaggcaaug

SEQ ID NO: 1367650 - RNA, 19 nt, Homo sapiens
ucugucaaguccaucucua

SEQ ID NO: 1367651 - RNA, 19 nt, Homo sapiens
cacucaagauagauaaagu

SEQ ID NO: 1367652 - RNA, 19 nt, Homo sapiens
gauaacacucaagauagau

SEQ ID NO: 1367653 - RNA, 19 nt, Homo sapiens
gauacuuccgcuacuuuua

SEQ ID NO: 1367654 - RNA, 19 nt, Homo sapiens
cuauagcauuuccugauac

SEQ ID NO: 1367655 - RNA, 19 nt, Homo sapiens
gagcugcggcaccucaagu

SEQ ID NO: 1367656 - RNA, 19 nt, Homo sapiens
caagcaagauucaaaagcu

SEQ ID NO: 1367657 - RNA, 19 nt, Homo sapiens
caaguccaucucuaauuca

SEQ ID NO: 1367658 - RNA, 19 nt, Homo sapiens
aaagauggccccucaggaa

SEQ ID NO: 1367659 - RNA, 19 nt, Homo sapiens
gaacagcugagacagauga

SEQ ID NO: 1367660 - RNA, 19 nt, Homo sapiens
uuaaggagguaccacauug

SEQ ID NO: 1367661 - RNA, 19 nt, Homo sapiens
cagaugaugugcaaagugu

SEQ ID NO: 1367662 - RNA, 19 nt, Homo sapiens
cagaacgacuugacacaug

SEQ ID NO: 1367663 - RNA, 19 nt, Homo sapiens
ugagacagaugaugugcaa

SEQ ID NO: 1367664 - RNA, 19 nt, Homo sapiens
gaugaugugcaaaguguuu

SEQ ID NO: 1367665 - RNA, 19 nt, Homo sapiens
cagaacagcugagacagau

SEQ ID NO: 1367666 - RNA, 19 nt, Homo sapiens
gcagaacagcugagacaga

SEQ ID NO: 1367667 - RNA, 19 nt, Homo sapiens
caucaacgacgacgaauuc

SEQ ID NO: 1367668 - RNA, 19 nt, Homo sapiens
gagcuggucaugagccuuu

SEQ ID NO: 1367669 - RNA, 19 nt, Homo sapiens
uggcagagcuggucaugag

SEQ ID NO: 1367670 - RNA, 19 nt, Homo sapiens
gcaagacuccgaugcuaca

SEQ ID NO: 1367671 - RNA, 19 nt, Homo sapiens
cgacaucaacgacgacgaa

SEQ ID NO: 1367672 - RNA, 19 nt, Homo sapiens
gcauggugaugucuguaau

SEQ ID NO: 1367673 - RNA, 19 nt, Homo sapiens
gcaaacugaggcaagagaa

SEQ ID NO: 1367674 - RNA, 19 nt, Homo sapiens
gaggccagcuagagugaca

SEQ ID NO: 1367675 - RNA, 19 nt, Homo sapiens
gucaugagccuuuuauaua

SEQ ID NO: 1367676 - RNA, 19 nt, Homo sapiens
ccgucuuuguucuuuauua

SEQ ID NO: 1367677 - RNA, 19 nt, Homo sapiens
cagcugacuugcaaacucu

SEQ ID NO: 1367678 - RNA, 19 nt, Homo sapiens
gaacgacuugacacauguu

SEQ ID NO: 1367679 - RNA, 19 nt, Homo sapiens
agaacgacuugacacaugu

SEQ ID NO: 1367680 - RNA, 19 nt, Homo sapiens
cgucggguaucaggaguuu

SEQ ID NO: 1367681 - RNA, 19 nt, Homo sapiens
ucacuggauuugcacaagu

SEQ ID NO: 1367682 - RNA, 19 nt, Homo sapiens
gacagaugaugugcaaagu

SEQ ID NO: 1367683 - RNA, 19 nt, Homo sapiens
cagcugagacagaugaugu

SEQ ID NO: 1367684 - RNA, 19 nt, Homo sapiens
aggagcaggucuugcagaa

SEQ ID NO: 1367685 - RNA, 19 nt, Homo sapiens
cgucuuuguucuuuauuag

SEQ ID NO: 1367686 - RNA, 19 nt, Homo sapiens
gggaggagcaggucuugca

SEQ ID NO: 1367687 - RNA, 19 nt, Homo sapiens
gcagaacgacuugacacau

SEQ ID NO: 1367688 - RNA, 19 nt, Homo sapiens
ggcauggugaugucuguaa

SEQ ID NO: 1367689 - RNA, 19 nt, Homo sapiens
ggccagcuagagugacaua

SEQ ID NO: 1367690 - RNA, 19 nt, Homo sapiens
ucagcugacuugcaaacuc

SEQ ID NO: 1367691 - RNA, 19 nt, Homo sapiens
cacuggauuugcacaaguu

SEQ ID NO: 1367692 - RNA, 19 nt, Homo sapiens
guggugcaguucugagugu

SEQ ID NO: 1367693 - RNA, 19 nt, Homo sapiens
ucuguaaucccagcaguuu

SEQ ID NO: 1367694 - RNA, 19 nt, Homo sapiens
ggucaugagccuuuuauau

SEQ ID NO: 1367695 - RNA, 19 nt, Homo sapiens
caaacugaggcaagagaau

SEQ ID NO: 1367696 - RNA, 19 nt, Homo sapiens
agacagaugaugugcaaag

SEQ ID NO: 1367697 - RNA, 19 nt, Homo sapiens
gacuugcaaacucuucuaa

SEQ ID NO: 1367698 - RNA, 19 nt, Homo sapiens
ggacagcagaacgacuuga

SEQ ID NO: 1367699 - RNA, 19 nt, Homo sapiens
cgacuugacacauguucau

SEQ ID NO: 1367700 - RNA, 19 nt, Homo sapiens
aaacugaggcaagagaauc

SEQ ID NO: 1367701 - RNA, 19 nt, Homo sapiens
cuugcaaacucuucuaagg

SEQ ID NO: 1367702 - RNA, 19 nt, Homo sapiens
agacuccgaugcuacaaaa

SEQ ID NO: 1367703 - RNA, 19 nt, Homo sapiens
ucugcucgcugguguacga

SEQ ID NO: 1367704 - RNA, 19 nt, Homo sapiens
ggccuggcauggugauguc

SEQ ID NO: 1367705 - RNA, 19 nt, Homo sapiens
ugacuugcaaacucuucua

SEQ ID NO: 1367706 - RNA, 19 nt, Homo sapiens
gcuaauaaaugcuucuuca

SEQ ID NO: 1367707 - RNA, 19 nt, Homo sapiens
cgacauaccuucggacuag

SEQ ID NO: 1367708 - RNA, 19 nt, Homo sapiens
gggaugagauuuggcguuu

SEQ ID NO: 1367709 - RNA, 19 nt, Homo sapiens
gaaccuaggaggccugauu

SEQ ID NO: 1367710 - RNA, 19 nt, Homo sapiens
aggaugagauuuaggguuu

SEQ ID NO: 1367711 - RNA, 19 nt, Homo sapiens
gggcucagcucacauucug

SEQ ID NO: 1367712 - RNA, 19 nt, Homo sapiens
ggaaauaaggagccucuag

SEQ ID NO: 1367713 - RNA, 19 nt, Homo sapiens
caucuuggcuucacagcau

SEQ ID NO: 1367714 - RNA, 19 nt, Homo sapiens
uaggaggccugauuaagau

SEQ ID NO: 1367715 - RNA, 19 nt, Homo sapiens
caugggcuguccucucuuu

SEQ ID NO: 1367716 - RNA, 19 nt, Homo sapiens
cuaggaggccugauuaaga

SEQ ID NO: 1367717 - RNA, 19 nt, Homo sapiens
ggaggaaggcgggaaccua

SEQ ID NO: 1367718 - RNA, 19 nt, Homo sapiens
ccuaauauccggacugcaa

SEQ ID NO: 1367719 - RNA, 19 nt, Homo sapiens
ggcccugcaugcuaauaaa

SEQ ID NO: 1367720 - RNA, 19 nt, Homo sapiens
ggccuugcccuggaaauaa

SEQ ID NO: 1367721 - RNA, 19 nt, Homo sapiens
gcuguccucucuuugcaau

SEQ ID NO: 1367722 - RNA, 19 nt, Homo sapiens
gagagaaggaccccaagua

SEQ ID NO: 1367723 - RNA, 19 nt, Homo sapiens
gaugagauuuggcguuucc

SEQ ID NO: 1367724 - RNA, 19 nt, Homo sapiens
ggaaggcgggaaccuagga

SEQ ID NO: 1367725 - RNA, 19 nt, Homo sapiens
gggaggccagccagcuuua

SEQ ID NO: 1367726 - RNA, 19 nt, Homo sapiens
gccuuacgcuggccacugu

SEQ ID NO: 1367727 - RNA, 19 nt, Homo sapiens
caucaaccucugcaucuug

SEQ ID NO: 1367728 - RNA, 19 nt, Homo sapiens
gggcuguccucucuuugca

SEQ ID NO: 1367729 - RNA, 19 nt, Homo sapiens
gggcccugcaugcuaauaa

SEQ ID NO: 1367730 - RNA, 19 nt, Homo sapiens
aaccuaggaggccugauua

SEQ ID NO: 1367731 - RNA, 19 nt, Homo sapiens
ucgggaucuucaccuaaua

SEQ ID NO: 1367732 - RNA, 19 nt, Homo sapiens
acagugcucuccgccagaa

SEQ ID NO: 1367733 - RNA, 19 nt, Homo sapiens
ugcaaaccguggagaagga

SEQ ID NO: 1367734 - RNA, 19 nt, Homo sapiens
ggaugagauuuaggguuuc

SEQ ID NO: 1367735 - RNA, 19 nt, Homo sapiens
caugggcugugccuucauc

SEQ ID NO: 1367736 - RNA, 19 nt, Homo sapiens
ucaucaaccucugcaucuu

SEQ ID NO: 1367737 - RNA, 19 nt, Homo sapiens
ggaugagauuuggcguuuc

SEQ ID NO: 1367738 - RNA, 19 nt, Homo sapiens
gccuugcccuggaaauaag

SEQ ID NO: 1367739 - RNA, 19 nt, Homo sapiens
cugcuguuccugagccuua

SEQ ID NO: 1367740 - RNA, 19 nt, Homo sapiens
ggacuagugcagagcaaac

SEQ ID NO: 1367741 - RNA, 19 nt, Homo sapiens
gcaaacucuuccccuucua

SEQ ID NO: 1367742 - RNA, 19 nt, Homo sapiens
gugcucuccgccagaauuu

SEQ ID NO: 1367743 - RNA, 19 nt, Homo sapiens
gcgagaagauugcuuaauu

SEQ ID NO: 1367744 - RNA, 19 nt, Homo sapiens
gaagauugcuuaauucaca

SEQ ID NO: 1367745 - RNA, 19 nt, Homo sapiens
ggucaugcaucccuuaaua

SEQ ID NO: 1367746 - RNA, 19 nt, Homo sapiens
ggacagaagccauauaaau

SEQ ID NO: 1367747 - RNA, 19 nt, Homo sapiens
ggaugugccucgagcguua

SEQ ID NO: 1367748 - RNA, 19 nt, Homo sapiens
gagagaagccuuaugaaug

SEQ ID NO: 1367749 - RNA, 19 nt, Homo sapiens
ggacacagaguuggaaaua

SEQ ID NO: 1367750 - RNA, 19 nt, Homo sapiens
gagaaacccuaugaaugua

SEQ ID NO: 1367751 - RNA, 19 nt, Homo sapiens
gagagaagcccuaugaaug

SEQ ID NO: 1367752 - RNA, 19 nt, Homo sapiens
agacacaccuccaguaaga

SEQ ID NO: 1367753 - RNA, 19 nt, Homo sapiens
gagaagcccuaugaaugua

SEQ ID NO: 1367754 - RNA, 19 nt, Homo sapiens
gaaacccuaugaauguaaa

SEQ ID NO: 1367755 - RNA, 19 nt, Homo sapiens
uaagaaagaucaucagcau

SEQ ID NO: 1367756 - RNA, 19 nt, Homo sapiens
gagagaaacccuaugaaug

SEQ ID NO: 1367757 - RNA, 19 nt, Homo sapiens
cagaugacaugcugaagaa

SEQ ID NO: 1367758 - RNA, 19 nt, Homo sapiens
gagaaaccauaugaaugua

SEQ ID NO: 1367759 - RNA, 19 nt, Homo sapiens
ggagagaaaccauaugaau

SEQ ID NO: 1367760 - RNA, 19 nt, Homo sapiens
ugucucaguuuguaucuua

SEQ ID NO: 1367761 - RNA, 19 nt, Homo sapiens
gacagaagccauauaaaug

SEQ ID NO: 1367762 - RNA, 19 nt, Homo sapiens
ugacagcauucagaaauaa

SEQ ID NO: 1367763 - RNA, 19 nt, Homo sapiens
cagaagccauauaaaugua

SEQ ID NO: 1367764 - RNA, 19 nt, Homo sapiens
gaauguaaacaauguggua

SEQ ID NO: 1367765 - RNA, 19 nt, Homo sapiens
guaagaaagccuucaguga

SEQ ID NO: 1367766 - RNA, 19 nt, Homo sapiens
ggagagaaacccuaugaau

SEQ ID NO: 1367767 - RNA, 19 nt, Homo sapiens
gggagaagccguaugaaug

SEQ ID NO: 1367768 - RNA, 19 nt, Homo sapiens
ggagagaagccuuaugaau

SEQ ID NO: 1367769 - RNA, 19 nt, Homo sapiens
ggauguagaugugaacuuc

SEQ ID NO: 1367770 - RNA, 19 nt, Homo sapiens
ccagaagaaucucuacaga

SEQ ID NO: 1367771 - RNA, 19 nt, Homo sapiens
cgagaagauugcuuaauuc

SEQ ID NO: 1367772 - RNA, 19 nt, Homo sapiens
gaauguaaacaguguggua

SEQ ID NO: 1367773 - RNA, 19 nt, Homo sapiens
gagagaaaccauaugaaug

SEQ ID NO: 1367774 - RNA, 19 nt, Homo sapiens
gagauggacccuacaaaug

SEQ ID NO: 1367775 - RNA, 19 nt, Homo sapiens
ggagagaagcccuaugaau

SEQ ID NO: 1367776 - RNA, 19 nt, Homo sapiens
gagaagccguaugaaugua

SEQ ID NO: 1367777 - RNA, 19 nt, Homo sapiens
ggagaagccguaugaaugu

SEQ ID NO: 1367778 - RNA, 19 nt, Homo sapiens
ggaaagccuugaugugucu

SEQ ID NO: 1367779 - RNA, 19 nt, Homo sapiens
ggaaagaucagaaaauuga

SEQ ID NO: 1367780 - RNA, 19 nt, Homo sapiens
gaagccguaugaauguaaa

SEQ ID NO: 1367781 - RNA, 19 nt, Homo sapiens
ggagauggacccuacaaau

SEQ ID NO: 1367782 - RNA, 19 nt, Homo sapiens
uaagaaagccuucagugau

SEQ ID NO: 1367783 - RNA, 19 nt, Homo sapiens
gacacaagccauaugagua

SEQ ID NO: 1367784 - RNA, 19 nt, Homo sapiens
ucacauaagauuccuagaa

SEQ ID NO: 1367785 - RNA, 19 nt, Homo sapiens
gggaaagccuucagaucug

SEQ ID NO: 1367786 - RNA, 19 nt, Homo sapiens
agagaaacccuaugaaugu

SEQ ID NO: 1367787 - RNA, 19 nt, Homo sapiens
cauaugaguaucaggaaua

SEQ ID NO: 1367788 - RNA, 19 nt, Homo sapiens
gacacagaguuggaaauaa

SEQ ID NO: 1367789 - RNA, 19 nt, Homo sapiens
cacugugacuggacuguua

SEQ ID NO: 1367790 - RNA, 19 nt, Homo sapiens
ugacccagguuccagauga

SEQ ID NO: 1367791 - RNA, 19 nt, Homo sapiens
ggagugggcuuugcuggau

SEQ ID NO: 1367792 - RNA, 19 nt, Homo sapiens
gagagacacaccuccagua

SEQ ID NO: 1367793 - RNA, 19 nt, Homo sapiens
cgaauccaaucaugguaaa

SEQ ID NO: 1367794 - RNA, 19 nt, Homo sapiens
cacauaagauuccuagaag

SEQ ID NO: 1367795 - RNA, 19 nt, Homo sapiens
gagaagauugcuuaauuca

SEQ ID NO: 1367796 - RNA, 19 nt, Homo sapiens
ggacacaagccauaugagu

SEQ ID NO: 1367797 - RNA, 19 nt, Homo sapiens
gaaagaucaucagcaugga

SEQ ID NO: 1367798 - RNA, 19 nt, Homo sapiens
acacagaguuggaaauaac

SEQ ID NO: 1367799 - RNA, 19 nt, Homo sapiens
gagggcgucuugcaccaaa

SEQ ID NO: 1367800 - RNA, 19 nt, Homo sapiens
guaugaauguaaacagugu

SEQ ID NO: 1367801 - RNA, 19 nt, Homo sapiens
agagaaaccauaugaaugu

SEQ ID NO: 1367802 - RNA, 19 nt, Homo sapiens
aagaaagccuucagugauc

SEQ ID NO: 1367803 - RNA, 19 nt, Homo sapiens
gaacucacacuggagagaa

SEQ ID NO: 1367804 - RNA, 19 nt, Homo sapiens
agagaagccuuaugaaugc

SEQ ID NO: 1367805 - RNA, 19 nt, Homo sapiens
gaacucacacuggagagaa

SEQ ID NO: 1367806 - RNA, 19 nt, Homo sapiens
gaacucacacuggagagaa

SEQ ID NO: 1367807 - RNA, 19 nt, Homo sapiens
gaaaccccaucucuacuaa

SEQ ID NO: 1367808 - RNA, 19 nt, Homo sapiens
ucaauuccguucgauauca

SEQ ID NO: 1367809 - RNA, 19 nt, Homo sapiens
ggaaaccuuaugauuguga

SEQ ID NO: 1367810 - RNA, 19 nt, Homo sapiens
gaugacaugcugaagaaga

SEQ ID NO: 1367811 - RNA, 19 nt, Homo sapiens
ccauaugaauguaaacagu

SEQ ID NO: 1367812 - RNA, 19 nt, Homo sapiens
gaagccauauaaauguaca

SEQ ID NO: 1367813 - RNA, 19 nt, Homo sapiens
ugaugugucucaguuugua

SEQ ID NO: 1367814 - RNA, 19 nt, Homo sapiens
ucaggaauauggacagaag

SEQ ID NO: 1367815 - RNA, 19 nt, Homo sapiens
gaagucagcgugggucaug

SEQ ID NO: 1367816 - RNA, 19 nt, Homo sapiens
ggggaaaccuuaugauugu

SEQ ID NO: 1367817 - RNA, 19 nt, Homo sapiens
acacaagccauaugaguau

SEQ ID NO: 1367818 - RNA, 19 nt, Homo sapiens
uugacagcauucagaaaua

SEQ ID NO: 1367819 - RNA, 19 nt, Homo sapiens
gacucacacuggagagaaa

SEQ ID NO: 1367820 - RNA, 19 nt, Homo sapiens
agagaagcccuaugaaugu

SEQ ID NO: 1367821 - RNA, 19 nt, Homo sapiens
uggauucaguggucuuuga

SEQ ID NO: 1367822 - RNA, 19 nt, Homo sapiens
uaucuuauccacaaacgaa

SEQ ID NO: 1367823 - RNA, 19 nt, Homo sapiens
gagaugugaugcaggaaac

SEQ ID NO: 1367824 - RNA, 19 nt, Homo sapiens
gaagacacaggauaaugca

SEQ ID NO: 1367825 - RNA, 19 nt, Homo sapiens
ccagaugacaugcugaaga

SEQ ID NO: 1367826 - RNA, 19 nt, Homo sapiens
ucgaauacaugaaagaacu

SEQ ID NO: 1367827 - RNA, 19 nt, Homo sapiens
ucaucagcauggagaaauu

SEQ ID NO: 1367828 - RNA, 19 nt, Homo sapiens
gaaaguaagaaagaucauc

SEQ ID NO: 1367829 - RNA, 19 nt, Homo sapiens
agagacacaccuccaguaa

SEQ ID NO: 1367830 - RNA, 19 nt, Homo sapiens
guguuucccucaaaucaug

SEQ ID NO: 1367831 - RNA, 19 nt, Homo sapiens
acagaagccauauaaaugu

SEQ ID NO: 1367832 - RNA, 19 nt, Homo sapiens
gaagcccuaugaauguaag

SEQ ID NO: 1367833 - RNA, 19 nt, Homo sapiens
acacuggacacaagccaua

SEQ ID NO: 1367834 - RNA, 19 nt, Homo sapiens
ggacucacacuggagagaa

SEQ ID NO: 1367835 - RNA, 19 nt, Homo sapiens
gaucaucagcauggagaaa

SEQ ID NO: 1367836 - RNA, 19 nt, Homo sapiens
ggccaaggcgagaagauug

SEQ ID NO: 1367837 - RNA, 19 nt, Homo sapiens
gaaaggccaaggcgagaag

SEQ ID NO: 1367838 - RNA, 19 nt, Homo sapiens
gaacacauggaaggacuca

SEQ ID NO: 1367839 - RNA, 19 nt, Homo sapiens
gccuugaugugucucaguu

SEQ ID NO: 1367840 - RNA, 19 nt, Homo sapiens
cguucgauaucaugaaaga

SEQ ID NO: 1367841 - RNA, 19 nt, Homo sapiens
acacuggagagaagccuua

SEQ ID NO: 1367842 - RNA, 19 nt, Homo sapiens
agauggacccuacaaaugu

SEQ ID NO: 1367843 - RNA, 19 nt, Homo sapiens
gcauucagcuugcuuaauu

SEQ ID NO: 1367844 - RNA, 19 nt, Homo sapiens
gcaaacaagcauucaauua

SEQ ID NO: 1367845 - RNA, 19 nt, Homo sapiens
gaaaguaaguauagacaga

SEQ ID NO: 1367846 - RNA, 19 nt, Homo sapiens
gaaaagcguuccauaauuu

SEQ ID NO: 1367847 - RNA, 19 nt, Homo sapiens
agaaagaccuuaugaaugu

SEQ ID NO: 1367848 - RNA, 19 nt, Homo sapiens
gaaaggacacaaacacaua

SEQ ID NO: 1367849 - RNA, 19 nt, Homo sapiens
ggauggaccuuauaaaugu

SEQ ID NO: 1367850 - RNA, 19 nt, Homo sapiens
ggagaaagaccuuauaaau

SEQ ID NO: 1367851 - RNA, 19 nt, Homo sapiens
ggaaagaccagaacauuga

SEQ ID NO: 1367852 - RNA, 19 nt, Homo sapiens
gcaaugugguaaagccuua

SEQ ID NO: 1367853 - RNA, 19 nt, Homo sapiens
gguaaagccuuaauuguuc

SEQ ID NO: 1367854 - RNA, 19 nt, Homo sapiens
ugaaagaacucacauugga

SEQ ID NO: 1367855 - RNA, 19 nt, Homo sapiens
gaagagaaagucaaugaaa

SEQ ID NO: 1367856 - RNA, 19 nt, Homo sapiens
gaaggaaacccuaugaaug

SEQ ID NO: 1367857 - RNA, 19 nt, Homo sapiens
gagaaaccguaucaaugua

SEQ ID NO: 1367858 - RNA, 19 nt, Homo sapiens
gagagaaacccuauaaaug

SEQ ID NO: 1367859 - RNA, 19 nt, Homo sapiens
gagaaaccguaucaaugua

SEQ ID NO: 1367860 - RNA, 19 nt, Homo sapiens
gagagaaaccguauaaaug

SEQ ID NO: 1367861 - RNA, 19 nt, Homo sapiens
ccauuggugucauguauua

SEQ ID NO: 1367862 - RNA, 19 nt, Homo sapiens
ggagaaagaccuuaugaau

SEQ ID NO: 1367863 - RNA, 19 nt, Homo sapiens
gagagaaaccuaugaaugu

SEQ ID NO: 1367864 - RNA, 19 nt, Homo sapiens
gagaaacccuaugaaugua

SEQ ID NO: 1367865 - RNA, 19 nt, Homo sapiens
gagaaacccuaugaaugua

SEQ ID NO: 1367866 - RNA, 19 nt, Homo sapiens
gguaaagccuucacucguu

SEQ ID NO: 1367867 - RNA, 19 nt, Homo sapiens
agagaaggcuuaucaaugu

SEQ ID NO: 1367868 - RNA, 19 nt, Homo sapiens
ggagaaaccguaucaaugu

SEQ ID NO: 1367869 - RNA, 19 nt, Homo sapiens
gggaaagccuucagauaug

SEQ ID NO: 1367870 - RNA, 19 nt, Homo sapiens
gguaacucaucuucuaaua

SEQ ID NO: 1367871 - RNA, 19 nt, Homo sapiens
gucaagaaccuuucaauuu

SEQ ID NO: 1367872 - RNA, 19 nt, Homo sapiens
ggagagaaacccuauaaau

SEQ ID NO: 1367873 - RNA, 19 nt, Homo sapiens
ggagagaaaccguauaaau

SEQ ID NO: 1367874 - RNA, 19 nt, Homo sapiens
gaaaggacccacucuagga

SEQ ID NO: 1367875 - RNA, 19 nt, Homo sapiens
gaaaccguaugaauguaaa

SEQ ID NO: 1367876 - RNA, 19 nt, Homo sapiens
ggcagaaacucuaugaaug

SEQ ID NO: 1367877 - RNA, 19 nt, Homo sapiens
gagaaagaccuuaugaaug

SEQ ID NO: 1367878 - RNA, 19 nt, Homo sapiens
cuagguaacucaucuucua

SEQ ID NO: 1367879 - RNA, 19 nt, Homo sapiens
gagagaauccguaugaaug

SEQ ID NO: 1367880 - RNA, 19 nt, Homo sapiens
ggaagaaaguaaguauaga

SEQ ID NO: 1367881 - RNA, 19 nt, Homo sapiens
gagagaaacccuaugaaug

SEQ ID NO: 1367882 - RNA, 19 nt, Homo sapiens
gagagaaacccuaugaaug

SEQ ID NO: 1367883 - RNA, 19 nt, Homo sapiens
gagagaaaccguaucaaug

SEQ ID NO: 1367884 - RNA, 19 nt, Homo sapiens
gagaaggcuuaucaaugua

SEQ ID NO: 1367885 - RNA, 19 nt, Homo sapiens
gagagaaaccguaugaaug

SEQ ID NO: 1367886 - RNA, 19 nt, Homo sapiens
ggaaagaaacccuaugcuu

SEQ ID NO: 1367887 - RNA, 19 nt, Homo sapiens
ggagagaaaccuaugaaug

SEQ ID NO: 1367888 - RNA, 19 nt, Homo sapiens
gaaagaccuuaugaaugua

SEQ ID NO: 1367889 - RNA, 19 nt, Homo sapiens
gaaacccuaugcuuguaaa

SEQ ID NO: 1367890 - RNA, 19 nt, Homo sapiens
ucagauauguccagaacuu

SEQ ID NO: 1367891 - RNA, 19 nt, Homo sapiens
gagagaaggcuuaucaaug

SEQ ID NO: 1367892 - RNA, 19 nt, Homo sapiens
ggaucacacuggaaagaaa

SEQ ID NO: 1367893 - RNA, 19 nt, Homo sapiens
ggacacaaacacauaagaa

SEQ ID NO: 1367894 - RNA, 19 nt, Homo sapiens
guccagaacuuucgauuuc

SEQ ID NO: 1367895 - RNA, 19 nt, Homo sapiens
gagaaacccuaugagugua

SEQ ID NO: 1367896 - RNA, 19 nt, Homo sapiens
gcagaaacucuaugaaugu

SEQ ID NO: 1367897 - RNA, 19 nt, Homo sapiens
caagaucguuugaauacau

SEQ ID NO: 1367898 - RNA, 19 nt, Homo sapiens
ggaaagccuucagauaugu

SEQ ID NO: 1367899 - RNA, 19 nt, Homo sapiens
uauccucucuuacaaguuu

SEQ ID NO: 1367900 - RNA, 19 nt, Homo sapiens
gaauguaaacaauguggua

SEQ ID NO: 1367901 - RNA, 19 nt, Homo sapiens
gaaccugaccucuauagga

SEQ ID NO: 1367902 - RNA, 19 nt, Homo sapiens
gaaacucuaugaauguaag

SEQ ID NO: 1367903 - RNA, 19 nt, Homo sapiens
gagaauccguaugaaugua

SEQ ID NO: 1367904 - RNA, 19 nt, Homo sapiens
cgagagagaauccguauga

SEQ ID NO: 1367905 - RNA, 19 nt, Homo sapiens
ggagagaaacccuaugaau

SEQ ID NO: 1367906 - RNA, 19 nt, Homo sapiens
gagaaacccuauaaaugca

SEQ ID NO: 1367907 - RNA, 19 nt, Homo sapiens
aaagggaucugaugaccaa

SEQ ID NO: 1367908 - RNA, 19 nt, Homo sapiens
ggagagaaacccuaugaau

SEQ ID NO: 1367909 - RNA, 19 nt, Homo sapiens
ggagagaaaccguaucaau

SEQ ID NO: 1367910 - RNA, 19 nt, Homo sapiens
gagaaaccguaugaaugua

SEQ ID NO: 1367911 - RNA, 19 nt, Homo sapiens
ggagagaaaccguaugaau

SEQ ID NO: 1367912 - RNA, 19 nt, Homo sapiens
cagaaacucuaugaaugua

SEQ ID NO: 1367913 - RNA, 19 nt, Homo sapiens
gggcuuugcuggauauuuc

SEQ ID NO: 1367914 - RNA, 19 nt, Homo sapiens
agagaaaccuaugaaugua

SEQ ID NO: 1367915 - RNA, 19 nt, Homo sapiens
gacacacacuggagagaaa

SEQ ID NO: 1367916 - RNA, 19 nt, Homo sapiens
caacuucgaauccaucgua

SEQ ID NO: 1367917 - RNA, 19 nt, Homo sapiens
gggaaagucuucagaucug

SEQ ID NO: 1367918 - RNA, 19 nt, Homo sapiens
gcauuauccucucuuacaa

SEQ ID NO: 1367919 - RNA, 19 nt, Homo sapiens
ggauguggcugugaacuuc

SEQ ID NO: 1367920 - RNA, 19 nt, Homo sapiens
gaccaaagcagggaauaaa

SEQ ID NO: 1367921 - RNA, 19 nt, Homo sapiens
gagaaaagccuuaugaaug

SEQ ID NO: 1367922 - RNA, 19 nt, Homo sapiens
gggagaaaccguaucaaug

SEQ ID NO: 1367923 - RNA, 19 nt, Homo sapiens
gagaaaccuaugaauguaa

SEQ ID NO: 1367924 - RNA, 19 nt, Homo sapiens
gggaaagccuucagaucug

SEQ ID NO: 1367925 - RNA, 19 nt, Homo sapiens
ggaagagucaacaaccuaa

SEQ ID NO: 1367926 - RNA, 19 nt, Homo sapiens
cagaagagaaagucaauga

SEQ ID NO: 1367927 - RNA, 19 nt, Homo sapiens
ggagaaacuucaggagugu

SEQ ID NO: 1367928 - RNA, 19 nt, Homo sapiens
gaacauugaauaugaguac

SEQ ID NO: 1367929 - RNA, 19 nt, Homo sapiens
agagaaacccuaugaaugu

SEQ ID NO: 1367930 - RNA, 19 nt, Homo sapiens
agagaaacccuaugaaugu

SEQ ID NO: 1367931 - RNA, 19 nt, Homo sapiens
gauucacacuggagagaaa

SEQ ID NO: 1367932 - RNA, 19 nt, Homo sapiens
aaagcauuauccucucuua

SEQ ID NO: 1367933 - RNA, 19 nt, Homo sapiens
gggauggaccuuauaaaug

SEQ ID NO: 1367934 - RNA, 19 nt, Homo sapiens
aaucuucaauugcauggua

SEQ ID NO: 1367935 - RNA, 19 nt, Homo sapiens
ggagugggcuuugcuggau

SEQ ID NO: 1367936 - RNA, 19 nt, Homo sapiens
ggagagaaggcuuaucaau

SEQ ID NO: 1367937 - RNA, 19 nt, Homo sapiens
gauggaccuuauaaaugua

SEQ ID NO: 1367938 - RNA, 19 nt, Homo sapiens
ggaaacccuaugaauguaa

SEQ ID NO: 1367939 - RNA, 19 nt, Homo sapiens
ggagagaaacccuaugagu

SEQ ID NO: 1367940 - RNA, 19 nt, Homo sapiens
gaaguaaaaucaugugaca

SEQ ID NO: 1367941 - RNA, 19 nt, Homo sapiens
uaaagaagacagucauugu

SEQ ID NO: 1367942 - RNA, 19 nt, Homo sapiens
ggaaagcauuauccucucu

SEQ ID NO: 1367943 - RNA, 19 nt, Homo sapiens
gacccaaccuuauuuauua

SEQ ID NO: 1367944 - RNA, 19 nt, Homo sapiens
aaacagagaucuaccagua

SEQ ID NO: 1367945 - RNA, 19 nt, Homo sapiens
gcaauacgcucaguuauau

SEQ ID NO: 1367946 - RNA, 19 nt, Homo sapiens
aaaggagacuuauguguua

SEQ ID NO: 1367947 - RNA, 19 nt, Homo sapiens
gaacaagugugccucaaug

SEQ ID NO: 1367948 - RNA, 19 nt, Homo sapiens
guguauaucuccaucuuua

SEQ ID NO: 1367949 - RNA, 19 nt, Homo sapiens
cuacaucccuacuaauaua

SEQ ID NO: 1367950 - RNA, 19 nt, Homo sapiens
gagaagucauuaccaaauu

SEQ ID NO: 1367951 - RNA, 19 nt, Homo sapiens
gaugugaacuuccaaagga

SEQ ID NO: 1367952 - RNA, 19 nt, Homo sapiens
ccaaggcacuuucuauuga

SEQ ID NO: 1367953 - RNA, 19 nt, Homo sapiens
gagagugacugaaacagaa

SEQ ID NO: 1367954 - RNA, 19 nt, Homo sapiens
gggcaacuuuccacacuua

SEQ ID NO: 1367955 - RNA, 19 nt, Homo sapiens
gcaucaagcuuguuuguca

SEQ ID NO: 1367956 - RNA, 19 nt, Homo sapiens
ggccugagauucugcauuu

SEQ ID NO: 1367957 - RNA, 19 nt, Homo sapiens
caacagcuauagagagaaa

SEQ ID NO: 1367958 - RNA, 19 nt, Homo sapiens
aaccauauaugccagauua

SEQ ID NO: 1367959 - RNA, 19 nt, Homo sapiens
gaacugcaaacucaugaua

SEQ ID NO: 1367960 - RNA, 19 nt, Homo sapiens
caagaaagcugaaaaugaa

SEQ ID NO: 1367961 - RNA, 19 nt, Homo sapiens
uaucagcaaugugcaauua

SEQ ID NO: 1367962 - RNA, 19 nt, Homo sapiens
gaggaugaguggcuuugua

SEQ ID NO: 1367963 - RNA, 19 nt, Homo sapiens
gaugggauccuauguguuu

SEQ ID NO: 1367964 - RNA, 19 nt, Homo sapiens
ccaguaagauggaauuuca

SEQ ID NO: 1367965 - RNA, 19 nt, Homo sapiens
gcaaacucaugauacauug

SEQ ID NO: 1367966 - RNA, 19 nt, Homo sapiens
caaugaaacuugaugugaa

SEQ ID NO: 1367967 - RNA, 19 nt, Homo sapiens
gaaaguucccgacuacaaa

SEQ ID NO: 1367968 - RNA, 19 nt, Homo sapiens
gauccuauguguuuggaaa

SEQ ID NO: 1367969 - RNA, 19 nt, Homo sapiens
ggauaaagcaaggaaauaa

SEQ ID NO: 1367970 - RNA, 19 nt, Homo sapiens
gagaugggauccuaugugu

SEQ ID NO: 1367971 - RNA, 19 nt, Homo sapiens
ggaugaaaguucccgacua

SEQ ID NO: 1367972 - RNA, 19 nt, Homo sapiens
uaaauacguugaacaagug

SEQ ID NO: 1367973 - RNA, 19 nt, Homo sapiens
gcacauaguaaucauauca

SEQ ID NO: 1367974 - RNA, 19 nt, Homo sapiens
gcagacgacuaaauacguu

SEQ ID NO: 1367975 - RNA, 19 nt, Homo sapiens
uuaagaaguuggaauguug

SEQ ID NO: 1367976 - RNA, 19 nt, Homo sapiens
gaaguugccaggauuagaa

SEQ ID NO: 1367977 - RNA, 19 nt, Homo sapiens
uaacuaacaugagaccaaa

SEQ ID NO: 1367978 - RNA, 19 nt, Homo sapiens
gaagaggaagcuaaaguga

SEQ ID NO: 1367979 - RNA, 19 nt, Homo sapiens
auacagaucuugcuuucaa

SEQ ID NO: 1367980 - RNA, 19 nt, Homo sapiens
gaguggagaucugggauaa

SEQ ID NO: 1367981 - RNA, 19 nt, Homo sapiens
cuaagaagcguauaccuaa

SEQ ID NO: 1367982 - RNA, 19 nt, Homo sapiens
caauacagaucuugcuuuc

SEQ ID NO: 1367983 - RNA, 19 nt, Homo sapiens
aagcacagaggaaauauua

SEQ ID NO: 1367984 - RNA, 19 nt, Homo sapiens
cuaaauacguugaacaagu

SEQ ID NO: 1367985 - RNA, 19 nt, Homo sapiens
gaaacgaggaccuagaaga

SEQ ID NO: 1367986 - RNA, 19 nt, Homo sapiens
ccagugaaguuuaaucuag

SEQ ID NO: 1367987 - RNA, 19 nt, Homo sapiens
gaugaaaguucccgacuac

SEQ ID NO: 1367988 - RNA, 19 nt, Homo sapiens
uaucaccgcugcauaacaa

SEQ ID NO: 1367989 - RNA, 19 nt, Homo sapiens
ggaccuagaagaucccuaa

SEQ ID NO: 1367990 - RNA, 19 nt, Homo sapiens
ggugagaagucauuaccaa

SEQ ID NO: 1367991 - RNA, 19 nt, Homo sapiens
gcguauaccuaacuguaaa

SEQ ID NO: 1367992 - RNA, 19 nt, Homo sapiens
aauauuagcuggcagagau

SEQ ID NO: 1367993 - RNA, 19 nt, Homo sapiens
uaaaggagacuuauguguu

SEQ ID NO: 1367994 - RNA, 19 nt, Homo sapiens
gcaagaauuuccaagaacu

SEQ ID NO: 1367995 - RNA, 19 nt, Homo sapiens
gcagagagugugcauguga

SEQ ID NO: 1367996 - RNA, 19 nt, Homo sapiens
gcagaaguugccaggauua

SEQ ID NO: 1367997 - RNA, 19 nt, Homo sapiens
ccagugauguggaaagaga

SEQ ID NO: 1367998 - RNA, 19 nt, Homo sapiens
gaaacuugaugugaacuuc

SEQ ID NO: 1367999 - RNA, 19 nt, Homo sapiens
gaagaucccuaaaacagaa

SEQ ID NO: 1368000 - RNA, 19 nt, Homo sapiens
uaaauggacuauuccuugu

SEQ ID NO: 1368001 - RNA, 19 nt, Homo sapiens
gcagagauaacgaagagaa

SEQ ID NO: 1368002 - RNA, 19 nt, Homo sapiens
gaagagagggguuuuguuu

SEQ ID NO: 1368003 - RNA, 19 nt, Homo sapiens
gagaggugcuuguccagau

SEQ ID NO: 1368004 - RNA, 19 nt, Homo sapiens
guacagaugaagcgaauug

SEQ ID NO: 1368005 - RNA, 19 nt, Homo sapiens
ggacgcgguuaaugccuaa

SEQ ID NO: 1368006 - RNA, 19 nt, Homo sapiens
gaaagaagccaaggagaag

SEQ ID NO: 1368007 - RNA, 19 nt, Homo sapiens
caggagggauucuggugua

SEQ ID NO: 1368008 - RNA, 19 nt, Homo sapiens
ucagcaaugugcaauuauu

SEQ ID NO: 1368009 - RNA, 19 nt, Homo sapiens
uaagauggaauuucaguga

SEQ ID NO: 1368010 - RNA, 19 nt, Homo sapiens
acacuuaccugaaccaucu

SEQ ID NO: 1368011 - RNA, 19 nt, Homo sapiens
caagugugccucaaugaaa

SEQ ID NO: 1368012 - RNA, 19 nt, Homo sapiens
gaaggaagcaguaaaucca

SEQ ID NO: 1368013 - RNA, 19 nt, Homo sapiens
guuaagaaguuggaauguu

SEQ ID NO: 1368014 - RNA, 19 nt, Homo sapiens
ugcagacgcucuuguguuu

SEQ ID NO: 1368015 - RNA, 19 nt, Homo sapiens
cugagaacgucaacuauga

SEQ ID NO: 1368016 - RNA, 19 nt, Homo sapiens
ggaagcaguaaauccauaa

SEQ ID NO: 1368017 - RNA, 19 nt, Homo sapiens
ggagagagauuuucuuugg

SEQ ID NO: 1368018 - RNA, 19 nt, Homo sapiens
acacaguucuuuccaagug

SEQ ID NO: 1368019 - RNA, 19 nt, Homo sapiens
gaacugaaggacgcgguua

SEQ ID NO: 1368020 - RNA, 19 nt, Homo sapiens
caaggcacuuucuauugaa

SEQ ID NO: 1368021 - RNA, 19 nt, Homo sapiens
ucacaaaccaggaacauuc

SEQ ID NO: 1368022 - RNA, 19 nt, Homo sapiens
caagcuaccuaugcauuug

SEQ ID NO: 1368023 - RNA, 19 nt, Homo sapiens
ugagaaagcgagagaaaga

SEQ ID NO: 1368024 - RNA, 19 nt, Homo sapiens
ggaagaggaagcuaaagug

SEQ ID NO: 1368025 - RNA, 19 nt, Homo sapiens
cgacuccgauggaacaguu

SEQ ID NO: 1368026 - RNA, 19 nt, Homo sapiens
ugaggaagaucuuuguauc

SEQ ID NO: 1368027 - RNA, 19 nt, Homo sapiens
gugauuguauuucugauuc

SEQ ID NO: 1368028 - RNA, 19 nt, Homo sapiens
gaaaagcaaaugaguguuu

SEQ ID NO: 1368029 - RNA, 19 nt, Homo sapiens
ggcuacaucccuacuaaua

SEQ ID NO: 1368030 - RNA, 19 nt, Homo sapiens
cagcagaaguugccaggau

SEQ ID NO: 1368031 - RNA, 19 nt, Homo sapiens
ggacucgcaguacuugaua

SEQ ID NO: 1368032 - RNA, 19 nt, Homo sapiens
gaucauggaaugcgacaga

SEQ ID NO: 1368033 - RNA, 19 nt, Homo sapiens
ggagugaagucucgaaucc

SEQ ID NO: 1368034 - RNA, 19 nt, Homo sapiens
ggacauggucaguuccaaa

SEQ ID NO: 1368035 - RNA, 19 nt, Homo sapiens
gaauuucagugagauaugg

SEQ ID NO: 1368036 - RNA, 19 nt, Homo sapiens
aaagaugaguuaaccaaag

SEQ ID NO: 1368037 - RNA, 19 nt, Homo sapiens
gacuauuccuugugcauug

SEQ ID NO: 1368038 - RNA, 19 nt, Homo sapiens
acagagaucuaccaguaug

SEQ ID NO: 1368039 - RNA, 19 nt, Homo sapiens
gauaggcacacgaggauga

SEQ ID NO: 1368040 - RNA, 19 nt, Homo sapiens
ccagauuacuuuauaugca

SEQ ID NO: 1368041 - RNA, 19 nt, Homo sapiens
uaagaaggaagcaguaaau

SEQ ID NO: 1368042 - RNA, 19 nt, Homo sapiens
gggauaaagcaaggaaaua

SEQ ID NO: 1368043 - RNA, 19 nt, Homo sapiens
guaaauagcugaacucaaa

SEQ ID NO: 1368044 - RNA, 19 nt, Homo sapiens
gaacauguauucuaucaga

SEQ ID NO: 1368045 - RNA, 19 nt, Homo sapiens
ggaaaucagugucauuauu

SEQ ID NO: 1368046 - RNA, 19 nt, Homo sapiens
gccaacagcuucuuucuaa

SEQ ID NO: 1368047 - RNA, 19 nt, Homo sapiens
gcucugaagugaucuauuu

SEQ ID NO: 1368048 - RNA, 19 nt, Homo sapiens
ggaggaagcucaugaaugg

SEQ ID NO: 1368049 - RNA, 19 nt, Homo sapiens
ggacaggaauaaugcauug

SEQ ID NO: 1368050 - RNA, 19 nt, Homo sapiens
ccagaaagcauacaucuaa

SEQ ID NO: 1368051 - RNA, 19 nt, Homo sapiens
gaacacacccaagaauaua

SEQ ID NO: 1368052 - RNA, 19 nt, Homo sapiens
aaauaagccugccuucaua

SEQ ID NO: 1368053 - RNA, 19 nt, Homo sapiens
uuacauagguucauagaug

SEQ ID NO: 1368054 - RNA, 19 nt, Homo sapiens
gaggacguaugcucuauuu

SEQ ID NO: 1368055 - RNA, 19 nt, Homo sapiens
gagaacacacccaagaaua

SEQ ID NO: 1368056 - RNA, 19 nt, Homo sapiens
gcaaaggauuucacagugu

SEQ ID NO: 1368057 - RNA, 19 nt, Homo sapiens
ggucauacagggauauaua

SEQ ID NO: 1368058 - RNA, 19 nt, Homo sapiens
gguaagaauuugaaaccaa

SEQ ID NO: 1368059 - RNA, 19 nt, Homo sapiens
gagcaaagucauuauauuc

SEQ ID NO: 1368060 - RNA, 19 nt, Homo sapiens
gcucaugaauggaaccaaa

SEQ ID NO: 1368061 - RNA, 19 nt, Homo sapiens
ggaauaaacgacuucuaaa

SEQ ID NO: 1368062 - RNA, 19 nt, Homo sapiens
uaaacagucucuuucucua

SEQ ID NO: 1368063 - RNA, 19 nt, Homo sapiens
caaaugagagcuccuauca

SEQ ID NO: 1368064 - RNA, 19 nt, Homo sapiens
caaaggauuucacaguguu

SEQ ID NO: 1368065 - RNA, 19 nt, Homo sapiens
uauauaagcuucaguacca

SEQ ID NO: 1368066 - RNA, 19 nt, Homo sapiens
gcucugcucuguucucuca

SEQ ID NO: 1368067 - RNA, 19 nt, Homo sapiens
ucacaacucuggaaugucu

SEQ ID NO: 1368068 - RNA, 19 nt, Homo sapiens
gaaaccaggacaggaauaa

SEQ ID NO: 1368069 - RNA, 19 nt, Homo sapiens
caagcagaaugaacagaaa

SEQ ID NO: 1368070 - RNA, 19 nt, Homo sapiens
ucuggaaugucuucuuaua

SEQ ID NO: 1368071 - RNA, 19 nt, Homo sapiens
gaacauuguccuucaaagu

SEQ ID NO: 1368072 - RNA, 19 nt, Homo sapiens
aaugagagcuccuaucaca

SEQ ID NO: 1368073 - RNA, 19 nt, Homo sapiens
gucggcagcucaaauguuu

SEQ ID NO: 1368074 - RNA, 19 nt, Homo sapiens
gguaucacauuuauaugga

SEQ ID NO: 1368075 - RNA, 19 nt, Homo sapiens
caacagcuucuuucuaaug

SEQ ID NO: 1368076 - RNA, 19 nt, Homo sapiens
gaauggagcaguggacaaa

SEQ ID NO: 1368077 - RNA, 19 nt, Homo sapiens
acucuggaaugucuucuua

SEQ ID NO: 1368078 - RNA, 19 nt, Homo sapiens
gggcauugcuacuuaucaa

SEQ ID NO: 1368079 - RNA, 19 nt, Homo sapiens
gagcuccaauuccagugua

SEQ ID NO: 1368080 - RNA, 19 nt, Homo sapiens
gggaagauggugccuauga

SEQ ID NO: 1368081 - RNA, 19 nt, Homo sapiens
gcugucaaauccuuaauag

SEQ ID NO: 1368082 - RNA, 19 nt, Homo sapiens
caucugcucugcucuguuc

SEQ ID NO: 1368083 - RNA, 19 nt, Homo sapiens
gcuuaacccucaucacuuc

SEQ ID NO: 1368084 - RNA, 19 nt, Homo sapiens
aaugugagaucaugauaga

SEQ ID NO: 1368085 - RNA, 19 nt, Homo sapiens
uuaaagugcuucuauaugc

SEQ ID NO: 1368086 - RNA, 19 nt, Homo sapiens
caaagauccugcccuugug

SEQ ID NO: 1368087 - RNA, 19 nt, Homo sapiens
ggaaucaucagugaacaaa

SEQ ID NO: 1368088 - RNA, 19 nt, Homo sapiens
ggacguaugcucuauuucu

SEQ ID NO: 1368089 - RNA, 19 nt, Homo sapiens
gucaaauccuuaauagcua

SEQ ID NO: 1368090 - RNA, 19 nt, Homo sapiens
aaacauucauggugucuca

SEQ ID NO: 1368091 - RNA, 19 nt, Homo sapiens
ggauuaaaccugaauaacu

SEQ ID NO: 1368092 - RNA, 19 nt, Homo sapiens
cagggaagauggugccuau

SEQ ID NO: 1368093 - RNA, 19 nt, Homo sapiens
gaaugucuucuuauacuga

SEQ ID NO: 1368094 - RNA, 19 nt, Homo sapiens
ugccauugcuacuuugaua

SEQ ID NO: 1368095 - RNA, 19 nt, Homo sapiens
gcugauggaaugacaauug

SEQ ID NO: 1368096 - RNA, 19 nt, Homo sapiens
gacguaugcucuauuucuu

SEQ ID NO: 1368097 - RNA, 19 nt, Homo sapiens
ggaaugucuucuuauacug

SEQ ID NO: 1368098 - RNA, 19 nt, Homo sapiens
ugaaagaacgguaugaaca

SEQ ID NO: 1368099 - RNA, 19 nt, Homo sapiens
gauuuaaugugagaucaug

SEQ ID NO: 1368100 - RNA, 19 nt, Homo sapiens
gaagcccuaugcagucaug

SEQ ID NO: 1368101 - RNA, 19 nt, Homo sapiens
ggaagauggugccuaugag

SEQ ID NO: 1368102 - RNA, 19 nt, Homo sapiens
aggaauaaacgacuucuaa

SEQ ID NO: 1368103 - RNA, 19 nt, Homo sapiens
ccucacaacucuggaaugu

SEQ ID NO: 1368104 - RNA, 19 nt, Homo sapiens
gaaaagccaagcagaauga

SEQ ID NO: 1368105 - RNA, 19 nt, Homo sapiens
gaugcugaauuuaugaauc

SEQ ID NO: 1368106 - RNA, 19 nt, Homo sapiens
gcaaagucauuauauucac

SEQ ID NO: 1368107 - RNA, 19 nt, Homo sapiens
aagccaugcucauuacaaa

SEQ ID NO: 1368108 - RNA, 19 nt, Homo sapiens
gcaaugaggaauggcauau

SEQ ID NO: 1368109 - RNA, 19 nt, Homo sapiens
ugaguucaauccugacuuc

SEQ ID NO: 1368110 - RNA, 19 nt, Homo sapiens
cagcuucuuucuaauguuc

SEQ ID NO: 1368111 - RNA, 19 nt, Homo sapiens
uggaacauguauucuauca

SEQ ID NO: 1368112 - RNA, 19 nt, Homo sapiens
gcauacaucuaagggaaca

SEQ ID NO: 1368113 - RNA, 19 nt, Homo sapiens
guaaacagucucuuucucu

SEQ ID NO: 1368114 - RNA, 19 nt, Homo sapiens
gaaaagcaaugaggaaugg

SEQ ID NO: 1368115 - RNA, 19 nt, Homo sapiens
gcauuaagacaaucaaguc

SEQ ID NO: 1368116 - RNA, 19 nt, Homo sapiens
ggaacauuguccuucaaag

SEQ ID NO: 1368117 - RNA, 19 nt, Homo sapiens
uaaagugcuucuauaugca

SEQ ID NO: 1368118 - RNA, 19 nt, Homo sapiens
ugagagcuccuaucacaga

SEQ ID NO: 1368119 - RNA, 19 nt, Homo sapiens
gaagauggugccuaugagu

SEQ ID NO: 1368120 - RNA, 19 nt, Homo sapiens
aacauuguccuucaaagua

SEQ ID NO: 1368121 - RNA, 19 nt, Homo sapiens
agucagagcuccaauucca

SEQ ID NO: 1368122 - RNA, 19 nt, Homo sapiens
uuacagccaggcagaauuu

SEQ ID NO: 1368123 - RNA, 19 nt, Homo sapiens
gagagcuccuaucacagaa

SEQ ID NO: 1368124 - RNA, 19 nt, Homo sapiens
gaauuccuacacagaguuu

SEQ ID NO: 1368125 - RNA, 19 nt, Homo sapiens
ccaagcagaaugaacagaa

SEQ ID NO: 1368126 - RNA, 19 nt, Homo sapiens
gaaagaacgguaugaacac

SEQ ID NO: 1368127 - RNA, 19 nt, Homo sapiens
aaagucacgccuuguguuu

SEQ ID NO: 1368128 - RNA, 19 nt, Homo sapiens
uaucaaagugccauugcua

SEQ ID NO: 1368129 - RNA, 19 nt, Homo sapiens
agaacacacccaagaauau

SEQ ID NO: 1368130 - RNA, 19 nt, Homo sapiens
gauuugucauuggaucuuu

SEQ ID NO: 1368131 - RNA, 19 nt, Homo sapiens
uggaaugucuucuuauacu

SEQ ID NO: 1368132 - RNA, 19 nt, Homo sapiens
ugggaauucugcagauuug

SEQ ID NO: 1368133 - RNA, 19 nt, Homo sapiens
guuaaagugcuucuauaug

SEQ ID NO: 1368134 - RNA, 19 nt, Homo sapiens
guugucaccauggauauua

SEQ ID NO: 1368135 - RNA, 19 nt, Homo sapiens
gaaugaaagaacgguauga

SEQ ID NO: 1368136 - RNA, 19 nt, Homo sapiens
gcugggaauucugcagauu

SEQ ID NO: 1368137 - RNA, 19 nt, Homo sapiens
cuauaugcauggucugaug

SEQ ID NO: 1368138 - RNA, 19 nt, Homo sapiens
ccaauuccaguguaaauag

SEQ ID NO: 1368139 - RNA, 19 nt, Homo sapiens
aaugacaauugcagcauga

SEQ ID NO: 1368140 - RNA, 19 nt, Homo sapiens
uaugcucuauuucuuguug

SEQ ID NO: 1368141 - RNA, 19 nt, Homo sapiens
uaaagucacgccuuguguu

SEQ ID NO: 1368142 - RNA, 19 nt, Homo sapiens
ggaauuccuacacagaguu

SEQ ID NO: 1368143 - RNA, 19 nt, Homo sapiens
gaagagacaugagaugauu

SEQ ID NO: 1368144 - RNA, 19 nt, Homo sapiens
ggacuuaaccaauguuuga

SEQ ID NO: 1368145 - RNA, 19 nt, Homo sapiens
gaaacucugucuccaggaa

SEQ ID NO: 1368146 - RNA, 19 nt, Homo sapiens
gcacagcagaauuuauaua

SEQ ID NO: 1368147 - RNA, 19 nt, Homo sapiens
gagagaaaccauacaaaug

SEQ ID NO: 1368148 - RNA, 19 nt, Homo sapiens
ggagagaaaccauacaaau

SEQ ID NO: 1368149 - RNA, 19 nt, Homo sapiens
caaaagagguuauaaugga

SEQ ID NO: 1368150 - RNA, 19 nt, Homo sapiens
gagaaaccauacaaaugug

SEQ ID NO: 1368151 - RNA, 19 nt, Homo sapiens
ccaguuguguguucucauu

SEQ ID NO: 1368152 - RNA, 19 nt, Homo sapiens
caacccauacuacacauaa

SEQ ID NO: 1368153 - RNA, 19 nt, Homo sapiens
cauggcaauuuacacuuua

SEQ ID NO: 1368154 - RNA, 19 nt, Homo sapiens
ggucuuccuugguauuauu

SEQ ID NO: 1368155 - RNA, 19 nt, Homo sapiens
caccuggucuuccuuggua

SEQ ID NO: 1368156 - RNA, 19 nt, Homo sapiens
agauguggcuguagaauuc

SEQ ID NO: 1368157 - RNA, 19 nt, Homo sapiens
gagcagagcauaaaagauu

SEQ ID NO: 1368158 - RNA, 19 nt, Homo sapiens
gaauaaaaccucugacuau

SEQ ID NO: 1368159 - RNA, 19 nt, Homo sapiens
auaauggacuuaaccaaug

SEQ ID NO: 1368160 - RNA, 19 nt, Homo sapiens
agagaaaccauacaaaugu

SEQ ID NO: 1368161 - RNA, 19 nt, Homo sapiens
gagauguggcuguagaauu

SEQ ID NO: 1368162 - RNA, 19 nt, Homo sapiens
acauggcaauuuacacuuu

SEQ ID NO: 1368163 - RNA, 19 nt, Homo sapiens
uauagaaggugacaaagcu

SEQ ID NO: 1368164 - RNA, 19 nt, Homo sapiens
ggacauggcaauuuacacu

SEQ ID NO: 1368165 - RNA, 19 nt, Homo sapiens
uaaaaccucugacuaugaa

SEQ ID NO: 1368166 - RNA, 19 nt, Homo sapiens
uuagagauguggcuguaga

SEQ ID NO: 1368167 - RNA, 19 nt, Homo sapiens
ggaaucauugcaauuuaga

SEQ ID NO: 1368168 - RNA, 19 nt, Homo sapiens
gaaaccauacaaaugugaa

SEQ ID NO: 1368169 - RNA, 19 nt, Homo sapiens
caccugaugucgggaguuu

SEQ ID NO: 1368170 - RNA, 19 nt, Homo sapiens
ccucuucgcuacucugugu

SEQ ID NO: 1368171 - RNA, 19 nt, Homo sapiens
uaauggacuuaaccaaugu

SEQ ID NO: 1368172 - RNA, 19 nt, Homo sapiens
ggccagagcagagcauaaa

SEQ ID NO: 1368173 - RNA, 19 nt, Homo sapiens
ggaauaaaaccucugacua

SEQ ID NO: 1368174 - RNA, 19 nt, Homo sapiens
gauguuagagaacuacaga

SEQ ID NO: 1368175 - RNA, 19 nt, Homo sapiens
aaccaguccucaacccaua

SEQ ID NO: 1368176 - RNA, 19 nt, Homo sapiens
ucauugcaauuuagagaug

SEQ ID NO: 1368177 - RNA, 19 nt, Homo sapiens
uuagaagccuagaaaugga

SEQ ID NO: 1368178 - RNA, 19 nt, Homo sapiens
ucaaugugguaaauaugug

SEQ ID NO: 1368179 - RNA, 19 nt, Homo sapiens
aaccaauguuugacaacua

SEQ ID NO: 1368180 - RNA, 19 nt, Homo sapiens
ccauacaaaugugaagaau

SEQ ID NO: 1368181 - RNA, 19 nt, Homo sapiens
gagguuauaauggacuuaa

SEQ ID NO: 1368182 - RNA, 19 nt, Homo sapiens
gcugugaaaguguggauga

SEQ ID NO: 1368183 - RNA, 19 nt, Homo sapiens
gaucaccugucuggagcaa

SEQ ID NO: 1368184 - RNA, 19 nt, Homo sapiens
gaaaguguggaugagugua

SEQ ID NO: 1368185 - RNA, 19 nt, Homo sapiens
ggagauccacagccaagau

SEQ ID NO: 1368186 - RNA, 19 nt, Homo sapiens
uggaaucauugcaauuuag

SEQ ID NO: 1368187 - RNA, 19 nt, Homo sapiens
uaaccaauguuugacaacu

SEQ ID NO: 1368188 - RNA, 19 nt, Homo sapiens
uagaaggugacaaagcuuu

SEQ ID NO: 1368189 - RNA, 19 nt, Homo sapiens
ugacaacuacccagagcaa

SEQ ID NO: 1368190 - RNA, 19 nt, Homo sapiens
aaaguguggaugaguguaa

SEQ ID NO: 1368191 - RNA, 19 nt, Homo sapiens
ccuguaaucccagcacuuu

SEQ ID NO: 1368192 - RNA, 19 nt, Homo sapiens
gagauccacagccaagaug

SEQ ID NO: 1368193 - RNA, 19 nt, Homo sapiens
aauugauacuggagagaaa

SEQ ID NO: 1368194 - RNA, 19 nt, Homo sapiens
gaaggugacaaagcuuuua

SEQ ID NO: 1368195 - RNA, 19 nt, Homo sapiens
cacagcagaauuuauauag

SEQ ID NO: 1368196 - RNA, 19 nt, Homo sapiens
ccuuagaagccuagaaaug

SEQ ID NO: 1368197 - RNA, 19 nt, Homo sapiens
cuuaaccaauguuugacaa

SEQ ID NO: 1368198 - RNA, 19 nt, Homo sapiens
ccuguguccuguagguauu

SEQ ID NO: 1368199 - RNA, 19 nt, Homo sapiens
ugaagagacaugagaugau

SEQ ID NO: 1368200 - RNA, 19 nt, Homo sapiens
ccugaugucgggaguuuga

SEQ ID NO: 1368201 - RNA, 19 nt, Homo sapiens
caaugugguaaauauguga

SEQ ID NO: 1368202 - RNA, 19 nt, Homo sapiens
cuuagaagccuagaaaugg

SEQ ID NO: 1368203 - RNA, 19 nt, Homo sapiens
uguggaugaguguaaguua

SEQ ID NO: 1368204 - RNA, 19 nt, Homo sapiens
gacauggcaauuuacacuu

SEQ ID NO: 1368205 - RNA, 19 nt, Homo sapiens
gaauguggcaaagccuuca

SEQ ID NO: 1368206 - RNA, 19 nt, Homo sapiens
agaaaccauacaaauguga

SEQ ID NO: 1368207 - RNA, 19 nt, Homo sapiens
auacuggagagaaaccaua

SEQ ID NO: 1368208 - RNA, 19 nt, Homo sapiens
ccucaacccauacuacaca

SEQ ID NO: 1368209 - RNA, 19 nt, Homo sapiens
cacaaaagagguuauaaug

SEQ ID NO: 1368210 - RNA, 19 nt, Homo sapiens
aaacggagaaacccagucu

SEQ ID NO: 1368211 - RNA, 19 nt, Homo sapiens
aaauugauacuggagagaa

SEQ ID NO: 1368212 - RNA, 19 nt, Homo sapiens
aaaccucugacuaugaaga

SEQ ID NO: 1368213 - RNA, 19 nt, Homo sapiens
aauaaaaccucugacuaug

SEQ ID NO: 1368214 - RNA, 19 nt, Homo sapiens
ucaaucaugucgagaaaua

SEQ ID NO: 1368215 - RNA, 19 nt, Homo sapiens
gcaagagccuaauccauga

SEQ ID NO: 1368216 - RNA, 19 nt, Homo sapiens
cgauaagccucuuugaaua

SEQ ID NO: 1368217 - RNA, 19 nt, Homo sapiens
ggaaacaacaguaacgaua

SEQ ID NO: 1368218 - RNA, 19 nt, Homo sapiens
caagacaccucaaucaugu

SEQ ID NO: 1368219 - RNA, 19 nt, Homo sapiens
gaaacaacaguaacgauaa

SEQ ID NO: 1368220 - RNA, 19 nt, Homo sapiens
gcuagucgaugcagcagua

SEQ ID NO: 1368221 - RNA, 19 nt, Homo sapiens
ggccagaugucaagagaga

SEQ ID NO: 1368222 - RNA, 19 nt, Homo sapiens
gauaagccucuuugaauau

SEQ ID NO: 1368223 - RNA, 19 nt, Homo sapiens
gccagaagcucaccggaau

SEQ ID NO: 1368224 - RNA, 19 nt, Homo sapiens
ugucagagaagaccaauuu

SEQ ID NO: 1368225 - RNA, 19 nt, Homo sapiens
caaaugcugucagagaaga

SEQ ID NO: 1368226 - RNA, 19 nt, Homo sapiens
gcagauacaggcagaguuc

SEQ ID NO: 1368227 - RNA, 19 nt, Homo sapiens
uaccagagcacaagaagaa

SEQ ID NO: 1368228 - RNA, 19 nt, Homo sapiens
ccaagacaccucaaucaug

SEQ ID NO: 1368229 - RNA, 19 nt, Homo sapiens
aaacaacaguaacgauaag

SEQ ID NO: 1368230 - RNA, 19 nt, Homo sapiens
agaagaagcgcaagggaaa

SEQ ID NO: 1368231 - RNA, 19 nt, Homo sapiens
agaagaagcaagagccuaa

SEQ ID NO: 1368232 - RNA, 19 nt, Homo sapiens
gcgacuggauguauaagca

SEQ ID NO: 1368233 - RNA, 19 nt, Homo sapiens
ccucaaucaugucgagaaa

SEQ ID NO: 1368234 - RNA, 19 nt, Homo sapiens
guacugugguaaaccuguu

SEQ ID NO: 1368235 - RNA, 19 nt, Homo sapiens
uguauaagcaucgguuuaa

SEQ ID NO: 1368236 - RNA, 19 nt, Homo sapiens
ccaaagggccagaugucaa

SEQ ID NO: 1368237 - RNA, 19 nt, Homo sapiens
ggccagugguccagacaau

SEQ ID NO: 1368238 - RNA, 19 nt, Homo sapiens
cagaagaagagaagcaaau

SEQ ID NO: 1368239 - RNA, 19 nt, Homo sapiens
acgauaagccucuuugaau

SEQ ID NO: 1368240 - RNA, 19 nt, Homo sapiens
gauacaggcagaguucuug

SEQ ID NO: 1368241 - RNA, 19 nt, Homo sapiens
gcccaagacaccucaauca

SEQ ID NO: 1368242 - RNA, 19 nt, Homo sapiens
ucuaacugguuuaucaaug

SEQ ID NO: 1368243 - RNA, 19 nt, Homo sapiens
cagagaagaccaauuuguc

SEQ ID NO: 1368244 - RNA, 19 nt, Homo sapiens
guaacgauaagccucuuug

SEQ ID NO: 1368245 - RNA, 19 nt, Homo sapiens
gagaaauaacgcagauaca

SEQ ID NO: 1368246 - RNA, 19 nt, Homo sapiens
caaagggccagaugucaag

SEQ ID NO: 1368247 - RNA, 19 nt, Homo sapiens
gaagaagagaagcaaaugc

SEQ ID NO: 1368248 - RNA, 19 nt, Homo sapiens
gcagaguucuugccuuacc

SEQ ID NO: 1368249 - RNA, 19 nt, Homo sapiens
ucagagaagaccaauuugu

SEQ ID NO: 1368250 - RNA, 19 nt, Homo sapiens
gcaaaugcugucagagaag

SEQ ID NO: 1368251 - RNA, 19 nt, Homo sapiens
ccagaagcucaccggaaua

SEQ ID NO: 1368252 - RNA, 19 nt, Homo sapiens
gacgcauucucccggauau

SEQ ID NO: 1368253 - RNA, 19 nt, Homo sapiens
gaagcaagagccuaaucca

SEQ ID NO: 1368254 - RNA, 19 nt, Homo sapiens
cuaacugguuuaucaaugc

SEQ ID NO: 1368255 - RNA, 19 nt, Homo sapiens
uaacgauaagccucuuuga

SEQ ID NO: 1368256 - RNA, 19 nt, Homo sapiens
guauaagcaucgguuuaag

SEQ ID NO: 1368257 - RNA, 19 nt, Homo sapiens
cgagaaauaacgcagauac

SEQ ID NO: 1368258 - RNA, 19 nt, Homo sapiens
ccagugguccagacaaugu

SEQ ID NO: 1368259 - RNA, 19 nt, Homo sapiens
gaagaagcaagagccuaau

SEQ ID NO: 1368260 - RNA, 19 nt, Homo sapiens
gaaacgaccccaucauugg

SEQ ID NO: 1368261 - RNA, 19 nt, Homo sapiens
caugauugaugauguucca

SEQ ID NO: 1368262 - RNA, 19 nt, Homo sapiens
auaagccucuuugaauaug

SEQ ID NO: 1368263 - RNA, 19 nt, Homo sapiens
gauugaugauguuccaaaa

SEQ ID NO: 1368264 - RNA, 19 nt, Homo sapiens
gucgagaaauaacgcagau

SEQ ID NO: 1368265 - RNA, 19 nt, Homo sapiens
cuccgcgacuggauguaua

SEQ ID NO: 1368266 - RNA, 19 nt, Homo sapiens
ccacaaaacgggcaaagau

SEQ ID NO: 1368267 - RNA, 19 nt, Homo sapiens
gaccaauuugucuuuguug

SEQ ID NO: 1368268 - RNA, 19 nt, Homo sapiens
ugauugaugauguuccaaa

SEQ ID NO: 1368269 - RNA, 19 nt, Homo sapiens
cagaagcucaccggaauag

SEQ ID NO: 1368270 - RNA, 19 nt, Homo sapiens
ucccggauaugcuucaaca

SEQ ID NO: 1368271 - RNA, 19 nt, Homo sapiens
agacgcauucucccggaua

SEQ ID NO: 1368272 - RNA, 19 nt, Homo sapiens
agaagaagagaagcaaaug

SEQ ID NO: 1368273 - RNA, 19 nt, Homo sapiens
ccaaagcccagcccaagac

SEQ ID NO: 1368274 - RNA, 19 nt, Homo sapiens
uaacugguuuaucaaugcu

SEQ ID NO: 1368275 - RNA, 19 nt, Homo sapiens
ucuguuagcaaagcuguuu

SEQ ID NO: 1368276 - RNA, 19 nt, Homo sapiens
caaucaugucgagaaauaa

SEQ ID NO: 1368277 - RNA, 19 nt, Homo sapiens
aacgauaagccucuuugaa

SEQ ID NO: 1368278 - RNA, 19 nt, Homo sapiens
gccaaagggccagauguca

SEQ ID NO: 1368279 - RNA, 19 nt, Homo sapiens
agaaauaacgcagauacag

SEQ ID NO: 1368280 - RNA, 19 nt, Homo sapiens
cagccgaguccguuaagau

SEQ ID NO: 1368281 - RNA, 19 nt, Homo sapiens
gaacuugacuuguguuaga

SEQ ID NO: 1368282 - RNA, 19 nt, Homo sapiens
gcaagaauauggacagaaa

SEQ ID NO: 1368283 - RNA, 19 nt, Homo sapiens
gcaaagagaucuacaccau

SEQ ID NO: 1368284 - RNA, 19 nt, Homo sapiens
gaggugaacuuucugguuu

SEQ ID NO: 1368285 - RNA, 19 nt, Homo sapiens
gcaagugcuucauuugauu

SEQ ID NO: 1368286 - RNA, 19 nt, Homo sapiens
uugaagaucuggaguauga

SEQ ID NO: 1368287 - RNA, 19 nt, Homo sapiens
agacucaacugcaaggaua

SEQ ID NO: 1368288 - RNA, 19 nt, Homo sapiens
aaagagaucuacaccauca

SEQ ID NO: 1368289 - RNA, 19 nt, Homo sapiens
ccacaggaguguauauguu

SEQ ID NO: 1368290 - RNA, 19 nt, Homo sapiens
caacaaagccacaguccuu

SEQ ID NO: 1368291 - RNA, 19 nt, Homo sapiens
ucacucggcuuucacguuu

SEQ ID NO: 1368292 - RNA, 19 nt, Homo sapiens
guucagagguccacacaug

SEQ ID NO: 1368293 - RNA, 19 nt, Homo sapiens
cuaaugaccugccuugaau

SEQ ID NO: 1368294 - RNA, 19 nt, Homo sapiens
gaauggagcacaugaaauc

SEQ ID NO: 1368295 - RNA, 19 nt, Homo sapiens
caacaucaaugggacacua

SEQ ID NO: 1368296 - RNA, 19 nt, Homo sapiens
ggaaaguacuuggcuagug

SEQ ID NO: 1368297 - RNA, 19 nt, Homo sapiens
guucauaucuggaauacuc

SEQ ID NO: 1368298 - RNA, 19 nt, Homo sapiens
aaugccagcuguucucuua

SEQ ID NO: 1368299 - RNA, 19 nt, Homo sapiens
gagaauggagcacaugaaa

SEQ ID NO: 1368300 - RNA, 19 nt, Homo sapiens
cacaugaaguuaccauaaa

SEQ ID NO: 1368301 - RNA, 19 nt, Homo sapiens
caaagccaauggaaauaga

SEQ ID NO: 1368302 - RNA, 19 nt, Homo sapiens
gagcacaugaaaucaauaa

SEQ ID NO: 1368303 - RNA, 19 nt, Homo sapiens
uauggaaccugaaugagaa

SEQ ID NO: 1368304 - RNA, 19 nt, Homo sapiens
ggauauggaaccugaauga

SEQ ID NO: 1368305 - RNA, 19 nt, Homo sapiens
gcacaugaaaucaauaauc

SEQ ID NO: 1368306 - RNA, 19 nt, Homo sapiens
gguuccaacuucaucaaua

SEQ ID NO: 1368307 - RNA, 19 nt, Homo sapiens
ccugauaguugcugugauu

SEQ ID NO: 1368308 - RNA, 19 nt, Homo sapiens
agaagggacugcaguaugu

SEQ ID NO: 1368309 - RNA, 19 nt, Homo sapiens
ggaaauagauggggauguu

SEQ ID NO: 1368310 - RNA, 19 nt, Homo sapiens
gacaugacauugaagaucu

SEQ ID NO: 1368311 - RNA, 19 nt, Homo sapiens
cgaggucaaugccaucaaa

SEQ ID NO: 1368312 - RNA, 19 nt, Homo sapiens
ugauguggauugucauaaa

SEQ ID NO: 1368313 - RNA, 19 nt, Homo sapiens
ugacuuguguuagaguaua

SEQ ID NO: 1368314 - RNA, 19 nt, Homo sapiens
gcuaguggauccuuugaca

SEQ ID NO: 1368315 - RNA, 19 nt, Homo sapiens
ggaagagaauggagcacau

SEQ ID NO: 1368316 - RNA, 19 nt, Homo sapiens
gcaaaggcggcaaccauga

SEQ ID NO: 1368317 - RNA, 19 nt, Homo sapiens
guauguagaggcugagaua

SEQ ID NO: 1368318 - RNA, 19 nt, Homo sapiens
guggauccuuugacaagua

SEQ ID NO: 1368319 - RNA, 19 nt, Homo sapiens
gauguggacuggcagaaca

SEQ ID NO: 1368320 - RNA, 19 nt, Homo sapiens
uaaccuggccagcaccuua

SEQ ID NO: 1368321 - RNA, 19 nt, Homo sapiens
agucugagguguucauuug

SEQ ID NO: 1368322 - RNA, 19 nt, Homo sapiens
guugagacauuguauacga

SEQ ID NO: 1368323 - RNA, 19 nt, Homo sapiens
ggcaagugcuucauuugau

SEQ ID NO: 1368324 - RNA, 19 nt, Homo sapiens
cggaugacaugacauugaa

SEQ ID NO: 1368325 - RNA, 19 nt, Homo sapiens
ggcacgacgucccaaguaa

SEQ ID NO: 1368326 - RNA, 19 nt, Homo sapiens
gaagucucguccacagcua

SEQ ID NO: 1368327 - RNA, 19 nt, Homo sapiens
guuggcaagugcuucauuu

SEQ ID NO: 1368328 - RNA, 19 nt, Homo sapiens
ggaacccugucagugauuu

SEQ ID NO: 1368329 - RNA, 19 nt, Homo sapiens
gaaaugaagcaggacuuga

SEQ ID NO: 1368330 - RNA, 19 nt, Homo sapiens
caucuucgcucugaaaugg

SEQ ID NO: 1368331 - RNA, 19 nt, Homo sapiens
gaagcucacucagcagcaa

SEQ ID NO: 1368332 - RNA, 19 nt, Homo sapiens
ugagaagccugcugguuca

SEQ ID NO: 1368333 - RNA, 19 nt, Homo sapiens
acagacggcuugccauuuc

SEQ ID NO: 1368334 - RNA, 19 nt, Homo sapiens
gguugcagcucuguucaaa

SEQ ID NO: 1368335 - RNA, 19 nt, Homo sapiens
ucaccucacuggacuggaa

SEQ ID NO: 1368336 - RNA, 19 nt, Homo sapiens
ccacgagucugagguguuc

SEQ ID NO: 1368337 - RNA, 19 nt, Homo sapiens
acacaugaaguuaccauaa

SEQ ID NO: 1368338 - RNA, 19 nt, Homo sapiens
gcucugaaauggaacaaaa

SEQ ID NO: 1368339 - RNA, 19 nt, Homo sapiens
uaccuaaacuuuccaguac

SEQ ID NO: 1368340 - RNA, 19 nt, Homo sapiens
caccuuaggccaacauaaa

SEQ ID NO: 1368341 - RNA, 19 nt, Homo sapiens
gacuugauguggauuguca

SEQ ID NO: 1368342 - RNA, 19 nt, Homo sapiens
gaacgcccgaggagauaaa

SEQ ID NO: 1368343 - RNA, 19 nt, Homo sapiens
ccaaggcacuggcgguauc

SEQ ID NO: 1368344 - RNA, 19 nt, Homo sapiens
ggaacacuauuggcuaugg

SEQ ID NO: 1368345 - RNA, 19 nt, Homo sapiens
gggcacgacgucccaagua

SEQ ID NO: 1368346 - RNA, 19 nt, Homo sapiens
cauugaagaucuggaguau

SEQ ID NO: 1368347 - RNA, 19 nt, Homo sapiens
cagcucguguugagacauu

SEQ ID NO: 1368348 - RNA, 19 nt, Homo sapiens
gaggcuaagaugagcauaa

SEQ ID NO: 1368349 - RNA, 19 nt, Homo sapiens
gagggugguuccaacuuca

SEQ ID NO: 1368350 - RNA, 19 nt, Homo sapiens
gcucggaugacaugacauu

SEQ ID NO: 1368351 - RNA, 19 nt, Homo sapiens
cacgacgucccaaguaaua

SEQ ID NO: 1368352 - RNA, 19 nt, Homo sapiens
caacugcaaggauauggaa

SEQ ID NO: 1368353 - RNA, 19 nt, Homo sapiens
ccacagaggcaucagcaau

SEQ ID NO: 1368354 - RNA, 19 nt, Homo sapiens
gcaggcauuuggagagaag

SEQ ID NO: 1368355 - RNA, 19 nt, Homo sapiens
gaagggacugcaguaugua

SEQ ID NO: 1368356 - RNA, 19 nt, Homo sapiens
ccacagacggcuugccauu

SEQ ID NO: 1368357 - RNA, 19 nt, Homo sapiens
ugugugaacuugacuugug

SEQ ID NO: 1368358 - RNA, 19 nt, Homo sapiens
gaugacaugacauugaaga

SEQ ID NO: 1368359 - RNA, 19 nt, Homo sapiens
cagaacaacaugaccuuug

SEQ ID NO: 1368360 - RNA, 19 nt, Homo sapiens
gaugguuucgcaagaauau

SEQ ID NO: 1368361 - RNA, 19 nt, Homo sapiens
ccacccagcucguguugag

SEQ ID NO: 1368362 - RNA, 19 nt, Homo sapiens
agauaagcaucaacaagga

SEQ ID NO: 1368363 - RNA, 19 nt, Homo sapiens
ggauccuucuggaauguug

SEQ ID NO: 1368364 - RNA, 19 nt, Homo sapiens
ucacacaggagaagccaaa

SEQ ID NO: 1368365 - RNA, 19 nt, Homo sapiens
gaagagaauggagcacaug

SEQ ID NO: 1368366 - RNA, 19 nt, Homo sapiens
uuaccuaaacuuuccagua

SEQ ID NO: 1368367 - RNA, 19 nt, Homo sapiens
gauguggauugucauaaac

SEQ ID NO: 1368368 - RNA, 19 nt, Homo sapiens
cacaggaguguauauguuu

SEQ ID NO: 1368369 - RNA, 19 nt, Homo sapiens
gcagaacaacaugaccuuu

SEQ ID NO: 1368370 - RNA, 19 nt, Homo sapiens
uaugaugguuucgcaagaa

SEQ ID NO: 1368371 - RNA, 19 nt, Homo sapiens
cgacgucccaaguaauaaa

SEQ ID NO: 1368372 - RNA, 19 nt, Homo sapiens
gcacgacgucccaaguaau

SEQ ID NO: 1368373 - RNA, 19 nt, Homo sapiens
cagcaggcauuuggagaga

SEQ ID NO: 1368374 - RNA, 19 nt, Homo sapiens
ggugaacuuucugguuuau

SEQ ID NO: 1368375 - RNA, 19 nt, Homo sapiens
gugacgaggugaacuuucu

SEQ ID NO: 1368376 - RNA, 19 nt, Homo sapiens
gagugcugguguagacaaa

SEQ ID NO: 1368377 - RNA, 19 nt, Homo sapiens
auaaagaugucaccucacu

SEQ ID NO: 1368378 - RNA, 19 nt, Homo sapiens
gaguauauucugaaaccaa

SEQ ID NO: 1368379 - RNA, 19 nt, Homo sapiens
gcaguuuccuuuucauuca

SEQ ID NO: 1368380 - RNA, 19 nt, Homo sapiens
gcaccuuaggccaacauaa

SEQ ID NO: 1368381 - RNA, 19 nt, Homo sapiens
gaacuugacuuguguuaga

SEQ ID NO: 1368382 - RNA, 19 nt, Homo sapiens
gcaagaauauggacagaaa

SEQ ID NO: 1368383 - RNA, 19 nt, Homo sapiens
gcaaagagaucuacaccau

SEQ ID NO: 1368384 - RNA, 19 nt, Homo sapiens
gaggugaacuuucugguuu

SEQ ID NO: 1368385 - RNA, 19 nt, Homo sapiens
gcaagugcuucauuugauu

SEQ ID NO: 1368386 - RNA, 19 nt, Homo sapiens
uugaagaucuggaguauga

SEQ ID NO: 1368387 - RNA, 19 nt, Homo sapiens
agacucaacugcaaggaua

SEQ ID NO: 1368388 - RNA, 19 nt, Homo sapiens
aaagagaucuacaccauca

SEQ ID NO: 1368389 - RNA, 19 nt, Homo sapiens
ccacaggaguguauauguu

SEQ ID NO: 1368390 - RNA, 19 nt, Homo sapiens
caacaaagccacaguccuu

SEQ ID NO: 1368391 - RNA, 19 nt, Homo sapiens
ucacucggcuuucacguuu

SEQ ID NO: 1368392 - RNA, 19 nt, Homo sapiens
guucagagguccacacaug

SEQ ID NO: 1368393 - RNA, 19 nt, Homo sapiens
cuaaugaccugccuugaau

SEQ ID NO: 1368394 - RNA, 19 nt, Homo sapiens
gaauggagcacaugaaauc

SEQ ID NO: 1368395 - RNA, 19 nt, Homo sapiens
caacaucaaugggacacua

SEQ ID NO: 1368396 - RNA, 19 nt, Homo sapiens
ggaaaguacuuggcuagug

SEQ ID NO: 1368397 - RNA, 19 nt, Homo sapiens
guucauaucuggaauacuc

SEQ ID NO: 1368398 - RNA, 19 nt, Homo sapiens
aaugccagcuguucucuua

SEQ ID NO: 1368399 - RNA, 19 nt, Homo sapiens
gagaauggagcacaugaaa

SEQ ID NO: 1368400 - RNA, 19 nt, Homo sapiens
cacaugaaguuaccauaaa

SEQ ID NO: 1368401 - RNA, 19 nt, Homo sapiens
caaagccaauggaaauaga

SEQ ID NO: 1368402 - RNA, 19 nt, Homo sapiens
gagcacaugaaaucaauaa

SEQ ID NO: 1368403 - RNA, 19 nt, Homo sapiens
uauggaaccugaaugagaa

SEQ ID NO: 1368404 - RNA, 19 nt, Homo sapiens
ggauauggaaccugaauga

SEQ ID NO: 1368405 - RNA, 19 nt, Homo sapiens
gcacaugaaaucaauaauc

SEQ ID NO: 1368406 - RNA, 19 nt, Homo sapiens
gguuccaacuucaucaaua

SEQ ID NO: 1368407 - RNA, 19 nt, Homo sapiens
ccugauaguugcugugauu

SEQ ID NO: 1368408 - RNA, 19 nt, Homo sapiens
agaagggacugcaguaugu

SEQ ID NO: 1368409 - RNA, 19 nt, Homo sapiens
ggaaauagauggggauguu

SEQ ID NO: 1368410 - RNA, 19 nt, Homo sapiens
gacaugacauugaagaucu

SEQ ID NO: 1368411 - RNA, 19 nt, Homo sapiens
cgaggucaaugccaucaaa

SEQ ID NO: 1368412 - RNA, 19 nt, Homo sapiens
ugauguggauugucauaaa

SEQ ID NO: 1368413 - RNA, 19 nt, Homo sapiens
ugacuuguguuagaguaua

SEQ ID NO: 1368414 - RNA, 19 nt, Homo sapiens
gcuaguggauccuuugaca

SEQ ID NO: 1368415 - RNA, 19 nt, Homo sapiens
ggaagagaauggagcacau

SEQ ID NO: 1368416 - RNA, 19 nt, Homo sapiens
gcaaaggcggcaaccauga

SEQ ID NO: 1368417 - RNA, 19 nt, Homo sapiens
guauguagaggcugagaua

SEQ ID NO: 1368418 - RNA, 19 nt, Homo sapiens
guggauccuuugacaagua

SEQ ID NO: 1368419 - RNA, 19 nt, Homo sapiens
gauguggacuggcagaaca

SEQ ID NO: 1368420 - RNA, 19 nt, Homo sapiens
uaaccuggccagcaccuua

SEQ ID NO: 1368421 - RNA, 19 nt, Homo sapiens
agucugagguguucauuug

SEQ ID NO: 1368422 - RNA, 19 nt, Homo sapiens
guugagacauuguauacga

SEQ ID NO: 1368423 - RNA, 19 nt, Homo sapiens
ggcaagugcuucauuugau

SEQ ID NO: 1368424 - RNA, 19 nt, Homo sapiens
cggaugacaugacauugaa

SEQ ID NO: 1368425 - RNA, 19 nt, Homo sapiens
ggcacgacgucccaaguaa

SEQ ID NO: 1368426 - RNA, 19 nt, Homo sapiens
gaagucucguccacagcua

SEQ ID NO: 1368427 - RNA, 19 nt, Homo sapiens
guuggcaagugcuucauuu

SEQ ID NO: 1368428 - RNA, 19 nt, Homo sapiens
ggaacccugucagugauuu

SEQ ID NO: 1368429 - RNA, 19 nt, Homo sapiens
gaaaugaagcaggacuuga

SEQ ID NO: 1368430 - RNA, 19 nt, Homo sapiens
caucuucgcucugaaaugg

SEQ ID NO: 1368431 - RNA, 19 nt, Homo sapiens
gaagcucacucagcagcaa

SEQ ID NO: 1368432 - RNA, 19 nt, Homo sapiens
ugagaagccugcugguuca

SEQ ID NO: 1368433 - RNA, 19 nt, Homo sapiens
acagacggcuugccauuuc

SEQ ID NO: 1368434 - RNA, 19 nt, Homo sapiens
gguugcagcucuguucaaa

SEQ ID NO: 1368435 - RNA, 19 nt, Homo sapiens
ucaccucacuggacuggaa

SEQ ID NO: 1368436 - RNA, 19 nt, Homo sapiens
ccacgagucugagguguuc

SEQ ID NO: 1368437 - RNA, 19 nt, Homo sapiens
acacaugaaguuaccauaa

SEQ ID NO: 1368438 - RNA, 19 nt, Homo sapiens
gcucugaaauggaacaaaa

SEQ ID NO: 1368439 - RNA, 19 nt, Homo sapiens
uaccuaaacuuuccaguac

SEQ ID NO: 1368440 - RNA, 19 nt, Homo sapiens
caccuuaggccaacauaaa

SEQ ID NO: 1368441 - RNA, 19 nt, Homo sapiens
gacuugauguggauuguca

SEQ ID NO: 1368442 - RNA, 19 nt, Homo sapiens
gaacgcccgaggagauaaa

SEQ ID NO: 1368443 - RNA, 19 nt, Homo sapiens
ccaaggcacuggcgguauc

SEQ ID NO: 1368444 - RNA, 19 nt, Homo sapiens
ggaacacuauuggcuaugg

SEQ ID NO: 1368445 - RNA, 19 nt, Homo sapiens
gggcacgacgucccaagua

SEQ ID NO: 1368446 - RNA, 19 nt, Homo sapiens
cauugaagaucuggaguau

SEQ ID NO: 1368447 - RNA, 19 nt, Homo sapiens
cagcucguguugagacauu

SEQ ID NO: 1368448 - RNA, 19 nt, Homo sapiens
gaggcuaagaugagcauaa

SEQ ID NO: 1368449 - RNA, 19 nt, Homo sapiens
gagggugguuccaacuuca

SEQ ID NO: 1368450 - RNA, 19 nt, Homo sapiens
gcucggaugacaugacauu

SEQ ID NO: 1368451 - RNA, 19 nt, Homo sapiens
cacgacgucccaaguaaua

SEQ ID NO: 1368452 - RNA, 19 nt, Homo sapiens
caacugcaaggauauggaa

SEQ ID NO: 1368453 - RNA, 19 nt, Homo sapiens
ccacagaggcaucagcaau

SEQ ID NO: 1368454 - RNA, 19 nt, Homo sapiens
gcaggcauuuggagagaag

SEQ ID NO: 1368455 - RNA, 19 nt, Homo sapiens
gaagggacugcaguaugua

SEQ ID NO: 1368456 - RNA, 19 nt, Homo sapiens
ccacagacggcuugccauu

SEQ ID NO: 1368457 - RNA, 19 nt, Homo sapiens
ugugugaacuugacuugug

SEQ ID NO: 1368458 - RNA, 19 nt, Homo sapiens
gaugacaugacauugaaga

SEQ ID NO: 1368459 - RNA, 19 nt, Homo sapiens
cagaacaacaugaccuuug

SEQ ID NO: 1368460 - RNA, 19 nt, Homo sapiens
gaugguuucgcaagaauau

SEQ ID NO: 1368461 - RNA, 19 nt, Homo sapiens
ccacccagcucguguugag

SEQ ID NO: 1368462 - RNA, 19 nt, Homo sapiens
agauaagcaucaacaagga

SEQ ID NO: 1368463 - RNA, 19 nt, Homo sapiens
gauguggauugucauaaac

SEQ ID NO: 1368464 - RNA, 19 nt, Homo sapiens
ggauccuucuggaauguug

SEQ ID NO: 1368465 - RNA, 19 nt, Homo sapiens
ucacacaggagaagccaaa

SEQ ID NO: 1368466 - RNA, 19 nt, Homo sapiens
gaagagaauggagcacaug

SEQ ID NO: 1368467 - RNA, 19 nt, Homo sapiens
uuaccuaaacuuuccagua

SEQ ID NO: 1368468 - RNA, 19 nt, Homo sapiens
cacaggaguguauauguuu

SEQ ID NO: 1368469 - RNA, 19 nt, Homo sapiens
gcagaacaacaugaccuuu

SEQ ID NO: 1368470 - RNA, 19 nt, Homo sapiens
uaugaugguuucgcaagaa

SEQ ID NO: 1368471 - RNA, 19 nt, Homo sapiens
cgacgucccaaguaauaaa

SEQ ID NO: 1368472 - RNA, 19 nt, Homo sapiens
gcacgacgucccaaguaau

SEQ ID NO: 1368473 - RNA, 19 nt, Homo sapiens
cagcaggcauuuggagaga

SEQ ID NO: 1368474 - RNA, 19 nt, Homo sapiens
ggugaacuuucugguuuau

SEQ ID NO: 1368475 - RNA, 19 nt, Homo sapiens
gugacgaggugaacuuucu

SEQ ID NO: 1368476 - RNA, 19 nt, Homo sapiens
gagugcugguguagacaaa

SEQ ID NO: 1368477 - RNA, 19 nt, Homo sapiens
auaaagaugucaccucacu

SEQ ID NO: 1368478 - RNA, 19 nt, Homo sapiens
gaguauauucugaaaccaa

SEQ ID NO: 1368479 - RNA, 19 nt, Homo sapiens
gcaguuuccuuuucauuca

SEQ ID NO: 1368480 - RNA, 19 nt, Homo sapiens
gcaccuuaggccaacauaa

SEQ ID NO: 1368481 - RNA, 19 nt, Homo sapiens
gaacuugacuuguguuaga

SEQ ID NO: 1368482 - RNA, 19 nt, Homo sapiens
gcaagaauauggacagaaa

SEQ ID NO: 1368483 - RNA, 19 nt, Homo sapiens
gcaaagagaucuacaccau

SEQ ID NO: 1368484 - RNA, 19 nt, Homo sapiens
gaggugaacuuucugguuu

SEQ ID NO: 1368485 - RNA, 19 nt, Homo sapiens
gcaagugcuucauuugauu

SEQ ID NO: 1368486 - RNA, 19 nt, Homo sapiens
uugaagaucuggaguauga

SEQ ID NO: 1368487 - RNA, 19 nt, Homo sapiens
agacucaacugcaaggaua

SEQ ID NO: 1368488 - RNA, 19 nt, Homo sapiens
aaagagaucuacaccauca

SEQ ID NO: 1368489 - RNA, 19 nt, Homo sapiens
ccacaggaguguauauguu

SEQ ID NO: 1368490 - RNA, 19 nt, Homo sapiens
caacaaagccacaguccuu

SEQ ID NO: 1368491 - RNA, 19 nt, Homo sapiens
ucacucggcuuucacguuu

SEQ ID NO: 1368492 - RNA, 19 nt, Homo sapiens
guucagagguccacacaug

SEQ ID NO: 1368493 - RNA, 19 nt, Homo sapiens
cuaaugaccugccuugaau

SEQ ID NO: 1368494 - RNA, 19 nt, Homo sapiens
gaauggagcacaugaaauc

SEQ ID NO: 1368495 - RNA, 19 nt, Homo sapiens
caacaucaaugggacacua

SEQ ID NO: 1368496 - RNA, 19 nt, Homo sapiens
ggaaaguacuuggcuagug

SEQ ID NO: 1368497 - RNA, 19 nt, Homo sapiens
guucauaucuggaauacuc

SEQ ID NO: 1368498 - RNA, 19 nt, Homo sapiens
gagaauggagcacaugaaa

SEQ ID NO: 1368499 - RNA, 19 nt, Homo sapiens
cacaugaaguuaccauaaa

SEQ ID NO: 1368500 - RNA, 19 nt, Homo sapiens
caaagccaauggaaauaga

SEQ ID NO: 1368501 - RNA, 19 nt, Homo sapiens
gagcacaugaaaucaauaa

SEQ ID NO: 1368502 - RNA, 19 nt, Homo sapiens
uauggaaccugaaugagaa

SEQ ID NO: 1368503 - RNA, 19 nt, Homo sapiens
ggauauggaaccugaauga

SEQ ID NO: 1368504 - RNA, 19 nt, Homo sapiens
gcacaugaaaucaauaauc

SEQ ID NO: 1368505 - RNA, 19 nt, Homo sapiens
gguuccaacuucaucaaua

SEQ ID NO: 1368506 - RNA, 19 nt, Homo sapiens
ccugauaguugcugugauu

SEQ ID NO: 1368507 - RNA, 19 nt, Homo sapiens
agaagggacugcaguaugu

SEQ ID NO: 1368508 - RNA, 19 nt, Homo sapiens
ggaaauagauggggauguu

SEQ ID NO: 1368509 - RNA, 19 nt, Homo sapiens
gacaugacauugaagaucu

SEQ ID NO: 1368510 - RNA, 19 nt, Homo sapiens
cgaggucaaugccaucaaa

SEQ ID NO: 1368511 - RNA, 19 nt, Homo sapiens
ugacuuguguuagaguaua

SEQ ID NO: 1368512 - RNA, 19 nt, Homo sapiens
gcuaguggauccuuugaca

SEQ ID NO: 1368513 - RNA, 19 nt, Homo sapiens
ggaagagaauggagcacau

SEQ ID NO: 1368514 - RNA, 19 nt, Homo sapiens
gcaaaggcggcaaccauga

SEQ ID NO: 1368515 - RNA, 19 nt, Homo sapiens
guauguagaggcugagaua

SEQ ID NO: 1368516 - RNA, 19 nt, Homo sapiens
guggauccuuugacaagua

SEQ ID NO: 1368517 - RNA, 19 nt, Homo sapiens
gauguggacuggcagaaca

SEQ ID NO: 1368518 - RNA, 19 nt, Homo sapiens
uaaccuggccagcaccuua

SEQ ID NO: 1368519 - RNA, 19 nt, Homo sapiens
agucugagguguucauuug

SEQ ID NO: 1368520 - RNA, 19 nt, Homo sapiens
guugagacauuguauacga

SEQ ID NO: 1368521 - RNA, 19 nt, Homo sapiens
ggcaagugcuucauuugau

SEQ ID NO: 1368522 - RNA, 19 nt, Homo sapiens
cggaugacaugacauugaa

SEQ ID NO: 1368523 - RNA, 19 nt, Homo sapiens
ggcacgacgucccaaguaa

SEQ ID NO: 1368524 - RNA, 19 nt, Homo sapiens
gaagucucguccacagcua

SEQ ID NO: 1368525 - RNA, 19 nt, Homo sapiens
guuggcaagugcuucauuu

SEQ ID NO: 1368526 - RNA, 19 nt, Homo sapiens
ggaacccugucagugauuu

SEQ ID NO: 1368527 - RNA, 19 nt, Homo sapiens
caucuucgcucugaaaugg

SEQ ID NO: 1368528 - RNA, 19 nt, Homo sapiens
gaagcucacucagcagcaa

SEQ ID NO: 1368529 - RNA, 19 nt, Homo sapiens
ugagaagccugcugguuca

SEQ ID NO: 1368530 - RNA, 19 nt, Homo sapiens
acagacggcuugccauuuc

SEQ ID NO: 1368531 - RNA, 19 nt, Homo sapiens
gguugcagcucuguucaaa

SEQ ID NO: 1368532 - RNA, 19 nt, Homo sapiens
ucaccucacuggacuggaa

SEQ ID NO: 1368533 - RNA, 19 nt, Homo sapiens
ccacgagucugagguguuc

SEQ ID NO: 1368534 - RNA, 19 nt, Homo sapiens
acacaugaaguuaccauaa

SEQ ID NO: 1368535 - RNA, 19 nt, Homo sapiens
gcucugaaauggaacaaaa

SEQ ID NO: 1368536 - RNA, 19 nt, Homo sapiens
uaccuaaacuuuccaguac

SEQ ID NO: 1368537 - RNA, 19 nt, Homo sapiens
caccuuaggccaacauaaa

SEQ ID NO: 1368538 - RNA, 19 nt, Homo sapiens
gaacgcccgaggagauaaa

SEQ ID NO: 1368539 - RNA, 19 nt, Homo sapiens
ccaaggcacuggcgguauc

SEQ ID NO: 1368540 - RNA, 19 nt, Homo sapiens
ggaacacuauuggcuaugg

SEQ ID NO: 1368541 - RNA, 19 nt, Homo sapiens
gggcacgacgucccaagua

SEQ ID NO: 1368542 - RNA, 19 nt, Homo sapiens
cauugaagaucuggaguau

SEQ ID NO: 1368543 - RNA, 19 nt, Homo sapiens
cagcucguguugagacauu

SEQ ID NO: 1368544 - RNA, 19 nt, Homo sapiens
gaggcuaagaugagcauaa

SEQ ID NO: 1368545 - RNA, 19 nt, Homo sapiens
gagggugguuccaacuuca

SEQ ID NO: 1368546 - RNA, 19 nt, Homo sapiens
gcucggaugacaugacauu

SEQ ID NO: 1368547 - RNA, 19 nt, Homo sapiens
cacgacgucccaaguaaua

SEQ ID NO: 1368548 - RNA, 19 nt, Homo sapiens
ccacagacggcuugccauu

SEQ ID NO: 1368549 - RNA, 19 nt, Homo sapiens
caacugcaaggauauggaa

SEQ ID NO: 1368550 - RNA, 19 nt, Homo sapiens
ccacagaggcaucagcaau

SEQ ID NO: 1368551 - RNA, 19 nt, Homo sapiens
gcaggcauuuggagagaag

SEQ ID NO: 1368552 - RNA, 19 nt, Homo sapiens
gaagggacugcaguaugua

SEQ ID NO: 1368553 - RNA, 19 nt, Homo sapiens
ugugugaacuugacuugug

SEQ ID NO: 1368554 - RNA, 19 nt, Homo sapiens
gaugacaugacauugaaga

SEQ ID NO: 1368555 - RNA, 19 nt, Homo sapiens
cagaacaacaugaccuuug

SEQ ID NO: 1368556 - RNA, 19 nt, Homo sapiens
gaugguuucgcaagaauau

SEQ ID NO: 1368557 - RNA, 19 nt, Homo sapiens
ccacccagcucguguugag

SEQ ID NO: 1368558 - RNA, 19 nt, Homo sapiens
agauaagcaucaacaagga

SEQ ID NO: 1368559 - RNA, 19 nt, Homo sapiens
ggauccuucuggaauguug

SEQ ID NO: 1368560 - RNA, 19 nt, Homo sapiens
ucacacaggagaagccaaa

SEQ ID NO: 1368561 - RNA, 19 nt, Homo sapiens
gaagagaauggagcacaug

SEQ ID NO: 1368562 - RNA, 19 nt, Homo sapiens
uuaccuaaacuuuccagua

SEQ ID NO: 1368563 - RNA, 19 nt, Homo sapiens
cacaggaguguauauguuu

SEQ ID NO: 1368564 - RNA, 19 nt, Homo sapiens
gcagaacaacaugaccuuu

SEQ ID NO: 1368565 - RNA, 19 nt, Homo sapiens
uaugaugguuucgcaagaa

SEQ ID NO: 1368566 - RNA, 19 nt, Homo sapiens
cgacgucccaaguaauaaa

SEQ ID NO: 1368567 - RNA, 19 nt, Homo sapiens
gcacgacgucccaaguaau

SEQ ID NO: 1368568 - RNA, 19 nt, Homo sapiens
cagcaggcauuuggagaga

SEQ ID NO: 1368569 - RNA, 19 nt, Homo sapiens
ggugaacuuucugguuuau

SEQ ID NO: 1368570 - RNA, 19 nt, Homo sapiens
gugacgaggugaacuuucu

SEQ ID NO: 1368571 - RNA, 19 nt, Homo sapiens
gagugcugguguagacaaa

SEQ ID NO: 1368572 - RNA, 19 nt, Homo sapiens
auaaagaugucaccucacu

SEQ ID NO: 1368573 - RNA, 19 nt, Homo sapiens
gaguauauucugaaaccaa

SEQ ID NO: 1368574 - RNA, 19 nt, Homo sapiens
gcaguuuccuuuucauuca

SEQ ID NO: 1368575 - RNA, 19 nt, Homo sapiens
gcaccuuaggccaacauaa

SEQ ID NO: 1368576 - RNA, 19 nt, Homo sapiens
gagacauuguauacgagaa

SEQ ID NO: 1368577 - RNA, 19 nt, Homo sapiens
acucaaagccaauggaaau

SEQ ID NO: 1368578 - RNA, 19 nt, Homo sapiens
gaagaucuggaguaugaag

SEQ ID NO: 1368579 - RNA, 19 nt, Homo sapiens
cggcuugccauuucuauga

SEQ ID NO: 1368580 - RNA, 19 nt, Homo sapiens
guuccaacuucaucaauac

SEQ ID NO: 1368581 - RNA, 19 nt, Homo sapiens
gaaacgagauccagagauu

SEQ ID NO: 1368582 - RNA, 19 nt, Homo sapiens
gcaaauggaucagaacaaa

SEQ ID NO: 1368583 - RNA, 19 nt, Homo sapiens
ugacacagcuggaguuaaa

SEQ ID NO: 1368584 - RNA, 19 nt, Homo sapiens
ccacaacugucccuccuua

SEQ ID NO: 1368585 - RNA, 19 nt, Homo sapiens
gaauaagaauggaacaguu

SEQ ID NO: 1368586 - RNA, 19 nt, Homo sapiens
cgaaauggaugaacgauuc

SEQ ID NO: 1368587 - RNA, 19 nt, Homo sapiens
caauaaaccugucuucagu

SEQ ID NO: 1368588 - RNA, 19 nt, Homo sapiens
gaacaguugauguccauaa

SEQ ID NO: 1368589 - RNA, 19 nt, Homo sapiens
ugaaaucgcuggaaaauga

SEQ ID NO: 1368590 - RNA, 19 nt, Homo sapiens
gaagcaggagugucaauaa

SEQ ID NO: 1368591 - RNA, 19 nt, Homo sapiens
cagaagcccuuguccuuga

SEQ ID NO: 1368592 - RNA, 19 nt, Homo sapiens
agucagggcuggaauacua

SEQ ID NO: 1368593 - RNA, 19 nt, Homo sapiens
gaaaauuacuggcugauuc

SEQ ID NO: 1368594 - RNA, 19 nt, Homo sapiens
ggaaacgccuggaguacca

SEQ ID NO: 1368595 - RNA, 19 nt, Homo sapiens
gggaaauccugacggaguu

SEQ ID NO: 1368596 - RNA, 19 nt, Homo sapiens
aagcaggagugucaauaaa

SEQ ID NO: 1368597 - RNA, 19 nt, Homo sapiens
gcuccagacucucaauguu

SEQ ID NO: 1368598 - RNA, 19 nt, Homo sapiens
gaaauccagucccgcucuu

SEQ ID NO: 1368599 - RNA, 19 nt, Homo sapiens
gaacgggaggcccagauga

SEQ ID NO: 1368600 - RNA, 19 nt, Homo sapiens
cagaucaggagccagauua

SEQ ID NO: 1368601 - RNA, 19 nt, Homo sapiens
gaagaaagaccugaugcau

SEQ ID NO: 1368602 - RNA, 19 nt, Homo sapiens
gcuggaaaaugaaagaaua

SEQ ID NO: 1368603 - RNA, 19 nt, Homo sapiens
uuuaugggauucugaguuu

SEQ ID NO: 1368604 - RNA, 19 nt, Homo sapiens
gagcuuggguccucaucug

SEQ ID NO: 1368605 - RNA, 19 nt, Homo sapiens
gaccaagcccuccgaguga

SEQ ID NO: 1368606 - RNA, 19 nt, Homo sapiens
gaacgauuccagcagauuc

SEQ ID NO: 1368607 - RNA, 19 nt, Homo sapiens
gcaaagccaggguccuaaa

SEQ ID NO: 1368608 - RNA, 19 nt, Homo sapiens
gagcugaaaccaccaaugg

SEQ ID NO: 1368609 - RNA, 19 nt, Homo sapiens
aagaaaagcuccgagauuu

SEQ ID NO: 1368610 - RNA, 19 nt, Homo sapiens
aacagaagaugcuggagaa

SEQ ID NO: 1368611 - RNA, 19 nt, Homo sapiens
gcacuaccugcccaucuuu

SEQ ID NO: 1368612 - RNA, 19 nt, Homo sapiens
uccagacucucaauguuaa

SEQ ID NO: 1368613 - RNA, 19 nt, Homo sapiens
guugugugcacuuuaguua

SEQ ID NO: 1368614 - RNA, 19 nt, Homo sapiens
ggcagcaaauggaucagaa

SEQ ID NO: 1368615 - RNA, 19 nt, Homo sapiens
gaugcuggcucacguucga

SEQ ID NO: 1368616 - RNA, 19 nt, Homo sapiens
ggaaauccugacggaguua

SEQ ID NO: 1368617 - RNA, 19 nt, Homo sapiens
gaauggaacaguugauguc

SEQ ID NO: 1368618 - RNA, 19 nt, Homo sapiens
gcaggacaaucagagacaa

SEQ ID NO: 1368619 - RNA, 19 nt, Homo sapiens
aggaagagcuccgggaaau

SEQ ID NO: 1368620 - RNA, 19 nt, Homo sapiens
cagcauggccgaaauggau

SEQ ID NO: 1368621 - RNA, 19 nt, Homo sapiens
gaagaggaaggaacagaag

SEQ ID NO: 1368622 - RNA, 19 nt, Homo sapiens
cagaugacauucucgacau

SEQ ID NO: 1368623 - RNA, 19 nt, Homo sapiens
caaggugggcgucucagaa

SEQ ID NO: 1368624 - RNA, 19 nt, Homo sapiens
ggagaguccgcgauuccua

SEQ ID NO: 1368625 - RNA, 19 nt, Homo sapiens
agaagaugcuggagaaacu

SEQ ID NO: 1368626 - RNA, 19 nt, Homo sapiens
ugacccagcuccagacucu

SEQ ID NO: 1368627 - RNA, 19 nt, Homo sapiens
uucuagaucuccacgauaa

SEQ ID NO: 1368628 - RNA, 19 nt, Homo sapiens
cgaagcaggagugucaaua

SEQ ID NO: 1368629 - RNA, 19 nt, Homo sapiens
gaucagaacaaagccauca

SEQ ID NO: 1368630 - RNA, 19 nt, Homo sapiens
ugaagcagacggaacagaa

SEQ ID NO: 1368631 - RNA, 19 nt, Homo sapiens
ugacugcccuccaggucuu

SEQ ID NO: 1368632 - RNA, 19 nt, Homo sapiens
ucaccucacuucccugcuu

SEQ ID NO: 1368633 - RNA, 19 nt, Homo sapiens
uggaguaccagauguguuu

SEQ ID NO: 1368634 - RNA, 19 nt, Homo sapiens
aaaccaggcaggaaaauua

SEQ ID NO: 1368635 - RNA, 19 nt, Homo sapiens
agacggaacagaacauuuc

SEQ ID NO: 1368636 - RNA, 19 nt, Homo sapiens
gcagcagccagaaggauga

SEQ ID NO: 1368637 - RNA, 19 nt, Homo sapiens
ggaaggaacagaagaugcu

SEQ ID NO: 1368638 - RNA, 19 nt, Homo sapiens
ucuuaaacguggaaaggaa

SEQ ID NO: 1368639 - RNA, 19 nt, Homo sapiens
ccaucaagguucuagaucu

SEQ ID NO: 1368640 - RNA, 19 nt, Homo sapiens
agaagaaggugcugaucgu

SEQ ID NO: 1368641 - RNA, 19 nt, Homo sapiens
gcaggagugucaauaaacc

SEQ ID NO: 1368642 - RNA, 19 nt, Homo sapiens
gaggaagagcuccgggaaa

SEQ ID NO: 1368643 - RNA, 19 nt, Homo sapiens
gcagaucaggagccagauu

SEQ ID NO: 1368644 - RNA, 19 nt, Homo sapiens
ugacugagagcuguaagaa

SEQ ID NO: 1368645 - RNA, 19 nt, Homo sapiens
gagaagaggaaggaacaga

SEQ ID NO: 1368646 - RNA, 19 nt, Homo sapiens
gcacugcggccaucuugca

SEQ ID NO: 1368647 - RNA, 19 nt, Homo sapiens
aaagaucgcucugggaaaa

SEQ ID NO: 1368648 - RNA, 19 nt, Homo sapiens
ccagcugucuugacugaag

SEQ ID NO: 1368649 - RNA, 19 nt, Homo sapiens
caggagccagauuaaguua

SEQ ID NO: 1368650 - RNA, 19 nt, Homo sapiens
caucaagguucuagaucuc

SEQ ID NO: 1368651 - RNA, 19 nt, Homo sapiens
acacgaaucaccucacuuc

SEQ ID NO: 1368652 - RNA, 19 nt, Homo sapiens
gaguuagaguggcagaaca

SEQ ID NO: 1368653 - RNA, 19 nt, Homo sapiens
ucccagcugucuugacuga

SEQ ID NO: 1368654 - RNA, 19 nt, Homo sapiens
caugacaccaccagucuga

SEQ ID NO: 1368655 - RNA, 19 nt, Homo sapiens
gaccugcugagccaaauga

SEQ ID NO: 1368656 - RNA, 19 nt, Homo sapiens
gcagacggaacagaacauu

SEQ ID NO: 1368657 - RNA, 19 nt, Homo sapiens
cuccagacucucaauguua

SEQ ID NO: 1368658 - RNA, 19 nt, Homo sapiens
guggaaaggaaucaacuga

SEQ ID NO: 1368659 - RNA, 19 nt, Homo sapiens
gguucuagaucuccacgau

SEQ ID NO: 1368660 - RNA, 19 nt, Homo sapiens
ggaagcggaaacccaguga

SEQ ID NO: 1368661 - RNA, 19 nt, Homo sapiens
ucaauaaaccugucuucag

SEQ ID NO: 1368662 - RNA, 19 nt, Homo sapiens
gaugaucuuccucaacugu

SEQ ID NO: 1368663 - RNA, 19 nt, Homo sapiens
ucaggagccagauuaaguu

SEQ ID NO: 1368664 - RNA, 19 nt, Homo sapiens
uaacccaggaggagacuga

SEQ ID NO: 1368665 - RNA, 19 nt, Homo sapiens
cccagcaccugccuuugaa

SEQ ID NO: 1368666 - RNA, 19 nt, Homo sapiens
gaagagcuccgggaaaucc

SEQ ID NO: 1368667 - RNA, 19 nt, Homo sapiens
gaaccggcucguccagaug

SEQ ID NO: 1368668 - RNA, 19 nt, Homo sapiens
ugugugcacuuuaguuauc

SEQ ID NO: 1368669 - RNA, 19 nt, Homo sapiens
ccacacgaaucaccucacu

SEQ ID NO: 1368670 - RNA, 19 nt, Homo sapiens
aauaagaauggaacaguug

SEQ ID NO: 1368671 - RNA, 19 nt, Homo sapiens
uagaguggcagaacagguu

SEQ ID NO: 1368672 - RNA, 19 nt, Homo sapiens
caaagagucagggcuggaa

SEQ ID NO: 1368673 - RNA, 19 nt, Homo sapiens
ggaaacgagauccagagau

SEQ ID NO: 1368674 - RNA, 19 nt, Homo sapiens
uuaaagacaacaagcugaa

SEQ ID NO: 1368675 - RNA, 19 nt, Homo sapiens
caaaacagucuauguggaa

SEQ ID NO: 1368676 - RNA, 19 nt, Homo sapiens
ucgaggcacuccaggugaa

SEQ ID NO: 1368677 - RNA, 19 nt, Homo sapiens
uaaagaucgcucugggaaa

SEQ ID NO: 1368678 - RNA, 19 nt, Homo sapiens
gcagcucccacguuccauu

SEQ ID NO: 1368679 - RNA, 19 nt, Homo sapiens
gaagcagcagcgagaggaa

SEQ ID NO: 1368680 - RNA, 19 nt, Homo sapiens
ugccaauucuggagcaaga

SEQ ID NO: 1368681 - RNA, 19 nt, Homo sapiens
gcacuauccuucagaauaa

SEQ ID NO: 1368682 - RNA, 19 nt, Homo sapiens
gaaauugaguuuacuguug

SEQ ID NO: 1368683 - RNA, 19 nt, Homo sapiens
ucaaagcagugucaaguua

SEQ ID NO: 1368684 - RNA, 19 nt, Homo sapiens
gcagagaaaggaaauauaa

SEQ ID NO: 1368685 - RNA, 19 nt, Homo sapiens
caaguuacgugagcaaaua

SEQ ID NO: 1368686 - RNA, 19 nt, Homo sapiens
ggaguaugcuggauucaug

SEQ ID NO: 1368687 - RNA, 19 nt, Homo sapiens
guucaaugcuguacuaugu

SEQ ID NO: 1368688 - RNA, 19 nt, Homo sapiens
gaaaucaugacccaaagaa

SEQ ID NO: 1368689 - RNA, 19 nt, Homo sapiens
ggacagagcaauacuuuac

SEQ ID NO: 1368690 - RNA, 19 nt, Homo sapiens
uauaauugcuggcuuagga

SEQ ID NO: 1368691 - RNA, 19 nt, Homo sapiens
gagcaaauacuagacuuaa

SEQ ID NO: 1368692 - RNA, 19 nt, Homo sapiens
agaucaagcugaaaugaaa

SEQ ID NO: 1368693 - RNA, 19 nt, Homo sapiens
ggacaagugaagaauguuu

SEQ ID NO: 1368694 - RNA, 19 nt, Homo sapiens
uaauuugguugauguggua

SEQ ID NO: 1368695 - RNA, 19 nt, Homo sapiens
gcuguacuauguccuuaaa

SEQ ID NO: 1368696 - RNA, 19 nt, Homo sapiens
caacaaccaagacaucaaa

SEQ ID NO: 1368697 - RNA, 19 nt, Homo sapiens
caaggaguaugcuggauuc

SEQ ID NO: 1368698 - RNA, 19 nt, Homo sapiens
gaacucuaauucuguacau

SEQ ID NO: 1368699 - RNA, 19 nt, Homo sapiens
gacaagugaagaauguuua

SEQ ID NO: 1368700 - RNA, 19 nt, Homo sapiens
gugcuucuauggcaggaua

SEQ ID NO: 1368701 - RNA, 19 nt, Homo sapiens
uagcagccacuguccauua

SEQ ID NO: 1368702 - RNA, 19 nt, Homo sapiens
ggagaacaaaguugacuau

SEQ ID NO: 1368703 - RNA, 19 nt, Homo sapiens
cccaaagaauguauugauu

SEQ ID NO: 1368704 - RNA, 19 nt, Homo sapiens
gagcagagaaaggaaauau

SEQ ID NO: 1368705 - RNA, 19 nt, Homo sapiens
ccaauuaugagcagagaaa

SEQ ID NO: 1368706 - RNA, 19 nt, Homo sapiens
agucaagucuguuuguuug

SEQ ID NO: 1368707 - RNA, 19 nt, Homo sapiens
gcacuauacuuuucaacaa

SEQ ID NO: 1368708 - RNA, 19 nt, Homo sapiens
gagaucaagcugaaaugaa

SEQ ID NO: 1368709 - RNA, 19 nt, Homo sapiens
guaagcagauaggugaguu

SEQ ID NO: 1368710 - RNA, 19 nt, Homo sapiens
gcuuguauuuggacucauu

SEQ ID NO: 1368711 - RNA, 19 nt, Homo sapiens
uguacuauguccuuaaaga

SEQ ID NO: 1368712 - RNA, 19 nt, Homo sapiens
gccaguaaccacaaauaaa

SEQ ID NO: 1368713 - RNA, 19 nt, Homo sapiens
gagaacaaaguugacuaua

SEQ ID NO: 1368714 - RNA, 19 nt, Homo sapiens
agacuacggcuauuugaaa

SEQ ID NO: 1368715 - RNA, 19 nt, Homo sapiens
cucaauagauguaacuguu

SEQ ID NO: 1368716 - RNA, 19 nt, Homo sapiens
gcagauaggugaguuuugu

SEQ ID NO: 1368717 - RNA, 19 nt, Homo sapiens
cuuuauaauugcuggcuua

SEQ ID NO: 1368718 - RNA, 19 nt, Homo sapiens
ucauggaacucuaauucug

SEQ ID NO: 1368719 - RNA, 19 nt, Homo sapiens
ggaauuuggugccaguaac

SEQ ID NO: 1368720 - RNA, 19 nt, Homo sapiens
uggugaagcuggagaacaa

SEQ ID NO: 1368721 - RNA, 19 nt, Homo sapiens
acagagcaauacuuuacaa

SEQ ID NO: 1368722 - RNA, 19 nt, Homo sapiens
gaagcuggagaacaaaguu

SEQ ID NO: 1368723 - RNA, 19 nt, Homo sapiens
gcaaauacuagacuuaagc

SEQ ID NO: 1368724 - RNA, 19 nt, Homo sapiens
aaauaugucccagaaauug

SEQ ID NO: 1368725 - RNA, 19 nt, Homo sapiens
uaggacagagcaauacuuu

SEQ ID NO: 1368726 - RNA, 19 nt, Homo sapiens
gaacaauugcuguccuucu

SEQ ID NO: 1368727 - RNA, 19 nt, Homo sapiens
aaucaugacccaaagaaug

SEQ ID NO: 1368728 - RNA, 19 nt, Homo sapiens
ugucauuuguucucaauag

SEQ ID NO: 1368729 - RNA, 19 nt, Homo sapiens
ucuguucaaugcuguacua

SEQ ID NO: 1368730 - RNA, 19 nt, Homo sapiens
caaccaagacaucaaagca

SEQ ID NO: 1368731 - RNA, 19 nt, Homo sapiens
gaugagaguaacaauaaag

SEQ ID NO: 1368732 - RNA, 19 nt, Homo sapiens
acgaaugucucgggcagua

SEQ ID NO: 1368733 - RNA, 19 nt, Homo sapiens
ugagcaaauacuagacuua

SEQ ID NO: 1368734 - RNA, 19 nt, Homo sapiens
ugcacuauccuucagaaua

SEQ ID NO: 1368735 - RNA, 19 nt, Homo sapiens
cauuuguucucaauagaug

SEQ ID NO: 1368736 - RNA, 19 nt, Homo sapiens
ugaguuuacuguugcuugu

SEQ ID NO: 1368737 - RNA, 19 nt, Homo sapiens
gggaauuuggugccaguaa

SEQ ID NO: 1368738 - RNA, 19 nt, Homo sapiens
gaucugaaaagaacaauug

SEQ ID NO: 1368739 - RNA, 19 nt, Homo sapiens
caucaaagcagugucaagu

SEQ ID NO: 1368740 - RNA, 19 nt, Homo sapiens
ucccagaaauugaguuuac

SEQ ID NO: 1368741 - RNA, 19 nt, Homo sapiens
acuauguccuuaaagagaa

SEQ ID NO: 1368742 - RNA, 19 nt, Homo sapiens
aggcaagucuguucaaugc

SEQ ID NO: 1368743 - RNA, 19 nt, Homo sapiens
ucaaggaguaugcuggauu

SEQ ID NO: 1368744 - RNA, 19 nt, Homo sapiens
caagucuguuuguuugcuu

SEQ ID NO: 1368745 - RNA, 19 nt, Homo sapiens
ccaguaaccacaaauaaaa

SEQ ID NO: 1368746 - RNA, 19 nt, Homo sapiens
ucagucaagucuguuuguu

SEQ ID NO: 1368747 - RNA, 19 nt, Homo sapiens
guuagacuacggcuauuug

SEQ ID NO: 1368748 - RNA, 19 nt, Homo sapiens
ucagauagcaguugaaaau

SEQ ID NO: 1368749 - RNA, 19 nt, Homo sapiens
ugauguuacugcacuauac

SEQ ID NO: 1368750 - RNA, 19 nt, Homo sapiens
gauugauguuacugcacua

SEQ ID NO: 1368751 - RNA, 19 nt, Homo sapiens
aagaacaauugcuguccuu

SEQ ID NO: 1368752 - RNA, 19 nt, Homo sapiens
caggauaugcggaucugaa

SEQ ID NO: 1368753 - RNA, 19 nt, Homo sapiens
gugagcaaauacuagacuu

SEQ ID NO: 1368754 - RNA, 19 nt, Homo sapiens
guauugauuugcacuaucc

SEQ ID NO: 1368755 - RNA, 19 nt, Homo sapiens
ccuuaaagagaauuuggua

SEQ ID NO: 1368756 - RNA, 19 nt, Homo sapiens
gugccaguaaccacaaaua

SEQ ID NO: 1368757 - RNA, 19 nt, Homo sapiens
gcagccaacaccaccaaug

SEQ ID NO: 1368758 - RNA, 19 nt, Homo sapiens
gucauuuguucucaauaga

SEQ ID NO: 1368759 - RNA, 19 nt, Homo sapiens
uuggacaagugaagaaugu

SEQ ID NO: 1368760 - RNA, 19 nt, Homo sapiens
ggauucauuucuauaacac

SEQ ID NO: 1368761 - RNA, 19 nt, Homo sapiens
ugagaucaagcugaaauga

SEQ ID NO: 1368762 - RNA, 19 nt, Homo sapiens
auggaacucuaauucugua

SEQ ID NO: 1368763 - RNA, 19 nt, Homo sapiens
gaaugucucgggcaguauc

SEQ ID NO: 1368764 - RNA, 19 nt, Homo sapiens
caaugguacuagugggaau

SEQ ID NO: 1368765 - RNA, 19 nt, Homo sapiens
aacaauugcuguccuucug

SEQ ID NO: 1368766 - RNA, 19 nt, Homo sapiens
caaauacuagacuuaagca

SEQ ID NO: 1368767 - RNA, 19 nt, Homo sapiens
cagucaagucuguuuguuu

SEQ ID NO: 1368768 - RNA, 19 nt, Homo sapiens
uugcuguccuucuggauga

SEQ ID NO: 1368769 - RNA, 19 nt, Homo sapiens
ucaggcaagucuguucaau

SEQ ID NO: 1368770 - RNA, 19 nt, Homo sapiens
gaguauaaucuugaaaugg

SEQ ID NO: 1368771 - RNA, 19 nt, Homo sapiens
guacuauguccuuaaagag

SEQ ID NO: 1368772 - RNA, 19 nt, Homo sapiens
ggacucauuuggggauuga

SEQ ID NO: 1368773 - RNA, 19 nt, Homo sapiens
cacaguggaugucgagaac

SEQ ID NO: 1368774 - RNA, 19 nt, Homo sapiens
ugaaaucaugacccaaaga

SEQ ID NO: 1368775 - RNA, 19 nt, Homo sapiens
gacuacggcuauuugaaaa

SEQ ID NO: 1368776 - RNA, 19 nt, Homo sapiens
ggaacucuaauucuguaca

SEQ ID NO: 1368777 - RNA, 19 nt, Homo sapiens
ugccaguaaccacaaauaa

SEQ ID NO: 1368778 - RNA, 19 nt, Homo sapiens
gauuugcacuauccuucag

SEQ ID NO: 1368779 - RNA, 19 nt, Homo sapiens
caagacaucaaagcagugu

SEQ ID NO: 1368780 - RNA, 19 nt, Homo sapiens
ucaaguuacgugagcaaau

SEQ ID NO: 1368781 - RNA, 19 nt, Homo sapiens
aaucagagcuggugaaaua

SEQ ID NO: 1368782 - RNA, 19 nt, Homo sapiens
gauagaggcuuguacaaag

SEQ ID NO: 1368783 - RNA, 19 nt, Homo sapiens
gugcauauguguuacuaaa

SEQ ID NO: 1368784 - RNA, 19 nt, Homo sapiens
gacaucaaauuucugacua

SEQ ID NO: 1368785 - RNA, 19 nt, Homo sapiens
ggagacaucaaauuucuga

SEQ ID NO: 1368786 - RNA, 19 nt, Homo sapiens
gggaagagcaagaggguuu

SEQ ID NO: 1368787 - RNA, 19 nt, Homo sapiens
ggacgagacauuccaauag

SEQ ID NO: 1368788 - RNA, 19 nt, Homo sapiens
uccaauaguucacagagua

SEQ ID NO: 1368789 - RNA, 19 nt, Homo sapiens
gggaccagauugaaaugaa

SEQ ID NO: 1368790 - RNA, 19 nt, Homo sapiens
ucaaauuucugacuaaagg

SEQ ID NO: 1368791 - RNA, 19 nt, Homo sapiens
ggaccagauugaaaugaau

SEQ ID NO: 1368792 - RNA, 19 nt, Homo sapiens
gaacaagcgccagcucuau

SEQ ID NO: 1368793 - RNA, 19 nt, Homo sapiens
gacgagacauuccaauagu

SEQ ID NO: 1368794 - RNA, 19 nt, Homo sapiens
gauaauggagacaucaaau

SEQ ID NO: 1368795 - RNA, 19 nt, Homo sapiens
acaagcgccagcucuauua

SEQ ID NO: 1368796 - RNA, 19 nt, Homo sapiens
uguaaugggugcauaugug

SEQ ID NO: 1368797 - RNA, 19 nt, Homo sapiens
ucacagaguaaucaaaguu

SEQ ID NO: 1368798 - RNA, 19 nt, Homo sapiens
guacaaagaaggccagaac

SEQ ID NO: 1368799 - RNA, 19 nt, Homo sapiens
cagagcuggugaaauaguu

SEQ ID NO: 1368800 - RNA, 19 nt, Homo sapiens
gaugauagaggcuuguaca

SEQ ID NO: 1368801 - RNA, 19 nt, Homo sapiens
cuucugcacucaugauaug

SEQ ID NO: 1368802 - RNA, 19 nt, Homo sapiens
gaccagauugaaaugaauu

SEQ ID NO: 1368803 - RNA, 19 nt, Homo sapiens
ugauagaggcuuguacaaa

SEQ ID NO: 1368804 - RNA, 19 nt, Homo sapiens
ccaauaguucacagaguaa

SEQ ID NO: 1368805 - RNA, 19 nt, Homo sapiens
ccagcucuauuaccagguu

SEQ ID NO: 1368806 - RNA, 19 nt, Homo sapiens
gaaggacgagacauuccaa

SEQ ID NO: 1368807 - RNA, 19 nt, Homo sapiens
aaacgugaauccuaaaaug

SEQ ID NO: 1368808 - RNA, 19 nt, Homo sapiens
ugaacaagcgccagcucua

SEQ ID NO: 1368809 - RNA, 19 nt, Homo sapiens
auagaggcuuguacaaaga

SEQ ID NO: 1368810 - RNA, 19 nt, Homo sapiens
ggagauaauaaugaaguug

SEQ ID NO: 1368811 - RNA, 19 nt, Homo sapiens
gcacucaugauauggaaag

SEQ ID NO: 1368812 - RNA, 19 nt, Homo sapiens
gauguuccauuuucuguau

SEQ ID NO: 1368813 - RNA, 19 nt, Homo sapiens
aaugggugcauauguguua

SEQ ID NO: 1368814 - RNA, 19 nt, Homo sapiens
gggugcauauguguuacua

SEQ ID NO: 1368815 - RNA, 19 nt, Homo sapiens
guaaugggugcauaugugu

SEQ ID NO: 1368816 - RNA, 19 nt, Homo sapiens
agaacuggcuggaaaagaa

SEQ ID NO: 1368817 - RNA, 19 nt, Homo sapiens
acagaguaaucaaaguuca

SEQ ID NO: 1368818 - RNA, 19 nt, Homo sapiens
gaccuccuguuccucacaa

SEQ ID NO: 1368819 - RNA, 19 nt, Homo sapiens
cgagacauuccaauaguuc

SEQ ID NO: 1368820 - RNA, 19 nt, Homo sapiens
ccaaucagagcuggugaaa

SEQ ID NO: 1368821 - RNA, 19 nt, Homo sapiens
acuaaaacgugaauccuaa

SEQ ID NO: 1368822 - RNA, 19 nt, Homo sapiens
gcauauguguuacuaaaac

SEQ ID NO: 1368823 - RNA, 19 nt, Homo sapiens
gauauggaaaggcuugauc

SEQ ID NO: 1368824 - RNA, 19 nt, Homo sapiens
guucacagaguaaucaaag

SEQ ID NO: 1368825 - RNA, 19 nt, Homo sapiens
acgagacauuccaauaguu

SEQ ID NO: 1368826 - RNA, 19 nt, Homo sapiens
acaaagaaggccagaacug

SEQ ID NO: 1368827 - RNA, 19 nt, Homo sapiens
uccuguuccucacaaauuu

SEQ ID NO: 1368828 - RNA, 19 nt, Homo sapiens
gaaggacguggugggaaga

SEQ ID NO: 1368829 - RNA, 19 nt, Homo sapiens
aggacgagacauuccaaua

SEQ ID NO: 1368830 - RNA, 19 nt, Homo sapiens
ccgggaagacccaaucaga

SEQ ID NO: 1368831 - RNA, 19 nt, Homo sapiens
gcuggugaaauaguuguuu

SEQ ID NO: 1368832 - RNA, 19 nt, Homo sapiens
ggugcugaguggcaguaug

SEQ ID NO: 1368833 - RNA, 19 nt, Homo sapiens
aacaagcgccagcucuauu

SEQ ID NO: 1368834 - RNA, 19 nt, Homo sapiens
auggagacaucaaauuucu

SEQ ID NO: 1368835 - RNA, 19 nt, Homo sapiens
gccaugaucgugucuucug

SEQ ID NO: 1368836 - RNA, 19 nt, Homo sapiens
ggacugauguggaagcuuu

SEQ ID NO: 1368837 - RNA, 19 nt, Homo sapiens
caagacaaaugaagacuga

SEQ ID NO: 1368838 - RNA, 19 nt, Homo sapiens
guaauuuaguugugaguga

SEQ ID NO: 1368839 - RNA, 19 nt, Homo sapiens
gaagggcaacuauagguuu

SEQ ID NO: 1368840 - RNA, 19 nt, Homo sapiens
ucaagggacugauguggaa

SEQ ID NO: 1368841 - RNA, 19 nt, Homo sapiens
gaggaaccaccaacugaua

SEQ ID NO: 1368842 - RNA, 19 nt, Homo sapiens
gaacuggcucugcuuaaga

SEQ ID NO: 1368843 - RNA, 19 nt, Homo sapiens
gaaauuugacugcuaacau

SEQ ID NO: 1368844 - RNA, 19 nt, Homo sapiens
gauaugagugagcauguaa

SEQ ID NO: 1368845 - RNA, 19 nt, Homo sapiens
agaguggucuuccugguaa

SEQ ID NO: 1368846 - RNA, 19 nt, Homo sapiens
gcuggaaauuugacugcua

SEQ ID NO: 1368847 - RNA, 19 nt, Homo sapiens
ggaacuggcucugcuuaag

SEQ ID NO: 1368848 - RNA, 19 nt, Homo sapiens
agacugaaaccaagaauau

SEQ ID NO: 1368849 - RNA, 19 nt, Homo sapiens
aaggagagguugugucuuc

SEQ ID NO: 1368850 - RNA, 19 nt, Homo sapiens
gggaggaagugagagauau

SEQ ID NO: 1368851 - RNA, 19 nt, Homo sapiens
gaagaggaaccaccaacug

SEQ ID NO: 1368852 - RNA, 19 nt, Homo sapiens
gggcaacuauagguuuaaa

SEQ ID NO: 1368853 - RNA, 19 nt, Homo sapiens
aagggcaacuauagguuua

SEQ ID NO: 1368854 - RNA, 19 nt, Homo sapiens
gagagguugugucuucguu

SEQ ID NO: 1368855 - RNA, 19 nt, Homo sapiens
gcaaggagagguugugucu

SEQ ID NO: 1368856 - RNA, 19 nt, Homo sapiens
gguugugucuucguucuuu

SEQ ID NO: 1368857 - RNA, 19 nt, Homo sapiens
guucuuaugcuggaaauuu

SEQ ID NO: 1368858 - RNA, 19 nt, Homo sapiens
gagugagcauguaacaaga

SEQ ID NO: 1368859 - RNA, 19 nt, Homo sapiens
uccaacaucuucguucuuu

SEQ ID NO: 1368860 - RNA, 19 nt, Homo sapiens
cuggaaauuugacugcuaa

SEQ ID NO: 1368861 - RNA, 19 nt, Homo sapiens
cugcuaacauucucuuaau

SEQ ID NO: 1368862 - RNA, 19 nt, Homo sapiens
aaaccaagacaaaugaaga

SEQ ID NO: 1368863 - RNA, 19 nt, Homo sapiens
ggaugcaccuggagauggu

SEQ ID NO: 1368864 - RNA, 19 nt, Homo sapiens
gaaaccaagaauauuguuc

SEQ ID NO: 1368865 - RNA, 19 nt, Homo sapiens
agacaaaugaagacugaaa

SEQ ID NO: 1368866 - RNA, 19 nt, Homo sapiens
guaacaagaucccaauccu

SEQ ID NO: 1368867 - RNA, 19 nt, Homo sapiens
caagaucccaauccucaga

SEQ ID NO: 1368868 - RNA, 19 nt, Homo sapiens
gcacaguccguggcuuuga

SEQ ID NO: 1368869 - RNA, 19 nt, Homo sapiens
caacaucuucguucuuucu

SEQ ID NO: 1368870 - RNA, 19 nt, Homo sapiens
aaaugaagacugaaaccaa

SEQ ID NO: 1368871 - RNA, 19 nt, Homo sapiens
gcaggugaagggcaacuau

SEQ ID NO: 1368872 - RNA, 19 nt, Homo sapiens
aagaggaaaugaccaagag

SEQ ID NO: 1368873 - RNA, 19 nt, Homo sapiens
ugagugagcauguaacaag

SEQ ID NO: 1368874 - RNA, 19 nt, Homo sapiens
ggaagugagagauaugagu

SEQ ID NO: 1368875 - RNA, 19 nt, Homo sapiens
gaggaagugagagauauga

SEQ ID NO: 1368876 - RNA, 19 nt, Homo sapiens
agauaugagugagcaugua

SEQ ID NO: 1368877 - RNA, 19 nt, Homo sapiens
ggaggaagugagagauaug

SEQ ID NO: 1368878 - RNA, 19 nt, Homo sapiens
cagaguggucuuccuggua

SEQ ID NO: 1368879 - RNA, 19 nt, Homo sapiens
gagguugugucuucguucu

SEQ ID NO: 1368880 - RNA, 19 nt, Homo sapiens
ggagaugguccugauguca

SEQ ID NO: 1368881 - RNA, 19 nt, Homo sapiens
caggaacuggcucugcuua

SEQ ID NO: 1368882 - RNA, 19 nt, Homo sapiens
aaucguggcugggcuggaa

SEQ ID NO: 1368883 - RNA, 19 nt, Homo sapiens
aagaggaaccaccaacuga

SEQ ID NO: 1368884 - RNA, 19 nt, Homo sapiens
uggcucugcuuaagauaga

SEQ ID NO: 1368885 - RNA, 19 nt, Homo sapiens
ggaaccaccaacugauaau

SEQ ID NO: 1368886 - RNA, 19 nt, Homo sapiens
agaaagaggaaaugaccaa

SEQ ID NO: 1368887 - RNA, 19 nt, Homo sapiens
caggugaagggcaacuaua

SEQ ID NO: 1368888 - RNA, 19 nt, Homo sapiens
uggucuuccugguaauuua

SEQ ID NO: 1368889 - RNA, 19 nt, Homo sapiens
gagauaugagugagcaugu

SEQ ID NO: 1368890 - RNA, 19 nt, Homo sapiens
ggaacgagggaggaaguga

SEQ ID NO: 1368891 - RNA, 19 nt, Homo sapiens
ccugguaauuuaguuguga

SEQ ID NO: 1368892 - RNA, 19 nt, Homo sapiens
acugaaaccaagaauauug

SEQ ID NO: 1368893 - RNA, 19 nt, Homo sapiens
gaagacugaaaccaagaau

SEQ ID NO: 1368894 - RNA, 19 nt, Homo sapiens
guuuaaaccaagacaaaug

SEQ ID NO: 1368895 - RNA, 19 nt, Homo sapiens
aaagaggaaaugaccaaga

SEQ ID NO: 1368896 - RNA, 19 nt, Homo sapiens
ggaaauuugacugcuaaca

SEQ ID NO: 1368897 - RNA, 19 nt, Homo sapiens
gaaccaccaacugauaauc

SEQ ID NO: 1368898 - RNA, 19 nt, Homo sapiens
gugagcauguaacaagauc

SEQ ID NO: 1368899 - RNA, 19 nt, Homo sapiens
gacugaaaccaagaauauu

SEQ ID NO: 1368900 - RNA, 19 nt, Homo sapiens
ugaagacugaaaccaagaa

SEQ ID NO: 1368901 - RNA, 19 nt, Homo sapiens
ugaagggcaacuauagguu

SEQ ID NO: 1368902 - RNA, 19 nt, Homo sapiens
ggacucugcccacuuuuga

SEQ ID NO: 1368903 - RNA, 19 nt, Homo sapiens
cgagggaggaagugagaga

SEQ ID NO: 1368904 - RNA, 19 nt, Homo sapiens
caaaugaagacugaaacca

SEQ ID NO: 1368905 - RNA, 19 nt, Homo sapiens
gugaagggcaacuauaggu

SEQ ID NO: 1368906 - RNA, 19 nt, Homo sapiens
gaggaugcaccuggagaug

SEQ ID NO: 1368907 - RNA, 19 nt, Homo sapiens
aggaaccaccaacugauaa

SEQ ID NO: 1368908 - RNA, 19 nt, Homo sapiens
aagacugaaaccaagaaua

SEQ ID NO: 1368909 - RNA, 19 nt, Homo sapiens
uggcacaguccguggcuuu

SEQ ID NO: 1368910 - RNA, 19 nt, Homo sapiens
ccaacaucuucguucuuuc

SEQ ID NO: 1368911 - RNA, 19 nt, Homo sapiens
gccgguaggucugcagagu

SEQ ID NO: 1368912 - RNA, 19 nt, Homo sapiens
caagaagaggaaccaccaa

SEQ ID NO: 1368913 - RNA, 19 nt, Homo sapiens
ggagugaggugaacgauga

SEQ ID NO: 1368914 - RNA, 19 nt, Homo sapiens
ggagacagcuuuagggaau

SEQ ID NO: 1368915 - RNA, 19 nt, Homo sapiens
gcacugggcuuuauuuguc

SEQ ID NO: 1368916 - RNA, 19 nt, Homo sapiens
gcccaucuguugcacauua

SEQ ID NO: 1368917 - RNA, 19 nt, Homo sapiens
gcucaacucuuguguuugu

SEQ ID NO: 1368918 - RNA, 19 nt, Homo sapiens
ccaaggagauccagucugu

SEQ ID NO: 1368919 - RNA, 19 nt, Homo sapiens
ggagagagcgcgcaguuug

SEQ ID NO: 1368920 - RNA, 19 nt, Homo sapiens
aaacuuacauguugagauc

SEQ ID NO: 1368921 - RNA, 19 nt, Homo sapiens
ugacagaccagaauauuug

SEQ ID NO: 1368922 - RNA, 19 nt, Homo sapiens
gaguguggcugcaagagaa

SEQ ID NO: 1368923 - RNA, 19 nt, Homo sapiens
caaaugaagaguccagaaa

SEQ ID NO: 1368924 - RNA, 19 nt, Homo sapiens
ccauuuaucuguugcuguu

SEQ ID NO: 1368925 - RNA, 19 nt, Homo sapiens
gaaggaagucaaauacuca

SEQ ID NO: 1368926 - RNA, 19 nt, Homo sapiens
gcaauucucauuccucuca

SEQ ID NO: 1368927 - RNA, 19 nt, Homo sapiens
ggagucaaguguuaaaggu

SEQ ID NO: 1368928 - RNA, 19 nt, Homo sapiens
gagaugcugucaggacgua

SEQ ID NO: 1368929 - RNA, 19 nt, Homo sapiens
cuacagagauccaggaaac

SEQ ID NO: 1368930 - RNA, 19 nt, Homo sapiens
gauccagucugucuacauc

SEQ ID NO: 1368931 - RNA, 19 nt, Homo sapiens
cgaaggaagucaaauacuc

SEQ ID NO: 1368932 - RNA, 19 nt, Homo sapiens
cugcucaacucuuguguuu

SEQ ID NO: 1368933 - RNA, 19 nt, Homo sapiens
cagaauauuugaaguuugg

SEQ ID NO: 1368934 - RNA, 19 nt, Homo sapiens
gauccucauugccauggua

SEQ ID NO: 1368935 - RNA, 19 nt, Homo sapiens
caaauagccugaggaagca

SEQ ID NO: 1368936 - RNA, 19 nt, Homo sapiens
acaaagugauggcagaaug

SEQ ID NO: 1368937 - RNA, 19 nt, Homo sapiens
gcaguuucuuggugauuug

SEQ ID NO: 1368938 - RNA, 19 nt, Homo sapiens
agaagagccuggaguuugu

SEQ ID NO: 1368939 - RNA, 19 nt, Homo sapiens
caacucccaugguggauca

SEQ ID NO: 1368940 - RNA, 19 nt, Homo sapiens
agucaaguguuaaagguuu

SEQ ID NO: 1368941 - RNA, 19 nt, Homo sapiens
gcugguggcugcuaacgau

SEQ ID NO: 1368942 - RNA, 19 nt, Homo sapiens
ggugaacgaugaccaggau

SEQ ID NO: 1368943 - RNA, 19 nt, Homo sapiens
gagacagcuuuagggaaua

SEQ ID NO: 1368944 - RNA, 19 nt, Homo sapiens
gaccagaauauuugaaguu

SEQ ID NO: 1368945 - RNA, 19 nt, Homo sapiens
gcaaaugaagaguccagaa

SEQ ID NO: 1368946 - RNA, 19 nt, Homo sapiens
uugggaaacuuacauguug

SEQ ID NO: 1368947 - RNA, 19 nt, Homo sapiens
gggugacgcuggugaagug

SEQ ID NO: 1368948 - RNA, 19 nt, Homo sapiens
gcagagcccuauaccucau

SEQ ID NO: 1368949 - RNA, 19 nt, Homo sapiens
uagaagagccuggaguuug

SEQ ID NO: 1368950 - RNA, 19 nt, Homo sapiens
gauaaaaggauccaaguga

SEQ ID NO: 1368951 - RNA, 19 nt, Homo sapiens
ccagaauauuugaaguuug

SEQ ID NO: 1368952 - RNA, 19 nt, Homo sapiens
ggcaguuucuuggugauuu

SEQ ID NO: 1368953 - RNA, 19 nt, Homo sapiens
agacagcuuuagggaauaa

SEQ ID NO: 1368954 - RNA, 19 nt, Homo sapiens
caagauacaguggcaaaga

SEQ ID NO: 1368955 - RNA, 19 nt, Homo sapiens
aagcgaaggaagucaaaua

SEQ ID NO: 1368956 - RNA, 19 nt, Homo sapiens
gguagaagagccuggaguu

SEQ ID NO: 1368957 - RNA, 19 nt, Homo sapiens
gaaaagaagcgaaggaagu

SEQ ID NO: 1368958 - RNA, 19 nt, Homo sapiens
caaggccggucugcaaaug

SEQ ID NO: 1368959 - RNA, 19 nt, Homo sapiens
ggaguuuguugcuucucuu

SEQ ID NO: 1368960 - RNA, 19 nt, Homo sapiens
guagaagagccuggaguuu

SEQ ID NO: 1368961 - RNA, 19 nt, Homo sapiens
ugaggaagcaggagaguuc

SEQ ID NO: 1368962 - RNA, 19 nt, Homo sapiens
ggacaaagugauggcagaa

SEQ ID NO: 1368963 - RNA, 19 nt, Homo sapiens
gcucugggagacagcuuua

SEQ ID NO: 1368964 - RNA, 19 nt, Homo sapiens
aaaaggggcuggaggaaga

SEQ ID NO: 1368965 - RNA, 19 nt, Homo sapiens
gaaacuuacauguugagau

SEQ ID NO: 1368966 - RNA, 19 nt, Homo sapiens
gcgcugcucguucuccuuu

SEQ ID NO: 1368967 - RNA, 19 nt, Homo sapiens
ccagggaagugcacauguc

SEQ ID NO: 1368968 - RNA, 19 nt, Homo sapiens
ucuugggccuggugauuaa

SEQ ID NO: 1368969 - RNA, 19 nt, Homo sapiens
caagacaguaggugagaga

SEQ ID NO: 1368970 - RNA, 19 nt, Homo sapiens
gaggugggcaggcagaaga

SEQ ID NO: 1368971 - RNA, 19 nt, Homo sapiens
ggccugcacugggcuuuau

SEQ ID NO: 1368972 - RNA, 19 nt, Homo sapiens
ucucuuugcuauucuuuca

SEQ ID NO: 1368973 - RNA, 19 nt, Homo sapiens
gguguucccucugcugaug

SEQ ID NO: 1368974 - RNA, 19 nt, Homo sapiens
ggaguguggcugcaagaga

SEQ ID NO: 1368975 - RNA, 19 nt, Homo sapiens
ggcagaagagccuggauug

SEQ ID NO: 1368976 - RNA, 19 nt, Homo sapiens
gaauccaccugcuucuacu

SEQ ID NO: 1368977 - RNA, 19 nt, Homo sapiens
gccaugguacucaaaggua

SEQ ID NO: 1368978 - RNA, 19 nt, Homo sapiens
ccccacagcuccagccuua

SEQ ID NO: 1368979 - RNA, 19 nt, Homo sapiens
uaacacaagucccuuuccu

SEQ ID NO: 1368980 - RNA, 19 nt, Homo sapiens
gggcccugcuuucaacaug

SEQ ID NO: 1368981 - RNA, 19 nt, Homo sapiens
gaccuuagcgcugcucguu

SEQ ID NO: 1368982 - RNA, 19 nt, Homo sapiens
aguuugggcuguccugaaa

SEQ ID NO: 1368983 - RNA, 19 nt, Homo sapiens
gcaaggccggucugcaaau

SEQ ID NO: 1368984 - RNA, 19 nt, Homo sapiens
uguguuuguuguucuguuu

SEQ ID NO: 1368985 - RNA, 19 nt, Homo sapiens
ugguggagcugacaaccuu

SEQ ID NO: 1368986 - RNA, 19 nt, Homo sapiens
ugggccuggugauuaauua

SEQ ID NO: 1368987 - RNA, 19 nt, Homo sapiens
aggaugccauucuguguga

SEQ ID NO: 1368988 - RNA, 19 nt, Homo sapiens
gucaggacguaucuucuuc

SEQ ID NO: 1368989 - RNA, 19 nt, Homo sapiens
gcugaccacugaagcuucu

SEQ ID NO: 1368990 - RNA, 19 nt, Homo sapiens
ugacugagagcgccuaugg

SEQ ID NO: 1368991 - RNA, 19 nt, Homo sapiens
ggagaguuccugguuaugg

SEQ ID NO: 1368992 - RNA, 19 nt, Homo sapiens
uaacaccugugccuaacac

SEQ ID NO: 1368993 - RNA, 19 nt, Homo sapiens
ggagauccagucugucuac

SEQ ID NO: 1368994 - RNA, 19 nt, Homo sapiens
ugaccaggaugccauucug

SEQ ID NO: 1368995 - RNA, 19 nt, Homo sapiens
gaaguggcccagggaagug

SEQ ID NO: 1368996 - RNA, 19 nt, Homo sapiens
ugcgaucucugccucaaga

SEQ ID NO: 1368997 - RNA, 19 nt, Homo sapiens
uugcuucucuuugcuauuc

SEQ ID NO: 1368998 - RNA, 19 nt, Homo sapiens
ccacagcuccagccuuagu

SEQ ID NO: 1368999 - RNA, 19 nt, Homo sapiens
ugggaaacuuacauguuga

SEQ ID NO: 1369000 - RNA, 19 nt, Homo sapiens
gaagagccuggaguuuguu

SEQ ID NO: 1369001 - RNA, 19 nt, Homo sapiens
ggcaaggccggucugcaaa

SEQ ID NO: 1369002 - RNA, 19 nt, Homo sapiens
ccugcauacucacaucuga

SEQ ID NO: 1369003 - RNA, 19 nt, Homo sapiens
cagcccaucuguugcacau

SEQ ID NO: 1369004 - RNA, 19 nt, Homo sapiens
gacagaccagaauauuuga

SEQ ID NO: 1369005 - RNA, 19 nt, Homo sapiens
acuuacauguugagaucua

SEQ ID NO: 1369006 - RNA, 19 nt, Homo sapiens
ccaccugcuucuacugcuu

SEQ ID NO: 1369007 - RNA, 19 nt, Homo sapiens
gcacugccugccagagaug

SEQ ID NO: 1369008 - RNA, 19 nt, Homo sapiens
gaguuuguugcuucucuuu

SEQ ID NO: 1369009 - RNA, 19 nt, Homo sapiens
guacucaaagguagaagag

SEQ ID NO: 1369010 - RNA, 19 nt, Homo sapiens
gggaagugcacaugucucu

SEQ ID NO: 1369011 - RNA, 19 nt, Homo sapiens
cguguguucuucaacuuuc

SEQ ID NO: 1369012 - RNA, 19 nt, Homo sapiens
ccaggcaacaugaacuuuc

SEQ ID NO: 1369013 - RNA, 19 nt, Homo sapiens
gaacaagaauuacaugaug

SEQ ID NO: 1369014 - RNA, 19 nt, Homo sapiens
ggaaauauuugaugguuug

SEQ ID NO: 1369015 - RNA, 19 nt, Homo sapiens
gaagaagguuuaaacauuc

SEQ ID NO: 1369016 - RNA, 19 nt, Homo sapiens
gaaagaagcauguagagaa

SEQ ID NO: 1369017 - RNA, 19 nt, Homo sapiens
uaaaggaacuccagaaugu

SEQ ID NO: 1369018 - RNA, 19 nt, Homo sapiens
gaacuagauuggauguuaa

SEQ ID NO: 1369019 - RNA, 19 nt, Homo sapiens
gaaaguaagugaacacagu

SEQ ID NO: 1369020 - RNA, 19 nt, Homo sapiens
agaagaaacuccaagauga

SEQ ID NO: 1369021 - RNA, 19 nt, Homo sapiens
cuaaugaaaugcugucuaa

SEQ ID NO: 1369022 - RNA, 19 nt, Homo sapiens
ugaacuagauuggauguua

SEQ ID NO: 1369023 - RNA, 19 nt, Homo sapiens
gcacacaccuuuucucuaa

SEQ ID NO: 1369024 - RNA, 19 nt, Homo sapiens
gaaaaucgaucaaagaaga

SEQ ID NO: 1369025 - RNA, 19 nt, Homo sapiens
gaacuaagaagacauaaag

SEQ ID NO: 1369026 - RNA, 19 nt, Homo sapiens
ggacauccuuuguugaaga

SEQ ID NO: 1369027 - RNA, 19 nt, Homo sapiens
gaaacuccaagaugaaaua

SEQ ID NO: 1369028 - RNA, 19 nt, Homo sapiens
uaaagcaguuccaaugaaa

SEQ ID NO: 1369029 - RNA, 19 nt, Homo sapiens
ggauggagaugaagcagaa

SEQ ID NO: 1369030 - RNA, 19 nt, Homo sapiens
gacauaaaguucaagagaa

SEQ ID NO: 1369031 - RNA, 19 nt, Homo sapiens
gagauuaacagaacaagaa

SEQ ID NO: 1369032 - RNA, 19 nt, Homo sapiens
guaccagaccucauaguua

SEQ ID NO: 1369033 - RNA, 19 nt, Homo sapiens
gaagaaacuccaagaugaa

SEQ ID NO: 1369034 - RNA, 19 nt, Homo sapiens
aaagaagcauguagagaaa

SEQ ID NO: 1369035 - RNA, 19 nt, Homo sapiens
gaacuuaaagccagagaga

SEQ ID NO: 1369036 - RNA, 19 nt, Homo sapiens
gcacaggcguuuacugaag

SEQ ID NO: 1369037 - RNA, 19 nt, Homo sapiens
agagggagcugagaucuaa

SEQ ID NO: 1369038 - RNA, 19 nt, Homo sapiens
ccgagcagcuauuccuuua

SEQ ID NO: 1369039 - RNA, 19 nt, Homo sapiens
uugaacagcuuaagaaaga

SEQ ID NO: 1369040 - RNA, 19 nt, Homo sapiens
aaacagauguccgccaauu

SEQ ID NO: 1369041 - RNA, 19 nt, Homo sapiens
gaaucuaaaucaucaugga

SEQ ID NO: 1369042 - RNA, 19 nt, Homo sapiens
uuaagaaucuccuggaaau

SEQ ID NO: 1369043 - RNA, 19 nt, Homo sapiens
uaacacagaaugaugauga

SEQ ID NO: 1369044 - RNA, 19 nt, Homo sapiens
gagaauauuggaccucuaa

SEQ ID NO: 1369045 - RNA, 19 nt, Homo sapiens
gagcagcuauuccuuuaca

SEQ ID NO: 1369046 - RNA, 19 nt, Homo sapiens
agaaagagauuaacagaac

SEQ ID NO: 1369047 - RNA, 19 nt, Homo sapiens
gaaagagauuaacagaaca

SEQ ID NO: 1369048 - RNA, 19 nt, Homo sapiens
ucaaaugcuuuaccuguau

SEQ ID NO: 1369049 - RNA, 19 nt, Homo sapiens
gaggagaagcuguucguaa

SEQ ID NO: 1369050 - RNA, 19 nt, Homo sapiens
uaccagaccucauaguuau

SEQ ID NO: 1369051 - RNA, 19 nt, Homo sapiens
gcaaagauuacgagaccua

SEQ ID NO: 1369052 - RNA, 19 nt, Homo sapiens
ggugaaaucauuagacuug

SEQ ID NO: 1369053 - RNA, 19 nt, Homo sapiens
aggagaagcuguucguaaa

SEQ ID NO: 1369054 - RNA, 19 nt, Homo sapiens
ggaucuagaugauggacuu

SEQ ID NO: 1369055 - RNA, 19 nt, Homo sapiens
cagcuugucucacauaaca

SEQ ID NO: 1369056 - RNA, 19 nt, Homo sapiens
aagaaacuaugccaaagaa

SEQ ID NO: 1369057 - RNA, 19 nt, Homo sapiens
agucagcccuggaagauuu

SEQ ID NO: 1369058 - RNA, 19 nt, Homo sapiens
gaaguaauggugcucaaug

SEQ ID NO: 1369059 - RNA, 19 nt, Homo sapiens
caagaaagagauuaacaga

SEQ ID NO: 1369060 - RNA, 19 nt, Homo sapiens
gccagaaaguacuaaagaa

SEQ ID NO: 1369061 - RNA, 19 nt, Homo sapiens
gaggagaacguuuggaaga

SEQ ID NO: 1369062 - RNA, 19 nt, Homo sapiens
guacaagcaguaauugauu

SEQ ID NO: 1369063 - RNA, 19 nt, Homo sapiens
gaacaucaagaacuuaaag

SEQ ID NO: 1369064 - RNA, 19 nt, Homo sapiens
ccauggagaacuacuauaa

SEQ ID NO: 1369065 - RNA, 19 nt, Homo sapiens
gcaguuccaaugaaaguaa

SEQ ID NO: 1369066 - RNA, 19 nt, Homo sapiens
uaacaaacacaaacaguuc

SEQ ID NO: 1369067 - RNA, 19 nt, Homo sapiens
gaagagccagaaaguacua

SEQ ID NO: 1369068 - RNA, 19 nt, Homo sapiens
gaaggaggaggaaacagaa

SEQ ID NO: 1369069 - RNA, 19 nt, Homo sapiens
caaaugcuuuaccuguauu

SEQ ID NO: 1369070 - RNA, 19 nt, Homo sapiens
ucaauguccuaaugaaaug

SEQ ID NO: 1369071 - RNA, 19 nt, Homo sapiens
caaagaagaaacuccaaga

SEQ ID NO: 1369072 - RNA, 19 nt, Homo sapiens
aaauaaagcaguuccaaug

SEQ ID NO: 1369073 - RNA, 19 nt, Homo sapiens
guaaaggaacuccagaaug

SEQ ID NO: 1369074 - RNA, 19 nt, Homo sapiens
cagcaaaugggaaguauau

SEQ ID NO: 1369075 - RNA, 19 nt, Homo sapiens
gcuagaaucgagccaguaa

SEQ ID NO: 1369076 - RNA, 19 nt, Homo sapiens
gcccagacauuacauaagg

SEQ ID NO: 1369077 - RNA, 19 nt, Homo sapiens
ggcaugaccuccuuacuac

SEQ ID NO: 1369078 - RNA, 19 nt, Homo sapiens
uaagaaagaagcauguaga

SEQ ID NO: 1369079 - RNA, 19 nt, Homo sapiens
gcacagguugaacagcuua

SEQ ID NO: 1369080 - RNA, 19 nt, Homo sapiens
gaauauuggaccucuaaga

SEQ ID NO: 1369081 - RNA, 19 nt, Homo sapiens
gaagacauaaaguucaaga

SEQ ID NO: 1369082 - RNA, 19 nt, Homo sapiens
gaaagccacccuacagauc

SEQ ID NO: 1369083 - RNA, 19 nt, Homo sapiens
ggaagccucccaaaggaaa

SEQ ID NO: 1369084 - RNA, 19 nt, Homo sapiens
caaggaagccucccaaagg

SEQ ID NO: 1369085 - RNA, 19 nt, Homo sapiens
uuacagaacgcaucaguga

SEQ ID NO: 1369086 - RNA, 19 nt, Homo sapiens
acaggaacaucaagaacuu

SEQ ID NO: 1369087 - RNA, 19 nt, Homo sapiens
acaagagacugcaagacuu

SEQ ID NO: 1369088 - RNA, 19 nt, Homo sapiens
acuccaagaugaaauagaa

SEQ ID NO: 1369089 - RNA, 19 nt, Homo sapiens
ggcguuuacugaagcauuu

SEQ ID NO: 1369090 - RNA, 19 nt, Homo sapiens
agacacagcacacaccuuu

SEQ ID NO: 1369091 - RNA, 19 nt, Homo sapiens
auaaagcaguuccaaugaa

SEQ ID NO: 1369092 - RNA, 19 nt, Homo sapiens
ccuggaagauuuacucuag

SEQ ID NO: 1369093 - RNA, 19 nt, Homo sapiens
ggacuuuccaugcguagaa

SEQ ID NO: 1369094 - RNA, 19 nt, Homo sapiens
ggauggaacugaggagaca

SEQ ID NO: 1369095 - RNA, 19 nt, Homo sapiens
gaagacacggaaacccuuu

SEQ ID NO: 1369096 - RNA, 19 nt, Homo sapiens
caauguacaagcaguaauu

SEQ ID NO: 1369097 - RNA, 19 nt, Homo sapiens
acagaaugaugaugauguu

SEQ ID NO: 1369098 - RNA, 19 nt, Homo sapiens
ggaacuaagaagacauaaa

SEQ ID NO: 1369099 - RNA, 19 nt, Homo sapiens
ggaaaagaauacuugcauu

SEQ ID NO: 1369100 - RNA, 19 nt, Homo sapiens
gauaauaguaggugaaggu

SEQ ID NO: 1369101 - RNA, 19 nt, Homo sapiens
agaaaagacugaccauaaa

SEQ ID NO: 1369102 - RNA, 19 nt, Homo sapiens
ggugaucggauuaaagaaa

SEQ ID NO: 1369103 - RNA, 19 nt, Homo sapiens
caggucagcuugucucaca

SEQ ID NO: 1369104 - RNA, 19 nt, Homo sapiens
gaagaugaugcacacaaug

SEQ ID NO: 1369105 - RNA, 19 nt, Homo sapiens
gaaacuaugccaaagaaaa

SEQ ID NO: 1369106 - RNA, 19 nt, Homo sapiens
uaagaaacuaugccaaaga

SEQ ID NO: 1369107 - RNA, 19 nt, Homo sapiens
uggaagauuuacucuagaa

SEQ ID NO: 1369108 - RNA, 19 nt, Homo sapiens
gaaagggaacuaagaagac

SEQ ID NO: 1369109 - RNA, 19 nt, Homo sapiens
gauauguuguacccuccua

SEQ ID NO: 1369110 - RNA, 19 nt, Homo sapiens
agaauccacuggugaaauc

SEQ ID NO: 1369111 - RNA, 19 nt, Homo sapiens
agaaucuccuggaaauauu

SEQ ID NO: 1369112 - RNA, 19 nt, Homo sapiens
gaggccagacuugauaaua

SEQ ID NO: 1369113 - RNA, 19 nt, Homo sapiens
gaagauaacucucaccuuu

SEQ ID NO: 1369114 - RNA, 19 nt, Homo sapiens
gcaagaaguucaagaagau

SEQ ID NO: 1369115 - RNA, 19 nt, Homo sapiens
ucagugauguccuauaaua

SEQ ID NO: 1369116 - RNA, 19 nt, Homo sapiens
aaagauguguggcauauuu

SEQ ID NO: 1369117 - RNA, 19 nt, Homo sapiens
gaacagacauauuucuagu

SEQ ID NO: 1369118 - RNA, 19 nt, Homo sapiens
ugauucaucucucuaguua

SEQ ID NO: 1369119 - RNA, 19 nt, Homo sapiens
gcacaaucauggcucacua

SEQ ID NO: 1369120 - RNA, 19 nt, Homo sapiens
ucaagaagaucauuaugga

SEQ ID NO: 1369121 - RNA, 19 nt, Homo sapiens
gguacucacuggaaacuuu

SEQ ID NO: 1369122 - RNA, 19 nt, Homo sapiens
gcagagaucaggccaaguu

SEQ ID NO: 1369123 - RNA, 19 nt, Homo sapiens
acagaaagauguguaagaa

SEQ ID NO: 1369124 - RNA, 19 nt, Homo sapiens
caaguaauccucucauuuc

SEQ ID NO: 1369125 - RNA, 19 nt, Homo sapiens
acagacauauuucuaguug

SEQ ID NO: 1369126 - RNA, 19 nt, Homo sapiens
acaaagauguguggcauau

SEQ ID NO: 1369127 - RNA, 19 nt, Homo sapiens
gagaccacccuguuuguuu

SEQ ID NO: 1369128 - RNA, 19 nt, Homo sapiens
guauuacacuggaguuuua

SEQ ID NO: 1369129 - RNA, 19 nt, Homo sapiens
uuucagugauguccuauaa

SEQ ID NO: 1369130 - RNA, 19 nt, Homo sapiens
ucaaguaauccucucauuu

SEQ ID NO: 1369131 - RNA, 19 nt, Homo sapiens
gaagauccuaggagacaaa

SEQ ID NO: 1369132 - RNA, 19 nt, Homo sapiens
guagcucccuuuccuagga

SEQ ID NO: 1369133 - RNA, 19 nt, Homo sapiens
gacaaggcaauguaacuuu

SEQ ID NO: 1369134 - RNA, 19 nt, Homo sapiens
ggaauugggaauauauaug

SEQ ID NO: 1369135 - RNA, 19 nt, Homo sapiens
caaacagaaagauguguaa

SEQ ID NO: 1369136 - RNA, 19 nt, Homo sapiens
cauuucggcuuccugagua

SEQ ID NO: 1369137 - RNA, 19 nt, Homo sapiens
ugagguggccuggacauua

SEQ ID NO: 1369138 - RNA, 19 nt, Homo sapiens
gagguggccuggacauuac

SEQ ID NO: 1369139 - RNA, 19 nt, Homo sapiens
ggaacagacauauuucuag

SEQ ID NO: 1369140 - RNA, 19 nt, Homo sapiens
ugcaagaaguucaagaaga

SEQ ID NO: 1369141 - RNA, 19 nt, Homo sapiens
caagauuuacuggaagaua

SEQ ID NO: 1369142 - RNA, 19 nt, Homo sapiens
aauaaacacuccuagaaac

SEQ ID NO: 1369143 - RNA, 19 nt, Homo sapiens
ggacuacaccgugggagaa

SEQ ID NO: 1369144 - RNA, 19 nt, Homo sapiens
guacuuuguuugcaagaag

SEQ ID NO: 1369145 - RNA, 19 nt, Homo sapiens
agacguacuuuguuugcaa

SEQ ID NO: 1369146 - RNA, 19 nt, Homo sapiens
agaccacccuguuuguuug

SEQ ID NO: 1369147 - RNA, 19 nt, Homo sapiens
gagccagacaucuuugauu

SEQ ID NO: 1369148 - RNA, 19 nt, Homo sapiens
aguauaacuugcugacaaa

SEQ ID NO: 1369149 - RNA, 19 nt, Homo sapiens
cacaagauuuacuggaaga

SEQ ID NO: 1369150 - RNA, 19 nt, Homo sapiens
aaauguugaucccaaaugu

SEQ ID NO: 1369151 - RNA, 19 nt, Homo sapiens
aagcggaauugggaauaua

SEQ ID NO: 1369152 - RNA, 19 nt, Homo sapiens
ucaaacagaaagaugugua

SEQ ID NO: 1369153 - RNA, 19 nt, Homo sapiens
augcagacguacuuuguuu

SEQ ID NO: 1369154 - RNA, 19 nt, Homo sapiens
aagauaacucucaccuuua

SEQ ID NO: 1369155 - RNA, 19 nt, Homo sapiens
ccagacaucuuugauucau

SEQ ID NO: 1369156 - RNA, 19 nt, Homo sapiens
acagugagaacaaguuuga

SEQ ID NO: 1369157 - RNA, 19 nt, Homo sapiens
caugaacgcugagggagau

SEQ ID NO: 1369158 - RNA, 19 nt, Homo sapiens
agacaucuuugauucaucu

SEQ ID NO: 1369159 - RNA, 19 nt, Homo sapiens
gccagugucuaccuaaugg

SEQ ID NO: 1369160 - RNA, 19 nt, Homo sapiens
guuguucuguccaccugua

SEQ ID NO: 1369161 - RNA, 19 nt, Homo sapiens
gacaaagauguguggcaua

SEQ ID NO: 1369162 - RNA, 19 nt, Homo sapiens
ccaaaugugaagacaguga

SEQ ID NO: 1369163 - RNA, 19 nt, Homo sapiens
uaaagcggaauugggaaua

SEQ ID NO: 1369164 - RNA, 19 nt, Homo sapiens
gagaaucugcaaagguguu

SEQ ID NO: 1369165 - RNA, 19 nt, Homo sapiens
ggaagauaacucucaccuu

SEQ ID NO: 1369166 - RNA, 19 nt, Homo sapiens
gugaagacagugagaacaa

SEQ ID NO: 1369167 - RNA, 19 nt, Homo sapiens
gcggaauugggaauauaua

SEQ ID NO: 1369168 - RNA, 19 nt, Homo sapiens
agccagacaucuuugauuc

SEQ ID NO: 1369169 - RNA, 19 nt, Homo sapiens
auaacuugcugacaaagau

SEQ ID NO: 1369170 - RNA, 19 nt, Homo sapiens
ggagaccacccuguuuguu

SEQ ID NO: 1369171 - RNA, 19 nt, Homo sapiens
ggaaucacuggguacaaug

SEQ ID NO: 1369172 - RNA, 19 nt, Homo sapiens
uggaaucacuggguacaau

SEQ ID NO: 1369173 - RNA, 19 nt, Homo sapiens
gaaguucaagaagaucauu

SEQ ID NO: 1369174 - RNA, 19 nt, Homo sapiens
gaagacagugagaacaagu

SEQ ID NO: 1369175 - RNA, 19 nt, Homo sapiens
ugagggagaugagccuuca

SEQ ID NO: 1369176 - RNA, 19 nt, Homo sapiens
aaacacuccuagaaacaag

SEQ ID NO: 1369177 - RNA, 19 nt, Homo sapiens
uaaacacuccuagaaacaa

SEQ ID NO: 1369178 - RNA, 19 nt, Homo sapiens
uaucuuaguagcucccuuu

SEQ ID NO: 1369179 - RNA, 19 nt, Homo sapiens
cugaguagcugggacuaga

SEQ ID NO: 1369180 - RNA, 19 nt, Homo sapiens
ucacuacagccucaaccua

SEQ ID NO: 1369181 - RNA, 19 nt, Homo sapiens
acucucaccuuuauagaca

SEQ ID NO: 1369182 - RNA, 19 nt, Homo sapiens
aaagcggaauugggaauau

SEQ ID NO: 1369183 - RNA, 19 nt, Homo sapiens
uagagacaaggcaauguaa

SEQ ID NO: 1369184 - RNA, 19 nt, Homo sapiens
ucccaaaugugaagacagu

SEQ ID NO: 1369185 - RNA, 19 nt, Homo sapiens
gaucccaaaugugaagaca

SEQ ID NO: 1369186 - RNA, 19 nt, Homo sapiens
gagacaaggcaauguaacu

SEQ ID NO: 1369187 - RNA, 19 nt, Homo sapiens
uggaacagacauauuucua

SEQ ID NO: 1369188 - RNA, 19 nt, Homo sapiens
guccaccuguagaccuaua

SEQ ID NO: 1369189 - RNA, 19 nt, Homo sapiens
auagagacaaggcaaugua

SEQ ID NO: 1369190 - RNA, 19 nt, Homo sapiens
agacagugagaacaaguuu

SEQ ID NO: 1369191 - RNA, 19 nt, Homo sapiens
uauguagccaugauaaaga

SEQ ID NO: 1369192 - RNA, 19 nt, Homo sapiens
gaugcagacguacuuuguu

SEQ ID NO: 1369193 - RNA, 19 nt, Homo sapiens
uucacaagauuuacuggaa

SEQ ID NO: 1369194 - RNA, 19 nt, Homo sapiens
acaaggcaauguaacuuuu

SEQ ID NO: 1369195 - RNA, 19 nt, Homo sapiens
ugaagacagugagaacaag

SEQ ID NO: 1369196 - RNA, 19 nt, Homo sapiens
gggcagagacuggacuaca

SEQ ID NO: 1369197 - RNA, 19 nt, Homo sapiens
uucccaauauucugaaaga

SEQ ID NO: 1369198 - RNA, 19 nt, Homo sapiens
acacuggaguuuuagguuu

SEQ ID NO: 1369199 - RNA, 19 nt, Homo sapiens
ggugugauaaagcggaauu

SEQ ID NO: 1369200 - RNA, 19 nt, Homo sapiens
gugucuaccuaauggauag

SEQ ID NO: 1369201 - RNA, 19 nt, Homo sapiens
cucaaguaauccucucauu

SEQ ID NO: 1369202 - RNA, 19 nt, Homo sapiens
gcagacguacuuuguuugc

SEQ ID NO: 1369203 - RNA, 19 nt, Homo sapiens
ucucaccuuuauagacauu

SEQ ID NO: 1369204 - RNA, 19 nt, Homo sapiens
uaacucucaccuuuauaga

SEQ ID NO: 1369205 - RNA, 19 nt, Homo sapiens
cgaagauccuaggagacaa

SEQ ID NO: 1369206 - RNA, 19 nt, Homo sapiens
cuuaguagcucccuuuccu

SEQ ID NO: 1369207 - RNA, 19 nt, Homo sapiens
ggcagagacuggacuacac

SEQ ID NO: 1369208 - RNA, 19 nt, Homo sapiens
agacaaggcaauguaacuu

SEQ ID NO: 1369209 - RNA, 19 nt, Homo sapiens
cggaauugggaauauauau

SEQ ID NO: 1369210 - RNA, 19 nt, Homo sapiens
uuugucucguucaucauua

SEQ ID NO: 1369211 - RNA, 19 nt, Homo sapiens
cagaaagauguguaagaau

SEQ ID NO: 1369212 - RNA, 19 nt, Homo sapiens
aaacuuuuguguuggugua

SEQ ID NO: 1369213 - RNA, 19 nt, Homo sapiens
gaacugauguguauauaac

SEQ ID NO: 1369214 - RNA, 19 nt, Homo sapiens
gcaggaaagugucaucuau

SEQ ID NO: 1369215 - RNA, 19 nt, Homo sapiens
ggacuuugcugcugcuauu

SEQ ID NO: 1369216 - RNA, 19 nt, Homo sapiens
uaaauaaggucaugacucu

SEQ ID NO: 1369217 - RNA, 19 nt, Homo sapiens
ggaaccaggcccucacuua

SEQ ID NO: 1369218 - RNA, 19 nt, Homo sapiens
ggacuuauccugugcuugu

SEQ ID NO: 1369219 - RNA, 19 nt, Homo sapiens
ccaagcagcugccuuccuu

SEQ ID NO: 1369220 - RNA, 19 nt, Homo sapiens
gaagggagcugggguaguu

SEQ ID NO: 1369221 - RNA, 19 nt, Homo sapiens
gggcgcagauacacacgua

SEQ ID NO: 1369222 - RNA, 19 nt, Homo sapiens
ggaacugauguguauauaa

SEQ ID NO: 1369223 - RNA, 19 nt, Homo sapiens
gaaccaggcccucacuuag

SEQ ID NO: 1369224 - RNA, 19 nt, Homo sapiens
ggacauugcaagaauacuu

SEQ ID NO: 1369225 - RNA, 19 nt, Homo sapiens
caaauguggugucugcaau

SEQ ID NO: 1369226 - RNA, 19 nt, Homo sapiens
gcaucagcauguagucaaa

SEQ ID NO: 1369227 - RNA, 19 nt, Homo sapiens
aggaaagugucaucuauug

SEQ ID NO: 1369228 - RNA, 19 nt, Homo sapiens
guaacugucuccuuaucug

SEQ ID NO: 1369229 - RNA, 19 nt, Homo sapiens
cuccuuaucugcaaaguga

SEQ ID NO: 1369230 - RNA, 19 nt, Homo sapiens
cccuguaacugucuccuua

SEQ ID NO: 1369231 - RNA, 19 nt, Homo sapiens
ccacuggccuugccuuugg

SEQ ID NO: 1369232 - RNA, 19 nt, Homo sapiens
aauaaggucaugacucuaa

SEQ ID NO: 1369233 - RNA, 19 nt, Homo sapiens
gagccauuccugucccuua

SEQ ID NO: 1369234 - RNA, 19 nt, Homo sapiens
gacauugcaagaauacuuu

SEQ ID NO: 1369235 - RNA, 19 nt, Homo sapiens
gccaaucucucaucaacgu

SEQ ID NO: 1369236 - RNA, 19 nt, Homo sapiens
gggcauuugucauccuguu

SEQ ID NO: 1369237 - RNA, 19 nt, Homo sapiens
caacguggaaggcaagaug

SEQ ID NO: 1369238 - RNA, 19 nt, Homo sapiens
auccugugcuuguaaauaa

SEQ ID NO: 1369239 - RNA, 19 nt, Homo sapiens
guacagaaccacaggaacu

SEQ ID NO: 1369240 - RNA, 19 nt, Homo sapiens
gauacacacguaagagaug

SEQ ID NO: 1369241 - RNA, 19 nt, Homo sapiens
guucacagaccgcacuuug

SEQ ID NO: 1369242 - RNA, 19 nt, Homo sapiens
uguggacauugcaagaaua

SEQ ID NO: 1369243 - RNA, 19 nt, Homo sapiens
guaggguugcucagucuuu

SEQ ID NO: 1369244 - RNA, 19 nt, Homo sapiens
caggaaagugucaucuauu

SEQ ID NO: 1369245 - RNA, 19 nt, Homo sapiens
caggaacugauguguauau

SEQ ID NO: 1369246 - RNA, 19 nt, Homo sapiens
ggaagcaugcacggcgaua

SEQ ID NO: 1369247 - RNA, 19 nt, Homo sapiens
cagauacacacguaagaga

SEQ ID NO: 1369248 - RNA, 19 nt, Homo sapiens
aggguuaucuguggacauu

SEQ ID NO: 1369249 - RNA, 19 nt, Homo sapiens
gugcaucccggaccucuga

SEQ ID NO: 1369250 - RNA, 19 nt, Homo sapiens
gacuuauccugugcuugua

SEQ ID NO: 1369251 - RNA, 19 nt, Homo sapiens
aggaacugauguguauaua

SEQ ID NO: 1369252 - RNA, 19 nt, Homo sapiens
ggaaagugucaucuauugg

SEQ ID NO: 1369253 - RNA, 19 nt, Homo sapiens
ccuauucacccuuaacuag

SEQ ID NO: 1369254 - RNA, 19 nt, Homo sapiens
auaaggucaugacucuaaa

SEQ ID NO: 1369255 - RNA, 19 nt, Homo sapiens
gaaccacaggaacugaugu

SEQ ID NO: 1369256 - RNA, 19 nt, Homo sapiens
gcaaaagaaucaucaaccu

SEQ ID NO: 1369257 - RNA, 19 nt, Homo sapiens
guagucaaauguggugucu

SEQ ID NO: 1369258 - RNA, 19 nt, Homo sapiens
uauccugugcuuguaaaua

SEQ ID NO: 1369259 - RNA, 19 nt, Homo sapiens
gcagauacacacguaagag

SEQ ID NO: 1369260 - RNA, 19 nt, Homo sapiens
aauguggugucugcaauga

SEQ ID NO: 1369261 - RNA, 19 nt, Homo sapiens
gguuggcucuggccucagu

SEQ ID NO: 1369262 - RNA, 19 nt, Homo sapiens
ccuguuggcugugcugugu

SEQ ID NO: 1369263 - RNA, 19 nt, Homo sapiens
gaagcaugcacggcgauau

SEQ ID NO: 1369264 - RNA, 19 nt, Homo sapiens
ucaaauguggugucugcaa

SEQ ID NO: 1369265 - RNA, 19 nt, Homo sapiens
uguuggcugugcuguguuu

SEQ ID NO: 1369266 - RNA, 19 nt, Homo sapiens
gguuaucuguggacauugc

SEQ ID NO: 1369267 - RNA, 19 nt, Homo sapiens
uaggguugcucagucuuug

SEQ ID NO: 1369268 - RNA, 19 nt, Homo sapiens
ggguaggguugcucagucu

SEQ ID NO: 1369269 - RNA, 19 nt, Homo sapiens
uccuguauuucccuuaauu

SEQ ID NO: 1369270 - RNA, 19 nt, Homo sapiens
gcgauauggaggcaucuau

SEQ ID NO: 1369271 - RNA, 19 nt, Homo sapiens
uguggugucugcaaugaag

SEQ ID NO: 1369272 - RNA, 19 nt, Homo sapiens
cagcauguagucaaaugug

SEQ ID NO: 1369273 - RNA, 19 nt, Homo sapiens
cuuauccugugcuuguaaa

SEQ ID NO: 1369274 - RNA, 19 nt, Homo sapiens
ucccucuugugcaccauua

SEQ ID NO: 1369275 - RNA, 19 nt, Homo sapiens
ccaaggguucugugucuag

SEQ ID NO: 1369276 - RNA, 19 nt, Homo sapiens
gcucuuuauugggccugua

SEQ ID NO: 1369277 - RNA, 19 nt, Homo sapiens
gcgcagauacacacguaag

SEQ ID NO: 1369278 - RNA, 19 nt, Homo sapiens
gaccgcacuuuggcacguu

SEQ ID NO: 1369279 - RNA, 19 nt, Homo sapiens
cugccaaucucucaucaac

SEQ ID NO: 1369280 - RNA, 19 nt, Homo sapiens
cagccacccuguccagaac

SEQ ID NO: 1369281 - RNA, 19 nt, Homo sapiens
gaagccaccccaaucaaga

SEQ ID NO: 1369282 - RNA, 19 nt, Homo sapiens
cgauauggaggcaucuaug

SEQ ID NO: 1369283 - RNA, 19 nt, Homo sapiens
auuccuguauuucccuuaa

SEQ ID NO: 1369284 - RNA, 19 nt, Homo sapiens
ggaaugugauguuagauaa

SEQ ID NO: 1369285 - RNA, 19 nt, Homo sapiens
gaagagacaugcgauggua

SEQ ID NO: 1369286 - RNA, 19 nt, Homo sapiens
gaagaaaguuguauaagcu

SEQ ID NO: 1369287 - RNA, 19 nt, Homo sapiens
aaagagcccugcaauauga

SEQ ID NO: 1369288 - RNA, 19 nt, Homo sapiens
ccgaguagcugggauuaua

SEQ ID NO: 1369289 - RNA, 19 nt, Homo sapiens
uagauuacauugagcagua

SEQ ID NO: 1369290 - RNA, 19 nt, Homo sapiens
guauaggaaugugauguua

SEQ ID NO: 1369291 - RNA, 19 nt, Homo sapiens
cuaauguucugucuuguuu

SEQ ID NO: 1369292 - RNA, 19 nt, Homo sapiens
gaaaagagcccugcaauau

SEQ ID NO: 1369293 - RNA, 19 nt, Homo sapiens
gaagauuguuagguacuuu

SEQ ID NO: 1369294 - RNA, 19 nt, Homo sapiens
uuacuaauguucugucuug

SEQ ID NO: 1369295 - RNA, 19 nt, Homo sapiens
cagguccucuguucucuua

SEQ ID NO: 1369296 - RNA, 19 nt, Homo sapiens
cagcagaauuuguauagga

SEQ ID NO: 1369297 - RNA, 19 nt, Homo sapiens
auagacaucuucccaauau

SEQ ID NO: 1369298 - RNA, 19 nt, Homo sapiens
uauaugugcugcauucuau

SEQ ID NO: 1369299 - RNA, 19 nt, Homo sapiens
ugaaugauuuggugacaga

SEQ ID NO: 1369300 - RNA, 19 nt, Homo sapiens
guauagacaucuucccaau

SEQ ID NO: 1369301 - RNA, 19 nt, Homo sapiens
gagauuccauauacuuuag

SEQ ID NO: 1369302 - RNA, 19 nt, Homo sapiens
gaaacuauaaugcuuccaa

SEQ ID NO: 1369303 - RNA, 19 nt, Homo sapiens
ucacaggcucuuccacuua

SEQ ID NO: 1369304 - RNA, 19 nt, Homo sapiens
gguggucugucaagaagaa

SEQ ID NO: 1369305 - RNA, 19 nt, Homo sapiens
cgucuucacugcucuaugu

SEQ ID NO: 1369306 - RNA, 19 nt, Homo sapiens
agacaucuucccaauauuu

SEQ ID NO: 1369307 - RNA, 19 nt, Homo sapiens
acacuucacagcagaauuu

SEQ ID NO: 1369308 - RNA, 19 nt, Homo sapiens
ggauguggccauagaauuc

SEQ ID NO: 1369309 - RNA, 19 nt, Homo sapiens
guacuuuauugucucuuga

SEQ ID NO: 1369310 - RNA, 19 nt, Homo sapiens
ccaaagugcugggauuaca

SEQ ID NO: 1369311 - RNA, 19 nt, Homo sapiens
agccagaccugaucacuug

SEQ ID NO: 1369312 - RNA, 19 nt, Homo sapiens
ggagugcaguggcgugauc

SEQ ID NO: 1369313 - RNA, 19 nt, Homo sapiens
ggaaaagagcccugcaaua

SEQ ID NO: 1369314 - RNA, 19 nt, Homo sapiens
ucuguucucuuacuaaugu

SEQ ID NO: 1369315 - RNA, 19 nt, Homo sapiens
acagaaauuugcauugcuu

SEQ ID NO: 1369316 - RNA, 19 nt, Homo sapiens
agaagaaaguuguauaagc

SEQ ID NO: 1369317 - RNA, 19 nt, Homo sapiens
guguguaucuuaauguugu

SEQ ID NO: 1369318 - RNA, 19 nt, Homo sapiens
gguacuuuauugucucuug

SEQ ID NO: 1369319 - RNA, 19 nt, Homo sapiens
aaagcaugcuaaagaaugu

SEQ ID NO: 1369320 - RNA, 19 nt, Homo sapiens
auaggaaugugauguuaga

SEQ ID NO: 1369321 - RNA, 19 nt, Homo sapiens
cuucacagcagaauuugua

SEQ ID NO: 1369322 - RNA, 19 nt, Homo sapiens
ugacagaaauuugcauugc

SEQ ID NO: 1369323 - RNA, 19 nt, Homo sapiens
auauauaugugcugcauuc

SEQ ID NO: 1369324 - RNA, 19 nt, Homo sapiens
cagaauuuguauaggaaug

SEQ ID NO: 1369325 - RNA, 19 nt, Homo sapiens
ggguguguaucuuaauguu

SEQ ID NO: 1369326 - RNA, 19 nt, Homo sapiens
uuagggauguggccauaga

SEQ ID NO: 1369327 - RNA, 19 nt, Homo sapiens
ccacuuacuggauguuuga

SEQ ID NO: 1369328 - RNA, 19 nt, Homo sapiens
gaauuuguauaggaaugug

SEQ ID NO: 1369329 - RNA, 19 nt, Homo sapiens
guuagguacuuuauugucu

SEQ ID NO: 1369330 - RNA, 19 nt, Homo sapiens
guauauauaugugcugcau

SEQ ID NO: 1369331 - RNA, 19 nt, Homo sapiens
ucacagcagaauuuguaua

SEQ ID NO: 1369332 - RNA, 19 nt, Homo sapiens
acaaaagcaugcuaaagaa

SEQ ID NO: 1369333 - RNA, 19 nt, Homo sapiens
uauagacaucuucccaaua

SEQ ID NO: 1369334 - RNA, 19 nt, Homo sapiens
ccuauuggcuuucaguaac

SEQ ID NO: 1369335 - RNA, 19 nt, Homo sapiens
gggauguggccauagaauu

SEQ ID NO: 1369336 - RNA, 19 nt, Homo sapiens
guggcgugaucuuggguua

SEQ ID NO: 1369337 - RNA, 19 nt, Homo sapiens
ccucgggauucaagugauu

SEQ ID NO: 1369338 - RNA, 19 nt, Homo sapiens
ggguauugcugucucuaag

SEQ ID NO: 1369339 - RNA, 19 nt, Homo sapiens
gcauugcuuuuaccuauug

SEQ ID NO: 1369340 - RNA, 19 nt, Homo sapiens
cgccugaccucgugugauc

SEQ ID NO: 1369341 - RNA, 19 nt, Homo sapiens
ggauucaagugauucuacu

SEQ ID NO: 1369342 - RNA, 19 nt, Homo sapiens
ccucuguucucuuacuaau

SEQ ID NO: 1369343 - RNA, 19 nt, Homo sapiens
gacagaaauuugcauugcu

SEQ ID NO: 1369344 - RNA, 19 nt, Homo sapiens
uuagauaacuacagaaacc

SEQ ID NO: 1369345 - RNA, 19 nt, Homo sapiens
ugaagauuguuagguacuu

SEQ ID NO: 1369346 - RNA, 19 nt, Homo sapiens
gcauuacugggaccacuga

SEQ ID NO: 1369347 - RNA, 19 nt, Homo sapiens
acagaaaccuggucuuccu

SEQ ID NO: 1369348 - RNA, 19 nt, Homo sapiens
aggaaugugauguuagaua

SEQ ID NO: 1369349 - RNA, 19 nt, Homo sapiens
uaugugcugcauucuauuu

SEQ ID NO: 1369350 - RNA, 19 nt, Homo sapiens
ggugacagaaauuugcauu

SEQ ID NO: 1369351 - RNA, 19 nt, Homo sapiens
cuacagaaaccuggucuuc

SEQ ID NO: 1369352 - RNA, 19 nt, Homo sapiens
ccuuuauacuuguagcaaa

SEQ ID NO: 1369353 - RNA, 19 nt, Homo sapiens
gcuuuuaccuauuggcuuu

SEQ ID NO: 1369354 - RNA, 19 nt, Homo sapiens
gccuucagguccucuguuc

SEQ ID NO: 1369355 - RNA, 19 nt, Homo sapiens
ugggaccacugacauuuag

SEQ ID NO: 1369356 - RNA, 19 nt, Homo sapiens
aaggguguguaucuuaaug

SEQ ID NO: 1369357 - RNA, 19 nt, Homo sapiens
cacaggcucuuccacuuac

SEQ ID NO: 1369358 - RNA, 19 nt, Homo sapiens
gaucacuugucuggagcaa

SEQ ID NO: 1369359 - RNA, 19 nt, Homo sapiens
uauguccucugcuccuaga

SEQ ID NO: 1369360 - RNA, 19 nt, Homo sapiens
agcagaauuuguauaggaa

SEQ ID NO: 1369361 - RNA, 19 nt, Homo sapiens
cuuauuugguggucuguca

SEQ ID NO: 1369362 - RNA, 19 nt, Homo sapiens
gaacaaaagcaugcuaaag

SEQ ID NO: 1369363 - RNA, 19 nt, Homo sapiens
gacaucuucccaauauuuc

SEQ ID NO: 1369364 - RNA, 19 nt, Homo sapiens
cacagcagaauuuguauag

SEQ ID NO: 1369365 - RNA, 19 nt, Homo sapiens
cuuacuggauguuugacaa

SEQ ID NO: 1369366 - RNA, 19 nt, Homo sapiens
acauugagcaguauagaca

SEQ ID NO: 1369367 - RNA, 19 nt, Homo sapiens
uuuaguagagugaggguuu

SEQ ID NO: 1369368 - RNA, 19 nt, Homo sapiens
ccugcaauaugaagagaca

SEQ ID NO: 1369369 - RNA, 19 nt, Homo sapiens
gcaaugccuggacacuuca

SEQ ID NO: 1369370 - RNA, 19 nt, Homo sapiens
gauuacauugagcaguaua

SEQ ID NO: 1369371 - RNA, 19 nt, Homo sapiens
ugccucagccucccgagua

SEQ ID NO: 1369372 - RNA, 19 nt, Homo sapiens
guccucuguucucuuacua

SEQ ID NO: 1369373 - RNA, 19 nt, Homo sapiens
gguccucuguucucuuacu

SEQ ID NO: 1369374 - RNA, 19 nt, Homo sapiens
cugggaccacugacauuua

SEQ ID NO: 1369375 - RNA, 19 nt, Homo sapiens
gagcaguauagacaucuuc

SEQ ID NO: 1369376 - RNA, 19 nt, Homo sapiens
cccaauauuucaacuuuug

SEQ ID NO: 1369377 - RNA, 19 nt, Homo sapiens
uagacaucuucccaauauu

SEQ ID NO: 1369378 - RNA, 19 nt, Homo sapiens
ucuguagcuuuguaauaug

SEQ ID NO: 1369379 - RNA, 19 nt, Homo sapiens
gcagaauuuguauaggaau

SEQ ID NO: 1369380 - RNA, 19 nt, Homo sapiens
cuauuggcuuucaguaaca

SEQ ID NO: 1369381 - RNA, 19 nt, Homo sapiens
cagaaauuugcauugcuuu

SEQ ID NO: 1369382 - RNA, 19 nt, Homo sapiens
ggacacuucacagcagaau

SEQ ID NO: 1369383 - RNA, 19 nt, Homo sapiens
ugucaagaagaaaguugua

SEQ ID NO: 1369384 - RNA, 19 nt, Homo sapiens
gaagagauaagaagaguaa

SEQ ID NO: 1369385 - RNA, 19 nt, Homo sapiens
uaaccaagcuuauuucugu

SEQ ID NO: 1369386 - RNA, 19 nt, Homo sapiens
gcucacauauguaggauaa

SEQ ID NO: 1369387 - RNA, 19 nt, Homo sapiens
uggcaaagcagcauauuua

SEQ ID NO: 1369388 - RNA, 19 nt, Homo sapiens
caccuaaacucuugaugaa

SEQ ID NO: 1369389 - RNA, 19 nt, Homo sapiens
gcaccuaaacucuugauga

SEQ ID NO: 1369390 - RNA, 19 nt, Homo sapiens
gugcguguguguauacaua

SEQ ID NO: 1369391 - RNA, 19 nt, Homo sapiens
cgaggaagaucgcccuuug

SEQ ID NO: 1369392 - RNA, 19 nt, Homo sapiens
gcaaagcagcauauuuaau

SEQ ID NO: 1369393 - RNA, 19 nt, Homo sapiens
gagauaagaagaguaagaa

SEQ ID NO: 1369394 - RNA, 19 nt, Homo sapiens
caaauuaccucuggaucuc

SEQ ID NO: 1369395 - RNA, 19 nt, Homo sapiens
ccuaaacucuugaugaaag

SEQ ID NO: 1369396 - RNA, 19 nt, Homo sapiens
aaagaggacacacccguua

SEQ ID NO: 1369397 - RNA, 19 nt, Homo sapiens
uuagguaauuuccuuggua

SEQ ID NO: 1369398 - RNA, 19 nt, Homo sapiens
gaaaugauaagaggaguag

SEQ ID NO: 1369399 - RNA, 19 nt, Homo sapiens
gcauuuggacccugaagaa

SEQ ID NO: 1369400 - RNA, 19 nt, Homo sapiens
aggaauaaacuggcaauua

SEQ ID NO: 1369401 - RNA, 19 nt, Homo sapiens
gggaagagauaagaagagu

SEQ ID NO: 1369402 - RNA, 19 nt, Homo sapiens
ggagaaaagugcccaagau

SEQ ID NO: 1369403 - RNA, 19 nt, Homo sapiens
gauaagaggaguagaugag

SEQ ID NO: 1369404 - RNA, 19 nt, Homo sapiens
gaagaguaagaaacaaguu

SEQ ID NO: 1369405 - RNA, 19 nt, Homo sapiens
cauuccauguuguaaagua

SEQ ID NO: 1369406 - RNA, 19 nt, Homo sapiens
guaccagcaucucauugga

SEQ ID NO: 1369407 - RNA, 19 nt, Homo sapiens
gaugaugcauuggaagcaa

SEQ ID NO: 1369408 - RNA, 19 nt, Homo sapiens
ccacagaacaugccaaagg

SEQ ID NO: 1369409 - RNA, 19 nt, Homo sapiens
ggcaaagcagcauauuuaa

SEQ ID NO: 1369410 - RNA, 19 nt, Homo sapiens
gauaagaagaguaagaaac

SEQ ID NO: 1369411 - RNA, 19 nt, Homo sapiens
ccugcaggauuaauuuauu

SEQ ID NO: 1369412 - RNA, 19 nt, Homo sapiens
gcaugggaauauguucauu

SEQ ID NO: 1369413 - RNA, 19 nt, Homo sapiens
ggaagagauaagaagagua

SEQ ID NO: 1369414 - RNA, 19 nt, Homo sapiens
ggacccugaagaaaugaua

SEQ ID NO: 1369415 - RNA, 19 nt, Homo sapiens
acacacccguuaggcauuu

SEQ ID NO: 1369416 - RNA, 19 nt, Homo sapiens
uugaaaggcuuagggaaga

SEQ ID NO: 1369417 - RNA, 19 nt, Homo sapiens
uuaaugaacacgugucuca

SEQ ID NO: 1369418 - RNA, 19 nt, Homo sapiens
ucacgcagccguccuuauc

SEQ ID NO: 1369419 - RNA, 19 nt, Homo sapiens
gaugagcuugaaaggcuua

SEQ ID NO: 1369420 - RNA, 19 nt, Homo sapiens
ucacaaacuuaaccaagcu

SEQ ID NO: 1369421 - RNA, 19 nt, Homo sapiens
gaccuccauuuuacuuuua

SEQ ID NO: 1369422 - RNA, 19 nt, Homo sapiens
uguagcagcuccuuauugc

SEQ ID NO: 1369423 - RNA, 19 nt, Homo sapiens
uaucagcucacauauguag

SEQ ID NO: 1369424 - RNA, 19 nt, Homo sapiens
aggaguagaugagcuugaa

SEQ ID NO: 1369425 - RNA, 19 nt, Homo sapiens
uuuggacccugaagaaaug

SEQ ID NO: 1369426 - RNA, 19 nt, Homo sapiens
ucaaauuaccucuggaucu

SEQ ID NO: 1369427 - RNA, 19 nt, Homo sapiens
ucuguguggugugaaauuu

SEQ ID NO: 1369428 - RNA, 19 nt, Homo sapiens
guccggaaguccuuauagu

SEQ ID NO: 1369429 - RNA, 19 nt, Homo sapiens
agagauaagaagaguaaga

SEQ ID NO: 1369430 - RNA, 19 nt, Homo sapiens
ugaagaaaaugagggaaaa

SEQ ID NO: 1369431 - RNA, 19 nt, Homo sapiens
cugcaggauuaauuuauuc

SEQ ID NO: 1369432 - RNA, 19 nt, Homo sapiens
guucauuccauguuguaaa

SEQ ID NO: 1369433 - RNA, 19 nt, Homo sapiens
ccagcuuucuuucuguuag

SEQ ID NO: 1369434 - RNA, 19 nt, Homo sapiens
ccaggaagcagaaggaaac

SEQ ID NO: 1369435 - RNA, 19 nt, Homo sapiens
auaauuugcaaccagcuua

SEQ ID NO: 1369436 - RNA, 19 nt, Homo sapiens
accagcaucucauuggauu

SEQ ID NO: 1369437 - RNA, 19 nt, Homo sapiens
aaaucgaggugagggaaga

SEQ ID NO: 1369438 - RNA, 19 nt, Homo sapiens
gaaaggcuuagggaagaga

SEQ ID NO: 1369439 - RNA, 19 nt, Homo sapiens
caaacuuaaccaagcuuau

SEQ ID NO: 1369440 - RNA, 19 nt, Homo sapiens
acaaacuuaaccaagcuua

SEQ ID NO: 1369441 - RNA, 19 nt, Homo sapiens
gccaaaggccgaggaagau

SEQ ID NO: 1369442 - RNA, 19 nt, Homo sapiens
guccuuauccugugugcuu

SEQ ID NO: 1369443 - RNA, 19 nt, Homo sapiens
ggaguagaugagcuugaaa

SEQ ID NO: 1369444 - RNA, 19 nt, Homo sapiens
uuuaggccuugaauucauu

SEQ ID NO: 1369445 - RNA, 19 nt, Homo sapiens
gaguagaugagcuugaaag

SEQ ID NO: 1369446 - RNA, 19 nt, Homo sapiens
uguguggugugaaauuuua

SEQ ID NO: 1369447 - RNA, 19 nt, Homo sapiens
ccagaggagggccgaauca

SEQ ID NO: 1369448 - RNA, 19 nt, Homo sapiens
ugaccuccauuuuacuuuu

SEQ ID NO: 1369449 - RNA, 19 nt, Homo sapiens
agaaaugauaagaggagua

SEQ ID NO: 1369450 - RNA, 19 nt, Homo sapiens
gacccugaagaaaugauaa

SEQ ID NO: 1369451 - RNA, 19 nt, Homo sapiens
cacaggaggcagaaggaaa

SEQ ID NO: 1369452 - RNA, 19 nt, Homo sapiens
ugccaaaggccgaggaaga

SEQ ID NO: 1369453 - RNA, 19 nt, Homo sapiens
gcuuuaggccuugaauuca

SEQ ID NO: 1369454 - RNA, 19 nt, Homo sapiens
acaggaggcagaaggaaau

SEQ ID NO: 1369455 - RNA, 19 nt, Homo sapiens
gguaccagcaucucauugg

SEQ ID NO: 1369456 - RNA, 19 nt, Homo sapiens
guuagcauuuucugaugua

SEQ ID NO: 1369457 - RNA, 19 nt, Homo sapiens
gaggaguagaugagcuuga

SEQ ID NO: 1369458 - RNA, 19 nt, Homo sapiens
gacacacccguuaggcauu

SEQ ID NO: 1369459 - RNA, 19 nt, Homo sapiens
gccaggaagcagaaggaaa

SEQ ID NO: 1369460 - RNA, 19 nt, Homo sapiens
uauguucauuccauguugu

SEQ ID NO: 1369461 - RNA, 19 nt, Homo sapiens
cauuggaagcaaagacauu

SEQ ID NO: 1369462 - RNA, 19 nt, Homo sapiens
uuauuucugugugguguga

SEQ ID NO: 1369463 - RNA, 19 nt, Homo sapiens
gugugugcguguguguaua

SEQ ID NO: 1369464 - RNA, 19 nt, Homo sapiens
uagggaagagauaagaaga

SEQ ID NO: 1369465 - RNA, 19 nt, Homo sapiens
aaugauaagaggaguagau

SEQ ID NO: 1369466 - RNA, 19 nt, Homo sapiens
gagaagccaucccuguaua

SEQ ID NO: 1369467 - RNA, 19 nt, Homo sapiens
gagugaagcuugugugcua

SEQ ID NO: 1369468 - RNA, 19 nt, Homo sapiens
gacaauaucuuccagaaag

SEQ ID NO: 1369469 - RNA, 19 nt, Homo sapiens
gggcauugcugcuggcauu

SEQ ID NO: 1369470 - RNA, 19 nt, Homo sapiens
ggaggucacucacucaagu

SEQ ID NO: 1369471 - RNA, 19 nt, Homo sapiens
gagugucccuucccuagaa

SEQ ID NO: 1369472 - RNA, 19 nt, Homo sapiens
gcaugaccaccacuucuua

SEQ ID NO: 1369473 - RNA, 19 nt, Homo sapiens
gggacaauaucuuccagaa

SEQ ID NO: 1369474 - RNA, 19 nt, Homo sapiens
caaagugguucauggagau

SEQ ID NO: 1369475 - RNA, 19 nt, Homo sapiens
ggagaagccaucccuguau

SEQ ID NO: 1369476 - RNA, 19 nt, Homo sapiens
cuacccaccugcccuguuu

SEQ ID NO: 1369477 - RNA, 19 nt, Homo sapiens
ugacaauguuugcuguuga

SEQ ID NO: 1369478 - RNA, 19 nt, Homo sapiens
cagcaucccuauucaguag

SEQ ID NO: 1369479 - RNA, 19 nt, Homo sapiens
ggacaauaucuuccagaaa

SEQ ID NO: 1369480 - RNA, 19 nt, Homo sapiens
caccaaagcuggagguucu

SEQ ID NO: 1369481 - RNA, 19 nt, Homo sapiens
gaccgcagauguucaugga

SEQ ID NO: 1369482 - RNA, 19 nt, Homo sapiens
guaagguggagaagagaua

SEQ ID NO: 1369483 - RNA, 19 nt, Homo sapiens
gagaaaaggggccugaaua

SEQ ID NO: 1369484 - RNA, 19 nt, Homo sapiens
cagaaagcccuaagccaaa

SEQ ID NO: 1369485 - RNA, 19 nt, Homo sapiens
gaagccaucccuguauauu

SEQ ID NO: 1369486 - RNA, 19 nt, Homo sapiens
gaauaucauugagcagcaa

SEQ ID NO: 1369487 - RNA, 19 nt, Homo sapiens
gcucggacccugcauguuc

SEQ ID NO: 1369488 - RNA, 19 nt, Homo sapiens
gacaauguuugcuguugau

SEQ ID NO: 1369489 - RNA, 19 nt, Homo sapiens
gaacuuccuguuugacaau

SEQ ID NO: 1369490 - RNA, 19 nt, Homo sapiens
gcccuaagccaaacuccua

SEQ ID NO: 1369491 - RNA, 19 nt, Homo sapiens
acaguaagguggagaagag

SEQ ID NO: 1369492 - RNA, 19 nt, Homo sapiens
gcccagaggcucagaagga

SEQ ID NO: 1369493 - RNA, 19 nt, Homo sapiens
ggaagguguucuggacaug

SEQ ID NO: 1369494 - RNA, 19 nt, Homo sapiens
gaaggagccgugcagacuu

SEQ ID NO: 1369495 - RNA, 19 nt, Homo sapiens
ggacauguucuccaucaag

SEQ ID NO: 1369496 - RNA, 19 nt, Homo sapiens
gggaagguguucuggacau

SEQ ID NO: 1369497 - RNA, 19 nt, Homo sapiens
uguuugaacuuccuguuug

SEQ ID NO: 1369498 - RNA, 19 nt, Homo sapiens
aagauggucuccuucaaca

SEQ ID NO: 1369499 - RNA, 19 nt, Homo sapiens
ugaacuuccuguuugacaa

SEQ ID NO: 1369500 - RNA, 19 nt, Homo sapiens
guuugaacuuccuguuuga

SEQ ID NO: 1369501 - RNA, 19 nt, Homo sapiens
gacauggaccagacacuga

SEQ ID NO: 1369502 - RNA, 19 nt, Homo sapiens
caauguuugcuguugauuu

SEQ ID NO: 1369503 - RNA, 19 nt, Homo sapiens
gaagccuguuccagagaga

SEQ ID NO: 1369504 - RNA, 19 nt, Homo sapiens
ucauugagcagcaacagaa

SEQ ID NO: 1369505 - RNA, 19 nt, Homo sapiens
gaugacaggaggccgaaug

SEQ ID NO: 1369506 - RNA, 19 nt, Homo sapiens
acugggagcccucgaauga

SEQ ID NO: 1369507 - RNA, 19 nt, Homo sapiens
aaccuggacuuguuucuca

SEQ ID NO: 1369508 - RNA, 19 nt, Homo sapiens
gcccgugacuccucuuugg

SEQ ID NO: 1369509 - RNA, 19 nt, Homo sapiens
gauggucuccuucaacagu

SEQ ID NO: 1369510 - RNA, 19 nt, Homo sapiens
gcucuacucauaccucaau

SEQ ID NO: 1369511 - RNA, 19 nt, Homo sapiens
aauggaggcugaagaggau

SEQ ID NO: 1369512 - RNA, 19 nt, Homo sapiens
gccgccugcucuacucaua

SEQ ID NO: 1369513 - RNA, 19 nt, Homo sapiens
ggacugggagcccucgaau

SEQ ID NO: 1369514 - RNA, 19 nt, Homo sapiens
gguacaagaccaaguaucg

SEQ ID NO: 1369515 - RNA, 19 nt, Homo sapiens
gccgguacaagaccaagua

SEQ ID NO: 1369516 - RNA, 19 nt, Homo sapiens
gucacucacucaagucugu

SEQ ID NO: 1369517 - RNA, 19 nt, Homo sapiens
gcugcuaggcuccuucgaa

SEQ ID NO: 1369518 - RNA, 19 nt, Homo sapiens
aaaaggggccugaauauca

SEQ ID NO: 1369519 - RNA, 19 nt, Homo sapiens
ccagcaucccuauucagua

SEQ ID NO: 1369520 - RNA, 19 nt, Homo sapiens
cccagaggcucagaaggaa

SEQ ID NO: 1369521 - RNA, 19 nt, Homo sapiens
cagacccagugcugaguga

SEQ ID NO: 1369522 - RNA, 19 nt, Homo sapiens
ucgaaucccuggcgaccau

SEQ ID NO: 1369523 - RNA, 19 nt, Homo sapiens
cagaggcucagaaggaaga

SEQ ID NO: 1369524 - RNA, 19 nt, Homo sapiens
gaacugccgccugcucuac

SEQ ID NO: 1369525 - RNA, 19 nt, Homo sapiens
cagggaagcccaggaggaa

SEQ ID NO: 1369526 - RNA, 19 nt, Homo sapiens
aaggagccgugcagacuuc

SEQ ID NO: 1369527 - RNA, 19 nt, Homo sapiens
aggagaagccaucccugua

SEQ ID NO: 1369528 - RNA, 19 nt, Homo sapiens
ucaccagcuccaagccuua

SEQ ID NO: 1369529 - RNA, 19 nt, Homo sapiens
cagcuggucucgggacaca

SEQ ID NO: 1369530 - RNA, 19 nt, Homo sapiens
aagguguucuggacauguu

SEQ ID NO: 1369531 - RNA, 19 nt, Homo sapiens
gaagguguucuggacaugu

SEQ ID NO: 1369532 - RNA, 19 nt, Homo sapiens
caagggcgaaguggagauu

SEQ ID NO: 1369533 - RNA, 19 nt, Homo sapiens
caccugcccuguuugaacu

SEQ ID NO: 1369534 - RNA, 19 nt, Homo sapiens
gcaucccuauucaguagca

SEQ ID NO: 1369535 - RNA, 19 nt, Homo sapiens
gcagcaugaccaccacuuc

SEQ ID NO: 1369536 - RNA, 19 nt, Homo sapiens
gaaaaggggccugaauauc

SEQ ID NO: 1369537 - RNA, 19 nt, Homo sapiens
gggaagcccaggaggaagu

SEQ ID NO: 1369538 - RNA, 19 nt, Homo sapiens
gcacuguuguccguuccau

SEQ ID NO: 1369539 - RNA, 19 nt, Homo sapiens
gaaccuggacuuguuucuc

SEQ ID NO: 1369540 - RNA, 19 nt, Homo sapiens
gcaccaauggccgguacaa

SEQ ID NO: 1369541 - RNA, 19 nt, Homo sapiens
ugacacaaggcaccaaugg

SEQ ID NO: 1369542 - RNA, 19 nt, Homo sapiens
gcauugcugcuggcauuga

SEQ ID NO: 1369543 - RNA, 19 nt, Homo sapiens
agccaucccuguauauugg

SEQ ID NO: 1369544 - RNA, 19 nt, Homo sapiens
ggggaagguucaaaagaug

SEQ ID NO: 1369545 - RNA, 19 nt, Homo sapiens
gagagaggugggacugcaa

SEQ ID NO: 1369546 - RNA, 19 nt, Homo sapiens
accaauggccgguacaaga

SEQ ID NO: 1369547 - RNA, 19 nt, Homo sapiens
agaaagcccuaagccaaac

SEQ ID NO: 1369548 - RNA, 19 nt, Homo sapiens
caaaagauggucuccuuca

SEQ ID NO: 1369549 - RNA, 19 nt, Homo sapiens
caacauugucugggaccuu

SEQ ID NO: 1369550 - RNA, 19 nt, Homo sapiens
ccaacugccacaucugcaa

SEQ ID NO: 1369551 - RNA, 19 nt, Homo sapiens
guaaguggcuuguuuaaau

SEQ ID NO: 1369552 - RNA, 19 nt, Homo sapiens
gcuagaaacaucaucauua

SEQ ID NO: 1369553 - RNA, 19 nt, Homo sapiens
cuacaaagcuuuauagaac

SEQ ID NO: 1369554 - RNA, 19 nt, Homo sapiens
cagaaacacuaacaguaua

SEQ ID NO: 1369555 - RNA, 19 nt, Homo sapiens
agaagaaccucagaacaua

SEQ ID NO: 1369556 - RNA, 19 nt, Homo sapiens
gcagaaacacuaacaguau

SEQ ID NO: 1369557 - RNA, 19 nt, Homo sapiens
ugaaacaucuugauugcuu

SEQ ID NO: 1369558 - RNA, 19 nt, Homo sapiens
gaaaugacucgucucugua

SEQ ID NO: 1369559 - RNA, 19 nt, Homo sapiens
ucacaguucuucccauaaa

SEQ ID NO: 1369560 - RNA, 19 nt, Homo sapiens
ggcagggacuucuggguua

SEQ ID NO: 1369561 - RNA, 19 nt, Homo sapiens
gaaccaaaaucggaucuua

SEQ ID NO: 1369562 - RNA, 19 nt, Homo sapiens
ggguguaacaguugaauua

SEQ ID NO: 1369563 - RNA, 19 nt, Homo sapiens
gaaacaucuugauugcuuu

SEQ ID NO: 1369564 - RNA, 19 nt, Homo sapiens
cagcaucuccuucuacuaa

SEQ ID NO: 1369565 - RNA, 19 nt, Homo sapiens
agaaaugacucgucucugu

SEQ ID NO: 1369566 - RNA, 19 nt, Homo sapiens
ccgaguaaguggcuuguuu

SEQ ID NO: 1369567 - RNA, 19 nt, Homo sapiens
gccaggagaugaaggaguu

SEQ ID NO: 1369568 - RNA, 19 nt, Homo sapiens
gaagagacuagagaccuua

SEQ ID NO: 1369569 - RNA, 19 nt, Homo sapiens
gagauaggguagccauguu

SEQ ID NO: 1369570 - RNA, 19 nt, Homo sapiens
accagaaacucaagagaua

SEQ ID NO: 1369571 - RNA, 19 nt, Homo sapiens
caucuguccugccuucuuu

SEQ ID NO: 1369572 - RNA, 19 nt, Homo sapiens
caaacaaacccaaggauca

SEQ ID NO: 1369573 - RNA, 19 nt, Homo sapiens
gaucacggcugcuaaaucc

SEQ ID NO: 1369574 - RNA, 19 nt, Homo sapiens
gauuggaugucuaggaaug

SEQ ID NO: 1369575 - RNA, 19 nt, Homo sapiens
ggccaucacucauguguag

SEQ ID NO: 1369576 - RNA, 19 nt, Homo sapiens
aauaugaacuacagcagaa

SEQ ID NO: 1369577 - RNA, 19 nt, Homo sapiens
caugcugccucacugcuua

SEQ ID NO: 1369578 - RNA, 19 nt, Homo sapiens
aaagucaauuguucaggua

SEQ ID NO: 1369579 - RNA, 19 nt, Homo sapiens
ggaggagaaucgagcaauc

SEQ ID NO: 1369580 - RNA, 19 nt, Homo sapiens
acucgucucuguauuugua

SEQ ID NO: 1369581 - RNA, 19 nt, Homo sapiens
auucagauauuuccgagua

SEQ ID NO: 1369582 - RNA, 19 nt, Homo sapiens
guagacaguucccuucaca

SEQ ID NO: 1369583 - RNA, 19 nt, Homo sapiens
ggagaucacggcugcuaaa

SEQ ID NO: 1369584 - RNA, 19 nt, Homo sapiens
gaggguuagucuuauguga

SEQ ID NO: 1369585 - RNA, 19 nt, Homo sapiens
gaugcaacuugaaaggaaa

SEQ ID NO: 1369586 - RNA, 19 nt, Homo sapiens
cgaguaaguggcuuguuua

SEQ ID NO: 1369587 - RNA, 19 nt, Homo sapiens
gggcuggucuugguccuuu

SEQ ID NO: 1369588 - RNA, 19 nt, Homo sapiens
ggaggaggcguaagcagaa

SEQ ID NO: 1369589 - RNA, 19 nt, Homo sapiens
gagcagagccaggugagaa

SEQ ID NO: 1369590 - RNA, 19 nt, Homo sapiens
gaauuaaacuagcaaucac

SEQ ID NO: 1369591 - RNA, 19 nt, Homo sapiens
uugauugccuguagacuuu

SEQ ID NO: 1369592 - RNA, 19 nt, Homo sapiens
cagcagccauguucaguca

SEQ ID NO: 1369593 - RNA, 19 nt, Homo sapiens
agucacaccuguccaauuc

SEQ ID NO: 1369594 - RNA, 19 nt, Homo sapiens
gggaagaccagcgacauuu

SEQ ID NO: 1369595 - RNA, 19 nt, Homo sapiens
ugaugcaacuugaaaggaa

SEQ ID NO: 1369596 - RNA, 19 nt, Homo sapiens
uagcagaaccgcuuccauu

SEQ ID NO: 1369597 - RNA, 19 nt, Homo sapiens
ccagugauguagacaguuc

SEQ ID NO: 1369598 - RNA, 19 nt, Homo sapiens
gcuugugaauucuugcuuu

SEQ ID NO: 1369599 - RNA, 19 nt, Homo sapiens
acacagggcuggucuuggu

SEQ ID NO: 1369600 - RNA, 19 nt, Homo sapiens
ggaaucugccugucuuuca

SEQ ID NO: 1369601 - RNA, 19 nt, Homo sapiens
caacagaagaaccucagaa

SEQ ID NO: 1369602 - RNA, 19 nt, Homo sapiens
ggaggcaaauccagcaucu

SEQ ID NO: 1369603 - RNA, 19 nt, Homo sapiens
cagaagaaccucagaacau

SEQ ID NO: 1369604 - RNA, 19 nt, Homo sapiens
ugacauuacucuucuugca

SEQ ID NO: 1369605 - RNA, 19 nt, Homo sapiens
ggagaaucgagcaaucuuu

SEQ ID NO: 1369606 - RNA, 19 nt, Homo sapiens
agucacaguucuucccaua

SEQ ID NO: 1369607 - RNA, 19 nt, Homo sapiens
acaguauauugaccucuua

SEQ ID NO: 1369608 - RNA, 19 nt, Homo sapiens
caaggaucauguuuucuua

SEQ ID NO: 1369609 - RNA, 19 nt, Homo sapiens
gcuaaugcuuggugcuaga

SEQ ID NO: 1369610 - RNA, 19 nt, Homo sapiens
ggaguucaguagcaaaguc

SEQ ID NO: 1369611 - RNA, 19 nt, Homo sapiens
ugacucgucucuguauuug

SEQ ID NO: 1369612 - RNA, 19 nt, Homo sapiens
gccuguauuuggaagauuu

SEQ ID NO: 1369613 - RNA, 19 nt, Homo sapiens
gggacugccuguauuugga

SEQ ID NO: 1369614 - RNA, 19 nt, Homo sapiens
gcaaauccagcaucuccuu

SEQ ID NO: 1369615 - RNA, 19 nt, Homo sapiens
gaacccaccgggaggcaaa

SEQ ID NO: 1369616 - RNA, 19 nt, Homo sapiens
cuaaugggauggcaaaggu

SEQ ID NO: 1369617 - RNA, 19 nt, Homo sapiens
gcaucuccuucuacuaaga

SEQ ID NO: 1369618 - RNA, 19 nt, Homo sapiens
gcagggacuucuggguuau

SEQ ID NO: 1369619 - RNA, 19 nt, Homo sapiens
gaguaaguggcuuguuuaa

SEQ ID NO: 1369620 - RNA, 19 nt, Homo sapiens
gaccagaaacucaagagau

SEQ ID NO: 1369621 - RNA, 19 nt, Homo sapiens
caaagucauugaugcaacu

SEQ ID NO: 1369622 - RNA, 19 nt, Homo sapiens
ccucugaagugcccaguuc

SEQ ID NO: 1369623 - RNA, 19 nt, Homo sapiens
gagaaaggcagcgccagaa

SEQ ID NO: 1369624 - RNA, 19 nt, Homo sapiens
guacugggcccugugauuc

SEQ ID NO: 1369625 - RNA, 19 nt, Homo sapiens
caaagucacaccuguccaa

SEQ ID NO: 1369626 - RNA, 19 nt, Homo sapiens
cucaucagccuuaaguuua

SEQ ID NO: 1369627 - RNA, 19 nt, Homo sapiens
guuggaaucugccugucuu

SEQ ID NO: 1369628 - RNA, 19 nt, Homo sapiens
ggcguaagcagaaacacua

SEQ ID NO: 1369629 - RNA, 19 nt, Homo sapiens
gaggaggcguaagcagaaa

SEQ ID NO: 1369630 - RNA, 19 nt, Homo sapiens
ggagguguccuguaugucu

SEQ ID NO: 1369631 - RNA, 19 nt, Homo sapiens
ccucagaacauacccaaga

SEQ ID NO: 1369632 - RNA, 19 nt, Homo sapiens
agaagagacuagagaccuu

SEQ ID NO: 1369633 - RNA, 19 nt, Homo sapiens
uguugacucuggucuguuu

SEQ ID NO: 1369634 - RNA, 19 nt, Homo sapiens
guucuuagguuuggauucu

SEQ ID NO: 1369635 - RNA, 19 nt, Homo sapiens
cuuccugugucuuucuuua

SEQ ID NO: 1369636 - RNA, 19 nt, Homo sapiens
cugauuggaugucuaggaa

SEQ ID NO: 1369637 - RNA, 19 nt, Homo sapiens
acaguucccuucacaaguc

SEQ ID NO: 1369638 - RNA, 19 nt, Homo sapiens
ucucaucagccuuaaguuu

SEQ ID NO: 1369639 - RNA, 19 nt, Homo sapiens
ucacgaauuccaaaucaga

SEQ ID NO: 1369640 - RNA, 19 nt, Homo sapiens
guuuaaugguggaaaugaa

SEQ ID NO: 1369641 - RNA, 19 nt, Homo sapiens
gcuguguggcugucguuua

SEQ ID NO: 1369642 - RNA, 19 nt, Homo sapiens
agucauugaugcaacuuga

SEQ ID NO: 1369643 - RNA, 19 nt, Homo sapiens
gaaggaguucaguagcaaa

SEQ ID NO: 1369644 - RNA, 19 nt, Homo sapiens
gguguaacaguugaauuaa

SEQ ID NO: 1369645 - RNA, 19 nt, Homo sapiens
gauaggagcguuuuguuau

SEQ ID NO: 1369646 - RNA, 19 nt, Homo sapiens
ugcauucggugccaacauu

SEQ ID NO: 1369647 - RNA, 19 nt, Homo sapiens
ggacugccuguauuuggaa

SEQ ID NO: 1369648 - RNA, 19 nt, Homo sapiens
gaucucauguuggaaucug

SEQ ID NO: 1369649 - RNA, 19 nt, Homo sapiens
gcccugacccucugaagug

SEQ ID NO: 1369650 - RNA, 19 nt, Homo sapiens
cccagcauauuguucugua

SEQ ID NO: 1369651 - RNA, 19 nt, Homo sapiens
ccaccaagcugcagaacaa

SEQ ID NO: 1369652 - RNA, 19 nt, Homo sapiens
ggccagggcuccaucauug

SEQ ID NO: 1369653 - RNA, 19 nt, Homo sapiens
ggucugggaugacuuaaau

SEQ ID NO: 1369654 - RNA, 19 nt, Homo sapiens
gagaggaagacgaguauuu

SEQ ID NO: 1369655 - RNA, 19 nt, Homo sapiens
gcacggcacacucaccuuu

SEQ ID NO: 1369656 - RNA, 19 nt, Homo sapiens
gaacaggaaguguauaggu

SEQ ID NO: 1369657 - RNA, 19 nt, Homo sapiens
gagcgaggccuccuucugu

SEQ ID NO: 1369658 - RNA, 19 nt, Homo sapiens
gaugaccucucccgucuac

SEQ ID NO: 1369659 - RNA, 19 nt, Homo sapiens
acaaauaccgccacacguu

SEQ ID NO: 1369660 - RNA, 19 nt, Homo sapiens
auguggaccuggacaaaua

SEQ ID NO: 1369661 - RNA, 19 nt, Homo sapiens
ucaagaacaggaaguguau

SEQ ID NO: 1369662 - RNA, 19 nt, Homo sapiens
gcggagaggaagacgagua

SEQ ID NO: 1369663 - RNA, 19 nt, Homo sapiens
ccacuucccuccaguaccu

SEQ ID NO: 1369664 - RNA, 19 nt, Homo sapiens
ucugggaugacuuaaauaa

SEQ ID NO: 1369665 - RNA, 19 nt, Homo sapiens
ggauguggaccuggacaaa

SEQ ID NO: 1369666 - RNA, 19 nt, Homo sapiens
cuagcaggcuccacuaacu

SEQ ID NO: 1369667 - RNA, 19 nt, Homo sapiens
cuacggcaccgacaugaug

SEQ ID NO: 1369668 - RNA, 19 nt, Homo sapiens
uaaggucagcuuccacaug

SEQ ID NO: 1369669 - RNA, 19 nt, Homo sapiens
caagaacaggaaguguaua

SEQ ID NO: 1369670 - RNA, 19 nt, Homo sapiens
ccacccugcugagcuguga

SEQ ID NO: 1369671 - RNA, 19 nt, Homo sapiens
gauguggaccuggacaaau

SEQ ID NO: 1369672 - RNA, 19 nt, Homo sapiens
cagcacuucugggagauca

SEQ ID NO: 1369673 - RNA, 19 nt, Homo sapiens
agcgaggccuccuucugua

SEQ ID NO: 1369674 - RNA, 19 nt, Homo sapiens
gcucuagcaggcuccacua

SEQ ID NO: 1369675 - RNA, 19 nt, Homo sapiens
agaggaagacgaguauuuc

SEQ ID NO: 1369676 - RNA, 19 nt, Homo sapiens
aagaacaggaaguguauag

SEQ ID NO: 1369677 - RNA, 19 nt, Homo sapiens
uucaagaacaggaagugua

SEQ ID NO: 1369678 - RNA, 19 nt, Homo sapiens
gaccggcgaguccuucugu

SEQ ID NO: 1369679 - RNA, 19 nt, Homo sapiens
ggaaagagccauagcuuaa

SEQ ID NO: 1369680 - RNA, 19 nt, Homo sapiens
ggaugaaaguuaugagaua

SEQ ID NO: 1369681 - RNA, 19 nt, Homo sapiens
gguaagauguuaaugguaa

SEQ ID NO: 1369682 - RNA, 19 nt, Homo sapiens
gaacuucauuucuguauca

SEQ ID NO: 1369683 - RNA, 19 nt, Homo sapiens
gagcagaucucccuuacug

SEQ ID NO: 1369684 - RNA, 19 nt, Homo sapiens
uuaaagagcuacuuagaga

SEQ ID NO: 1369685 - RNA, 19 nt, Homo sapiens
cuaaagagauacagucuga

SEQ ID NO: 1369686 - RNA, 19 nt, Homo sapiens
gagaaggaaugagagauaa

SEQ ID NO: 1369687 - RNA, 19 nt, Homo sapiens
gauaagguguuacugaguu

SEQ ID NO: 1369688 - RNA, 19 nt, Homo sapiens
acaggaauuucaccuauua

SEQ ID NO: 1369689 - RNA, 19 nt, Homo sapiens
uaaaagaggcugagaauua

SEQ ID NO: 1369690 - RNA, 19 nt, Homo sapiens
ggaccuaugucuuuuaaua

SEQ ID NO: 1369691 - RNA, 19 nt, Homo sapiens
gagaauuuguguacugaaa

SEQ ID NO: 1369692 - RNA, 19 nt, Homo sapiens
ggagaaggaaugagagaua

SEQ ID NO: 1369693 - RNA, 19 nt, Homo sapiens
gaaauauacuagagcacuu

SEQ ID NO: 1369694 - RNA, 19 nt, Homo sapiens
agagacaggugacaucuaa

SEQ ID NO: 1369695 - RNA, 19 nt, Homo sapiens
ggaaugagagauaaagaaa

SEQ ID NO: 1369696 - RNA, 19 nt, Homo sapiens
uagcuuaagucucuaugua

SEQ ID NO: 1369697 - RNA, 19 nt, Homo sapiens
uaaagaaacggucaacauu

SEQ ID NO: 1369698 - RNA, 19 nt, Homo sapiens
gaagaacacagcaagcaaa

SEQ ID NO: 1369699 - RNA, 19 nt, Homo sapiens
uagaugagacaccgaauua

SEQ ID NO: 1369700 - RNA, 19 nt, Homo sapiens
gauauauguugaagacuug

SEQ ID NO: 1369701 - RNA, 19 nt, Homo sapiens
aaggaggccuguuacuuua

SEQ ID NO: 1369702 - RNA, 19 nt, Homo sapiens
uguaagugcuaguagaaua

SEQ ID NO: 1369703 - RNA, 19 nt, Homo sapiens
gaauuucaccuauuacaga

SEQ ID NO: 1369704 - RNA, 19 nt, Homo sapiens
gaaacggucaacauucuaa

SEQ ID NO: 1369705 - RNA, 19 nt, Homo sapiens
ccagaaagaacuucauauu

SEQ ID NO: 1369706 - RNA, 19 nt, Homo sapiens
aaaguagacucuucugaga

SEQ ID NO: 1369707 - RNA, 19 nt, Homo sapiens
gcacauacaaugaucaauc

SEQ ID NO: 1369708 - RNA, 19 nt, Homo sapiens
ucacaggaauuucaccuau

SEQ ID NO: 1369709 - RNA, 19 nt, Homo sapiens
gcauccaaguaccauauaa

SEQ ID NO: 1369710 - RNA, 19 nt, Homo sapiens
ggucaacauucuaaagaga

SEQ ID NO: 1369711 - RNA, 19 nt, Homo sapiens
ccaacuguguuucauuuga

SEQ ID NO: 1369712 - RNA, 19 nt, Homo sapiens
cuagagcacuucaugauuc

SEQ ID NO: 1369713 - RNA, 19 nt, Homo sapiens
gagauacagucugaccuuu

SEQ ID NO: 1369714 - RNA, 19 nt, Homo sapiens
ccagaugcuucacagaauu

SEQ ID NO: 1369715 - RNA, 19 nt, Homo sapiens
ucaaguaucacaggaauuu

SEQ ID NO: 1369716 - RNA, 19 nt, Homo sapiens
agacaccgaauuaacauua

SEQ ID NO: 1369717 - RNA, 19 nt, Homo sapiens
gaaagagacaggugacauc

SEQ ID NO: 1369718 - RNA, 19 nt, Homo sapiens
gauacagucugaccuuuac

SEQ ID NO: 1369719 - RNA, 19 nt, Homo sapiens
guaaagaaacggucaacau

SEQ ID NO: 1369720 - RNA, 19 nt, Homo sapiens
ugauaacacugcuuacugu

SEQ ID NO: 1369721 - RNA, 19 nt, Homo sapiens
caagccagguaacauaaau

SEQ ID NO: 1369722 - RNA, 19 nt, Homo sapiens
guagaugucuuaggcaaca

SEQ ID NO: 1369723 - RNA, 19 nt, Homo sapiens
acgauaggcucaaacacua

SEQ ID NO: 1369724 - RNA, 19 nt, Homo sapiens
gcaaagccuuguguuucaa

SEQ ID NO: 1369725 - RNA, 19 nt, Homo sapiens
uaucagggguccagaaaua

SEQ ID NO: 1369726 - RNA, 19 nt, Homo sapiens
uauuccagcuuccugauaa

SEQ ID NO: 1369727 - RNA, 19 nt, Homo sapiens
gaggaagugaaguaaauuu

SEQ ID NO: 1369728 - RNA, 19 nt, Homo sapiens
gaccagaugcuucacagaa

SEQ ID NO: 1369729 - RNA, 19 nt, Homo sapiens
ugaaucaggugacgguguu

SEQ ID NO: 1369730 - RNA, 19 nt, Homo sapiens
aaagauaagguguuacuga

SEQ ID NO: 1369731 - RNA, 19 nt, Homo sapiens
ugagauauauguugaagac

SEQ ID NO: 1369732 - RNA, 19 nt, Homo sapiens
gcugagaauuaccauacaa

SEQ ID NO: 1369733 - RNA, 19 nt, Homo sapiens
uaauccaacuaucauggua

SEQ ID NO: 1369734 - RNA, 19 nt, Homo sapiens
gauguaagugcuaguagaa

SEQ ID NO: 1369735 - RNA, 19 nt, Homo sapiens
uaacuaccaugcccuugau

SEQ ID NO: 1369736 - RNA, 19 nt, Homo sapiens
gaaaucuucuaaccuacca

SEQ ID NO: 1369737 - RNA, 19 nt, Homo sapiens
caaguaccauauaauccaa

SEQ ID NO: 1369738 - RNA, 19 nt, Homo sapiens
agacagggauccauuuuaa

SEQ ID NO: 1369739 - RNA, 19 nt, Homo sapiens
ugagaccuauuagauguaa

SEQ ID NO: 1369740 - RNA, 19 nt, Homo sapiens
aaacguuuauucugcuuug

SEQ ID NO: 1369741 - RNA, 19 nt, Homo sapiens
agagcuacuuagagaaaua

SEQ ID NO: 1369742 - RNA, 19 nt, Homo sapiens
aaagagcuacuuagagaaa

SEQ ID NO: 1369743 - RNA, 19 nt, Homo sapiens
gaaguauucaaccaacaaa

SEQ ID NO: 1369744 - RNA, 19 nt, Homo sapiens
uauaucaucccaucugaaa

SEQ ID NO: 1369745 - RNA, 19 nt, Homo sapiens
aauacucacugucacauug

SEQ ID NO: 1369746 - RNA, 19 nt, Homo sapiens
gagcauccaaguaccauau

SEQ ID NO: 1369747 - RNA, 19 nt, Homo sapiens
acaaggguauuacaacugu

SEQ ID NO: 1369748 - RNA, 19 nt, Homo sapiens
ggaagaacacagcaagcaa

SEQ ID NO: 1369749 - RNA, 19 nt, Homo sapiens
gaggaaagagccauagcuu

SEQ ID NO: 1369750 - RNA, 19 nt, Homo sapiens
caaaguugcuucuaauccu

SEQ ID NO: 1369751 - RNA, 19 nt, Homo sapiens
ggccuaccaucccuucuga

SEQ ID NO: 1369752 - RNA, 19 nt, Homo sapiens
caacagaaggccaaagaag

SEQ ID NO: 1369753 - RNA, 19 nt, Homo sapiens
gacugauccuggaguguuu

SEQ ID NO: 1369754 - RNA, 19 nt, Homo sapiens
gcacaaaagacaucuggua

SEQ ID NO: 1369755 - RNA, 19 nt, Homo sapiens
ggaauauucauuugacauc

SEQ ID NO: 1369756 - RNA, 19 nt, Homo sapiens
gguaaggccagaaaucuuc

SEQ ID NO: 1369757 - RNA, 19 nt, Homo sapiens
gcuccgcucuggccuuaug

SEQ ID NO: 1369758 - RNA, 19 nt, Homo sapiens
cagaugcuucacagaauua

SEQ ID NO: 1369759 - RNA, 19 nt, Homo sapiens
agccauagcuuaagucucu

SEQ ID NO: 1369760 - RNA, 19 nt, Homo sapiens
cuccaacuguguuucauuu

SEQ ID NO: 1369761 - RNA, 19 nt, Homo sapiens
gugcuuugccuuugguaua

SEQ ID NO: 1369762 - RNA, 19 nt, Homo sapiens
gguacucgcugccugucaa

SEQ ID NO: 1369763 - RNA, 19 nt, Homo sapiens
cuaccaugcccuugauaua

SEQ ID NO: 1369764 - RNA, 19 nt, Homo sapiens
acgaggaagugaaguaaau

SEQ ID NO: 1369765 - RNA, 19 nt, Homo sapiens
gcaagccagguaacauaaa

SEQ ID NO: 1369766 - RNA, 19 nt, Homo sapiens
aaagagccauagcuuaagu

SEQ ID NO: 1369767 - RNA, 19 nt, Homo sapiens
uaaggccacugaggaaaga

SEQ ID NO: 1369768 - RNA, 19 nt, Homo sapiens
gauggaaaccugugagucu

SEQ ID NO: 1369769 - RNA, 19 nt, Homo sapiens
acagaaggccaaagaaguu

SEQ ID NO: 1369770 - RNA, 19 nt, Homo sapiens
auaagguguuacugaguua

SEQ ID NO: 1369771 - RNA, 19 nt, Homo sapiens
ccauauaauccaacuauca

SEQ ID NO: 1369772 - RNA, 19 nt, Homo sapiens
caacaccccucaaaugaau

SEQ ID NO: 1369773 - RNA, 19 nt, Homo sapiens
cacaggaauuucaccuauu

SEQ ID NO: 1369774 - RNA, 19 nt, Homo sapiens
guaagugcuaguagaauau

SEQ ID NO: 1369775 - RNA, 19 nt, Homo sapiens
guacugagucacaacaugu

SEQ ID NO: 1369776 - RNA, 19 nt, Homo sapiens
gaaggaaugagagauaaag

SEQ ID NO: 1369777 - RNA, 19 nt, Homo sapiens
gauaaucaucuugcucuga

SEQ ID NO: 1369778 - RNA, 19 nt, Homo sapiens
aagcuccgcucuggccuua

SEQ ID NO: 1369779 - RNA, 19 nt, Homo sapiens
ggcaaaggcuuccgcuaua

SEQ ID NO: 1369780 - RNA, 19 nt, Homo sapiens
gcaaaggcuuccgcuauaa

SEQ ID NO: 1369781 - RNA, 19 nt, Homo sapiens
gugaugacuuccuuaaaua

SEQ ID NO: 1369782 - RNA, 19 nt, Homo sapiens
ggugaugacuuccuuaaau

SEQ ID NO: 1369783 - RNA, 19 nt, Homo sapiens
gcaacaagccgcacaagug

SEQ ID NO: 1369784 - RNA, 19 nt, Homo sapiens
gaagaauuguucaggagau

SEQ ID NO: 1369785 - RNA, 19 nt, Homo sapiens
ggaggaguguugaguaagu

SEQ ID NO: 1369786 - RNA, 19 nt, Homo sapiens
guagauauccugggacuga

SEQ ID NO: 1369787 - RNA, 19 nt, Homo sapiens
gcgagaagcccuacaugug

SEQ ID NO: 1369788 - RNA, 19 nt, Homo sapiens
caacaagccgcacaagugu

SEQ ID NO: 1369789 - RNA, 19 nt, Homo sapiens
gcgauggccuguagaaggu

SEQ ID NO: 1369790 - RNA, 19 nt, Homo sapiens
gggagaggguuuaaaugag

SEQ ID NO: 1369791 - RNA, 19 nt, Homo sapiens
ugggaggaguguugaguaa

SEQ ID NO: 1369792 - RNA, 19 nt, Homo sapiens
caaaggcuuccgcuauaaa

SEQ ID NO: 1369793 - RNA, 19 nt, Homo sapiens
gaggaguguugaguaaguu

SEQ ID NO: 1369794 - RNA, 19 nt, Homo sapiens
ggucuuucccggugcuaua

SEQ ID NO: 1369795 - RNA, 19 nt, Homo sapiens
gcucggacuuggugaagca

SEQ ID NO: 1369796 - RNA, 19 nt, Homo sapiens
gaccaggcacuuugaggaa

SEQ ID NO: 1369797 - RNA, 19 nt, Homo sapiens
ggaggaccaggcacuuuga

SEQ ID NO: 1369798 - RNA, 19 nt, Homo sapiens
gaagugggaggaguguuga

SEQ ID NO: 1369799 - RNA, 19 nt, Homo sapiens
agaagcugcaccuguguua

SEQ ID NO: 1369800 - RNA, 19 nt, Homo sapiens
cggcaaaggcuuccgcuau

SEQ ID NO: 1369801 - RNA, 19 nt, Homo sapiens
ugaagugggaggaguguug

SEQ ID NO: 1369802 - RNA, 19 nt, Homo sapiens
ggguuuaaaugaggguuau

SEQ ID NO: 1369803 - RNA, 19 nt, Homo sapiens
ggagggacaaucugagagu

SEQ ID NO: 1369804 - RNA, 19 nt, Homo sapiens
ccagagcucccaccugauc

SEQ ID NO: 1369805 - RNA, 19 nt, Homo sapiens
gaugacuuccuuaaauaca

SEQ ID NO: 1369806 - RNA, 19 nt, Homo sapiens
ccucagcucgcaucuguug

SEQ ID NO: 1369807 - RNA, 19 nt, Homo sapiens
ggggagaggguuuaaauga

SEQ ID NO: 1369808 - RNA, 19 nt, Homo sapiens
guucgcaccuggccaacca

SEQ ID NO: 1369809 - RNA, 19 nt, Homo sapiens
gagugcggcaagagcuuua

SEQ ID NO: 1369810 - RNA, 19 nt, Homo sapiens
ugaguaaguuggucuuucc

SEQ ID NO: 1369811 - RNA, 19 nt, Homo sapiens
agccucagcucgcaucugu

SEQ ID NO: 1369812 - RNA, 19 nt, Homo sapiens
ggcgagaagcccuacaugu

SEQ ID NO: 1369813 - RNA, 19 nt, Homo sapiens
gugggaggaguguugagua

SEQ ID NO: 1369814 - RNA, 19 nt, Homo sapiens
gggugaugacuuccuuaaa

SEQ ID NO: 1369815 - RNA, 19 nt, Homo sapiens
ccucuccacggaagaauug

SEQ ID NO: 1369816 - RNA, 19 nt, Homo sapiens
cgucagcucgcaccucuuc

SEQ ID NO: 1369817 - RNA, 19 nt, Homo sapiens
aagaauuguucaggagaug

SEQ ID NO: 1369818 - RNA, 19 nt, Homo sapiens
ggaaagaacuggaguggau

SEQ ID NO: 1369819 - RNA, 19 nt, Homo sapiens
aacaaagacuucugucaua

SEQ ID NO: 1369820 - RNA, 19 nt, Homo sapiens
acaaagacuucugucauaa

SEQ ID NO: 1369821 - RNA, 19 nt, Homo sapiens
aggcaccucuucaauauaa

SEQ ID NO: 1369822 - RNA, 19 nt, Homo sapiens
ccuguuugguuaagaauaa

SEQ ID NO: 1369823 - RNA, 19 nt, Homo sapiens
gaggcucagugcuuucuuu

SEQ ID NO: 1369824 - RNA, 19 nt, Homo sapiens
agacuucugucauaaauag

SEQ ID NO: 1369825 - RNA, 19 nt, Homo sapiens
gcaccucuucaauauaaua

SEQ ID NO: 1369826 - RNA, 19 nt, Homo sapiens
caaagacuucugucauaaa

SEQ ID NO: 1369827 - RNA, 19 nt, Homo sapiens
caagguuguucauggugua

SEQ ID NO: 1369828 - RNA, 19 nt, Homo sapiens
ggucaaccgucauccuuuc

SEQ ID NO: 1369829 - RNA, 19 nt, Homo sapiens
uaacaaagacuucugucau

SEQ ID NO: 1369830 - RNA, 19 nt, Homo sapiens
auaggcaccucuucaauau

SEQ ID NO: 1369831 - RNA, 19 nt, Homo sapiens
aauaggcaccucuucaaua

SEQ ID NO: 1369832 - RNA, 19 nt, Homo sapiens
ccuguaagacuucuggaua

SEQ ID NO: 1369833 - RNA, 19 nt, Homo sapiens
gugaguaaucuugcaaaua

SEQ ID NO: 1369834 - RNA, 19 nt, Homo sapiens
caacaugggagcguuccua

SEQ ID NO: 1369835 - RNA, 19 nt, Homo sapiens
gguuguucaugguguauau

SEQ ID NO: 1369836 - RNA, 19 nt, Homo sapiens
gaccugacccauccaguuc

SEQ ID NO: 1369837 - RNA, 19 nt, Homo sapiens
cauguauuauugugugaga

SEQ ID NO: 1369838 - RNA, 19 nt, Homo sapiens
cguccuggcuguucuccaa

SEQ ID NO: 1369839 - RNA, 19 nt, Homo sapiens
auagauuuccugugaguaa

SEQ ID NO: 1369840 - RNA, 19 nt, Homo sapiens
uuacacaguucaucauugc

SEQ ID NO: 1369841 - RNA, 19 nt, Homo sapiens
cuaauaggcaccucuucaa

SEQ ID NO: 1369842 - RNA, 19 nt, Homo sapiens
ccucuucaauauaauaguc

SEQ ID NO: 1369843 - RNA, 19 nt, Homo sapiens
uaauaggcaccucuucaau

SEQ ID NO: 1369844 - RNA, 19 nt, Homo sapiens
gcucagugcuuucuuuucu

SEQ ID NO: 1369845 - RNA, 19 nt, Homo sapiens
ccagauacagcccauccuu

SEQ ID NO: 1369846 - RNA, 19 nt, Homo sapiens
gauauaacaaagacuucug

SEQ ID NO: 1369847 - RNA, 19 nt, Homo sapiens
gugccaauucguaaauauu

SEQ ID NO: 1369848 - RNA, 19 nt, Homo sapiens
ucccuucuguccgcucuua

SEQ ID NO: 1369849 - RNA, 19 nt, Homo sapiens
ugugagagggaccaucuaa

SEQ ID NO: 1369850 - RNA, 19 nt, Homo sapiens
uuuacacaguucaucauug

SEQ ID NO: 1369851 - RNA, 19 nt, Homo sapiens
gccauguauuauuguguga

SEQ ID NO: 1369852 - RNA, 19 nt, Homo sapiens
gagcguuccuaaccccuaa

SEQ ID NO: 1369853 - RNA, 19 nt, Homo sapiens
ugagagggaccaucuaaaa

SEQ ID NO: 1369854 - RNA, 19 nt, Homo sapiens
ugugaguaaucuugcaaau

SEQ ID NO: 1369855 - RNA, 19 nt, Homo sapiens
gggucaaccgucauccuuu

SEQ ID NO: 1369856 - RNA, 19 nt, Homo sapiens
gugagagggaccaucuaaa

SEQ ID NO: 1369857 - RNA, 19 nt, Homo sapiens
gggagucucugaggaucuc

SEQ ID NO: 1369858 - RNA, 19 nt, Homo sapiens
uagauuuccugugaguaau

SEQ ID NO: 1369859 - RNA, 19 nt, Homo sapiens
ugugccaauucguaaauau

SEQ ID NO: 1369860 - RNA, 19 nt, Homo sapiens
agaccugacccauccaguu

SEQ ID NO: 1369861 - RNA, 19 nt, Homo sapiens
acacaguucaucauugcuu

SEQ ID NO: 1369862 - RNA, 19 nt, Homo sapiens
ccaggggccucucuauuca

SEQ ID NO: 1369863 - RNA, 19 nt, Homo sapiens
cuguaagacuucuggauac

SEQ ID NO: 1369864 - RNA, 19 nt, Homo sapiens
gaauuuagcuucacuugag

SEQ ID NO: 1369865 - RNA, 19 nt, Homo sapiens
ggguagagcuggguaauaa

SEQ ID NO: 1369866 - RNA, 19 nt, Homo sapiens
gaggagggauucuaaacuu

SEQ ID NO: 1369867 - RNA, 19 nt, Homo sapiens
gaacugaagagccagauga

SEQ ID NO: 1369868 - RNA, 19 nt, Homo sapiens
caauaggugugaagaggua

SEQ ID NO: 1369869 - RNA, 19 nt, Homo sapiens
gaggagagccuuggguaua

SEQ ID NO: 1369870 - RNA, 19 nt, Homo sapiens
aggaagaccuggacuacua

SEQ ID NO: 1369871 - RNA, 19 nt, Homo sapiens
gaggguggcccguaaguuu

SEQ ID NO: 1369872 - RNA, 19 nt, Homo sapiens
ggaagaagaggguguguuc

SEQ ID NO: 1369873 - RNA, 19 nt, Homo sapiens
gagcgugucuuuccuuucu

SEQ ID NO: 1369874 - RNA, 19 nt, Homo sapiens
guguguaccuggacuauga

SEQ ID NO: 1369875 - RNA, 19 nt, Homo sapiens
ucaaggagacuuucaauag

SEQ ID NO: 1369876 - RNA, 19 nt, Homo sapiens
cugcaugggucccugauaa

SEQ ID NO: 1369877 - RNA, 19 nt, Homo sapiens
gcccagagcuccacagaac

SEQ ID NO: 1369878 - RNA, 19 nt, Homo sapiens
uagcuucacuugagagaga

SEQ ID NO: 1369879 - RNA, 19 nt, Homo sapiens
gggaaggcgugcuguggaa

SEQ ID NO: 1369880 - RNA, 19 nt, Homo sapiens
ccucuugccuugucacuug

SEQ ID NO: 1369881 - RNA, 19 nt, Homo sapiens
caaggagacuuucaauagg

SEQ ID NO: 1369882 - RNA, 19 nt, Homo sapiens
ugagagagaucuggaaugg

SEQ ID NO: 1369883 - RNA, 19 nt, Homo sapiens
gugaaucaacccaucauaa

SEQ ID NO: 1369884 - RNA, 19 nt, Homo sapiens
caccauuacaucaucauua

SEQ ID NO: 1369885 - RNA, 19 nt, Homo sapiens
gauuuuagcugagggauuu

SEQ ID NO: 1369886 - RNA, 19 nt, Homo sapiens
gaacagcugccuggucuuc

SEQ ID NO: 1369887 - RNA, 19 nt, Homo sapiens
uggaggagguugaggaaga

SEQ ID NO: 1369888 - RNA, 19 nt, Homo sapiens
gcgagcgugucuuuccuuu

SEQ ID NO: 1369889 - RNA, 19 nt, Homo sapiens
ggagagccuuggguauaau

SEQ ID NO: 1369890 - RNA, 19 nt, Homo sapiens
ccauagaccggccagaauu

SEQ ID NO: 1369891 - RNA, 19 nt, Homo sapiens
aggagagccuuggguauaa

SEQ ID NO: 1369892 - RNA, 19 nt, Homo sapiens
gcucugcccuugauuaucc

SEQ ID NO: 1369893 - RNA, 19 nt, Homo sapiens
gccaugacuuccugacaga

SEQ ID NO: 1369894 - RNA, 19 nt, Homo sapiens
ggcgugcuguggaaauaaa

SEQ ID NO: 1369895 - RNA, 19 nt, Homo sapiens
ggagggauucuaaacuuuc

SEQ ID NO: 1369896 - RNA, 19 nt, Homo sapiens
guagagcuggguaauaaau

SEQ ID NO: 1369897 - RNA, 19 nt, Homo sapiens
gcaggagguugcugaccau

SEQ ID NO: 1369898 - RNA, 19 nt, Homo sapiens
ccuugucacuugcagcuuu

SEQ ID NO: 1369899 - RNA, 19 nt, Homo sapiens
ccuuggguauaaucuauuu

SEQ ID NO: 1369900 - RNA, 19 nt, Homo sapiens
cauagaccggccagaauuu

SEQ ID NO: 1369901 - RNA, 19 nt, Homo sapiens
gagaaaccaaggcgcuuug

SEQ ID NO: 1369902 - RNA, 19 nt, Homo sapiens
uugaaaccacgcaccauua

SEQ ID NO: 1369903 - RNA, 19 nt, Homo sapiens
agccuucucucaccuacua

SEQ ID NO: 1369904 - RNA, 19 nt, Homo sapiens
gaaucaacccaucauaagg

SEQ ID NO: 1369905 - RNA, 19 nt, Homo sapiens
ugaaucaacccaucauaag

SEQ ID NO: 1369906 - RNA, 19 nt, Homo sapiens
ccaauaugguccaggugau

SEQ ID NO: 1369907 - RNA, 19 nt, Homo sapiens
gaaggcgugcuguggaaau

SEQ ID NO: 1369908 - RNA, 19 nt, Homo sapiens
ggaggagagccuuggguau

SEQ ID NO: 1369909 - RNA, 19 nt, Homo sapiens
aggagggauucuaaacuuu

SEQ ID NO: 1369910 - RNA, 19 nt, Homo sapiens
agagccagaugaagucaga

SEQ ID NO: 1369911 - RNA, 19 nt, Homo sapiens
gcaugggucccugauaaug

SEQ ID NO: 1369912 - RNA, 19 nt, Homo sapiens
ggaggaagaccuggacuac

SEQ ID NO: 1369913 - RNA, 19 nt, Homo sapiens
agagcuggguaauaaaugu

SEQ ID NO: 1369914 - RNA, 19 nt, Homo sapiens
caacauccccauuccaauu

SEQ ID NO: 1369915 - RNA, 19 nt, Homo sapiens
ggaggagguugaggaagag

SEQ ID NO: 1369916 - RNA, 19 nt, Homo sapiens
aaggcgugcuguggaaaua

SEQ ID NO: 1369917 - RNA, 19 nt, Homo sapiens
gcaccauuacaucaucauu

SEQ ID NO: 1369918 - RNA, 19 nt, Homo sapiens
uuccuuccguccucaauuu

SEQ ID NO: 1369919 - RNA, 19 nt, Homo sapiens
ccaauuccauuuucugaug

SEQ ID NO: 1369920 - RNA, 19 nt, Homo sapiens
caugggucccugauaauga

SEQ ID NO: 1369921 - RNA, 19 nt, Homo sapiens
ggaggucgaggaggaagaa

SEQ ID NO: 1369922 - RNA, 19 nt, Homo sapiens
gaaaccacgcaccauuaca

SEQ ID NO: 1369923 - RNA, 19 nt, Homo sapiens
cucaauuucuaccuccaua

SEQ ID NO: 1369924 - RNA, 19 nt, Homo sapiens
ggaggagggauucuaaacu

SEQ ID NO: 1369925 - RNA, 19 nt, Homo sapiens
ggaggaggacgaggaggaa

SEQ ID NO: 1369926 - RNA, 19 nt, Homo sapiens
aaucaacccaucauaagga

SEQ ID NO: 1369927 - RNA, 19 nt, Homo sapiens
ggacaucaaggagacuuuc

SEQ ID NO: 1369928 - RNA, 19 nt, Homo sapiens
gggcaucugucccaaacac

SEQ ID NO: 1369929 - RNA, 19 nt, Homo sapiens
gcacucaaccaaggagcaa

SEQ ID NO: 1369930 - RNA, 19 nt, Homo sapiens
agaccuggacuacuacuug

SEQ ID NO: 1369931 - RNA, 19 nt, Homo sapiens
aaggagacuuucaauaggu

SEQ ID NO: 1369932 - RNA, 19 nt, Homo sapiens
caauaugguccaggugauu

SEQ ID NO: 1369933 - RNA, 19 nt, Homo sapiens
gcucuucaaccucuuuauc

SEQ ID NO: 1369934 - RNA, 19 nt, Homo sapiens
caagggcacccgcaucaag

SEQ ID NO: 1369935 - RNA, 19 nt, Homo sapiens
agacgaagaggccaucugu

SEQ ID NO: 1369936 - RNA, 19 nt, Homo sapiens
cagaauuuagcuucacuug

SEQ ID NO: 1369937 - RNA, 19 nt, Homo sapiens
uucaaccucuuuaucaguu

SEQ ID NO: 1369938 - RNA, 19 nt, Homo sapiens
gcugggacaacauggacua

SEQ ID NO: 1369939 - RNA, 19 nt, Homo sapiens
caucaaggagacuuucaau

SEQ ID NO: 1369940 - RNA, 19 nt, Homo sapiens
gagccuuggguauaaucua

SEQ ID NO: 1369941 - RNA, 19 nt, Homo sapiens
cuagucgccuugcagaaca

SEQ ID NO: 1369942 - RNA, 19 nt, Homo sapiens
gaagagccagaugaaguca

SEQ ID NO: 1369943 - RNA, 19 nt, Homo sapiens
aggagguggugcaggagua

SEQ ID NO: 1369944 - RNA, 19 nt, Homo sapiens
acgaagaggccaucugugu

SEQ ID NO: 1369945 - RNA, 19 nt, Homo sapiens
gcuggguaauaaaugucua

SEQ ID NO: 1369946 - RNA, 19 nt, Homo sapiens
gguagagcuggguaauaaa

SEQ ID NO: 1369947 - RNA, 19 nt, Homo sapiens
cagggcaucugucccaaac

SEQ ID NO: 1369948 - RNA, 19 nt, Homo sapiens
gcgugucuuuccuuucuuc

SEQ ID NO: 1369949 - RNA, 19 nt, Homo sapiens
ugagccggauguucuguca

SEQ ID NO: 1369950 - RNA, 19 nt, Homo sapiens
cugaagagccagaugaagu

SEQ ID NO: 1369951 - RNA, 19 nt, Homo sapiens
ggaguacaaggccaaacug

SEQ ID NO: 1369952 - RNA, 19 nt, Homo sapiens
ggaaggcgugcuguggaaa

SEQ ID NO: 1369953 - RNA, 19 nt, Homo sapiens
aaaccacgcaccauuacau

SEQ ID NO: 1369954 - RNA, 19 nt, Homo sapiens
gggaugaggggaaauugua

SEQ ID NO: 1369955 - RNA, 19 nt, Homo sapiens
cccugggacuggaauuuga

SEQ ID NO: 1369956 - RNA, 19 nt, Homo sapiens
ugagaaaccaaggcgcuuu

SEQ ID NO: 1369957 - RNA, 19 nt, Homo sapiens
cacgguuucuggcugaaga

SEQ ID NO: 1369958 - RNA, 19 nt, Homo sapiens
ugaagagccagaugaaguc

SEQ ID NO: 1369959 - RNA, 19 nt, Homo sapiens
auagaccggccagaauuua

SEQ ID NO: 1369960 - RNA, 19 nt, Homo sapiens
ggauuuggaagccauuugg

SEQ ID NO: 1369961 - RNA, 19 nt, Homo sapiens
ucccacugcuuguuacugu

SEQ ID NO: 1369962 - RNA, 19 nt, Homo sapiens
ggaggguggcccguaaguu

SEQ ID NO: 1369963 - RNA, 19 nt, Homo sapiens
caaggcgcuuuggugugua

SEQ ID NO: 1369964 - RNA, 19 nt, Homo sapiens
gauagggaaucucuuauua

SEQ ID NO: 1369965 - RNA, 19 nt, Homo sapiens
gaaauuagcuacucaccaa

SEQ ID NO: 1369966 - RNA, 19 nt, Homo sapiens
ggaaguggaucuggaauug

SEQ ID NO: 1369967 - RNA, 19 nt, Homo sapiens
gaggauagggaaucucuua

SEQ ID NO: 1369968 - RNA, 19 nt, Homo sapiens
ccagcucccuguauugaua

SEQ ID NO: 1369969 - RNA, 19 nt, Homo sapiens
gacacaaucuccaagaaug

SEQ ID NO: 1369970 - RNA, 19 nt, Homo sapiens
caagcuggcucucugguau

SEQ ID NO: 1369971 - RNA, 19 nt, Homo sapiens
ucaccaaccuuucgucuuc

SEQ ID NO: 1369972 - RNA, 19 nt, Homo sapiens
gaugaugccugcccagagu

SEQ ID NO: 1369973 - RNA, 19 nt, Homo sapiens
ggcccacccucaaccaaua

SEQ ID NO: 1369974 - RNA, 19 nt, Homo sapiens
gaucagguguuguccuaca

SEQ ID NO: 1369975 - RNA, 19 nt, Homo sapiens
ggauagggaaucucuuauu

SEQ ID NO: 1369976 - RNA, 19 nt, Homo sapiens
guauugauauaaccuguca

SEQ ID NO: 1369977 - RNA, 19 nt, Homo sapiens
ggaggugcccuuugugaug

SEQ ID NO: 1369978 - RNA, 19 nt, Homo sapiens
gaggagccagccaaugaua

SEQ ID NO: 1369979 - RNA, 19 nt, Homo sapiens
ccagggagggccaugauuu

SEQ ID NO: 1369980 - RNA, 19 nt, Homo sapiens
gcaagacaaacaaggcaaa

SEQ ID NO: 1369981 - RNA, 19 nt, Homo sapiens
caugggaggugcccuuugu

SEQ ID NO: 1369982 - RNA, 19 nt, Homo sapiens
cucauuggcuaaaggauuu

SEQ ID NO: 1369983 - RNA, 19 nt, Homo sapiens
cagacacaaucuccaagaa

SEQ ID NO: 1369984 - RNA, 19 nt, Homo sapiens
gccuggagcugcagugguu

SEQ ID NO: 1369985 - RNA, 19 nt, Homo sapiens
gcaccagcauuagauguca

SEQ ID NO: 1369986 - RNA, 19 nt, Homo sapiens
guaagcccgcuguccaaua

SEQ ID NO: 1369987 - RNA, 19 nt, Homo sapiens
aaaggaggaucagguguug

SEQ ID NO: 1369988 - RNA, 19 nt, Homo sapiens
gaggugcccuuugugaugu

SEQ ID NO: 1369989 - RNA, 19 nt, Homo sapiens
gacagaaggagaagaggaa

SEQ ID NO: 1369990 - RNA, 19 nt, Homo sapiens
cccaagagcucagacacaa

SEQ ID NO: 1369991 - RNA, 19 nt, Homo sapiens
aagcaaaccuggaguaucc

SEQ ID NO: 1369992 - RNA, 19 nt, Homo sapiens
ugucauccgugggucuuua

SEQ ID NO: 1369993 - RNA, 19 nt, Homo sapiens
uaagcccgcuguccaauac

SEQ ID NO: 1369994 - RNA, 19 nt, Homo sapiens
gggaaaaccaucucaguaa

SEQ ID NO: 1369995 - RNA, 19 nt, Homo sapiens
gacaaacaaggcaaaucua

SEQ ID NO: 1369996 - RNA, 19 nt, Homo sapiens
gggaaucucuuauuaaaac

SEQ ID NO: 1369997 - RNA, 19 nt, Homo sapiens
caagagcucagacacaauc

SEQ ID NO: 1369998 - RNA, 19 nt, Homo sapiens
uggaggagccagccaauga

SEQ ID NO: 1369999 - RNA, 19 nt, Homo sapiens
ggagacagaaggagaagag

SEQ ID NO: 1370000 - RNA, 19 nt, Homo sapiens
agaacucaauguacugguu

SEQ ID NO: 1370001 - RNA, 19 nt, Homo sapiens
gaaugugcaagacaaacaa

SEQ ID NO: 1370002 - RNA, 19 nt, Homo sapiens
gagaagaggaaguggaucu

SEQ ID NO: 1370003 - RNA, 19 nt, Homo sapiens
caagacugcccacgacaga

SEQ ID NO: 1370004 - RNA, 19 nt, Homo sapiens
gcucagacacaaucuccaa

SEQ ID NO: 1370005 - RNA, 19 nt, Homo sapiens
caaggaggaugccauugcu

SEQ ID NO: 1370006 - RNA, 19 nt, Homo sapiens
gguguuguccuacaucaau

SEQ ID NO: 1370007 - RNA, 19 nt, Homo sapiens
ggaaaaccaucucaguaag

SEQ ID NO: 1370008 - RNA, 19 nt, Homo sapiens
gcacagaggccugagucau

SEQ ID NO: 1370009 - RNA, 19 nt, Homo sapiens
ugaugugguucuucaaaca

SEQ ID NO: 1370010 - RNA, 19 nt, Homo sapiens
ucacacuccugacccuuag

SEQ ID NO: 1370011 - RNA, 19 nt, Homo sapiens
ggagccagccaaugauauc

SEQ ID NO: 1370012 - RNA, 19 nt, Homo sapiens
gcacugcccaauguaaugu

SEQ ID NO: 1370013 - RNA, 19 nt, Homo sapiens
aaccuuagaacucaaugua

SEQ ID NO: 1370014 - RNA, 19 nt, Homo sapiens
agacaaacaaggcaaaucu

SEQ ID NO: 1370015 - RNA, 19 nt, Homo sapiens
gaaaaccaucucaguaaga

SEQ ID NO: 1370016 - RNA, 19 nt, Homo sapiens
uaucaaggaggaugccauu

SEQ ID NO: 1370017 - RNA, 19 nt, Homo sapiens
cacagaggccugagucaug

SEQ ID NO: 1370018 - RNA, 19 nt, Homo sapiens
gaguaagcccgcuguccaa

SEQ ID NO: 1370019 - RNA, 19 nt, Homo sapiens
uuucuuugcaccagcauua

SEQ ID NO: 1370020 - RNA, 19 nt, Homo sapiens
ccaggagacagaaggagaa

SEQ ID NO: 1370021 - RNA, 19 nt, Homo sapiens
ccaagaaugggacccuuuc

SEQ ID NO: 1370022 - RNA, 19 nt, Homo sapiens
ggaggagccagccaaugau

SEQ ID NO: 1370023 - RNA, 19 nt, Homo sapiens
ccuuagaacucaauguacu

SEQ ID NO: 1370024 - RNA, 19 nt, Homo sapiens
uggcugggcugguccucuu

SEQ ID NO: 1370025 - RNA, 19 nt, Homo sapiens
guaaugugacgcuggaagu

SEQ ID NO: 1370026 - RNA, 19 nt, Homo sapiens
ccugacuccuccuuaugaa

SEQ ID NO: 1370027 - RNA, 19 nt, Homo sapiens
ccagugggaucggcagcuu

SEQ ID NO: 1370028 - RNA, 19 nt, Homo sapiens
acaaacaaggcaaaucuag

SEQ ID NO: 1370029 - RNA, 19 nt, Homo sapiens
cuacagcugcuccgugaau

SEQ ID NO: 1370030 - RNA, 19 nt, Homo sapiens
gggcagaggauagggaauc

SEQ ID NO: 1370031 - RNA, 19 nt, Homo sapiens
gugaugugguucuucaaac

SEQ ID NO: 1370032 - RNA, 19 nt, Homo sapiens
ucaagcuggcucucuggua

SEQ ID NO: 1370033 - RNA, 19 nt, Homo sapiens
agacacaaucuccaagaau

SEQ ID NO: 1370034 - RNA, 19 nt, Homo sapiens
ucagacacaaucuccaaga

SEQ ID NO: 1370035 - RNA, 19 nt, Homo sapiens
cagguguuguccuacauca

SEQ ID NO: 1370036 - RNA, 19 nt, Homo sapiens
uuccauccuuccagacuuu

SEQ ID NO: 1370037 - RNA, 19 nt, Homo sapiens
gcaaaccuggaguauccuu

SEQ ID NO: 1370038 - RNA, 19 nt, Homo sapiens
cacuccagcucccuguauu

SEQ ID NO: 1370039 - RNA, 19 nt, Homo sapiens
ccacuccagcucccuguau

SEQ ID NO: 1370040 - RNA, 19 nt, Homo sapiens
ucugcaaggcccacaauga

SEQ ID NO: 1370041 - RNA, 19 nt, Homo sapiens
ccgugaaugugcaagacaa

SEQ ID NO: 1370042 - RNA, 19 nt, Homo sapiens
gccagccaaugauaucaag

SEQ ID NO: 1370043 - RNA, 19 nt, Homo sapiens
caagacaaacaaggcaaau

SEQ ID NO: 1370044 - RNA, 19 nt, Homo sapiens
ugaaugugcaagacaaaca

SEQ ID NO: 1370045 - RNA, 19 nt, Homo sapiens
acacuccugacccuuagua

SEQ ID NO: 1370046 - RNA, 19 nt, Homo sapiens
cagccaaugauaucaagga

SEQ ID NO: 1370047 - RNA, 19 nt, Homo sapiens
cagggagggccaugauuuc

SEQ ID NO: 1370048 - RNA, 19 nt, Homo sapiens
ccacucauuggcuaaagga

SEQ ID NO: 1370049 - RNA, 19 nt, Homo sapiens
uuaagccucaccaaccuuu

SEQ ID NO: 1370050 - RNA, 19 nt, Homo sapiens
uuugugaugugguucuuca

SEQ ID NO: 1370051 - RNA, 19 nt, Homo sapiens
agaaggagaagaggaagug

SEQ ID NO: 1370052 - RNA, 19 nt, Homo sapiens
agacugcccacgacagaug

SEQ ID NO: 1370053 - RNA, 19 nt, Homo sapiens
ucaaggaggaugccauugc

SEQ ID NO: 1370054 - RNA, 19 nt, Homo sapiens
caagcaaaccuggaguauc

SEQ ID NO: 1370055 - RNA, 19 nt, Homo sapiens
ggaggaggacgaauaaauu

SEQ ID NO: 1370056 - RNA, 19 nt, Homo sapiens
uuacgaagcucagaaucua

SEQ ID NO: 1370057 - RNA, 19 nt, Homo sapiens
gaggaggacgaauaaauuu

SEQ ID NO: 1370058 - RNA, 19 nt, Homo sapiens
uggcuuagcuugccugaga

SEQ ID NO: 1370059 - RNA, 19 nt, Homo sapiens
gcagaccagucguuucuag

SEQ ID NO: 1370060 - RNA, 19 nt, Homo sapiens
caggucaacuuccggaaug

SEQ ID NO: 1370061 - RNA, 19 nt, Homo sapiens
aaaggcugcuccucccuaa

SEQ ID NO: 1370062 - RNA, 19 nt, Homo sapiens
cccuaaagcugaccugguu

SEQ ID NO: 1370063 - RNA, 19 nt, Homo sapiens
ggcuuucugugcccaauuu

SEQ ID NO: 1370064 - RNA, 19 nt, Homo sapiens
gcugggacguuuuaaaauu

SEQ ID NO: 1370065 - RNA, 19 nt, Homo sapiens
gcgcucuguuggugaaauu

SEQ ID NO: 1370066 - RNA, 19 nt, Homo sapiens
ugugaaagccgucaaguuc

SEQ ID NO: 1370067 - RNA, 19 nt, Homo sapiens
uauggcagcugggacguuu

SEQ ID NO: 1370068 - RNA, 19 nt, Homo sapiens
gcugaugguccaacagauu

SEQ ID NO: 1370069 - RNA, 19 nt, Homo sapiens
gggccuauccauuccauug

SEQ ID NO: 1370070 - RNA, 19 nt, Homo sapiens
ugaccugguuggaucaaau

SEQ ID NO: 1370071 - RNA, 19 nt, Homo sapiens
caacuuccggaaugugaaa

SEQ ID NO: 1370072 - RNA, 19 nt, Homo sapiens
ggaaggggccuauccauuc

SEQ ID NO: 1370073 - RNA, 19 nt, Homo sapiens
ccaggcaucaaguggcuua

SEQ ID NO: 1370074 - RNA, 19 nt, Homo sapiens
ggccggaaaccuccagaaa

SEQ ID NO: 1370075 - RNA, 19 nt, Homo sapiens
acacucuccuucagggaaa

SEQ ID NO: 1370076 - RNA, 19 nt, Homo sapiens
ucgcucaggugcauaugga

SEQ ID NO: 1370077 - RNA, 19 nt, Homo sapiens
ccggaaaccuccagaaaau

SEQ ID NO: 1370078 - RNA, 19 nt, Homo sapiens
ggcuuccucugcuugguuu

SEQ ID NO: 1370079 - RNA, 19 nt, Homo sapiens
gaccugcugcugaugaaga

SEQ ID NO: 1370080 - RNA, 19 nt, Homo sapiens
aggaggacgaauaaauuua

SEQ ID NO: 1370081 - RNA, 19 nt, Homo sapiens
uagcuugccugagauugug

SEQ ID NO: 1370082 - RNA, 19 nt, Homo sapiens
ggagcauccucucuuuuga

SEQ ID NO: 1370083 - RNA, 19 nt, Homo sapiens
uagaacacuuccaggucaa

SEQ ID NO: 1370084 - RNA, 19 nt, Homo sapiens
ccuuggaaauggccggaaa

SEQ ID NO: 1370085 - RNA, 19 nt, Homo sapiens
uggaggaggacgaauaaau

SEQ ID NO: 1370086 - RNA, 19 nt, Homo sapiens
cucagaaucuagaacacuu

SEQ ID NO: 1370087 - RNA, 19 nt, Homo sapiens
agaccagucguuucuagaa

SEQ ID NO: 1370088 - RNA, 19 nt, Homo sapiens
uuggauaccuuggaaaugg

SEQ ID NO: 1370089 - RNA, 19 nt, Homo sapiens
gccuauccauuccauugug

SEQ ID NO: 1370090 - RNA, 19 nt, Homo sapiens
agauugaccugcguuacga

SEQ ID NO: 1370091 - RNA, 19 nt, Homo sapiens
caaagcauacgccaacacu

SEQ ID NO: 1370092 - RNA, 19 nt, Homo sapiens
uguggaggaggacgaauaa

SEQ ID NO: 1370093 - RNA, 19 nt, Homo sapiens
ccagggacacucuccuuca

SEQ ID NO: 1370094 - RNA, 19 nt, Homo sapiens
cugagauuguggaggaauu

SEQ ID NO: 1370095 - RNA, 19 nt, Homo sapiens
gacagcguccagagacuug

SEQ ID NO: 1370096 - RNA, 19 nt, Homo sapiens
ggcccaaccuacaucaaac

SEQ ID NO: 1370097 - RNA, 19 nt, Homo sapiens
gaaugugaaagccgucaag

SEQ ID NO: 1370098 - RNA, 19 nt, Homo sapiens
cagcugggacguuuuaaaa

SEQ ID NO: 1370099 - RNA, 19 nt, Homo sapiens
agaagcugaugguccaaca

SEQ ID NO: 1370100 - RNA, 19 nt, Homo sapiens
ugagauuguggaggaauuu

SEQ ID NO: 1370101 - RNA, 19 nt, Homo sapiens
ggcaucaaguggcuuagcu

SEQ ID NO: 1370102 - RNA, 19 nt, Homo sapiens
gaccugguuggaucaaaug

SEQ ID NO: 1370103 - RNA, 19 nt, Homo sapiens
gcccagguguacaaagcau

SEQ ID NO: 1370104 - RNA, 19 nt, Homo sapiens
gagcucagacagggacuca

SEQ ID NO: 1370105 - RNA, 19 nt, Homo sapiens
guuacgaagcucagaaucu

SEQ ID NO: 1370106 - RNA, 19 nt, Homo sapiens
ggaauuugagaagcugaug

SEQ ID NO: 1370107 - RNA, 19 nt, Homo sapiens
gaacagaacugcauuugaa

SEQ ID NO: 1370108 - RNA, 19 nt, Homo sapiens
gaauuaaguucaccugaua

SEQ ID NO: 1370109 - RNA, 19 nt, Homo sapiens
gaacagcugugucuaagaa

SEQ ID NO: 1370110 - RNA, 19 nt, Homo sapiens
caagaacgauggauaugua

SEQ ID NO: 1370111 - RNA, 19 nt, Homo sapiens
uaaaggagcuucguuguga

SEQ ID NO: 1370112 - RNA, 19 nt, Homo sapiens
gaagaguucugcaggaaau

SEQ ID NO: 1370113 - RNA, 19 nt, Homo sapiens
agaagaagcuaaccagaaa

SEQ ID NO: 1370114 - RNA, 19 nt, Homo sapiens
gcaaagggauggaaagucu

SEQ ID NO: 1370115 - RNA, 19 nt, Homo sapiens
gaacagcuacagucuaauu

SEQ ID NO: 1370116 - RNA, 19 nt, Homo sapiens
ggaaauggccagccucaaa

SEQ ID NO: 1370117 - RNA, 19 nt, Homo sapiens
ggucguacauuuccuguug

SEQ ID NO: 1370118 - RNA, 19 nt, Homo sapiens
gagaagaggcaaacucaaa

SEQ ID NO: 1370119 - RNA, 19 nt, Homo sapiens
aggaggagauggugucuua

SEQ ID NO: 1370120 - RNA, 19 nt, Homo sapiens
uauaagggauggcagcuaa

SEQ ID NO: 1370121 - RNA, 19 nt, Homo sapiens
gaagaaagagaaaccauuc

SEQ ID NO: 1370122 - RNA, 19 nt, Homo sapiens
gaacugcauuugaagaagu

SEQ ID NO: 1370123 - RNA, 19 nt, Homo sapiens
gcaggaguaacuaagauua

SEQ ID NO: 1370124 - RNA, 19 nt, Homo sapiens
gaagguagccaacaucauc

SEQ ID NO: 1370125 - RNA, 19 nt, Homo sapiens
ccacacaaauuccgcaguu

SEQ ID NO: 1370126 - RNA, 19 nt, Homo sapiens
uaaauaauccugccuguca

SEQ ID NO: 1370127 - RNA, 19 nt, Homo sapiens
gagauaugaugccagcaaa

SEQ ID NO: 1370128 - RNA, 19 nt, Homo sapiens
caacagacguaguaaucga

SEQ ID NO: 1370129 - RNA, 19 nt, Homo sapiens
ggaucaggauucugucaaa

SEQ ID NO: 1370130 - RNA, 19 nt, Homo sapiens
gaaccucuaccucgaacua

SEQ ID NO: 1370131 - RNA, 19 nt, Homo sapiens
caauugcugugacaaggua

SEQ ID NO: 1370132 - RNA, 19 nt, Homo sapiens
uagcucaccugggaaauaa

SEQ ID NO: 1370133 - RNA, 19 nt, Homo sapiens
gaacuguugucggauauag

SEQ ID NO: 1370134 - RNA, 19 nt, Homo sapiens
gauggcagcuaaguacaaa

SEQ ID NO: 1370135 - RNA, 19 nt, Homo sapiens
ggaagaaagagaaaccauu

SEQ ID NO: 1370136 - RNA, 19 nt, Homo sapiens
aaagcuaugugaaccuuaa

SEQ ID NO: 1370137 - RNA, 19 nt, Homo sapiens
gaugauguugucuauguua

SEQ ID NO: 1370138 - RNA, 19 nt, Homo sapiens
ccacuucauucaucuuuau

SEQ ID NO: 1370139 - RNA, 19 nt, Homo sapiens
ggccaggucuucaaguuau

SEQ ID NO: 1370140 - RNA, 19 nt, Homo sapiens
uauaccaggucguacauuu

SEQ ID NO: 1370141 - RNA, 19 nt, Homo sapiens
agauacagcucuacaagga

SEQ ID NO: 1370142 - RNA, 19 nt, Homo sapiens
cgacgaaucucugcaaucu

SEQ ID NO: 1370143 - RNA, 19 nt, Homo sapiens
gcaagcaguuccgaaugaa

SEQ ID NO: 1370144 - RNA, 19 nt, Homo sapiens
gcugugugcugcuuuguau

SEQ ID NO: 1370145 - RNA, 19 nt, Homo sapiens
cgaauacccaccacaagua

SEQ ID NO: 1370146 - RNA, 19 nt, Homo sapiens
acacaaauuccgcaguuua

SEQ ID NO: 1370147 - RNA, 19 nt, Homo sapiens
ucuaggaccagaauaaaua

SEQ ID NO: 1370148 - RNA, 19 nt, Homo sapiens
cagcugaguugaaguuugu

SEQ ID NO: 1370149 - RNA, 19 nt, Homo sapiens
gaggccaggucuucaaguu

SEQ ID NO: 1370150 - RNA, 19 nt, Homo sapiens
caaggaguuucccauauca

SEQ ID NO: 1370151 - RNA, 19 nt, Homo sapiens
gagaaugaaagcuauguga

SEQ ID NO: 1370152 - RNA, 19 nt, Homo sapiens
ggcaguguauauacccuua

SEQ ID NO: 1370153 - RNA, 19 nt, Homo sapiens
gagcuucguugugaacuug

SEQ ID NO: 1370154 - RNA, 19 nt, Homo sapiens
uggcugaacugguaaagga

SEQ ID NO: 1370155 - RNA, 19 nt, Homo sapiens
aaacaacagcuaccagaaa

SEQ ID NO: 1370156 - RNA, 19 nt, Homo sapiens
cuaaugcucuacaaaggaa

SEQ ID NO: 1370157 - RNA, 19 nt, Homo sapiens
guacauuuccuguugauca

SEQ ID NO: 1370158 - RNA, 19 nt, Homo sapiens
gaucagcuucuccaggaua

SEQ ID NO: 1370159 - RNA, 19 nt, Homo sapiens
augaacagcuacagucuaa

SEQ ID NO: 1370160 - RNA, 19 nt, Homo sapiens
ggaacagaacugcauuuga

SEQ ID NO: 1370161 - RNA, 19 nt, Homo sapiens
agaaggagauacagcucua

SEQ ID NO: 1370162 - RNA, 19 nt, Homo sapiens
gcagcauggugucugugua

SEQ ID NO: 1370163 - RNA, 19 nt, Homo sapiens
cagcugugucuaagaauua

SEQ ID NO: 1370164 - RNA, 19 nt, Homo sapiens
cagaucaacaguuagauuu

SEQ ID NO: 1370165 - RNA, 19 nt, Homo sapiens
gaaccugucguauauucuu

SEQ ID NO: 1370166 - RNA, 19 nt, Homo sapiens
ugaaguuugucaccaagaa

SEQ ID NO: 1370167 - RNA, 19 nt, Homo sapiens
gaaaagcccagaaggaaaa

SEQ ID NO: 1370168 - RNA, 19 nt, Homo sapiens
gaagaggcaaacucaaaug

SEQ ID NO: 1370169 - RNA, 19 nt, Homo sapiens
ggacaccuuuguaucucaa

SEQ ID NO: 1370170 - RNA, 19 nt, Homo sapiens
ucgaugauguugucuaugu

SEQ ID NO: 1370171 - RNA, 19 nt, Homo sapiens
gaggaagagucggaaauag

SEQ ID NO: 1370172 - RNA, 19 nt, Homo sapiens
cguaguaaucgauguguua

SEQ ID NO: 1370173 - RNA, 19 nt, Homo sapiens
ccaccagacuguuauacug

SEQ ID NO: 1370174 - RNA, 19 nt, Homo sapiens
ggaaauaacagcagaaccu

SEQ ID NO: 1370175 - RNA, 19 nt, Homo sapiens
caaauguagugcaggugaa

SEQ ID NO: 1370176 - RNA, 19 nt, Homo sapiens
caccauugcugccaguuug

SEQ ID NO: 1370177 - RNA, 19 nt, Homo sapiens
gagaauuggcaaacuaaug

SEQ ID NO: 1370178 - RNA, 19 nt, Homo sapiens
gagcauuaacuccagauga

SEQ ID NO: 1370179 - RNA, 19 nt, Homo sapiens
cuacaaggaguuucccaua

SEQ ID NO: 1370180 - RNA, 19 nt, Homo sapiens
gauaccagauucgguuaga

SEQ ID NO: 1370181 - RNA, 19 nt, Homo sapiens
ugaacgcguugcuaaagaa

SEQ ID NO: 1370182 - RNA, 19 nt, Homo sapiens
ugugagaauuggcaaacua

SEQ ID NO: 1370183 - RNA, 19 nt, Homo sapiens
gcugagacauccauaacca

SEQ ID NO: 1370184 - RNA, 19 nt, Homo sapiens
gaagaugcaauugcuguga

SEQ ID NO: 1370185 - RNA, 19 nt, Homo sapiens
acaaggaguuucccauauc

SEQ ID NO: 1370186 - RNA, 19 nt, Homo sapiens
ggaagagucggaaauaguc

SEQ ID NO: 1370187 - RNA, 19 nt, Homo sapiens
gaagagaaauacgccuuuu

SEQ ID NO: 1370188 - RNA, 19 nt, Homo sapiens
gcaaugcugugugcugcuu

SEQ ID NO: 1370189 - RNA, 19 nt, Homo sapiens
caaauuccgcaguuuauuc

SEQ ID NO: 1370190 - RNA, 19 nt, Homo sapiens
aaacccagcuugccugucu

SEQ ID NO: 1370191 - RNA, 19 nt, Homo sapiens
guuauucacccacuucauu

SEQ ID NO: 1370192 - RNA, 19 nt, Homo sapiens
uacaaggaguuucccauau

SEQ ID NO: 1370193 - RNA, 19 nt, Homo sapiens
cagcugaggcaguguauau

SEQ ID NO: 1370194 - RNA, 19 nt, Homo sapiens
uaacgaauacccaccacaa

SEQ ID NO: 1370195 - RNA, 19 nt, Homo sapiens
gauguuuagugcucauaau

SEQ ID NO: 1370196 - RNA, 19 nt, Homo sapiens
ucacuacaaucaccagcuu

SEQ ID NO: 1370197 - RNA, 19 nt, Homo sapiens
uugaagaaguggaagaaga

SEQ ID NO: 1370198 - RNA, 19 nt, Homo sapiens
ccauauaugcgguccauga

SEQ ID NO: 1370199 - RNA, 19 nt, Homo sapiens
gaaagcuaugugaaccuua

SEQ ID NO: 1370200 - RNA, 19 nt, Homo sapiens
guucuggagugaauuaagu

SEQ ID NO: 1370201 - RNA, 19 nt, Homo sapiens
gaaugugcagcuucaaaga

SEQ ID NO: 1370202 - RNA, 19 nt, Homo sapiens
ucaccaagaacgauggaua

SEQ ID NO: 1370203 - RNA, 19 nt, Homo sapiens
ggagauggugucuuagaug

SEQ ID NO: 1370204 - RNA, 19 nt, Homo sapiens
gaggagauggugucuuaga

SEQ ID NO: 1370205 - RNA, 19 nt, Homo sapiens
gagcaagggaaauugagaa

SEQ ID NO: 1370206 - RNA, 19 nt, Homo sapiens
ggaagaguucugcaggaaa

SEQ ID NO: 1370207 - RNA, 19 nt, Homo sapiens
gcaaauuccuuuacuguua

SEQ ID NO: 1370208 - RNA, 19 nt, Homo sapiens
ggucuuggcuuucuccuua

SEQ ID NO: 1370209 - RNA, 19 nt, Homo sapiens
ggugacggcuggugacuga

SEQ ID NO: 1370210 - RNA, 19 nt, Homo sapiens
cauguagggugcagucuuu

SEQ ID NO: 1370211 - RNA, 19 nt, Homo sapiens
agaaagcccuucccacuuc

SEQ ID NO: 1370212 - RNA, 19 nt, Homo sapiens
caagcucccuagccucuuu

SEQ ID NO: 1370213 - RNA, 19 nt, Homo sapiens
aaucaggcauggcauuaaa

SEQ ID NO: 1370214 - RNA, 19 nt, Homo sapiens
ugccagaacucaagggaaa

SEQ ID NO: 1370215 - RNA, 19 nt, Homo sapiens
gaacugcaggcgugagcua

SEQ ID NO: 1370216 - RNA, 19 nt, Homo sapiens
ugguggagaucuacaauga

SEQ ID NO: 1370217 - RNA, 19 nt, Homo sapiens
gaaagcccuucccacuuca

SEQ ID NO: 1370218 - RNA, 19 nt, Homo sapiens
ccacaggucuuggcuuucu

SEQ ID NO: 1370219 - RNA, 19 nt, Homo sapiens
aggaggaggucuucagaga

SEQ ID NO: 1370220 - RNA, 19 nt, Homo sapiens
ggacuaggaagggcuauuc

SEQ ID NO: 1370221 - RNA, 19 nt, Homo sapiens
ccagaacucaagggaaaua

SEQ ID NO: 1370222 - RNA, 19 nt, Homo sapiens
ggcgugagcuacagcagau

SEQ ID NO: 1370223 - RNA, 19 nt, Homo sapiens
aaacguugcaaauuccuuu

SEQ ID NO: 1370224 - RNA, 19 nt, Homo sapiens
ccaagugguuacccaaguc

SEQ ID NO: 1370225 - RNA, 19 nt, Homo sapiens
uggcagaggcgguaguaaa

SEQ ID NO: 1370226 - RNA, 19 nt, Homo sapiens
gggaggcccagaccauaaa

SEQ ID NO: 1370227 - RNA, 19 nt, Homo sapiens
gaacucaagggaaauaucc

SEQ ID NO: 1370228 - RNA, 19 nt, Homo sapiens
gccaagugguuacccaagu

SEQ ID NO: 1370229 - RNA, 19 nt, Homo sapiens
cagaggcgguaguaaaguc

SEQ ID NO: 1370230 - RNA, 19 nt, Homo sapiens
ugcccaaccuggagacauu

SEQ ID NO: 1370231 - RNA, 19 nt, Homo sapiens
cuucuagccuugugagugu

SEQ ID NO: 1370232 - RNA, 19 nt, Homo sapiens
gguuuggucagcaccuuua

SEQ ID NO: 1370233 - RNA, 19 nt, Homo sapiens
ggagaacgaggcccugaag

SEQ ID NO: 1370234 - RNA, 19 nt, Homo sapiens
uaucaccauuugcuguuau

SEQ ID NO: 1370235 - RNA, 19 nt, Homo sapiens
ggagacauugcaccagaug

SEQ ID NO: 1370236 - RNA, 19 nt, Homo sapiens
ucagcaugguggagaucua

SEQ ID NO: 1370237 - RNA, 19 nt, Homo sapiens
cuacagcgucugcaucuuc

SEQ ID NO: 1370238 - RNA, 19 nt, Homo sapiens
ggaggcggaggcauugcua

SEQ ID NO: 1370239 - RNA, 19 nt, Homo sapiens
gagaagaggggacuaggaa

SEQ ID NO: 1370240 - RNA, 19 nt, Homo sapiens
ucaccacuccugacccaaa

SEQ ID NO: 1370241 - RNA, 19 nt, Homo sapiens
uuaucaccauuugcuguua

SEQ ID NO: 1370242 - RNA, 19 nt, Homo sapiens
gaaaaggguucagcaucug

SEQ ID NO: 1370243 - RNA, 19 nt, Homo sapiens
gguagugggcugagaagag

SEQ ID NO: 1370244 - RNA, 19 nt, Homo sapiens
ggacaucuucuagccuugu

SEQ ID NO: 1370245 - RNA, 19 nt, Homo sapiens
aaauauccgugugcugugu

SEQ ID NO: 1370246 - RNA, 19 nt, Homo sapiens
ccacaucccaagaagaaag

SEQ ID NO: 1370247 - RNA, 19 nt, Homo sapiens
gguaguaaagucccuguac

SEQ ID NO: 1370248 - RNA, 19 nt, Homo sapiens
aagaaagcccuucccacuu

SEQ ID NO: 1370249 - RNA, 19 nt, Homo sapiens
ggcagaggcgguaguaaag

SEQ ID NO: 1370250 - RNA, 19 nt, Homo sapiens
gcgucugcaucuucaccua

SEQ ID NO: 1370251 - RNA, 19 nt, Homo sapiens
gggcgacggacucagagaa

SEQ ID NO: 1370252 - RNA, 19 nt, Homo sapiens
gcucaucuacaucuucuac

SEQ ID NO: 1370253 - RNA, 19 nt, Homo sapiens
cuucuggcauggcuucgaa

SEQ ID NO: 1370254 - RNA, 19 nt, Homo sapiens
cgggaggcccagaccauaa

SEQ ID NO: 1370255 - RNA, 19 nt, Homo sapiens
ccaggaggaggucuucaga

SEQ ID NO: 1370256 - RNA, 19 nt, Homo sapiens
gcaccgucaccaccugcua

SEQ ID NO: 1370257 - RNA, 19 nt, Homo sapiens
acucguugcucaucuacau

SEQ ID NO: 1370258 - RNA, 19 nt, Homo sapiens
guugcaaauuccuuuacug

SEQ ID NO: 1370259 - RNA, 19 nt, Homo sapiens
ggcgacggacucagagaaa

SEQ ID NO: 1370260 - RNA, 19 nt, Homo sapiens
caucaggccacaggucuug

SEQ ID NO: 1370261 - RNA, 19 nt, Homo sapiens
gauccacaucccaagaaga

SEQ ID NO: 1370262 - RNA, 19 nt, Homo sapiens
ccaccaccaggaccaugua

SEQ ID NO: 1370263 - RNA, 19 nt, Homo sapiens
uagccucuuuggauccauu

SEQ ID NO: 1370264 - RNA, 19 nt, Homo sapiens
gcagaggcgguaguaaagu

SEQ ID NO: 1370265 - RNA, 19 nt, Homo sapiens
gacaucuucuagccuugug

SEQ ID NO: 1370266 - RNA, 19 nt, Homo sapiens
gauggguagugggcugaga

SEQ ID NO: 1370267 - RNA, 19 nt, Homo sapiens
gcaugguggagaucuacaa

SEQ ID NO: 1370268 - RNA, 19 nt, Homo sapiens
uacagcgucugcaucuuca

SEQ ID NO: 1370269 - RNA, 19 nt, Homo sapiens
ggccagggacaucuucuag

SEQ ID NO: 1370270 - RNA, 19 nt, Homo sapiens
ugagagagggcaggacuuc

SEQ ID NO: 1370271 - RNA, 19 nt, Homo sapiens
gcuaccuccuuuccagaca

SEQ ID NO: 1370272 - RNA, 19 nt, Homo sapiens
uuuacucccuaacccguuu

SEQ ID NO: 1370273 - RNA, 19 nt, Homo sapiens
uguugugccugcugaagug

SEQ ID NO: 1370274 - RNA, 19 nt, Homo sapiens
gcuggcagaggcgguagua

SEQ ID NO: 1370275 - RNA, 19 nt, Homo sapiens
agaaaaggguucagcaucu

SEQ ID NO: 1370276 - RNA, 19 nt, Homo sapiens
aaaucaggcauggcauuaa

SEQ ID NO: 1370277 - RNA, 19 nt, Homo sapiens
acagucugcucccucaagu

SEQ ID NO: 1370278 - RNA, 19 nt, Homo sapiens
ucaucuacaucuucuacag

SEQ ID NO: 1370279 - RNA, 19 nt, Homo sapiens
gcaucugacucuggagaac

SEQ ID NO: 1370280 - RNA, 19 nt, Homo sapiens
gaggaguucuugcucacua

SEQ ID NO: 1370281 - RNA, 19 nt, Homo sapiens
cgaccacucuguucucauu

SEQ ID NO: 1370282 - RNA, 19 nt, Homo sapiens
acaaugaacuguggaagaa

SEQ ID NO: 1370283 - RNA, 19 nt, Homo sapiens
guaagaagaaggaguaugu

SEQ ID NO: 1370284 - RNA, 19 nt, Homo sapiens
caggagagccgucguaaga

SEQ ID NO: 1370285 - RNA, 19 nt, Homo sapiens
ggagaaggccuugaagaga

SEQ ID NO: 1370286 - RNA, 19 nt, Homo sapiens
ccaaacugcucucuucauc

SEQ ID NO: 1370287 - RNA, 19 nt, Homo sapiens
ggagagccgucguaagaag

SEQ ID NO: 1370288 - RNA, 19 nt, Homo sapiens
gaaggaguauguggagugu

SEQ ID NO: 1370289 - RNA, 19 nt, Homo sapiens
gaagagaguccggaggaaa

SEQ ID NO: 1370290 - RNA, 19 nt, Homo sapiens
gggaccaccugcagcauga

SEQ ID NO: 1370291 - RNA, 19 nt, Homo sapiens
aaaagaagguggagacauu

SEQ ID NO: 1370292 - RNA, 19 nt, Homo sapiens
guacagagaccaagaacag

SEQ ID NO: 1370293 - RNA, 19 nt, Homo sapiens
gagaagcggacccugauug

SEQ ID NO: 1370294 - RNA, 19 nt, Homo sapiens
ggaggaaaaucaagaacaa

SEQ ID NO: 1370295 - RNA, 19 nt, Homo sapiens
ugacucagcugccagugau

SEQ ID NO: 1370296 - RNA, 19 nt, Homo sapiens
aacaagaucuccagaccuu

SEQ ID NO: 1370297 - RNA, 19 nt, Homo sapiens
cuccagaccuuacaagaug

SEQ ID NO: 1370298 - RNA, 19 nt, Homo sapiens
ccucaacaaugcgcacuuu

SEQ ID NO: 1370299 - RNA, 19 nt, Homo sapiens
uauguggagugucuagaaa

SEQ ID NO: 1370300 - RNA, 19 nt, Homo sapiens
gaggagaaggccuugaaga

SEQ ID NO: 1370301 - RNA, 19 nt, Homo sapiens
aaacugcucucuucaucag

SEQ ID NO: 1370302 - RNA, 19 nt, Homo sapiens
uuacaucugagaacaauga

SEQ ID NO: 1370303 - RNA, 19 nt, Homo sapiens
guggagacauuuacaucug

SEQ ID NO: 1370304 - RNA, 19 nt, Homo sapiens
ggccacugcuccugacaga

SEQ ID NO: 1370305 - RNA, 19 nt, Homo sapiens
cggaggaccuggugcagau

SEQ ID NO: 1370306 - RNA, 19 nt, Homo sapiens
ggacaccacccaagaugca

SEQ ID NO: 1370307 - RNA, 19 nt, Homo sapiens
cccgaagccuccuauucua

SEQ ID NO: 1370308 - RNA, 19 nt, Homo sapiens
cggagaacauggaggacuu

SEQ ID NO: 1370309 - RNA, 19 nt, Homo sapiens
gaggacaccacccaagaug

SEQ ID NO: 1370310 - RNA, 19 nt, Homo sapiens
gaaguuagugcgggcuuug

SEQ ID NO: 1370311 - RNA, 19 nt, Homo sapiens
gaagguggagacauuuaca

SEQ ID NO: 1370312 - RNA, 19 nt, Homo sapiens
uggagacauuuacaucuga

SEQ ID NO: 1370313 - RNA, 19 nt, Homo sapiens
gagcaccuggaccacuuua

SEQ ID NO: 1370314 - RNA, 19 nt, Homo sapiens
ccccuaagauauuguauuu

SEQ ID NO: 1370315 - RNA, 19 nt, Homo sapiens
caaacugugcuccaucaug

SEQ ID NO: 1370316 - RNA, 19 nt, Homo sapiens
ggaggacaccacccaagau

SEQ ID NO: 1370317 - RNA, 19 nt, Homo sapiens
gaagccuccuauucuacga

SEQ ID NO: 1370318 - RNA, 19 nt, Homo sapiens
guauguggagugucuagaa

SEQ ID NO: 1370319 - RNA, 19 nt, Homo sapiens
ggagaagcggacccugauu

SEQ ID NO: 1370320 - RNA, 19 nt, Homo sapiens
ccaccaaguaccugaguga

SEQ ID NO: 1370321 - RNA, 19 nt, Homo sapiens
ucagcagcuucuuugauga

SEQ ID NO: 1370322 - RNA, 19 nt, Homo sapiens
gguggcagccuugugcuuu

SEQ ID NO: 1370323 - RNA, 19 nt, Homo sapiens
aagaagguggagacauuua

SEQ ID NO: 1370324 - RNA, 19 nt, Homo sapiens
ugaagagaguccggaggaa

SEQ ID NO: 1370325 - RNA, 19 nt, Homo sapiens
uucagcagcuucuuugaug

SEQ ID NO: 1370326 - RNA, 19 nt, Homo sapiens
gaccaagaacagaaauugu

SEQ ID NO: 1370327 - RNA, 19 nt, Homo sapiens
uugccaaacugcucucuuc

SEQ ID NO: 1370328 - RNA, 19 nt, Homo sapiens
gagaccaagaacagaaauu

SEQ ID NO: 1370329 - RNA, 19 nt, Homo sapiens
ugaaguuagugcgggcuuu

SEQ ID NO: 1370330 - RNA, 19 nt, Homo sapiens
gccccucccuuguuuuaua

SEQ ID NO: 1370331 - RNA, 19 nt, Homo sapiens
acagagaccaagaacagaa

SEQ ID NO: 1370332 - RNA, 19 nt, Homo sapiens
caacaccaccaucaaacuc

SEQ ID NO: 1370333 - RNA, 19 nt, Homo sapiens
ugcagaaacuccagacucu

SEQ ID NO: 1370334 - RNA, 19 nt, Homo sapiens
gagagccgucguaagaaga

SEQ ID NO: 1370335 - RNA, 19 nt, Homo sapiens
agaccaagaacagaaauug

SEQ ID NO: 1370336 - RNA, 19 nt, Homo sapiens
ccugacauuuggacucuuc

SEQ ID NO: 1370337 - RNA, 19 nt, Homo sapiens
cccacgagaccaccaagua

SEQ ID NO: 1370338 - RNA, 19 nt, Homo sapiens
guggcagccuugugcuuug

SEQ ID NO: 1370339 - RNA, 19 nt, Homo sapiens
caagaucuccagaccuuac

SEQ ID NO: 1370340 - RNA, 19 nt, Homo sapiens
caugggcgcugggacacaa

SEQ ID NO: 1370341 - RNA, 19 nt, Homo sapiens
aaagaagguggagacauuu

SEQ ID NO: 1370342 - RNA, 19 nt, Homo sapiens
gucguaagaagaaggagua

SEQ ID NO: 1370343 - RNA, 19 nt, Homo sapiens
caaacugcucucuucauca

SEQ ID NO: 1370344 - RNA, 19 nt, Homo sapiens
cagagaccaagaacagaaa

SEQ ID NO: 1370345 - RNA, 19 nt, Homo sapiens
gcucccagacugugaagga

SEQ ID NO: 1370346 - RNA, 19 nt, Homo sapiens
gcagccuugugcuuuguuc

SEQ ID NO: 1370347 - RNA, 19 nt, Homo sapiens
ucaccaaagccgaggagaa

SEQ ID NO: 1370348 - RNA, 19 nt, Homo sapiens
ugagggaagcccaguggaa

SEQ ID NO: 1370349 - RNA, 19 nt, Homo sapiens
cccagacugugaaggaaga

SEQ ID NO: 1370350 - RNA, 19 nt, Homo sapiens
uggagacccuggagaaugc

SEQ ID NO: 1370351 - RNA, 19 nt, Homo sapiens
cugagcaccuggaccacuu

SEQ ID NO: 1370352 - RNA, 19 nt, Homo sapiens
caagacccaggacauagga

SEQ ID NO: 1370353 - RNA, 19 nt, Homo sapiens
cuacacggccagccagaug

SEQ ID NO: 1370354 - RNA, 19 nt, Homo sapiens
caccaaagccgaggagaag

SEQ ID NO: 1370355 - RNA, 19 nt, Homo sapiens
gcgcugggacacaaacugu

SEQ ID NO: 1370356 - RNA, 19 nt, Homo sapiens
caccuccucucucauaugc

SEQ ID NO: 1370357 - RNA, 19 nt, Homo sapiens
cauccguccuucucagaca

SEQ ID NO: 1370358 - RNA, 19 nt, Homo sapiens
gcaggcuuaugggaagaug

SEQ ID NO: 1370359 - RNA, 19 nt, Homo sapiens
guggagacccuggagaaug

SEQ ID NO: 1370360 - RNA, 19 nt, Homo sapiens
caucugagaacaaugaacu

SEQ ID NO: 1370361 - RNA, 19 nt, Homo sapiens
agaaggccuugaagagagu

SEQ ID NO: 1370362 - RNA, 19 nt, Homo sapiens
gccgaccacucuguucuca

SEQ ID NO: 1370363 - RNA, 19 nt, Homo sapiens
gggcaggcuuaugggaaga

SEQ ID NO: 1370364 - RNA, 19 nt, Homo sapiens
guucagcagcuucuuugau

SEQ ID NO: 1370365 - RNA, 19 nt, Homo sapiens
aggaguauguggagugucu

SEQ ID NO: 1370366 - RNA, 19 nt, Homo sapiens
ccgaggagaaggccuugaa

SEQ ID NO: 1370367 - RNA, 19 nt, Homo sapiens
ucacugccccucacaaauu

SEQ ID NO: 1370368 - RNA, 19 nt, Homo sapiens
gcacccaaacagacacauc

SEQ ID NO: 1370369 - RNA, 19 nt, Homo sapiens
aaccaguuccucaaaguga

SEQ ID NO: 1370370 - RNA, 19 nt, Homo sapiens
ccacgagaccaccaaguac

SEQ ID NO: 1370371 - RNA, 19 nt, Homo sapiens
acauuuacaucugagaaca

SEQ ID NO: 1370372 - RNA, 19 nt, Homo sapiens
gaaaaucaagaacaagauc

SEQ ID NO: 1370373 - RNA, 19 nt, Homo sapiens
gccaauccccuaagauauu

SEQ ID NO: 1370374 - RNA, 19 nt, Homo sapiens
aggaguucuugcucacuaa

SEQ ID NO: 1370375 - RNA, 19 nt, Homo sapiens
ugccaagacccaggacaua

SEQ ID NO: 1370376 - RNA, 19 nt, Homo sapiens
acccugugcuggaugagaa

SEQ ID NO: 1370377 - RNA, 19 nt, Homo sapiens
gccaagacccaggacauag

SEQ ID NO: 1370378 - RNA, 19 nt, Homo sapiens
agacauuuacaucugagaa

SEQ ID NO: 1370379 - RNA, 19 nt, Homo sapiens
caacaaugcgcacuuuccu

SEQ ID NO: 1370380 - RNA, 19 nt, Homo sapiens
caaagcagcuggauuggaa

SEQ ID NO: 1370381 - RNA, 19 nt, Homo sapiens
gaaagcauguggagauuca

SEQ ID NO: 1370382 - RNA, 19 nt, Homo sapiens
gacaguagcuccagcaaug

SEQ ID NO: 1370383 - RNA, 19 nt, Homo sapiens
caaguucagucccacauuu

SEQ ID NO: 1370384 - RNA, 19 nt, Homo sapiens
gaaguuguauagaaacaga

SEQ ID NO: 1370385 - RNA, 19 nt, Homo sapiens
gccaauacccugcucuuua

SEQ ID NO: 1370386 - RNA, 19 nt, Homo sapiens
gaaaagguguucauaucua

SEQ ID NO: 1370387 - RNA, 19 nt, Homo sapiens
gcaaggcacugaggaguau

SEQ ID NO: 1370388 - RNA, 19 nt, Homo sapiens
ccacauuucuguacuguuc

SEQ ID NO: 1370389 - RNA, 19 nt, Homo sapiens
uaucuacucuucugugauu

SEQ ID NO: 1370390 - RNA, 19 nt, Homo sapiens
cagcacacauggacuugua

SEQ ID NO: 1370391 - RNA, 19 nt, Homo sapiens
ggaauuggccuucuauugg

SEQ ID NO: 1370392 - RNA, 19 nt, Homo sapiens
gaauggagcagccaaguuc

SEQ ID NO: 1370393 - RNA, 19 nt, Homo sapiens
gaugugcguuugugcauau

SEQ ID NO: 1370394 - RNA, 19 nt, Homo sapiens
ccaauuaugccaaguauca

SEQ ID NO: 1370395 - RNA, 19 nt, Homo sapiens
gaauuggccuucuauuggu

SEQ ID NO: 1370396 - RNA, 19 nt, Homo sapiens
uuucacagcuggaauaugu

SEQ ID NO: 1370397 - RNA, 19 nt, Homo sapiens
gaacucugaucaugugucu

SEQ ID NO: 1370398 - RNA, 19 nt, Homo sapiens
ccaauacccugcucuuuac

SEQ ID NO: 1370399 - RNA, 19 nt, Homo sapiens
cgacagugcuggcauaacu

SEQ ID NO: 1370400 - RNA, 19 nt, Homo sapiens
caccuuaguuccacauuug

SEQ ID NO: 1370401 - RNA, 19 nt, Homo sapiens
uggcauaacuauccauuuc

SEQ ID NO: 1370402 - RNA, 19 nt, Homo sapiens
agaguaaggugguugcuau

SEQ ID NO: 1370403 - RNA, 19 nt, Homo sapiens
ggucuuauacuauuguuug

SEQ ID NO: 1370404 - RNA, 19 nt, Homo sapiens
caucugguccuaccuaauu

SEQ ID NO: 1370405 - RNA, 19 nt, Homo sapiens
gcacugaggaguaucaaag

SEQ ID NO: 1370406 - RNA, 19 nt, Homo sapiens
gaaggaugaucgcagugau

SEQ ID NO: 1370407 - RNA, 19 nt, Homo sapiens
ccauugggcuuaucuccuu

SEQ ID NO: 1370408 - RNA, 19 nt, Homo sapiens
ccaccuuaguuccacauuu

SEQ ID NO: 1370409 - RNA, 19 nt, Homo sapiens
gaaagguaucgaaggauga

SEQ ID NO: 1370410 - RNA, 19 nt, Homo sapiens
acauuuggcugcaucuuga

SEQ ID NO: 1370411 - RNA, 19 nt, Homo sapiens
cauaucuacucuucuguga

SEQ ID NO: 1370412 - RNA, 19 nt, Homo sapiens
caugguggcuccucaaugg

SEQ ID NO: 1370413 - RNA, 19 nt, Homo sapiens
gaacacgacccucuuugag

SEQ ID NO: 1370414 - RNA, 19 nt, Homo sapiens
ucuccuacaucaacaauau

SEQ ID NO: 1370415 - RNA, 19 nt, Homo sapiens
ugucaaagcagcuggauug

SEQ ID NO: 1370416 - RNA, 19 nt, Homo sapiens
gacuaggaaucuauccauu

SEQ ID NO: 1370417 - RNA, 19 nt, Homo sapiens
ggccaauuaugccaaguau

SEQ ID NO: 1370418 - RNA, 19 nt, Homo sapiens
gugaaagcauguggagauu

SEQ ID NO: 1370419 - RNA, 19 nt, Homo sapiens
ccacugaacccaccuuagu

SEQ ID NO: 1370420 - RNA, 19 nt, Homo sapiens
ccucuuggcccuucccaua

SEQ ID NO: 1370421 - RNA, 19 nt, Homo sapiens
gcauaacuauccauuucag

SEQ ID NO: 1370422 - RNA, 19 nt, Homo sapiens
gggagauaaucgggccuua

SEQ ID NO: 1370423 - RNA, 19 nt, Homo sapiens
ggacuuccugaucauguuu

SEQ ID NO: 1370424 - RNA, 19 nt, Homo sapiens
ccccaacgcuuacuaaauu

SEQ ID NO: 1370425 - RNA, 19 nt, Homo sapiens
guaauguuauuugcucugu

SEQ ID NO: 1370426 - RNA, 19 nt, Homo sapiens
guaaggugguugcuauagg

SEQ ID NO: 1370427 - RNA, 19 nt, Homo sapiens
uguauauucugcuauggaa

SEQ ID NO: 1370428 - RNA, 19 nt, Homo sapiens
ccuccagguucuuucagua

SEQ ID NO: 1370429 - RNA, 19 nt, Homo sapiens
gcucagaggaagaagaugu

SEQ ID NO: 1370430 - RNA, 19 nt, Homo sapiens
cuaccuaauugcacggauu

SEQ ID NO: 1370431 - RNA, 19 nt, Homo sapiens
gcccuuggcucuugacacu

SEQ ID NO: 1370432 - RNA, 19 nt, Homo sapiens
ggcugcaucuugaauuaug

SEQ ID NO: 1370433 - RNA, 19 nt, Homo sapiens
uuggcugcaucuugaauua

SEQ ID NO: 1370434 - RNA, 19 nt, Homo sapiens
cuauuggucccuuauguuu

SEQ ID NO: 1370435 - RNA, 19 nt, Homo sapiens
ucauggaauuggccuucua

SEQ ID NO: 1370436 - RNA, 19 nt, Homo sapiens
caaacccugugcacucugu

SEQ ID NO: 1370437 - RNA, 19 nt, Homo sapiens
ucacggucuuauacuauug

SEQ ID NO: 1370438 - RNA, 19 nt, Homo sapiens
ggauggauggccaggauug

SEQ ID NO: 1370439 - RNA, 19 nt, Homo sapiens
gaguaaggugguugcuaua

SEQ ID NO: 1370440 - RNA, 19 nt, Homo sapiens
ccagguucuuucaguaaug

SEQ ID NO: 1370441 - RNA, 19 nt, Homo sapiens
uaauugcacggauugcuuu

SEQ ID NO: 1370442 - RNA, 19 nt, Homo sapiens
ccaaugccauccuugaaaa

SEQ ID NO: 1370443 - RNA, 19 nt, Homo sapiens
aaucgggccuuaugcuuca

SEQ ID NO: 1370444 - RNA, 19 nt, Homo sapiens
uuugagaguugggagauaa

SEQ ID NO: 1370445 - RNA, 19 nt, Homo sapiens
ugaacacgacccucuuuga

SEQ ID NO: 1370446 - RNA, 19 nt, Homo sapiens
gucacaugaugaaguugua

SEQ ID NO: 1370447 - RNA, 19 nt, Homo sapiens
guacuguuccucuuucaca

SEQ ID NO: 1370448 - RNA, 19 nt, Homo sapiens
guuauuugcucuguguguu

SEQ ID NO: 1370449 - RNA, 19 nt, Homo sapiens
ugggaacucugaucaugug

SEQ ID NO: 1370450 - RNA, 19 nt, Homo sapiens
gcuauggaauuagauuucu

SEQ ID NO: 1370451 - RNA, 19 nt, Homo sapiens
uuaauagccuccagguucu

SEQ ID NO: 1370452 - RNA, 19 nt, Homo sapiens
ggacuucagcacacaugga

SEQ ID NO: 1370453 - RNA, 19 nt, Homo sapiens
ggauuggaauguccgaaaa

SEQ ID NO: 1370454 - RNA, 19 nt, Homo sapiens
cuacaucaacaauaugguu

SEQ ID NO: 1370455 - RNA, 19 nt, Homo sapiens
cgagcgauuuauugccaaa

SEQ ID NO: 1370456 - RNA, 19 nt, Homo sapiens
uggaauuggccuucuauug

SEQ ID NO: 1370457 - RNA, 19 nt, Homo sapiens
ggagggagcaugggaagag

SEQ ID NO: 1370458 - RNA, 19 nt, Homo sapiens
gcauaugcgugaguuucau

SEQ ID NO: 1370459 - RNA, 19 nt, Homo sapiens
aauguuauuugcucugugu

SEQ ID NO: 1370460 - RNA, 19 nt, Homo sapiens
cccuacagcuucugcaugu

SEQ ID NO: 1370461 - RNA, 19 nt, Homo sapiens
uuacacgacuaggaaucua

SEQ ID NO: 1370462 - RNA, 19 nt, Homo sapiens
gcagcuggauuggaauguc

SEQ ID NO: 1370463 - RNA, 19 nt, Homo sapiens
ugaugugcguuugugcaua

SEQ ID NO: 1370464 - RNA, 19 nt, Homo sapiens
gcacauccucucgguguuc

SEQ ID NO: 1370465 - RNA, 19 nt, Homo sapiens
guucacggucuuauacuau

SEQ ID NO: 1370466 - RNA, 19 nt, Homo sapiens
gccaaacccugugcacucu

SEQ ID NO: 1370467 - RNA, 19 nt, Homo sapiens
ggggaaagguaucgaagga

SEQ ID NO: 1370468 - RNA, 19 nt, Homo sapiens
uugcacggauugcuuugaa

SEQ ID NO: 1370469 - RNA, 19 nt, Homo sapiens
gguucuuucaguaauguua

SEQ ID NO: 1370470 - RNA, 19 nt, Homo sapiens
ucccauaucuacucuucug

SEQ ID NO: 1370471 - RNA, 19 nt, Homo sapiens
gcugaagaguaaggugguu

SEQ ID NO: 1370472 - RNA, 19 nt, Homo sapiens
cgaaggaugaucgcaguga

SEQ ID NO: 1370473 - RNA, 19 nt, Homo sapiens
uguucacggucuuauacua

SEQ ID NO: 1370474 - RNA, 19 nt, Homo sapiens
uggagggccugucaaagca

SEQ ID NO: 1370475 - RNA, 19 nt, Homo sapiens
gaguaucaaagaagcaaau

SEQ ID NO: 1370476 - RNA, 19 nt, Homo sapiens
acugaggaguaucaaagaa

SEQ ID NO: 1370477 - RNA, 19 nt, Homo sapiens
gggcuuuaucacuauuaua

SEQ ID NO: 1370478 - RNA, 19 nt, Homo sapiens
cacaugaugaaguuguaua

SEQ ID NO: 1370479 - RNA, 19 nt, Homo sapiens
gucaucugguccuaccuaa

SEQ ID NO: 1370480 - RNA, 19 nt, Homo sapiens
ggaagaaguagacacauua

SEQ ID NO: 1370481 - RNA, 19 nt, Homo sapiens
caaaccaccucuacauauu

SEQ ID NO: 1370482 - RNA, 19 nt, Homo sapiens
uggagaagcugcccaauga

SEQ ID NO: 1370483 - RNA, 19 nt, Homo sapiens
gaaacucugucucaaaaua

SEQ ID NO: 1370484 - RNA, 19 nt, Homo sapiens
gaauuuaagugccccauua

SEQ ID NO: 1370485 - RNA, 19 nt, Homo sapiens
gaggucagcugagcgguua

SEQ ID NO: 1370486 - RNA, 19 nt, Homo sapiens
guagacacauuaaacgauu

SEQ ID NO: 1370487 - RNA, 19 nt, Homo sapiens
gagccaagaucgcaccauu

SEQ ID NO: 1370488 - RNA, 19 nt, Homo sapiens
ccaagaagguccggaaaga

SEQ ID NO: 1370489 - RNA, 19 nt, Homo sapiens
gaagaaguagacacauuaa

SEQ ID NO: 1370490 - RNA, 19 nt, Homo sapiens
ucccauagcugcuccauga

SEQ ID NO: 1370491 - RNA, 19 nt, Homo sapiens
ugaaaccgcuggaaaucaa

SEQ ID NO: 1370492 - RNA, 19 nt, Homo sapiens
ucaaaggcaucaaguacuu

SEQ ID NO: 1370493 - RNA, 19 nt, Homo sapiens
cuccagagaucuuccauuu

SEQ ID NO: 1370494 - RNA, 19 nt, Homo sapiens
ccaccaagguuuauccaau

SEQ ID NO: 1370495 - RNA, 19 nt, Homo sapiens
gagcgaaacucugucucaa

SEQ ID NO: 1370496 - RNA, 19 nt, Homo sapiens
gagcccaaccgcuugcuua

SEQ ID NO: 1370497 - RNA, 19 nt, Homo sapiens
gaggcucucuggacccuuu

SEQ ID NO: 1370498 - RNA, 19 nt, Homo sapiens
ccaccguccucuuuguaua

SEQ ID NO: 1370499 - RNA, 19 nt, Homo sapiens
gaacaaccagcacggcuau

SEQ ID NO: 1370500 - RNA, 19 nt, Homo sapiens
aaaggaagacggacucgua

SEQ ID NO: 1370501 - RNA, 19 nt, Homo sapiens
acucugagauucccaagaa

SEQ ID NO: 1370502 - RNA, 19 nt, Homo sapiens
aaaccaccucuacauauua

SEQ ID NO: 1370503 - RNA, 19 nt, Homo sapiens
gugccuaaaucuagacuug

SEQ ID NO: 1370504 - RNA, 19 nt, Homo sapiens
gcgaaacucugucucaaaa

SEQ ID NO: 1370505 - RNA, 19 nt, Homo sapiens
uggaagaaguagacacauu

SEQ ID NO: 1370506 - RNA, 19 nt, Homo sapiens
ccagagaucuuccauuucc

SEQ ID NO: 1370507 - RNA, 19 nt, Homo sapiens
caacuugauguuuguguuu

SEQ ID NO: 1370508 - RNA, 19 nt, Homo sapiens
gaaacaaaccaccucuaca

SEQ ID NO: 1370509 - RNA, 19 nt, Homo sapiens
caaagucaccgccguuuua

SEQ ID NO: 1370510 - RNA, 19 nt, Homo sapiens
aaacaaaccaccucuacau

SEQ ID NO: 1370511 - RNA, 19 nt, Homo sapiens
aggugcagcuggugaauaa

SEQ ID NO: 1370512 - RNA, 19 nt, Homo sapiens
caccaagguuuauccaaug

SEQ ID NO: 1370513 - RNA, 19 nt, Homo sapiens
uggcugaguuccagacuga

SEQ ID NO: 1370514 - RNA, 19 nt, Homo sapiens
ggacgucccugagaacaac

SEQ ID NO: 1370515 - RNA, 19 nt, Homo sapiens
ccacaucacagcacaagug

SEQ ID NO: 1370516 - RNA, 19 nt, Homo sapiens
ucacguugcugcacuuucu

SEQ ID NO: 1370517 - RNA, 19 nt, Homo sapiens
gagaacaccggaaguugga

SEQ ID NO: 1370518 - RNA, 19 nt, Homo sapiens
gcaggagaaucgcuugaac

SEQ ID NO: 1370519 - RNA, 19 nt, Homo sapiens
gaaaccccgucucuacuaa

SEQ ID NO: 1370520 - RNA, 19 nt, Homo sapiens
gccagaacuucgacauguu

SEQ ID NO: 1370521 - RNA, 19 nt, Homo sapiens
caaguacucgggccucauu

SEQ ID NO: 1370522 - RNA, 19 nt, Homo sapiens
acaaaccaccucuacauau

SEQ ID NO: 1370523 - RNA, 19 nt, Homo sapiens
ccaacuugauguuuguguu

SEQ ID NO: 1370524 - RNA, 19 nt, Homo sapiens
ggaauguccagccguaugu

SEQ ID NO: 1370525 - RNA, 19 nt, Homo sapiens
gaaguagacacauuaaacg

SEQ ID NO: 1370526 - RNA, 19 nt, Homo sapiens
ccaccucaggguuauauuu

SEQ ID NO: 1370527 - RNA, 19 nt, Homo sapiens
cuuaccagcuccagaucua

SEQ ID NO: 1370528 - RNA, 19 nt, Homo sapiens
gacccgggauggcaaauac

SEQ ID NO: 1370529 - RNA, 19 nt, Homo sapiens
gcagcaagaaucccaagau

SEQ ID NO: 1370530 - RNA, 19 nt, Homo sapiens
gggaagaugaauuuaagug

SEQ ID NO: 1370531 - RNA, 19 nt, Homo sapiens
caacgagagacacaguauu

SEQ ID NO: 1370532 - RNA, 19 nt, Homo sapiens
gagccgaguugccauccau

SEQ ID NO: 1370533 - RNA, 19 nt, Homo sapiens
acacugagcgcuacaugga

SEQ ID NO: 1370534 - RNA, 19 nt, Homo sapiens
gcucggaugugcggcucua

SEQ ID NO: 1370535 - RNA, 19 nt, Homo sapiens
gaaacgcaccgaacuucca

SEQ ID NO: 1370536 - RNA, 19 nt, Homo sapiens
uccaagaucugggucaaug

SEQ ID NO: 1370537 - RNA, 19 nt, Homo sapiens
aacaaaccaccucuacaua

SEQ ID NO: 1370538 - RNA, 19 nt, Homo sapiens
ggacccgggauggcaaaua

SEQ ID NO: 1370539 - RNA, 19 nt, Homo sapiens
cuucugggcuagcaugaug

SEQ ID NO: 1370540 - RNA, 19 nt, Homo sapiens
ggaagacggacucguaucg

SEQ ID NO: 1370541 - RNA, 19 nt, Homo sapiens
gcaagaacggcuucauggu

SEQ ID NO: 1370542 - RNA, 19 nt, Homo sapiens
gcagaugcuggaucauuuc

SEQ ID NO: 1370543 - RNA, 19 nt, Homo sapiens
aaccaccucuacauauuau

SEQ ID NO: 1370544 - RNA, 19 nt, Homo sapiens
acauggacgucccugagaa

SEQ ID NO: 1370545 - RNA, 19 nt, Homo sapiens
caucaccuccuacgacuuc

SEQ ID NO: 1370546 - RNA, 19 nt, Homo sapiens
ccauauggcagccgagaga

SEQ ID NO: 1370547 - RNA, 19 nt, Homo sapiens
gcuccaagaucugggucaa

SEQ ID NO: 1370548 - RNA, 19 nt, Homo sapiens
cauuaaacgauuccaguug

SEQ ID NO: 1370549 - RNA, 19 nt, Homo sapiens
agaaguagacacauuaaac

SEQ ID NO: 1370550 - RNA, 19 nt, Homo sapiens
cugguaggcuccauuucuu

SEQ ID NO: 1370551 - RNA, 19 nt, Homo sapiens
ccaacgagagacacaguau

SEQ ID NO: 1370552 - RNA, 19 nt, Homo sapiens
ggacgaaaacgugcacuuu

SEQ ID NO: 1370553 - RNA, 19 nt, Homo sapiens
ggaaaccccgucucuacua

SEQ ID NO: 1370554 - RNA, 19 nt, Homo sapiens
aagaccggcuucugccauu

SEQ ID NO: 1370555 - RNA, 19 nt, Homo sapiens
ccuaugaaaccgcuggaaa

SEQ ID NO: 1370556 - RNA, 19 nt, Homo sapiens
cgguuaaugcggaagguua

SEQ ID NO: 1370557 - RNA, 19 nt, Homo sapiens
ggagaggccagaagagacu

SEQ ID NO: 1370558 - RNA, 19 nt, Homo sapiens
guucguggccgagaaguau

SEQ ID NO: 1370559 - RNA, 19 nt, Homo sapiens
gagccagaacuucgacaug

SEQ ID NO: 1370560 - RNA, 19 nt, Homo sapiens
caacgucuggaucaauguu

SEQ ID NO: 1370561 - RNA, 19 nt, Homo sapiens
cgucauacaggaagaguuc

SEQ ID NO: 1370562 - RNA, 19 nt, Homo sapiens
gcacccaagcaugcaauug

SEQ ID NO: 1370563 - RNA, 19 nt, Homo sapiens
gugcggcucuacggcauga

SEQ ID NO: 1370564 - RNA, 19 nt, Homo sapiens
ucaccaacgucuggaucaa

SEQ ID NO: 1370565 - RNA, 19 nt, Homo sapiens
cuaugaaaccgcuggaaau

SEQ ID NO: 1370566 - RNA, 19 nt, Homo sapiens
gaagcuucucgcugaauuc

SEQ ID NO: 1370567 - RNA, 19 nt, Homo sapiens
gcaccugguaggcuccauu

SEQ ID NO: 1370568 - RNA, 19 nt, Homo sapiens
agaacucccuccucuacuc

SEQ ID NO: 1370569 - RNA, 19 nt, Homo sapiens
gaaagcaaggggugccuaa

SEQ ID NO: 1370570 - RNA, 19 nt, Homo sapiens
ucuguaaucccagcacuuu

SEQ ID NO: 1370571 - RNA, 19 nt, Homo sapiens
gcugcacuuucuacaggaa

SEQ ID NO: 1370572 - RNA, 19 nt, Homo sapiens
guggagaagcugcccaaug

SEQ ID NO: 1370573 - RNA, 19 nt, Homo sapiens
gauuauguuccuccagaga

SEQ ID NO: 1370574 - RNA, 19 nt, Homo sapiens
agccagaacuucgacaugu

SEQ ID NO: 1370575 - RNA, 19 nt, Homo sapiens
ggacaggcagcaagaaucc

SEQ ID NO: 1370576 - RNA, 19 nt, Homo sapiens
gaacucccuccucuacucu

SEQ ID NO: 1370577 - RNA, 19 nt, Homo sapiens
ggcgagcacuaugaaguca

SEQ ID NO: 1370578 - RNA, 19 nt, Homo sapiens
ucccgaagguggaguacau

SEQ ID NO: 1370579 - RNA, 19 nt, Homo sapiens
auaauuaugcguggaagaa

SEQ ID NO: 1370580 - RNA, 19 nt, Homo sapiens
gaagaaaccuaggacuuua

SEQ ID NO: 1370581 - RNA, 19 nt, Homo sapiens
gcacaacuauugagagauu

SEQ ID NO: 1370582 - RNA, 19 nt, Homo sapiens
guacauaaguugccuaaug

SEQ ID NO: 1370583 - RNA, 19 nt, Homo sapiens
gaauggugcuucugcuuua

SEQ ID NO: 1370584 - RNA, 19 nt, Homo sapiens
uaaaugagcuuggaaauuc

SEQ ID NO: 1370585 - RNA, 19 nt, Homo sapiens
gagaauagaaugugacuuu

SEQ ID NO: 1370586 - RNA, 19 nt, Homo sapiens
gaagccaucucgaagaauu

SEQ ID NO: 1370587 - RNA, 19 nt, Homo sapiens
gaaaugcaguugcuucuca

SEQ ID NO: 1370588 - RNA, 19 nt, Homo sapiens
agaggaagcuggagaguaa

SEQ ID NO: 1370589 - RNA, 19 nt, Homo sapiens
gaagauguauguggaagaa

SEQ ID NO: 1370590 - RNA, 19 nt, Homo sapiens
caaguaagauggauuucaa

SEQ ID NO: 1370591 - RNA, 19 nt, Homo sapiens
ggagaagguuuaaauguuc

SEQ ID NO: 1370592 - RNA, 19 nt, Homo sapiens
caaagcaacccauaacuaa

SEQ ID NO: 1370593 - RNA, 19 nt, Homo sapiens
caccagagaugaagaugua

SEQ ID NO: 1370594 - RNA, 19 nt, Homo sapiens
uaaagcaacuccaugaaga

SEQ ID NO: 1370595 - RNA, 19 nt, Homo sapiens
ggaaugcacuggaaacuac

SEQ ID NO: 1370596 - RNA, 19 nt, Homo sapiens
ggacacuuguuuauaaaug

SEQ ID NO: 1370597 - RNA, 19 nt, Homo sapiens
gcacaggaaagaaagauaa

SEQ ID NO: 1370598 - RNA, 19 nt, Homo sapiens
aaacguccauuccucauuu

SEQ ID NO: 1370599 - RNA, 19 nt, Homo sapiens
guccauuccucauuucuua

SEQ ID NO: 1370600 - RNA, 19 nt, Homo sapiens
caacauccauccuaguaug

SEQ ID NO: 1370601 - RNA, 19 nt, Homo sapiens
ggaggucacuuauguugga

SEQ ID NO: 1370602 - RNA, 19 nt, Homo sapiens
gaaugugacuuuggucuau

SEQ ID NO: 1370603 - RNA, 19 nt, Homo sapiens
gaaacaggcuaaucuugca

SEQ ID NO: 1370604 - RNA, 19 nt, Homo sapiens
gucaguaccugguguguaa

SEQ ID NO: 1370605 - RNA, 19 nt, Homo sapiens
ggaaugagggcugagaaua

SEQ ID NO: 1370606 - RNA, 19 nt, Homo sapiens
cagaacaccucaucuuuca

SEQ ID NO: 1370607 - RNA, 19 nt, Homo sapiens
gagguaauaucaagagugu

SEQ ID NO: 1370608 - RNA, 19 nt, Homo sapiens
uuaaagaacuucagcaaag

SEQ ID NO: 1370609 - RNA, 19 nt, Homo sapiens
ugacacggguaauuuauug

SEQ ID NO: 1370610 - RNA, 19 nt, Homo sapiens
gcacuggacccugcaauuu

SEQ ID NO: 1370611 - RNA, 19 nt, Homo sapiens
acaagagggucccacauuu

SEQ ID NO: 1370612 - RNA, 19 nt, Homo sapiens
ggacgaggcuaccagaagu

SEQ ID NO: 1370613 - RNA, 19 nt, Homo sapiens
caccacgccugacuaauuu

SEQ ID NO: 1370614 - RNA, 19 nt, Homo sapiens
ggaugacacggguaauuua

SEQ ID NO: 1370615 - RNA, 19 nt, Homo sapiens
gcauguagagacacaguua

SEQ ID NO: 1370616 - RNA, 19 nt, Homo sapiens
gcacagucuuggaucacua

SEQ ID NO: 1370617 - RNA, 19 nt, Homo sapiens
aagauaaccuuggcuuuaa

SEQ ID NO: 1370618 - RNA, 19 nt, Homo sapiens
ugacagagguaauaucaag

SEQ ID NO: 1370619 - RNA, 19 nt, Homo sapiens
ggaaagggaccaguacaaa

SEQ ID NO: 1370620 - RNA, 19 nt, Homo sapiens
ggaaacaauccacgagaaa

SEQ ID NO: 1370621 - RNA, 19 nt, Homo sapiens
ugacccaauugcaaucuua

SEQ ID NO: 1370622 - RNA, 19 nt, Homo sapiens
gaaaucaaacauugccaaa

SEQ ID NO: 1370623 - RNA, 19 nt, Homo sapiens
ggaugacgauugccaaaca

SEQ ID NO: 1370624 - RNA, 19 nt, Homo sapiens
gcaaaggcuuggagaaguc

SEQ ID NO: 1370625 - RNA, 19 nt, Homo sapiens
aaacuacccuggucucugu

SEQ ID NO: 1370626 - RNA, 19 nt, Homo sapiens
caugggaucuuuccucuuc

SEQ ID NO: 1370627 - RNA, 19 nt, Homo sapiens
gaagauugcaccagagaug

SEQ ID NO: 1370628 - RNA, 19 nt, Homo sapiens
ggaaaggguaccagccaua

SEQ ID NO: 1370629 - RNA, 19 nt, Homo sapiens
ccaaagcaacccauaacua

SEQ ID NO: 1370630 - RNA, 19 nt, Homo sapiens
gaagggaugacacggguaa

SEQ ID NO: 1370631 - RNA, 19 nt, Homo sapiens
gaacagguaccuucaagag

SEQ ID NO: 1370632 - RNA, 19 nt, Homo sapiens
gagaacagguaccuucaag

SEQ ID NO: 1370633 - RNA, 19 nt, Homo sapiens
gagauaggguuuuaccaua

SEQ ID NO: 1370634 - RNA, 19 nt, Homo sapiens
gauuaaagcaacuccauga

SEQ ID NO: 1370635 - RNA, 19 nt, Homo sapiens
guaaaugagcuuggaaauu

SEQ ID NO: 1370636 - RNA, 19 nt, Homo sapiens
gggaggugguggugaauau

SEQ ID NO: 1370637 - RNA, 19 nt, Homo sapiens
ugaagaaaccuaggacuuu

SEQ ID NO: 1370638 - RNA, 19 nt, Homo sapiens
ucgaagaauugaugaagaa

SEQ ID NO: 1370639 - RNA, 19 nt, Homo sapiens
ccaccacgccugacuaauu

SEQ ID NO: 1370640 - RNA, 19 nt, Homo sapiens
uggaaugucuuaucugguu

SEQ ID NO: 1370641 - RNA, 19 nt, Homo sapiens
cagccauacugaaugcuua

SEQ ID NO: 1370642 - RNA, 19 nt, Homo sapiens
gcaguugccuggugaucga

SEQ ID NO: 1370643 - RNA, 19 nt, Homo sapiens
acagauugauucacuaaug

SEQ ID NO: 1370644 - RNA, 19 nt, Homo sapiens
ccuuucagcuccucaaauu

SEQ ID NO: 1370645 - RNA, 19 nt, Homo sapiens
gaaggaagcccugcugauc

SEQ ID NO: 1370646 - RNA, 19 nt, Homo sapiens
caaagcaaguucaggaucu

SEQ ID NO: 1370647 - RNA, 19 nt, Homo sapiens
gcacgagaaccgcaucauu

SEQ ID NO: 1370648 - RNA, 19 nt, Homo sapiens
ccagagagcgagcacagua

SEQ ID NO: 1370649 - RNA, 19 nt, Homo sapiens
gaccuucacucugguauuc

SEQ ID NO: 1370650 - RNA, 19 nt, Homo sapiens
gaaugagggcugagaauag

SEQ ID NO: 1370651 - RNA, 19 nt, Homo sapiens
cacgaaauguccuccauga

SEQ ID NO: 1370652 - RNA, 19 nt, Homo sapiens
uaucaagaguguucagaga

SEQ ID NO: 1370653 - RNA, 19 nt, Homo sapiens
gaugacagagguaauauca

SEQ ID NO: 1370654 - RNA, 19 nt, Homo sapiens
uaacguagccauuagagau

SEQ ID NO: 1370655 - RNA, 19 nt, Homo sapiens
gagcagagacgugaaagga

SEQ ID NO: 1370656 - RNA, 19 nt, Homo sapiens
caacggaagccaucucgaa

SEQ ID NO: 1370657 - RNA, 19 nt, Homo sapiens
gaacaccucaucuuucaag

SEQ ID NO: 1370658 - RNA, 19 nt, Homo sapiens
aagagaagcuggagugaag

SEQ ID NO: 1370659 - RNA, 19 nt, Homo sapiens
ggaaugucuuaucugguuu

SEQ ID NO: 1370660 - RNA, 19 nt, Homo sapiens
acucugagcuacacacuga

SEQ ID NO: 1370661 - RNA, 19 nt, Homo sapiens
ccaaagugcugagauuaca

SEQ ID NO: 1370662 - RNA, 19 nt, Homo sapiens
aggagaagguuuaaauguu

SEQ ID NO: 1370663 - RNA, 19 nt, Homo sapiens
gaaaaggaaggguaauuaa

SEQ ID NO: 1370664 - RNA, 19 nt, Homo sapiens
gagcuaaggaacagauuga

SEQ ID NO: 1370665 - RNA, 19 nt, Homo sapiens
gagguucauuuaucuuuca

SEQ ID NO: 1370666 - RNA, 19 nt, Homo sapiens
ggucacuuauguuggaauu

SEQ ID NO: 1370667 - RNA, 19 nt, Homo sapiens
ucaagaguguucagagaau

SEQ ID NO: 1370668 - RNA, 19 nt, Homo sapiens
ucacagacuccuuugauga

SEQ ID NO: 1370669 - RNA, 19 nt, Homo sapiens
cgagaaagaacggauauga

SEQ ID NO: 1370670 - RNA, 19 nt, Homo sapiens
cggaagccaucucgaagaa

SEQ ID NO: 1370671 - RNA, 19 nt, Homo sapiens
uugagucucuuccuucuuu

SEQ ID NO: 1370672 - RNA, 19 nt, Homo sapiens
cagccacccugucuaaaug

SEQ ID NO: 1370673 - RNA, 19 nt, Homo sapiens
ucuaaacccugguccauuc

SEQ ID NO: 1370674 - RNA, 19 nt, Homo sapiens
gacaggagaagguuuaaau

SEQ ID NO: 1370675 - RNA, 19 nt, Homo sapiens
gguaauaucaagaguguuc

SEQ ID NO: 1370676 - RNA, 19 nt, Homo sapiens
gggagaagaaauuaaagaa

SEQ ID NO: 1370677 - RNA, 19 nt, Homo sapiens
ggaccgaaauaaacaucug

SEQ ID NO: 1370678 - RNA, 19 nt, Homo sapiens
ccuaggacuuuacaucuug

SEQ ID NO: 1370679 - RNA, 19 nt, Homo sapiens
gaaacguccauuccucauu

SEQ ID NO: 1370680 - RNA, 19 nt, Homo sapiens
gaagaaggcugaagcuaga

SEQ ID NO: 1370681 - RNA, 19 nt, Homo sapiens
gaaacccugugucuaauaa

SEQ ID NO: 1370682 - RNA, 19 nt, Homo sapiens
gaacuuugccgaccucuuu

SEQ ID NO: 1370683 - RNA, 19 nt, Homo sapiens
ggacaaacauucaaaccau

SEQ ID NO: 1370684 - RNA, 19 nt, Homo sapiens
ggucuaaucuuauacuguu

SEQ ID NO: 1370685 - RNA, 19 nt, Homo sapiens
gacaaacauucaaaccaua

SEQ ID NO: 1370686 - RNA, 19 nt, Homo sapiens
ggaagggccugcuaauaag

SEQ ID NO: 1370687 - RNA, 19 nt, Homo sapiens
ucacccagcuguuugguaa

SEQ ID NO: 1370688 - RNA, 19 nt, Homo sapiens
ggagugcaguggugugauu

SEQ ID NO: 1370689 - RNA, 19 nt, Homo sapiens
cgaacccacucccaagaua

SEQ ID NO: 1370690 - RNA, 19 nt, Homo sapiens
gaaaccuaauuugugcuua

SEQ ID NO: 1370691 - RNA, 19 nt, Homo sapiens
gcaaggcucugucucaaaa

SEQ ID NO: 1370692 - RNA, 19 nt, Homo sapiens
caggagcgguugagugauu

SEQ ID NO: 1370693 - RNA, 19 nt, Homo sapiens
ggcgaaacccugugucuaa

SEQ ID NO: 1370694 - RNA, 19 nt, Homo sapiens
gaacccacucccaagauaa

SEQ ID NO: 1370695 - RNA, 19 nt, Homo sapiens
cauguacguugccucauuu

SEQ ID NO: 1370696 - RNA, 19 nt, Homo sapiens
aggaagggccugcuaauaa

SEQ ID NO: 1370697 - RNA, 19 nt, Homo sapiens
gguagcagguuuccauuac

SEQ ID NO: 1370698 - RNA, 19 nt, Homo sapiens
gcaggagaauuacuugaac

SEQ ID NO: 1370699 - RNA, 19 nt, Homo sapiens
cuaagaaaccuaauuugug

SEQ ID NO: 1370700 - RNA, 19 nt, Homo sapiens
gaacuccugggcuuaaaug

SEQ ID NO: 1370701 - RNA, 19 nt, Homo sapiens
gcgaaacccugugucuaau

SEQ ID NO: 1370702 - RNA, 19 nt, Homo sapiens
gggcuuaaaugacucuucu

SEQ ID NO: 1370703 - RNA, 19 nt, Homo sapiens
ccaaacaugcaaacacuga

SEQ ID NO: 1370704 - RNA, 19 nt, Homo sapiens
guguggaccugaccuguug

SEQ ID NO: 1370705 - RNA, 19 nt, Homo sapiens
ggcaggagcgguugaguga

SEQ ID NO: 1370706 - RNA, 19 nt, Homo sapiens
ggcugaggcaggagaauua

SEQ ID NO: 1370707 - RNA, 19 nt, Homo sapiens
cgaaacccugugucuaaua

SEQ ID NO: 1370708 - RNA, 19 nt, Homo sapiens
acauguacguugccucauu

SEQ ID NO: 1370709 - RNA, 19 nt, Homo sapiens
agaaauguauuggcucaga

SEQ ID NO: 1370710 - RNA, 19 nt, Homo sapiens
gcaggacuguggcccuugu

SEQ ID NO: 1370711 - RNA, 19 nt, Homo sapiens
ccuaagaaaccuaauuugu

SEQ ID NO: 1370712 - RNA, 19 nt, Homo sapiens
ggccuaagccagaaacaga

SEQ ID NO: 1370713 - RNA, 19 nt, Homo sapiens
cuagugcucuccagaaucu

SEQ ID NO: 1370714 - RNA, 19 nt, Homo sapiens
gcuacagaguuccuucuca

SEQ ID NO: 1370715 - RNA, 19 nt, Homo sapiens
cagguaagaagaacuaguu

SEQ ID NO: 1370716 - RNA, 19 nt, Homo sapiens
ggacaguacuuuucuuucu

SEQ ID NO: 1370717 - RNA, 19 nt, Homo sapiens
uaaggucacccagcuguuu

SEQ ID NO: 1370718 - RNA, 19 nt, Homo sapiens
gaggccagguguuugagau

SEQ ID NO: 1370719 - RNA, 19 nt, Homo sapiens
ccauuaccaugccaucaga

SEQ ID NO: 1370720 - RNA, 19 nt, Homo sapiens
ggauguccaugcccuuuac

SEQ ID NO: 1370721 - RNA, 19 nt, Homo sapiens
aauaaggucuagggucuga

SEQ ID NO: 1370722 - RNA, 19 nt, Homo sapiens
uaggaagggccugcuaaua

SEQ ID NO: 1370723 - RNA, 19 nt, Homo sapiens
cuucucaacucccaagguu

SEQ ID NO: 1370724 - RNA, 19 nt, Homo sapiens
ugcccucgcuggcuuguuu

SEQ ID NO: 1370725 - RNA, 19 nt, Homo sapiens
ggcaggagaauuacuugaa

SEQ ID NO: 1370726 - RNA, 19 nt, Homo sapiens
acucagugauuuaggaaga

SEQ ID NO: 1370727 - RNA, 19 nt, Homo sapiens
ugaggacccuucugcaucu

SEQ ID NO: 1370728 - RNA, 19 nt, Homo sapiens
ugcaaacacugaggauuga

SEQ ID NO: 1370729 - RNA, 19 nt, Homo sapiens
acccagcuguuugguaaua

SEQ ID NO: 1370730 - RNA, 19 nt, Homo sapiens
gaaccugggaggcagaagu

SEQ ID NO: 1370731 - RNA, 19 nt, Homo sapiens
guacguugccucauuucau

SEQ ID NO: 1370732 - RNA, 19 nt, Homo sapiens
gccagagggugcugagagu

SEQ ID NO: 1370733 - RNA, 19 nt, Homo sapiens
ggccagguguuugagauca

SEQ ID NO: 1370734 - RNA, 19 nt, Homo sapiens
uugaggagcucugggauuc

SEQ ID NO: 1370735 - RNA, 19 nt, Homo sapiens
uguaaucccagcacuuuga

SEQ ID NO: 1370736 - RNA, 19 nt, Homo sapiens
guaauaguguuuugucauc

SEQ ID NO: 1370737 - RNA, 19 nt, Homo sapiens
ccuguaaucccagcacuuu

SEQ ID NO: 1370738 - RNA, 19 nt, Homo sapiens
gcuguuugguaauaguguu

SEQ ID NO: 1370739 - RNA, 19 nt, Homo sapiens
ucucaacucccaagguuug

SEQ ID NO: 1370740 - RNA, 19 nt, Homo sapiens
cacuagugcucuccagaau

SEQ ID NO: 1370741 - RNA, 19 nt, Homo sapiens
ccaaggcacacuccuguag

SEQ ID NO: 1370742 - RNA, 19 nt, Homo sapiens
gggcagacuaggagaggaa

SEQ ID NO: 1370743 - RNA, 19 nt, Homo sapiens
gagacgggguaaguuauaa

SEQ ID NO: 1370744 - RNA, 19 nt, Homo sapiens
aaccgucucugcccucuuc

SEQ ID NO: 1370745 - RNA, 19 nt, Homo sapiens
uacguugccucauuucauc

SEQ ID NO: 1370746 - RNA, 19 nt, Homo sapiens
uuccuaggcuggucucgaa

SEQ ID NO: 1370747 - RNA, 19 nt, Homo sapiens
uacaguggcaaucgcauuu

SEQ ID NO: 1370748 - RNA, 19 nt, Homo sapiens
cacgugccaugcccacuug

SEQ ID NO: 1370749 - RNA, 19 nt, Homo sapiens
uagcagguuuccauuacca

SEQ ID NO: 1370750 - RNA, 19 nt, Homo sapiens
cccaagcugugccgauuag

SEQ ID NO: 1370751 - RNA, 19 nt, Homo sapiens
gagugcaguggugugauua

SEQ ID NO: 1370752 - RNA, 19 nt, Homo sapiens
ggcaaucgcauuucaacgu

SEQ ID NO: 1370753 - RNA, 19 nt, Homo sapiens
caguggcaaucgcauuuca

SEQ ID NO: 1370754 - RNA, 19 nt, Homo sapiens
cuguagcucugucgccaaa

SEQ ID NO: 1370755 - RNA, 19 nt, Homo sapiens
acacuagugcucuccagaa

SEQ ID NO: 1370756 - RNA, 19 nt, Homo sapiens
ugaggcaggagaauuacuu

SEQ ID NO: 1370757 - RNA, 19 nt, Homo sapiens
caaaguguugggauuacug

SEQ ID NO: 1370758 - RNA, 19 nt, Homo sapiens
acccggcacuguagagcua

SEQ ID NO: 1370759 - RNA, 19 nt, Homo sapiens
gggacaaacauucaaacca

SEQ ID NO: 1370760 - RNA, 19 nt, Homo sapiens
cuccugauccuuccgauug

SEQ ID NO: 1370761 - RNA, 19 nt, Homo sapiens
augcaaacacugaggauug

SEQ ID NO: 1370762 - RNA, 19 nt, Homo sapiens
ucccaaacaugcaaacacu

SEQ ID NO: 1370763 - RNA, 19 nt, Homo sapiens
uaaggucuagggucugaga

SEQ ID NO: 1370764 - RNA, 19 nt, Homo sapiens
uaagccagaaacagaaaga

SEQ ID NO: 1370765 - RNA, 19 nt, Homo sapiens
agccagcgcuucucaacuc

SEQ ID NO: 1370766 - RNA, 19 nt, Homo sapiens
aaagacaggaucucacucu

SEQ ID NO: 1370767 - RNA, 19 nt, Homo sapiens
gacaguacuuuucuuucuu

SEQ ID NO: 1370768 - RNA, 19 nt, Homo sapiens
gaggcaggagaauuacuug

SEQ ID NO: 1370769 - RNA, 19 nt, Homo sapiens
ggaaggacagcuguaugca

SEQ ID NO: 1370770 - RNA, 19 nt, Homo sapiens
uaauuugugcuuaggaauc

SEQ ID NO: 1370771 - RNA, 19 nt, Homo sapiens
gaagggccugcuaauaagg

SEQ ID NO: 1370772 - RNA, 19 nt, Homo sapiens
cagccucaccaaaguguug

SEQ ID NO: 1370773 - RNA, 19 nt, Homo sapiens
gcgaacccacucccaagau

SEQ ID NO: 1370774 - RNA, 19 nt, Homo sapiens
ugguagcagguuuccauua

SEQ ID NO: 1370775 - RNA, 19 nt, Homo sapiens
ccagcuguuugguaauagu

SEQ ID NO: 1370776 - RNA, 19 nt, Homo sapiens
gguuaaagacaggaucuca

SEQ ID NO: 1370777 - RNA, 19 nt, Homo sapiens
cagacuaggagaggaaaga

SEQ ID NO: 1370778 - RNA, 19 nt, Homo sapiens
caacucccaagguuugcaa

SEQ ID NO: 1370779 - RNA, 19 nt, Homo sapiens
gccaaggcacacuccugua

SEQ ID NO: 1370780 - RNA, 19 nt, Homo sapiens
caucaaggcuuaauuagaa

SEQ ID NO: 1370781 - RNA, 19 nt, Homo sapiens
gcacucagguugaaucaga

SEQ ID NO: 1370782 - RNA, 19 nt, Homo sapiens
gaaggaaauugguuagaug

SEQ ID NO: 1370783 - RNA, 19 nt, Homo sapiens
gaaagauaauugcugaaga

SEQ ID NO: 1370784 - RNA, 19 nt, Homo sapiens
ggaaauugguuagauguau

SEQ ID NO: 1370785 - RNA, 19 nt, Homo sapiens
gaaauugguuagauguaug

SEQ ID NO: 1370786 - RNA, 19 nt, Homo sapiens
ucacacacauucgaaauuu

SEQ ID NO: 1370787 - RNA, 19 nt, Homo sapiens
guaaauccauccucccauu

SEQ ID NO: 1370788 - RNA, 19 nt, Homo sapiens
caccagagcuuccaguuug

SEQ ID NO: 1370789 - RNA, 19 nt, Homo sapiens
ggucaucaaggcuuaauua

SEQ ID NO: 1370790 - RNA, 19 nt, Homo sapiens
ugaaagcucuagaggaauu

SEQ ID NO: 1370791 - RNA, 19 nt, Homo sapiens
gcagaauaguuugcucuuu

SEQ ID NO: 1370792 - RNA, 19 nt, Homo sapiens
caccaagucuguauuucua

SEQ ID NO: 1370793 - RNA, 19 nt, Homo sapiens
cagaauaguuugcucuuuc

SEQ ID NO: 1370794 - RNA, 19 nt, Homo sapiens
caggugcgcuuaccagaaa

SEQ ID NO: 1370795 - RNA, 19 nt, Homo sapiens
uccaggagcuagaugaaua

SEQ ID NO: 1370796 - RNA, 19 nt, Homo sapiens
ggacauuuaucaagucucu

SEQ ID NO: 1370797 - RNA, 19 nt, Homo sapiens
cuuagagucuuucuucuuu

SEQ ID NO: 1370798 - RNA, 19 nt, Homo sapiens
caguagaccuaauccaauu

SEQ ID NO: 1370799 - RNA, 19 nt, Homo sapiens
acugaaagcucuagaggaa

SEQ ID NO: 1370800 - RNA, 19 nt, Homo sapiens
gcccauuucuccuucguaa

SEQ ID NO: 1370801 - RNA, 19 nt, Homo sapiens
gagacaauauauucacugu

SEQ ID NO: 1370802 - RNA, 19 nt, Homo sapiens
caauuugucuucuguugug

SEQ ID NO: 1370803 - RNA, 19 nt, Homo sapiens
cuuauucuguggucaauuu

SEQ ID NO: 1370804 - RNA, 19 nt, Homo sapiens
ccauuucucuguuucauuc

SEQ ID NO: 1370805 - RNA, 19 nt, Homo sapiens
gaaauggaagaacgugaaa

SEQ ID NO: 1370806 - RNA, 19 nt, Homo sapiens
uaaccaagaagaacagaaa

SEQ ID NO: 1370807 - RNA, 19 nt, Homo sapiens
ugugaucucuuuccauuau

SEQ ID NO: 1370808 - RNA, 19 nt, Homo sapiens
agacguggaugaugaggaa

SEQ ID NO: 1370809 - RNA, 19 nt, Homo sapiens
gauaauugcugaagaaaag

SEQ ID NO: 1370810 - RNA, 19 nt, Homo sapiens
aaucaaaccuaguuguugu

SEQ ID NO: 1370811 - RNA, 19 nt, Homo sapiens
uauacuggauuguaagcua

SEQ ID NO: 1370812 - RNA, 19 nt, Homo sapiens
aggaagacguggaugauga

SEQ ID NO: 1370813 - RNA, 19 nt, Homo sapiens
gcccugacauaaaucacua

SEQ ID NO: 1370814 - RNA, 19 nt, Homo sapiens
gaugaauaccugcgcauga

SEQ ID NO: 1370815 - RNA, 19 nt, Homo sapiens
caaggaauggguucagaaa

SEQ ID NO: 1370816 - RNA, 19 nt, Homo sapiens
gaaguggcuugcccugaca

SEQ ID NO: 1370817 - RNA, 19 nt, Homo sapiens
gcaguagaccuaauccaau

SEQ ID NO: 1370818 - RNA, 19 nt, Homo sapiens
ucuaaugccuaaugguauu

SEQ ID NO: 1370819 - RNA, 19 nt, Homo sapiens
uaucaagucucuaucuucu

SEQ ID NO: 1370820 - RNA, 19 nt, Homo sapiens
gaaagccgccugacaccau

SEQ ID NO: 1370821 - RNA, 19 nt, Homo sapiens
gaauaccugcgcaugauau

SEQ ID NO: 1370822 - RNA, 19 nt, Homo sapiens
caugggaggugugguuuau

SEQ ID NO: 1370823 - RNA, 19 nt, Homo sapiens
agaaggaaauugguuagau

SEQ ID NO: 1370824 - RNA, 19 nt, Homo sapiens
gaugauauaaccuucuuca

SEQ ID NO: 1370825 - RNA, 19 nt, Homo sapiens
aaucuaaugccuaauggua

SEQ ID NO: 1370826 - RNA, 19 nt, Homo sapiens
ccuguggcuugcacuaaua

SEQ ID NO: 1370827 - RNA, 19 nt, Homo sapiens
ugggaggugugguuuauug

SEQ ID NO: 1370828 - RNA, 19 nt, Homo sapiens
ugauauaaccuucuucauc

SEQ ID NO: 1370829 - RNA, 19 nt, Homo sapiens
ugagaggaauggaguuaca

SEQ ID NO: 1370830 - RNA, 19 nt, Homo sapiens
gcaaaauuccguaauguug

SEQ ID NO: 1370831 - RNA, 19 nt, Homo sapiens
ccaaucaaaccuaguuguu

SEQ ID NO: 1370832 - RNA, 19 nt, Homo sapiens
gaucacacacauucgaaau

SEQ ID NO: 1370833 - RNA, 19 nt, Homo sapiens
uuugugaucucuuuccauu

SEQ ID NO: 1370834 - RNA, 19 nt, Homo sapiens
cuccaagucugcaaaucua

SEQ ID NO: 1370835 - RNA, 19 nt, Homo sapiens
gcccuuugcccucuacuuu

SEQ ID NO: 1370836 - RNA, 19 nt, Homo sapiens
gaaagcucuagaggaauua

SEQ ID NO: 1370837 - RNA, 19 nt, Homo sapiens
caaaguggcgagccugaga

SEQ ID NO: 1370838 - RNA, 19 nt, Homo sapiens
uguugaaucuaaugccuaa

SEQ ID NO: 1370839 - RNA, 19 nt, Homo sapiens
gucaauuugucuucuguug

SEQ ID NO: 1370840 - RNA, 19 nt, Homo sapiens
auaaaucucugugacuguu

SEQ ID NO: 1370841 - RNA, 19 nt, Homo sapiens
ccaaguauuauaagaagga

SEQ ID NO: 1370842 - RNA, 19 nt, Homo sapiens
gcagucaccaagucuguau

SEQ ID NO: 1370843 - RNA, 19 nt, Homo sapiens
ggcuugcccugacauaaau

SEQ ID NO: 1370844 - RNA, 19 nt, Homo sapiens
ugucuaggaauguaagaua

SEQ ID NO: 1370845 - RNA, 19 nt, Homo sapiens
aguuugcucuuuccucuaa

SEQ ID NO: 1370846 - RNA, 19 nt, Homo sapiens
cuucuucauccaaguauua

SEQ ID NO: 1370847 - RNA, 19 nt, Homo sapiens
cuaaucaucuccuccuuuu

SEQ ID NO: 1370848 - RNA, 19 nt, Homo sapiens
ggcaguagaccuaauccaa

SEQ ID NO: 1370849 - RNA, 19 nt, Homo sapiens
caaucaaaccuaguuguug

SEQ ID NO: 1370850 - RNA, 19 nt, Homo sapiens
ucucggucaucaaggcuua

SEQ ID NO: 1370851 - RNA, 19 nt, Homo sapiens
ccaccagagcuuccaguuu

SEQ ID NO: 1370852 - RNA, 19 nt, Homo sapiens
cuagaggaauuaaaucaac

SEQ ID NO: 1370853 - RNA, 19 nt, Homo sapiens
ccauauuuguuuagaaguc

SEQ ID NO: 1370854 - RNA, 19 nt, Homo sapiens
cuacauaagggcagggauu

SEQ ID NO: 1370855 - RNA, 19 nt, Homo sapiens
gugaucucuuuccauuaua

SEQ ID NO: 1370856 - RNA, 19 nt, Homo sapiens
guuagauguauguguguua

SEQ ID NO: 1370857 - RNA, 19 nt, Homo sapiens
guauguguguuauaaccau

SEQ ID NO: 1370858 - RNA, 19 nt, Homo sapiens
ugaauaccugcgcaugaua

SEQ ID NO: 1370859 - RNA, 19 nt, Homo sapiens
ccaagucugcaaaucuaaa

SEQ ID NO: 1370860 - RNA, 19 nt, Homo sapiens
uuucuucuuuggcuuguuu

SEQ ID NO: 1370861 - RNA, 19 nt, Homo sapiens
guuguuguuugucuaggaa

SEQ ID NO: 1370862 - RNA, 19 nt, Homo sapiens
uuacacaugcagaauaguu

SEQ ID NO: 1370863 - RNA, 19 nt, Homo sapiens
uaaaucucugugacuguua

SEQ ID NO: 1370864 - RNA, 19 nt, Homo sapiens
gguggacauuuaucaaguc

SEQ ID NO: 1370865 - RNA, 19 nt, Homo sapiens
agaaauggaagaacgugaa

SEQ ID NO: 1370866 - RNA, 19 nt, Homo sapiens
cuaggaauguaagauacuu

SEQ ID NO: 1370867 - RNA, 19 nt, Homo sapiens
auucuucuguuguuccuaa

SEQ ID NO: 1370868 - RNA, 19 nt, Homo sapiens
caacccauuuugcccauuu

SEQ ID NO: 1370869 - RNA, 19 nt, Homo sapiens
cacaaggaauggguucaga

SEQ ID NO: 1370870 - RNA, 19 nt, Homo sapiens
gggagacaauauauucacu

SEQ ID NO: 1370871 - RNA, 19 nt, Homo sapiens
acagaaacaggugcgcuua

SEQ ID NO: 1370872 - RNA, 19 nt, Homo sapiens
ugaaucuaaugccuaaugg

SEQ ID NO: 1370873 - RNA, 19 nt, Homo sapiens
ggaucacacacauucgaaa

SEQ ID NO: 1370874 - RNA, 19 nt, Homo sapiens
ucaucaaggcuuaauuaga

SEQ ID NO: 1370875 - RNA, 19 nt, Homo sapiens
cuauccugguggacauuua

SEQ ID NO: 1370876 - RNA, 19 nt, Homo sapiens
gugaccggcugcaacugaa

SEQ ID NO: 1370877 - RNA, 19 nt, Homo sapiens
ggugugguuuauuggcaaa

SEQ ID NO: 1370878 - RNA, 19 nt, Homo sapiens
uggcuugcccugacauaaa

SEQ ID NO: 1370879 - RNA, 19 nt, Homo sapiens
ccuaguuguuguuugucua

SEQ ID NO: 1370880 - RNA, 19 nt, Homo sapiens
uaagaaagcugacaacaaa

SEQ ID NO: 1370881 - RNA, 19 nt, Homo sapiens
gaaggaagcugaacacaug

SEQ ID NO: 1370882 - RNA, 19 nt, Homo sapiens
gagaagaaaugccgauaua

SEQ ID NO: 1370883 - RNA, 19 nt, Homo sapiens
ggagauaaauagagaagua

SEQ ID NO: 1370884 - RNA, 19 nt, Homo sapiens
ggaaauagccacacugaaa

SEQ ID NO: 1370885 - RNA, 19 nt, Homo sapiens
gcagauauauguggaguaa

SEQ ID NO: 1370886 - RNA, 19 nt, Homo sapiens
gaagaaaugccgauauauu

SEQ ID NO: 1370887 - RNA, 19 nt, Homo sapiens
cgaaugcaguuaauaagua

SEQ ID NO: 1370888 - RNA, 19 nt, Homo sapiens
gcauaaagcugcacaggau

SEQ ID NO: 1370889 - RNA, 19 nt, Homo sapiens
caagagcucugcaguguga

SEQ ID NO: 1370890 - RNA, 19 nt, Homo sapiens
acacaaugcucacuucuaa

SEQ ID NO: 1370891 - RNA, 19 nt, Homo sapiens
ugaacaggcucucagaaua

SEQ ID NO: 1370892 - RNA, 19 nt, Homo sapiens
ggaaagaguuagaagugaa

SEQ ID NO: 1370893 - RNA, 19 nt, Homo sapiens
ugaaggacaugcaaacuuu

SEQ ID NO: 1370894 - RNA, 19 nt, Homo sapiens
gaccagaucuuuacucaca

SEQ ID NO: 1370895 - RNA, 19 nt, Homo sapiens
gagauugacuuuaaaccaa

SEQ ID NO: 1370896 - RNA, 19 nt, Homo sapiens
gcaagaguaacaucuaaua

SEQ ID NO: 1370897 - RNA, 19 nt, Homo sapiens
uuagaagggucuccuguua

SEQ ID NO: 1370898 - RNA, 19 nt, Homo sapiens
gaagaaacaccuagggaaa

SEQ ID NO: 1370899 - RNA, 19 nt, Homo sapiens
gaaaagaagugagcaaauu

SEQ ID NO: 1370900 - RNA, 19 nt, Homo sapiens
gaagagaagagaagaaaug

SEQ ID NO: 1370901 - RNA, 19 nt, Homo sapiens
gaacacaggacaccucuga

SEQ ID NO: 1370902 - RNA, 19 nt, Homo sapiens
gauguucccuucagaauca

SEQ ID NO: 1370903 - RNA, 19 nt, Homo sapiens
agaggaagaugaagaauau

SEQ ID NO: 1370904 - RNA, 19 nt, Homo sapiens
gaugaaggcucuacaaugc

SEQ ID NO: 1370905 - RNA, 19 nt, Homo sapiens
gcaauuaguucaugcacau

SEQ ID NO: 1370906 - RNA, 19 nt, Homo sapiens
caaauaaagccuuggaauu

SEQ ID NO: 1370907 - RNA, 19 nt, Homo sapiens
caaauaaagccuuggaauu

SEQ ID NO: 1370908 - RNA, 19 nt, Homo sapiens
caaauaaagccuuggaauu

SEQ ID NO: 1370909 - RNA, 19 nt, Homo sapiens
gcugaaagcuugguggaaa

SEQ ID NO: 1370910 - RNA, 19 nt, Homo sapiens
gcugaaagcuugguggaaa

SEQ ID NO: 1370911 - RNA, 19 nt, Homo sapiens
agaagagucuccuaauaaa

SEQ ID NO: 1370912 - RNA, 19 nt, Homo sapiens
gugcaaauauucugauaga

SEQ ID NO: 1370913 - RNA, 19 nt, Homo sapiens
uagaagagccuccuaagaa

SEQ ID NO: 1370914 - RNA, 19 nt, Homo sapiens
gaaggaacaucugcaggaa

SEQ ID NO: 1370915 - RNA, 19 nt, Homo sapiens
gaaccugcuuuccacauug

SEQ ID NO: 1370916 - RNA, 19 nt, Homo sapiens
uagaagagucuccuaauaa

SEQ ID NO: 1370917 - RNA, 19 nt, Homo sapiens
ggagaugcuuguuugcaaa

SEQ ID NO: 1370918 - RNA, 19 nt, Homo sapiens
gaucuuuacucacaacuca

SEQ ID NO: 1370919 - RNA, 19 nt, Homo sapiens
cgucuuugcugcagauaua

SEQ ID NO: 1370920 - RNA, 19 nt, Homo sapiens
gaccaucaaccuuaauaua

SEQ ID NO: 1370921 - RNA, 19 nt, Homo sapiens
caacagcaauuaguucaug

SEQ ID NO: 1370922 - RNA, 19 nt, Homo sapiens
acaagaccaugaucaaauu

SEQ ID NO: 1370923 - RNA, 19 nt, Homo sapiens
gaagaucgcaugggagaaa

SEQ ID NO: 1370924 - RNA, 19 nt, Homo sapiens
gaagaucgcaugggagaaa

SEQ ID NO: 1370925 - RNA, 19 nt, Homo sapiens
ggaaagaacaccugacaca

SEQ ID NO: 1370926 - RNA, 19 nt, Homo sapiens
agaagggucuccuguuaaa

SEQ ID NO: 1370927 - RNA, 19 nt, Homo sapiens
ggagggaacaucugacaaa

SEQ ID NO: 1370928 - RNA, 19 nt, Homo sapiens
gaacuucagaugacccuaa

SEQ ID NO: 1370929 - RNA, 19 nt, Homo sapiens
ugaagaguguagaaaguaa

SEQ ID NO: 1370930 - RNA, 19 nt, Homo sapiens
gcaaaagucuguuccaaau

SEQ ID NO: 1370931 - RNA, 19 nt, Homo sapiens
gcaaaagucuguuccaaau

SEQ ID NO: 1370932 - RNA, 19 nt, Homo sapiens
gcaaaacucuguuccaaau

SEQ ID NO: 1370933 - RNA, 19 nt, Homo sapiens
acaaugaggugcuccauca

SEQ ID NO: 1370934 - RNA, 19 nt, Homo sapiens
uuagaagagucuccugaua

SEQ ID NO: 1370935 - RNA, 19 nt, Homo sapiens
acagaaggauguguguuua

SEQ ID NO: 1370936 - RNA, 19 nt, Homo sapiens
acagaaggauguguguuua

SEQ ID NO: 1370937 - RNA, 19 nt, Homo sapiens
acagaaggauguguguuua

SEQ ID NO: 1370938 - RNA, 19 nt, Homo sapiens
gaucagagguucccaucag

SEQ ID NO: 1370939 - RNA, 19 nt, Homo sapiens
gaagacacaccuagggaaa

SEQ ID NO: 1370940 - RNA, 19 nt, Homo sapiens
cagcagacaucauucaauc

SEQ ID NO: 1370941 - RNA, 19 nt, Homo sapiens
aaauaaagccuuggaauug

SEQ ID NO: 1370942 - RNA, 19 nt, Homo sapiens
ugauggacaugcaaacuuu

SEQ ID NO: 1370943 - RNA, 19 nt, Homo sapiens
aaauaaagccuuggaauug

SEQ ID NO: 1370944 - RNA, 19 nt, Homo sapiens
ugauggacaugcaaacuuu

SEQ ID NO: 1370945 - RNA, 19 nt, Homo sapiens
aaauaaagccuuggaauug

SEQ ID NO: 1370946 - RNA, 19 nt, Homo sapiens
ugagaguucugcaaagauu

SEQ ID NO: 1370947 - RNA, 19 nt, Homo sapiens
gggaacaucugacaaaauu

SEQ ID NO: 1370948 - RNA, 19 nt, Homo sapiens
gcaaaagucugucccaaau

SEQ ID NO: 1370949 - RNA, 19 nt, Homo sapiens
aagaagaccaucaaccuua

SEQ ID NO: 1370950 - RNA, 19 nt, Homo sapiens
caauauagugggcagcuua

SEQ ID NO: 1370951 - RNA, 19 nt, Homo sapiens
gaaagaguuagaagugaaa

SEQ ID NO: 1370952 - RNA, 19 nt, Homo sapiens
agugugagauugacuuuaa

SEQ ID NO: 1370953 - RNA, 19 nt, Homo sapiens
uagaagagucuccugauaa

SEQ ID NO: 1370954 - RNA, 19 nt, Homo sapiens
gaaauuacgaguccugcaa

SEQ ID NO: 1370955 - RNA, 19 nt, Homo sapiens
caaaugcgaaugcaguuaa

SEQ ID NO: 1370956 - RNA, 19 nt, Homo sapiens
gcacaggauucccaucuac

SEQ ID NO: 1370957 - RNA, 19 nt, Homo sapiens
caacagaccagaucuuuac

SEQ ID NO: 1370958 - RNA, 19 nt, Homo sapiens
gcucucagaauacaagaua

SEQ ID NO: 1370959 - RNA, 19 nt, Homo sapiens
ggauacaguucauucuugu

SEQ ID NO: 1370960 - RNA, 19 nt, Homo sapiens
gaagaagaccaucaaccuu

SEQ ID NO: 1370961 - RNA, 19 nt, Homo sapiens
ucaggaggcuugugcaaau

SEQ ID NO: 1370962 - RNA, 19 nt, Homo sapiens
ccugaagccuacagacaua

SEQ ID NO: 1370963 - RNA, 19 nt, Homo sapiens
caaagagaccaacgugaaa

SEQ ID NO: 1370964 - RNA, 19 nt, Homo sapiens
agaagaccaucaaccuuaa

SEQ ID NO: 1370965 - RNA, 19 nt, Homo sapiens
gaaagaggaaucauuaacu

SEQ ID NO: 1370966 - RNA, 19 nt, Homo sapiens
gagagcagaucagauguuc

SEQ ID NO: 1370967 - RNA, 19 nt, Homo sapiens
ccaccagaauccaaacaaa

SEQ ID NO: 1370968 - RNA, 19 nt, Homo sapiens
agaaacaccuagggaaauu

SEQ ID NO: 1370969 - RNA, 19 nt, Homo sapiens
gcaaaauguugacgucuuu

SEQ ID NO: 1370970 - RNA, 19 nt, Homo sapiens
gaacaggcucucagaauac

SEQ ID NO: 1370971 - RNA, 19 nt, Homo sapiens
gaucagauguucccuucag

SEQ ID NO: 1370972 - RNA, 19 nt, Homo sapiens
agaagagucuccugauaau

SEQ ID NO: 1370973 - RNA, 19 nt, Homo sapiens
agaauuacuuguucacgaa

SEQ ID NO: 1370974 - RNA, 19 nt, Homo sapiens
gaacaaacacacugaacag

SEQ ID NO: 1370975 - RNA, 19 nt, Homo sapiens
aaaggaaauugccaugcua

SEQ ID NO: 1370976 - RNA, 19 nt, Homo sapiens
gaagaagagaagagaagaa

SEQ ID NO: 1370977 - RNA, 19 nt, Homo sapiens
aauaaagccuuggaauuga

SEQ ID NO: 1370978 - RNA, 19 nt, Homo sapiens
ggacaugcaaacuuucaaa

SEQ ID NO: 1370979 - RNA, 19 nt, Homo sapiens
aauaaagccuuggaauuga

SEQ ID NO: 1370980 - RNA, 19 nt, Homo sapiens
ggagauagcauuaaacuaa

SEQ ID NO: 1370981 - RNA, 19 nt, Homo sapiens
ggagcaagcugaagaggaa

SEQ ID NO: 1370982 - RNA, 19 nt, Homo sapiens
gccaaugucuaaagaauuu

SEQ ID NO: 1370983 - RNA, 19 nt, Homo sapiens
gaaguuagacggccacaaa

SEQ ID NO: 1370984 - RNA, 19 nt, Homo sapiens
aaacagaugugugaacuaa

SEQ ID NO: 1370985 - RNA, 19 nt, Homo sapiens
ggacguauuucuuccuuga

SEQ ID NO: 1370986 - RNA, 19 nt, Homo sapiens
aaaggaagcuuaauaugga

SEQ ID NO: 1370987 - RNA, 19 nt, Homo sapiens
gacaagagcuggguuuaga

SEQ ID NO: 1370988 - RNA, 19 nt, Homo sapiens
gcaaauuaauaccugauga

SEQ ID NO: 1370989 - RNA, 19 nt, Homo sapiens
gcauuuaucuucucugcaa

SEQ ID NO: 1370990 - RNA, 19 nt, Homo sapiens
gaaucagacucuucacauu

SEQ ID NO: 1370991 - RNA, 19 nt, Homo sapiens
gaagauauaucagcucaca

SEQ ID NO: 1370992 - RNA, 19 nt, Homo sapiens
ggucccaccucgcaacuua

SEQ ID NO: 1370993 - RNA, 19 nt, Homo sapiens
gaacaaacacaggcaaauu

SEQ ID NO: 1370994 - RNA, 19 nt, Homo sapiens
auaguaagcuguucccaua

SEQ ID NO: 1370995 - RNA, 19 nt, Homo sapiens
gagcaguucuuaacacaug

SEQ ID NO: 1370996 - RNA, 19 nt, Homo sapiens
gauaaagucagaagaugua

SEQ ID NO: 1370997 - RNA, 19 nt, Homo sapiens
agacagcacuuuccauuug

SEQ ID NO: 1370998 - RNA, 19 nt, Homo sapiens
gcaaaaugcuccaaagaaa

SEQ ID NO: 1370999 - RNA, 19 nt, Homo sapiens
ccuaauacuucacuuguuu

SEQ ID NO: 1371000 - RNA, 19 nt, Homo sapiens
caaagugucuucuguaggu

SEQ ID NO: 1371001 - RNA, 19 nt, Homo sapiens
agaaguagcaccucauaua

SEQ ID NO: 1371002 - RNA, 19 nt, Homo sapiens
uagcagauauuguugaaga

SEQ ID NO: 1371003 - RNA, 19 nt, Homo sapiens
gauauugacuuggauaauc

SEQ ID NO: 1371004 - RNA, 19 nt, Homo sapiens
gggaugauaguuacgauua

SEQ ID NO: 1371005 - RNA, 19 nt, Homo sapiens
gaccauagcagauauuguu

SEQ ID NO: 1371006 - RNA, 19 nt, Homo sapiens
caggauagauucugugugu

SEQ ID NO: 1371007 - RNA, 19 nt, Homo sapiens
ccacuguaaucucuucuaa

SEQ ID NO: 1371008 - RNA, 19 nt, Homo sapiens
caccuaagauugucuguau

SEQ ID NO: 1371009 - RNA, 19 nt, Homo sapiens
gaaauagggaguagagaga

SEQ ID NO: 1371010 - RNA, 19 nt, Homo sapiens
ccaguaggauggugugaaa

SEQ ID NO: 1371011 - RNA, 19 nt, Homo sapiens
aaaggaggcuucaaagugu

SEQ ID NO: 1371012 - RNA, 19 nt, Homo sapiens
uuacacaagugauggcaua

SEQ ID NO: 1371013 - RNA, 19 nt, Homo sapiens
agggaaagaugaaauugua

SEQ ID NO: 1371014 - RNA, 19 nt, Homo sapiens
uggaaaggguggagaaauu

SEQ ID NO: 1371015 - RNA, 19 nt, Homo sapiens
gaagauauugacuuggaua

SEQ ID NO: 1371016 - RNA, 19 nt, Homo sapiens
gaacuugcguccuucuuac

SEQ ID NO: 1371017 - RNA, 19 nt, Homo sapiens
gccaacaacuguccaacaa

SEQ ID NO: 1371018 - RNA, 19 nt, Homo sapiens
uagcggagguuugugguua

SEQ ID NO: 1371019 - RNA, 19 nt, Homo sapiens
gaaaagaagcccaaggaua

SEQ ID NO: 1371020 - RNA, 19 nt, Homo sapiens
gagaauggaagaacucuga

SEQ ID NO: 1371021 - RNA, 19 nt, Homo sapiens
uaaaggaggcuucaaagug

SEQ ID NO: 1371022 - RNA, 19 nt, Homo sapiens
gaacgaaugaccugaagau

SEQ ID NO: 1371023 - RNA, 19 nt, Homo sapiens
ccuaagcaguuuaucguuu

SEQ ID NO: 1371024 - RNA, 19 nt, Homo sapiens
cauaccacauacauuguua

SEQ ID NO: 1371025 - RNA, 19 nt, Homo sapiens
gucagaagauguauauaug

SEQ ID NO: 1371026 - RNA, 19 nt, Homo sapiens
gcuaugcuaugccuuguau

SEQ ID NO: 1371027 - RNA, 19 nt, Homo sapiens
gaaggaaggcauuuaucuu

SEQ ID NO: 1371028 - RNA, 19 nt, Homo sapiens
ccaacaaacaugugaauga

SEQ ID NO: 1371029 - RNA, 19 nt, Homo sapiens
ugaaacagcccaacaggaa

SEQ ID NO: 1371030 - RNA, 19 nt, Homo sapiens
gaauacgugucagaccaua

SEQ ID NO: 1371031 - RNA, 19 nt, Homo sapiens
guucguucauugaguauuu

SEQ ID NO: 1371032 - RNA, 19 nt, Homo sapiens
gagcauaaaucaggacaag

SEQ ID NO: 1371033 - RNA, 19 nt, Homo sapiens
ccucgcaacuuauaaaugu

SEQ ID NO: 1371034 - RNA, 19 nt, Homo sapiens
gagccuaaauuccugacaa

SEQ ID NO: 1371035 - RNA, 19 nt, Homo sapiens
caacaacuguccaacaaac

SEQ ID NO: 1371036 - RNA, 19 nt, Homo sapiens
caacaaacaugugaaugag

SEQ ID NO: 1371037 - RNA, 19 nt, Homo sapiens
gaguaaagguucauuuuga

SEQ ID NO: 1371038 - RNA, 19 nt, Homo sapiens
gaauggaagaacucugaua

SEQ ID NO: 1371039 - RNA, 19 nt, Homo sapiens
aauauuuccuguccuguaa

SEQ ID NO: 1371040 - RNA, 19 nt, Homo sapiens
aagauugucuguauggaaa

SEQ ID NO: 1371041 - RNA, 19 nt, Homo sapiens
ggauagauucuguguguga

SEQ ID NO: 1371042 - RNA, 19 nt, Homo sapiens
ggaaagaugaaauuguaga

SEQ ID NO: 1371043 - RNA, 19 nt, Homo sapiens
ugacuuggauaaucucuuc

SEQ ID NO: 1371044 - RNA, 19 nt, Homo sapiens
aagaagauauugacuugga

SEQ ID NO: 1371045 - RNA, 19 nt, Homo sapiens
cauagcagauauuguugaa

SEQ ID NO: 1371046 - RNA, 19 nt, Homo sapiens
gugagaaucuacaggauag

SEQ ID NO: 1371047 - RNA, 19 nt, Homo sapiens
cagcuugacuggaaaauaa

SEQ ID NO: 1371048 - RNA, 19 nt, Homo sapiens
gcugauggucccugaauuu

SEQ ID NO: 1371049 - RNA, 19 nt, Homo sapiens
ugaaugagcccugcugaaa

SEQ ID NO: 1371050 - RNA, 19 nt, Homo sapiens
ggaagcuacucaaaccaau

SEQ ID NO: 1371051 - RNA, 19 nt, Homo sapiens
cuaaugggccaaugucuaa

SEQ ID NO: 1371052 - RNA, 19 nt, Homo sapiens
uacauucucuugcuaucua

SEQ ID NO: 1371053 - RNA, 19 nt, Homo sapiens
gaaacagcccaacaggaaa

SEQ ID NO: 1371054 - RNA, 19 nt, Homo sapiens
gggccaaugucuaaagaau

SEQ ID NO: 1371055 - RNA, 19 nt, Homo sapiens
gcuaugccuuguaugacua

SEQ ID NO: 1371056 - RNA, 19 nt, Homo sapiens
gaaguagcaccucauauac

SEQ ID NO: 1371057 - RNA, 19 nt, Homo sapiens
gauuacuggugcgauguua

SEQ ID NO: 1371058 - RNA, 19 nt, Homo sapiens
guagagagaaauggagaua

SEQ ID NO: 1371059 - RNA, 19 nt, Homo sapiens
cauauacauucucuugcua

SEQ ID NO: 1371060 - RNA, 19 nt, Homo sapiens
auaaacaugucaccuacaa

SEQ ID NO: 1371061 - RNA, 19 nt, Homo sapiens
gaugauaaagucagaagau

SEQ ID NO: 1371062 - RNA, 19 nt, Homo sapiens
gaaugagcccugcugaaau

SEQ ID NO: 1371063 - RNA, 19 nt, Homo sapiens
guacaaaccacacaaugca

SEQ ID NO: 1371064 - RNA, 19 nt, Homo sapiens
ugccaaauaugaaacuuga

SEQ ID NO: 1371065 - RNA, 19 nt, Homo sapiens
gaacugcacaucccuaagg

SEQ ID NO: 1371066 - RNA, 19 nt, Homo sapiens
ugacauucauccaguagga

SEQ ID NO: 1371067 - RNA, 19 nt, Homo sapiens
uaacccaaaugcccaggaa

SEQ ID NO: 1371068 - RNA, 19 nt, Homo sapiens
ggaaaaggaagcuuaauau

SEQ ID NO: 1371069 - RNA, 19 nt, Homo sapiens
gagacagcacuuuccauuu

SEQ ID NO: 1371070 - RNA, 19 nt, Homo sapiens
caggugaccauuacucuaa

SEQ ID NO: 1371071 - RNA, 19 nt, Homo sapiens
uguugaagaucgcuuacua

SEQ ID NO: 1371072 - RNA, 19 nt, Homo sapiens
gaacuugaccauaguaagc

SEQ ID NO: 1371073 - RNA, 19 nt, Homo sapiens
cuacagugcaguuucagua

SEQ ID NO: 1371074 - RNA, 19 nt, Homo sapiens
gcauaaaucaggacaagag

SEQ ID NO: 1371075 - RNA, 19 nt, Homo sapiens
aaagaaguagcaccucaua

SEQ ID NO: 1371076 - RNA, 19 nt, Homo sapiens
ccagaugacugcagauagg

SEQ ID NO: 1371077 - RNA, 19 nt, Homo sapiens
gaacuucaauggaaaacau

SEQ ID NO: 1371078 - RNA, 19 nt, Homo sapiens
ggaaucagacucuucacau

SEQ ID NO: 1371079 - RNA, 19 nt, Homo sapiens
uaaagaauuucagguugga

SEQ ID NO: 1371080 - RNA, 19 nt, Homo sapiens
gcaagucucuuuacagaaa

SEQ ID NO: 1371081 - RNA, 19 nt, Homo sapiens
gaauagauuugcuggauuu

SEQ ID NO: 1371082 - RNA, 19 nt, Homo sapiens
gugaacagcugaauagauu

SEQ ID NO: 1371083 - RNA, 19 nt, Homo sapiens
gaaaauggauuggaaagua

SEQ ID NO: 1371084 - RNA, 19 nt, Homo sapiens
guucugacguuauacuuua

SEQ ID NO: 1371085 - RNA, 19 nt, Homo sapiens
caaggaacacgcacaauaa

SEQ ID NO: 1371086 - RNA, 19 nt, Homo sapiens
gccaaugucagguuaauua

SEQ ID NO: 1371087 - RNA, 19 nt, Homo sapiens
gcacauccuugcauuguuc

SEQ ID NO: 1371088 - RNA, 19 nt, Homo sapiens
uuacauaaauggaguccua

SEQ ID NO: 1371089 - RNA, 19 nt, Homo sapiens
acacuuacaucaccuuauu

SEQ ID NO: 1371090 - RNA, 19 nt, Homo sapiens
ccaucugacuucaauauuu

SEQ ID NO: 1371091 - RNA, 19 nt, Homo sapiens
cuaaagcccauacugauua

SEQ ID NO: 1371092 - RNA, 19 nt, Homo sapiens
uaaauggaguccuaaacaa

SEQ ID NO: 1371093 - RNA, 19 nt, Homo sapiens
gcagaaggcauaauuagug

SEQ ID NO: 1371094 - RNA, 19 nt, Homo sapiens
caagggagguuuuacauaa

SEQ ID NO: 1371095 - RNA, 19 nt, Homo sapiens
guuuggugcuguuauaaua

SEQ ID NO: 1371096 - RNA, 19 nt, Homo sapiens
auacagaccuuggcuauga

SEQ ID NO: 1371097 - RNA, 19 nt, Homo sapiens
uaaauugcauugucccuau

SEQ ID NO: 1371098 - RNA, 19 nt, Homo sapiens
caucugacuucaauauuug

SEQ ID NO: 1371099 - RNA, 19 nt, Homo sapiens
guacuaaagcccauacuga

SEQ ID NO: 1371100 - RNA, 19 nt, Homo sapiens
ucaaggaacacgcacaaua

SEQ ID NO: 1371101 - RNA, 19 nt, Homo sapiens
gaacuuauugcuaacuuug

SEQ ID NO: 1371102 - RNA, 19 nt, Homo sapiens
gagaaagacuuacaauagc

SEQ ID NO: 1371103 - RNA, 19 nt, Homo sapiens
gggagugccucauagcaaa

SEQ ID NO: 1371104 - RNA, 19 nt, Homo sapiens
cuagauugauguugguaua

SEQ ID NO: 1371105 - RNA, 19 nt, Homo sapiens
ugaguagucuggaagauau

SEQ ID NO: 1371106 - RNA, 19 nt, Homo sapiens
ggaaugagagacuguauca

SEQ ID NO: 1371107 - RNA, 19 nt, Homo sapiens
gaacagcugaauagauuug

SEQ ID NO: 1371108 - RNA, 19 nt, Homo sapiens
gaaguuuguccuacuaauu

SEQ ID NO: 1371109 - RNA, 19 nt, Homo sapiens
gcucaguuauucagaaguu

SEQ ID NO: 1371110 - RNA, 19 nt, Homo sapiens
uacaucaccuuauugcaua

SEQ ID NO: 1371111 - RNA, 19 nt, Homo sapiens
ggauacaagugaaauacug

SEQ ID NO: 1371112 - RNA, 19 nt, Homo sapiens
uaacuuacgugguggcaau

SEQ ID NO: 1371113 - RNA, 19 nt, Homo sapiens
cuacugaaaucccuaacuu

SEQ ID NO: 1371114 - RNA, 19 nt, Homo sapiens
gaaccucauuucccuuuua

SEQ ID NO: 1371115 - RNA, 19 nt, Homo sapiens
gcagugaacagcugaauag

SEQ ID NO: 1371116 - RNA, 19 nt, Homo sapiens
ggagcagaaggcauaauua

SEQ ID NO: 1371117 - RNA, 19 nt, Homo sapiens
caacauccuuguccauauc

SEQ ID NO: 1371118 - RNA, 19 nt, Homo sapiens
ggaagaaaauggauuggaa

SEQ ID NO: 1371119 - RNA, 19 nt, Homo sapiens
cagaaggcauaauuaguga

SEQ ID NO: 1371120 - RNA, 19 nt, Homo sapiens
gauugauguugguauagua

SEQ ID NO: 1371121 - RNA, 19 nt, Homo sapiens
cugaauggcuugucugaga

SEQ ID NO: 1371122 - RNA, 19 nt, Homo sapiens
uuucagugcuagcaacuua

SEQ ID NO: 1371123 - RNA, 19 nt, Homo sapiens
uuccagaacuuauugcuaa

SEQ ID NO: 1371124 - RNA, 19 nt, Homo sapiens
ucagaaguuuguccuacua

SEQ ID NO: 1371125 - RNA, 19 nt, Homo sapiens
gaaggaauuggaagaguga

SEQ ID NO: 1371126 - RNA, 19 nt, Homo sapiens
gcacucaugcugaaguaaa

SEQ ID NO: 1371127 - RNA, 19 nt, Homo sapiens
agagaaagacuuacaauag

SEQ ID NO: 1371128 - RNA, 19 nt, Homo sapiens
ggaaaggaaugggaaguac

SEQ ID NO: 1371129 - RNA, 19 nt, Homo sapiens
gcaggaggaaggaguguuu

SEQ ID NO: 1371130 - RNA, 19 nt, Homo sapiens
uaacuuugcugccagucuu

SEQ ID NO: 1371131 - RNA, 19 nt, Homo sapiens
uuacuacuguuuccacauu

SEQ ID NO: 1371132 - RNA, 19 nt, Homo sapiens
guaagcaggaguauaaaug

SEQ ID NO: 1371133 - RNA, 19 nt, Homo sapiens
cugauuaucuugacuuugu

SEQ ID NO: 1371134 - RNA, 19 nt, Homo sapiens
gagccacuguuaagagaga

SEQ ID NO: 1371135 - RNA, 19 nt, Homo sapiens
gaucguaggcagaagcaaa

SEQ ID NO: 1371136 - RNA, 19 nt, Homo sapiens
ucuguaagcaggaguauaa

SEQ ID NO: 1371137 - RNA, 19 nt, Homo sapiens
augagagacuguaucaaua

SEQ ID NO: 1371138 - RNA, 19 nt, Homo sapiens
cagcaagucugauugaaac

SEQ ID NO: 1371139 - RNA, 19 nt, Homo sapiens
gaacaccuucuacugaaau

SEQ ID NO: 1371140 - RNA, 19 nt, Homo sapiens
gagcagaaggcauaauuag

SEQ ID NO: 1371141 - RNA, 19 nt, Homo sapiens
cuaguugugugaaucauug

SEQ ID NO: 1371142 - RNA, 19 nt, Homo sapiens
gcuagcaacuuaauuucuc

SEQ ID NO: 1371143 - RNA, 19 nt, Homo sapiens
ugaauagauuugcuggauu

SEQ ID NO: 1371144 - RNA, 19 nt, Homo sapiens
uaccaucucacuccauuua

SEQ ID NO: 1371145 - RNA, 19 nt, Homo sapiens
gcaacuuaauuucucauac

SEQ ID NO: 1371146 - RNA, 19 nt, Homo sapiens
uaaagcccauacugauuau

SEQ ID NO: 1371147 - RNA, 19 nt, Homo sapiens
uaaagaaggaauuggaaga

SEQ ID NO: 1371148 - RNA, 19 nt, Homo sapiens
gaaggcauaauuagugaau

SEQ ID NO: 1371149 - RNA, 19 nt, Homo sapiens
agaguauguuggaugcuua

SEQ ID NO: 1371150 - RNA, 19 nt, Homo sapiens
ugaaaucccuaacuuacgu

SEQ ID NO: 1371151 - RNA, 19 nt, Homo sapiens
ccauuuacagucaucaaua

SEQ ID NO: 1371152 - RNA, 19 nt, Homo sapiens
uugcaagucucuuuacaga

SEQ ID NO: 1371153 - RNA, 19 nt, Homo sapiens
caucaucagcucaguuauu

SEQ ID NO: 1371154 - RNA, 19 nt, Homo sapiens
gaaguuaugagggauacaa

SEQ ID NO: 1371155 - RNA, 19 nt, Homo sapiens
ggaguguguuaaagaagga

SEQ ID NO: 1371156 - RNA, 19 nt, Homo sapiens
uagagccacuguuaagaga

SEQ ID NO: 1371157 - RNA, 19 nt, Homo sapiens
uaagggaugauuagacuug

SEQ ID NO: 1371158 - RNA, 19 nt, Homo sapiens
uaaaggguuuggugcuguu

SEQ ID NO: 1371159 - RNA, 19 nt, Homo sapiens
caauacagaccuuggcuau

SEQ ID NO: 1371160 - RNA, 19 nt, Homo sapiens
gcaugggagugccucauag

SEQ ID NO: 1371161 - RNA, 19 nt, Homo sapiens
gugaaucauugggcuguuu

SEQ ID NO: 1371162 - RNA, 19 nt, Homo sapiens
gagggauacaagugaaaua

SEQ ID NO: 1371163 - RNA, 19 nt, Homo sapiens
aggaaggaguguuugguuu

SEQ ID NO: 1371164 - RNA, 19 nt, Homo sapiens
gaggaaggaguguuugguu

SEQ ID NO: 1371165 - RNA, 19 nt, Homo sapiens
uucauggaguucuucauua

SEQ ID NO: 1371166 - RNA, 19 nt, Homo sapiens
gcaccgccuucacauucaa

SEQ ID NO: 1371167 - RNA, 19 nt, Homo sapiens
cguuauacuuuacccauug

SEQ ID NO: 1371168 - RNA, 19 nt, Homo sapiens
uacaucaucagcucaguua

SEQ ID NO: 1371169 - RNA, 19 nt, Homo sapiens
gcucagcauuaccaucuca

SEQ ID NO: 1371170 - RNA, 19 nt, Homo sapiens
cgacuucuuccgcuucuuu

SEQ ID NO: 1371171 - RNA, 19 nt, Homo sapiens
gaaacagugcagagugaga

SEQ ID NO: 1371172 - RNA, 19 nt, Homo sapiens
acaaauaggagaacaccuu

SEQ ID NO: 1371173 - RNA, 19 nt, Homo sapiens
gaaaggaaugggaaguaca

SEQ ID NO: 1371174 - RNA, 19 nt, Homo sapiens
acauguaacuuggaauuuc

SEQ ID NO: 1371175 - RNA, 19 nt, Homo sapiens
cagaacuuauugcuaacuu

SEQ ID NO: 1371176 - RNA, 19 nt, Homo sapiens
aaauggaguccuaaacaaa

SEQ ID NO: 1371177 - RNA, 19 nt, Homo sapiens
aagcaggaguauaaauguu

SEQ ID NO: 1371178 - RNA, 19 nt, Homo sapiens
guauguuggaugcuuauuu

SEQ ID NO: 1371179 - RNA, 19 nt, Homo sapiens
ccuacuaauucuaaagaga

SEQ ID NO: 1371180 - RNA, 19 nt, Homo sapiens
gcaaaugaauggaaugaaa

SEQ ID NO: 1371181 - RNA, 19 nt, Homo sapiens
ggaaauaugugugugauga

SEQ ID NO: 1371182 - RNA, 19 nt, Homo sapiens
ggaacaaccuaccaacaaa

SEQ ID NO: 1371183 - RNA, 19 nt, Homo sapiens
gaaguuggcaugucuuuaa

SEQ ID NO: 1371184 - RNA, 19 nt, Homo sapiens
ggucuuuacuggcuuauuu

SEQ ID NO: 1371185 - RNA, 19 nt, Homo sapiens
cagaaugguuugcaaagua

SEQ ID NO: 1371186 - RNA, 19 nt, Homo sapiens
gaccugcuauuauuuguaa

SEQ ID NO: 1371187 - RNA, 19 nt, Homo sapiens
ugaaauggaucauggagaa

SEQ ID NO: 1371188 - RNA, 19 nt, Homo sapiens
gcuaaaugcugcuuauuca

SEQ ID NO: 1371189 - RNA, 19 nt, Homo sapiens
uaaaauaucugccccaaaa

SEQ ID NO: 1371190 - RNA, 19 nt, Homo sapiens
gaaagagacauuaauggaa

SEQ ID NO: 1371191 - RNA, 19 nt, Homo sapiens
caugaaagguguuacagaa

SEQ ID NO: 1371192 - RNA, 19 nt, Homo sapiens
gauuuaugcucuaugagua

SEQ ID NO: 1371193 - RNA, 19 nt, Homo sapiens
ugacuuaacugccgaagga

SEQ ID NO: 1371194 - RNA, 19 nt, Homo sapiens
ggagucccaugauugauuu

SEQ ID NO: 1371195 - RNA, 19 nt, Homo sapiens
ggaaagagacauuaaugga

SEQ ID NO: 1371196 - RNA, 19 nt, Homo sapiens
gagacaacauuaugacaga

SEQ ID NO: 1371197 - RNA, 19 nt, Homo sapiens
caugaauucuuacgacuuu

SEQ ID NO: 1371198 - RNA, 19 nt, Homo sapiens
ggacugagcacuguucauu

SEQ ID NO: 1371199 - RNA, 19 nt, Homo sapiens
gaugaucucuaauaaugga

SEQ ID NO: 1371200 - RNA, 19 nt, Homo sapiens
ucagcaguguccuguauua

SEQ ID NO: 1371201 - RNA, 19 nt, Homo sapiens
guuccucccucgcuucuua

SEQ ID NO: 1371202 - RNA, 19 nt, Homo sapiens
ugaaagguguuacagaaga

SEQ ID NO: 1371203 - RNA, 19 nt, Homo sapiens
aagcucauaucccagauua

SEQ ID NO: 1371204 - RNA, 19 nt, Homo sapiens
gaauuucagcugcacguua

SEQ ID NO: 1371205 - RNA, 19 nt, Homo sapiens
ccgaggaacuucaugugua

SEQ ID NO: 1371206 - RNA, 19 nt, Homo sapiens
caacacagauggucagacu

SEQ ID NO: 1371207 - RNA, 19 nt, Homo sapiens
cuacauagcuccuuauagc

SEQ ID NO: 1371208 - RNA, 19 nt, Homo sapiens
aaacccaccuagcuacaua

SEQ ID NO: 1371209 - RNA, 19 nt, Homo sapiens
uagcauccuuccuuacaua

SEQ ID NO: 1371210 - RNA, 19 nt, Homo sapiens
uuaauggacucaucuucua

SEQ ID NO: 1371211 - RNA, 19 nt, Homo sapiens
aaacaucuacccucccuua

SEQ ID NO: 1371212 - RNA, 19 nt, Homo sapiens
uggaggaccugcuauuauu

SEQ ID NO: 1371213 - RNA, 19 nt, Homo sapiens
ggccaggauuaguuucuua

SEQ ID NO: 1371214 - RNA, 19 nt, Homo sapiens
gcaguguccuguauuaugg

SEQ ID NO: 1371215 - RNA, 19 nt, Homo sapiens
gaaagguguuacagaagau

SEQ ID NO: 1371216 - RNA, 19 nt, Homo sapiens
gacaaggguucaccauguu

SEQ ID NO: 1371217 - RNA, 19 nt, Homo sapiens
ccagacagauauugcuuug

SEQ ID NO: 1371218 - RNA, 19 nt, Homo sapiens
agacaaggguucaccaugu

SEQ ID NO: 1371219 - RNA, 19 nt, Homo sapiens
gcaugcagauacuaauaug

SEQ ID NO: 1371220 - RNA, 19 nt, Homo sapiens
ugacagaauucaugagaca

SEQ ID NO: 1371221 - RNA, 19 nt, Homo sapiens
gcuagccauuggaauuaua

SEQ ID NO: 1371222 - RNA, 19 nt, Homo sapiens
caucuacccucccuuaauc

SEQ ID NO: 1371223 - RNA, 19 nt, Homo sapiens
cacaauaaauggaaacauc

SEQ ID NO: 1371224 - RNA, 19 nt, Homo sapiens
cuaccucucuuccuacaaa

SEQ ID NO: 1371225 - RNA, 19 nt, Homo sapiens
ugaugcauguggacuauuu

SEQ ID NO: 1371226 - RNA, 19 nt, Homo sapiens
gaccuucucuuucccuuuc

SEQ ID NO: 1371227 - RNA, 19 nt, Homo sapiens
guaagcauauggagaacau

SEQ ID NO: 1371228 - RNA, 19 nt, Homo sapiens
ggaugugccuuugcucuga

SEQ ID NO: 1371229 - RNA, 19 nt, Homo sapiens
ugaaauucuugguguacua

SEQ ID NO: 1371230 - RNA, 19 nt, Homo sapiens
cuaccaggauuucagauga

SEQ ID NO: 1371231 - RNA, 19 nt, Homo sapiens
cgaggaacuucauguguau

SEQ ID NO: 1371232 - RNA, 19 nt, Homo sapiens
gauaaguugcuucuugaaa

SEQ ID NO: 1371233 - RNA, 19 nt, Homo sapiens
guacuaugcuggugaucug

SEQ ID NO: 1371234 - RNA, 19 nt, Homo sapiens
guugauuuaugcucuauga

SEQ ID NO: 1371235 - RNA, 19 nt, Homo sapiens
gcaguaaguggacgagaaa

SEQ ID NO: 1371236 - RNA, 19 nt, Homo sapiens
gcucugugauggaaaugaa

SEQ ID NO: 1371237 - RNA, 19 nt, Homo sapiens
aaacauugguggaucaaag

SEQ ID NO: 1371238 - RNA, 19 nt, Homo sapiens
ugaugaagguuauucuuuc

SEQ ID NO: 1371239 - RNA, 19 nt, Homo sapiens
ggauauuacauucauggua

SEQ ID NO: 1371240 - RNA, 19 nt, Homo sapiens
gaaucuuccuuggcuguuu

SEQ ID NO: 1371241 - RNA, 19 nt, Homo sapiens
gagcacuguucauucuauu

SEQ ID NO: 1371242 - RNA, 19 nt, Homo sapiens
ggagcgaccuaaaggaaag

SEQ ID NO: 1371243 - RNA, 19 nt, Homo sapiens
cuacacauggccaggauua

SEQ ID NO: 1371244 - RNA, 19 nt, Homo sapiens
uuucuuggcuccuucauug

SEQ ID NO: 1371245 - RNA, 19 nt, Homo sapiens
acacagauggucagacuuu

SEQ ID NO: 1371246 - RNA, 19 nt, Homo sapiens
gggcaugcagauacuaaua

SEQ ID NO: 1371247 - RNA, 19 nt, Homo sapiens
uacagacaguugugaaauu

SEQ ID NO: 1371248 - RNA, 19 nt, Homo sapiens
ucuggaaaguggcuucuaa

SEQ ID NO: 1371249 - RNA, 19 nt, Homo sapiens
guggcaaacuuuagaagga

SEQ ID NO: 1371250 - RNA, 19 nt, Homo sapiens
uguggacuauuucaguuua

SEQ ID NO: 1371251 - RNA, 19 nt, Homo sapiens
gaaauaugugugugaugaa

SEQ ID NO: 1371252 - RNA, 19 nt, Homo sapiens
ggaggaccugcuauuauuu

SEQ ID NO: 1371253 - RNA, 19 nt, Homo sapiens
ucugaaggcacuacaauuu

SEQ ID NO: 1371254 - RNA, 19 nt, Homo sapiens
gagaaaaccagaauacaaa

SEQ ID NO: 1371255 - RNA, 19 nt, Homo sapiens
uuacgacuuugccacauuu

SEQ ID NO: 1371256 - RNA, 19 nt, Homo sapiens
uggcaugucuuuaacuuca

SEQ ID NO: 1371257 - RNA, 19 nt, Homo sapiens
ucauugaccauguucauaa

SEQ ID NO: 1371258 - RNA, 19 nt, Homo sapiens
ucuuaaagcuguugaaggu

SEQ ID NO: 1371259 - RNA, 19 nt, Homo sapiens
uaucccagauuacaauaga

SEQ ID NO: 1371260 - RNA, 19 nt, Homo sapiens
gauauugcuuuggguguau

SEQ ID NO: 1371261 - RNA, 19 nt, Homo sapiens
caagacagcaacucuggaa

SEQ ID NO: 1371262 - RNA, 19 nt, Homo sapiens
gaaccaagacagcaacucu

SEQ ID NO: 1371263 - RNA, 19 nt, Homo sapiens
gcacuguucauucuauuuc

SEQ ID NO: 1371264 - RNA, 19 nt, Homo sapiens
gcagcugcauguuggguau

SEQ ID NO: 1371265 - RNA, 19 nt, Homo sapiens
cgacaacaaccaguacuuu

SEQ ID NO: 1371266 - RNA, 19 nt, Homo sapiens
ccaacacaauaaauggaaa

SEQ ID NO: 1371267 - RNA, 19 nt, Homo sapiens
gaaaaugacuuaggaacuc

SEQ ID NO: 1371268 - RNA, 19 nt, Homo sapiens
agaaugguuugcaaaguau

SEQ ID NO: 1371269 - RNA, 19 nt, Homo sapiens
gagaaguuggcaugucuuu

SEQ ID NO: 1371270 - RNA, 19 nt, Homo sapiens
guacccaacacaauaaaug

SEQ ID NO: 1371271 - RNA, 19 nt, Homo sapiens
cauguggacuauuucaguu

SEQ ID NO: 1371272 - RNA, 19 nt, Homo sapiens
caugagacacuaauaagga

SEQ ID NO: 1371273 - RNA, 19 nt, Homo sapiens
gacaguucguugauuuaug

SEQ ID NO: 1371274 - RNA, 19 nt, Homo sapiens
gaaauucagacugugagaa

SEQ ID NO: 1371275 - RNA, 19 nt, Homo sapiens
caugauugauuuacagaca

SEQ ID NO: 1371276 - RNA, 19 nt, Homo sapiens
gacagcaacucuggaaagu

SEQ ID NO: 1371277 - RNA, 19 nt, Homo sapiens
gauguguaccuugaauaua

SEQ ID NO: 1371278 - RNA, 19 nt, Homo sapiens
gacaacaaccaguacuuug

SEQ ID NO: 1371279 - RNA, 19 nt, Homo sapiens
caacuugugagcucuguga

SEQ ID NO: 1371280 - RNA, 19 nt, Homo sapiens
agacggaacucauaaauua

SEQ ID NO: 1371281 - RNA, 19 nt, Homo sapiens
gaaaggagauaaaggaguu

SEQ ID NO: 1371282 - RNA, 19 nt, Homo sapiens
gcaaacggcuguauagaug

SEQ ID NO: 1371283 - RNA, 19 nt, Homo sapiens
ugaaagagaugcaacaaga

SEQ ID NO: 1371284 - RNA, 19 nt, Homo sapiens
guacaacuguuccugaauu

SEQ ID NO: 1371285 - RNA, 19 nt, Homo sapiens
guauaucagugcccauuua

SEQ ID NO: 1371286 - RNA, 19 nt, Homo sapiens
guacauugccugugauaua

SEQ ID NO: 1371287 - RNA, 19 nt, Homo sapiens
ggacuaccuucuugacuuu

SEQ ID NO: 1371288 - RNA, 19 nt, Homo sapiens
gaagcuggacgaucacuua

SEQ ID NO: 1371289 - RNA, 19 nt, Homo sapiens
cauaagaccuccaccucua

SEQ ID NO: 1371290 - RNA, 19 nt, Homo sapiens
agaaacaguuccagaguaa

SEQ ID NO: 1371291 - RNA, 19 nt, Homo sapiens
ggacaacgggagccaaaua

SEQ ID NO: 1371292 - RNA, 19 nt, Homo sapiens
aaaccuaggccucauaaua

SEQ ID NO: 1371293 - RNA, 19 nt, Homo sapiens
gauagggugugguuaaaug

SEQ ID NO: 1371294 - RNA, 19 nt, Homo sapiens
gaaaaggguugucuccuaa

SEQ ID NO: 1371295 - RNA, 19 nt, Homo sapiens
caaauauggugauguagau

SEQ ID NO: 1371296 - RNA, 19 nt, Homo sapiens
gcugugaauugucuuguuu

SEQ ID NO: 1371297 - RNA, 19 nt, Homo sapiens
ggacgucagggcauuguua

SEQ ID NO: 1371298 - RNA, 19 nt, Homo sapiens
acaaguacauugccuguga

SEQ ID NO: 1371299 - RNA, 19 nt, Homo sapiens
gaugauagggugugguuaa

SEQ ID NO: 1371300 - RNA, 19 nt, Homo sapiens
ggaaauauacaacacugaa

SEQ ID NO: 1371301 - RNA, 19 nt, Homo sapiens
gggaaaguaugcagguauu

SEQ ID NO: 1371302 - RNA, 19 nt, Homo sapiens
aaaggaaccugaauaugau

SEQ ID NO: 1371303 - RNA, 19 nt, Homo sapiens
ggaugaaacagaccucuuu

SEQ ID NO: 1371304 - RNA, 19 nt, Homo sapiens
caagauuacucugucauug

SEQ ID NO: 1371305 - RNA, 19 nt, Homo sapiens
gggaaaaucuucuuuacaa

SEQ ID NO: 1371306 - RNA, 19 nt, Homo sapiens
caaaggaaguuguucaaaa

SEQ ID NO: 1371307 - RNA, 19 nt, Homo sapiens
uaagagagaguuuggacua

SEQ ID NO: 1371308 - RNA, 19 nt, Homo sapiens
aagaaacaguuccagagua

SEQ ID NO: 1371309 - RNA, 19 nt, Homo sapiens
caaauaaccauagcaaaug

SEQ ID NO: 1371310 - RNA, 19 nt, Homo sapiens
aaaugaagguucuaaguag

SEQ ID NO: 1371311 - RNA, 19 nt, Homo sapiens
gcaacuggcagcuuucuga

SEQ ID NO: 1371312 - RNA, 19 nt, Homo sapiens
aaacagaccucuuuuggaa

SEQ ID NO: 1371313 - RNA, 19 nt, Homo sapiens
caaacuacuuucuucuuca

SEQ ID NO: 1371314 - RNA, 19 nt, Homo sapiens
gaaagagaugcaacaagaa

SEQ ID NO: 1371315 - RNA, 19 nt, Homo sapiens
gcaagagaaaggagauaaa

SEQ ID NO: 1371316 - RNA, 19 nt, Homo sapiens
gaagcaacuugaagagagu

SEQ ID NO: 1371317 - RNA, 19 nt, Homo sapiens
uaucagugcccauuuauau

SEQ ID NO: 1371318 - RNA, 19 nt, Homo sapiens
aaccaaagguggaauaaca

SEQ ID NO: 1371319 - RNA, 19 nt, Homo sapiens
cagugaggauggucgaaua

SEQ ID NO: 1371320 - RNA, 19 nt, Homo sapiens
gcgaacagauuucaaagcu

SEQ ID NO: 1371321 - RNA, 19 nt, Homo sapiens
auacaacacugaauuugga

SEQ ID NO: 1371322 - RNA, 19 nt, Homo sapiens
ucagugcccauuuauauaa

SEQ ID NO: 1371323 - RNA, 19 nt, Homo sapiens
acaacaaacuacuuucuuc

SEQ ID NO: 1371324 - RNA, 19 nt, Homo sapiens
guugagccauuucgacaaa

SEQ ID NO: 1371325 - RNA, 19 nt, Homo sapiens
gccaauucauuaaggcuuu

SEQ ID NO: 1371326 - RNA, 19 nt, Homo sapiens
gaaauagucaagaaacagu

SEQ ID NO: 1371327 - RNA, 19 nt, Homo sapiens
ggaagucaaugccagaaaa

SEQ ID NO: 1371328 - RNA, 19 nt, Homo sapiens
gaaaucggcaugcaauugg

SEQ ID NO: 1371329 - RNA, 19 nt, Homo sapiens
gaagcaggacaugccauua

SEQ ID NO: 1371330 - RNA, 19 nt, Homo sapiens
uguaauggaugaauuugga

SEQ ID NO: 1371331 - RNA, 19 nt, Homo sapiens
gugguuaaauggagaugaa

SEQ ID NO: 1371332 - RNA, 19 nt, Homo sapiens
ggaugaauuuggaaucagu

SEQ ID NO: 1371333 - RNA, 19 nt, Homo sapiens
gauggaagcaacuugaaga

SEQ ID NO: 1371334 - RNA, 19 nt, Homo sapiens
gaggagaaacugugucuag

SEQ ID NO: 1371335 - RNA, 19 nt, Homo sapiens
agccaaauauggugaugua

SEQ ID NO: 1371336 - RNA, 19 nt, Homo sapiens
acaaacuacuuucuucuuc

SEQ ID NO: 1371337 - RNA, 19 nt, Homo sapiens
ugaauaagagagggaaaua

SEQ ID NO: 1371338 - RNA, 19 nt, Homo sapiens
guucagaguuaaauucagu

SEQ ID NO: 1371339 - RNA, 19 nt, Homo sapiens
gcagcuuucugagugcaua

SEQ ID NO: 1371340 - RNA, 19 nt, Homo sapiens
gaagccacauugcaucucu

SEQ ID NO: 1371341 - RNA, 19 nt, Homo sapiens
caacuucugguucuaauca

SEQ ID NO: 1371342 - RNA, 19 nt, Homo sapiens
aaagagaugcaacaagaaa

SEQ ID NO: 1371343 - RNA, 19 nt, Homo sapiens
agaaagugaugaugagcaa

SEQ ID NO: 1371344 - RNA, 19 nt, Homo sapiens
ugaagaaagugaugaugag

SEQ ID NO: 1371345 - RNA, 19 nt, Homo sapiens
gcucauccuuccucugaau

SEQ ID NO: 1371346 - RNA, 19 nt, Homo sapiens
ccacauugcaucucugcua

SEQ ID NO: 1371347 - RNA, 19 nt, Homo sapiens
agagaugcaacaagaaaua

SEQ ID NO: 1371348 - RNA, 19 nt, Homo sapiens
uaaguuggaugaugauagg

SEQ ID NO: 1371349 - RNA, 19 nt, Homo sapiens
cauugccugugauauauaa

SEQ ID NO: 1371350 - RNA, 19 nt, Homo sapiens
gaaagaggacacaaguaca

SEQ ID NO: 1371351 - RNA, 19 nt, Homo sapiens
gcagacggaacucauaaau

SEQ ID NO: 1371352 - RNA, 19 nt, Homo sapiens
cgaacagauuucaaagcua

SEQ ID NO: 1371353 - RNA, 19 nt, Homo sapiens
ccaaauauggugauguaga

SEQ ID NO: 1371354 - RNA, 19 nt, Homo sapiens
gagaagagaaagaggacaa

SEQ ID NO: 1371355 - RNA, 19 nt, Homo sapiens
gaauuuggaaucaguaagu

SEQ ID NO: 1371356 - RNA, 19 nt, Homo sapiens
aauugaagcuggacgauca

SEQ ID NO: 1371357 - RNA, 19 nt, Homo sapiens
gacugaggcuguuguaucu

SEQ ID NO: 1371358 - RNA, 19 nt, Homo sapiens
aaaaggaaccugaauauga

SEQ ID NO: 1371359 - RNA, 19 nt, Homo sapiens
uaagaggcguggagcuuca

SEQ ID NO: 1371360 - RNA, 19 nt, Homo sapiens
uuucagagauuccacuuca

SEQ ID NO: 1371361 - RNA, 19 nt, Homo sapiens
gaauaagagagggaaauau

SEQ ID NO: 1371362 - RNA, 19 nt, Homo sapiens
cugaaucccuaaccaguga

SEQ ID NO: 1371363 - RNA, 19 nt, Homo sapiens
uacauugccugugauauau

SEQ ID NO: 1371364 - RNA, 19 nt, Homo sapiens
gcaggacaugccauuagua

SEQ ID NO: 1371365 - RNA, 19 nt, Homo sapiens
ggauuucauucauauguac

SEQ ID NO: 1371366 - RNA, 19 nt, Homo sapiens
gauaaucaaagaggagaaa

SEQ ID NO: 1371367 - RNA, 19 nt, Homo sapiens
cgaaaucggcaugcaauug

SEQ ID NO: 1371368 - RNA, 19 nt, Homo sapiens
ccauuauccuccaauacaa

SEQ ID NO: 1371369 - RNA, 19 nt, Homo sapiens
gcucuucagucaugguuag

SEQ ID NO: 1371370 - RNA, 19 nt, Homo sapiens
ggaauaacaaaggaaguug

SEQ ID NO: 1371371 - RNA, 19 nt, Homo sapiens
caucccuccucucuucaua

SEQ ID NO: 1371372 - RNA, 19 nt, Homo sapiens
gaggagaagcugagaagca

SEQ ID NO: 1371373 - RNA, 19 nt, Homo sapiens
agagaaaggagauaaagga

SEQ ID NO: 1371374 - RNA, 19 nt, Homo sapiens
ugaaagaggacacaaguac

SEQ ID NO: 1371375 - RNA, 19 nt, Homo sapiens
agacaggacuuugcaacug

SEQ ID NO: 1371376 - RNA, 19 nt, Homo sapiens
ucauugccuuugagucuuu

SEQ ID NO: 1371377 - RNA, 19 nt, Homo sapiens
caagaaacaguuccagagu

SEQ ID NO: 1371378 - RNA, 19 nt, Homo sapiens
caacaagaaauagucaaga

SEQ ID NO: 1371379 - RNA, 19 nt, Homo sapiens
ccaaagguggaauaacaaa

SEQ ID NO: 1371380 - RNA, 19 nt, Homo sapiens
gaaacuacccaaagucgua

SEQ ID NO: 1371381 - RNA, 19 nt, Homo sapiens
gaugggaggguuccgcuua

SEQ ID NO: 1371382 - RNA, 19 nt, Homo sapiens
uagcggagguugcgucuca

SEQ ID NO: 1371383 - RNA, 19 nt, Homo sapiens
gagaccaaguguagcaaug

SEQ ID NO: 1371384 - RNA, 19 nt, Homo sapiens
ggcagaaacuacccaaagu

SEQ ID NO: 1371385 - RNA, 19 nt, Homo sapiens
gguuagggcuaccuucuca

SEQ ID NO: 1371386 - RNA, 19 nt, Homo sapiens
ggaggguuccgcuuaaaga

SEQ ID NO: 1371387 - RNA, 19 nt, Homo sapiens
ggacgugacaggccagugu

SEQ ID NO: 1371388 - RNA, 19 nt, Homo sapiens
ugaaggcccuguguacugu

SEQ ID NO: 1371389 - RNA, 19 nt, Homo sapiens
gcgacgggcaugccuguaa

SEQ ID NO: 1371390 - RNA, 19 nt, Homo sapiens
gagcagcccucaccauccu

SEQ ID NO: 1371391 - RNA, 19 nt, Homo sapiens
gcagaaacuacccaaaguc

SEQ ID NO: 1371392 - RNA, 19 nt, Homo sapiens
ugacaggccaguguacuug

SEQ ID NO: 1371393 - RNA, 19 nt, Homo sapiens
ugcagccgcuccuggauug

SEQ ID NO: 1371394 - RNA, 19 nt, Homo sapiens
ggagguugcgucucauugg

SEQ ID NO: 1371395 - RNA, 19 nt, Homo sapiens
cagcggacacugcgacuuc

SEQ ID NO: 1371396 - RNA, 19 nt, Homo sapiens
gcagugcgaggacgugaca

SEQ ID NO: 1371397 - RNA, 19 nt, Homo sapiens
ccaggaguggacuugguua

SEQ ID NO: 1371398 - RNA, 19 nt, Homo sapiens
ggugcgagaccaaguguag

SEQ ID NO: 1371399 - RNA, 19 nt, Homo sapiens
gcaaguguacgcgcugcaa

SEQ ID NO: 1371400 - RNA, 19 nt, Homo sapiens
ggccaggaguggacuuggu

SEQ ID NO: 1371401 - RNA, 19 nt, Homo sapiens
gggccuccuucuccucguu

SEQ ID NO: 1371402 - RNA, 19 nt, Homo sapiens
gggcuaccuucucauuggu

SEQ ID NO: 1371403 - RNA, 19 nt, Homo sapiens
ggacgcccagcgacaaauc

SEQ ID NO: 1371404 - RNA, 19 nt, Homo sapiens
gacgugacaggccagugua

SEQ ID NO: 1371405 - RNA, 19 nt, Homo sapiens
gcaacuccacgugcucaga

SEQ ID NO: 1371406 - RNA, 19 nt, Homo sapiens
caugucaccggcaagugua

SEQ ID NO: 1371407 - RNA, 19 nt, Homo sapiens
cgacgggcaugccuguaac

SEQ ID NO: 1371408 - RNA, 19 nt, Homo sapiens
agccuaagguguccuggau

SEQ ID NO: 1371409 - RNA, 19 nt, Homo sapiens
ccaugucaccggcaagugu

SEQ ID NO: 1371410 - RNA, 19 nt, Homo sapiens
uuagggcuaccuucucauu

SEQ ID NO: 1371411 - RNA, 19 nt, Homo sapiens
gccaggaguggacuugguu

SEQ ID NO: 1371412 - RNA, 19 nt, Homo sapiens
ugggaggguuccgcuuaaa

SEQ ID NO: 1371413 - RNA, 19 nt, Homo sapiens
gcgucucauuggccaaaga

SEQ ID NO: 1371414 - RNA, 19 nt, Homo sapiens
gcgagauccuguucaauga

SEQ ID NO: 1371415 - RNA, 19 nt, Homo sapiens
ucacgacaguggagagaaa

SEQ ID NO: 1371416 - RNA, 19 nt, Homo sapiens
gagauccuguucaaugaug

SEQ ID NO: 1371417 - RNA, 19 nt, Homo sapiens
ccacucacccgaucuccua

SEQ ID NO: 1371418 - RNA, 19 nt, Homo sapiens
gcacugcucaccugucugu

SEQ ID NO: 1371419 - RNA, 19 nt, Homo sapiens
cagccgcucucgucaaugu

SEQ ID NO: 1371420 - RNA, 19 nt, Homo sapiens
ccacugcacuggccaucau

SEQ ID NO: 1371421 - RNA, 19 nt, Homo sapiens
ucagcgagauccuguucaa

SEQ ID NO: 1371422 - RNA, 19 nt, Homo sapiens
gacuucagcucucccaaca

SEQ ID NO: 1371423 - RNA, 19 nt, Homo sapiens
caccaucaaccucuacuuu

SEQ ID NO: 1371424 - RNA, 19 nt, Homo sapiens
ccaucaaccucuacuuugg

SEQ ID NO: 1371425 - RNA, 19 nt, Homo sapiens
ucaaugaugaaauggauga

SEQ ID NO: 1371426 - RNA, 19 nt, Homo sapiens
gggcacugcucaccugucu

SEQ ID NO: 1371427 - RNA, 19 nt, Homo sapiens
gcacuggccaucaucuaca

SEQ ID NO: 1371428 - RNA, 19 nt, Homo sapiens
cuucagcucucccaacauc

SEQ ID NO: 1371429 - RNA, 19 nt, Homo sapiens
ucaaugugcccgacgauca

SEQ ID NO: 1371430 - RNA, 19 nt, Homo sapiens
gacaguggagagaaacauu

SEQ ID NO: 1371431 - RNA, 19 nt, Homo sapiens
ccagcaccaucaaccucua

SEQ ID NO: 1371432 - RNA, 19 nt, Homo sapiens
guucggcuaugacgugaag

SEQ ID NO: 1371433 - RNA, 19 nt, Homo sapiens
acuacaagcccgaguucua

SEQ ID NO: 1371434 - RNA, 19 nt, Homo sapiens
cacccgaucuccuacuaca

SEQ ID NO: 1371435 - RNA, 19 nt, Homo sapiens
ggucagcgagauccuguuc

SEQ ID NO: 1371436 - RNA, 19 nt, Homo sapiens
augaugaaauggaugacuu

SEQ ID NO: 1371437 - RNA, 19 nt, Homo sapiens
caguggagagaaacauuga

SEQ ID NO: 1371438 - RNA, 19 nt, Homo sapiens
gcaccaucaaccucuacuu

SEQ ID NO: 1371439 - RNA, 19 nt, Homo sapiens
gcaauaagaugcucggauu

SEQ ID NO: 1371440 - RNA, 19 nt, Homo sapiens
cgagaggucuggaugguuu

SEQ ID NO: 1371441 - RNA, 19 nt, Homo sapiens
uaagagaccuguacucagu

SEQ ID NO: 1371442 - RNA, 19 nt, Homo sapiens
gaaguuggcggucuaagga

SEQ ID NO: 1371443 - RNA, 19 nt, Homo sapiens
gaaagugacagaguaaaug

SEQ ID NO: 1371444 - RNA, 19 nt, Homo sapiens
ggauuaacuuucccugaug

SEQ ID NO: 1371445 - RNA, 19 nt, Homo sapiens
gaugagggucagagacuua

SEQ ID NO: 1371446 - RNA, 19 nt, Homo sapiens
ggccaacagugcaacauga

SEQ ID NO: 1371447 - RNA, 19 nt, Homo sapiens
ggaaagugacagaguaaau

SEQ ID NO: 1371448 - RNA, 19 nt, Homo sapiens
gggagaaguuggcggucua

SEQ ID NO: 1371449 - RNA, 19 nt, Homo sapiens
gcaauguguuucugcaucu

SEQ ID NO: 1371450 - RNA, 19 nt, Homo sapiens
ccaacaccaucgauaacuu

SEQ ID NO: 1371451 - RNA, 19 nt, Homo sapiens
gaagaucgggcuccugaca

SEQ ID NO: 1371452 - RNA, 19 nt, Homo sapiens
ggaccaugcugcgcucaga

SEQ ID NO: 1371453 - RNA, 19 nt, Homo sapiens
uggauuaacuuucccugau

SEQ ID NO: 1371454 - RNA, 19 nt, Homo sapiens
ccguuuguaucuguaaaua

SEQ ID NO: 1371455 - RNA, 19 nt, Homo sapiens
ggggugagauggacagaaa

SEQ ID NO: 1371456 - RNA, 19 nt, Homo sapiens
cuucaccucuggcggcuuu

SEQ ID NO: 1371457 - RNA, 19 nt, Homo sapiens
caacaccaucgauaacuuc

SEQ ID NO: 1371458 - RNA, 19 nt, Homo sapiens
caacagugcaacaugaagu

SEQ ID NO: 1371459 - RNA, 19 nt, Homo sapiens
gcugugauuccguuuguau

SEQ ID NO: 1371460 - RNA, 19 nt, Homo sapiens
ggagaaguuggcggucuaa

SEQ ID NO: 1371461 - RNA, 19 nt, Homo sapiens
gagggucagagacuuaaga

SEQ ID NO: 1371462 - RNA, 19 nt, Homo sapiens
guccggagcaucaaaguca

SEQ ID NO: 1371463 - RNA, 19 nt, Homo sapiens
cgugcucccugaccucuug

SEQ ID NO: 1371464 - RNA, 19 nt, Homo sapiens
gcccaaggcuccucuuccu

SEQ ID NO: 1371465 - RNA, 19 nt, Homo sapiens
guacucagucgcuaucucu

SEQ ID NO: 1371466 - RNA, 19 nt, Homo sapiens
gcucuucguggauuaacuu

SEQ ID NO: 1371467 - RNA, 19 nt, Homo sapiens
ccagcuuccuugugagcaa

SEQ ID NO: 1371468 - RNA, 19 nt, Homo sapiens
ccuccuggguucccucaug

SEQ ID NO: 1371469 - RNA, 19 nt, Homo sapiens
uggccaacaccaucgauaa

SEQ ID NO: 1371470 - RNA, 19 nt, Homo sapiens
ugaccuuccuggcguugga

SEQ ID NO: 1371471 - RNA, 19 nt, Homo sapiens
uuucagaaguggccaucga

SEQ ID NO: 1371472 - RNA, 19 nt, Homo sapiens
ucugugaccgcauauguga

SEQ ID NO: 1371473 - RNA, 19 nt, Homo sapiens
gugcgggcaucgugguaau

SEQ ID NO: 1371474 - RNA, 19 nt, Homo sapiens
ugagauggacagaaagcuu

SEQ ID NO: 1371475 - RNA, 19 nt, Homo sapiens
gauuccguuuguaucugua

SEQ ID NO: 1371476 - RNA, 19 nt, Homo sapiens
ugauuccguuuguaucugu

SEQ ID NO: 1371477 - RNA, 19 nt, Homo sapiens
ucucgcucuucguggauua

SEQ ID NO: 1371478 - RNA, 19 nt, Homo sapiens
gccaacagugcaacaugaa

SEQ ID NO: 1371479 - RNA, 19 nt, Homo sapiens
cuuaagagaccuguacuca

SEQ ID NO: 1371480 - RNA, 19 nt, Homo sapiens
aauaagaugcucggauuca

SEQ ID NO: 1371481 - RNA, 19 nt, Homo sapiens
gggaaagugacagaguaaa

SEQ ID NO: 1371482 - RNA, 19 nt, Homo sapiens
uggccauccuccugcauga

SEQ ID NO: 1371483 - RNA, 19 nt, Homo sapiens
cgcuaucucugcccaauac

SEQ ID NO: 1371484 - RNA, 19 nt, Homo sapiens
caauaagaugcucggauuc

SEQ ID NO: 1371485 - RNA, 19 nt, Homo sapiens
gaaggccaacagugcaaca

SEQ ID NO: 1371486 - RNA, 19 nt, Homo sapiens
ugacaaccauggccauccu

SEQ ID NO: 1371487 - RNA, 19 nt, Homo sapiens
acucuugggcaauguguuu

SEQ ID NO: 1371488 - RNA, 19 nt, Homo sapiens
cuacaucgccuuggugaac

SEQ ID NO: 1371489 - RNA, 19 nt, Homo sapiens
gccauccuccugcaugaga

SEQ ID NO: 1371490 - RNA, 19 nt, Homo sapiens
caaagaagcuguuauaguc

SEQ ID NO: 1371491 - RNA, 19 nt, Homo sapiens
gagaaagaguucauacauu

SEQ ID NO: 1371492 - RNA, 19 nt, Homo sapiens
ucaaacagcugaagaagug

SEQ ID NO: 1371493 - RNA, 19 nt, Homo sapiens
gaagauguauugggaaaga

SEQ ID NO: 1371494 - RNA, 19 nt, Homo sapiens
gaagaacaccaucaacaaa

SEQ ID NO: 1371495 - RNA, 19 nt, Homo sapiens
gaaaggagagagaaaguga

SEQ ID NO: 1371496 - RNA, 19 nt, Homo sapiens
caacaaauguccaucuuac

SEQ ID NO: 1371497 - RNA, 19 nt, Homo sapiens
uuauaaagccugccaaaua

SEQ ID NO: 1371498 - RNA, 19 nt, Homo sapiens
gguaguagucacuuauuua

SEQ ID NO: 1371499 - RNA, 19 nt, Homo sapiens
gcaaagaagcuguuauagu

SEQ ID NO: 1371500 - RNA, 19 nt, Homo sapiens
ggaagaacaccaucaacaa

SEQ ID NO: 1371501 - RNA, 19 nt, Homo sapiens
guguucagcugucagaaua

SEQ ID NO: 1371502 - RNA, 19 nt, Homo sapiens
aauaugugcuggaauguaa

SEQ ID NO: 1371503 - RNA, 19 nt, Homo sapiens
cagaauaacagccaauaaa

SEQ ID NO: 1371504 - RNA, 19 nt, Homo sapiens
caagaaucauuugcuguuu

SEQ ID NO: 1371505 - RNA, 19 nt, Homo sapiens
uauaaagccugccaaauac

SEQ ID NO: 1371506 - RNA, 19 nt, Homo sapiens
auaaauaugugcuggaaug

SEQ ID NO: 1371507 - RNA, 19 nt, Homo sapiens
ggguggcucucuuguaauu

SEQ ID NO: 1371508 - RNA, 19 nt, Homo sapiens
caacugcaacugauacaaa

SEQ ID NO: 1371509 - RNA, 19 nt, Homo sapiens
caucaaggcucggaccaaa

SEQ ID NO: 1371510 - RNA, 19 nt, Homo sapiens
gcagauagagcgagagugu

SEQ ID NO: 1371511 - RNA, 19 nt, Homo sapiens
guauaaauaugugcuggaa

SEQ ID NO: 1371512 - RNA, 19 nt, Homo sapiens
guggcucucuuguaauuaa

SEQ ID NO: 1371513 - RNA, 19 nt, Homo sapiens
caacugauacaaaugaaug

SEQ ID NO: 1371514 - RNA, 19 nt, Homo sapiens
uggcaaagaagcuguuaua

SEQ ID NO: 1371515 - RNA, 19 nt, Homo sapiens
aagaagauguauugggaaa

SEQ ID NO: 1371516 - RNA, 19 nt, Homo sapiens
caggagaaauacaguggaa

SEQ ID NO: 1371517 - RNA, 19 nt, Homo sapiens
ccaauucgcccuaagacuu

SEQ ID NO: 1371518 - RNA, 19 nt, Homo sapiens
aaagaugcaugaggaagaa

SEQ ID NO: 1371519 - RNA, 19 nt, Homo sapiens
guucauacauuuuccagua

SEQ ID NO: 1371520 - RNA, 19 nt, Homo sapiens
auagagaacugugcgauga

SEQ ID NO: 1371521 - RNA, 19 nt, Homo sapiens
ucaggaaggugcuuuaaaa

SEQ ID NO: 1371522 - RNA, 19 nt, Homo sapiens
gcaaagaaugucuggaaca

SEQ ID NO: 1371523 - RNA, 19 nt, Homo sapiens
gaacaccaucaacaaaugu

SEQ ID NO: 1371524 - RNA, 19 nt, Homo sapiens
ccaagaaucauuugcuguu

SEQ ID NO: 1371525 - RNA, 19 nt, Homo sapiens
ccugcuggcuuuaguagaa

SEQ ID NO: 1371526 - RNA, 19 nt, Homo sapiens
gaggaggaacacaggauaa

SEQ ID NO: 1371527 - RNA, 19 nt, Homo sapiens
ucaacaaauguccaucuua

SEQ ID NO: 1371528 - RNA, 19 nt, Homo sapiens
agaacaccaucaacaaaug

SEQ ID NO: 1371529 - RNA, 19 nt, Homo sapiens
gaaauacaguggaaaaugc

SEQ ID NO: 1371530 - RNA, 19 nt, Homo sapiens
caauucgcccuaagacuuu

SEQ ID NO: 1371531 - RNA, 19 nt, Homo sapiens
gaacuauugcccuuaagca

SEQ ID NO: 1371532 - RNA, 19 nt, Homo sapiens
acaaauguccaucuuacaa

SEQ ID NO: 1371533 - RNA, 19 nt, Homo sapiens
gagcaaaaccucucaggaa

SEQ ID NO: 1371534 - RNA, 19 nt, Homo sapiens
agaaucauuugcuguuuca

SEQ ID NO: 1371535 - RNA, 19 nt, Homo sapiens
ugagaaagaguucauacau

SEQ ID NO: 1371536 - RNA, 19 nt, Homo sapiens
uggccuguuuccucauuua

SEQ ID NO: 1371537 - RNA, 19 nt, Homo sapiens
gcgaugaugagaaagaguu

SEQ ID NO: 1371538 - RNA, 19 nt, Homo sapiens
ugguaguagucacuuauuu

SEQ ID NO: 1371539 - RNA, 19 nt, Homo sapiens
ucagaauaacagccaauaa

SEQ ID NO: 1371540 - RNA, 19 nt, Homo sapiens
gaacugugcgaugaugaga

SEQ ID NO: 1371541 - RNA, 19 nt, Homo sapiens
cggaggaggagcccgaaua

SEQ ID NO: 1371542 - RNA, 19 nt, Homo sapiens
ggcggucaguaaccuguaa

SEQ ID NO: 1371543 - RNA, 19 nt, Homo sapiens
accaaggaauggccuguuu

SEQ ID NO: 1371544 - RNA, 19 nt, Homo sapiens
acugugcgaugaugagaaa

SEQ ID NO: 1371545 - RNA, 19 nt, Homo sapiens
ggagaaauacaguggaaaa

SEQ ID NO: 1371546 - RNA, 19 nt, Homo sapiens
cgcgaacuauugcccuuaa

SEQ ID NO: 1371547 - RNA, 19 nt, Homo sapiens
ugagugcuauaauucugaa

SEQ ID NO: 1371548 - RNA, 19 nt, Homo sapiens
ggacuuggcggucaguaac

SEQ ID NO: 1371549 - RNA, 19 nt, Homo sapiens
uggcaaagaaugucuggaa

SEQ ID NO: 1371550 - RNA, 19 nt, Homo sapiens
aaucuguguuggcaaagaa

SEQ ID NO: 1371551 - RNA, 19 nt, Homo sapiens
agauagagcgagaguguga

SEQ ID NO: 1371552 - RNA, 19 nt, Homo sapiens
aagaaucauuugcuguuuc

SEQ ID NO: 1371553 - RNA, 19 nt, Homo sapiens
uaaagccugccaaauacuu

SEQ ID NO: 1371554 - RNA, 19 nt, Homo sapiens
ggagagagaaagugaaacg

SEQ ID NO: 1371555 - RNA, 19 nt, Homo sapiens
uaugagugcuauaauucug

SEQ ID NO: 1371556 - RNA, 19 nt, Homo sapiens
auuaaucuguguuggcaaa

SEQ ID NO: 1371557 - RNA, 19 nt, Homo sapiens
ggaggaggagcccgaauac

SEQ ID NO: 1371558 - RNA, 19 nt, Homo sapiens
guaacagagcuacaacuag

SEQ ID NO: 1371559 - RNA, 19 nt, Homo sapiens
cuagcggccaggagaaaua

SEQ ID NO: 1371560 - RNA, 19 nt, Homo sapiens
gaaaaugcaaaacaacgaa

SEQ ID NO: 1371561 - RNA, 19 nt, Homo sapiens
gaaaauuagagugguagua

SEQ ID NO: 1371562 - RNA, 19 nt, Homo sapiens
gcaacugauacaaaugaau

SEQ ID NO: 1371563 - RNA, 19 nt, Homo sapiens
aagaacaccaucaacaaau

SEQ ID NO: 1371564 - RNA, 19 nt, Homo sapiens
agagaacugugcgaugaug

SEQ ID NO: 1371565 - RNA, 19 nt, Homo sapiens
gcuguuauagucuucugaa

SEQ ID NO: 1371566 - RNA, 19 nt, Homo sapiens
uaaucuguguuggcaaaga

SEQ ID NO: 1371567 - RNA, 19 nt, Homo sapiens
ugaggaagaacaccaucaa

SEQ ID NO: 1371568 - RNA, 19 nt, Homo sapiens
gagaacugugcgaugauga

SEQ ID NO: 1371569 - RNA, 19 nt, Homo sapiens
cgccucagcccaagaauca

SEQ ID NO: 1371570 - RNA, 19 nt, Homo sapiens
aaggagagagaaagugaaa

SEQ ID NO: 1371571 - RNA, 19 nt, Homo sapiens
gcgcgaacuauugcccuua

SEQ ID NO: 1371572 - RNA, 19 nt, Homo sapiens
ggaaagaaaacuacaaacu

SEQ ID NO: 1371573 - RNA, 19 nt, Homo sapiens
agaggaggaacacaggaua

SEQ ID NO: 1371574 - RNA, 19 nt, Homo sapiens
cugcaacugauacaaauga

SEQ ID NO: 1371575 - RNA, 19 nt, Homo sapiens
aaauaugugcuggaaugua

SEQ ID NO: 1371576 - RNA, 19 nt, Homo sapiens
gcauccugcuggcuuuagu

SEQ ID NO: 1371577 - RNA, 19 nt, Homo sapiens
cgacgccucagcccaagaa

SEQ ID NO: 1371578 - RNA, 19 nt, Homo sapiens
aagaagugcugggagaaca

SEQ ID NO: 1371579 - RNA, 19 nt, Homo sapiens
acaaaugaaugaggugcau

SEQ ID NO: 1371580 - RNA, 19 nt, Homo sapiens
gaagaagugcugggagaac

SEQ ID NO: 1371581 - RNA, 19 nt, Homo sapiens
aaagugaugcgcgaacuau

SEQ ID NO: 1371582 - RNA, 19 nt, Homo sapiens
aaauuagagugguaguagu

SEQ ID NO: 1371583 - RNA, 19 nt, Homo sapiens
gcuacaacuaggaaaauua

SEQ ID NO: 1371584 - RNA, 19 nt, Homo sapiens
ugagauggcagaggaggaa

SEQ ID NO: 1371585 - RNA, 19 nt, Homo sapiens
ugaggugcauguggccaaa

SEQ ID NO: 1371586 - RNA, 19 nt, Homo sapiens
gugcuggaauguaagaaaa

SEQ ID NO: 1371587 - RNA, 19 nt, Homo sapiens
caaccugaacccucguguu

SEQ ID NO: 1371588 - RNA, 19 nt, Homo sapiens
ccucagcccaagaaucauu

SEQ ID NO: 1371589 - RNA, 19 nt, Homo sapiens
gcucucuuguaauuaaucu

SEQ ID NO: 1371590 - RNA, 19 nt, Homo sapiens
ggacggagaucgaguucau

SEQ ID NO: 1371591 - RNA, 19 nt, Homo sapiens
gaaagaaguagcuguguuc

SEQ ID NO: 1371592 - RNA, 19 nt, Homo sapiens
cgaaagaaguagcuguguu

SEQ ID NO: 1371593 - RNA, 19 nt, Homo sapiens
gcucagugcuguaguccaa

SEQ ID NO: 1371594 - RNA, 19 nt, Homo sapiens
gcgcuuggcugcuuucuac

SEQ ID NO: 1371595 - RNA, 19 nt, Homo sapiens
ggccagguguuccuuuauu

SEQ ID NO: 1371596 - RNA, 19 nt, Homo sapiens
gagcccagcgcuacaagua

SEQ ID NO: 1371597 - RNA, 19 nt, Homo sapiens
gccagguguuccuuuauuu

SEQ ID NO: 1371598 - RNA, 19 nt, Homo sapiens
gaagcucagugcuguaguc

SEQ ID NO: 1371599 - RNA, 19 nt, Homo sapiens
gaucugggcaccaauaaag

SEQ ID NO: 1371600 - RNA, 19 nt, Homo sapiens
gagguagucuagucugcaa

SEQ ID NO: 1371601 - RNA, 19 nt, Homo sapiens
guggccaccuuccuaauug

SEQ ID NO: 1371602 - RNA, 19 nt, Homo sapiens
gccaguggguggaggaguu

SEQ ID NO: 1371603 - RNA, 19 nt, Homo sapiens
ggagaucgaguucauguac

SEQ ID NO: 1371604 - RNA, 19 nt, Homo sapiens
gcaacuacaacuucuucaa

SEQ ID NO: 1371605 - RNA, 19 nt, Homo sapiens
ccagguaucccuuccacaa

SEQ ID NO: 1371606 - RNA, 19 nt, Homo sapiens
cagcccauccugcccuuua

SEQ ID NO: 1371607 - RNA, 19 nt, Homo sapiens
gagaucgaguucauguaca

SEQ ID NO: 1371608 - RNA, 19 nt, Homo sapiens
ucacugcccucaccuacca

SEQ ID NO: 1371609 - RNA, 19 nt, Homo sapiens
gaaccacuuucaccuucca

SEQ ID NO: 1371610 - RNA, 19 nt, Homo sapiens
ugggccagguguuccuuua

SEQ ID NO: 1371611 - RNA, 19 nt, Homo sapiens
gcucaggcaguuuggacua

SEQ ID NO: 1371612 - RNA, 19 nt, Homo sapiens
acucagagguagucuaguc

SEQ ID NO: 1371613 - RNA, 19 nt, Homo sapiens
gcgccacccugucaucuac

SEQ ID NO: 1371614 - RNA, 19 nt, Homo sapiens
cauggcagccgcaagaaga

SEQ ID NO: 1371615 - RNA, 19 nt, Homo sapiens
caacuacaacuucuucaac

SEQ ID NO: 1371616 - RNA, 19 nt, Homo sapiens
gagggcauccuaccugcaa

SEQ ID NO: 1371617 - RNA, 19 nt, Homo sapiens
acuauugccucugugauug

SEQ ID NO: 1371618 - RNA, 19 nt, Homo sapiens
gcacagcccgugguucaca

SEQ ID NO: 1371619 - RNA, 19 nt, Homo sapiens
uuagaucugggcaccaaua

SEQ ID NO: 1371620 - RNA, 19 nt, Homo sapiens
agaucgaguucauguacaa

SEQ ID NO: 1371621 - RNA, 19 nt, Homo sapiens
gcuuaccacugcgcuguug

SEQ ID NO: 1371622 - RNA, 19 nt, Homo sapiens
ugaugacgcuggugcuuac

SEQ ID NO: 1371623 - RNA, 19 nt, Homo sapiens
gucaucuacuugcugcuuu

SEQ ID NO: 1371624 - RNA, 19 nt, Homo sapiens
ccagaaccacuuucaccuu

SEQ ID NO: 1371625 - RNA, 19 nt, Homo sapiens
gcccagcgcuacaaguacu

SEQ ID NO: 1371626 - RNA, 19 nt, Homo sapiens
caacuccuacggccucuuc

SEQ ID NO: 1371627 - RNA, 19 nt, Homo sapiens
caacuucuucaaccugaug

SEQ ID NO: 1371628 - RNA, 19 nt, Homo sapiens
uaucaucaccggcaacuac

SEQ ID NO: 1371629 - RNA, 19 nt, Homo sapiens
ccaccuuccuaauugagau

SEQ ID NO: 1371630 - RNA, 19 nt, Homo sapiens
gggcaaggagccagugauc

SEQ ID NO: 1371631 - RNA, 19 nt, Homo sapiens
cgccuggacuggcagaugu

SEQ ID NO: 1371632 - RNA, 19 nt, Homo sapiens
guggccuuguuccugauua

SEQ ID NO: 1371633 - RNA, 19 nt, Homo sapiens
cacugacgcugcccacugu

SEQ ID NO: 1371634 - RNA, 19 nt, Homo sapiens
ucaucuacuugcugcuuug

SEQ ID NO: 1371635 - RNA, 19 nt, Homo sapiens
gugauuggcccaggaggaa

SEQ ID NO: 1371636 - RNA, 19 nt, Homo sapiens
cacuauugccucugugauu

SEQ ID NO: 1371637 - RNA, 19 nt, Homo sapiens
ggacuggcagaugugguuu

SEQ ID NO: 1371638 - RNA, 19 nt, Homo sapiens
gguaucccuuccacaagca

SEQ ID NO: 1371639 - RNA, 19 nt, Homo sapiens
uagaucugggcaccaauaa

SEQ ID NO: 1371640 - RNA, 19 nt, Homo sapiens
ccagguguuccuuuauuuc

SEQ ID NO: 1371641 - RNA, 19 nt, Homo sapiens
ggccagccucccagaaaga

SEQ ID NO: 1371642 - RNA, 19 nt, Homo sapiens
ccugcugggugcacuagug

SEQ ID NO: 1371643 - RNA, 19 nt, Homo sapiens
gcuguuccgccucauguuc

SEQ ID NO: 1371644 - RNA, 19 nt, Homo sapiens
agaagcaucuuguguugua

SEQ ID NO: 1371645 - RNA, 19 nt, Homo sapiens
ggaaacagcacuucaucaa

SEQ ID NO: 1371646 - RNA, 19 nt, Homo sapiens
ccagaagcaucuuguguug

SEQ ID NO: 1371647 - RNA, 19 nt, Homo sapiens
caucuuguguuguauaugu

SEQ ID NO: 1371648 - RNA, 19 nt, Homo sapiens
gaaaguggggaauuuaaua

SEQ ID NO: 1371649 - RNA, 19 nt, Homo sapiens
caacaacgccaccuaugug

SEQ ID NO: 1371650 - RNA, 19 nt, Homo sapiens
gcaacaacgccaccuaugu

SEQ ID NO: 1371651 - RNA, 19 nt, Homo sapiens
gaccugaccugggcauguu

SEQ ID NO: 1371652 - RNA, 19 nt, Homo sapiens
guggaggucuggaacgauu

SEQ ID NO: 1371653 - RNA, 19 nt, Homo sapiens
ggugugauuuguuguagau

SEQ ID NO: 1371654 - RNA, 19 nt, Homo sapiens
gcauguuccuguuucuuca

SEQ ID NO: 1371655 - RNA, 19 nt, Homo sapiens
gcucuuggcagucaacaga

SEQ ID NO: 1371656 - RNA, 19 nt, Homo sapiens
gaauuuggugugauuuguu

SEQ ID NO: 1371657 - RNA, 19 nt, Homo sapiens
uagaauuuguccucggaaa

SEQ ID NO: 1371658 - RNA, 19 nt, Homo sapiens
ggucuccugcuuuauauga

SEQ ID NO: 1371659 - RNA, 19 nt, Homo sapiens
gccagaagcaucuuguguu

SEQ ID NO: 1371660 - RNA, 19 nt, Homo sapiens
ugaauuuggugugauuugu

SEQ ID NO: 1371661 - RNA, 19 nt, Homo sapiens
ggaagcggcagaugaaggu

SEQ ID NO: 1371662 - RNA, 19 nt, Homo sapiens
gacagaagccacgguccua

SEQ ID NO: 1371663 - RNA, 19 nt, Homo sapiens
gaaacagcacuucaucaac

SEQ ID NO: 1371664 - RNA, 19 nt, Homo sapiens
gcagaugaaggucaguaau

SEQ ID NO: 1371665 - RNA, 19 nt, Homo sapiens
gaagcaucuuguguuguau

SEQ ID NO: 1371666 - RNA, 19 nt, Homo sapiens
ggucuggaacgauuucaug

SEQ ID NO: 1371667 - RNA, 19 nt, Homo sapiens
ugacccugcuggagacaga

SEQ ID NO: 1371668 - RNA, 19 nt, Homo sapiens
ugcacuaccuugucuguca

SEQ ID NO: 1371669 - RNA, 19 nt, Homo sapiens
aauuuggugugauuuguug

SEQ ID NO: 1371670 - RNA, 19 nt, Homo sapiens
cagaugaaggucaguaauc

SEQ ID NO: 1371671 - RNA, 19 nt, Homo sapiens
gccaucaagcccuccgaua

SEQ ID NO: 1371672 - RNA, 19 nt, Homo sapiens
gccugacuccugccugaua

SEQ ID NO: 1371673 - RNA, 19 nt, Homo sapiens
gcguguggguaauuguguu

SEQ ID NO: 1371674 - RNA, 19 nt, Homo sapiens
gcucagccccucccaguuu

SEQ ID NO: 1371675 - RNA, 19 nt, Homo sapiens
gagcaggagcggguucuuc

SEQ ID NO: 1371676 - RNA, 19 nt, Homo sapiens
gcucccaggugaagagacu

SEQ ID NO: 1371677 - RNA, 19 nt, Homo sapiens
gcggaaacagcacuucauc

SEQ ID NO: 1371678 - RNA, 19 nt, Homo sapiens
ggcagaugaaggucaguaa

SEQ ID NO: 1371679 - RNA, 19 nt, Homo sapiens
gccaguacauggaccucau

SEQ ID NO: 1371680 - RNA, 19 nt, Homo sapiens
aagcaucuuguguuguaua

SEQ ID NO: 1371681 - RNA, 19 nt, Homo sapiens
ggcauguuccuguuucuuc

SEQ ID NO: 1371682 - RNA, 19 nt, Homo sapiens
acgcagcucuuggcaguca

SEQ ID NO: 1371683 - RNA, 19 nt, Homo sapiens
ccaucaagcccuccgauac

SEQ ID NO: 1371684 - RNA, 19 nt, Homo sapiens
cuggaacgauuucaugaac

SEQ ID NO: 1371685 - RNA, 19 nt, Homo sapiens
ggaggucuggaacgauuuc

SEQ ID NO: 1371686 - RNA, 19 nt, Homo sapiens
agaagccacgguccuaaga

SEQ ID NO: 1371687 - RNA, 19 nt, Homo sapiens
agaugaaggucaguaaucg

SEQ ID NO: 1371688 - RNA, 19 nt, Homo sapiens
ggaaaguggggaauuuaau

SEQ ID NO: 1371689 - RNA, 19 nt, Homo sapiens
gggaaaguggggaauuuaa

SEQ ID NO: 1371690 - RNA, 19 nt, Homo sapiens
aaaacucgccccacuggua

SEQ ID NO: 1371691 - RNA, 19 nt, Homo sapiens
gcacagaggcccugaauga

SEQ ID NO: 1371692 - RNA, 19 nt, Homo sapiens
gaacagcuccaucaaguuu

SEQ ID NO: 1371693 - RNA, 19 nt, Homo sapiens
caagauggcugucaccuau

SEQ ID NO: 1371694 - RNA, 19 nt, Homo sapiens
gaggagcgcucauuccauu

SEQ ID NO: 1371695 - RNA, 19 nt, Homo sapiens
agaauaaacugucuguuga

SEQ ID NO: 1371696 - RNA, 19 nt, Homo sapiens
gggaacagcuccaucaagu

SEQ ID NO: 1371697 - RNA, 19 nt, Homo sapiens
gcagcaaccuggacaugga

SEQ ID NO: 1371698 - RNA, 19 nt, Homo sapiens
uagaauaaacugucuguug

SEQ ID NO: 1371699 - RNA, 19 nt, Homo sapiens
aggaagagcugaccaugga

SEQ ID NO: 1371700 - RNA, 19 nt, Homo sapiens
ccgaugacaugaacaacaa

SEQ ID NO: 1371701 - RNA, 19 nt, Homo sapiens
caccagaucuuugucuuca

SEQ ID NO: 1371702 - RNA, 19 nt, Homo sapiens
gagcacuaccgcuuuguga

SEQ ID NO: 1371703 - RNA, 19 nt, Homo sapiens
ccagaucuuugucuucauc

SEQ ID NO: 1371704 - RNA, 19 nt, Homo sapiens
agagaccgcugccaucauc

SEQ ID NO: 1371705 - RNA, 19 nt, Homo sapiens
ggaacagcuccaucaaguu

SEQ ID NO: 1371706 - RNA, 19 nt, Homo sapiens
ggacacuugcgggucguua

SEQ ID NO: 1371707 - RNA, 19 nt, Homo sapiens
ugucggaguucuucaacga

SEQ ID NO: 1371708 - RNA, 19 nt, Homo sapiens
ggcgagcacuaccgcuuug

SEQ ID NO: 1371709 - RNA, 19 nt, Homo sapiens
gcucaaggcccuguuugug

SEQ ID NO: 1371710 - RNA, 19 nt, Homo sapiens
gagcugaccauggagaugu

SEQ ID NO: 1371711 - RNA, 19 nt, Homo sapiens
ccgcugccaucaucacaga

SEQ ID NO: 1371712 - RNA, 19 nt, Homo sapiens
gggcgagcacuaccgcuuu

SEQ ID NO: 1371713 - RNA, 19 nt, Homo sapiens
caucguggaguacucacua

SEQ ID NO: 1371714 - RNA, 19 nt, Homo sapiens
ugaaugacagccaggaguu

SEQ ID NO: 1371715 - RNA, 19 nt, Homo sapiens
agauggcugucaccuauuc

SEQ ID NO: 1371716 - RNA, 19 nt, Homo sapiens
ucaagauggcugucaccua

SEQ ID NO: 1371717 - RNA, 19 nt, Homo sapiens
guacucacaccaccagauc

SEQ ID NO: 1371718 - RNA, 19 nt, Homo sapiens
cgcauuccaugaucuacuu

SEQ ID NO: 1371719 - RNA, 19 nt, Homo sapiens
cuugguaggucugcaguga

SEQ ID NO: 1371720 - RNA, 19 nt, Homo sapiens
uccaggagaugcugcuuca

SEQ ID NO: 1371721 - RNA, 19 nt, Homo sapiens
ugcagaugcuggagaugaa

SEQ ID NO: 1371722 - RNA, 19 nt, Homo sapiens
ucacaccaccagaucuuug

SEQ ID NO: 1371723 - RNA, 19 nt, Homo sapiens
ccgagacgcccaccaaagu

SEQ ID NO: 1371724 - RNA, 19 nt, Homo sapiens
gaauaaacugucuguugac

SEQ ID NO: 1371725 - RNA, 19 nt, Homo sapiens
guggugaccuggguuggau

SEQ ID NO: 1371726 - RNA, 19 nt, Homo sapiens
gagacgcccaccaaagugu

SEQ ID NO: 1371727 - RNA, 19 nt, Homo sapiens
gaaugacagccaggaguuc

SEQ ID NO: 1371728 - RNA, 19 nt, Homo sapiens
aagaugaggaggaggaaga

SEQ ID NO: 1371729 - RNA, 19 nt, Homo sapiens
ggaagaugaggaggaggaa

SEQ ID NO: 1371730 - RNA, 19 nt, Homo sapiens
caucaugucggaguucuuc

SEQ ID NO: 1371731 - RNA, 19 nt, Homo sapiens
acagaggcccugaaugaca

SEQ ID NO: 1371732 - RNA, 19 nt, Homo sapiens
aguuugagcuggacaucga

SEQ ID NO: 1371733 - RNA, 19 nt, Homo sapiens
cuacauccacaucgucuuc

SEQ ID NO: 1371734 - RNA, 19 nt, Homo sapiens
cuccgcagcuucugacaca

SEQ ID NO: 1371735 - RNA, 19 nt, Homo sapiens
caccaccgccuucuacauc

SEQ ID NO: 1371736 - RNA, 19 nt, Homo sapiens
uagcacagaggcccugaau

SEQ ID NO: 1371737 - RNA, 19 nt, Homo sapiens
ggaggagcgcucauuccau

SEQ ID NO: 1371738 - RNA, 19 nt, Homo sapiens
acuagaguauggcuuccuu

SEQ ID NO: 1371739 - RNA, 19 nt, Homo sapiens
uccacgcgcuguucuucaa

SEQ ID NO: 1371740 - RNA, 19 nt, Homo sapiens
ccauggugcaggucucuga

SEQ ID NO: 1371741 - RNA, 19 nt, Homo sapiens
gaaggacucugucuagauu

SEQ ID NO: 1371742 - RNA, 19 nt, Homo sapiens
ggaaauggccgaugggauu

SEQ ID NO: 1371743 - RNA, 19 nt, Homo sapiens
gaagaccugccacaauuua

SEQ ID NO: 1371744 - RNA, 19 nt, Homo sapiens
gaccacagcagcucucuua

SEQ ID NO: 1371745 - RNA, 19 nt, Homo sapiens
uggaagaccugccacaauu

SEQ ID NO: 1371746 - RNA, 19 nt, Homo sapiens
caucaaagcuaagccagaa

SEQ ID NO: 1371747 - RNA, 19 nt, Homo sapiens
gcaguggcgcgauauauuu

SEQ ID NO: 1371748 - RNA, 19 nt, Homo sapiens
cacagcagcucucuuaaga

SEQ ID NO: 1371749 - RNA, 19 nt, Homo sapiens
gaaaggaggcugggaugaa

SEQ ID NO: 1371750 - RNA, 19 nt, Homo sapiens
ccagaagauuuaucacauu

SEQ ID NO: 1371751 - RNA, 19 nt, Homo sapiens
uaccagaagugaauuaaug

SEQ ID NO: 1371752 - RNA, 19 nt, Homo sapiens
gagaaggacucugucuaga

SEQ ID NO: 1371753 - RNA, 19 nt, Homo sapiens
ggaaugagaaggacucugu

SEQ ID NO: 1371754 - RNA, 19 nt, Homo sapiens
guaaaaguaugcauggaua

SEQ ID NO: 1371755 - RNA, 19 nt, Homo sapiens
guagugcaguggcgcgaua

SEQ ID NO: 1371756 - RNA, 19 nt, Homo sapiens
ggaagaccugccacaauuu

SEQ ID NO: 1371757 - RNA, 19 nt, Homo sapiens
aagcuaagccagaagauuu

SEQ ID NO: 1371758 - RNA, 19 nt, Homo sapiens
ggccaaccaucucuuccua

SEQ ID NO: 1371759 - RNA, 19 nt, Homo sapiens
gcaaaacuccgucucaaaa

SEQ ID NO: 1371760 - RNA, 19 nt, Homo sapiens
gccagaagauuuaucacau

SEQ ID NO: 1371761 - RNA, 19 nt, Homo sapiens
ggagguggagguugcagua

SEQ ID NO: 1371762 - RNA, 19 nt, Homo sapiens
uagacaaggugauggaaau

SEQ ID NO: 1371763 - RNA, 19 nt, Homo sapiens
uaaagaggcagguggaaug

SEQ ID NO: 1371764 - RNA, 19 nt, Homo sapiens
gaacuccugggcucauauu

SEQ ID NO: 1371765 - RNA, 19 nt, Homo sapiens
cagcagcucucuuaagacu

SEQ ID NO: 1371766 - RNA, 19 nt, Homo sapiens
gcucauauuuucaggguuu

SEQ ID NO: 1371767 - RNA, 19 nt, Homo sapiens
aaaggaggcugggaugaau

SEQ ID NO: 1371768 - RNA, 19 nt, Homo sapiens
uaaaucaugcacucuaaga

SEQ ID NO: 1371769 - RNA, 19 nt, Homo sapiens
aucaucagcuacaggauua

SEQ ID NO: 1371770 - RNA, 19 nt, Homo sapiens
gaaaccccgucucuacuaa

SEQ ID NO: 1371771 - RNA, 19 nt, Homo sapiens
gaaauggccgaugggauug

SEQ ID NO: 1371772 - RNA, 19 nt, Homo sapiens
aagccaagaucgugccauu

SEQ ID NO: 1371773 - RNA, 19 nt, Homo sapiens
auaauaaucccagcacuuu

SEQ ID NO: 1371774 - RNA, 19 nt, Homo sapiens
gcagguggaaugagaagga

SEQ ID NO: 1371775 - RNA, 19 nt, Homo sapiens
agaggcagguggaaugaga

SEQ ID NO: 1371776 - RNA, 19 nt, Homo sapiens
gcuacaggauuagaaagga

SEQ ID NO: 1371777 - RNA, 19 nt, Homo sapiens
caggaguuaucacuguaaa

SEQ ID NO: 1371778 - RNA, 19 nt, Homo sapiens
cgacaaggucucacucugu

SEQ ID NO: 1371779 - RNA, 19 nt, Homo sapiens
gaguucaucaacauuguaa

SEQ ID NO: 1371780 - RNA, 19 nt, Homo sapiens
cuuaagacuccugguauua

SEQ ID NO: 1371781 - RNA, 19 nt, Homo sapiens
caucaucagcuacaggauu

SEQ ID NO: 1371782 - RNA, 19 nt, Homo sapiens
aggcugcaguuacaauaaa

SEQ ID NO: 1371783 - RNA, 19 nt, Homo sapiens
ucuuaagacuccugguauu

SEQ ID NO: 1371784 - RNA, 19 nt, Homo sapiens
gcaguuccgcuccuacuca

SEQ ID NO: 1371785 - RNA, 19 nt, Homo sapiens
gugcaguauuggcucauug

SEQ ID NO: 1371786 - RNA, 19 nt, Homo sapiens
ugagaaggacucugucuag

SEQ ID NO: 1371787 - RNA, 19 nt, Homo sapiens
cauaauaaucccagcacuu

SEQ ID NO: 1371788 - RNA, 19 nt, Homo sapiens
gaccugccacaauuuacua

SEQ ID NO: 1371789 - RNA, 19 nt, Homo sapiens
uaagccagaagauuuauca

SEQ ID NO: 1371790 - RNA, 19 nt, Homo sapiens
gagcaaaacuccgucucaa

SEQ ID NO: 1371791 - RNA, 19 nt, Homo sapiens
ucaaagcuaagccagaaga

SEQ ID NO: 1371792 - RNA, 19 nt, Homo sapiens
ucagagagcgagaagcaau

SEQ ID NO: 1371793 - RNA, 19 nt, Homo sapiens
cccaggaguuaucacugua

SEQ ID NO: 1371794 - RNA, 19 nt, Homo sapiens
ccacagcagcucucuuaag

SEQ ID NO: 1371795 - RNA, 19 nt, Homo sapiens
acaauuuacuaccagaagu

SEQ ID NO: 1371796 - RNA, 19 nt, Homo sapiens
cgcgauauauuuucaguuu

SEQ ID NO: 1371797 - RNA, 19 nt, Homo sapiens
cgaugggauugaaguggaa

SEQ ID NO: 1371798 - RNA, 19 nt, Homo sapiens
gaggcugggaugaauguga

SEQ ID NO: 1371799 - RNA, 19 nt, Homo sapiens
ucgaacuccugggcucaua

SEQ ID NO: 1371800 - RNA, 19 nt, Homo sapiens
aaucaugcacucuaagaug

SEQ ID NO: 1371801 - RNA, 19 nt, Homo sapiens
ccaggaguuaucacuguaa

SEQ ID NO: 1371802 - RNA, 19 nt, Homo sapiens
ggugcaguauuggcucauu

SEQ ID NO: 1371803 - RNA, 19 nt, Homo sapiens
cuaggcugcaguuacaaua

SEQ ID NO: 1371804 - RNA, 19 nt, Homo sapiens
gcaguggaggagcugguuu

SEQ ID NO: 1371805 - RNA, 19 nt, Homo sapiens
ucucuuaagacuccuggua

SEQ ID NO: 1371806 - RNA, 19 nt, Homo sapiens
ucagcuacaggauuagaaa

SEQ ID NO: 1371807 - RNA, 19 nt, Homo sapiens
ccagaagugaauuaaugaa

SEQ ID NO: 1371808 - RNA, 19 nt, Homo sapiens
gcacuccagccuaggcaau

SEQ ID NO: 1371809 - RNA, 19 nt, Homo sapiens
ccaagaucgugccauugca

SEQ ID NO: 1371810 - RNA, 19 nt, Homo sapiens
ggaggcugaagcagaagaa

SEQ ID NO: 1371811 - RNA, 19 nt, Homo sapiens
ucccaggaguuaucacugu

SEQ ID NO: 1371812 - RNA, 19 nt, Homo sapiens
cgacuucgcggagcaguuc

SEQ ID NO: 1371813 - RNA, 19 nt, Homo sapiens
caauuuacuaccagaagug

SEQ ID NO: 1371814 - RNA, 19 nt, Homo sapiens
agaaggacucugucuagau

SEQ ID NO: 1371815 - RNA, 19 nt, Homo sapiens
aaagaggcagguggaauga

SEQ ID NO: 1371816 - RNA, 19 nt, Homo sapiens
gagguggagguugcaguaa

SEQ ID NO: 1371817 - RNA, 19 nt, Homo sapiens
aaaauuagcugggcauggu

SEQ ID NO: 1371818 - RNA, 19 nt, Homo sapiens
uaauaaucccagcacuuug

SEQ ID NO: 1371819 - RNA, 19 nt, Homo sapiens
acuccagccuaggcaauaa

SEQ ID NO: 1371820 - RNA, 19 nt, Homo sapiens
gccaagaucgugccauugc

SEQ ID NO: 1371821 - RNA, 19 nt, Homo sapiens
gguggagguugcaguaagc

SEQ ID NO: 1371822 - RNA, 19 nt, Homo sapiens
caugguggcggacaucugu

SEQ ID NO: 1371823 - RNA, 19 nt, Homo sapiens
ugaguucaucaacauugua

SEQ ID NO: 1371824 - RNA, 19 nt, Homo sapiens
ccacaauuuacuaccagaa

SEQ ID NO: 1371825 - RNA, 19 nt, Homo sapiens
aaagcuaagccagaagauu

SEQ ID NO: 1371826 - RNA, 19 nt, Homo sapiens
uuccuaggcugcaguuaca

SEQ ID NO: 1371827 - RNA, 19 nt, Homo sapiens
gaugaaaccccgucucuac

SEQ ID NO: 1371828 - RNA, 19 nt, Homo sapiens
gugcaguggcgcgauauau

SEQ ID NO: 1371829 - RNA, 19 nt, Homo sapiens
uaggcugcaguuacaauaa

SEQ ID NO: 1371830 - RNA, 19 nt, Homo sapiens
caguuacaauaaagaccuu

SEQ ID NO: 1371831 - RNA, 19 nt, Homo sapiens
gguggucucuuaccuguua

SEQ ID NO: 1371832 - RNA, 19 nt, Homo sapiens
ucacaacucugcugacauu

SEQ ID NO: 1371833 - RNA, 19 nt, Homo sapiens
ccaauacucuguuaaggaa

SEQ ID NO: 1371834 - RNA, 19 nt, Homo sapiens
gaaaggccuugcuauaaca

SEQ ID NO: 1371835 - RNA, 19 nt, Homo sapiens
gagcggagccuauuucuag

SEQ ID NO: 1371836 - RNA, 19 nt, Homo sapiens
ggagagaaaucaggaagau

SEQ ID NO: 1371837 - RNA, 19 nt, Homo sapiens
uaagagaguugucuaagca

SEQ ID NO: 1371838 - RNA, 19 nt, Homo sapiens
gacaagccauugaucuaaa

SEQ ID NO: 1371839 - RNA, 19 nt, Homo sapiens
ggacaagccauugaucuaa

SEQ ID NO: 1371840 - RNA, 19 nt, Homo sapiens
gcugugagcuggguguuaa

SEQ ID NO: 1371841 - RNA, 19 nt, Homo sapiens
ggagaagaucagaaaguua

SEQ ID NO: 1371842 - RNA, 19 nt, Homo sapiens
acugugagguuuccuauaa

SEQ ID NO: 1371843 - RNA, 19 nt, Homo sapiens
gaaaugccaguccaguuaa

SEQ ID NO: 1371844 - RNA, 19 nt, Homo sapiens
gaagaugaacgcccuccua

SEQ ID NO: 1371845 - RNA, 19 nt, Homo sapiens
agaaaugccaguccaguua

SEQ ID NO: 1371846 - RNA, 19 nt, Homo sapiens
gacaggagcucaccuacca

SEQ ID NO: 1371847 - RNA, 19 nt, Homo sapiens
agaagaagaugaugaugau

SEQ ID NO: 1371848 - RNA, 19 nt, Homo sapiens
ggaagaagaagaugaugau

SEQ ID NO: 1371849 - RNA, 19 nt, Homo sapiens
gagguuuccuauaacauau

SEQ ID NO: 1371850 - RNA, 19 nt, Homo sapiens
guaaaccuauugcuugaag

SEQ ID NO: 1371851 - RNA, 19 nt, Homo sapiens
caguaaaccuauugcuuga

SEQ ID NO: 1371852 - RNA, 19 nt, Homo sapiens
gaagaaggagucagaacug

SEQ ID NO: 1371853 - RNA, 19 nt, Homo sapiens
guaaauaugcuguuaacca

SEQ ID NO: 1371854 - RNA, 19 nt, Homo sapiens
ugaaaggccuugcuauaac

SEQ ID NO: 1371855 - RNA, 19 nt, Homo sapiens
gaaaguuacccaauacucu

SEQ ID NO: 1371856 - RNA, 19 nt, Homo sapiens
gaugugaacucccaaaaug

SEQ ID NO: 1371857 - RNA, 19 nt, Homo sapiens
ggacagauggauucuagug

SEQ ID NO: 1371858 - RNA, 19 nt, Homo sapiens
ggauguugcucgacuccaa

SEQ ID NO: 1371859 - RNA, 19 nt, Homo sapiens
ccacaccucuuuggcacua

SEQ ID NO: 1371860 - RNA, 19 nt, Homo sapiens
aaacacucaugacugcuaa

SEQ ID NO: 1371861 - RNA, 19 nt, Homo sapiens
ucagaaaguuacccaauac

SEQ ID NO: 1371862 - RNA, 19 nt, Homo sapiens
gagaagaucagaaaguuac

SEQ ID NO: 1371863 - RNA, 19 nt, Homo sapiens
uuucuucacuggagcauuu

SEQ ID NO: 1371864 - RNA, 19 nt, Homo sapiens
agucagaacugcccuuugu

SEQ ID NO: 1371865 - RNA, 19 nt, Homo sapiens
gaagcugaagguucuauau

SEQ ID NO: 1371866 - RNA, 19 nt, Homo sapiens
gagcucaccuaccaagagu

SEQ ID NO: 1371867 - RNA, 19 nt, Homo sapiens
cagauggauucuaguguga

SEQ ID NO: 1371868 - RNA, 19 nt, Homo sapiens
gaucagaaaguuacccaau

SEQ ID NO: 1371869 - RNA, 19 nt, Homo sapiens
uggagaagaucagaaaguu

SEQ ID NO: 1371870 - RNA, 19 nt, Homo sapiens
gagaaaugccaguccaguu

SEQ ID NO: 1371871 - RNA, 19 nt, Homo sapiens
ugagguuuccuauaacaua

SEQ ID NO: 1371872 - RNA, 19 nt, Homo sapiens
gcucacaacucugcugaca

SEQ ID NO: 1371873 - RNA, 19 nt, Homo sapiens
gcacagauacuggacagau

SEQ ID NO: 1371874 - RNA, 19 nt, Homo sapiens
gcacagauacuggacagau

SEQ ID NO: 1371875 - RNA, 19 nt, Homo sapiens
guaagagaguugucuaagc

SEQ ID NO: 1371876 - RNA, 19 nt, Homo sapiens
gucaacggcuggacuuguu

SEQ ID NO: 1371877 - RNA, 19 nt, Homo sapiens
gaugaacgcccuccuagag

SEQ ID NO: 1371878 - RNA, 19 nt, Homo sapiens
ggacuuuuaucacugagua

SEQ ID NO: 1371879 - RNA, 19 nt, Homo sapiens
ugcaagagcugguacucaa

SEQ ID NO: 1371880 - RNA, 19 nt, Homo sapiens
gaagggcugggaugcguuu

SEQ ID NO: 1371881 - RNA, 19 nt, Homo sapiens
cuucaaaacugacuuacua

SEQ ID NO: 1371882 - RNA, 19 nt, Homo sapiens
cugaaaggccuugcuauaa

SEQ ID NO: 1371883 - RNA, 19 nt, Homo sapiens
cagaucaaguggagaagau

SEQ ID NO: 1371884 - RNA, 19 nt, Homo sapiens
ggagcauuuccauuuaaua

SEQ ID NO: 1371885 - RNA, 19 nt, Homo sapiens
caacggcuggacuuguuua

SEQ ID NO: 1371886 - RNA, 19 nt, Homo sapiens
guuacccaauacucuguua

SEQ ID NO: 1371887 - RNA, 19 nt, Homo sapiens
gagaggaagacucgggaaa

SEQ ID NO: 1371888 - RNA, 19 nt, Homo sapiens
uaaacacucaugacugcua

SEQ ID NO: 1371889 - RNA, 19 nt, Homo sapiens
gagagagcggagccuauuu

SEQ ID NO: 1371890 - RNA, 19 nt, Homo sapiens
guucugaugauaagugaaa

SEQ ID NO: 1371891 - RNA, 19 nt, Homo sapiens
uaaggaaggacaaggaugu

SEQ ID NO: 1371892 - RNA, 19 nt, Homo sapiens
aucagaaaguuacccaaua

SEQ ID NO: 1371893 - RNA, 19 nt, Homo sapiens
aagaagaugaugaugauga

SEQ ID NO: 1371894 - RNA, 19 nt, Homo sapiens
aagaagaagaugaugauga

SEQ ID NO: 1371895 - RNA, 19 nt, Homo sapiens
caggagagcuucaaaacug

SEQ ID NO: 1371896 - RNA, 19 nt, Homo sapiens
auggucagguggucucuua

SEQ ID NO: 1371897 - RNA, 19 nt, Homo sapiens
acugaaaggccuugcuaua

SEQ ID NO: 1371898 - RNA, 19 nt, Homo sapiens
agaagaugaugaugaugau

SEQ ID NO: 1371899 - RNA, 19 nt, Homo sapiens
ugacauugggaacuuauga

SEQ ID NO: 1371900 - RNA, 19 nt, Homo sapiens
cauccacacugacugaaag

SEQ ID NO: 1371901 - RNA, 19 nt, Homo sapiens
uugcucgacuccaagauuu

SEQ ID NO: 1371902 - RNA, 19 nt, Homo sapiens
aaacugacuuacuaaugca

SEQ ID NO: 1371903 - RNA, 19 nt, Homo sapiens
ugacugaaaggccuugcua

SEQ ID NO: 1371904 - RNA, 19 nt, Homo sapiens
gcucaccuaccaagaguug

SEQ ID NO: 1371905 - RNA, 19 nt, Homo sapiens
cagcccagaugcagaaugg

SEQ ID NO: 1371906 - RNA, 19 nt, Homo sapiens
cacagauacuggacagaug

SEQ ID NO: 1371907 - RNA, 19 nt, Homo sapiens
cacagauacuggacagaug

SEQ ID NO: 1371908 - RNA, 19 nt, Homo sapiens
gaggaagacucgggaaagc

SEQ ID NO: 1371909 - RNA, 19 nt, Homo sapiens
gguucuauauccagugugu

SEQ ID NO: 1371910 - RNA, 19 nt, Homo sapiens
acaagccauugaucuaaau

SEQ ID NO: 1371911 - RNA, 19 nt, Homo sapiens
gaacaccagaaagcacaaa

SEQ ID NO: 1371912 - RNA, 19 nt, Homo sapiens
gaagauuaugggaguggaa

SEQ ID NO: 1371913 - RNA, 19 nt, Homo sapiens
gauacuggacagauggauu

SEQ ID NO: 1371914 - RNA, 19 nt, Homo sapiens
ccaguccaguuaacaucaa

SEQ ID NO: 1371915 - RNA, 19 nt, Homo sapiens
gauacuggacagauggauu

SEQ ID NO: 1371916 - RNA, 19 nt, Homo sapiens
auugggaacuuaugagaga

SEQ ID NO: 1371917 - RNA, 19 nt, Homo sapiens
gcugaagguucuauaucca

SEQ ID NO: 1371918 - RNA, 19 nt, Homo sapiens
gcccuuuguucccaacuau

SEQ ID NO: 1371919 - RNA, 19 nt, Homo sapiens
ggagucagaacugcccuuu

SEQ ID NO: 1371920 - RNA, 19 nt, Homo sapiens
gaagaagaagaugaugaug

SEQ ID NO: 1371921 - RNA, 19 nt, Homo sapiens
cuggacagauggauucuag

SEQ ID NO: 1371922 - RNA, 19 nt, Homo sapiens
gagagagagcggagccuau

SEQ ID NO: 1371923 - RNA, 19 nt, Homo sapiens
gaauucagaacccaucucu

SEQ ID NO: 1371924 - RNA, 19 nt, Homo sapiens
uagugugacuugugacugu

SEQ ID NO: 1371925 - RNA, 19 nt, Homo sapiens
uggcucaccuccauugcuu

SEQ ID NO: 1371926 - RNA, 19 nt, Homo sapiens
aagaugaugaugaugauga

SEQ ID NO: 1371927 - RNA, 19 nt, Homo sapiens
gcauccacacugacugaaa

SEQ ID NO: 1371928 - RNA, 19 nt, Homo sapiens
ucucuuaccuguuaaaauc

SEQ ID NO: 1371929 - RNA, 19 nt, Homo sapiens
caagaguugcucagagugu

SEQ ID NO: 1371930 - RNA, 19 nt, Homo sapiens
gggaguggaagaagaagau

SEQ ID NO: 1371931 - RNA, 19 nt, Homo sapiens
gcucauagcucaucucuua

SEQ ID NO: 1371932 - RNA, 19 nt, Homo sapiens
ggaaaguucuucagacaua

SEQ ID NO: 1371933 - RNA, 19 nt, Homo sapiens
gcaaggagcugaagagaga

SEQ ID NO: 1371934 - RNA, 19 nt, Homo sapiens
ggaaagaaauggucugcua

SEQ ID NO: 1371935 - RNA, 19 nt, Homo sapiens
gagaagcucuauaaaugua

SEQ ID NO: 1371936 - RNA, 19 nt, Homo sapiens
gagaaacccuauaaaugua

SEQ ID NO: 1371937 - RNA, 19 nt, Homo sapiens
gcacagcucugauguagug

SEQ ID NO: 1371938 - RNA, 19 nt, Homo sapiens
gagaagcccuauaaaugua

SEQ ID NO: 1371939 - RNA, 19 nt, Homo sapiens
caacugggcugaccucuau

SEQ ID NO: 1371940 - RNA, 19 nt, Homo sapiens
gugagaagcucuauaaaug

SEQ ID NO: 1371941 - RNA, 19 nt, Homo sapiens
gaaauaggagaccaaguua

SEQ ID NO: 1371942 - RNA, 19 nt, Homo sapiens
gagagaagcccuauaaaug

SEQ ID NO: 1371943 - RNA, 19 nt, Homo sapiens
acucagagcucaucccuua

SEQ ID NO: 1371944 - RNA, 19 nt, Homo sapiens
cgaaaacacucaaaucuua

SEQ ID NO: 1371945 - RNA, 19 nt, Homo sapiens
gagagaaaccuuauaaaug

SEQ ID NO: 1371946 - RNA, 19 nt, Homo sapiens
gagagaaaccuuauaaaug

SEQ ID NO: 1371947 - RNA, 19 nt, Homo sapiens
cgaugucgaucauuucuua

SEQ ID NO: 1371948 - RNA, 19 nt, Homo sapiens
gguaaagccuucauucaga

SEQ ID NO: 1371949 - RNA, 19 nt, Homo sapiens
gagagaaacccuauaaaug

SEQ ID NO: 1371950 - RNA, 19 nt, Homo sapiens
ugagagaaaugacauaguu

SEQ ID NO: 1371951 - RNA, 19 nt, Homo sapiens
gagcccaucucuuauuaaa

SEQ ID NO: 1371952 - RNA, 19 nt, Homo sapiens
gaagagagagacauuagaa

SEQ ID NO: 1371953 - RNA, 19 nt, Homo sapiens
ggagagaaaccuuauaaau

SEQ ID NO: 1371954 - RNA, 19 nt, Homo sapiens
ggagagaaaccuuauaaau

SEQ ID NO: 1371955 - RNA, 19 nt, Homo sapiens
gugaaggucuuuccugauu

SEQ ID NO: 1371956 - RNA, 19 nt, Homo sapiens
ggagagaaacccuauaaau

SEQ ID NO: 1371957 - RNA, 19 nt, Homo sapiens
ccaaauuccuuucauguuc

SEQ ID NO: 1371958 - RNA, 19 nt, Homo sapiens
gagcaagucaccuacauaa

SEQ ID NO: 1371959 - RNA, 19 nt, Homo sapiens
gcucaucucuuacugaaca

SEQ ID NO: 1371960 - RNA, 19 nt, Homo sapiens
ggagagaagcccuauaaau

SEQ ID NO: 1371961 - RNA, 19 nt, Homo sapiens
caacaucagagaacucaua

SEQ ID NO: 1371962 - RNA, 19 nt, Homo sapiens
ggauagccuuugauuggua

SEQ ID NO: 1371963 - RNA, 19 nt, Homo sapiens
gcccaucucuuauuaaaca

SEQ ID NO: 1371964 - RNA, 19 nt, Homo sapiens
ggaaggcauucaaucagaa

SEQ ID NO: 1371965 - RNA, 19 nt, Homo sapiens
caaaguaaauguccaacuc

SEQ ID NO: 1371966 - RNA, 19 nt, Homo sapiens
ccauaaaugugacgaaugu

SEQ ID NO: 1371967 - RNA, 19 nt, Homo sapiens
gggcugaccucuauagauc

SEQ ID NO: 1371968 - RNA, 19 nt, Homo sapiens
ugacauaguuuucccuuua

SEQ ID NO: 1371969 - RNA, 19 nt, Homo sapiens
gcacuucuguucacuuuac

SEQ ID NO: 1371970 - RNA, 19 nt, Homo sapiens
agagaaaccuuauaaaugc

SEQ ID NO: 1371971 - RNA, 19 nt, Homo sapiens
agagaaaccuuauaaaugc

SEQ ID NO: 1371972 - RNA, 19 nt, Homo sapiens
cagcucagaugauccauga

SEQ ID NO: 1371973 - RNA, 19 nt, Homo sapiens
gaauaacuuucauccacaa

SEQ ID NO: 1371974 - RNA, 19 nt, Homo sapiens
gaggaugaauaccaagauu

SEQ ID NO: 1371975 - RNA, 19 nt, Homo sapiens
gaggauagccuuugauugg

SEQ ID NO: 1371976 - RNA, 19 nt, Homo sapiens
cuauagaucugccaguaaa

SEQ ID NO: 1371977 - RNA, 19 nt, Homo sapiens
gggaaggcauucaaucaga

SEQ ID NO: 1371978 - RNA, 19 nt, Homo sapiens
ccaagaggaugaauaccaa

SEQ ID NO: 1371979 - RNA, 19 nt, Homo sapiens
ggagcaggaugucuguaaa

SEQ ID NO: 1371980 - RNA, 19 nt, Homo sapiens
cuaacaauguccuaacaaa

SEQ ID NO: 1371981 - RNA, 19 nt, Homo sapiens
gcucaucccuuacccaaca

SEQ ID NO: 1371982 - RNA, 19 nt, Homo sapiens
ugaaauaggagaccaaguu

SEQ ID NO: 1371983 - RNA, 19 nt, Homo sapiens
agacauaguucaguccuuu

SEQ ID NO: 1371984 - RNA, 19 nt, Homo sapiens
ugagaagccuuaugagugu

SEQ ID NO: 1371985 - RNA, 19 nt, Homo sapiens
ggagagacccuacaaaugc

SEQ ID NO: 1371986 - RNA, 19 nt, Homo sapiens
gaagagagucugcaucagu

SEQ ID NO: 1371987 - RNA, 19 nt, Homo sapiens
ggagagagacacacuagga

SEQ ID NO: 1371988 - RNA, 19 nt, Homo sapiens
gaacauuacagaauucaca

SEQ ID NO: 1371989 - RNA, 19 nt, Homo sapiens
auacacaccuuauucauca

SEQ ID NO: 1371990 - RNA, 19 nt, Homo sapiens
caucagggauaguaguaaa

SEQ ID NO: 1371991 - RNA, 19 nt, Homo sapiens
agauaaagccuacacauug

SEQ ID NO: 1371992 - RNA, 19 nt, Homo sapiens
agagaaacccuauaaaugu

SEQ ID NO: 1371993 - RNA, 19 nt, Homo sapiens
gagacgaucuguggauguu

SEQ ID NO: 1371994 - RNA, 19 nt, Homo sapiens
uaacugcuacccagaaauu

SEQ ID NO: 1371995 - RNA, 19 nt, Homo sapiens
gauaaagccuacacauugc

SEQ ID NO: 1371996 - RNA, 19 nt, Homo sapiens
aaauggaggugggagcuua

SEQ ID NO: 1371997 - RNA, 19 nt, Homo sapiens
uagcacuucuguucacuuu

SEQ ID NO: 1371998 - RNA, 19 nt, Homo sapiens
ggugggagcuuagggaaug

SEQ ID NO: 1371999 - RNA, 19 nt, Homo sapiens
gugagaagccuuacauaug

SEQ ID NO: 1372000 - RNA, 19 nt, Homo sapiens
uuccagaccugaaguguuu

SEQ ID NO: 1372001 - RNA, 19 nt, Homo sapiens
ggaauacaggguagaaaga

SEQ ID NO: 1372002 - RNA, 19 nt, Homo sapiens
ccaagauucuacauuugaa

SEQ ID NO: 1372003 - RNA, 19 nt, Homo sapiens
ccauuuagguuaugacagu

SEQ ID NO: 1372004 - RNA, 19 nt, Homo sapiens
aaacaccagcgaauucaua

SEQ ID NO: 1372005 - RNA, 19 nt, Homo sapiens
gaauguggcucuucuuuuc

SEQ ID NO: 1372006 - RNA, 19 nt, Homo sapiens
ugagaagccuuacauaugc

SEQ ID NO: 1372007 - RNA, 19 nt, Homo sapiens
gaucuguggauguugaaua

SEQ ID NO: 1372008 - RNA, 19 nt, Homo sapiens
gauugaggauagccuuuga

SEQ ID NO: 1372009 - RNA, 19 nt, Homo sapiens
gaaggucuuuccugauucu

SEQ ID NO: 1372010 - RNA, 19 nt, Homo sapiens
gacgaucuguggauguuga

SEQ ID NO: 1372011 - RNA, 19 nt, Homo sapiens
ggugagaagcucuauaaau

SEQ ID NO: 1372012 - RNA, 19 nt, Homo sapiens
ggcaaagcguuuacucaga

SEQ ID NO: 1372013 - RNA, 19 nt, Homo sapiens
gcucagaugauccaugauu

SEQ ID NO: 1372014 - RNA, 19 nt, Homo sapiens
acucaaaucuuacgcaaca

SEQ ID NO: 1372015 - RNA, 19 nt, Homo sapiens
gagagacccuacacaugug

SEQ ID NO: 1372016 - RNA, 19 nt, Homo sapiens
gaagagacgaucuguggau

SEQ ID NO: 1372017 - RNA, 19 nt, Homo sapiens
ucagagcauuugccuuauu

SEQ ID NO: 1372018 - RNA, 19 nt, Homo sapiens
caucagagaauucauagug

SEQ ID NO: 1372019 - RNA, 19 nt, Homo sapiens
ggagagagacccuacacau

SEQ ID NO: 1372020 - RNA, 19 nt, Homo sapiens
gcuggcagguugagauguu

SEQ ID NO: 1372021 - RNA, 19 nt, Homo sapiens
gaauacaggguagaaagaa

SEQ ID NO: 1372022 - RNA, 19 nt, Homo sapiens
gagaaaaccuuccgcaagu

SEQ ID NO: 1372023 - RNA, 19 nt, Homo sapiens
uagcucaucucuuacugaa

SEQ ID NO: 1372024 - RNA, 19 nt, Homo sapiens
gaagcccuauaaauguaaa

SEQ ID NO: 1372025 - RNA, 19 nt, Homo sapiens
ggugagaagccuuacauau

SEQ ID NO: 1372026 - RNA, 19 nt, Homo sapiens
gagagagacccuacacaug

SEQ ID NO: 1372027 - RNA, 19 nt, Homo sapiens
gaauucaugauacugguuu

SEQ ID NO: 1372028 - RNA, 19 nt, Homo sapiens
cagauaaagccuacacauu

SEQ ID NO: 1372029 - RNA, 19 nt, Homo sapiens
uagcgaggaugacuacgaa

SEQ ID NO: 1372030 - RNA, 19 nt, Homo sapiens
gaauguggcaaagcguuua

SEQ ID NO: 1372031 - RNA, 19 nt, Homo sapiens
gcacagaacugacuacuuu

SEQ ID NO: 1372032 - RNA, 19 nt, Homo sapiens
gauaacagcuuucauaaug

SEQ ID NO: 1372033 - RNA, 19 nt, Homo sapiens
ggaaagaucuucagcuuau

SEQ ID NO: 1372034 - RNA, 19 nt, Homo sapiens
gaaguuagcuagugaguug

SEQ ID NO: 1372035 - RNA, 19 nt, Homo sapiens
ucaaauagcucaaaugaug

SEQ ID NO: 1372036 - RNA, 19 nt, Homo sapiens
gaagauggauugcaacaug

SEQ ID NO: 1372037 - RNA, 19 nt, Homo sapiens
gaacagauagaaagagaua

SEQ ID NO: 1372038 - RNA, 19 nt, Homo sapiens
caaguaggauucauugauu

SEQ ID NO: 1372039 - RNA, 19 nt, Homo sapiens
ggaaagagucuaugugaga

SEQ ID NO: 1372040 - RNA, 19 nt, Homo sapiens
ggaaagaggcauuuguuga

SEQ ID NO: 1372041 - RNA, 19 nt, Homo sapiens
gaagcuacguuuacacuca

SEQ ID NO: 1372042 - RNA, 19 nt, Homo sapiens
gaaagagucuaugugagaa

SEQ ID NO: 1372043 - RNA, 19 nt, Homo sapiens
aaucauacaugguguguuu

SEQ ID NO: 1372044 - RNA, 19 nt, Homo sapiens
ugaaggaacugcaaacuca

SEQ ID NO: 1372045 - RNA, 19 nt, Homo sapiens
caaaggagcccucaugaau

SEQ ID NO: 1372046 - RNA, 19 nt, Homo sapiens
gagugaagcucccaccauu

SEQ ID NO: 1372047 - RNA, 19 nt, Homo sapiens
gaagcagguuugaguguga

SEQ ID NO: 1372048 - RNA, 19 nt, Homo sapiens
ucacaaaugucaguacaaa

SEQ ID NO: 1372049 - RNA, 19 nt, Homo sapiens
gaaagaucuucagcuuaua

SEQ ID NO: 1372050 - RNA, 19 nt, Homo sapiens
gaaaauggauuggaacaaa

SEQ ID NO: 1372051 - RNA, 19 nt, Homo sapiens
gagauaacagcuuucauaa

SEQ ID NO: 1372052 - RNA, 19 nt, Homo sapiens
acucuaaacccucuuauua

SEQ ID NO: 1372053 - RNA, 19 nt, Homo sapiens
gaaagaggcauuuguugau

SEQ ID NO: 1372054 - RNA, 19 nt, Homo sapiens
gcaaggccguggaaacuuc

SEQ ID NO: 1372055 - RNA, 19 nt, Homo sapiens
ugaaccaucuccuuaaaga

SEQ ID NO: 1372056 - RNA, 19 nt, Homo sapiens
gaacuacaugcacuaauga

SEQ ID NO: 1372057 - RNA, 19 nt, Homo sapiens
gcugaaccaucuccuuaaa

SEQ ID NO: 1372058 - RNA, 19 nt, Homo sapiens
agagauaacagcuuucaua

SEQ ID NO: 1372059 - RNA, 19 nt, Homo sapiens
gcggagcccuuuauuggaa

SEQ ID NO: 1372060 - RNA, 19 nt, Homo sapiens
acucauaccuucccuauca

SEQ ID NO: 1372061 - RNA, 19 nt, Homo sapiens
ucagugcuauugcuaauga

SEQ ID NO: 1372062 - RNA, 19 nt, Homo sapiens
ccaccagccuucacaaaug

SEQ ID NO: 1372063 - RNA, 19 nt, Homo sapiens
cuacagcucuaauucaaau

SEQ ID NO: 1372064 - RNA, 19 nt, Homo sapiens
aaacaaggaucaagcuaca

SEQ ID NO: 1372065 - RNA, 19 nt, Homo sapiens
uaacagcuuucauaaugug

SEQ ID NO: 1372066 - RNA, 19 nt, Homo sapiens
cagcugaaccaucuccuua

SEQ ID NO: 1372067 - RNA, 19 nt, Homo sapiens
uagaacagauagaaagaga

SEQ ID NO: 1372068 - RNA, 19 nt, Homo sapiens
uaaaggacuagaacagaua

SEQ ID NO: 1372069 - RNA, 19 nt, Homo sapiens
gagcggagcccuuuauugg

SEQ ID NO: 1372070 - RNA, 19 nt, Homo sapiens
ggagcaacauugaaguuag

SEQ ID NO: 1372071 - RNA, 19 nt, Homo sapiens
acuuugagcuggauacuuu

SEQ ID NO: 1372072 - RNA, 19 nt, Homo sapiens
gaggaaagaggcauuuguu

SEQ ID NO: 1372073 - RNA, 19 nt, Homo sapiens
ggacaagacaaguaggauu

SEQ ID NO: 1372074 - RNA, 19 nt, Homo sapiens
ggacuagaacagauagaaa

SEQ ID NO: 1372075 - RNA, 19 nt, Homo sapiens
agaacuacaugcacuaaug

SEQ ID NO: 1372076 - RNA, 19 nt, Homo sapiens
uagaaauacugccuuugaa

SEQ ID NO: 1372077 - RNA, 19 nt, Homo sapiens
ugaaagcauugaagaagug

SEQ ID NO: 1372078 - RNA, 19 nt, Homo sapiens
ggaaauuuagccuguuuga

SEQ ID NO: 1372079 - RNA, 19 nt, Homo sapiens
ucaccauccugauauuaaa

SEQ ID NO: 1372080 - RNA, 19 nt, Homo sapiens
aaacagcuaccuccuacua

SEQ ID NO: 1372081 - RNA, 19 nt, Homo sapiens
aaagaggcauuuguugauu

SEQ ID NO: 1372082 - RNA, 19 nt, Homo sapiens
gaucgacuuugcuuaaugg

SEQ ID NO: 1372083 - RNA, 19 nt, Homo sapiens
gcuauuucccuucuaauug

SEQ ID NO: 1372084 - RNA, 19 nt, Homo sapiens
ggaccaucaucuaucaaug

SEQ ID NO: 1372085 - RNA, 19 nt, Homo sapiens
aaggaaagaucuucagcuu

SEQ ID NO: 1372086 - RNA, 19 nt, Homo sapiens
ccaaaccaauuuuaccuua

SEQ ID NO: 1372087 - RNA, 19 nt, Homo sapiens
caugaaugguguaacagaa

SEQ ID NO: 1372088 - RNA, 19 nt, Homo sapiens
aaagaagaccugacuccua

SEQ ID NO: 1372089 - RNA, 19 nt, Homo sapiens
gaaaugcaaggccguggaa

SEQ ID NO: 1372090 - RNA, 19 nt, Homo sapiens
agaacugacuacuuugaaa

SEQ ID NO: 1372091 - RNA, 19 nt, Homo sapiens
guccaugcguuauugguuu

SEQ ID NO: 1372092 - RNA, 19 nt, Homo sapiens
uaugaggaaugccagcuuu

SEQ ID NO: 1372093 - RNA, 19 nt, Homo sapiens
gauaccacuuuaugaggaa

SEQ ID NO: 1372094 - RNA, 19 nt, Homo sapiens
agauagaaauacugccuuu

SEQ ID NO: 1372095 - RNA, 19 nt, Homo sapiens
ggucacaagccaauucuau

SEQ ID NO: 1372096 - RNA, 19 nt, Homo sapiens
acagcuaccuccuacuauu

SEQ ID NO: 1372097 - RNA, 19 nt, Homo sapiens
gaagugaaggaacugcaaa

SEQ ID NO: 1372098 - RNA, 19 nt, Homo sapiens
ccucaugaaugguguaaca

SEQ ID NO: 1372099 - RNA, 19 nt, Homo sapiens
ugauuggugugauaacauu

SEQ ID NO: 1372100 - RNA, 19 nt, Homo sapiens
uuaaaggacuagaacagau

SEQ ID NO: 1372101 - RNA, 19 nt, Homo sapiens
gugaaaagcugauucuugu

SEQ ID NO: 1372102 - RNA, 19 nt, Homo sapiens
uacaugcacuaaugaaaga

SEQ ID NO: 1372103 - RNA, 19 nt, Homo sapiens
ggcaucacaugaaagcauu

SEQ ID NO: 1372104 - RNA, 19 nt, Homo sapiens
gcauugagcagcauaaacu

SEQ ID NO: 1372105 - RNA, 19 nt, Homo sapiens
gacaagacaaguaggauuc

SEQ ID NO: 1372106 - RNA, 19 nt, Homo sapiens
gaaaaggagaucauuauuc

SEQ ID NO: 1372107 - RNA, 19 nt, Homo sapiens
ugaaugguguaacagaaau

SEQ ID NO: 1372108 - RNA, 19 nt, Homo sapiens
uacuguaaauccugaguuu

SEQ ID NO: 1372109 - RNA, 19 nt, Homo sapiens
gaaugguguaacagaaaua

SEQ ID NO: 1372110 - RNA, 19 nt, Homo sapiens
ggauuggaacaaacucuuu

SEQ ID NO: 1372111 - RNA, 19 nt, Homo sapiens
guaaggacaagacaaguag

SEQ ID NO: 1372112 - RNA, 19 nt, Homo sapiens
gaaaagcugauucuuguug

SEQ ID NO: 1372113 - RNA, 19 nt, Homo sapiens
gaucuucagcuuauagcaa

SEQ ID NO: 1372114 - RNA, 19 nt, Homo sapiens
gaagcucccaccauuggaa

SEQ ID NO: 1372115 - RNA, 19 nt, Homo sapiens
ugauucagguacacaaguu

SEQ ID NO: 1372116 - RNA, 19 nt, Homo sapiens
cauugaaguuagcuaguga

SEQ ID NO: 1372117 - RNA, 19 nt, Homo sapiens
aaacauucaggacuacuuu

SEQ ID NO: 1372118 - RNA, 19 nt, Homo sapiens
aagggaagauggauugcaa

SEQ ID NO: 1372119 - RNA, 19 nt, Homo sapiens
ugggaaauuuagccuguuu

SEQ ID NO: 1372120 - RNA, 19 nt, Homo sapiens
gugcagguguccacaguag

SEQ ID NO: 1372121 - RNA, 19 nt, Homo sapiens
gcuucucagucuuggauuu

SEQ ID NO: 1372122 - RNA, 19 nt, Homo sapiens
agaaauacugccuuugaaa

SEQ ID NO: 1372123 - RNA, 19 nt, Homo sapiens
gauccaacacugcgaagga

SEQ ID NO: 1372124 - RNA, 19 nt, Homo sapiens
acucagugcuguggacuuu

SEQ ID NO: 1372125 - RNA, 19 nt, Homo sapiens
acaaaucccagauguacaa

SEQ ID NO: 1372126 - RNA, 19 nt, Homo sapiens
ggcagaagcuacguuuaca

SEQ ID NO: 1372127 - RNA, 19 nt, Homo sapiens
aaccacagcugaaccaucu

SEQ ID NO: 1372128 - RNA, 19 nt, Homo sapiens
uaagcuaagucggaaggaa

SEQ ID NO: 1372129 - RNA, 19 nt, Homo sapiens
ucagugcuguggacuuuca

SEQ ID NO: 1372130 - RNA, 19 nt, Homo sapiens
ucccagauguacaagcuuu

SEQ ID NO: 1372131 - RNA, 19 nt, Homo sapiens
ccacagaacugaaugaaga

SEQ ID NO: 1372132 - RNA, 19 nt, Homo sapiens
gggaagagcugacaugugu

SEQ ID NO: 1372133 - RNA, 19 nt, Homo sapiens
gauaagcaacuccaaguaa

SEQ ID NO: 1372134 - RNA, 19 nt, Homo sapiens
gagcugacauguguacgua

SEQ ID NO: 1372135 - RNA, 19 nt, Homo sapiens
gcugacauguguacguaua

SEQ ID NO: 1372136 - RNA, 19 nt, Homo sapiens
aaacuugucugcacuuuag

SEQ ID NO: 1372137 - RNA, 19 nt, Homo sapiens
ggauagugguagauucaaa

SEQ ID NO: 1372138 - RNA, 19 nt, Homo sapiens
gcuauaugguguucuguug

SEQ ID NO: 1372139 - RNA, 19 nt, Homo sapiens
ggaauacuuuguagauaag

SEQ ID NO: 1372140 - RNA, 19 nt, Homo sapiens
uauaugguguucuguugua

SEQ ID NO: 1372141 - RNA, 19 nt, Homo sapiens
ugaauaauaccucaaguga

SEQ ID NO: 1372142 - RNA, 19 nt, Homo sapiens
caagcacgguccuaaacuu

SEQ ID NO: 1372143 - RNA, 19 nt, Homo sapiens
guggaauacuuuguagaua

SEQ ID NO: 1372144 - RNA, 19 nt, Homo sapiens
auaagcaacuccaaguaaa

SEQ ID NO: 1372145 - RNA, 19 nt, Homo sapiens
ugaaaacucugcugccuaa

SEQ ID NO: 1372146 - RNA, 19 nt, Homo sapiens
gggcauagggucaagauca

SEQ ID NO: 1372147 - RNA, 19 nt, Homo sapiens
gguguucuguuguaugaau

SEQ ID NO: 1372148 - RNA, 19 nt, Homo sapiens
ugucugcacuuuagaaaca

SEQ ID NO: 1372149 - RNA, 19 nt, Homo sapiens
gggcucagaugcagucaag

SEQ ID NO: 1372150 - RNA, 19 nt, Homo sapiens
ucauuucccugcuuucguu

SEQ ID NO: 1372151 - RNA, 19 nt, Homo sapiens
agaaacaccuggagagcau

SEQ ID NO: 1372152 - RNA, 19 nt, Homo sapiens
ggcauagggucaagaucaa

SEQ ID NO: 1372153 - RNA, 19 nt, Homo sapiens
gccagagacuugccagugu

SEQ ID NO: 1372154 - RNA, 19 nt, Homo sapiens
gggcuggcauucugugugu

SEQ ID NO: 1372155 - RNA, 19 nt, Homo sapiens
gcacgguccuaaacuuguc

SEQ ID NO: 1372156 - RNA, 19 nt, Homo sapiens
ucagucauuucccugcuuu

SEQ ID NO: 1372157 - RNA, 19 nt, Homo sapiens
ccucaucccagguacauuu

SEQ ID NO: 1372158 - RNA, 19 nt, Homo sapiens
gaauaauaccucaagugau

SEQ ID NO: 1372159 - RNA, 19 nt, Homo sapiens
gaaaccagagcuucuaggu

SEQ ID NO: 1372160 - RNA, 19 nt, Homo sapiens
gaagagcugacauguguac

SEQ ID NO: 1372161 - RNA, 19 nt, Homo sapiens
cgucuucugucagucauuu

SEQ ID NO: 1372162 - RNA, 19 nt, Homo sapiens
ggaagccacagaacugaau

SEQ ID NO: 1372163 - RNA, 19 nt, Homo sapiens
aaacucugcugccuaaggu

SEQ ID NO: 1372164 - RNA, 19 nt, Homo sapiens
auucuuguaugcagccuua

SEQ ID NO: 1372165 - RNA, 19 nt, Homo sapiens
ugacauguguacguauaug

SEQ ID NO: 1372166 - RNA, 19 nt, Homo sapiens
acauaguuguguuugcuuu

SEQ ID NO: 1372167 - RNA, 19 nt, Homo sapiens
cgacauaguuguguuugcu

SEQ ID NO: 1372168 - RNA, 19 nt, Homo sapiens
gggucaagaucaagauaag

SEQ ID NO: 1372169 - RNA, 19 nt, Homo sapiens
cuaaacuugucugcacuuu

SEQ ID NO: 1372170 - RNA, 19 nt, Homo sapiens
gcuguggccaguccaguuu

SEQ ID NO: 1372171 - RNA, 19 nt, Homo sapiens
ggacaccaccagcuuggau

SEQ ID NO: 1372172 - RNA, 19 nt, Homo sapiens
gaacugaaugaagaugguu

SEQ ID NO: 1372173 - RNA, 19 nt, Homo sapiens
gaaccuggcagaggaugga

SEQ ID NO: 1372174 - RNA, 19 nt, Homo sapiens
guauaauccauccuuguug

SEQ ID NO: 1372175 - RNA, 19 nt, Homo sapiens
guauaugcaacaccuguga

SEQ ID NO: 1372176 - RNA, 19 nt, Homo sapiens
uguauaauccauccuuguu

SEQ ID NO: 1372177 - RNA, 19 nt, Homo sapiens
ucacucagcauuguauaau

SEQ ID NO: 1372178 - RNA, 19 nt, Homo sapiens
uauacgacauaguuguguu

SEQ ID NO: 1372179 - RNA, 19 nt, Homo sapiens
cguguaugcuguggagaaa

SEQ ID NO: 1372180 - RNA, 19 nt, Homo sapiens
aaggucagcaucaaucaaa

SEQ ID NO: 1372181 - RNA, 19 nt, Homo sapiens
gauagugguagauucaaag

SEQ ID NO: 1372182 - RNA, 19 nt, Homo sapiens
cagcaucaaucaaaacaau

SEQ ID NO: 1372183 - RNA, 19 nt, Homo sapiens
ggaagagcugacaugugua

SEQ ID NO: 1372184 - RNA, 19 nt, Homo sapiens
ccaaggcugcccaccagaa

SEQ ID NO: 1372185 - RNA, 19 nt, Homo sapiens
guguucuguuguaugaaua

SEQ ID NO: 1372186 - RNA, 19 nt, Homo sapiens
gcuuuugaguguuagauaa

SEQ ID NO: 1372187 - RNA, 19 nt, Homo sapiens
agauaagcaacuccaagua

SEQ ID NO: 1372188 - RNA, 19 nt, Homo sapiens
caucccagguacauuugau

SEQ ID NO: 1372189 - RNA, 19 nt, Homo sapiens
ccauucaggucaaggaaaa

SEQ ID NO: 1372190 - RNA, 19 nt, Homo sapiens
uagauaagcaacuccaagu

SEQ ID NO: 1372191 - RNA, 19 nt, Homo sapiens
ggcagaggauggagagacu

SEQ ID NO: 1372192 - RNA, 19 nt, Homo sapiens
augguguucuguuguauga

SEQ ID NO: 1372193 - RNA, 19 nt, Homo sapiens
cuuguuggguccuggaguu

SEQ ID NO: 1372194 - RNA, 19 nt, Homo sapiens
aaagggaagagcugacaug

SEQ ID NO: 1372195 - RNA, 19 nt, Homo sapiens
gaaagggaagagcugacau

SEQ ID NO: 1372196 - RNA, 19 nt, Homo sapiens
ggccucgccguguggaaua

SEQ ID NO: 1372197 - RNA, 19 nt, Homo sapiens
caagggaagccacagaacu

SEQ ID NO: 1372198 - RNA, 19 nt, Homo sapiens
ccucaagcacgguccuaaa

SEQ ID NO: 1372199 - RNA, 19 nt, Homo sapiens
gaagccacagaacugaaug

SEQ ID NO: 1372200 - RNA, 19 nt, Homo sapiens
uuaaugcuauaugguguuc

SEQ ID NO: 1372201 - RNA, 19 nt, Homo sapiens
gucaucgucuucugucagu

SEQ ID NO: 1372202 - RNA, 19 nt, Homo sapiens
gcacauuccaggucaucgu

SEQ ID NO: 1372203 - RNA, 19 nt, Homo sapiens
uaagcaacuccaaguaaag

SEQ ID NO: 1372204 - RNA, 19 nt, Homo sapiens
cauagggucaagaucaaga

SEQ ID NO: 1372205 - RNA, 19 nt, Homo sapiens
gggaagccacagaacugaa

SEQ ID NO: 1372206 - RNA, 19 nt, Homo sapiens
guagagggcauagggucaa

SEQ ID NO: 1372207 - RNA, 19 nt, Homo sapiens
caaugaaaccagagcuucu

SEQ ID NO: 1372208 - RNA, 19 nt, Homo sapiens
ccuaaggucagcaucaauc

SEQ ID NO: 1372209 - RNA, 19 nt, Homo sapiens
cauguguacguauauguau

SEQ ID NO: 1372210 - RNA, 19 nt, Homo sapiens
ugaaugaagaugguucuca

SEQ ID NO: 1372211 - RNA, 19 nt, Homo sapiens
agaacugaaugaagauggu

SEQ ID NO: 1372212 - RNA, 19 nt, Homo sapiens
gaugugcagcugagauugg

SEQ ID NO: 1372213 - RNA, 19 nt, Homo sapiens
cuagguguguggccuggau

SEQ ID NO: 1372214 - RNA, 19 nt, Homo sapiens
aaugaaaccagagcuucua

SEQ ID NO: 1372215 - RNA, 19 nt, Homo sapiens
uguaugcuguggagaaagg

SEQ ID NO: 1372216 - RNA, 19 nt, Homo sapiens
gcaagggaagccacagaac

SEQ ID NO: 1372217 - RNA, 19 nt, Homo sapiens
cguguggaauacuuuguag

SEQ ID NO: 1372218 - RNA, 19 nt, Homo sapiens
ggaaauggcuacagaaaga

SEQ ID NO: 1372219 - RNA, 19 nt, Homo sapiens
ggacuggacugagaaucua

SEQ ID NO: 1372220 - RNA, 19 nt, Homo sapiens
gcagauccaugccuucuuc

SEQ ID NO: 1372221 - RNA, 19 nt, Homo sapiens
ccaaagagcccaguaagaa

SEQ ID NO: 1372222 - RNA, 19 nt, Homo sapiens
uaaaggaauuguagucguu

SEQ ID NO: 1372223 - RNA, 19 nt, Homo sapiens
ccucuaaucucagcacuuu

SEQ ID NO: 1372224 - RNA, 19 nt, Homo sapiens
gcucacgccucuaaucuca

SEQ ID NO: 1372225 - RNA, 19 nt, Homo sapiens
gaagacagcggaucaucug

SEQ ID NO: 1372226 - RNA, 19 nt, Homo sapiens
ggcaggaaauggcuacaga

SEQ ID NO: 1372227 - RNA, 19 nt, Homo sapiens
gaucuuguuuucagcuuua

SEQ ID NO: 1372228 - RNA, 19 nt, Homo sapiens
ccaagcauccagcaacuga

SEQ ID NO: 1372229 - RNA, 19 nt, Homo sapiens
cagcagaucccaggaguug

SEQ ID NO: 1372230 - RNA, 19 nt, Homo sapiens
ggaauuguagucguugaaa

SEQ ID NO: 1372231 - RNA, 19 nt, Homo sapiens
gcagaucccaggaguugga

SEQ ID NO: 1372232 - RNA, 19 nt, Homo sapiens
ccaguugguucaagagcaa

SEQ ID NO: 1372233 - RNA, 19 nt, Homo sapiens
aaaccaaagagcccaguaa

SEQ ID NO: 1372234 - RNA, 19 nt, Homo sapiens
gagaugcaagggaaaauua

SEQ ID NO: 1372235 - RNA, 19 nt, Homo sapiens
gcaugagaaucacuugaac

SEQ ID NO: 1372236 - RNA, 19 nt, Homo sapiens
gcauccagcaacugaguaa

SEQ ID NO: 1372237 - RNA, 19 nt, Homo sapiens
caggaaauggcuacagaaa

SEQ ID NO: 1372238 - RNA, 19 nt, Homo sapiens
gcaggaaauggcuacagaa

SEQ ID NO: 1372239 - RNA, 19 nt, Homo sapiens
ggcaugagaaucacuugaa

SEQ ID NO: 1372240 - RNA, 19 nt, Homo sapiens
gaugagugaacaauacuuc

SEQ ID NO: 1372241 - RNA, 19 nt, Homo sapiens
ggguuagaaauuccaauaa

SEQ ID NO: 1372242 - RNA, 19 nt, Homo sapiens
gaauuguagucguugaaaa

SEQ ID NO: 1372243 - RNA, 19 nt, Homo sapiens
ggccgaggcaugagaauca

SEQ ID NO: 1372244 - RNA, 19 nt, Homo sapiens
ccggaugagugaacaauac

SEQ ID NO: 1372245 - RNA, 19 nt, Homo sapiens
cggguuagaaauuccaaua

SEQ ID NO: 1372246 - RNA, 19 nt, Homo sapiens
ccacaaacaccaggaucuu

SEQ ID NO: 1372247 - RNA, 19 nt, Homo sapiens
ucccagcccuacagaaguu

SEQ ID NO: 1372248 - RNA, 19 nt, Homo sapiens
caaagagcccaguaagaac

SEQ ID NO: 1372249 - RNA, 19 nt, Homo sapiens
caaaccaaagagcccagua

SEQ ID NO: 1372250 - RNA, 19 nt, Homo sapiens
ggaggccgaggcaugagaa

SEQ ID NO: 1372251 - RNA, 19 nt, Homo sapiens
gcagguggucggacaagca

SEQ ID NO: 1372252 - RNA, 19 nt, Homo sapiens
cuccagaaguuuccaagca

SEQ ID NO: 1372253 - RNA, 19 nt, Homo sapiens
uggcuugacaccagacuuu

SEQ ID NO: 1372254 - RNA, 19 nt, Homo sapiens
aaucuacgguggagaccau

SEQ ID NO: 1372255 - RNA, 19 nt, Homo sapiens
ucauccaguugguucaaga

SEQ ID NO: 1372256 - RNA, 19 nt, Homo sapiens
gcaggagaugcaagggaaa

SEQ ID NO: 1372257 - RNA, 19 nt, Homo sapiens
cugauuugguggcaggaaa

SEQ ID NO: 1372258 - RNA, 19 nt, Homo sapiens
ggccgaagacagcggauca

SEQ ID NO: 1372259 - RNA, 19 nt, Homo sapiens
uucaagagcaaaccaaaga

SEQ ID NO: 1372260 - RNA, 19 nt, Homo sapiens
gucuuggacuggacugaga

SEQ ID NO: 1372261 - RNA, 19 nt, Homo sapiens
cgaagacagcggaucaucu

SEQ ID NO: 1372262 - RNA, 19 nt, Homo sapiens
uuucgaggauggcuugaca

SEQ ID NO: 1372263 - RNA, 19 nt, Homo sapiens
gaaauggcuacagaaagag

SEQ ID NO: 1372264 - RNA, 19 nt, Homo sapiens
ggaugagugaacaauacuu

SEQ ID NO: 1372265 - RNA, 19 nt, Homo sapiens
gagagaaacugucagagua

SEQ ID NO: 1372266 - RNA, 19 nt, Homo sapiens
gaagaaaccaccagcuuua

SEQ ID NO: 1372267 - RNA, 19 nt, Homo sapiens
aaacaaagaucuugaggaa

SEQ ID NO: 1372268 - RNA, 19 nt, Homo sapiens
agaaauugcugucccauaa

SEQ ID NO: 1372269 - RNA, 19 nt, Homo sapiens
gaacauacagccgagaaua

SEQ ID NO: 1372270 - RNA, 19 nt, Homo sapiens
gggaaagucuucacucaga

SEQ ID NO: 1372271 - RNA, 19 nt, Homo sapiens
gagaaacugucagaguaua

SEQ ID NO: 1372272 - RNA, 19 nt, Homo sapiens
ggaagaaaccaccagcuuu

SEQ ID NO: 1372273 - RNA, 19 nt, Homo sapiens
cagauggacucaacagaaa

SEQ ID NO: 1372274 - RNA, 19 nt, Homo sapiens
gagaacaacuugaaugacu

SEQ ID NO: 1372275 - RNA, 19 nt, Homo sapiens
gaugguggcuuccagaugu

SEQ ID NO: 1372276 - RNA, 19 nt, Homo sapiens
ccacacugcuccuggcuaa

SEQ ID NO: 1372277 - RNA, 19 nt, Homo sapiens
ccaauaccuugauuugauu

SEQ ID NO: 1372278 - RNA, 19 nt, Homo sapiens
uggcuuaacucacagguuu

SEQ ID NO: 1372279 - RNA, 19 nt, Homo sapiens
gccacagcauuuaauauaa

SEQ ID NO: 1372280 - RNA, 19 nt, Homo sapiens
ccagaaauccagccucuuu

SEQ ID NO: 1372281 - RNA, 19 nt, Homo sapiens
gaauaucgccaccgcugua

SEQ ID NO: 1372282 - RNA, 19 nt, Homo sapiens
caccagaguucaguguuua

SEQ ID NO: 1372283 - RNA, 19 nt, Homo sapiens
gaagccaaguugucuuuua

SEQ ID NO: 1372284 - RNA, 19 nt, Homo sapiens
acaaagggaugcaccaaau

SEQ ID NO: 1372285 - RNA, 19 nt, Homo sapiens
gauauuugccacagcauuu

SEQ ID NO: 1372286 - RNA, 19 nt, Homo sapiens
gaaaccaccagcuuuauag

SEQ ID NO: 1372287 - RNA, 19 nt, Homo sapiens
ggugagacauguggcuuaa

SEQ ID NO: 1372288 - RNA, 19 nt, Homo sapiens
caucagagcuuuggaacuc

SEQ ID NO: 1372289 - RNA, 19 nt, Homo sapiens
ucacgccucuuccuauuug

SEQ ID NO: 1372290 - RNA, 19 nt, Homo sapiens
ggccagagccggagaauag

SEQ ID NO: 1372291 - RNA, 19 nt, Homo sapiens
aguaauaacugaacaagca

SEQ ID NO: 1372292 - RNA, 19 nt, Homo sapiens
gaaauugcugucccauaaa

SEQ ID NO: 1372293 - RNA, 19 nt, Homo sapiens
ggaaucagugggaucagua

SEQ ID NO: 1372294 - RNA, 19 nt, Homo sapiens
cuuaaccagucacuaauuu

SEQ ID NO: 1372295 - RNA, 19 nt, Homo sapiens
gagcuccgaggcaguaaua

SEQ ID NO: 1372296 - RNA, 19 nt, Homo sapiens
ugacuacugugcauuagga

SEQ ID NO: 1372297 - RNA, 19 nt, Homo sapiens
gugccgcucuguucucuuu

SEQ ID NO: 1372298 - RNA, 19 nt, Homo sapiens
gcagaaagagagaaacugu

SEQ ID NO: 1372299 - RNA, 19 nt, Homo sapiens
cccaauaccuugauuugau

SEQ ID NO: 1372300 - RNA, 19 nt, Homo sapiens
uugaaugacuuccugguuu

SEQ ID NO: 1372301 - RNA, 19 nt, Homo sapiens
ggucuuacccaacagauug

SEQ ID NO: 1372302 - RNA, 19 nt, Homo sapiens
uagugugccugauagauuu

SEQ ID NO: 1372303 - RNA, 19 nt, Homo sapiens
ggauuuggauuuggagaug

SEQ ID NO: 1372304 - RNA, 19 nt, Homo sapiens
ucaaggauuuggauuugga

SEQ ID NO: 1372305 - RNA, 19 nt, Homo sapiens
ggagagcucagccaacaga

SEQ ID NO: 1372306 - RNA, 19 nt, Homo sapiens
gaaaacuccuuguaugugu

SEQ ID NO: 1372307 - RNA, 19 nt, Homo sapiens
ccacaugugacccugauuu

SEQ ID NO: 1372308 - RNA, 19 nt, Homo sapiens
gggaagaggcagaaagaga

SEQ ID NO: 1372309 - RNA, 19 nt, Homo sapiens
gagggaagaggcagaaaga

SEQ ID NO: 1372310 - RNA, 19 nt, Homo sapiens
guaaacacucuauaacuuc

SEQ ID NO: 1372311 - RNA, 19 nt, Homo sapiens
ccagaugucuuuuggaauu

SEQ ID NO: 1372312 - RNA, 19 nt, Homo sapiens
caggagagcucagccaaca

SEQ ID NO: 1372313 - RNA, 19 nt, Homo sapiens
uugaguaggugguucauau

SEQ ID NO: 1372314 - RNA, 19 nt, Homo sapiens
gggccucucuccuacuuug

SEQ ID NO: 1372315 - RNA, 19 nt, Homo sapiens
caucagcuuucucccuaaa

SEQ ID NO: 1372316 - RNA, 19 nt, Homo sapiens
cagagaacaacuugaauga

SEQ ID NO: 1372317 - RNA, 19 nt, Homo sapiens
gguauggcuugauagaguu

SEQ ID NO: 1372318 - RNA, 19 nt, Homo sapiens
gaacaacuugaaugacuuc

SEQ ID NO: 1372319 - RNA, 19 nt, Homo sapiens
ugaaucauuuggacucuuc

SEQ ID NO: 1372320 - RNA, 19 nt, Homo sapiens
ugaaugacuuccugguuuc

SEQ ID NO: 1372321 - RNA, 19 nt, Homo sapiens
guagagaugcaagaaauug

SEQ ID NO: 1372322 - RNA, 19 nt, Homo sapiens
ugccacagcauuuaauaua

SEQ ID NO: 1372323 - RNA, 19 nt, Homo sapiens
caccuuaaccagucacuaa

SEQ ID NO: 1372324 - RNA, 19 nt, Homo sapiens
agaaaccaccagcuuuaua

SEQ ID NO: 1372325 - RNA, 19 nt, Homo sapiens
ugacugggcuggcguuaac

SEQ ID NO: 1372326 - RNA, 19 nt, Homo sapiens
cagcccaacugcaugcaaa

SEQ ID NO: 1372327 - RNA, 19 nt, Homo sapiens
gguguguccuguuugcaaa

SEQ ID NO: 1372328 - RNA, 19 nt, Homo sapiens
cgaauccacuugguaggaa

SEQ ID NO: 1372329 - RNA, 19 nt, Homo sapiens
caccugaguuuaauauuac

SEQ ID NO: 1372330 - RNA, 19 nt, Homo sapiens
guacaguggcacaccuuaa

SEQ ID NO: 1372331 - RNA, 19 nt, Homo sapiens
cugggaaccuguuaguaaa

SEQ ID NO: 1372332 - RNA, 19 nt, Homo sapiens
ucagauggacucaacagaa

SEQ ID NO: 1372333 - RNA, 19 nt, Homo sapiens
cauaauugcaguagcuaaa

SEQ ID NO: 1372334 - RNA, 19 nt, Homo sapiens
gaagaggcagaaagagaga

SEQ ID NO: 1372335 - RNA, 19 nt, Homo sapiens
ucugggaaccuguuaguaa

SEQ ID NO: 1372336 - RNA, 19 nt, Homo sapiens
gcacucugggaaccuguua

SEQ ID NO: 1372337 - RNA, 19 nt, Homo sapiens
cagaagccaaguugucuuu

SEQ ID NO: 1372338 - RNA, 19 nt, Homo sapiens
gaaacugucagaguauaau

SEQ ID NO: 1372339 - RNA, 19 nt, Homo sapiens
gugacaccaugaaaucuug

SEQ ID NO: 1372340 - RNA, 19 nt, Homo sapiens
ggacuuuggugggauuugg

SEQ ID NO: 1372341 - RNA, 19 nt, Homo sapiens
gacugacuacugugcauua

SEQ ID NO: 1372342 - RNA, 19 nt, Homo sapiens
gagaacauacagccgagaa

SEQ ID NO: 1372343 - RNA, 19 nt, Homo sapiens
acucacagguuucccauca

SEQ ID NO: 1372344 - RNA, 19 nt, Homo sapiens
gaaucagugggaucaguaa

SEQ ID NO: 1372345 - RNA, 19 nt, Homo sapiens
aggcagcuuuccuuucuuu

SEQ ID NO: 1372346 - RNA, 19 nt, Homo sapiens
ccucagagaacaacuugaa

SEQ ID NO: 1372347 - RNA, 19 nt, Homo sapiens
gcucugggcugugcucagu

SEQ ID NO: 1372348 - RNA, 19 nt, Homo sapiens
cuugguaaguugcuucuga

SEQ ID NO: 1372349 - RNA, 19 nt, Homo sapiens
aaucuugacuccuggaauc

SEQ ID NO: 1372350 - RNA, 19 nt, Homo sapiens
uggagugucucuucucuag

SEQ ID NO: 1372351 - RNA, 19 nt, Homo sapiens
ugagacauguggcuuaacu

SEQ ID NO: 1372352 - RNA, 19 nt, Homo sapiens
aaagagagaaacugucaga

SEQ ID NO: 1372353 - RNA, 19 nt, Homo sapiens
ugucacgccucuuccuauu

SEQ ID NO: 1372354 - RNA, 19 nt, Homo sapiens
ucagagaacaacuugaaug

SEQ ID NO: 1372355 - RNA, 19 nt, Homo sapiens
cuguagagaugcaagaaau

SEQ ID NO: 1372356 - RNA, 19 nt, Homo sapiens
agaaagagagaaacuguca

SEQ ID NO: 1372357 - RNA, 19 nt, Homo sapiens
uuucaaggauuuggauuug

SEQ ID NO: 1372358 - RNA, 19 nt, Homo sapiens
aaauggguuuccagaagaa

SEQ ID NO: 1372359 - RNA, 19 nt, Homo sapiens
cauaagcuucuuccucuga

SEQ ID NO: 1372360 - RNA, 19 nt, Homo sapiens
caccagagacucaaagauc

SEQ ID NO: 1372361 - RNA, 19 nt, Homo sapiens
ggagucuuguuucuucauc

SEQ ID NO: 1372362 - RNA, 19 nt, Homo sapiens
ggacgagcaguuccuguca

SEQ ID NO: 1372363 - RNA, 19 nt, Homo sapiens
ucacuaauuuucacuguug

SEQ ID NO: 1372364 - RNA, 19 nt, Homo sapiens
cuggaaauccgcaaaguug

SEQ ID NO: 1372365 - RNA, 19 nt, Homo sapiens
gaaggacccuguaaacuuu

SEQ ID NO: 1372366 - RNA, 19 nt, Homo sapiens
cagaagcacugaagaagua

SEQ ID NO: 1372367 - RNA, 19 nt, Homo sapiens
gacgaauucucuaauguua

SEQ ID NO: 1372368 - RNA, 19 nt, Homo sapiens
gauauaaccucagaucuug

SEQ ID NO: 1372369 - RNA, 19 nt, Homo sapiens
ugagaaaguugaagaauug

SEQ ID NO: 1372370 - RNA, 19 nt, Homo sapiens
gaaaggagcagaacaaagu

SEQ ID NO: 1372371 - RNA, 19 nt, Homo sapiens
ggacuaauauugcugauac

SEQ ID NO: 1372372 - RNA, 19 nt, Homo sapiens
ggaacaauuuggacaagaa

SEQ ID NO: 1372373 - RNA, 19 nt, Homo sapiens
guucaggcaucauuauuaa

SEQ ID NO: 1372374 - RNA, 19 nt, Homo sapiens
gaagauggcaggaauaaca

SEQ ID NO: 1372375 - RNA, 19 nt, Homo sapiens
cagcagaccauaagaauuu

SEQ ID NO: 1372376 - RNA, 19 nt, Homo sapiens
ucaaguaccuccuggaaau

SEQ ID NO: 1372377 - RNA, 19 nt, Homo sapiens
ggaacuggaugaccucaga

SEQ ID NO: 1372378 - RNA, 19 nt, Homo sapiens
gaaguuuacugugauucua

SEQ ID NO: 1372379 - RNA, 19 nt, Homo sapiens
uuacaggaauucagcauuu

SEQ ID NO: 1372380 - RNA, 19 nt, Homo sapiens
gaacuugaaggacauuaaa

SEQ ID NO: 1372381 - RNA, 19 nt, Homo sapiens
ggaagaagaggcccaagaa

SEQ ID NO: 1372382 - RNA, 19 nt, Homo sapiens
uggaaacgcugacugcuuu

SEQ ID NO: 1372383 - RNA, 19 nt, Homo sapiens
cggagaaacugacgaauuc

SEQ ID NO: 1372384 - RNA, 19 nt, Homo sapiens
gaaguaaagcccauugaug

SEQ ID NO: 1372385 - RNA, 19 nt, Homo sapiens
gcuaacguuugccaucaua

SEQ ID NO: 1372386 - RNA, 19 nt, Homo sapiens
ggcaggaguucugauauaa

SEQ ID NO: 1372387 - RNA, 19 nt, Homo sapiens
ugaaggugauccagaguuu

SEQ ID NO: 1372388 - RNA, 19 nt, Homo sapiens
gcacagugguugguguauu

SEQ ID NO: 1372389 - RNA, 19 nt, Homo sapiens
gagaagauggcaggaauaa

SEQ ID NO: 1372390 - RNA, 19 nt, Homo sapiens
gagauguaaucgacuuuau

SEQ ID NO: 1372391 - RNA, 19 nt, Homo sapiens
gcaggugguugcaguugaa

SEQ ID NO: 1372392 - RNA, 19 nt, Homo sapiens
ccucagaucuugguaaugu

SEQ ID NO: 1372393 - RNA, 19 nt, Homo sapiens
gauugcauauguugaagaa

SEQ ID NO: 1372394 - RNA, 19 nt, Homo sapiens
cacagugguugguguauuu

SEQ ID NO: 1372395 - RNA, 19 nt, Homo sapiens
gacaagcgauucagacagu

SEQ ID NO: 1372396 - RNA, 19 nt, Homo sapiens
gagcagaacaaagugauaa

SEQ ID NO: 1372397 - RNA, 19 nt, Homo sapiens
uggcaggaguucugauaua

SEQ ID NO: 1372398 - RNA, 19 nt, Homo sapiens
caggaagaauggucauauu

SEQ ID NO: 1372399 - RNA, 19 nt, Homo sapiens
caaagguaccauugugaua

SEQ ID NO: 1372400 - RNA, 19 nt, Homo sapiens
gugauucuauggaacaauu

SEQ ID NO: 1372401 - RNA, 19 nt, Homo sapiens
ggaagucauugucacuaau

SEQ ID NO: 1372402 - RNA, 19 nt, Homo sapiens
gccaaugacugagaaaguu

SEQ ID NO: 1372403 - RNA, 19 nt, Homo sapiens
gccaacaaaugaaaugaug

SEQ ID NO: 1372404 - RNA, 19 nt, Homo sapiens
gacauaggaugcaacacuu

SEQ ID NO: 1372405 - RNA, 19 nt, Homo sapiens
ucacuaauggcuaugauaa

SEQ ID NO: 1372406 - RNA, 19 nt, Homo sapiens
guaauguucucacuucuac

SEQ ID NO: 1372407 - RNA, 19 nt, Homo sapiens
gcaaaccaggagugaauuu

SEQ ID NO: 1372408 - RNA, 19 nt, Homo sapiens
gauuuacccugcccuugaa

SEQ ID NO: 1372409 - RNA, 19 nt, Homo sapiens
uaucaaagaaggagaagaa

SEQ ID NO: 1372410 - RNA, 19 nt, Homo sapiens
caaagaggaagccaugauu

SEQ ID NO: 1372411 - RNA, 19 nt, Homo sapiens
ugaaggacccuguaaacuu

SEQ ID NO: 1372412 - RNA, 19 nt, Homo sapiens
ggagaagauggcaggaaua

SEQ ID NO: 1372413 - RNA, 19 nt, Homo sapiens
gaagucagcagaccauaag

SEQ ID NO: 1372414 - RNA, 19 nt, Homo sapiens
cugagaaaguugaagaauu

SEQ ID NO: 1372415 - RNA, 19 nt, Homo sapiens
ggacauaggaugcaacacu

SEQ ID NO: 1372416 - RNA, 19 nt, Homo sapiens
gaagaaguaaagcccauug

SEQ ID NO: 1372417 - RNA, 19 nt, Homo sapiens
agaagaggcccaagaagaa

SEQ ID NO: 1372418 - RNA, 19 nt, Homo sapiens
caacugaaggacccuguaa

SEQ ID NO: 1372419 - RNA, 19 nt, Homo sapiens
gcggagaaacugacgaauu

SEQ ID NO: 1372420 - RNA, 19 nt, Homo sapiens
guaaagcccauugaugaaa

SEQ ID NO: 1372421 - RNA, 19 nt, Homo sapiens
cagaacaaagugauaauga

SEQ ID NO: 1372422 - RNA, 19 nt, Homo sapiens
gauccuauuggaagauaua

SEQ ID NO: 1372423 - RNA, 19 nt, Homo sapiens
uaaucaaucucuacuaggu

SEQ ID NO: 1372424 - RNA, 19 nt, Homo sapiens
cuacacaaacgauaacauu

SEQ ID NO: 1372425 - RNA, 19 nt, Homo sapiens
caagaagacuacuggaacu

SEQ ID NO: 1372426 - RNA, 19 nt, Homo sapiens
gaauucagcauuugacaag

SEQ ID NO: 1372427 - RNA, 19 nt, Homo sapiens
cauaagaauuuggaaguca

SEQ ID NO: 1372428 - RNA, 19 nt, Homo sapiens
gggauccuauuggaagaua

SEQ ID NO: 1372429 - RNA, 19 nt, Homo sapiens
aaguaaagcccauugauga

SEQ ID NO: 1372430 - RNA, 19 nt, Homo sapiens
ccaaaaccguuaaugguaa

SEQ ID NO: 1372431 - RNA, 19 nt, Homo sapiens
uggaagucauugucacuaa

SEQ ID NO: 1372432 - RNA, 19 nt, Homo sapiens
gaagaauugcugcguguca

SEQ ID NO: 1372433 - RNA, 19 nt, Homo sapiens
aggaagccaugauugcaua

SEQ ID NO: 1372434 - RNA, 19 nt, Homo sapiens
aaacugacgaauucucuaa

SEQ ID NO: 1372435 - RNA, 19 nt, Homo sapiens
gaaacugacgaauucucua

SEQ ID NO: 1372436 - RNA, 19 nt, Homo sapiens
caugcaggcucuugggaaa

SEQ ID NO: 1372437 - RNA, 19 nt, Homo sapiens
aaagguaccauugugauaa

SEQ ID NO: 1372438 - RNA, 19 nt, Homo sapiens
uuacugugauucuauggaa

SEQ ID NO: 1372439 - RNA, 19 nt, Homo sapiens
gaagaagucagcagaccau

SEQ ID NO: 1372440 - RNA, 19 nt, Homo sapiens
cugauuaucuuccauagag

SEQ ID NO: 1372441 - RNA, 19 nt, Homo sapiens
ugaacuggauugugguguu

SEQ ID NO: 1372442 - RNA, 19 nt, Homo sapiens
ggagcagaacaaagugaua

SEQ ID NO: 1372443 - RNA, 19 nt, Homo sapiens
aaacuaugccaaugacuga

SEQ ID NO: 1372444 - RNA, 19 nt, Homo sapiens
ucuauaagcaggcaacuga

SEQ ID NO: 1372445 - RNA, 19 nt, Homo sapiens
gauuaucuuccauagagua

SEQ ID NO: 1372446 - RNA, 19 nt, Homo sapiens
gaugucuccuggugugcua

SEQ ID NO: 1372447 - RNA, 19 nt, Homo sapiens
ugggugauaugaccaaaga

SEQ ID NO: 1372448 - RNA, 19 nt, Homo sapiens
gaagcgaggcggagaaacu

SEQ ID NO: 1372449 - RNA, 19 nt, Homo sapiens
ggaauucagcauuugacaa

SEQ ID NO: 1372450 - RNA, 19 nt, Homo sapiens
ugaagauguuacaggaauu

SEQ ID NO: 1372451 - RNA, 19 nt, Homo sapiens
gaucauguugaagauguua

SEQ ID NO: 1372452 - RNA, 19 nt, Homo sapiens
gaugaaaacuuggggcaaa

SEQ ID NO: 1372453 - RNA, 19 nt, Homo sapiens
gcagaagcacugaagaagu

SEQ ID NO: 1372454 - RNA, 19 nt, Homo sapiens
aagaagaggcccaagaaga

SEQ ID NO: 1372455 - RNA, 19 nt, Homo sapiens
gguaauguucucacuucua

SEQ ID NO: 1372456 - RNA, 19 nt, Homo sapiens
ugauauaaccucagaucuu

SEQ ID NO: 1372457 - RNA, 19 nt, Homo sapiens
uggaugaccucagaaugaa

SEQ ID NO: 1372458 - RNA, 19 nt, Homo sapiens
gcagaauguccuucagaga

SEQ ID NO: 1372459 - RNA, 19 nt, Homo sapiens
gcauucaccaagauauaaa

SEQ ID NO: 1372460 - RNA, 19 nt, Homo sapiens
gcagaacaaagugauaaug

SEQ ID NO: 1372461 - RNA, 19 nt, Homo sapiens
aucaaucucuacuagguua

SEQ ID NO: 1372462 - RNA, 19 nt, Homo sapiens
gaagauguuacaggaauuc

SEQ ID NO: 1372463 - RNA, 19 nt, Homo sapiens
aaacugaacugaggaaaau

SEQ ID NO: 1372464 - RNA, 19 nt, Homo sapiens
agugguugguguauuuaua

SEQ ID NO: 1372465 - RNA, 19 nt, Homo sapiens
ggaaggagaugaagguaga

SEQ ID NO: 1372466 - RNA, 19 nt, Homo sapiens
ggacacacccuauccaaga

SEQ ID NO: 1372467 - RNA, 19 nt, Homo sapiens
gggcaaggcuagaaagaug

SEQ ID NO: 1372468 - RNA, 19 nt, Homo sapiens
gcucacaccuguacagauc

SEQ ID NO: 1372469 - RNA, 19 nt, Homo sapiens
ggagaucacuguguguaau

SEQ ID NO: 1372470 - RNA, 19 nt, Homo sapiens
ccacgagggucuagcucua

SEQ ID NO: 1372471 - RNA, 19 nt, Homo sapiens
ggcagggucuauuugcaua

SEQ ID NO: 1372472 - RNA, 19 nt, Homo sapiens
gagaucacuguguguaaua

SEQ ID NO: 1372473 - RNA, 19 nt, Homo sapiens
acacaguggugaucgacua

SEQ ID NO: 1372474 - RNA, 19 nt, Homo sapiens
agaggaaacugcccaaagu

SEQ ID NO: 1372475 - RNA, 19 nt, Homo sapiens
gacacacccuauccaagaa

SEQ ID NO: 1372476 - RNA, 19 nt, Homo sapiens
caaagccaccggcauguga

SEQ ID NO: 1372477 - RNA, 19 nt, Homo sapiens
gggcuuggauggagcaaag

SEQ ID NO: 1372478 - RNA, 19 nt, Homo sapiens
cagcaaguguucccagcaa

SEQ ID NO: 1372479 - RNA, 19 nt, Homo sapiens
caaaggagagcccggacaa

SEQ ID NO: 1372480 - RNA, 19 nt, Homo sapiens
ccaagucucccacccagaa

SEQ ID NO: 1372481 - RNA, 19 nt, Homo sapiens
ccuccaaacucaaccacaa

SEQ ID NO: 1372482 - RNA, 19 nt, Homo sapiens
gcaaagcucagggcugguu

SEQ ID NO: 1372483 - RNA, 19 nt, Homo sapiens
gagcgagcguggagagaag

SEQ ID NO: 1372484 - RNA, 19 nt, Homo sapiens
uggaguaccuggaaagaag

SEQ ID NO: 1372485 - RNA, 19 nt, Homo sapiens
guacuuccugucucuguuu

SEQ ID NO: 1372486 - RNA, 19 nt, Homo sapiens
caguggugaucgacuauga

SEQ ID NO: 1372487 - RNA, 19 nt, Homo sapiens
gcuagaaagaugcuacguu

SEQ ID NO: 1372488 - RNA, 19 nt, Homo sapiens
ggugggcugugcaggcaaa

SEQ ID NO: 1372489 - RNA, 19 nt, Homo sapiens
gaagcuccauccgaaugug

SEQ ID NO: 1372490 - RNA, 19 nt, Homo sapiens
gggaagcuccauccgaaug

SEQ ID NO: 1372491 - RNA, 19 nt, Homo sapiens
gcugcuacccggaggcuaa

SEQ ID NO: 1372492 - RNA, 19 nt, Homo sapiens
ggagaugaagguagaagca

SEQ ID NO: 1372493 - RNA, 19 nt, Homo sapiens
ggagaaguuggacggacua

SEQ ID NO: 1372494 - RNA, 19 nt, Homo sapiens
gaucacuguguguaauaaa

SEQ ID NO: 1372495 - RNA, 19 nt, Homo sapiens
gggucuagcucuaccacau

SEQ ID NO: 1372496 - RNA, 19 nt, Homo sapiens
acagauccguguggacauu

SEQ ID NO: 1372497 - RNA, 19 nt, Homo sapiens
gagacacaguggugaucga

SEQ ID NO: 1372498 - RNA, 19 nt, Homo sapiens
cggcaagccugggagaaga

SEQ ID NO: 1372499 - RNA, 19 nt, Homo sapiens
ggagcgagcguggagagaa

SEQ ID NO: 1372500 - RNA, 19 nt, Homo sapiens
ccagagagggacaagauag

SEQ ID NO: 1372501 - RNA, 19 nt, Homo sapiens
ggaagcuccauccgaaugu

SEQ ID NO: 1372502 - RNA, 19 nt, Homo sapiens
aggaaucgauggagagaag

SEQ ID NO: 1372503 - RNA, 19 nt, Homo sapiens
gaggaaacugcccaaagug

SEQ ID NO: 1372504 - RNA, 19 nt, Homo sapiens
ggucuagcucuaccacauu

SEQ ID NO: 1372505 - RNA, 19 nt, Homo sapiens
ucaucagccuccaaacuca

SEQ ID NO: 1372506 - RNA, 19 nt, Homo sapiens
agccaggacuagaugguuu

SEQ ID NO: 1372507 - RNA, 19 nt, Homo sapiens
caagggugagccuggagua

SEQ ID NO: 1372508 - RNA, 19 nt, Homo sapiens
ggagaccaaggacaagaug

SEQ ID NO: 1372509 - RNA, 19 nt, Homo sapiens
agaucacuguguguaauaa

SEQ ID NO: 1372510 - RNA, 19 nt, Homo sapiens
gcucugugaucgcugugau

SEQ ID NO: 1372511 - RNA, 19 nt, Homo sapiens
cgaugggccuccagggaau

SEQ ID NO: 1372512 - RNA, 19 nt, Homo sapiens
gagccuggaguaccuggaa

SEQ ID NO: 1372513 - RNA, 19 nt, Homo sapiens
caccugaucagcagagaga

SEQ ID NO: 1372514 - RNA, 19 nt, Homo sapiens
caugugaagcugccggaaa

SEQ ID NO: 1372515 - RNA, 19 nt, Homo sapiens
gcucgggcaaggcuagaaa

SEQ ID NO: 1372516 - RNA, 19 nt, Homo sapiens
ccaggaaggagaugaaggu

SEQ ID NO: 1372517 - RNA, 19 nt, Homo sapiens
ugccuuccauuuccgugua

SEQ ID NO: 1372518 - RNA, 19 nt, Homo sapiens
aguaguggcugagcucugu

SEQ ID NO: 1372519 - RNA, 19 nt, Homo sapiens
ggacuuccaggcccgaaag

SEQ ID NO: 1372520 - RNA, 19 nt, Homo sapiens
aaggagagcccggacaaga

SEQ ID NO: 1372521 - RNA, 19 nt, Homo sapiens
gggugcaccaggagacuuu

SEQ ID NO: 1372522 - RNA, 19 nt, Homo sapiens
gcugugguacugcccugua

SEQ ID NO: 1372523 - RNA, 19 nt, Homo sapiens
gagccaggacuagaugguu

SEQ ID NO: 1372524 - RNA, 19 nt, Homo sapiens
gucuagcucuaccacauuc

SEQ ID NO: 1372525 - RNA, 19 nt, Homo sapiens
ggugggucccugcuccuuu

SEQ ID NO: 1372526 - RNA, 19 nt, Homo sapiens
gacuguacuuccugucucu

SEQ ID NO: 1372527 - RNA, 19 nt, Homo sapiens
ccucugcaguuggacaaga

SEQ ID NO: 1372528 - RNA, 19 nt, Homo sapiens
ggccucaucagccuccaaa

SEQ ID NO: 1372529 - RNA, 19 nt, Homo sapiens
acucucagcugugguacug

SEQ ID NO: 1372530 - RNA, 19 nt, Homo sapiens
gaaggagaugaagguagaa

SEQ ID NO: 1372531 - RNA, 19 nt, Homo sapiens
uggcgacacugggaaagau

SEQ ID NO: 1372532 - RNA, 19 nt, Homo sapiens
gcugcuugccuuccauuuc

SEQ ID NO: 1372533 - RNA, 19 nt, Homo sapiens
uagaggaaacugcccaaag

SEQ ID NO: 1372534 - RNA, 19 nt, Homo sapiens
ccuguggccuuuuaacauu

SEQ ID NO: 1372535 - RNA, 19 nt, Homo sapiens
gaaacuaaaugcugacuug

SEQ ID NO: 1372536 - RNA, 19 nt, Homo sapiens
ugagaaaggugaaaugaaa

SEQ ID NO: 1372537 - RNA, 19 nt, Homo sapiens
gaacauggauuggacagau

SEQ ID NO: 1372538 - RNA, 19 nt, Homo sapiens
uaaacaaguugcacagaaa

SEQ ID NO: 1372539 - RNA, 19 nt, Homo sapiens
ggacuugcauuuccacuuc

SEQ ID NO: 1372540 - RNA, 19 nt, Homo sapiens
agacugaccuuguuaacuu

SEQ ID NO: 1372541 - RNA, 19 nt, Homo sapiens
gcgaguggaucaagaagaa

SEQ ID NO: 1372542 - RNA, 19 nt, Homo sapiens
gaucuagaaucaacugaga

SEQ ID NO: 1372543 - RNA, 19 nt, Homo sapiens
caacugagagagaugcuua

SEQ ID NO: 1372544 - RNA, 19 nt, Homo sapiens
gggacgagaucuagaauca

SEQ ID NO: 1372545 - RNA, 19 nt, Homo sapiens
ggcagcugcuucacaauaa

SEQ ID NO: 1372546 - RNA, 19 nt, Homo sapiens
gcagagccauccugugcaa

SEQ ID NO: 1372547 - RNA, 19 nt, Homo sapiens
gagcugaacuucgaacaag

SEQ ID NO: 1372548 - RNA, 19 nt, Homo sapiens
ggagugacccagcguuauu

SEQ ID NO: 1372549 - RNA, 19 nt, Homo sapiens
cccagaggcuaaccuauuu

SEQ ID NO: 1372550 - RNA, 19 nt, Homo sapiens
gcacaacggccuuaacuac

SEQ ID NO: 1372551 - RNA, 19 nt, Homo sapiens
gacuuaccauuucauguuu

SEQ ID NO: 1372552 - RNA, 19 nt, Homo sapiens
gacugaccuuguuaacuua

SEQ ID NO: 1372553 - RNA, 19 nt, Homo sapiens
ccagucggaucaauucuau

SEQ ID NO: 1372554 - RNA, 19 nt, Homo sapiens
gaagcuaccuggagaaccu

SEQ ID NO: 1372555 - RNA, 19 nt, Homo sapiens
gaugcugucuuuguauuga

SEQ ID NO: 1372556 - RNA, 19 nt, Homo sapiens
ggccuuauuuccucuuuau

SEQ ID NO: 1372557 - RNA, 19 nt, Homo sapiens
auaaacaaguugcacagaa

SEQ ID NO: 1372558 - RNA, 19 nt, Homo sapiens
ugacuuaccauuucauguu

SEQ ID NO: 1372559 - RNA, 19 nt, Homo sapiens
uguauugacuuaccauuuc

SEQ ID NO: 1372560 - RNA, 19 nt, Homo sapiens
ucacacaugucaaagucuu

SEQ ID NO: 1372561 - RNA, 19 nt, Homo sapiens
ccaagaaagccaaggaaga

SEQ ID NO: 1372562 - RNA, 19 nt, Homo sapiens
gagccaaggccucaauaga

SEQ ID NO: 1372563 - RNA, 19 nt, Homo sapiens
caaaggaagagucaaaaua

SEQ ID NO: 1372564 - RNA, 19 nt, Homo sapiens
gacgagaucuagaaucaac

SEQ ID NO: 1372565 - RNA, 19 nt, Homo sapiens
acacccagauuacugagaa

SEQ ID NO: 1372566 - RNA, 19 nt, Homo sapiens
gaacuucgaacaagaugag

SEQ ID NO: 1372567 - RNA, 19 nt, Homo sapiens
caccggaaaugucaucuuc

SEQ ID NO: 1372568 - RNA, 19 nt, Homo sapiens
guacuggacuugcauuucc

SEQ ID NO: 1372569 - RNA, 19 nt, Homo sapiens
ucauugcuguuaccaagaa

SEQ ID NO: 1372570 - RNA, 19 nt, Homo sapiens
acuaaaugcugacuugugu

SEQ ID NO: 1372571 - RNA, 19 nt, Homo sapiens
aaaacaagcucaaaaccaa

SEQ ID NO: 1372572 - RNA, 19 nt, Homo sapiens
gcauagggcaguauacaag

SEQ ID NO: 1372573 - RNA, 19 nt, Homo sapiens
acaaggaccuggugcuucu

SEQ ID NO: 1372574 - RNA, 19 nt, Homo sapiens
ccucacuccuauucucuuu

SEQ ID NO: 1372575 - RNA, 19 nt, Homo sapiens
caagaaagccaaggaagag

SEQ ID NO: 1372576 - RNA, 19 nt, Homo sapiens
caucagcccaugcagguuu

SEQ ID NO: 1372577 - RNA, 19 nt, Homo sapiens
cggcagcugcuucacaaua

SEQ ID NO: 1372578 - RNA, 19 nt, Homo sapiens
gcacccagaggcuaaccua

SEQ ID NO: 1372579 - RNA, 19 nt, Homo sapiens
ucucuuugccuuuguguaa

SEQ ID NO: 1372580 - RNA, 19 nt, Homo sapiens
aagagcagccugacucauu

SEQ ID NO: 1372581 - RNA, 19 nt, Homo sapiens
guauugacuuaccauuuca

SEQ ID NO: 1372582 - RNA, 19 nt, Homo sapiens
ccgauuaccuccagaccau

SEQ ID NO: 1372583 - RNA, 19 nt, Homo sapiens
ccuauucucuuugccuuug

SEQ ID NO: 1372584 - RNA, 19 nt, Homo sapiens
aaucaaaggaagagucaaa

SEQ ID NO: 1372585 - RNA, 19 nt, Homo sapiens
ucuugaagcuucggucauu

SEQ ID NO: 1372586 - RNA, 19 nt, Homo sapiens
ggaagagcagccugacuca

SEQ ID NO: 1372587 - RNA, 19 nt, Homo sapiens
ugacacuuccuuuccauug

SEQ ID NO: 1372588 - RNA, 19 nt, Homo sapiens
ccgaggcacguaaacauaa

SEQ ID NO: 1372589 - RNA, 19 nt, Homo sapiens
agaaucaacugagagagau

SEQ ID NO: 1372590 - RNA, 19 nt, Homo sapiens
cgaagacaauuuuaugguu

SEQ ID NO: 1372591 - RNA, 19 nt, Homo sapiens
acaauaaguucguggucau

SEQ ID NO: 1372592 - RNA, 19 nt, Homo sapiens
uagaaucaacugagagaga

SEQ ID NO: 1372593 - RNA, 19 nt, Homo sapiens
gcuacacccagauuacuga

SEQ ID NO: 1372594 - RNA, 19 nt, Homo sapiens
ccagauuacugagaaaggu

SEQ ID NO: 1372595 - RNA, 19 nt, Homo sapiens
gccucgaccuucaaagaga

SEQ ID NO: 1372596 - RNA, 19 nt, Homo sapiens
ggagcugaacuucgaacaa

SEQ ID NO: 1372597 - RNA, 19 nt, Homo sapiens
agagcagccugacucauuc

SEQ ID NO: 1372598 - RNA, 19 nt, Homo sapiens
agacggaccuaggccuuau

SEQ ID NO: 1372599 - RNA, 19 nt, Homo sapiens
gcagcugcuucacaauaag

SEQ ID NO: 1372600 - RNA, 19 nt, Homo sapiens
gaggaagaaagcuaucuag

SEQ ID NO: 1372601 - RNA, 19 nt, Homo sapiens
aagcuucggucauuagucu

SEQ ID NO: 1372602 - RNA, 19 nt, Homo sapiens
ggaccuaggccuuauuucc

SEQ ID NO: 1372603 - RNA, 19 nt, Homo sapiens
ggagaagcuaccuggagaa

SEQ ID NO: 1372604 - RNA, 19 nt, Homo sapiens
ugggacaucuccagguaug

SEQ ID NO: 1372605 - RNA, 19 nt, Homo sapiens
ccuuauuuccucuuuauga

SEQ ID NO: 1372606 - RNA, 19 nt, Homo sapiens
caggagaggaagaaagcua

SEQ ID NO: 1372607 - RNA, 19 nt, Homo sapiens
cuugaagcuucggucauua

SEQ ID NO: 1372608 - RNA, 19 nt, Homo sapiens
ccucgaccuucaaagagaa

SEQ ID NO: 1372609 - RNA, 19 nt, Homo sapiens
gaaaacaagcucaaaacca

SEQ ID NO: 1372610 - RNA, 19 nt, Homo sapiens
aaugcugacuugugucguu

SEQ ID NO: 1372611 - RNA, 19 nt, Homo sapiens
cagccugacucauucuucu

SEQ ID NO: 1372612 - RNA, 19 nt, Homo sapiens
ggauuggacagaucugaca

SEQ ID NO: 1372613 - RNA, 19 nt, Homo sapiens
gaaaugaaaacaagcucaa

SEQ ID NO: 1372614 - RNA, 19 nt, Homo sapiens
uuucacacaugucaaaguc

SEQ ID NO: 1372615 - RNA, 19 nt, Homo sapiens
ggacaucuccagguauggu

SEQ ID NO: 1372616 - RNA, 19 nt, Homo sapiens
ccggaaaugucaucuucuc

SEQ ID NO: 1372617 - RNA, 19 nt, Homo sapiens
ccuaaagcaagaaacuaaa

SEQ ID NO: 1372618 - RNA, 19 nt, Homo sapiens
gaucugacacuuccuuucc

SEQ ID NO: 1372619 - RNA, 19 nt, Homo sapiens
uccuaaagcaagaaacuaa

SEQ ID NO: 1372620 - RNA, 19 nt, Homo sapiens
ucacuccuauucucuuugc

SEQ ID NO: 1372621 - RNA, 19 nt, Homo sapiens
ucaccaguuacuuuaauga

SEQ ID NO: 1372622 - RNA, 19 nt, Homo sapiens
ggacgagaucuagaaucaa

SEQ ID NO: 1372623 - RNA, 19 nt, Homo sapiens
agaggaagaaagcuaucua

SEQ ID NO: 1372624 - RNA, 19 nt, Homo sapiens
gaucuacaggagaggaaga

SEQ ID NO: 1372625 - RNA, 19 nt, Homo sapiens
ccagaugccaccggaaaug

SEQ ID NO: 1372626 - RNA, 19 nt, Homo sapiens
aauaagcuacacccagauu

SEQ ID NO: 1372627 - RNA, 19 nt, Homo sapiens
gcugaacuucgaacaagau

SEQ ID NO: 1372628 - RNA, 19 nt, Homo sapiens
gacacuuccuuuccauugc

SEQ ID NO: 1372629 - RNA, 19 nt, Homo sapiens
uggagaaccuggagaaccu

SEQ ID NO: 1372630 - RNA, 19 nt, Homo sapiens
auaagcuacacccagauua

SEQ ID NO: 1372631 - RNA, 19 nt, Homo sapiens
gaucucccgucuggucaca

SEQ ID NO: 1372632 - RNA, 19 nt, Homo sapiens
gaugccaccggaaauguca

SEQ ID NO: 1372633 - RNA, 19 nt, Homo sapiens
uaagcuacacccagauuac

SEQ ID NO: 1372634 - RNA, 19 nt, Homo sapiens
uagacggaccuaggccuua

SEQ ID NO: 1372635 - RNA, 19 nt, Homo sapiens
gaagugaccuguaaggaua

SEQ ID NO: 1372636 - RNA, 19 nt, Homo sapiens
caacaaggcugucaaaugu

SEQ ID NO: 1372637 - RNA, 19 nt, Homo sapiens
gaaauugacuguguggaua

SEQ ID NO: 1372638 - RNA, 19 nt, Homo sapiens
gaaagacaauguaaccaaa

SEQ ID NO: 1372639 - RNA, 19 nt, Homo sapiens
gcacucagcugaugucaau

SEQ ID NO: 1372640 - RNA, 19 nt, Homo sapiens
ggacuugaauacacccuua

SEQ ID NO: 1372641 - RNA, 19 nt, Homo sapiens
ccacuuagcugccuacaau

SEQ ID NO: 1372642 - RNA, 19 nt, Homo sapiens
gcgcagaagugaccuguaa

SEQ ID NO: 1372643 - RNA, 19 nt, Homo sapiens
gcagaaaguuguuaucauc

SEQ ID NO: 1372644 - RNA, 19 nt, Homo sapiens
gaugauggcugcugagaau

SEQ ID NO: 1372645 - RNA, 19 nt, Homo sapiens
caucagacauggauagaaa

SEQ ID NO: 1372646 - RNA, 19 nt, Homo sapiens
gggcaaauaucaaugcauu

SEQ ID NO: 1372647 - RNA, 19 nt, Homo sapiens
gaaaugcccaugauaauuc

SEQ ID NO: 1372648 - RNA, 19 nt, Homo sapiens
gaauacacccuuacauuug

SEQ ID NO: 1372649 - RNA, 19 nt, Homo sapiens
ggaggacuguuguuucaaa

SEQ ID NO: 1372650 - RNA, 19 nt, Homo sapiens
gaacaagaagugucaauuc

SEQ ID NO: 1372651 - RNA, 19 nt, Homo sapiens
gagguaauguggaauguau

SEQ ID NO: 1372652 - RNA, 19 nt, Homo sapiens
gacgagagccuuauuaaug

SEQ ID NO: 1372653 - RNA, 19 nt, Homo sapiens
gaggaggacuguuguuuca

SEQ ID NO: 1372654 - RNA, 19 nt, Homo sapiens
ggaucuggcugccuuuaaa

SEQ ID NO: 1372655 - RNA, 19 nt, Homo sapiens
cuucaugccucaguaauua

SEQ ID NO: 1372656 - RNA, 19 nt, Homo sapiens
ccagauaaauuuggaagaa

SEQ ID NO: 1372657 - RNA, 19 nt, Homo sapiens
guaaggauaagaaggguua

SEQ ID NO: 1372658 - RNA, 19 nt, Homo sapiens
gauggucaauuuacucuug

SEQ ID NO: 1372659 - RNA, 19 nt, Homo sapiens
ugaccaagcugggcaguuu

SEQ ID NO: 1372660 - RNA, 19 nt, Homo sapiens
ggaaaugcccaugauaauu

SEQ ID NO: 1372661 - RNA, 19 nt, Homo sapiens
uaaauuuagugggcuguua

SEQ ID NO: 1372662 - RNA, 19 nt, Homo sapiens
gucaggagcucguguaaau

SEQ ID NO: 1372663 - RNA, 19 nt, Homo sapiens
ugaauacacccuuacauuu

SEQ ID NO: 1372664 - RNA, 19 nt, Homo sapiens
gaggugaaauugacugugu

SEQ ID NO: 1372665 - RNA, 19 nt, Homo sapiens
gauaaggacuugaauacac

SEQ ID NO: 1372666 - RNA, 19 nt, Homo sapiens
gaagaagcaguacagguuu

SEQ ID NO: 1372667 - RNA, 19 nt, Homo sapiens
ggacuguuguuucaaagau

SEQ ID NO: 1372668 - RNA, 19 nt, Homo sapiens
ucacagacccucauucaga

SEQ ID NO: 1372669 - RNA, 19 nt, Homo sapiens
ugaaaucaaugucuaugga

SEQ ID NO: 1372670 - RNA, 19 nt, Homo sapiens
caagacgagagccuuauua

SEQ ID NO: 1372671 - RNA, 19 nt, Homo sapiens
ggaggacgcccuugcacua

SEQ ID NO: 1372672 - RNA, 19 nt, Homo sapiens
ggacaaggaagguuacaau

SEQ ID NO: 1372673 - RNA, 19 nt, Homo sapiens
gaauggaggugaaauugac

SEQ ID NO: 1372674 - RNA, 19 nt, Homo sapiens
ggagcacaguggugaaaga

SEQ ID NO: 1372675 - RNA, 19 nt, Homo sapiens
ugacgcuguuucauuguua

SEQ ID NO: 1372676 - RNA, 19 nt, Homo sapiens
ccacuuggauguuguagca

SEQ ID NO: 1372677 - RNA, 19 nt, Homo sapiens
gcacugggcagcauacaug

SEQ ID NO: 1372678 - RNA, 19 nt, Homo sapiens
acgagagccuuauuaauga

SEQ ID NO: 1372679 - RNA, 19 nt, Homo sapiens
ggccauagauuccaguauc

SEQ ID NO: 1372680 - RNA, 19 nt, Homo sapiens
cggagcagauuuccauaaa

SEQ ID NO: 1372681 - RNA, 19 nt, Homo sapiens
ugaaccagccaaacaauaa

SEQ ID NO: 1372682 - RNA, 19 nt, Homo sapiens
gaacgcaguagauaauuca

SEQ ID NO: 1372683 - RNA, 19 nt, Homo sapiens
gaaagaugccaaaggacaa

SEQ ID NO: 1372684 - RNA, 19 nt, Homo sapiens
gcgcauccaucuuugugaa

SEQ ID NO: 1372685 - RNA, 19 nt, Homo sapiens
gacaaggaagguuacaaua

SEQ ID NO: 1372686 - RNA, 19 nt, Homo sapiens
cacacuaugucuagaguuu

SEQ ID NO: 1372687 - RNA, 19 nt, Homo sapiens
acauuuggcuuguaguaaa

SEQ ID NO: 1372688 - RNA, 19 nt, Homo sapiens
uauugacgcuguuucauug

SEQ ID NO: 1372689 - RNA, 19 nt, Homo sapiens
ugugaaagaugccaaagga

SEQ ID NO: 1372690 - RNA, 19 nt, Homo sapiens
caaggaagguuacaauagc

SEQ ID NO: 1372691 - RNA, 19 nt, Homo sapiens
gucaugagcuuuugauuaa

SEQ ID NO: 1372692 - RNA, 19 nt, Homo sapiens
ucacaucgccugcuacaau

SEQ ID NO: 1372693 - RNA, 19 nt, Homo sapiens
ggaaauacagcgcuucaca

SEQ ID NO: 1372694 - RNA, 19 nt, Homo sapiens
ugaagaagcaguacagguu

SEQ ID NO: 1372695 - RNA, 19 nt, Homo sapiens
ggccgaggcaguuggauua

SEQ ID NO: 1372696 - RNA, 19 nt, Homo sapiens
gguaauguggaauguauaa

SEQ ID NO: 1372697 - RNA, 19 nt, Homo sapiens
gaaaucaaugucuauggaa

SEQ ID NO: 1372698 - RNA, 19 nt, Homo sapiens
ggguggagauugaugaaau

SEQ ID NO: 1372699 - RNA, 19 nt, Homo sapiens
ccagggucauagucauuua

SEQ ID NO: 1372700 - RNA, 19 nt, Homo sapiens
gaucugacuguaaaggaua

SEQ ID NO: 1372701 - RNA, 19 nt, Homo sapiens
ccagggagcugaaggaaaa

SEQ ID NO: 1372702 - RNA, 19 nt, Homo sapiens
gaauugucauuuccacugu

SEQ ID NO: 1372703 - RNA, 19 nt, Homo sapiens
gaaauagacaccccagaua

SEQ ID NO: 1372704 - RNA, 19 nt, Homo sapiens
ugucaaaugugcagaagug

SEQ ID NO: 1372705 - RNA, 19 nt, Homo sapiens
ccaacaaggcugucaaaug

SEQ ID NO: 1372706 - RNA, 19 nt, Homo sapiens
cgugguggcucaugccuuu

SEQ ID NO: 1372707 - RNA, 19 nt, Homo sapiens
uugaagaguuucuaagcua

SEQ ID NO: 1372708 - RNA, 19 nt, Homo sapiens
caacguuaaugaaacagau

SEQ ID NO: 1372709 - RNA, 19 nt, Homo sapiens
ccacuguauugagacauua

SEQ ID NO: 1372710 - RNA, 19 nt, Homo sapiens
caacacuccucuccaugug

SEQ ID NO: 1372711 - RNA, 19 nt, Homo sapiens
uuaacgaguugauugacua

SEQ ID NO: 1372712 - RNA, 19 nt, Homo sapiens
ggaacaagaagugucaauu

SEQ ID NO: 1372713 - RNA, 19 nt, Homo sapiens
cgaggaaugugugcaaaug

SEQ ID NO: 1372714 - RNA, 19 nt, Homo sapiens
aaaggaagccacacuaugu

SEQ ID NO: 1372715 - RNA, 19 nt, Homo sapiens
uaggaaaugcccaugauaa

SEQ ID NO: 1372716 - RNA, 19 nt, Homo sapiens
cagaauacauuugaagagu

SEQ ID NO: 1372717 - RNA, 19 nt, Homo sapiens
ggucauagucauuuauuca

SEQ ID NO: 1372718 - RNA, 19 nt, Homo sapiens
aaaugugccuuguuaauac

SEQ ID NO: 1372719 - RNA, 19 nt, Homo sapiens
aggcugaucugacuguaaa

SEQ ID NO: 1372720 - RNA, 19 nt, Homo sapiens
uaaaggauaaggacuugaa

SEQ ID NO: 1372721 - RNA, 19 nt, Homo sapiens
ggcaggcgcuguggauauu

SEQ ID NO: 1372722 - RNA, 19 nt, Homo sapiens
uuacacagagggauuauga

SEQ ID NO: 1372723 - RNA, 19 nt, Homo sapiens
uuacggcuguugcuagaaa

SEQ ID NO: 1372724 - RNA, 19 nt, Homo sapiens
agacauggauagaaauaag

SEQ ID NO: 1372725 - RNA, 19 nt, Homo sapiens
cacagacccucauucagaa

SEQ ID NO: 1372726 - RNA, 19 nt, Homo sapiens
ccaauggacagauuaaugu

SEQ ID NO: 1372727 - RNA, 19 nt, Homo sapiens
acguggagauggucaauuu

SEQ ID NO: 1372728 - RNA, 19 nt, Homo sapiens
gcaacaagagcgagacugu

SEQ ID NO: 1372729 - RNA, 19 nt, Homo sapiens
cgaggcaguuggauuacuu

SEQ ID NO: 1372730 - RNA, 19 nt, Homo sapiens
gaagaguuucuaagcuauu

SEQ ID NO: 1372731 - RNA, 19 nt, Homo sapiens
gacuguuguuucaaagaua

SEQ ID NO: 1372732 - RNA, 19 nt, Homo sapiens
uaaaggacacacagaaugu

SEQ ID NO: 1372733 - RNA, 19 nt, Homo sapiens
gaaagaacaaacaguggau

SEQ ID NO: 1372734 - RNA, 19 nt, Homo sapiens
gcacaggcagugucuggaa

SEQ ID NO: 1372735 - RNA, 19 nt, Homo sapiens
gaaagaacgucaucaguug

SEQ ID NO: 1372736 - RNA, 19 nt, Homo sapiens
gaagaaagcccuugaugaa

SEQ ID NO: 1372737 - RNA, 19 nt, Homo sapiens
caagggagcuucuuuaugu

SEQ ID NO: 1372738 - RNA, 19 nt, Homo sapiens
gaagacaacugcaaaguca

SEQ ID NO: 1372739 - RNA, 19 nt, Homo sapiens
gagagaaacuacaaagaaa

SEQ ID NO: 1372740 - RNA, 19 nt, Homo sapiens
gaagacagguggcaggaaa

SEQ ID NO: 1372741 - RNA, 19 nt, Homo sapiens
gauaacagcuaaucuggaa

SEQ ID NO: 1372742 - RNA, 19 nt, Homo sapiens
gaaagaagccaguguggaa

SEQ ID NO: 1372743 - RNA, 19 nt, Homo sapiens
gaccugaguuuaucacuuu

SEQ ID NO: 1372744 - RNA, 19 nt, Homo sapiens
ugacuaaccugcagaaaga

SEQ ID NO: 1372745 - RNA, 19 nt, Homo sapiens
ggaaaccucuucucacuuc

SEQ ID NO: 1372746 - RNA, 19 nt, Homo sapiens
ggaacaagcucuccagaca

SEQ ID NO: 1372747 - RNA, 19 nt, Homo sapiens
gaaguaucauucugaggua

SEQ ID NO: 1372748 - RNA, 19 nt, Homo sapiens
ggaaagaacgucaucaguu

SEQ ID NO: 1372749 - RNA, 19 nt, Homo sapiens
agaaagagaugcagauguu

SEQ ID NO: 1372750 - RNA, 19 nt, Homo sapiens
gaaagagagucagaaguug

SEQ ID NO: 1372751 - RNA, 19 nt, Homo sapiens
guacuggacuuugcucuuu

SEQ ID NO: 1372752 - RNA, 19 nt, Homo sapiens
ggugaaaucuauucuugaa

SEQ ID NO: 1372753 - RNA, 19 nt, Homo sapiens
gaagacaacaggaaacuug

SEQ ID NO: 1372754 - RNA, 19 nt, Homo sapiens
aaagaaagcucagcaggaa

SEQ ID NO: 1372755 - RNA, 19 nt, Homo sapiens
aaacaaagcuagaucacau

SEQ ID NO: 1372756 - RNA, 19 nt, Homo sapiens
uaaccugccuucuaugaaa

SEQ ID NO: 1372757 - RNA, 19 nt, Homo sapiens
gaacuugagcgacagaauu

SEQ ID NO: 1372758 - RNA, 19 nt, Homo sapiens
gcaaggugcucuggagaaa

SEQ ID NO: 1372759 - RNA, 19 nt, Homo sapiens
gcacaacagugagauugaa

SEQ ID NO: 1372760 - RNA, 19 nt, Homo sapiens
gaaaacaucucaggauauu

SEQ ID NO: 1372761 - RNA, 19 nt, Homo sapiens
gcacagguuugauggucua

SEQ ID NO: 1372762 - RNA, 19 nt, Homo sapiens
cagaacagauaacagcuaa

SEQ ID NO: 1372763 - RNA, 19 nt, Homo sapiens
gaacaugaagucuuugaug

SEQ ID NO: 1372764 - RNA, 19 nt, Homo sapiens
gagaaucggugccaggaau

SEQ ID NO: 1372765 - RNA, 19 nt, Homo sapiens
gcuaagagccaauaugaug

SEQ ID NO: 1372766 - RNA, 19 nt, Homo sapiens
cgaauaaugcucagaauau

SEQ ID NO: 1372767 - RNA, 19 nt, Homo sapiens
gcggagggauucagagauu

SEQ ID NO: 1372768 - RNA, 19 nt, Homo sapiens
ucuaggaucucucuaaaga

SEQ ID NO: 1372769 - RNA, 19 nt, Homo sapiens
gaaagaaagggaucucaau

SEQ ID NO: 1372770 - RNA, 19 nt, Homo sapiens
gaaagcagagaaacacauu

SEQ ID NO: 1372771 - RNA, 19 nt, Homo sapiens
aaauggagcuaauuaagga

SEQ ID NO: 1372772 - RNA, 19 nt, Homo sapiens
gcaccuaaccugccuucua

SEQ ID NO: 1372773 - RNA, 19 nt, Homo sapiens
guaaagaggcaacagagaa

SEQ ID NO: 1372774 - RNA, 19 nt, Homo sapiens
aaagggaucucaaucaaca

SEQ ID NO: 1372775 - RNA, 19 nt, Homo sapiens
caaccaaucuguucugcau

SEQ ID NO: 1372776 - RNA, 19 nt, Homo sapiens
gcucaucgcugguuuaagc

SEQ ID NO: 1372777 - RNA, 19 nt, Homo sapiens
cauauuggauucuuucugu

SEQ ID NO: 1372778 - RNA, 19 nt, Homo sapiens
ggaaguggcugagcugaag

SEQ ID NO: 1372779 - RNA, 19 nt, Homo sapiens
caaaguggaagcagaauug

SEQ ID NO: 1372780 - RNA, 19 nt, Homo sapiens
ugaaagagagucagaaguu

SEQ ID NO: 1372781 - RNA, 19 nt, Homo sapiens
gaacagauaacagcuaauc

SEQ ID NO: 1372782 - RNA, 19 nt, Homo sapiens
caacagagaauacgcugaa

SEQ ID NO: 1372783 - RNA, 19 nt, Homo sapiens
caccuaaccugccuucuau

SEQ ID NO: 1372784 - RNA, 19 nt, Homo sapiens
uaugaacagucuuugagua

SEQ ID NO: 1372785 - RNA, 19 nt, Homo sapiens
ucaaagaccggaugacuga

SEQ ID NO: 1372786 - RNA, 19 nt, Homo sapiens
agaaagggaucucaaucaa

SEQ ID NO: 1372787 - RNA, 19 nt, Homo sapiens
gaugugggcugaagauuuu

SEQ ID NO: 1372788 - RNA, 19 nt, Homo sapiens
ugacaagggagcuucuuua

SEQ ID NO: 1372789 - RNA, 19 nt, Homo sapiens
gcgaauaaugcucagaaua

SEQ ID NO: 1372790 - RNA, 19 nt, Homo sapiens
ggaccugaguuuaucacuu

SEQ ID NO: 1372791 - RNA, 19 nt, Homo sapiens
uaaagaagacaacugcaaa

SEQ ID NO: 1372792 - RNA, 19 nt, Homo sapiens
gcaaauggagcuaauuaag

SEQ ID NO: 1372793 - RNA, 19 nt, Homo sapiens
uggagucacugcuguguaa

SEQ ID NO: 1372794 - RNA, 19 nt, Homo sapiens
aaauuaagcuccacuuguc

SEQ ID NO: 1372795 - RNA, 19 nt, Homo sapiens
gcaauuggaaagcaaagaa

SEQ ID NO: 1372796 - RNA, 19 nt, Homo sapiens
aaacaggacucggugaaau

SEQ ID NO: 1372797 - RNA, 19 nt, Homo sapiens
ucacugcuguguaaauguu

SEQ ID NO: 1372798 - RNA, 19 nt, Homo sapiens
aaagcuagaucacauucaa

SEQ ID NO: 1372799 - RNA, 19 nt, Homo sapiens
caagcucuccagacaaaua

SEQ ID NO: 1372800 - RNA, 19 nt, Homo sapiens
acagugaagugucguaaug

SEQ ID NO: 1372801 - RNA, 19 nt, Homo sapiens
uagcuacacuccaugauuc

SEQ ID NO: 1372802 - RNA, 19 nt, Homo sapiens
gagaauacgcugaaagaag

SEQ ID NO: 1372803 - RNA, 19 nt, Homo sapiens
aagcaaauggagcuaauua

SEQ ID NO: 1372804 - RNA, 19 nt, Homo sapiens
gaacaagcucuccagacaa

SEQ ID NO: 1372805 - RNA, 19 nt, Homo sapiens
gaaaguacaaauagagcuu

SEQ ID NO: 1372806 - RNA, 19 nt, Homo sapiens
caagaaggugggaaacuuu

SEQ ID NO: 1372807 - RNA, 19 nt, Homo sapiens
gaacagugaagugucguaa

SEQ ID NO: 1372808 - RNA, 19 nt, Homo sapiens
gggcuggccuguuucuaga

SEQ ID NO: 1372809 - RNA, 19 nt, Homo sapiens
ggaaaaggaccaagaugua

SEQ ID NO: 1372810 - RNA, 19 nt, Homo sapiens
agcaggaacugguaacuuu

SEQ ID NO: 1372811 - RNA, 19 nt, Homo sapiens
uagaaaggaugaagguugu

SEQ ID NO: 1372812 - RNA, 19 nt, Homo sapiens
aacaagcucuccagacaaa

SEQ ID NO: 1372813 - RNA, 19 nt, Homo sapiens
ucacaaucauguuggagaa

SEQ ID NO: 1372814 - RNA, 19 nt, Homo sapiens
caaauuaagcuccacuugu

SEQ ID NO: 1372815 - RNA, 19 nt, Homo sapiens
acagaaacuugcagagcua

SEQ ID NO: 1372816 - RNA, 19 nt, Homo sapiens
ugaagaaagcccuugauga

SEQ ID NO: 1372817 - RNA, 19 nt, Homo sapiens
gacagaauuuggaaaccuu

SEQ ID NO: 1372818 - RNA, 19 nt, Homo sapiens
gaacgucaucaguugguuu

SEQ ID NO: 1372819 - RNA, 19 nt, Homo sapiens
gaagcucaucgcugguuua

SEQ ID NO: 1372820 - RNA, 19 nt, Homo sapiens
gaacagucuuugaguaucc

SEQ ID NO: 1372821 - RNA, 19 nt, Homo sapiens
agagagaaacuacaaagaa

SEQ ID NO: 1372822 - RNA, 19 nt, Homo sapiens
gacaaauaaucaucugcaa

SEQ ID NO: 1372823 - RNA, 19 nt, Homo sapiens
caaagucacaaucauguug

SEQ ID NO: 1372824 - RNA, 19 nt, Homo sapiens
acaagaaggugggaaacuu

SEQ ID NO: 1372825 - RNA, 19 nt, Homo sapiens
gggagcuucuuuaugugua

SEQ ID NO: 1372826 - RNA, 19 nt, Homo sapiens
caaauaaucaucugcaaac

SEQ ID NO: 1372827 - RNA, 19 nt, Homo sapiens
ggagaaaguacaaauagag

SEQ ID NO: 1372828 - RNA, 19 nt, Homo sapiens
gucagaaguugaaagaaga

SEQ ID NO: 1372829 - RNA, 19 nt, Homo sapiens
aaagaacuaugaacagucu

SEQ ID NO: 1372830 - RNA, 19 nt, Homo sapiens
ugacgaugccucuaagaaa

SEQ ID NO: 1372831 - RNA, 19 nt, Homo sapiens
cagagaauacgcugaaaga

SEQ ID NO: 1372832 - RNA, 19 nt, Homo sapiens
ccaggaugcuugucaugga

SEQ ID NO: 1372833 - RNA, 19 nt, Homo sapiens
cgugugagcuuugcaccua

SEQ ID NO: 1372834 - RNA, 19 nt, Homo sapiens
agagaggacugcaucuuca

SEQ ID NO: 1372835 - RNA, 19 nt, Homo sapiens
gaaauaagcucuagugaua

SEQ ID NO: 1372836 - RNA, 19 nt, Homo sapiens
gcagaaagauuuguuauug

SEQ ID NO: 1372837 - RNA, 19 nt, Homo sapiens
caaaguaucugccucaauu

SEQ ID NO: 1372838 - RNA, 19 nt, Homo sapiens
caagaagucucuagaaaga

SEQ ID NO: 1372839 - RNA, 19 nt, Homo sapiens
ggaaauaucccaugcaguu

SEQ ID NO: 1372840 - RNA, 19 nt, Homo sapiens
gaaagacuccuaccuuauu

SEQ ID NO: 1372841 - RNA, 19 nt, Homo sapiens
uagagucgcuuucaagaua

SEQ ID NO: 1372842 - RNA, 19 nt, Homo sapiens
ggaagucaauguccuuauu

SEQ ID NO: 1372843 - RNA, 19 nt, Homo sapiens
gagaauaccugggcaaguu

SEQ ID NO: 1372844 - RNA, 19 nt, Homo sapiens
gaaauaggguaccaucuag

SEQ ID NO: 1372845 - RNA, 19 nt, Homo sapiens
gaacagaucaaagcacuaa

SEQ ID NO: 1372846 - RNA, 19 nt, Homo sapiens
gaauauaugcgcuuucuga

SEQ ID NO: 1372847 - RNA, 19 nt, Homo sapiens
guaucugccucaauuauuu

SEQ ID NO: 1372848 - RNA, 19 nt, Homo sapiens
ucacugaacacacgaauaa

SEQ ID NO: 1372849 - RNA, 19 nt, Homo sapiens
agaggugguuccagaauua

SEQ ID NO: 1372850 - RNA, 19 nt, Homo sapiens
uaggauagguugucuucua

SEQ ID NO: 1372851 - RNA, 19 nt, Homo sapiens
ucugagacauuacaaagua

SEQ ID NO: 1372852 - RNA, 19 nt, Homo sapiens
ggaauacacacaggaauaa

SEQ ID NO: 1372853 - RNA, 19 nt, Homo sapiens
gggaagcucuugagugugu

SEQ ID NO: 1372854 - RNA, 19 nt, Homo sapiens
gaagcagaaagauuuguua

SEQ ID NO: 1372855 - RNA, 19 nt, Homo sapiens
aagauacgcuuuccauuug

SEQ ID NO: 1372856 - RNA, 19 nt, Homo sapiens
gagaggugguuccagaauu

SEQ ID NO: 1372857 - RNA, 19 nt, Homo sapiens
gaguaaggcugaucugaag

SEQ ID NO: 1372858 - RNA, 19 nt, Homo sapiens
ggagagccauuucuucaag

SEQ ID NO: 1372859 - RNA, 19 nt, Homo sapiens
uaacaugagugcacuuuac

SEQ ID NO: 1372860 - RNA, 19 nt, Homo sapiens
ggauguugguguagaagaa

SEQ ID NO: 1372861 - RNA, 19 nt, Homo sapiens
uggagaagaugcucuaaga

SEQ ID NO: 1372862 - RNA, 19 nt, Homo sapiens
gaaaaugucacguaaacua

SEQ ID NO: 1372863 - RNA, 19 nt, Homo sapiens
gaauuauggugaguauuug

SEQ ID NO: 1372864 - RNA, 19 nt, Homo sapiens
caaccagcgucaacuauca

SEQ ID NO: 1372865 - RNA, 19 nt, Homo sapiens
ugaaauaggguaccaucua

SEQ ID NO: 1372866 - RNA, 19 nt, Homo sapiens
caugaaugcuggcuaccua

SEQ ID NO: 1372867 - RNA, 19 nt, Homo sapiens
uuucacaucugagacauua

SEQ ID NO: 1372868 - RNA, 19 nt, Homo sapiens
ugagugcacuuuacuaauc

SEQ ID NO: 1372869 - RNA, 19 nt, Homo sapiens
ggaagaaugugagcaagag

SEQ ID NO: 1372870 - RNA, 19 nt, Homo sapiens
guacagaaauagucaacag

SEQ ID NO: 1372871 - RNA, 19 nt, Homo sapiens
gcucaaugaugcguuugua

SEQ ID NO: 1372872 - RNA, 19 nt, Homo sapiens
cgaauaacuuggauagcaa

SEQ ID NO: 1372873 - RNA, 19 nt, Homo sapiens
ggaguaaggcugaucugaa

SEQ ID NO: 1372874 - RNA, 19 nt, Homo sapiens
augaaagacuccuaccuua

SEQ ID NO: 1372875 - RNA, 19 nt, Homo sapiens
gaugaaagacuccuaccuu

SEQ ID NO: 1372876 - RNA, 19 nt, Homo sapiens
acaaagaaguguccugcuu

SEQ ID NO: 1372877 - RNA, 19 nt, Homo sapiens
aagagaagcagaaagauuu

SEQ ID NO: 1372878 - RNA, 19 nt, Homo sapiens
gaaggaauacacacaggaa

SEQ ID NO: 1372879 - RNA, 19 nt, Homo sapiens
gauagcaaauccugagaca

SEQ ID NO: 1372880 - RNA, 19 nt, Homo sapiens
gaauaggaguguaguugag

SEQ ID NO: 1372881 - RNA, 19 nt, Homo sapiens
gaaauaucccaugcaguuu

SEQ ID NO: 1372882 - RNA, 19 nt, Homo sapiens
gagagugccuggauuucau

SEQ ID NO: 1372883 - RNA, 19 nt, Homo sapiens
gcaauacuaucccguuggu

SEQ ID NO: 1372884 - RNA, 19 nt, Homo sapiens
uaacugccauugucugcaa

SEQ ID NO: 1372885 - RNA, 19 nt, Homo sapiens
gaagccaugucaccauauc

SEQ ID NO: 1372886 - RNA, 19 nt, Homo sapiens
ggaacgagacuucaacaca

SEQ ID NO: 1372887 - RNA, 19 nt, Homo sapiens
uaagagaagcagaaagauu

SEQ ID NO: 1372888 - RNA, 19 nt, Homo sapiens
ggacaugacggaacagauc

SEQ ID NO: 1372889 - RNA, 19 nt, Homo sapiens
ccagaauuauggugaguau

SEQ ID NO: 1372890 - RNA, 19 nt, Homo sapiens
ucagagaaagcaagcauaa

SEQ ID NO: 1372891 - RNA, 19 nt, Homo sapiens
ggaugaauauaugcgcuuu

SEQ ID NO: 1372892 - RNA, 19 nt, Homo sapiens
gaggauugcuuuugcuuaa

SEQ ID NO: 1372893 - RNA, 19 nt, Homo sapiens
guuccagguuuguucauuu

SEQ ID NO: 1372894 - RNA, 19 nt, Homo sapiens
gaccugacauuuagcucaa

SEQ ID NO: 1372895 - RNA, 19 nt, Homo sapiens
uagcaaauccugagacaau

SEQ ID NO: 1372896 - RNA, 19 nt, Homo sapiens
gauugugucuaagcuauga

SEQ ID NO: 1372897 - RNA, 19 nt, Homo sapiens
uaaacuagaucagggaaca

SEQ ID NO: 1372898 - RNA, 19 nt, Homo sapiens
acacuggguuggcauaaga

SEQ ID NO: 1372899 - RNA, 19 nt, Homo sapiens
gagcaagaguagagagagu

SEQ ID NO: 1372900 - RNA, 19 nt, Homo sapiens
ucaaagaucccugagcaaa

SEQ ID NO: 1372901 - RNA, 19 nt, Homo sapiens
gauuaccuguggucacuga

SEQ ID NO: 1372902 - RNA, 19 nt, Homo sapiens
gcacguggcaucugauuac

SEQ ID NO: 1372903 - RNA, 19 nt, Homo sapiens
uagaguaacugccauuguc

SEQ ID NO: 1372904 - RNA, 19 nt, Homo sapiens
ugacagcuuugacgaggaa

SEQ ID NO: 1372905 - RNA, 19 nt, Homo sapiens
cagaaauagucaacagaug

SEQ ID NO: 1372906 - RNA, 19 nt, Homo sapiens
uaagaaauaagcucuagug

SEQ ID NO: 1372907 - RNA, 19 nt, Homo sapiens
gauaggauagguugucuuc

SEQ ID NO: 1372908 - RNA, 19 nt, Homo sapiens
uaagaagagucagcucaga

SEQ ID NO: 1372909 - RNA, 19 nt, Homo sapiens
ggaaaaccauuaacuuuac

SEQ ID NO: 1372910 - RNA, 19 nt, Homo sapiens
caaaugcggcuucuguuuc

SEQ ID NO: 1372911 - RNA, 19 nt, Homo sapiens
caugagugcacuuuacuaa

SEQ ID NO: 1372912 - RNA, 19 nt, Homo sapiens
ccuaucaucuggccacaug

SEQ ID NO: 1372913 - RNA, 19 nt, Homo sapiens
gauaugauaauccuaccaa

SEQ ID NO: 1372914 - RNA, 19 nt, Homo sapiens
uauaugcgcuuucugaacu

SEQ ID NO: 1372915 - RNA, 19 nt, Homo sapiens
ucaauuauuucugcugguu

SEQ ID NO: 1372916 - RNA, 19 nt, Homo sapiens
cuaggucaguuuaagaaga

SEQ ID NO: 1372917 - RNA, 19 nt, Homo sapiens
caaggaagaaugugagcaa

SEQ ID NO: 1372918 - RNA, 19 nt, Homo sapiens
ggcauaagauauccuaaaa

SEQ ID NO: 1372919 - RNA, 19 nt, Homo sapiens
gugcuugcauugcuuuguu

SEQ ID NO: 1372920 - RNA, 19 nt, Homo sapiens
uucaagaagucucuagaaa

SEQ ID NO: 1372921 - RNA, 19 nt, Homo sapiens
cagaaagauuuguuauugg

SEQ ID NO: 1372922 - RNA, 19 nt, Homo sapiens
aaagagauaacacauggaa

SEQ ID NO: 1372923 - RNA, 19 nt, Homo sapiens
cugggaagcucuugagugu

SEQ ID NO: 1372924 - RNA, 19 nt, Homo sapiens
aauaagcucuagugauauc

SEQ ID NO: 1372925 - RNA, 19 nt, Homo sapiens
gaauaacuuggauagcaaa

SEQ ID NO: 1372926 - RNA, 19 nt, Homo sapiens
ucuaagagaagcagaaaga

SEQ ID NO: 1372927 - RNA, 19 nt, Homo sapiens
ggaggugguguagggauua

SEQ ID NO: 1372928 - RNA, 19 nt, Homo sapiens
gcacuuuacuaauccucau

SEQ ID NO: 1372929 - RNA, 19 nt, Homo sapiens
aaagcaagcauaagggaaa

SEQ ID NO: 1372930 - RNA, 19 nt, Homo sapiens
aaagacuccuaccuuauuc

SEQ ID NO: 1372931 - RNA, 19 nt, Homo sapiens
uccagugccucuuaauuga

SEQ ID NO: 1372932 - RNA, 19 nt, Homo sapiens
ggugagguucugcaaagua

SEQ ID NO: 1372933 - RNA, 19 nt, Homo sapiens
gaagagucagcucagagaa

SEQ ID NO: 1372934 - RNA, 19 nt, Homo sapiens
cuacaaaugcggcuucugu

SEQ ID NO: 1372935 - RNA, 19 nt, Homo sapiens
gaacaggccuuccuacuga

SEQ ID NO: 1372936 - RNA, 19 nt, Homo sapiens
cauauuggauggcuucuuu

SEQ ID NO: 1372937 - RNA, 19 nt, Homo sapiens
gaugacugcugagaaauuu

SEQ ID NO: 1372938 - RNA, 19 nt, Homo sapiens
caggaugacugcugagaaa

SEQ ID NO: 1372939 - RNA, 19 nt, Homo sapiens
gaacuaugagcucaccuuu

SEQ ID NO: 1372940 - RNA, 19 nt, Homo sapiens
ggcccagacugaugagaua

SEQ ID NO: 1372941 - RNA, 19 nt, Homo sapiens
cagcuggauucuagaagua

SEQ ID NO: 1372942 - RNA, 19 nt, Homo sapiens
guccaaggaucagaagaua

SEQ ID NO: 1372943 - RNA, 19 nt, Homo sapiens
uuagugagcuggugguaga

SEQ ID NO: 1372944 - RNA, 19 nt, Homo sapiens
ccugacagcuggauucuag

SEQ ID NO: 1372945 - RNA, 19 nt, Homo sapiens
ggaugacugcugagaaauu

SEQ ID NO: 1372946 - RNA, 19 nt, Homo sapiens
gagcugauggccuucauga

SEQ ID NO: 1372947 - RNA, 19 nt, Homo sapiens
cacccaggcuccaggauga

SEQ ID NO: 1372948 - RNA, 19 nt, Homo sapiens
acuaugagcucaccuuugg

SEQ ID NO: 1372949 - RNA, 19 nt, Homo sapiens
gugagugacuugcgcaauc

SEQ ID NO: 1372950 - RNA, 19 nt, Homo sapiens
cgaaguccagccugaaauu

SEQ ID NO: 1372951 - RNA, 19 nt, Homo sapiens
gcaggcagcggaugcacaa

SEQ ID NO: 1372952 - RNA, 19 nt, Homo sapiens
ggaugacagccaagaaguu

SEQ ID NO: 1372953 - RNA, 19 nt, Homo sapiens
cgaggaauccgcaucuaug

SEQ ID NO: 1372954 - RNA, 19 nt, Homo sapiens
gaacaggcuccccaaguuu

SEQ ID NO: 1372955 - RNA, 19 nt, Homo sapiens
ggacgugcgagcucugcua

SEQ ID NO: 1372956 - RNA, 19 nt, Homo sapiens
gaugacagccaagaaguuc

SEQ ID NO: 1372957 - RNA, 19 nt, Homo sapiens
ugaaggcccagacugauga

SEQ ID NO: 1372958 - RNA, 19 nt, Homo sapiens
gcgaggaauccgcaucuau

SEQ ID NO: 1372959 - RNA, 19 nt, Homo sapiens
gaaguccagccugaaauuc

SEQ ID NO: 1372960 - RNA, 19 nt, Homo sapiens
ugagugacuugcgcaauca

SEQ ID NO: 1372961 - RNA, 19 nt, Homo sapiens
gcgcugccuccgagacaua

SEQ ID NO: 1372962 - RNA, 19 nt, Homo sapiens
cugaagcucuaccggaaug

SEQ ID NO: 1372963 - RNA, 19 nt, Homo sapiens
aggaggaacuggagacgau

SEQ ID NO: 1372964 - RNA, 19 nt, Homo sapiens
cugaugagauacuguccaa

SEQ ID NO: 1372965 - RNA, 19 nt, Homo sapiens
ugaacaggcuccccaaguu

SEQ ID NO: 1372966 - RNA, 19 nt, Homo sapiens
cuaccggaauggcaucaug

SEQ ID NO: 1372967 - RNA, 19 nt, Homo sapiens
ggacucagagagcaagaca

SEQ ID NO: 1372968 - RNA, 19 nt, Homo sapiens
ggaugccucugccuuugag

SEQ ID NO: 1372969 - RNA, 19 nt, Homo sapiens
cauggaugccucugccuuu

SEQ ID NO: 1372970 - RNA, 19 nt, Homo sapiens
gcaucaagucugagaaugg

SEQ ID NO: 1372971 - RNA, 19 nt, Homo sapiens
uuugagaucuucagcacau

SEQ ID NO: 1372972 - RNA, 19 nt, Homo sapiens
gcgcaucaagucugagaau

SEQ ID NO: 1372973 - RNA, 19 nt, Homo sapiens
ucagggacaccuugcagaa

SEQ ID NO: 1372974 - RNA, 19 nt, Homo sapiens
ugacagcuggauucuagaa

SEQ ID NO: 1372975 - RNA, 19 nt, Homo sapiens
cagaacugcugcccauugc

SEQ ID NO: 1372976 - RNA, 19 nt, Homo sapiens
ccaucccgcugaagcucua

SEQ ID NO: 1372977 - RNA, 19 nt, Homo sapiens
gaggaauccgcaucuaugg

SEQ ID NO: 1372978 - RNA, 19 nt, Homo sapiens
acagcuggauucuagaagu

SEQ ID NO: 1372979 - RNA, 19 nt, Homo sapiens
ggcgaggaauccgcaucua

SEQ ID NO: 1372980 - RNA, 19 nt, Homo sapiens
gugaaggcccagacugaug

SEQ ID NO: 1372981 - RNA, 19 nt, Homo sapiens
ccaaggaucagaagauagc

SEQ ID NO: 1372982 - RNA, 19 nt, Homo sapiens
ccucggagccuaugaaucc

SEQ ID NO: 1372983 - RNA, 19 nt, Homo sapiens
ggcaaggcgaggugauuga

SEQ ID NO: 1372984 - RNA, 19 nt, Homo sapiens
ccaggaugacugcugagaa

SEQ ID NO: 1372985 - RNA, 19 nt, Homo sapiens
ggcgagagggacuggauga

SEQ ID NO: 1372986 - RNA, 19 nt, Homo sapiens
uggagcgguuccucaguga

SEQ ID NO: 1372987 - RNA, 19 nt, Homo sapiens
ucagagcuccagcgacugu

SEQ ID NO: 1372988 - RNA, 19 nt, Homo sapiens
ccagacugaugagauacug

SEQ ID NO: 1372989 - RNA, 19 nt, Homo sapiens
ccucugccuuugagaucuu

SEQ ID NO: 1372990 - RNA, 19 nt, Homo sapiens
gggacaccuugcagaacug

SEQ ID NO: 1372991 - RNA, 19 nt, Homo sapiens
gaaacucucuucucugauu

SEQ ID NO: 1372992 - RNA, 19 nt, Homo sapiens
gggagaagcugacguuguu

SEQ ID NO: 1372993 - RNA, 19 nt, Homo sapiens
ggaaggaguugucauugug

SEQ ID NO: 1372994 - RNA, 19 nt, Homo sapiens
gugaaacucucuucucuga

SEQ ID NO: 1372995 - RNA, 19 nt, Homo sapiens
ggacuacccugcacugcuu

SEQ ID NO: 1372996 - RNA, 19 nt, Homo sapiens
gaauaaugguggcgaguuc

SEQ ID NO: 1372997 - RNA, 19 nt, Homo sapiens
gaaacacagucaguacuau

SEQ ID NO: 1372998 - RNA, 19 nt, Homo sapiens
aauuagagauuccaacuga

SEQ ID NO: 1372999 - RNA, 19 nt, Homo sapiens
caagaauaauggcuacuuc

SEQ ID NO: 1373000 - RNA, 19 nt, Homo sapiens
gaagagcaguuugugaaag

SEQ ID NO: 1373001 - RNA, 19 nt, Homo sapiens
gggaaggaguugucauugu

SEQ ID NO: 1373002 - RNA, 19 nt, Homo sapiens
ggaugagaaugaacucgaa

SEQ ID NO: 1373003 - RNA, 19 nt, Homo sapiens
uaaagaaacacagucagua

SEQ ID NO: 1373004 - RNA, 19 nt, Homo sapiens
gaacugugggagucaagua

SEQ ID NO: 1373005 - RNA, 19 nt, Homo sapiens
caagagaaaguagauguuu

SEQ ID NO: 1373006 - RNA, 19 nt, Homo sapiens
ugacaaaguucuguuucuu

SEQ ID NO: 1373007 - RNA, 19 nt, Homo sapiens
aauaauggcuacuucuaga

SEQ ID NO: 1373008 - RNA, 19 nt, Homo sapiens
acagagacaugcacgauuc

SEQ ID NO: 1373009 - RNA, 19 nt, Homo sapiens
gaacagagacaugcacgau

SEQ ID NO: 1373010 - RNA, 19 nt, Homo sapiens
caaugacacacgccuauaa

SEQ ID NO: 1373011 - RNA, 19 nt, Homo sapiens
gcaaaggaaacccuggaaa

SEQ ID NO: 1373012 - RNA, 19 nt, Homo sapiens
acaaaguucuguuucuuca

SEQ ID NO: 1373013 - RNA, 19 nt, Homo sapiens
gaagcuacuuaaagaacug

SEQ ID NO: 1373014 - RNA, 19 nt, Homo sapiens
gagcaccguggguuuauuu

SEQ ID NO: 1373015 - RNA, 19 nt, Homo sapiens
gagggaaggaguugucauu

SEQ ID NO: 1373016 - RNA, 19 nt, Homo sapiens
gaauaauggcuacuucuag

SEQ ID NO: 1373017 - RNA, 19 nt, Homo sapiens
gggaaagaagcuucaguuu

SEQ ID NO: 1373018 - RNA, 19 nt, Homo sapiens
aaacacagucaguacuaua

SEQ ID NO: 1373019 - RNA, 19 nt, Homo sapiens
gcaacugcguggugcugaa

SEQ ID NO: 1373020 - RNA, 19 nt, Homo sapiens
cggcgucucuccagugauu

SEQ ID NO: 1373021 - RNA, 19 nt, Homo sapiens
gcaaugacacacgccuaua

SEQ ID NO: 1373022 - RNA, 19 nt, Homo sapiens
guuguaaagugccaucaga

SEQ ID NO: 1373023 - RNA, 19 nt, Homo sapiens
gaaggaguugucauuguga

SEQ ID NO: 1373024 - RNA, 19 nt, Homo sapiens
ucgcgcagcuccaaccaaa

SEQ ID NO: 1373025 - RNA, 19 nt, Homo sapiens
caucagacaagaucaguug

SEQ ID NO: 1373026 - RNA, 19 nt, Homo sapiens
ccucaggcaucguuguaaa

SEQ ID NO: 1373027 - RNA, 19 nt, Homo sapiens
gacggugccucacaucugu

SEQ ID NO: 1373028 - RNA, 19 nt, Homo sapiens
ggaaaauccuacaagagaa

SEQ ID NO: 1373029 - RNA, 19 nt, Homo sapiens
gcagagccacguuccuuau

SEQ ID NO: 1373030 - RNA, 19 nt, Homo sapiens
gcgcagcuccaaccaaaga

SEQ ID NO: 1373031 - RNA, 19 nt, Homo sapiens
guaaagugccaucagacaa

SEQ ID NO: 1373032 - RNA, 19 nt, Homo sapiens
ccgcugaggugauuuggau

SEQ ID NO: 1373033 - RNA, 19 nt, Homo sapiens
gcaggagaauugcgugaac

SEQ ID NO: 1373034 - RNA, 19 nt, Homo sapiens
gaaaccccgucucuacuaa

SEQ ID NO: 1373035 - RNA, 19 nt, Homo sapiens
cuacaccacugacccgaau

SEQ ID NO: 1373036 - RNA, 19 nt, Homo sapiens
guaccuuugugagauugua

SEQ ID NO: 1373037 - RNA, 19 nt, Homo sapiens
agaaacacagucaguacua

SEQ ID NO: 1373038 - RNA, 19 nt, Homo sapiens
gcacuccaccuguccacuu

SEQ ID NO: 1373039 - RNA, 19 nt, Homo sapiens
caucaccagcauuauuaua

SEQ ID NO: 1373040 - RNA, 19 nt, Homo sapiens
uccaucaccagcauuauua

SEQ ID NO: 1373041 - RNA, 19 nt, Homo sapiens
ggaauaaugguggcgaguu

SEQ ID NO: 1373042 - RNA, 19 nt, Homo sapiens
gagaagcugacguuguuau

SEQ ID NO: 1373043 - RNA, 19 nt, Homo sapiens
ggccgaggcaggagaauug

SEQ ID NO: 1373044 - RNA, 19 nt, Homo sapiens
cgaagagcaguuugugaaa

SEQ ID NO: 1373045 - RNA, 19 nt, Homo sapiens
agagccacguuccuuauga

SEQ ID NO: 1373046 - RNA, 19 nt, Homo sapiens
gcgcagugaguaaacauga

SEQ ID NO: 1373047 - RNA, 19 nt, Homo sapiens
agucaguacuauacaagaa

SEQ ID NO: 1373048 - RNA, 19 nt, Homo sapiens
ucgaagagcaguuugugaa

SEQ ID NO: 1373049 - RNA, 19 nt, Homo sapiens
gacaaaguucuguuucuuc

SEQ ID NO: 1373050 - RNA, 19 nt, Homo sapiens
ggacggugccucacaucug

SEQ ID NO: 1373051 - RNA, 19 nt, Homo sapiens
ucaccagcauuauuauagu

SEQ ID NO: 1373052 - RNA, 19 nt, Homo sapiens
cacuugaggucaggaguuu

SEQ ID NO: 1373053 - RNA, 19 nt, Homo sapiens
agacaugcacgauucaaga

SEQ ID NO: 1373054 - RNA, 19 nt, Homo sapiens
gaaaauccuacaagagaaa

SEQ ID NO: 1373055 - RNA, 19 nt, Homo sapiens
cccaggagcucaagauugc

SEQ ID NO: 1373056 - RNA, 19 nt, Homo sapiens
gacaugcacgauucaagaa

SEQ ID NO: 1373057 - RNA, 19 nt, Homo sapiens
caaaggaaacccuggaaaa

SEQ ID NO: 1373058 - RNA, 19 nt, Homo sapiens
ggagaagcugacguuguua

SEQ ID NO: 1373059 - RNA, 19 nt, Homo sapiens
gcaccuguaaucccagcua

SEQ ID NO: 1373060 - RNA, 19 nt, Homo sapiens
caguugaucagaacagaaa

SEQ ID NO: 1373061 - RNA, 19 nt, Homo sapiens
uaugagcaccguggguuua

SEQ ID NO: 1373062 - RNA, 19 nt, Homo sapiens
gcccaggagcucaagauug

SEQ ID NO: 1373063 - RNA, 19 nt, Homo sapiens
aaagugccaucagacaaga

SEQ ID NO: 1373064 - RNA, 19 nt, Homo sapiens
uaaagugccaucagacaag

SEQ ID NO: 1373065 - RNA, 19 nt, Homo sapiens
aaacucucuucucugauug

SEQ ID NO: 1373066 - RNA, 19 nt, Homo sapiens
cacagucaguacuauacaa

SEQ ID NO: 1373067 - RNA, 19 nt, Homo sapiens
ccauaaagaaacacaguca

SEQ ID NO: 1373068 - RNA, 19 nt, Homo sapiens
agaaaccgcgaucggagua

SEQ ID NO: 1373069 - RNA, 19 nt, Homo sapiens
gcauuauuauagugcuuca

SEQ ID NO: 1373070 - RNA, 19 nt, Homo sapiens
augagccucugguagauaa

SEQ ID NO: 1373071 - RNA, 19 nt, Homo sapiens
ccagauggcaggcaagaag

SEQ ID NO: 1373072 - RNA, 19 nt, Homo sapiens
gcugaggugauuuggauau

SEQ ID NO: 1373073 - RNA, 19 nt, Homo sapiens
uaaacaugagccucuggua

SEQ ID NO: 1373074 - RNA, 19 nt, Homo sapiens
caccagcauuauuauagug

SEQ ID NO: 1373075 - RNA, 19 nt, Homo sapiens
gagccacguuccuuaugag

SEQ ID NO: 1373076 - RNA, 19 nt, Homo sapiens
caagauugcagugagcuau

SEQ ID NO: 1373077 - RNA, 19 nt, Homo sapiens
ugauuuggauaucccuaga

SEQ ID NO: 1373078 - RNA, 19 nt, Homo sapiens
caccguggguuuauuucau

SEQ ID NO: 1373079 - RNA, 19 nt, Homo sapiens
gcaccguggguuuauuuca

SEQ ID NO: 1373080 - RNA, 19 nt, Homo sapiens
aaagaaacacagucaguac

SEQ ID NO: 1373081 - RNA, 19 nt, Homo sapiens
agauugcagugagcuauga

SEQ ID NO: 1373082 - RNA, 19 nt, Homo sapiens
cagcagagccacguuccuu

SEQ ID NO: 1373083 - RNA, 19 nt, Homo sapiens
gguggacggugccucacau

SEQ ID NO: 1373084 - RNA, 19 nt, Homo sapiens
cgaguuccaucaccagcau

SEQ ID NO: 1373085 - RNA, 19 nt, Homo sapiens
aacaugagccucugguaga

SEQ ID NO: 1373086 - RNA, 19 nt, Homo sapiens
gagcucaagauugcaguga

SEQ ID NO: 1373087 - RNA, 19 nt, Homo sapiens
ucuguaaucccagcacuuu

SEQ ID NO: 1373088 - RNA, 19 nt, Homo sapiens
uaaauggugcacuaaacug

SEQ ID NO: 1373089 - RNA, 19 nt, Homo sapiens
aaagaacugugggagucaa

SEQ ID NO: 1373090 - RNA, 19 nt, Homo sapiens
gaaggguguccccguauuu

SEQ ID NO: 1373091 - RNA, 19 nt, Homo sapiens
ggaaggagauggagaaaga

SEQ ID NO: 1373092 - RNA, 19 nt, Homo sapiens
ggagaucgaugagcagaua

SEQ ID NO: 1373093 - RNA, 19 nt, Homo sapiens
gaauguauguaucuucuga

SEQ ID NO: 1373094 - RNA, 19 nt, Homo sapiens
aaagaaauccugaccauaa

SEQ ID NO: 1373095 - RNA, 19 nt, Homo sapiens
ugagguagaugcaagagua

SEQ ID NO: 1373096 - RNA, 19 nt, Homo sapiens
ggaaaggaguucauuagag

SEQ ID NO: 1373097 - RNA, 19 nt, Homo sapiens
ccaaacgauuucuuuagua

SEQ ID NO: 1373098 - RNA, 19 nt, Homo sapiens
gaaaguggccgagcugaaa

SEQ ID NO: 1373099 - RNA, 19 nt, Homo sapiens
aaacuggauuguugagaua

SEQ ID NO: 1373100 - RNA, 19 nt, Homo sapiens
cgaccaagaugucaagaga

SEQ ID NO: 1373101 - RNA, 19 nt, Homo sapiens
gcacucaguuuccucuuca

SEQ ID NO: 1373102 - RNA, 19 nt, Homo sapiens
gcaaggagcacucaguuuc

SEQ ID NO: 1373103 - RNA, 19 nt, Homo sapiens
guauagcgguuacuucaug

SEQ ID NO: 1373104 - RNA, 19 nt, Homo sapiens
gaaagcagaaauacaugaa

SEQ ID NO: 1373105 - RNA, 19 nt, Homo sapiens
guacagcccuccacaucug

SEQ ID NO: 1373106 - RNA, 19 nt, Homo sapiens
aaagugcugucucucagua

SEQ ID NO: 1373107 - RNA, 19 nt, Homo sapiens
aaacaccgcggaagcguua

SEQ ID NO: 1373108 - RNA, 19 nt, Homo sapiens
caaguagugugcugccaaa

SEQ ID NO: 1373109 - RNA, 19 nt, Homo sapiens
uaaacuggauuguugagau

SEQ ID NO: 1373110 - RNA, 19 nt, Homo sapiens
cuucaugccucaagauuug

SEQ ID NO: 1373111 - RNA, 19 nt, Homo sapiens
aagaaauccugaccauaaa

SEQ ID NO: 1373112 - RNA, 19 nt, Homo sapiens
ggacaaagagugggacgaa

SEQ ID NO: 1373113 - RNA, 19 nt, Homo sapiens
aagaucagauggacaaaga

SEQ ID NO: 1373114 - RNA, 19 nt, Homo sapiens
gccaaacgauuucuuuagu

SEQ ID NO: 1373115 - RNA, 19 nt, Homo sapiens
gaaagcagcaccgagagaa

SEQ ID NO: 1373116 - RNA, 19 nt, Homo sapiens
uugcuaaacuggauuguug

SEQ ID NO: 1373117 - RNA, 19 nt, Homo sapiens
ggaacuacaggauuuguug

SEQ ID NO: 1373118 - RNA, 19 nt, Homo sapiens
caaacgauuucuuuaguac

SEQ ID NO: 1373119 - RNA, 19 nt, Homo sapiens
ugaggcaggucaacacuau

SEQ ID NO: 1373120 - RNA, 19 nt, Homo sapiens
ucagaugaaugcuuacugu

SEQ ID NO: 1373121 - RNA, 19 nt, Homo sapiens
gauaaaucaggaagaauug

SEQ ID NO: 1373122 - RNA, 19 nt, Homo sapiens
ggaggaaggagauggagaa

SEQ ID NO: 1373123 - RNA, 19 nt, Homo sapiens
gcagggaagcgagugauaa

SEQ ID NO: 1373124 - RNA, 19 nt, Homo sapiens
guagugugcugccaaacga

SEQ ID NO: 1373125 - RNA, 19 nt, Homo sapiens
ggacgcagacgaccaagau

SEQ ID NO: 1373126 - RNA, 19 nt, Homo sapiens
gaaucgccaggaugaaaua

SEQ ID NO: 1373127 - RNA, 19 nt, Homo sapiens
ccggcaaacuuucagauga

SEQ ID NO: 1373128 - RNA, 19 nt, Homo sapiens
guaccuggauugcuaaacu

SEQ ID NO: 1373129 - RNA, 19 nt, Homo sapiens
gggcauuguuauaggguuu

SEQ ID NO: 1373130 - RNA, 19 nt, Homo sapiens
ugagaaagcagaaauacau

SEQ ID NO: 1373131 - RNA, 19 nt, Homo sapiens
uuaaagaaauccugaccau

SEQ ID NO: 1373132 - RNA, 19 nt, Homo sapiens
uaaagaaauccugaccaua

SEQ ID NO: 1373133 - RNA, 19 nt, Homo sapiens
ggaaagcagcaccgagaga

SEQ ID NO: 1373134 - RNA, 19 nt, Homo sapiens
gacccaagguuucuaacag

SEQ ID NO: 1373135 - RNA, 19 nt, Homo sapiens
augagcagauagaguguua

SEQ ID NO: 1373136 - RNA, 19 nt, Homo sapiens
caaagagugggacgaauuc

SEQ ID NO: 1373137 - RNA, 19 nt, Homo sapiens
acaaagagugggacgaauu

SEQ ID NO: 1373138 - RNA, 19 nt, Homo sapiens
gaaagguugaugcuccaaa

SEQ ID NO: 1373139 - RNA, 19 nt, Homo sapiens
uuagagcgacucccaguaa

SEQ ID NO: 1373140 - RNA, 19 nt, Homo sapiens
gggaagcgagugauaaauc

SEQ ID NO: 1373141 - RNA, 19 nt, Homo sapiens
agacucacguccugggaaa

SEQ ID NO: 1373142 - RNA, 19 nt, Homo sapiens
agaccaaccggcaaacuuu

SEQ ID NO: 1373143 - RNA, 19 nt, Homo sapiens
ggaaucgccaggaugaaau

SEQ ID NO: 1373144 - RNA, 19 nt, Homo sapiens
ggugaaaggggcauuguua

SEQ ID NO: 1373145 - RNA, 19 nt, Homo sapiens
ugacgacccugagguagau

SEQ ID NO: 1373146 - RNA, 19 nt, Homo sapiens
ucacgggagguaacaagua

SEQ ID NO: 1373147 - RNA, 19 nt, Homo sapiens
gaacuacaggauuuguugu

SEQ ID NO: 1373148 - RNA, 19 nt, Homo sapiens
gagaaagcagaaauacaug

SEQ ID NO: 1373149 - RNA, 19 nt, Homo sapiens
uuggguaccuggauugcua

SEQ ID NO: 1373150 - RNA, 19 nt, Homo sapiens
gauuuguugucucaggauu

SEQ ID NO: 1373151 - RNA, 19 nt, Homo sapiens
cagggaagcgagugauaaa

SEQ ID NO: 1373152 - RNA, 19 nt, Homo sapiens
gggcaaggagcacucaguu

SEQ ID NO: 1373153 - RNA, 19 nt, Homo sapiens
ugugguauuuggaauguau

SEQ ID NO: 1373154 - RNA, 19 nt, Homo sapiens
agccucugcuguuguauaa

SEQ ID NO: 1373155 - RNA, 19 nt, Homo sapiens
ugaguugugcccuguguaa

SEQ ID NO: 1373156 - RNA, 19 nt, Homo sapiens
ggaggaagaggaggaggaa

SEQ ID NO: 1373157 - RNA, 19 nt, Homo sapiens
agaaagaccaaccggcaaa

SEQ ID NO: 1373158 - RNA, 19 nt, Homo sapiens
uacaggauuuguugucuca

SEQ ID NO: 1373159 - RNA, 19 nt, Homo sapiens
gacaaagagugggacgaau

SEQ ID NO: 1373160 - RNA, 19 nt, Homo sapiens
gaucagauggacaaagagu

SEQ ID NO: 1373161 - RNA, 19 nt, Homo sapiens
caaaagaucagauggacaa

SEQ ID NO: 1373162 - RNA, 19 nt, Homo sapiens
aaucuccauucgcgaagua

SEQ ID NO: 1373163 - RNA, 19 nt, Homo sapiens
gcugaaaggcgcgaaggaa

SEQ ID NO: 1373164 - RNA, 19 nt, Homo sapiens
ggaagaggaggaggaagga

SEQ ID NO: 1373165 - RNA, 19 nt, Homo sapiens
gagcuacagcacuuuggaa

SEQ ID NO: 1373166 - RNA, 19 nt, Homo sapiens
aaagacccaagguuucuaa

SEQ ID NO: 1373167 - RNA, 19 nt, Homo sapiens
gaaaggggcauuguuauag

SEQ ID NO: 1373168 - RNA, 19 nt, Homo sapiens
gcugaguugugcccugugu

SEQ ID NO: 1373169 - RNA, 19 nt, Homo sapiens
caauugagaaagcagaaau

SEQ ID NO: 1373170 - RNA, 19 nt, Homo sapiens
gcugccaaacgauuucuuu

SEQ ID NO: 1373171 - RNA, 19 nt, Homo sapiens
ggcaaggagcacucaguuu

SEQ ID NO: 1373172 - RNA, 19 nt, Homo sapiens
ggaggaggaaggagaugga

SEQ ID NO: 1373173 - RNA, 19 nt, Homo sapiens
uaggaaaggaguucauuag

SEQ ID NO: 1373174 - RNA, 19 nt, Homo sapiens
cauucagggucaauugaga

SEQ ID NO: 1373175 - RNA, 19 nt, Homo sapiens
cacgggagguaacaaguag

SEQ ID NO: 1373176 - RNA, 19 nt, Homo sapiens
gaaggagauggagaaagaa

SEQ ID NO: 1373177 - RNA, 19 nt, Homo sapiens
caagaguacgaaagguuga

SEQ ID NO: 1373178 - RNA, 19 nt, Homo sapiens
agaaagcagaaauacauga

SEQ ID NO: 1373179 - RNA, 19 nt, Homo sapiens
auaggaaaggaguucauua

SEQ ID NO: 1373180 - RNA, 19 nt, Homo sapiens
uggaauguauguaucuucu

SEQ ID NO: 1373181 - RNA, 19 nt, Homo sapiens
aaaaugagccagugagcua

SEQ ID NO: 1373182 - RNA, 19 nt, Homo sapiens
ugaaaggggcauuguuaua

SEQ ID NO: 1373183 - RNA, 19 nt, Homo sapiens
aaugcuuacugugguauuu

SEQ ID NO: 1373184 - RNA, 19 nt, Homo sapiens
cuacagcacuuuggaaaau

SEQ ID NO: 1373185 - RNA, 19 nt, Homo sapiens
aggcaggucaacacuauuu

SEQ ID NO: 1373186 - RNA, 19 nt, Homo sapiens
agauuuggguaccuggauu

SEQ ID NO: 1373187 - RNA, 19 nt, Homo sapiens
ccucugcuguuguauaaaa

SEQ ID NO: 1373188 - RNA, 19 nt, Homo sapiens
cggaaucgccaggaugaaa

SEQ ID NO: 1373189 - RNA, 19 nt, Homo sapiens
gcuacggaaucgccaggau

SEQ ID NO: 1373190 - RNA, 19 nt, Homo sapiens
ggcagggaagcgagugaua

SEQ ID NO: 1373191 - RNA, 19 nt, Homo sapiens
gaacacagcuguacgauua

SEQ ID NO: 1373192 - RNA, 19 nt, Homo sapiens
gagaagagcucaccagaau

SEQ ID NO: 1373193 - RNA, 19 nt, Homo sapiens
cagggaaccuuacgaauua

SEQ ID NO: 1373194 - RNA, 19 nt, Homo sapiens
ggacggagcugacacaaag

SEQ ID NO: 1373195 - RNA, 19 nt, Homo sapiens
gaccaagccuuaauuguga

SEQ ID NO: 1373196 - RNA, 19 nt, Homo sapiens
agaaaggccuggaacauaa

SEQ ID NO: 1373197 - RNA, 19 nt, Homo sapiens
ggaauucucuggaucuuuc

SEQ ID NO: 1373198 - RNA, 19 nt, Homo sapiens
ggagaagccucacaaucaa

SEQ ID NO: 1373199 - RNA, 19 nt, Homo sapiens
gaaccagacuugggaaaga

SEQ ID NO: 1373200 - RNA, 19 nt, Homo sapiens
ggacaaagaauaccguuau

SEQ ID NO: 1373201 - RNA, 19 nt, Homo sapiens
gaaaggagcauaguguuug

SEQ ID NO: 1373202 - RNA, 19 nt, Homo sapiens
gcaaaugcaaccuuucuuu

SEQ ID NO: 1373203 - RNA, 19 nt, Homo sapiens
caagagaggcauucuguuu

SEQ ID NO: 1373204 - RNA, 19 nt, Homo sapiens
ccugaauucuugacauuua

SEQ ID NO: 1373205 - RNA, 19 nt, Homo sapiens
gaaauuauaggccaagaug

SEQ ID NO: 1373206 - RNA, 19 nt, Homo sapiens
gaaaauagaacaagccaua

SEQ ID NO: 1373207 - RNA, 19 nt, Homo sapiens
ugacgaagcucagaauuuc

SEQ ID NO: 1373208 - RNA, 19 nt, Homo sapiens
ggaagaacuccaaaucaaa

SEQ ID NO: 1373209 - RNA, 19 nt, Homo sapiens
ggaaaggagcauaguguuu

SEQ ID NO: 1373210 - RNA, 19 nt, Homo sapiens
gaagagcucaccagaauag

SEQ ID NO: 1373211 - RNA, 19 nt, Homo sapiens
gcacugccuuuacuuugaa

SEQ ID NO: 1373212 - RNA, 19 nt, Homo sapiens
cagaauacgucccugcauu

SEQ ID NO: 1373213 - RNA, 19 nt, Homo sapiens
caagagaaggagagaguua

SEQ ID NO: 1373214 - RNA, 19 nt, Homo sapiens
caaacuaccuuguguucau

SEQ ID NO: 1373215 - RNA, 19 nt, Homo sapiens
ucacaaggguguauaccaa

SEQ ID NO: 1373216 - RNA, 19 nt, Homo sapiens
cagccucaguucuucauua

SEQ ID NO: 1373217 - RNA, 19 nt, Homo sapiens
cuucagaucugcaggcuuu

SEQ ID NO: 1373218 - RNA, 19 nt, Homo sapiens
cagcuuaguucuaugcauu

SEQ ID NO: 1373219 - RNA, 19 nt, Homo sapiens
cuugagagguuucuguaua

SEQ ID NO: 1373220 - RNA, 19 nt, Homo sapiens
gagaagaucaggaaugugu

SEQ ID NO: 1373221 - RNA, 19 nt, Homo sapiens
ggucaucaguguaggagaa

SEQ ID NO: 1373222 - RNA, 19 nt, Homo sapiens
gaagaucaggaauguguuu

SEQ ID NO: 1373223 - RNA, 19 nt, Homo sapiens
ggagaugggacuggauuua

SEQ ID NO: 1373224 - RNA, 19 nt, Homo sapiens
ucaggucucucuugaguga

SEQ ID NO: 1373225 - RNA, 19 nt, Homo sapiens
ggacuagaggaguuaauaa

SEQ ID NO: 1373226 - RNA, 19 nt, Homo sapiens
agagguuucuguauacaua

SEQ ID NO: 1373227 - RNA, 19 nt, Homo sapiens
gcuguacgauuauuuguca

SEQ ID NO: 1373228 - RNA, 19 nt, Homo sapiens
guuauggacugaauguuug

SEQ ID NO: 1373229 - RNA, 19 nt, Homo sapiens
ccagcuaucuuacccaaug

SEQ ID NO: 1373230 - RNA, 19 nt, Homo sapiens
gaacaagccauauacaaac

SEQ ID NO: 1373231 - RNA, 19 nt, Homo sapiens
caaaacacuuccaagaaua

SEQ ID NO: 1373232 - RNA, 19 nt, Homo sapiens
gagcugacacaaagaguuu

SEQ ID NO: 1373233 - RNA, 19 nt, Homo sapiens
ugcaggcgcuucuuugaua

SEQ ID NO: 1373234 - RNA, 19 nt, Homo sapiens
acacagaauucucuacguu

SEQ ID NO: 1373235 - RNA, 19 nt, Homo sapiens
ccgauaaccuucacacuca

SEQ ID NO: 1373236 - RNA, 19 nt, Homo sapiens
ggcugcaugugcuuuauua

SEQ ID NO: 1373237 - RNA, 19 nt, Homo sapiens
agaagugacucuuggagaa

SEQ ID NO: 1373238 - RNA, 19 nt, Homo sapiens
cagauacaacucagcauua

SEQ ID NO: 1373239 - RNA, 19 nt, Homo sapiens
ugcaggcucuccuaacuua

SEQ ID NO: 1373240 - RNA, 19 nt, Homo sapiens
gaaauugcaggcucuccua

SEQ ID NO: 1373241 - RNA, 19 nt, Homo sapiens
ugaaagcaaugaggaagaa

SEQ ID NO: 1373242 - RNA, 19 nt, Homo sapiens
ugaggaacuuuaucaguga

SEQ ID NO: 1373243 - RNA, 19 nt, Homo sapiens
guucacaagucagagauuu

SEQ ID NO: 1373244 - RNA, 19 nt, Homo sapiens
gcucagaauuuccguacug

SEQ ID NO: 1373245 - RNA, 19 nt, Homo sapiens
gacaaagaauaccguuaug

SEQ ID NO: 1373246 - RNA, 19 nt, Homo sapiens
ccagaaagauggugguuuu

SEQ ID NO: 1373247 - RNA, 19 nt, Homo sapiens
ccagaagccuccgcaagaa

SEQ ID NO: 1373248 - RNA, 19 nt, Homo sapiens
caaagaauaccguuaugau

SEQ ID NO: 1373249 - RNA, 19 nt, Homo sapiens
aggaagaacuccaaaucaa

SEQ ID NO: 1373250 - RNA, 19 nt, Homo sapiens
gaauuuccguacugaagau

SEQ ID NO: 1373251 - RNA, 19 nt, Homo sapiens
gacccugacucuuugagaa

SEQ ID NO: 1373252 - RNA, 19 nt, Homo sapiens
ggauccugcugaccuaauu

SEQ ID NO: 1373253 - RNA, 19 nt, Homo sapiens
agauacaacucagcauuaa

SEQ ID NO: 1373254 - RNA, 19 nt, Homo sapiens
ucagggaaccuuacgaauu

SEQ ID NO: 1373255 - RNA, 19 nt, Homo sapiens
cagaauaguucgcaaugca

SEQ ID NO: 1373256 - RNA, 19 nt, Homo sapiens
gaaaggccuggaacauaaa

SEQ ID NO: 1373257 - RNA, 19 nt, Homo sapiens
gcagaccaguguacuccaa

SEQ ID NO: 1373258 - RNA, 19 nt, Homo sapiens
ucuaugcauugcucuauaa

SEQ ID NO: 1373259 - RNA, 19 nt, Homo sapiens
ucacagcccagcaguauga

SEQ ID NO: 1373260 - RNA, 19 nt, Homo sapiens
gaaauggguaggcaugaug

SEQ ID NO: 1373261 - RNA, 19 nt, Homo sapiens
gaggaggagugauucgaau

SEQ ID NO: 1373262 - RNA, 19 nt, Homo sapiens
uaugagcucuugaaagcaa

SEQ ID NO: 1373263 - RNA, 19 nt, Homo sapiens
agaccaauauccaagagaa

SEQ ID NO: 1373264 - RNA, 19 nt, Homo sapiens
agaacaagccauauacaaa

SEQ ID NO: 1373265 - RNA, 19 nt, Homo sapiens
gaacuuccuugccuuucuc

SEQ ID NO: 1373266 - RNA, 19 nt, Homo sapiens
gcugugaguucaacaugga

SEQ ID NO: 1373267 - RNA, 19 nt, Homo sapiens
agaaaacacugacacuuaa

SEQ ID NO: 1373268 - RNA, 19 nt, Homo sapiens
ggccguagcagaagcaauu

SEQ ID NO: 1373269 - RNA, 19 nt, Homo sapiens
acagaauucucuacguuug

SEQ ID NO: 1373270 - RNA, 19 nt, Homo sapiens
auaagcaaaugcaaccuuu

SEQ ID NO: 1373271 - RNA, 19 nt, Homo sapiens
aagaaaggccuggaacaua

SEQ ID NO: 1373272 - RNA, 19 nt, Homo sapiens
gaaugucagcugagucuau

SEQ ID NO: 1373273 - RNA, 19 nt, Homo sapiens
ggagagcucuauggcuaug

SEQ ID NO: 1373274 - RNA, 19 nt, Homo sapiens
gaagaacuccaaaucaaaa

SEQ ID NO: 1373275 - RNA, 19 nt, Homo sapiens
ggacaguguucggcgauuc

SEQ ID NO: 1373276 - RNA, 19 nt, Homo sapiens
gcagcucagugaugcaugu

SEQ ID NO: 1373277 - RNA, 19 nt, Homo sapiens
ggaucuuucuggauuacuu

SEQ ID NO: 1373278 - RNA, 19 nt, Homo sapiens
gacuagaggaguuaauaaa

SEQ ID NO: 1373279 - RNA, 19 nt, Homo sapiens
ggauaguggaggacaagua

SEQ ID NO: 1373280 - RNA, 19 nt, Homo sapiens
ccucaguucuucauuauac

SEQ ID NO: 1373281 - RNA, 19 nt, Homo sapiens
ccaauguucugaucugucu

SEQ ID NO: 1373282 - RNA, 19 nt, Homo sapiens
uccaauagccaaguacuua

SEQ ID NO: 1373283 - RNA, 19 nt, Homo sapiens
cagauccaauagccaagua

SEQ ID NO: 1373284 - RNA, 19 nt, Homo sapiens
cagaagcucccaauucaug

SEQ ID NO: 1373285 - RNA, 19 nt, Homo sapiens
uggcuacacugaaagauuc

SEQ ID NO: 1373286 - RNA, 19 nt, Homo sapiens
uaucugggcuugaaauugc

SEQ ID NO: 1373287 - RNA, 19 nt, Homo sapiens
cagaaaacacugacacuua

SEQ ID NO: 1373288 - RNA, 19 nt, Homo sapiens
aguggaagaugauauuaga

SEQ ID NO: 1373289 - RNA, 19 nt, Homo sapiens
gaagcauggucuguuagga

SEQ ID NO: 1373290 - RNA, 19 nt, Homo sapiens
gcucacagcccagcaguau

SEQ ID NO: 1373291 - RNA, 19 nt, Homo sapiens
gaacagagccagggaaaga

SEQ ID NO: 1373292 - RNA, 19 nt, Homo sapiens
caacccaggucuuggauuu

SEQ ID NO: 1373293 - RNA, 19 nt, Homo sapiens
caagugaccugcccucugu

SEQ ID NO: 1373294 - RNA, 19 nt, Homo sapiens
gaacgugucgcaccuggua

SEQ ID NO: 1373295 - RNA, 19 nt, Homo sapiens
aaagaaagcuguccuugag

SEQ ID NO: 1373296 - RNA, 19 nt, Homo sapiens
ggaauggcaugagggauug

SEQ ID NO: 1373297 - RNA, 19 nt, Homo sapiens
caaagaaagcuguccuuga

SEQ ID NO: 1373298 - RNA, 19 nt, Homo sapiens
caccggagcugaucacugu

SEQ ID NO: 1373299 - RNA, 19 nt, Homo sapiens
cagcgucuguugguacuua

SEQ ID NO: 1373300 - RNA, 19 nt, Homo sapiens
gaagugcggcuacguggaa

SEQ ID NO: 1373301 - RNA, 19 nt, Homo sapiens
ccuggcagcuucuuuguga

SEQ ID NO: 1373302 - RNA, 19 nt, Homo sapiens
ucacagggcucucauuucg

SEQ ID NO: 1373303 - RNA, 19 nt, Homo sapiens
gcucacagggcucucauuu

SEQ ID NO: 1373304 - RNA, 19 nt, Homo sapiens
ucaccaacauccauuguag

SEQ ID NO: 1373305 - RNA, 19 nt, Homo sapiens
gcauauagaccaggaaauc

SEQ ID NO: 1373306 - RNA, 19 nt, Homo sapiens
gcaagcagaggcagcaaug

SEQ ID NO: 1373307 - RNA, 19 nt, Homo sapiens
gagaggacaacuccgcuuu

SEQ ID NO: 1373308 - RNA, 19 nt, Homo sapiens
cgccuucagugcuguauuu

SEQ ID NO: 1373309 - RNA, 19 nt, Homo sapiens
gcuguuacccgaagucaga

SEQ ID NO: 1373310 - RNA, 19 nt, Homo sapiens
agacuauccugauuaaucu

SEQ ID NO: 1373311 - RNA, 19 nt, Homo sapiens
gggaauuuaucaccaacau

SEQ ID NO: 1373312 - RNA, 19 nt, Homo sapiens
cagacuauccugauuaauc

SEQ ID NO: 1373313 - RNA, 19 nt, Homo sapiens
gaggacaacuccgcuuugg

SEQ ID NO: 1373314 - RNA, 19 nt, Homo sapiens
agucagcccuauacccuaa

SEQ ID NO: 1373315 - RNA, 19 nt, Homo sapiens
caacaccagucagcccuau

SEQ ID NO: 1373316 - RNA, 19 nt, Homo sapiens
gcugggaggguaacaaaga

SEQ ID NO: 1373317 - RNA, 19 nt, Homo sapiens
gcaggauggugcccagaag

SEQ ID NO: 1373318 - RNA, 19 nt, Homo sapiens
ccagagacacaacaaccua

SEQ ID NO: 1373319 - RNA, 19 nt, Homo sapiens
gacaucugcugcuuugaca

SEQ ID NO: 1373320 - RNA, 19 nt, Homo sapiens
gagacacaccugcaucuuc

SEQ ID NO: 1373321 - RNA, 19 nt, Homo sapiens
gauccuggcagcuucuuug

SEQ ID NO: 1373322 - RNA, 19 nt, Homo sapiens
uacgacaucugcugcuuug

SEQ ID NO: 1373323 - RNA, 19 nt, Homo sapiens
uagcacagccucacagcaa

SEQ ID NO: 1373324 - RNA, 19 nt, Homo sapiens
ccucagaucucagacuauc

SEQ ID NO: 1373325 - RNA, 19 nt, Homo sapiens
ggaaugcucggccaaguac

SEQ ID NO: 1373326 - RNA, 19 nt, Homo sapiens
gaggcauggucuccaccua

SEQ ID NO: 1373327 - RNA, 19 nt, Homo sapiens
cuucagugcuguauuuagu

SEQ ID NO: 1373328 - RNA, 19 nt, Homo sapiens
ucugugagccucccucuga

SEQ ID NO: 1373329 - RNA, 19 nt, Homo sapiens
gccaggcuccaguccuuua

SEQ ID NO: 1373330 - RNA, 19 nt, Homo sapiens
ucagagacgcccaucauca

SEQ ID NO: 1373331 - RNA, 19 nt, Homo sapiens
ugccucagaucucagacua

SEQ ID NO: 1373332 - RNA, 19 nt, Homo sapiens
agagggagcggaugaagga

SEQ ID NO: 1373333 - RNA, 19 nt, Homo sapiens
cgaggucccagaucaguga

SEQ ID NO: 1373334 - RNA, 19 nt, Homo sapiens
aaccuaccuuccagccuua

SEQ ID NO: 1373335 - RNA, 19 nt, Homo sapiens
gcuuugacagcuuugagua

SEQ ID NO: 1373336 - RNA, 19 nt, Homo sapiens
ggucuggaaguguguguga

SEQ ID NO: 1373337 - RNA, 19 nt, Homo sapiens
ggucguggguggggaauuu

SEQ ID NO: 1373338 - RNA, 19 nt, Homo sapiens
cagcauauagaccaggaaa

SEQ ID NO: 1373339 - RNA, 19 nt, Homo sapiens
guuacccgaagucagauua

SEQ ID NO: 1373340 - RNA, 19 nt, Homo sapiens
acugcaaucugaucuguca

SEQ ID NO: 1373341 - RNA, 19 nt, Homo sapiens
ugacgcccauugagcuguu

SEQ ID NO: 1373342 - RNA, 19 nt, Homo sapiens
agucuaguguuccugcauu

SEQ ID NO: 1373343 - RNA, 19 nt, Homo sapiens
gcccaaggaccacgaucaa

SEQ ID NO: 1373344 - RNA, 19 nt, Homo sapiens
ccgcugcgccaucauguga

SEQ ID NO: 1373345 - RNA, 19 nt, Homo sapiens
uacccgaagucagauuaaa

SEQ ID NO: 1373346 - RNA, 19 nt, Homo sapiens
ccaaggcugcagcauauag

SEQ ID NO: 1373347 - RNA, 19 nt, Homo sapiens
ggagacacaccugcaucuu

SEQ ID NO: 1373348 - RNA, 19 nt, Homo sapiens
uuuauucccuucugcauac

SEQ ID NO: 1373349 - RNA, 19 nt, Homo sapiens
caaggcugcagcauauaga

SEQ ID NO: 1373350 - RNA, 19 nt, Homo sapiens
caaccgcugcgccaucaug

SEQ ID NO: 1373351 - RNA, 19 nt, Homo sapiens
cagagacgcccaucaucau

SEQ ID NO: 1373352 - RNA, 19 nt, Homo sapiens
caccagagggagcggauga

SEQ ID NO: 1373353 - RNA, 19 nt, Homo sapiens
gaccuugggcagucuagug

SEQ ID NO: 1373354 - RNA, 19 nt, Homo sapiens
cauauagaccaggaaauca

SEQ ID NO: 1373355 - RNA, 19 nt, Homo sapiens
aggaauggcaugagggauu

SEQ ID NO: 1373356 - RNA, 19 nt, Homo sapiens
uggaaugcucggccaagua

SEQ ID NO: 1373357 - RNA, 19 nt, Homo sapiens
cuacgacaucugcugcuuu

SEQ ID NO: 1373358 - RNA, 19 nt, Homo sapiens
aagaacagagccagggaaa

SEQ ID NO: 1373359 - RNA, 19 nt, Homo sapiens
guuagguugucccagugaa

SEQ ID NO: 1373360 - RNA, 19 nt, Homo sapiens
gcgggaaauggaacuguga

SEQ ID NO: 1373361 - RNA, 19 nt, Homo sapiens
cuaguguuccugcauucua

SEQ ID NO: 1373362 - RNA, 19 nt, Homo sapiens
gcacauccugcugcucuuc

SEQ ID NO: 1373363 - RNA, 19 nt, Homo sapiens
ccacagggucuggaagugu

SEQ ID NO: 1373364 - RNA, 19 nt, Homo sapiens
gucuuugccuggugucuuc

SEQ ID NO: 1373365 - RNA, 19 nt, Homo sapiens
ccucagagacgcccaucau

SEQ ID NO: 1373366 - RNA, 19 nt, Homo sapiens
gacgcccauugagcuguua

SEQ ID NO: 1373367 - RNA, 19 nt, Homo sapiens
ugauuaaucuggggaagaa

SEQ ID NO: 1373368 - RNA, 19 nt, Homo sapiens
auacugcaaucugaucugu

SEQ ID NO: 1373369 - RNA, 19 nt, Homo sapiens
aggcuccaguccuuuauuc

SEQ ID NO: 1373370 - RNA, 19 nt, Homo sapiens
uaguguuccugcauucuag

SEQ ID NO: 1373371 - RNA, 19 nt, Homo sapiens
ggaauuuaucaccaacauc

SEQ ID NO: 1373372 - RNA, 19 nt, Homo sapiens
agacacaacaaccuaccuu

SEQ ID NO: 1373373 - RNA, 19 nt, Homo sapiens
guggaaugcucggccaagu

SEQ ID NO: 1373374 - RNA, 19 nt, Homo sapiens
gaaagcauguaaaguacua

SEQ ID NO: 1373375 - RNA, 19 nt, Homo sapiens
gcaguuauguggucagaaa

SEQ ID NO: 1373376 - RNA, 19 nt, Homo sapiens
gagaagaaauaguuaccua

SEQ ID NO: 1373377 - RNA, 19 nt, Homo sapiens
ggaauuauauaccacgaaa

SEQ ID NO: 1373378 - RNA, 19 nt, Homo sapiens
gaauggaucuuucuuacug

SEQ ID NO: 1373379 - RNA, 19 nt, Homo sapiens
acaaaugacucucuuauuc

SEQ ID NO: 1373380 - RNA, 19 nt, Homo sapiens
gaaagaagaagauggagaa

SEQ ID NO: 1373381 - RNA, 19 nt, Homo sapiens
gagugaagcaucuuuguua

SEQ ID NO: 1373382 - RNA, 19 nt, Homo sapiens
agaagaagauggagaagaa

SEQ ID NO: 1373383 - RNA, 19 nt, Homo sapiens
gauguaaugugguauccua

SEQ ID NO: 1373384 - RNA, 19 nt, Homo sapiens
gcauuacucuggacuuuau

SEQ ID NO: 1373385 - RNA, 19 nt, Homo sapiens
aaccagauauggcuuguua

SEQ ID NO: 1373386 - RNA, 19 nt, Homo sapiens
ggccacagcuggagcaauu

SEQ ID NO: 1373387 - RNA, 19 nt, Homo sapiens
agauauggcuuguuauuug

SEQ ID NO: 1373388 - RNA, 19 nt, Homo sapiens
gagcaaaguguucauugua

SEQ ID NO: 1373389 - RNA, 19 nt, Homo sapiens
gagcaagacuccaucucaa

SEQ ID NO: 1373390 - RNA, 19 nt, Homo sapiens
gcaaaguguucauuguaga

SEQ ID NO: 1373391 - RNA, 19 nt, Homo sapiens
ggaaaagcuuuguugaaua

SEQ ID NO: 1373392 - RNA, 19 nt, Homo sapiens
ugauaagaauggcacuuua

SEQ ID NO: 1373393 - RNA, 19 nt, Homo sapiens
gcugagcucuucugcuaaa

SEQ ID NO: 1373394 - RNA, 19 nt, Homo sapiens
uaagguaggugcuauugau

SEQ ID NO: 1373395 - RNA, 19 nt, Homo sapiens
gaaccagggcuccuuagaa

SEQ ID NO: 1373396 - RNA, 19 nt, Homo sapiens
cagcaagccugaugguuug

SEQ ID NO: 1373397 - RNA, 19 nt, Homo sapiens
acaaugagguggcuucaau

SEQ ID NO: 1373398 - RNA, 19 nt, Homo sapiens
uuacaagcccaaacuaaua

SEQ ID NO: 1373399 - RNA, 19 nt, Homo sapiens
gagcucuucugcuaaaguu

SEQ ID NO: 1373400 - RNA, 19 nt, Homo sapiens
aaccagggcuccuuagaaa

SEQ ID NO: 1373401 - RNA, 19 nt, Homo sapiens
gauauggcuuguuauuugu

SEQ ID NO: 1373402 - RNA, 19 nt, Homo sapiens
gcaaccucgucuuuacuaa

SEQ ID NO: 1373403 - RNA, 19 nt, Homo sapiens
guucaaaguucacaucagu

SEQ ID NO: 1373404 - RNA, 19 nt, Homo sapiens
gaaaugagcaaaguguuca

SEQ ID NO: 1373405 - RNA, 19 nt, Homo sapiens
gaacaagaaaugagcaaag

SEQ ID NO: 1373406 - RNA, 19 nt, Homo sapiens
gccaggagguuauaaacug

SEQ ID NO: 1373407 - RNA, 19 nt, Homo sapiens
guagcaguauagucauuaa

SEQ ID NO: 1373408 - RNA, 19 nt, Homo sapiens
ugaauacaguguggacuuu

SEQ ID NO: 1373409 - RNA, 19 nt, Homo sapiens
gcugggauaugaacuauac

SEQ ID NO: 1373410 - RNA, 19 nt, Homo sapiens
ccuaugaucauuuguguaa

SEQ ID NO: 1373411 - RNA, 19 nt, Homo sapiens
uuuaaagggucaggcauua

SEQ ID NO: 1373412 - RNA, 19 nt, Homo sapiens
ugagguggcuucaauuagu

SEQ ID NO: 1373413 - RNA, 19 nt, Homo sapiens
gcauguaaaguacuagaaa

SEQ ID NO: 1373414 - RNA, 19 nt, Homo sapiens
gguagaaacuagggaaauc

SEQ ID NO: 1373415 - RNA, 19 nt, Homo sapiens
ggauaugaacuauacaaga

SEQ ID NO: 1373416 - RNA, 19 nt, Homo sapiens
gagcugggauaugaacuau

SEQ ID NO: 1373417 - RNA, 19 nt, Homo sapiens
ggaggacauucccuguuga

SEQ ID NO: 1373418 - RNA, 19 nt, Homo sapiens
acaaauccuugaaagaaga

SEQ ID NO: 1373419 - RNA, 19 nt, Homo sapiens
caaacaaauccuugaaaga

SEQ ID NO: 1373420 - RNA, 19 nt, Homo sapiens
gaauacaguguggacuuua

SEQ ID NO: 1373421 - RNA, 19 nt, Homo sapiens
gaaacuagggaaaucugaa

SEQ ID NO: 1373422 - RNA, 19 nt, Homo sapiens
caagaugagccuagaguau

SEQ ID NO: 1373423 - RNA, 19 nt, Homo sapiens
gacaaaugacucucuuauu

SEQ ID NO: 1373424 - RNA, 19 nt, Homo sapiens
gaacaggagaaucgcuuga

SEQ ID NO: 1373425 - RNA, 19 nt, Homo sapiens
ccagauauggcuuguuauu

SEQ ID NO: 1373426 - RNA, 19 nt, Homo sapiens
ggucaggcauuagaaacaa

SEQ ID NO: 1373427 - RNA, 19 nt, Homo sapiens
acaaacaaauccuugaaag

SEQ ID NO: 1373428 - RNA, 19 nt, Homo sapiens
gggaaaagcuuuguugaau

SEQ ID NO: 1373429 - RNA, 19 nt, Homo sapiens
caagaaaugagcaaagugu

SEQ ID NO: 1373430 - RNA, 19 nt, Homo sapiens
gcaguauagucauuaagca

SEQ ID NO: 1373431 - RNA, 19 nt, Homo sapiens
gaacugaaggaucucugaa

SEQ ID NO: 1373432 - RNA, 19 nt, Homo sapiens
ccugaugguuugucuuauu

SEQ ID NO: 1373433 - RNA, 19 nt, Homo sapiens
uguaagaauugucaucaug

SEQ ID NO: 1373434 - RNA, 19 nt, Homo sapiens
gauggagaagaaauaguua

SEQ ID NO: 1373435 - RNA, 19 nt, Homo sapiens
gaacucagaacccaagucu

SEQ ID NO: 1373436 - RNA, 19 nt, Homo sapiens
gaugguuugucuuauuuca

SEQ ID NO: 1373437 - RNA, 19 nt, Homo sapiens
cgacaaaugacucucuuau

SEQ ID NO: 1373438 - RNA, 19 nt, Homo sapiens
agacaugaguauacauuca

SEQ ID NO: 1373439 - RNA, 19 nt, Homo sapiens
gcacuuauuuaauccucau

SEQ ID NO: 1373440 - RNA, 19 nt, Homo sapiens
gccaggugauugagguuaa

SEQ ID NO: 1373441 - RNA, 19 nt, Homo sapiens
gcaucuuuguuagcaguua

SEQ ID NO: 1373442 - RNA, 19 nt, Homo sapiens
gcaaagccgaagauacuau

SEQ ID NO: 1373443 - RNA, 19 nt, Homo sapiens
uagaaagcauguaaaguac

SEQ ID NO: 1373444 - RNA, 19 nt, Homo sapiens
gucauuaagcaaagcauua

SEQ ID NO: 1373445 - RNA, 19 nt, Homo sapiens
ugacuuccuugcagaguau

SEQ ID NO: 1373446 - RNA, 19 nt, Homo sapiens
ggagcaauuugaguaacaa

SEQ ID NO: 1373447 - RNA, 19 nt, Homo sapiens
cugaugguuugucuuauuu

SEQ ID NO: 1373448 - RNA, 19 nt, Homo sapiens
gaagauggagaagaaauag

SEQ ID NO: 1373449 - RNA, 19 nt, Homo sapiens
guuuagccauaaccagaua

SEQ ID NO: 1373450 - RNA, 19 nt, Homo sapiens
aagcauuacucuggacuuu

SEQ ID NO: 1373451 - RNA, 19 nt, Homo sapiens
uaaaauaccuaaccaguac

SEQ ID NO: 1373452 - RNA, 19 nt, Homo sapiens
uggaggacauucccuguug

SEQ ID NO: 1373453 - RNA, 19 nt, Homo sapiens
uguaggagcucauuguucu

SEQ ID NO: 1373454 - RNA, 19 nt, Homo sapiens
gagguggcuucaauuagug

SEQ ID NO: 1373455 - RNA, 19 nt, Homo sapiens
gcacuggccaggagguuau

SEQ ID NO: 1373456 - RNA, 19 nt, Homo sapiens
ggaaaucugaauacagugu

SEQ ID NO: 1373457 - RNA, 19 nt, Homo sapiens
gaaaaugaacugauucuag

SEQ ID NO: 1373458 - RNA, 19 nt, Homo sapiens
ugaagcaucuuuguuagca

SEQ ID NO: 1373459 - RNA, 19 nt, Homo sapiens
agaagauggagaagaaaua

SEQ ID NO: 1373460 - RNA, 19 nt, Homo sapiens
ggccaaagcaggcggauca

SEQ ID NO: 1373461 - RNA, 19 nt, Homo sapiens
ugagcaaaguguucauugu

SEQ ID NO: 1373462 - RNA, 19 nt, Homo sapiens
uaaagggucaggcauuaga

SEQ ID NO: 1373463 - RNA, 19 nt, Homo sapiens
guguggacuuuaguuaaua

SEQ ID NO: 1373464 - RNA, 19 nt, Homo sapiens
caucacaucauacagaaug

SEQ ID NO: 1373465 - RNA, 19 nt, Homo sapiens
cugcuaaaguucaaaguuc

SEQ ID NO: 1373466 - RNA, 19 nt, Homo sapiens
acagcaagccugaugguuu

SEQ ID NO: 1373467 - RNA, 19 nt, Homo sapiens
caacaugggaggcugaaca

SEQ ID NO: 1373468 - RNA, 19 nt, Homo sapiens
ggugcaaccucgucuuuac

SEQ ID NO: 1373469 - RNA, 19 nt, Homo sapiens
aaugagguggcuucaauua

SEQ ID NO: 1373470 - RNA, 19 nt, Homo sapiens
agggaaaucugaauacagu

SEQ ID NO: 1373471 - RNA, 19 nt, Homo sapiens
gugacuuccuugcagagua

SEQ ID NO: 1373472 - RNA, 19 nt, Homo sapiens
caaaugacucucuuauucu

SEQ ID NO: 1373473 - RNA, 19 nt, Homo sapiens
gaagaagauggagaagaaa

SEQ ID NO: 1373474 - RNA, 19 nt, Homo sapiens
aagaugagcuguugaauuu

SEQ ID NO: 1373475 - RNA, 19 nt, Homo sapiens
gaacagacuuagugaaaga

SEQ ID NO: 1373476 - RNA, 19 nt, Homo sapiens
gcaagaggcuguaccuaaa

SEQ ID NO: 1373477 - RNA, 19 nt, Homo sapiens
gcaaagagaacaaacuaua

SEQ ID NO: 1373478 - RNA, 19 nt, Homo sapiens
gcaauugacuguucagaau

SEQ ID NO: 1373479 - RNA, 19 nt, Homo sapiens
gauaguaguugcagccuuu

SEQ ID NO: 1373480 - RNA, 19 nt, Homo sapiens
gcaaauccuucugaguuua

SEQ ID NO: 1373481 - RNA, 19 nt, Homo sapiens
gaagagauccaaauagaga

SEQ ID NO: 1373482 - RNA, 19 nt, Homo sapiens
gcagaugcauuauuuaagu

SEQ ID NO: 1373483 - RNA, 19 nt, Homo sapiens
aaauagagaugcaggauau

SEQ ID NO: 1373484 - RNA, 19 nt, Homo sapiens
cauaaacacucuucaaaca

SEQ ID NO: 1373485 - RNA, 19 nt, Homo sapiens
gcagaacucuuagugaaug

SEQ ID NO: 1373486 - RNA, 19 nt, Homo sapiens
gggaaccucuguuaaauca

SEQ ID NO: 1373487 - RNA, 19 nt, Homo sapiens
gagggauucucaaggcuua

SEQ ID NO: 1373488 - RNA, 19 nt, Homo sapiens
cggaagagauccaaauaga

SEQ ID NO: 1373489 - RNA, 19 nt, Homo sapiens
gucaagcgcuuauggacua

SEQ ID NO: 1373490 - RNA, 19 nt, Homo sapiens
gaagacggaaauagcuuua

SEQ ID NO: 1373491 - RNA, 19 nt, Homo sapiens
guagggaaccucuguuaaa

SEQ ID NO: 1373492 - RNA, 19 nt, Homo sapiens
uaucagaucagccaguuua

SEQ ID NO: 1373493 - RNA, 19 nt, Homo sapiens
gcucuaaauuugaaacugu

SEQ ID NO: 1373494 - RNA, 19 nt, Homo sapiens
caacgugacuauuccaaca

SEQ ID NO: 1373495 - RNA, 19 nt, Homo sapiens
gaacggaagagauccaaau

SEQ ID NO: 1373496 - RNA, 19 nt, Homo sapiens
gaauuuguguaguucuuug

SEQ ID NO: 1373497 - RNA, 19 nt, Homo sapiens
cagcaaauccuucugaguu

SEQ ID NO: 1373498 - RNA, 19 nt, Homo sapiens
gaagacuacuguauuucau

SEQ ID NO: 1373499 - RNA, 19 nt, Homo sapiens
gauaucagaucagccaguu

SEQ ID NO: 1373500 - RNA, 19 nt, Homo sapiens
aaacacaaguggaagugaa

SEQ ID NO: 1373501 - RNA, 19 nt, Homo sapiens
uaaacacucuucaaacaca

SEQ ID NO: 1373502 - RNA, 19 nt, Homo sapiens
gaauuuagaagacuacugu

SEQ ID NO: 1373503 - RNA, 19 nt, Homo sapiens
ucacuuaucugacguucau

SEQ ID NO: 1373504 - RNA, 19 nt, Homo sapiens
gaugagcuguugaauuuac

SEQ ID NO: 1373505 - RNA, 19 nt, Homo sapiens
gagaugcaggauauauuua

SEQ ID NO: 1373506 - RNA, 19 nt, Homo sapiens
gaaccucuguuaaaucacu

SEQ ID NO: 1373507 - RNA, 19 nt, Homo sapiens
gcuuauggacuacaaagua

SEQ ID NO: 1373508 - RNA, 19 nt, Homo sapiens
cauaaaagguuucagugua

SEQ ID NO: 1373509 - RNA, 19 nt, Homo sapiens
cuacccagcuccuucuaaa

SEQ ID NO: 1373510 - RNA, 19 nt, Homo sapiens
guaaauaucucugcaaccu

SEQ ID NO: 1373511 - RNA, 19 nt, Homo sapiens
gagaagacaaccaaagaug

SEQ ID NO: 1373512 - RNA, 19 nt, Homo sapiens
caaauagagaugcaggaua

SEQ ID NO: 1373513 - RNA, 19 nt, Homo sapiens
gggaaaaucugaguuuaaa

SEQ ID NO: 1373514 - RNA, 19 nt, Homo sapiens
ugaagcaguuccaaccaaa

SEQ ID NO: 1373515 - RNA, 19 nt, Homo sapiens
gcaggaauuuggcauaaaa

SEQ ID NO: 1373516 - RNA, 19 nt, Homo sapiens
ggaagacggaaauagcuuu

SEQ ID NO: 1373517 - RNA, 19 nt, Homo sapiens
uaucugacguucauaaugg

SEQ ID NO: 1373518 - RNA, 19 nt, Homo sapiens
caacagcaguaacuaucug

SEQ ID NO: 1373519 - RNA, 19 nt, Homo sapiens
uggaagcucuaaauuugaa

SEQ ID NO: 1373520 - RNA, 19 nt, Homo sapiens
ccaaagaugagcuguugaa

SEQ ID NO: 1373521 - RNA, 19 nt, Homo sapiens
gaaagugacaaccgaaugg

SEQ ID NO: 1373522 - RNA, 19 nt, Homo sapiens
agacggaaauagcuuuaga

SEQ ID NO: 1373523 - RNA, 19 nt, Homo sapiens
uugcagaacucuuagugaa

SEQ ID NO: 1373524 - RNA, 19 nt, Homo sapiens
uggaauugcagaacucuua

SEQ ID NO: 1373525 - RNA, 19 nt, Homo sapiens
caaauggugguggaaauaa

SEQ ID NO: 1373526 - RNA, 19 nt, Homo sapiens
ccaaauggugguggaaaua

SEQ ID NO: 1373527 - RNA, 19 nt, Homo sapiens
cuucuugacuccuuacuga

SEQ ID NO: 1373528 - RNA, 19 nt, Homo sapiens
uaauggaucaucagaaaga

SEQ ID NO: 1373529 - RNA, 19 nt, Homo sapiens
caaauccuucugaguuuaa

SEQ ID NO: 1373530 - RNA, 19 nt, Homo sapiens
cuccacaaguuauuaauga

SEQ ID NO: 1373531 - RNA, 19 nt, Homo sapiens
uaagucauccgauaucaga

SEQ ID NO: 1373532 - RNA, 19 nt, Homo sapiens
ccacaauaccuaaccaaga

SEQ ID NO: 1373533 - RNA, 19 nt, Homo sapiens
gagccaaaguggugagagu

SEQ ID NO: 1373534 - RNA, 19 nt, Homo sapiens
aaagaugagcuguugaauu

SEQ ID NO: 1373535 - RNA, 19 nt, Homo sapiens
gaagacaaccaaagaugag

SEQ ID NO: 1373536 - RNA, 19 nt, Homo sapiens
guugcagccuuuauagauu

SEQ ID NO: 1373537 - RNA, 19 nt, Homo sapiens
acccagacaucuuuauuga

SEQ ID NO: 1373538 - RNA, 19 nt, Homo sapiens
aaccaaagaugagcuguug

SEQ ID NO: 1373539 - RNA, 19 nt, Homo sapiens
cagagaagacaaccaaaga

SEQ ID NO: 1373540 - RNA, 19 nt, Homo sapiens
gagaagaauuuagaagacu

SEQ ID NO: 1373541 - RNA, 19 nt, Homo sapiens
uagggaaccucuguuaaau

SEQ ID NO: 1373542 - RNA, 19 nt, Homo sapiens
ccgaacagacuuagugaaa

SEQ ID NO: 1373543 - RNA, 19 nt, Homo sapiens
caauugacuguucagaaua

SEQ ID NO: 1373544 - RNA, 19 nt, Homo sapiens
ugugguaucuggaauuugu

SEQ ID NO: 1373545 - RNA, 19 nt, Homo sapiens
gaugaggauucaaaacuuu

SEQ ID NO: 1373546 - RNA, 19 nt, Homo sapiens
agagaugcaggauauauuu

SEQ ID NO: 1373547 - RNA, 19 nt, Homo sapiens
ccagagaauugaucaacgu

SEQ ID NO: 1373548 - RNA, 19 nt, Homo sapiens
cggcagcaauugacuguuc

SEQ ID NO: 1373549 - RNA, 19 nt, Homo sapiens
cuaggucaauucuauaagu

SEQ ID NO: 1373550 - RNA, 19 nt, Homo sapiens
ugacguucauaauggaauu

SEQ ID NO: 1373551 - RNA, 19 nt, Homo sapiens
uggcaggaauuuggcauaa

SEQ ID NO: 1373552 - RNA, 19 nt, Homo sapiens
agcaaauccuucugaguuu

SEQ ID NO: 1373553 - RNA, 19 nt, Homo sapiens
uuaaugaaguguggcaaga

SEQ ID NO: 1373554 - RNA, 19 nt, Homo sapiens
cacaauaccuaaccaagac

SEQ ID NO: 1373555 - RNA, 19 nt, Homo sapiens
gaauugaucaacgugacua

SEQ ID NO: 1373556 - RNA, 19 nt, Homo sapiens
ggaauuuguguaguucuuu

SEQ ID NO: 1373557 - RNA, 19 nt, Homo sapiens
caacuccccucauguaaau

SEQ ID NO: 1373558 - RNA, 19 nt, Homo sapiens
cuuauggacuacaaaguau

SEQ ID NO: 1373559 - RNA, 19 nt, Homo sapiens
cagaagcuuuccugagcaa

SEQ ID NO: 1373560 - RNA, 19 nt, Homo sapiens
cuuuauagauucaccacaa

SEQ ID NO: 1373561 - RNA, 19 nt, Homo sapiens
ggcaggaauuuggcauaaa

SEQ ID NO: 1373562 - RNA, 19 nt, Homo sapiens
agaagacaaccaaagauga

SEQ ID NO: 1373563 - RNA, 19 nt, Homo sapiens
gggaugagagguuuaugug

SEQ ID NO: 1373564 - RNA, 19 nt, Homo sapiens
gcuccucccuugcccacuu

SEQ ID NO: 1373565 - RNA, 19 nt, Homo sapiens
uggcagauauuacaguagu

SEQ ID NO: 1373566 - RNA, 19 nt, Homo sapiens
ggucaacagcaguaacuau

SEQ ID NO: 1373567 - RNA, 19 nt, Homo sapiens
gggcgucuacuacaacuug

SEQ ID NO: 1373568 - RNA, 19 nt, Homo sapiens
guucagaagcuguggaugu

SEQ ID NO: 1373569 - RNA, 19 nt, Homo sapiens
gauaugcuccgcggugcua

SEQ ID NO: 1373570 - RNA, 19 nt, Homo sapiens
uaguagggaaccucuguua

SEQ ID NO: 1373571 - RNA, 19 nt, Homo sapiens
ggaugagagguuuauguga

SEQ ID NO: 1373572 - RNA, 19 nt, Homo sapiens
uacccagacucucaacuug

SEQ ID NO: 1373573 - RNA, 19 nt, Homo sapiens
caucauaaacacucuucaa

SEQ ID NO: 1373574 - RNA, 19 nt, Homo sapiens
gcuaguaccuguauucuua

SEQ ID NO: 1373575 - RNA, 19 nt, Homo sapiens
gacaaucucucaagaauuu

SEQ ID NO: 1373576 - RNA, 19 nt, Homo sapiens
guaaagcagucaacaauaa

SEQ ID NO: 1373577 - RNA, 19 nt, Homo sapiens
ggagaagacuaucaauaua

SEQ ID NO: 1373578 - RNA, 19 nt, Homo sapiens
ggaaggagaugauucacua

SEQ ID NO: 1373579 - RNA, 19 nt, Homo sapiens
gaaauuacauggugguuug

SEQ ID NO: 1373580 - RNA, 19 nt, Homo sapiens
ggagaugauucacuacuua

SEQ ID NO: 1373581 - RNA, 19 nt, Homo sapiens
ccacuaugcugacuucuua

SEQ ID NO: 1373582 - RNA, 19 nt, Homo sapiens
ggaaauugaugcagcacua

SEQ ID NO: 1373583 - RNA, 19 nt, Homo sapiens
gaaauaugguaguagauga

SEQ ID NO: 1373584 - RNA, 19 nt, Homo sapiens
ggagaaauaugguaguaga

SEQ ID NO: 1373585 - RNA, 19 nt, Homo sapiens
ggaagaagguagcaucaug

SEQ ID NO: 1373586 - RNA, 19 nt, Homo sapiens
gaaaauacagcgugaauua

SEQ ID NO: 1373587 - RNA, 19 nt, Homo sapiens
ccagucagauuuacgguua

SEQ ID NO: 1373588 - RNA, 19 nt, Homo sapiens
gcaagaaggagaacaauug

SEQ ID NO: 1373589 - RNA, 19 nt, Homo sapiens
gaacaaagaagaauugaag

SEQ ID NO: 1373590 - RNA, 19 nt, Homo sapiens
ucagauuuaucgccuauua

SEQ ID NO: 1373591 - RNA, 19 nt, Homo sapiens
gaagguagcaucaugaaug

SEQ ID NO: 1373592 - RNA, 19 nt, Homo sapiens
gaacaacgaccaucucuca

SEQ ID NO: 1373593 - RNA, 19 nt, Homo sapiens
gaacaaagggaaauugaug

SEQ ID NO: 1373594 - RNA, 19 nt, Homo sapiens
ggagaacaauugaccuuga

SEQ ID NO: 1373595 - RNA, 19 nt, Homo sapiens
gaagaacaaagaagaauug

SEQ ID NO: 1373596 - RNA, 19 nt, Homo sapiens
ggaagaugauguugauguu

SEQ ID NO: 1373597 - RNA, 19 nt, Homo sapiens
gagcagagaauaugaagaa

SEQ ID NO: 1373598 - RNA, 19 nt, Homo sapiens
gcacagcucaucuaaagaa

SEQ ID NO: 1373599 - RNA, 19 nt, Homo sapiens
gaacccaaaccagaaauua

SEQ ID NO: 1373600 - RNA, 19 nt, Homo sapiens
gcgagaagcugaaaauuuu

SEQ ID NO: 1373601 - RNA, 19 nt, Homo sapiens
gaauugagcaggauauguu

SEQ ID NO: 1373602 - RNA, 19 nt, Homo sapiens
gaacggaggaggaacgaaa

SEQ ID NO: 1373603 - RNA, 19 nt, Homo sapiens
ggaagaaaaugaaaccuuu

SEQ ID NO: 1373604 - RNA, 19 nt, Homo sapiens
gcaaagaagagaagaugaa

SEQ ID NO: 1373605 - RNA, 19 nt, Homo sapiens
gaagaagaacaaagaagaa

SEQ ID NO: 1373606 - RNA, 19 nt, Homo sapiens
gagaacaauugaccuugaa

SEQ ID NO: 1373607 - RNA, 19 nt, Homo sapiens
gaaggagaauagaggaaga

SEQ ID NO: 1373608 - RNA, 19 nt, Homo sapiens
uaaaggaucugcagcuagu

SEQ ID NO: 1373609 - RNA, 19 nt, Homo sapiens
gaaauggaaaggcaaagaa

SEQ ID NO: 1373610 - RNA, 19 nt, Homo sapiens
gaggagaguauauguguaa

SEQ ID NO: 1373611 - RNA, 19 nt, Homo sapiens
gaaacucacugccuuuacu

SEQ ID NO: 1373612 - RNA, 19 nt, Homo sapiens
gaacaacugagacaggaaa

SEQ ID NO: 1373613 - RNA, 19 nt, Homo sapiens
gaagaagccagaaggagaa

SEQ ID NO: 1373614 - RNA, 19 nt, Homo sapiens
gaagaagguagcaucauga

SEQ ID NO: 1373615 - RNA, 19 nt, Homo sapiens
gaagaugauguugauguua

SEQ ID NO: 1373616 - RNA, 19 nt, Homo sapiens
ggagaaacaagaauuugaa

SEQ ID NO: 1373617 - RNA, 19 nt, Homo sapiens
aagcacagcucaucuaaag

SEQ ID NO: 1373618 - RNA, 19 nt, Homo sapiens
ggaggagaguauaugugua

SEQ ID NO: 1373619 - RNA, 19 nt, Homo sapiens
gaagauggaggagaguaua

SEQ ID NO: 1373620 - RNA, 19 nt, Homo sapiens
agaaagaaaggaucaagua

SEQ ID NO: 1373621 - RNA, 19 nt, Homo sapiens
gaagagcgagcaagaagga

SEQ ID NO: 1373622 - RNA, 19 nt, Homo sapiens
gaagaaauggaaaggcaaa

SEQ ID NO: 1373623 - RNA, 19 nt, Homo sapiens
gagaaacucacugccuuua

SEQ ID NO: 1373624 - RNA, 19 nt, Homo sapiens
gaagaagaagaacaaagaa

SEQ ID NO: 1373625 - RNA, 19 nt, Homo sapiens
gaaacaaagacaagaggaa

SEQ ID NO: 1373626 - RNA, 19 nt, Homo sapiens
gaagagaacggaggaggaa

SEQ ID NO: 1373627 - RNA, 19 nt, Homo sapiens
gaagagaaagaaaggauca

SEQ ID NO: 1373628 - RNA, 19 nt, Homo sapiens
gaacagauugaggacauaa

SEQ ID NO: 1373629 - RNA, 19 nt, Homo sapiens
gaacgaaaacgcagaauug

SEQ ID NO: 1373630 - RNA, 19 nt, Homo sapiens
aaugaaaccuuuggauuga

SEQ ID NO: 1373631 - RNA, 19 nt, Homo sapiens
ccagagauguauaagacaa

SEQ ID NO: 1373632 - RNA, 19 nt, Homo sapiens
gcugacuucuuauuccuuu

SEQ ID NO: 1373633 - RNA, 19 nt, Homo sapiens
ugaggaagaugauguugau

SEQ ID NO: 1373634 - RNA, 19 nt, Homo sapiens
cagagaauaugaagaacug

SEQ ID NO: 1373635 - RNA, 19 nt, Homo sapiens
gaacgugaagagaaagaaa

SEQ ID NO: 1373636 - RNA, 19 nt, Homo sapiens
caaagcacagcucaucuaa

SEQ ID NO: 1373637 - RNA, 19 nt, Homo sapiens
ccauagacguuuacagcaa

SEQ ID NO: 1373638 - RNA, 19 nt, Homo sapiens
gaagaagagcgagcaagaa

SEQ ID NO: 1373639 - RNA, 19 nt, Homo sapiens
gaagaagaagccagaagga

SEQ ID NO: 1373640 - RNA, 19 nt, Homo sapiens
cgaggaagauaaaagaaua

SEQ ID NO: 1373641 - RNA, 19 nt, Homo sapiens
ggcaagagaagaagaagaa

SEQ ID NO: 1373642 - RNA, 19 nt, Homo sapiens
gaacaauugaccuugaaau

SEQ ID NO: 1373643 - RNA, 19 nt, Homo sapiens
gaagcaaggagaaauaugg

SEQ ID NO: 1373644 - RNA, 19 nt, Homo sapiens
ugugguaccugucaaauca

SEQ ID NO: 1373645 - RNA, 19 nt, Homo sapiens
ggagaacccaaaccagaaa

SEQ ID NO: 1373646 - RNA, 19 nt, Homo sapiens
ggagcuccaugguucaaga

SEQ ID NO: 1373647 - RNA, 19 nt, Homo sapiens
acaaauggcuaaggcaaga

SEQ ID NO: 1373648 - RNA, 19 nt, Homo sapiens
aaaugaaaccuuuggauug

SEQ ID NO: 1373649 - RNA, 19 nt, Homo sapiens
gcugaagcaaggagaaaua

SEQ ID NO: 1373650 - RNA, 19 nt, Homo sapiens
ucaaguacgaggaagauaa

SEQ ID NO: 1373651 - RNA, 19 nt, Homo sapiens
ggagaaacucacugccuuu

SEQ ID NO: 1373652 - RNA, 19 nt, Homo sapiens
agaagaagaagaacaaaga

SEQ ID NO: 1373653 - RNA, 19 nt, Homo sapiens
gaggaggaacggaagcaua

SEQ ID NO: 1373654 - RNA, 19 nt, Homo sapiens
caaguacgaggaagauaaa

SEQ ID NO: 1373655 - RNA, 19 nt, Homo sapiens
aagaaaggaucaaguacga

SEQ ID NO: 1373656 - RNA, 19 nt, Homo sapiens
uggagaagacuaucaauau

SEQ ID NO: 1373657 - RNA, 19 nt, Homo sapiens
caagaaggagaacaauuga

SEQ ID NO: 1373658 - RNA, 19 nt, Homo sapiens
aagacaaucucucaagaau

SEQ ID NO: 1373659 - RNA, 19 nt, Homo sapiens
caucagauuuaucgccuau

SEQ ID NO: 1373660 - RNA, 19 nt, Homo sapiens
gaaauuaaagagcgagaag

SEQ ID NO: 1373661 - RNA, 19 nt, Homo sapiens
cgggaaaacuggaaauuaa

SEQ ID NO: 1373662 - RNA, 19 nt, Homo sapiens
aaggaaagcagaagaagaa

SEQ ID NO: 1373663 - RNA, 19 nt, Homo sapiens
caaagaagagaagaugaaa

SEQ ID NO: 1373664 - RNA, 19 nt, Homo sapiens
gaaagaaaggaucaaguac

SEQ ID NO: 1373665 - RNA, 19 nt, Homo sapiens
guaccugucaaaucauaua

SEQ ID NO: 1373666 - RNA, 19 nt, Homo sapiens
gaucaggagcuccaugguu

SEQ ID NO: 1373667 - RNA, 19 nt, Homo sapiens
aaaagaacgugaagagaaa

SEQ ID NO: 1373668 - RNA, 19 nt, Homo sapiens
uaucgccuauuaugcagua

SEQ ID NO: 1373669 - RNA, 19 nt, Homo sapiens
ucaaagcacagcucaucua

SEQ ID NO: 1373670 - RNA, 19 nt, Homo sapiens
aauaaaggaucugcagcua

SEQ ID NO: 1373671 - RNA, 19 nt, Homo sapiens
gagaguauauguguaaagc

SEQ ID NO: 1373672 - RNA, 19 nt, Homo sapiens
gauguuaggccugcaagaa

SEQ ID NO: 1373673 - RNA, 19 nt, Homo sapiens
acaagaauuugaacaacug

SEQ ID NO: 1373674 - RNA, 19 nt, Homo sapiens
gaagguggcuuugagauaa

SEQ ID NO: 1373675 - RNA, 19 nt, Homo sapiens
gaauguaggagaugaauug

SEQ ID NO: 1373676 - RNA, 19 nt, Homo sapiens
ggagaugaauugugcaagu

SEQ ID NO: 1373677 - RNA, 19 nt, Homo sapiens
ggaggagcccgagacauua

SEQ ID NO: 1373678 - RNA, 19 nt, Homo sapiens
gaggaggcguugagagguu

SEQ ID NO: 1373679 - RNA, 19 nt, Homo sapiens
gacuuucucucgacucuga

SEQ ID NO: 1373680 - RNA, 19 nt, Homo sapiens
gcaccacagucaagcacaa

SEQ ID NO: 1373681 - RNA, 19 nt, Homo sapiens
ccaugcaccugaccacauu

SEQ ID NO: 1373682 - RNA, 19 nt, Homo sapiens
gagaugaauugugcaagug

SEQ ID NO: 1373683 - RNA, 19 nt, Homo sapiens
gagacacagugcgcuagua

SEQ ID NO: 1373684 - RNA, 19 nt, Homo sapiens
uaguggaacuucaaaggaa

SEQ ID NO: 1373685 - RNA, 19 nt, Homo sapiens
caacacaugggcuuuacaa

SEQ ID NO: 1373686 - RNA, 19 nt, Homo sapiens
ggaagagguuuuaucagaa

SEQ ID NO: 1373687 - RNA, 19 nt, Homo sapiens
gaacuucaaaggaaugagu

SEQ ID NO: 1373688 - RNA, 19 nt, Homo sapiens
ggacaacccaacccagaga

SEQ ID NO: 1373689 - RNA, 19 nt, Homo sapiens
ugaagguggcuuugagaua

SEQ ID NO: 1373690 - RNA, 19 nt, Homo sapiens
cgacagaaaggaagagguu

SEQ ID NO: 1373691 - RNA, 19 nt, Homo sapiens
guugagagguuuccguaca

SEQ ID NO: 1373692 - RNA, 19 nt, Homo sapiens
gaagagguuuuaucagaau

SEQ ID NO: 1373693 - RNA, 19 nt, Homo sapiens
ggaaugagugggauccaau

SEQ ID NO: 1373694 - RNA, 19 nt, Homo sapiens
gggauccaaucaucgaaug

SEQ ID NO: 1373695 - RNA, 19 nt, Homo sapiens
ugagugggauccaaucauc

SEQ ID NO: 1373696 - RNA, 19 nt, Homo sapiens
ugagugggcccaugacuau

SEQ ID NO: 1373697 - RNA, 19 nt, Homo sapiens
uggaggagcccgagacauu

SEQ ID NO: 1373698 - RNA, 19 nt, Homo sapiens
gggcagccgugaaguuucu

SEQ ID NO: 1373699 - RNA, 19 nt, Homo sapiens
aggauaccaucaaguacua

SEQ ID NO: 1373700 - RNA, 19 nt, Homo sapiens
cgaaugggcugagaaaaga

SEQ ID NO: 1373701 - RNA, 19 nt, Homo sapiens
uuacaacacaugggcuuua

SEQ ID NO: 1373702 - RNA, 19 nt, Homo sapiens
agacauuaguggaacuuca

SEQ ID NO: 1373703 - RNA, 19 nt, Homo sapiens
caucgaaugggcugagaaa

SEQ ID NO: 1373704 - RNA, 19 nt, Homo sapiens
ccuggcaucuuacaacaca

SEQ ID NO: 1373705 - RNA, 19 nt, Homo sapiens
gacauuaguggaacuucaa

SEQ ID NO: 1373706 - RNA, 19 nt, Homo sapiens
ggaggaggaguaccagauc

SEQ ID NO: 1373707 - RNA, 19 nt, Homo sapiens
gggugaagguggcuuugag

SEQ ID NO: 1373708 - RNA, 19 nt, Homo sapiens
gcucaaguccauggugcua

SEQ ID NO: 1373709 - RNA, 19 nt, Homo sapiens
gaaaggaagagguuuuauc

SEQ ID NO: 1373710 - RNA, 19 nt, Homo sapiens
aggaagagguuuuaucaga

SEQ ID NO: 1373711 - RNA, 19 nt, Homo sapiens
caccuggcaucuuacaaca

SEQ ID NO: 1373712 - RNA, 19 nt, Homo sapiens
aagguggcuuugagauaaa

SEQ ID NO: 1373713 - RNA, 19 nt, Homo sapiens
gaaugagugggauccaauc

SEQ ID NO: 1373714 - RNA, 19 nt, Homo sapiens
caacccagagaaacaagga

SEQ ID NO: 1373715 - RNA, 19 nt, Homo sapiens
caacacaucauuggacaac

SEQ ID NO: 1373716 - RNA, 19 nt, Homo sapiens
ucucgacucugauuuuauu

SEQ ID NO: 1373717 - RNA, 19 nt, Homo sapiens
agcaggauaccaucaagua

SEQ ID NO: 1373718 - RNA, 19 nt, Homo sapiens
uaucagaaugucagcauca

SEQ ID NO: 1373719 - RNA, 19 nt, Homo sapiens
cagugaauguaggagauga

SEQ ID NO: 1373720 - RNA, 19 nt, Homo sapiens
ucaaguccauggugcuaac

SEQ ID NO: 1373721 - RNA, 19 nt, Homo sapiens
ucccaucgcucuguguuuc

SEQ ID NO: 1373722 - RNA, 19 nt, Homo sapiens
gaggagcccgagacauuag

SEQ ID NO: 1373723 - RNA, 19 nt, Homo sapiens
acaccgacaccaucugcua

SEQ ID NO: 1373724 - RNA, 19 nt, Homo sapiens
gaucccaucgcucuguguu

SEQ ID NO: 1373725 - RNA, 19 nt, Homo sapiens
aguaccagauccagaagug

SEQ ID NO: 1373726 - RNA, 19 nt, Homo sapiens
uaaccuugggccugauuga

SEQ ID NO: 1373727 - RNA, 19 nt, Homo sapiens
gcccgagacauuaguggaa

SEQ ID NO: 1373728 - RNA, 19 nt, Homo sapiens
ggugaagguggcuuugaga

SEQ ID NO: 1373729 - RNA, 19 nt, Homo sapiens
ccagcaggauaccaucaag

SEQ ID NO: 1373730 - RNA, 19 nt, Homo sapiens
gcagugaauguaggagaug

SEQ ID NO: 1373731 - RNA, 19 nt, Homo sapiens
cagcuccuccaccagcaua

SEQ ID NO: 1373732 - RNA, 19 nt, Homo sapiens
gcaggauaccaucaaguac

SEQ ID NO: 1373733 - RNA, 19 nt, Homo sapiens
cgagagcaccacagucaag

SEQ ID NO: 1373734 - RNA, 19 nt, Homo sapiens
ccgggcagccgugaaguuu

SEQ ID NO: 1373735 - RNA, 19 nt, Homo sapiens
cagaaaggaagagguuuua

SEQ ID NO: 1373736 - RNA, 19 nt, Homo sapiens
caagggauugaguuuguag

SEQ ID NO: 1373737 - RNA, 19 nt, Homo sapiens
gacagaaaggaagagguuu

SEQ ID NO: 1373738 - RNA, 19 nt, Homo sapiens
gcaacacaucauuggacaa

SEQ ID NO: 1373739 - RNA, 19 nt, Homo sapiens
ggacgagggcucuuucuua

SEQ ID NO: 1373740 - RNA, 19 nt, Homo sapiens
ccagaaagacuauauauug

SEQ ID NO: 1373741 - RNA, 19 nt, Homo sapiens
gaaaguagaagaaaguguu

SEQ ID NO: 1373742 - RNA, 19 nt, Homo sapiens
caccaccucucacaauuua

SEQ ID NO: 1373743 - RNA, 19 nt, Homo sapiens
gauggcagcuuacaacugu

SEQ ID NO: 1373744 - RNA, 19 nt, Homo sapiens
acaagaagcuaaagaaagu

SEQ ID NO: 1373745 - RNA, 19 nt, Homo sapiens
gacgagggcucuuucuuau

SEQ ID NO: 1373746 - RNA, 19 nt, Homo sapiens
gguagcagcucgaaaguag

SEQ ID NO: 1373747 - RNA, 19 nt, Homo sapiens
gugccaagcuuaccuguga

SEQ ID NO: 1373748 - RNA, 19 nt, Homo sapiens
gcaacgugaugaucuguga

SEQ ID NO: 1373749 - RNA, 19 nt, Homo sapiens
ggacgggccugugcuaaug

SEQ ID NO: 1373750 - RNA, 19 nt, Homo sapiens
ccacagacagugacaauga

SEQ ID NO: 1373751 - RNA, 19 nt, Homo sapiens
gaccaaagcucggaagucu

SEQ ID NO: 1373752 - RNA, 19 nt, Homo sapiens
gaaagugggagacuggauu

SEQ ID NO: 1373753 - RNA, 19 nt, Homo sapiens
caagacagacucauaugaa

SEQ ID NO: 1373754 - RNA, 19 nt, Homo sapiens
gaaaggcaccuccuacaag

SEQ ID NO: 1373755 - RNA, 19 nt, Homo sapiens
gggcagcggucauccucua

SEQ ID NO: 1373756 - RNA, 19 nt, Homo sapiens
ggacggcaguaucucuuug

SEQ ID NO: 1373757 - RNA, 19 nt, Homo sapiens
cuaaugggauccacaugaa

SEQ ID NO: 1373758 - RNA, 19 nt, Homo sapiens
guacaagaagcuaaagaaa

SEQ ID NO: 1373759 - RNA, 19 nt, Homo sapiens
gaccugcccuaucugauug

SEQ ID NO: 1373760 - RNA, 19 nt, Homo sapiens
gcaaagagcagcagaucca

SEQ ID NO: 1373761 - RNA, 19 nt, Homo sapiens
cgagggcucuuucuuauac

SEQ ID NO: 1373762 - RNA, 19 nt, Homo sapiens
cgacauuuauaccgucuga

SEQ ID NO: 1373763 - RNA, 19 nt, Homo sapiens
caagaaggauaugguggaa

SEQ ID NO: 1373764 - RNA, 19 nt, Homo sapiens
gaucacgggccuagagaaa

SEQ ID NO: 1373765 - RNA, 19 nt, Homo sapiens
gacguuggcuucagaccuu

SEQ ID NO: 1373766 - RNA, 19 nt, Homo sapiens
aaguggagauggcagcuua

SEQ ID NO: 1373767 - RNA, 19 nt, Homo sapiens
uggcacaccuccuguauca

SEQ ID NO: 1373768 - RNA, 19 nt, Homo sapiens
cagggaaccuccagauugu

SEQ ID NO: 1373769 - RNA, 19 nt, Homo sapiens
gcacgugauugaaguggau

SEQ ID NO: 1373770 - RNA, 19 nt, Homo sapiens
gaugaucugugagaccaaa

SEQ ID NO: 1373771 - RNA, 19 nt, Homo sapiens
ucacggaugcggucaauga

SEQ ID NO: 1373772 - RNA, 19 nt, Homo sapiens
gcuaaugggauccacauga

SEQ ID NO: 1373773 - RNA, 19 nt, Homo sapiens
gggaaacacagcagucauu

SEQ ID NO: 1373774 - RNA, 19 nt, Homo sapiens
gcagacccaucuuggcaau

SEQ ID NO: 1373775 - RNA, 19 nt, Homo sapiens
gaucauggccagcaaagag

SEQ ID NO: 1373776 - RNA, 19 nt, Homo sapiens
ucagggaaccuccagauug

SEQ ID NO: 1373777 - RNA, 19 nt, Homo sapiens
gcucgaaaguagaagaaag

SEQ ID NO: 1373778 - RNA, 19 nt, Homo sapiens
caaauuccucugacgauug

SEQ ID NO: 1373779 - RNA, 19 nt, Homo sapiens
ggccagagugccaagcuua

SEQ ID NO: 1373780 - RNA, 19 nt, Homo sapiens
gaccaucucuggcauucca

SEQ ID NO: 1373781 - RNA, 19 nt, Homo sapiens
ccaagacagacucauauga

SEQ ID NO: 1373782 - RNA, 19 nt, Homo sapiens
ggaaacacagcagucauug

SEQ ID NO: 1373783 - RNA, 19 nt, Homo sapiens
ucacugcccuuaacaacca

SEQ ID NO: 1373784 - RNA, 19 nt, Homo sapiens
gaaacaccaccucucacaa

SEQ ID NO: 1373785 - RNA, 19 nt, Homo sapiens
ccagcgaccugcccuaucu

SEQ ID NO: 1373786 - RNA, 19 nt, Homo sapiens
aaaggcaccuccuacaagu

SEQ ID NO: 1373787 - RNA, 19 nt, Homo sapiens
gugugacccuggcggcuua

SEQ ID NO: 1373788 - RNA, 19 nt, Homo sapiens
gguacagcgucaaacaaga

SEQ ID NO: 1373789 - RNA, 19 nt, Homo sapiens
acauuaagaugcagugcuu

SEQ ID NO: 1373790 - RNA, 19 nt, Homo sapiens
gagaaaggcaccuccuaca

SEQ ID NO: 1373791 - RNA, 19 nt, Homo sapiens
ggagauggcagcuuacaac

SEQ ID NO: 1373792 - RNA, 19 nt, Homo sapiens
uagccaaucuccaggacuu

SEQ ID NO: 1373793 - RNA, 19 nt, Homo sapiens
acaaauuccucugacgauu

SEQ ID NO: 1373794 - RNA, 19 nt, Homo sapiens
cgaccugcccuaucugauu

SEQ ID NO: 1373795 - RNA, 19 nt, Homo sapiens
agacagccauggucaccuu

SEQ ID NO: 1373796 - RNA, 19 nt, Homo sapiens
gaaccuccaaggaugaaug

SEQ ID NO: 1373797 - RNA, 19 nt, Homo sapiens
aaacaccaccucucacaau

SEQ ID NO: 1373798 - RNA, 19 nt, Homo sapiens
aaugggauccacaugaaua

SEQ ID NO: 1373799 - RNA, 19 nt, Homo sapiens
gagaccuccuacgacauua

SEQ ID NO: 1373800 - RNA, 19 nt, Homo sapiens
gaggguagcagcucgaaag

SEQ ID NO: 1373801 - RNA, 19 nt, Homo sapiens
cgccaauccucuacuaugu

SEQ ID NO: 1373802 - RNA, 19 nt, Homo sapiens
aaggauggguccaguguca

SEQ ID NO: 1373803 - RNA, 19 nt, Homo sapiens
gggaaccuccagauuguga

SEQ ID NO: 1373804 - RNA, 19 nt, Homo sapiens
cugaauggcucggaugaug

SEQ ID NO: 1373805 - RNA, 19 nt, Homo sapiens
gcuucagaccuuugugaua

SEQ ID NO: 1373806 - RNA, 19 nt, Homo sapiens
aagcugauaucccagaaag

SEQ ID NO: 1373807 - RNA, 19 nt, Homo sapiens
ccacccuccugcccguaua

SEQ ID NO: 1373808 - RNA, 19 nt, Homo sapiens
aagaugcagugcuucaaug

SEQ ID NO: 1373809 - RNA, 19 nt, Homo sapiens
ggagaucacgggccuagag

SEQ ID NO: 1373810 - RNA, 19 nt, Homo sapiens
cgucaucacugcccuuaac

SEQ ID NO: 1373811 - RNA, 19 nt, Homo sapiens
ccuccaaggaugaauguaa

SEQ ID NO: 1373812 - RNA, 19 nt, Homo sapiens
cggaggcacugugaucuug

SEQ ID NO: 1373813 - RNA, 19 nt, Homo sapiens
cuucagaccuuugugauac

SEQ ID NO: 1373814 - RNA, 19 nt, Homo sapiens
ucuacuauguggugaaaca

SEQ ID NO: 1373815 - RNA, 19 nt, Homo sapiens
gcgccaauccucuacuaug

SEQ ID NO: 1373816 - RNA, 19 nt, Homo sapiens
ccuccaagacagacucaua

SEQ ID NO: 1373817 - RNA, 19 nt, Homo sapiens
gaagcugauaucccagaaa

SEQ ID NO: 1373818 - RNA, 19 nt, Homo sapiens
ucacgggccuagagaaagg

SEQ ID NO: 1373819 - RNA, 19 nt, Homo sapiens
cccgggagcuuguaugaag

SEQ ID NO: 1373820 - RNA, 19 nt, Homo sapiens
ccucuacuauguggugaaa

SEQ ID NO: 1373821 - RNA, 19 nt, Homo sapiens
cggcaacccugagcagaug

SEQ ID NO: 1373822 - RNA, 19 nt, Homo sapiens
gcaguaucucuuuguguga

SEQ ID NO: 1373823 - RNA, 19 nt, Homo sapiens
gcggucauccucuacaaug

SEQ ID NO: 1373824 - RNA, 19 nt, Homo sapiens
aacaccaccucucacaauu

SEQ ID NO: 1373825 - RNA, 19 nt, Homo sapiens
gcccaaacccgagaucaug

SEQ ID NO: 1373826 - RNA, 19 nt, Homo sapiens
caaaggccagagucucauu

SEQ ID NO: 1373827 - RNA, 19 nt, Homo sapiens
ugauaucccagaaagacua

SEQ ID NO: 1373828 - RNA, 19 nt, Homo sapiens
ugaaacaccaccucucaca

SEQ ID NO: 1373829 - RNA, 19 nt, Homo sapiens
uaagaugcagugcuucaau

SEQ ID NO: 1373830 - RNA, 19 nt, Homo sapiens
agaaaggcaccuccuacaa

SEQ ID NO: 1373831 - RNA, 19 nt, Homo sapiens
agagaccuccuacgacauu

SEQ ID NO: 1373832 - RNA, 19 nt, Homo sapiens
acagugacaaugauaguga

SEQ ID NO: 1373833 - RNA, 19 nt, Homo sapiens
ccaccaucaugcucaagug

SEQ ID NO: 1373834 - RNA, 19 nt, Homo sapiens
uagcagcucgaaaguagaa

SEQ ID NO: 1373835 - RNA, 19 nt, Homo sapiens
cagcggucauccucuacaa

SEQ ID NO: 1373836 - RNA, 19 nt, Homo sapiens
uaaccuggcgccugaaugg

SEQ ID NO: 1373837 - RNA, 19 nt, Homo sapiens
ccagaggcccaaaccauca

SEQ ID NO: 1373838 - RNA, 19 nt, Homo sapiens
gaaccuccagauugugaau

SEQ ID NO: 1373839 - RNA, 19 nt, Homo sapiens
gcagauagcucuuggaaau

SEQ ID NO: 1373840 - RNA, 19 nt, Homo sapiens
gaucugggcugcuuacuuc

SEQ ID NO: 1373841 - RNA, 19 nt, Homo sapiens
gaucucagguggaacaguu

SEQ ID NO: 1373842 - RNA, 19 nt, Homo sapiens
caacaauccucccaucuca

SEQ ID NO: 1373843 - RNA, 19 nt, Homo sapiens
ggaagcacgugguugagaa

SEQ ID NO: 1373844 - RNA, 19 nt, Homo sapiens
uaggauugcuggauuguuu

SEQ ID NO: 1373845 - RNA, 19 nt, Homo sapiens
gaaugugccugcugaaucu

SEQ ID NO: 1373846 - RNA, 19 nt, Homo sapiens
ggcagcagcuccaucguuu

SEQ ID NO: 1373847 - RNA, 19 nt, Homo sapiens
gggaggagcucugaacuuc

SEQ ID NO: 1373848 - RNA, 19 nt, Homo sapiens
gagguaggauugcuggauu

SEQ ID NO: 1373849 - RNA, 19 nt, Homo sapiens
gcuccucccuggucaauau

SEQ ID NO: 1373850 - RNA, 19 nt, Homo sapiens
gcaccugccuccugagugu

SEQ ID NO: 1373851 - RNA, 19 nt, Homo sapiens
cuagacaguucucugcuaa

SEQ ID NO: 1373852 - RNA, 19 nt, Homo sapiens
acaaauggccucagaccua

SEQ ID NO: 1373853 - RNA, 19 nt, Homo sapiens
uaaggaagcacgugguuga

SEQ ID NO: 1373854 - RNA, 19 nt, Homo sapiens
ugagcuacgucuucacaaa

SEQ ID NO: 1373855 - RNA, 19 nt, Homo sapiens
acaguucucugcuaaggaa

SEQ ID NO: 1373856 - RNA, 19 nt, Homo sapiens
ggaaugugccugcugaauc

SEQ ID NO: 1373857 - RNA, 19 nt, Homo sapiens
gggauugacuucuaaagac

SEQ ID NO: 1373858 - RNA, 19 nt, Homo sapiens
ggauguggccauagaauuc

SEQ ID NO: 1373859 - RNA, 19 nt, Homo sapiens
ccgcuaaucuagacaguuc

SEQ ID NO: 1373860 - RNA, 19 nt, Homo sapiens
ucaaacuaaugccugauga

SEQ ID NO: 1373861 - RNA, 19 nt, Homo sapiens
gcucuuaaguugggcauca

SEQ ID NO: 1373862 - RNA, 19 nt, Homo sapiens
gaggagcucugaacuucuc

SEQ ID NO: 1373863 - RNA, 19 nt, Homo sapiens
acgugaugcuggagaauua

SEQ ID NO: 1373864 - RNA, 19 nt, Homo sapiens
ucagggauguggccauaga

SEQ ID NO: 1373865 - RNA, 19 nt, Homo sapiens
gcggggagcucuuaaguug

SEQ ID NO: 1373866 - RNA, 19 nt, Homo sapiens
gaucugggauacuguucug

SEQ ID NO: 1373867 - RNA, 19 nt, Homo sapiens
caaaagaucugggauacug

SEQ ID NO: 1373868 - RNA, 19 nt, Homo sapiens
gaacaguuuaauccugaaa

SEQ ID NO: 1373869 - RNA, 19 nt, Homo sapiens
guuuauccgugcaucauga

SEQ ID NO: 1373870 - RNA, 19 nt, Homo sapiens
ggaagaggaaagcaaagga

SEQ ID NO: 1373871 - RNA, 19 nt, Homo sapiens
ggaacaguuuaauccugaa

SEQ ID NO: 1373872 - RNA, 19 nt, Homo sapiens
ggauugacuucuaaagacu

SEQ ID NO: 1373873 - RNA, 19 nt, Homo sapiens
gggaaccgcuaaucuagac

SEQ ID NO: 1373874 - RNA, 19 nt, Homo sapiens
gagcuacgucuucacaaau

SEQ ID NO: 1373875 - RNA, 19 nt, Homo sapiens
ugacgugccuuggcugaug

SEQ ID NO: 1373876 - RNA, 19 nt, Homo sapiens
caaagucaagcugcacuaa

SEQ ID NO: 1373877 - RNA, 19 nt, Homo sapiens
gagcaggaaaggacaagga

SEQ ID NO: 1373878 - RNA, 19 nt, Homo sapiens
cagggucuauugacauuca

SEQ ID NO: 1373879 - RNA, 19 nt, Homo sapiens
ucuagacaguucucugcua

SEQ ID NO: 1373880 - RNA, 19 nt, Homo sapiens
gaggaaagcaaaggaguca

SEQ ID NO: 1373881 - RNA, 19 nt, Homo sapiens
gcacgugguugagaagcau

SEQ ID NO: 1373882 - RNA, 19 nt, Homo sapiens
aagucaagcugcacuaauc

SEQ ID NO: 1373883 - RNA, 19 nt, Homo sapiens
gggauguggccauagaauu

SEQ ID NO: 1373884 - RNA, 19 nt, Homo sapiens
gaugaucucagguggaaca

SEQ ID NO: 1373885 - RNA, 19 nt, Homo sapiens
cuucacaaauggccucaga

SEQ ID NO: 1373886 - RNA, 19 nt, Homo sapiens
agacgcauacucagaggua

SEQ ID NO: 1373887 - RNA, 19 nt, Homo sapiens
gggacgugaugcuggagaa

SEQ ID NO: 1373888 - RNA, 19 nt, Homo sapiens
gugcagauagcucuuggaa

SEQ ID NO: 1373889 - RNA, 19 nt, Homo sapiens
gcgaauaacacugcagcaa

SEQ ID NO: 1373890 - RNA, 19 nt, Homo sapiens
ggaccaugcuccggagucu

SEQ ID NO: 1373891 - RNA, 19 nt, Homo sapiens
gagaagcaucagaaucguu

SEQ ID NO: 1373892 - RNA, 19 nt, Homo sapiens
aaacugccuuccacuaaac

SEQ ID NO: 1373893 - RNA, 19 nt, Homo sapiens
gaggaagaaaccuggaaga

SEQ ID NO: 1373894 - RNA, 19 nt, Homo sapiens
cagauagcucuuggaaaua

SEQ ID NO: 1373895 - RNA, 19 nt, Homo sapiens
gguugcaugcucuuuauga

SEQ ID NO: 1373896 - RNA, 19 nt, Homo sapiens
gcagcuccaucguuugcau

SEQ ID NO: 1373897 - RNA, 19 nt, Homo sapiens
gggcagcagcuccaucguu

SEQ ID NO: 1373898 - RNA, 19 nt, Homo sapiens
guccuucccugaugugauc

SEQ ID NO: 1373899 - RNA, 19 nt, Homo sapiens
agauagcucuuggaaauac

SEQ ID NO: 1373900 - RNA, 19 nt, Homo sapiens
gcuaaggaagcacgugguu

SEQ ID NO: 1373901 - RNA, 19 nt, Homo sapiens
gggcugcuuacuucccuua

SEQ ID NO: 1373902 - RNA, 19 nt, Homo sapiens
agaggaagaggaaagcaaa

SEQ ID NO: 1373903 - RNA, 19 nt, Homo sapiens
ccccauggguggccuguua

SEQ ID NO: 1373904 - RNA, 19 nt, Homo sapiens
ggaucugggcugcuuacuu

SEQ ID NO: 1373905 - RNA, 19 nt, Homo sapiens
gcuggauuguuuggucauu

SEQ ID NO: 1373906 - RNA, 19 nt, Homo sapiens
auucagggauguggccaua

SEQ ID NO: 1373907 - RNA, 19 nt, Homo sapiens
ugccuuggcugaugcgaau

SEQ ID NO: 1373908 - RNA, 19 nt, Homo sapiens
aaaacugccuuccacuaaa

SEQ ID NO: 1373909 - RNA, 19 nt, Homo sapiens
uggguugcaugcucuuuau

SEQ ID NO: 1373910 - RNA, 19 nt, Homo sapiens
ccaaagucaagcugcacua

SEQ ID NO: 1373911 - RNA, 19 nt, Homo sapiens
gcucuuggaaauacccauu

SEQ ID NO: 1373912 - RNA, 19 nt, Homo sapiens
cucagggucuauugacauu

SEQ ID NO: 1373913 - RNA, 19 nt, Homo sapiens
gugaugcuggagaauuaua

SEQ ID NO: 1373914 - RNA, 19 nt, Homo sapiens
aaacuaaugccugaugauc

SEQ ID NO: 1373915 - RNA, 19 nt, Homo sapiens
gacaaaagaucugggauac

SEQ ID NO: 1373916 - RNA, 19 nt, Homo sapiens
gacgugaugcuggagaauu

SEQ ID NO: 1373917 - RNA, 19 nt, Homo sapiens
agacaguucucugcuaagg

SEQ ID NO: 1373918 - RNA, 19 nt, Homo sapiens
cgggauugacuucuaaaga

SEQ ID NO: 1373919 - RNA, 19 nt, Homo sapiens
acuaaugccugaugaucuc

SEQ ID NO: 1373920 - RNA, 19 nt, Homo sapiens
caacccuacugugaacugu

SEQ ID NO: 1373921 - RNA, 19 nt, Homo sapiens
augcaauggugccaacuug

SEQ ID NO: 1373922 - RNA, 19 nt, Homo sapiens
cacgcuggcuccugugugu

SEQ ID NO: 1373923 - RNA, 19 nt, Homo sapiens
gcagugcagauagcucuug

SEQ ID NO: 1373924 - RNA, 19 nt, Homo sapiens
aagcguggcagugcagaua

SEQ ID NO: 1373925 - RNA, 19 nt, Homo sapiens
cuugguaugugaggaagaa

SEQ ID NO: 1373926 - RNA, 19 nt, Homo sapiens
ucaggugggcagagcuuaa

SEQ ID NO: 1373927 - RNA, 19 nt, Homo sapiens
auacucagagguaggauug

SEQ ID NO: 1373928 - RNA, 19 nt, Homo sapiens
caagcugcacuaaucuaga

SEQ ID NO: 1373929 - RNA, 19 nt, Homo sapiens
ccaacaauccucccaucuc

SEQ ID NO: 1373930 - RNA, 19 nt, Homo sapiens
guccagcacauucauagga

SEQ ID NO: 1373931 - RNA, 19 nt, Homo sapiens
caaacuaaugccugaugau

SEQ ID NO: 1373932 - RNA, 19 nt, Homo sapiens
aaagaucugggauacuguu

SEQ ID NO: 1373933 - RNA, 19 nt, Homo sapiens
acugggaaccgcuaaucua

SEQ ID NO: 1373934 - RNA, 19 nt, Homo sapiens
ucucagguggaacaguuua

SEQ ID NO: 1373935 - RNA, 19 nt, Homo sapiens
gaagcugacacugaguuca

SEQ ID NO: 1373936 - RNA, 19 nt, Homo sapiens
gaagcacgugguugagaag

SEQ ID NO: 1373937 - RNA, 19 nt, Homo sapiens
gggaaugugccugcugaau

SEQ ID NO: 1373938 - RNA, 19 nt, Homo sapiens
cuggauuguuuggucauuu

SEQ ID NO: 1373939 - RNA, 19 nt, Homo sapiens
gaacggagacagauaauaa

SEQ ID NO: 1373940 - RNA, 19 nt, Homo sapiens
gagcugagauugcgccauu

SEQ ID NO: 1373941 - RNA, 19 nt, Homo sapiens
ccaaagugcugggauuaua

SEQ ID NO: 1373942 - RNA, 19 nt, Homo sapiens
gaaacccugucucuacuaa

SEQ ID NO: 1373943 - RNA, 19 nt, Homo sapiens
ggucaggaguuugagauua

SEQ ID NO: 1373944 - RNA, 19 nt, Homo sapiens
uaaauuggcuggucaugau

SEQ ID NO: 1373945 - RNA, 19 nt, Homo sapiens
gcucauguauguaauccua

SEQ ID NO: 1373946 - RNA, 19 nt, Homo sapiens
caagagagcacgcauccua

SEQ ID NO: 1373947 - RNA, 19 nt, Homo sapiens
ggagacagauaauaaagag

SEQ ID NO: 1373948 - RNA, 19 nt, Homo sapiens
gagcuggccucaacucuca

SEQ ID NO: 1373949 - RNA, 19 nt, Homo sapiens
gcacgcauccuaaugagaa

SEQ ID NO: 1373950 - RNA, 19 nt, Homo sapiens
guaaaccaacuaucaauga

SEQ ID NO: 1373951 - RNA, 19 nt, Homo sapiens
cauaaacggugaaaugaca

SEQ ID NO: 1373952 - RNA, 19 nt, Homo sapiens
gaaacaaguaaaccaacua

SEQ ID NO: 1373953 - RNA, 19 nt, Homo sapiens
gggugaagcugcucuguca

SEQ ID NO: 1373954 - RNA, 19 nt, Homo sapiens
aaggauagcaugcuucaua

SEQ ID NO: 1373955 - RNA, 19 nt, Homo sapiens
gagauuagccuggccaaga

SEQ ID NO: 1373956 - RNA, 19 nt, Homo sapiens
ggaaacaaguaaaccaacu

SEQ ID NO: 1373957 - RNA, 19 nt, Homo sapiens
cgaguccucugguuauuug

SEQ ID NO: 1373958 - RNA, 19 nt, Homo sapiens
cagaagacugugugaauaa

SEQ ID NO: 1373959 - RNA, 19 nt, Homo sapiens
ccaacaaucuucuguagac

SEQ ID NO: 1373960 - RNA, 19 nt, Homo sapiens
gagacagacucaugcagau

SEQ ID NO: 1373961 - RNA, 19 nt, Homo sapiens
ggauggaccugaauaaaau

SEQ ID NO: 1373962 - RNA, 19 nt, Homo sapiens
gcaggaggauugcuucaac

SEQ ID NO: 1373963 - RNA, 19 nt, Homo sapiens
gagcgaaacuccgucucaa

SEQ ID NO: 1373964 - RNA, 19 nt, Homo sapiens
uaaagagggaaacaaguaa

SEQ ID NO: 1373965 - RNA, 19 nt, Homo sapiens
cgugguggcucauguaugu

SEQ ID NO: 1373966 - RNA, 19 nt, Homo sapiens
caaguaaaccaacuaucaa

SEQ ID NO: 1373967 - RNA, 19 nt, Homo sapiens
acaaguaaaccaacuauca

SEQ ID NO: 1373968 - RNA, 19 nt, Homo sapiens
auaaagagggaaacaagua

SEQ ID NO: 1373969 - RNA, 19 nt, Homo sapiens
gcaaaggccauaguuguca

SEQ ID NO: 1373970 - RNA, 19 nt, Homo sapiens
ugagaacggagacagauaa

SEQ ID NO: 1373971 - RNA, 19 nt, Homo sapiens
ggaaaugcacuggaggauu

SEQ ID NO: 1373972 - RNA, 19 nt, Homo sapiens
ccaauaagaauuugacaag

SEQ ID NO: 1373973 - RNA, 19 nt, Homo sapiens
gaaaccccaucucuacuaa

SEQ ID NO: 1373974 - RNA, 19 nt, Homo sapiens
gucaggagauggcuucugu

SEQ ID NO: 1373975 - RNA, 19 nt, Homo sapiens
ucucauagccaauaagaau

SEQ ID NO: 1373976 - RNA, 19 nt, Homo sapiens
aggauagcaugcuucauaa

SEQ ID NO: 1373977 - RNA, 19 nt, Homo sapiens
caccacacccagcuaauuu

SEQ ID NO: 1373978 - RNA, 19 nt, Homo sapiens
ggauuugggccugagguua

SEQ ID NO: 1373979 - RNA, 19 nt, Homo sapiens
caaaggccauaguugucaa

SEQ ID NO: 1373980 - RNA, 19 nt, Homo sapiens
ggugaaacccugucucuac

SEQ ID NO: 1373981 - RNA, 19 nt, Homo sapiens
gucaggaguuugagauuag

SEQ ID NO: 1373982 - RNA, 19 nt, Homo sapiens
gacagacucaugcagauug

SEQ ID NO: 1373983 - RNA, 19 nt, Homo sapiens
ggccaaggcaggaggauug

SEQ ID NO: 1373984 - RNA, 19 nt, Homo sapiens
gcagcucucauagccaaua

SEQ ID NO: 1373985 - RNA, 19 nt, Homo sapiens
gaggucaagccuacaguga

SEQ ID NO: 1373986 - RNA, 19 nt, Homo sapiens
gagcacgcauccuaaugag

SEQ ID NO: 1373987 - RNA, 19 nt, Homo sapiens
uaauaaagagggaaacaag

SEQ ID NO: 1373988 - RNA, 19 nt, Homo sapiens
ccucaacucucagugugaa

SEQ ID NO: 1373989 - RNA, 19 nt, Homo sapiens
cagcucucauagccaauaa

SEQ ID NO: 1373990 - RNA, 19 nt, Homo sapiens
gauagcaugcuucauaaac

SEQ ID NO: 1373991 - RNA, 19 nt, Homo sapiens
ggauagcaugcuucauaaa

SEQ ID NO: 1373992 - RNA, 19 nt, Homo sapiens
gugacgagcuggccucaac

SEQ ID NO: 1373993 - RNA, 19 nt, Homo sapiens
gcucucauagccaauaaga

SEQ ID NO: 1373994 - RNA, 19 nt, Homo sapiens
cugaagaggugccgcaucu

SEQ ID NO: 1373995 - RNA, 19 nt, Homo sapiens
gcaccaauccaaaccugau

SEQ ID NO: 1373996 - RNA, 19 nt, Homo sapiens
gugaaacccugucucuacu

SEQ ID NO: 1373997 - RNA, 19 nt, Homo sapiens
caacaaucuucuguagaca

SEQ ID NO: 1373998 - RNA, 19 nt, Homo sapiens
gaagaucugccgccucacu

SEQ ID NO: 1373999 - RNA, 19 nt, Homo sapiens
gauaauaaagagggaaaca

SEQ ID NO: 1374000 - RNA, 19 nt, Homo sapiens
gagagcacgcauccuaaug

SEQ ID NO: 1374001 - RNA, 19 nt, Homo sapiens
acccacaucugguugaguu

SEQ ID NO: 1374002 - RNA, 19 nt, Homo sapiens
ggcugcagaugauucaguu

SEQ ID NO: 1374003 - RNA, 19 nt, Homo sapiens
caaagugcugggauuauag

SEQ ID NO: 1374004 - RNA, 19 nt, Homo sapiens
gcuggacgccuacagugaa

SEQ ID NO: 1374005 - RNA, 19 nt, Homo sapiens
ccacacccagccucuauau

SEQ ID NO: 1374006 - RNA, 19 nt, Homo sapiens
ggucaggaguacgagauca

SEQ ID NO: 1374007 - RNA, 19 nt, Homo sapiens
ugauuaggagcgucagaua

SEQ ID NO: 1374008 - RNA, 19 nt, Homo sapiens
ccaccacacccagcuaauu

SEQ ID NO: 1374009 - RNA, 19 nt, Homo sapiens
agauuagccuggccaagau

SEQ ID NO: 1374010 - RNA, 19 nt, Homo sapiens
gaucagccuccuuccuaga

SEQ ID NO: 1374011 - RNA, 19 nt, Homo sapiens
guuggcagcgcuucgagua

SEQ ID NO: 1374012 - RNA, 19 nt, Homo sapiens
gggugcugcugcuguguga

SEQ ID NO: 1374013 - RNA, 19 nt, Homo sapiens
cagagguuguggcugaaga

SEQ ID NO: 1374014 - RNA, 19 nt, Homo sapiens
ggccucagccucccaaagu

SEQ ID NO: 1374015 - RNA, 19 nt, Homo sapiens
acagacucaugcagauuga

SEQ ID NO: 1374016 - RNA, 19 nt, Homo sapiens
gggauggaccugaauaaaa

SEQ ID NO: 1374017 - RNA, 19 nt, Homo sapiens
acagguguccgacugcuuu

SEQ ID NO: 1374018 - RNA, 19 nt, Homo sapiens
ggacccaacaaucuucugu

SEQ ID NO: 1374019 - RNA, 19 nt, Homo sapiens
gaagcugcucugucaagga

SEQ ID NO: 1374020 - RNA, 19 nt, Homo sapiens
agagcacgcauccuaauga

SEQ ID NO: 1374021 - RNA, 19 nt, Homo sapiens
gcaccaguaacaccagaga

SEQ ID NO: 1374022 - RNA, 19 nt, Homo sapiens
aaagagggaaacaaguaaa

SEQ ID NO: 1374023 - RNA, 19 nt, Homo sapiens
gacccaacaaucuucugua

SEQ ID NO: 1374024 - RNA, 19 nt, Homo sapiens
gagaguggccugucuuucc

SEQ ID NO: 1374025 - RNA, 19 nt, Homo sapiens
gcgaaacuccgucucaaaa

SEQ ID NO: 1374026 - RNA, 19 nt, Homo sapiens
gagaacggagacagauaau

SEQ ID NO: 1374027 - RNA, 19 nt, Homo sapiens
gaucacgaggucaggaguu

SEQ ID NO: 1374028 - RNA, 19 nt, Homo sapiens
gaccuugaccgaccuuuac

SEQ ID NO: 1374029 - RNA, 19 nt, Homo sapiens
cagagaguggccugucuuu

SEQ ID NO: 1374030 - RNA, 19 nt, Homo sapiens
ggugcagccuggacaacau

SEQ ID NO: 1374031 - RNA, 19 nt, Homo sapiens
gauuaggagcgucagauag

SEQ ID NO: 1374032 - RNA, 19 nt, Homo sapiens
agaccuugaccgaccuuua

SEQ ID NO: 1374033 - RNA, 19 nt, Homo sapiens
ggacuuuguggcugaagau

SEQ ID NO: 1374034 - RNA, 19 nt, Homo sapiens
cagauaauaaagagggaaa

SEQ ID NO: 1374035 - RNA, 19 nt, Homo sapiens
ggugaaaugacaugcaaag

SEQ ID NO: 1374036 - RNA, 19 nt, Homo sapiens
cugcuugggaucaaauuaa

SEQ ID NO: 1374037 - RNA, 19 nt, Homo sapiens
uauuugggauggaccugaa

SEQ ID NO: 1374038 - RNA, 19 nt, Homo sapiens
cauagccaauaagaauuug

SEQ ID NO: 1374039 - RNA, 19 nt, Homo sapiens
ccacggagcugcuucuuaa

SEQ ID NO: 1374040 - RNA, 19 nt, Homo sapiens
ggagauggcuucugugcuu

SEQ ID NO: 1374041 - RNA, 19 nt, Homo sapiens
gaaacccugucucuacuaa

SEQ ID NO: 1374042 - RNA, 19 nt, Homo sapiens
ggucaggaguuugagauua

SEQ ID NO: 1374043 - RNA, 19 nt, Homo sapiens
gcucauguauguaauccua

SEQ ID NO: 1374044 - RNA, 19 nt, Homo sapiens
gagcuggacuugaguuuca

SEQ ID NO: 1374045 - RNA, 19 nt, Homo sapiens
gauuaucucuucuacauca

SEQ ID NO: 1374046 - RNA, 19 nt, Homo sapiens
cagaaacuguggcuggaua

SEQ ID NO: 1374047 - RNA, 19 nt, Homo sapiens
gagcuggccucaacucuca

SEQ ID NO: 1374048 - RNA, 19 nt, Homo sapiens
agaaggacaucaacuguga

SEQ ID NO: 1374049 - RNA, 19 nt, Homo sapiens
ggaagucucucuugucacu

SEQ ID NO: 1374050 - RNA, 19 nt, Homo sapiens
caacauugccuccaagaug

SEQ ID NO: 1374051 - RNA, 19 nt, Homo sapiens
gggugaagcugcucuguca

SEQ ID NO: 1374052 - RNA, 19 nt, Homo sapiens
ggaauucuuugcagcuaug

SEQ ID NO: 1374053 - RNA, 19 nt, Homo sapiens
cuacaaguauuuccacaau

SEQ ID NO: 1374054 - RNA, 19 nt, Homo sapiens
gagauuagccuggccaaga

SEQ ID NO: 1374055 - RNA, 19 nt, Homo sapiens
gagccucucuucaccaugu

SEQ ID NO: 1374056 - RNA, 19 nt, Homo sapiens
cgaguccucugguuauuug

SEQ ID NO: 1374057 - RNA, 19 nt, Homo sapiens
ggacaacgagccucucuuc

SEQ ID NO: 1374058 - RNA, 19 nt, Homo sapiens
gagacagacucaugcagau

SEQ ID NO: 1374059 - RNA, 19 nt, Homo sapiens
ggauggaccugaauaaaau

SEQ ID NO: 1374060 - RNA, 19 nt, Homo sapiens
cgugguggcucauguaugu

SEQ ID NO: 1374061 - RNA, 19 nt, Homo sapiens
cgggccaagucuucaauua

SEQ ID NO: 1374062 - RNA, 19 nt, Homo sapiens
caaggcagauuugauuauc

SEQ ID NO: 1374063 - RNA, 19 nt, Homo sapiens
ggaaaugcacuggaggauu

SEQ ID NO: 1374064 - RNA, 19 nt, Homo sapiens
ccaauaagaauuugacaag

SEQ ID NO: 1374065 - RNA, 19 nt, Homo sapiens
uugcagcuauguacuauau

SEQ ID NO: 1374066 - RNA, 19 nt, Homo sapiens
gucaggagauggcuucugu

SEQ ID NO: 1374067 - RNA, 19 nt, Homo sapiens
ucucauagccaauaagaau

SEQ ID NO: 1374068 - RNA, 19 nt, Homo sapiens
ggagccaccuggagaagag

SEQ ID NO: 1374069 - RNA, 19 nt, Homo sapiens
ggauuugggccugagguua

SEQ ID NO: 1374070 - RNA, 19 nt, Homo sapiens
gcaggagaaucgcuugaac

SEQ ID NO: 1374071 - RNA, 19 nt, Homo sapiens
ggugaaacccugucucuac

SEQ ID NO: 1374072 - RNA, 19 nt, Homo sapiens
gagagguacuacagcuuca

SEQ ID NO: 1374073 - RNA, 19 nt, Homo sapiens
acaugaacaucuuccagaa

SEQ ID NO: 1374074 - RNA, 19 nt, Homo sapiens
ucaauuacgugagggacaa

SEQ ID NO: 1374075 - RNA, 19 nt, Homo sapiens
gaaaagauccccaggaaac

SEQ ID NO: 1374076 - RNA, 19 nt, Homo sapiens
gucaggaguuugagauuag

SEQ ID NO: 1374077 - RNA, 19 nt, Homo sapiens
gacagacucaugcagauug

SEQ ID NO: 1374078 - RNA, 19 nt, Homo sapiens
acaaguauuuccacaaugc

SEQ ID NO: 1374079 - RNA, 19 nt, Homo sapiens
cagaaaggaaggaauacuu

SEQ ID NO: 1374080 - RNA, 19 nt, Homo sapiens
gcagcucucauagccaaua

SEQ ID NO: 1374081 - RNA, 19 nt, Homo sapiens
gaucguggucagcaacauu

SEQ ID NO: 1374082 - RNA, 19 nt, Homo sapiens
caggaauucuuugcagcua

SEQ ID NO: 1374083 - RNA, 19 nt, Homo sapiens
gcucuuccaaggcagauuu

SEQ ID NO: 1374084 - RNA, 19 nt, Homo sapiens
ccucaacucucagugugaa

SEQ ID NO: 1374085 - RNA, 19 nt, Homo sapiens
cagcucucauagccaauaa

SEQ ID NO: 1374086 - RNA, 19 nt, Homo sapiens
ggacgugaccaggcuguug

SEQ ID NO: 1374087 - RNA, 19 nt, Homo sapiens
gcagcuauguacuauaucc

SEQ ID NO: 1374088 - RNA, 19 nt, Homo sapiens
cuggaagucucucuuguca

SEQ ID NO: 1374089 - RNA, 19 nt, Homo sapiens
gugacgagcuggccucaac

SEQ ID NO: 1374090 - RNA, 19 nt, Homo sapiens
gcucucauagccaauaaga

SEQ ID NO: 1374091 - RNA, 19 nt, Homo sapiens
cugaagaggugccgcaucu

SEQ ID NO: 1374092 - RNA, 19 nt, Homo sapiens
gcaccaauccaaaccugau

SEQ ID NO: 1374093 - RNA, 19 nt, Homo sapiens
gcaguggauccaaagcaaa

SEQ ID NO: 1374094 - RNA, 19 nt, Homo sapiens
ggccaagucuucaauuacg

SEQ ID NO: 1374095 - RNA, 19 nt, Homo sapiens
aggcagaaaggaaggaaua

SEQ ID NO: 1374096 - RNA, 19 nt, Homo sapiens
ccaaggcagauuugauuau

SEQ ID NO: 1374097 - RNA, 19 nt, Homo sapiens
gugaaacccugucucuacu

SEQ ID NO: 1374098 - RNA, 19 nt, Homo sapiens
gaagaucugccgccucacu

SEQ ID NO: 1374099 - RNA, 19 nt, Homo sapiens
ugugaaugaugcaauggaa

SEQ ID NO: 1374100 - RNA, 19 nt, Homo sapiens
acccacaucugguugaguu

SEQ ID NO: 1374101 - RNA, 19 nt, Homo sapiens
ggcugcagaugauucaguu

SEQ ID NO: 1374102 - RNA, 19 nt, Homo sapiens
gcuggacgccuacagugaa

SEQ ID NO: 1374103 - RNA, 19 nt, Homo sapiens
aagaaaagauccccaggaa

SEQ ID NO: 1374104 - RNA, 19 nt, Homo sapiens
ccagaaggacaucaacugu

SEQ ID NO: 1374105 - RNA, 19 nt, Homo sapiens
gcaccuguagucccagcua

SEQ ID NO: 1374106 - RNA, 19 nt, Homo sapiens
agauuagccuggccaagau

SEQ ID NO: 1374107 - RNA, 19 nt, Homo sapiens
gaucagccuccuuccuaga

SEQ ID NO: 1374108 - RNA, 19 nt, Homo sapiens
guuggcagcgcuucgagua

SEQ ID NO: 1374109 - RNA, 19 nt, Homo sapiens
gggugcugcugcuguguga

SEQ ID NO: 1374110 - RNA, 19 nt, Homo sapiens
caccagccgcuuccuguuu

SEQ ID NO: 1374111 - RNA, 19 nt, Homo sapiens
gaagaaguucaaguuauac

SEQ ID NO: 1374112 - RNA, 19 nt, Homo sapiens
acagacucaugcagauuga

SEQ ID NO: 1374113 - RNA, 19 nt, Homo sapiens
gggauggaccugaauaaaa

SEQ ID NO: 1374114 - RNA, 19 nt, Homo sapiens
acagguguccgacugcuuu

SEQ ID NO: 1374115 - RNA, 19 nt, Homo sapiens
gaagcugcucugucaagga

SEQ ID NO: 1374116 - RNA, 19 nt, Homo sapiens
ccaggcuguugaccgagua

SEQ ID NO: 1374117 - RNA, 19 nt, Homo sapiens
gacgugaccaggcuguuga

SEQ ID NO: 1374118 - RNA, 19 nt, Homo sapiens
aaaccuacagggacuaugu

SEQ ID NO: 1374119 - RNA, 19 nt, Homo sapiens
gaucacgaggucaggaguu

SEQ ID NO: 1374120 - RNA, 19 nt, Homo sapiens
cagcaccuuugagcggaua

SEQ ID NO: 1374121 - RNA, 19 nt, Homo sapiens
gaccuugaccgaccuuuac

SEQ ID NO: 1374122 - RNA, 19 nt, Homo sapiens
gauccaggaggaggaguuu

SEQ ID NO: 1374123 - RNA, 19 nt, Homo sapiens
gcucauggaagaccgcaau

SEQ ID NO: 1374124 - RNA, 19 nt, Homo sapiens
gacuauguccgcaggaaau

SEQ ID NO: 1374125 - RNA, 19 nt, Homo sapiens
gaggaccuggugagggaua

SEQ ID NO: 1374126 - RNA, 19 nt, Homo sapiens
ggaaaccuacagggacuau

SEQ ID NO: 1374127 - RNA, 19 nt, Homo sapiens
ccaccuacuuggaagaacu

SEQ ID NO: 1374128 - RNA, 19 nt, Homo sapiens
agaccuugaccgaccuuua

SEQ ID NO: 1374129 - RNA, 19 nt, Homo sapiens
ggacuuuguggcugaagau

SEQ ID NO: 1374130 - RNA, 19 nt, Homo sapiens
gcccacggcuuuggagaag

SEQ ID NO: 1374131 - RNA, 19 nt, Homo sapiens
cugcuugggaucaaauuaa

SEQ ID NO: 1374132 - RNA, 19 nt, Homo sapiens
uauuugggauggaccugaa

SEQ ID NO: 1374133 - RNA, 19 nt, Homo sapiens
gcccgcugccugugaauga

SEQ ID NO: 1374134 - RNA, 19 nt, Homo sapiens
cauagccaauaagaauuug

SEQ ID NO: 1374135 - RNA, 19 nt, Homo sapiens
gccaauaagaauuugacaa

SEQ ID NO: 1374136 - RNA, 19 nt, Homo sapiens
cagcuuaauucggaagaag

SEQ ID NO: 1374137 - RNA, 19 nt, Homo sapiens
gaugagcucaagccuucuu

SEQ ID NO: 1374138 - RNA, 19 nt, Homo sapiens
uauguaauccuagcacuuc

SEQ ID NO: 1374139 - RNA, 19 nt, Homo sapiens
gagauuggcuccagaauuu

SEQ ID NO: 1374140 - RNA, 19 nt, Homo sapiens
cgagaucacuggcuauaug

SEQ ID NO: 1374141 - RNA, 19 nt, Homo sapiens
ccaauuccuugcacucuaa

SEQ ID NO: 1374142 - RNA, 19 nt, Homo sapiens
guacuuccccuuuaaauua

SEQ ID NO: 1374143 - RNA, 19 nt, Homo sapiens
ggaggaaggugugcagugu

SEQ ID NO: 1374144 - RNA, 19 nt, Homo sapiens
caacuauucucugugguau

SEQ ID NO: 1374145 - RNA, 19 nt, Homo sapiens
ggaggucaguaauuuccaa

SEQ ID NO: 1374146 - RNA, 19 nt, Homo sapiens
ggucaguaauuuccaaugg

SEQ ID NO: 1374147 - RNA, 19 nt, Homo sapiens
gcaguguacuuccccuuua

SEQ ID NO: 1374148 - RNA, 19 nt, Homo sapiens
ccaguucgaugagaaguau

SEQ ID NO: 1374149 - RNA, 19 nt, Homo sapiens
caaaggugcugagcucaca

SEQ ID NO: 1374150 - RNA, 19 nt, Homo sapiens
uaagacggauucucacucu

SEQ ID NO: 1374151 - RNA, 19 nt, Homo sapiens
gcacccagccuguuucucu

SEQ ID NO: 1374152 - RNA, 19 nt, Homo sapiens
uagaggccaucuuaaagga

SEQ ID NO: 1374153 - RNA, 19 nt, Homo sapiens
caaccucuuuguucuucuu

SEQ ID NO: 1374154 - RNA, 19 nt, Homo sapiens
acuauucucugugguauga

SEQ ID NO: 1374155 - RNA, 19 nt, Homo sapiens
ccaacuauucucuguggua

SEQ ID NO: 1374156 - RNA, 19 nt, Homo sapiens
gaacacccacugccuagag

SEQ ID NO: 1374157 - RNA, 19 nt, Homo sapiens
gaaggugugcaguguacuu

SEQ ID NO: 1374158 - RNA, 19 nt, Homo sapiens
gcacucugcccaccugguu

SEQ ID NO: 1374159 - RNA, 19 nt, Homo sapiens
caucccaacuauucucugu

SEQ ID NO: 1374160 - RNA, 19 nt, Homo sapiens
gcuguuuccuuccuguguu

SEQ ID NO: 1374161 - RNA, 19 nt, Homo sapiens
gaggaaggugugcagugua

SEQ ID NO: 1374162 - RNA, 19 nt, Homo sapiens
uggguugccugucggcuuu

SEQ ID NO: 1374163 - RNA, 19 nt, Homo sapiens
guucuuggaugcaucuucu

SEQ ID NO: 1374164 - RNA, 19 nt, Homo sapiens
ccugucggcuuucuuaucu

SEQ ID NO: 1374165 - RNA, 19 nt, Homo sapiens
guggauuccucugcuaaga

SEQ ID NO: 1374166 - RNA, 19 nt, Homo sapiens
cccaauuccuugcacucua

SEQ ID NO: 1374167 - RNA, 19 nt, Homo sapiens
uauauuuggaggucaguaa

SEQ ID NO: 1374168 - RNA, 19 nt, Homo sapiens
caagcaccuucuccugugu

SEQ ID NO: 1374169 - RNA, 19 nt, Homo sapiens
uuucuuuccuucccaauuc

SEQ ID NO: 1374170 - RNA, 19 nt, Homo sapiens
ucaaccuacuggcguaugu

SEQ ID NO: 1374171 - RNA, 19 nt, Homo sapiens
caccaccuauguccaguuc

SEQ ID NO: 1374172 - RNA, 19 nt, Homo sapiens
agagauuggcuccagaauu

SEQ ID NO: 1374173 - RNA, 19 nt, Homo sapiens
ccaccacgacgucaucuuc

SEQ ID NO: 1374174 - RNA, 19 nt, Homo sapiens
auuuggaggucaguaauuu

SEQ ID NO: 1374175 - RNA, 19 nt, Homo sapiens
ggcgagaucacuggcuaua

SEQ ID NO: 1374176 - RNA, 19 nt, Homo sapiens
ccagagauuggcuccagaa

SEQ ID NO: 1374177 - RNA, 19 nt, Homo sapiens
ugccugaggugcucuuaca

SEQ ID NO: 1374178 - RNA, 19 nt, Homo sapiens
uuccuucccuuuccucuug

SEQ ID NO: 1374179 - RNA, 19 nt, Homo sapiens
caucuucuuccuucccuuu

SEQ ID NO: 1374180 - RNA, 19 nt, Homo sapiens
gcaucgcguguguggcuua

SEQ ID NO: 1374181 - RNA, 19 nt, Homo sapiens
gggcaacugguccauguuc

SEQ ID NO: 1374182 - RNA, 19 nt, Homo sapiens
uauucucugugguaugaaa

SEQ ID NO: 1374183 - RNA, 19 nt, Homo sapiens
ggauugggcccucuuucuc

SEQ ID NO: 1374184 - RNA, 19 nt, Homo sapiens
ccgcagccaugccuacuac

SEQ ID NO: 1374185 - RNA, 19 nt, Homo sapiens
ggcaacugguccauguuca

SEQ ID NO: 1374186 - RNA, 19 nt, Homo sapiens
uuucuuaucugccuguuuu

SEQ ID NO: 1374187 - RNA, 19 nt, Homo sapiens
gugcaguggugcgaucuca

SEQ ID NO: 1374188 - RNA, 19 nt, Homo sapiens
ucuccaaccucuuuguucu

SEQ ID NO: 1374189 - RNA, 19 nt, Homo sapiens
ccuagaggccaucuuaaag

SEQ ID NO: 1374190 - RNA, 19 nt, Homo sapiens
ggagcccugagacuucuuu

SEQ ID NO: 1374191 - RNA, 19 nt, Homo sapiens
guaacccgcaccaccauca

SEQ ID NO: 1374192 - RNA, 19 nt, Homo sapiens
ucuaccaguucgaugagaa

SEQ ID NO: 1374193 - RNA, 19 nt, Homo sapiens
gggauugggcccucuuucu

SEQ ID NO: 1374194 - RNA, 19 nt, Homo sapiens
gcacucuaaccaguucuug

SEQ ID NO: 1374195 - RNA, 19 nt, Homo sapiens
uugccaggcuuacagaaca

SEQ ID NO: 1374196 - RNA, 19 nt, Homo sapiens
caaccaccacgacgucauc

SEQ ID NO: 1374197 - RNA, 19 nt, Homo sapiens
agacggauucucacucugu

SEQ ID NO: 1374198 - RNA, 19 nt, Homo sapiens
gagaucacuggcuauaugg

SEQ ID NO: 1374199 - RNA, 19 nt, Homo sapiens
ccuuucaucccaacuauuc

SEQ ID NO: 1374200 - RNA, 19 nt, Homo sapiens
gcugggaggacagguguga

SEQ ID NO: 1374201 - RNA, 19 nt, Homo sapiens
gaucuuucuccguggauuc

SEQ ID NO: 1374202 - RNA, 19 nt, Homo sapiens
cuuuauggaguacuucuuu

SEQ ID NO: 1374203 - RNA, 19 nt, Homo sapiens
aggaaggugugcaguguac

SEQ ID NO: 1374204 - RNA, 19 nt, Homo sapiens
gcugugccuuagucagugu

SEQ ID NO: 1374205 - RNA, 19 nt, Homo sapiens
cacccagccuguuucucuu

SEQ ID NO: 1374206 - RNA, 19 nt, Homo sapiens
ugacggccaucaaccuacu

SEQ ID NO: 1374207 - RNA, 19 nt, Homo sapiens
ccaccuauguccaguuccu

SEQ ID NO: 1374208 - RNA, 19 nt, Homo sapiens
caaggaagaugacuaguua

SEQ ID NO: 1374209 - RNA, 19 nt, Homo sapiens
gaaaggcuguuauuaccua

SEQ ID NO: 1374210 - RNA, 19 nt, Homo sapiens
gaacagaguuggccugcau

SEQ ID NO: 1374211 - RNA, 19 nt, Homo sapiens
gggaguggcucgaaucaga

SEQ ID NO: 1374212 - RNA, 19 nt, Homo sapiens
gcuaaccacuucacaccua

SEQ ID NO: 1374213 - RNA, 19 nt, Homo sapiens
ugaagacacuugaauuuag

SEQ ID NO: 1374214 - RNA, 19 nt, Homo sapiens
gaguauaccugauucucuu

SEQ ID NO: 1374215 - RNA, 19 nt, Homo sapiens
gguagagugaucugaauua

SEQ ID NO: 1374216 - RNA, 19 nt, Homo sapiens
caucagggcuaaccacuuc

SEQ ID NO: 1374217 - RNA, 19 nt, Homo sapiens
ggaguucauuguccuguug

SEQ ID NO: 1374218 - RNA, 19 nt, Homo sapiens
gcaaagaguaguuuacauc

SEQ ID NO: 1374219 - RNA, 19 nt, Homo sapiens
agagugaucugaauuaucu

SEQ ID NO: 1374220 - RNA, 19 nt, Homo sapiens
gaagacacuugaauuuagg

SEQ ID NO: 1374221 - RNA, 19 nt, Homo sapiens
gcagggaggugaggacuuc

SEQ ID NO: 1374222 - RNA, 19 nt, Homo sapiens
caagauaucccugcuguug

SEQ ID NO: 1374223 - RNA, 19 nt, Homo sapiens
gcagagaagauaagaacuu

SEQ ID NO: 1374224 - RNA, 19 nt, Homo sapiens
gggcaugacugcacguuca

SEQ ID NO: 1374225 - RNA, 19 nt, Homo sapiens
ggacaaggaagaugacuag

SEQ ID NO: 1374226 - RNA, 19 nt, Homo sapiens
ucacagacaucccugaaag

SEQ ID NO: 1374227 - RNA, 19 nt, Homo sapiens
gcaacagccugcccagauc

SEQ ID NO: 1374228 - RNA, 19 nt, Homo sapiens
guacacugcugccacuguu

SEQ ID NO: 1374229 - RNA, 19 nt, Homo sapiens
gaccugagauaaagcaaca

SEQ ID NO: 1374230 - RNA, 19 nt, Homo sapiens
cagagaagauaagaacuug

SEQ ID NO: 1374231 - RNA, 19 nt, Homo sapiens
guagagugaucugaauuau

SEQ ID NO: 1374232 - RNA, 19 nt, Homo sapiens
gauccaagaccugagauaa

SEQ ID NO: 1374233 - RNA, 19 nt, Homo sapiens
gagaagauaagaacuugga

SEQ ID NO: 1374234 - RNA, 19 nt, Homo sapiens
guuauuaccuagaguuuac

SEQ ID NO: 1374235 - RNA, 19 nt, Homo sapiens
guugggcugugaaugauaa

SEQ ID NO: 1374236 - RNA, 19 nt, Homo sapiens
ggagggacaaggaagauga

SEQ ID NO: 1374237 - RNA, 19 nt, Homo sapiens
gaggcucugucucucuuaa

SEQ ID NO: 1374238 - RNA, 19 nt, Homo sapiens
gguucaaacuguuggagaa

SEQ ID NO: 1374239 - RNA, 19 nt, Homo sapiens
gaguuaauguugcaaagag

SEQ ID NO: 1374240 - RNA, 19 nt, Homo sapiens
gcuuuaguccuuuguaauu

SEQ ID NO: 1374241 - RNA, 19 nt, Homo sapiens
gaacuuggagcccauuucu

SEQ ID NO: 1374242 - RNA, 19 nt, Homo sapiens
gcugauggcagagaagaua

SEQ ID NO: 1374243 - RNA, 19 nt, Homo sapiens
gggaaaggcuguuauuacc

SEQ ID NO: 1374244 - RNA, 19 nt, Homo sapiens
ccacagaaaccucaguguu

SEQ ID NO: 1374245 - RNA, 19 nt, Homo sapiens
uugggcaccuuguuaauuu

SEQ ID NO: 1374246 - RNA, 19 nt, Homo sapiens
aaacuugucaucuggcuuu

SEQ ID NO: 1374247 - RNA, 19 nt, Homo sapiens
ugacaagcaugccagaagu

SEQ ID NO: 1374248 - RNA, 19 nt, Homo sapiens
gaauuuaggaccgauguau

SEQ ID NO: 1374249 - RNA, 19 nt, Homo sapiens
uggacuggcuagaaucuuu

SEQ ID NO: 1374250 - RNA, 19 nt, Homo sapiens
cguaguacauuaucuuuac

SEQ ID NO: 1374251 - RNA, 19 nt, Homo sapiens
cgucuggucucugcuauga

SEQ ID NO: 1374252 - RNA, 19 nt, Homo sapiens
cugaagacacuugaauuua

SEQ ID NO: 1374253 - RNA, 19 nt, Homo sapiens
acgcagcccuguacuguau

SEQ ID NO: 1374254 - RNA, 19 nt, Homo sapiens
gggaggcucugucucucuu

SEQ ID NO: 1374255 - RNA, 19 nt, Homo sapiens
caacauggaguucauuguc

SEQ ID NO: 1374256 - RNA, 19 nt, Homo sapiens
ucugaagacacuugaauuu

SEQ ID NO: 1374257 - RNA, 19 nt, Homo sapiens
cagggagggugaugaagga

SEQ ID NO: 1374258 - RNA, 19 nt, Homo sapiens
cauagaguauaccugauuc

SEQ ID NO: 1374259 - RNA, 19 nt, Homo sapiens
gaggaaaacuugucaucug

SEQ ID NO: 1374260 - RNA, 19 nt, Homo sapiens
gccauucucucccuaaggu

SEQ ID NO: 1374261 - RNA, 19 nt, Homo sapiens
gcugaggcuuggaaacguu

SEQ ID NO: 1374262 - RNA, 19 nt, Homo sapiens
uuuacuaugugcuaggaua

SEQ ID NO: 1374263 - RNA, 19 nt, Homo sapiens
uuuccaggcugaagugauu

SEQ ID NO: 1374264 - RNA, 19 nt, Homo sapiens
ucagagccgugcccaagau

SEQ ID NO: 1374265 - RNA, 19 nt, Homo sapiens
ucucuggacuguugcaugu

SEQ ID NO: 1374266 - RNA, 19 nt, Homo sapiens
ggaggagggacaaggaaga

SEQ ID NO: 1374267 - RNA, 19 nt, Homo sapiens
gugucaaaguuguuaaaug

SEQ ID NO: 1374268 - RNA, 19 nt, Homo sapiens
guuuacaucuucacuuucu

SEQ ID NO: 1374269 - RNA, 19 nt, Homo sapiens
gcucccaccuucucuggau

SEQ ID NO: 1374270 - RNA, 19 nt, Homo sapiens
gggaagcccaucucaguuc

SEQ ID NO: 1374271 - RNA, 19 nt, Homo sapiens
auacuugaaugagcuugua

SEQ ID NO: 1374272 - RNA, 19 nt, Homo sapiens
acaaggaagaugacuaguu

SEQ ID NO: 1374273 - RNA, 19 nt, Homo sapiens
gacaucagcaggucugugu

SEQ ID NO: 1374274 - RNA, 19 nt, Homo sapiens
cauguuaggaguuaauguu

SEQ ID NO: 1374275 - RNA, 19 nt, Homo sapiens
ucugcucacucuccaauug

SEQ ID NO: 1374276 - RNA, 19 nt, Homo sapiens
cuuaaaagguggagaaaga

SEQ ID NO: 1374277 - RNA, 19 nt, Homo sapiens
cuugaaugagcuuguauua

SEQ ID NO: 1374278 - RNA, 19 nt, Homo sapiens
gaaucuuucucuggacugu

SEQ ID NO: 1374279 - RNA, 19 nt, Homo sapiens
ggaguuaauguugcaaaga

SEQ ID NO: 1374280 - RNA, 19 nt, Homo sapiens
gcuggagucugcuguuguc

SEQ ID NO: 1374281 - RNA, 19 nt, Homo sapiens
ggaugugccugggcuugga

SEQ ID NO: 1374282 - RNA, 19 nt, Homo sapiens
cugcuuuaguccuuuguaa

SEQ ID NO: 1374283 - RNA, 19 nt, Homo sapiens
caucuggcuuugcggagaa

SEQ ID NO: 1374284 - RNA, 19 nt, Homo sapiens
uccaagaccugagauaaag

SEQ ID NO: 1374285 - RNA, 19 nt, Homo sapiens
gcuguugcaucguuugaag

SEQ ID NO: 1374286 - RNA, 19 nt, Homo sapiens
caagggaugaggaggaguu

SEQ ID NO: 1374287 - RNA, 19 nt, Homo sapiens
caaagaguaguuuacaucu

SEQ ID NO: 1374288 - RNA, 19 nt, Homo sapiens
guuaauguugcaaagagua

SEQ ID NO: 1374289 - RNA, 19 nt, Homo sapiens
ggugguauccgaggccuuu

SEQ ID NO: 1374290 - RNA, 19 nt, Homo sapiens
ucuggucucugcuaugaug

SEQ ID NO: 1374291 - RNA, 19 nt, Homo sapiens
gcucguaguacauuaucuu

SEQ ID NO: 1374292 - RNA, 19 nt, Homo sapiens
guuaggaguuaauguugca

SEQ ID NO: 1374293 - RNA, 19 nt, Homo sapiens
uaccuugggcaccuuguua

SEQ ID NO: 1374294 - RNA, 19 nt, Homo sapiens
ggaugugugucgguuaugg

SEQ ID NO: 1374295 - RNA, 19 nt, Homo sapiens
ggauccaagaccugagaua

SEQ ID NO: 1374296 - RNA, 19 nt, Homo sapiens
gagcgucuggucucugcua

SEQ ID NO: 1374297 - RNA, 19 nt, Homo sapiens
gaguaccuccuguguggaa

SEQ ID NO: 1374298 - RNA, 19 nt, Homo sapiens
cgugacacccuucauccua

SEQ ID NO: 1374299 - RNA, 19 nt, Homo sapiens
guauccagcaccacagaaa

SEQ ID NO: 1374300 - RNA, 19 nt, Homo sapiens
gggcuuggacuggcuagaa

SEQ ID NO: 1374301 - RNA, 19 nt, Homo sapiens
ccugugacuucaugucuca

SEQ ID NO: 1374302 - RNA, 19 nt, Homo sapiens
acauagaguauaccugauu

SEQ ID NO: 1374303 - RNA, 19 nt, Homo sapiens
gacauagaguauaccugau

SEQ ID NO: 1374304 - RNA, 19 nt, Homo sapiens
gaggaggagggacaaggaa

SEQ ID NO: 1374305 - RNA, 19 nt, Homo sapiens
agauaucccugcuguugca

SEQ ID NO: 1374306 - RNA, 19 nt, Homo sapiens
gcaacauggaguucauugu

SEQ ID NO: 1374307 - RNA, 19 nt, Homo sapiens
gacugcacguucacucuca

SEQ ID NO: 1374308 - RNA, 19 nt, Homo sapiens
gaacagaacacuuggcuuu

SEQ ID NO: 1374309 - RNA, 19 nt, Homo sapiens
gaacuuugcugcucuacuu

SEQ ID NO: 1374310 - RNA, 19 nt, Homo sapiens
ccaaugaggucuccauaaa

SEQ ID NO: 1374311 - RNA, 19 nt, Homo sapiens
gagaugugcuguccacuaa

SEQ ID NO: 1374312 - RNA, 19 nt, Homo sapiens
gcacaaacaagcaaucaaa

SEQ ID NO: 1374313 - RNA, 19 nt, Homo sapiens
uuagagagcuuucggagaa

SEQ ID NO: 1374314 - RNA, 19 nt, Homo sapiens
aaacucggguucugugaua

SEQ ID NO: 1374315 - RNA, 19 nt, Homo sapiens
ggagaaagcacuaacugaa

SEQ ID NO: 1374316 - RNA, 19 nt, Homo sapiens
ugaccuaccuugucugauu

SEQ ID NO: 1374317 - RNA, 19 nt, Homo sapiens
uaacaggaauuacagaaag

SEQ ID NO: 1374318 - RNA, 19 nt, Homo sapiens
gaggaaagauggcgauguc

SEQ ID NO: 1374319 - RNA, 19 nt, Homo sapiens
ucuauuuccuggcuuauaa

SEQ ID NO: 1374320 - RNA, 19 nt, Homo sapiens
agaaagcacuaacugaaga

SEQ ID NO: 1374321 - RNA, 19 nt, Homo sapiens
gaccuaccuugucugauuu

SEQ ID NO: 1374322 - RNA, 19 nt, Homo sapiens
ugacagcucugcuuguuag

SEQ ID NO: 1374323 - RNA, 19 nt, Homo sapiens
gaugaugacuaacaggaau

SEQ ID NO: 1374324 - RNA, 19 nt, Homo sapiens
gggccuagcuugaggaaag

SEQ ID NO: 1374325 - RNA, 19 nt, Homo sapiens
ucucugcuguccuuuauuu

SEQ ID NO: 1374326 - RNA, 19 nt, Homo sapiens
caagaacuuugcugcucua

SEQ ID NO: 1374327 - RNA, 19 nt, Homo sapiens
gcacuucgggccucagaaa

SEQ ID NO: 1374328 - RNA, 19 nt, Homo sapiens
cuuguuagcauacuacuua

SEQ ID NO: 1374329 - RNA, 19 nt, Homo sapiens
ggacacucauuagcaagaa

SEQ ID NO: 1374330 - RNA, 19 nt, Homo sapiens
caugacagcucugcuuguu

SEQ ID NO: 1374331 - RNA, 19 nt, Homo sapiens
ccacuaagcacugcacaaa

SEQ ID NO: 1374332 - RNA, 19 nt, Homo sapiens
ggaauuacagaaaggagaa

SEQ ID NO: 1374333 - RNA, 19 nt, Homo sapiens
ugaugaugaugaugacuaa

SEQ ID NO: 1374334 - RNA, 19 nt, Homo sapiens
gcggcucgcuggcuaguau

SEQ ID NO: 1374335 - RNA, 19 nt, Homo sapiens
ggcaggccauagaaacuaa

SEQ ID NO: 1374336 - RNA, 19 nt, Homo sapiens
acuaaagccucaugccauu

SEQ ID NO: 1374337 - RNA, 19 nt, Homo sapiens
ucaucuauuuccuggcuua

SEQ ID NO: 1374338 - RNA, 19 nt, Homo sapiens
acuaagcacugcacaaaca

SEQ ID NO: 1374339 - RNA, 19 nt, Homo sapiens
gaaagcacuaacugaagaa

SEQ ID NO: 1374340 - RNA, 19 nt, Homo sapiens
ggagccuggugaacuauuc

SEQ ID NO: 1374341 - RNA, 19 nt, Homo sapiens
gagaaagcacuaacugaag

SEQ ID NO: 1374342 - RNA, 19 nt, Homo sapiens
gaacacuuggcuuugcaaa

SEQ ID NO: 1374343 - RNA, 19 nt, Homo sapiens
uggcugcaguuucucagua

SEQ ID NO: 1374344 - RNA, 19 nt, Homo sapiens
guagacaggccuuguugga

SEQ ID NO: 1374345 - RNA, 19 nt, Homo sapiens
augcaucucuucagcugua

SEQ ID NO: 1374346 - RNA, 19 nt, Homo sapiens
caagaagacagguuuagag

SEQ ID NO: 1374347 - RNA, 19 nt, Homo sapiens
gaaaggagaaagcacuaac

SEQ ID NO: 1374348 - RNA, 19 nt, Homo sapiens
cagaggaugaugaugauga

SEQ ID NO: 1374349 - RNA, 19 nt, Homo sapiens
gcacugcacaaacaagcaa

SEQ ID NO: 1374350 - RNA, 19 nt, Homo sapiens
ggugaagcuuccuguaugg

SEQ ID NO: 1374351 - RNA, 19 nt, Homo sapiens
agcacuaacugaagaaaug

SEQ ID NO: 1374352 - RNA, 19 nt, Homo sapiens
ucaaucaucccuauccaau

SEQ ID NO: 1374353 - RNA, 19 nt, Homo sapiens
guuauaauguugggcacuu

SEQ ID NO: 1374354 - RNA, 19 nt, Homo sapiens
cguguguucuccauuguga

SEQ ID NO: 1374355 - RNA, 19 nt, Homo sapiens
uggugaagcuuccuguaug

SEQ ID NO: 1374356 - RNA, 19 nt, Homo sapiens
ccaagaagacagguuuaga

SEQ ID NO: 1374357 - RNA, 19 nt, Homo sapiens
ucccauuucuccaguguug

SEQ ID NO: 1374358 - RNA, 19 nt, Homo sapiens
aguggagccuggugaacua

SEQ ID NO: 1374359 - RNA, 19 nt, Homo sapiens
gguucuaguuggugcaguu

SEQ ID NO: 1374360 - RNA, 19 nt, Homo sapiens
ccucugaccuaccuugucu

SEQ ID NO: 1374361 - RNA, 19 nt, Homo sapiens
ugucucugcuguccuuuau

SEQ ID NO: 1374362 - RNA, 19 nt, Homo sapiens
ugagaugugcuguccacua

SEQ ID NO: 1374363 - RNA, 19 nt, Homo sapiens
aaaagaauccucugaccua

SEQ ID NO: 1374364 - RNA, 19 nt, Homo sapiens
ccaaggcaggccauagaaa

SEQ ID NO: 1374365 - RNA, 19 nt, Homo sapiens
ggauauagauagguuuuca

SEQ ID NO: 1374366 - RNA, 19 nt, Homo sapiens
gaugugcuguccacuaagc

SEQ ID NO: 1374367 - RNA, 19 nt, Homo sapiens
cagaaaggagaaagcacua

SEQ ID NO: 1374368 - RNA, 19 nt, Homo sapiens
gacaggccuuguuggacuu

SEQ ID NO: 1374369 - RNA, 19 nt, Homo sapiens
ccugagaggaagaaaugua

SEQ ID NO: 1374370 - RNA, 19 nt, Homo sapiens
guucugugauaugaggaua

SEQ ID NO: 1374371 - RNA, 19 nt, Homo sapiens
agugauggcugcaguuucu

SEQ ID NO: 1374372 - RNA, 19 nt, Homo sapiens
cuaacaggaauuacagaaa

SEQ ID NO: 1374373 - RNA, 19 nt, Homo sapiens
ucucuucagcuguaucuuu

SEQ ID NO: 1374374 - RNA, 19 nt, Homo sapiens
ucggagaacagaacacuug

SEQ ID NO: 1374375 - RNA, 19 nt, Homo sapiens
aagaagacagguuuagaga

SEQ ID NO: 1374376 - RNA, 19 nt, Homo sapiens
gcccaagaagacagguuua

SEQ ID NO: 1374377 - RNA, 19 nt, Homo sapiens
cugcguguguucuccauug

SEQ ID NO: 1374378 - RNA, 19 nt, Homo sapiens
gaagggauucugccccaua

SEQ ID NO: 1374379 - RNA, 19 nt, Homo sapiens
gcaggcuguuucucagauc

SEQ ID NO: 1374380 - RNA, 19 nt, Homo sapiens
uacaaaagcccaacagaaa

SEQ ID NO: 1374381 - RNA, 19 nt, Homo sapiens
cugcuguccuuuauuuaug

SEQ ID NO: 1374382 - RNA, 19 nt, Homo sapiens
auaaaccaguaaacggaaa

SEQ ID NO: 1374383 - RNA, 19 nt, Homo sapiens
cagaacacuuggcuuugca

SEQ ID NO: 1374384 - RNA, 19 nt, Homo sapiens
uaccugagaggaagaaaug

SEQ ID NO: 1374385 - RNA, 19 nt, Homo sapiens
ggaugaugaugaugaugac

SEQ ID NO: 1374386 - RNA, 19 nt, Homo sapiens
agacagguuuagagagcuu

SEQ ID NO: 1374387 - RNA, 19 nt, Homo sapiens
ggcccaagaagacagguuu

SEQ ID NO: 1374388 - RNA, 19 nt, Homo sapiens
cauaaaaggcccaagaaga

SEQ ID NO: 1374389 - RNA, 19 nt, Homo sapiens
ucgggacacucauuagcaa

SEQ ID NO: 1374390 - RNA, 19 nt, Homo sapiens
ggcugcaguuucucaguau

SEQ ID NO: 1374391 - RNA, 19 nt, Homo sapiens
ugaugacuaacaggaauua

SEQ ID NO: 1374392 - RNA, 19 nt, Homo sapiens
gggacacucauuagcaaga

SEQ ID NO: 1374393 - RNA, 19 nt, Homo sapiens
agaggaugaugaugaugau

SEQ ID NO: 1374394 - RNA, 19 nt, Homo sapiens
caaggcaggccauagaaac

SEQ ID NO: 1374395 - RNA, 19 nt, Homo sapiens
uguccaugcuucaaucauc

SEQ ID NO: 1374396 - RNA, 19 nt, Homo sapiens
gaauuacagaaaggagaaa

SEQ ID NO: 1374397 - RNA, 19 nt, Homo sapiens
ggccuagcuugaggaaaga

SEQ ID NO: 1374398 - RNA, 19 nt, Homo sapiens
cuucaugggcuaacuaaag

SEQ ID NO: 1374399 - RNA, 19 nt, Homo sapiens
acagaacacuuggcuuugc

SEQ ID NO: 1374400 - RNA, 19 nt, Homo sapiens
augaggauauagauagguu

SEQ ID NO: 1374401 - RNA, 19 nt, Homo sapiens
ccugggaacuauuuucauu

SEQ ID NO: 1374402 - RNA, 19 nt, Homo sapiens
ugagugauggcugcaguuu

SEQ ID NO: 1374403 - RNA, 19 nt, Homo sapiens
aaauggugaugcucucagu

SEQ ID NO: 1374404 - RNA, 19 nt, Homo sapiens
ccucaugccauucuguguu

SEQ ID NO: 1374405 - RNA, 19 nt, Homo sapiens
cacaaacaagcaaucaaau

SEQ ID NO: 1374406 - RNA, 19 nt, Homo sapiens
cugaagaaauggugaugcu

SEQ ID NO: 1374407 - RNA, 19 nt, Homo sapiens
uccagaggaugaugaugau

SEQ ID NO: 1374408 - RNA, 19 nt, Homo sapiens
ucagagagcuucaugauuu

SEQ ID NO: 1374409 - RNA, 19 nt, Homo sapiens
ggaaagcgguuuaggguuu

SEQ ID NO: 1374410 - RNA, 19 nt, Homo sapiens
gaccaagaauguuccaaua

SEQ ID NO: 1374411 - RNA, 19 nt, Homo sapiens
ugaaguaucugccugauga

SEQ ID NO: 1374412 - RNA, 19 nt, Homo sapiens
ccaguuaguuuguacauuu

SEQ ID NO: 1374413 - RNA, 19 nt, Homo sapiens
ccaagaauguuccaauauu

SEQ ID NO: 1374414 - RNA, 19 nt, Homo sapiens
ucacacagcuguuggaaga

SEQ ID NO: 1374415 - RNA, 19 nt, Homo sapiens
ggacauucguucuguaaga

SEQ ID NO: 1374416 - RNA, 19 nt, Homo sapiens
gaauuugccucagauauau

SEQ ID NO: 1374417 - RNA, 19 nt, Homo sapiens
gcagcugguuucagaauuu

SEQ ID NO: 1374418 - RNA, 19 nt, Homo sapiens
gcuuauauuugcacaagua

SEQ ID NO: 1374419 - RNA, 19 nt, Homo sapiens
gagccaagauacagauuga

SEQ ID NO: 1374420 - RNA, 19 nt, Homo sapiens
gauaggagguacuguguca

SEQ ID NO: 1374421 - RNA, 19 nt, Homo sapiens
gaacugucuugaccauuga

SEQ ID NO: 1374422 - RNA, 19 nt, Homo sapiens
cacauuaacugcccauuug

SEQ ID NO: 1374423 - RNA, 19 nt, Homo sapiens
gcaacaugguuuauauuca

SEQ ID NO: 1374424 - RNA, 19 nt, Homo sapiens
ggaucucccuuuaaaguga

SEQ ID NO: 1374425 - RNA, 19 nt, Homo sapiens
cuaaguaacuaacucuuug

SEQ ID NO: 1374426 - RNA, 19 nt, Homo sapiens
gcugaacucucacacuuga

SEQ ID NO: 1374427 - RNA, 19 nt, Homo sapiens
aaagaacgguugaccaaga

SEQ ID NO: 1374428 - RNA, 19 nt, Homo sapiens
gaaugaagaugagauuaag

SEQ ID NO: 1374429 - RNA, 19 nt, Homo sapiens
ugaauuugccucagauaua

SEQ ID NO: 1374430 - RNA, 19 nt, Homo sapiens
acuaagaacuugcacagaa

SEQ ID NO: 1374431 - RNA, 19 nt, Homo sapiens
gaaggucugugguugauac

SEQ ID NO: 1374432 - RNA, 19 nt, Homo sapiens
gcugcaacaugguuuauau

SEQ ID NO: 1374433 - RNA, 19 nt, Homo sapiens
uaacugcccauuuguguaa

SEQ ID NO: 1374434 - RNA, 19 nt, Homo sapiens
ugaacugucuugaccauug

SEQ ID NO: 1374435 - RNA, 19 nt, Homo sapiens
gcacugccgacauugaaua

SEQ ID NO: 1374436 - RNA, 19 nt, Homo sapiens
cuaagaacuugcacagaaa

SEQ ID NO: 1374437 - RNA, 19 nt, Homo sapiens
ugaagaaacugcugaacuc

SEQ ID NO: 1374438 - RNA, 19 nt, Homo sapiens
gaucauucuuuguuggaaa

SEQ ID NO: 1374439 - RNA, 19 nt, Homo sapiens
gcuguuggaagaauuaaua

SEQ ID NO: 1374440 - RNA, 19 nt, Homo sapiens
ugaccaagauacagcauau

SEQ ID NO: 1374441 - RNA, 19 nt, Homo sapiens
ugacuguccuuauuaacuu

SEQ ID NO: 1374442 - RNA, 19 nt, Homo sapiens
uggaagauguuaagguuga

SEQ ID NO: 1374443 - RNA, 19 nt, Homo sapiens
gcaccauauuguccucuuu

SEQ ID NO: 1374444 - RNA, 19 nt, Homo sapiens
guaaagggagaacucaauu

SEQ ID NO: 1374445 - RNA, 19 nt, Homo sapiens
uaaucuggcugcauugaug

SEQ ID NO: 1374446 - RNA, 19 nt, Homo sapiens
cagcugguuucagaauuua

SEQ ID NO: 1374447 - RNA, 19 nt, Homo sapiens
ugucgaaccucuacauugu

SEQ ID NO: 1374448 - RNA, 19 nt, Homo sapiens
gagaaugaagaugagauua

SEQ ID NO: 1374449 - RNA, 19 nt, Homo sapiens
gaaugaaagauggauauug

SEQ ID NO: 1374450 - RNA, 19 nt, Homo sapiens
agauacagauugaugauuc

SEQ ID NO: 1374451 - RNA, 19 nt, Homo sapiens
agaaacugcugaacucuca

SEQ ID NO: 1374452 - RNA, 19 nt, Homo sapiens
gaugaacugucugagagaa

SEQ ID NO: 1374453 - RNA, 19 nt, Homo sapiens
cagaagaauuaaucgaugu

SEQ ID NO: 1374454 - RNA, 19 nt, Homo sapiens
gcccauuuguguaauuuau

SEQ ID NO: 1374455 - RNA, 19 nt, Homo sapiens
cagcauauacugaccuauu

SEQ ID NO: 1374456 - RNA, 19 nt, Homo sapiens
agaccaaucuaaguaacua

SEQ ID NO: 1374457 - RNA, 19 nt, Homo sapiens
uuguaaaccugacauggua

SEQ ID NO: 1374458 - RNA, 19 nt, Homo sapiens
ugaaagaacgguugaccaa

SEQ ID NO: 1374459 - RNA, 19 nt, Homo sapiens
ucuggaagauguuaagguu

SEQ ID NO: 1374460 - RNA, 19 nt, Homo sapiens
ggacggaaggucugugguu

SEQ ID NO: 1374461 - RNA, 19 nt, Homo sapiens
gcaaagaaagcuuaaaaga

SEQ ID NO: 1374462 - RNA, 19 nt, Homo sapiens
gauaccagcugucgguuuu

SEQ ID NO: 1374463 - RNA, 19 nt, Homo sapiens
uauacagacuggaaccaaa

SEQ ID NO: 1374464 - RNA, 19 nt, Homo sapiens
gcccaaguuuacaagagua

SEQ ID NO: 1374465 - RNA, 19 nt, Homo sapiens
caagauacagcauauacug

SEQ ID NO: 1374466 - RNA, 19 nt, Homo sapiens
cagagagcuucaugauuug

SEQ ID NO: 1374467 - RNA, 19 nt, Homo sapiens
ucacauuaacugcccauuu

SEQ ID NO: 1374468 - RNA, 19 nt, Homo sapiens
aaugaaagauggauauugc

SEQ ID NO: 1374469 - RNA, 19 nt, Homo sapiens
ggaaugaaagauggauauu

SEQ ID NO: 1374470 - RNA, 19 nt, Homo sapiens
ucucagauuucgaguguuc

SEQ ID NO: 1374471 - RNA, 19 nt, Homo sapiens
ugccgagggucauuuauug

SEQ ID NO: 1374472 - RNA, 19 nt, Homo sapiens
gauuaugguuguauguuac

SEQ ID NO: 1374473 - RNA, 19 nt, Homo sapiens
gugcaaauguuaguuaugc

SEQ ID NO: 1374474 - RNA, 19 nt, Homo sapiens
ugaggaucauucuuuguug

SEQ ID NO: 1374475 - RNA, 19 nt, Homo sapiens
ggucauuuauugcccaagu

SEQ ID NO: 1374476 - RNA, 19 nt, Homo sapiens
gaacuugccgagggucauu

SEQ ID NO: 1374477 - RNA, 19 nt, Homo sapiens
cuuuggaucucccuuuaaa

SEQ ID NO: 1374478 - RNA, 19 nt, Homo sapiens
agcauauacugaccuauuu

SEQ ID NO: 1374479 - RNA, 19 nt, Homo sapiens
guuuagaucaugcaccaua

SEQ ID NO: 1374480 - RNA, 19 nt, Homo sapiens
guauaaacccauuaaggau

SEQ ID NO: 1374481 - RNA, 19 nt, Homo sapiens
gguaaagggagaacucaau

SEQ ID NO: 1374482 - RNA, 19 nt, Homo sapiens
ucgaaccucuacauuguga

SEQ ID NO: 1374483 - RNA, 19 nt, Homo sapiens
ccaagauacagauugauga

SEQ ID NO: 1374484 - RNA, 19 nt, Homo sapiens
cugcugaacucucacacuu

SEQ ID NO: 1374485 - RNA, 19 nt, Homo sapiens
ggucucggugcaaauguua

SEQ ID NO: 1374486 - RNA, 19 nt, Homo sapiens
ugucucagauuucgagugu

SEQ ID NO: 1374487 - RNA, 19 nt, Homo sapiens
gccugcagcugguuucaga

SEQ ID NO: 1374488 - RNA, 19 nt, Homo sapiens
cgacauugaauaucuggaa

SEQ ID NO: 1374489 - RNA, 19 nt, Homo sapiens
caaauuagaaacgugcauu

SEQ ID NO: 1374490 - RNA, 19 nt, Homo sapiens
gccuugcccucuccaugua

SEQ ID NO: 1374491 - RNA, 19 nt, Homo sapiens
gaucaugcaccauauuguc

SEQ ID NO: 1374492 - RNA, 19 nt, Homo sapiens
gggagaacucaauucagua

SEQ ID NO: 1374493 - RNA, 19 nt, Homo sapiens
agggagaacucaauucagu

SEQ ID NO: 1374494 - RNA, 19 nt, Homo sapiens
uguaaauacuugcaucaca

SEQ ID NO: 1374495 - RNA, 19 nt, Homo sapiens
acuaugacacaguuucuua

SEQ ID NO: 1374496 - RNA, 19 nt, Homo sapiens
aaauacugcucuugcugaa

SEQ ID NO: 1374497 - RNA, 19 nt, Homo sapiens
gcggacauucguucuguaa

SEQ ID NO: 1374498 - RNA, 19 nt, Homo sapiens
cauauuguccucuuugcaa

SEQ ID NO: 1374499 - RNA, 19 nt, Homo sapiens
aaagggagaacucaauuca

SEQ ID NO: 1374500 - RNA, 19 nt, Homo sapiens
guccuaaugcuuauauuug

SEQ ID NO: 1374501 - RNA, 19 nt, Homo sapiens
aagaguagcgauacaaguu

SEQ ID NO: 1374502 - RNA, 19 nt, Homo sapiens
gaaguugcacuauguccau

SEQ ID NO: 1374503 - RNA, 19 nt, Homo sapiens
cugcauugauggccagauu

SEQ ID NO: 1374504 - RNA, 19 nt, Homo sapiens
ggaccugcaugguguuggu

SEQ ID NO: 1374505 - RNA, 19 nt, Homo sapiens
auguuaagguugagaauga

SEQ ID NO: 1374506 - RNA, 19 nt, Homo sapiens
gagcguuguuuagaucaug

SEQ ID NO: 1374507 - RNA, 19 nt, Homo sapiens
ggaaaagagaagaaguuua

SEQ ID NO: 1374508 - RNA, 19 nt, Homo sapiens
gaagaucgcugaggaagaa

SEQ ID NO: 1374509 - RNA, 19 nt, Homo sapiens
ggucacagauguugaaguu

SEQ ID NO: 1374510 - RNA, 19 nt, Homo sapiens
ccaaucaaguucucugaaa

SEQ ID NO: 1374511 - RNA, 19 nt, Homo sapiens
gcaacaggcuucucacuac

SEQ ID NO: 1374512 - RNA, 19 nt, Homo sapiens
gaagaguggcauucacaaa

SEQ ID NO: 1374513 - RNA, 19 nt, Homo sapiens
acaaauggaucagugacua

SEQ ID NO: 1374514 - RNA, 19 nt, Homo sapiens
ggaggcauaugaccagaag

SEQ ID NO: 1374515 - RNA, 19 nt, Homo sapiens
caccaucccuggccuuguu

SEQ ID NO: 1374516 - RNA, 19 nt, Homo sapiens
gcacacggcauucaacaag

SEQ ID NO: 1374517 - RNA, 19 nt, Homo sapiens
cuacgcagcuauuccaauc

SEQ ID NO: 1374518 - RNA, 19 nt, Homo sapiens
ggacugaggcagccagcuu

SEQ ID NO: 1374519 - RNA, 19 nt, Homo sapiens
caaauuccgacccuacuga

SEQ ID NO: 1374520 - RNA, 19 nt, Homo sapiens
ggagcacuaggucuucaua

SEQ ID NO: 1374521 - RNA, 19 nt, Homo sapiens
ugaggacccuggaugaauc

SEQ ID NO: 1374522 - RNA, 19 nt, Homo sapiens
acacguucauggaggcaua

SEQ ID NO: 1374523 - RNA, 19 nt, Homo sapiens
ggguggaaguggacacguu

SEQ ID NO: 1374524 - RNA, 19 nt, Homo sapiens
uguccagucuguagaguug

SEQ ID NO: 1374525 - RNA, 19 nt, Homo sapiens
ggagcuggcugggagucaa

SEQ ID NO: 1374526 - RNA, 19 nt, Homo sapiens
caaguucucugaaaagcaa

SEQ ID NO: 1374527 - RNA, 19 nt, Homo sapiens
ccucgggucuugugcuuca

SEQ ID NO: 1374528 - RNA, 19 nt, Homo sapiens
ggagucaaggucgaaguuu

SEQ ID NO: 1374529 - RNA, 19 nt, Homo sapiens
ggaaguggacacguucaug

SEQ ID NO: 1374530 - RNA, 19 nt, Homo sapiens
gagccacccugugaagagu

SEQ ID NO: 1374531 - RNA, 19 nt, Homo sapiens
caaucaaguucucugaaaa

SEQ ID NO: 1374532 - RNA, 19 nt, Homo sapiens
gagagcacacggcauucaa

SEQ ID NO: 1374533 - RNA, 19 nt, Homo sapiens
gcaaauuccgacccuacug

SEQ ID NO: 1374534 - RNA, 19 nt, Homo sapiens
gagucaaggucgaaguuuu

SEQ ID NO: 1374535 - RNA, 19 nt, Homo sapiens
cuguagaguugaaggagaa

SEQ ID NO: 1374536 - RNA, 19 nt, Homo sapiens
gagcacacggcauucaaca

SEQ ID NO: 1374537 - RNA, 19 nt, Homo sapiens
cgugagagccgcaguggau

SEQ ID NO: 1374538 - RNA, 19 nt, Homo sapiens
agacggaagcgcagccaaa

SEQ ID NO: 1374539 - RNA, 19 nt, Homo sapiens
acgcagcuauuccaaucaa

SEQ ID NO: 1374540 - RNA, 19 nt, Homo sapiens
gggagucaaggucgaaguu

SEQ ID NO: 1374541 - RNA, 19 nt, Homo sapiens
gcagcuauuccaaucaagu

SEQ ID NO: 1374542 - RNA, 19 nt, Homo sapiens
caacuacgccuggcagcau

SEQ ID NO: 1374543 - RNA, 19 nt, Homo sapiens
ccaccuggccucagaagag

SEQ ID NO: 1374544 - RNA, 19 nt, Homo sapiens
cagcuauuccaaucaaguu

SEQ ID NO: 1374545 - RNA, 19 nt, Homo sapiens
ugaggucacagauguugaa

SEQ ID NO: 1374546 - RNA, 19 nt, Homo sapiens
aagaguggcauucacaaau

SEQ ID NO: 1374547 - RNA, 19 nt, Homo sapiens
ccagaagaucgcugaggaa

SEQ ID NO: 1374548 - RNA, 19 nt, Homo sapiens
cagcugcgcaagaaguuug

SEQ ID NO: 1374549 - RNA, 19 nt, Homo sapiens
ggcugggccucaagacuag

SEQ ID NO: 1374550 - RNA, 19 nt, Homo sapiens
cagcaucgagagagcaaga

SEQ ID NO: 1374551 - RNA, 19 nt, Homo sapiens
gagagccacccugugaaga

SEQ ID NO: 1374552 - RNA, 19 nt, Homo sapiens
cccuugaggucacagaugu

SEQ ID NO: 1374553 - RNA, 19 nt, Homo sapiens
cugcugguguccacagaga

SEQ ID NO: 1374554 - RNA, 19 nt, Homo sapiens
cacagauguugaaguugga

SEQ ID NO: 1374555 - RNA, 19 nt, Homo sapiens
uccguucugugcuuccuuu

SEQ ID NO: 1374556 - RNA, 19 nt, Homo sapiens
gcagcugcgcaagaaguuu

SEQ ID NO: 1374557 - RNA, 19 nt, Homo sapiens
ucgcugaggaagaagcuaa

SEQ ID NO: 1374558 - RNA, 19 nt, Homo sapiens
gggaggaccugcucuauga

SEQ ID NO: 1374559 - RNA, 19 nt, Homo sapiens
caacaugggcaccugcuua

SEQ ID NO: 1374560 - RNA, 19 nt, Homo sapiens
gcuacaaccuggacucugu

SEQ ID NO: 1374561 - RNA, 19 nt, Homo sapiens
ccacgugggcccaugaaua

SEQ ID NO: 1374562 - RNA, 19 nt, Homo sapiens
agacugagaaguucacauu

SEQ ID NO: 1374563 - RNA, 19 nt, Homo sapiens
ccacaguucuggacuucau

SEQ ID NO: 1374564 - RNA, 19 nt, Homo sapiens
ggacuucaucgaacucuuc

SEQ ID NO: 1374565 - RNA, 19 nt, Homo sapiens
accagcagcuuccucaauu

SEQ ID NO: 1374566 - RNA, 19 nt, Homo sapiens
caaccaggguacggccuuu

SEQ ID NO: 1374567 - RNA, 19 nt, Homo sapiens
gaaguccucccacgaaguc

SEQ ID NO: 1374568 - RNA, 19 nt, Homo sapiens
caacaccacggccaacaug

SEQ ID NO: 1374569 - RNA, 19 nt, Homo sapiens
acugagaaguucacauuca

SEQ ID NO: 1374570 - RNA, 19 nt, Homo sapiens
gacauuuucucaaggauga

SEQ ID NO: 1374571 - RNA, 19 nt, Homo sapiens
gccgcuacguggaccauga

SEQ ID NO: 1374572 - RNA, 19 nt, Homo sapiens
ugagauggaagccuauaga

SEQ ID NO: 1374573 - RNA, 19 nt, Homo sapiens
ccacgcagcaagcagaaga

SEQ ID NO: 1374574 - RNA, 19 nt, Homo sapiens
ccagcagcuuccucaauuc

SEQ ID NO: 1374575 - RNA, 19 nt, Homo sapiens
ggccacaguucuggacuuc

SEQ ID NO: 1374576 - RNA, 19 nt, Homo sapiens
ucaucgaacucuucaacca

SEQ ID NO: 1374577 - RNA, 19 nt, Homo sapiens
gaccucaaccgcaccuuca

SEQ ID NO: 1374578 - RNA, 19 nt, Homo sapiens
gcacgcauggcaacgagau

SEQ ID NO: 1374579 - RNA, 19 nt, Homo sapiens
gccaggccuuugacuuugu

SEQ ID NO: 1374580 - RNA, 19 nt, Homo sapiens
gagcacagaggucccuucu

SEQ ID NO: 1374581 - RNA, 19 nt, Homo sapiens
caugggcaccugcuuaauc

SEQ ID NO: 1374582 - RNA, 19 nt, Homo sapiens
caagagcccgagagcugaa

SEQ ID NO: 1374583 - RNA, 19 nt, Homo sapiens
ccagcuuccuaacccaaga

SEQ ID NO: 1374584 - RNA, 19 nt, Homo sapiens
ccuuugacuuuguccuuga

SEQ ID NO: 1374585 - RNA, 19 nt, Homo sapiens
cucaauuucccuuucuaua

SEQ ID NO: 1374586 - RNA, 19 nt, Homo sapiens
gccuggugcucccaucuuc

SEQ ID NO: 1374587 - RNA, 19 nt, Homo sapiens
gggcugacauuuucucaag

SEQ ID NO: 1374588 - RNA, 19 nt, Homo sapiens
gccucaauuucccuuucua

SEQ ID NO: 1374589 - RNA, 19 nt, Homo sapiens
ccuggacucuguggccaaa

SEQ ID NO: 1374590 - RNA, 19 nt, Homo sapiens
aacaugggcaccugcuuaa

SEQ ID NO: 1374591 - RNA, 19 nt, Homo sapiens
ggccucaauuucccuuucu

SEQ ID NO: 1374592 - RNA, 19 nt, Homo sapiens
cgagaugucgggcgucuac

SEQ ID NO: 1374593 - RNA, 19 nt, Homo sapiens
cgacccauaugaggugaca

SEQ ID NO: 1374594 - RNA, 19 nt, Homo sapiens
ccaagugacucgacguuua

SEQ ID NO: 1374595 - RNA, 19 nt, Homo sapiens
gaggaaaugcugauuguug

SEQ ID NO: 1374596 - RNA, 19 nt, Homo sapiens
gauugcccaucauguauaa

SEQ ID NO: 1374597 - RNA, 19 nt, Homo sapiens
ggaugagaaugauaagguu

SEQ ID NO: 1374598 - RNA, 19 nt, Homo sapiens
gaacccggaucccagugaa

SEQ ID NO: 1374599 - RNA, 19 nt, Homo sapiens
gcaugaaauuuguuaccuu

SEQ ID NO: 1374600 - RNA, 19 nt, Homo sapiens
gagagcaugaaauuuguua

SEQ ID NO: 1374601 - RNA, 19 nt, Homo sapiens
cagcagaacuggaagaaaa

SEQ ID NO: 1374602 - RNA, 19 nt, Homo sapiens
caagagaggucgggucaca

SEQ ID NO: 1374603 - RNA, 19 nt, Homo sapiens
gaagaugcguauggucuca

SEQ ID NO: 1374604 - RNA, 19 nt, Homo sapiens
guaguagccacccauuaua

SEQ ID NO: 1374605 - RNA, 19 nt, Homo sapiens
ggaucucuguaucauguuu

SEQ ID NO: 1374606 - RNA, 19 nt, Homo sapiens
gggagagcaugaaauuugu

SEQ ID NO: 1374607 - RNA, 19 nt, Homo sapiens
gacaaucuaucaccacaag

SEQ ID NO: 1374608 - RNA, 19 nt, Homo sapiens
gaugagaaugauaagguua

SEQ ID NO: 1374609 - RNA, 19 nt, Homo sapiens
ccacuucuguucauuugau

SEQ ID NO: 1374610 - RNA, 19 nt, Homo sapiens
gcaggcagacgcaccauug

SEQ ID NO: 1374611 - RNA, 19 nt, Homo sapiens
cuucagcguugucuuguuu

SEQ ID NO: 1374612 - RNA, 19 nt, Homo sapiens
gaauugccaucugaacgaa

SEQ ID NO: 1374613 - RNA, 19 nt, Homo sapiens
gcagaggucggacacgaaa

SEQ ID NO: 1374614 - RNA, 19 nt, Homo sapiens
caagaggaauugccaucug

SEQ ID NO: 1374615 - RNA, 19 nt, Homo sapiens
cauucaaucuugcauccua

SEQ ID NO: 1374616 - RNA, 19 nt, Homo sapiens
caucaacuuugucauaucu

SEQ ID NO: 1374617 - RNA, 19 nt, Homo sapiens
ggacacgaaagucacguuu

SEQ ID NO: 1374618 - RNA, 19 nt, Homo sapiens
ggaauugccaucugaacga

SEQ ID NO: 1374619 - RNA, 19 nt, Homo sapiens
gcaacacaaggcugcauuu

SEQ ID NO: 1374620 - RNA, 19 nt, Homo sapiens
gaacgaaaacauugagaaa

SEQ ID NO: 1374621 - RNA, 19 nt, Homo sapiens
cauuugaucguuucaguaa

SEQ ID NO: 1374622 - RNA, 19 nt, Homo sapiens
gaugggaucucuguaucau

SEQ ID NO: 1374623 - RNA, 19 nt, Homo sapiens
gcagggaggaaauuuaaca

SEQ ID NO: 1374624 - RNA, 19 nt, Homo sapiens
aagaggaauugccaucuga

SEQ ID NO: 1374625 - RNA, 19 nt, Homo sapiens
caagugacucgacguuuau

SEQ ID NO: 1374626 - RNA, 19 nt, Homo sapiens
ggucacagccagcagcuau

SEQ ID NO: 1374627 - RNA, 19 nt, Homo sapiens
ugggaucucuguaucaugu

SEQ ID NO: 1374628 - RNA, 19 nt, Homo sapiens
gcaagcagagcugggaauu

SEQ ID NO: 1374629 - RNA, 19 nt, Homo sapiens
cagaggacauuguguucau

SEQ ID NO: 1374630 - RNA, 19 nt, Homo sapiens
ugaaauuuguuaccuucug

SEQ ID NO: 1374631 - RNA, 19 nt, Homo sapiens
uggaggaaaugcugauugu

SEQ ID NO: 1374632 - RNA, 19 nt, Homo sapiens
ucagcguugucuuguuuaa

SEQ ID NO: 1374633 - RNA, 19 nt, Homo sapiens
aggaaaugcugauuguugu

SEQ ID NO: 1374634 - RNA, 19 nt, Homo sapiens
gcaaaaggggcacuugauu

SEQ ID NO: 1374635 - RNA, 19 nt, Homo sapiens
uguaguagccacccauuau

SEQ ID NO: 1374636 - RNA, 19 nt, Homo sapiens
ucacguuuccuggguauuu

SEQ ID NO: 1374637 - RNA, 19 nt, Homo sapiens
caagaaucgaauccugaua

SEQ ID NO: 1374638 - RNA, 19 nt, Homo sapiens
cagcugauccugaaagucu

SEQ ID NO: 1374639 - RNA, 19 nt, Homo sapiens
ucaacuuugucauaucuuc

SEQ ID NO: 1374640 - RNA, 19 nt, Homo sapiens
gaggacauuguguucauga

SEQ ID NO: 1374641 - RNA, 19 nt, Homo sapiens
ggacauuguguucaugaca

SEQ ID NO: 1374642 - RNA, 19 nt, Homo sapiens
ggaucccagugaaacgaaa

SEQ ID NO: 1374643 - RNA, 19 nt, Homo sapiens
aaucuugcauccuaauaca

SEQ ID NO: 1374644 - RNA, 19 nt, Homo sapiens
uugcagcgcuuggaggaaa

SEQ ID NO: 1374645 - RNA, 19 nt, Homo sapiens
guugcagggaggaaauuua

SEQ ID NO: 1374646 - RNA, 19 nt, Homo sapiens
ggggagagcaugaaauuug

SEQ ID NO: 1374647 - RNA, 19 nt, Homo sapiens
uuuaccgacuccuguagua

SEQ ID NO: 1374648 - RNA, 19 nt, Homo sapiens
ucuguucauuugaucguuu

SEQ ID NO: 1374649 - RNA, 19 nt, Homo sapiens
cgacguuuauccacuucug

SEQ ID NO: 1374650 - RNA, 19 nt, Homo sapiens
ucaaucuugcauccuaaua

SEQ ID NO: 1374651 - RNA, 19 nt, Homo sapiens
ggaugggaucucuguauca

SEQ ID NO: 1374652 - RNA, 19 nt, Homo sapiens
caggaugggaucucuguau

SEQ ID NO: 1374653 - RNA, 19 nt, Homo sapiens
ggagagcaugaaauuuguu

SEQ ID NO: 1374654 - RNA, 19 nt, Homo sapiens
agaaucgaauccugauaca

SEQ ID NO: 1374655 - RNA, 19 nt, Homo sapiens
ggaaaugcugauuguugug

SEQ ID NO: 1374656 - RNA, 19 nt, Homo sapiens
uugcagggaggaaauuuaa

SEQ ID NO: 1374657 - RNA, 19 nt, Homo sapiens
caaaaggggcacuugauug

SEQ ID NO: 1374658 - RNA, 19 nt, Homo sapiens
uuuguuaccuucugcuugu

SEQ ID NO: 1374659 - RNA, 19 nt, Homo sapiens
gaucguuucaguaauaugc

SEQ ID NO: 1374660 - RNA, 19 nt, Homo sapiens
aagcagagcugggaauucc

SEQ ID NO: 1374661 - RNA, 19 nt, Homo sapiens
ggucgagucagccaugugu

SEQ ID NO: 1374662 - RNA, 19 nt, Homo sapiens
guagccacccauuauacaa

SEQ ID NO: 1374663 - RNA, 19 nt, Homo sapiens
cauccuaauacaagcagua

SEQ ID NO: 1374664 - RNA, 19 nt, Homo sapiens
gcccaucauguauaaauca

SEQ ID NO: 1374665 - RNA, 19 nt, Homo sapiens
ucgagucagccauguguaa

SEQ ID NO: 1374666 - RNA, 19 nt, Homo sapiens
ggcaaaaucagacagaauu

SEQ ID NO: 1374667 - RNA, 19 nt, Homo sapiens
ugauuguuguggaugagaa

SEQ ID NO: 1374668 - RNA, 19 nt, Homo sapiens
ccaagaaucgaauccugau

SEQ ID NO: 1374669 - RNA, 19 nt, Homo sapiens
ggaggaaaugcugauuguu

SEQ ID NO: 1374670 - RNA, 19 nt, Homo sapiens
aaucuugacuggguugaca

SEQ ID NO: 1374671 - RNA, 19 nt, Homo sapiens
caacuuugucauaucuuca

SEQ ID NO: 1374672 - RNA, 19 nt, Homo sapiens
ucauuugaucguuucagua

SEQ ID NO: 1374673 - RNA, 19 nt, Homo sapiens
uauccacuucuguucauuu

SEQ ID NO: 1374674 - RNA, 19 nt, Homo sapiens
gaucuugagaguccugaag

SEQ ID NO: 1374675 - RNA, 19 nt, Homo sapiens
ucaucaacuuugucauauc

SEQ ID NO: 1374676 - RNA, 19 nt, Homo sapiens
ggcgaggggugaagucaaa

SEQ ID NO: 1374677 - RNA, 19 nt, Homo sapiens
uauggucucagccaaguga

SEQ ID NO: 1374678 - RNA, 19 nt, Homo sapiens
cguauggucucagccaagu

SEQ ID NO: 1374679 - RNA, 19 nt, Homo sapiens
gagucagccauguguaaug

SEQ ID NO: 1374680 - RNA, 19 nt, Homo sapiens
acucgacguuuauccacuu

SEQ ID NO: 1374681 - RNA, 19 nt, Homo sapiens
cauuuccuuugucccaauu

SEQ ID NO: 1374682 - RNA, 19 nt, Homo sapiens
aaugauacacccucuccaa

SEQ ID NO: 1374683 - RNA, 19 nt, Homo sapiens
aggaugggaucucuguauc

SEQ ID NO: 1374684 - RNA, 19 nt, Homo sapiens
gaggucgagucagccaugu

SEQ ID NO: 1374685 - RNA, 19 nt, Homo sapiens
gaagagagcuagaggcaua

SEQ ID NO: 1374686 - RNA, 19 nt, Homo sapiens
ccacugagcucaucuguua

SEQ ID NO: 1374687 - RNA, 19 nt, Homo sapiens
ggaggaagaugaagaagua

SEQ ID NO: 1374688 - RNA, 19 nt, Homo sapiens
caagacaacugguuucuaa

SEQ ID NO: 1374689 - RNA, 19 nt, Homo sapiens
gaagcaagauacagagaua

SEQ ID NO: 1374690 - RNA, 19 nt, Homo sapiens
ggagaaagauggagaacuu

SEQ ID NO: 1374691 - RNA, 19 nt, Homo sapiens
ggagagaggucgauauaga

SEQ ID NO: 1374692 - RNA, 19 nt, Homo sapiens
gaaugaacauaaaccagua

SEQ ID NO: 1374693 - RNA, 19 nt, Homo sapiens
ccaguaaacucaaauaugu

SEQ ID NO: 1374694 - RNA, 19 nt, Homo sapiens
gaacauaaaccaguaaaga

SEQ ID NO: 1374695 - RNA, 19 nt, Homo sapiens
gaagugaacucugaagaau

SEQ ID NO: 1374696 - RNA, 19 nt, Homo sapiens
cgaauggaaucuacugaua

SEQ ID NO: 1374697 - RNA, 19 nt, Homo sapiens
ucaaauaugugcuucaaga

SEQ ID NO: 1374698 - RNA, 19 nt, Homo sapiens
ggaagaagauguggaggaa

SEQ ID NO: 1374699 - RNA, 19 nt, Homo sapiens
gaaugugucucuugccaaa

SEQ ID NO: 1374700 - RNA, 19 nt, Homo sapiens
agaagaagaugcagaagaa

SEQ ID NO: 1374701 - RNA, 19 nt, Homo sapiens
gaauuacccuucacuaagu

SEQ ID NO: 1374702 - RNA, 19 nt, Homo sapiens
uggaagcacugauuguuua

SEQ ID NO: 1374703 - RNA, 19 nt, Homo sapiens
gcucaucuguuagcaauaa

SEQ ID NO: 1374704 - RNA, 19 nt, Homo sapiens
cagagaaccuuauaagaau

SEQ ID NO: 1374705 - RNA, 19 nt, Homo sapiens
ggaacaaccuccacaacau

SEQ ID NO: 1374706 - RNA, 19 nt, Homo sapiens
ggaagaagaagaauaugaa

SEQ ID NO: 1374707 - RNA, 19 nt, Homo sapiens
ccagagaaccuuauaagaa

SEQ ID NO: 1374708 - RNA, 19 nt, Homo sapiens
gaaagucagccacagagua

SEQ ID NO: 1374709 - RNA, 19 nt, Homo sapiens
ccaagaauguagauacuga

SEQ ID NO: 1374710 - RNA, 19 nt, Homo sapiens
gaaagaaaccaaggauuga

SEQ ID NO: 1374711 - RNA, 19 nt, Homo sapiens
gcugggaggugucuuuaaa

SEQ ID NO: 1374712 - RNA, 19 nt, Homo sapiens
gaacaacacugagaaugag

SEQ ID NO: 1374713 - RNA, 19 nt, Homo sapiens
ucaaagaucugaaagaaac

SEQ ID NO: 1374714 - RNA, 19 nt, Homo sapiens
gaagacgauucccauauuc

SEQ ID NO: 1374715 - RNA, 19 nt, Homo sapiens
auacagagauaaacgagua

SEQ ID NO: 1374716 - RNA, 19 nt, Homo sapiens
ggaggaagaagaagaauau

SEQ ID NO: 1374717 - RNA, 19 nt, Homo sapiens
ggaacaacacugagaauga

SEQ ID NO: 1374718 - RNA, 19 nt, Homo sapiens
cgagaaggcugaguguuaa

SEQ ID NO: 1374719 - RNA, 19 nt, Homo sapiens
gacaggaaauugaacuuga

SEQ ID NO: 1374720 - RNA, 19 nt, Homo sapiens
gcaaggaguguuaucuuaa

SEQ ID NO: 1374721 - RNA, 19 nt, Homo sapiens
gaucaaaccaguaaacuca

SEQ ID NO: 1374722 - RNA, 19 nt, Homo sapiens
ggaaucuacugauaccaaa

SEQ ID NO: 1374723 - RNA, 19 nt, Homo sapiens
gauaaacgaguacaugauu

SEQ ID NO: 1374724 - RNA, 19 nt, Homo sapiens
cgagauagaggacgugaua

SEQ ID NO: 1374725 - RNA, 19 nt, Homo sapiens
gagcucaucuguuagcaau

SEQ ID NO: 1374726 - RNA, 19 nt, Homo sapiens
ggaaguggacagacgauuu

SEQ ID NO: 1374727 - RNA, 19 nt, Homo sapiens
aagaagacauugcuaucua

SEQ ID NO: 1374728 - RNA, 19 nt, Homo sapiens
uguaucaggucauucauaa

SEQ ID NO: 1374729 - RNA, 19 nt, Homo sapiens
ggaggugucuuuaaaauug

SEQ ID NO: 1374730 - RNA, 19 nt, Homo sapiens
gcuucaagaugcaagauuu

SEQ ID NO: 1374731 - RNA, 19 nt, Homo sapiens
guaaagaucggacgugaug

SEQ ID NO: 1374732 - RNA, 19 nt, Homo sapiens
gcauuuagaucugcaagga

SEQ ID NO: 1374733 - RNA, 19 nt, Homo sapiens
gaaagaaacaagcgucuag

SEQ ID NO: 1374734 - RNA, 19 nt, Homo sapiens
auugauaacugccaugaua

SEQ ID NO: 1374735 - RNA, 19 nt, Homo sapiens
uuaaauggguccuacaaug

SEQ ID NO: 1374736 - RNA, 19 nt, Homo sapiens
gagggaauuucauaacaug

SEQ ID NO: 1374737 - RNA, 19 nt, Homo sapiens
ggaaauugaacuugaaugu

SEQ ID NO: 1374738 - RNA, 19 nt, Homo sapiens
caaggaguguuaucuuaau

SEQ ID NO: 1374739 - RNA, 19 nt, Homo sapiens
gcacagauggaucagauga

SEQ ID NO: 1374740 - RNA, 19 nt, Homo sapiens
gagauaaacgaguacauga

SEQ ID NO: 1374741 - RNA, 19 nt, Homo sapiens
gcaggaagcaggcuccauu

SEQ ID NO: 1374742 - RNA, 19 nt, Homo sapiens
ugcaaggaguguuaucuua

SEQ ID NO: 1374743 - RNA, 19 nt, Homo sapiens
aggcauaucuccaauuguu

SEQ ID NO: 1374744 - RNA, 19 nt, Homo sapiens
aaagagagcgauuauguga

SEQ ID NO: 1374745 - RNA, 19 nt, Homo sapiens
cgagaccgcccuagagaua

SEQ ID NO: 1374746 - RNA, 19 nt, Homo sapiens
uaaauggguccuacaauga

SEQ ID NO: 1374747 - RNA, 19 nt, Homo sapiens
ccagagaccaggguauuua

SEQ ID NO: 1374748 - RNA, 19 nt, Homo sapiens
agaagacauugcuaucuaa

SEQ ID NO: 1374749 - RNA, 19 nt, Homo sapiens
acaguugaauugacacuuu

SEQ ID NO: 1374750 - RNA, 19 nt, Homo sapiens
gcuggaugcuggagugaaa

SEQ ID NO: 1374751 - RNA, 19 nt, Homo sapiens
gguccacgcucccuguaaa

SEQ ID NO: 1374752 - RNA, 19 nt, Homo sapiens
gacgagagcaauauuaaga

SEQ ID NO: 1374753 - RNA, 19 nt, Homo sapiens
gaaagagagcgauuaugug

SEQ ID NO: 1374754 - RNA, 19 nt, Homo sapiens
gaacccagcuuugucuucu

SEQ ID NO: 1374755 - RNA, 19 nt, Homo sapiens
gaaaagggauccugaaagg

SEQ ID NO: 1374756 - RNA, 19 nt, Homo sapiens
ucgagaaggcugaguguua

SEQ ID NO: 1374757 - RNA, 19 nt, Homo sapiens
gaaguaugaugguuugacu

SEQ ID NO: 1374758 - RNA, 19 nt, Homo sapiens
gaggguggaugauuuccuu

SEQ ID NO: 1374759 - RNA, 19 nt, Homo sapiens
agaaagaaaccaaggauug

SEQ ID NO: 1374760 - RNA, 19 nt, Homo sapiens
aagaagauguggaggaaga

SEQ ID NO: 1374761 - RNA, 19 nt, Homo sapiens
uaacugaaguaccagaaca

SEQ ID NO: 1374762 - RNA, 19 nt, Homo sapiens
agugaacucugaagaauau

SEQ ID NO: 1374763 - RNA, 19 nt, Homo sapiens
ggaagcaggcuccauuuua

SEQ ID NO: 1374764 - RNA, 19 nt, Homo sapiens
aggaagaagugaacucuga

SEQ ID NO: 1374765 - RNA, 19 nt, Homo sapiens
uagaggacgugauagagaa

SEQ ID NO: 1374766 - RNA, 19 nt, Homo sapiens
gaccagaagauuaugauau

SEQ ID NO: 1374767 - RNA, 19 nt, Homo sapiens
gggaaggcgucgaccagaa

SEQ ID NO: 1374768 - RNA, 19 nt, Homo sapiens
ucaaaccaguaaacucaaa

SEQ ID NO: 1374769 - RNA, 19 nt, Homo sapiens
gaaagaggagggaaaugau

SEQ ID NO: 1374770 - RNA, 19 nt, Homo sapiens
ggaagaugaagaaguagaa

SEQ ID NO: 1374771 - RNA, 19 nt, Homo sapiens
gauaacugccaugauauuu

SEQ ID NO: 1374772 - RNA, 19 nt, Homo sapiens
gagagaggucgauauagaa

SEQ ID NO: 1374773 - RNA, 19 nt, Homo sapiens
agaaagagagcgauuaugu

SEQ ID NO: 1374774 - RNA, 19 nt, Homo sapiens
gaacaaccuccacaacauc

SEQ ID NO: 1374775 - RNA, 19 nt, Homo sapiens
gaaagauggagaacuuaau

SEQ ID NO: 1374776 - RNA, 19 nt, Homo sapiens
guaacaaccaugagaaugu

SEQ ID NO: 1374777 - RNA, 19 nt, Homo sapiens
acaagaugaugaacuguau

SEQ ID NO: 1374778 - RNA, 19 nt, Homo sapiens
ggagggaaaugauuaugac

SEQ ID NO: 1374779 - RNA, 19 nt, Homo sapiens
agaagaauaugaacaggau

SEQ ID NO: 1374780 - RNA, 19 nt, Homo sapiens
uaugaugguuugacuguau

SEQ ID NO: 1374781 - RNA, 19 nt, Homo sapiens
agaacaagaugaugaacug

SEQ ID NO: 1374782 - RNA, 19 nt, Homo sapiens
agaggcauaucuccaauug

SEQ ID NO: 1374783 - RNA, 19 nt, Homo sapiens
ggaggaggaagaagaagaa

SEQ ID NO: 1374784 - RNA, 19 nt, Homo sapiens
gcacugauuguuuaaagau

SEQ ID NO: 1374785 - RNA, 19 nt, Homo sapiens
caacaaacgugaaccgaaa

SEQ ID NO: 1374786 - RNA, 19 nt, Homo sapiens
ucacugacaucuuugaaua

SEQ ID NO: 1374787 - RNA, 19 nt, Homo sapiens
gauagcaacuucaguguau

SEQ ID NO: 1374788 - RNA, 19 nt, Homo sapiens
gagcagagcauuagcagaa

SEQ ID NO: 1374789 - RNA, 19 nt, Homo sapiens
gcccacagcugaagucuau

SEQ ID NO: 1374790 - RNA, 19 nt, Homo sapiens
gaauaacugccacuucuaa

SEQ ID NO: 1374791 - RNA, 19 nt, Homo sapiens
gcuccgggcuaaaugaaua

SEQ ID NO: 1374792 - RNA, 19 nt, Homo sapiens
gugaagcacuugccagaaa

SEQ ID NO: 1374793 - RNA, 19 nt, Homo sapiens
guacuuacauguucuuagu

SEQ ID NO: 1374794 - RNA, 19 nt, Homo sapiens
cagcugaagucuauaauca

SEQ ID NO: 1374795 - RNA, 19 nt, Homo sapiens
gagcugagguaacauaugg

SEQ ID NO: 1374796 - RNA, 19 nt, Homo sapiens
guucuuaguuucugucauu

SEQ ID NO: 1374797 - RNA, 19 nt, Homo sapiens
ggacccacguuucaagauu

SEQ ID NO: 1374798 - RNA, 19 nt, Homo sapiens
gggauugaguguugcuaua

SEQ ID NO: 1374799 - RNA, 19 nt, Homo sapiens
ccagagucuuccauaaaua

SEQ ID NO: 1374800 - RNA, 19 nt, Homo sapiens
ucucggagcuccagaaguu

SEQ ID NO: 1374801 - RNA, 19 nt, Homo sapiens
guccuuaucuuggcuauuu

SEQ ID NO: 1374802 - RNA, 19 nt, Homo sapiens
gguaacauauggcucuuau

SEQ ID NO: 1374803 - RNA, 19 nt, Homo sapiens
uaucuucgguguuucaauu

SEQ ID NO: 1374804 - RNA, 19 nt, Homo sapiens
gggcugggauugaguguug

SEQ ID NO: 1374805 - RNA, 19 nt, Homo sapiens
gcagagcauuagcagaauu

SEQ ID NO: 1374806 - RNA, 19 nt, Homo sapiens
ggagcaagcugcggugguu

SEQ ID NO: 1374807 - RNA, 19 nt, Homo sapiens
cgaaauaucaguagucugu

SEQ ID NO: 1374808 - RNA, 19 nt, Homo sapiens
gcugaagucuauaaucaau

SEQ ID NO: 1374809 - RNA, 19 nt, Homo sapiens
agaaagcucugcucucuag

SEQ ID NO: 1374810 - RNA, 19 nt, Homo sapiens
ucaauuggcauucuggaua

SEQ ID NO: 1374811 - RNA, 19 nt, Homo sapiens
gaaccgaaauaucaguagu

SEQ ID NO: 1374812 - RNA, 19 nt, Homo sapiens
gacccacguuucaagauuu

SEQ ID NO: 1374813 - RNA, 19 nt, Homo sapiens
guuuagagaagauggauua

SEQ ID NO: 1374814 - RNA, 19 nt, Homo sapiens
gaaacgaaugauacaauga

SEQ ID NO: 1374815 - RNA, 19 nt, Homo sapiens
ugaaacgaaugauacaaug

SEQ ID NO: 1374816 - RNA, 19 nt, Homo sapiens
caaaagggacuaacguuua

SEQ ID NO: 1374817 - RNA, 19 nt, Homo sapiens
gcugagacauuucgaagag

SEQ ID NO: 1374818 - RNA, 19 nt, Homo sapiens
gaaaugauugaaacgaaug

SEQ ID NO: 1374819 - RNA, 19 nt, Homo sapiens
gaaagagugaggaccagaa

SEQ ID NO: 1374820 - RNA, 19 nt, Homo sapiens
gaaccaugauuguguugag

SEQ ID NO: 1374821 - RNA, 19 nt, Homo sapiens
agaauuuacugugggcuua

SEQ ID NO: 1374822 - RNA, 19 nt, Homo sapiens
ggucgugccuugggauauu

SEQ ID NO: 1374823 - RNA, 19 nt, Homo sapiens
gucuuuaucuuguuccuuu

SEQ ID NO: 1374824 - RNA, 19 nt, Homo sapiens
ugacaucuuugaauaacug

SEQ ID NO: 1374825 - RNA, 19 nt, Homo sapiens
uagagaagauggauuacuc

SEQ ID NO: 1374826 - RNA, 19 nt, Homo sapiens
ccgccgagcuggaguuaga

SEQ ID NO: 1374827 - RNA, 19 nt, Homo sapiens
ccacagcugaagucuauaa

SEQ ID NO: 1374828 - RNA, 19 nt, Homo sapiens
ggauagcaacuucagugua

SEQ ID NO: 1374829 - RNA, 19 nt, Homo sapiens
gcucuuauguuuucucauu

SEQ ID NO: 1374830 - RNA, 19 nt, Homo sapiens
cagagucuuccauaaauaa

SEQ ID NO: 1374831 - RNA, 19 nt, Homo sapiens
uaucacaacgcccuucuuu

SEQ ID NO: 1374832 - RNA, 19 nt, Homo sapiens
aguagucugucuuucauuu

SEQ ID NO: 1374833 - RNA, 19 nt, Homo sapiens
uuucuuggauugagcagua

SEQ ID NO: 1374834 - RNA, 19 nt, Homo sapiens
gcaauauuacucacuguca

SEQ ID NO: 1374835 - RNA, 19 nt, Homo sapiens
cccagagucuuccauaaau

SEQ ID NO: 1374836 - RNA, 19 nt, Homo sapiens
uaucgguacuuacauguuc

SEQ ID NO: 1374837 - RNA, 19 nt, Homo sapiens
gcacugguguuugagucuu

SEQ ID NO: 1374838 - RNA, 19 nt, Homo sapiens
uaacugccacuucuaagga

SEQ ID NO: 1374839 - RNA, 19 nt, Homo sapiens
gcccuucuuugucuccuuu

SEQ ID NO: 1374840 - RNA, 19 nt, Homo sapiens
gaauagcucaaagcaagaa

SEQ ID NO: 1374841 - RNA, 19 nt, Homo sapiens
uaaagaauagcucaaagca

SEQ ID NO: 1374842 - RNA, 19 nt, Homo sapiens
caaaggagccccacauaug

SEQ ID NO: 1374843 - RNA, 19 nt, Homo sapiens
uugucgaugucaugaauua

SEQ ID NO: 1374844 - RNA, 19 nt, Homo sapiens
guggauuucuugucgaugu

SEQ ID NO: 1374845 - RNA, 19 nt, Homo sapiens
gcuaaaugaauaugaggaa

SEQ ID NO: 1374846 - RNA, 19 nt, Homo sapiens
gcaucaauagcuacuggua

SEQ ID NO: 1374847 - RNA, 19 nt, Homo sapiens
ucaguagucugucuuucau

SEQ ID NO: 1374848 - RNA, 19 nt, Homo sapiens
gcacucaaccaaucaucug

SEQ ID NO: 1374849 - RNA, 19 nt, Homo sapiens
gugguaacguccuuaucuu

SEQ ID NO: 1374850 - RNA, 19 nt, Homo sapiens
caauuggcauucuggauac

SEQ ID NO: 1374851 - RNA, 19 nt, Homo sapiens
cagaauuucaccaugcuuu

SEQ ID NO: 1374852 - RNA, 19 nt, Homo sapiens
gauugaguguugcuauagu

SEQ ID NO: 1374853 - RNA, 19 nt, Homo sapiens
caaggaaaauacccugauu

SEQ ID NO: 1374854 - RNA, 19 nt, Homo sapiens
ggcuauuccugcagucauu

SEQ ID NO: 1374855 - RNA, 19 nt, Homo sapiens
cgagugguguuucuuggau

SEQ ID NO: 1374856 - RNA, 19 nt, Homo sapiens
cccaauuugucucuggaua

SEQ ID NO: 1374857 - RNA, 19 nt, Homo sapiens
caauauuacucacugucau

SEQ ID NO: 1374858 - RNA, 19 nt, Homo sapiens
caagacagcaauauuacuc

SEQ ID NO: 1374859 - RNA, 19 nt, Homo sapiens
auuacucacugacaucuuu

SEQ ID NO: 1374860 - RNA, 19 nt, Homo sapiens
aauaugaggaagagaauga

SEQ ID NO: 1374861 - RNA, 19 nt, Homo sapiens
uggaguaccuaaugauaag

SEQ ID NO: 1374862 - RNA, 19 nt, Homo sapiens
gaagcucuguuuggaguac

SEQ ID NO: 1374863 - RNA, 19 nt, Homo sapiens
uggcuccacugcuagcuaa

SEQ ID NO: 1374864 - RNA, 19 nt, Homo sapiens
ucacugucaugaugccuau

SEQ ID NO: 1374865 - RNA, 19 nt, Homo sapiens
uugaauaacugccacuucu

SEQ ID NO: 1374866 - RNA, 19 nt, Homo sapiens
aaucaauacccaucaaaug

SEQ ID NO: 1374867 - RNA, 19 nt, Homo sapiens
cauuggaauucuucaagga

SEQ ID NO: 1374868 - RNA, 19 nt, Homo sapiens
gcucugugauugguggauu

SEQ ID NO: 1374869 - RNA, 19 nt, Homo sapiens
gaagaggaggaugcagaaa

SEQ ID NO: 1374870 - RNA, 19 nt, Homo sapiens
cagagcauuagcagaauuu

SEQ ID NO: 1374871 - RNA, 19 nt, Homo sapiens
guaguucuguauaccucuu

SEQ ID NO: 1374872 - RNA, 19 nt, Homo sapiens
gagugguguuucuuggauu

SEQ ID NO: 1374873 - RNA, 19 nt, Homo sapiens
agagacaucuagaaguagu

SEQ ID NO: 1374874 - RNA, 19 nt, Homo sapiens
gcuguuaucgguacuuaca

SEQ ID NO: 1374875 - RNA, 19 nt, Homo sapiens
ggugguaacguccuuaucu

SEQ ID NO: 1374876 - RNA, 19 nt, Homo sapiens
uugaguggcucugugauug

SEQ ID NO: 1374877 - RNA, 19 nt, Homo sapiens
gagcauuagcagaauuuca

SEQ ID NO: 1374878 - RNA, 19 nt, Homo sapiens
ugaauaacugccacuucua

SEQ ID NO: 1374879 - RNA, 19 nt, Homo sapiens
acaaacgugaaccgaaaua

SEQ ID NO: 1374880 - RNA, 19 nt, Homo sapiens
gcagugcccaugugaagca

SEQ ID NO: 1374881 - RNA, 19 nt, Homo sapiens
ugaagaggaggaugcagaa

SEQ ID NO: 1374882 - RNA, 19 nt, Homo sapiens
caucaaaugcacugguguu

SEQ ID NO: 1374883 - RNA, 19 nt, Homo sapiens
aaagagugaggaccagaaa

SEQ ID NO: 1374884 - RNA, 19 nt, Homo sapiens
ugauuugccuguaguucug

SEQ ID NO: 1374885 - RNA, 19 nt, Homo sapiens
gcacuuuccuuguacauuu

SEQ ID NO: 1374886 - RNA, 19 nt, Homo sapiens
gaacuucacagcacacuua

SEQ ID NO: 1374887 - RNA, 19 nt, Homo sapiens
ugauugagcuggaauauug

SEQ ID NO: 1374888 - RNA, 19 nt, Homo sapiens
agaaggaacuguacacuug

SEQ ID NO: 1374889 - RNA, 19 nt, Homo sapiens
gaaacuggauguuaucaag

SEQ ID NO: 1374890 - RNA, 19 nt, Homo sapiens
ccauaaagcuggaauccuu

SEQ ID NO: 1374891 - RNA, 19 nt, Homo sapiens
ccagugaagucuauauuug

SEQ ID NO: 1374892 - RNA, 19 nt, Homo sapiens
ggaguaaaguacaauuuca

SEQ ID NO: 1374893 - RNA, 19 nt, Homo sapiens
gaacaagaaauuagaagga

SEQ ID NO: 1374894 - RNA, 19 nt, Homo sapiens
gaaaggagcuggaaaaugc

SEQ ID NO: 1374895 - RNA, 19 nt, Homo sapiens
ucacacagcugcuauugau

SEQ ID NO: 1374896 - RNA, 19 nt, Homo sapiens
gagggaaccuguaugacaa

SEQ ID NO: 1374897 - RNA, 19 nt, Homo sapiens
gaugggacauuucuguuga

SEQ ID NO: 1374898 - RNA, 19 nt, Homo sapiens
ggagagagauggaggaaaa

SEQ ID NO: 1374899 - RNA, 19 nt, Homo sapiens
ccacuuaaccuguguguga

SEQ ID NO: 1374900 - RNA, 19 nt, Homo sapiens
gagcagcuuuccuggcuuu

SEQ ID NO: 1374901 - RNA, 19 nt, Homo sapiens
ccacauggcucugauaucu

SEQ ID NO: 1374902 - RNA, 19 nt, Homo sapiens
uaaagugucuggcugaaca

SEQ ID NO: 1374903 - RNA, 19 nt, Homo sapiens
ggugaugaguuuaccauug

SEQ ID NO: 1374904 - RNA, 19 nt, Homo sapiens
ccaaacaguuguccuuuua

SEQ ID NO: 1374905 - RNA, 19 nt, Homo sapiens
caaaguugcuggcccugaa

SEQ ID NO: 1374906 - RNA, 19 nt, Homo sapiens
gagcuggaauauuguaaug

SEQ ID NO: 1374907 - RNA, 19 nt, Homo sapiens
uauaagauccguaccauug

SEQ ID NO: 1374908 - RNA, 19 nt, Homo sapiens
ucaauaagcugggucugaa

SEQ ID NO: 1374909 - RNA, 19 nt, Homo sapiens
gaaacaaggaagucuauuc

SEQ ID NO: 1374910 - RNA, 19 nt, Homo sapiens
ccaguacucuuuggaauug

SEQ ID NO: 1374911 - RNA, 19 nt, Homo sapiens
gaagaucgugcaaggaauu

SEQ ID NO: 1374912 - RNA, 19 nt, Homo sapiens
gaacucagacagcaaagga

SEQ ID NO: 1374913 - RNA, 19 nt, Homo sapiens
cugaagcacuuuccuugua

SEQ ID NO: 1374914 - RNA, 19 nt, Homo sapiens
aagauacccugcccuauga

SEQ ID NO: 1374915 - RNA, 19 nt, Homo sapiens
gaccaaggcaaaccugaua

SEQ ID NO: 1374916 - RNA, 19 nt, Homo sapiens
ggaaggaagucgauuugac

SEQ ID NO: 1374917 - RNA, 19 nt, Homo sapiens
caagaaaaccuccagauuu

SEQ ID NO: 1374918 - RNA, 19 nt, Homo sapiens
ggaauggaagguuuaauca

SEQ ID NO: 1374919 - RNA, 19 nt, Homo sapiens
ggaagcagaccgaggaaug

SEQ ID NO: 1374920 - RNA, 19 nt, Homo sapiens
gaaguucccuacacaacgu

SEQ ID NO: 1374921 - RNA, 19 nt, Homo sapiens
gaacugcuuaccuuaaaga

SEQ ID NO: 1374922 - RNA, 19 nt, Homo sapiens
gcuggaauauuguaaugga

SEQ ID NO: 1374923 - RNA, 19 nt, Homo sapiens
ggagggaaccuguaugaca

SEQ ID NO: 1374924 - RNA, 19 nt, Homo sapiens
ggacucaaugaauucaaua

SEQ ID NO: 1374925 - RNA, 19 nt, Homo sapiens
cuacuacaaucacuucaug

SEQ ID NO: 1374926 - RNA, 19 nt, Homo sapiens
ggaauuaucaaccaugaag

SEQ ID NO: 1374927 - RNA, 19 nt, Homo sapiens
ccuguggacucaaugaauu

SEQ ID NO: 1374928 - RNA, 19 nt, Homo sapiens
cagaagaggauuauuauac

SEQ ID NO: 1374929 - RNA, 19 nt, Homo sapiens
ccaugcagcugaacuucuu

SEQ ID NO: 1374930 - RNA, 19 nt, Homo sapiens
guaguaacaucacgaacca

SEQ ID NO: 1374931 - RNA, 19 nt, Homo sapiens
cgugaugccuugaaugaga

SEQ ID NO: 1374932 - RNA, 19 nt, Homo sapiens
aggaagagauggaaaugga

SEQ ID NO: 1374933 - RNA, 19 nt, Homo sapiens
cugcagaaguugaacaaga

SEQ ID NO: 1374934 - RNA, 19 nt, Homo sapiens
agacaaagccuccuaucga

SEQ ID NO: 1374935 - RNA, 19 nt, Homo sapiens
ggaauugauccaaaugguu

SEQ ID NO: 1374936 - RNA, 19 nt, Homo sapiens
auaccacgcugcugauuga

SEQ ID NO: 1374937 - RNA, 19 nt, Homo sapiens
ugacuuagauucagauucc

SEQ ID NO: 1374938 - RNA, 19 nt, Homo sapiens
caaaggaagagauggaaau

SEQ ID NO: 1374939 - RNA, 19 nt, Homo sapiens
gcagaugaacuucuagauc

SEQ ID NO: 1374940 - RNA, 19 nt, Homo sapiens
gauuauggccuagcaaaga

SEQ ID NO: 1374941 - RNA, 19 nt, Homo sapiens
gagauuauggccuagcaaa

SEQ ID NO: 1374942 - RNA, 19 nt, Homo sapiens
gagaaggaacgucgugaug

SEQ ID NO: 1374943 - RNA, 19 nt, Homo sapiens
aacagaagcuacagcaaga

SEQ ID NO: 1374944 - RNA, 19 nt, Homo sapiens
gcaggucugugcagggaau

SEQ ID NO: 1374945 - RNA, 19 nt, Homo sapiens
uaaugcaccuacaaagaga

SEQ ID NO: 1374946 - RNA, 19 nt, Homo sapiens
caacauuauugccuacuac

SEQ ID NO: 1374947 - RNA, 19 nt, Homo sapiens
gcaaaggaagagauggaaa

SEQ ID NO: 1374948 - RNA, 19 nt, Homo sapiens
aaagauacccugcccuaug

SEQ ID NO: 1374949 - RNA, 19 nt, Homo sapiens
caaagcauguggaaaaguu

SEQ ID NO: 1374950 - RNA, 19 nt, Homo sapiens
gcugggccauggagacaaa

SEQ ID NO: 1374951 - RNA, 19 nt, Homo sapiens
gagaaggaacuguacacuu

SEQ ID NO: 1374952 - RNA, 19 nt, Homo sapiens
gaaccagugaagucuauau

SEQ ID NO: 1374953 - RNA, 19 nt, Homo sapiens
ggaauccuucauagagaua

SEQ ID NO: 1374954 - RNA, 19 nt, Homo sapiens
gcauaccauucucaucguu

SEQ ID NO: 1374955 - RNA, 19 nt, Homo sapiens
gaagaggauuauuauacac

SEQ ID NO: 1374956 - RNA, 19 nt, Homo sapiens
ccauggaaguugacucuag

SEQ ID NO: 1374957 - RNA, 19 nt, Homo sapiens
gugaagaucgugcaaggaa

SEQ ID NO: 1374958 - RNA, 19 nt, Homo sapiens
ucugauaucugggcaguug

SEQ ID NO: 1374959 - RNA, 19 nt, Homo sapiens
guaccuauuucagauuguu

SEQ ID NO: 1374960 - RNA, 19 nt, Homo sapiens
gauaggaucuaggagugau

SEQ ID NO: 1374961 - RNA, 19 nt, Homo sapiens
cagcuuuccuggcuuuguu

SEQ ID NO: 1374962 - RNA, 19 nt, Homo sapiens
ugacccggcugucugagaa

SEQ ID NO: 1374963 - RNA, 19 nt, Homo sapiens
ugcagaaguugaacaagaa

SEQ ID NO: 1374964 - RNA, 19 nt, Homo sapiens
gggaagggaacaccacuga

SEQ ID NO: 1374965 - RNA, 19 nt, Homo sapiens
cagugcaugucgggaauua

SEQ ID NO: 1374966 - RNA, 19 nt, Homo sapiens
gaacuucuuccucagcaau

SEQ ID NO: 1374967 - RNA, 19 nt, Homo sapiens
gcaaggaggcacuaaacuc

SEQ ID NO: 1374968 - RNA, 19 nt, Homo sapiens
gaaccuguaugacaaaauc

SEQ ID NO: 1374969 - RNA, 19 nt, Homo sapiens
caaaguggccucugaagcu

SEQ ID NO: 1374970 - RNA, 19 nt, Homo sapiens
aauggaagguuuaaucagu

SEQ ID NO: 1374971 - RNA, 19 nt, Homo sapiens
acacagcugcuauugauga

SEQ ID NO: 1374972 - RNA, 19 nt, Homo sapiens
uaucaaccaugaagcauac

SEQ ID NO: 1374973 - RNA, 19 nt, Homo sapiens
uuaaagaggacguuugaug

SEQ ID NO: 1374974 - RNA, 19 nt, Homo sapiens
gaagggaacaccacugacu

SEQ ID NO: 1374975 - RNA, 19 nt, Homo sapiens
gaaagauacccugcccuau

SEQ ID NO: 1374976 - RNA, 19 nt, Homo sapiens
agcaguggcuuauccauug

SEQ ID NO: 1374977 - RNA, 19 nt, Homo sapiens
ugaagcauaccaugaaguu

SEQ ID NO: 1374978 - RNA, 19 nt, Homo sapiens
cuagaucgcccucuucuca

SEQ ID NO: 1374979 - RNA, 19 nt, Homo sapiens
gaugcuacaaacccacuua

SEQ ID NO: 1374980 - RNA, 19 nt, Homo sapiens
gcaagaaaaccuccagauu

SEQ ID NO: 1374981 - RNA, 19 nt, Homo sapiens
gauuauuguugcaguucaa

SEQ ID NO: 1374982 - RNA, 19 nt, Homo sapiens
ggacgacuggguuuggauu

SEQ ID NO: 1374983 - RNA, 19 nt, Homo sapiens
gcagcacgacaacauuauu

SEQ ID NO: 1374984 - RNA, 19 nt, Homo sapiens
uugaacugcuuaccuuaaa

SEQ ID NO: 1374985 - RNA, 19 nt, Homo sapiens
gagcagcacuuacuuacua

SEQ ID NO: 1374986 - RNA, 19 nt, Homo sapiens
gcagugaguuugaaagaga

SEQ ID NO: 1374987 - RNA, 19 nt, Homo sapiens
ggaauucgcccuccacuug

SEQ ID NO: 1374988 - RNA, 19 nt, Homo sapiens
gaucuucccuuccuacaug

SEQ ID NO: 1374989 - RNA, 19 nt, Homo sapiens
gcaagaauauaugcugauu

SEQ ID NO: 1374990 - RNA, 19 nt, Homo sapiens
ggagaaguuuccucacauu

SEQ ID NO: 1374991 - RNA, 19 nt, Homo sapiens
caaagagugugccaaucua

SEQ ID NO: 1374992 - RNA, 19 nt, Homo sapiens
ugacaacagugauugacua

SEQ ID NO: 1374993 - RNA, 19 nt, Homo sapiens
gggcugccaugcaagaaua

SEQ ID NO: 1374994 - RNA, 19 nt, Homo sapiens
gagaacugauugccuuuga

SEQ ID NO: 1374995 - RNA, 19 nt, Homo sapiens
gaauuaaacucuuguugcu

SEQ ID NO: 1374996 - RNA, 19 nt, Homo sapiens
gaacaggcgagaacugauu

SEQ ID NO: 1374997 - RNA, 19 nt, Homo sapiens
gaaguuuccucacauuaag

SEQ ID NO: 1374998 - RNA, 19 nt, Homo sapiens
gaagucaagcauuuaauug

SEQ ID NO: 1374999 - RNA, 19 nt, Homo sapiens
ccagaucuguuccaacuug

SEQ ID NO: 1375000 - RNA, 19 nt, Homo sapiens
gggagaagcaguacuagaa

SEQ ID NO: 1375001 - RNA, 19 nt, Homo sapiens
gaagagagucugcagaagu

SEQ ID NO: 1375002 - RNA, 19 nt, Homo sapiens
ggcgguggcucuuucuuaa

SEQ ID NO: 1375003 - RNA, 19 nt, Homo sapiens
cuagaugauuucuggauaa

SEQ ID NO: 1375004 - RNA, 19 nt, Homo sapiens
gagaaguuuccucacauua

SEQ ID NO: 1375005 - RNA, 19 nt, Homo sapiens
gagacuuuauggacuauga

SEQ ID NO: 1375006 - RNA, 19 nt, Homo sapiens
gaaguuggacggaggaaga

SEQ ID NO: 1375007 - RNA, 19 nt, Homo sapiens
gcaagugucugagagauac

SEQ ID NO: 1375008 - RNA, 19 nt, Homo sapiens
gugaagggcuugagcauac

SEQ ID NO: 1375009 - RNA, 19 nt, Homo sapiens
ccucggaucucaagaagga

SEQ ID NO: 1375010 - RNA, 19 nt, Homo sapiens
uaccaggaauggcagaaua

SEQ ID NO: 1375011 - RNA, 19 nt, Homo sapiens
aaagauacccucauugugu

SEQ ID NO: 1375012 - RNA, 19 nt, Homo sapiens
gcauuuaauugacaaacug

SEQ ID NO: 1375013 - RNA, 19 nt, Homo sapiens
uggaagauauugaggagaa

SEQ ID NO: 1375014 - RNA, 19 nt, Homo sapiens
gagagccuguggccaugua

SEQ ID NO: 1375015 - RNA, 19 nt, Homo sapiens
gaaggcgaguucugagugu

SEQ ID NO: 1375016 - RNA, 19 nt, Homo sapiens
aggcugaccuucaacaauu

SEQ ID NO: 1375017 - RNA, 19 nt, Homo sapiens
caagggccauuucuucuca

SEQ ID NO: 1375018 - RNA, 19 nt, Homo sapiens
gaacugauugccuuugaau

SEQ ID NO: 1375019 - RNA, 19 nt, Homo sapiens
caacagugauugacuacgu

SEQ ID NO: 1375020 - RNA, 19 nt, Homo sapiens
ggagaagcaguacuagaaa

SEQ ID NO: 1375021 - RNA, 19 nt, Homo sapiens
ccaguggccuuguggcaaa

SEQ ID NO: 1375022 - RNA, 19 nt, Homo sapiens
ggacggaggaagacaauca

SEQ ID NO: 1375023 - RNA, 19 nt, Homo sapiens
aagagagucugcagaaguu

SEQ ID NO: 1375024 - RNA, 19 nt, Homo sapiens
gcuauggacuccucaagca

SEQ ID NO: 1375025 - RNA, 19 nt, Homo sapiens
ggauaaagaaggcgaguuc

SEQ ID NO: 1375026 - RNA, 19 nt, Homo sapiens
aagcaguacuagaaacuuu

SEQ ID NO: 1375027 - RNA, 19 nt, Homo sapiens
gggaagagagucugcagaa

SEQ ID NO: 1375028 - RNA, 19 nt, Homo sapiens
cgaagucaagcauuuaauu

SEQ ID NO: 1375029 - RNA, 19 nt, Homo sapiens
gcaacacgauaccaggaau

SEQ ID NO: 1375030 - RNA, 19 nt, Homo sapiens
ggcugaccuucaacaauua

SEQ ID NO: 1375031 - RNA, 19 nt, Homo sapiens
guagugaccugggagacuu

SEQ ID NO: 1375032 - RNA, 19 nt, Homo sapiens
ucuagaugauuucuggaua

SEQ ID NO: 1375033 - RNA, 19 nt, Homo sapiens
ugguuaagcugacuaagga

SEQ ID NO: 1375034 - RNA, 19 nt, Homo sapiens
gaacaugcggcaacacgau

SEQ ID NO: 1375035 - RNA, 19 nt, Homo sapiens
caagaggagccaugagcua

SEQ ID NO: 1375036 - RNA, 19 nt, Homo sapiens
caauuucuguuacccacaa

SEQ ID NO: 1375037 - RNA, 19 nt, Homo sapiens
ggaggaagacaaucaacug

SEQ ID NO: 1375038 - RNA, 19 nt, Homo sapiens
gagaauuaaacucuuguug

SEQ ID NO: 1375039 - RNA, 19 nt, Homo sapiens
gagaagcaguacuagaaac

SEQ ID NO: 1375040 - RNA, 19 nt, Homo sapiens
agaaguuuccucacauuaa

SEQ ID NO: 1375041 - RNA, 19 nt, Homo sapiens
uggagacccuggaagauau

SEQ ID NO: 1375042 - RNA, 19 nt, Homo sapiens
ggaagagagucugcagaag

SEQ ID NO: 1375043 - RNA, 19 nt, Homo sapiens
gaacucagaauaccagacu

SEQ ID NO: 1375044 - RNA, 19 nt, Homo sapiens
ggacagccaagggccauuu

SEQ ID NO: 1375045 - RNA, 19 nt, Homo sapiens
ggccauuucuucucagcuu

SEQ ID NO: 1375046 - RNA, 19 nt, Homo sapiens
ucugagagauacugcauca

SEQ ID NO: 1375047 - RNA, 19 nt, Homo sapiens
gaggaggugugugcugaga

SEQ ID NO: 1375048 - RNA, 19 nt, Homo sapiens
aacacgaagucaagcauuu

SEQ ID NO: 1375049 - RNA, 19 nt, Homo sapiens
gaucauuggucuggaaggu

SEQ ID NO: 1375050 - RNA, 19 nt, Homo sapiens
gagagaggcaccagcugaa

SEQ ID NO: 1375051 - RNA, 19 nt, Homo sapiens
cagaauaguccuuaucagu

SEQ ID NO: 1375052 - RNA, 19 nt, Homo sapiens
guauuuaacccucgcacuu

SEQ ID NO: 1375053 - RNA, 19 nt, Homo sapiens
ggaggugugugcugagaac

SEQ ID NO: 1375054 - RNA, 19 nt, Homo sapiens
gugaagcccucggaucuca

SEQ ID NO: 1375055 - RNA, 19 nt, Homo sapiens
caaacgcguucugaucuuc

SEQ ID NO: 1375056 - RNA, 19 nt, Homo sapiens
agagugugccaaucuauuu

SEQ ID NO: 1375057 - RNA, 19 nt, Homo sapiens
acacgaagucaagcauuua

SEQ ID NO: 1375058 - RNA, 19 nt, Homo sapiens
ugggagacuuuauggacua

SEQ ID NO: 1375059 - RNA, 19 nt, Homo sapiens
ucacccagaccaaagaauu

SEQ ID NO: 1375060 - RNA, 19 nt, Homo sapiens
guauuccuguccucuaugu

SEQ ID NO: 1375061 - RNA, 19 nt, Homo sapiens
uugacaaacuggaagagaa

SEQ ID NO: 1375062 - RNA, 19 nt, Homo sapiens
aauuggaagugaccucaaa

SEQ ID NO: 1375063 - RNA, 19 nt, Homo sapiens
gggaaacucaacaaacaga

SEQ ID NO: 1375064 - RNA, 19 nt, Homo sapiens
cuacaugacaacagugauu

SEQ ID NO: 1375065 - RNA, 19 nt, Homo sapiens
agagaucauuggucuggaa

SEQ ID NO: 1375066 - RNA, 19 nt, Homo sapiens
gcagaauaguccuuaucag

SEQ ID NO: 1375067 - RNA, 19 nt, Homo sapiens
guguauuccuguccucuau

SEQ ID NO: 1375068 - RNA, 19 nt, Homo sapiens
ugacugacauuguuuuguu

SEQ ID NO: 1375069 - RNA, 19 nt, Homo sapiens
ucaagaacaugcggcaaca

SEQ ID NO: 1375070 - RNA, 19 nt, Homo sapiens
ucaaagagugugccaaucu

SEQ ID NO: 1375071 - RNA, 19 nt, Homo sapiens
ggugugugcugagaacaga

SEQ ID NO: 1375072 - RNA, 19 nt, Homo sapiens
guggagcagcacuuacuua

SEQ ID NO: 1375073 - RNA, 19 nt, Homo sapiens
ggaggacuguggccuugag

SEQ ID NO: 1375074 - RNA, 19 nt, Homo sapiens
ucaagaaggacaugaacga

SEQ ID NO: 1375075 - RNA, 19 nt, Homo sapiens
aaacacaaacgcguucuga

SEQ ID NO: 1375076 - RNA, 19 nt, Homo sapiens
gcugaugggaagacuguuu

SEQ ID NO: 1375077 - RNA, 19 nt, Homo sapiens
ggaaacucaacaaacagaa

SEQ ID NO: 1375078 - RNA, 19 nt, Homo sapiens
acaaacgcguucugaucuu

SEQ ID NO: 1375079 - RNA, 19 nt, Homo sapiens
guuaguggccuuggaauuc

SEQ ID NO: 1375080 - RNA, 19 nt, Homo sapiens
acacaaacgcguucugauc

SEQ ID NO: 1375081 - RNA, 19 nt, Homo sapiens
acgcaugauugguguuuga

SEQ ID NO: 1375082 - RNA, 19 nt, Homo sapiens
gcguggcgcucuguaacuu

SEQ ID NO: 1375083 - RNA, 19 nt, Homo sapiens
ggcagaauaguccuuauca

SEQ ID NO: 1375084 - RNA, 19 nt, Homo sapiens
uuccuugaaugcuuucuaa

SEQ ID NO: 1375085 - RNA, 19 nt, Homo sapiens
gcaaagacauggaauuuua

SEQ ID NO: 1375086 - RNA, 19 nt, Homo sapiens
gaacucugcugccuucuuu

SEQ ID NO: 1375087 - RNA, 19 nt, Homo sapiens
aaagaaagcccaagaagua

SEQ ID NO: 1375088 - RNA, 19 nt, Homo sapiens
gaagacagaugcuugaagu

SEQ ID NO: 1375089 - RNA, 19 nt, Homo sapiens
gaaggaaaguuagacguaa

SEQ ID NO: 1375090 - RNA, 19 nt, Homo sapiens
ggaaaucuguaaauggaaa

SEQ ID NO: 1375091 - RNA, 19 nt, Homo sapiens
ggaauugacuuuuguguaa

SEQ ID NO: 1375092 - RNA, 19 nt, Homo sapiens
aaagaaugcuacgguauua

SEQ ID NO: 1375093 - RNA, 19 nt, Homo sapiens
cgacagcaguggacaguuu

SEQ ID NO: 1375094 - RNA, 19 nt, Homo sapiens
guagaguguuuguagcuua

SEQ ID NO: 1375095 - RNA, 19 nt, Homo sapiens
agacguaacuucuaauuuc

SEQ ID NO: 1375096 - RNA, 19 nt, Homo sapiens
guuuguagcuuaucuggua

SEQ ID NO: 1375097 - RNA, 19 nt, Homo sapiens
gaacacagugguugccaua

SEQ ID NO: 1375098 - RNA, 19 nt, Homo sapiens
gcuaaugaguguauuugaa

SEQ ID NO: 1375099 - RNA, 19 nt, Homo sapiens
gaucuggacuuaauaugau

SEQ ID NO: 1375100 - RNA, 19 nt, Homo sapiens
gaggaacaccuucaaguuu

SEQ ID NO: 1375101 - RNA, 19 nt, Homo sapiens
ggaagggacuggaggaauc

SEQ ID NO: 1375102 - RNA, 19 nt, Homo sapiens
gcagcagaauuacccauuu

SEQ ID NO: 1375103 - RNA, 19 nt, Homo sapiens
gaaaaguggugcauuuauu

SEQ ID NO: 1375104 - RNA, 19 nt, Homo sapiens
guaagcaucucuucuugga

SEQ ID NO: 1375105 - RNA, 19 nt, Homo sapiens
ggaaggaaaguuagacgua

SEQ ID NO: 1375106 - RNA, 19 nt, Homo sapiens
uagcuuaucugguaaagga

SEQ ID NO: 1375107 - RNA, 19 nt, Homo sapiens
gcacacccauucucucaug

SEQ ID NO: 1375108 - RNA, 19 nt, Homo sapiens
caaagaugcuaaugagugu

SEQ ID NO: 1375109 - RNA, 19 nt, Homo sapiens
acagagugcuuacaaagaa

SEQ ID NO: 1375110 - RNA, 19 nt, Homo sapiens
cuacauuuguuccagauuu

SEQ ID NO: 1375111 - RNA, 19 nt, Homo sapiens
guagacagaugaagaaacu

SEQ ID NO: 1375112 - RNA, 19 nt, Homo sapiens
cuaaggaucacuuguagua

SEQ ID NO: 1375113 - RNA, 19 nt, Homo sapiens
uaaugguccuuacgcuuua

SEQ ID NO: 1375114 - RNA, 19 nt, Homo sapiens
gagaugacugcccuuaaua

SEQ ID NO: 1375115 - RNA, 19 nt, Homo sapiens
acaacauccugcucaaaua

SEQ ID NO: 1375116 - RNA, 19 nt, Homo sapiens
gcaaugguuugaauaccuu

SEQ ID NO: 1375117 - RNA, 19 nt, Homo sapiens
guagaacucuuaacugcau

SEQ ID NO: 1375118 - RNA, 19 nt, Homo sapiens
gaaugugggucccuuccuu

SEQ ID NO: 1375119 - RNA, 19 nt, Homo sapiens
uuauaaagcuguggaaguu

SEQ ID NO: 1375120 - RNA, 19 nt, Homo sapiens
uaaaggaaauugagugcau

SEQ ID NO: 1375121 - RNA, 19 nt, Homo sapiens
cagaugaaguuauugugaa

SEQ ID NO: 1375122 - RNA, 19 nt, Homo sapiens
gcauuuauuuggugacuca

SEQ ID NO: 1375123 - RNA, 19 nt, Homo sapiens
aagcaucucuucuuggaaa

SEQ ID NO: 1375124 - RNA, 19 nt, Homo sapiens
gaaguaugguggagacuac

SEQ ID NO: 1375125 - RNA, 19 nt, Homo sapiens
gcaagaagaauuguauaga

SEQ ID NO: 1375126 - RNA, 19 nt, Homo sapiens
gagcugugauagauuauag

SEQ ID NO: 1375127 - RNA, 19 nt, Homo sapiens
gagaaagcuuauagucaga

SEQ ID NO: 1375128 - RNA, 19 nt, Homo sapiens
agaugacccuggcccauua

SEQ ID NO: 1375129 - RNA, 19 nt, Homo sapiens
uaaagaaugcuacgguauu

SEQ ID NO: 1375130 - RNA, 19 nt, Homo sapiens
gaaauuugaggguuuagga

SEQ ID NO: 1375131 - RNA, 19 nt, Homo sapiens
gaauuagcuucuccuagga

SEQ ID NO: 1375132 - RNA, 19 nt, Homo sapiens
cagauuuaguggaguuuaa

SEQ ID NO: 1375133 - RNA, 19 nt, Homo sapiens
gacagggucuauuucaaga

SEQ ID NO: 1375134 - RNA, 19 nt, Homo sapiens
agaagaaugggucaaauaa

SEQ ID NO: 1375135 - RNA, 19 nt, Homo sapiens
gacagaugcuugaaguaug

SEQ ID NO: 1375136 - RNA, 19 nt, Homo sapiens
ggaccaauuucuucaaacu

SEQ ID NO: 1375137 - RNA, 19 nt, Homo sapiens
cagacaauguggaccaauu

SEQ ID NO: 1375138 - RNA, 19 nt, Homo sapiens
acagaugcuugaaguauga

SEQ ID NO: 1375139 - RNA, 19 nt, Homo sapiens
ggaguacauuggugugaug

SEQ ID NO: 1375140 - RNA, 19 nt, Homo sapiens
gcacaaguaauccaucuuc

SEQ ID NO: 1375141 - RNA, 19 nt, Homo sapiens
gaagaaugggucaaauaau

SEQ ID NO: 1375142 - RNA, 19 nt, Homo sapiens
uagaagaaugggucaaaua

SEQ ID NO: 1375143 - RNA, 19 nt, Homo sapiens
uuugagcugugauagauua

SEQ ID NO: 1375144 - RNA, 19 nt, Homo sapiens
ggagcaagaagaauuguau

SEQ ID NO: 1375145 - RNA, 19 nt, Homo sapiens
aaagaaaaguggugcauuu

SEQ ID NO: 1375146 - RNA, 19 nt, Homo sapiens
caacauuacagagugcuua

SEQ ID NO: 1375147 - RNA, 19 nt, Homo sapiens
uaacugggacuauaggauu

SEQ ID NO: 1375148 - RNA, 19 nt, Homo sapiens
gaaugcuacgguauuauaa

SEQ ID NO: 1375149 - RNA, 19 nt, Homo sapiens
uaaccaaagaugcuaauga

SEQ ID NO: 1375150 - RNA, 19 nt, Homo sapiens
agagaugacugcccuuaau

SEQ ID NO: 1375151 - RNA, 19 nt, Homo sapiens
agaaccagcuggacauguu

SEQ ID NO: 1375152 - RNA, 19 nt, Homo sapiens
gugcuggucaucaauguua

SEQ ID NO: 1375153 - RNA, 19 nt, Homo sapiens
uaaggguacuagcaggaua

SEQ ID NO: 1375154 - RNA, 19 nt, Homo sapiens
gaucacuuguaguaucuga

SEQ ID NO: 1375155 - RNA, 19 nt, Homo sapiens
gaaacuaacagucuagaac

SEQ ID NO: 1375156 - RNA, 19 nt, Homo sapiens
gagcaagaagaauuguaua

SEQ ID NO: 1375157 - RNA, 19 nt, Homo sapiens
uagaguacuuggaccauga

SEQ ID NO: 1375158 - RNA, 19 nt, Homo sapiens
ugaaucaacugcagucucu

SEQ ID NO: 1375159 - RNA, 19 nt, Homo sapiens
gaagaagcugcuauuccua

SEQ ID NO: 1375160 - RNA, 19 nt, Homo sapiens
gcuuuggaauugauauuug

SEQ ID NO: 1375161 - RNA, 19 nt, Homo sapiens
gggacaaguuugguuggua

SEQ ID NO: 1375162 - RNA, 19 nt, Homo sapiens
gaccugaguuacagaaagu

SEQ ID NO: 1375163 - RNA, 19 nt, Homo sapiens
cagaauuacccauuucaaa

SEQ ID NO: 1375164 - RNA, 19 nt, Homo sapiens
uuaaguugcuccuaaguag

SEQ ID NO: 1375165 - RNA, 19 nt, Homo sapiens
ccacuaguuucagguguuu

SEQ ID NO: 1375166 - RNA, 19 nt, Homo sapiens
agaaugcuacgguauuaua

SEQ ID NO: 1375167 - RNA, 19 nt, Homo sapiens
ggaaauaugaaagcaguau

SEQ ID NO: 1375168 - RNA, 19 nt, Homo sapiens
caucaauguuacucaggua

SEQ ID NO: 1375169 - RNA, 19 nt, Homo sapiens
gauagaagcaaaugaaacu

SEQ ID NO: 1375170 - RNA, 19 nt, Homo sapiens
uaaguagacagaugaagaa

SEQ ID NO: 1375171 - RNA, 19 nt, Homo sapiens
uaguuuaaguugcuccuaa

SEQ ID NO: 1375172 - RNA, 19 nt, Homo sapiens
ccuacuggcuaucuaagaa

SEQ ID NO: 1375173 - RNA, 19 nt, Homo sapiens
gacuauaggauuucuuuga

SEQ ID NO: 1375174 - RNA, 19 nt, Homo sapiens
gaguuucucuugaugaucu

SEQ ID NO: 1375175 - RNA, 19 nt, Homo sapiens
caaagaaagcccaagaagu

SEQ ID NO: 1375176 - RNA, 19 nt, Homo sapiens
guacauuggugugaugauc

SEQ ID NO: 1375177 - RNA, 19 nt, Homo sapiens
uaagaugcgucaguuuaau

SEQ ID NO: 1375178 - RNA, 19 nt, Homo sapiens
cugaguaacugggacuaua

SEQ ID NO: 1375179 - RNA, 19 nt, Homo sapiens
cagcagaauuacccauuuc

SEQ ID NO: 1375180 - RNA, 19 nt, Homo sapiens
cagcuacuuugucaucuug

SEQ ID NO: 1375181 - RNA, 19 nt, Homo sapiens
ugacaggaauuagccgaaa

SEQ ID NO: 1375182 - RNA, 19 nt, Homo sapiens
aaucugugcuuuggaauug

SEQ ID NO: 1375183 - RNA, 19 nt, Homo sapiens
ugacuuagccaugguagaa

SEQ ID NO: 1375184 - RNA, 19 nt, Homo sapiens
ggacuuaauaugaugacuu

SEQ ID NO: 1375185 - RNA, 19 nt, Homo sapiens
ggacuuagcugccauuuua

SEQ ID NO: 1375186 - RNA, 19 nt, Homo sapiens
gagcagaggagaagaauuu

SEQ ID NO: 1375187 - RNA, 19 nt, Homo sapiens
gcaccgggcucucugaauu

SEQ ID NO: 1375188 - RNA, 19 nt, Homo sapiens
gggagaagauugugaaguu

SEQ ID NO: 1375189 - RNA, 19 nt, Homo sapiens
gcagagagguguaaagaag

SEQ ID NO: 1375190 - RNA, 19 nt, Homo sapiens
gaaaggagaaccacugauu

SEQ ID NO: 1375191 - RNA, 19 nt, Homo sapiens
gaagagaaacaaucacuau

SEQ ID NO: 1375192 - RNA, 19 nt, Homo sapiens
gugaagaacuggagaagga

SEQ ID NO: 1375193 - RNA, 19 nt, Homo sapiens
acaagaaacucucagaaug

SEQ ID NO: 1375194 - RNA, 19 nt, Homo sapiens
gaaggacccucauguaaaa

SEQ ID NO: 1375195 - RNA, 19 nt, Homo sapiens
ggagaagauugugaaguuu

SEQ ID NO: 1375196 - RNA, 19 nt, Homo sapiens
ggagguguaucgucuguau

SEQ ID NO: 1375197 - RNA, 19 nt, Homo sapiens
gguaacaaauggcuuagau

SEQ ID NO: 1375198 - RNA, 19 nt, Homo sapiens
caaggucucuccagucaau

SEQ ID NO: 1375199 - RNA, 19 nt, Homo sapiens
ccacuugauuucacuggua

SEQ ID NO: 1375200 - RNA, 19 nt, Homo sapiens
ggaccugccuucucaucuu

SEQ ID NO: 1375201 - RNA, 19 nt, Homo sapiens
gccaggaugugcaauagaa

SEQ ID NO: 1375202 - RNA, 19 nt, Homo sapiens
gcacucaaacucuccauga

SEQ ID NO: 1375203 - RNA, 19 nt, Homo sapiens
ucaaguggacucuuucuaa

SEQ ID NO: 1375204 - RNA, 19 nt, Homo sapiens
gcugggagauaauaagguu

SEQ ID NO: 1375205 - RNA, 19 nt, Homo sapiens
ggaagaggcccagucacua

SEQ ID NO: 1375206 - RNA, 19 nt, Homo sapiens
gcuaaugucaguuaaauag

SEQ ID NO: 1375207 - RNA, 19 nt, Homo sapiens
gugaaggacccucauguaa

SEQ ID NO: 1375208 - RNA, 19 nt, Homo sapiens
gaccugccuucucaucuuu

SEQ ID NO: 1375209 - RNA, 19 nt, Homo sapiens
caagaaacucucagaaugu

SEQ ID NO: 1375210 - RNA, 19 nt, Homo sapiens
gccaaggucucuccaguca

SEQ ID NO: 1375211 - RNA, 19 nt, Homo sapiens
ugaaggacccucauguaaa

SEQ ID NO: 1375212 - RNA, 19 nt, Homo sapiens
ucacaguccucgagcagaa

SEQ ID NO: 1375213 - RNA, 19 nt, Homo sapiens
ucaaugaauuucucuccaa

SEQ ID NO: 1375214 - RNA, 19 nt, Homo sapiens
gaacaagccacacaacaac

SEQ ID NO: 1375215 - RNA, 19 nt, Homo sapiens
caucauggaguaacuuaaa

SEQ ID NO: 1375216 - RNA, 19 nt, Homo sapiens
gaaacucucagaauguguu

SEQ ID NO: 1375217 - RNA, 19 nt, Homo sapiens
ccagacagaucagaugguu

SEQ ID NO: 1375218 - RNA, 19 nt, Homo sapiens
ccucucaaguggacucuuu

SEQ ID NO: 1375219 - RNA, 19 nt, Homo sapiens
guaggacccucaagugaag

SEQ ID NO: 1375220 - RNA, 19 nt, Homo sapiens
cagagagccucguggauca

SEQ ID NO: 1375221 - RNA, 19 nt, Homo sapiens
acacuuagauuugucuuca

SEQ ID NO: 1375222 - RNA, 19 nt, Homo sapiens
gagaaaggagaaccacuga

SEQ ID NO: 1375223 - RNA, 19 nt, Homo sapiens
gagaagauugugaaguuug

SEQ ID NO: 1375224 - RNA, 19 nt, Homo sapiens
ucauggaccugccuucuca

SEQ ID NO: 1375225 - RNA, 19 nt, Homo sapiens
cuacaggacagauagaauu

SEQ ID NO: 1375226 - RNA, 19 nt, Homo sapiens
gagaaacuguccuuaucag

SEQ ID NO: 1375227 - RNA, 19 nt, Homo sapiens
gaacuugaagcugaacuug

SEQ ID NO: 1375228 - RNA, 19 nt, Homo sapiens
ugagaggaccuucuacuug

SEQ ID NO: 1375229 - RNA, 19 nt, Homo sapiens
ugauuucacugguaagaau

SEQ ID NO: 1375230 - RNA, 19 nt, Homo sapiens
gcgcauguccuuccuguuc

SEQ ID NO: 1375231 - RNA, 19 nt, Homo sapiens
aagcugaacuugagaaacu

SEQ ID NO: 1375232 - RNA, 19 nt, Homo sapiens
ggaugaaguuucucagacu

SEQ ID NO: 1375233 - RNA, 19 nt, Homo sapiens
gagccaggaugugcaauag

SEQ ID NO: 1375234 - RNA, 19 nt, Homo sapiens
agagagguguaaagaagaa

SEQ ID NO: 1375235 - RNA, 19 nt, Homo sapiens
cuaacaugcugggagauaa

SEQ ID NO: 1375236 - RNA, 19 nt, Homo sapiens
caaguggacucuuucuaac

SEQ ID NO: 1375237 - RNA, 19 nt, Homo sapiens
gaagaggcccagucacuac

SEQ ID NO: 1375238 - RNA, 19 nt, Homo sapiens
ggguuuauccugucgcuaa

SEQ ID NO: 1375239 - RNA, 19 nt, Homo sapiens
gaggagguguaucgucugu

SEQ ID NO: 1375240 - RNA, 19 nt, Homo sapiens
gcaaagaggcaaaauuguu

SEQ ID NO: 1375241 - RNA, 19 nt, Homo sapiens
ggaagaggagaaaggagaa

SEQ ID NO: 1375242 - RNA, 19 nt, Homo sapiens
caauuggaaccgacucuaa

SEQ ID NO: 1375243 - RNA, 19 nt, Homo sapiens
ggaauuggacauccuccuu

SEQ ID NO: 1375244 - RNA, 19 nt, Homo sapiens
cagcuucucucacgcaaag

SEQ ID NO: 1375245 - RNA, 19 nt, Homo sapiens
gcuaacuccugcccagaug

SEQ ID NO: 1375246 - RNA, 19 nt, Homo sapiens
acauaucuaucuuccagaa

SEQ ID NO: 1375247 - RNA, 19 nt, Homo sapiens
aaaggagaaccacugauuu

SEQ ID NO: 1375248 - RNA, 19 nt, Homo sapiens
guggagcuguugaaggaaa

SEQ ID NO: 1375249 - RNA, 19 nt, Homo sapiens
gccaggagcacaaaucguu

SEQ ID NO: 1375250 - RNA, 19 nt, Homo sapiens
gguaagaaugagaaugaaa

SEQ ID NO: 1375251 - RNA, 19 nt, Homo sapiens
aaacaagaaacucucagaa

SEQ ID NO: 1375252 - RNA, 19 nt, Homo sapiens
cagaugagaggaccuucua

SEQ ID NO: 1375253 - RNA, 19 nt, Homo sapiens
caacacaccuccccuccuu

SEQ ID NO: 1375254 - RNA, 19 nt, Homo sapiens
gcaaaguggaguccuuauc

SEQ ID NO: 1375255 - RNA, 19 nt, Homo sapiens
guagagcagaggagaagaa

SEQ ID NO: 1375256 - RNA, 19 nt, Homo sapiens
uugagaaacuguccuuauc

SEQ ID NO: 1375257 - RNA, 19 nt, Homo sapiens
guaacaaauggcuuagauu

SEQ ID NO: 1375258 - RNA, 19 nt, Homo sapiens
gaucuaugccucccagaca

SEQ ID NO: 1375259 - RNA, 19 nt, Homo sapiens
acagaauucuccagguguu

SEQ ID NO: 1375260 - RNA, 19 nt, Homo sapiens
ucgcuaaugucaguuaaau

SEQ ID NO: 1375261 - RNA, 19 nt, Homo sapiens
gagaaccacugauuuuauc

SEQ ID NO: 1375262 - RNA, 19 nt, Homo sapiens
uaaacaagaaacucucaga

SEQ ID NO: 1375263 - RNA, 19 nt, Homo sapiens
gguaggagcacucaaacuc

SEQ ID NO: 1375264 - RNA, 19 nt, Homo sapiens
ccaagcaacggacagagaa

SEQ ID NO: 1375265 - RNA, 19 nt, Homo sapiens
agaacaagccacacaacaa

SEQ ID NO: 1375266 - RNA, 19 nt, Homo sapiens
cuguggagcuguugaagga

SEQ ID NO: 1375267 - RNA, 19 nt, Homo sapiens
aagaaacucucagaaugug

SEQ ID NO: 1375268 - RNA, 19 nt, Homo sapiens
ggacagagaagcgcaucga

SEQ ID NO: 1375269 - RNA, 19 nt, Homo sapiens
cuggguguguacauaguua

SEQ ID NO: 1375270 - RNA, 19 nt, Homo sapiens
gaugcagagugaacagcuu

SEQ ID NO: 1375271 - RNA, 19 nt, Homo sapiens
gcuuauuccugucccacuu

SEQ ID NO: 1375272 - RNA, 19 nt, Homo sapiens
gcaauuggaaccgacucua

SEQ ID NO: 1375273 - RNA, 19 nt, Homo sapiens
gaagaacuggagaaggaau

SEQ ID NO: 1375274 - RNA, 19 nt, Homo sapiens
ugaagagaaacaaucacua

SEQ ID NO: 1375275 - RNA, 19 nt, Homo sapiens
cgaccuugguaaacggaaa

SEQ ID NO: 1375276 - RNA, 19 nt, Homo sapiens
gugccacgauuuauacagu

SEQ ID NO: 1375277 - RNA, 19 nt, Homo sapiens
ugagaaacuguccuuauca

SEQ ID NO: 1375278 - RNA, 19 nt, Homo sapiens
gggaagaggcccagucacu

SEQ ID NO: 1375279 - RNA, 19 nt, Homo sapiens
cacuugauuucacugguaa

SEQ ID NO: 1375280 - RNA, 19 nt, Homo sapiens
uuuauagugccacgauuua

SEQ ID NO: 1375281 - RNA, 19 nt, Homo sapiens
cagaauguguuuggaagag

SEQ ID NO: 1375282 - RNA, 19 nt, Homo sapiens
gcaauaggcauuuuaccaa

SEQ ID NO: 1375283 - RNA, 19 nt, Homo sapiens
cuccagguguucagagaaa

SEQ ID NO: 1375284 - RNA, 19 nt, Homo sapiens
cacucaaacucuccaugaa

SEQ ID NO: 1375285 - RNA, 19 nt, Homo sapiens
gaggaaagguuacauuaaa

SEQ ID NO: 1375286 - RNA, 19 nt, Homo sapiens
gcaaacaccuuguaacugu

SEQ ID NO: 1375287 - RNA, 19 nt, Homo sapiens
ggaaggcacucauuuaugu

SEQ ID NO: 1375288 - RNA, 19 nt, Homo sapiens
gaagaaaugcucacuuaaa

SEQ ID NO: 1375289 - RNA, 19 nt, Homo sapiens
caaaaggccugauuauuua

SEQ ID NO: 1375290 - RNA, 19 nt, Homo sapiens
caaggaaacugguguguga

SEQ ID NO: 1375291 - RNA, 19 nt, Homo sapiens
aagaagaaaugcucacuua

SEQ ID NO: 1375292 - RNA, 19 nt, Homo sapiens
ggacuacgaacaucauuua

SEQ ID NO: 1375293 - RNA, 19 nt, Homo sapiens
gaaggaggauguaauucaa

SEQ ID NO: 1375294 - RNA, 19 nt, Homo sapiens
gcaagauugucauggauuu

SEQ ID NO: 1375295 - RNA, 19 nt, Homo sapiens
uaagggaaauccugauaaa

SEQ ID NO: 1375296 - RNA, 19 nt, Homo sapiens
guuaugaguuccacuauga

SEQ ID NO: 1375297 - RNA, 19 nt, Homo sapiens
gaaaagaaguaguggauga

SEQ ID NO: 1375298 - RNA, 19 nt, Homo sapiens
ccaaguaucuuagaggaaa

SEQ ID NO: 1375299 - RNA, 19 nt, Homo sapiens
gcaaaccuguugagccauu

SEQ ID NO: 1375300 - RNA, 19 nt, Homo sapiens
acauaaaccugaucaaaug

SEQ ID NO: 1375301 - RNA, 19 nt, Homo sapiens
caaggcaaguuucuaauuc

SEQ ID NO: 1375302 - RNA, 19 nt, Homo sapiens
gaagauacagacaaucaaa

SEQ ID NO: 1375303 - RNA, 19 nt, Homo sapiens
uaacaagccguacucauuu

SEQ ID NO: 1375304 - RNA, 19 nt, Homo sapiens
gaaagaaagaggagaugaa

SEQ ID NO: 1375305 - RNA, 19 nt, Homo sapiens
auacagaacuacagaagaa

SEQ ID NO: 1375306 - RNA, 19 nt, Homo sapiens
aaacagaaauagccaagga

SEQ ID NO: 1375307 - RNA, 19 nt, Homo sapiens
gaacuacagaagaaucuaa

SEQ ID NO: 1375308 - RNA, 19 nt, Homo sapiens
ggaaggaggauguaauuca

SEQ ID NO: 1375309 - RNA, 19 nt, Homo sapiens
aagaggagaugaacaguga

SEQ ID NO: 1375310 - RNA, 19 nt, Homo sapiens
aaagaucacucuguauuug

SEQ ID NO: 1375311 - RNA, 19 nt, Homo sapiens
gcugagacaugaaggcauu

SEQ ID NO: 1375312 - RNA, 19 nt, Homo sapiens
gcacacgcauggugagaau

SEQ ID NO: 1375313 - RNA, 19 nt, Homo sapiens
gacagaagauacagacaau

SEQ ID NO: 1375314 - RNA, 19 nt, Homo sapiens
gauaaaggcaaaccuguug

SEQ ID NO: 1375315 - RNA, 19 nt, Homo sapiens
ugacauuugugaaagcuuu

SEQ ID NO: 1375316 - RNA, 19 nt, Homo sapiens
ucuaagagagccuauguua

SEQ ID NO: 1375317 - RNA, 19 nt, Homo sapiens
gaaucuagauaccuuugga

SEQ ID NO: 1375318 - RNA, 19 nt, Homo sapiens
gaucaaaugaccauaaauc

SEQ ID NO: 1375319 - RNA, 19 nt, Homo sapiens
gagaaaugguugaggaaag

SEQ ID NO: 1375320 - RNA, 19 nt, Homo sapiens
gcaaccaucaaaguaauua

SEQ ID NO: 1375321 - RNA, 19 nt, Homo sapiens
gguggaugcucucuuaaug

SEQ ID NO: 1375322 - RNA, 19 nt, Homo sapiens
ggacagaagauacagacaa

SEQ ID NO: 1375323 - RNA, 19 nt, Homo sapiens
gacaaaagaucacucugua

SEQ ID NO: 1375324 - RNA, 19 nt, Homo sapiens
agaaguaguggaugauuua

SEQ ID NO: 1375325 - RNA, 19 nt, Homo sapiens
ucaaaaggccugauuauuu

SEQ ID NO: 1375326 - RNA, 19 nt, Homo sapiens
gcaaagcuacuacgaucaa

SEQ ID NO: 1375327 - RNA, 19 nt, Homo sapiens
ggacagcaaccaucaaagu

SEQ ID NO: 1375328 - RNA, 19 nt, Homo sapiens
caagcugccuguucauguu

SEQ ID NO: 1375329 - RNA, 19 nt, Homo sapiens
caaaugaccauaaaucagu

SEQ ID NO: 1375330 - RNA, 19 nt, Homo sapiens
caaacaccuuguaacugua

SEQ ID NO: 1375331 - RNA, 19 nt, Homo sapiens
uggagaggcuggcaaagaa

SEQ ID NO: 1375332 - RNA, 19 nt, Homo sapiens
acagaagaguaaagcauuu

SEQ ID NO: 1375333 - RNA, 19 nt, Homo sapiens
cuaacaagccguacucauu

SEQ ID NO: 1375334 - RNA, 19 nt, Homo sapiens
gagaacaacaauguagaua

SEQ ID NO: 1375335 - RNA, 19 nt, Homo sapiens
gaggagaugaacagugaua

SEQ ID NO: 1375336 - RNA, 19 nt, Homo sapiens
gcaauggaacaagaauaua

SEQ ID NO: 1375337 - RNA, 19 nt, Homo sapiens
cuacgaacaucauuuacau

SEQ ID NO: 1375338 - RNA, 19 nt, Homo sapiens
gacagcaaccaucaaagua

SEQ ID NO: 1375339 - RNA, 19 nt, Homo sapiens
ggaaacuggugugugauuc

SEQ ID NO: 1375340 - RNA, 19 nt, Homo sapiens
caugguaguagaagaaaua

SEQ ID NO: 1375341 - RNA, 19 nt, Homo sapiens
gaaauagccaaggaaagaa

SEQ ID NO: 1375342 - RNA, 19 nt, Homo sapiens
agaaauagccaaggaaaga

SEQ ID NO: 1375343 - RNA, 19 nt, Homo sapiens
aagaaguaguggaugauuu

SEQ ID NO: 1375344 - RNA, 19 nt, Homo sapiens
gaguaaagcauuuugguua

SEQ ID NO: 1375345 - RNA, 19 nt, Homo sapiens
acugguggaugcucucuua

SEQ ID NO: 1375346 - RNA, 19 nt, Homo sapiens
gcauugagacaguauccua

SEQ ID NO: 1375347 - RNA, 19 nt, Homo sapiens
ggaaagaaagaggagauga

SEQ ID NO: 1375348 - RNA, 19 nt, Homo sapiens
cagcaaccaucaaaguaau

SEQ ID NO: 1375349 - RNA, 19 nt, Homo sapiens
gcauugcagugccaguuau

SEQ ID NO: 1375350 - RNA, 19 nt, Homo sapiens
gcacccagauggcauugca

SEQ ID NO: 1375351 - RNA, 19 nt, Homo sapiens
ggaaagguuacauuaaaca

SEQ ID NO: 1375352 - RNA, 19 nt, Homo sapiens
gcagaaaauuugauacugu

SEQ ID NO: 1375353 - RNA, 19 nt, Homo sapiens
gagccuauguuacccucaa

SEQ ID NO: 1375354 - RNA, 19 nt, Homo sapiens
uaccugaacacaucauaua

SEQ ID NO: 1375355 - RNA, 19 nt, Homo sapiens
ggcaauggaacaagaauau

SEQ ID NO: 1375356 - RNA, 19 nt, Homo sapiens
gugggaaggcacucauuua

SEQ ID NO: 1375357 - RNA, 19 nt, Homo sapiens
guacucauuugcaagauac

SEQ ID NO: 1375358 - RNA, 19 nt, Homo sapiens
ccugaacacaucauauaua

SEQ ID NO: 1375359 - RNA, 19 nt, Homo sapiens
uggcagcucuccaagaaau

SEQ ID NO: 1375360 - RNA, 19 nt, Homo sapiens
ggaaucacgugcagaaaau

SEQ ID NO: 1375361 - RNA, 19 nt, Homo sapiens
cagauuaaagccaagcaua

SEQ ID NO: 1375362 - RNA, 19 nt, Homo sapiens
ugaggaaagguuacauuaa

SEQ ID NO: 1375363 - RNA, 19 nt, Homo sapiens
cagaagauacagacaauca

SEQ ID NO: 1375364 - RNA, 19 nt, Homo sapiens
cagaaguccaaguaucuua

SEQ ID NO: 1375365 - RNA, 19 nt, Homo sapiens
guaugaaccugggcaagau

SEQ ID NO: 1375366 - RNA, 19 nt, Homo sapiens
ggaguuugcuggugaugac

SEQ ID NO: 1375367 - RNA, 19 nt, Homo sapiens
ggagaaaugguugaggaaa

SEQ ID NO: 1375368 - RNA, 19 nt, Homo sapiens
caagauacagaacuacaga

SEQ ID NO: 1375369 - RNA, 19 nt, Homo sapiens
uuauuuaccugaacacauc

SEQ ID NO: 1375370 - RNA, 19 nt, Homo sapiens
gcaggacugugagugaugu

SEQ ID NO: 1375371 - RNA, 19 nt, Homo sapiens
ucaaggcaaguuucuaauu

SEQ ID NO: 1375372 - RNA, 19 nt, Homo sapiens
caggaaggaggauguaauu

SEQ ID NO: 1375373 - RNA, 19 nt, Homo sapiens
cagugauguuggagacuua

SEQ ID NO: 1375374 - RNA, 19 nt, Homo sapiens
caaaagaucacucuguauu

SEQ ID NO: 1375375 - RNA, 19 nt, Homo sapiens
cugguucccuggcaccuua

SEQ ID NO: 1375376 - RNA, 19 nt, Homo sapiens
ugacaggagaaucuagaua

SEQ ID NO: 1375377 - RNA, 19 nt, Homo sapiens
gggcaagauugucauggau

SEQ ID NO: 1375378 - RNA, 19 nt, Homo sapiens
cugaucaaaugaccauaaa

SEQ ID NO: 1375379 - RNA, 19 nt, Homo sapiens
cguacucauuugcaagaua

SEQ ID NO: 1375380 - RNA, 19 nt, Homo sapiens
guccuguguuucaucguua

SEQ ID NO: 1375381 - RNA, 19 nt, Homo sapiens
uaucuuagaggaaacagaa

SEQ ID NO: 1375382 - RNA, 19 nt, Homo sapiens
gggaaggcacucauuuaug

SEQ ID NO: 1375383 - RNA, 19 nt, Homo sapiens
aguggcagcucuccaagaa

SEQ ID NO: 1375384 - RNA, 19 nt, Homo sapiens
gaagcggaguuugcuaugg

SEQ ID NO: 1375385 - RNA, 19 nt, Homo sapiens
gguuagcgcuccuguauua

SEQ ID NO: 1375386 - RNA, 19 nt, Homo sapiens
gagacugacuguacuaaua

SEQ ID NO: 1375387 - RNA, 19 nt, Homo sapiens
gaacacagccuacuuguca

SEQ ID NO: 1375388 - RNA, 19 nt, Homo sapiens
ggaaggagaugaacgagau

SEQ ID NO: 1375389 - RNA, 19 nt, Homo sapiens
gggaaacaaugacuuuaaa

SEQ ID NO: 1375390 - RNA, 19 nt, Homo sapiens
gggaacauguacuuauaua

SEQ ID NO: 1375391 - RNA, 19 nt, Homo sapiens
gaugaacgcugcuuuccaa

SEQ ID NO: 1375392 - RNA, 19 nt, Homo sapiens
ggacacauuucuagcaaga

SEQ ID NO: 1375393 - RNA, 19 nt, Homo sapiens
gaucacaagcgaaaucaua

SEQ ID NO: 1375394 - RNA, 19 nt, Homo sapiens
gaacgcugcuuuccaagau

SEQ ID NO: 1375395 - RNA, 19 nt, Homo sapiens
gaacuugaauagguaguga

SEQ ID NO: 1375396 - RNA, 19 nt, Homo sapiens
gcacagauggccaugaauu

SEQ ID NO: 1375397 - RNA, 19 nt, Homo sapiens
aaacggaacucuacagaca

SEQ ID NO: 1375398 - RNA, 19 nt, Homo sapiens
gggaaggccugguaaagug

SEQ ID NO: 1375399 - RNA, 19 nt, Homo sapiens
uagagccgcugauauguaa

SEQ ID NO: 1375400 - RNA, 19 nt, Homo sapiens
gugggaacauguacuuaua

SEQ ID NO: 1375401 - RNA, 19 nt, Homo sapiens
ugacuugaguaaaccaaua

SEQ ID NO: 1375402 - RNA, 19 nt, Homo sapiens
auagacaagucacgaguua

SEQ ID NO: 1375403 - RNA, 19 nt, Homo sapiens
gccgggagcuguacuucua

SEQ ID NO: 1375404 - RNA, 19 nt, Homo sapiens
caacagccuuccacauuca

SEQ ID NO: 1375405 - RNA, 19 nt, Homo sapiens
cagcacagauggccaugaa

SEQ ID NO: 1375406 - RNA, 19 nt, Homo sapiens
guacaaugaaugugaauga

SEQ ID NO: 1375407 - RNA, 19 nt, Homo sapiens
aaagauagcacaugagaga

SEQ ID NO: 1375408 - RNA, 19 nt, Homo sapiens
gagcuguacuucuauaucu

SEQ ID NO: 1375409 - RNA, 19 nt, Homo sapiens
uugaauagguagugacuuu

SEQ ID NO: 1375410 - RNA, 19 nt, Homo sapiens
caccagaucuagaacuuga

SEQ ID NO: 1375411 - RNA, 19 nt, Homo sapiens
ggaacccucuccuuaagug

SEQ ID NO: 1375412 - RNA, 19 nt, Homo sapiens
gaggaaagacuaauagaca

SEQ ID NO: 1375413 - RNA, 19 nt, Homo sapiens
gagaugaacgagauuaaga

SEQ ID NO: 1375414 - RNA, 19 nt, Homo sapiens
gcaaggacacacacaaaug

SEQ ID NO: 1375415 - RNA, 19 nt, Homo sapiens
gcagagaucgagcaaauag

SEQ ID NO: 1375416 - RNA, 19 nt, Homo sapiens
acacaaaugucaugaaugc

SEQ ID NO: 1375417 - RNA, 19 nt, Homo sapiens
uagcaggguugauugauau

SEQ ID NO: 1375418 - RNA, 19 nt, Homo sapiens
acacacaaaugucaugaau

SEQ ID NO: 1375419 - RNA, 19 nt, Homo sapiens
gagcaaggacacacacaaa

SEQ ID NO: 1375420 - RNA, 19 nt, Homo sapiens
uaugggaccuuacagaaga

SEQ ID NO: 1375421 - RNA, 19 nt, Homo sapiens
ggucaguguuguagcguuu

SEQ ID NO: 1375422 - RNA, 19 nt, Homo sapiens
gcuuauagacccaaucaaa

SEQ ID NO: 1375423 - RNA, 19 nt, Homo sapiens
gcaacacuuucacuacaug

SEQ ID NO: 1375424 - RNA, 19 nt, Homo sapiens
agaagaaggugacccuaug

SEQ ID NO: 1375425 - RNA, 19 nt, Homo sapiens
aaagagaagagccuuaauu

SEQ ID NO: 1375426 - RNA, 19 nt, Homo sapiens
ccaacagccuuccacauuc

SEQ ID NO: 1375427 - RNA, 19 nt, Homo sapiens
uggcagagaucgagcaaau

SEQ ID NO: 1375428 - RNA, 19 nt, Homo sapiens
cgaguuaccugugucaaau

SEQ ID NO: 1375429 - RNA, 19 nt, Homo sapiens
aagagaagagccuuaauuu

SEQ ID NO: 1375430 - RNA, 19 nt, Homo sapiens
ggagaggcaccacgagaaa

SEQ ID NO: 1375431 - RNA, 19 nt, Homo sapiens
uuagcaggguugauugaua

SEQ ID NO: 1375432 - RNA, 19 nt, Homo sapiens
ucuagaacuugaauaggua

SEQ ID NO: 1375433 - RNA, 19 nt, Homo sapiens
agaaagaucacaagcgaaa

SEQ ID NO: 1375434 - RNA, 19 nt, Homo sapiens
gggaaggucuguacaagcu

SEQ ID NO: 1375435 - RNA, 19 nt, Homo sapiens
guacuucuauaucuacaag

SEQ ID NO: 1375436 - RNA, 19 nt, Homo sapiens
gcaauccacagaaagagaa

SEQ ID NO: 1375437 - RNA, 19 nt, Homo sapiens
gaaugugaaugacacuucu

SEQ ID NO: 1375438 - RNA, 19 nt, Homo sapiens
cugguaaagugguaaguuu

SEQ ID NO: 1375439 - RNA, 19 nt, Homo sapiens
agagaucgagcaaauagua

SEQ ID NO: 1375440 - RNA, 19 nt, Homo sapiens
gugaaugacacuucuuauu

SEQ ID NO: 1375441 - RNA, 19 nt, Homo sapiens
gagauuaagacccaauuca

SEQ ID NO: 1375442 - RNA, 19 nt, Homo sapiens
gagcugcacgguacgauga

SEQ ID NO: 1375443 - RNA, 19 nt, Homo sapiens
caggguugauugauauuau

SEQ ID NO: 1375444 - RNA, 19 nt, Homo sapiens
gcacuuagggcaggaugaa

SEQ ID NO: 1375445 - RNA, 19 nt, Homo sapiens
gaccgccucugcuucaaug

SEQ ID NO: 1375446 - RNA, 19 nt, Homo sapiens
gcaggguugauugauauua

SEQ ID NO: 1375447 - RNA, 19 nt, Homo sapiens
uauauagagucccaagguu

SEQ ID NO: 1375448 - RNA, 19 nt, Homo sapiens
gguguacaaugaaugugaa

SEQ ID NO: 1375449 - RNA, 19 nt, Homo sapiens
caaggacacacacaaaugu

SEQ ID NO: 1375450 - RNA, 19 nt, Homo sapiens
gaagauguucccuuguuag

SEQ ID NO: 1375451 - RNA, 19 nt, Homo sapiens
gaaagagaagagccuuaau

SEQ ID NO: 1375452 - RNA, 19 nt, Homo sapiens
caggagggauuuauuugca

SEQ ID NO: 1375453 - RNA, 19 nt, Homo sapiens
gugacaaacugaaucuagu

SEQ ID NO: 1375454 - RNA, 19 nt, Homo sapiens
gcgaugaggacuuccaaga

SEQ ID NO: 1375455 - RNA, 19 nt, Homo sapiens
agaaagagaagagccuuaa

SEQ ID NO: 1375456 - RNA, 19 nt, Homo sapiens
caaauuugcaacacuuuca

SEQ ID NO: 1375457 - RNA, 19 nt, Homo sapiens
gaagcaaugggaacagugu

SEQ ID NO: 1375458 - RNA, 19 nt, Homo sapiens
gcacaaguccugggucagu

SEQ ID NO: 1375459 - RNA, 19 nt, Homo sapiens
uuuguagacugccgaguaa

SEQ ID NO: 1375460 - RNA, 19 nt, Homo sapiens
gugacagucugguccuuug

SEQ ID NO: 1375461 - RNA, 19 nt, Homo sapiens
gaggagggaaggagaugaa

SEQ ID NO: 1375462 - RNA, 19 nt, Homo sapiens
ggcgugauccgggcacuua

SEQ ID NO: 1375463 - RNA, 19 nt, Homo sapiens
cgggagcuguacuucuaua

SEQ ID NO: 1375464 - RNA, 19 nt, Homo sapiens
uguagacugccgaguaaua

SEQ ID NO: 1375465 - RNA, 19 nt, Homo sapiens
ggaaagacuaauagacaag

SEQ ID NO: 1375466 - RNA, 19 nt, Homo sapiens
gcaggccaaguccagcuua

SEQ ID NO: 1375467 - RNA, 19 nt, Homo sapiens
cagaaagagaagagccuua

SEQ ID NO: 1375468 - RNA, 19 nt, Homo sapiens
gcgcuccuguauuagacua

SEQ ID NO: 1375469 - RNA, 19 nt, Homo sapiens
auauagagucccaagguua

SEQ ID NO: 1375470 - RNA, 19 nt, Homo sapiens
caucagagccauaauuuug

SEQ ID NO: 1375471 - RNA, 19 nt, Homo sapiens
ugucaggagggauuuauuu

SEQ ID NO: 1375472 - RNA, 19 nt, Homo sapiens
gacugacuguacuaauauu

SEQ ID NO: 1375473 - RNA, 19 nt, Homo sapiens
aggaaagacuaauagacaa

SEQ ID NO: 1375474 - RNA, 19 nt, Homo sapiens
gagagacugacuguacuaa

SEQ ID NO: 1375475 - RNA, 19 nt, Homo sapiens
caugagagacugacuguac

SEQ ID NO: 1375476 - RNA, 19 nt, Homo sapiens
uccaacagccuuccacauu

SEQ ID NO: 1375477 - RNA, 19 nt, Homo sapiens
ccaaacggaacucuacaga

SEQ ID NO: 1375478 - RNA, 19 nt, Homo sapiens
gaagaaggugacccuaugg

SEQ ID NO: 1375479 - RNA, 19 nt, Homo sapiens
gcuuugccgugcacacuug

SEQ ID NO: 1375480 - RNA, 19 nt, Homo sapiens
gaaagacuaauagacaagu

SEQ ID NO: 1375481 - RNA, 19 nt, Homo sapiens
guauauagagucccaaggu

SEQ ID NO: 1375482 - RNA, 19 nt, Homo sapiens
agacugacuguacuaauau

SEQ ID NO: 1375483 - RNA, 19 nt, Homo sapiens
cauagcaugggacacauuu

SEQ ID NO: 1375484 - RNA, 19 nt, Homo sapiens
gagggaaggagaugaacga

SEQ ID NO: 1375485 - RNA, 19 nt, Homo sapiens
gaacagagcuugaagauuu

SEQ ID NO: 1375486 - RNA, 19 nt, Homo sapiens
ggaaagaccuauucucaug

SEQ ID NO: 1375487 - RNA, 19 nt, Homo sapiens
gaagaaagaaguugauaga

SEQ ID NO: 1375488 - RNA, 19 nt, Homo sapiens
caaaugcagucaauuauuc

SEQ ID NO: 1375489 - RNA, 19 nt, Homo sapiens
ucacaacacugcucuaguu

SEQ ID NO: 1375490 - RNA, 19 nt, Homo sapiens
gaagggcucuuucagaauc

SEQ ID NO: 1375491 - RNA, 19 nt, Homo sapiens
guaaauaacugugaacaag

SEQ ID NO: 1375492 - RNA, 19 nt, Homo sapiens
uagccaagauucuacguua

SEQ ID NO: 1375493 - RNA, 19 nt, Homo sapiens
gaagggaauugcuuaguag

SEQ ID NO: 1375494 - RNA, 19 nt, Homo sapiens
ccagaaagaaguuaaauug

SEQ ID NO: 1375495 - RNA, 19 nt, Homo sapiens
gaacaucuccuccaaagag

SEQ ID NO: 1375496 - RNA, 19 nt, Homo sapiens
cagcuggacugcaggcuua

SEQ ID NO: 1375497 - RNA, 19 nt, Homo sapiens
agaagggaauugcuuagua

SEQ ID NO: 1375498 - RNA, 19 nt, Homo sapiens
ucacauuucuuuacagguu

SEQ ID NO: 1375499 - RNA, 19 nt, Homo sapiens
gagaguaaauaacugugaa

SEQ ID NO: 1375500 - RNA, 19 nt, Homo sapiens
aaauagcacuggagacuga

SEQ ID NO: 1375501 - RNA, 19 nt, Homo sapiens
cgagucagauguccaaaug

SEQ ID NO: 1375502 - RNA, 19 nt, Homo sapiens
gaacugucaugggaacauu

SEQ ID NO: 1375503 - RNA, 19 nt, Homo sapiens
gcucugcccuuaggucuuu

SEQ ID NO: 1375504 - RNA, 19 nt, Homo sapiens
aagcaaagcuagccaagau

SEQ ID NO: 1375505 - RNA, 19 nt, Homo sapiens
caacacugcucuaguuucu

SEQ ID NO: 1375506 - RNA, 19 nt, Homo sapiens
gaggagggauagaacauca

SEQ ID NO: 1375507 - RNA, 19 nt, Homo sapiens
gaaccauugugcaaauugu

SEQ ID NO: 1375508 - RNA, 19 nt, Homo sapiens
acaauaaggugaccagcaa

SEQ ID NO: 1375509 - RNA, 19 nt, Homo sapiens
gaaacugaauccauguaag

SEQ ID NO: 1375510 - RNA, 19 nt, Homo sapiens
gagucaggguaaagaauaa

SEQ ID NO: 1375511 - RNA, 19 nt, Homo sapiens
gauagaacaucacaacacu

SEQ ID NO: 1375512 - RNA, 19 nt, Homo sapiens
gaagaaacgaugccugugu

SEQ ID NO: 1375513 - RNA, 19 nt, Homo sapiens
gaaagaaagagaagggaau

SEQ ID NO: 1375514 - RNA, 19 nt, Homo sapiens
aaacgaugccuguguauga

SEQ ID NO: 1375515 - RNA, 19 nt, Homo sapiens
aagaaacgaugccugugua

SEQ ID NO: 1375516 - RNA, 19 nt, Homo sapiens
aaacucaaaugcagucaau

SEQ ID NO: 1375517 - RNA, 19 nt, Homo sapiens
gaagauuuagucaagguuu

SEQ ID NO: 1375518 - RNA, 19 nt, Homo sapiens
caagguguguccagguaaa

SEQ ID NO: 1375519 - RNA, 19 nt, Homo sapiens
cauauugcauguuucaaga

SEQ ID NO: 1375520 - RNA, 19 nt, Homo sapiens
cagaggagauggagaacug

SEQ ID NO: 1375521 - RNA, 19 nt, Homo sapiens
uuucauagccucauucauu

SEQ ID NO: 1375522 - RNA, 19 nt, Homo sapiens
cuagaaaguuauucaagug

SEQ ID NO: 1375523 - RNA, 19 nt, Homo sapiens
acacugcucuaguuucuug

SEQ ID NO: 1375524 - RNA, 19 nt, Homo sapiens
gcaagcaucaggaaccauu

SEQ ID NO: 1375525 - RNA, 19 nt, Homo sapiens
acacucacauuaaacgaaa

SEQ ID NO: 1375526 - RNA, 19 nt, Homo sapiens
acucaaaugcagucaauua

SEQ ID NO: 1375527 - RNA, 19 nt, Homo sapiens
gcaaagcuagccaagauuc

SEQ ID NO: 1375528 - RNA, 19 nt, Homo sapiens
gaaggccagugcccagguu

SEQ ID NO: 1375529 - RNA, 19 nt, Homo sapiens
agacagacaguauuggaua

SEQ ID NO: 1375530 - RNA, 19 nt, Homo sapiens
caagcaagaguguaagaaa

SEQ ID NO: 1375531 - RNA, 19 nt, Homo sapiens
acacaagcauggacaagug

SEQ ID NO: 1375532 - RNA, 19 nt, Homo sapiens
aaacugaauccauguaaga

SEQ ID NO: 1375533 - RNA, 19 nt, Homo sapiens
cuccagcacuuccauauug

SEQ ID NO: 1375534 - RNA, 19 nt, Homo sapiens
caacagagaagcaagacau

SEQ ID NO: 1375535 - RNA, 19 nt, Homo sapiens
guacagagugggugagaga

SEQ ID NO: 1375536 - RNA, 19 nt, Homo sapiens
cguccacacucacauuaaa

SEQ ID NO: 1375537 - RNA, 19 nt, Homo sapiens
gcucagaucagccagaugu

SEQ ID NO: 1375538 - RNA, 19 nt, Homo sapiens
ucaccaagcaagaguguaa

SEQ ID NO: 1375539 - RNA, 19 nt, Homo sapiens
agucagauguccaaauguu

SEQ ID NO: 1375540 - RNA, 19 nt, Homo sapiens
gaaaaugggaggcaugaaa

SEQ ID NO: 1375541 - RNA, 19 nt, Homo sapiens
ggaggucugucccgcuuuc

SEQ ID NO: 1375542 - RNA, 19 nt, Homo sapiens
auaauuugcuccuuugugu

SEQ ID NO: 1375543 - RNA, 19 nt, Homo sapiens
aacagagcuugaagauuua

SEQ ID NO: 1375544 - RNA, 19 nt, Homo sapiens
gcagugguccaaaugagaa

SEQ ID NO: 1375545 - RNA, 19 nt, Homo sapiens
ggaacauucugauggugau

SEQ ID NO: 1375546 - RNA, 19 nt, Homo sapiens
auccuuaccuggaaccuua

SEQ ID NO: 1375547 - RNA, 19 nt, Homo sapiens
caaaacagagcaaguaaaa

SEQ ID NO: 1375548 - RNA, 19 nt, Homo sapiens
ggagaguaaauaacuguga

SEQ ID NO: 1375549 - RNA, 19 nt, Homo sapiens
gcacguccacacucacauu

SEQ ID NO: 1375550 - RNA, 19 nt, Homo sapiens
caggaaccauugugcaaau

SEQ ID NO: 1375551 - RNA, 19 nt, Homo sapiens
uaggaguucugcaguauag

SEQ ID NO: 1375552 - RNA, 19 nt, Homo sapiens
gcagaacagagcuugaaga

SEQ ID NO: 1375553 - RNA, 19 nt, Homo sapiens
gcuauguacuuguaauguc

SEQ ID NO: 1375554 - RNA, 19 nt, Homo sapiens
cacauuaaacgaaagcuuu

SEQ ID NO: 1375555 - RNA, 19 nt, Homo sapiens
uaguaggaguucugcagua

SEQ ID NO: 1375556 - RNA, 19 nt, Homo sapiens
ccaaagagacuagaagagu

SEQ ID NO: 1375557 - RNA, 19 nt, Homo sapiens
gaaggagaagcucagauca

SEQ ID NO: 1375558 - RNA, 19 nt, Homo sapiens
ggacaaguguguguuucca

SEQ ID NO: 1375559 - RNA, 19 nt, Homo sapiens
ccaccgcucucacuaugau

SEQ ID NO: 1375560 - RNA, 19 nt, Homo sapiens
uaugggacuuccagaaaga

SEQ ID NO: 1375561 - RNA, 19 nt, Homo sapiens
cacauuucuuuacagguua

SEQ ID NO: 1375562 - RNA, 19 nt, Homo sapiens
guuuaagucaccaacaaua

SEQ ID NO: 1375563 - RNA, 19 nt, Homo sapiens
gacagacaguauuggauag

SEQ ID NO: 1375564 - RNA, 19 nt, Homo sapiens
caagacagacaguauugga

SEQ ID NO: 1375565 - RNA, 19 nt, Homo sapiens
ggaaccauugugcaaauug

SEQ ID NO: 1375566 - RNA, 19 nt, Homo sapiens
gcucagagaaugggaaugu

SEQ ID NO: 1375567 - RNA, 19 nt, Homo sapiens
ccucauucauucacuuaga

SEQ ID NO: 1375568 - RNA, 19 nt, Homo sapiens
agagucaggguaaagaaua

SEQ ID NO: 1375569 - RNA, 19 nt, Homo sapiens
aaauaacugugaacaagag

SEQ ID NO: 1375570 - RNA, 19 nt, Homo sapiens
gagggaaacguguauugug

SEQ ID NO: 1375571 - RNA, 19 nt, Homo sapiens
gaagcaaagcuagccaaga

SEQ ID NO: 1375572 - RNA, 19 nt, Homo sapiens
uuuagaaugucauguguuc

SEQ ID NO: 1375573 - RNA, 19 nt, Homo sapiens
aagagaagggaauugcuua

SEQ ID NO: 1375574 - RNA, 19 nt, Homo sapiens
ggagcuuccucacuucaag

SEQ ID NO: 1375575 - RNA, 19 nt, Homo sapiens
gaaacgaugccuguguaug

SEQ ID NO: 1375576 - RNA, 19 nt, Homo sapiens
ugugugcuauguacuugua

SEQ ID NO: 1375577 - RNA, 19 nt, Homo sapiens
acaaguguguguuuccaau

SEQ ID NO: 1375578 - RNA, 19 nt, Homo sapiens
ugucagcccuugaacaucu

SEQ ID NO: 1375579 - RNA, 19 nt, Homo sapiens
gaacauucugauggugaua

SEQ ID NO: 1375580 - RNA, 19 nt, Homo sapiens
aacaauagagucaggguaa

SEQ ID NO: 1375581 - RNA, 19 nt, Homo sapiens
caagauucuacguuacuuu

SEQ ID NO: 1375582 - RNA, 19 nt, Homo sapiens
guaggaguucugcaguaua

SEQ ID NO: 1375583 - RNA, 19 nt, Homo sapiens
ggcaagacagacaguauug

SEQ ID NO: 1375584 - RNA, 19 nt, Homo sapiens
cgaaggagaagcucagauc

SEQ ID NO: 1375585 - RNA, 19 nt, Homo sapiens
gagaggagguggaauauua

SEQ ID NO: 1375586 - RNA, 19 nt, Homo sapiens
uauaggagcuggaaucuuu

SEQ ID NO: 1375587 - RNA, 19 nt, Homo sapiens
cagcagaaauguuugaauu

SEQ ID NO: 1375588 - RNA, 19 nt, Homo sapiens
gaagccagcagaaauguuu

SEQ ID NO: 1375589 - RNA, 19 nt, Homo sapiens
gaacacggaguuugggaaa

SEQ ID NO: 1375590 - RNA, 19 nt, Homo sapiens
gcaggagaaucgcuugaau

SEQ ID NO: 1375591 - RNA, 19 nt, Homo sapiens
ccacaaaugcaaauacuug

SEQ ID NO: 1375592 - RNA, 19 nt, Homo sapiens
gguggaauauuaccaguca

SEQ ID NO: 1375593 - RNA, 19 nt, Homo sapiens
ccacggagcagauauagga

SEQ ID NO: 1375594 - RNA, 19 nt, Homo sapiens
gggagagccugcugccaaa

SEQ ID NO: 1375595 - RNA, 19 nt, Homo sapiens
gacgagaggagguggaaua

SEQ ID NO: 1375596 - RNA, 19 nt, Homo sapiens
ccacugccuuucccaagaa

SEQ ID NO: 1375597 - RNA, 19 nt, Homo sapiens
gggcgguccuggccauaaa

SEQ ID NO: 1375598 - RNA, 19 nt, Homo sapiens
ggaaugccacaaaugcaaa

SEQ ID NO: 1375599 - RNA, 19 nt, Homo sapiens
ggcaggcgcuguaccaaag

SEQ ID NO: 1375600 - RNA, 19 nt, Homo sapiens
gccuauggcucuccugugu

SEQ ID NO: 1375601 - RNA, 19 nt, Homo sapiens
gagaccagcuuggccaaca

SEQ ID NO: 1375602 - RNA, 19 nt, Homo sapiens
ggagagagagagggaaaga

SEQ ID NO: 1375603 - RNA, 19 nt, Homo sapiens
ggagaaggcccagcaacug

SEQ ID NO: 1375604 - RNA, 19 nt, Homo sapiens
gcagauauaggagcuggaa

SEQ ID NO: 1375605 - RNA, 19 nt, Homo sapiens
ugagguggguggaucacuu

SEQ ID NO: 1375606 - RNA, 19 nt, Homo sapiens
cuaccucucugcugccuau

SEQ ID NO: 1375607 - RNA, 19 nt, Homo sapiens
gccacugccuuucccaaga

SEQ ID NO: 1375608 - RNA, 19 nt, Homo sapiens
ccauaaagggcuaccgaaa

SEQ ID NO: 1375609 - RNA, 19 nt, Homo sapiens
aaagagaagccagcagaaa

SEQ ID NO: 1375610 - RNA, 19 nt, Homo sapiens
guccaguucuaccagcuaa

SEQ ID NO: 1375611 - RNA, 19 nt, Homo sapiens
gccaaaugcuggagguucu

SEQ ID NO: 1375612 - RNA, 19 nt, Homo sapiens
ccgcagacccgaaagugaa

SEQ ID NO: 1375613 - RNA, 19 nt, Homo sapiens
gcucuccuguguguaaaga

SEQ ID NO: 1375614 - RNA, 19 nt, Homo sapiens
agagagagagggaaagaga

SEQ ID NO: 1375615 - RNA, 19 nt, Homo sapiens
gcauuuacuacuaucaguu

SEQ ID NO: 1375616 - RNA, 19 nt, Homo sapiens
guacuucuacuuccacuac

SEQ ID NO: 1375617 - RNA, 19 nt, Homo sapiens
aagagaagccagcagaaau

SEQ ID NO: 1375618 - RNA, 19 nt, Homo sapiens
cuucuggaguccucuguga

SEQ ID NO: 1375619 - RNA, 19 nt, Homo sapiens
agagaagccagcagaaaug

SEQ ID NO: 1375620 - RNA, 19 nt, Homo sapiens
gcaaaggcuacagcgguuu

SEQ ID NO: 1375621 - RNA, 19 nt, Homo sapiens
cuauggcucuccugugugu

SEQ ID NO: 1375622 - RNA, 19 nt, Homo sapiens
cauggucacuguggcaaug

SEQ ID NO: 1375623 - RNA, 19 nt, Homo sapiens
gagagccugcugccaaaug

SEQ ID NO: 1375624 - RNA, 19 nt, Homo sapiens
gagggaccaaucaaaauua

SEQ ID NO: 1375625 - RNA, 19 nt, Homo sapiens
gagugagggaccaaucaaa

SEQ ID NO: 1375626 - RNA, 19 nt, Homo sapiens
gagaagccagcagaaaugu

SEQ ID NO: 1375627 - RNA, 19 nt, Homo sapiens
ugacagagcgagacuccau

SEQ ID NO: 1375628 - RNA, 19 nt, Homo sapiens
agucugagccacugccuuu

SEQ ID NO: 1375629 - RNA, 19 nt, Homo sapiens
gcaggugaacacggaguuu

SEQ ID NO: 1375630 - RNA, 19 nt, Homo sapiens
acacgggcaucaccagcuu

SEQ ID NO: 1375631 - RNA, 19 nt, Homo sapiens
agaaucccuuguuguggaa

SEQ ID NO: 1375632 - RNA, 19 nt, Homo sapiens
ggcauuuacuacuaucagu

SEQ ID NO: 1375633 - RNA, 19 nt, Homo sapiens
gagguggguggaucacuug

SEQ ID NO: 1375634 - RNA, 19 nt, Homo sapiens
gaaugccacaaaugcaaau

SEQ ID NO: 1375635 - RNA, 19 nt, Homo sapiens
gauauaggagcuggaaucu

SEQ ID NO: 1375636 - RNA, 19 nt, Homo sapiens
gggcuuacaguggcuuuga

SEQ ID NO: 1375637 - RNA, 19 nt, Homo sapiens
ccccgucucuacuaaaaua

SEQ ID NO: 1375638 - RNA, 19 nt, Homo sapiens
caaaggcuacagcgguuuc

SEQ ID NO: 1375639 - RNA, 19 nt, Homo sapiens
ggugaccgaaggcuuguug

SEQ ID NO: 1375640 - RNA, 19 nt, Homo sapiens
gggagaaggcccagcaacu

SEQ ID NO: 1375641 - RNA, 19 nt, Homo sapiens
cauaaagggcuaccgaaaa

SEQ ID NO: 1375642 - RNA, 19 nt, Homo sapiens
ggccuuguacuucuacuuc

SEQ ID NO: 1375643 - RNA, 19 nt, Homo sapiens
caaguggugguggaaggua

SEQ ID NO: 1375644 - RNA, 19 nt, Homo sapiens
aagagaggcaggcgcugua

SEQ ID NO: 1375645 - RNA, 19 nt, Homo sapiens
caggagaaucgcuugaauc

SEQ ID NO: 1375646 - RNA, 19 nt, Homo sapiens
cgagaggagguggaauauu

SEQ ID NO: 1375647 - RNA, 19 nt, Homo sapiens
agauauaggagcuggaauc

SEQ ID NO: 1375648 - RNA, 19 nt, Homo sapiens
ggaaaucguuggcguagua

SEQ ID NO: 1375649 - RNA, 19 nt, Homo sapiens
gcagagagccugucgguaa

SEQ ID NO: 1375650 - RNA, 19 nt, Homo sapiens
agaccaagcugauccauuu

SEQ ID NO: 1375651 - RNA, 19 nt, Homo sapiens
gaaauggagcguuuauaaa

SEQ ID NO: 1375652 - RNA, 19 nt, Homo sapiens
caaccaagcuucaaacucu

SEQ ID NO: 1375653 - RNA, 19 nt, Homo sapiens
gaauugcacuggugacaga

SEQ ID NO: 1375654 - RNA, 19 nt, Homo sapiens
gaaagaggcuaaacugacu

SEQ ID NO: 1375655 - RNA, 19 nt, Homo sapiens
gaaaucaugagcaguguuu

SEQ ID NO: 1375656 - RNA, 19 nt, Homo sapiens
gacagaguguuucacauuu

SEQ ID NO: 1375657 - RNA, 19 nt, Homo sapiens
gaucuguuacccaauauua

SEQ ID NO: 1375658 - RNA, 19 nt, Homo sapiens
ggacagcauuccucacaga

SEQ ID NO: 1375659 - RNA, 19 nt, Homo sapiens
cagauaagguuuaacagau

SEQ ID NO: 1375660 - RNA, 19 nt, Homo sapiens
gcucugcuauguuauuuau

SEQ ID NO: 1375661 - RNA, 19 nt, Homo sapiens
gaaaggaugccacacuuca

SEQ ID NO: 1375662 - RNA, 19 nt, Homo sapiens
agaaauggagcguuuauaa

SEQ ID NO: 1375663 - RNA, 19 nt, Homo sapiens
gcaagaggcggacuuugaa

SEQ ID NO: 1375664 - RNA, 19 nt, Homo sapiens
aagaggaggucgacaggua

SEQ ID NO: 1375665 - RNA, 19 nt, Homo sapiens
gggaaaggaugccacacuu

SEQ ID NO: 1375666 - RNA, 19 nt, Homo sapiens
uacaagaaauggagcguuu

SEQ ID NO: 1375667 - RNA, 19 nt, Homo sapiens
ggugacagauaagguuuaa

SEQ ID NO: 1375668 - RNA, 19 nt, Homo sapiens
gcccugaaguuguggcuuu

SEQ ID NO: 1375669 - RNA, 19 nt, Homo sapiens
gguguuauccuaucucuug

SEQ ID NO: 1375670 - RNA, 19 nt, Homo sapiens
gauaagguuuaacagaugu

SEQ ID NO: 1375671 - RNA, 19 nt, Homo sapiens
ucacaggaauauugaacuu

SEQ ID NO: 1375672 - RNA, 19 nt, Homo sapiens
cuggugcucugcuauguua

SEQ ID NO: 1375673 - RNA, 19 nt, Homo sapiens
caacuggaguggugcuguu

SEQ ID NO: 1375674 - RNA, 19 nt, Homo sapiens
gcacaagcacauauguuug

SEQ ID NO: 1375675 - RNA, 19 nt, Homo sapiens
gcagagccuuugcuucauc

SEQ ID NO: 1375676 - RNA, 19 nt, Homo sapiens
ugacagaguguuucacauu

SEQ ID NO: 1375677 - RNA, 19 nt, Homo sapiens
gaucaccuuugucuugaau

SEQ ID NO: 1375678 - RNA, 19 nt, Homo sapiens
ugaagugccugauccuaau

SEQ ID NO: 1375679 - RNA, 19 nt, Homo sapiens
cuuccugucuccagaauaa

SEQ ID NO: 1375680 - RNA, 19 nt, Homo sapiens
ggcacaagcacauauguuu

SEQ ID NO: 1375681 - RNA, 19 nt, Homo sapiens
ugagaaauccaagaaauga

SEQ ID NO: 1375682 - RNA, 19 nt, Homo sapiens
agacaaggcaaacucuaua

SEQ ID NO: 1375683 - RNA, 19 nt, Homo sapiens
gaaaugaaaccaggaaggu

SEQ ID NO: 1375684 - RNA, 19 nt, Homo sapiens
guauugaacuuuggugauc

SEQ ID NO: 1375685 - RNA, 19 nt, Homo sapiens
ugacagaaggcgagcgaua

SEQ ID NO: 1375686 - RNA, 19 nt, Homo sapiens
gaggcggacuuugaagaaa

SEQ ID NO: 1375687 - RNA, 19 nt, Homo sapiens
gaaguuguggcuuucuuug

SEQ ID NO: 1375688 - RNA, 19 nt, Homo sapiens
gaaggcgagcgauauguga

SEQ ID NO: 1375689 - RNA, 19 nt, Homo sapiens
gaaucaaccaagcuucaaa

SEQ ID NO: 1375690 - RNA, 19 nt, Homo sapiens
ggcauuuccuggugucuga

SEQ ID NO: 1375691 - RNA, 19 nt, Homo sapiens
gacuaacgcugcuuuacuc

SEQ ID NO: 1375692 - RNA, 19 nt, Homo sapiens
ugacagauaagguuuaaca

SEQ ID NO: 1375693 - RNA, 19 nt, Homo sapiens
aaucuuggcugucgugauc

SEQ ID NO: 1375694 - RNA, 19 nt, Homo sapiens
ugagacaccugugaccauu

SEQ ID NO: 1375695 - RNA, 19 nt, Homo sapiens
ggccugaccaucacuguuu

SEQ ID NO: 1375696 - RNA, 19 nt, Homo sapiens
ugaaacagauuuugacaga

SEQ ID NO: 1375697 - RNA, 19 nt, Homo sapiens
gcacacugcaggugaaauc

SEQ ID NO: 1375698 - RNA, 19 nt, Homo sapiens
gaucaauacaaccaaauuc

SEQ ID NO: 1375699 - RNA, 19 nt, Homo sapiens
caagaaauggagcguuuau

SEQ ID NO: 1375700 - RNA, 19 nt, Homo sapiens
caucuuggccaacugcuuu

SEQ ID NO: 1375701 - RNA, 19 nt, Homo sapiens
guugaucaccuuugucuug

SEQ ID NO: 1375702 - RNA, 19 nt, Homo sapiens
cagaauaagacaaggcaaa

SEQ ID NO: 1375703 - RNA, 19 nt, Homo sapiens
ucucaggauuuguugauug

SEQ ID NO: 1375704 - RNA, 19 nt, Homo sapiens
caagaaaugaaaccaggaa

SEQ ID NO: 1375705 - RNA, 19 nt, Homo sapiens
acagaguguuucacauuug

SEQ ID NO: 1375706 - RNA, 19 nt, Homo sapiens
cagagagccugucgguaau

SEQ ID NO: 1375707 - RNA, 19 nt, Homo sapiens
agauaagguuuaacagaug

SEQ ID NO: 1375708 - RNA, 19 nt, Homo sapiens
gaccagcuauggguaguuc

SEQ ID NO: 1375709 - RNA, 19 nt, Homo sapiens
guaagacuaacgcugcuuu

SEQ ID NO: 1375710 - RNA, 19 nt, Homo sapiens
gguugcagcugcuugaagu

SEQ ID NO: 1375711 - RNA, 19 nt, Homo sapiens
uaacgcugcuuuacucaac

SEQ ID NO: 1375712 - RNA, 19 nt, Homo sapiens
gugcucugcuauguuauuu

SEQ ID NO: 1375713 - RNA, 19 nt, Homo sapiens
agugagaaauccaagaaau

SEQ ID NO: 1375714 - RNA, 19 nt, Homo sapiens
ucacagagaccaagcugau

SEQ ID NO: 1375715 - RNA, 19 nt, Homo sapiens
ggaaaggaugccacacuuc

SEQ ID NO: 1375716 - RNA, 19 nt, Homo sapiens
gagagccugucgguaauuc

SEQ ID NO: 1375717 - RNA, 19 nt, Homo sapiens
cuaauguugucccucacua

SEQ ID NO: 1375718 - RNA, 19 nt, Homo sapiens
cccauuaauuccagcauug

SEQ ID NO: 1375719 - RNA, 19 nt, Homo sapiens
uaagacuaacgcugcuuua

SEQ ID NO: 1375720 - RNA, 19 nt, Homo sapiens
gagaaauccaagaaaugaa

SEQ ID NO: 1375721 - RNA, 19 nt, Homo sapiens
ggguguguaugauauagug

SEQ ID NO: 1375722 - RNA, 19 nt, Homo sapiens
gugaucaggguguguauga

SEQ ID NO: 1375723 - RNA, 19 nt, Homo sapiens
caaggcaaacucuauaugg

SEQ ID NO: 1375724 - RNA, 19 nt, Homo sapiens
cagcgugggcuucaucuug

SEQ ID NO: 1375725 - RNA, 19 nt, Homo sapiens
ccucauuccugguguuauc

SEQ ID NO: 1375726 - RNA, 19 nt, Homo sapiens
gacagaaggcgagcgauau

SEQ ID NO: 1375727 - RNA, 19 nt, Homo sapiens
gacaaggcaaacucuauau

SEQ ID NO: 1375728 - RNA, 19 nt, Homo sapiens
acagauaagguuuaacaga

SEQ ID NO: 1375729 - RNA, 19 nt, Homo sapiens
uaacuucucacaugggaau

SEQ ID NO: 1375730 - RNA, 19 nt, Homo sapiens
gcagcuuucuguaacuucu

SEQ ID NO: 1375731 - RNA, 19 nt, Homo sapiens
gugagaaauccaagaaaug

SEQ ID NO: 1375732 - RNA, 19 nt, Homo sapiens
gaaaucguuggcguaguaa

SEQ ID NO: 1375733 - RNA, 19 nt, Homo sapiens
ucagugagaaauccaagaa

SEQ ID NO: 1375734 - RNA, 19 nt, Homo sapiens
acaggaauauugaacuucu

SEQ ID NO: 1375735 - RNA, 19 nt, Homo sapiens
gcuacaugcuccaacaaac

SEQ ID NO: 1375736 - RNA, 19 nt, Homo sapiens
ggagugacagaguguuuca

SEQ ID NO: 1375737 - RNA, 19 nt, Homo sapiens
gccugucgguaauucuuaa

SEQ ID NO: 1375738 - RNA, 19 nt, Homo sapiens
uaagacaaggcaaacucua

SEQ ID NO: 1375739 - RNA, 19 nt, Homo sapiens
gcuuugcagcuuucuguaa

SEQ ID NO: 1375740 - RNA, 19 nt, Homo sapiens
ugcaagaggcggacuuuga

SEQ ID NO: 1375741 - RNA, 19 nt, Homo sapiens
gaauauugaacuucuucug

SEQ ID NO: 1375742 - RNA, 19 nt, Homo sapiens
gcccagacgcacugacaaa

SEQ ID NO: 1375743 - RNA, 19 nt, Homo sapiens
acgcagagccuuugcuuca

SEQ ID NO: 1375744 - RNA, 19 nt, Homo sapiens
ggcgagcgauaugugauga

SEQ ID NO: 1375745 - RNA, 19 nt, Homo sapiens
ccgcagagcaugucucagu

SEQ ID NO: 1375746 - RNA, 19 nt, Homo sapiens
uugcacuggugacagauaa

SEQ ID NO: 1375747 - RNA, 19 nt, Homo sapiens
ccacauggaaacagagugu

SEQ ID NO: 1375748 - RNA, 19 nt, Homo sapiens
gaacagcggugccgucauc

SEQ ID NO: 1375749 - RNA, 19 nt, Homo sapiens
gggcgacguugcauaaaua

SEQ ID NO: 1375750 - RNA, 19 nt, Homo sapiens
gaacaaagucuccuugcaa

SEQ ID NO: 1375751 - RNA, 19 nt, Homo sapiens
uaaguuggcuguucagaug

SEQ ID NO: 1375752 - RNA, 19 nt, Homo sapiens
gaucagcucuacucauuuc

SEQ ID NO: 1375753 - RNA, 19 nt, Homo sapiens
gaugauggcugaugaagag

SEQ ID NO: 1375754 - RNA, 19 nt, Homo sapiens
ggacugacacugaagauga

SEQ ID NO: 1375755 - RNA, 19 nt, Homo sapiens
cagagaaaguugacagaaa

SEQ ID NO: 1375756 - RNA, 19 nt, Homo sapiens
gauggccgcuccugguaua

SEQ ID NO: 1375757 - RNA, 19 nt, Homo sapiens
ggaggaauguuuuaaauga

SEQ ID NO: 1375758 - RNA, 19 nt, Homo sapiens
gcagugaugguguacaaua

SEQ ID NO: 1375759 - RNA, 19 nt, Homo sapiens
ggaauuccuggauagauua

SEQ ID NO: 1375760 - RNA, 19 nt, Homo sapiens
gcacaaguucuaaugcuaa

SEQ ID NO: 1375761 - RNA, 19 nt, Homo sapiens
cugaggagcuucugucaaa

SEQ ID NO: 1375762 - RNA, 19 nt, Homo sapiens
cacauacucuucuggcaua

SEQ ID NO: 1375763 - RNA, 19 nt, Homo sapiens
gcauaucucuccugucucu

SEQ ID NO: 1375764 - RNA, 19 nt, Homo sapiens
gaauucagcacaaaggaaa

SEQ ID NO: 1375765 - RNA, 19 nt, Homo sapiens
uggaucagcucuacucauu

SEQ ID NO: 1375766 - RNA, 19 nt, Homo sapiens
gcaaagagcauggaauugg

SEQ ID NO: 1375767 - RNA, 19 nt, Homo sapiens
gcuaugcagugauggugua

SEQ ID NO: 1375768 - RNA, 19 nt, Homo sapiens
gcaacaacuucuggaauuc

SEQ ID NO: 1375769 - RNA, 19 nt, Homo sapiens
ggaacaaagucuccuugca

SEQ ID NO: 1375770 - RNA, 19 nt, Homo sapiens
gggagaugauggcugauga

SEQ ID NO: 1375771 - RNA, 19 nt, Homo sapiens
caggagcccucacccauug

SEQ ID NO: 1375772 - RNA, 19 nt, Homo sapiens
guuguugccuccuuccuaa

SEQ ID NO: 1375773 - RNA, 19 nt, Homo sapiens
ggaauugguagaagucuug

SEQ ID NO: 1375774 - RNA, 19 nt, Homo sapiens
aaaugugacuccugacuau

SEQ ID NO: 1375775 - RNA, 19 nt, Homo sapiens
gggaaagcacuaaauguga

SEQ ID NO: 1375776 - RNA, 19 nt, Homo sapiens
gggcaaggcacaaguucua

SEQ ID NO: 1375777 - RNA, 19 nt, Homo sapiens
guagaagucuugggaucuu

SEQ ID NO: 1375778 - RNA, 19 nt, Homo sapiens
gugaaugaccuuugacuug

SEQ ID NO: 1375779 - RNA, 19 nt, Homo sapiens
gcacaaaggaaaggacuau

SEQ ID NO: 1375780 - RNA, 19 nt, Homo sapiens
gcaacgagagcaacaacuu

SEQ ID NO: 1375781 - RNA, 19 nt, Homo sapiens
gcagauggaagaaguagug

SEQ ID NO: 1375782 - RNA, 19 nt, Homo sapiens
caaagagcauggaauuggu

SEQ ID NO: 1375783 - RNA, 19 nt, Homo sapiens
ggaccuugcuaugcaguga

SEQ ID NO: 1375784 - RNA, 19 nt, Homo sapiens
uggaauuccuggauagauu

SEQ ID NO: 1375785 - RNA, 19 nt, Homo sapiens
ggcacaaguucuaaugcua

SEQ ID NO: 1375786 - RNA, 19 nt, Homo sapiens
ugggaaaggugguauuuag

SEQ ID NO: 1375787 - RNA, 19 nt, Homo sapiens
aacaaagucuccuugcaaa

SEQ ID NO: 1375788 - RNA, 19 nt, Homo sapiens
ggaggaagcaacaggaugu

SEQ ID NO: 1375789 - RNA, 19 nt, Homo sapiens
uggcauaucucuccugucu

SEQ ID NO: 1375790 - RNA, 19 nt, Homo sapiens
gcauggaauugguagaagu

SEQ ID NO: 1375791 - RNA, 19 nt, Homo sapiens
gacugacacugaagaugaa

SEQ ID NO: 1375792 - RNA, 19 nt, Homo sapiens
gagcauggaauugguagaa

SEQ ID NO: 1375793 - RNA, 19 nt, Homo sapiens
ccacugcucucuauguuuu

SEQ ID NO: 1375794 - RNA, 19 nt, Homo sapiens
agcaacaacuucuggaauu

SEQ ID NO: 1375795 - RNA, 19 nt, Homo sapiens
aagcaaagagcauggaauu

SEQ ID NO: 1375796 - RNA, 19 nt, Homo sapiens
uaaaugugacuccugacua

SEQ ID NO: 1375797 - RNA, 19 nt, Homo sapiens
gcagagaaaguugacagaa

SEQ ID NO: 1375798 - RNA, 19 nt, Homo sapiens
aagccgaucuugcagaaau

SEQ ID NO: 1375799 - RNA, 19 nt, Homo sapiens
ccugguagauucagaugga

SEQ ID NO: 1375800 - RNA, 19 nt, Homo sapiens
gagcaacaacuucuggaau

SEQ ID NO: 1375801 - RNA, 19 nt, Homo sapiens
uggagacucuguagccauu

SEQ ID NO: 1375802 - RNA, 19 nt, Homo sapiens
cuugggaauucauaucuuu

SEQ ID NO: 1375803 - RNA, 19 nt, Homo sapiens
ccagccacauccagugauu

SEQ ID NO: 1375804 - RNA, 19 nt, Homo sapiens
gugaugguguacaauauag

SEQ ID NO: 1375805 - RNA, 19 nt, Homo sapiens
cuucuggaauuccuggaua

SEQ ID NO: 1375806 - RNA, 19 nt, Homo sapiens
gauggcugaugaagaggaa

SEQ ID NO: 1375807 - RNA, 19 nt, Homo sapiens
gaaugaccuuugacuugca

SEQ ID NO: 1375808 - RNA, 19 nt, Homo sapiens
cagugaugguguacaauau

SEQ ID NO: 1375809 - RNA, 19 nt, Homo sapiens
gaagaagucaagccgaucu

SEQ ID NO: 1375810 - RNA, 19 nt, Homo sapiens
ugggugagguguacuggaa

SEQ ID NO: 1375811 - RNA, 19 nt, Homo sapiens
ucucuucucucuccucugu

SEQ ID NO: 1375812 - RNA, 19 nt, Homo sapiens
cuucguaucucuucucucu

SEQ ID NO: 1375813 - RNA, 19 nt, Homo sapiens
cauuuggccugguagauuc

SEQ ID NO: 1375814 - RNA, 19 nt, Homo sapiens
agagaaaguugacagaaaa

SEQ ID NO: 1375815 - RNA, 19 nt, Homo sapiens
ugcaggaacucguggauca

SEQ ID NO: 1375816 - RNA, 19 nt, Homo sapiens
agacugcuauuucgagaca

SEQ ID NO: 1375817 - RNA, 19 nt, Homo sapiens
cagugugaaugaccuuuga

SEQ ID NO: 1375818 - RNA, 19 nt, Homo sapiens
agggaaaggugaagaccaa

SEQ ID NO: 1375819 - RNA, 19 nt, Homo sapiens
ccagccuccuugagaguaa

SEQ ID NO: 1375820 - RNA, 19 nt, Homo sapiens
ggccagaacccuaagaucu

SEQ ID NO: 1375821 - RNA, 19 nt, Homo sapiens
uuccuaagccucauaugua

SEQ ID NO: 1375822 - RNA, 19 nt, Homo sapiens
caaggcacaaguucuaaug

SEQ ID NO: 1375823 - RNA, 19 nt, Homo sapiens
ccucuguccucaucauguu

SEQ ID NO: 1375824 - RNA, 19 nt, Homo sapiens
ucaccgaauucagcacaaa

SEQ ID NO: 1375825 - RNA, 19 nt, Homo sapiens
uauuuagccucaccacaga

SEQ ID NO: 1375826 - RNA, 19 nt, Homo sapiens
gcaaggcacaaguucuaau

SEQ ID NO: 1375827 - RNA, 19 nt, Homo sapiens
gaauuccuggauagauuaa

SEQ ID NO: 1375828 - RNA, 19 nt, Homo sapiens
acagggcgacguugcauaa

SEQ ID NO: 1375829 - RNA, 19 nt, Homo sapiens
ggagaugauggcugaugaa

SEQ ID NO: 1375830 - RNA, 19 nt, Homo sapiens
acaaaggaaaggacuauuc

SEQ ID NO: 1375831 - RNA, 19 nt, Homo sapiens
caacgagagcaacaacuuc

SEQ ID NO: 1375832 - RNA, 19 nt, Homo sapiens
gcucauuggagacucugua

SEQ ID NO: 1375833 - RNA, 19 nt, Homo sapiens
gcugcggacugacacugaa

SEQ ID NO: 1375834 - RNA, 19 nt, Homo sapiens
uaacugggaaagcacuaaa

SEQ ID NO: 1375835 - RNA, 19 nt, Homo sapiens
gggcuggaacagaauuaaa

SEQ ID NO: 1375836 - RNA, 19 nt, Homo sapiens
cagcagggaugggaggaau

SEQ ID NO: 1375837 - RNA, 19 nt, Homo sapiens
gaacagggcgacguugcau

SEQ ID NO: 1375838 - RNA, 19 nt, Homo sapiens
cuacuggccagaacccuaa

SEQ ID NO: 1375839 - RNA, 19 nt, Homo sapiens
aaagagcauggaauuggua

SEQ ID NO: 1375840 - RNA, 19 nt, Homo sapiens
ugacuugcaugcucaacag

SEQ ID NO: 1375841 - RNA, 19 nt, Homo sapiens
ucagauggaccuugcuaug

SEQ ID NO: 1375842 - RNA, 19 nt, Homo sapiens
ggccgcuccugguauauuc

SEQ ID NO: 1375843 - RNA, 19 nt, Homo sapiens
uccuaagccucauauguau

SEQ ID NO: 1375844 - RNA, 19 nt, Homo sapiens
ggaucagcucuacucauuu

SEQ ID NO: 1375845 - RNA, 19 nt, Homo sapiens
uacagcagauggaagaagu

SEQ ID NO: 1375846 - RNA, 19 nt, Homo sapiens
cgaauucagcacaaaggaa

SEQ ID NO: 1375847 - RNA, 19 nt, Homo sapiens
agauggaccuugcuaugca

SEQ ID NO: 1375848 - RNA, 19 nt, Homo sapiens
aaacuuagcuauccacaug

SEQ ID NO: 1375849 - RNA, 19 nt, Homo sapiens
gaagacagcaacuuacauu

SEQ ID NO: 1375850 - RNA, 19 nt, Homo sapiens
gacagcaacuuacauuaug

SEQ ID NO: 1375851 - RNA, 19 nt, Homo sapiens
ugaaacacgugcauuuaga

SEQ ID NO: 1375852 - RNA, 19 nt, Homo sapiens
ggaguuaauaguugguuua

SEQ ID NO: 1375853 - RNA, 19 nt, Homo sapiens
caaacaagacggacacuga

SEQ ID NO: 1375854 - RNA, 19 nt, Homo sapiens
gggagaaccuacugcuuug

SEQ ID NO: 1375855 - RNA, 19 nt, Homo sapiens
caucaacuuuccagaagaa

SEQ ID NO: 1375856 - RNA, 19 nt, Homo sapiens
gaacgggacccugguguga

SEQ ID NO: 1375857 - RNA, 19 nt, Homo sapiens
gaaacacgugcauuuagaa

SEQ ID NO: 1375858 - RNA, 19 nt, Homo sapiens
gaccucaagucagugauaa

SEQ ID NO: 1375859 - RNA, 19 nt, Homo sapiens
ggaccucaagucagugaua

SEQ ID NO: 1375860 - RNA, 19 nt, Homo sapiens
guuaauaguugguuuagcu

SEQ ID NO: 1375861 - RNA, 19 nt, Homo sapiens
uaaacggccugagaaacaa

SEQ ID NO: 1375862 - RNA, 19 nt, Homo sapiens
caauaaacggccugagaaa

SEQ ID NO: 1375863 - RNA, 19 nt, Homo sapiens
ucaauaaacggccugagaa

SEQ ID NO: 1375864 - RNA, 19 nt, Homo sapiens
ggagcugcccaucaacuuu

SEQ ID NO: 1375865 - RNA, 19 nt, Homo sapiens
gcacgugggcugaucuugu

SEQ ID NO: 1375866 - RNA, 19 nt, Homo sapiens
ggguggauagcuaaacuua

SEQ ID NO: 1375867 - RNA, 19 nt, Homo sapiens
gcacagugaggccuggaaa

SEQ ID NO: 1375868 - RNA, 19 nt, Homo sapiens
gaccuuaacagacaaaugg

SEQ ID NO: 1375869 - RNA, 19 nt, Homo sapiens
cacgugggcugaucuuguu

SEQ ID NO: 1375870 - RNA, 19 nt, Homo sapiens
agacagcaacuuacauuau

SEQ ID NO: 1375871 - RNA, 19 nt, Homo sapiens
gaagugaaacacgugcauu

SEQ ID NO: 1375872 - RNA, 19 nt, Homo sapiens
ccaaagggccaugaaacaa

SEQ ID NO: 1375873 - RNA, 19 nt, Homo sapiens
agaaaacgcuacagaguau

SEQ ID NO: 1375874 - RNA, 19 nt, Homo sapiens
gcagcagaaucucccaaag

SEQ ID NO: 1375875 - RNA, 19 nt, Homo sapiens
aaacaagacggacacugaa

SEQ ID NO: 1375876 - RNA, 19 nt, Homo sapiens
gaaaagaggaagccaaaca

SEQ ID NO: 1375877 - RNA, 19 nt, Homo sapiens
aaacaacaggacauacgua

SEQ ID NO: 1375878 - RNA, 19 nt, Homo sapiens
gucggaagacagcaacuua

SEQ ID NO: 1375879 - RNA, 19 nt, Homo sapiens
gaaacaacaggacauacgu

SEQ ID NO: 1375880 - RNA, 19 nt, Homo sapiens
aaagggccaugaaacaaca

SEQ ID NO: 1375881 - RNA, 19 nt, Homo sapiens
ggaggaaggcccaguccau

SEQ ID NO: 1375882 - RNA, 19 nt, Homo sapiens
caugaaacaacaggacaua

SEQ ID NO: 1375883 - RNA, 19 nt, Homo sapiens
aaacacgugcauuuagaaa

SEQ ID NO: 1375884 - RNA, 19 nt, Homo sapiens
gcagaaagagcagguaaaa

SEQ ID NO: 1375885 - RNA, 19 nt, Homo sapiens
acuguuagguuggaguuaa

SEQ ID NO: 1375886 - RNA, 19 nt, Homo sapiens
acauuaugcugacauucaa

SEQ ID NO: 1375887 - RNA, 19 nt, Homo sapiens
gagcugcccaucaacuuuc

SEQ ID NO: 1375888 - RNA, 19 nt, Homo sapiens
uuccagaccuuaacagaca

SEQ ID NO: 1375889 - RNA, 19 nt, Homo sapiens
ggaagacagcaacuuacau

SEQ ID NO: 1375890 - RNA, 19 nt, Homo sapiens
gcccaucaacuuuccagaa

SEQ ID NO: 1375891 - RNA, 19 nt, Homo sapiens
agugaggccuggaaacuuc

SEQ ID NO: 1375892 - RNA, 19 nt, Homo sapiens
ccaucaacuuuccagaaga

SEQ ID NO: 1375893 - RNA, 19 nt, Homo sapiens
gugaaacacgugcauuuag

SEQ ID NO: 1375894 - RNA, 19 nt, Homo sapiens
auaaacggccugagaaaca

SEQ ID NO: 1375895 - RNA, 19 nt, Homo sapiens
guuuagcuauggguggaua

SEQ ID NO: 1375896 - RNA, 19 nt, Homo sapiens
ccucuuacuugccacuguu

SEQ ID NO: 1375897 - RNA, 19 nt, Homo sapiens
ugugagcgcuugggaggaa

SEQ ID NO: 1375898 - RNA, 19 nt, Homo sapiens
ugaucuuguuggacuuuaa

SEQ ID NO: 1375899 - RNA, 19 nt, Homo sapiens
gugcagaaagagcagguaa

SEQ ID NO: 1375900 - RNA, 19 nt, Homo sapiens
agugaaacacgugcauuua

SEQ ID NO: 1375901 - RNA, 19 nt, Homo sapiens
caaagggccaugaaacaac

SEQ ID NO: 1375902 - RNA, 19 nt, Homo sapiens
cccaucaacuuuccagaag

SEQ ID NO: 1375903 - RNA, 19 nt, Homo sapiens
gaucuuguuggacuuuaau

SEQ ID NO: 1375904 - RNA, 19 nt, Homo sapiens
ggggagaaccuacugcuuu

SEQ ID NO: 1375905 - RNA, 19 nt, Homo sapiens
ggccacaccucgcuaugac

SEQ ID NO: 1375906 - RNA, 19 nt, Homo sapiens
gcagcaagggucucaagag

SEQ ID NO: 1375907 - RNA, 19 nt, Homo sapiens
ccgcuaggaucaauaaacg

SEQ ID NO: 1375908 - RNA, 19 nt, Homo sapiens
uagguuggaguuaauaguu

SEQ ID NO: 1375909 - RNA, 19 nt, Homo sapiens
gaaggcccaguccaucguu

SEQ ID NO: 1375910 - RNA, 19 nt, Homo sapiens
aagaggaagccaaacaaga

SEQ ID NO: 1375911 - RNA, 19 nt, Homo sapiens
aagacagcaacuuacauua

SEQ ID NO: 1375912 - RNA, 19 nt, Homo sapiens
gcugaggcguggaggaaac

SEQ ID NO: 1375913 - RNA, 19 nt, Homo sapiens
gacagagcgccaugggaaa

SEQ ID NO: 1375914 - RNA, 19 nt, Homo sapiens
aagugaaacacgugcauuu

SEQ ID NO: 1375915 - RNA, 19 nt, Homo sapiens
uacauuaugcugacauuca

SEQ ID NO: 1375916 - RNA, 19 nt, Homo sapiens
ggaagugaaacacgugcau

SEQ ID NO: 1375917 - RNA, 19 nt, Homo sapiens
cuccugcucuugcaaagug

SEQ ID NO: 1375918 - RNA, 19 nt, Homo sapiens
uggaguuaauaguugguuu

SEQ ID NO: 1375919 - RNA, 19 nt, Homo sapiens
caaagccccuggaauugug

SEQ ID NO: 1375920 - RNA, 19 nt, Homo sapiens
uagaaaacgcuacagagua

SEQ ID NO: 1375921 - RNA, 19 nt, Homo sapiens
auucugagcuuuuacauuc

SEQ ID NO: 1375922 - RNA, 19 nt, Homo sapiens
cguaugaacggguguuaca

SEQ ID NO: 1375923 - RNA, 19 nt, Homo sapiens
cagggauguuguccacguu

SEQ ID NO: 1375924 - RNA, 19 nt, Homo sapiens
cagcagaaucucccaaagg

SEQ ID NO: 1375925 - RNA, 19 nt, Homo sapiens
cauuguugcuccugcucuu

SEQ ID NO: 1375926 - RNA, 19 nt, Homo sapiens
uucaggaccucaagucagu

SEQ ID NO: 1375927 - RNA, 19 nt, Homo sapiens
cccaaagggccaugaaaca

SEQ ID NO: 1375928 - RNA, 19 nt, Homo sapiens
guuggacuuuaauuaaugg

SEQ ID NO: 1375929 - RNA, 19 nt, Homo sapiens
ggaaggcccaguccaucgu

SEQ ID NO: 1375930 - RNA, 19 nt, Homo sapiens
cuuacauuaugcugacauu

SEQ ID NO: 1375931 - RNA, 19 nt, Homo sapiens
cggaagacagcaacuuaca

SEQ ID NO: 1375932 - RNA, 19 nt, Homo sapiens
agguuggaguuaauaguug

SEQ ID NO: 1375933 - RNA, 19 nt, Homo sapiens
guccaucguuaaccacuac

SEQ ID NO: 1375934 - RNA, 19 nt, Homo sapiens
aaggcccaguccaucguua

SEQ ID NO: 1375935 - RNA, 19 nt, Homo sapiens
ccaaauaaacagugcauua

SEQ ID NO: 1375936 - RNA, 19 nt, Homo sapiens
ggaaaucacagaucaggaa

SEQ ID NO: 1375937 - RNA, 19 nt, Homo sapiens
cgucaaauaucaggaauga

SEQ ID NO: 1375938 - RNA, 19 nt, Homo sapiens
gcacgcgggucacucauuc

SEQ ID NO: 1375939 - RNA, 19 nt, Homo sapiens
acacacagauauagacaug

SEQ ID NO: 1375940 - RNA, 19 nt, Homo sapiens
gagcaacaagaaacgaaua

SEQ ID NO: 1375941 - RNA, 19 nt, Homo sapiens
gagcugaacauguccauca

SEQ ID NO: 1375942 - RNA, 19 nt, Homo sapiens
gaccaacagucucuucauc

SEQ ID NO: 1375943 - RNA, 19 nt, Homo sapiens
ccaauaaacacuccaaucu

SEQ ID NO: 1375944 - RNA, 19 nt, Homo sapiens
caaauaaacagugcauuag

SEQ ID NO: 1375945 - RNA, 19 nt, Homo sapiens
ugaaggaggccaucaagga

SEQ ID NO: 1375946 - RNA, 19 nt, Homo sapiens
ucacagaucaggaacacaa

SEQ ID NO: 1375947 - RNA, 19 nt, Homo sapiens
gagccuaaguaccuuucuu

SEQ ID NO: 1375948 - RNA, 19 nt, Homo sapiens
ccaacagucucuucaucga

SEQ ID NO: 1375949 - RNA, 19 nt, Homo sapiens
uggaggagcugaacauguc

SEQ ID NO: 1375950 - RNA, 19 nt, Homo sapiens
ggucacucauucccacuga

SEQ ID NO: 1375951 - RNA, 19 nt, Homo sapiens
gcaacaagaaacgaauaaa

SEQ ID NO: 1375952 - RNA, 19 nt, Homo sapiens
ggccaguccuguccuguca

SEQ ID NO: 1375953 - RNA, 19 nt, Homo sapiens
ccagagacccggaccaagu

SEQ ID NO: 1375954 - RNA, 19 nt, Homo sapiens
aaacagugcauuagcuuuc

SEQ ID NO: 1375955 - RNA, 19 nt, Homo sapiens
uaaacagugcauuagcuuu

SEQ ID NO: 1375956 - RNA, 19 nt, Homo sapiens
acaugagccuggagaagga

SEQ ID NO: 1375957 - RNA, 19 nt, Homo sapiens
ccuuaaacacacagauaua

SEQ ID NO: 1375958 - RNA, 19 nt, Homo sapiens
cccgguaggugcauacuuc

SEQ ID NO: 1375959 - RNA, 19 nt, Homo sapiens
acacagauauagacaugac

SEQ ID NO: 1375960 - RNA, 19 nt, Homo sapiens
acaagaugcugcgggaaau

SEQ ID NO: 1375961 - RNA, 19 nt, Homo sapiens
cacaagaugcugcgggaaa

SEQ ID NO: 1375962 - RNA, 19 nt, Homo sapiens
ggcuguaccugcucucaca

SEQ ID NO: 1375963 - RNA, 19 nt, Homo sapiens
aauaaacagugcauuagcu

SEQ ID NO: 1375964 - RNA, 19 nt, Homo sapiens
gcauagaugggccguccuu

SEQ ID NO: 1375965 - RNA, 19 nt, Homo sapiens
guggcuauguuuccagugu

SEQ ID NO: 1375966 - RNA, 19 nt, Homo sapiens
cagcaccaccugcacaaga

SEQ ID NO: 1375967 - RNA, 19 nt, Homo sapiens
caauaaacacuccaaucuc

SEQ ID NO: 1375968 - RNA, 19 nt, Homo sapiens
cagagacccggaccaaguu

SEQ ID NO: 1375969 - RNA, 19 nt, Homo sapiens
acuccaaucuccacacaca

SEQ ID NO: 1375970 - RNA, 19 nt, Homo sapiens
gccuuaaacacacagauau

SEQ ID NO: 1375971 - RNA, 19 nt, Homo sapiens
cuggugggauccuuucaug

SEQ ID NO: 1375972 - RNA, 19 nt, Homo sapiens
cuccuuccgucaaauauca

SEQ ID NO: 1375973 - RNA, 19 nt, Homo sapiens
ggugccuccuuccgucaaa

SEQ ID NO: 1375974 - RNA, 19 nt, Homo sapiens
acacuccaaucuccacaca

SEQ ID NO: 1375975 - RNA, 19 nt, Homo sapiens
caaguucacacaggacaau

SEQ ID NO: 1375976 - RNA, 19 nt, Homo sapiens
caagaaacgaauaaaucuc

SEQ ID NO: 1375977 - RNA, 19 nt, Homo sapiens
aaacacacagauauagaca

SEQ ID NO: 1375978 - RNA, 19 nt, Homo sapiens
guacugccugggccacuga

SEQ ID NO: 1375979 - RNA, 19 nt, Homo sapiens
gcacugaaggaggccauca

SEQ ID NO: 1375980 - RNA, 19 nt, Homo sapiens
uaaacacacagauauagac

SEQ ID NO: 1375981 - RNA, 19 nt, Homo sapiens
ugcgggaaaucacagauca

SEQ ID NO: 1375982 - RNA, 19 nt, Homo sapiens
ucgaggacauccacaugag

SEQ ID NO: 1375983 - RNA, 19 nt, Homo sapiens
caucaaggacaaggaggaa

SEQ ID NO: 1375984 - RNA, 19 nt, Homo sapiens
caacgugguggcacugaag

SEQ ID NO: 1375985 - RNA, 19 nt, Homo sapiens
acaacgugguggcacugaa

SEQ ID NO: 1375986 - RNA, 19 nt, Homo sapiens
gagaggggagggagaguuu

SEQ ID NO: 1375987 - RNA, 19 nt, Homo sapiens
guucaacgauguaaagaua

SEQ ID NO: 1375988 - RNA, 19 nt, Homo sapiens
gcaguagcauguuagauug

SEQ ID NO: 1375989 - RNA, 19 nt, Homo sapiens
ggaauacccaugucaauga

SEQ ID NO: 1375990 - RNA, 19 nt, Homo sapiens
gaauacccaugucaaugaa

SEQ ID NO: 1375991 - RNA, 19 nt, Homo sapiens
ggaaacucauggaaaccua

SEQ ID NO: 1375992 - RNA, 19 nt, Homo sapiens
gaacaccacuccagaugac

SEQ ID NO: 1375993 - RNA, 19 nt, Homo sapiens
ccaugucaaugaagaauga

SEQ ID NO: 1375994 - RNA, 19 nt, Homo sapiens
uaacaacgcaguagcaugu

SEQ ID NO: 1375995 - RNA, 19 nt, Homo sapiens
gagggaaacucauggaaac

SEQ ID NO: 1375996 - RNA, 19 nt, Homo sapiens
cuuaguagauuuccuuguu

SEQ ID NO: 1375997 - RNA, 19 nt, Homo sapiens
gauuugugcucuucgcauu

SEQ ID NO: 1375998 - RNA, 19 nt, Homo sapiens
acacaaggcuagacuacau

SEQ ID NO: 1375999 - RNA, 19 nt, Homo sapiens
cauccucacugcagaauca

SEQ ID NO: 1376000 - RNA, 19 nt, Homo sapiens
caacaucccacgugucaau

SEQ ID NO: 1376001 - RNA, 19 nt, Homo sapiens
acaacgcaguagcauguua

SEQ ID NO: 1376002 - RNA, 19 nt, Homo sapiens
uccaaagaguccaaaguuu

SEQ ID NO: 1376003 - RNA, 19 nt, Homo sapiens
ggaacaccacuccagauga

SEQ ID NO: 1376004 - RNA, 19 nt, Homo sapiens
caagaaagucagcaaaaua

SEQ ID NO: 1376005 - RNA, 19 nt, Homo sapiens
caggacagauggauggaau

SEQ ID NO: 1376006 - RNA, 19 nt, Homo sapiens
gcaaacacgugccuuucac

SEQ ID NO: 1376007 - RNA, 19 nt, Homo sapiens
guugggcuuuggauagaua

SEQ ID NO: 1376008 - RNA, 19 nt, Homo sapiens
cuacagagagccucaacaa

SEQ ID NO: 1376009 - RNA, 19 nt, Homo sapiens
guacugcugccgcauagaa

SEQ ID NO: 1376010 - RNA, 19 nt, Homo sapiens
ggaggaagccacaggucuu

SEQ ID NO: 1376011 - RNA, 19 nt, Homo sapiens
ugacaaccauugccgucuu

SEQ ID NO: 1376012 - RNA, 19 nt, Homo sapiens
gaaagugacagcggugugu

SEQ ID NO: 1376013 - RNA, 19 nt, Homo sapiens
gcgccugaaucuacagaga

SEQ ID NO: 1376014 - RNA, 19 nt, Homo sapiens
guccaaagaaccucucauu

SEQ ID NO: 1376015 - RNA, 19 nt, Homo sapiens
cgcaguagcauguuagauu

SEQ ID NO: 1376016 - RNA, 19 nt, Homo sapiens
cagagagccucaacaacca

SEQ ID NO: 1376017 - RNA, 19 nt, Homo sapiens
gauaaacgugcgccugaau

SEQ ID NO: 1376018 - RNA, 19 nt, Homo sapiens
gagguugggcuuuggauag

SEQ ID NO: 1376019 - RNA, 19 nt, Homo sapiens
aaacacgugccuuucacua

SEQ ID NO: 1376020 - RNA, 19 nt, Homo sapiens
gacaaccauugccgucuuc

SEQ ID NO: 1376021 - RNA, 19 nt, Homo sapiens
gaccacacccgaucucaca

SEQ ID NO: 1376022 - RNA, 19 nt, Homo sapiens
cagcugcacuuccaacaac

SEQ ID NO: 1376023 - RNA, 19 nt, Homo sapiens
gaaacucauggaaaccuau

SEQ ID NO: 1376024 - RNA, 19 nt, Homo sapiens
gaggugaugucuccuugac

SEQ ID NO: 1376025 - RNA, 19 nt, Homo sapiens
agaaugaaaugcccaucuc

SEQ ID NO: 1376026 - RNA, 19 nt, Homo sapiens
gcagaacaacaacaacaag

SEQ ID NO: 1376027 - RNA, 19 nt, Homo sapiens
gcauggaagggaagacgaa

SEQ ID NO: 1376028 - RNA, 19 nt, Homo sapiens
gagagggaaacucauggaa

SEQ ID NO: 1376029 - RNA, 19 nt, Homo sapiens
ggacagauggauggaauac

SEQ ID NO: 1376030 - RNA, 19 nt, Homo sapiens
agggugaccucaagaaagu

SEQ ID NO: 1376031 - RNA, 19 nt, Homo sapiens
caacaaccacgcacagaac

SEQ ID NO: 1376032 - RNA, 19 nt, Homo sapiens
ucaacaaccacgcacagaa

SEQ ID NO: 1376033 - RNA, 19 nt, Homo sapiens
uaguagauuuccuuguuuc

SEQ ID NO: 1376034 - RNA, 19 nt, Homo sapiens
cagcaguuccugagcagaa

SEQ ID NO: 1376035 - RNA, 19 nt, Homo sapiens
cagccuggagcaucugaua

SEQ ID NO: 1376036 - RNA, 19 nt, Homo sapiens
gaaagucagcaaaauauag

SEQ ID NO: 1376037 - RNA, 19 nt, Homo sapiens
cuacauuggagauaguaaa

SEQ ID NO: 1376038 - RNA, 19 nt, Homo sapiens
ggaaaacgagugauucugu

SEQ ID NO: 1376039 - RNA, 19 nt, Homo sapiens
agagggaaacucauggaaa

SEQ ID NO: 1376040 - RNA, 19 nt, Homo sapiens
gcccaucucccaacuacug

SEQ ID NO: 1376041 - RNA, 19 nt, Homo sapiens
cgagugauucugugucuuc

SEQ ID NO: 1376042 - RNA, 19 nt, Homo sapiens
acacgugccuuucacuaac

SEQ ID NO: 1376043 - RNA, 19 nt, Homo sapiens
auacccaugucaaugaaga

SEQ ID NO: 1376044 - RNA, 19 nt, Homo sapiens
uagacuacauuggagauag

SEQ ID NO: 1376045 - RNA, 19 nt, Homo sapiens
ugacuuugcccugucugua

SEQ ID NO: 1376046 - RNA, 19 nt, Homo sapiens
ucauggaaaccuauuguuc

SEQ ID NO: 1376047 - RNA, 19 nt, Homo sapiens
gagcagaacaaaacaacaa

SEQ ID NO: 1376048 - RNA, 19 nt, Homo sapiens
cugcugacauccaaagagu

SEQ ID NO: 1376049 - RNA, 19 nt, Homo sapiens
acacgcagaacaacaacaa

SEQ ID NO: 1376050 - RNA, 19 nt, Homo sapiens
caacgcaguagcauguuag

SEQ ID NO: 1376051 - RNA, 19 nt, Homo sapiens
caucccacgugucaaugug

SEQ ID NO: 1376052 - RNA, 19 nt, Homo sapiens
caccaccacccgacaaaug

SEQ ID NO: 1376053 - RNA, 19 nt, Homo sapiens
ucaagaaagucagcaaaau

SEQ ID NO: 1376054 - RNA, 19 nt, Homo sapiens
ggaagggcccauccucacu

SEQ ID NO: 1376055 - RNA, 19 nt, Homo sapiens
acagcaaacacgugccuuu

SEQ ID NO: 1376056 - RNA, 19 nt, Homo sapiens
gcucuucgcauuguuugug

SEQ ID NO: 1376057 - RNA, 19 nt, Homo sapiens
agugauuccuggaguagug

SEQ ID NO: 1376058 - RNA, 19 nt, Homo sapiens
cuacuucugcugacacugu

SEQ ID NO: 1376059 - RNA, 19 nt, Homo sapiens
cggaacaccacuccagaug

SEQ ID NO: 1376060 - RNA, 19 nt, Homo sapiens
agauaaacgugcgccugaa

SEQ ID NO: 1376061 - RNA, 19 nt, Homo sapiens
cacaacagcaacagcaugu

SEQ ID NO: 1376062 - RNA, 19 nt, Homo sapiens
gaagacgaagacggccuuu

SEQ ID NO: 1376063 - RNA, 19 nt, Homo sapiens
aaaccuauuguucgcagaa

SEQ ID NO: 1376064 - RNA, 19 nt, Homo sapiens
aaacucauggaaaccuauu

SEQ ID NO: 1376065 - RNA, 19 nt, Homo sapiens
ugacucccgagccuucuaa

SEQ ID NO: 1376066 - RNA, 19 nt, Homo sapiens
uaaacgugcgccugaaucu

SEQ ID NO: 1376067 - RNA, 19 nt, Homo sapiens
ccucaagaaagucagcaaa

SEQ ID NO: 1376068 - RNA, 19 nt, Homo sapiens
cagcaaacacgugccuuuc

SEQ ID NO: 1376069 - RNA, 19 nt, Homo sapiens
aaacgugcgccugaaucua

SEQ ID NO: 1376070 - RNA, 19 nt, Homo sapiens
gaagugccuggcugguuca

SEQ ID NO: 1376071 - RNA, 19 nt, Homo sapiens
guguacugcugccgcauag

SEQ ID NO: 1376072 - RNA, 19 nt, Homo sapiens
uggaauacccaugucaaug

SEQ ID NO: 1376073 - RNA, 19 nt, Homo sapiens
gcacagauuugcucagaaa

SEQ ID NO: 1376074 - RNA, 19 nt, Homo sapiens
gagaaacccucacagauga

SEQ ID NO: 1376075 - RNA, 19 nt, Homo sapiens
ggaaguaucuaucugauuc

SEQ ID NO: 1376076 - RNA, 19 nt, Homo sapiens
ccaaguaugugucugauuu

SEQ ID NO: 1376077 - RNA, 19 nt, Homo sapiens
ggacauagcugugauuucu

SEQ ID NO: 1376078 - RNA, 19 nt, Homo sapiens
ccaagcagcuggccacuga

SEQ ID NO: 1376079 - RNA, 19 nt, Homo sapiens
gaacagaugauucuuguca

SEQ ID NO: 1376080 - RNA, 19 nt, Homo sapiens
gaagaacucugccaagaac

SEQ ID NO: 1376081 - RNA, 19 nt, Homo sapiens
gaagguguuuacugaaauu

SEQ ID NO: 1376082 - RNA, 19 nt, Homo sapiens
ggagaaacccucacagaug

SEQ ID NO: 1376083 - RNA, 19 nt, Homo sapiens
auaauuaccuccagaaaga

SEQ ID NO: 1376084 - RNA, 19 nt, Homo sapiens
gaacaggacacaucucaau

SEQ ID NO: 1376085 - RNA, 19 nt, Homo sapiens
gagagcaucuugacagaca

SEQ ID NO: 1376086 - RNA, 19 nt, Homo sapiens
caagagcugugucaaagug

SEQ ID NO: 1376087 - RNA, 19 nt, Homo sapiens
caagccagauggaucauga

SEQ ID NO: 1376088 - RNA, 19 nt, Homo sapiens
gugaagguguuuacugaaa

SEQ ID NO: 1376089 - RNA, 19 nt, Homo sapiens
ccacugacaucgacuaucu

SEQ ID NO: 1376090 - RNA, 19 nt, Homo sapiens
guagaucaguccaaagugu

SEQ ID NO: 1376091 - RNA, 19 nt, Homo sapiens
ggaaacaagucaccaagcu

SEQ ID NO: 1376092 - RNA, 19 nt, Homo sapiens
agauaacccugcugaauau

SEQ ID NO: 1376093 - RNA, 19 nt, Homo sapiens
aagauaacccugcugaaua

SEQ ID NO: 1376094 - RNA, 19 nt, Homo sapiens
gaaacucugcccaagauug

SEQ ID NO: 1376095 - RNA, 19 nt, Homo sapiens
gguagaaauugaccaagug

SEQ ID NO: 1376096 - RNA, 19 nt, Homo sapiens
uuucagaacuccauuagga

SEQ ID NO: 1376097 - RNA, 19 nt, Homo sapiens
gauauugaggagacauuua

SEQ ID NO: 1376098 - RNA, 19 nt, Homo sapiens
caagugaaguccagaaugc

SEQ ID NO: 1376099 - RNA, 19 nt, Homo sapiens
gaauaugccaguuuaaugg

SEQ ID NO: 1376100 - RNA, 19 nt, Homo sapiens
gggaagugauugacugugu

SEQ ID NO: 1376101 - RNA, 19 nt, Homo sapiens
ccaccuacaugaacacaau

SEQ ID NO: 1376102 - RNA, 19 nt, Homo sapiens
gcagaacagcuuaaugaug

SEQ ID NO: 1376103 - RNA, 19 nt, Homo sapiens
gaacccauggcaagaauau

SEQ ID NO: 1376104 - RNA, 19 nt, Homo sapiens
gcugguggaugcuguguau

SEQ ID NO: 1376105 - RNA, 19 nt, Homo sapiens
ggcaagagcugugucaaag

SEQ ID NO: 1376106 - RNA, 19 nt, Homo sapiens
gagccacaaugcagaccua

SEQ ID NO: 1376107 - RNA, 19 nt, Homo sapiens
aagaagaacucugccaaga

SEQ ID NO: 1376108 - RNA, 19 nt, Homo sapiens
ccagugggcuacacagguu

SEQ ID NO: 1376109 - RNA, 19 nt, Homo sapiens
ccaaagugcuccgugaugu

SEQ ID NO: 1376110 - RNA, 19 nt, Homo sapiens
gcagcuagccaacaggauu

SEQ ID NO: 1376111 - RNA, 19 nt, Homo sapiens
uaacagguaugcagaacag

SEQ ID NO: 1376112 - RNA, 19 nt, Homo sapiens
gcccugaaaucccucuuug

SEQ ID NO: 1376113 - RNA, 19 nt, Homo sapiens
gaaguauggcgacauggaa

SEQ ID NO: 1376114 - RNA, 19 nt, Homo sapiens
gcugaaguauggcgacaug

SEQ ID NO: 1376115 - RNA, 19 nt, Homo sapiens
gugaaggaguggaucaaug

SEQ ID NO: 1376116 - RNA, 19 nt, Homo sapiens
gaagauggacagcuggaau

SEQ ID NO: 1376117 - RNA, 19 nt, Homo sapiens
ucaccaagcucuccagaac

SEQ ID NO: 1376118 - RNA, 19 nt, Homo sapiens
ucagaacuccauuaggaua

SEQ ID NO: 1376119 - RNA, 19 nt, Homo sapiens
uaauggugcugcugauuca

SEQ ID NO: 1376120 - RNA, 19 nt, Homo sapiens
caagauugggcagaaguua

SEQ ID NO: 1376121 - RNA, 19 nt, Homo sapiens
gcuuaaugaugcuuguuga

SEQ ID NO: 1376122 - RNA, 19 nt, Homo sapiens
gaaaccccaucucuacuaa

SEQ ID NO: 1376123 - RNA, 19 nt, Homo sapiens
ucaggaggacucugccuua

SEQ ID NO: 1376124 - RNA, 19 nt, Homo sapiens
guccacagcugggaaguau

SEQ ID NO: 1376125 - RNA, 19 nt, Homo sapiens
uaaugaugcuuguugauac

SEQ ID NO: 1376126 - RNA, 19 nt, Homo sapiens
gaaagauaacccugcugaa

SEQ ID NO: 1376127 - RNA, 19 nt, Homo sapiens
gcccggagccaacucuuaa

SEQ ID NO: 1376128 - RNA, 19 nt, Homo sapiens
gacaucgacuaucugauca

SEQ ID NO: 1376129 - RNA, 19 nt, Homo sapiens
caaugcagaccuacuguga

SEQ ID NO: 1376130 - RNA, 19 nt, Homo sapiens
acaccagacuacucagaaa

SEQ ID NO: 1376131 - RNA, 19 nt, Homo sapiens
ugacaucgacuaucugauc

SEQ ID NO: 1376132 - RNA, 19 nt, Homo sapiens
ugaauaugccaguuuaaug

SEQ ID NO: 1376133 - RNA, 19 nt, Homo sapiens
ugccgaaucucuucaggaa

SEQ ID NO: 1376134 - RNA, 19 nt, Homo sapiens
gaaauugaccaagugaagu

SEQ ID NO: 1376135 - RNA, 19 nt, Homo sapiens
ccuaccagcugaaguaugg

SEQ ID NO: 1376136 - RNA, 19 nt, Homo sapiens
ugaagguguuuacugaaau

SEQ ID NO: 1376137 - RNA, 19 nt, Homo sapiens
gcagguguugguagaaauu

SEQ ID NO: 1376138 - RNA, 19 nt, Homo sapiens
gugaugcgauccuacagau

SEQ ID NO: 1376139 - RNA, 19 nt, Homo sapiens
aaagauaacccugcugaau

SEQ ID NO: 1376140 - RNA, 19 nt, Homo sapiens
guaauggugcugcugauuc

SEQ ID NO: 1376141 - RNA, 19 nt, Homo sapiens
ccaugcggagugugaauua

SEQ ID NO: 1376142 - RNA, 19 nt, Homo sapiens
caagaacccauggcaagaa

SEQ ID NO: 1376143 - RNA, 19 nt, Homo sapiens
ggaggaaacaagucaccaa

SEQ ID NO: 1376144 - RNA, 19 nt, Homo sapiens
gauaaguggagcacguuga

SEQ ID NO: 1376145 - RNA, 19 nt, Homo sapiens
gagaccagccugaccaaca

SEQ ID NO: 1376146 - RNA, 19 nt, Homo sapiens
gcacguugagcgccgauau

SEQ ID NO: 1376147 - RNA, 19 nt, Homo sapiens
guagaaauugaccaaguga

SEQ ID NO: 1376148 - RNA, 19 nt, Homo sapiens
ccaugcagguguugguaga

SEQ ID NO: 1376149 - RNA, 19 nt, Homo sapiens
ggacuucgagcagcagcua

SEQ ID NO: 1376150 - RNA, 19 nt, Homo sapiens
gcaaccuccucauccagau

SEQ ID NO: 1376151 - RNA, 19 nt, Homo sapiens
gcacuuggaggcacugaag

SEQ ID NO: 1376152 - RNA, 19 nt, Homo sapiens
ugugauuucugccaagcua

SEQ ID NO: 1376153 - RNA, 19 nt, Homo sapiens
aagauggacagcuggaaua

SEQ ID NO: 1376154 - RNA, 19 nt, Homo sapiens
ugcugaauaugccaguuua

SEQ ID NO: 1376155 - RNA, 19 nt, Homo sapiens
cuacacagguuuuccagaa

SEQ ID NO: 1376156 - RNA, 19 nt, Homo sapiens
uaaaacaggaggcaucuuu

SEQ ID NO: 1376157 - RNA, 19 nt, Homo sapiens
ucagcaacaucgggcagua

SEQ ID NO: 1376158 - RNA, 19 nt, Homo sapiens
agaagaacucugccaagaa

SEQ ID NO: 1376159 - RNA, 19 nt, Homo sapiens
caaagugcuccgugauguu

SEQ ID NO: 1376160 - RNA, 19 nt, Homo sapiens
cagaacuccauuaggauaa

SEQ ID NO: 1376161 - RNA, 19 nt, Homo sapiens
uugugaagguguuuacuga

SEQ ID NO: 1376162 - RNA, 19 nt, Homo sapiens
augcagaacagcuuaauga

SEQ ID NO: 1376163 - RNA, 19 nt, Homo sapiens
ccacaaugcagaccuacug

SEQ ID NO: 1376164 - RNA, 19 nt, Homo sapiens
gcagcgcugacucggcuua

SEQ ID NO: 1376165 - RNA, 19 nt, Homo sapiens
cugccaagcuaacagguau

SEQ ID NO: 1376166 - RNA, 19 nt, Homo sapiens
ccacacaccggaccaccaa

SEQ ID NO: 1376167 - RNA, 19 nt, Homo sapiens
augcagaccuacugugaug

SEQ ID NO: 1376168 - RNA, 19 nt, Homo sapiens
gggaaguaucuaucugauu

SEQ ID NO: 1376169 - RNA, 19 nt, Homo sapiens
caugaacacaaucugguaa

SEQ ID NO: 1376170 - RNA, 19 nt, Homo sapiens
gcagcuuaccggacucuau

SEQ ID NO: 1376171 - RNA, 19 nt, Homo sapiens
cuacugugaugcgauccua

SEQ ID NO: 1376172 - RNA, 19 nt, Homo sapiens
ccaagaacccauggcaaga

SEQ ID NO: 1376173 - RNA, 19 nt, Homo sapiens
gaagaaagcuuaaguaaac

SEQ ID NO: 1376174 - RNA, 19 nt, Homo sapiens
gaagagccauggaucauaa

SEQ ID NO: 1376175 - RNA, 19 nt, Homo sapiens
ggagaaaccuuaugauugu

SEQ ID NO: 1376176 - RNA, 19 nt, Homo sapiens
ggaaagacccuaucaaugu

SEQ ID NO: 1376177 - RNA, 19 nt, Homo sapiens
gaaagaaaccauaugauug

SEQ ID NO: 1376178 - RNA, 19 nt, Homo sapiens
ggaaagaaaccauaugauu

SEQ ID NO: 1376179 - RNA, 19 nt, Homo sapiens
aguauuagcucaagccuua

SEQ ID NO: 1376180 - RNA, 19 nt, Homo sapiens
ugacagcgguucccauuaa

SEQ ID NO: 1376181 - RNA, 19 nt, Homo sapiens
gaaguuucaucuuguugua

SEQ ID NO: 1376182 - RNA, 19 nt, Homo sapiens
gaaagacccuaucaaugug

SEQ ID NO: 1376183 - RNA, 19 nt, Homo sapiens
agagaaaccuuacauaugu

SEQ ID NO: 1376184 - RNA, 19 nt, Homo sapiens
caucagggcauaaauauaa

SEQ ID NO: 1376185 - RNA, 19 nt, Homo sapiens
gaucauaaagggagacaua

SEQ ID NO: 1376186 - RNA, 19 nt, Homo sapiens
gacaacaucccaauagaua

SEQ ID NO: 1376187 - RNA, 19 nt, Homo sapiens
cagaaaagccuuaguauua

SEQ ID NO: 1376188 - RNA, 19 nt, Homo sapiens
gcuaagaagucacaacuca

SEQ ID NO: 1376189 - RNA, 19 nt, Homo sapiens
cuacaaaugugcucaaugu

SEQ ID NO: 1376190 - RNA, 19 nt, Homo sapiens
ggaagaaagcuuaaguaaa

SEQ ID NO: 1376191 - RNA, 19 nt, Homo sapiens
gggaauuuguuucuaguuu

SEQ ID NO: 1376192 - RNA, 19 nt, Homo sapiens
ggagagaaaccuuacauau

SEQ ID NO: 1376193 - RNA, 19 nt, Homo sapiens
ggagacauaucaaauugga

SEQ ID NO: 1376194 - RNA, 19 nt, Homo sapiens
gggaaagccuucucucaga

SEQ ID NO: 1376195 - RNA, 19 nt, Homo sapiens
agacagaacucauuacaca

SEQ ID NO: 1376196 - RNA, 19 nt, Homo sapiens
gggaaagccuucugugaga

SEQ ID NO: 1376197 - RNA, 19 nt, Homo sapiens
ggaauuuguuucuaguuug

SEQ ID NO: 1376198 - RNA, 19 nt, Homo sapiens
gagagaaaccuuacauaug

SEQ ID NO: 1376199 - RNA, 19 nt, Homo sapiens
gaagucacaucucauugga

SEQ ID NO: 1376200 - RNA, 19 nt, Homo sapiens
ggacaccagcgaauucaua

SEQ ID NO: 1376201 - RNA, 19 nt, Homo sapiens
gcacagcaaguuaagcaua

SEQ ID NO: 1376202 - RNA, 19 nt, Homo sapiens
gcaggagaguuugccaaua

SEQ ID NO: 1376203 - RNA, 19 nt, Homo sapiens
gagaaacccuacaaaugug

SEQ ID NO: 1376204 - RNA, 19 nt, Homo sapiens
gggagaaaccuuaugauug

SEQ ID NO: 1376205 - RNA, 19 nt, Homo sapiens
gauucacaauggaguaaua

SEQ ID NO: 1376206 - RNA, 19 nt, Homo sapiens
ucaguaaaguugaucugua

SEQ ID NO: 1376207 - RNA, 19 nt, Homo sapiens
gagaacacauacuggagaa

SEQ ID NO: 1376208 - RNA, 19 nt, Homo sapiens
acacaucaguuaguucaua

SEQ ID NO: 1376209 - RNA, 19 nt, Homo sapiens
gagaagucccaccucauua

SEQ ID NO: 1376210 - RNA, 19 nt, Homo sapiens
gaaaucaccccucauuaua

SEQ ID NO: 1376211 - RNA, 19 nt, Homo sapiens
guacaucagagaacucaua

SEQ ID NO: 1376212 - RNA, 19 nt, Homo sapiens
agagugagcccaauucuaa

SEQ ID NO: 1376213 - RNA, 19 nt, Homo sapiens
gaucagcacagcaaguuaa

SEQ ID NO: 1376214 - RNA, 19 nt, Homo sapiens
gaagucccaccucauuaua

SEQ ID NO: 1376215 - RNA, 19 nt, Homo sapiens
ggaaaagccuucagugaga

SEQ ID NO: 1376216 - RNA, 19 nt, Homo sapiens
caacaucccaauagauaaa

SEQ ID NO: 1376217 - RNA, 19 nt, Homo sapiens
gaagucagaccuuguuuua

SEQ ID NO: 1376218 - RNA, 19 nt, Homo sapiens
ugagaaacccuacaaaugu

SEQ ID NO: 1376219 - RNA, 19 nt, Homo sapiens
cacaagggaugguucauug

SEQ ID NO: 1376220 - RNA, 19 nt, Homo sapiens
caggagaguuugccaauag

SEQ ID NO: 1376221 - RNA, 19 nt, Homo sapiens
agaaauacacaaucccuua

SEQ ID NO: 1376222 - RNA, 19 nt, Homo sapiens
gacaagacaggaagaguaa

SEQ ID NO: 1376223 - RNA, 19 nt, Homo sapiens
caguaaaguugaucuguau

SEQ ID NO: 1376224 - RNA, 19 nt, Homo sapiens
cuaccgaguuguuauaaga

SEQ ID NO: 1376225 - RNA, 19 nt, Homo sapiens
cugcagagauuucuagaga

SEQ ID NO: 1376226 - RNA, 19 nt, Homo sapiens
ccagauggccuuggguuua

SEQ ID NO: 1376227 - RNA, 19 nt, Homo sapiens
auaaugaacuggccacaga

SEQ ID NO: 1376228 - RNA, 19 nt, Homo sapiens
gaagacagaacucauuaca

SEQ ID NO: 1376229 - RNA, 19 nt, Homo sapiens
gaaauacacaaucccuuau

SEQ ID NO: 1376230 - RNA, 19 nt, Homo sapiens
acaguuuccuuccaucaua

SEQ ID NO: 1376231 - RNA, 19 nt, Homo sapiens
caacuugacccuucucaga

SEQ ID NO: 1376232 - RNA, 19 nt, Homo sapiens
cagauggccuuggguuuaa

SEQ ID NO: 1376233 - RNA, 19 nt, Homo sapiens
gaucagauucaguaaaguu

SEQ ID NO: 1376234 - RNA, 19 nt, Homo sapiens
ucaaguugcauauuccuua

SEQ ID NO: 1376235 - RNA, 19 nt, Homo sapiens
cagcaaagaugauggaaaa

SEQ ID NO: 1376236 - RNA, 19 nt, Homo sapiens
uaagggaauuuguuucuag

SEQ ID NO: 1376237 - RNA, 19 nt, Homo sapiens
gaaaagcuguguauguguu

SEQ ID NO: 1376238 - RNA, 19 nt, Homo sapiens
gugcauagaaacagauaua

SEQ ID NO: 1376239 - RNA, 19 nt, Homo sapiens
uaagaagucacaacucauu

SEQ ID NO: 1376240 - RNA, 19 nt, Homo sapiens
ggugaaggauguuuugaua

SEQ ID NO: 1376241 - RNA, 19 nt, Homo sapiens
gaagauucacaauggagua

SEQ ID NO: 1376242 - RNA, 19 nt, Homo sapiens
ggauguggcuguggauuuc

SEQ ID NO: 1376243 - RNA, 19 nt, Homo sapiens
gcauauuccuuauacuaca

SEQ ID NO: 1376244 - RNA, 19 nt, Homo sapiens
guuaugaacucagugauca

SEQ ID NO: 1376245 - RNA, 19 nt, Homo sapiens
gcucagugccucacagauu

SEQ ID NO: 1376246 - RNA, 19 nt, Homo sapiens
gaagucacaacuaacugua

SEQ ID NO: 1376247 - RNA, 19 nt, Homo sapiens
gggaaagacccuaucaaug

SEQ ID NO: 1376248 - RNA, 19 nt, Homo sapiens
gugagaaacccuacaaaug

SEQ ID NO: 1376249 - RNA, 19 nt, Homo sapiens
aaagcuacauguaaaguuc

SEQ ID NO: 1376250 - RNA, 19 nt, Homo sapiens
gaagucacagcugauuaua

SEQ ID NO: 1376251 - RNA, 19 nt, Homo sapiens
gagcccaauucuaaucuug

SEQ ID NO: 1376252 - RNA, 19 nt, Homo sapiens
caaguugcauauuccuuau

SEQ ID NO: 1376253 - RNA, 19 nt, Homo sapiens
gaauuuguuucuaguuugg

SEQ ID NO: 1376254 - RNA, 19 nt, Homo sapiens
gagaaaagcuguguaugug

SEQ ID NO: 1376255 - RNA, 19 nt, Homo sapiens
gauaaucagccauugugaa

SEQ ID NO: 1376256 - RNA, 19 nt, Homo sapiens
ggacaacaucccaauagau

SEQ ID NO: 1376257 - RNA, 19 nt, Homo sapiens
agucacagcugauuauaca

SEQ ID NO: 1376258 - RNA, 19 nt, Homo sapiens
acaggaagcaggagaguuu

SEQ ID NO: 1376259 - RNA, 19 nt, Homo sapiens
uguggaaacuaaagagaaa

SEQ ID NO: 1376260 - RNA, 19 nt, Homo sapiens
gcaaagaugauggaaaaua

SEQ ID NO: 1376261 - RNA, 19 nt, Homo sapiens
gagaaaccuuacauaugug

SEQ ID NO: 1376262 - RNA, 19 nt, Homo sapiens
caagucacagcucaucaua

SEQ ID NO: 1376263 - RNA, 19 nt, Homo sapiens
gagaagccguaugagugua

SEQ ID NO: 1376264 - RNA, 19 nt, Homo sapiens
ggagagaagccguaugagu

SEQ ID NO: 1376265 - RNA, 19 nt, Homo sapiens
acaauggaguaauaccuuu

SEQ ID NO: 1376266 - RNA, 19 nt, Homo sapiens
caauacagagauuccauaa

SEQ ID NO: 1376267 - RNA, 19 nt, Homo sapiens
ccagaagucacaucucauu

SEQ ID NO: 1376268 - RNA, 19 nt, Homo sapiens
caucauacaucagagaaca

SEQ ID NO: 1376269 - RNA, 19 nt, Homo sapiens
ugagaaguuucaucuuguu

SEQ ID NO: 1376270 - RNA, 19 nt, Homo sapiens
gugagaaguuucaucuugu

SEQ ID NO: 1376271 - RNA, 19 nt, Homo sapiens
agugagaaguuucaucuug

SEQ ID NO: 1376272 - RNA, 19 nt, Homo sapiens
ucacauuuguuaacagcaa

SEQ ID NO: 1376273 - RNA, 19 nt, Homo sapiens
cgaggaaucuguauuauua

SEQ ID NO: 1376274 - RNA, 19 nt, Homo sapiens
ggacagcacuucacaguug

SEQ ID NO: 1376275 - RNA, 19 nt, Homo sapiens
gaagcuggcugcuaagaug

SEQ ID NO: 1376276 - RNA, 19 nt, Homo sapiens
acaaauaucugcugaguuc

SEQ ID NO: 1376277 - RNA, 19 nt, Homo sapiens
gcagggcacauuuauaaua

SEQ ID NO: 1376278 - RNA, 19 nt, Homo sapiens
gaacaacccugagagaaag

SEQ ID NO: 1376279 - RNA, 19 nt, Homo sapiens
gcugugcucuggaaaguaa

SEQ ID NO: 1376280 - RNA, 19 nt, Homo sapiens
gaaggaaagccucucauug

SEQ ID NO: 1376281 - RNA, 19 nt, Homo sapiens
gaugauggcagcuuuauau

SEQ ID NO: 1376282 - RNA, 19 nt, Homo sapiens
ggagaccacugcacccaaa

SEQ ID NO: 1376283 - RNA, 19 nt, Homo sapiens
aauaagagcucagucaaug

SEQ ID NO: 1376284 - RNA, 19 nt, Homo sapiens
gauggcagcuuuauaucga

SEQ ID NO: 1376285 - RNA, 19 nt, Homo sapiens
ggagaaggcugugcuagag

SEQ ID NO: 1376286 - RNA, 19 nt, Homo sapiens
cagcugacccucaacauuu

SEQ ID NO: 1376287 - RNA, 19 nt, Homo sapiens
cuucagaggucaccaaguu

SEQ ID NO: 1376288 - RNA, 19 nt, Homo sapiens
gcaccauucuuggcacuaa

SEQ ID NO: 1376289 - RNA, 19 nt, Homo sapiens
gaagaaaggaaggaagaaa

SEQ ID NO: 1376290 - RNA, 19 nt, Homo sapiens
gagcaugaagucaccauaa

SEQ ID NO: 1376291 - RNA, 19 nt, Homo sapiens
gaacuaggaggcagagguu

SEQ ID NO: 1376292 - RNA, 19 nt, Homo sapiens
gcacuaaggauauaacagu

SEQ ID NO: 1376293 - RNA, 19 nt, Homo sapiens
caugaagucaccauaauuu

SEQ ID NO: 1376294 - RNA, 19 nt, Homo sapiens
caaguucagucgucccaaa

SEQ ID NO: 1376295 - RNA, 19 nt, Homo sapiens
gaggagcaauucauucauc

SEQ ID NO: 1376296 - RNA, 19 nt, Homo sapiens
gagaagaaaggaaggaaga

SEQ ID NO: 1376297 - RNA, 19 nt, Homo sapiens
gcucuuuccuguuccugua

SEQ ID NO: 1376298 - RNA, 19 nt, Homo sapiens
gcaauucauucauccaucu

SEQ ID NO: 1376299 - RNA, 19 nt, Homo sapiens
gauaagucaagcaaagaua

SEQ ID NO: 1376300 - RNA, 19 nt, Homo sapiens
gacaagaggacuccaguug

SEQ ID NO: 1376301 - RNA, 19 nt, Homo sapiens
aagaugaggacaaguauaa

SEQ ID NO: 1376302 - RNA, 19 nt, Homo sapiens
ccaggugauuccagcauaa

SEQ ID NO: 1376303 - RNA, 19 nt, Homo sapiens
cgacaaauaucugcugagu

SEQ ID NO: 1376304 - RNA, 19 nt, Homo sapiens
augagaagcuggcugcuaa

SEQ ID NO: 1376305 - RNA, 19 nt, Homo sapiens
gcaugaagucaccauaauu

SEQ ID NO: 1376306 - RNA, 19 nt, Homo sapiens
caaaacaaauccuuucuuc

SEQ ID NO: 1376307 - RNA, 19 nt, Homo sapiens
gaagaccagccauucaaga

SEQ ID NO: 1376308 - RNA, 19 nt, Homo sapiens
gcugaagccugaaggaaag

SEQ ID NO: 1376309 - RNA, 19 nt, Homo sapiens
ggcaggaguucgucagcua

SEQ ID NO: 1376310 - RNA, 19 nt, Homo sapiens
gcaguuggucuucaucuau

SEQ ID NO: 1376311 - RNA, 19 nt, Homo sapiens
gcucuaggcuggaaaaguu

SEQ ID NO: 1376312 - RNA, 19 nt, Homo sapiens
caaaguggggugcuuauua

SEQ ID NO: 1376313 - RNA, 19 nt, Homo sapiens
gagcaagucauuucacauc

SEQ ID NO: 1376314 - RNA, 19 nt, Homo sapiens
gcagcugacccucaacauu

SEQ ID NO: 1376315 - RNA, 19 nt, Homo sapiens
gcucugaaaucaucugacu

SEQ ID NO: 1376316 - RNA, 19 nt, Homo sapiens
agagaaagauauuguuguc

SEQ ID NO: 1376317 - RNA, 19 nt, Homo sapiens
gauugcaaauggcuucaga

SEQ ID NO: 1376318 - RNA, 19 nt, Homo sapiens
caacgacuaccgaaauuuc

SEQ ID NO: 1376319 - RNA, 19 nt, Homo sapiens
uaacugcagccaccaggua

SEQ ID NO: 1376320 - RNA, 19 nt, Homo sapiens
ucaagaaucugaaaaguag

SEQ ID NO: 1376321 - RNA, 19 nt, Homo sapiens
gggcuucacuaaggaaaug

SEQ ID NO: 1376322 - RNA, 19 nt, Homo sapiens
gacaguagggaagacauua

SEQ ID NO: 1376323 - RNA, 19 nt, Homo sapiens
ccucugcucuuuccuguuc

SEQ ID NO: 1376324 - RNA, 19 nt, Homo sapiens
ccagagcgauggccgaagu

SEQ ID NO: 1376325 - RNA, 19 nt, Homo sapiens
agaacaacccugagagaaa

SEQ ID NO: 1376326 - RNA, 19 nt, Homo sapiens
gaugaugauggcagcuuua

SEQ ID NO: 1376327 - RNA, 19 nt, Homo sapiens
gaaaguggaccagcaugug

SEQ ID NO: 1376328 - RNA, 19 nt, Homo sapiens
gugauuccagcauaacuua

SEQ ID NO: 1376329 - RNA, 19 nt, Homo sapiens
gacaggagaaucacuugaa

SEQ ID NO: 1376330 - RNA, 19 nt, Homo sapiens
aaugguagguuucaugcaa

SEQ ID NO: 1376331 - RNA, 19 nt, Homo sapiens
uguaagaugaggacaagua

SEQ ID NO: 1376332 - RNA, 19 nt, Homo sapiens
gcaagucauuucacaucuc

SEQ ID NO: 1376333 - RNA, 19 nt, Homo sapiens
caguuggucuucaucuauu

SEQ ID NO: 1376334 - RNA, 19 nt, Homo sapiens
ugaaaucaucugacuguga

SEQ ID NO: 1376335 - RNA, 19 nt, Homo sapiens
gacagcacuucacaguuga

SEQ ID NO: 1376336 - RNA, 19 nt, Homo sapiens
gguguuuucucuugaauuu

SEQ ID NO: 1376337 - RNA, 19 nt, Homo sapiens
ggauagcgauugcauuuuc

SEQ ID NO: 1376338 - RNA, 19 nt, Homo sapiens
gagagaaagauauuguugu

SEQ ID NO: 1376339 - RNA, 19 nt, Homo sapiens
ggaaaguggaccagcaugu

SEQ ID NO: 1376340 - RNA, 19 nt, Homo sapiens
agucgaggaaucuguauua

SEQ ID NO: 1376341 - RNA, 19 nt, Homo sapiens
cacaaaaccugauugcaaa

SEQ ID NO: 1376342 - RNA, 19 nt, Homo sapiens
ugaaggaaagccucucauu

SEQ ID NO: 1376343 - RNA, 19 nt, Homo sapiens
ucauccaucugucuaucua

SEQ ID NO: 1376344 - RNA, 19 nt, Homo sapiens
aaaguggggugcuuauuaa

SEQ ID NO: 1376345 - RNA, 19 nt, Homo sapiens
gcauauuggagaaggguaa

SEQ ID NO: 1376346 - RNA, 19 nt, Homo sapiens
gggagaaggcugugcuaga

SEQ ID NO: 1376347 - RNA, 19 nt, Homo sapiens
ggaagacauuauagagcau

SEQ ID NO: 1376348 - RNA, 19 nt, Homo sapiens
agaaucacuugaacuagga

SEQ ID NO: 1376349 - RNA, 19 nt, Homo sapiens
cuaccgaaauuucaacaag

SEQ ID NO: 1376350 - RNA, 19 nt, Homo sapiens
gcagccaccagguaugaaa

SEQ ID NO: 1376351 - RNA, 19 nt, Homo sapiens
guucugcugugcucuggaa

SEQ ID NO: 1376352 - RNA, 19 nt, Homo sapiens
ugggauagcgauugcauuu

SEQ ID NO: 1376353 - RNA, 19 nt, Homo sapiens
guagggaagacauuauaga

SEQ ID NO: 1376354 - RNA, 19 nt, Homo sapiens
uaacuuauccaugguuugu

SEQ ID NO: 1376355 - RNA, 19 nt, Homo sapiens
uaccgaaauuucaacaaga

SEQ ID NO: 1376356 - RNA, 19 nt, Homo sapiens
aacaaauccuuucuucuuc

SEQ ID NO: 1376357 - RNA, 19 nt, Homo sapiens
ucaugcaacugcugcucua

SEQ ID NO: 1376358 - RNA, 19 nt, Homo sapiens
uaagaugaggacaaguaua

SEQ ID NO: 1376359 - RNA, 19 nt, Homo sapiens
guaagaugaggacaaguau

SEQ ID NO: 1376360 - RNA, 19 nt, Homo sapiens
caguagggaagacauuaua

SEQ ID NO: 1376361 - RNA, 19 nt, Homo sapiens
gagaugcaguuggucuuca

SEQ ID NO: 1376362 - RNA, 19 nt, Homo sapiens
aaggauaagucaagcaaag

SEQ ID NO: 1376363 - RNA, 19 nt, Homo sapiens
cccaacgacuaccgaaauu

SEQ ID NO: 1376364 - RNA, 19 nt, Homo sapiens
ugagagaaagauauuguug

SEQ ID NO: 1376365 - RNA, 19 nt, Homo sapiens
ugaugaugauggcagcuuu

SEQ ID NO: 1376366 - RNA, 19 nt, Homo sapiens
gugaugaugaugaugauga

SEQ ID NO: 1376367 - RNA, 19 nt, Homo sapiens
uuaaagugguggugaugau

SEQ ID NO: 1376368 - RNA, 19 nt, Homo sapiens
uaacaggacaggugcaaag

SEQ ID NO: 1376369 - RNA, 19 nt, Homo sapiens
caaauccuuucuucuucug

SEQ ID NO: 1376370 - RNA, 19 nt, Homo sapiens
uauaauaagagcucaguca

SEQ ID NO: 1376371 - RNA, 19 nt, Homo sapiens
gggaugaggccaugggaau

SEQ ID NO: 1376372 - RNA, 19 nt, Homo sapiens
ggauaagucaagcaaagau

SEQ ID NO: 1376373 - RNA, 19 nt, Homo sapiens
caacguggcugaaaucuau

SEQ ID NO: 1376374 - RNA, 19 nt, Homo sapiens
ggaggcaggugucaagcua

SEQ ID NO: 1376375 - RNA, 19 nt, Homo sapiens
gguggcagguguuuaauga

SEQ ID NO: 1376376 - RNA, 19 nt, Homo sapiens
acaaguaccugcuccacua

SEQ ID NO: 1376377 - RNA, 19 nt, Homo sapiens
gaaaggaaagucaugaaau

SEQ ID NO: 1376378 - RNA, 19 nt, Homo sapiens
ugacaucaaugaaaggaaa

SEQ ID NO: 1376379 - RNA, 19 nt, Homo sapiens
gagaggacuuugacuacaa

SEQ ID NO: 1376380 - RNA, 19 nt, Homo sapiens
ggaaagucaugaaaucgau

SEQ ID NO: 1376381 - RNA, 19 nt, Homo sapiens
aaaggaaagucaugaaauc

SEQ ID NO: 1376382 - RNA, 19 nt, Homo sapiens
ugaaaucgaugagacugaa

SEQ ID NO: 1376383 - RNA, 19 nt, Homo sapiens
gaauuggacucccgcuucu

SEQ ID NO: 1376384 - RNA, 19 nt, Homo sapiens
uauugugucugaucucauu

SEQ ID NO: 1376385 - RNA, 19 nt, Homo sapiens
cuaugacccuuaccugauu

SEQ ID NO: 1376386 - RNA, 19 nt, Homo sapiens
ggcaugacaucaaugaaag

SEQ ID NO: 1376387 - RNA, 19 nt, Homo sapiens
ggacuuugacuacaauaca

SEQ ID NO: 1376388 - RNA, 19 nt, Homo sapiens
caucugcguuuguccuuug

SEQ ID NO: 1376389 - RNA, 19 nt, Homo sapiens
ugaaaggaaagucaugaaa

SEQ ID NO: 1376390 - RNA, 19 nt, Homo sapiens
gauaauauugugucugauc

SEQ ID NO: 1376391 - RNA, 19 nt, Homo sapiens
ccacugcuugcaccauuua

SEQ ID NO: 1376392 - RNA, 19 nt, Homo sapiens
gcaacguggcugaaaucua

SEQ ID NO: 1376393 - RNA, 19 nt, Homo sapiens
auacaggcaugacaucaau

SEQ ID NO: 1376394 - RNA, 19 nt, Homo sapiens
ccaaagagaagcccaggau

SEQ ID NO: 1376395 - RNA, 19 nt, Homo sapiens
gagaaugaaugugcaacgu

SEQ ID NO: 1376396 - RNA, 19 nt, Homo sapiens
gaccuuaccaagccaauca

SEQ ID NO: 1376397 - RNA, 19 nt, Homo sapiens
ggacgccuaugacccuuac

SEQ ID NO: 1376398 - RNA, 19 nt, Homo sapiens
ugccaugucuucaauuuac

SEQ ID NO: 1376399 - RNA, 19 nt, Homo sapiens
ugagaggacuuugacuaca

SEQ ID NO: 1376400 - RNA, 19 nt, Homo sapiens
gccacugcuugcaccauuu

SEQ ID NO: 1376401 - RNA, 19 nt, Homo sapiens
gcuugcaccauuuaccaua

SEQ ID NO: 1376402 - RNA, 19 nt, Homo sapiens
cgugguggcagguguuuaa

SEQ ID NO: 1376403 - RNA, 19 nt, Homo sapiens
ucaauguguccaacaggua

SEQ ID NO: 1376404 - RNA, 19 nt, Homo sapiens
ccauuuaccauaaguucuu

SEQ ID NO: 1376405 - RNA, 19 nt, Homo sapiens
aggcaugacaucaaugaaa

SEQ ID NO: 1376406 - RNA, 19 nt, Homo sapiens
gguguuuaaugacgaccuu

SEQ ID NO: 1376407 - RNA, 19 nt, Homo sapiens
cuugcaccauuuaccauaa

SEQ ID NO: 1376408 - RNA, 19 nt, Homo sapiens
agaggacuuugacuacaau

SEQ ID NO: 1376409 - RNA, 19 nt, Homo sapiens
ggacagcaucgugcagugu

SEQ ID NO: 1376410 - RNA, 19 nt, Homo sapiens
acacagagauccccuaagg

SEQ ID NO: 1376411 - RNA, 19 nt, Homo sapiens
uuuauaccauggacacaga

SEQ ID NO: 1376412 - RNA, 19 nt, Homo sapiens
aauauugugucugaucuca

SEQ ID NO: 1376413 - RNA, 19 nt, Homo sapiens
ggacacagagauccccuaa

SEQ ID NO: 1376414 - RNA, 19 nt, Homo sapiens
ggacucgugacaucaucaa

SEQ ID NO: 1376415 - RNA, 19 nt, Homo sapiens
cuuaaaagccagauuugua

SEQ ID NO: 1376416 - RNA, 19 nt, Homo sapiens
gaaaucgaugagacugaau

SEQ ID NO: 1376417 - RNA, 19 nt, Homo sapiens
ugccacugcuugcaccauu

SEQ ID NO: 1376418 - RNA, 19 nt, Homo sapiens
acaggcaugacaucaauga

SEQ ID NO: 1376419 - RNA, 19 nt, Homo sapiens
gcaccauuuaccauaaguu

SEQ ID NO: 1376420 - RNA, 19 nt, Homo sapiens
ccuaugacccuuaccugau

SEQ ID NO: 1376421 - RNA, 19 nt, Homo sapiens
gacuuugacuacaauacag

SEQ ID NO: 1376422 - RNA, 19 nt, Homo sapiens
cugcaggucuacggaguug

SEQ ID NO: 1376423 - RNA, 19 nt, Homo sapiens
gcggugagccccuggaauu

SEQ ID NO: 1376424 - RNA, 19 nt, Homo sapiens
uguccaacagguacuuuaa

SEQ ID NO: 1376425 - RNA, 19 nt, Homo sapiens
aaaggugauacaagucaaa

SEQ ID NO: 1376426 - RNA, 19 nt, Homo sapiens
uggcgagguucaucaugga

SEQ ID NO: 1376427 - RNA, 19 nt, Homo sapiens
caauacaggcaugacauca

SEQ ID NO: 1376428 - RNA, 19 nt, Homo sapiens
cugcuccacuaccugguuu

SEQ ID NO: 1376429 - RNA, 19 nt, Homo sapiens
uuugagaggacuuugacua

SEQ ID NO: 1376430 - RNA, 19 nt, Homo sapiens
gcaggucuacggaguugag

SEQ ID NO: 1376431 - RNA, 19 nt, Homo sapiens
uaugacccuuaccugauug

SEQ ID NO: 1376432 - RNA, 19 nt, Homo sapiens
uuaaugacgaccuuaccaa

SEQ ID NO: 1376433 - RNA, 19 nt, Homo sapiens
uccagcauccacacaagua

SEQ ID NO: 1376434 - RNA, 19 nt, Homo sapiens
caagauauaucaccucaua

SEQ ID NO: 1376435 - RNA, 19 nt, Homo sapiens
ggaaaucccaaucuuauua

SEQ ID NO: 1376436 - RNA, 19 nt, Homo sapiens
gaaccuaacagaacaauaa

SEQ ID NO: 1376437 - RNA, 19 nt, Homo sapiens
gcucagaugucacagguua

SEQ ID NO: 1376438 - RNA, 19 nt, Homo sapiens
gaagaaauugggaacauua

SEQ ID NO: 1376439 - RNA, 19 nt, Homo sapiens
gcacugaaaugucauggaa

SEQ ID NO: 1376440 - RNA, 19 nt, Homo sapiens
ggaaagaguucagacauug

SEQ ID NO: 1376441 - RNA, 19 nt, Homo sapiens
caacuacgcuugcacuuau

SEQ ID NO: 1376442 - RNA, 19 nt, Homo sapiens
ccacaagcaucaugacaaa

SEQ ID NO: 1376443 - RNA, 19 nt, Homo sapiens
gcaaucacauuucccauuc

SEQ ID NO: 1376444 - RNA, 19 nt, Homo sapiens
gaagagagaaccuaacaga

SEQ ID NO: 1376445 - RNA, 19 nt, Homo sapiens
ggaagaaauugggaacauu

SEQ ID NO: 1376446 - RNA, 19 nt, Homo sapiens
ugacaaaguuaggcuuaua

SEQ ID NO: 1376447 - RNA, 19 nt, Homo sapiens
uaaaggaaaucccaaucuu

SEQ ID NO: 1376448 - RNA, 19 nt, Homo sapiens
gaaaugucauggaauugga

SEQ ID NO: 1376449 - RNA, 19 nt, Homo sapiens
gcacuuauguuuggucugu

SEQ ID NO: 1376450 - RNA, 19 nt, Homo sapiens
gagagaaccuaacagaaca

SEQ ID NO: 1376451 - RNA, 19 nt, Homo sapiens
gagaagggauggauuucga

SEQ ID NO: 1376452 - RNA, 19 nt, Homo sapiens
gaugaagcauuacuugugu

SEQ ID NO: 1376453 - RNA, 19 nt, Homo sapiens
gaaauugggaacauuauca

SEQ ID NO: 1376454 - RNA, 19 nt, Homo sapiens
aauauaaguuggugucgua

SEQ ID NO: 1376455 - RNA, 19 nt, Homo sapiens
ucaaggcacugaaauguca

SEQ ID NO: 1376456 - RNA, 19 nt, Homo sapiens
caagcaucaugacaaauuu

SEQ ID NO: 1376457 - RNA, 19 nt, Homo sapiens
uuggugagaugaagcauua

SEQ ID NO: 1376458 - RNA, 19 nt, Homo sapiens
ggucagaggguuagugaaa

SEQ ID NO: 1376459 - RNA, 19 nt, Homo sapiens
aaaggaaaucccaaucuua

SEQ ID NO: 1376460 - RNA, 19 nt, Homo sapiens
gaugggaaauccaguuauc

SEQ ID NO: 1376461 - RNA, 19 nt, Homo sapiens
gaacaauaacaauggaaga

SEQ ID NO: 1376462 - RNA, 19 nt, Homo sapiens
uaagaagaaugcaguuugg

SEQ ID NO: 1376463 - RNA, 19 nt, Homo sapiens
gaaaagaggccaccaauac

SEQ ID NO: 1376464 - RNA, 19 nt, Homo sapiens
uggaaagaguucagacauu

SEQ ID NO: 1376465 - RNA, 19 nt, Homo sapiens
gaagacaacuacgcuugca

SEQ ID NO: 1376466 - RNA, 19 nt, Homo sapiens
gcagcaugauggauucaga

SEQ ID NO: 1376467 - RNA, 19 nt, Homo sapiens
gguuaaaaguuucuccuua

SEQ ID NO: 1376468 - RNA, 19 nt, Homo sapiens
acugaaaugucauggaauu

SEQ ID NO: 1376469 - RNA, 19 nt, Homo sapiens
gaacauuaucacaaagcua

SEQ ID NO: 1376470 - RNA, 19 nt, Homo sapiens
ggaguaggucagaggguua

SEQ ID NO: 1376471 - RNA, 19 nt, Homo sapiens
cgaaauuuguaucguggaa

SEQ ID NO: 1376472 - RNA, 19 nt, Homo sapiens
gaguucuuguuaaagguua

SEQ ID NO: 1376473 - RNA, 19 nt, Homo sapiens
gaagggauggauuucgaaa

SEQ ID NO: 1376474 - RNA, 19 nt, Homo sapiens
caccucauauuacaaaugu

SEQ ID NO: 1376475 - RNA, 19 nt, Homo sapiens
gauaaaagguuccaauagg

SEQ ID NO: 1376476 - RNA, 19 nt, Homo sapiens
caugacaaauuuaccaaca

SEQ ID NO: 1376477 - RNA, 19 nt, Homo sapiens
acaagcaucaugacaaauu

SEQ ID NO: 1376478 - RNA, 19 nt, Homo sapiens
caacagcuguauggcauca

SEQ ID NO: 1376479 - RNA, 19 nt, Homo sapiens
aaagaggccaccaauacua

SEQ ID NO: 1376480 - RNA, 19 nt, Homo sapiens
gggaugcaauacuucaguu

SEQ ID NO: 1376481 - RNA, 19 nt, Homo sapiens
ucaagaagagagaaccuaa

SEQ ID NO: 1376482 - RNA, 19 nt, Homo sapiens
gggaaauccaguuaucaaa

SEQ ID NO: 1376483 - RNA, 19 nt, Homo sapiens
gaucuuaagcagcaugaug

SEQ ID NO: 1376484 - RNA, 19 nt, Homo sapiens
ucacauuucccauucagaa

SEQ ID NO: 1376485 - RNA, 19 nt, Homo sapiens
gugcagccuucaacaaugu

SEQ ID NO: 1376486 - RNA, 19 nt, Homo sapiens
ggccuucgaggucccauua

SEQ ID NO: 1376487 - RNA, 19 nt, Homo sapiens
cuaagaagaaugcaguuug

SEQ ID NO: 1376488 - RNA, 19 nt, Homo sapiens
uaagcagcaugauggauuc

SEQ ID NO: 1376489 - RNA, 19 nt, Homo sapiens
gaaucucuuucuuaauugg

SEQ ID NO: 1376490 - RNA, 19 nt, Homo sapiens
ggaauuggagaguauuauc

SEQ ID NO: 1376491 - RNA, 19 nt, Homo sapiens
ucauggaauuggagaguau

SEQ ID NO: 1376492 - RNA, 19 nt, Homo sapiens
guugagaagggauggauuu

SEQ ID NO: 1376493 - RNA, 19 nt, Homo sapiens
gaugcaauacuucaguuga

SEQ ID NO: 1376494 - RNA, 19 nt, Homo sapiens
uuacaaauguuggugagau

SEQ ID NO: 1376495 - RNA, 19 nt, Homo sapiens
ucucaauccucacaaaaua

SEQ ID NO: 1376496 - RNA, 19 nt, Homo sapiens
aaggaaaucccaaucuuau

SEQ ID NO: 1376497 - RNA, 19 nt, Homo sapiens
gaacgggacagaaaacuga

SEQ ID NO: 1376498 - RNA, 19 nt, Homo sapiens
gcaauacuucaguugagaa

SEQ ID NO: 1376499 - RNA, 19 nt, Homo sapiens
ccuuaggacuagugacaaa

SEQ ID NO: 1376500 - RNA, 19 nt, Homo sapiens
caccaauacuaacaucuuc

SEQ ID NO: 1376501 - RNA, 19 nt, Homo sapiens
caugauggauucagaagcu

SEQ ID NO: 1376502 - RNA, 19 nt, Homo sapiens
uugggaacauuaucacaaa

SEQ ID NO: 1376503 - RNA, 19 nt, Homo sapiens
ucagaggguuagugaaagu

SEQ ID NO: 1376504 - RNA, 19 nt, Homo sapiens
ugacaaauuuaccaacacu

SEQ ID NO: 1376505 - RNA, 19 nt, Homo sapiens
ggaaauccaguuaucaaaa

SEQ ID NO: 1376506 - RNA, 19 nt, Homo sapiens
gagaugaagcauuacuugu

SEQ ID NO: 1376507 - RNA, 19 nt, Homo sapiens
uaugaguucuuguuaaagg

SEQ ID NO: 1376508 - RNA, 19 nt, Homo sapiens
acaacuacgcuugcacuua

SEQ ID NO: 1376509 - RNA, 19 nt, Homo sapiens
gaagguccucuuucgacaa

SEQ ID NO: 1376510 - RNA, 19 nt, Homo sapiens
gcaauucuccugccuuagc

SEQ ID NO: 1376511 - RNA, 19 nt, Homo sapiens
ggacuagugacaaaguuag

SEQ ID NO: 1376512 - RNA, 19 nt, Homo sapiens
ccuaacagaacaauaacaa

SEQ ID NO: 1376513 - RNA, 19 nt, Homo sapiens
ggaacauuaucacaaagcu

SEQ ID NO: 1376514 - RNA, 19 nt, Homo sapiens
caacaaugucgcaaucaca

SEQ ID NO: 1376515 - RNA, 19 nt, Homo sapiens
uuaagcagcaugauggauu

SEQ ID NO: 1376516 - RNA, 19 nt, Homo sapiens
acagaacaauaacaaugga

SEQ ID NO: 1376517 - RNA, 19 nt, Homo sapiens
cgcauacagucucagauug

SEQ ID NO: 1376518 - RNA, 19 nt, Homo sapiens
aaauuuguaucguggaauc

SEQ ID NO: 1376519 - RNA, 19 nt, Homo sapiens
acagcuguauggcaucaaa

SEQ ID NO: 1376520 - RNA, 19 nt, Homo sapiens
ugagaugaagcauuacuug

SEQ ID NO: 1376521 - RNA, 19 nt, Homo sapiens
ccucauauuacaaauguug

SEQ ID NO: 1376522 - RNA, 19 nt, Homo sapiens
ccaccaauacuaacaucuu

SEQ ID NO: 1376523 - RNA, 19 nt, Homo sapiens
guuguucaauauugucuuc

SEQ ID NO: 1376524 - RNA, 19 nt, Homo sapiens
ccaaucuuauuauggaaag

SEQ ID NO: 1376525 - RNA, 19 nt, Homo sapiens
gaaugcaguuuggccucuu

SEQ ID NO: 1376526 - RNA, 19 nt, Homo sapiens
ccauuuaucaacugaauag

SEQ ID NO: 1376527 - RNA, 19 nt, Homo sapiens
aaacucgcauacagucuca

SEQ ID NO: 1376528 - RNA, 19 nt, Homo sapiens
gcauacagucucagauugg

SEQ ID NO: 1376529 - RNA, 19 nt, Homo sapiens
gcuaucauccugccaaacu

SEQ ID NO: 1376530 - RNA, 19 nt, Homo sapiens
gucauggaauuggagagua

SEQ ID NO: 1376531 - RNA, 19 nt, Homo sapiens
aagaggccaccaauacuaa

SEQ ID NO: 1376532 - RNA, 19 nt, Homo sapiens
ucgcauacagucucagauu

SEQ ID NO: 1376533 - RNA, 19 nt, Homo sapiens
agagagaaccuaacagaac

SEQ ID NO: 1376534 - RNA, 19 nt, Homo sapiens
gaacgucgaugagguauua

SEQ ID NO: 1376535 - RNA, 19 nt, Homo sapiens
gacaagggccaaccuauua

SEQ ID NO: 1376536 - RNA, 19 nt, Homo sapiens
ucacacaccucaaauacaa

SEQ ID NO: 1376537 - RNA, 19 nt, Homo sapiens
gaugagguauuaaaggaaa

SEQ ID NO: 1376538 - RNA, 19 nt, Homo sapiens
ggacaaaccagguagauca

SEQ ID NO: 1376539 - RNA, 19 nt, Homo sapiens
gaagaaggcucagcuuugc

SEQ ID NO: 1376540 - RNA, 19 nt, Homo sapiens
ucaagcaauucuccuguuu

SEQ ID NO: 1376541 - RNA, 19 nt, Homo sapiens
ggacgaaugcugcuucaug

SEQ ID NO: 1376542 - RNA, 19 nt, Homo sapiens
caagauuccuacacccaaa

SEQ ID NO: 1376543 - RNA, 19 nt, Homo sapiens
uaucaugacuucuauuugg

SEQ ID NO: 1376544 - RNA, 19 nt, Homo sapiens
uaaagaagcaucggcguuu

SEQ ID NO: 1376545 - RNA, 19 nt, Homo sapiens
cgaagaaggcucagcuuug

SEQ ID NO: 1376546 - RNA, 19 nt, Homo sapiens
ccaaagugcugagauuaca

SEQ ID NO: 1376547 - RNA, 19 nt, Homo sapiens
ccgaguagcuggaauugca

SEQ ID NO: 1376548 - RNA, 19 nt, Homo sapiens
ccacuguccuggcuuguuc

SEQ ID NO: 1376549 - RNA, 19 nt, Homo sapiens
ucgaugagguauuaaagga

SEQ ID NO: 1376550 - RNA, 19 nt, Homo sapiens
gggccaaccuauuacuuca

SEQ ID NO: 1376551 - RNA, 19 nt, Homo sapiens
ccacccagauucaagcaau

SEQ ID NO: 1376552 - RNA, 19 nt, Homo sapiens
uuauucaacucggguauuu

SEQ ID NO: 1376553 - RNA, 19 nt, Homo sapiens
aagcaauucuccuguuuca

SEQ ID NO: 1376554 - RNA, 19 nt, Homo sapiens
cgaaaacaaccaagaauuu

SEQ ID NO: 1376555 - RNA, 19 nt, Homo sapiens
gaauuccacaggcaacuga

SEQ ID NO: 1376556 - RNA, 19 nt, Homo sapiens
guaucacgcucaagacaag

SEQ ID NO: 1376557 - RNA, 19 nt, Homo sapiens
ucucccaccuccagucuuu

SEQ ID NO: 1376558 - RNA, 19 nt, Homo sapiens
ucaacucggguauuuauga

SEQ ID NO: 1376559 - RNA, 19 nt, Homo sapiens
uaaaaugaccagcaaguaa

SEQ ID NO: 1376560 - RNA, 19 nt, Homo sapiens
agacaagggccaaccuauu

SEQ ID NO: 1376561 - RNA, 19 nt, Homo sapiens
gcacagcucgucccaacuc

SEQ ID NO: 1376562 - RNA, 19 nt, Homo sapiens
ugucagcgcguuaucauga

SEQ ID NO: 1376563 - RNA, 19 nt, Homo sapiens
caacucggguauuuaugag

SEQ ID NO: 1376564 - RNA, 19 nt, Homo sapiens
gccagaggcaugggcauua

SEQ ID NO: 1376565 - RNA, 19 nt, Homo sapiens
caagacaagggccaaccua

SEQ ID NO: 1376566 - RNA, 19 nt, Homo sapiens
aaacucaguccacucuaaa

SEQ ID NO: 1376567 - RNA, 19 nt, Homo sapiens
gccaaccuauuacuucaca

SEQ ID NO: 1376568 - RNA, 19 nt, Homo sapiens
ucaccacgcccagcuaauu

SEQ ID NO: 1376569 - RNA, 19 nt, Homo sapiens
ucagucauguacacacaga

SEQ ID NO: 1376570 - RNA, 19 nt, Homo sapiens
ucaguccacucuaaagaag

SEQ ID NO: 1376571 - RNA, 19 nt, Homo sapiens
uuacuucacacaccucaaa

SEQ ID NO: 1376572 - RNA, 19 nt, Homo sapiens
gggcaacuccagccaagau

SEQ ID NO: 1376573 - RNA, 19 nt, Homo sapiens
caccacgcccagcuaauuu

SEQ ID NO: 1376574 - RNA, 19 nt, Homo sapiens
gaauugcagacacccauca

SEQ ID NO: 1376575 - RNA, 19 nt, Homo sapiens
gcguuaucaugacuucuau

SEQ ID NO: 1376576 - RNA, 19 nt, Homo sapiens
ccagaggcaugggcauuag

SEQ ID NO: 1376577 - RNA, 19 nt, Homo sapiens
ccagggauccagcgucuuc

SEQ ID NO: 1376578 - RNA, 19 nt, Homo sapiens
aauuucagcucacugcaau

SEQ ID NO: 1376579 - RNA, 19 nt, Homo sapiens
aaaacucaguccacucuaa

SEQ ID NO: 1376580 - RNA, 19 nt, Homo sapiens
gcaacuccagccaagauuc

SEQ ID NO: 1376581 - RNA, 19 nt, Homo sapiens
caucaccacgcccagcuaa

SEQ ID NO: 1376582 - RNA, 19 nt, Homo sapiens
ucagcucacugcaaucucu

SEQ ID NO: 1376583 - RNA, 19 nt, Homo sapiens
gucgguguguucaguauca

SEQ ID NO: 1376584 - RNA, 19 nt, Homo sapiens
gggcaaccguucugauucc

SEQ ID NO: 1376585 - RNA, 19 nt, Homo sapiens
guugccacaugggcuauuu

SEQ ID NO: 1376586 - RNA, 19 nt, Homo sapiens
gcgcugccuucuccaacug

SEQ ID NO: 1376587 - RNA, 19 nt, Homo sapiens
ccagccacgugugaaagaa

SEQ ID NO: 1376588 - RNA, 19 nt, Homo sapiens
gugggacaaccuaguauug

SEQ ID NO: 1376589 - RNA, 19 nt, Homo sapiens
cagccuccguugccacaug

SEQ ID NO: 1376590 - RNA, 19 nt, Homo sapiens
acaauaaaaugaccagcaa

SEQ ID NO: 1376591 - RNA, 19 nt, Homo sapiens
cacccagauucaagcaauu

SEQ ID NO: 1376592 - RNA, 19 nt, Homo sapiens
ggucuugucagucauguac

SEQ ID NO: 1376593 - RNA, 19 nt, Homo sapiens
acccaaaugugaccguguu

SEQ ID NO: 1376594 - RNA, 19 nt, Homo sapiens
ucccaaagugcugagauua

SEQ ID NO: 1376595 - RNA, 19 nt, Homo sapiens
caaccuauuacuucacaca

SEQ ID NO: 1376596 - RNA, 19 nt, Homo sapiens
caccaggacaaaccaggua

SEQ ID NO: 1376597 - RNA, 19 nt, Homo sapiens
ugaaagaagaacuccaagu

SEQ ID NO: 1376598 - RNA, 19 nt, Homo sapiens
caagcaauucuccuguuuc

SEQ ID NO: 1376599 - RNA, 19 nt, Homo sapiens
caauuucagcucacugcaa

SEQ ID NO: 1376600 - RNA, 19 nt, Homo sapiens
aaaaugaccagcaaguaaa

SEQ ID NO: 1376601 - RNA, 19 nt, Homo sapiens
ccacugugcccagccgaaa

SEQ ID NO: 1376602 - RNA, 19 nt, Homo sapiens
cucccaaagugcugagauu

SEQ ID NO: 1376603 - RNA, 19 nt, Homo sapiens
acgaagaaggcucagcuuu

SEQ ID NO: 1376604 - RNA, 19 nt, Homo sapiens
uguuucagccucccgagua

SEQ ID NO: 1376605 - RNA, 19 nt, Homo sapiens
ugucagucauguacacaca

SEQ ID NO: 1376606 - RNA, 19 nt, Homo sapiens
ccgggcaaccguucugauu

SEQ ID NO: 1376607 - RNA, 19 nt, Homo sapiens
ugugaaagaagaacuccaa

SEQ ID NO: 1376608 - RNA, 19 nt, Homo sapiens
gcugagauuacaggcauga

SEQ ID NO: 1376609 - RNA, 19 nt, Homo sapiens
uggucaggcuggucuugaa

SEQ ID NO: 1376610 - RNA, 19 nt, Homo sapiens
ggaacgucgaugagguauu

SEQ ID NO: 1376611 - RNA, 19 nt, Homo sapiens
ugggaacgucgaugaggua

SEQ ID NO: 1376612 - RNA, 19 nt, Homo sapiens
cgccuggugugcagccaaa

SEQ ID NO: 1376613 - RNA, 19 nt, Homo sapiens
uuaugagugucuccucugu

SEQ ID NO: 1376614 - RNA, 19 nt, Homo sapiens
ggaaaacucaguccacucu

SEQ ID NO: 1376615 - RNA, 19 nt, Homo sapiens
ggacaaggcugacaagcaa

SEQ ID NO: 1376616 - RNA, 19 nt, Homo sapiens
cagcagagcagcacaauaa

SEQ ID NO: 1376617 - RNA, 19 nt, Homo sapiens
agacaaacauucagaguug

SEQ ID NO: 1376618 - RNA, 19 nt, Homo sapiens
gagaaacauugaccaggaa

SEQ ID NO: 1376619 - RNA, 19 nt, Homo sapiens
ggaaccugcuggcuacuga

SEQ ID NO: 1376620 - RNA, 19 nt, Homo sapiens
gcgggauccugcucaauaa

SEQ ID NO: 1376621 - RNA, 19 nt, Homo sapiens
ggauccugcucaauaauga

SEQ ID NO: 1376622 - RNA, 19 nt, Homo sapiens
ucacgacaguggagagaaa

SEQ ID NO: 1376623 - RNA, 19 nt, Homo sapiens
gacaagcaauccaggaaca

SEQ ID NO: 1376624 - RNA, 19 nt, Homo sapiens
cgacaugaccuccgaguuc

SEQ ID NO: 1376625 - RNA, 19 nt, Homo sapiens
cagcaucaccaacgaguuu

SEQ ID NO: 1376626 - RNA, 19 nt, Homo sapiens
ggacgaggaagaggacuuu

SEQ ID NO: 1376627 - RNA, 19 nt, Homo sapiens
gcucaauaaugaaauggau

SEQ ID NO: 1376628 - RNA, 19 nt, Homo sapiens
cagagcagcacaauaaaug

SEQ ID NO: 1376629 - RNA, 19 nt, Homo sapiens
gcagagcagcacaauaaau

SEQ ID NO: 1376630 - RNA, 19 nt, Homo sapiens
gaucacguccaccuucauu

SEQ ID NO: 1376631 - RNA, 19 nt, Homo sapiens
ccacucacccgaucuccua

SEQ ID NO: 1376632 - RNA, 19 nt, Homo sapiens
gcacugcucaccugucugu

SEQ ID NO: 1376633 - RNA, 19 nt, Homo sapiens
ccacugcacuggccaucau

SEQ ID NO: 1376634 - RNA, 19 nt, Homo sapiens
caccaucaaccucuacuuu

SEQ ID NO: 1376635 - RNA, 19 nt, Homo sapiens
ggaccaggcagacaaacau

SEQ ID NO: 1376636 - RNA, 19 nt, Homo sapiens
ccaucaaccucuacuuugg

SEQ ID NO: 1376637 - RNA, 19 nt, Homo sapiens
gcagcagagcagcacaaua

SEQ ID NO: 1376638 - RNA, 19 nt, Homo sapiens
gggcacugcucaccugucu

SEQ ID NO: 1376639 - RNA, 19 nt, Homo sapiens
ccagaggguuguggucaga

SEQ ID NO: 1376640 - RNA, 19 nt, Homo sapiens
caauaaaugaggccacugu

SEQ ID NO: 1376641 - RNA, 19 nt, Homo sapiens
gcacuggccaucaucuaca

SEQ ID NO: 1376642 - RNA, 19 nt, Homo sapiens
gacaugaccuccgaguucu

SEQ ID NO: 1376643 - RNA, 19 nt, Homo sapiens
gcagacaaacauucagagu

SEQ ID NO: 1376644 - RNA, 19 nt, Homo sapiens
cagaucacguccaccuuca

SEQ ID NO: 1376645 - RNA, 19 nt, Homo sapiens
cagccgcucucguccaugu

SEQ ID NO: 1376646 - RNA, 19 nt, Homo sapiens
cagacaaacauucagaguu

SEQ ID NO: 1376647 - RNA, 19 nt, Homo sapiens
caagcaauccaggaacaaa

SEQ ID NO: 1376648 - RNA, 19 nt, Homo sapiens
cgacagagacagggaguca

SEQ ID NO: 1376649 - RNA, 19 nt, Homo sapiens
gacaguggagagaaacauu

SEQ ID NO: 1376650 - RNA, 19 nt, Homo sapiens
ccagcaccaucaaccucua

SEQ ID NO: 1376651 - RNA, 19 nt, Homo sapiens
gggauccugcucaauaaug

SEQ ID NO: 1376652 - RNA, 19 nt, Homo sapiens
gagcagcagagcagcacaa

SEQ ID NO: 1376653 - RNA, 19 nt, Homo sapiens
guucggcuaugacgugaag

SEQ ID NO: 1376654 - RNA, 19 nt, Homo sapiens
acuacaagcccgaguucua

SEQ ID NO: 1376655 - RNA, 19 nt, Homo sapiens
cacccgaucuccuacuaca

SEQ ID NO: 1376656 - RNA, 19 nt, Homo sapiens
gagcagcacaauaaaugag

SEQ ID NO: 1376657 - RNA, 19 nt, Homo sapiens
gaccaggcagacaaacauu

SEQ ID NO: 1376658 - RNA, 19 nt, Homo sapiens
ccaggcagacaaacauuca

SEQ ID NO: 1376659 - RNA, 19 nt, Homo sapiens
aaacauugaccaggaagug

SEQ ID NO: 1376660 - RNA, 19 nt, Homo sapiens
cuaccagcaucaccaacga

SEQ ID NO: 1376661 - RNA, 19 nt, Homo sapiens
auggaugacuucagcucua

SEQ ID NO: 1376662 - RNA, 19 nt, Homo sapiens
acagagacagggagucaga

SEQ ID NO: 1376663 - RNA, 19 nt, Homo sapiens
gcaauccaggaacaaaaua

SEQ ID NO: 1376664 - RNA, 19 nt, Homo sapiens
caccaucacacccagauca

SEQ ID NO: 1376665 - RNA, 19 nt, Homo sapiens
agcgggauccugcucaaua

SEQ ID NO: 1376666 - RNA, 19 nt, Homo sapiens
gaaacauugaccaggaagu

SEQ ID NO: 1376667 - RNA, 19 nt, Homo sapiens
uaaugaaauggaugacuuc

SEQ ID NO: 1376668 - RNA, 19 nt, Homo sapiens
ccugcucaauaaugaaaug

SEQ ID NO: 1376669 - RNA, 19 nt, Homo sapiens
ucagcgggauccugcucaa

SEQ ID NO: 1376670 - RNA, 19 nt, Homo sapiens
caguggagagaaacauuga

SEQ ID NO: 1376671 - RNA, 19 nt, Homo sapiens
gcaccaucaaccucuacuu

SEQ ID NO: 1376672 - RNA, 19 nt, Homo sapiens
gaauauaacuccugucuua

SEQ ID NO: 1376673 - RNA, 19 nt, Homo sapiens
gaaaggagaaugcaaacuu

SEQ ID NO: 1376674 - RNA, 19 nt, Homo sapiens
gcuaaaggauacugucauu

SEQ ID NO: 1376675 - RNA, 19 nt, Homo sapiens
ccacacaccugucaacaug

SEQ ID NO: 1376676 - RNA, 19 nt, Homo sapiens
gcuuauagaugcuaaagga

SEQ ID NO: 1376677 - RNA, 19 nt, Homo sapiens
gagauggucuugcucuguu

SEQ ID NO: 1376678 - RNA, 19 nt, Homo sapiens
ggauaaaugcaacaaguuu

SEQ ID NO: 1376679 - RNA, 19 nt, Homo sapiens
uaaaggauacugucauuug

SEQ ID NO: 1376680 - RNA, 19 nt, Homo sapiens
gcacccagccucuuaacaa

SEQ ID NO: 1376681 - RNA, 19 nt, Homo sapiens
gcaaagagaggcuaaaauu

SEQ ID NO: 1376682 - RNA, 19 nt, Homo sapiens
gaccaaggacugaauauuc

SEQ ID NO: 1376683 - RNA, 19 nt, Homo sapiens
auauaaagcugcacaagau

SEQ ID NO: 1376684 - RNA, 19 nt, Homo sapiens
gauacugucauuugcauuu

SEQ ID NO: 1376685 - RNA, 19 nt, Homo sapiens
uaaagaagauggaaaagga

SEQ ID NO: 1376686 - RNA, 19 nt, Homo sapiens
gaagauggcagcugcuauc

SEQ ID NO: 1376687 - RNA, 19 nt, Homo sapiens
gagcucugcugacuucugu

SEQ ID NO: 1376688 - RNA, 19 nt, Homo sapiens
gaaguaaagaagauggaaa

SEQ ID NO: 1376689 - RNA, 19 nt, Homo sapiens
ggagugcagugacgugauc

SEQ ID NO: 1376690 - RNA, 19 nt, Homo sapiens
gauaauucaucaccuucga

SEQ ID NO: 1376691 - RNA, 19 nt, Homo sapiens
aaaggagaaugcaaacuuc

SEQ ID NO: 1376692 - RNA, 19 nt, Homo sapiens
gaaugaccccugucuuuua

SEQ ID NO: 1376693 - RNA, 19 nt, Homo sapiens
ggacugaauauuccaagug

SEQ ID NO: 1376694 - RNA, 19 nt, Homo sapiens
gcaccacgaccagcuaauu

SEQ ID NO: 1376695 - RNA, 19 nt, Homo sapiens
ccuguacccuuucccauga

SEQ ID NO: 1376696 - RNA, 19 nt, Homo sapiens
acagauaauucaucaccuu

SEQ ID NO: 1376697 - RNA, 19 nt, Homo sapiens
gacugaauauuccaagugu

SEQ ID NO: 1376698 - RNA, 19 nt, Homo sapiens
ggaccaaggacugaauauu

SEQ ID NO: 1376699 - RNA, 19 nt, Homo sapiens
ggagaaugcaaacuucaga

SEQ ID NO: 1376700 - RNA, 19 nt, Homo sapiens
acugcaaccucaaggauaa

SEQ ID NO: 1376701 - RNA, 19 nt, Homo sapiens
cccagccucuuaacaaauu

SEQ ID NO: 1376702 - RNA, 19 nt, Homo sapiens
cacccagccucuuaacaaa

SEQ ID NO: 1376703 - RNA, 19 nt, Homo sapiens
cauauaaagcugcacaaga

SEQ ID NO: 1376704 - RNA, 19 nt, Homo sapiens
gauaaucuccaccuacaag

SEQ ID NO: 1376705 - RNA, 19 nt, Homo sapiens
aagaagcccugcccagugu

SEQ ID NO: 1376706 - RNA, 19 nt, Homo sapiens
aaggauaaaugcaacaagu

SEQ ID NO: 1376707 - RNA, 19 nt, Homo sapiens
gauaaaugcaacaaguuuc

SEQ ID NO: 1376708 - RNA, 19 nt, Homo sapiens
ccaccuacaagcauauaaa

SEQ ID NO: 1376709 - RNA, 19 nt, Homo sapiens
gcgaccagcugcacuucug

SEQ ID NO: 1376710 - RNA, 19 nt, Homo sapiens
guucacaucguacauaauc

SEQ ID NO: 1376711 - RNA, 19 nt, Homo sapiens
aaacggucccaucagcuua

SEQ ID NO: 1376712 - RNA, 19 nt, Homo sapiens
gaauauuccaaguguuguu

SEQ ID NO: 1376713 - RNA, 19 nt, Homo sapiens
aaagagaggcuaaaauuga

SEQ ID NO: 1376714 - RNA, 19 nt, Homo sapiens
caaguuucaugugugcaaa

SEQ ID NO: 1376715 - RNA, 19 nt, Homo sapiens
uauagaugcuaaaggauac

SEQ ID NO: 1376716 - RNA, 19 nt, Homo sapiens
ucccagagugcuaggauua

SEQ ID NO: 1376717 - RNA, 19 nt, Homo sapiens
caaacggucccaucagcuu

SEQ ID NO: 1376718 - RNA, 19 nt, Homo sapiens
caccacgaccagcuaauuu

SEQ ID NO: 1376719 - RNA, 19 nt, Homo sapiens
gcaaacuucagaccugcaa

SEQ ID NO: 1376720 - RNA, 19 nt, Homo sapiens
gauauccacacaccuguca

SEQ ID NO: 1376721 - RNA, 19 nt, Homo sapiens
ucucauaagcaucuuucua

SEQ ID NO: 1376722 - RNA, 19 nt, Homo sapiens
ugcaacaaguuucaugugu

SEQ ID NO: 1376723 - RNA, 19 nt, Homo sapiens
aaaggauacugucauuugc

SEQ ID NO: 1376724 - RNA, 19 nt, Homo sapiens
ccagagugcuaggauuaca

SEQ ID NO: 1376725 - RNA, 19 nt, Homo sapiens
cagcuucggauccugcuuu

SEQ ID NO: 1376726 - RNA, 19 nt, Homo sapiens
cucauaagcaucuuucuau

SEQ ID NO: 1376727 - RNA, 19 nt, Homo sapiens
uggucuaccuguacccuuu

SEQ ID NO: 1376728 - RNA, 19 nt, Homo sapiens
cagggcaagugcugaagau

SEQ ID NO: 1376729 - RNA, 19 nt, Homo sapiens
uggcaauccuagaguacuu

SEQ ID NO: 1376730 - RNA, 19 nt, Homo sapiens
cugaauauuccaaguguug

SEQ ID NO: 1376731 - RNA, 19 nt, Homo sapiens
gagaaguaaagaagaugga

SEQ ID NO: 1376732 - RNA, 19 nt, Homo sapiens
cagaaugaccccugucuuu

SEQ ID NO: 1376733 - RNA, 19 nt, Homo sapiens
ugugaaaggagaaugcaaa

SEQ ID NO: 1376734 - RNA, 19 nt, Homo sapiens
ucacugcagccuugacuuc

SEQ ID NO: 1376735 - RNA, 19 nt, Homo sapiens
gcaauccuagaguacuuug

SEQ ID NO: 1376736 - RNA, 19 nt, Homo sapiens
gaggguauuuugccauguu

SEQ ID NO: 1376737 - RNA, 19 nt, Homo sapiens
uagcugggacuacagguau

SEQ ID NO: 1376738 - RNA, 19 nt, Homo sapiens
caaagagaggcuaaaauug

SEQ ID NO: 1376739 - RNA, 19 nt, Homo sapiens
acacaccugucaacaugca

SEQ ID NO: 1376740 - RNA, 19 nt, Homo sapiens
caggaccaaggacugaaua

SEQ ID NO: 1376741 - RNA, 19 nt, Homo sapiens
cuacaggaccaaggacuga

SEQ ID NO: 1376742 - RNA, 19 nt, Homo sapiens
uaacuccugucuuaaaauc

SEQ ID NO: 1376743 - RNA, 19 nt, Homo sapiens
uuguucacaucguacauaa

SEQ ID NO: 1376744 - RNA, 19 nt, Homo sapiens
aaccgggacugcuggucua

SEQ ID NO: 1376745 - RNA, 19 nt, Homo sapiens
auucaucaccuucgacuga

SEQ ID NO: 1376746 - RNA, 19 nt, Homo sapiens
cuaaaggauacugucauuu

SEQ ID NO: 1376747 - RNA, 19 nt, Homo sapiens
ggacauugaacaggcaaag

SEQ ID NO: 1376748 - RNA, 19 nt, Homo sapiens
ugcgagaaguaaagaagau

SEQ ID NO: 1376749 - RNA, 19 nt, Homo sapiens
cccagugucuugcgagaag

SEQ ID NO: 1376750 - RNA, 19 nt, Homo sapiens
caccuucgacugagcauuc

SEQ ID NO: 1376751 - RNA, 19 nt, Homo sapiens
gcauauaaagcugcacaag

SEQ ID NO: 1376752 - RNA, 19 nt, Homo sapiens
ccagccucuuaacaaauuu

SEQ ID NO: 1376753 - RNA, 19 nt, Homo sapiens
auggagcucugcugacuuc

SEQ ID NO: 1376754 - RNA, 19 nt, Homo sapiens
uguacccuuucccaugaua

SEQ ID NO: 1376755 - RNA, 19 nt, Homo sapiens
gacugcuggucuaccugua

SEQ ID NO: 1376756 - RNA, 19 nt, Homo sapiens
gcuaggauuacaggcauga

SEQ ID NO: 1376757 - RNA, 19 nt, Homo sapiens
gcaaccucaaggauaaaug

SEQ ID NO: 1376758 - RNA, 19 nt, Homo sapiens
caaccucaaggauaaaugc

SEQ ID NO: 1376759 - RNA, 19 nt, Homo sapiens
uuccugggcucaagugauc

SEQ ID NO: 1376760 - RNA, 19 nt, Homo sapiens
ucacaucguacauaaucau

SEQ ID NO: 1376761 - RNA, 19 nt, Homo sapiens
gauaggaacucuuuauugu

SEQ ID NO: 1376762 - RNA, 19 nt, Homo sapiens
gaagaaagaaugcauguug

SEQ ID NO: 1376763 - RNA, 19 nt, Homo sapiens
gaaauacauuccuguguug

SEQ ID NO: 1376764 - RNA, 19 nt, Homo sapiens
gaaaagaucuuccgcaaau

SEQ ID NO: 1376765 - RNA, 19 nt, Homo sapiens
ucaagaauguguccaguuu

SEQ ID NO: 1376766 - RNA, 19 nt, Homo sapiens
gaaugucagugcuauugua

SEQ ID NO: 1376767 - RNA, 19 nt, Homo sapiens
gcaacgaagucuaguuuag

SEQ ID NO: 1376768 - RNA, 19 nt, Homo sapiens
gagauuauaggauggaaua

SEQ ID NO: 1376769 - RNA, 19 nt, Homo sapiens
gcaaaucuguggaauucug

SEQ ID NO: 1376770 - RNA, 19 nt, Homo sapiens
caaauaaagccaugucuau

SEQ ID NO: 1376771 - RNA, 19 nt, Homo sapiens
gaccaaagcacuguuagua

SEQ ID NO: 1376772 - RNA, 19 nt, Homo sapiens
gaauguggcucauguucug

SEQ ID NO: 1376773 - RNA, 19 nt, Homo sapiens
gcaaauaaagccaugucua

SEQ ID NO: 1376774 - RNA, 19 nt, Homo sapiens
guacggguauguuugcauu

SEQ ID NO: 1376775 - RNA, 19 nt, Homo sapiens
gaguugacguuucagcuuu

SEQ ID NO: 1376776 - RNA, 19 nt, Homo sapiens
agaaauacauuccuguguu

SEQ ID NO: 1376777 - RNA, 19 nt, Homo sapiens
caaagaagccauugguuuc

SEQ ID NO: 1376778 - RNA, 19 nt, Homo sapiens
ccagacaauugaaagcuuu

SEQ ID NO: 1376779 - RNA, 19 nt, Homo sapiens
ccagacagcuccugaagag

SEQ ID NO: 1376780 - RNA, 19 nt, Homo sapiens
uaccaucucugcauuguga

SEQ ID NO: 1376781 - RNA, 19 nt, Homo sapiens
ccgcaaaucuguggaauuc

SEQ ID NO: 1376782 - RNA, 19 nt, Homo sapiens
gaaaacaugucaaaacaca

SEQ ID NO: 1376783 - RNA, 19 nt, Homo sapiens
guacaaguauaaugggaau

SEQ ID NO: 1376784 - RNA, 19 nt, Homo sapiens
agaauacagucacagauga

SEQ ID NO: 1376785 - RNA, 19 nt, Homo sapiens
gaaugcauguugggaagaa

SEQ ID NO: 1376786 - RNA, 19 nt, Homo sapiens
cagaggaguugaugaggaa

SEQ ID NO: 1376787 - RNA, 19 nt, Homo sapiens
uagaugcccugaucacuug

SEQ ID NO: 1376788 - RNA, 19 nt, Homo sapiens
ggaagaauacagucacaga

SEQ ID NO: 1376789 - RNA, 19 nt, Homo sapiens
acaaagaagccauugguuu

SEQ ID NO: 1376790 - RNA, 19 nt, Homo sapiens
gcaaguacaggaagcaaga

SEQ ID NO: 1376791 - RNA, 19 nt, Homo sapiens
augaaaccauggagaaaua

SEQ ID NO: 1376792 - RNA, 19 nt, Homo sapiens
gaaugaauaugaugaaacc

SEQ ID NO: 1376793 - RNA, 19 nt, Homo sapiens
gcagauguccuggcagaaa

SEQ ID NO: 1376794 - RNA, 19 nt, Homo sapiens
caaaauggcuuucuuacgu

SEQ ID NO: 1376795 - RNA, 19 nt, Homo sapiens
ugacaguguuauucaagaa

SEQ ID NO: 1376796 - RNA, 19 nt, Homo sapiens
caugauguguggaaguuga

SEQ ID NO: 1376797 - RNA, 19 nt, Homo sapiens
cuaucucuaugacuucuua

SEQ ID NO: 1376798 - RNA, 19 nt, Homo sapiens
uagggacuaugcaguguaa

SEQ ID NO: 1376799 - RNA, 19 nt, Homo sapiens
agauagaguugacguuuca

SEQ ID NO: 1376800 - RNA, 19 nt, Homo sapiens
gucaagaagcauuaugaua

SEQ ID NO: 1376801 - RNA, 19 nt, Homo sapiens
ggaauucuguaacgaccau

SEQ ID NO: 1376802 - RNA, 19 nt, Homo sapiens
aaaaggcagugaaugaaua

SEQ ID NO: 1376803 - RNA, 19 nt, Homo sapiens
uuuggucacugauauguaa

SEQ ID NO: 1376804 - RNA, 19 nt, Homo sapiens
caucacuucugcuuucuuc

SEQ ID NO: 1376805 - RNA, 19 nt, Homo sapiens
gaagaauacagucacagau

SEQ ID NO: 1376806 - RNA, 19 nt, Homo sapiens
uuaggacacugugaacuuu

SEQ ID NO: 1376807 - RNA, 19 nt, Homo sapiens
uuugguauuucucgaguua

SEQ ID NO: 1376808 - RNA, 19 nt, Homo sapiens
cuuggcaucuuuauauuug

SEQ ID NO: 1376809 - RNA, 19 nt, Homo sapiens
caaauacaaagaagccauu

SEQ ID NO: 1376810 - RNA, 19 nt, Homo sapiens
ucacugauauguaaaugac

SEQ ID NO: 1376811 - RNA, 19 nt, Homo sapiens
ccagauagaguugacguuu

SEQ ID NO: 1376812 - RNA, 19 nt, Homo sapiens
ugaagaagcagaggaguug

SEQ ID NO: 1376813 - RNA, 19 nt, Homo sapiens
gcaaguaaccccagauaga

SEQ ID NO: 1376814 - RNA, 19 nt, Homo sapiens
gagaaauacauuccugugu

SEQ ID NO: 1376815 - RNA, 19 nt, Homo sapiens
cacccuaucucuaugacuu

SEQ ID NO: 1376816 - RNA, 19 nt, Homo sapiens
cagauagaguugacguuuc

SEQ ID NO: 1376817 - RNA, 19 nt, Homo sapiens
gaugaguccagacaauuga

SEQ ID NO: 1376818 - RNA, 19 nt, Homo sapiens
acagaugaguccagacaau

SEQ ID NO: 1376819 - RNA, 19 nt, Homo sapiens
ugauaggaacucuuuauug

SEQ ID NO: 1376820 - RNA, 19 nt, Homo sapiens
ggugauaggaacucuuuau

SEQ ID NO: 1376821 - RNA, 19 nt, Homo sapiens
gaugaaaccauggagaaau

SEQ ID NO: 1376822 - RNA, 19 nt, Homo sapiens
uaugagguuuggucaguga

SEQ ID NO: 1376823 - RNA, 19 nt, Homo sapiens
ccucacacccuaucucuau

SEQ ID NO: 1376824 - RNA, 19 nt, Homo sapiens
caucuggucuugcccucaa

SEQ ID NO: 1376825 - RNA, 19 nt, Homo sapiens
ugacaaucaucuggucuug

SEQ ID NO: 1376826 - RNA, 19 nt, Homo sapiens
ccagaaggguagggacuau

SEQ ID NO: 1376827 - RNA, 19 nt, Homo sapiens
gaugcuuccuguccuuguu

SEQ ID NO: 1376828 - RNA, 19 nt, Homo sapiens
uaugauaacauccugaaug

SEQ ID NO: 1376829 - RNA, 19 nt, Homo sapiens
guuaugagguuuggucagu

SEQ ID NO: 1376830 - RNA, 19 nt, Homo sapiens
cauaccugcuguuauugaa

SEQ ID NO: 1376831 - RNA, 19 nt, Homo sapiens
cauugugaauuuggugaua

SEQ ID NO: 1376832 - RNA, 19 nt, Homo sapiens
gcagcucucuuaugaugac

SEQ ID NO: 1376833 - RNA, 19 nt, Homo sapiens
cuucuuagaugcccugauc

SEQ ID NO: 1376834 - RNA, 19 nt, Homo sapiens
cugcaucacuucugcuuuc

SEQ ID NO: 1376835 - RNA, 19 nt, Homo sapiens
ucaaaagcuuggagccuua

SEQ ID NO: 1376836 - RNA, 19 nt, Homo sapiens
ccugaucacuugccagaca

SEQ ID NO: 1376837 - RNA, 19 nt, Homo sapiens
caaguauaaugggaauuuc

SEQ ID NO: 1376838 - RNA, 19 nt, Homo sapiens
aaagaugcuuccuguccuu

SEQ ID NO: 1376839 - RNA, 19 nt, Homo sapiens
uaugaugacccaaauagga

SEQ ID NO: 1376840 - RNA, 19 nt, Homo sapiens
ggcagugaaugaauaugau

SEQ ID NO: 1376841 - RNA, 19 nt, Homo sapiens
gugauaggaacucuuuauu

SEQ ID NO: 1376842 - RNA, 19 nt, Homo sapiens
ugaggaagauugaaaagga

SEQ ID NO: 1376843 - RNA, 19 nt, Homo sapiens
ggucacugauauguaaaug

SEQ ID NO: 1376844 - RNA, 19 nt, Homo sapiens
gagacucaccaagcaagua

SEQ ID NO: 1376845 - RNA, 19 nt, Homo sapiens
aacaauugcuagaguaaca

SEQ ID NO: 1376846 - RNA, 19 nt, Homo sapiens
gccuuggcaucuuuauauu

SEQ ID NO: 1376847 - RNA, 19 nt, Homo sapiens
ccauagucaagaagcauua

SEQ ID NO: 1376848 - RNA, 19 nt, Homo sapiens
gaaguugaauguggcucau

SEQ ID NO: 1376849 - RNA, 19 nt, Homo sapiens
uaugcugucugauaaaucu

SEQ ID NO: 1376850 - RNA, 19 nt, Homo sapiens
uaggauggaauaaguaguu

SEQ ID NO: 1376851 - RNA, 19 nt, Homo sapiens
gaacuuuauggcacaaaca

SEQ ID NO: 1376852 - RNA, 19 nt, Homo sapiens
gaguugaugaggaagauug

SEQ ID NO: 1376853 - RNA, 19 nt, Homo sapiens
uaaucucuguguuuccuau

SEQ ID NO: 1376854 - RNA, 19 nt, Homo sapiens
ccuuuaacuuucuggauug

SEQ ID NO: 1376855 - RNA, 19 nt, Homo sapiens
gauauguaaaugacugcua

SEQ ID NO: 1376856 - RNA, 19 nt, Homo sapiens
gguagggacuaugcagugu

SEQ ID NO: 1376857 - RNA, 19 nt, Homo sapiens
aggauggaauaaguaguua

SEQ ID NO: 1376858 - RNA, 19 nt, Homo sapiens
gagcagcuucggagacuca

SEQ ID NO: 1376859 - RNA, 19 nt, Homo sapiens
uggcuaaucucuguguuuc

SEQ ID NO: 1376860 - RNA, 19 nt, Homo sapiens
uccuuuaacuuucuggauu

SEQ ID NO: 1376861 - RNA, 19 nt, Homo sapiens
ggaaauugcuacuaagaaa

SEQ ID NO: 1376862 - RNA, 19 nt, Homo sapiens
gcacuaagcuaccagagaa

SEQ ID NO: 1376863 - RNA, 19 nt, Homo sapiens
gaaauacgcuuaguugaug

SEQ ID NO: 1376864 - RNA, 19 nt, Homo sapiens
ggacugaaauuacaccaaa

SEQ ID NO: 1376865 - RNA, 19 nt, Homo sapiens
gaagaaauacgcuuaguug

SEQ ID NO: 1376866 - RNA, 19 nt, Homo sapiens
gaaucaagcuauccaaaug

SEQ ID NO: 1376867 - RNA, 19 nt, Homo sapiens
guacuaauguuucaaccaa

SEQ ID NO: 1376868 - RNA, 19 nt, Homo sapiens
gaacucuuaugcuguacua

SEQ ID NO: 1376869 - RNA, 19 nt, Homo sapiens
gcaagucaguucucauuuc

SEQ ID NO: 1376870 - RNA, 19 nt, Homo sapiens
ugaaagaggacugaaauua

SEQ ID NO: 1376871 - RNA, 19 nt, Homo sapiens
gaaaccugauucaacuuaa

SEQ ID NO: 1376872 - RNA, 19 nt, Homo sapiens
gaagugccuugauuuccua

SEQ ID NO: 1376873 - RNA, 19 nt, Homo sapiens
gcugagaagugccuugauu

SEQ ID NO: 1376874 - RNA, 19 nt, Homo sapiens
caacuuaaccgaacucuca

SEQ ID NO: 1376875 - RNA, 19 nt, Homo sapiens
caugaacucuuaugcugua

SEQ ID NO: 1376876 - RNA, 19 nt, Homo sapiens
gaaauaagugccugcaguu

SEQ ID NO: 1376877 - RNA, 19 nt, Homo sapiens
caaaugcgauuaguugaug

SEQ ID NO: 1376878 - RNA, 19 nt, Homo sapiens
gaaagaggacugaaauuac

SEQ ID NO: 1376879 - RNA, 19 nt, Homo sapiens
ggagaaaagugucacaaaa

SEQ ID NO: 1376880 - RNA, 19 nt, Homo sapiens
gaucugaggaggaaacgua

SEQ ID NO: 1376881 - RNA, 19 nt, Homo sapiens
gaagcggguuuaugaggaa

SEQ ID NO: 1376882 - RNA, 19 nt, Homo sapiens
caacaucacccuccgagaa

SEQ ID NO: 1376883 - RNA, 19 nt, Homo sapiens
aaagaggacugaaauuaca

SEQ ID NO: 1376884 - RNA, 19 nt, Homo sapiens
ccagagauguccagaagau

SEQ ID NO: 1376885 - RNA, 19 nt, Homo sapiens
uaaccgaacucucaggaau

SEQ ID NO: 1376886 - RNA, 19 nt, Homo sapiens
gagcaagucaguucucauu

SEQ ID NO: 1376887 - RNA, 19 nt, Homo sapiens
uuaagaagcggguuuauga

SEQ ID NO: 1376888 - RNA, 19 nt, Homo sapiens
gcugugaacuugauugagu

SEQ ID NO: 1376889 - RNA, 19 nt, Homo sapiens
ccaauuccuucuucuaaug

SEQ ID NO: 1376890 - RNA, 19 nt, Homo sapiens
gcaguuacuuggcaaucuu

SEQ ID NO: 1376891 - RNA, 19 nt, Homo sapiens
cgucugcagucuauacaua

SEQ ID NO: 1376892 - RNA, 19 nt, Homo sapiens
ggaaacguacugcacauga

SEQ ID NO: 1376893 - RNA, 19 nt, Homo sapiens
aggaggaaauugcuacuaa

SEQ ID NO: 1376894 - RNA, 19 nt, Homo sapiens
gcucuauccugaaagcauu

SEQ ID NO: 1376895 - RNA, 19 nt, Homo sapiens
agagauguccagaagauua

SEQ ID NO: 1376896 - RNA, 19 nt, Homo sapiens
ucaacauccugcagaauga

SEQ ID NO: 1376897 - RNA, 19 nt, Homo sapiens
aagaucagcuugacacugu

SEQ ID NO: 1376898 - RNA, 19 nt, Homo sapiens
gaaaauugcaucauuguug

SEQ ID NO: 1376899 - RNA, 19 nt, Homo sapiens
ggaaguacgucugcagucu

SEQ ID NO: 1376900 - RNA, 19 nt, Homo sapiens
gagaaugauccaucuguga

SEQ ID NO: 1376901 - RNA, 19 nt, Homo sapiens
ggauucucuuggaacauua

SEQ ID NO: 1376902 - RNA, 19 nt, Homo sapiens
uaagcugaguaucacauuu

SEQ ID NO: 1376903 - RNA, 19 nt, Homo sapiens
gaaacguacugcacaugag

SEQ ID NO: 1376904 - RNA, 19 nt, Homo sapiens
ggauucaucuugcauuggu

SEQ ID NO: 1376905 - RNA, 19 nt, Homo sapiens
gagaugaugcucccaagga

SEQ ID NO: 1376906 - RNA, 19 nt, Homo sapiens
ggaggaaauugcuacuaag

SEQ ID NO: 1376907 - RNA, 19 nt, Homo sapiens
uuagaaaccugauucaacu

SEQ ID NO: 1376908 - RNA, 19 nt, Homo sapiens
gaaguacgucugcagucua

SEQ ID NO: 1376909 - RNA, 19 nt, Homo sapiens
caagucaguucucauuucu

SEQ ID NO: 1376910 - RNA, 19 nt, Homo sapiens
gagaaucaagcuauccaaa

SEQ ID NO: 1376911 - RNA, 19 nt, Homo sapiens
gaggaaauugcuacuaaga

SEQ ID NO: 1376912 - RNA, 19 nt, Homo sapiens
cgaugaaauugaggaagua

SEQ ID NO: 1376913 - RNA, 19 nt, Homo sapiens
guuggaagaugagauguau

SEQ ID NO: 1376914 - RNA, 19 nt, Homo sapiens
ggaauucacgaaagugguu

SEQ ID NO: 1376915 - RNA, 19 nt, Homo sapiens
cccauaaugugguaaaugu

SEQ ID NO: 1376916 - RNA, 19 nt, Homo sapiens
cagacugcauuauggauga

SEQ ID NO: 1376917 - RNA, 19 nt, Homo sapiens
ucaccagacugcauuaugg

SEQ ID NO: 1376918 - RNA, 19 nt, Homo sapiens
caaggagaaugauccaucu

SEQ ID NO: 1376919 - RNA, 19 nt, Homo sapiens
ugugguagcuguuacaagu

SEQ ID NO: 1376920 - RNA, 19 nt, Homo sapiens
agaaaccugauucaacuua

SEQ ID NO: 1376921 - RNA, 19 nt, Homo sapiens
gacauuuguuccguccuua

SEQ ID NO: 1376922 - RNA, 19 nt, Homo sapiens
ucacugagucccauaaugu

SEQ ID NO: 1376923 - RNA, 19 nt, Homo sapiens
guucauggguuggaagaug

SEQ ID NO: 1376924 - RNA, 19 nt, Homo sapiens
agucaguucucauuucuug

SEQ ID NO: 1376925 - RNA, 19 nt, Homo sapiens
auagaucuguguaaagcua

SEQ ID NO: 1376926 - RNA, 19 nt, Homo sapiens
ugucagaacagcagcuaua

SEQ ID NO: 1376927 - RNA, 19 nt, Homo sapiens
ggaaagcguagagggagua

SEQ ID NO: 1376928 - RNA, 19 nt, Homo sapiens
gcagaugcuuugcaauacu

SEQ ID NO: 1376929 - RNA, 19 nt, Homo sapiens
acuaagaaacuccgacuaa

SEQ ID NO: 1376930 - RNA, 19 nt, Homo sapiens
gaggaaacguacugcacau

SEQ ID NO: 1376931 - RNA, 19 nt, Homo sapiens
gaccaagacccacguguca

SEQ ID NO: 1376932 - RNA, 19 nt, Homo sapiens
ucucaugguguaagaaaua

SEQ ID NO: 1376933 - RNA, 19 nt, Homo sapiens
gcuguuacaaguauagaaa

SEQ ID NO: 1376934 - RNA, 19 nt, Homo sapiens
ccaccuagcaaauauuaug

SEQ ID NO: 1376935 - RNA, 19 nt, Homo sapiens
cugcagcacuccacauaga

SEQ ID NO: 1376936 - RNA, 19 nt, Homo sapiens
uaucaaagacagcaggauu

SEQ ID NO: 1376937 - RNA, 19 nt, Homo sapiens
uaagaaacuccgacuaaca

SEQ ID NO: 1376938 - RNA, 19 nt, Homo sapiens
cagaugcuuugcaauacuu

SEQ ID NO: 1376939 - RNA, 19 nt, Homo sapiens
caucauuguuggguuuauu

SEQ ID NO: 1376940 - RNA, 19 nt, Homo sapiens
guuccguccuuauagauug

SEQ ID NO: 1376941 - RNA, 19 nt, Homo sapiens
ugacauuuguuccguccuu

SEQ ID NO: 1376942 - RNA, 19 nt, Homo sapiens
uggaagaugagauguauga

SEQ ID NO: 1376943 - RNA, 19 nt, Homo sapiens
agauacgucucauggugua

SEQ ID NO: 1376944 - RNA, 19 nt, Homo sapiens
agaaauacgcuuaguugau

SEQ ID NO: 1376945 - RNA, 19 nt, Homo sapiens
caugaaagaggacugaaau

SEQ ID NO: 1376946 - RNA, 19 nt, Homo sapiens
gagauguccagaagauuau

SEQ ID NO: 1376947 - RNA, 19 nt, Homo sapiens
uagcucaacugcuggauac

SEQ ID NO: 1376948 - RNA, 19 nt, Homo sapiens
aagaaacuccgacuaacaa

SEQ ID NO: 1376949 - RNA, 19 nt, Homo sapiens
ggucgucagucagcucuau

SEQ ID NO: 1376950 - RNA, 19 nt, Homo sapiens
cucaacugcuggauacuuu

SEQ ID NO: 1376951 - RNA, 19 nt, Homo sapiens
ccaucaacauccugcagaa

SEQ ID NO: 1376952 - RNA, 19 nt, Homo sapiens
ccaaagaagggauucaucu

SEQ ID NO: 1376953 - RNA, 19 nt, Homo sapiens
gugccuugauuuccuaguu

SEQ ID NO: 1376954 - RNA, 19 nt, Homo sapiens
aaauaagugccugcaguua

SEQ ID NO: 1376955 - RNA, 19 nt, Homo sapiens
gguagcuguuacaaguaua

SEQ ID NO: 1376956 - RNA, 19 nt, Homo sapiens
cuuaguugaugaugcguuu

SEQ ID NO: 1376957 - RNA, 19 nt, Homo sapiens
ugaagaaauacgcuuaguu

SEQ ID NO: 1376958 - RNA, 19 nt, Homo sapiens
ugaugacuaugaacaagug

SEQ ID NO: 1376959 - RNA, 19 nt, Homo sapiens
agaaaagugucacaaaaga

SEQ ID NO: 1376960 - RNA, 19 nt, Homo sapiens
ugaaaagucucaucaaguc

SEQ ID NO: 1376961 - RNA, 19 nt, Homo sapiens
ucaaucagcugaccauaua

SEQ ID NO: 1376962 - RNA, 19 nt, Homo sapiens
gaacacauuugcuuugaga

SEQ ID NO: 1376963 - RNA, 19 nt, Homo sapiens
ggaauuaacccucugcuuu

SEQ ID NO: 1376964 - RNA, 19 nt, Homo sapiens
gaucaagacuuuuccuuua

SEQ ID NO: 1376965 - RNA, 19 nt, Homo sapiens
ccagcgaacuccuguuuaa

SEQ ID NO: 1376966 - RNA, 19 nt, Homo sapiens
auaaagaggugagaucuaa

SEQ ID NO: 1376967 - RNA, 19 nt, Homo sapiens
ggagauaagagaucauauu

SEQ ID NO: 1376968 - RNA, 19 nt, Homo sapiens
aaacaaccauguacccaaa

SEQ ID NO: 1376969 - RNA, 19 nt, Homo sapiens
gagaguggguggagaguuc

SEQ ID NO: 1376970 - RNA, 19 nt, Homo sapiens
cacaauacguguacacuug

SEQ ID NO: 1376971 - RNA, 19 nt, Homo sapiens
ccaguggguugauuucuuu

SEQ ID NO: 1376972 - RNA, 19 nt, Homo sapiens
gcaggaacuuugugagaau

SEQ ID NO: 1376973 - RNA, 19 nt, Homo sapiens
gaacucaagccauacauca

SEQ ID NO: 1376974 - RNA, 19 nt, Homo sapiens
gaagauugcaugcaguuug

SEQ ID NO: 1376975 - RNA, 19 nt, Homo sapiens
guggagaguucuucuuuga

SEQ ID NO: 1376976 - RNA, 19 nt, Homo sapiens
gauaugagauaggaacaau

SEQ ID NO: 1376977 - RNA, 19 nt, Homo sapiens
gcgaacuccuguuuaagaa

SEQ ID NO: 1376978 - RNA, 19 nt, Homo sapiens
gaauuaacccucugcuuuc

SEQ ID NO: 1376979 - RNA, 19 nt, Homo sapiens
gaauuggcagugaaauaua

SEQ ID NO: 1376980 - RNA, 19 nt, Homo sapiens
gcaggaggagucggaauua

SEQ ID NO: 1376981 - RNA, 19 nt, Homo sapiens
cuagaaaccucguguugau

SEQ ID NO: 1376982 - RNA, 19 nt, Homo sapiens
caagagagagugauagaau

SEQ ID NO: 1376983 - RNA, 19 nt, Homo sapiens
caacugcuguacauccaaa

SEQ ID NO: 1376984 - RNA, 19 nt, Homo sapiens
gauugacacucagcacuuu

SEQ ID NO: 1376985 - RNA, 19 nt, Homo sapiens
gaacuccuguuuaagaaaa

SEQ ID NO: 1376986 - RNA, 19 nt, Homo sapiens
aaaguuucccugcuucuua

SEQ ID NO: 1376987 - RNA, 19 nt, Homo sapiens
gaagaauaacggagaagga

SEQ ID NO: 1376988 - RNA, 19 nt, Homo sapiens
cagcugaccauauacuuaa

SEQ ID NO: 1376989 - RNA, 19 nt, Homo sapiens
ucagagagcaggcaaacaa

SEQ ID NO: 1376990 - RNA, 19 nt, Homo sapiens
gagauugugucagcagcua

SEQ ID NO: 1376991 - RNA, 19 nt, Homo sapiens
ugaauuuccugagaagauu

SEQ ID NO: 1376992 - RNA, 19 nt, Homo sapiens
cguguacacuugacuguga

SEQ ID NO: 1376993 - RNA, 19 nt, Homo sapiens
gauagaauuggcagugaaa

SEQ ID NO: 1376994 - RNA, 19 nt, Homo sapiens
aagagagagugauagaauu

SEQ ID NO: 1376995 - RNA, 19 nt, Homo sapiens
uagaauuggcagugaaaua

SEQ ID NO: 1376996 - RNA, 19 nt, Homo sapiens
augcggaacucaagccaua

SEQ ID NO: 1376997 - RNA, 19 nt, Homo sapiens
aaacagacuacacaaauca

SEQ ID NO: 1376998 - RNA, 19 nt, Homo sapiens
gagaagauugcaugcaguu

SEQ ID NO: 1376999 - RNA, 19 nt, Homo sapiens
acggucagcuuguuaauuc

SEQ ID NO: 1377000 - RNA, 19 nt, Homo sapiens
caucacggaaggaagaaua

SEQ ID NO: 1377001 - RNA, 19 nt, Homo sapiens
caggaggagucggaauuaa

SEQ ID NO: 1377002 - RNA, 19 nt, Homo sapiens
gguggagaguucuucuuug

SEQ ID NO: 1377003 - RNA, 19 nt, Homo sapiens
gaacaagagagagugauag

SEQ ID NO: 1377004 - RNA, 19 nt, Homo sapiens
ccagacugcuagaacaaga

SEQ ID NO: 1377005 - RNA, 19 nt, Homo sapiens
guggguugauuucuuuauu

SEQ ID NO: 1377006 - RNA, 19 nt, Homo sapiens
uaaccagcauaaugaaauc

SEQ ID NO: 1377007 - RNA, 19 nt, Homo sapiens
cuucuuaucgucugcuuua

SEQ ID NO: 1377008 - RNA, 19 nt, Homo sapiens
caaaagaaauggauaugag

SEQ ID NO: 1377009 - RNA, 19 nt, Homo sapiens
gccaguggguugauuucuu

SEQ ID NO: 1377010 - RNA, 19 nt, Homo sapiens
ggccugugcugcuguuaug

SEQ ID NO: 1377011 - RNA, 19 nt, Homo sapiens
aagaacacauuugcuuuga

SEQ ID NO: 1377012 - RNA, 19 nt, Homo sapiens
agaaggagauaagagauca

SEQ ID NO: 1377013 - RNA, 19 nt, Homo sapiens
gaauaacggagaaggagau

SEQ ID NO: 1377014 - RNA, 19 nt, Homo sapiens
aaacuauucuacagugcaa

SEQ ID NO: 1377015 - RNA, 19 nt, Homo sapiens
ucagcugaccauauacuua

SEQ ID NO: 1377016 - RNA, 19 nt, Homo sapiens
agaaauggauaugagauag

SEQ ID NO: 1377017 - RNA, 19 nt, Homo sapiens
ccaagcaacuggaaaacaa

SEQ ID NO: 1377018 - RNA, 19 nt, Homo sapiens
uaacggagaaggagauaag

SEQ ID NO: 1377019 - RNA, 19 nt, Homo sapiens
ggguggagaguucuucuuu

SEQ ID NO: 1377020 - RNA, 19 nt, Homo sapiens
ugauagaauuggcagugaa

SEQ ID NO: 1377021 - RNA, 19 nt, Homo sapiens
gaccauauacuuaaugacu

SEQ ID NO: 1377022 - RNA, 19 nt, Homo sapiens
aaauggauaugagauagga

SEQ ID NO: 1377023 - RNA, 19 nt, Homo sapiens
agaauuggcagugaaauau

SEQ ID NO: 1377024 - RNA, 19 nt, Homo sapiens
gugauagaauuggcaguga

SEQ ID NO: 1377025 - RNA, 19 nt, Homo sapiens
gggcgacggucagcuuguu

SEQ ID NO: 1377026 - RNA, 19 nt, Homo sapiens
agaacaagagagagugaua

SEQ ID NO: 1377027 - RNA, 19 nt, Homo sapiens
gaagagccuccgcuugcuu

SEQ ID NO: 1377028 - RNA, 19 nt, Homo sapiens
acucuaaccagcauaauga

SEQ ID NO: 1377029 - RNA, 19 nt, Homo sapiens
gagaaggagauaagagauc

SEQ ID NO: 1377030 - RNA, 19 nt, Homo sapiens
caaaacagacuacacaaau

SEQ ID NO: 1377031 - RNA, 19 nt, Homo sapiens
cgucugcuuuaacgccuua

SEQ ID NO: 1377032 - RNA, 19 nt, Homo sapiens
ggagaaggagauaagagau

SEQ ID NO: 1377033 - RNA, 19 nt, Homo sapiens
ggaccaaaauauucuguca

SEQ ID NO: 1377034 - RNA, 19 nt, Homo sapiens
agaaaccucguguugauug

SEQ ID NO: 1377035 - RNA, 19 nt, Homo sapiens
agagagagugauagaauug

SEQ ID NO: 1377036 - RNA, 19 nt, Homo sapiens
caggaacuuugugagaauu

SEQ ID NO: 1377037 - RNA, 19 nt, Homo sapiens
gggaggcgagagcagcuua

SEQ ID NO: 1377038 - RNA, 19 nt, Homo sapiens
uaugauuccuggguuguug

SEQ ID NO: 1377039 - RNA, 19 nt, Homo sapiens
acaaccauguacccaaaga

SEQ ID NO: 1377040 - RNA, 19 nt, Homo sapiens
ccuaaaaucucguggacuu

SEQ ID NO: 1377041 - RNA, 19 nt, Homo sapiens
guacccaaagaacacauuu

SEQ ID NO: 1377042 - RNA, 19 nt, Homo sapiens
ugcaggaacuuugugagaa

SEQ ID NO: 1377043 - RNA, 19 nt, Homo sapiens
cgcagcagaucuccucaga

SEQ ID NO: 1377044 - RNA, 19 nt, Homo sapiens
gcggaugccucuagaaacc

SEQ ID NO: 1377045 - RNA, 19 nt, Homo sapiens
cuaaccagcauaaugaaau

SEQ ID NO: 1377046 - RNA, 19 nt, Homo sapiens
uaccagcgaacuccuguuu

SEQ ID NO: 1377047 - RNA, 19 nt, Homo sapiens
gaaauggauaugagauagg

SEQ ID NO: 1377048 - RNA, 19 nt, Homo sapiens
cggagaaggagauaagaga

SEQ ID NO: 1377049 - RNA, 19 nt, Homo sapiens
aaggaagaauaacggagaa

SEQ ID NO: 1377050 - RNA, 19 nt, Homo sapiens
gcgacggucagcuuguuaa

SEQ ID NO: 1377051 - RNA, 19 nt, Homo sapiens
gaaaccucguguugauugc

SEQ ID NO: 1377052 - RNA, 19 nt, Homo sapiens
aaggaaaacugaucacaug

SEQ ID NO: 1377053 - RNA, 19 nt, Homo sapiens
cugaccauauacuuaauga

SEQ ID NO: 1377054 - RNA, 19 nt, Homo sapiens
uaaagaggugagaucuaaa

SEQ ID NO: 1377055 - RNA, 19 nt, Homo sapiens
uggguugauuucuuuauuc

SEQ ID NO: 1377056 - RNA, 19 nt, Homo sapiens
gcacuuugcgccaccuuac

SEQ ID NO: 1377057 - RNA, 19 nt, Homo sapiens
aaguuucccugcuucuuau

SEQ ID NO: 1377058 - RNA, 19 nt, Homo sapiens
auacaucacggaaggaaga

SEQ ID NO: 1377059 - RNA, 19 nt, Homo sapiens
gaauuuccugagaagauug

SEQ ID NO: 1377060 - RNA, 19 nt, Homo sapiens
ucacaauacguguacacuu

SEQ ID NO: 1377061 - RNA, 19 nt, Homo sapiens
gcaaacagcuucuccauaa

SEQ ID NO: 1377062 - RNA, 19 nt, Homo sapiens
ggacagagauauacaauuu

SEQ ID NO: 1377063 - RNA, 19 nt, Homo sapiens
gcagaaauuugcacuaaua

SEQ ID NO: 1377064 - RNA, 19 nt, Homo sapiens
gaacaaagaagucaaauga

SEQ ID NO: 1377065 - RNA, 19 nt, Homo sapiens
gaucagaacucauuuacuu

SEQ ID NO: 1377066 - RNA, 19 nt, Homo sapiens
ggcaagggcugguagauua

SEQ ID NO: 1377067 - RNA, 19 nt, Homo sapiens
ggagacaccugguuuacua

SEQ ID NO: 1377068 - RNA, 19 nt, Homo sapiens
caacauagauuuacucaag

SEQ ID NO: 1377069 - RNA, 19 nt, Homo sapiens
gaaagaagaguuacagaaa

SEQ ID NO: 1377070 - RNA, 19 nt, Homo sapiens
caucauaucugacauguau

SEQ ID NO: 1377071 - RNA, 19 nt, Homo sapiens
ggagguaaaugcuaaauuc

SEQ ID NO: 1377072 - RNA, 19 nt, Homo sapiens
aaagaaagguacaggcuua

SEQ ID NO: 1377073 - RNA, 19 nt, Homo sapiens
ggugaaagcuccuaucaga

SEQ ID NO: 1377074 - RNA, 19 nt, Homo sapiens
gcagcagccuugagaauaa

SEQ ID NO: 1377075 - RNA, 19 nt, Homo sapiens
ccaaagaacuguggguaua

SEQ ID NO: 1377076 - RNA, 19 nt, Homo sapiens
gaacuugccuagagaugaa

SEQ ID NO: 1377077 - RNA, 19 nt, Homo sapiens
uaaaggagguaaaugcuaa

SEQ ID NO: 1377078 - RNA, 19 nt, Homo sapiens
gaacaugauuucucuuugu

SEQ ID NO: 1377079 - RNA, 19 nt, Homo sapiens
ggaguacucuucacacuga

SEQ ID NO: 1377080 - RNA, 19 nt, Homo sapiens
gcaagcugcugaauuuaaa

SEQ ID NO: 1377081 - RNA, 19 nt, Homo sapiens
gaauggagcuggaaauugg

SEQ ID NO: 1377082 - RNA, 19 nt, Homo sapiens
gauaaaggaucuaaagcaa

SEQ ID NO: 1377083 - RNA, 19 nt, Homo sapiens
guaacaaucugccuccuuu

SEQ ID NO: 1377084 - RNA, 19 nt, Homo sapiens
gaucauggcguuaauguuu

SEQ ID NO: 1377085 - RNA, 19 nt, Homo sapiens
ggaaacacauugagcauca

SEQ ID NO: 1377086 - RNA, 19 nt, Homo sapiens
gcaagaagauuccccaaua

SEQ ID NO: 1377087 - RNA, 19 nt, Homo sapiens
cagaagaguuuguuuauuc

SEQ ID NO: 1377088 - RNA, 19 nt, Homo sapiens
gaucagaaauagaaacguu

SEQ ID NO: 1377089 - RNA, 19 nt, Homo sapiens
gcaaauguauucaaagaag

SEQ ID NO: 1377090 - RNA, 19 nt, Homo sapiens
gacaugaacccuacuauuu

SEQ ID NO: 1377091 - RNA, 19 nt, Homo sapiens
guaauaagacuccuguuaa

SEQ ID NO: 1377092 - RNA, 19 nt, Homo sapiens
gaaagcaaaugggagauga

SEQ ID NO: 1377093 - RNA, 19 nt, Homo sapiens
ugauagagaugcugaauau

SEQ ID NO: 1377094 - RNA, 19 nt, Homo sapiens
guuauugccuugugguuua

SEQ ID NO: 1377095 - RNA, 19 nt, Homo sapiens
gagcugaaauucucaaaca

SEQ ID NO: 1377096 - RNA, 19 nt, Homo sapiens
ccacuaauaugauagcauu

SEQ ID NO: 1377097 - RNA, 19 nt, Homo sapiens
auaauaggcugaugaguaa

SEQ ID NO: 1377098 - RNA, 19 nt, Homo sapiens
cuaguaaucucaagaaaga

SEQ ID NO: 1377099 - RNA, 19 nt, Homo sapiens
gguaggcucugaaaucaaa

SEQ ID NO: 1377100 - RNA, 19 nt, Homo sapiens
ggacucaauuuguuaaugu

SEQ ID NO: 1377101 - RNA, 19 nt, Homo sapiens
gaaucucaguguuuacuuu

SEQ ID NO: 1377102 - RNA, 19 nt, Homo sapiens
aaacagaacuugccuagag

SEQ ID NO: 1377103 - RNA, 19 nt, Homo sapiens
gaagagagaccucacuguu

SEQ ID NO: 1377104 - RNA, 19 nt, Homo sapiens
aaagagggauuaucacuau

SEQ ID NO: 1377105 - RNA, 19 nt, Homo sapiens
ucacaucacucccauccua

SEQ ID NO: 1377106 - RNA, 19 nt, Homo sapiens
gggcauggauuuauucaau

SEQ ID NO: 1377107 - RNA, 19 nt, Homo sapiens
ggauguuucucucucauaa

SEQ ID NO: 1377108 - RNA, 19 nt, Homo sapiens
ggaaacagacugaagauca

SEQ ID NO: 1377109 - RNA, 19 nt, Homo sapiens
gaaagcgucuacucacaga

SEQ ID NO: 1377110 - RNA, 19 nt, Homo sapiens
caacauauuccuucccaua

SEQ ID NO: 1377111 - RNA, 19 nt, Homo sapiens
ggaauaagucuuugaacaa

SEQ ID NO: 1377112 - RNA, 19 nt, Homo sapiens
cauaauaggcugaugagua

SEQ ID NO: 1377113 - RNA, 19 nt, Homo sapiens
uggaguauguggaguaaua

SEQ ID NO: 1377114 - RNA, 19 nt, Homo sapiens
ggcagaaucucaguguuua

SEQ ID NO: 1377115 - RNA, 19 nt, Homo sapiens
ggaaauacagauggaaaua

SEQ ID NO: 1377116 - RNA, 19 nt, Homo sapiens
cagcagaaauuugcacuaa

SEQ ID NO: 1377117 - RNA, 19 nt, Homo sapiens
ggaaauaucaccaacuaau

SEQ ID NO: 1377118 - RNA, 19 nt, Homo sapiens
ccagaaagccagcuaguuu

SEQ ID NO: 1377119 - RNA, 19 nt, Homo sapiens
ccaagccacuaauaugaua

SEQ ID NO: 1377120 - RNA, 19 nt, Homo sapiens
gagaugagguuccaauugg

SEQ ID NO: 1377121 - RNA, 19 nt, Homo sapiens
gaagugcagugacaguuau

SEQ ID NO: 1377122 - RNA, 19 nt, Homo sapiens
gggcaaacauacacaaaug

SEQ ID NO: 1377123 - RNA, 19 nt, Homo sapiens
ucacaagaauugcauaugu

SEQ ID NO: 1377124 - RNA, 19 nt, Homo sapiens
ccaaguggaaugaaauuua

SEQ ID NO: 1377125 - RNA, 19 nt, Homo sapiens
gaaacagacugaagaucau

SEQ ID NO: 1377126 - RNA, 19 nt, Homo sapiens
gcaaugcagaguuguauuu

SEQ ID NO: 1377127 - RNA, 19 nt, Homo sapiens
ggaaagaagaguuacagaa

SEQ ID NO: 1377128 - RNA, 19 nt, Homo sapiens
gcaaaacaaucaguaguua

SEQ ID NO: 1377129 - RNA, 19 nt, Homo sapiens
gcagauuuauugauaguuc

SEQ ID NO: 1377130 - RNA, 19 nt, Homo sapiens
ccuaggauauccaaaguuu

SEQ ID NO: 1377131 - RNA, 19 nt, Homo sapiens
gccuagagaugaaauuaaa

SEQ ID NO: 1377132 - RNA, 19 nt, Homo sapiens
cuaaauccgucacacagua

SEQ ID NO: 1377133 - RNA, 19 nt, Homo sapiens
gauggagucucacuuuguu

SEQ ID NO: 1377134 - RNA, 19 nt, Homo sapiens
gaaacuacuguucccuuua

SEQ ID NO: 1377135 - RNA, 19 nt, Homo sapiens
gcugaacucucaauauugu

SEQ ID NO: 1377136 - RNA, 19 nt, Homo sapiens
ggagaaauccaagcaauga

SEQ ID NO: 1377137 - RNA, 19 nt, Homo sapiens
uaccugacauucuaagaua

SEQ ID NO: 1377138 - RNA, 19 nt, Homo sapiens
uaaggaauguuauguaugg

SEQ ID NO: 1377139 - RNA, 19 nt, Homo sapiens
gauugucccucuguaauuu

SEQ ID NO: 1377140 - RNA, 19 nt, Homo sapiens
cacagaaagugcaagauuu

SEQ ID NO: 1377141 - RNA, 19 nt, Homo sapiens
gacugaagauauuccauuu

SEQ ID NO: 1377142 - RNA, 19 nt, Homo sapiens
gaauggaaggugucagaua

SEQ ID NO: 1377143 - RNA, 19 nt, Homo sapiens
cgauggauauuaauacuug

SEQ ID NO: 1377144 - RNA, 19 nt, Homo sapiens
gaagcuaaaucugcauaga

SEQ ID NO: 1377145 - RNA, 19 nt, Homo sapiens
ugauaaagcucuguauaug

SEQ ID NO: 1377146 - RNA, 19 nt, Homo sapiens
ucgcugaacucucaauauu

SEQ ID NO: 1377147 - RNA, 19 nt, Homo sapiens
gaaaaggucuucugacaca

SEQ ID NO: 1377148 - RNA, 19 nt, Homo sapiens
gucagugccuucuuucaua

SEQ ID NO: 1377149 - RNA, 19 nt, Homo sapiens
gcaccgaccuaaagaugga

SEQ ID NO: 1377150 - RNA, 19 nt, Homo sapiens
ucaagacacuuaauaugug

SEQ ID NO: 1377151 - RNA, 19 nt, Homo sapiens
gaaccuccuccaccacuua

SEQ ID NO: 1377152 - RNA, 19 nt, Homo sapiens
ggagaaagaagcuaaaucu

SEQ ID NO: 1377153 - RNA, 19 nt, Homo sapiens
gcagaguuguauuuacuug

SEQ ID NO: 1377154 - RNA, 19 nt, Homo sapiens
aaacuacuguucccuuuau

SEQ ID NO: 1377155 - RNA, 19 nt, Homo sapiens
gcagguagcaagcaagaaa

SEQ ID NO: 1377156 - RNA, 19 nt, Homo sapiens
ucccauaucucucaugauu

SEQ ID NO: 1377157 - RNA, 19 nt, Homo sapiens
gugcuuugcuucucuuaaa

SEQ ID NO: 1377158 - RNA, 19 nt, Homo sapiens
caccaaagcaugcugauuu

SEQ ID NO: 1377159 - RNA, 19 nt, Homo sapiens
gagaaagcgucuacucaca

SEQ ID NO: 1377160 - RNA, 19 nt, Homo sapiens
gcuaaaggccuugcaauug

SEQ ID NO: 1377161 - RNA, 19 nt, Homo sapiens
guagugggauucugcauua

SEQ ID NO: 1377162 - RNA, 19 nt, Homo sapiens
gcuauaaccuguaaccuuu

SEQ ID NO: 1377163 - RNA, 19 nt, Homo sapiens
uuaaagggccuguuucuua

SEQ ID NO: 1377164 - RNA, 19 nt, Homo sapiens
gauggucacugaacugauu

SEQ ID NO: 1377165 - RNA, 19 nt, Homo sapiens
gagguuuauuucacacuua

SEQ ID NO: 1377166 - RNA, 19 nt, Homo sapiens
agaaggaguuaaagcuaua

SEQ ID NO: 1377167 - RNA, 19 nt, Homo sapiens
agaaauggaugcugucuca

SEQ ID NO: 1377168 - RNA, 19 nt, Homo sapiens
gaaaagagaaccuggagua

SEQ ID NO: 1377169 - RNA, 19 nt, Homo sapiens
cagaaggaguuaaagcuau

SEQ ID NO: 1377170 - RNA, 19 nt, Homo sapiens
caacaaacaccagcgcuuu

SEQ ID NO: 1377171 - RNA, 19 nt, Homo sapiens
uaaagggccuguuucuuac

SEQ ID NO: 1377172 - RNA, 19 nt, Homo sapiens
ggaagacgcagaaggugaa

SEQ ID NO: 1377173 - RNA, 19 nt, Homo sapiens
ggacuuggcggaucuuaca

SEQ ID NO: 1377174 - RNA, 19 nt, Homo sapiens
cuaaugugcugaaucaaca

SEQ ID NO: 1377175 - RNA, 19 nt, Homo sapiens
ccaccugcaucgugccaua

SEQ ID NO: 1377176 - RNA, 19 nt, Homo sapiens
caucagagagguuuauuuc

SEQ ID NO: 1377177 - RNA, 19 nt, Homo sapiens
gcagcuaggguuuguguug

SEQ ID NO: 1377178 - RNA, 19 nt, Homo sapiens
caggaaacccuugggcuua

SEQ ID NO: 1377179 - RNA, 19 nt, Homo sapiens
ucaggccucuugagaaaug

SEQ ID NO: 1377180 - RNA, 19 nt, Homo sapiens
guagagcgcgugcugaaga

SEQ ID NO: 1377181 - RNA, 19 nt, Homo sapiens
ccagagcugugauguccaa

SEQ ID NO: 1377182 - RNA, 19 nt, Homo sapiens
aagagaaccuggaguacug

SEQ ID NO: 1377183 - RNA, 19 nt, Homo sapiens
ccaacuguguaaaggauga

SEQ ID NO: 1377184 - RNA, 19 nt, Homo sapiens
gaggcuugcugccaucaga

SEQ ID NO: 1377185 - RNA, 19 nt, Homo sapiens
ccuaagaaaugagcagguu

SEQ ID NO: 1377186 - RNA, 19 nt, Homo sapiens
gcugagacuuugcccugaa

SEQ ID NO: 1377187 - RNA, 19 nt, Homo sapiens
gaagagggaagaggaagga

SEQ ID NO: 1377188 - RNA, 19 nt, Homo sapiens
cagagagguuuauuucaca

SEQ ID NO: 1377189 - RNA, 19 nt, Homo sapiens
gccuugggccuguguguua

SEQ ID NO: 1377190 - RNA, 19 nt, Homo sapiens
ccaguuaaagggccuguuu

SEQ ID NO: 1377191 - RNA, 19 nt, Homo sapiens
gugacuuccugcagacuuu

SEQ ID NO: 1377192 - RNA, 19 nt, Homo sapiens
gcuguacacccucaacaaa

SEQ ID NO: 1377193 - RNA, 19 nt, Homo sapiens
gagcagaagacaagcuguu

SEQ ID NO: 1377194 - RNA, 19 nt, Homo sapiens
ggcaggaaguauucagguu

SEQ ID NO: 1377195 - RNA, 19 nt, Homo sapiens
ucagagagguuuauuucac

SEQ ID NO: 1377196 - RNA, 19 nt, Homo sapiens
ugaagaguguggcugugaa

SEQ ID NO: 1377197 - RNA, 19 nt, Homo sapiens
gcccagcacucugucaaga

SEQ ID NO: 1377198 - RNA, 19 nt, Homo sapiens
ggcaaguccucccucauca

SEQ ID NO: 1377199 - RNA, 19 nt, Homo sapiens
gcuccaugcuggucacuag

SEQ ID NO: 1377200 - RNA, 19 nt, Homo sapiens
ucagaaggaguuaaagcua

SEQ ID NO: 1377201 - RNA, 19 nt, Homo sapiens
gaccugacgcuuuuauuua

SEQ ID NO: 1377202 - RNA, 19 nt, Homo sapiens
caguggaaccuaagaaaug

SEQ ID NO: 1377203 - RNA, 19 nt, Homo sapiens
gaaggaguuaaagcuauaa

SEQ ID NO: 1377204 - RNA, 19 nt, Homo sapiens
ccaaggggcugaagaagau

SEQ ID NO: 1377205 - RNA, 19 nt, Homo sapiens
ccacagucgucauagucuu

SEQ ID NO: 1377206 - RNA, 19 nt, Homo sapiens
ucucaccaguggaaccuaa

SEQ ID NO: 1377207 - RNA, 19 nt, Homo sapiens
aggaaacccuugggcuuaa

SEQ ID NO: 1377208 - RNA, 19 nt, Homo sapiens
aauggaugcugucucagaa

SEQ ID NO: 1377209 - RNA, 19 nt, Homo sapiens
ggaccugacgcuuuuauuu

SEQ ID NO: 1377210 - RNA, 19 nt, Homo sapiens
gggcaaguccucccucauc

SEQ ID NO: 1377211 - RNA, 19 nt, Homo sapiens
gaaccuggaguacuguauc

SEQ ID NO: 1377212 - RNA, 19 nt, Homo sapiens
augcuaaugugcugaauca

SEQ ID NO: 1377213 - RNA, 19 nt, Homo sapiens
gcugcuggguuccgugaug

SEQ ID NO: 1377214 - RNA, 19 nt, Homo sapiens
gaaaaugucaagcagauca

SEQ ID NO: 1377215 - RNA, 19 nt, Homo sapiens
guauucagguuggcugugu

SEQ ID NO: 1377216 - RNA, 19 nt, Homo sapiens
cagccuguguccuagaaga

SEQ ID NO: 1377217 - RNA, 19 nt, Homo sapiens
gguagugggauucugcauu

SEQ ID NO: 1377218 - RNA, 19 nt, Homo sapiens
aguggaaccuaagaaauga

SEQ ID NO: 1377219 - RNA, 19 nt, Homo sapiens
gauugaaaguguggagaca

SEQ ID NO: 1377220 - RNA, 19 nt, Homo sapiens
gcugugauguccaaaauuc

SEQ ID NO: 1377221 - RNA, 19 nt, Homo sapiens
gugggauucugcauuagug

SEQ ID NO: 1377222 - RNA, 19 nt, Homo sapiens
ccuuuaaaaucuccaguua

SEQ ID NO: 1377223 - RNA, 19 nt, Homo sapiens
uguacacccucaacaaaca

SEQ ID NO: 1377224 - RNA, 19 nt, Homo sapiens
gagcugugauguccaaaau

SEQ ID NO: 1377225 - RNA, 19 nt, Homo sapiens
gcaaguccucccucaucaa

SEQ ID NO: 1377226 - RNA, 19 nt, Homo sapiens
uaccaacuguguaaaggau

SEQ ID NO: 1377227 - RNA, 19 nt, Homo sapiens
gcaguccuacaacaaguga

SEQ ID NO: 1377228 - RNA, 19 nt, Homo sapiens
ggaaacccuugggcuuaag

SEQ ID NO: 1377229 - RNA, 19 nt, Homo sapiens
cagguuggcugugucagau

SEQ ID NO: 1377230 - RNA, 19 nt, Homo sapiens
cgugcuggcuccucggauu

SEQ ID NO: 1377231 - RNA, 19 nt, Homo sapiens
gguuuguguuggaggcuuu

SEQ ID NO: 1377232 - RNA, 19 nt, Homo sapiens
cagcucacccgguccagaa

SEQ ID NO: 1377233 - RNA, 19 nt, Homo sapiens
gcuaaugugcugaaucaac

SEQ ID NO: 1377234 - RNA, 19 nt, Homo sapiens
ugugucagaugcuaaugug

SEQ ID NO: 1377235 - RNA, 19 nt, Homo sapiens
ccagugucuugcaguccua

SEQ ID NO: 1377236 - RNA, 19 nt, Homo sapiens
ccaguggaaccuaagaaau

SEQ ID NO: 1377237 - RNA, 19 nt, Homo sapiens
aaauggaugcugucucaga

SEQ ID NO: 1377238 - RNA, 19 nt, Homo sapiens
guugggaccugacgcuuuu

SEQ ID NO: 1377239 - RNA, 19 nt, Homo sapiens
cagaugaggaggccacugu

SEQ ID NO: 1377240 - RNA, 19 nt, Homo sapiens
gcaacacuuagaaggagaa

SEQ ID NO: 1377241 - RNA, 19 nt, Homo sapiens
gaagaguguggcugugaag

SEQ ID NO: 1377242 - RNA, 19 nt, Homo sapiens
ccacucccuuccuuguguu

SEQ ID NO: 1377243 - RNA, 19 nt, Homo sapiens
cagugccugugacaacgua

SEQ ID NO: 1377244 - RNA, 19 nt, Homo sapiens
aggagaccauggcugacua

SEQ ID NO: 1377245 - RNA, 19 nt, Homo sapiens
uuacagagcagcagaaaau

SEQ ID NO: 1377246 - RNA, 19 nt, Homo sapiens
gagaaccuggaguacugua

SEQ ID NO: 1377247 - RNA, 19 nt, Homo sapiens
agagguuuauuucacacuu

SEQ ID NO: 1377248 - RNA, 19 nt, Homo sapiens
ccaucagagagguuuauuu

SEQ ID NO: 1377249 - RNA, 19 nt, Homo sapiens
cuauaaccuguaaccuuua

SEQ ID NO: 1377250 - RNA, 19 nt, Homo sapiens
agacuuugcccugaacuug

SEQ ID NO: 1377251 - RNA, 19 nt, Homo sapiens
ccuguaaccuuuaaaaucu

SEQ ID NO: 1377252 - RNA, 19 nt, Homo sapiens
ugucucagaaggaguuaaa

SEQ ID NO: 1377253 - RNA, 19 nt, Homo sapiens
ugaaucaacagucauugca

SEQ ID NO: 1377254 - RNA, 19 nt, Homo sapiens
ccauuauagugcaccugaa

SEQ ID NO: 1377255 - RNA, 19 nt, Homo sapiens
guuggcagcuaggguuugu

SEQ ID NO: 1377256 - RNA, 19 nt, Homo sapiens
cacagucgucauagucuuu

SEQ ID NO: 1377257 - RNA, 19 nt, Homo sapiens
cagcuccgcaugcuugguu

SEQ ID NO: 1377258 - RNA, 19 nt, Homo sapiens
gcaccucaggaaagggaaa

SEQ ID NO: 1377259 - RNA, 19 nt, Homo sapiens
gggccuguguguuaaagcu

SEQ ID NO: 1377260 - RNA, 19 nt, Homo sapiens
ccuugggccuguguguuaa

SEQ ID NO: 1377261 - RNA, 19 nt, Homo sapiens
gaaaggcaguuaagaaaua

SEQ ID NO: 1377262 - RNA, 19 nt, Homo sapiens
gcaaagaccucaagcuugu

SEQ ID NO: 1377263 - RNA, 19 nt, Homo sapiens
gauaucagcuuccagugua

SEQ ID NO: 1377264 - RNA, 19 nt, Homo sapiens
uuagaacacucaacaacua

SEQ ID NO: 1377265 - RNA, 19 nt, Homo sapiens
gaaaagcgauuauccuaug

SEQ ID NO: 1377266 - RNA, 19 nt, Homo sapiens
ccagaaaccauaaauaaug

SEQ ID NO: 1377267 - RNA, 19 nt, Homo sapiens
gaacagauaucagcuucca

SEQ ID NO: 1377268 - RNA, 19 nt, Homo sapiens
uaugacagauggacaacua

SEQ ID NO: 1377269 - RNA, 19 nt, Homo sapiens
gcagaccucucacugacaa

SEQ ID NO: 1377270 - RNA, 19 nt, Homo sapiens
ggacuauguuguacagguu

SEQ ID NO: 1377271 - RNA, 19 nt, Homo sapiens
gagcaaugaucaugaacug

SEQ ID NO: 1377272 - RNA, 19 nt, Homo sapiens
gcucuaaauucccuaugaa

SEQ ID NO: 1377273 - RNA, 19 nt, Homo sapiens
ugacuuggacuguaaauga

SEQ ID NO: 1377274 - RNA, 19 nt, Homo sapiens
gcgauuauccuaugacaga

SEQ ID NO: 1377275 - RNA, 19 nt, Homo sapiens
ggacaacuacgcagcaaga

SEQ ID NO: 1377276 - RNA, 19 nt, Homo sapiens
ugagagcaaugaucaugaa

SEQ ID NO: 1377277 - RNA, 19 nt, Homo sapiens
gaaaagagcgacauagaga

SEQ ID NO: 1377278 - RNA, 19 nt, Homo sapiens
gacacaguauuccacauga

SEQ ID NO: 1377279 - RNA, 19 nt, Homo sapiens
gcagcaagagggaugaauu

SEQ ID NO: 1377280 - RNA, 19 nt, Homo sapiens
gacuuggacuguaaaugaa

SEQ ID NO: 1377281 - RNA, 19 nt, Homo sapiens
cagcuucguuugcgccuuu

SEQ ID NO: 1377282 - RNA, 19 nt, Homo sapiens
ggucguaaccagccuuuga

SEQ ID NO: 1377283 - RNA, 19 nt, Homo sapiens
cagcaagagggaugaauuu

SEQ ID NO: 1377284 - RNA, 19 nt, Homo sapiens
ccacaucccucugcuccuu

SEQ ID NO: 1377285 - RNA, 19 nt, Homo sapiens
cauugauggugcaaacaua

SEQ ID NO: 1377286 - RNA, 19 nt, Homo sapiens
gaacacucaacaacuaugu

SEQ ID NO: 1377287 - RNA, 19 nt, Homo sapiens
ggauuuaguucugaggaau

SEQ ID NO: 1377288 - RNA, 19 nt, Homo sapiens
ccaaaggacuauguuguac

SEQ ID NO: 1377289 - RNA, 19 nt, Homo sapiens
gaagaucccaaaggacuau

SEQ ID NO: 1377290 - RNA, 19 nt, Homo sapiens
ugaauggauuuaguucuga

SEQ ID NO: 1377291 - RNA, 19 nt, Homo sapiens
ucugaggaauuaccaguga

SEQ ID NO: 1377292 - RNA, 19 nt, Homo sapiens
aacauaacauuaccacaug

SEQ ID NO: 1377293 - RNA, 19 nt, Homo sapiens
gauuugggaugccuugaag

SEQ ID NO: 1377294 - RNA, 19 nt, Homo sapiens
cagcacagacacaguauuc

SEQ ID NO: 1377295 - RNA, 19 nt, Homo sapiens
uuacagagugcuacgauga

SEQ ID NO: 1377296 - RNA, 19 nt, Homo sapiens
acaacuauguaauggcuau

SEQ ID NO: 1377297 - RNA, 19 nt, Homo sapiens
acacucaacaacuauguaa

SEQ ID NO: 1377298 - RNA, 19 nt, Homo sapiens
cccaaaggacuauguugua

SEQ ID NO: 1377299 - RNA, 19 nt, Homo sapiens
gaguugcucuaggucguaa

SEQ ID NO: 1377300 - RNA, 19 nt, Homo sapiens
gcacagacacaguauucca

SEQ ID NO: 1377301 - RNA, 19 nt, Homo sapiens
gcaccgccaaucaacauga

SEQ ID NO: 1377302 - RNA, 19 nt, Homo sapiens
gaaggcugcugcacaugcu

SEQ ID NO: 1377303 - RNA, 19 nt, Homo sapiens
uugaaaggcaguuaagaaa

SEQ ID NO: 1377304 - RNA, 19 nt, Homo sapiens
acacaguauuccacaugaa

SEQ ID NO: 1377305 - RNA, 19 nt, Homo sapiens
caagagggaugaauuuugg

SEQ ID NO: 1377306 - RNA, 19 nt, Homo sapiens
aaacauugcauccaugaag

SEQ ID NO: 1377307 - RNA, 19 nt, Homo sapiens
ugaaacauugcauccauga

SEQ ID NO: 1377308 - RNA, 19 nt, Homo sapiens
ugaaaggcaguuaagaaau

SEQ ID NO: 1377309 - RNA, 19 nt, Homo sapiens
gagccaaccugugcagaac

SEQ ID NO: 1377310 - RNA, 19 nt, Homo sapiens
ggacagcaccaagcaccuu

SEQ ID NO: 1377311 - RNA, 19 nt, Homo sapiens
gaaacauugcauccaugaa

SEQ ID NO: 1377312 - RNA, 19 nt, Homo sapiens
uguaauggcuauauuucag

SEQ ID NO: 1377313 - RNA, 19 nt, Homo sapiens
aaaggacuauguuguacag

SEQ ID NO: 1377314 - RNA, 19 nt, Homo sapiens
caaaauggaaaagcgauua

SEQ ID NO: 1377315 - RNA, 19 nt, Homo sapiens
aaaggcaguuaagaaauag

SEQ ID NO: 1377316 - RNA, 19 nt, Homo sapiens
ggagaaaccaaaauggaaa

SEQ ID NO: 1377317 - RNA, 19 nt, Homo sapiens
gaaggccggaaagagauuu

SEQ ID NO: 1377318 - RNA, 19 nt, Homo sapiens
gcaagagggaugaauuuug

SEQ ID NO: 1377319 - RNA, 19 nt, Homo sapiens
caccggaguugcucuaggu

SEQ ID NO: 1377320 - RNA, 19 nt, Homo sapiens
gauuuaguucugaggaauu

SEQ ID NO: 1377321 - RNA, 19 nt, Homo sapiens
gagcugaagaucccaaagg

SEQ ID NO: 1377322 - RNA, 19 nt, Homo sapiens
gaagagacgguugcaugca

SEQ ID NO: 1377323 - RNA, 19 nt, Homo sapiens
ucgcagcacagacacagua

SEQ ID NO: 1377324 - RNA, 19 nt, Homo sapiens
acucaacaacuauguaaug

SEQ ID NO: 1377325 - RNA, 19 nt, Homo sapiens
gacuauguuguacagguua

SEQ ID NO: 1377326 - RNA, 19 nt, Homo sapiens
ggauacagcaccagcuuuu

SEQ ID NO: 1377327 - RNA, 19 nt, Homo sapiens
ggaguugcucuaggucgua

SEQ ID NO: 1377328 - RNA, 19 nt, Homo sapiens
gacagcaccaagcaccuuu

SEQ ID NO: 1377329 - RNA, 19 nt, Homo sapiens
gggauacagcaccagcuuu

SEQ ID NO: 1377330 - RNA, 19 nt, Homo sapiens
caaaggacuauguuguaca

SEQ ID NO: 1377331 - RNA, 19 nt, Homo sapiens
gaaguucgaagagcugaag

SEQ ID NO: 1377332 - RNA, 19 nt, Homo sapiens
acccaauucuggauaugaa

SEQ ID NO: 1377333 - RNA, 19 nt, Homo sapiens
ugaggaauuaccagugaaa

SEQ ID NO: 1377334 - RNA, 19 nt, Homo sapiens
ccuaugaauggauuuaguu

SEQ ID NO: 1377335 - RNA, 19 nt, Homo sapiens
cuugaaggcugcugcacau

SEQ ID NO: 1377336 - RNA, 19 nt, Homo sapiens
uuugaaaggcaguuaagaa

SEQ ID NO: 1377337 - RNA, 19 nt, Homo sapiens
uggauuuaguucugaggaa

SEQ ID NO: 1377338 - RNA, 19 nt, Homo sapiens
augaauggauuuaguucug

SEQ ID NO: 1377339 - RNA, 19 nt, Homo sapiens
gaucccaaaggacuauguu

SEQ ID NO: 1377340 - RNA, 19 nt, Homo sapiens
ugaagaucccaaaggacua

SEQ ID NO: 1377341 - RNA, 19 nt, Homo sapiens
agacacaguauuccacaug

SEQ ID NO: 1377342 - RNA, 19 nt, Homo sapiens
aggcaaagaccucaagcuu

SEQ ID NO: 1377343 - RNA, 19 nt, Homo sapiens
uaugguucuuguugucauu

SEQ ID NO: 1377344 - RNA, 19 nt, Homo sapiens
gaaugucagcuucguuugc

SEQ ID NO: 1377345 - RNA, 19 nt, Homo sapiens
ggaaaagcgauuauccuau

SEQ ID NO: 1377346 - RNA, 19 nt, Homo sapiens
gcagcacagacacaguauu

SEQ ID NO: 1377347 - RNA, 19 nt, Homo sapiens
ugcucuaaauucccuauga

SEQ ID NO: 1377348 - RNA, 19 nt, Homo sapiens
cgggcagccucaacgagaa

SEQ ID NO: 1377349 - RNA, 19 nt, Homo sapiens
gugcaaacauaacauuacc

SEQ ID NO: 1377350 - RNA, 19 nt, Homo sapiens
ggugcaaacauaacauuac

SEQ ID NO: 1377351 - RNA, 19 nt, Homo sapiens
guaauggcuauauuucagu

SEQ ID NO: 1377352 - RNA, 19 nt, Homo sapiens
uuugaaggccggaaagaga

SEQ ID NO: 1377353 - RNA, 19 nt, Homo sapiens
ccacccaauucuggauaug

SEQ ID NO: 1377354 - RNA, 19 nt, Homo sapiens
ugaaggacagcaccaagca

SEQ ID NO: 1377355 - RNA, 19 nt, Homo sapiens
uagaacacucaacaacuau

SEQ ID NO: 1377356 - RNA, 19 nt, Homo sapiens
ugagccaaccugugcagaa

SEQ ID NO: 1377357 - RNA, 19 nt, Homo sapiens
guuguacagguuauaguga

SEQ ID NO: 1377358 - RNA, 19 nt, Homo sapiens
gagggaguggaaccaggua

SEQ ID NO: 1377359 - RNA, 19 nt, Homo sapiens
gggcaccggaguugcucua

SEQ ID NO: 1377360 - RNA, 19 nt, Homo sapiens
ggcaguuaagaaauagaua

SEQ ID NO: 1377361 - RNA, 19 nt, Homo sapiens
caacaaggcuuacuucuag

SEQ ID NO: 1377362 - RNA, 19 nt, Homo sapiens
gaaagagcguucagaagaa

SEQ ID NO: 1377363 - RNA, 19 nt, Homo sapiens
gauggagccuuugaaauua

SEQ ID NO: 1377364 - RNA, 19 nt, Homo sapiens
gagcaaggaugcacagaaa

SEQ ID NO: 1377365 - RNA, 19 nt, Homo sapiens
gaaccuggagcuagaauua

SEQ ID NO: 1377366 - RNA, 19 nt, Homo sapiens
ggaaagagcguucagaaga

SEQ ID NO: 1377367 - RNA, 19 nt, Homo sapiens
gagcaacacugacuagaau

SEQ ID NO: 1377368 - RNA, 19 nt, Homo sapiens
acacagagguggaagauug

SEQ ID NO: 1377369 - RNA, 19 nt, Homo sapiens
gaacucagcugccauugac

SEQ ID NO: 1377370 - RNA, 19 nt, Homo sapiens
gcagguggauccauucuuc

SEQ ID NO: 1377371 - RNA, 19 nt, Homo sapiens
uagcaaagaucuugucuag

SEQ ID NO: 1377372 - RNA, 19 nt, Homo sapiens
gaaagcaaauguagguaag

SEQ ID NO: 1377373 - RNA, 19 nt, Homo sapiens
gaucucaucaucauccuua

SEQ ID NO: 1377374 - RNA, 19 nt, Homo sapiens
ccaacaaccugguggacua

SEQ ID NO: 1377375 - RNA, 19 nt, Homo sapiens
ggaugcauuuggaaagaua

SEQ ID NO: 1377376 - RNA, 19 nt, Homo sapiens
gagccaaucuugcaaacug

SEQ ID NO: 1377377 - RNA, 19 nt, Homo sapiens
ggaaagcaaauguagguaa

SEQ ID NO: 1377378 - RNA, 19 nt, Homo sapiens
gguuugagcuguccaugaa

SEQ ID NO: 1377379 - RNA, 19 nt, Homo sapiens
ggaggagggugcagccaaa

SEQ ID NO: 1377380 - RNA, 19 nt, Homo sapiens
gaaugaagcccaagucaca

SEQ ID NO: 1377381 - RNA, 19 nt, Homo sapiens
cgauggagccuuugaaauu

SEQ ID NO: 1377382 - RNA, 19 nt, Homo sapiens
gcugggagcaucaucuuua

SEQ ID NO: 1377383 - RNA, 19 nt, Homo sapiens
ugggaaagcuguuuaaagu

SEQ ID NO: 1377384 - RNA, 19 nt, Homo sapiens
ucagggcaguugaugaaua

SEQ ID NO: 1377385 - RNA, 19 nt, Homo sapiens
caaagccgcuaccaaguuc

SEQ ID NO: 1377386 - RNA, 19 nt, Homo sapiens
gagggaagaugagauugaa

SEQ ID NO: 1377387 - RNA, 19 nt, Homo sapiens
gagauuguaugcauuugug

SEQ ID NO: 1377388 - RNA, 19 nt, Homo sapiens
gaagccaucaucagcauuu

SEQ ID NO: 1377389 - RNA, 19 nt, Homo sapiens
ggaagggacugccuauggu

SEQ ID NO: 1377390 - RNA, 19 nt, Homo sapiens
gggcagaccucuuccugau

SEQ ID NO: 1377391 - RNA, 19 nt, Homo sapiens
gggcaaacccaaucgaauu

SEQ ID NO: 1377392 - RNA, 19 nt, Homo sapiens
uugaagagcuggacagaga

SEQ ID NO: 1377393 - RNA, 19 nt, Homo sapiens
gcaacaagaagucuaacaa

SEQ ID NO: 1377394 - RNA, 19 nt, Homo sapiens
gaagcacugucgucucuca

SEQ ID NO: 1377395 - RNA, 19 nt, Homo sapiens
gcuccuggcuguugaagug

SEQ ID NO: 1377396 - RNA, 19 nt, Homo sapiens
caaauugccaugcagauau

SEQ ID NO: 1377397 - RNA, 19 nt, Homo sapiens
gcauuuggcucuacuuacu

SEQ ID NO: 1377398 - RNA, 19 nt, Homo sapiens
agucaacucugaucucuga

SEQ ID NO: 1377399 - RNA, 19 nt, Homo sapiens
aaugagaacuguaacaaca

SEQ ID NO: 1377400 - RNA, 19 nt, Homo sapiens
gggaagcacugucgucucu

SEQ ID NO: 1377401 - RNA, 19 nt, Homo sapiens
ucacacaccucuacuucug

SEQ ID NO: 1377402 - RNA, 19 nt, Homo sapiens
ccaaguucaugcucaaaga

SEQ ID NO: 1377403 - RNA, 19 nt, Homo sapiens
uaaagucuguuacccaaag

SEQ ID NO: 1377404 - RNA, 19 nt, Homo sapiens
gggcugagauguggugaga

SEQ ID NO: 1377405 - RNA, 19 nt, Homo sapiens
cagcugccauugacuuuga

SEQ ID NO: 1377406 - RNA, 19 nt, Homo sapiens
ggagaggacugugcuggau

SEQ ID NO: 1377407 - RNA, 19 nt, Homo sapiens
gcucuuccagaaaguauua

SEQ ID NO: 1377408 - RNA, 19 nt, Homo sapiens
ggucuagggugaggauuga

SEQ ID NO: 1377409 - RNA, 19 nt, Homo sapiens
gcacaacaaggcuuacuuc

SEQ ID NO: 1377410 - RNA, 19 nt, Homo sapiens
aagagaaaccucccaauga

SEQ ID NO: 1377411 - RNA, 19 nt, Homo sapiens
gagguggacucgagcaauc

SEQ ID NO: 1377412 - RNA, 19 nt, Homo sapiens
gcacagagagagaaaagua

SEQ ID NO: 1377413 - RNA, 19 nt, Homo sapiens
ggagcaacacugacuagaa

SEQ ID NO: 1377414 - RNA, 19 nt, Homo sapiens
gaaggcagaggacauggaa

SEQ ID NO: 1377415 - RNA, 19 nt, Homo sapiens
ggagaacucagcugccauu

SEQ ID NO: 1377416 - RNA, 19 nt, Homo sapiens
aaauggaugugacaccaaa

SEQ ID NO: 1377417 - RNA, 19 nt, Homo sapiens
caaucaaccucuuuuguaa

SEQ ID NO: 1377418 - RNA, 19 nt, Homo sapiens
uaacaaccccucuagaaua

SEQ ID NO: 1377419 - RNA, 19 nt, Homo sapiens
gggugcagcucuuccagaa

SEQ ID NO: 1377420 - RNA, 19 nt, Homo sapiens
gugcaaagcggcaugaaug

SEQ ID NO: 1377421 - RNA, 19 nt, Homo sapiens
cagggcaguugaugaauau

SEQ ID NO: 1377422 - RNA, 19 nt, Homo sapiens
agacgaggaugcagaggaa

SEQ ID NO: 1377423 - RNA, 19 nt, Homo sapiens
cacagacaguccugaauga

SEQ ID NO: 1377424 - RNA, 19 nt, Homo sapiens
ccaaauugccaugcagaua

SEQ ID NO: 1377425 - RNA, 19 nt, Homo sapiens
gcaaucaaccucuuuugua

SEQ ID NO: 1377426 - RNA, 19 nt, Homo sapiens
ugaacaguauuaagcaaga

SEQ ID NO: 1377427 - RNA, 19 nt, Homo sapiens
ggccaucacuguccucauc

SEQ ID NO: 1377428 - RNA, 19 nt, Homo sapiens
ccacugggcuuaucuacac

SEQ ID NO: 1377429 - RNA, 19 nt, Homo sapiens
gagggagugucaccuacuu

SEQ ID NO: 1377430 - RNA, 19 nt, Homo sapiens
cagccaagucccuguguua

SEQ ID NO: 1377431 - RNA, 19 nt, Homo sapiens
gugcagcucuuccagaaag

SEQ ID NO: 1377432 - RNA, 19 nt, Homo sapiens
ucuaguguaugcccuauga

SEQ ID NO: 1377433 - RNA, 19 nt, Homo sapiens
gaagaagagugugcacaac

SEQ ID NO: 1377434 - RNA, 19 nt, Homo sapiens
ccaaagccgcuaccaaguu

SEQ ID NO: 1377435 - RNA, 19 nt, Homo sapiens
gaacgauggagccuuugaa

SEQ ID NO: 1377436 - RNA, 19 nt, Homo sapiens
gcuguagccucauggacaa

SEQ ID NO: 1377437 - RNA, 19 nt, Homo sapiens
gagggugcagccaaacuua

SEQ ID NO: 1377438 - RNA, 19 nt, Homo sapiens
gaauacagcauccuuacag

SEQ ID NO: 1377439 - RNA, 19 nt, Homo sapiens
aaccagagcuccaagucuu

SEQ ID NO: 1377440 - RNA, 19 nt, Homo sapiens
uaaagucgcugaucauccu

SEQ ID NO: 1377441 - RNA, 19 nt, Homo sapiens
cuacugggaucucaucauc

SEQ ID NO: 1377442 - RNA, 19 nt, Homo sapiens
acaagaaguugcgcucuga

SEQ ID NO: 1377443 - RNA, 19 nt, Homo sapiens
agagaaaccucccaaugag

SEQ ID NO: 1377444 - RNA, 19 nt, Homo sapiens
ggacauggaaggcaaguac

SEQ ID NO: 1377445 - RNA, 19 nt, Homo sapiens
gcucccugcuuucauuuau

SEQ ID NO: 1377446 - RNA, 19 nt, Homo sapiens
gcagguugguagcaaagau

SEQ ID NO: 1377447 - RNA, 19 nt, Homo sapiens
gcuccaagucuuuaauuug

SEQ ID NO: 1377448 - RNA, 19 nt, Homo sapiens
agaagagugugcacaacaa

SEQ ID NO: 1377449 - RNA, 19 nt, Homo sapiens
gggagccaaugccaaauuc

SEQ ID NO: 1377450 - RNA, 19 nt, Homo sapiens
gcucggagguacugaaggu

SEQ ID NO: 1377451 - RNA, 19 nt, Homo sapiens
gagggaaugcuuugcuuga

SEQ ID NO: 1377452 - RNA, 19 nt, Homo sapiens
aaagagaaaccucccaaug

SEQ ID NO: 1377453 - RNA, 19 nt, Homo sapiens
cuacuacguugccaggauu

SEQ ID NO: 1377454 - RNA, 19 nt, Homo sapiens
ccaagucccuguguuacga

SEQ ID NO: 1377455 - RNA, 19 nt, Homo sapiens
gcagagccaaucuugcaaa

SEQ ID NO: 1377456 - RNA, 19 nt, Homo sapiens
ccuguaggcucucacguau

SEQ ID NO: 1377457 - RNA, 19 nt, Homo sapiens
gcugagaauugacgagaag

SEQ ID NO: 1377458 - RNA, 19 nt, Homo sapiens
cuaacaagguccugccaau

SEQ ID NO: 1377459 - RNA, 19 nt, Homo sapiens
agaucuggcucaagaauuc

SEQ ID NO: 1377460 - RNA, 19 nt, Homo sapiens
gguacaacuucuaugugaa

SEQ ID NO: 1377461 - RNA, 19 nt, Homo sapiens
gagcauggauuagauguuu

SEQ ID NO: 1377462 - RNA, 19 nt, Homo sapiens
gaacaugacagccaagaaa

SEQ ID NO: 1377463 - RNA, 19 nt, Homo sapiens
gcagaacggugcuaaggaa

SEQ ID NO: 1377464 - RNA, 19 nt, Homo sapiens
gaagacacaggguggauua

SEQ ID NO: 1377465 - RNA, 19 nt, Homo sapiens
ggacuugguucaacaacaa

SEQ ID NO: 1377466 - RNA, 19 nt, Homo sapiens
ggagggagcugcagugaag

SEQ ID NO: 1377467 - RNA, 19 nt, Homo sapiens
ugugcaagcuacauaauua

SEQ ID NO: 1377468 - RNA, 19 nt, Homo sapiens
cagaagacccuaaauugua

SEQ ID NO: 1377469 - RNA, 19 nt, Homo sapiens
gacacaggguggauuauuu

SEQ ID NO: 1377470 - RNA, 19 nt, Homo sapiens
ggucuuuagucucuucuua

SEQ ID NO: 1377471 - RNA, 19 nt, Homo sapiens
gacccuaaauuguaucaaa

SEQ ID NO: 1377472 - RNA, 19 nt, Homo sapiens
auagaaacccuguaaguua

SEQ ID NO: 1377473 - RNA, 19 nt, Homo sapiens
gaaggaaaccggccuguuc

SEQ ID NO: 1377474 - RNA, 19 nt, Homo sapiens
gaauuugcauuuccagaau

SEQ ID NO: 1377475 - RNA, 19 nt, Homo sapiens
guggagaacuuggagauuu

SEQ ID NO: 1377476 - RNA, 19 nt, Homo sapiens
gagccagccuccuaaauuc

SEQ ID NO: 1377477 - RNA, 19 nt, Homo sapiens
uuggguagcucuugcuuua

SEQ ID NO: 1377478 - RNA, 19 nt, Homo sapiens
gaguuuaugucauuugaug

SEQ ID NO: 1377479 - RNA, 19 nt, Homo sapiens
gcagguagcagcaacaguu

SEQ ID NO: 1377480 - RNA, 19 nt, Homo sapiens
acacaucucuuugcaggua

SEQ ID NO: 1377481 - RNA, 19 nt, Homo sapiens
ggacagggccacagaggaa

SEQ ID NO: 1377482 - RNA, 19 nt, Homo sapiens
ggacugauauugucauagc

SEQ ID NO: 1377483 - RNA, 19 nt, Homo sapiens
agaagacccuaaauuguau

SEQ ID NO: 1377484 - RNA, 19 nt, Homo sapiens
ggacuagaagagauaauga

SEQ ID NO: 1377485 - RNA, 19 nt, Homo sapiens
uguuuacgguucucaaaua

SEQ ID NO: 1377486 - RNA, 19 nt, Homo sapiens
ggagaaaucaccacccaau

SEQ ID NO: 1377487 - RNA, 19 nt, Homo sapiens
ggaggugccuugaguacca

SEQ ID NO: 1377488 - RNA, 19 nt, Homo sapiens
ggguagcucuugcuuuaau

SEQ ID NO: 1377489 - RNA, 19 nt, Homo sapiens
gaggaugaauuugcauuuc

SEQ ID NO: 1377490 - RNA, 19 nt, Homo sapiens
gcucgccucugauugagaa

SEQ ID NO: 1377491 - RNA, 19 nt, Homo sapiens
gguagcucuugcuuuaaua

SEQ ID NO: 1377492 - RNA, 19 nt, Homo sapiens
aagcagugauaccugaaua

SEQ ID NO: 1377493 - RNA, 19 nt, Homo sapiens
uuacgguucucaaauauca

SEQ ID NO: 1377494 - RNA, 19 nt, Homo sapiens
aaagccagcuggagaggaa

SEQ ID NO: 1377495 - RNA, 19 nt, Homo sapiens
ggagacaccagccaguaaa

SEQ ID NO: 1377496 - RNA, 19 nt, Homo sapiens
gcugaucucuaauuuaacu

SEQ ID NO: 1377497 - RNA, 19 nt, Homo sapiens
ggcagaauaugcugagugu

SEQ ID NO: 1377498 - RNA, 19 nt, Homo sapiens
ugaaguugcuggacacauc

SEQ ID NO: 1377499 - RNA, 19 nt, Homo sapiens
gaacggugcuaaggaagag

SEQ ID NO: 1377500 - RNA, 19 nt, Homo sapiens
uuacagaagacccuaaauu

SEQ ID NO: 1377501 - RNA, 19 nt, Homo sapiens
ugaaggacauggaggaaag

SEQ ID NO: 1377502 - RNA, 19 nt, Homo sapiens
ccacagaggaagccaagaa

SEQ ID NO: 1377503 - RNA, 19 nt, Homo sapiens
uacagaagacccuaaauug

SEQ ID NO: 1377504 - RNA, 19 nt, Homo sapiens
gaagcuucaggccaauuua

SEQ ID NO: 1377505 - RNA, 19 nt, Homo sapiens
cgagccagccuccuaaauu

SEQ ID NO: 1377506 - RNA, 19 nt, Homo sapiens
aggguaguguuuaguguua

SEQ ID NO: 1377507 - RNA, 19 nt, Homo sapiens
ccagaauggugaggagaaa

SEQ ID NO: 1377508 - RNA, 19 nt, Homo sapiens
gcuuuaauauucuguuugg

SEQ ID NO: 1377509 - RNA, 19 nt, Homo sapiens
uuagguggccauaaacaua

SEQ ID NO: 1377510 - RNA, 19 nt, Homo sapiens
guggagcccuggaugcuau

SEQ ID NO: 1377511 - RNA, 19 nt, Homo sapiens
ucaggccaauuuaaccuuu

SEQ ID NO: 1377512 - RNA, 19 nt, Homo sapiens
ucaguuuccucaucccauu

SEQ ID NO: 1377513 - RNA, 19 nt, Homo sapiens
guaccucaguuuccucauc

SEQ ID NO: 1377514 - RNA, 19 nt, Homo sapiens
uuaaaacacuggacuagaa

SEQ ID NO: 1377515 - RNA, 19 nt, Homo sapiens
caacaacaagaacuuacuu

SEQ ID NO: 1377516 - RNA, 19 nt, Homo sapiens
gggagagggugcaaaauga

SEQ ID NO: 1377517 - RNA, 19 nt, Homo sapiens
uaaaccaacccgaaggaaa

SEQ ID NO: 1377518 - RNA, 19 nt, Homo sapiens
agugauaccugaauaaugc

SEQ ID NO: 1377519 - RNA, 19 nt, Homo sapiens
gaggaaagaccggcagaga

SEQ ID NO: 1377520 - RNA, 19 nt, Homo sapiens
gugaagaacagcucauugu

SEQ ID NO: 1377521 - RNA, 19 nt, Homo sapiens
ugaguaccauuaugugcaa

SEQ ID NO: 1377522 - RNA, 19 nt, Homo sapiens
gcagugauaccugaauaau

SEQ ID NO: 1377523 - RNA, 19 nt, Homo sapiens
gaaguguugccauccaaga

SEQ ID NO: 1377524 - RNA, 19 nt, Homo sapiens
gcucuugcuuuaauauucu

SEQ ID NO: 1377525 - RNA, 19 nt, Homo sapiens
guuuacgguucucaaauau

SEQ ID NO: 1377526 - RNA, 19 nt, Homo sapiens
ggagucaucucagcagaac

SEQ ID NO: 1377527 - RNA, 19 nt, Homo sapiens
ggagugaguuggggucuuu

SEQ ID NO: 1377528 - RNA, 19 nt, Homo sapiens
ugaauuugcauuuccagaa

SEQ ID NO: 1377529 - RNA, 19 nt, Homo sapiens
aaugcuggcucuccgauug

SEQ ID NO: 1377530 - RNA, 19 nt, Homo sapiens
aagaggaggucccggaauc

SEQ ID NO: 1377531 - RNA, 19 nt, Homo sapiens
gguaguguuuaguguuaau

SEQ ID NO: 1377532 - RNA, 19 nt, Homo sapiens
ggaugaauuugcauuucca

SEQ ID NO: 1377533 - RNA, 19 nt, Homo sapiens
caucuccuccugaaagaaa

SEQ ID NO: 1377534 - RNA, 19 nt, Homo sapiens
gagaaaucaccacccaaug

SEQ ID NO: 1377535 - RNA, 19 nt, Homo sapiens
uuugguaguuggaagaauu

SEQ ID NO: 1377536 - RNA, 19 nt, Homo sapiens
gcagagaccaaugccaaug

SEQ ID NO: 1377537 - RNA, 19 nt, Homo sapiens
acacuggacuagaagagau

SEQ ID NO: 1377538 - RNA, 19 nt, Homo sapiens
gagacaacuuuucaauuug

SEQ ID NO: 1377539 - RNA, 19 nt, Homo sapiens
acagaagacccuaaauugu

SEQ ID NO: 1377540 - RNA, 19 nt, Homo sapiens
aaauagaaacccuguaagu

SEQ ID NO: 1377541 - RNA, 19 nt, Homo sapiens
uaacuccaggguaguguuu

SEQ ID NO: 1377542 - RNA, 19 nt, Homo sapiens
cagaauggcaggagguuuc

SEQ ID NO: 1377543 - RNA, 19 nt, Homo sapiens
aauagaaacccuguaaguu

SEQ ID NO: 1377544 - RNA, 19 nt, Homo sapiens
caccaaacguucccuugca

SEQ ID NO: 1377545 - RNA, 19 nt, Homo sapiens
cagaauaugcugagugucu

SEQ ID NO: 1377546 - RNA, 19 nt, Homo sapiens
ggugggaccugaacaugac

SEQ ID NO: 1377547 - RNA, 19 nt, Homo sapiens
ggauggggaugaaguguug

SEQ ID NO: 1377548 - RNA, 19 nt, Homo sapiens
ggucgguccuuauucugau

SEQ ID NO: 1377549 - RNA, 19 nt, Homo sapiens
gugcaagcuacauaauuaa

SEQ ID NO: 1377550 - RNA, 19 nt, Homo sapiens
ugaaagaaaagcagugaua

SEQ ID NO: 1377551 - RNA, 19 nt, Homo sapiens
uagguggccauaaacauaa

SEQ ID NO: 1377552 - RNA, 19 nt, Homo sapiens
ccuugcagauggagacuga

SEQ ID NO: 1377553 - RNA, 19 nt, Homo sapiens
gaaaaggccaggcggaguu

SEQ ID NO: 1377554 - RNA, 19 nt, Homo sapiens
ucagggcgguggagucauc

SEQ ID NO: 1377555 - RNA, 19 nt, Homo sapiens
uggagaacuuggagauuuc

SEQ ID NO: 1377556 - RNA, 19 nt, Homo sapiens
gcagaggaggugccuguca

SEQ ID NO: 1377557 - RNA, 19 nt, Homo sapiens
ccaggguaguguuuagugu

SEQ ID NO: 1377558 - RNA, 19 nt, Homo sapiens
ucuguuagacuacauccua

SEQ ID NO: 1377559 - RNA, 19 nt, Homo sapiens
cuagaagagauaaugauug

SEQ ID NO: 1377560 - RNA, 19 nt, Homo sapiens
gagaggaagcagagaugga

SEQ ID NO: 1377561 - RNA, 19 nt, Homo sapiens
guacguauauugugaagua

SEQ ID NO: 1377562 - RNA, 19 nt, Homo sapiens
gaguauaacuggcuuagua

SEQ ID NO: 1377563 - RNA, 19 nt, Homo sapiens
gaaggaaacuugugucuca

SEQ ID NO: 1377564 - RNA, 19 nt, Homo sapiens
gaggaucagugaaauaauu

SEQ ID NO: 1377565 - RNA, 19 nt, Homo sapiens
ggacacugcagaaauaaua

SEQ ID NO: 1377566 - RNA, 19 nt, Homo sapiens
aaauuuagauggacacuug

SEQ ID NO: 1377567 - RNA, 19 nt, Homo sapiens
uaccaguguugaacuauua

SEQ ID NO: 1377568 - RNA, 19 nt, Homo sapiens
uaucaaacauuaccagugu

SEQ ID NO: 1377569 - RNA, 19 nt, Homo sapiens
ccacacacuccauuaauaa

SEQ ID NO: 1377570 - RNA, 19 nt, Homo sapiens
uaucauaggauucccauaa

SEQ ID NO: 1377571 - RNA, 19 nt, Homo sapiens
ccacaagcuuaccuaauug

SEQ ID NO: 1377572 - RNA, 19 nt, Homo sapiens
ggacacuuguauuuccuaa

SEQ ID NO: 1377573 - RNA, 19 nt, Homo sapiens
caaauccugauaaccauua

SEQ ID NO: 1377574 - RNA, 19 nt, Homo sapiens
ggaauaaagauuucacuag

SEQ ID NO: 1377575 - RNA, 19 nt, Homo sapiens
gcauaggaauaaagauuuc

SEQ ID NO: 1377576 - RNA, 19 nt, Homo sapiens
uccacaagcuuaccuaauu

SEQ ID NO: 1377577 - RNA, 19 nt, Homo sapiens
caccagauuugcugaugua

SEQ ID NO: 1377578 - RNA, 19 nt, Homo sapiens
ucacaacauucuaaaggaa

SEQ ID NO: 1377579 - RNA, 19 nt, Homo sapiens
uuaauaagguuuccugaca

SEQ ID NO: 1377580 - RNA, 19 nt, Homo sapiens
cagcagggcuaccaucuca

SEQ ID NO: 1377581 - RNA, 19 nt, Homo sapiens
cauaggauucccauaauuu

SEQ ID NO: 1377582 - RNA, 19 nt, Homo sapiens
ccaucucacucuucuguaa

SEQ ID NO: 1377583 - RNA, 19 nt, Homo sapiens
gaaguaaagccucacaaag

SEQ ID NO: 1377584 - RNA, 19 nt, Homo sapiens
ccauuaaccuucucaaacu

SEQ ID NO: 1377585 - RNA, 19 nt, Homo sapiens
ucucuguucucuaauguuu

SEQ ID NO: 1377586 - RNA, 19 nt, Homo sapiens
caaaccacacacuccauua

SEQ ID NO: 1377587 - RNA, 19 nt, Homo sapiens
uaaauucucuuccauaccu

SEQ ID NO: 1377588 - RNA, 19 nt, Homo sapiens
ucauaggauucccauaauu

SEQ ID NO: 1377589 - RNA, 19 nt, Homo sapiens
uaaaggacuuccaaaauga

SEQ ID NO: 1377590 - RNA, 19 nt, Homo sapiens
caugguggcugcuguuugu

SEQ ID NO: 1377591 - RNA, 19 nt, Homo sapiens
gaaauugggugaggaucag

SEQ ID NO: 1377592 - RNA, 19 nt, Homo sapiens
uagauggacacuuguauuu

SEQ ID NO: 1377593 - RNA, 19 nt, Homo sapiens
ccucagaaauacagaagga

SEQ ID NO: 1377594 - RNA, 19 nt, Homo sapiens
cagaagagacaauccuaaa

SEQ ID NO: 1377595 - RNA, 19 nt, Homo sapiens
caagcuuaccuaauuguuu

SEQ ID NO: 1377596 - RNA, 19 nt, Homo sapiens
ucucaaacuuaaugucuga

SEQ ID NO: 1377597 - RNA, 19 nt, Homo sapiens
gugaggaucagugaaauaa

SEQ ID NO: 1377598 - RNA, 19 nt, Homo sapiens
uaaacccaauguaucagaa

SEQ ID NO: 1377599 - RNA, 19 nt, Homo sapiens
acguggagguccugaauaa

SEQ ID NO: 1377600 - RNA, 19 nt, Homo sapiens
ugaaguaaagccucacaaa

SEQ ID NO: 1377601 - RNA, 19 nt, Homo sapiens
cagaugagaaacuguauau

SEQ ID NO: 1377602 - RNA, 19 nt, Homo sapiens
accacacacuccauuaaua

SEQ ID NO: 1377603 - RNA, 19 nt, Homo sapiens
ucacucuucuguaauuuca

SEQ ID NO: 1377604 - RNA, 19 nt, Homo sapiens
caauguaucagaagcuuug

SEQ ID NO: 1377605 - RNA, 19 nt, Homo sapiens
uaaagccucacaaagcuaa

SEQ ID NO: 1377606 - RNA, 19 nt, Homo sapiens
aaaccacacacuccauuaa

SEQ ID NO: 1377607 - RNA, 19 nt, Homo sapiens
cauuaccaguguugaacua

SEQ ID NO: 1377608 - RNA, 19 nt, Homo sapiens
ggugaggaucagugaaaua

SEQ ID NO: 1377609 - RNA, 19 nt, Homo sapiens
gauggacacuuguauuucc

SEQ ID NO: 1377610 - RNA, 19 nt, Homo sapiens
caaaaugacagaugagaaa

SEQ ID NO: 1377611 - RNA, 19 nt, Homo sapiens
accggacacugcagaaaua

SEQ ID NO: 1377612 - RNA, 19 nt, Homo sapiens
ucagaaauacagaaggaaa

SEQ ID NO: 1377613 - RNA, 19 nt, Homo sapiens
gacagaagagacaauccua

SEQ ID NO: 1377614 - RNA, 19 nt, Homo sapiens
aauaagguuuccugacaga

SEQ ID NO: 1377615 - RNA, 19 nt, Homo sapiens
aaggguacguauauuguga

SEQ ID NO: 1377616 - RNA, 19 nt, Homo sapiens
gcaaauccugauaaccauu

SEQ ID NO: 1377617 - RNA, 19 nt, Homo sapiens
caacguggagguccugaau

SEQ ID NO: 1377618 - RNA, 19 nt, Homo sapiens
gaagagacaauccuaaacc

SEQ ID NO: 1377619 - RNA, 19 nt, Homo sapiens
auccuacucugaaugauaa

SEQ ID NO: 1377620 - RNA, 19 nt, Homo sapiens
aaauacagaaggaaacuug

SEQ ID NO: 1377621 - RNA, 19 nt, Homo sapiens
guaaagccucacaaagcua

SEQ ID NO: 1377622 - RNA, 19 nt, Homo sapiens
caagauggcgucugcuagu

SEQ ID NO: 1377623 - RNA, 19 nt, Homo sapiens
gccuauuaauuuacucuug

SEQ ID NO: 1377624 - RNA, 19 nt, Homo sapiens
uaucagaagcuuugagauc

SEQ ID NO: 1377625 - RNA, 19 nt, Homo sapiens
ucucuuccauaccuuuaaa

SEQ ID NO: 1377626 - RNA, 19 nt, Homo sapiens
ccaaggguacguauauugu

SEQ ID NO: 1377627 - RNA, 19 nt, Homo sapiens
gccaaggguacguauauug

SEQ ID NO: 1377628 - RNA, 19 nt, Homo sapiens
uuugugaucuuguaugcaa

SEQ ID NO: 1377629 - RNA, 19 nt, Homo sapiens
agucagaauugcuguuuua

SEQ ID NO: 1377630 - RNA, 19 nt, Homo sapiens
uuaccaguguugaacuauu

SEQ ID NO: 1377631 - RNA, 19 nt, Homo sapiens
aagauggcgucugcuagua

SEQ ID NO: 1377632 - RNA, 19 nt, Homo sapiens
auaaaggacuuccaaaaug

SEQ ID NO: 1377633 - RNA, 19 nt, Homo sapiens
agacaauccuaaacccaau

SEQ ID NO: 1377634 - RNA, 19 nt, Homo sapiens
gggcuaccaucucacucuu

SEQ ID NO: 1377635 - RNA, 19 nt, Homo sapiens
cauuaaccuucucaaacuu

SEQ ID NO: 1377636 - RNA, 19 nt, Homo sapiens
gaaauacagaaggaaacuu

SEQ ID NO: 1377637 - RNA, 19 nt, Homo sapiens
aacauuaccucagaaauac

SEQ ID NO: 1377638 - RNA, 19 nt, Homo sapiens
gcuaccaucucacucuucu

SEQ ID NO: 1377639 - RNA, 19 nt, Homo sapiens
ccucacaaagcuaaauaaa

SEQ ID NO: 1377640 - RNA, 19 nt, Homo sapiens
gaucuuguaugcaaauccu

SEQ ID NO: 1377641 - RNA, 19 nt, Homo sapiens
gugccaaggguacguauau

SEQ ID NO: 1377642 - RNA, 19 nt, Homo sapiens
uauauccuacucugaauga

SEQ ID NO: 1377643 - RNA, 19 nt, Homo sapiens
ucaaaccacacacuccauu

SEQ ID NO: 1377644 - RNA, 19 nt, Homo sapiens
guucuuaauucucuguucu

SEQ ID NO: 1377645 - RNA, 19 nt, Homo sapiens
gacacugcagaaauaauaa

SEQ ID NO: 1377646 - RNA, 19 nt, Homo sapiens
cguauauugugaaguaaag

SEQ ID NO: 1377647 - RNA, 19 nt, Homo sapiens
caauaaaggacuuccaaaa

SEQ ID NO: 1377648 - RNA, 19 nt, Homo sapiens
guaugcaaauccugauaac

SEQ ID NO: 1377649 - RNA, 19 nt, Homo sapiens
ucaccagauuugcugaugu

SEQ ID NO: 1377650 - RNA, 19 nt, Homo sapiens
ugauaaccauuaaccuucu

SEQ ID NO: 1377651 - RNA, 19 nt, Homo sapiens
ccugauaaccauuaaccuu

SEQ ID NO: 1377652 - RNA, 19 nt, Homo sapiens
ugaaauugggugaggauca

SEQ ID NO: 1377653 - RNA, 19 nt, Homo sapiens
acagaagagacaauccuaa

SEQ ID NO: 1377654 - RNA, 19 nt, Homo sapiens
aguaaagccucacaaagcu

SEQ ID NO: 1377655 - RNA, 19 nt, Homo sapiens
ucccauaauuucacuuuac

SEQ ID NO: 1377656 - RNA, 19 nt, Homo sapiens
aagguuuccugacagaaga

SEQ ID NO: 1377657 - RNA, 19 nt, Homo sapiens
ucagucagaauugcuguuu

SEQ ID NO: 1377658 - RNA, 19 nt, Homo sapiens
aaugacagaugagaaacug

SEQ ID NO: 1377659 - RNA, 19 nt, Homo sapiens
gucaucagacaauagaauu

SEQ ID NO: 1377660 - RNA, 19 nt, Homo sapiens
gcugcuguuugucaucaga

SEQ ID NO: 1377661 - RNA, 19 nt, Homo sapiens
gaaaauagcuuugaccuua

SEQ ID NO: 1377662 - RNA, 19 nt, Homo sapiens
caagaaaccuuaugaaugu

SEQ ID NO: 1377663 - RNA, 19 nt, Homo sapiens
caacuuaacuuacaucaga

SEQ ID NO: 1377664 - RNA, 19 nt, Homo sapiens
gcacagaaauuguuaauac

SEQ ID NO: 1377665 - RNA, 19 nt, Homo sapiens
gaaagaaaccuuaucaaug

SEQ ID NO: 1377666 - RNA, 19 nt, Homo sapiens
guucauugcucacaacuua

SEQ ID NO: 1377667 - RNA, 19 nt, Homo sapiens
gaucacagcuuacucaaca

SEQ ID NO: 1377668 - RNA, 19 nt, Homo sapiens
ugagaaaccuuaugaaugu

SEQ ID NO: 1377669 - RNA, 19 nt, Homo sapiens
gggaaggcguuuaaucaua

SEQ ID NO: 1377670 - RNA, 19 nt, Homo sapiens
gcaagaaaccuuaugaaug

SEQ ID NO: 1377671 - RNA, 19 nt, Homo sapiens
agacagcgaucacagcuua

SEQ ID NO: 1377672 - RNA, 19 nt, Homo sapiens
aggcaucgcucacaucuua

SEQ ID NO: 1377673 - RNA, 19 nt, Homo sapiens
gaacuuacucuacaucaaa

SEQ ID NO: 1377674 - RNA, 19 nt, Homo sapiens
agagaaaccuuaugaaugu

SEQ ID NO: 1377675 - RNA, 19 nt, Homo sapiens
ggaaagaaaccuuaucaau

SEQ ID NO: 1377676 - RNA, 19 nt, Homo sapiens
gcaaaugucucggaauuag

SEQ ID NO: 1377677 - RNA, 19 nt, Homo sapiens
gggaaggccuuuaauuaug

SEQ ID NO: 1377678 - RNA, 19 nt, Homo sapiens
gagaaacccuaugaaugua

SEQ ID NO: 1377679 - RNA, 19 nt, Homo sapiens
gguaaggccuuuagacuuc

SEQ ID NO: 1377680 - RNA, 19 nt, Homo sapiens
ggaaggcguuuaaucauag

SEQ ID NO: 1377681 - RNA, 19 nt, Homo sapiens
aaagaaaccuuaucaaugc

SEQ ID NO: 1377682 - RNA, 19 nt, Homo sapiens
ugugauggcuuacaacuaa

SEQ ID NO: 1377683 - RNA, 19 nt, Homo sapiens
gacagaagaugcuggagaa

SEQ ID NO: 1377684 - RNA, 19 nt, Homo sapiens
caacuaacccuacaucaga

SEQ ID NO: 1377685 - RNA, 19 nt, Homo sapiens
gcucagaacuuacucuaca

SEQ ID NO: 1377686 - RNA, 19 nt, Homo sapiens
gcucacaucuuacuauaca

SEQ ID NO: 1377687 - RNA, 19 nt, Homo sapiens
gagagaaaccuuaugaaug

SEQ ID NO: 1377688 - RNA, 19 nt, Homo sapiens
ggaaggccuuuguucauug

SEQ ID NO: 1377689 - RNA, 19 nt, Homo sapiens
caacaucagagacuucaua

SEQ ID NO: 1377690 - RNA, 19 nt, Homo sapiens
gugggaaggccuuuaauua

SEQ ID NO: 1377691 - RNA, 19 nt, Homo sapiens
gaacaccugcgacuccaua

SEQ ID NO: 1377692 - RNA, 19 nt, Homo sapiens
gcucacaacuuaaacaucu

SEQ ID NO: 1377693 - RNA, 19 nt, Homo sapiens
ggagagaaaccuuaugaau

SEQ ID NO: 1377694 - RNA, 19 nt, Homo sapiens
auucguggcuuucaacuua

SEQ ID NO: 1377695 - RNA, 19 nt, Homo sapiens
gagaaacccuaugagugua

SEQ ID NO: 1377696 - RNA, 19 nt, Homo sapiens
aauuauggcucagaacuua

SEQ ID NO: 1377697 - RNA, 19 nt, Homo sapiens
ggaaggccuuuaauuaugg

SEQ ID NO: 1377698 - RNA, 19 nt, Homo sapiens
caaaugaaccucacaugug

SEQ ID NO: 1377699 - RNA, 19 nt, Homo sapiens
gaaggcaacugucauuuug

SEQ ID NO: 1377700 - RNA, 19 nt, Homo sapiens
ugagaaacccuaugaaugu

SEQ ID NO: 1377701 - RNA, 19 nt, Homo sapiens
ugagaaacccuaugaaugu

SEQ ID NO: 1377702 - RNA, 19 nt, Homo sapiens
gcaaugaguguaaagaaug

SEQ ID NO: 1377703 - RNA, 19 nt, Homo sapiens
caaaugcaaugaguguaaa

SEQ ID NO: 1377704 - RNA, 19 nt, Homo sapiens
agacuucauucacaccuua

SEQ ID NO: 1377705 - RNA, 19 nt, Homo sapiens
gacaagaggaggguuauuu

SEQ ID NO: 1377706 - RNA, 19 nt, Homo sapiens
uaaagaauguggaaagacu

SEQ ID NO: 1377707 - RNA, 19 nt, Homo sapiens
gaaugcacagaaauuguua

SEQ ID NO: 1377708 - RNA, 19 nt, Homo sapiens
ggguuaacauggaagaauu

SEQ ID NO: 1377709 - RNA, 19 nt, Homo sapiens
gggaaggccuuuagcuauc

SEQ ID NO: 1377710 - RNA, 19 nt, Homo sapiens
gggaaggccuuuagcuauc

SEQ ID NO: 1377711 - RNA, 19 nt, Homo sapiens
gagaaaccuuaugaaugua

SEQ ID NO: 1377712 - RNA, 19 nt, Homo sapiens
gcuuugaccuuauagacuu

SEQ ID NO: 1377713 - RNA, 19 nt, Homo sapiens
gagaaaccuuaugaaugua

SEQ ID NO: 1377714 - RNA, 19 nt, Homo sapiens
uguaaagaaugcacagaaa

SEQ ID NO: 1377715 - RNA, 19 nt, Homo sapiens
cauccuauaucauuccauu

SEQ ID NO: 1377716 - RNA, 19 nt, Homo sapiens
gaguacugcugcuauauag

SEQ ID NO: 1377717 - RNA, 19 nt, Homo sapiens
guuaauacaccaugccuuu

SEQ ID NO: 1377718 - RNA, 19 nt, Homo sapiens
ggaaggccuuuagcuauca

SEQ ID NO: 1377719 - RNA, 19 nt, Homo sapiens
caaaagacaucagagaauu

SEQ ID NO: 1377720 - RNA, 19 nt, Homo sapiens
ggaaggccuuuagcuauca

SEQ ID NO: 1377721 - RNA, 19 nt, Homo sapiens
aggcaaaugucucggaauu

SEQ ID NO: 1377722 - RNA, 19 nt, Homo sapiens
ugagaaacccuaugagugu

SEQ ID NO: 1377723 - RNA, 19 nt, Homo sapiens
ccuuauagacuuccugaua

SEQ ID NO: 1377724 - RNA, 19 nt, Homo sapiens
caugaaauuuguugaugga

SEQ ID NO: 1377725 - RNA, 19 nt, Homo sapiens
gaaugcaugauauguggua

SEQ ID NO: 1377726 - RNA, 19 nt, Homo sapiens
caucagagacuucauacug

SEQ ID NO: 1377727 - RNA, 19 nt, Homo sapiens
gugagaaaccuuaugaaug

SEQ ID NO: 1377728 - RNA, 19 nt, Homo sapiens
ggacuuggcauccagagau

SEQ ID NO: 1377729 - RNA, 19 nt, Homo sapiens
agacaucagagaauucaua

SEQ ID NO: 1377730 - RNA, 19 nt, Homo sapiens
ggauaucgccuaccuuugg

SEQ ID NO: 1377731 - RNA, 19 nt, Homo sapiens
gcgagaagccagucagguu

SEQ ID NO: 1377732 - RNA, 19 nt, Homo sapiens
uaacuuacaucagacucuu

SEQ ID NO: 1377733 - RNA, 19 nt, Homo sapiens
gaaggcguuuaaucauaga

SEQ ID NO: 1377734 - RNA, 19 nt, Homo sapiens
gaaacccuaugaauguaag

SEQ ID NO: 1377735 - RNA, 19 nt, Homo sapiens
cuacaucagaggauucaua

SEQ ID NO: 1377736 - RNA, 19 nt, Homo sapiens
caaugaguguaaagaaugu

SEQ ID NO: 1377737 - RNA, 19 nt, Homo sapiens
gcgggaaggcguuuaauca

SEQ ID NO: 1377738 - RNA, 19 nt, Homo sapiens
gugagaaacccuaugaaug

SEQ ID NO: 1377739 - RNA, 19 nt, Homo sapiens
caucaaagaauucauacug

SEQ ID NO: 1377740 - RNA, 19 nt, Homo sapiens
gugagaaacccuaugaaug

SEQ ID NO: 1377741 - RNA, 19 nt, Homo sapiens
ucgcucacaucuuacuaua

SEQ ID NO: 1377742 - RNA, 19 nt, Homo sapiens
guaaagaaugcacagaaau

SEQ ID NO: 1377743 - RNA, 19 nt, Homo sapiens
caggauaucgccuaccuuu

SEQ ID NO: 1377744 - RNA, 19 nt, Homo sapiens
agucuagcaucaugaaauu

SEQ ID NO: 1377745 - RNA, 19 nt, Homo sapiens
ggugagaaaccuuaugaau

SEQ ID NO: 1377746 - RNA, 19 nt, Homo sapiens
acaaaugcaaugaguguaa

SEQ ID NO: 1377747 - RNA, 19 nt, Homo sapiens
ggugacaaaugcaaugagu

SEQ ID NO: 1377748 - RNA, 19 nt, Homo sapiens
gauucauacuggugagaaa

SEQ ID NO: 1377749 - RNA, 19 nt, Homo sapiens
gagaaacccuaugaauguc

SEQ ID NO: 1377750 - RNA, 19 nt, Homo sapiens
uggaaggccuuuguucauu

SEQ ID NO: 1377751 - RNA, 19 nt, Homo sapiens
gagaugagccccagaaguu

SEQ ID NO: 1377752 - RNA, 19 nt, Homo sapiens
uuacaucagacucuucaua

SEQ ID NO: 1377753 - RNA, 19 nt, Homo sapiens
gccuuuagcuaucauucaa

SEQ ID NO: 1377754 - RNA, 19 nt, Homo sapiens
gauaugugguaaggccuuu

SEQ ID NO: 1377755 - RNA, 19 nt, Homo sapiens
caucagagaauucauacug

SEQ ID NO: 1377756 - RNA, 19 nt, Homo sapiens
gcugcuauauaguaaugaa

SEQ ID NO: 1377757 - RNA, 19 nt, Homo sapiens
ggcaagaaaccuuaugaau

SEQ ID NO: 1377758 - RNA, 19 nt, Homo sapiens
caucagagaauucauacug

SEQ ID NO: 1377759 - RNA, 19 nt, Homo sapiens
gaauguaaagaauguggaa

SEQ ID NO: 1377760 - RNA, 19 nt, Homo sapiens
ugaguacugcugcuauaua

SEQ ID NO: 1377761 - RNA, 19 nt, Homo sapiens
uaacucagaucucaguaua

SEQ ID NO: 1377762 - RNA, 19 nt, Homo sapiens
gggaagaccuuucgacaga

SEQ ID NO: 1377763 - RNA, 19 nt, Homo sapiens
ggucaaaucucauuacaca

SEQ ID NO: 1377764 - RNA, 19 nt, Homo sapiens
gagagaaaccuuauaaaug

SEQ ID NO: 1377765 - RNA, 19 nt, Homo sapiens
acucagaagucaaaucuua

SEQ ID NO: 1377766 - RNA, 19 nt, Homo sapiens
agagaaaucuuccauaugu

SEQ ID NO: 1377767 - RNA, 19 nt, Homo sapiens
guucacagaugaccacuaa

SEQ ID NO: 1377768 - RNA, 19 nt, Homo sapiens
gagagaagccuuaugaaug

SEQ ID NO: 1377769 - RNA, 19 nt, Homo sapiens
ggucagaguugauuauuca

SEQ ID NO: 1377770 - RNA, 19 nt, Homo sapiens
gaaaugaccacaucagaau

SEQ ID NO: 1377771 - RNA, 19 nt, Homo sapiens
ggagagaaaccuuauaaau

SEQ ID NO: 1377772 - RNA, 19 nt, Homo sapiens
ggagaagccuuaugaaugc

SEQ ID NO: 1377773 - RNA, 19 nt, Homo sapiens
ggaaaggcuucguucagaa

SEQ ID NO: 1377774 - RNA, 19 nt, Homo sapiens
ggaaagccuucaaccagaa

SEQ ID NO: 1377775 - RNA, 19 nt, Homo sapiens
gaaagagcuucaccuggaa

SEQ ID NO: 1377776 - RNA, 19 nt, Homo sapiens
gcacaccgaagaauucaua

SEQ ID NO: 1377777 - RNA, 19 nt, Homo sapiens
gagagaaaccuuaugaaug

SEQ ID NO: 1377778 - RNA, 19 nt, Homo sapiens
ggagagaaacccuauguau

SEQ ID NO: 1377779 - RNA, 19 nt, Homo sapiens
gagaaaucuuccauaugua

SEQ ID NO: 1377780 - RNA, 19 nt, Homo sapiens
gugaagcccuauauaugua

SEQ ID NO: 1377781 - RNA, 19 nt, Homo sapiens
gaauaaacaucagacaaca

SEQ ID NO: 1377782 - RNA, 19 nt, Homo sapiens
gauuacacaucacagaauu

SEQ ID NO: 1377783 - RNA, 19 nt, Homo sapiens
gggaaaggcuucguucaga

SEQ ID NO: 1377784 - RNA, 19 nt, Homo sapiens
agagagaaaucuuccauau

SEQ ID NO: 1377785 - RNA, 19 nt, Homo sapiens
gggagaagccuuaugaaug

SEQ ID NO: 1377786 - RNA, 19 nt, Homo sapiens
ggagagaaaccuuaugaau

SEQ ID NO: 1377787 - RNA, 19 nt, Homo sapiens
caagguacaucugaaaguu

SEQ ID NO: 1377788 - RNA, 19 nt, Homo sapiens
ggaaaagccuucucaugaa

SEQ ID NO: 1377789 - RNA, 19 nt, Homo sapiens
gaaaagcccuacauuuguu

SEQ ID NO: 1377790 - RNA, 19 nt, Homo sapiens
ggucaaaucucaguaagca

SEQ ID NO: 1377791 - RNA, 19 nt, Homo sapiens
caaggaaccgagucaauuu

SEQ ID NO: 1377792 - RNA, 19 nt, Homo sapiens
ggauguggcuaucgauuuc

SEQ ID NO: 1377793 - RNA, 19 nt, Homo sapiens
gaaaagccuucucaugaaa

SEQ ID NO: 1377794 - RNA, 19 nt, Homo sapiens
gaaaggcuucguucagaaa

SEQ ID NO: 1377795 - RNA, 19 nt, Homo sapiens
gggaaggccuuuagcaaca

SEQ ID NO: 1377796 - RNA, 19 nt, Homo sapiens
cgacagaagucagaguuga

SEQ ID NO: 1377797 - RNA, 19 nt, Homo sapiens
ggagagaagccuuaugaau

SEQ ID NO: 1377798 - RNA, 19 nt, Homo sapiens
cagccacgcuugagagaaa

SEQ ID NO: 1377799 - RNA, 19 nt, Homo sapiens
acacaucacagaauucaua

SEQ ID NO: 1377800 - RNA, 19 nt, Homo sapiens
ggagagagacaguaugaau

SEQ ID NO: 1377801 - RNA, 19 nt, Homo sapiens
ggagagccuucacucagaa

SEQ ID NO: 1377802 - RNA, 19 nt, Homo sapiens
agagaaaccuuaugaaugc

SEQ ID NO: 1377803 - RNA, 19 nt, Homo sapiens
gagaaaagcccuacauuug

SEQ ID NO: 1377804 - RNA, 19 nt, Homo sapiens
ggagagaaacccuaugugu

SEQ ID NO: 1377805 - RNA, 19 nt, Homo sapiens
gagagaaacccuauguaug

SEQ ID NO: 1377806 - RNA, 19 nt, Homo sapiens
gggagagccuucacucaga

SEQ ID NO: 1377807 - RNA, 19 nt, Homo sapiens
gcaaagcguucacacaaaa

SEQ ID NO: 1377808 - RNA, 19 nt, Homo sapiens
ggcaaagcguucacacaaa

SEQ ID NO: 1377809 - RNA, 19 nt, Homo sapiens
gaagucacaguucaaggua

SEQ ID NO: 1377810 - RNA, 19 nt, Homo sapiens
ggucagacuugauuacaca

SEQ ID NO: 1377811 - RNA, 19 nt, Homo sapiens
ggagagagacaccaugaau

SEQ ID NO: 1377812 - RNA, 19 nt, Homo sapiens
uaaaccagcuuccucucaa

SEQ ID NO: 1377813 - RNA, 19 nt, Homo sapiens
ucaauuuggugaauaggaa

SEQ ID NO: 1377814 - RNA, 19 nt, Homo sapiens
caacagguccaauuugaau

SEQ ID NO: 1377815 - RNA, 19 nt, Homo sapiens
ggaaguccuuuaccuccaa

SEQ ID NO: 1377816 - RNA, 19 nt, Homo sapiens
gagugaagcccuauauaug

SEQ ID NO: 1377817 - RNA, 19 nt, Homo sapiens
ggagagaaaccuuaugagu

SEQ ID NO: 1377818 - RNA, 19 nt, Homo sapiens
ggaccauaaucaacauaga

SEQ ID NO: 1377819 - RNA, 19 nt, Homo sapiens
agaaaucaguguucagugu

SEQ ID NO: 1377820 - RNA, 19 nt, Homo sapiens
ccagaaaucaauacucauu

SEQ ID NO: 1377821 - RNA, 19 nt, Homo sapiens
gagaauucauacaggagaa

SEQ ID NO: 1377822 - RNA, 19 nt, Homo sapiens
gggaaggccuuuaccuaca

SEQ ID NO: 1377823 - RNA, 19 nt, Homo sapiens
caugagaagauucaaagua

SEQ ID NO: 1377824 - RNA, 19 nt, Homo sapiens
aaauagaaaugaccacauc

SEQ ID NO: 1377825 - RNA, 19 nt, Homo sapiens
agacaaacccuacaagugu

SEQ ID NO: 1377826 - RNA, 19 nt, Homo sapiens
gagacaaacccuacaagug

SEQ ID NO: 1377827 - RNA, 19 nt, Homo sapiens
caguaaaccuugggucauu

SEQ ID NO: 1377828 - RNA, 19 nt, Homo sapiens
gcaggucaaaucucaguaa

SEQ ID NO: 1377829 - RNA, 19 nt, Homo sapiens
gagaaaccuuauaaaugug

SEQ ID NO: 1377830 - RNA, 19 nt, Homo sapiens
ggacuauuuucacguuuua

SEQ ID NO: 1377831 - RNA, 19 nt, Homo sapiens
cuaugagugugcugaauuu

SEQ ID NO: 1377832 - RNA, 19 nt, Homo sapiens
gaucauggcagcuccuaug

SEQ ID NO: 1377833 - RNA, 19 nt, Homo sapiens
gaaaucaguguucaguguu

SEQ ID NO: 1377834 - RNA, 19 nt, Homo sapiens
gguccaauuugaauaaaca

SEQ ID NO: 1377835 - RNA, 19 nt, Homo sapiens
agagaagccuuacgugugu

SEQ ID NO: 1377836 - RNA, 19 nt, Homo sapiens
gaauucaucacacaucaga

SEQ ID NO: 1377837 - RNA, 19 nt, Homo sapiens
cuacaaguguggcaucugu

SEQ ID NO: 1377838 - RNA, 19 nt, Homo sapiens
gaagaccuuucgacagaag

SEQ ID NO: 1377839 - RNA, 19 nt, Homo sapiens
caaaucucauuacacauca

SEQ ID NO: 1377840 - RNA, 19 nt, Homo sapiens
uuucaaguaucgucucuuu

SEQ ID NO: 1377841 - RNA, 19 nt, Homo sapiens
ggaagaccuuucgacagaa

SEQ ID NO: 1377842 - RNA, 19 nt, Homo sapiens
aaccagaaaucaauacuca

SEQ ID NO: 1377843 - RNA, 19 nt, Homo sapiens
gauucaaaguagagagaaa

SEQ ID NO: 1377844 - RNA, 19 nt, Homo sapiens
cgagucaauuuggugaaua

SEQ ID NO: 1377845 - RNA, 19 nt, Homo sapiens
ccaagugcaucagcgaauu

SEQ ID NO: 1377846 - RNA, 19 nt, Homo sapiens
ugggaagucuuucacuaaa

SEQ ID NO: 1377847 - RNA, 19 nt, Homo sapiens
ggagaaaagcccuacauuu

SEQ ID NO: 1377848 - RNA, 19 nt, Homo sapiens
acaacuccauguucauaaa

SEQ ID NO: 1377849 - RNA, 19 nt, Homo sapiens
ucacaacuccauguucaua

SEQ ID NO: 1377850 - RNA, 19 nt, Homo sapiens
gagagaaaucuuccauaug

SEQ ID NO: 1377851 - RNA, 19 nt, Homo sapiens
agagaagccuuaugaaugc

SEQ ID NO: 1377852 - RNA, 19 nt, Homo sapiens
caucaaagaauucauacug

SEQ ID NO: 1377853 - RNA, 19 nt, Homo sapiens
gagagagacaguaugaaug

SEQ ID NO: 1377854 - RNA, 19 nt, Homo sapiens
caaaguagagagaaaucuu

SEQ ID NO: 1377855 - RNA, 19 nt, Homo sapiens
ucagguacaucaacguguu

SEQ ID NO: 1377856 - RNA, 19 nt, Homo sapiens
cagaauucaucacacauca

SEQ ID NO: 1377857 - RNA, 19 nt, Homo sapiens
gaccauaaucaacauagaa

SEQ ID NO: 1377858 - RNA, 19 nt, Homo sapiens
gagaaaagcccuauguaug

SEQ ID NO: 1377859 - RNA, 19 nt, Homo sapiens
guacagaagccagaauuca

SEQ ID NO: 1377860 - RNA, 19 nt, Homo sapiens
ugagugugcugaauuugga

SEQ ID NO: 1377861 - RNA, 19 nt, Homo sapiens
gaacauggcucccaacaaa

SEQ ID NO: 1377862 - RNA, 19 nt, Homo sapiens
guccaaagcucaaauaaua

SEQ ID NO: 1377863 - RNA, 19 nt, Homo sapiens
gaaggauggucccaaauaa

SEQ ID NO: 1377864 - RNA, 19 nt, Homo sapiens
ggagagucauggcguauua

SEQ ID NO: 1377865 - RNA, 19 nt, Homo sapiens
ggagauaaaugccucuuug

SEQ ID NO: 1377866 - RNA, 19 nt, Homo sapiens
gggcugagcagauucaaua

SEQ ID NO: 1377867 - RNA, 19 nt, Homo sapiens
gaaaggaccucggaagucu

SEQ ID NO: 1377868 - RNA, 19 nt, Homo sapiens
gaaauucaucgccauguuu

SEQ ID NO: 1377869 - RNA, 19 nt, Homo sapiens
gauauaagcagauuugaca

SEQ ID NO: 1377870 - RNA, 19 nt, Homo sapiens
auaaagaacuccuugacuu

SEQ ID NO: 1377871 - RNA, 19 nt, Homo sapiens
cgaaggauggucccaaaua

SEQ ID NO: 1377872 - RNA, 19 nt, Homo sapiens
ccaccaaccuggcaucguu

SEQ ID NO: 1377873 - RNA, 19 nt, Homo sapiens
gugagugacuugcugcuaa

SEQ ID NO: 1377874 - RNA, 19 nt, Homo sapiens
ccaagugggccaacagaua

SEQ ID NO: 1377875 - RNA, 19 nt, Homo sapiens
aaacgccucuccaauguga

SEQ ID NO: 1377876 - RNA, 19 nt, Homo sapiens
agacacaccugccuaggaa

SEQ ID NO: 1377877 - RNA, 19 nt, Homo sapiens
gcauugcccucuaaaucuu

SEQ ID NO: 1377878 - RNA, 19 nt, Homo sapiens
ggauuuccuuaauggcuua

SEQ ID NO: 1377879 - RNA, 19 nt, Homo sapiens
gaugauauaagcagauuug

SEQ ID NO: 1377880 - RNA, 19 nt, Homo sapiens
gcaacuucaccaugacuua

SEQ ID NO: 1377881 - RNA, 19 nt, Homo sapiens
aaagccagcuacauaagaa

SEQ ID NO: 1377882 - RNA, 19 nt, Homo sapiens
gaaagggaggggauaauua

SEQ ID NO: 1377883 - RNA, 19 nt, Homo sapiens
gugacuugauggacuauuu

SEQ ID NO: 1377884 - RNA, 19 nt, Homo sapiens
ggaaugcagagcuuagaaa

SEQ ID NO: 1377885 - RNA, 19 nt, Homo sapiens
uaaagaacuccuugacuug

SEQ ID NO: 1377886 - RNA, 19 nt, Homo sapiens
ggaaaagccagcuacauaa

SEQ ID NO: 1377887 - RNA, 19 nt, Homo sapiens
ggguggaaguggugauuga

SEQ ID NO: 1377888 - RNA, 19 nt, Homo sapiens
cagaaacacuguccaaagc

SEQ ID NO: 1377889 - RNA, 19 nt, Homo sapiens
gcaagugauucuaggaaac

SEQ ID NO: 1377890 - RNA, 19 nt, Homo sapiens
gucaagauuuccaacagaa

SEQ ID NO: 1377891 - RNA, 19 nt, Homo sapiens
agaaugggcuggugagucu

SEQ ID NO: 1377892 - RNA, 19 nt, Homo sapiens
cgcagcagauucuuccaua

SEQ ID NO: 1377893 - RNA, 19 nt, Homo sapiens
uggaaguggugauugauga

SEQ ID NO: 1377894 - RNA, 19 nt, Homo sapiens
acgggaagauggcgaguuu

SEQ ID NO: 1377895 - RNA, 19 nt, Homo sapiens
agagggcgcuggagugaug

SEQ ID NO: 1377896 - RNA, 19 nt, Homo sapiens
caacauccaucugcacucu

SEQ ID NO: 1377897 - RNA, 19 nt, Homo sapiens
caacaaagcauuuucaaca

SEQ ID NO: 1377898 - RNA, 19 nt, Homo sapiens
ugagugacuugcugcuaaa

SEQ ID NO: 1377899 - RNA, 19 nt, Homo sapiens
gaugucgugucaagauuuc

SEQ ID NO: 1377900 - RNA, 19 nt, Homo sapiens
agaaauucaucgccauguu

SEQ ID NO: 1377901 - RNA, 19 nt, Homo sapiens
ggaaaggaccucggaaguc

SEQ ID NO: 1377902 - RNA, 19 nt, Homo sapiens
gaaagcagaagaugcaaaa

SEQ ID NO: 1377903 - RNA, 19 nt, Homo sapiens
cacgaaggauggucccaaa

SEQ ID NO: 1377904 - RNA, 19 nt, Homo sapiens
aaauucaucgccauguuua

SEQ ID NO: 1377905 - RNA, 19 nt, Homo sapiens
gcacagacacggagaaaau

SEQ ID NO: 1377906 - RNA, 19 nt, Homo sapiens
ggaugucgugucaagauuu

SEQ ID NO: 1377907 - RNA, 19 nt, Homo sapiens
ggcagaagauccugauggu

SEQ ID NO: 1377908 - RNA, 19 nt, Homo sapiens
aagcagauuugacauccaa

SEQ ID NO: 1377909 - RNA, 19 nt, Homo sapiens
agaccuccaucaucaaguu

SEQ ID NO: 1377910 - RNA, 19 nt, Homo sapiens
gaacuauguugugguugca

SEQ ID NO: 1377911 - RNA, 19 nt, Homo sapiens
caccaugacuuaccaucug

SEQ ID NO: 1377912 - RNA, 19 nt, Homo sapiens
cgccgcaacuucaccauga

SEQ ID NO: 1377913 - RNA, 19 nt, Homo sapiens
gcugucacaccaucaaauu

SEQ ID NO: 1377914 - RNA, 19 nt, Homo sapiens
ugacucagaacccacagua

SEQ ID NO: 1377915 - RNA, 19 nt, Homo sapiens
gcagcagauucuuccauag

SEQ ID NO: 1377916 - RNA, 19 nt, Homo sapiens
gcagagaggagaagugacu

SEQ ID NO: 1377917 - RNA, 19 nt, Homo sapiens
guucugcugugccuggaaa

SEQ ID NO: 1377918 - RNA, 19 nt, Homo sapiens
gccggacguuuaaggauga

SEQ ID NO: 1377919 - RNA, 19 nt, Homo sapiens
cagcacaggcgauggagaa

SEQ ID NO: 1377920 - RNA, 19 nt, Homo sapiens
gugcauugcccucuaaauc

SEQ ID NO: 1377921 - RNA, 19 nt, Homo sapiens
gaagcaagugauucuagga

SEQ ID NO: 1377922 - RNA, 19 nt, Homo sapiens
ccaagcugcucggauccua

SEQ ID NO: 1377923 - RNA, 19 nt, Homo sapiens
ugucaagauuuccaacaga

SEQ ID NO: 1377924 - RNA, 19 nt, Homo sapiens
gagauaaaugccucuuugu

SEQ ID NO: 1377925 - RNA, 19 nt, Homo sapiens
gaaugcagagcuuagaaag

SEQ ID NO: 1377926 - RNA, 19 nt, Homo sapiens
ggaaggcaccaauguuguc

SEQ ID NO: 1377927 - RNA, 19 nt, Homo sapiens
cacaggcgauggagaaugg

SEQ ID NO: 1377928 - RNA, 19 nt, Homo sapiens
ggucccaaauaauguuuag

SEQ ID NO: 1377929 - RNA, 19 nt, Homo sapiens
aaacaagcaauuggcagua

SEQ ID NO: 1377930 - RNA, 19 nt, Homo sapiens
ugggaacuauguugugguu

SEQ ID NO: 1377931 - RNA, 19 nt, Homo sapiens
ugucacaccaucaaauuug

SEQ ID NO: 1377932 - RNA, 19 nt, Homo sapiens
cccaaauaauguuuaggaa

SEQ ID NO: 1377933 - RNA, 19 nt, Homo sapiens
cauaagaaacgggaagaug

SEQ ID NO: 1377934 - RNA, 19 nt, Homo sapiens
cggaaaagccagcuacaua

SEQ ID NO: 1377935 - RNA, 19 nt, Homo sapiens
caagugggccaacagauac

SEQ ID NO: 1377936 - RNA, 19 nt, Homo sapiens
caggaggcgugaucaccaa

SEQ ID NO: 1377937 - RNA, 19 nt, Homo sapiens
caccugagcagccauuuca

SEQ ID NO: 1377938 - RNA, 19 nt, Homo sapiens
gaaaaucagcggaguucuu

SEQ ID NO: 1377939 - RNA, 19 nt, Homo sapiens
caaauuugaaagcagaaga

SEQ ID NO: 1377940 - RNA, 19 nt, Homo sapiens
gugagggaccggugaguga

SEQ ID NO: 1377941 - RNA, 19 nt, Homo sapiens
cgaaggggcugggaagaaa

SEQ ID NO: 1377942 - RNA, 19 nt, Homo sapiens
ccacaguacaggcagaaga

SEQ ID NO: 1377943 - RNA, 19 nt, Homo sapiens
cagaagcugcuccaggaaa

SEQ ID NO: 1377944 - RNA, 19 nt, Homo sapiens
guuuaaggaugagacauuc

SEQ ID NO: 1377945 - RNA, 19 nt, Homo sapiens
gcuccgaaucuuccugaaa

SEQ ID NO: 1377946 - RNA, 19 nt, Homo sapiens
agcagaagaugcaaaauuu

SEQ ID NO: 1377947 - RNA, 19 nt, Homo sapiens
caauggaaggcaccaaugu

SEQ ID NO: 1377948 - RNA, 19 nt, Homo sapiens
aaacacacuccacgaagga

SEQ ID NO: 1377949 - RNA, 19 nt, Homo sapiens
uggaugauauaagcagauu

SEQ ID NO: 1377950 - RNA, 19 nt, Homo sapiens
gauggucccaaauaauguu

SEQ ID NO: 1377951 - RNA, 19 nt, Homo sapiens
cuccaugccuacacuguga

SEQ ID NO: 1377952 - RNA, 19 nt, Homo sapiens
gcacaggcgauggagaaug

SEQ ID NO: 1377953 - RNA, 19 nt, Homo sapiens
ggaagcggccacaggaucu

SEQ ID NO: 1377954 - RNA, 19 nt, Homo sapiens
guuuauaccagaugcaaau

SEQ ID NO: 1377955 - RNA, 19 nt, Homo sapiens
gaugcucaauucaacuucu

SEQ ID NO: 1377956 - RNA, 19 nt, Homo sapiens
ggauggucccaaauaaugu

SEQ ID NO: 1377957 - RNA, 19 nt, Homo sapiens
gggagauaaaugccucuuu

SEQ ID NO: 1377958 - RNA, 19 nt, Homo sapiens
cugccaagcucgguagaga

SEQ ID NO: 1377959 - RNA, 19 nt, Homo sapiens
ucugagcccugggaacuau

SEQ ID NO: 1377960 - RNA, 19 nt, Homo sapiens
caagugauucuaggaaaca

SEQ ID NO: 1377961 - RNA, 19 nt, Homo sapiens
gaacuuggauuacugugaa

SEQ ID NO: 1377962 - RNA, 19 nt, Homo sapiens
ggagaugacugaugacaug

SEQ ID NO: 1377963 - RNA, 19 nt, Homo sapiens
caaauaagauggugucaca

SEQ ID NO: 1377964 - RNA, 19 nt, Homo sapiens
gaacacugauacuacaauu

SEQ ID NO: 1377965 - RNA, 19 nt, Homo sapiens
gccaagccaucucuuaaua

SEQ ID NO: 1377966 - RNA, 19 nt, Homo sapiens
ccacccagaugaugaauuu

SEQ ID NO: 1377967 - RNA, 19 nt, Homo sapiens
cauaagaacuuccuaacug

SEQ ID NO: 1377968 - RNA, 19 nt, Homo sapiens
gaaaagaaauccagagaau

SEQ ID NO: 1377969 - RNA, 19 nt, Homo sapiens
ggaaucaguucagugagua

SEQ ID NO: 1377970 - RNA, 19 nt, Homo sapiens
caagccaucucuuaauauu

SEQ ID NO: 1377971 - RNA, 19 nt, Homo sapiens
gauaagaguggcuacauuu

SEQ ID NO: 1377972 - RNA, 19 nt, Homo sapiens
ggauaagaguggcuacauu

SEQ ID NO: 1377973 - RNA, 19 nt, Homo sapiens
aaacguauaucguauguuc

SEQ ID NO: 1377974 - RNA, 19 nt, Homo sapiens
aaccuaaucuguauggaua

SEQ ID NO: 1377975 - RNA, 19 nt, Homo sapiens
caaagucagugaaaguaga

SEQ ID NO: 1377976 - RNA, 19 nt, Homo sapiens
ugacauggauucauacaca

SEQ ID NO: 1377977 - RNA, 19 nt, Homo sapiens
gcaacuugguuaauagaau

SEQ ID NO: 1377978 - RNA, 19 nt, Homo sapiens
gaacauugcagcuauagca

SEQ ID NO: 1377979 - RNA, 19 nt, Homo sapiens
guagaaagguauccaaggu

SEQ ID NO: 1377980 - RNA, 19 nt, Homo sapiens
gaaugucccugcuauuucu

SEQ ID NO: 1377981 - RNA, 19 nt, Homo sapiens
gggaggguauauucuuuaa

SEQ ID NO: 1377982 - RNA, 19 nt, Homo sapiens
caacauggcacgagugaug

SEQ ID NO: 1377983 - RNA, 19 nt, Homo sapiens
gugaaacucccaacuuuaa

SEQ ID NO: 1377984 - RNA, 19 nt, Homo sapiens
gaagugaacacggaaggua

SEQ ID NO: 1377985 - RNA, 19 nt, Homo sapiens
gagaggagccugcauuaca

SEQ ID NO: 1377986 - RNA, 19 nt, Homo sapiens
cugaaucccugaucuuaaa

SEQ ID NO: 1377987 - RNA, 19 nt, Homo sapiens
aaagaaauccagagaauca

SEQ ID NO: 1377988 - RNA, 19 nt, Homo sapiens
ggaaucagaacucuuuaug

SEQ ID NO: 1377989 - RNA, 19 nt, Homo sapiens
gcauauugggcacuuauaa

SEQ ID NO: 1377990 - RNA, 19 nt, Homo sapiens
acacaaacguauaucguau

SEQ ID NO: 1377991 - RNA, 19 nt, Homo sapiens
gauuagagagugaguagaa

SEQ ID NO: 1377992 - RNA, 19 nt, Homo sapiens
caacuugguuaauagaauc

SEQ ID NO: 1377993 - RNA, 19 nt, Homo sapiens
aaucagaacucuuuaugca

SEQ ID NO: 1377994 - RNA, 19 nt, Homo sapiens
gaugaugaauuugaaagug

SEQ ID NO: 1377995 - RNA, 19 nt, Homo sapiens
uaacugaacacugauacua

SEQ ID NO: 1377996 - RNA, 19 nt, Homo sapiens
gguuguaaguucagccuuu

SEQ ID NO: 1377997 - RNA, 19 nt, Homo sapiens
gcaaugguacacuaaagaa

SEQ ID NO: 1377998 - RNA, 19 nt, Homo sapiens
gccaugcacuaucauaaga

SEQ ID NO: 1377999 - RNA, 19 nt, Homo sapiens
ugaagacucccgcagauuu

SEQ ID NO: 1378000 - RNA, 19 nt, Homo sapiens
guuauuauccggccucaaa

SEQ ID NO: 1378001 - RNA, 19 nt, Homo sapiens
cacagaaucuaguuccauu

SEQ ID NO: 1378002 - RNA, 19 nt, Homo sapiens
caaacuguguucaaauaag

SEQ ID NO: 1378003 - RNA, 19 nt, Homo sapiens
aagcagacaccacagaaua

SEQ ID NO: 1378004 - RNA, 19 nt, Homo sapiens
gaagacucccgcagauuug

SEQ ID NO: 1378005 - RNA, 19 nt, Homo sapiens
gccauuggaacuuggauua

SEQ ID NO: 1378006 - RNA, 19 nt, Homo sapiens
auucugggcugguaaauga

SEQ ID NO: 1378007 - RNA, 19 nt, Homo sapiens
auaagaacuuccuaacuga

SEQ ID NO: 1378008 - RNA, 19 nt, Homo sapiens
uuacaucucuguguuggaa

SEQ ID NO: 1378009 - RNA, 19 nt, Homo sapiens
gcucaaugccuccaguaaa

SEQ ID NO: 1378010 - RNA, 19 nt, Homo sapiens
ggaaacagagacuccaaau

SEQ ID NO: 1378011 - RNA, 19 nt, Homo sapiens
cuuccuaacugaacacuga

SEQ ID NO: 1378012 - RNA, 19 nt, Homo sapiens
caguaaacauguaacuaga

SEQ ID NO: 1378013 - RNA, 19 nt, Homo sapiens
ccuggagccuugauguuaa

SEQ ID NO: 1378014 - RNA, 19 nt, Homo sapiens
cacauccucuucaugauug

SEQ ID NO: 1378015 - RNA, 19 nt, Homo sapiens
cagaguggcugaggauaau

SEQ ID NO: 1378016 - RNA, 19 nt, Homo sapiens
gaaauccagagaaucaaau

SEQ ID NO: 1378017 - RNA, 19 nt, Homo sapiens
aaaugaaugucccugcuau

SEQ ID NO: 1378018 - RNA, 19 nt, Homo sapiens
gcaguuugguuucuuugag

SEQ ID NO: 1378019 - RNA, 19 nt, Homo sapiens
ccauggacccuucuuguga

SEQ ID NO: 1378020 - RNA, 19 nt, Homo sapiens
ggaagcgagggaagaauga

SEQ ID NO: 1378021 - RNA, 19 nt, Homo sapiens
uaucguauguucuccaaag

SEQ ID NO: 1378022 - RNA, 19 nt, Homo sapiens
gcacuacugcuaucauaag

SEQ ID NO: 1378023 - RNA, 19 nt, Homo sapiens
ccaguaaacauguaacuag

SEQ ID NO: 1378024 - RNA, 19 nt, Homo sapiens
cauggacccuucuugugaa

SEQ ID NO: 1378025 - RNA, 19 nt, Homo sapiens
ccagcuggaugucucuuau

SEQ ID NO: 1378026 - RNA, 19 nt, Homo sapiens
aaacagagacuccaaaucc

SEQ ID NO: 1378027 - RNA, 19 nt, Homo sapiens
gaaacagagacuccaaauc

SEQ ID NO: 1378028 - RNA, 19 nt, Homo sapiens
acaaacguauaucguaugu

SEQ ID NO: 1378029 - RNA, 19 nt, Homo sapiens
uaagauggugucacaagaa

SEQ ID NO: 1378030 - RNA, 19 nt, Homo sapiens
ggugaggauuagagaguga

SEQ ID NO: 1378031 - RNA, 19 nt, Homo sapiens
ucucacauccucuucauga

SEQ ID NO: 1378032 - RNA, 19 nt, Homo sapiens
guucuuaccucugggaauc

SEQ ID NO: 1378033 - RNA, 19 nt, Homo sapiens
caucaagcgcugcauagaa

SEQ ID NO: 1378034 - RNA, 19 nt, Homo sapiens
gacauggauucauacacaa

SEQ ID NO: 1378035 - RNA, 19 nt, Homo sapiens
agcaggagaugacugauga

SEQ ID NO: 1378036 - RNA, 19 nt, Homo sapiens
ggaacuuggauuacuguga

SEQ ID NO: 1378037 - RNA, 19 nt, Homo sapiens
gcacuaucauaagaacuuc

SEQ ID NO: 1378038 - RNA, 19 nt, Homo sapiens
ucacauccucuucaugauu

SEQ ID NO: 1378039 - RNA, 19 nt, Homo sapiens
uaaagcagacaccacagaa

SEQ ID NO: 1378040 - RNA, 19 nt, Homo sapiens
cacgagugauggugcgaua

SEQ ID NO: 1378041 - RNA, 19 nt, Homo sapiens
gagccugcauuacaucaag

SEQ ID NO: 1378042 - RNA, 19 nt, Homo sapiens
ggauucauacacaaacgua

SEQ ID NO: 1378043 - RNA, 19 nt, Homo sapiens
gaugacugaugacauggau

SEQ ID NO: 1378044 - RNA, 19 nt, Homo sapiens
uugcacuacugcuaucaua

SEQ ID NO: 1378045 - RNA, 19 nt, Homo sapiens
ucaguucagugaguagaaa

SEQ ID NO: 1378046 - RNA, 19 nt, Homo sapiens
ggaagauaaaugaaggauu

SEQ ID NO: 1378047 - RNA, 19 nt, Homo sapiens
gcagacaccacagaauaga

SEQ ID NO: 1378048 - RNA, 19 nt, Homo sapiens
cggaagauauucugaagcu

SEQ ID NO: 1378049 - RNA, 19 nt, Homo sapiens
ggauuacugugaacauugc

SEQ ID NO: 1378050 - RNA, 19 nt, Homo sapiens
gccaaucccagcagccaua

SEQ ID NO: 1378051 - RNA, 19 nt, Homo sapiens
uaaagaauggaaucaguuc

SEQ ID NO: 1378052 - RNA, 19 nt, Homo sapiens
ugugaacauugcagcuaua

SEQ ID NO: 1378053 - RNA, 19 nt, Homo sapiens
caacaaaacuuggccucuu

SEQ ID NO: 1378054 - RNA, 19 nt, Homo sapiens
aaaugcagaugauggaaag

SEQ ID NO: 1378055 - RNA, 19 nt, Homo sapiens
gagcacuccucuugguuac

SEQ ID NO: 1378056 - RNA, 19 nt, Homo sapiens
ggugaagccugagacgaau

SEQ ID NO: 1378057 - RNA, 19 nt, Homo sapiens
gauggugucacaagaagga

SEQ ID NO: 1378058 - RNA, 19 nt, Homo sapiens
acaagaaggaucugaagug

SEQ ID NO: 1378059 - RNA, 19 nt, Homo sapiens
uucaaggucucaaggugua

SEQ ID NO: 1378060 - RNA, 19 nt, Homo sapiens
gaaagguauccaaggugaa

SEQ ID NO: 1378061 - RNA, 19 nt, Homo sapiens
caauaaacgugguuaagag

SEQ ID NO: 1378062 - RNA, 19 nt, Homo sapiens
ucaauaaacgugguuaaga

SEQ ID NO: 1378063 - RNA, 19 nt, Homo sapiens
cagcuccgcucgugcuuuc

SEQ ID NO: 1378064 - RNA, 19 nt, Homo sapiens
auagagggcucccagaagu

SEQ ID NO: 1378065 - RNA, 19 nt, Homo sapiens
caucuacaccugaggacaa

SEQ ID NO: 1378066 - RNA, 19 nt, Homo sapiens
ucauagagggcucccagaa

SEQ ID NO: 1378067 - RNA, 19 nt, Homo sapiens
cauagagggcucccagaag

SEQ ID NO: 1378068 - RNA, 19 nt, Homo sapiens
gcaaagggcucuacuuaaa

SEQ ID NO: 1378069 - RNA, 19 nt, Homo sapiens
gcagaaggcugaggacuuu

SEQ ID NO: 1378070 - RNA, 19 nt, Homo sapiens
ggucagagcgcccucauuu

SEQ ID NO: 1378071 - RNA, 19 nt, Homo sapiens
gaccuucacucucgccuau

SEQ ID NO: 1378072 - RNA, 19 nt, Homo sapiens
uggcaaagggcucuacuua

SEQ ID NO: 1378073 - RNA, 19 nt, Homo sapiens
gcgagugccagcaguguua

SEQ ID NO: 1378074 - RNA, 19 nt, Homo sapiens
gcauacccacccucaguua

SEQ ID NO: 1378075 - RNA, 19 nt, Homo sapiens
gcuguugccuccucuguca

SEQ ID NO: 1378076 - RNA, 19 nt, Homo sapiens
ggcaaagggcucuacuuaa

SEQ ID NO: 1378077 - RNA, 19 nt, Homo sapiens
gagcauacccacccucagu

SEQ ID NO: 1378078 - RNA, 19 nt, Homo sapiens
uaaaagcaauccucaugaa

SEQ ID NO: 1378079 - RNA, 19 nt, Homo sapiens
gcugaggacuuuugguuaa

SEQ ID NO: 1378080 - RNA, 19 nt, Homo sapiens
ucagagcgcccucauuugu

SEQ ID NO: 1378081 - RNA, 19 nt, Homo sapiens
uuacuucucuggagcauac

SEQ ID NO: 1378082 - RNA, 19 nt, Homo sapiens
gcgugaagcuggugaagac

SEQ ID NO: 1378083 - RNA, 19 nt, Homo sapiens
ccauuugccuuacuucucu

SEQ ID NO: 1378084 - RNA, 19 nt, Homo sapiens
caaaccgauuguagccaaa

SEQ ID NO: 1378085 - RNA, 19 nt, Homo sapiens
aggccuagcuuugaacuga

SEQ ID NO: 1378086 - RNA, 19 nt, Homo sapiens
gagccaggccuagcuuuga

SEQ ID NO: 1378087 - RNA, 19 nt, Homo sapiens
acacgugggugaugaaggu

SEQ ID NO: 1378088 - RNA, 19 nt, Homo sapiens
ggagcuggaggccugcaua

SEQ ID NO: 1378089 - RNA, 19 nt, Homo sapiens
gacgugcaccugacuguga

SEQ ID NO: 1378090 - RNA, 19 nt, Homo sapiens
uauaaagacaaaccgauug

SEQ ID NO: 1378091 - RNA, 19 nt, Homo sapiens
ggauuugggaggcuuccua

SEQ ID NO: 1378092 - RNA, 19 nt, Homo sapiens
ggaaggccgaggucucaga

SEQ ID NO: 1378093 - RNA, 19 nt, Homo sapiens
caaagggcucuacuuaaag

SEQ ID NO: 1378094 - RNA, 19 nt, Homo sapiens
ggagccaggccuagcuuug

SEQ ID NO: 1378095 - RNA, 19 nt, Homo sapiens
cuacuuaaagcacaugaug

SEQ ID NO: 1378096 - RNA, 19 nt, Homo sapiens
acagacacgugggugauga

SEQ ID NO: 1378097 - RNA, 19 nt, Homo sapiens
ccuccucugucaacacuga

SEQ ID NO: 1378098 - RNA, 19 nt, Homo sapiens
gugcaggccuuugacaucu

SEQ ID NO: 1378099 - RNA, 19 nt, Homo sapiens
caugagcucucgccagacu

SEQ ID NO: 1378100 - RNA, 19 nt, Homo sapiens
gucgucaucugggccauuu

SEQ ID NO: 1378101 - RNA, 19 nt, Homo sapiens
gcagucgccccaugaauuu

SEQ ID NO: 1378102 - RNA, 19 nt, Homo sapiens
aaagggcucuacuuaaagc

SEQ ID NO: 1378103 - RNA, 19 nt, Homo sapiens
ccugcauccugaucuacua

SEQ ID NO: 1378104 - RNA, 19 nt, Homo sapiens
aaagugccauagcgacauc

SEQ ID NO: 1378105 - RNA, 19 nt, Homo sapiens
gcuacuacgugggcaugug

SEQ ID NO: 1378106 - RNA, 19 nt, Homo sapiens
gguuugaguugaggaccaa

SEQ ID NO: 1378107 - RNA, 19 nt, Homo sapiens
gggacuccaugcccuagag

SEQ ID NO: 1378108 - RNA, 19 nt, Homo sapiens
ccaggugcccgugugauug

SEQ ID NO: 1378109 - RNA, 19 nt, Homo sapiens
gcauccugaucuacuacug

SEQ ID NO: 1378110 - RNA, 19 nt, Homo sapiens
gagcuggaggccugcauag

SEQ ID NO: 1378111 - RNA, 19 nt, Homo sapiens
agccaggccuagcuuugaa

SEQ ID NO: 1378112 - RNA, 19 nt, Homo sapiens
aaagcaauccucaugaaaa

SEQ ID NO: 1378113 - RNA, 19 nt, Homo sapiens
cggagucucggcagcauga

SEQ ID NO: 1378114 - RNA, 19 nt, Homo sapiens
ucgccugcauccugaucua

SEQ ID NO: 1378115 - RNA, 19 nt, Homo sapiens
cuucgugcccuuccacuug

SEQ ID NO: 1378116 - RNA, 19 nt, Homo sapiens
gaacucaugucauuucuua

SEQ ID NO: 1378117 - RNA, 19 nt, Homo sapiens
gaagggcauuucugucuuu

SEQ ID NO: 1378118 - RNA, 19 nt, Homo sapiens
gaaccacucuuucuucaag

SEQ ID NO: 1378119 - RNA, 19 nt, Homo sapiens
aaaguugacugcugacuga

SEQ ID NO: 1378120 - RNA, 19 nt, Homo sapiens
ucacaucauucauggcaua

SEQ ID NO: 1378121 - RNA, 19 nt, Homo sapiens
ucagaccucucccucauaa

SEQ ID NO: 1378122 - RNA, 19 nt, Homo sapiens
ccuagaagcuuguuccaau

SEQ ID NO: 1378123 - RNA, 19 nt, Homo sapiens
caaguacagugucaagguu

SEQ ID NO: 1378124 - RNA, 19 nt, Homo sapiens
ugaaugagcuggcgauugc

SEQ ID NO: 1378125 - RNA, 19 nt, Homo sapiens
aguaggaacucaugucauu

SEQ ID NO: 1378126 - RNA, 19 nt, Homo sapiens
cgaccagccucauucuauu

SEQ ID NO: 1378127 - RNA, 19 nt, Homo sapiens
gaucucaucuguacacacu

SEQ ID NO: 1378128 - RNA, 19 nt, Homo sapiens
agcagaaucuccaggguua

SEQ ID NO: 1378129 - RNA, 19 nt, Homo sapiens
gaagcuuguuccaaugaga

SEQ ID NO: 1378130 - RNA, 19 nt, Homo sapiens
ucaauagcauccuucucua

SEQ ID NO: 1378131 - RNA, 19 nt, Homo sapiens
ccugggagcugaauuccaa

SEQ ID NO: 1378132 - RNA, 19 nt, Homo sapiens
cacaaucccuuuagcuuuc

SEQ ID NO: 1378133 - RNA, 19 nt, Homo sapiens
ucagaugccucagaugcua

SEQ ID NO: 1378134 - RNA, 19 nt, Homo sapiens
ucacaaucccuuuagcuuu

SEQ ID NO: 1378135 - RNA, 19 nt, Homo sapiens
gcucucagaugccucagau

SEQ ID NO: 1378136 - RNA, 19 nt, Homo sapiens
guugacugcugacugauug

SEQ ID NO: 1378137 - RNA, 19 nt, Homo sapiens
gcagcaaccucagcaugau

SEQ ID NO: 1378138 - RNA, 19 nt, Homo sapiens
ugaaggcccucgacuacau

SEQ ID NO: 1378139 - RNA, 19 nt, Homo sapiens
aaacaggaggucaugagua

SEQ ID NO: 1378140 - RNA, 19 nt, Homo sapiens
caauagcauccuucucuaa

SEQ ID NO: 1378141 - RNA, 19 nt, Homo sapiens
gcgaccagccucauucuau

SEQ ID NO: 1378142 - RNA, 19 nt, Homo sapiens
caacccggaugccagguau

SEQ ID NO: 1378143 - RNA, 19 nt, Homo sapiens
guuaugaugccaagucuga

SEQ ID NO: 1378144 - RNA, 19 nt, Homo sapiens
gaccagccucauucuauuu

SEQ ID NO: 1378145 - RNA, 19 nt, Homo sapiens
aggcauaaguggcaggauu

SEQ ID NO: 1378146 - RNA, 19 nt, Homo sapiens
gacccgaggcugaggcaua

SEQ ID NO: 1378147 - RNA, 19 nt, Homo sapiens
ccacccagaugcugcuaga

SEQ ID NO: 1378148 - RNA, 19 nt, Homo sapiens
gaugcgagcucagagucaa

SEQ ID NO: 1378149 - RNA, 19 nt, Homo sapiens
gugugugccucauuccuuu

SEQ ID NO: 1378150 - RNA, 19 nt, Homo sapiens
cuauuuaacuuugcucuca

SEQ ID NO: 1378151 - RNA, 19 nt, Homo sapiens
ggucggggcugcuugcuaa

SEQ ID NO: 1378152 - RNA, 19 nt, Homo sapiens
gaaucuagcaagguacaaa

SEQ ID NO: 1378153 - RNA, 19 nt, Homo sapiens
uagcauccuucucuaaaca

SEQ ID NO: 1378154 - RNA, 19 nt, Homo sapiens
cagcugcccuggugcuuuc

SEQ ID NO: 1378155 - RNA, 19 nt, Homo sapiens
uggaaucuuuggccuggua

SEQ ID NO: 1378156 - RNA, 19 nt, Homo sapiens
ccugaugacugugaaucua

SEQ ID NO: 1378157 - RNA, 19 nt, Homo sapiens
cuugagggcuuaaguccuu

SEQ ID NO: 1378158 - RNA, 19 nt, Homo sapiens
ccucauaauuccagagaag

SEQ ID NO: 1378159 - RNA, 19 nt, Homo sapiens
agaccucucccucauaauu

SEQ ID NO: 1378160 - RNA, 19 nt, Homo sapiens
cagaggcuuugcccgaauu

SEQ ID NO: 1378161 - RNA, 19 nt, Homo sapiens
ccaggaacagguuuaaguu

SEQ ID NO: 1378162 - RNA, 19 nt, Homo sapiens
ugugauaggcaaaggauuu

SEQ ID NO: 1378163 - RNA, 19 nt, Homo sapiens
gaacaguccauccuuaucc

SEQ ID NO: 1378164 - RNA, 19 nt, Homo sapiens
gacauucccaguccuguga

SEQ ID NO: 1378165 - RNA, 19 nt, Homo sapiens
ggcauaaguggcaggauuu

SEQ ID NO: 1378166 - RNA, 19 nt, Homo sapiens
cuagaagcuuguuccaaug

SEQ ID NO: 1378167 - RNA, 19 nt, Homo sapiens
aacaggaggucaugaguag

SEQ ID NO: 1378168 - RNA, 19 nt, Homo sapiens
caggaacagguuuaaguuu

SEQ ID NO: 1378169 - RNA, 19 nt, Homo sapiens
gaucagcuccugggugugu

SEQ ID NO: 1378170 - RNA, 19 nt, Homo sapiens
uugaggaccugaugacugu

SEQ ID NO: 1378171 - RNA, 19 nt, Homo sapiens
ccucagaccucucccucau

SEQ ID NO: 1378172 - RNA, 19 nt, Homo sapiens
agugaaagggcaaguagua

SEQ ID NO: 1378173 - RNA, 19 nt, Homo sapiens
gugacuguacggaggauua

SEQ ID NO: 1378174 - RNA, 19 nt, Homo sapiens
ggucaugaguagcuuucug

SEQ ID NO: 1378175 - RNA, 19 nt, Homo sapiens
ugacugauugggaaagaaa

SEQ ID NO: 1378176 - RNA, 19 nt, Homo sapiens
gcugaggagcugaccauga

SEQ ID NO: 1378177 - RNA, 19 nt, Homo sapiens
cgagcugcaugucuccaaa

SEQ ID NO: 1378178 - RNA, 19 nt, Homo sapiens
ggaacaguccauccuuauc

SEQ ID NO: 1378179 - RNA, 19 nt, Homo sapiens
gagcucagagucaauagca

SEQ ID NO: 1378180 - RNA, 19 nt, Homo sapiens
ccagccucauucuauuuaa

SEQ ID NO: 1378181 - RNA, 19 nt, Homo sapiens
caacucacaaucccuuuag

SEQ ID NO: 1378182 - RNA, 19 nt, Homo sapiens
caacggccauguccccuuu

SEQ ID NO: 1378183 - RNA, 19 nt, Homo sapiens
agucugacaucuacagugu

SEQ ID NO: 1378184 - RNA, 19 nt, Homo sapiens
gcugaaggcccucgacuac

SEQ ID NO: 1378185 - RNA, 19 nt, Homo sapiens
gcaugucuccaaacucuuc

SEQ ID NO: 1378186 - RNA, 19 nt, Homo sapiens
gaaagggcaaguaguaagc

SEQ ID NO: 1378187 - RNA, 19 nt, Homo sapiens
aauagcauccuucucuaaa

SEQ ID NO: 1378188 - RNA, 19 nt, Homo sapiens
aagggaaucucaacaacca

SEQ ID NO: 1378189 - RNA, 19 nt, Homo sapiens
gguggacgauugggaguuc

SEQ ID NO: 1378190 - RNA, 19 nt, Homo sapiens
gcaacccggaugccaggua

SEQ ID NO: 1378191 - RNA, 19 nt, Homo sapiens
cugaggagcugaccaugag

SEQ ID NO: 1378192 - RNA, 19 nt, Homo sapiens
cccagaugcugcuagagaa

SEQ ID NO: 1378193 - RNA, 19 nt, Homo sapiens
cugcaugucuccaaacucu

SEQ ID NO: 1378194 - RNA, 19 nt, Homo sapiens
cugugaaucuagcaaggua

SEQ ID NO: 1378195 - RNA, 19 nt, Homo sapiens
gugaaagggcaaguaguaa

SEQ ID NO: 1378196 - RNA, 19 nt, Homo sapiens
gcugacugauugggaaaga

SEQ ID NO: 1378197 - RNA, 19 nt, Homo sapiens
guucugagccucugcaaac

SEQ ID NO: 1378198 - RNA, 19 nt, Homo sapiens
gucaauagcauccuucucu

SEQ ID NO: 1378199 - RNA, 19 nt, Homo sapiens
cagcaaccucagcaugaua

SEQ ID NO: 1378200 - RNA, 19 nt, Homo sapiens
cuagcaagguacaaaccaa

SEQ ID NO: 1378201 - RNA, 19 nt, Homo sapiens
cuugggcccugacaccuaa

SEQ ID NO: 1378202 - RNA, 19 nt, Homo sapiens
gaauugcuucguccuguca

SEQ ID NO: 1378203 - RNA, 19 nt, Homo sapiens
ucucaucuguacacacuuc

SEQ ID NO: 1378204 - RNA, 19 nt, Homo sapiens
cagagucaauagcauccuu

SEQ ID NO: 1378205 - RNA, 19 nt, Homo sapiens
cccaggguuuggcuccuua

SEQ ID NO: 1378206 - RNA, 19 nt, Homo sapiens
ccaaugaugcgagcucaga

SEQ ID NO: 1378207 - RNA, 19 nt, Homo sapiens
acacugcuccuuccucuca

SEQ ID NO: 1378208 - RNA, 19 nt, Homo sapiens
uagaagcuuguuccaauga

SEQ ID NO: 1378209 - RNA, 19 nt, Homo sapiens
ugccaagucugacaucuac

SEQ ID NO: 1378210 - RNA, 19 nt, Homo sapiens
ugucaaagccagccacauc

SEQ ID NO: 1378211 - RNA, 19 nt, Homo sapiens
cuucaaccaucccaauauc

SEQ ID NO: 1378212 - RNA, 19 nt, Homo sapiens
ucuccaaacucuucaacca

SEQ ID NO: 1378213 - RNA, 19 nt, Homo sapiens
guaggaacucaugucauuu

SEQ ID NO: 1378214 - RNA, 19 nt, Homo sapiens
acaagggaaucucaacaac

SEQ ID NO: 1378215 - RNA, 19 nt, Homo sapiens
acaacucacaaucccuuua

SEQ ID NO: 1378216 - RNA, 19 nt, Homo sapiens
gaacauaagucaauggaaa

SEQ ID NO: 1378217 - RNA, 19 nt, Homo sapiens
gcaccagacuuuccuuaga

SEQ ID NO: 1378218 - RNA, 19 nt, Homo sapiens
aggaugaccuuucaguuua

SEQ ID NO: 1378219 - RNA, 19 nt, Homo sapiens
gaggaugaccuuucaguuu

SEQ ID NO: 1378220 - RNA, 19 nt, Homo sapiens
gagaagagagggacagaaa

SEQ ID NO: 1378221 - RNA, 19 nt, Homo sapiens
ggaugaccuuucaguuuaa

SEQ ID NO: 1378222 - RNA, 19 nt, Homo sapiens
caacccagauuauuauagu

SEQ ID NO: 1378223 - RNA, 19 nt, Homo sapiens
aaccuuaccuaauguagua

SEQ ID NO: 1378224 - RNA, 19 nt, Homo sapiens
guaauuugcaccagacuuu

SEQ ID NO: 1378225 - RNA, 19 nt, Homo sapiens
uaaaugagccagaugugaa

SEQ ID NO: 1378226 - RNA, 19 nt, Homo sapiens
cauuagagauggagcuuug

SEQ ID NO: 1378227 - RNA, 19 nt, Homo sapiens
guucaucucuuucagaagu

SEQ ID NO: 1378228 - RNA, 19 nt, Homo sapiens
ggaucagguuuacuaggua

SEQ ID NO: 1378229 - RNA, 19 nt, Homo sapiens
uguauaagcugcuaaagag

SEQ ID NO: 1378230 - RNA, 19 nt, Homo sapiens
ucagaaguuuguagaagaa

SEQ ID NO: 1378231 - RNA, 19 nt, Homo sapiens
ccuuugaccuccuggcuua

SEQ ID NO: 1378232 - RNA, 19 nt, Homo sapiens
cauguuaaguuaucaguag

SEQ ID NO: 1378233 - RNA, 19 nt, Homo sapiens
guagcuaacuccacuuugg

SEQ ID NO: 1378234 - RNA, 19 nt, Homo sapiens
gaucagguuuacuagguau

SEQ ID NO: 1378235 - RNA, 19 nt, Homo sapiens
gaucacuugugggaacaua

SEQ ID NO: 1378236 - RNA, 19 nt, Homo sapiens
caagggaggguccaaagaa

SEQ ID NO: 1378237 - RNA, 19 nt, Homo sapiens
gaacuuggagccacaugga

SEQ ID NO: 1378238 - RNA, 19 nt, Homo sapiens
auagaaacauuaccagguu

SEQ ID NO: 1378239 - RNA, 19 nt, Homo sapiens
ugaauuaacacccauuaga

SEQ ID NO: 1378240 - RNA, 19 nt, Homo sapiens
gaauaauugaggcagauuu

SEQ ID NO: 1378241 - RNA, 19 nt, Homo sapiens
ccauuuacaacccagauua

SEQ ID NO: 1378242 - RNA, 19 nt, Homo sapiens
gcagcucccucucaagaca

SEQ ID NO: 1378243 - RNA, 19 nt, Homo sapiens
gauuacagguguuuaugag

SEQ ID NO: 1378244 - RNA, 19 nt, Homo sapiens
gaacuucccuggagaaaac

SEQ ID NO: 1378245 - RNA, 19 nt, Homo sapiens
uauggugauugaugaagua

SEQ ID NO: 1378246 - RNA, 19 nt, Homo sapiens
gaauuaacacccauuagag

SEQ ID NO: 1378247 - RNA, 19 nt, Homo sapiens
gaaguuuguagaagaaaga

SEQ ID NO: 1378248 - RNA, 19 nt, Homo sapiens
cagcaaagcacauuauuuu

SEQ ID NO: 1378249 - RNA, 19 nt, Homo sapiens
gggaggguccaaagaaauu

SEQ ID NO: 1378250 - RNA, 19 nt, Homo sapiens
guaaaugagccagauguga

SEQ ID NO: 1378251 - RNA, 19 nt, Homo sapiens
uaccuaauguaguagcuaa

SEQ ID NO: 1378252 - RNA, 19 nt, Homo sapiens
acaguauggugauugauga

SEQ ID NO: 1378253 - RNA, 19 nt, Homo sapiens
uauagaagaccaucuggaa

SEQ ID NO: 1378254 - RNA, 19 nt, Homo sapiens
cacaaaggccaaagugaaa

SEQ ID NO: 1378255 - RNA, 19 nt, Homo sapiens
auaagaggaugaccuuuca

SEQ ID NO: 1378256 - RNA, 19 nt, Homo sapiens
ccagcaaagcacauuauuu

SEQ ID NO: 1378257 - RNA, 19 nt, Homo sapiens
gacuuuccuuagacuguua

SEQ ID NO: 1378258 - RNA, 19 nt, Homo sapiens
caaaggccaaagugaaauu

SEQ ID NO: 1378259 - RNA, 19 nt, Homo sapiens
cuugagagcugccaaagag

SEQ ID NO: 1378260 - RNA, 19 nt, Homo sapiens
ccucagaaaccauuuacaa

SEQ ID NO: 1378261 - RNA, 19 nt, Homo sapiens
uuuccagcauguuaaguua

SEQ ID NO: 1378262 - RNA, 19 nt, Homo sapiens
ugaggcagauuugugugua

SEQ ID NO: 1378263 - RNA, 19 nt, Homo sapiens
guguucaucucuuucagaa

SEQ ID NO: 1378264 - RNA, 19 nt, Homo sapiens
ccagguuuccagcauguua

SEQ ID NO: 1378265 - RNA, 19 nt, Homo sapiens
aagggaggguccaaagaaa

SEQ ID NO: 1378266 - RNA, 19 nt, Homo sapiens
guuaaguuaucaguaguga

SEQ ID NO: 1378267 - RNA, 19 nt, Homo sapiens
guagaagaaagagauguuu

SEQ ID NO: 1378268 - RNA, 19 nt, Homo sapiens
gaggcagauuuguguguau

SEQ ID NO: 1378269 - RNA, 19 nt, Homo sapiens
ccuccuggcuuauuucaca

SEQ ID NO: 1378270 - RNA, 19 nt, Homo sapiens
gcagccagcaguucaagga

SEQ ID NO: 1378271 - RNA, 19 nt, Homo sapiens
aaaugcagcucccucucaa

SEQ ID NO: 1378272 - RNA, 19 nt, Homo sapiens
gauugaugaaguaaccuua

SEQ ID NO: 1378273 - RNA, 19 nt, Homo sapiens
gaucugauuacagguguuu

SEQ ID NO: 1378274 - RNA, 19 nt, Homo sapiens
gaaguugaagaaucugaau

SEQ ID NO: 1378275 - RNA, 19 nt, Homo sapiens
auaacaguauggugauuga

SEQ ID NO: 1378276 - RNA, 19 nt, Homo sapiens
uauaagcugcuaaagagaa

SEQ ID NO: 1378277 - RNA, 19 nt, Homo sapiens
gaaaacagcccuccuugag

SEQ ID NO: 1378278 - RNA, 19 nt, Homo sapiens
gaggaccaaagacgucuaa

SEQ ID NO: 1378279 - RNA, 19 nt, Homo sapiens
auaagcugcuaaagagaaa

SEQ ID NO: 1378280 - RNA, 19 nt, Homo sapiens
ugaaaaccaucuuguugaa

SEQ ID NO: 1378281 - RNA, 19 nt, Homo sapiens
gaagagagggacagaaaau

SEQ ID NO: 1378282 - RNA, 19 nt, Homo sapiens
gagcuuugacccuggauuc

SEQ ID NO: 1378283 - RNA, 19 nt, Homo sapiens
uggagguguucaucucuuu

SEQ ID NO: 1378284 - RNA, 19 nt, Homo sapiens
guauggugauugaugaagu

SEQ ID NO: 1378285 - RNA, 19 nt, Homo sapiens
gaccagaauacucaaaaua

SEQ ID NO: 1378286 - RNA, 19 nt, Homo sapiens
uuuguaagcuuguacuaag

SEQ ID NO: 1378287 - RNA, 19 nt, Homo sapiens
gcauguuaaguuaucagua

SEQ ID NO: 1378288 - RNA, 19 nt, Homo sapiens
agauuuguguguaucauca

SEQ ID NO: 1378289 - RNA, 19 nt, Homo sapiens
uggaucagguuuacuaggu

SEQ ID NO: 1378290 - RNA, 19 nt, Homo sapiens
agugaaauuugcugggaaa

SEQ ID NO: 1378291 - RNA, 19 nt, Homo sapiens
gcagauuuguguguaucau

SEQ ID NO: 1378292 - RNA, 19 nt, Homo sapiens
gcauuuaauaagaggauga

SEQ ID NO: 1378293 - RNA, 19 nt, Homo sapiens
uuaauaagaggaugaccuu

SEQ ID NO: 1378294 - RNA, 19 nt, Homo sapiens
agguauaacugcauucaag

SEQ ID NO: 1378295 - RNA, 19 nt, Homo sapiens
gaugaccuuucaguuuaau

SEQ ID NO: 1378296 - RNA, 19 nt, Homo sapiens
gagaacuucccuggagaaa

SEQ ID NO: 1378297 - RNA, 19 nt, Homo sapiens
aauaagaggaugaccuuuc

SEQ ID NO: 1378298 - RNA, 19 nt, Homo sapiens
aaagaugcaggaaaccaaa

SEQ ID NO: 1378299 - RNA, 19 nt, Homo sapiens
ccccagagcugcuuggaaa

SEQ ID NO: 1378300 - RNA, 19 nt, Homo sapiens
caugcuaugccuaaagauu

SEQ ID NO: 1378301 - RNA, 19 nt, Homo sapiens
uccagaaguugaagaaucu

SEQ ID NO: 1378302 - RNA, 19 nt, Homo sapiens
uucagaaguuuguagaaga

SEQ ID NO: 1378303 - RNA, 19 nt, Homo sapiens
ucaccucagaaaccauuua

SEQ ID NO: 1378304 - RNA, 19 nt, Homo sapiens
gggaacauaagucaaugga

SEQ ID NO: 1378305 - RNA, 19 nt, Homo sapiens
uuuaagaccagaauacuca

SEQ ID NO: 1378306 - RNA, 19 nt, Homo sapiens
aaaugagccagaugugaaa

SEQ ID NO: 1378307 - RNA, 19 nt, Homo sapiens
ggaccaaagacgucuaaaa

SEQ ID NO: 1378308 - RNA, 19 nt, Homo sapiens
ggaacauaagucaauggaa

SEQ ID NO: 1378309 - RNA, 19 nt, Homo sapiens
gagcugucagucucagaaa

SEQ ID NO: 1378310 - RNA, 19 nt, Homo sapiens
guggagguguucaucucuu

SEQ ID NO: 1378311 - RNA, 19 nt, Homo sapiens
caccagacuuuccuuagac

SEQ ID NO: 1378312 - RNA, 19 nt, Homo sapiens
uaauugaggcagauuugug

SEQ ID NO: 1378313 - RNA, 19 nt, Homo sapiens
ggaaaacagcccuccuuga

SEQ ID NO: 1378314 - RNA, 19 nt, Homo sapiens
ccagagcugcuuggaaaga

SEQ ID NO: 1378315 - RNA, 19 nt, Homo sapiens
agacuuuccuuagacuguu

SEQ ID NO: 1378316 - RNA, 19 nt, Homo sapiens
gaacagaaagugucaagaa

SEQ ID NO: 1378317 - RNA, 19 nt, Homo sapiens
gcagagaccaugaaacuaa

SEQ ID NO: 1378318 - RNA, 19 nt, Homo sapiens
gauacucaauaccuaguua

SEQ ID NO: 1378319 - RNA, 19 nt, Homo sapiens
ggaggagagugugacauua

SEQ ID NO: 1378320 - RNA, 19 nt, Homo sapiens
gcagaaagauccaaaagaa

SEQ ID NO: 1378321 - RNA, 19 nt, Homo sapiens
caaaggaacugggacuuga

SEQ ID NO: 1378322 - RNA, 19 nt, Homo sapiens
cagcaaagcuagauauaca

SEQ ID NO: 1378323 - RNA, 19 nt, Homo sapiens
gaaacacacacacuuauau

SEQ ID NO: 1378324 - RNA, 19 nt, Homo sapiens
gaacaccuuuguacgauca

SEQ ID NO: 1378325 - RNA, 19 nt, Homo sapiens
ggauauuacuagaguugua

SEQ ID NO: 1378326 - RNA, 19 nt, Homo sapiens
cuacaugguuggaguguuu

SEQ ID NO: 1378327 - RNA, 19 nt, Homo sapiens
gacuaaagauccauuugaa

SEQ ID NO: 1378328 - RNA, 19 nt, Homo sapiens
gaaacuggaauuuauguga

SEQ ID NO: 1378329 - RNA, 19 nt, Homo sapiens
ggaucaaccucauuacuuc

SEQ ID NO: 1378330 - RNA, 19 nt, Homo sapiens
gaauuacccugucaugaag

SEQ ID NO: 1378331 - RNA, 19 nt, Homo sapiens
ugaagaaccaaacaacuua

SEQ ID NO: 1378332 - RNA, 19 nt, Homo sapiens
gaauuuaugugaagaacca

SEQ ID NO: 1378333 - RNA, 19 nt, Homo sapiens
gcaacucacugaacaccuu

SEQ ID NO: 1378334 - RNA, 19 nt, Homo sapiens
gaagaaaagucgacaacaa

SEQ ID NO: 1378335 - RNA, 19 nt, Homo sapiens
gaacugggacuugagaauu

SEQ ID NO: 1378336 - RNA, 19 nt, Homo sapiens
aaagguagaugaccagugu

SEQ ID NO: 1378337 - RNA, 19 nt, Homo sapiens
aaagccagauugcaaauug

SEQ ID NO: 1378338 - RNA, 19 nt, Homo sapiens
cagaaagugucaagaacaa

SEQ ID NO: 1378339 - RNA, 19 nt, Homo sapiens
agaaggaguugcaggcuuu

SEQ ID NO: 1378340 - RNA, 19 nt, Homo sapiens
aaaguggaauugcaagaaa

SEQ ID NO: 1378341 - RNA, 19 nt, Homo sapiens
gaaaguggaauugcaagaa

SEQ ID NO: 1378342 - RNA, 19 nt, Homo sapiens
gggaaguccuccaacaaga

SEQ ID NO: 1378343 - RNA, 19 nt, Homo sapiens
ugaauuacccugucaugaa

SEQ ID NO: 1378344 - RNA, 19 nt, Homo sapiens
gaagaaccaaacaacuuaa

SEQ ID NO: 1378345 - RNA, 19 nt, Homo sapiens
uaaagcggauccagaagga

SEQ ID NO: 1378346 - RNA, 19 nt, Homo sapiens
ggcuaaagcuauugcagaa

SEQ ID NO: 1378347 - RNA, 19 nt, Homo sapiens
ucaugaagcguuuaaauug

SEQ ID NO: 1378348 - RNA, 19 nt, Homo sapiens
gacuaaagcagacuaaaga

SEQ ID NO: 1378349 - RNA, 19 nt, Homo sapiens
aaacacaacuuggaaacug

SEQ ID NO: 1378350 - RNA, 19 nt, Homo sapiens
aaaguugcagguugaauua

SEQ ID NO: 1378351 - RNA, 19 nt, Homo sapiens
gagugugacauuagaauuu

SEQ ID NO: 1378352 - RNA, 19 nt, Homo sapiens
caacaagaacaacggcuaa

SEQ ID NO: 1378353 - RNA, 19 nt, Homo sapiens
ugaaacacacacacuuaua

SEQ ID NO: 1378354 - RNA, 19 nt, Homo sapiens
gaacugaggagacuaaagc

SEQ ID NO: 1378355 - RNA, 19 nt, Homo sapiens
gaugaccaguguggaaauu

SEQ ID NO: 1378356 - RNA, 19 nt, Homo sapiens
cagagaccaugaaacuaaa

SEQ ID NO: 1378357 - RNA, 19 nt, Homo sapiens
caagauggaucaaccucau

SEQ ID NO: 1378358 - RNA, 19 nt, Homo sapiens
caugaagcguuuaaauugu

SEQ ID NO: 1378359 - RNA, 19 nt, Homo sapiens
cuuggaaacuggaauuuau

SEQ ID NO: 1378360 - RNA, 19 nt, Homo sapiens
cacaugaaguucugguauu

SEQ ID NO: 1378361 - RNA, 19 nt, Homo sapiens
ggaaguccuccaacaagaa

SEQ ID NO: 1378362 - RNA, 19 nt, Homo sapiens
ucaauuugccuuccaguga

SEQ ID NO: 1378363 - RNA, 19 nt, Homo sapiens
cuaaagcuauugcagaaag

SEQ ID NO: 1378364 - RNA, 19 nt, Homo sapiens
gaggaacugaggagacuaa

SEQ ID NO: 1378365 - RNA, 19 nt, Homo sapiens
gugaagaaccaaacaacuu

SEQ ID NO: 1378366 - RNA, 19 nt, Homo sapiens
caacuuggaaacuggaauu

SEQ ID NO: 1378367 - RNA, 19 nt, Homo sapiens
gcccugaccuccaauaaaa

SEQ ID NO: 1378368 - RNA, 19 nt, Homo sapiens
gcaacaacuagauguagaa

SEQ ID NO: 1378369 - RNA, 19 nt, Homo sapiens
acacuggaauucucaggaa

SEQ ID NO: 1378370 - RNA, 19 nt, Homo sapiens
guuuguuaauugccuguua

SEQ ID NO: 1378371 - RNA, 19 nt, Homo sapiens
gcccaaaucaagaagguaa

SEQ ID NO: 1378372 - RNA, 19 nt, Homo sapiens
uacuaguacuugaccaaua

SEQ ID NO: 1378373 - RNA, 19 nt, Homo sapiens
gucaugaagcguuuaaauu

SEQ ID NO: 1378374 - RNA, 19 nt, Homo sapiens
caacaacuucagcgagaaa

SEQ ID NO: 1378375 - RNA, 19 nt, Homo sapiens
gcgcaagacugagauaaaa

SEQ ID NO: 1378376 - RNA, 19 nt, Homo sapiens
caauuugccuuccagugau

SEQ ID NO: 1378377 - RNA, 19 nt, Homo sapiens
guagaugaccaguguggaa

SEQ ID NO: 1378378 - RNA, 19 nt, Homo sapiens
ggaggucgagggauugcua

SEQ ID NO: 1378379 - RNA, 19 nt, Homo sapiens
guuaauugccuguuacuag

SEQ ID NO: 1378380 - RNA, 19 nt, Homo sapiens
guuaaacucauuucacuuc

SEQ ID NO: 1378381 - RNA, 19 nt, Homo sapiens
ugaagagacuuuggagcuu

SEQ ID NO: 1378382 - RNA, 19 nt, Homo sapiens
uaaagcuauugcagaaaga

SEQ ID NO: 1378383 - RNA, 19 nt, Homo sapiens
caagaacaacggcuaaugg

SEQ ID NO: 1378384 - RNA, 19 nt, Homo sapiens
acagagaguuaacguucaa

SEQ ID NO: 1378385 - RNA, 19 nt, Homo sapiens
uuaauugccuguuacuagu

SEQ ID NO: 1378386 - RNA, 19 nt, Homo sapiens
agacuaaagauccauuuga

SEQ ID NO: 1378387 - RNA, 19 nt, Homo sapiens
cagguugaauuaucuaucu

SEQ ID NO: 1378388 - RNA, 19 nt, Homo sapiens
ggaaaaugauacucaauac

SEQ ID NO: 1378389 - RNA, 19 nt, Homo sapiens
gaugcaacaacuagaugua

SEQ ID NO: 1378390 - RNA, 19 nt, Homo sapiens
uaaaagagcaacucacuga

SEQ ID NO: 1378391 - RNA, 19 nt, Homo sapiens
gcagacuaaagauccauuu

SEQ ID NO: 1378392 - RNA, 19 nt, Homo sapiens
caaacugcccaaaucaaga

SEQ ID NO: 1378393 - RNA, 19 nt, Homo sapiens
gaggagagugugacauuag

SEQ ID NO: 1378394 - RNA, 19 nt, Homo sapiens
gcauugaaagucagccaaa

SEQ ID NO: 1378395 - RNA, 19 nt, Homo sapiens
gcaccaaaacagagaguua

SEQ ID NO: 1378396 - RNA, 19 nt, Homo sapiens
gaaguuggaggaguugaug

SEQ ID NO: 1378397 - RNA, 19 nt, Homo sapiens
aagagcaacucacugaaca

SEQ ID NO: 1378398 - RNA, 19 nt, Homo sapiens
gaacucaggcagagaccau

SEQ ID NO: 1378399 - RNA, 19 nt, Homo sapiens
cagcaucacuuuugucuuc

SEQ ID NO: 1378400 - RNA, 19 nt, Homo sapiens
agauggaucaaccucauua

SEQ ID NO: 1378401 - RNA, 19 nt, Homo sapiens
ggagacuaaagcagacuaa

SEQ ID NO: 1378402 - RNA, 19 nt, Homo sapiens
gaaggaguugcaggcuuua

SEQ ID NO: 1378403 - RNA, 19 nt, Homo sapiens
ggaacugggacuugagaau

SEQ ID NO: 1378404 - RNA, 19 nt, Homo sapiens
ccugggagacguauuaaga

SEQ ID NO: 1378405 - RNA, 19 nt, Homo sapiens
ggacaaccacagggcauug

SEQ ID NO: 1378406 - RNA, 19 nt, Homo sapiens
ccacaugaaguucugguau

SEQ ID NO: 1378407 - RNA, 19 nt, Homo sapiens
aaacugcccaaaucaagaa

SEQ ID NO: 1378408 - RNA, 19 nt, Homo sapiens
aaagaaaguggaauugcaa

SEQ ID NO: 1378409 - RNA, 19 nt, Homo sapiens
auuaauagguuuggccauu

SEQ ID NO: 1378410 - RNA, 19 nt, Homo sapiens
cuaaagagaacagaaagug

SEQ ID NO: 1378411 - RNA, 19 nt, Homo sapiens
caaccugcguuuuguuauu

SEQ ID NO: 1378412 - RNA, 19 nt, Homo sapiens
guauguuucaccuugauuu

SEQ ID NO: 1378413 - RNA, 19 nt, Homo sapiens
caaaucaagaagguaauga

SEQ ID NO: 1378414 - RNA, 19 nt, Homo sapiens
cacagggcauugaaaguca

SEQ ID NO: 1378415 - RNA, 19 nt, Homo sapiens
aguccaaacugcccaaauc

SEQ ID NO: 1378416 - RNA, 19 nt, Homo sapiens
gggaugguuucaaguauua

SEQ ID NO: 1378417 - RNA, 19 nt, Homo sapiens
gaagaacucacuauuauuc

SEQ ID NO: 1378418 - RNA, 19 nt, Homo sapiens
agauggagaugaugauuua

SEQ ID NO: 1378419 - RNA, 19 nt, Homo sapiens
gggagaacauuaaauuaug

SEQ ID NO: 1378420 - RNA, 19 nt, Homo sapiens
ccagagaaauguggacuuu

SEQ ID NO: 1378421 - RNA, 19 nt, Homo sapiens
ucaggagacuucaggauuu

SEQ ID NO: 1378422 - RNA, 19 nt, Homo sapiens
gaugaugauuuacaaguug

SEQ ID NO: 1378423 - RNA, 19 nt, Homo sapiens
cagaucacauugagaguaa

SEQ ID NO: 1378424 - RNA, 19 nt, Homo sapiens
gccugaagauauugaguua

SEQ ID NO: 1378425 - RNA, 19 nt, Homo sapiens
guugaagaacucacuauua

SEQ ID NO: 1378426 - RNA, 19 nt, Homo sapiens
uuaaugaacugccuucugu

SEQ ID NO: 1378427 - RNA, 19 nt, Homo sapiens
gaaaaugucagcucaaauu

SEQ ID NO: 1378428 - RNA, 19 nt, Homo sapiens
gaaacagauucagauaguu

SEQ ID NO: 1378429 - RNA, 19 nt, Homo sapiens
gcuggaaacucugaaauuc

SEQ ID NO: 1378430 - RNA, 19 nt, Homo sapiens
cagaacauaugguaucuca

SEQ ID NO: 1378431 - RNA, 19 nt, Homo sapiens
uaacucagaacauauggua

SEQ ID NO: 1378432 - RNA, 19 nt, Homo sapiens
aaacauggcugcucaucca

SEQ ID NO: 1378433 - RNA, 19 nt, Homo sapiens
caccagaggccuuagauuu

SEQ ID NO: 1378434 - RNA, 19 nt, Homo sapiens
uaaaugauuccuucuguug

SEQ ID NO: 1378435 - RNA, 19 nt, Homo sapiens
acaagcagcaggaaagaua

SEQ ID NO: 1378436 - RNA, 19 nt, Homo sapiens
gcucauccauuacuuaacu

SEQ ID NO: 1378437 - RNA, 19 nt, Homo sapiens
caccucagcauuucuauaa

SEQ ID NO: 1378438 - RNA, 19 nt, Homo sapiens
gaucagaugcaucauggaa

SEQ ID NO: 1378439 - RNA, 19 nt, Homo sapiens
ucagaugcaucauggaaga

SEQ ID NO: 1378440 - RNA, 19 nt, Homo sapiens
cgagauauuuggaccuguu

SEQ ID NO: 1378441 - RNA, 19 nt, Homo sapiens
ugaacugccuucuguugaa

SEQ ID NO: 1378442 - RNA, 19 nt, Homo sapiens
gcaaaaggauaucguaaca

SEQ ID NO: 1378443 - RNA, 19 nt, Homo sapiens
aaugauuccuucuguugua

SEQ ID NO: 1378444 - RNA, 19 nt, Homo sapiens
caggaaagauauucgagau

SEQ ID NO: 1378445 - RNA, 19 nt, Homo sapiens
gcucauagcucugcuucag

SEQ ID NO: 1378446 - RNA, 19 nt, Homo sapiens
gaagaaugaucaggaacca

SEQ ID NO: 1378447 - RNA, 19 nt, Homo sapiens
gauaagggaucagaugcau

SEQ ID NO: 1378448 - RNA, 19 nt, Homo sapiens
ucagauaguucaaguucau

SEQ ID NO: 1378449 - RNA, 19 nt, Homo sapiens
gggcagaccguggagguua

SEQ ID NO: 1378450 - RNA, 19 nt, Homo sapiens
uaaugagccuggugaagau

SEQ ID NO: 1378451 - RNA, 19 nt, Homo sapiens
ccagaggccuuagauuuua

SEQ ID NO: 1378452 - RNA, 19 nt, Homo sapiens
cuccaucaaugaaagauuu

SEQ ID NO: 1378453 - RNA, 19 nt, Homo sapiens
aaugucagcucaaauucuu

SEQ ID NO: 1378454 - RNA, 19 nt, Homo sapiens
cuaaaugauuccuucuguu

SEQ ID NO: 1378455 - RNA, 19 nt, Homo sapiens
gacuaugcauuuccagaga

SEQ ID NO: 1378456 - RNA, 19 nt, Homo sapiens
agaauucacacgaggauuu

SEQ ID NO: 1378457 - RNA, 19 nt, Homo sapiens
gcgguugccuaaguuguuu

SEQ ID NO: 1378458 - RNA, 19 nt, Homo sapiens
uaagggaucagaugcauca

SEQ ID NO: 1378459 - RNA, 19 nt, Homo sapiens
ggcagaccguggagguuaa

SEQ ID NO: 1378460 - RNA, 19 nt, Homo sapiens
gagaaggaagccaaacaga

SEQ ID NO: 1378461 - RNA, 19 nt, Homo sapiens
gcugucagauggagaugau

SEQ ID NO: 1378462 - RNA, 19 nt, Homo sapiens
gagaugaugauuuacaagu

SEQ ID NO: 1378463 - RNA, 19 nt, Homo sapiens
aaaaggauaucguaacaga

SEQ ID NO: 1378464 - RNA, 19 nt, Homo sapiens
ugaaguacaucagaauugg

SEQ ID NO: 1378465 - RNA, 19 nt, Homo sapiens
gaauuggaaugcucauagc

SEQ ID NO: 1378466 - RNA, 19 nt, Homo sapiens
ccgcucagcuggaaacucu

SEQ ID NO: 1378467 - RNA, 19 nt, Homo sapiens
aaacagauucagauaguuc

SEQ ID NO: 1378468 - RNA, 19 nt, Homo sapiens
aaacauggguugggcuaca

SEQ ID NO: 1378469 - RNA, 19 nt, Homo sapiens
uuaaugagccuggugaaga

SEQ ID NO: 1378470 - RNA, 19 nt, Homo sapiens
uggagaugaugauuuacaa

SEQ ID NO: 1378471 - RNA, 19 nt, Homo sapiens
cagauggagaugaugauuu

SEQ ID NO: 1378472 - RNA, 19 nt, Homo sapiens
gcguguaguuaccugagaa

SEQ ID NO: 1378473 - RNA, 19 nt, Homo sapiens
acuaaaugauuccuucugu

SEQ ID NO: 1378474 - RNA, 19 nt, Homo sapiens
guacaucagaauuggaaug

SEQ ID NO: 1378475 - RNA, 19 nt, Homo sapiens
ugggaugguuucaaguauu

SEQ ID NO: 1378476 - RNA, 19 nt, Homo sapiens
uauucugccugaagauauu

SEQ ID NO: 1378477 - RNA, 19 nt, Homo sapiens
ggacucggacagugaaaca

SEQ ID NO: 1378478 - RNA, 19 nt, Homo sapiens
acuauuaggugacuaugca

SEQ ID NO: 1378479 - RNA, 19 nt, Homo sapiens
ucagaucacauugagagua

SEQ ID NO: 1378480 - RNA, 19 nt, Homo sapiens
gaagauauugaguuaaagc

SEQ ID NO: 1378481 - RNA, 19 nt, Homo sapiens
gcugcucauccauuacuua

SEQ ID NO: 1378482 - RNA, 19 nt, Homo sapiens
aaggauaucguaacagaga

SEQ ID NO: 1378483 - RNA, 19 nt, Homo sapiens
gaugcaucauggaagaaug

SEQ ID NO: 1378484 - RNA, 19 nt, Homo sapiens
guguuacgguuuaauucuu

SEQ ID NO: 1378485 - RNA, 19 nt, Homo sapiens
gaaguacaucagaauugga

SEQ ID NO: 1378486 - RNA, 19 nt, Homo sapiens
guuaaugaggagacuguaa

SEQ ID NO: 1378487 - RNA, 19 nt, Homo sapiens
cuauuauucugccugaaga

SEQ ID NO: 1378488 - RNA, 19 nt, Homo sapiens
caggagacuucaggauuuc

SEQ ID NO: 1378489 - RNA, 19 nt, Homo sapiens
ggccuccaccucagcauuu

SEQ ID NO: 1378490 - RNA, 19 nt, Homo sapiens
uaaugaggagacuguaauu

SEQ ID NO: 1378491 - RNA, 19 nt, Homo sapiens
cuugggagaacauuaaauu

SEQ ID NO: 1378492 - RNA, 19 nt, Homo sapiens
uuucaagagugauuaugga

SEQ ID NO: 1378493 - RNA, 19 nt, Homo sapiens
guucaucgucuuccucuuc

SEQ ID NO: 1378494 - RNA, 19 nt, Homo sapiens
gagacaaaauaaucccauu

SEQ ID NO: 1378495 - RNA, 19 nt, Homo sapiens
ccucagcauuucuauaacu

SEQ ID NO: 1378496 - RNA, 19 nt, Homo sapiens
ccaccucagcauuucuaua

SEQ ID NO: 1378497 - RNA, 19 nt, Homo sapiens
ugagaaacgcgggaaguug

SEQ ID NO: 1378498 - RNA, 19 nt, Homo sapiens
uaaaagugaucgacaagca

SEQ ID NO: 1378499 - RNA, 19 nt, Homo sapiens
gagagagccgugagcuugu

SEQ ID NO: 1378500 - RNA, 19 nt, Homo sapiens
caauggcaccgacuuugga

SEQ ID NO: 1378501 - RNA, 19 nt, Homo sapiens
caggauaagggaucagaug

SEQ ID NO: 1378502 - RNA, 19 nt, Homo sapiens
uguaaccuuugugaaauug

SEQ ID NO: 1378503 - RNA, 19 nt, Homo sapiens
gagugauuauggagcuaga

SEQ ID NO: 1378504 - RNA, 19 nt, Homo sapiens
guguuugacaugcauaauu

SEQ ID NO: 1378505 - RNA, 19 nt, Homo sapiens
gcggugcgauggagguagu

SEQ ID NO: 1378506 - RNA, 19 nt, Homo sapiens
gcuccuccgcguguaguua

SEQ ID NO: 1378507 - RNA, 19 nt, Homo sapiens
gugauuauggagcuagauu

SEQ ID NO: 1378508 - RNA, 19 nt, Homo sapiens
agaauuggaaugcucauag

SEQ ID NO: 1378509 - RNA, 19 nt, Homo sapiens
ggauaagggaucagaugca

SEQ ID NO: 1378510 - RNA, 19 nt, Homo sapiens
cgacaagcagcaggaaaga

SEQ ID NO: 1378511 - RNA, 19 nt, Homo sapiens
uuaaugaggagacuguaau

SEQ ID NO: 1378512 - RNA, 19 nt, Homo sapiens
uaaagccucuugggauggu

SEQ ID NO: 1378513 - RNA, 19 nt, Homo sapiens
cuauaacucagaacauaug

SEQ ID NO: 1378514 - RNA, 19 nt, Homo sapiens
guauuuugcuccaucaaug

SEQ ID NO: 1378515 - RNA, 19 nt, Homo sapiens
cauugagaguaaagguauu

SEQ ID NO: 1378516 - RNA, 19 nt, Homo sapiens
uaagauugcugguauucua

SEQ ID NO: 1378517 - RNA, 19 nt, Homo sapiens
ucacacagauguugguaga

SEQ ID NO: 1378518 - RNA, 19 nt, Homo sapiens
caacccaaauuccagacua

SEQ ID NO: 1378519 - RNA, 19 nt, Homo sapiens
guacaaccaagaacaauga

SEQ ID NO: 1378520 - RNA, 19 nt, Homo sapiens
gcucuuaccucuauguucu

SEQ ID NO: 1378521 - RNA, 19 nt, Homo sapiens
cccagaagauauccucaua

SEQ ID NO: 1378522 - RNA, 19 nt, Homo sapiens
caccugagccuuuccauga

SEQ ID NO: 1378523 - RNA, 19 nt, Homo sapiens
acacagauguugguagaga

SEQ ID NO: 1378524 - RNA, 19 nt, Homo sapiens
gcccagaaaggaaccaaua

SEQ ID NO: 1378525 - RNA, 19 nt, Homo sapiens
aagcauccuuugagaauug

SEQ ID NO: 1378526 - RNA, 19 nt, Homo sapiens
caccuucuccucacaauuu
